United States Patent 9,254,311 (MODIFIED POLYNUCLEOTIDES FOR THE PRODUCTION OF PROTEINS) - sequence listing, part 24

SEQ ID NO: 51180 - DNA, 14103 bp, Artificial Sequence
  Description of Artificial Sequence: Synthetic coding sequence
atggccaacgtgcaggtggccgtgcgggtgcggcccctgagcaagagagagaccaaagaagggggacgtatcatcgtggaagttgatggcaaggttgctaagatcaggaacctgaaagtagacaataggccagatggcttcggggattcaagggagaaggtgatggcttttggattcgattactgttattggtccgtcaatcctgaggatccacagtatgcttcccaggacgtcgtttttcaggatttgggtatggaggtcctctccggcgttgccaagggctacaacatctgcttatttgcctatgggcagacagggtctggaaagacctacaccatgttggggacccccgcaagcgtcggcctgaccccgaggatctgtgaaggactcttcgtaagagagaaagattgtgcttccttgcccagttcatgccggattaaagtttcctttctggaaatctacaacgagcgagttagggatctcttgaagcagagcggacagaaaaagagttatacactgagagtgcgggagcaccccgagatggggccctatgtccaggggttaagccagcacgtggtgacaaattataagcaggtcattcagttgctagaggaaggcatcgcaaatcgcatcactgcggccactcacgtccacgaggcctcaagcagatctcacgccattttcaccatccattatacacaagctattctggaaaacaatttgcccagcgagatggcatcaaagataaatctggtcgacctggccggatccgaacgggccgatccctcctattgcaaggatcggattgccgagggggcaaacatcaacaaatctctggtgacgctgggcatcgtgattagcacactggcccagaactctcaagttttcagctcatgccagagcctcaactcatccgttagcaacggtggggattccggaatcctaagctcacctagcggtacttccagcgggggggcaccttcgcggaggcagtcttacatcccgtacagagacagcgttctgacttggttgctgaaggatagtctgggcgggaactctaaaacaatcatggtggctactgtgtctcccgcgcatacatcttactcggaaaccatgtccacactcaggtacgccagctcagctaaaaatattatcaacaagccgcgtgtcaacgaagatgcgaacctaaagcttatcagagaactgcgggaagaaattgaacgattaaaggctctcctgttgagctttgagctgcgcaacttcagctctctctctgatgagaacctcaaagaactcgtactgcaaaacgaactaaaaatcgaccagttgacaaaggactggacacaaaaatggaacgattggcaggctctaatggagcattacagcgttgatatcaaccgacggagagctggagttgtgatcgactcttccttgccccatcttatggcactggaagacgatgtgttatctacaggcgtagtgttataccaccttaaggagggaacaactaagatcggcagaatagacagcgaccaggaacaggacatcgtcctgcaggggcagtggatcgagagagaccactgtacaatcacatcagcatgtggtgtggtagtgttaaggcccgccaggggagctcggtgtaccgtcaatggcagagaagttaccgcctcttgccgcctgacccaaggcgccgtgatcaccctgggcaaagcacagaaattcagattcaatcatccagccgaggcggctgtgctccggcagcgcagacaagtcggtgaagctgctgccggcagaggctcattagaatggctcgatctggacggcgacctggcagccagtagactcggtctgtctccactcttgtggaaagagcgcagggcactggaagagcaatgcgatgaggaccaccagacccctcgcgatggcgagacctcacacagagcccagatccagcaacagcagtcatacgtggaagacttacggcatcagatcctggcggaggagatccgcgccgccaaggaactggaattcgatcaggcttggatttcccagcaaatcaaggagaaccagcagtgtctcctgagagaggagacatggctggcaagcctacagcagcagcagcaggaagatcaggtcgcagagaaagagttggaagcttcagttgcactggatgcctggctgcagactgatccagagatacagccttctccattcgtgcaatctcaaaagagagttgtccatcttcagctcctgcgccgccataccctgagggccgctgagcggaacgtacgcagaaaaaaggtgtcttttcagttggaaagaattatcaaaaaacagaggctgctggaagctcagaagaggttagaaaaattgaccaccctctgttggcttcaagatgactctacacaagaaccaccgtatcaggtcctctcccctgacgccacagtgcctcgacccccctgtaggagtaaactgaccagctgcagcagcctgagtccccagaggctgtgtagcaaacacatgccccaactgcattcgattttcctgagttgggaccctagtaccaccctacccccgcgcccagaccccacccatcaaacgtccgagaaaactagttccgaagaacacctcccgcaggcagcctcataccctgcgcggacgggttgtcttcggaaaaatggactgcactctagcggacatggtcaaccatgcacggcacgggcagcccttgcaagaaagggagctagtgctccagatgcttgtttaaccatgagccccaacagcgtcggcatccaggagatggaaatgggcgtgaaacagccgcaccagatggtttcccaaggtctcgcgtctctcaggaagtctgctaataagttaaagccacgccatgagccaaagattttcacatccacaacacaaacacggggggctaagggtctcgctgatccgtcccacacccaggcaggttggaggaaagaaggcaatctcgggactcacaaggcagcaaagggggcgagctgtaacagcctgtatccacatggcccccgtcaaacagctggacatggtaaggcagtcaaaaccttctggacagagtacaaacctccctccccgagtcgggccagcaagaggcatcagagagtgctggcaacacgggtccggaacatcacgaaaaagtccagtcacttacctctgggttcacctctgaagcggcagcagaatacacgggacccagatacgatggtaccattgactgacttctcaccagtcatggaccacagcagagaaaaagataatgatctgagcgatacagactcaaactactcgctggacagtctctcgtgtgtctacgcaaaggccttgatcgagccactgaagccagaagagagaaagtgggactttcctgagcctgagaattccgagtctgacgactcccagctttcggaagacagtctcgccgaaaagagataccagtcaccaaagaaccggctaggaggaaacaggcctaccaacaatcgtggtcagccacgaacgcgaacacgggcctctgttagaggatttactgcagcctccgactctgatttgttagcccagacccaccgctcctttagtctggattccctcattgatgctgaggaggagctcggggaagaccagcaggaggagccctttcccggatcagcggacgaaatacctactgaaacattctggcacctggaagactcatccctgccggtgatggaccaggaggcaatctgccggttggggccgataaattatcgcactgccgccaggctggatgccgtgctccccatgtcctcgtcgttttatttagacccccaattccagcctcattgtgaactgcaaccacactgtgagctgcaaccacattgcgagctccaaccccactgcgagcaggcagagtcccaagtggagccttcctactcggagcaggcagacagtttgcagggaatgcaactcagcagagagtccccattaatgagcatggactcctggttcagctgcgatagtaagattaatccttcttctccaccggggatagtcgggtccctatgcccctcacccgatatgcaagaatttcattcatgcaagggcgagcgccctggatattggcccaacaccgaggaactgaagccctcggatgctgaaacagtgctgccctattccagcaaactgcaccagggtagcaccgagctgctgtgctcagcccgcgacgaacataccgcatcagccgcagatactagcaggctgtccttgtgggggatccagcgtttgattcaaccgggcgctgacggtaccttccagggtcgctgtattccagacatgactcagcaaggatcttccgaggcatcccacaattctagcgtatctaatgtacttgctgcaagcgccaccaccctgactcatgtgggatctacccatgagagggattggagtgccctgcagcaaaagtatctgttggagctctcttgtcccgtgctggaggcgattggcgcacccaaaccagcgtatccatacttggaggaggacagcgggtctctagcccaagctagtagtaaaggtggagataccctgcttcctgtggggccccgcgtcagctccaacctcaacctcaataacttccctgtgcatctttctcgcatcaggagacttagagctgagaaagaacaggactcactgaacgcgaagttggagggcgtttctgactttttcagtacatccgaaaaggaagcctcttacgatgaaacctactccgctgaccttgaatcacttagcgcgagtagaagcaccaatgcccaggtctttgctactgagaacgcaatccctgactccatgactgaagcatgtgaggtcaaacaaaacaatctggaggaatgcctgcagtcttgcaggaagcctggcctgatgactagctctgacgaagatttcttccagaaaaatgcctgtcacagtaacgttacaactgcaaccaaggcagaccactggtctcaagggtgggcacccttgaggaaaaatagcgctgttcaacctggccagttatcccccgactcccattaccctttggaagaggagaaaacagattgtcaggagtcctcaaaggaagccgtccgacgacatattaacgtgtcctttgcactgcccagcgggccagagctgtacctccatagtgccccctggaaccctctttctagctcgctccaaccacctttacttgaaactttctacgtgacaaagtccagagatgccctcactgagacagcactcgagatccctgcctgccgagaggtgcgtgtgccatcccctccccctcgagaagcctggggcttcggccacaatcaccaggccctgcaaggggcttacctgaagaataacctgcccgtactgctgcagaaccagaatagcaagatcgccagcagccagcaagtgacagctgagataccagtggatctgaatacccgggaggtcattcgggagtctggaaaatgccctgggaatattaccgaagaatcgcacgacagtgtgtattcaagtgtgacccaaaatcgccacttcctccctagcactagcaccaaggtgtgtgagttcgagaaccaggttgtgatactgaacaaaaaacattcattcccagcactggaagggggggaagtgaccgcacaaagctgttgcggcgctagtagcgactcgacagagagcggcaaatctctgctgtttagagagtccgaggcccgtgaagaggaagagctggaccagaacacagtcctgaggcagacgattaatgtttcgcttgagaaggatatgcctggggagtctgctgtgtctctgaagtccagaagcgtggacagacgcgtcagttcacccgtgatggttgcccagggaggcggccccactcctaagtgggaggggaagaacgagacagggctactggagaaaggactgcgccccaaagattcatcagaggagttcaagttgcccggcacaaagcctgcctacgagcggttccaactggtagcctgccctcaagaacgcaatcccagtgaatgcaagtcccaggaaatgttaaaccccaatagggaaccttccggcaaaaaacagaacaaaagagtgaataacactgacgagatggcaaggctcattaggagtgtcatgcagctggaaaacggtattctggagatcgagagcaagcagaacaagcaagtgcatgcctcccacacaccaggaacagataaagagctggtttttcaggaccagaaagaacaggagaagacggatcacgcattcagaccagattctagtggaaatcccttaccttctaaggaccagccatcgagcccccgtcaaactgatgacaccgtcttccgggacagcgaagctggtgctatggaggtaaatagcatcggaaatcaccctcaggttcagaagatcactcctaatccctttaggtcaagggaaggtgtgcgcgaatcagagcccgttcgggaacacacgcatcctgccggctccgacagacccgctcgtgatatctgtgatagtctgggcaagcatacaacatgtagggagttcaccaacacttcactccatccgcaacgcatgaaggcactagcccgggcacttccattgcaacctcggctggaaaggagctctaagaacaacggtcagtttgtgaaagctagtgcttctctgaagggccaaccgtgggggctgggcagtcttgaggaactcgagacagtgaagggcttccaggaaagccaggtggctgagcatgtttccagcagtaatcaagaggagccaaaggcacagggcaaggtagaggagatgccaatgcagcgaggcgggtcgctgcaagaagagaacaaggtgactcagaagttcccttctctctcccagctctgcagagataccttttttcggcaggagacagtgtctcctcttctgagcagaacggaattctgtaccgctccccttcatcaagacctcagtaacacactgccccttaactcccctcgatggcctaggaggtgcttgcacgtgccggtggcactcggcatatcaagcctggactgtgtgctggacctgaccatgctgaaaattcataattcccctctcgtgaccggagtcgagcatcaggatcagtcgaccgagacgagaagtcactcccctgaagggaatgtgcgggggcgatcctcagaagcccacacagcatggtgtgggtcggtgaggtccatggccatgggtagccatagccagtctggcgtccccgagagcatccccctcggcactgaagatcgaatttccgccagcacctctccccaggatcacggcaaagatttacgcattacattactgggcttttctacttccgaggatttcgcaagcgaagctgaggtcgcagtccagaaggagatcagagtttctagccttaataaagtaagttcgcagcccgagaaaagggtgtccttttccttggaggaggactctgatcaggcctctaaaccaaggcaaaaggctgaaaaggagactgaagatgttgggctgaccagcggcgtgagtctcgctcctgtgagtctgcctcgagtgccatctcctgagcctcggctgctggagccctccgaccacgcttctatgtgcctagccatccttgaagaaatccgccaggcaaaggctcagagaaaacagctgcacgacttcgtggctaggggtaccgtgctttcatattgtgaaaccttgcttgagcctgagtgcagcagtcgtgtggcaggtaggccccaatgcaaacagatcgaccagagttcatctgatcagacaaggaacgaaggcgaagccccaggctttcatgttgcgagtctctccgcagaggcaggccagatagacctgcttcccgacgaaaggaaggtacaggctacatccctgtcagctgacagcttcgagagcctgccaaacacagagaccgacagggagccatgggaccccgtgcaggctttttctcacgccgctcctgctcaggacaggaagcggcgcacaggagagttgagacagttcgctggagctagcgagccttttatttgtcacagttcgtcttcagagataattgaaaagaaaaaggatgctactcgaactccatcaagcgctgaccctctggcgcccgatagcccgagaagctccgcgccggtcgaggaagtcaggagagtcgtttcgaaaaaggttgttgccgccctgccatcccaggccccctacgacgatccacgagtgaccctgcacgagcttagccagtcggtacctcaagaaacagccgaaggaataccccctggcagtcaggattcctctcccgaacaccaggagccaagaactctggacactacttacggcgaggtgtccgataacctgctggttacggctcagggcgagaaaaccgctcacttcgagtctcagtcggtcacatgtgatgtgcagaactccaccagtgctagtggcccaaaacaagaccacgttcaatgccctgaagcctccactggctttgaggagggcagagcttcacctaaacaggacactattctgcccggggcactgactcgcgtagcactggaggcaccaactcagcaatgcgttcagtgcaaagagtcagttggttctggtctcacagaggtctgtcgtgcgggttccaaacactcacgacctatccctctgcccgatcagagacctagtgcaaaccccgggggtataggagaggaggccccttgccgacacccccgagaggccctggatggaccagtgttttccaggaacccggagggctcccgtacattgtccccatcacgcggaaaagagtctaggaccctcccttgccgacagccatgttcttctcagcctgtggccacccacgcctacagtagccactcttcaactcttctctgttttcgagacggtgacctgggtaaggagccattcaaagctgcaccccataccatacaccccccctgtgttgtcccttcccgtgcctacgagatggatgagaccggggaaatcagtcggggccccgatgtacatctcactcatggactcgagcctaaggacgttaatagggaattccgactgacggaaagctcaacctgcgagccatccacagtagctgctgttctgtctagggctcaggggtgtcgaagtcctagtgcacccgatgtgcgcaccggaagcttctctcattcagcgacagacggtagcgttggactgatcggggttcctgagaagaaagtcgccgaaaagcaagcatccactgagttggaggcggcttcttttcccgccggaatgtactctgagccacttcggcaattcagagatagtagtgtcggcgatcagaacgctcaggtgtgtcagactaatccagaaccccccgccactacccagggccctcatacgctcgacctctctgagggcagcgcagaatcaaagctggttgtagagccacaacacgagtgtctcgagaatactactcgctgcttcctggagaagccacaattttcaactgagcttagagatcacaaccgtcttgactcgcaagccaaattcgtggccagactaaaacatacctgctcccctcaagaagattctccctggcaggaggaagagcagcaccgtgaccaagctagcggaggaggagaagggttcgcccagggagtgaatcccttgccggatgaggacggcttggacgggtgtcaaatcctggatgccggcagggaagaagtcgccgtcgctaagcccccagtatccaagattctgagtcaaggatttaaggatcctgcgacggtgtcgctaagacagaacgaaactcctcagccagccgcccagcgatccgggcacctctacaccggcagagaacaacccgctccaaatcacaggggctccttacctgtcacgacgatattttcggggcccaaacacagcaggtcctcccctacacctcagttttccgtcgtgggctcttcccggagtctacaggagttgaaccttagcgtggagccaccttcccctaccgacgaggatacccagggacccaatcggctgtggaacccacatcttcgcggatactctagtggcaagagcgtagcccgaacatccctgcaggccgaggactctaaccagaaggcaagtagccgccttgacgacggaaccaccgaccacaggcatctgaagcccgccacaccaccctatcctatgccttcaacactctcccatatgcctacgcccgactttaccaccagctggatgtcaggcaccctggagcaggctcagcagggcaaaagggagaagttgggggtgcaggtgcgcccggaaaactggtgtagtcagatggataagggtatgctgcatttcggttccagtgatatttcaccatacgctctaccttggcgccctgaggaaccggccagaatctcttggaagcagtatatgtcgggatctgccgttgacgtcagctgcagccagaagccacagggactgacattgagcaatgtcgcccgatgctcttccatggataatggcctggaggaccagaattctccctttcacagccacctgtcaacctatgccaacatttgcgatctgtcgactactcattccagtaccgaaaacgcgcaggggtctaatgaggcgtgggaagtgtttaggggaagctcatccatagctctcggggatccccatatccctacatctccagagggggtagctccaactagcggacatgacagacgcccccagtttcgcggcccctccggagaggccgactgtctcaggtcaaaaccccctctagccaaagggtcagccgccggacctgttgatgagatcatgctcctgtatcctagtgaggctggttgccctgtcggacaaacccggaccaataccttcgaacagggaactcaaaccctgggatcgagacgacattggagtagtactgatatctccttcgcccaaccggaggcttccgccgtcagcgccttcgaccttgcatcgtggacatcaatgcataatctgagtctgcacctgtcccagcttctccactcgaccagtgaactgctaggctctctgagccagccggatgtagccagaagagagcaaaataccaagcgtgatataccggataaagcaccacaagcgctcatgatggacggttcaacgcaaactactgtagacgaaggctcgcagaccgatctgactctgccaacactgtgtctgcagacttcagaggccgaacctcaaggggctaatgtgatcctcgaaggactcgggtcagacacctccacggtttcacaagaagaaggcgacgtcccaggggtgccccaaaaaagagaggctgaagaaacagcacagaaaatggctcagctgctttacctccaagaagaaagcaccccctacaagccgcagtcaccatcgatcccctccagtcatctccgtttccagaaggctcccgtgggccagcatctaccttccgtgtcaccttctgtatctgacgcctttctgcccccaagctcccagcctgaggaatcttattgccttgttgtttcctcacccagtcccagctcaccgcattccccaggcctattccccagcacctccgagtatccgggggactcgagagtccagaagaaactgggccccacaagtgctttgtttgtcgaccgcgcatccagcccaatcctgactctctctgcttccacccaggagcctggtttgtctccgggatccctgaccttgtctgcccccagcacccaccctgtggaggggcaccagaaactcgattcctcaccagaccccgtggacgctccgagaaccccaatggacaattactcccagaccaccgatgagctggggggaagccagaggggccggagctcgctccagcggtctaacgggcgatccttcctagagctacactccccgcactccccccagcagagtcctaagctgcagttttcatttttgggccagcatccacagcagctgcagccccgcaccacaatcggggtgcagagcagattgctccccccaccactccggcatcgttcccagagactcggaaactcattcgtccccgagaaagtggcctcacccgaacactgccctctgtccggtcgggagcccagtcagtggcagtcgaggactgaaaacggaggtgagagctctgcttctcctggtgaacctcagcgcacactggatcgtccgtcctcttggggaggcttgcaacatctatccccttgccctgtatccgagttaactgacacagcaggtcttaggggctccgcgctcgggctgccccaggcctgccagccggaggagctgctctgtttttcatgccagatgtgcatggcccctgaacatcaacaccattcactgagagatttgcccgtgcataataagtttagtaactggtgcggcgtgcagaaagggagcccaggcgggctggatatgacagaagaggaactcggcgcgtctggtgacctatcaagcgaaaagcaggagcagtcgcctcctcagccacccaacgaccactcccaggacagtgagtggagcaaaagggaacagattcccttacaagtgggggcccagaatctgtctctcagtgttgagctgacagaggccaaactacaccatgggttcggagaagctgatgccctgttgcaagtgctccaatcaggcacaggggaagcacttgctgccgatgaacccgtgactagcacctggaaagaattgtatgcaagacagaaaaaagctatagagacccttaggagagaaagagcagaaaggcttggcaatttctgccgcacacgatcactgtcaccacagaaacagcttagcctcctgccaaacaaagacctgttcatttgggaccttgacctgccgtctagacgacgggaatacctgcaacaactaaggaaagacgtggtcgaaaccaccagatccccagagtctgttagtcggtctgcccacaccccatcagacatcgagctaatgctgcaggactatcagcaggcccatgaggaagctaaggtggaaatcgccagggcccgagatcaactgagagaaagaaccgaacaggaaaagctcagaattcaccagaagatcataagccagctgctgaaagaggaagataagctccatactctagctaatagttcctctttatgcacatcatcgaacgggtccctgtcctcgggcatgacctcgggctataatagctccccggccctctctggacagttgcagtttccagaaaacatgggtcacactaatctgccggattctcgagacgtatggattggggatgaacgaggcggacattccgccgtacgcaaaaacagtgcctactcccacagagcctccctagggtcatgctgttgttcgccatcttctctgtcctccctgggcacctgcttctcttctagttaccaggatctggctaagcacgtcgtagatacaagcatggctgacgtcatggctgcctgttcagacaatctgcataatctgttcagctgtcaggctaccgcagggtggaactatcagggggaggaacaggctgtgcagctgtattataaggttttcagccctacccgacatggttttttaggggccggggtggtcagtcagccactgtctagagtatgggcagccgtatcagatccaacagtgtggccactctactacaaacctatccagaccgcaagacttcaccagcgcgtaactaattctatctcattggtatatcttgtgtgcaacactacactgtgcgctctcaaacagcccagggatttctgctgtgtgtgcgtcgaagctaaggaggggcacctttccgttatggccgctcagagtgtttacgacactagcatgccccggccctcaagaaagatggtcaggggagaaatcttgccaagcgcatggattctccaaccaatcaccgtggagggcaaagaagtgactcgagtgatatacctcgcgcaggtggaactgggtgccccaggctttcctccccagctgctgagctctttcattaaacggcagccactggtcattgcccgacttgctagtttccttggacgatag

SEQ ID NO: 51181 - DNA, 570 bp, Artificial Sequence
  Description of Artificial Sequence: Synthetic coding sequence
atgaccctggccgcctacaaggagaagatgaaggagctgcccctggtgagtctcttttgttcctgcttccttgccgacccattgaacaaatcttcatacaagtatgaagccgatacagtcgacttgaactggtgtgtcatttctgacatggaggtgattgaactcaataaatgtacctcaggacagtcttttgaggtgatcttaaagccaccctccttcgatggagtccctgagttcaatgcatccctgccacggagaagggaccccagcctcgaggagatacagaaaaaactggaagccgccgaggaacgtcggaagtaccaagaagccgagctgttgaaacacctggccgagaaacgagaacacgaacgagaggtcatccagaaggcaatcgaggagaataataactttatcaagatggcaaaggagaagttagctcaaaaaatggaatctaacaaggagaaccgggaggcccatctggcagccatgttggagagactgcaggagaaggataaacacgcagaagaagttcggaagaataaagaattgaaagaagaggcatccaggtag

SEQ ID NO: 51182 - DNA, 651 bp, Artificial Sequence
  Description of Artificial Sequence: Synthetic coding sequence
atgaccctggccgcctacaaggagaagatgaaggagctgcccctggttagcttattctgctcctgtttcttagcagatcctctgaacaagtcttcatacaagtatgagggctggtgtgggaggcaatgccggcgtaaggacgaaagccagagaaaggatagcgccgactggcgggagagacgtgcacaagccgacacagtggaccttaactggtgtgtgatcagcgacatggaagtgatagagctgaacaaatgtacaagtggtcagagctttgaagtcatcctgaagccaccctcttttgacggcgtcccagagtttaatgcctccctgccacggcgccgggatccaagcctcgaggaaattcaaaaaaagctggaggcagcagaggaacgcagaaaataccaggaggctgagcttctaaaacatctcgcagagaagagggaacatgaacgtgaagtcatccagaaggccatagaagagaacaataattttattaaaatggcgaaagagaagctcgctcagaaaatggaatccaacaaagaaaaccgcgaagcgcatcttgccgccatgctggaacgcctgcaggaaaaagataagcatgctgaagaggtcagaaaaaacaaggaactgaaagaggaggcttctcgttag

SEQ ID NO: 51183 - DNA, 945 bp, Artificial Sequence
  Description of Artificial Sequence: Synthetic coding sequence
atgagcttcctggtgagcaagcccgagcggatccggaccaacgacgcatcctcagaaagcattgcctcattcagtaagcaagaggtcatgtcttcattccttcccgagggcggttgctatgagctcttgactgtaattggtaaaggcttcgaagatttgatgactgtaaaccttgcgaggtataaaccaactggcgagtatgtcaccgttcgcaggatcaatctggaagcttgctctaacgaaatggtaaccttcctccagggcgagctccacgtgtcaaagctgttcaatcatcctaatattgttccctacagagcgacattcatcgctgacaatgagttatgggtcgtaacctcttttatggcctatggcagtgctaaagatcttatttgcacacacttcatggacggaatgaatgaactggcaattgcttacatattgcagggggtgcttaaagccctggattacattcaccacatgggatacgtccatagatcggtgaaggccagccatattctgatctctgttgatggtaaagtgtatctgagcggcctcagatctaacttatccatgatatctcacgggcaaaggcagcgtgtggtccacgactttcctaaatacagtgtgaaggtgctgccctggctctcccctgaggtcctccagcaaaacctccagggatacgatgctaagtcagacatctacagcgtcggtattacagcttgcgagttggcaaatggacacgtcccttttaaggatatgccagctacgcagatgctgcttgaaaaattaaacggcactgtaccatgcctcctggatacctctaccattcctgcagaggagctgaccatgagcccctccagaagtgtggcaaacagtggtctaagtgacagcctaaccaccagcacaccacggccctccaatggtcccgtcccagcccctagttag

SEQ ID NO: 51184 - DNA, 2073 bp, Artificial Sequence
  Description of Artificial Sequence: Synthetic coding sequence
atgggcgccgtggcccgggcccacggcggcctgcgggtggcccgggcccgagagtcagtggcaggcggtcgccacaggggagccggcagaccaggtgccagagccgcaggagcagccgctggcctggtgcgagctgaagctggcgggcgccgcgcaggcagaggacgccgcccgggccgtggccttccaacaggcggcggcggccttgcagctgcggccgtcgggcgggaagtcgcccaagggctgtgcgatgctatccggctggatggcggtctcgacctgctgctgaggctattgcaagcaccggagctggagacacgcgttcaggccgcacggctccttgagcagattctcgttgccgaaaaccgagatcgcgtcgccagaattgggcttggagtaattctgaatttagccaaggagagagagcctgtggagctggcaaggagcggaagtggaattttggaacacatgttcaagcacagcgaggaaacttgtcagcggctggtggccgccggcggcctggatgccgtactttactggtgccgtcgtactgatccggctcttcttagacattgcgccctcgccctggggaactgtgctcttcacggcggccaggcagtccaacggcgaatggtggagaaaagagccgctgagtggttgttcccgcttgcattctctaaggaagatgaactcctcagtttgcatgcctgccttgcggtcgctgtgcttgcgacaaacaaggaagtcgaacgtgaggtcgaaagaagcgggaccctcgcactggttgagcctctcgtggcttccctcgatccggggcgatttgcccgctgtcttgttgatgctagcgacacctctcagggaaggggtcctgacgacctgcagaggctagtgcccttgttggactccaataggcttgaggcgcagtgcatcggagcgttctacctgtgtgcagaagccgcgataaagagcctacagggtaaaacaaaagtgttcagcgacatcggcgccatccagagtctcaagcgtctggttagctacagtaccaacggaaccaaatccgccctcgctaagagggccttgagactgctgggggaagaggtgccacgccctatcctgccgagcgtaccttcttggaaagaggccgaggttcaaacctggctgcagcagattggcttttccaaatattgtgagtctttcagggaacagcaggtcgatggggatctgttactgcgcttgacagaagaggagttgcaaactgacctaggtatgaagagtggcatcactcgtaaaaggttttttcgtgagcttactgagctaaagacatttgcaaattattcaacctgcgaccgtagtaatctggccgattggcttggctctcttgatccacggtttcggcaatatacctacggcctcgtctcctgtggcctggacagaagcctactgcacagggtatcagagcagcagctccttgaagattgcggaattcatctcggggtccatagagctagaatccttactgctgctagagagatgctgcactctccactgccgtgcaccggcgggaagccatctggggacactccagatgtcttcattagctatcgaaggaactctggtagtcagctggcatcccttttgaaggttcacctgcagttgcacggattttcagtgtttatagatgtagaaaagcttgaagccggcaagtttgaggacaaactgatccagtctgtcatgggagccagaaatttcgtcctcgtgctttcgcccggcgctctagacaagtgtatgcaagaccatgactgtaaagactgggtgcataaggagattgtaacagcccttagttgcggcaagaatatcgtgccaattattgatggctttgaatggccggagccccaggtgctgccggaggatatgcaggctgtcctgacgttcaatggtattaagtggtcacacgaatatcaagaagccaccattgagaaaatcatcagattcctccaagggagaagtagccgtgattcttcagccggatccgacacaagcttagaaggcgccgcaccaatgggacccacgtag

SEQ ID NO: 51185 - DNA, 2169 bp, Artificial Sequence
  Description of Artificial Sequence: Synthetic coding sequence
atggtgctgaccctgctgctgagcgcctacaagctgtgccggttcttcgcgatgtctggccctcggcgtggagccgagcgccttgctgtccctgggcccgacggagggggcggaacaggtccatggtgggctgcggggggcccgggcccacgcgttagccctggcgctggtactgaagtgcaggatgccctggaacgggccctaccagaactgcaacaggccctgtccgccctgaagcaagccggcggcgcccgcgccgtgggtgctggtctggctgaggtttttcagctggtggaagaagcatggctgttagcggttggaagggaagtggctcagggactgtgcgatgccatccgactggacggagggctagatctgctgttgagattgctccaggcacccgaacttgagactcgagtgcaggcagccagactgttagagcagatcctggtcgctgagaaccgcgatagagtggcacggattggcctcggagtcatcttaaatctggcaaaggagcgggagcccgtggagctagcacgttctggcagcggcatccttgaacacatgttcaagcactctgaggaaacttgtcaacgtctagtggccgcagggggcctagacgctgtgctctattggtgcagacgcactgatccagctcttttaaggcattgtgcgctggccctgggcaactgcgctctccacgggggtcaggctgtgcaaagacggatggtggaaaaaagagccgccgagtggctgtttccgcttgcttttagcaaggaagatgagctgctgtccttgcatgcttgtttggctgtcgcggtgctggcaactaacaaagaggttgagagagaggttgagcggagtggcacgctggcgctggtggagccactggtggccagcctggatcccgggaggttcgctagatgtctcgtagatgcctcagacaccagtcaggggaggggaccggacgatctccagcgtcttgtacctctgttggacagcaatcggctagaggcacagtgtatcggggccttctatttatgcgccgaagccgcaatcaagagtctccaaggcaagacaaaagtgttctcagatatcggggctatacagtcgttaaaacggctcgtgagttattccaccaatgggactaaaagcgctctggctaaacgtgctttgcggctgctcggagaagaggtgcctagacctatcctgccatctgtgccctcttggaaagaggctgaggtgcaaacatggttacaacaaatcggtttcagcaagtactgcgagtctttccgcgagcaacaggtcgatggggatttgttgcttcgtctcaccgaagaagaattacagacagacctgggtatgaaatccggcatcaccagaaagaggtttttcagggaattgacagaactcaaaaccttcgccaactactcaacctgtgatcggtcaaatctagcagactggctgggctcgctggatccccgatttagacagtatacttatggtctcgtttcatgcggtctagaccgcagcttgctacaccgtgtctctgaacagcagctgttagaggactgcgggattcatctgggggtacaccgcgcacgcatcctcaccgccgccagggaaatgctccacagtcctttgccttgtactgggggaaagcccagcggagatacccctgacgttttcatttcttataggagaaatagtggaagccaactggccagtcttcttaaagttcacctgcagttgcatggtttctcagtatttattgacgtggaaaagctagaggcagggaagtttgaagacaagctgatccagtctgtgatgggggctcgcaatttcgtgctagtcctttccccaggggccctggacaagtgtatgcaggatcacgattgcaaagactgggtgcacaaggaaatcgtgaccgccttgagctgtgggaaaaatatagtacccatcattgacggtttcgagtggccagagccacaagtgttgccggaggacatgcaggcagttctgactttcaatggcattaagtggagccacgagtaccaagaagccactatcgaaaaaattatacgctttctgcagggcagatcatctcgcgactctagcgctggatccgacacttctctcgagggagcagcccccatgggtcctacctag

SEQ ID NO: 51186 - DNA, 1254 bp, Artificial Sequence
  Description of Artificial Sequence: Synthetic coding sequence
atggccagcagcaagctgcgggagcccgtggacgaggtgttcgacctggaccttgcggtgccagaaacggccagactggactccagcctgcacaaggctcgcgcacagcttttagccaagggccggaggcacaggccctcccgctctcggctgagagactccgccagcagcgccgaagacggggagggcagcgacggccccggcgggaaggtgacagacggctgtggtagtccgctacatcggctgcgcagcccattacacagcggacctgggagtcccgcaggaggatcgttttgtctcgatccacctgggctccggaggagtctggatgaagatgagccaccaccttccccgctcacaaggtataggcccctgcacaacgcagcatctcacgagggtctggctgcagctagctgttcccctcccaggtcggctcccagctctgacagctccccctccttcgtgagacggcatccccgggccgagcctcatagcgaggacgactctcgcgatgcctctccgccagagccagcatccccaaccataggcctggataagaaaacaaggcgtaaatttctggacttgggagtgacactcagaagggctagcactggtaagtcccgaaaggagaaggggtccaacagactctcaatggggtcaagggaaagcgtggagggcagcggacgcagtggaggctcgccattcctgccattcagttggttcaccgactccggcaaggggtcagcctccagtggctcaactacatcacccacctgttccccaaagcacgagggattctcccctaagaagagtgcttcacaggagtcaaccctgagcgacgattctacaccaccaagctcgagtcctaagatcccgagcgggccatggcaggaggccaagtgcagctacccttaccacacactttcccagagctctgatgaattcctcgatgaacccctccctcccgttcatcattggacctcacagcaagtggggcagtggttgcagtccttgaacctggagcagtatgctgccgagtttgccgcaagacaggttgacggtcctcaactgctacagttggacgggtcaaaattgaagtctctcggcctgtcgaactcacacgatcgcgctctcgtaaaacggaagctcaaggaaatggccgctgcagccgaaaaagaacgcaaggcacaggagaaggccgctaggcagagagagaagctaaggcggcgagaacaggaggccaagaaaagctag

SEQ ID NO: 51187 - DNA, 1338 bp, Artificial Sequence
  Description of Artificial Sequence: Synthetic coding sequence
atggccagcagcaagctgcgggagcccgtggacgaggtgttcgacctggacctcgccgtccccgagacagcacgactggatagcagccttcacaaggccagggcccagctgctcgccaaaggccgccggcaccgaccatccaggagtcgactgcgagattcggctagcagcgccgaagacggcgagggatctgatggtcctggcggcaaagtaacagacggatgcggcagccccttacaccgtctgagaagccctttgcattctgggcccggtagccccgcaggcggttccttttgcttggatccccctgggttacgccgtagtttggacgaggacgaacctccaccgagccccctgactcgttatcgtcccctgcacaatgccgccagccatgagggcctcgcggcagcttcgtgcagtcctcctcgatctgcgcccagttccgactcctctccaagctttgtacgcaggcatcctcgcgccgagcctcactcagaagacgatagcagggacgcttccccgccagagcctgcttctcccaccatcgggcttgacaagaagactcgacgtaaattcctggatctgggagttactcttagacgcgcatctaccggaaagtctcggaaagaaaagggcagcaatagactgtctatgggatcccgggaaagtgtagaaggatccgggcgatccggggggagtccatttctgccattttcctggttcaccgatagtggcaagggctcagccagctcaggatcaacgacttctccaacctgcagccctaaacacgaaggcttttctcccaaaaagtcggcatctcaggcccagctgctggcccacgcacaggaggcgctatccaactcatggtgtctggtacaggactttggatctacccaaattggcatggaatcaactctgtcagatgactctacacctccttcgtccagcccaaagattccatctggcccctggcaggaagccaaatgctcatacccatatcatacgctgtcccaaagctcagacgagttcctagacgaaccccttcctcccgtgcaccactggacaagccagcaggtcggccagtggctccagtccctcaacctggagcagtacgcagcagaattcgctgcaagacaggtggacgggccccagcttctgcagctggacggcagtaagctcaagtcattggggctgtctaattcccacgaccgggccctggtgaagaggaaactcaaagagatggctgctgctgcagagaaggagagaaaggcccaggagaaagcggcgcggcagcgcgagaagctacggcgaagggagcaggaggctaaaaagagttag

SEQ ID NO: 51188 - DNA, 42 bp, Artificial Sequence
  Description of Artificial Sequence: Synthetic coding sequence
atggccagcagcaagctgcgggagcccgtggacgaggtgtag

SEQ ID NO: 51189 - DNA, 978 bp, Artificial Sequence
  Description of Artificial Sequence: Synthetic coding sequence
atgagcgacctgcaggccgccgagggccccggcagctggagccccaccgctagacctggatccgcagggggagtgggcgattgccagggcgttgagggtagccaggctgctgcaagcgagaatgaggatcttgaaaacaaagatacatcgctattggctagcgcgactgatcctgagccttgcagttccccgcataggccacagatggtgtctcctgtgagcaaggatgcaactgaggatctgagaaaggccaccggacccctggaagctcaagccctcgttaagcaggaccttctgcccgctgatcaggctcaagttctgaacgaaatggccaagtaccaggtccctcagcggtctggcgacattgtcatgatccagagcgaacataccggtgctatcgatgtcctctctgccgatttagagagcgcagaccttctgggggaccatcgtaaggtgagccccccactaatggcaccaccttgcatttggacctttgccaaggttaaggaattcaagagcaaactcgggaaggagaaaaattcacgcctggtggtaaaaagaggggaagttgtgacaattagagtgcctacacacccagagggaaagcgcgtgtgttgggaattcgcgacagatgattacgacatcggtttcggagtctactttgactggacaccagtgacgagcacagacataactgtccaggtgtcggactctagcgacgacgaagatgaagaggaagaagaggaggaggaaatcgaagagcccgtgccagccggtgatgtggaacgtggttcccgctcatcactgcgtgggcgctatggcgaggttatgcccgtatacagacgtgacagtcacagggacgtgcaggccggatctcacgactaccctggagagggaatctatcttctgaaatttgacaacagctatagtctcttgagaaacaagaccttgtactttcacatctattacactagttag

SEQ ID NO: 51190 - DNA, 666 bp, Artificial Sequence
  Description of Artificial Sequence: Synthetic coding sequence
atggagacctggagcgtggagcaggtgtgcagctggctggtggagaagaacctgggagaactggtgcaccggttccaagaagaggaggtctccggagctgccttgctggcactcaacgacagaatggtgcagcagctcgttaagaagataggccatcaggccgtgttaatggatctgattaagaaatataagcaaaacacccagggactgaaatcaccggagaatcccaaaaaggctgccttagtcatgcaaacagaggcggctcgtgattacagagatgaggagagctcttcccccgcccgacacggcgagcagatgcctagcttttacccagccgagaatctagacaacggactgatcgaccagcgcgtcctgaagcagcgaagaaatgtgaaacaaattctagcccggtctaaggccttgcagtggaccaagtcttatgtacttccagagttcccctatgacgtcaagtgtatgttggccgagcagaagtgcccagatcactcgatgagaatccgtatcatcgagtttctccaagccgacatgacaaaatacctagaaggaagcttgtacccatctacccaacagtacaatgacgttgtcaatgctctactgcaggcccatcctttcttagatgaagacggatgcgggtttgcgggagtgtag

SEQ ID NO: 51191 - DNA, 1563 bp, Artificial Sequence
  Description of Artificial Sequence: Synthetic coding sequence
atggagacctggagcgtggagcaggtgtgcagctggctggtggagaaaaaccttggtgagctcgtgcacagatttcaggaggaggaggtcagcggtgcagctttgctcgctctcaacgacagaatggtccagcagctggttaagaaaattggtcaccaggctgtgttgatggatctcatcaaaaaatacaaacaaaatactcagggccttaaatctcccgaaaaccccaagaaggccgccctggtcatgcagactgaggccgccagagactatcgtgatgaagagtcaagcagtcccgcaaggcatggggagcaaatgccttctttctacccagcagagaatctcgacaacggcctgattgaccagcgcgtcttaaagcaacgaagaaacgtgaaacaaattttggctcggtccaaggcactgcagtggaccaaaagctacgttttacctgagttcccctatgacgtcaagtgtatgcttgccgagcagaagtgtccggaccatagcatgaggattagaatcatcgagtttctgcaggccgacatgaccaaatacctcgaaggaagtctatacccgtccacccagcagtataacgatgtggtgaatgccctcctacaggcccacccctttctggatgaggatggctgcggcttcttcctctggaagcgcgcactgaaggatcgattcaagtatgtgaggagaccgatagaggacgacgagcaagtgattcggaacaagtgtaagtttggccacaggcgagggcaaacacgcaagagcctcgcggacattcggtttgacgaaatcaagttggtccagattaaggaggaggccgtctgcttcgacagtgagcttgacgagcatattaagtggtttcagcaggaatatgtcaagactgaaaaggactggcgggagatcgacaaaagaatgagccagacactggagattcggcgcaaaatgatcggttctagaacaccactgaaggatattctgaaactgttccctttcctgaagtgtccataccagatgtttagggaattccagcttctgacacgcacggacatttataagaaaactaggcacatcttagagtcttactcagagaacattctcacatcctttagcgtcgtggacaacccaatcaacattgtgttacaggagaaaatgaagcactataccgacgaagatatgttaaagtacatgaaaatgaccgccacatgccttcttttgcccgatgtctttggagacgatccctcacttttcgtgattatgaacgaacaggtccaggtctccacccccgtgctggaggtcaaaaacccattcaacatggaagtgtgtgagttttcactctaccttgaaagagagcgacttacgaaggtggacgattgcgtgactgccctggctgccctggttgcagcatttcacgtgtttagaatcgagtgcccccgccggctatcacagaccttcaatttcctggagacgctgattttcgatatgcatagtccatactttccttcgctcaaggagaaagaaaatgaagttgggttccagcaccctctgacttag

SEQ ID NO: 51192 - DNA, 1563 bp, Artificial Sequence
  Description of Artificial Sequence: Synthetic coding sequence
atggagacctggagcgtggagcaggtgtgcagctggctggtggagaaaaatctaggagaactggtgcaccgttttcaagaagaagaggtctctggagctgctcttctagcgctgaacgacagaatggtccaacagctagttaaaaaaatcgggcaccaggcagtgctcatggatctgattaaaaagtataaacagaacactcaggggctgaagtcccccgaaaatccaaagaaagccgctttagttatgcagacagaggccgcgagagattatcgcgatgaggaatcttctagcccagctcgccacggagaacagatgccttctttctacccagcagaaaacctggacaatggcctgattgatcagcgagtgttaaaacagcgccgaaacgttaaacagatcctagcgaggagtaaagccctccagtggactaagagttacgttctgccagagtttccatatgacgtgaaatgtatgctagcagagcagaagtgccccgaccacagtatgcgtattagaattattgaatttctccaggctgatatgacgaaatatttagagggaagtctctacccatccacgcaacagtataacgatgtggtgaacgcattgttgcaagcccaccccttcttagatgaggatgggtgcggatttttcctgtggaagcgggccctgaaggaccgttttaagtacgtgaggcgacctatcgaggatgacgaacaggtgatccggaataaatgcaaatttggacaccggaggggccagactaggaaatccctggccgacatccggttcgatgagatcaagctggtgcagattaaggaggaagccgtgtgctttgactccgagttggacgagcacattaagtggttccagcaggagtacgtgaaaaccgaaaaagactggcgcgagatcgacaaacgaatgagtcagacattggaaatcaggaggaagatgatcggttctcgcactcccttgaaggacattttgaagctttttccgttcctgaagtgtccataccagatgtttcgagagttccagctgttaacacgtactgacatctataagaagacaagacacatcctggagtcctacagcgaaaacattctcacaagttttagcgttgtagataatcctattaatatcgtgctgcaggagaaaatgaagcactacactgatgaagacatgctcaaatacatgaagatgaccgccacctgtctgttattgccagatgtgttcggcgacgacccgtctcttttcgtgatcatgaatgaacaggtccaagtctccactccggtgctggaggtaaaaaatccattcaatatggaagtgtgtgagttcagcctctatttagagagagagagactgactaaagtggacgactgcgtgaccgccctggccgccttagttgctgccttccacgtgttccgcatagaatgccccagacggctctcccagacctttaactttttagagacccttatctttgacatgcacagcccttactttccttccctgaaggaaaaagaaaacgaagtaggtttccagcatccccttacctag

SEQ ID NO: 51193 - DNA, 1563 bp, Artificial Sequence
  Description of Artificial Sequence: Synthetic coding sequence
atggagacctggagcgtggagcaggtgtgcagctggctggtggagaagaacctcggcgaattggtacaccgtttccaggaagaggaagtatctggtgcggcccttttagctctgaacgaccgtatggtgcaacagttagtcaaaaaaattggccatcaggcggttttgatggacctcatcaagaaatacaaacagaatactcagggccttaagtcccccgagaatcccaaaaaagccgcactcgtgatgcagaccgaggctgctcgagactaccgggacgaggagtcctcctctccggcccgtcacggagagcagatgccaagcttctatcctgccgaaaatcttgataatggtttgatcgaccagcgcgtcctcaagcagcggcgaaacgtgaagcagatcttggcacggtctaaggccctgcagtggaccaagagctacgtgcttcccgagttcccgtacgacgttaagtgtatgttagcagagcagaagtgccctgatcacagtatgaggatacgtatcatcgaatttctccaagctgatatgaccaaatacttagagggaagtctgtacccttcaactcaacagtacaacgacgtggtaaatgcattactccaagcacatcccttccttgatgaagatggctgcgggttcttcctgtggaaaagggctctgaaggatcgcttcaagtacgtgaggcggccgattgaggatgatgagcaggtaataaggaacaaatgtaagttcgggcaccggagaggccagactagaaaaagcctggctgatatcagattcgatgagatcaaattggtgcagatcaaagaagaggcggtgtgctttgactctgagctggatgaacacattaaatggttccagcaggagtatgtgaaaaccgagaaagattggagggaaatcgacaagcgtatgagccaaactctggagatccggcgaaagatgattggtagtcgtacaccgctgaaggatattcttaaacttttcccatttctgaagtgcccttaccagatgtttcgggagttccaactcctgactcgtactgatatttataaaaagacgcgtcacattctggagagttactccgagaatattctcacgtctttttccgtggtggataaccccataaatattgtgctccaggaaaaaatgaagcactacactgatgaggacatgctgaaatacatgaaaatgacggctacatgcctcctcttgccagatgtgttcggcgatgacccatcattatttgtgattatgaatgaacaggtgcaggtttcaacaccagtgcttgaggtgaagaatccctttaacatggaggtgtgtgagttcagcctctatcttgagcgagagcggctgactaaggtggatgattgtgtgacagccctcgccgccttggttgccgccttccacgtgttccggatcgaatgccccagacggctttctcagacattcaattttctggagactttgatcttcgatatgcactccccttactttccatccttaaaggaaaaagagaatgaggttggcttccagcatcccttaacatag

SEQ ID NO: 51194 - DNA, 522 bp, Artificial Sequence
  Description of Artificial Sequence: Synthetic coding sequence
atggagacctggagcgtggagcaggtgtgcagctggctggtggagaagaatttaggcgagttggtccaccgattccaggaggaggaagtgtctggcgccgcacttttggcactgaatgataggatggtgcagcaactcgtaaagaaaattggccaccaggctgtactgatggacctaattaagaaatacaaacagaatacacaaggcttgaaaagcccagaaaatcccaagaaggccgctctagtgatgcagaccgaagcagccagagactaccgggatgaggagtcctcgtcccctgcgaggcacggcgaacaaatgccatccttctacccagcagagaatctggataatggccttatagatcaacgggtgcttaaacaacggcggaacgtgaagcagattctggccagaagcaaggctctgcaatggacaaagagctacgttctgcccgagtttccttatgacgtgaaatgcatgcttgccgaacagaagtgcccagaccattccatgcgaattagatag

SEQ ID NO: 51195 - DNA, 2085 bp, Artificial Sequence
  Description of Artificial Sequence: Synthetic coding sequence
atgatgttccgggaccaggtgggcatcctggccggctggttcaagggatggaacgagtgcgaacagaccgtggccctgctcagcctgctgaagcgggtaacaagaacccaggctagattcttgcaactgtgcttagaacactccttagctgattgtaatgatatccatcttttagagagtgaggccaactctgccgcaatcgtatcccagtggcagcaggaaagcaaggagaaggttgttagcctgctgctctcccatttaccattgctccagccaggcaatactgaggcaaaaagtgagtacatgagactcctgcaaaaggtgctggcctactcaattgagagtaatgccttcatcgaggagtcccgccagctgctgtcatatgcattgatccaccctgctacaactctggaagatagaaacgcactggccctgtggttgtcacatctggaagagagacttgcatctgggttccgaagcagacctgagccctcttatcatagccggcagggctccgatgagtggggcgggccagcagagctcggcccaggcgaggctggtccaggatggcaggacaaacctccacgagaaaacgggcatgttccgtttcacccgtcaagtagcgtgccccccgctatcaactcgattggcagcaacgccaatacaggcctaccctgtcagattcaccccagccccctgaaacgctccatgtccctcattccgacgtctccccaggtgcctggtgaatggccctcgcccgaggagctcggcgcccgcgccgcattcactacccctgatcatgcccctctctcccctcagtcgtcggtggcatcctctggcagcgagcaaaccgaggagcagggatccagccgcaacacgttccaagaggacggttctgggatgaaggatgttcctagttggcttaagagcttgagactgcacaagtacgcggcgctgttctctcagatgagctatgaagagatgatgacactcacagagcaacatctggaaagccagaacgtgacaaagggtgctcgccacaaaatagccctaagcatccagaaattacgggagcgccagtccgtgctaaagtcactcgaaaaagacgtgctggagggcggtaacttgcgtaacgcgttgcaggaacttcagcagattattattacgcctataaaggcatactccgtgctgcaggctaccgtggccgccgccacgactacccctacagcgaaggacggagccccaggggagccgccgctgccgggggccgaacccccattggcacatccaggaaccgacaaggggactgaagctaaggatccaccagccgtagagaattacccccctcctcccgctcctgctccaacagatggatcggaacctgcacctgcccctgtcgctgatggcgacatcccgtcccagttcacgcgggtgatgggcaaagtgtgcacacagttgctggtcagtagacccgacgaggagaacatcacctcctacctccaactcattgaaaaatgcctgacacatgaggcatttaccgaaacccagaaaaagcggcttctgtcctggaagcagcaagtgcttaagcttctgcggaccttcccccgcaaggccgccttggaaatgcagaactacaggcaacagaagggctgggcctttggctcaaattctttgccaatcgcagggagtgtcgggatgggggtagcccgaagaacccagcggcagttccccatgcccccccgcgctcttccccccggccggatgggacttctgagcccttccggcatcggaggagtaagccctcgtcacgctctcacatccccatcgttgggaggccagggtcgacagaatctgtggtttgctaatccaggcggctctaactcaatgccttctcagtctcggtcctcagtccagaggacccattcactgccagtgcatagcagtccgcaggccatcctgatgttcccacctgattgccccgtgccgggaccggacctagaaattaacccaaccctggaaagtctgtgcctatccatgacagaacacgcactgggggacggaacagacaaaacgtcgacgatctag

SEQ ID NO: 51196 - DNA, 1992 bp, Artificial Sequence
  Description of Artificial Sequence: Synthetic coding sequence
atgatgttccgggaccaggtgggcatcctggccggctggttcaagggctggaacgaatgtgagcagaccgtcgctcttctgtccctgctaaaacgcgttacaaggactcaggctcgctttctgcagctgtgcctcgaacattcgcttgccgactgtaacgatattcatttactggagtcggaagctaatagcgccgctattgtgtcacagtggcaacaggagagtaaagagaaggtggtgtcgctgttgctctcccatcttccactcttacaacctgggaacacggaggctaaatccgagtatatgcgactcttacagaaagttctggcttactccatcgagtcaaacgccttcatagaggagagcagacaactcttgtcttacgctctcatccaccctgccaccactctggaagatcggaacgccctggcactgtggctcagtcacctggaagaacgcttggcctccggctttcgctctcgcccagaaccctcttaccactcacgccagggaagcgacgagtgggggggaccggcagagttgggaccaggcgaagccgggcccggatggcaggacaaaccaccgcgggaaaatgggcacgttccatttcaccccagcagctccgtccctccggctatcaactccatcggttccaacgcaaatactggtctgccctgtcagatccacccgagtcccttgaaacggtctatgtccctgattcctactagcccccaggtaccaggagagtggccatctccagaggagcttggcgctagagccgcctttactactcctgaccatgcaccactctctccccaatcatctgtggcatcctcagggagcgagcaaacggaggaacagggtagctcccgcaatacattccaggaagatggttctggaatgaaggacgttcccagctggctcaaatctttacgactacacaagtatgccgcactcttttcccaaatgtcatacgaagaaatgatgaccctgaccgagcaacatctcgaatcccagaatgtaacgaagggggcgaggcacaagatcgctctctcaatccagaagttgagagagcggcagtctgtgcttaaatcccttgagaaggacgtgctagagggtggcaacttaagaaatgcccttcaggaattgcaacaaatcatcattacccccataaaggcatatagcgtgctgcaggcaacggtcgccgccgccaccacaacacctacagccaaagacggggcgcccggcgagcctcctctgcctggcgctgaaccccctctggcccaccccggtactgacaagggcactgaggcgaaagatccaccagcagtggaaaactatcccccaccaccggctcccgccccgacagacggaagtgagcccgcaccagctcctgtcgctgacggagatattccatcacaatttactcgcgtgatggggaaggtgtgcacccaacttcttgtgtctcgccctgatgaagagaacataacgtcatatttgcagcttatcgagaaatgtttaactcatgaagccttcactgaaacgcagaagaagcgcttgcttagctggaaacagcaagtgctcaaattgttgagaacgtttccacgtaaagctgccctggaaatgcagaattacaggcaacaaaaagggtgggctttcgggtcaaattctttaccaattgccggatcagtgggcatgggggttgccagacggacacagagacaattccctatgccaccaagggcgcttccaccagggcggatggggctcctcagcccctccggcatcggaggagtatcgccccgccacgcgcttacgccccagccatggcggccgggtcctaccgagcccgtcgtgtgccagccatggcggcaacaacagcacgcacagtctgagccccagctgtgtgcggctcatcccctggctcccggcccccttgtcacaccaggccactctcacgtacccagccgcctcccggggtcctgggcctag

SEQ ID NO: 51197 - DNA, 522 bp, Artificial Sequence
  Description of Artificial Sequence: Synthetic coding sequence
atgtgcaccaacatcgtgtacgagtggctgaaggccctgcagctgccacaatatgctgagagcttcgtggacaatggatatgacgacctcgaagtatgtaaacaaataggggatccagaccttgacgcaattggcgtgctggctcccgcgcatcgtcgcagaattctggaagcagttagacggctccgtgaacaggacgccaatgccgctggtctgtatttcactctcgagcctcaacccgcaccgcccggtcctcccgccgacgcggtgccgacaggcaggcggggcgaaccctgcggcggtccagcacagggaacaagaggcgacagtcgaggccatacaactgctccgcggagccgtgaattggtgtcctaccccaaactgaagttgaaaattatgattagagacaagctagtgagggacgggatccatttgagcaaacccccgtattcgcgcaaagtgcctatggcaggcatcctcgagtatctgatgaactggcctaagtcgtcacagtctaggtag

SEQ ID NO: 51198 - DNA, 1341 bp, Artificial Sequence
  Description of Artificial Sequence: Synthetic coding sequence
atggccgtgaaccccctgctgacccccaccggccagcagaccatcccgcttatcccgagcccctttggcccccctaccgtggaccgagacgtgttacctagcactgtagcccccacagatcctcgacaattctgcgtcccatcacagttcggttctagtgtgttaccaaacaccaatatggctaatgttctcagcagcagaatttatccagggtggggtatcttacccccagagagcatcaaggctgtggctaggcggaatgaaatgatccagaggcaccacactgctcggacggagatggagatgtacgcgatctaccaacagcgtagaatggaaaaaataaacccaaagggcttagccggactgggaatcccttttctgtatggtagctccgtgcccgctgcacctgccgcatatcacggccgatcgatgctgcctgccggagatttgcacttccatcgttctaccctccggaatttgcagggaaacccaatgctggccgcgacagcccctcattttgaggagagctgggggcagcggtgtcggaggctgcggaaaaacaccggcaatcagaaagctcttgactcggacgctgagtcatctaaaagtcaggctgaggagaagattctgggacagacccacgctgtaccctatgaagaagaccactacgccaaggaccctgacatcgaagccccctcgaaccagaaaagttccgagactaacgagaaacctaccacagctctggccaacacctgcggagagttggagcccactcaccgcaagccttgggggagccatactacaactctgaaggctaaggcctgggatgacggcaaggaggaagcttcggagcagatcttcgctacttgcgacgagaaaaacggcgtctgcccaccagttcccaggccttccctgcctggaacccatgcacttgtcacaattggtggcaacctcagtctggatgaggatatacagaagtggacagtcgatgatgtgcactcttttatcagatccttgcctggttgtagcgactatgcccaggtgtttaaagatcacgccattgatggcgaaactttgcccctcctcaccgaagagcatttgcgcggtacaatggggctcaagctgggacctgcactcaagatccaatcacaggtgagtcaacacgtgggctcaatgttctacaaaaaaactctctctttccccattaggcaggcctttgaccaaccggccgacacatcaccactcctggatccaaattcctggtccgacaccatgaacattttttgtcctcaagacaccattataccaaagggaattgagagaggatccatgcggaactag

SEQ ID NO: 51199 - DNA, 1341 bp, Artificial Sequence
  Description of Artificial Sequence: Synthetic coding sequence
atggccgtgaaccccctgctgacccccaccggccagcagaccatccctctaataccttcacccttcggacctccaacggtcgatcgcgatgttctcccatccacagtggctcccaccgacccaagacaattctgtgtgccatcccagttcggctcctcagtgctcccaaataccaatatggctaatgtgctctcttcgaggatctaccccggctggggaatcctcccgcctgagagcattaaggccgtcgcgaggcgtaatgagatgatccagaggcaccacactgcgcgcactgaaatggagatgtatgcgatctaccagcagcgcagaatggagaaaatcaaccccaagggacttgccgggctgggaatccccttcttatatggaagctcggtgcccgccgcaccggctgcctatcacggccgcagtatgctgcccgctggcgacctgcacttccataggtccacactcaggaatcttcagggaaatcctatgctcgccgccacagcaccacatttcgaggagtcttggggccagagatgtcgccggctgaggaagaacacgggcaaccagaaagctctagactcagatgcggaatcaagtaagtcacaggccgaggaaaagatcctgggacagacacatgccgtgccgtacgaggaagaccactatgcgaaagatcccgatatcgaggctccttcaaatcagaagtcctcggagactaatgaaaagcctaccactgcgctggcaaatacctgtggagagttagagccgacccatcggaagccctgggggtcccacaccacgactctcaaggcaaaggcctgggatgacggaaaggaggaagcgagcgagcaaattttcgcaacatgcgacgagaagaacggtgtctgcccccctgtgccgagaccttccttgcctggcacgcacgcactcgtaacgataggtggcaacttatccctggatgaggacatccaaaaatggacggtggacgacgtacatagttttatcaggagcctgcccggctgtagtgattacgcccaggtttttaaggaccatgccatcgatggcgaaacccttcccttactgactgaagaacacctgagaggcaccatgggactgaagctggggccagcacttaaaatacaaagccaggtgtcccagcacgtggggtcgatgttctataagaaaacactcagcttcccgatccggcaggcgtttgaccagcctgcagacacaagtcctctgctggaccctaatagctggtcagacacaatgaatatcttctgcccccaagacaccatcatccccaagggaatcgagcgagggagcatgcgcaactag

SEQ ID NO: 51200 - DNA, 2781 bp, Artificial Sequence
  Description of Artificial Sequence: Synthetic coding sequence
atgaagaagacccggagcaccaccctgcggcgggcctggcccagctctgatttcagcgatagagcttcagataggatgagatcaagaagcgagaaagattataggctgcataagaggttccctgccgctttcgctccccaggcaagcagagggtatatgacctcaggagacgtctctccaatctctatgagccccatttcacaatcccaatttatcccactcggagagatattatgcctggccatcagcgccatgaatagtgcaaggaaacccgtgacccaggaagctctgatggaacatctaactacttgcttccccggggtcccaactccctcccaggaaatcctgcgacacactctgaatactctcgtacgagaacggaagatttatcccacccccgatggctactttatcgtgacaccccaaacctatttcatcacccctagtttaataaggacgaacagtaagtggtaccacctggacgagagaatccccgaccgtagccagtgcacctcaccccaacctgggaccatcaccccaagcgcctctggatgcgtgcgggaacgtactctacctcgtaatcactgcgacagctgtcattgttgtcgagaggatgtccatagtacccacgcacccactctgcagcgcaaatcggcaaaggattgtaaggatccatactgcccaccatccctgtgtcaggtaccccctaccgaaaagagcaaatcgactgtcaatttttcttacaaaactgagactctctcaaagcctaaggattctgaaaaacagtctaaaaagtttggcctgaagctgttccgtctgtcctttaagaaggataaaactaaacagctggcgaatttctctgcacaatttccgcctgaggaatggcctttgagagacgaagacactcctgccaccatcccgagggaagttgagatggaaatcattcggcgaattaacccagacctgacagtggagaacgttatgaggcacacggctctgatgaaaaagttggaggaggaaaaggcccagaggtctaaagccggcagttctgcccatcattcaggaaggagcaaaaaatcaaggacacaccggaaatcccacgggaaatcccgctcacactcgaaaaccagggtgagtaagggggacccctcagacggtagccatctggatattccagctgaaagggaatatgacttctgcgatcccctgaccagagtgcccagagaaggctgttttatcattgagcacaaaggcgataattttatcatgcactctaacaccaacgtgctggaaagtcactttccgatgaccccagaatgggacgtgagcggcgagctggccaaaagacgcacggagatgccttttcccgagccctccagggggtcctctcacagcaaagtgcaccgctcacattcacacacccaagacagaagaagtaggaatgaaaggtctaacaaagccaaagaacgtagtaggtctatggacaattctaagggtcccttgggagcatcttcactaggcacccccgaggatctggctgagggctgttcccaggacgaccagaccccgtcccagtcttacattgatgacagcaccctgagacccgcacaaaccgttagcctgcaaagagctcacatctcatccaccagctataaggaggtatgcatcccggagatcgtgtccggttccaaggagcctagtagtgcctgttctttgctagagcctggaaagcctcctgaatctctgccttcatacggagaattgaatagttgtcctacaaagaccgcgaccgatgactacttccaatgtaacacatcgtccgaaaccgtcctaactgcgccttctcctttaggtaagaacaaagaggatcacgacacactgacattagccgaaggcgttaagaagttatccccatcggatcgccaggtgcctcacagcagtcgggaacctgttgggcataaagaggagagcccgaagggcccgggagggggccctgccgcatccgggggggttgcagagggaatcgccaacgggcgcctggttcaacatcacggcgccgagccatcttctctggataaacggaaagaaatcttcagtaaggacactttattcaagcccttgcactctacattgtctgtcaattcctatcacaaatctagtctgtccctgctgaagagccatcctaagacaccagcggacaccctccctggacgctgcgagaagctcgaaccctcactgggaacatcagccgcacaggccatgccagctagccagaggcaacaggagagcggcggcaatcaggaagcatcctttgactactacaacgttagtgatgacgacgatagtgaagagggcgcgaataaaaatacggaggaggaaaaaaaccgggaagacgtgggtacgatgcagtggctgctggagcgcgagaaagagcgtgacctgcagcgaaagttcgaaaaaaacctcactctgctcgctcccaaggagacagatagctcctccaatcagcgagcaacccattctgccagacttgactcaatggacagctcgtctatcaccgttgatagcggctttaactcccctagaactagagaatctttggcctccaataccagctctatcgtcgaatcaaatcgtaggcagaaccccgctctcagccctgcccatggaggcgccggccctgctttcaatttccgcgcatctgcagaaccgccaacgaatgaggccgagaaattgcagaagcctagtaattgcctacaggcgtccgtcaccagcgtctag

SEQ ID NO: 51201 - DNA, 2592 bp, Artificial Sequence
  Description of Artificial Sequence: Synthetic coding sequence
atgaagaagacccggagcaccaccctgcggcgggcctggcccagcagtgatttctctgatagagcctcggacaggatgaggtcccggtcagagaaagactacaggctacacaaacggttcccagcggccttcgccccccaggcgagtagagggtacatgacttcaggcgacgtaagtcccatctcaatgtcccctatctcccagagccagtttatacctctgggggagatcctgtgcctggccatctctgcgatgaattctgcaagaaaaccagtgacccaagaagcgctcatggagcatctgactacttgtttcccaggcgtaccaaccccaagtcaggagatactgcgccacaccctgaacacactcgtgagagaacgcaaaatctacccgacacccgacgggtatttcatcgtgacaccccagacttattttataacgccttctttaataagaacaaattctaaatggtatcatttggacgagaggatcccagaccgtagtcagtgtaccagcccacaacccggaaccatcacaccatccgcttctggctgcgttcgcgaacgcaccctgccaagaaatcattgtgacagctgccactgttgtagggaggatgttcatagcacccatgctcccacattgcaaaggaaaagtgcgaaggactgtaaggatccttattgccccccctccctgtgtcaggtccctcctaccgagaagtccaaatctaccgtgaacttctcatacaagaccgaaacactgtctaaacctaaggattccgagaagcagagtaaaaaatttggcctgaaactctttcgcctgtcgtttaagaaagacaaaactaagcagttggcgaactttagtgcccagtttccacctgaggagtggccgctgagggacgaggatacaccggccaccatcccgagggaggtggagatggagattatccggcggattaatcccgacttgacagtcgagaatgtaatgcggcatactgccctgatgaaaaaactggaggaggagaaggcccaacgatctaaggctggttcctcagcccaccattctgggagaagcaaaaagtcaaggacccacaggaagtctcatgggaaaagcaggagccacagtaagacccgcgtgagcaagggggacccaagcgatggctcacatcttgatatacctgccgagagggaatatgacttttgtgatcccctgacaagagtcccaagagaggggtgttttattatagagcacaagggagataattttatcatgcatagcaacaccaacgttctggagagccactttcccatgacaccagaatgggacgtatccggcgagctagctaagcgacgcacagagatgccattcccggagccaagccgcggatcctctcattctaaggtccatagaagtcactcacacactcaggacagacggtcccgaaatgagaggtcgaataaggccaaagagcgttcgaggtcaatggacaattctaagggaccactgggcgcgagttcccttgggacgccagaggaccttgccgaaggatgctcacaagacgatcagaccccctcgcagtcttatatcgatgatagcacacttcggcctgcacagacagtcagtctgcagagggcacacatcagcagcacctcttataaagaagtttgcatcccggaaatcgtgtctggatcaaaagaacccagctccgcctgcagcctcttggaacccgggaaacctcctgaaagcttgcccagctatggcgagcttaattcttgccctacaaagacagctacagatgactacttccaatgtaatacatcctctgaaaccgtactgacagcaccctcccccctcggaaagaataaagaggatcatgacacactgactctggccgaaggggtgaaaaaactgtctcccagcgatagacaggttcctcactcaagccgagagccggtaggtcacaaggaggaatctcctaaagggccaggcggggggcctgctgcctcaggcggggtggctgaggggatagccaacggaagattggtgcagcatcacggcgccgagccgtcctcattggataaacggaaggaaatcttcagcaaagacaccctattcaagcccctgcactccactttgtccgtgaatagctaccacaagagctcgctctcactccttaagtctcatccaaagaccccagctgatacactgcctgggcgctgtgagaaactagagcctagcctgggaacctcggcagcgcaggcaatgccagccagccaacggcagcaagaaagcggcggaaaccaagaggccagcttcgactattacaatgtaagcgacgacgacgactccgaggagggggcgaacaaaaacaccgaggaagagaaaaatcgcgaggatgtgggtactatgcagtggctcctggaacgagaaaaagaacgggatctccaacggaaatttgaaaaaaacctgaccctgctggcccctaaagagacagattcctcttctaatcagagggcgacccattctgccaggcttgattccatggacagttcttctataacagtggactccggatttaactcgcctcgcaactag

SEQ ID NO: 51202 - DNA, 4155 bp, Artificial Sequence
  Description of Artificial Sequence: Synthetic coding sequence
atgagccagctgcagctgtggctgcagttcgaggccctgaacaaggggatggcccccggcagcccgcagactcgtgccgcccaatcatcttgctccatcgccgccctgcaagtcctgcaaaagagcgatgctgttttgagaggtcctgaggatagcagctactttgaggatttttctaacatttctatattttccagtagcgtggatagcctctctgatatcgtggatactcctgattttctccctgctgacagcctcaatcaggtgtctacaatctgggacgacaacccagctccatctactcatgacaaagtgtcggccccaggagcaccgtctcagccccgccctacctccgttgcgagccccgcccgcgacccgcacggacctgtaaggcttcgaggaccaacatcctgtgacctcagccggctggcccgggccgatatcctgctgccatttcaattgttccaactcagccgacctttcgcgggcttcgaagacttcctcccatcccattctacacctcttttggtgtcttaccaagagcaatctgtgcagtctcagcccgaagaggaggacgaagcggaagaagaggaggcggaagaattggggcacaccgagacgtatgctgactatgtgccttcaaaatcaaaaattggtaaacagcatcccgatcgagtcgtagaaacatctactctctcatccgtcccacccccggatattacctacactcttgcacttcctagcgatagtggagccctgtccgccttgcagttggaagctattacctatgcctgccaacagcatgaagtgctgttgcccagcggtcaaagggccgggttcttaatcggagacggggccggcgtgggcaaagggcgaactgtggccggtgtgattctagagaaccacctgcggggacggaagaaagccctgtggtttagcgtctccaatgatctgaagtacgacgctgagcgtgatctgcgggatattgaagcgaccggaatcgcagtgcacgcattatcaaaggtgggagcagtgctcggcaaagtcgggggaaaagtgggcacagtgccatgcaaaattaaatatggggataccacaacatccgagggagtgttgttcgccacgtactccgccctgattggagagtctcaggccgggggacagcacaggacgcgactccggcaaatcctcgattggtgtggagaggcctttgagggagtgatcgtcttcgatgagtgtcataaagcaaagaacgcaggctctaccaaaatgggcaaagcggtgctggatctacagaacaaactccctcttgcacgcgtcgtttatgcctctgcgactggcgcctctgagccgaggaacatgatatacatgagccgtctgggtatttggggtgagggcaccccctttcgaaatttcgaggaatttcttcatgccatcgagaagcgcggggtgggagctatggagattgtcgccatggatatgaaggtgtcagggatgtacatcgccagacagcttagcttttcaggagtcacctttcgcatcgaagagattccacttgcccctgcttttgagtgcgtgtacaacagagctgcgctgctgtgggccgaagcattgaacgttttccagcaggcagctgattggattggcctagaaagccggaagagtttatggggccagttttggtcggcacaccagcgattctttaaatatctctgcatcgctgcaaaagttagaaggctcgtagagttggcccgggaagaactggcgagggacaagtgtgttgtgatcggactccagtcaacaggtgaagctcgaacgcgtgaggtgctgggcgaaaacgacggtcatcttaactgttttgtctcagctgcagaaggcgtctttctcagcctgattcagaaacactttccaagcactaaaaggaagagagaccgcggggcaggttccaagcgtaagccaggagtgattaggatttccgacgattcgtcaactgagagcgatccaggtcttgacagcgactttaactcctcgcctgaatccctcgtcgacgatgatgtggtaatcgttgatgccgtgggtctgccctctgacgaccgcggaccactgtgcctcctgcagagggatcctcatggaccaggagtcctcgagagagtcgagagactgaaacaggatctgctggacaaggtgcggaggttgggccgtgaactgcctgtgaataccctcgacgagttgatcgatcagctgggcggcccgcaacgcgtggccgagatgactggcagaaaaggtagagtcgtctccagacccgatggaactgtcgccttcgagtcaagagcagaacaaggcctctccatcgatcatgtgaatcttcgagaaaagcagcgcttcatgtccggtgagaaattggtggctattatttcagaggcatcaagttcaggggtctcactgcaggctgatcggcgggtgcaaaaccagcgcagaagggttcacatgacactggaattgccttggtccgctgatcgagccattcagcagtttggacgtacacatcgctcaaaccaagtatctgcacctgagtacgtgtttcttatctcggagctggcaggagaacggaggtttgcgtcaatcgttgccaagcgcctggaaagtctgggggctctgacacatggggaccggagagctactgagtcgagggacctttctaaatacaactttgagaataaatacggtacacgtgccttgcattgtgtcctgaccactattttgtcacagacggaaaataaggtgcccgtgcctcagggctacccaggcggcgtgcctaccttttttcgtgatatgaagcagggcctcctgtctgttggaattgggggacgggagtctagaaacgggtgtctcgacgtagaaaaggactgtagcatcactaaatttttgaatcgaattcttggcctggaggtccacaaacagaacgcactcttccagtacttttccgacacatttgaccatctaatagaaatggataagcgggagggcaaatacgatatggggatcctgggagagcataggtgcagaggcgttgtctgggtcgacctagcaccgggtatcgaagagatctatgaggagagtcagcaagtgttcctggcgccgggtcatcctcaggacggccaggttgtcttctataagatttcagttgatcgcggcttgaagtgggaagatgcctttgccaagtctcttgccctgactggaccctacgacgggttctacctaagctataaggtccgaggaaataagccgtcttgtttgctcgcagagcagaatagaggacaattcttcacagtttataagcctaacatcggacgacaaagccaactggaggctctggattcgcttcgcagaaagtttcatagagttacagccgaagaggccaaagaaccttgggagtcaggctatgccctttcccttactcattgcagccattccgcatggaataggcattgtagacttgcccaggagggcaaggactgtttacagggcctacgtcttaggcaccactatatgctctgcggcgctctcctgagagtgtgggggcggatcgctgcagtgatggctgacgtcagtagcagctcttacctccagatcgtgagactgaagacaaaagatcgcaagaaacaggtgggaatcaagatcccagagggctgtgtgcgtcgcgtattgcaagagctcagactgatggacgctgacgtcaagcgccgacaggcgccggcactgggatgccccgctcccccagcaccgcggcccctggctctgccttgtggacctggggaagtgctggatttaacctatagtccgcctgcagaggcattccctcccccccctcatttcagtttccccgcacctctgtcgctggacgccgggccaggcgtcgttccgttagggacaccagatgcccaggcagatcctgccgcactggcccaccagggctgcgacatcaactttaaagaggttttggaagatatgcttcgaagcctccacgctgggccacccagcgagggagctctgggtgagggtgccggagctgggggggccgccggcggtgggcccgagcgccagtctgttatccagttctcaccacccttccccggggctcaggcgcctctgtag

SEQ ID NO: 51203 - DNA, 4101 bp, Artificial Sequence
  Description of Artificial Sequence: Synthetic coding sequence
atgctggccgtgggccccgccatggaccgggactacccccagcacgagcctccaccagcaggaagtctcttgtactctccacctcccctgcaatcggcaatgctgcactgtccttactggaataccttctccctgcccccatatcccgctttttcttccgatagcaggccctttatgtcttccgcgagtttccttggctcccagccctgtccagatacgagctatgcccccgttgctaccgcatctagcctgcctccgaagacctgtgatttcgcacaggactcatcttactttgaagacttctctaacatatcgatattctcaagttctgtggactccctatctgatatagttgacacgcctgactttttacccgccgacagcctgaatcaggtgtcgaccatctgggatgataatcctgcaccatccactcacgataagttatttcagttgtcacggcctttcgctggctttgaagacttcttgccaagccatagcacgccgttgctcgtctcatatcaggagcagtctgttcagtcacagcccgaagaagaagacgaggccgaagaggaggaagccgaggaactcgggcacaccgagacttatgcagactatgtgccttctaaaagtaaaatcggcaagcagcaccctgatcgcgtggtggaaaccagcacactctctagcgtccctccacccgacatcacttatactctcgcattgccatctgactcaggggcactttccgcactgcagctcgaggctatcacatatgcttgccaacagcatgaggtgttactaccaagcgggcagagggccggctttctgattggtgacggggctggcgtgggtaaaggcaggacggtcgccggcgtgattctcgaaaatcatttacgtggtaggaaaaaggccctgtggttttctgtctctaacgacttaaaatatgatgccgaacgtgacttgagagatattgaagccacaggcatcgcagtgcacgcgctctctaagattaaatacggagacactaccacctcagagggtgttctcttcgccacttactccgctctgatcggcgagagtcaagctgggggtcagcaccgcaccagactgaggcagatcttagactggtgcggagaagctttcgaaggggtgatagtgtttgatgaatgtcataaagcaaagaatgcgggctccacgaaaatggggaaagccgtactagatcttcagaacaagctgcccctggctagggtggtttatgcaagcgctacaggcgccagtgagcctcggaatatgatctacatgtccaggcttgggatttggggagaggggacacctttccgcaattttgaggaatttttgcatgctatagaaaaacgtggggtcggcgctatggagatcgtagccatggacatgaaagtctcaggaatgtacattgcaagacagttgtccttcagcggagtgacctttcgcattgaagagatccccttggcccccgccttcgagtgtgtgtacaaccgggccgccctgctttgggcagaggcacttaacgtttttcagcaggctgccgactggatagggctggaatcaaggaagtctttgtggggtcagttttggtccgcccatcagcggttcttcaaatacctatgtattgctgctaaagttcggaggctggtagagctggctcgtgaagagctcgcccgggataaatgcgtcgtgatcgggttgcagtccactggagaggcccgcactagggaagtgttgggtgagaatgatggccaccttaactgtttcgtgtcagccgctgagggggtctttctgagcctaatccaaaagcatttcccctccacaaagagaaagcgggaccggggcgccggttccaaacggaaaagacgtccaaggggaaggggcgccaaggctccaagattagcttgtgagaccgccggtgtgatcagaatttccgacgactcgagtacggagtccgacccaggcctggatagcgactttaactccagccccgagagtctggtggacgatgacgtggttatcgtcgacgcggtagggctgccatccgatgatagaggtccactttgtcttctacaaagagacccccacggtcccggcgtccttgagagagtggaaaggctgaaacaagatcttctggacaaagtgcggaggctcggcagagaactgcctgttaatacactcgatgagctaatcgaccaattgggaggccctcagcgcgtcgctgagatgacaggcaggaagggccgtgtggtatctcggccagatggaactgtagcctttgaatcccgtgctgagcagggattatcaattgatcatgttaacctacgggaaaagcaacgattcatgtccggcgagaaactggttgcgattatttctgaagccagttcatctggcgttagtctacaggccgataggcgagtgcagaaccagcgtcgccgcgtgcacatgaccctggagctgccatggtccgctgacagggcgattcaacagttcggtagaactcatcgatctaaccaggtgagcgcgccagagtacgtgtttttgataagtgagcttgctggcgagcgccggttcgcatcgatcgtagctaaacgcctagaatctctaggcgcattgacgcacggagatcgtcgcgcaacggaatccagagacttgagtaagtataacttcgaaaacaagtacgggacacgcgcccttcattgcgtgttgacaacaattctgagccagaccgagaacaaagtcccagtgccgcagggctacccaggcggtgttccaaccttttttcgagacatgaagcagggtttgctgtccgtgggcataggcggtcgcgaaagcagaaacggatgcttggacgtggagaaggattgcagcatcacgaagtttttgaaccgcatcctcgggctagaagttcataagcagaacgccctatttcagtacttctctgataccttcgaccacctgatcgaaatggacaagagagaaggcaagtacgatatgggaattctggacctggcacctggtatcgaagaaatatacgaggaatcccagcaggtgtttctggcaccaggacatccccaggacgggcaagttgtgttttataaaataagcgtggatcggggactgaaatgggaagacgcctttgctaaatctttggcacttacgggtccatacgacggcttttacctgagttacaaagtgcgtggaaataagcctagttgcctgttagcggaacagaacagagggcagttcttcactgtgtacaagccaaatatcggccgccaatctcagctcgaggctctggacagcctcagaagaaaattccacagagtgaccgcagaggaggcaaaagaaccctgggaatccgggtacgccctgtcgcttactcattgctcacatagcgcttggaatcggcactgccggctggcacaggaagggaaggactgcctgcaggggcttcgcctacgtcaccattatatgctgtgcggcgccctcctcagggtgtggggcaggattgctgccgtgatggccgatgtgagttccagctcttacctgcagattgtgcggctgaagacaaaagataggaagaagcaggtgggcatcaagattccagaggggtgtgtaagaagggttctccaggagctgagactcatggatgcagacgtgaaacggaggcaagccccagctctcggatgtcccgctccccctgcaccccgccctttggccctgccttgcggcccaggggaggtgttggacttaacgtactcccccccagctgaggcctttcctccaccgccccacttcagcttcccagccccattgtccctggatgccgggccaggggtagtgccactgggaactcccgacgctcaggccgaccccgcagccctggcgcaccagggctgcgacatcaactttaaggaagtgctggaagacatgcttcgttcattacatgccggaccccccagtgagggtgcacttggtgaaggtgccggggccggaggcgctgccggcggtggcccagagcgccagagcgtcatccagtttagccctccttttcctggcgcccaagcgccactatag

SEQ ID NO: 51204 - DNA, 3930 bp, Artificial Sequence
  Description of Artificial Sequence: Synthetic coding sequence
atgcgggagcccctgcccggcagcgccagctggggcacccccggcccgccatcagcaggcacaatgagtcagcttcagctgtggctgcagttcgaagcacttaacaaggattccagttatttcgaggacttctcgaacatttccatcttttcttcctccgttgactccctgagtgatatcgtcgacactccagatttcctaccggccgactctctcaaccaagtgtcaactatttgggatgataaccccgcccctagtacccatgataaactgtttcagttatcccgcccctttgctggatttgaagactttttgccaagccacagcacccccctcctggtcagttaccaggaacagtcggtgcaaagccagccagaggaagaggatgaggcggaggaagaagaggccgaggagctcggccacactgaaacatacgcagattacgtgccatcaaagtccaaaattggaaaacaacacccagatagggtggtcgagacctcgaccttgtcctctgtgcccccacctgacatcacttatacattggccctcccatctgattcgggcgctcttagcgcactacagctagaagccatcacatatgcctgtcagcagcatgaagtgctgcttccttccggtcagagagctggcttccttattggagacggggccggggtcggcaaaggcagaactgttgccggagtgatcctcgagaatcaccttcgcggacgcaagaaagctctttggttctcggtgtccaatgatttgaagtacgacgccgagcgtgacttgcgtgacattgaagcaacgggaatcgcagtgcacgctctgtctaaaattaagtacggcgacactacaacctccgagggcgtgctgttcgctacttactcagccctcatcggggagtcgcaggctggcgggcaacacagaaccaggttaaggcagattcttgattggtgtggggaagccttcgaaggcgtaatcgtgtttgatgaatgtcacaaggccaaaaacgctggttctaccaagatgggcaaagcagtgctggacctgcagaacaagctgccgcttgcaagggtagtgtacgcctcagctaccggggcatctgagcctagaaatatgatttatatgtctcgcctagggatttggggggaaggaactccgtttagaaacttcgaggaattcctgcacgccattgaaaaacggggcgtcggtgcaatggaaatcgttgcaatggacatgaaggtttccgggatgtatattgctaggcagttgagcttttctggtgtcactttcaggattgaggaaattcctctggccccagcctttgagtgtgtctataaccgcgctgctttgctgtgggctgaggcactgaatgttttccaacaggccgctgactggatcggcctcgagagtcgaaagtcgctttggggacaattctggtccgcccatcagaggttttttaaatacttgtgcatcgcagcaaaggttcgacgccttgtcgaactcgctcgggaggaattagcgcgcgataagtgcgtcgtaatcgggcttcagagcactggtgaggcccgaactcgcgaggttctgggcgaaaatgacgggcacctcaactgcttcgtgtctgcggctgaaggggtgtttctgtctttgattcagaagcacttcccatcaactaagcgcaaacgggatcgtggcgcagggtcgaagcggaagaggagacccagaggaagaggggcgaaggccccccgcctggcctgcgagacagccggggtaattcgaatatcggatgactctagtactgagtccgatcccggtcttgattccgattttaacagcagccccgagtccctcgtggatgatgacgtggtaattgttgatgcagtgggcctcccatcggatgatcgcggacctctgtgtttgctccagcgcgatccacatgggcccggagtgctggaaagggtggaacggttgaaacaagatctcctggacaaagtcagaagactaggtagagaactgccagtgaatactttggacgagctaatagatcagctcggaggccctcagcgcgtggcagaaatgacaggcagaaagggacgtgtggtgtcgcggcccgacggcaccgtagcttttgagagccgggcggagcaggggcttagcatcgatcatgtgaacctcagagagaaacagcggtttatgtccggcgaaaaactggtggcaattatttccgaggcatctagttcgggtgtatcactacaggccgatcgcagagtgcagaaccagaggaggcgagtgcacatgacactagagctgccttggagcgccgacagggccatccagcagtttgggagaactcacaggtctaatcaggtatccgcccccgaatatgtctttctcatatcagagttggcaggagaacggagatttgcatccatcgtcgccaaacgcctggaatcactcggcgcccttacgcatggtgaccggagagctaccgaatcccgggacttgagtaaatataactttgagaataaatatggtacgcgggcgctccattgcgtcttgaccacaattttgtcacagactgagaacaaggtccctgtgcctcaagggtatcccggcggggttcctacctttttcagagacatgaagcagggccttctgagtgttggaatcggaggcagagagtccagaaacgggtgcctcgatgttgaaaaagattgctcgataaccaagtttctgaaccggattctaggccttgaggtccataaacagaacgcactttttcagtatttttctgatactttcgatcacctcattgaaatggataaacgagagggcaaatacgacatggggatactggatctggcgcccggcattgaggaaatctatgaggaaagccagcaggtatttctggcacccgggcacccccaggatggccaggttgtgttctacaaaatatcagttgaccggggattgaagtgggaggatgctttcgctaaaagcctggccctgaccggtccatacgatggattctacctttcttacaaggttcgcggaaacaaaccctcgtgcctattggccgagcagaaccgggggcagttttttactgtgtacaagcccaatataggtcgacagtcccagcttgaggcacttgattcgctgcgtcgcaaattccacagggtcaccgctgaggaggctaaggaaccgtgggagtcaggatatgccctctcacttacccactgttcacactctgcctggaatagacattgcagattagcccaggaaggtaaggattgcctgcagggactcaggctccggcaccactacatgctctgcggagccctgctgcgggtgtgggggcggatcgccgcggtgatggctgacgtctccagttccagttatctccaaatagtaagactgaaaactaaagaccgcaagaagcaggtgggcatcaagatccctgagggctgcgtccgacgtgttttacaggagctacgactgatggatgctgatgtgaagagacgacaggccccagccctggggtgccccgcacctcccgctccccggcctttggcactcccgtgcgggccaggggaggtgctcgacctgacctacagtcctcccgcagaggcttttccacctcctcctcacttctcctttcctgccccattgtctctggatgcgggacctggagtggtgcctcttggtacccccgacgcacaggcagatccagctgctctcgcacaccagggttgcgacatcaactttaaagaggtcctggaggacatgcttcgaagccttcacgcaggacccccaagcgaaggggctttgggcgaaggagctggagcaggcggagccgctggcggtggacccgaacgccagtctgtgattcagttttcgcctccgttccccggtgcccaggcaccactatag

SEQ ID NO: 51205 - DNA, 453 bp, Artificial Sequence
  Description of Artificial Sequence: Synthetic coding sequence
atgagcggctggatcgccaccagcaagacccggatgcaggacttctggtcgctgctgactttctcatcggatctcgtagacgtgaaagactccggcgactaccctctgacagccccgggactgtcctggaaaaagttccagggctcattctgcgaattcgtgggaactctcgtgtgtcgctgccagtacatactgttacacgacgatttccccatggataatctgatatcattattgactggcttttctgactcccaggtgtgtgcattctgtcatactagtactctggcggctatgaagttaatgacctccttggtgagagtggccctgcagttgagcttacatgaggacattaatcagcgccaatacgaggctgagaggaataagggccccggccagcgggcccctgagaggctcgagtccctcctagaaaagcataaggaactacactag

SEQ ID NO: 51206 - DNA, 453 bp, Artificial Sequence
  Description of Artificial Sequence: Synthetic coding sequence
atgagcggctggatcgccaccagcaagacccggatgcaggacttctggtcactgctgacatttagcagcgatttggtggacgttaaggacagcggggattatcctctcacggcacctgggttgtcctggaagaaatttcaggggagcttctgcgaatttgttggtaccctagtatgtagatgtcagtacatcctgttgcacgatgatttccctatggacaatctgatctccctgctcacaggcttttccgacagccaggtgtgtgcgttctgtcatactagtaccttggcagcgatgaaacttatgacctcattagtgcgcgttgccctgcagttgtcgttgcatgaggacatcaatcagcggcagtacgaagcagagcggaataaaggcccagggcagcgcgctcccgagcgccttgaatcactactggagaagcataaggagcttcattag

SEQ ID NO: 51207 - DNA, 891 bp, Artificial Sequence
  Description of Artificial Sequence: Synthetic coding sequence
atgctgagccccaaggacatcctgcggaaggacctgaagctggtgcatgggtacccgatgacctgtgcctttgctagtaattgggagaagatcgagcaatttcactcacgtcctgacgacattgtgatcgcaacctaccctaagagtgggaccacctgggtgtccgagatcatagatatgattttgaatgacggggacatcgagaagtgcaagagaggattcatcaccgagaaggtccctatgctggaaatgacattaccagggctgcgtacttccggcatcgaacagctcgaaaaaaatccgagcccaagaattgtcaaaacgcatctgcctacagaccttttgccgaaaagtttttgggaaaacaactgtaagatgatttatctggctcgtaatgcaaaggatgtttctgtctcatactaccacttcgatctgatgaacaacctccaacctttccctggcacctgggaggaatatcttgagaagtttttaacaggtaaggtggcctatggcagctggttcacacacgtaaaaaattggtggaagaaaaaggaggagcatccaatcctttttctctactatgaagacatgaaagaaaatcccaaggaggagatcaaaaagataatcagattccttgaaaagaatttgaacgatgagatcctggatcgaatcatccaccacacttcctttgaggttatgaaagataacccactagtcaactatactcacctgcctaccacagtcatggatcacagcaaaagccctttcatgaggaagggcaccgcaggcgactggaagaactactttaccgtggcacaaaatgagaagttcgatgctatttacgagactgagatgtctaagaccgctttgcagttccggacagagatctag

SEQ ID NO: 51208 - DNA, 468 bp, Artificial Sequence
  Description of Artificial Sequence: Synthetic coding sequence
atgctgagccccaaggacatcctgcggaaggacctgaagctggtgcacggatacccaatgacttgtgccttcgcaagtaactgggaaaaaatagagcagtttcacagtaggccagatgacattgtaatcgcaacatatcctaagagcgggactacgtgggtgtctgagattatcgatatgatcctcaacgacggcgatattgaaaaatgcaagcgaggcttcattaccgagaaggtgccaatgttagagatgacgcttcccggcctgaggacatctggcatcgagcagctggagaaaaatccatccccccgcatcgtaaaaacacatctccctaccgacctgctgccaaaatcattctgggaaaacaactgcaaaatgatctacttggcaaggaacgccaaggacgtatctgtgagctactaccacttcgatctaatgaataatctgcagccgttccccggaacatag

SEQ ID NO: 51209 - DNA, 639 bp, Artificial Sequence
  Description of Artificial Sequence: Synthetic coding sequence
atggaccccgtggtgctgagctacatggacagcctgctgcggcagtccgatgtctccctgctggacccgccaagttggttgaatgaccatatcattggatttgcattcgagtactttgcgaactcccaattccatgattgctctgaccacgtttctttcatctccccagaagttacccagttcatcaaatgtaccagtaacccggcagagatcgccatgtttttggaacccctcgatctgcctaacaagcgagtcgtgttcctcgccatcaatgacaattcaaatcaagcagccggcggcacccactggagcctcctcgtctacctacaagacaagaattcctttttccactacgacagtcattccaggagtaattccgttcacgccaagcaggtcgcagagaaattggaagctttcctgggtagaaaaggagataagttagcgtttgtggaggagaaagctccggcgcagcagaattcttatgactgcggcatgtacgtgatatgcaatacggaggctctgtgtcagaactttttccgccagcaaactgagtctttgctgcagcttctgaccccagcgtatattaccaagaagcggggagagtggaaagatcttatcactactttggccaagaagtag

SEQ ID NO: 51210 - DNA, 639 bp, Artificial Sequence
  Description of Artificial Sequence: Synthetic coding sequence
atggaccccgtggtgctgagctacatggacagcctgctgcggcagtctgatgtaagcctcctggacccgcccagctggctgaatgaccacatcatcggcttcgcatttgaatactttgctaattcccagttccatgactgcagtgatcatgtatctttcataagccccgaagtcactcaatttataaaatgcacatcaaaccccgcagagatagctatgtttctggaacccctcgacttacctaataagcgcgtcgtgttcctcgcgataaatgataattccaaccaggcagctggagggactcactggtcgctgctggtttaccttcaggacaagaacagttttttccattacgatagccatagtcgctccaacagcgtacacgccaagcaagtagccgagaagctggaagcgttcctgggtcggaagggagataagctggcttttgtggaggagaaagctccagctcagcagaattcttacgattgcggaatgtatgttatatgtaacacagaggccctatgccagaatttcttccggcagcagacagagagtctgcttcagctgctgaccccagcgtatattaccaaaaaacgtggagaatggaaagatctgattactacacttgccaagaaatag

SEQ ID NO: 51211 - DNA, 639 bp, Artificial Sequence
  Description of Artificial Sequence: Synthetic coding sequence
atggaccccgtggtgctgagctacatggacagcctgctgcggcagagtgatgttagcctcctcgacccccctagctggctaaacgatcacatcattggatttgcttttgagtactttgccaactctcaattccatgactgtagcgatcacgtgtccttcatctcaccggaggtgacccagtttataaagtgcacctctaaccccgcagaaatcgcaatgtttctagagccgctggacctgcctaataaaagagtggtcttcctggctatcaacgacaactcaaatcaggccgctggggggacccactggtcgctcttggtctacttacaggataaaaacagttttttccattatgactctcactcccgatccaattctgtacacgccaaacaggttgccgaaaagctggaggcctttctgggtcggaaaggcgacaaacttgcgttcgtcgaggagaaggcgccagctcaacagaactcctatgactgcggcatgtatgtcatctgtaatactgaagccctctgtcaaaatttttttagacaacagaccgaatccctgctgcagctgctgacccccgcctatatcacaaagaagagaggggagtggaaagacctgatcaccactctggctaaaaagtag

SEQ ID NO: 51212 - DNA, 639 bp, Artificial Sequence
  Description of Artificial Sequence: Synthetic coding sequence
atggaccccgtggtgctgagctacatggacagcctgctgcggcagagcgacgtgtccctgttggatcccccctcatggctcaacgatcacattatagggtttgcatttgagtatttcgccaactcccagtttcacgattgtagtgaccacgtgagttttatctcccctgaggtgacccagttcatcaaatgcactagtaacccggcagaaattgccatgttcctcgaacccctagatttaccaaataaaagagttgtgtttctagctatcaacgataacagcaatcaagccgctgggggaactcattggtccctgcttgtctatcttcaggacaaaaattccttttttcactacgattcccactctaggagcaactcggtgcatgcaaagcaggtggctgaaaaactggaggctttccttgggcgcaagggagataagctggctttcgtggaggagaaagcccctgcccagcagaactcatacgactgtggcatgtatgtcatctgcaatactgaggccctgtgtcagaatttcttccgtcagcagacagagtcactgctccagttattaacgccagcttatattacgaagaaaaggggggaatggaaagacttgattactacactggccaaaaagtag

SEQ ID NO: 51213 - DNA, 1668 bp, Artificial Sequence
  Description of Artificial Sequence: Synthetic coding sequence
atggccgaccggggcggcgtgggcgaggccgccgccgtgggcgcctctcctgcctctgtgccgggattgaatcctactctagggtggcgagaaaggttgagggctggactcgccgggaccggggcaagcctgtggttcgtcgccggcctggggctgttgtacgcgcttaggatacctctgagattgtgtgagaatctagccgccgtaactgtcttcctgaattctctgactcccaaattttacgtagctctaactggcaccagtagtctcatcagcgggcttatatttatattcgaatggtggtactttcataaacacggcacttctttcatcgaacaggttagtgtgagccatctccagcccctgatgggggggacagaaagcagcatctccgaacccgggagcccatctagaaatcgagagaatgaaacgtcccgtcagaatttgagtgagtgcaaggtctggcggaatccgcttaatttatttaggggcgcagagtaccgtcgctacacttgggtcaccgggaaagaacctctgacctactatgatatgaatctgagtgcccaggatcaccaaacttttttcacatgtgatactgattttctgcgcccatccgacaccgtgatgcagaaagcttggagggagcgcaacccgccagccagaatcaaggctgcctatcaggcactcgagctgaacaacgattgcgctaccgcttacgtcttgctcgccgaggaagaagcaaccactatcgttgatgccgaacgtcttttcaaacaggcgctgaaggccggagaaactatctatcgccagtcccaacagtgtcagcatcagtcccctcagcacgaggctcaactgcggcgtgatacaaacgtccttgtgtatattaagaggcggctcgctatgtgcgctcgtaagcttggccggattagggaagccgtgaaaatcatgagggatcttatgaaggaattcccaccgctgaccatgctcaacatccacgagaaccttctggagagccttcttgaactgcaggcttacccagatgttcaggccgtgctcgccaagtatgacgacatttctttacccaaatctgccgccatttgctacaccgctgctctactgaagacaagaaccgtatcagagaagttcagccccgagacagcctcaaggcgaggactctctacagccgaaatcaacgctgtggaggctattcatcgcgccgtggagttcaatccccacgtgcccaaatatttgttagagatgaagagtctgatcttaccgcctgaacacattctgaagagaggagacagcgaggccatcgcctacgctttcttccatctacagcactggaagcgcatcgaaggagctctgaatttactccagtgtacttgggaaggtacttttagaatgatcccgtaccctcttgagaaaggccacctgttctatccctatccgtcctgcacagagacggcggacagggagttgctgccaaccttccaccacgtctctgtctatcctaagaaggaattgcctctctttatccactttacggcaggcttctgctcctccacggctatgatcgccatactgacccaccagttccccgagatcatggggatctttgctaaggccgtgtctatgatctcgagaacctgcgtggactacctctag

SEQ ID NO: 51214 - DNA, 1728 bp, Artificial Sequence
  Description of Artificial Sequence: Synthetic coding sequence
atggccgaccggggcggcgtgggcgaggccgccgccgtgggcgccagcccagctagcgtgccagggctgaaccccactctgggatggcgggaacgcttgagagcggggttggcaggtacaggtgcaagcctgtggtttgttgcaggtctgggcctgctgtatgcactgagaatacccctgagactttgcgagaacctcgcagccgtaacagtctttctgaacagccttacgccaaaattttacgtcgcactcacgggcacatcttcattgatttccggcctgatcttcattttcgagtggtggtacttccacaaacacggcacctcttttatcgaacaagtgtccgtatcacacctgcagccgcttatgggaggaacagaaagttcaatcagcgagcccggatctccgagtcggaacagggagaacgaaacaagcagacagaatctaagtgaatgcaaagtgtggcgtaacccactcaatcttttccgaggagcagagtataggaggtatacttgggttacggggaaagagccactgacatattatgacatgaatttaagcgctcaggatcaccaaacattttttacttgcgataccgacttcttgcggccaagcgacacagttatgcaaaaagcatggcgggaacggaatccacccgcgcggattaaggctgcctatcaggcgcttgaacttaacaatgattgtgcaactgcctacgtgctcctggccgaggaggaggccaccaccattgtagatgccgagcgactgtttaaacaggctctcaaggcaggcgaaacaatctatagacaaagtcagcagtgtcagcaccagagcccgcagcatgaagcccagcttcgacgggatactaacgtgctagtttatattaagcgccgcctggccatgtgcgctcgcaaattgggtagaataagggaggccgtgaaaatcatgcgcgatctgatgaaagagttccctccactaactatgttgaatatccacgaaaatctgctcgagagcctgctcgagctgcaggcatacccggatgtccaggcagttctggccaaatacgacgatatatccctacccaagtcagccgccatctgctataccgccgcactgctgaagacccgcactgtgtctgaaaagttctctcccgagaccgcatcacgaaggggactgtccactgccgaaattaatgcggtcgaggcaatccacagggccgtcgaattcaatccccacgtgccaaagtacctgctcgaaatgaaaagcctcatcctgccaccggagcacattttgaagcgaggggattcggaggccatcgcatacgcctttttccaccttcagcactggaagagaatcgaaggagcgcttaatctcctgcagtgcacctgggaaggcacttttaggatgatcccttaccccctggaaaaaggacatcttttttatccttatccaagctgcaccgaaaccgccgatcgcgagctccttccaacctttcaccacgtctcagtataccccaaaaaggaacttcctctgtttatccacttcaccgcggggttctgttcaagcacggctatgattgctatactcacacaccaattccccgagattatgggtatcttcgctaaggccgtgctggggctgtggtgcccccagccttgggcctcttccggatttgaggaaaatacgcaggacctgaagtcggaggatctgggcttgagttcaggatag

SEQ ID NO: 51215 - DNA, 1635 bp, Artificial Sequence
  Description of Artificial Sequence: Synthetic coding sequence
atggccgaccggggcggcgtgggcgaggccgccgccgtgggcgccagtccggctagcgtgcctggcctcaaccctaccctcggctggcgggaaaggctgagggccgggctcgccggcacaggcgcctccctgtggttcgtggccggactcggactcctgtacgcacttcggatccctctgcgcctttgtgagaatcttgcggccgtgacagtgttcctgaattctctcacaccaaagttttatgtggcactcaccggcacttctagtctgatttccggactcatcttcatctttgaatggtggtattttcacaagcatggtacctccttcatcgagcaggtttctgtgagccacctgcagcccctgatgggggggacagaatcttcaatctccgagccaggctccccgagccgaaaccgagaaaacgagactagccgccagaatctttccgagtgtaaggtgtggagaaatcctctgaatctttttaggggcgccgagtaccggagatacacctgggtgaccgggaaagaacctttaacgtactacgatatgaatctttctgcacaggaccaccagacattctttacatgcgatactgattttctgcggccttctgatactgtgatgcaaaaagcttggcgggagcggaacccgcccgccaggattaaggcagcctatcaagccctcgagttgaataacgattgcgctacagcgtatgtcctgctcgcagaagaagaggctacaactatcgtcgacgccgagagactcttcaaacaggcactcaaggccggcgaaacgatatacagacaatcacaacagtgtcagcatcagtctccacagcacgaagcacagctccggcgagacacgaatgtgctggtctacataaagcggcggttagcgatgtgcgccagaaagttgggccggatccgcgaggccgtgaagatcatgcgcgacctgatgaaggagtttcctcctctcactatgctcaatatacacgagaatctgctggagtcacttctcgaattgcaggcctaccctgacgtccaggccgtgttggccaaatatgacgatatctcgcttcccaagagcgccgcgatatgctatactgccgcactccttaaaacgagaacagtgtctgaaaagttcagccctgagacggcttccaggcggggattgtctaccgccgagatcaacgctgtggaggcaatccatcgggccgttgaatttaatccacacgtaccaaaatatttgctggagatgaagagtcttatattgcctccagagcatattctgaagagaggggattctgaagcaatagcatatgcgttcttccatctgcagcattggaaacggatcgaaggagccctgaacctgctccagtgtacgtgggaaggtacctttcaccatgtgtccgtttaccctaagaaggaactccctctgtttattcattttactgcaggattttgtagcagcaccgcgatgatcgcaatattgacacaccagtttcctgagatcatgggaattttcgctaaggcagtccttgggctatggtgtccgcagccttgggcaagctctggattcgaagagaatacccaagacctgaagagcgaggacctgggactgagctccggttag

SEQ ID NO: 51216 - DNA, 690 bp, Artificial Sequence
  Description of Artificial Sequence: Synthetic coding sequence
atgagccccttcctgttccgggacgacatgaaggacctgaccgtgtttctcaacagtctaactccaaagttctacgtggcactgacaggtactagcagcctcatctccggcttgatattcatttttgagtggtggtattttcacaaacatggcacctcgttcatcgaacaggtctccgtgtctcacctgcagcctcttatgggcgggaccgagagcagtatctcagagccgggttctccctcacgaaaccgagaaaacgagacctcccgtcagaatcttagcgagtgtaaggtctggaggaatcccctgaacctatttagaggggctgaataccggaggtacacttgggtcaccggcaaagagcccttgacctattatgacatgaatcttagcgcacaggatcatcagaccttctttacctgcgacacggatttcttgcgaccctccgacacagtcatgcagaaggcctggagggagaggaatccacccgcacggataaaggcagcctatcaggcactggagctaaataacgactgcgctaccgcttacgtcttattggcagaggaagaggctactaccatcgttgacgccgagaggctgttcaaacaggccttaaaagcaggagaaaccatctaccgacagtcccagcagtgccaacatcagtctccgcagcacgaggcccagttgtag

SEQ ID NO: 51217 - DNA, 966 bp, Artificial Sequence
  Description of Artificial Sequence: Synthetic coding sequence
atgggcggcaccgagagcagcatcagcgagcccggcagccccagccgcaatcgagagaacgagacctcgcgccaaaacctcagcgaatgtaaggtctggagaaatccactgaacctgttcagaggagccgagtataggcgctacacctgggtaacgggtaaggagcctctcacgtattatgacatgaatctgtcagcgcaggatcaccagacgttcttcacatgcgacaccgatttcctccggccaagtgacaccgtgatgcagaaagcctggagagaacgaaacccgcccgcccggataaaagctgcctatcaagcgttggaattgaataacgactgtgccactgcttatgtgctgttggcagaagaggaagcaaccaccatcgtcgacgccgagagactgttcaagcaagctctcaaggctggagagaccatctaccgccagtcacaacagtgtcagcatcagagcccccagcacgaagctcagctccgcagggatacaaacgtgctggtgtatataaagcgacgccttgccatgtgtgccagaaagcttggtcgcatcagggaagccgtgaaaattatgcgggacttgatgaaagagttcccacctctgacaatgttgaatatccacgaaaatctactcgaatccctcctcgagctgcaagcctatccggatgtacaggcggttctggcgaaatacgacgatatttccttgccaaagtcagccgcgatttgctatacagccgcactcctgaaaaccaggaccgtaagtgaaaaattcagtccagagacagcatcccgtcggggcctgagtacagccgaaatcaatgcggtggaagccatacatcgagcagtggagttcaatccccatgtccccaaggtagaaatctaccccttcagccctcagctaaacatcaaggccgttgataatagcgccatctccaagtatccggctaatatgtactag

SEQ ID NO: 51218 - DNA, 1617 bp, Artificial Sequence
  Description of Artificial Sequence: Synthetic coding sequence
atggccgaccggggcggcgtgggcgaggccgccgccgtgggcgccagccctgcctctgtcccaggattaaacccaacgctgggttggcgcgaaagactaagggccgggcttgcagggaccggagcatctctgtggtttgtggccgggctggggcttctgtatgcccttcggattcctctgcgtctgtgcgaaaatctagccgccggtacatcttccctgatttccggattgatctttattttcgagtggtggtatttccacaaacacggaaccagcttcatagagcaagtgtcagtgtcacaccttcagcccctcatggggggcacagaatctagcatatccgagccagggtcaccatctaggaacagggagaatgagaccagtagacagaacttgtccgagtgtaaagtttggcgaaatccactcaatcttttccggggagcagagtatcggcggtacacttgggtgaccggcaaggaacctctgacctactacgatatgaacctatctgcccaggaccatcagactttctttacgtgcgacactgatttcttaagaccgtctgatactgtcatgcagaaggcttggagagagcggaatccaccagctcgcatcaaagccgcctaccaggccctggagctgaacaacgattgcgctacagcctatgtgctgttagctgaagaggaagccacgaccatcgtcgacgccgagaggctgtttaagcaggcactgaaagccggcgagacaatctacagacagtcacagcaatgtcagcatcagtctccccagcatgaggctcagctccggcgggatacaaacgttcttgtgtatataaagcgcagacttgccatgtgtgctcgaaaactcggacggatcagggaagccgtcaagataatgcgagatctgatgaaagagttcccccccttgactatgctgaacattcatgagaacttgctggagtccttgctggagttacaggcgtatcccgacgttcaagctgtgttagctaagtacgacgatatatcactccccaagtcagccgctatctgctacactgccgctcttttgaagacgagaacggtctctgagaaattttcccctgagacagcttcccgtcgcgggctcagcactgccgaaatcaatgcggtggaagcaatacatagagcggtggagttcaatcctcacgtgcctaaatatttgcttgagatgaaaagccttattctgcctcccgagcatatactgaagcgtggcgactccgaggccattgcttatgcattctttcatttgcagcattggaaaaggattgagggcgcactcaacctgcttcagtgcacatgggaaggtacgtttcgcatgatcccgtacccgctggagaagggccacctcttctacccctacccaagctgtacagagaccgctgacagagaacttctgcctacgtttcaccatgtgtccgtgtatcccaagaaggaactgcctttgttcattcattttacagccggtttttgcagctctactgctatgattgccattctcacccatcagttcccggaaatcatggggatcttcgccaaagctgttagtatgatatctcgaacctgcgttgactatctttag

SEQ ID NO: 51219 - DNA, 1668 bp, Artificial Sequence
  Description of Artificial Sequence: Synthetic coding sequence
atggccgaccggggcggcgtgggcgaggccgccgccgtgggcgccagccccgcgagcgttcctggtttgaatccaaccctggggtggcgcgagcgtctccgggccggacttgcaggcactggcgccagtctgtggttcgtggctggcctgggcttgctctacgctctaagaatcccccttcgcctgtgcgagaatctcgctgcggtgacagtatttctgaatagcttaaccccgaagttctatgtcgcactaactggaacatcatcacttatttctggcctaatcttcatctttgaatggtggtattttcataaacatggtactagcttcatcgaacaggtgtccgtatctcacttacagccgctcatgggtggcactgagtccagcatcagtgaacctggttctccttcacgcaatagagaaaacgaaacaagccggcagaacctctccgagtgcaaggtctggcgaaatcccctgaatctctttcgaggtgcggaatatcgtagatacacctgggtgacagggaaggaacccctgacatactatgatatgaacctgagcgcccaggatcatcaaacttttttcacttgtgacaccgatttcctgcgccctagcgatacagtgatgcagaaggcctggagagagcgcaatccccccgcgcggatcaaggcagcgtatcaggctttagagctgaacaatgactgcgccaccgcgtacgtgttgctggctgaagaggaggcaaccacgatcgtggacgcggagaggctcttcaagcaggccctgaaggcaggggagacaatttatcgccagtcccagcaatgccagcaccaaagcccccaacacgaagcccagttacgccgtgatacgaatgtcttggtttatattaagagacgcttggccatgtgtgcgagaaaactgggacggatacgggaagccgtgaaaatcatgcgcgacctgatgaaggaattcccacctctgacgatgctaaatatacacgaaaatctgctagaatctctcctcgagctccaggcatacccagacgttcaggccgtccttgcaaaatatgatgatatttccctccctaagagcgctgctatttgctatacagcagcactgttgaaaacgcgaactgtgtcagaaaagttctcgcccgagaccgcatctcggcggggactatcgactgcagaaataaatgctgttgaagccatccaccgcgccgtcgagttcaatccacacgtccctaaatatctcttagagatgaaaagtctcatcctgccacccgagcatatcctgaagagaggcgacagtgaggctattgcctacgcctttttccatctccagcactggaagcgcatcgaaggagctctgaacctactgcagtgtacctgggaaggaactttccgcatgattccttatcccttggagaaggggcacctgttttatccatatcctagttgtaccgagacagcggatcgagaactgctgcccaccttccatcatgtgtccgtttaccccaagaaggaactgcctctcttcatccacttcacagctggcttctgttcaagcactgccatgatcgccattctcacacatcagtttccggaaatcatgggaattttcgctaaagctgttgtgggagtgaagactcagaaggaaaatgccgactag

SEQ ID NO: 51220 - DNA, 1179 bp, Artificial Sequence
  Description of Artificial Sequence: Synthetic coding sequence
atgaacctgagcgcccaggaccaccagaccttcttcacctgcgacaccgacttcctacgcccatccgacacagtcatgcagaaagcttggcgcgagcgcaaccctcccgctaggatcaaagctgcataccaggccctcgagcttaataacgattgcgctaccgcgtatgtcctgttggccgaagaagaggccacaacgattgtcgacgcagagaggctttttaagcaggccctgaaagccggggaaactatttacaggcaaagccaacagtgccagcaccagagtccccagcacgaggcacagctccgccgtgataccaacgtattggtttacatcaagcgcaggctggccatgtgtgcccgcaagttgggtcggataagggaggctgtgaaaattatgagagacctaatgaaagaattccctcccttgaccatgcttaacattcatgagaacctgctcgaatccttgctcgagttacaagcctatcccgatgtccaggccgtcttggccaagtacgacgacattagcttgccaaagtccgctgctatttgttacacggctgccttactcaagactaggaccgtgagtgaaaagttcagcccagaaaccgcgagcagacgggggctttcaactgccgaaatcaatgctgtggaagccattcaccgtgccgtggagtttaacccacatgtgccgaaatatctgctagagatgaagtcgctgatcctgccaccggagcacattctgaagaggggcgattccgaagctattgcttatgcgttttttcacctgcagcactggaagaggatcgagggggctctgaacctacttcagtgcacgtgggaagggaccttcaggatgattccttatccgctggagaaaggacacctcttttacccttatccatcttgtaccgaaactgccgacagggagctgcttccaacctttcatcatgtgtccgtataccctaaaaaggaactgccgctctttatccacttcacagccggattttgtagttctaccgcaatgattgcgatcttgacacaccagttcccagaaattatggggatcttcgccaaagccgtcttgggtttatggtgccctcagccttgggcctctagtgggttcgaagaaaatacccaggacctgaaaagtgaagacctgggcctctcctctggctag

SEQ ID NO: 51221 - DNA, 978 bp, Artificial Sequence
  Description of Artificial Sequence: Synthetic coding sequence
atgggcggcaccgagagcagcatcagcgagcccggcagccccagccgcaaccgggagaatgagaccagtcgtcagaacctcagcgagtgtaaagtttggaggaacccgctaaatctctttcgcggcgctgagtatagacgctacacctgggtcacaggcaaagagcccctcacatattacgatatgaacctctctgcccaggaccatcagactttcttcacctgcgacactgacttcttgagaccctcagacacggtgatgcaaaaggcctggagggaacggaatccaccagctaggatcaaggccgcttaccaggctctcgaacttaacaacgattgtgcaaccgcatatgttttgctggccgaggaagaagccactactatcgttgatgctgaacggctgttcaagcaggctttaaaggctggggaaactatatatcggcagtcacagcaatgccagcatcagtcccctcaacatgaagctcaattgcgacgagataccaacgttctggtatatatcaagcgccgtctcgctatgtgcgccaggaagttaggccgtatcagagaagctgttaaaatcatgagagattatctgctggaaatgaagagtctcatattacctcctgagcacattctcaagcgaggtgactctgaagcgatagcctacgccttcttccatctgcagcattggaaacgaatcgagggcgcactcaacttgcttcagtgcacctgggaagggacattccaccacgtgtccgtgtaccctaagaaggaactaccgctgttcatccattttacagcaggtttctgcagctctactgccatgatagcgatactcacgcaccaatttccagagattatggggatctttgctaaggctgtcctgggtctgtggtgccctcaaccttgggcgtcatctgggttcgaggagaatacacaggatctaaaaagcgaagaccttggcctgagtagcggatag

SEQ ID NO: 51222 - DNA, 864 bp, Artificial Sequence
  Description of Artificial Sequence: Synthetic coding sequence
tgaatcagcgagcccggcagccccagccggaaccgggagaacgagacatccagacaaaacctgagtgaatgtaaggtctggcgaaacccgctcaacctctttcggggtgccgagtaccgccgatatacgtgggtgacaggtaaggaacccctaacgtattacgacatgaatttgtcggctcaggatcaccagacgtttttcacctgtgacaccgactttctgcgcccatccgataccgtgatgcaaaaggcatggagggaacgtaacccgcccgcgcggattaaggctgcatatcaggctctagaactgaataacgactgtgctaccgcctacgtgctgctagcagaggaggaggctaccacaatcgtggatgcggaacggctgtttaaacaggccctgaaggctggtgaaactatatatcggcagagccagcagtgccagcaccagtcccctcagcacgaagcccagctcagaagggatacaaatgtgctcgtatacatcaagagacgcttagccatgtgtgcccggaaactgggtagaatccgggaagcagtgaagatcatgagagactatttgctggagatgaaatccctcattctccctccagaacatatattgaaacggggcgactccgaggctattgcttacgcattctttcacctacagcactggaaaaggatcgagggtgcgctgaacctgctgcagtgtacttgggaaggtaccttccatcacgtctccgtttatcctaaaaaagagctgccactgttcatccacttcactgccggcttctgcagtagcaccgcgatgatcgccattttgacgcatcagtttcctgagatcatgggaatttttgctaaggcttag

SEQ ID NO: 51223 - DNA, 1677 bp, Artificial Sequence
  Description of Artificial Sequence: Synthetic coding sequence
atggccgaccggggcggcgtgggcgaggccgccgccgtgggcgcctcacctgcgagtgtcccaggactgaatcctaccttggggtggagagagcgccttcgagccggcctagctggcaccggcgcctccttgtggtttgtagcaggcctaggactcttgtatgccttgcgcatcccactgcgcttgtgcgagaacctcgcagctggcacttcaagccttatatccggcctgatatttattttcgaatggtggtattttcacaagcatggcacaagtttcatcgagcaggtgtccgtatcccacttacagccattaatggggggcactgaatctagcatctcagagccaggctccccctccagaaacagggagaatgaaacatctcgccagaacctgtctgaatgtaaagtctggcgcaaccctcttaacttgtttagaggggcagagtatcgaaggtacacgtgggtaacagggaaggagccccttacttactacgacatgaacctgtctgcgcaagaccatcagacattcttcacctgcgacaccgacttcctaagacccagtgacaccgttatgcagaaagcctggagagagagaaacccacccgctcgaatcaaagccgcctatcaagccctggagttgaataatgactgtgcgactgcgtatgttctccttgccgaagaggaagcgaccacaattgtggacgcggaaaggctgttcaagcaagctctcaaagctggcgagaccatataccgacaatcccagcagtgccagcaccagagcccacagcacgaagcacagcttcgccgtgacacaaacgtattggtgtatatcaaaagacggttggctatgtgcgccagaaaactcggtaggattagagaggccgtaaaaatcatgcgggatttgatgaaggaatttccacccctgaccatgttgaacatccatgagaacctgctggagtctctgctggagctgcaggcataccccgatgttcaggctgttttggcgaaatacgatgatatctccttaccaaaaagcgccgctatttgttacactgccgcacttctaaaaactaggacagtcagcgaaaaattttcacccgagaccgccagtcgtcgggggctctctaccgccgagatcaatgccgtagaggcaattcacagagccgtcgaatttaatccccacgtgcccaagtacctcctagagatgaagtctttaatcctacctcctgagcacattctaaagcgaggcgattcggaggctattgcttacgcctttttccatctgcagcactggaagagaattgaaggcgctctgaatctattacagtgtacgtgggagggcacctttagaatgattccttaccccttagaaaaaggccacctgttctacccgtaccctagttgtaccgagacagcagatcgcgagctgctaccaacgtttcaccatgtctcagtgtaccccaaaaaggaattgcctcttttcatacactttaccgcaggattttgttcgtctacggccatgattgccatccttacccatcagtttcccgagatcatgggaatatttgctaaagccgtacttggtttgtggtgtcctcagccatgggcgtcaagtggctttgaggagaacacccaggatctgaaatcggaggacctcggcctctcgtctgggtag

SEQ ID NO: 51224 - DNA, 1500 bp, Artificial Sequence
  Description of Artificial Sequence: Synthetic coding sequence
atgagccccttcctgttccgggacgacatgaaggacctgaccgtgttcctgaacagtctgactcctaagttctatgtggcactgaccggaacaagctccctgattagcggccttatttttatattcgagtggtggtactttcataagcatggaacctccttcattgaacaagttagcgtgagccacctgcagcccctgatgggcggcactgagtccagcatcagtgaacctgggtcgccctcccgcaaccgtgaaaatgagacatcgcggcagaacctgagtgagtgcaaggtttggaggaacccactgaatctctttcgcggcgccgaatatcgtcgttatacctgggtgactggaaaagagcctctgacgtactacgatatgaacttgagcgcacaagatcaccagaccttttttacttgcgacactgattttctgaggccatcggacaccgttatgcaaaaggcttggcgggagcgcaaccctccggcccgtattaaggctgcataccaagccctggagctgaataatgactgtgccactgcttatgtgctgctggcagaggaagaggcaacaactattgtggatgccgaacgcctctttaagcaggcactcaaagccggcgagactatttatcgccagtcccagcaatgccaacatcagagtccgcagcatgaggctcaactgcggagagatactaacgttctagtgtatatcaaacgacgattagccatgtgcgcgaggaagctgggaaggatcagagaagcggtcaagataatgcgtgatcttatgaaagaattcccccctttaacgatgttaaacatacacgagaatctgctggaaagtctgctcgagctgcaagcataccccgatgtccaggccgtgctggctaagtacgacgacatcagcctccctaaatcggccgctatctgttatacagcagccctcctcaagacccgaaccgtcagcgaaaaattctccccagagactgcatcacggagaggactgagcaccgcggagattaacgccgtcgaagctatccacagagcagtcgagttcaatcctcatgtcccaaagtatctgctcgagatgaagtcccttatactgccgccggagcatattctgaagcggggagattcagaagccatagcctacgcgtttttccacctccagcattggaaaaggatcgaaggagcccttaatcttctgcaatgtacttgggagggcacctttcgaatgataccctatccgttagaaaaaggccaccttttttatccttacccatcttgcacagagactgcggaccgcgaattactgcctacattccatcacgtgagtgtctatcccaaaaaggagctgccactcttcattcactttacagccggcttttgcagttcgacagccatgatagctatacttacacaccagttccccgagattatgggtatcttcgcaaaagctgtgagtatgatcagtaggacctgcgtcgactacctgtag

SEQ ID NO: 51225 - DNA, 1206 bp, Artificial Sequence
  Description of Artificial Sequence: Synthetic coding sequence
atggccgaccggggcggcgtgggcgaggccgccgccgtgggcgcctcccccgctagcgtacctgggttgaatcccacactgggatggcgtgaacgactgagggctggtctggctggcacaggggcatccctctggttcgtggcaggtctgggtcttctttatgcattgcgaatcccgttgcgcctctgcgagaacctggcagcggggactagtagcttgatcagcggactgatttttatctttgaatggtggtattttcataaacacggtactagctttatagagcaggtgagtgtgtcccacttgcagcctctgatggggggcacggagagttccatctctgaaccaggttccccctcccgcaacagggaaaacgaaacttcaagacagaatttgagtgagtgcaaagtctggcgcaatccgttgaatctatttagaggcgccgagtacagaagatatacatgggtcaccggcaaggagccacttacctattacgatatgaacctgtcagcacaggatcaccagacattttttacttgcgatacagattttctgcgccccagcgataccgtaatgcaaaaggcatggcgagagcggaaccctcctgcccgcattaaggctgcatatcaggccttggagctgaataatgattgcgccaccgcatatgtgcttctcgccgaggaagaggcgaccacaattgtggacgctgaaaggttgttcaagcaagcgctgaaagccggtgagactatctatcggcagtcacagcaatgccagcatcagagtccacagcatgaggctcagctcaggcgggacaccaatgttctggtgtatatcaagaggcgactggcaatgtgtgcccgaaaactaggtagaattcgggaagcagttaagatcatgcgcgatctgatgaaggagtttccgcccttaacaatgctcaatatccatgaaaacctgttggagtcccttcttgagctgcaggcataccccgacgttcaggccgtattagctaagtatgatgatattagccttcccaaatcagctgccatctgctacacggctgcactcctgaagactagaaccgtctcagaaaaattctctcctgaaactgcttcccgacgcggcctgtccactgccgagatcaacgctgtggaagctattcacagagcagtggagtttaatccacacgtgccaaaattgctggagtag

SEQ ID NO: 51226 - DNA, 1533 bp, Artificial Sequence
  Description of Artificial Sequence: Synthetic coding sequence
atggccgaccggggcggcgtgggcgaggccgccgccgtgggcgcctcacccgcttcagttccagggctaaatcccacgctgggctggcgcgagaggctacgagctgggctcgctgggaccggcgcctccctctggtttgtcgcaggtcttggactactctatgctctgcggattcctctgcggctctgcgagaatctggctgccgtgacagtcttcttgaatagtttaacccctaaattctacgttgcactcacaggtacttcctccctgattagcgggttgatcttcatcttcgagtggtggtacttccacaaacatggtaccagcttcatcgagcaggtctctgtgagccatctccagccgctgatgggtggaacggagtcttctatttctgaacctggttccccttccaggaaccgagaaaatgagacaagtagacaaaacctctccgagtgtaaagtctggagaaacccccttaacctgtttagaggggccgagtatagatcatgcgctaccgcgtatgttctgctggcagaagaagaggccaccacgattgtggacgccgaacgccttttcaaacaggcactcaaggccggagaaactatctatcggcagagccagcagtgtcagcatcagtcccctcagcacgaggctcaacttcgccgagacacaaatgttctggtgtacatcaagagacggttggccatgtgcgcccggaagttaggaaggatccgcgaagccgtcaagatcatgcgcgatctgatgaaggaatttccacctttgactatgctaaatatccatgaaaacctgctggagagcttgttggagctgcaggcctatcccgatgtgcaggcggttctcgccaaatatgacgacatctctctgccgaagagcgcagcaatttgctatacggccgccttactgaaaacacgtactgtctcagagaagttctcaccagagaccgcatctcgaaggggcctgtcgacggctgagatcaatgcggttgaagctatccatagagccgtggagtttaaccctcatgtgcctaaatacctgctggagatgaaatcactgattctcccacctgagcacattcttaaacgaggcgacagtgaggccattgcatacgccttttttcatttgcagcattggaagcgaattgagggggctctgaacctccttcagtgtacatgggaggggacctttcgaatgatcccctacccccttgagaaagggcacctgttttatccgtaccccagctgtactgagactgccgacagagagctcctgcccactttccatcacgtgtctgtgtatcctaaaaaagaactcccgctgttcatccatttcacggcaggcttctgctcgtccaccgccatgatcgcaatcttgacgcatcagttcccagagattatgggcatctttgctaaggctgtgctagggctctggtgtccccagccctgggcatcctctggcttcgaagagaacacgcaggacttaaaaagtgaggacctggggctctcctccggctag

SEQ ID NO: 51227 - DNA, 444 bp, Artificial Sequence
  Description of Artificial Sequence: Synthetic coding sequence
atgggcagccagggcagcggcggcgtgcccctggtgcaggccccctatacggtcttgctccttcccttaggcacgtcccgtcaggatcccggcgcccagtctttcttcttgtggctgcgaaggatgcaagcactcgagagggaacaggacgccctgtggcagggcctggagctgctgcagcatggccaggcttggtttgaagatcatcttagagaggcgcagcgccagcaactgcatctcggggccctcggggagaatttcttaacagacctacacagcgagcccggaaggcccccgctggcacaaattcagaaagtgaatatttgtttgcagaatctcattcatgaaaaattatccaggcagcagaaaggcgtgacgcaacctaaggaagagatggcacagcgaggctgcactaaagggccaaggggcccaacaagagtgtag

SEQ ID NO: 51228 - DNA, 537 bp, Artificial Sequence
  Description of Artificial Sequence: Synthetic coding sequence
atgggcagccagggcagcggcggcgtgcccctggtgcaggccccctacacagttttgcttctccctctcgggaccagtaggcaggatcctggtgcccagtccttcttcctctggcttagaagaatgcaggcactggaacgggaacaggatgccctgtggcaaggcctagagctgctgcaacacggacaagcctggttcgaagatcacctgagggaggcccagcgccagcagctgcatcttggagccctcggggagaattttctgacagatctccatagcgagccaggtcgccctccactggctcagatccagaaagtgaatatctgtctgcagaatctcatccacgaaaaattttctccatcccctctcaataaagcttcaagctgcaccactcaggattccaaagagagacggcgcgagcagaacctgtggcagcagcaggaattgtcccgccagcagaagggggttacccagccaaaagaggaaatggctcagaggggatgtacaaagggccctcgggggccaacaagagtgtag

SEQ ID NO: 51229 - DNA, 444 bp, Artificial Sequence
  Description of Artificial Sequence: Synthetic coding sequence
atgggcagccagggcagcggcggcgtgcccctggtgcaggccccctatacggtgctgctgctccccctgggcacatcccgacaggatcctggtgcccaatcattcttcctttggcttaggagaatgcaggccctcgagcgggaacaggacgctttgtggcagggcttggagttactgcagcacgggcaggcttggtttgaagaccaccttagggaggcacaacgtcagcagctgcatctaggagcgttgggggaaaacttcttaacagatctccactcagagccgggccgaccccccttagctcagattcagaaagtgaacatttgtttgcagaacctcattcatgagaagctatcccgtcagcagaagggggtcacccagcccaaggaggaaatggcccagcgcggatgcactaaaggcccaagggggccaaccagggtttag

SEQ ID NO: 51230 - DNA, 447 bp, Artificial Sequence
  Description of Artificial Sequence: Synthetic coding sequence
atgggcagccagggcagcggcggcgtgcccctggtgcaggccccctatacagtacttctcttgccactcgggacaagtcgccaggacccaggtgcacagagcttctttctatggcttcggagaatgcaagccctggaacgcgagcaggatgcgttatggcagggcctggaattgcttcagcacgggcaagcgtggtttgaggaccacttgcgggaggcccagcgtcagcagctgcatctgggcgctctcggggagaacttcctcaccgatttacactctgagcccggtagacctcctctggctcagatccagaaagtaaatatctgccttcagaatctgatccacgaaaaagaactgagcaggcagcagaagggtgtgacccagccaaaagaagagatggcccagcgtggatgtacgaagggcccacgcgggcccactagggtctag

SEQ ID NO: 51231 - DNA, 444 bp, Artificial Sequence
  Description of Artificial Sequence: Synthetic coding sequence
atgggcagccagggcagcggcggcgtgcccctggtgcaggccccctatacagtactgctgcttccgctgggaaccagcagacaggatcccggggcccaatctttcttcctgtggctgaggcggatgcaggctttggaaagggaacaggacgccctgtggcaggggctagagttgctccagcatggccaggcctggttcgaagaccatctgcgcgaggcacaacgtcagcagttacacctgggagccctgggggagaatttccttaccgacttgcactccgagccaggtcggcccccgctcgcccagatccagaaggtgaacatctgcttgcagaacctcattcatgagaagctctctcggcagcagaagggggtcacccagcctaaagaggagatggcccagagaggctgcaccaaaggccccaggggacctacccgagtctag

SEQ ID NO: 51232 - DNA, 444 bp, Artificial Sequence
  Description of Artificial Sequence: Synthetic coding sequence
atgggcagccagggcagcggcggcgtgcccctggtgcaggccccctatactgtgcttcttctgccattagggacaagtaggcaggatcctggggctcagtccttttttttgtggctgagaaggatgcaggccttggagcgcgagcaagacgcgctgtggcaggggctagagctcctgcaacacggccaagcttggttcgaagaccatctgcgtgaagctcaacggcaacagctgcacctgggagctcttggggagaacttcttgaccgacctgcacagcgagcctggtcggcctcccttggcccaaatacagaaggtgaacatctgtcttcaaaatctaatacacgaaaagctgagcaggcaacaaaagggcgtgacacagcccaaggaagaaatggctcaacgaggatgcaccaaggggccccgggggccgacacgggtctag

SEQ ID NO: 51233 - DNA, 444 bp, Artificial Sequence
  Description of Artificial Sequence: Synthetic coding sequence
atgggcagccagggcagcggcggcgtgcccctggtgcaggccccctataccgtcctgttgctgcccctgggaacctcgcggcaggatcccggggcccaaagcttctttctgtggctcagacggatgcaagcgctcgaacgcgaacaggacgccttatggcagggtttggagctgttgcagcacggacaggcttggtttgaagatcacctgagagaagcacagcggcagcagctgcatctcggagctctgggtgaaaactttctgaccgatctgcacagcgaaccaggtagacctccacttgctcagattcaaaaagtgaacatatgtctgcagaacctcatccacgagaagctgagtaggcaacagaagggagtgacacaaccaaaagaggagatggcccaacgggggtgcactaaaggcccaaggggccccacccgcgtgtag

SEQ ID NO: 51234 - DNA, 537 bp, Artificial Sequence
  Description of Artificial Sequence: Synthetic coding sequence
atgggcagccagggcagcggcggcgtgcccctggtgcaggccccctatactgtgctgctccttcccctggggacgtctcggcaggacccaggagcgcaatctttctttttgtggctcaggcggatgcaagcactagagcgcgaacaggatgccctgtggcagggtctggaactcctgcagcacggacaggcttggttcgaggaccacttgcgagaggctcagcgtcaacagctgcacctgggggccttaggcgagaacttcctgactgatctccacagtgagccaggaagacctccgctggcccagattcagaaggtaaatatctgccttcagaaccttatccacgagaaattctccccctcaccgctaaataaggcctcatcttgtacaacgcaggattcaaaggaacgccggagagagcagaatctatggcaacaacaggaactcagccggcagcagaagggcgtgacgcaaccgaaggaagagatggcacaacggggttgtactaaggggccccgcggacctacgcgagtgtag

SEQ ID NO: 51235 - DNA, 537 bp, Artificial Sequence
  Description of Artificial Sequence: Synthetic coding sequence
atgggcagccagggcagcggcggcgtgcccctggtgcaggccccctatactgtgctgctcctaccactgggcacttcccggcaggatcccggggcccaaagtttttttctgtggttgaggcgtatgcaagcgctggagcgcgaacaagatgccctgtggcagggtttggagctgctgcagcatggacaggcctggtttgaggatcacctgcgggaggctcagcgccaacagttacacctaggcgccctcggagagaattttctcactgacttgcacagcgaacctgggaggcctccactggcccagatccagaaagtgaatatttgtctccagaatctaattcacgagaaatttagcccaagcccactgaataaggcatcgtcatgcactacacaggacagtaaggagcgccggagggaacagaacctttggcagcagcaagaactttcaagacaacaaaaaggggtcacccagcccaaagaggaaatggctcagcggggatgcaccaaggggccgcgagggccaaccagggtctag

SEQ ID NO: 51236 - DNA, 537 bp, Artificial Sequence
  Description of Artificial Sequence: Synthetic coding sequence
atgggcagccagggcagcggcggcgtgcccctggtgcaggccccctataccgtgctacttctgccactggggacatctagacaggaccccggagcccaaagcttctttttgtggctgcgtaggatgcaggctttggaaagagaacaggacgctctgtggcagggcttggagctcctccaacatggtcaagcctggtttgaagaccatctaagagaagcccagcggcagcagctacacctgggtgctttgggggagaacttcctgaccgacctgcactcagaacccggccgtccgcctttagcacaaatccagaaagtcaacatttgtctccagaatctcatccatgaaaagttcagcccctccccactcaacaaagccagttcatgtaccacccaagatagcaaggagagacgaagagaacagaatctgtggcaacagcaagagctctctcgacaacagaaaggcgtgacacagcctaaagaggagatggcacagaggggctgcacaaaaggtccacgcggtccaaccagggtgtag

SEQ ID NO: 51237 - DNA, 444 bp, Artificial Sequence
  Description of Artificial Sequence: Synthetic coding sequence
atgggcagccagggcagcggcggcgtgcccctggtgcaggccccctacacagtacttctactgcccctgggaacctccagacaggaccccggtgcccagtctttctttctctggctgcgtagaatgcaagccctagaaagagagcaggatgcgttgtggcagggtctcgaactactgcagcacggccaggcctggttcgaagatcacctccgagaagcccaacgccaacaattgcaccttggcgctttaggagagaattttctgacggatcttcactcagaacccgggcgtcctccgttggctcaaatccagaaggttaatatttgtttgcagaacttgattcatgaaaagttgtcgagacaacagaagggagtaacacagcccaaagaagagatggcccagaggggttgtaccaaaggtcctaggggacccactcgggtatag

SEQ ID NO: 51238 - DNA, 537 bp, Artificial Sequence
  Description of Artificial Sequence: Synthetic coding sequence
atgggcagccagggcagcggcggcgtgcccctggtgcaggccccctataccgtcctccttttaccactgggaacttcaagacaggacccgggcgctcagagcttcttcctatggttacgccgcatgcaagccctggagcgcgagcaggacgccctctggcaaggccttgaactgctccagcatggccaggcgtggttcgaagaccatttgagagaagcccaacgccaacagctgcacctaggagccctgggagagaactttctcactgatctccatagcgagcctgggaggccaccgctcgctcagattcaaaaagtgaatatctgccttcagaatctgattcatgagaagtttagtccctcgcctctgaataaagccagctcctgtactacccaggactctaaggagcggcgacgcgaacagaacctgtggcagcagcaagaattaagtagacagcagaagggtgtgacccagccaaaggaggaaatggcgcagcggggatgcaccaaagggccgcgaggccctacgcgtgtgtag

SEQ ID NO: 51239 - DNA, 447 bp, Artificial Sequence
  Description of Artificial Sequence: Synthetic coding sequence
atgggcagccagggcagcggcggcgtgcccctggtgcaggccccctataccgtcctgttgttgccattagggactagccgtcaggatccaggggcgcagtctttcttcttatggttgagacggatgcaggccctggaacgagaacaagacgccctttggcagggccttgagttgttgcagcacggccaggcgtggtttgaagatcacctgagagaggcacagagacagcaacttcatctgggtgctttgggcgagaacttcctcactgacctccacagtgaaccgggccggcctcccctcgcccaaattcagaaggtgaacatctgtctgcagaacctgatccacgagaaggagttgagcaggcagcagaagggggtaactcagcccaaggaagagatggctcagagaggatgtactaaaggccctcgggggcccactcgtgtgtag

SEQ ID NO: 51240 - DNA, 447 bp, Artificial Sequence
  Description of Artificial Sequence: Synthetic coding sequence
atgggcagccagggcagcggcggcgtgcccctggtgcaggccccctatacagtgctgctgttaccacttggcacatcaagacaggatccaggcgcccaatcctttttcctttggctaaggaggatgcaagctctagaacgggaacaggatgccttgtggcagggtttagaactcctgcagcacggacaggcttggttcgaagaccatcttcgcgaggcccagagacagcagctccacctaggcgcactgggggagaactttctcactgatcttcatagcgaaccggggcgtccacctctggctcagattcagaaggtgaacatatgcctgcaaaacctgatacatgagaaggagttgagtaggcagcagaagggggtgacccaaccaaaggaagagatggcccagagggggtgcacgaaagggccgcgtggcccaacgcgggtgtag

SEQ ID NO: 51241 - DNA, 447 bp, Artificial Sequence
  Description of Artificial Sequence: Synthetic coding sequence
atgggcagccagggcagcggcggcgtgcccctggtgcaggccccctatactgtccttttactgcccttgggcacttcgcggcaggaccctggcgcccagtccttctttctgtggctccgccgaatgcaggctctggagcgcgaacaagacgccctctggcagggcttagagctgttgcagcacggtcaagcatggttcgaggaccacctgagggaggcccagcgccagcagctgcacctgggagcacttggggagaacttcctgaccgatttgcatagcgagcctgggagaccaccgctagctcagattcagaaggtaaacatctgcctgcagaacctgattcacgagaaggagctttcccggcaacaaaaaggcgtgacgcaacccaaggaggaaatggcccagcgtggatgcacaaagggacctcgcggcccaacccgggtctag

SEQ ID NO: 51242 - DNA, 447 bp, Artificial Sequence
  Description of Artificial Sequence: Synthetic coding sequence
atgggcagccagggcagcggcggcgtgcccctggtgcaggccccctacaccgtcttactactgcccttggggacatctcggcaggatcctggcgcccagagcttctttctgtggctccgacggatgcaggcgctcgagcgggaacaagatgcactatggcaagggctggagttgcttcagcacgggcaggcttggttcgaagaccatctacgagaagcacagcggcaacagttgcacctgggggcactgggagaaaatttcctaactgacctccacagcgagccagggcgcccgcctctggctcagatccagaaagtgaatatctgtctgcagaatctgattcatgagaaagagctgtcaaggcagcaaaagggtgtgacccaaccaaaagaggagatggcccagcgtggctgcacaaaggggcctcggggccccaccagagtctag

SEQ ID NO: 51243 - DNA, 447 bp, Artificial Sequence
  Description of Artificial Sequence: Synthetic coding sequence
atgggcagccagggcagcggcggcgtgcccctggtgcaggccccctataccgtactgcttttaccactcggtacaagccggcaggatcctggggcccaatctttctttctgtggctcaggaggatgcaagctcttgaacgcgaacaagacgctctgtggcagggcctggagctgctgcagcatgggcaagcttggtttgaggatcacctgcgagaggcccaacgtcagcaactgcacctgggagccctcggggagaattttcttaccgacttgcacagcgagccaggccggcccccactggctcaaatacagaaggtgaatatatgcttacagaatctgatccacgagaaggaattgtcacgccagcagaaaggggttacacaaccgaaggaggaaatggctcagagaggctgcacaaaaggaccacggggccctaccagagtgtag

SEQ ID NO: 51244 - DNA, 99 bp, Artificial Sequence
  Description of Artificial Sequence: Synthetic coding sequence
atggccgccgccgccgccggccccgccgccagccagcggttcttccagtccttcagtgacgcactgatagaccaggatccccaggcagcattggaatag

SEQ ID NO: 51245 - DNA, 99 bp, Artificial Sequence
  Description of Artificial Sequence: Synthetic coding sequence
atggccgccgccgccgccggccccgccgccagccagcggttcttccagagcttctccgatgctcttattgaccaggaccctcaagctgccctggagtag

SEQ ID NO: 51246 - DNA, 4986 bp, Artificial Sequence
  Description of Artificial Sequence: Synthetic coding sequence
atggaggcccccgccgccgagccccccgtgcggggctgcggcccccagccagcacctgccccagccccagcccccgagagaaagaaatcacatagagctcccagccccgctaggcctaaggacgttgctggttggagtctcgccaaaggcagaagggggccagggcctggcagcgccgtggcctgctccgccgcatttagttcccgacccgataaaaaaggcagggctgtggccccaggggcgcggggcgctggggtgcgtgtcgctggtgtgagaaccggggtccgagccaagggtcggccgcggtctggcgcaggacctcggcctccgcctcccccaccgagtctcactgattcatctagtgaagtctcagattgcgccagcgaggaagcaagactgctcggtctggaattggcactgagcagcgatgctgaaagtgctgcgggaggaccagccggagtccggactggccagccggcccaaccagcccctagcgcccagcagcctcccaggccacccgcttcaccagatgagccatccgtggcagcttcctctgtggggagtagtaggctacctctgagcgctagtctggcattttctgatctgaccgaagagatgctggattgcggcccttctggcctcgtgagagagttggaagaactgaggagcgaaaatgactatttgaaagatgaaatagaggagttgagagccgaaatgctggagatgcgggatgtttacatggaagaagatgtgtaccaactgcaggagctgaggcagcagctggaccaggccagcaaaacttgccgcatccttcagtaccggctgcgcaaagccgagcgaaggtcgcttcgggccgcccaaactgggcaagtggacggtgagctgattcgggggttggaacaggatgtgaaagtctctaaggatatatctatgcgcctgcacaaagagctggaggtggtggagaaaaagcgagctaggttggaagaggaaaatgaagaactcagacaaagactgatagagactgagctggccaaacaggtgctccaaaccgagttagagcgcccccgcgaacactcgttgaagaaaagaggaaccaggtccctgggcaaagccgacaaaaagacccttgtccaggaggactccgctgacctcaagtgccagctgcacttcgcaaaggaggaaagtgctctgatgtgtaaaaagcttactaagttggccaaagaaaatgattccatgaaagaggaactgcttaagtatcggtcattgtacggcgacctcgacagcgccctttcagccgaagaactcgccgatgccccccattctcgggaaaccgagttgaaggtgcacttgaaactggtggaagaggaggcaaaccttctgtcacggcgtattgtggaactagaggttgagaataggggcctgcgcgcagagatggacgatatgaaggatcacggtgggggatgcgggggaccagaagcccgcctggcattctccgccctggggggaggtgaatgcggcgaaagcctggccgagctgaggcgccacctgcagtttgttgaggaagaggctgagttactgcggcgaagttcggcggagctcgaggaccagaacaaactgcttcttaatgagcttgcgaaatttcgtagcgagcacgagttggacgtggcattatcagaagacagttgctccgtactgtccgagccatctcaagaggagctcgccgcagctaagctccagatcggtgagttatctgggaaggttaaaaagctgcaatacgaaaaccgagtgctgctaagtaacctgcagaggtgcgatctcgctagctgtcaatcaaccaggcccatgctagagacagatgcagaagccggtgatagtgcccaatgcgtgccagcccccctgggcgagacccatgagtctcacgccgtacgattgtgtagagcacgtgaggcggaggtcctcccgggactcagagagcaggctgcactggtctcgaaggccatcgacgttcttgtggccgacgcaaacggattcaccgccggcctgagactatgtttggataacgaatgcgctgatttcagactccacgaggcccctgataatagcgagggtcctcgcgatacaaaactcatccatgccattctggtaagactctctgtcttacagcaagaactcaatgcgtttacccgcaaagcggatgcagtgttgggttgctctgtgaaggagcagcaagagagtttttctagcttgccacctttagggtcccaaggcctgtctaaggaaattctgctagctaaggatctgggctccgactttcagccacccgatttcagggatcttcctgaatgggaaccacggatacgtgaggcttttaggaccggtgacctggattctaagccagacccctcacggagctttcgaccctatagggccgaggataatgactcatacgctagcgaaatcaaagagctgcaacttgtcctggcagaggcacatgactcactgagaggtctacaggaacagttaagtcaggagcgccagctcaggaaggaagaggcagataacttcaaccaaaaaatggtacagctcaaggaggaccagcagcgcgccttactgaggcgggagtttgaactccagagtttgtccctccagagacggcttgaacagaagttttggagccaggagaagaacatgctggtccaagaatcccagcagttcaagcacaactttttactgctcttcatgaagctccgatggttcctcaaacgatggaggcagggcaaagtgctcccctccgaaggagacgattttctggaggtcaattctatgaaggagctgtacttactgatggaagaggaggaaatcaatgcccaacactccgataacaaggcgtgtacaggagattcctggacacaaaataccccaaatgagtatattaagacacttgcggacatgaaggtcaccctcaaggagctctgctggctactgcgcgacgagaggcgcgggcttaccgaattgcagcagcagttcgcgaaggcaaaagccacctgggagaccgaacgagctgagttgaaagggcacacaagtcagatggagttgaaaactgggaaaggggccggagagagggccggccccgactggaaagccgccctccaaagagaacgggaggaacagcaacacctcctggccgagagctacagtgccgtgatggaattgacgagacagctgcagatctctgaacggaattggtcacaggaaaaactgcagctggtagagcgcctccagggtgagaagcagcaggtagagcagcaggttaaggaactgcagaaccgactgtcacaactccagaaggccgctgacccctgggtgctaaagcactccgagctagagaagcaggataattcctggaaggagactcggagtgagaaaatccacgataaagaggctgtatcagaagtggagttaggcggaaatggactcaaaagaaccaaatctgtcagtagtatgtcagagtttgagagcttgttggattgcagcccctacctcgcagggggcgacgctcgtgggaagaagttaccgaataaccccgccttcgggttcgtttcttctgaacctggagatcctgaaaaggacaccaaggaaaaacccggcttgtcgtccagagactgtaatcatcttggggctttggcatgccaggaccccccaggacggcaaatgcagcgctcttatactgctcccgataagacgggtattcgggtgtattactctccaccagttgctcgccgcttgggcgttcccgtcgtccatgacaaggagggaaaaattattatcgagcccgggttcctgtttaccactgccaaacccaaagagtccgccgaagccgatggactcgccgagagtagttatgggcgctggctttgcaacttttcaagacagcgcctggatgggggatccgctggctccccatcagcagccggtccaggcttccccgccgccctgcacgatttcgagatgagcggtaacatgagtgacgacatgaaggaaattaccaactgcgtacgccaggccatgagatcaggatcccttgagagaaaagtgaaaagtaccagctctcagaccgtgggcttggccagcgtggggactcagacaattcggaccgtgtccgtcggtctgcagacagatcctccacgttccagtcttcacggcaaggcttggtccccacggtcaagcagcctcgtgagtgtgcggagcaagcagatctccagctctctcgacaaggtacactcaaggatcgagaggccatgctgtagtccaaaatatggcagtcctaagctgcaaagaagaagcgttagcaagcttgactcaagtaaagaccggagtctgtggaaccttcatcagggtaaacagaacgggtctgcatgggcccgtagtaccaccactcgcgactcccccgtgttgcgcaacataaacgacggccttagcagtctatttagtgtcgtggagcactccgggagtaccgaatcggtgtggaagttaggcatgagcgaaacacgagcaaaacctgagcctccaaagtatggcatcgtgcaagagttcttccgcaatgtttgcgggagagcacctagtcctaccagttcagccggcgaagagggcaccaagaagcctgaacctctgtctcctgctagctaccaccaacctgaaggtgtggcgcgcattctcaataagaaagccgcaaaactggggtcatcagaggaagttcgcctgaccatgctgccccaggtgggcaaggacggagttctgagggatggcgacggcgctgtcgtcctgcccaatgaggatgctgtctgcgactgtagcacgcagagcctcacaagctgcttcgccaggagttctcgttcggctatcaggcactcaccatctaagtgccggttgcaccccagcgaaagtagctggggaggcgaagaacgggccttgccaccaagtgaatag

SEQ ID NO: 51247 - DNA, 3051 bp, Artificial Sequence
  Description of Artificial Sequence: Synthetic coding sequence
atgctggagatgcgggacgtgtacatggaggaggacgtgtaccagctccaagagttaagacagcagctggatcaggcctccaaaacttgccggattctgcaatacagactcagaaaggcagagaggcgatctttgcgagccgcccagactggacaggttgatggtgagttaatcagaggattggaacaggacgtgaaagtgagcaaggacatctctatgaggttgcataaagagttagaagttgtggaaaagaagagagctcgcttggaggaggaaaacgaagaattgcgacaaagactaatcgagacggagctggctaagcaagtgttacaaacggagctcgagcggcctcgggaacattcattaaagaagagaggcacccggtctctgggcaaagcagataagaagaccctcgtccaagaggacagtgctgatctgaagtgtcagctgcacttcgccaaagaagaaagcgcactcatgtgtaagaagctaactaaactcgctaaagaaaatgattccatgaaagaggagcttttgaaatatcgttctttatacggagaccttgactcggcactgtctgctgaagaactggctgatgcacctcatagcagggagacggagctgaaggtgcatctgaaactggtggaggaagaagcaaacctgctgtcacgtcggatagtggagctggaagtggaaaatcggggcctaagggctgaaatggatgacatgaaagaccacggtggcgggtgtggaggcccagaggcaaggttggctttctccgcgctgggcggaggagagtgtggggagtccttagctgaacttagaaggcacctgcagtttgtcgaagaagaagccgaactgctgcgacggtcttctgccgagctagaggaccagaataagctgctcctcaatgaactagccaagtttaggtctgaacatgagttggatgtggctttgagcgaggattcctgtagtgttctgagcgaaccgagtcaggaggagctcgccgcagcaaagttacagattggagagttaagtggcaaggtaaaaaagctccaatacgaaaaccgggtgcttctgagtaacctgcaaaggtgtgatctggccagttgtcagagtacacgcccgatgctcgagaccgatgccgaggccggcgactcagcacagtgcgtccccgcccctctgggtgagacgcatgaaagccacgctgtgcgcctgtgcagagcgcgagaagccgaagtcttgcctggcctgagagaacaggctgctctggtttctaaggctattgatgtcttggtggccgacgcgaacggatttactgctgggcttcgcttatgtctggataacgagtgcgcagacttccgcctccacgaagccccagataactctgaaggcccgagggacactaagctgatccatgctatcctggtaaggctgtcagtattgcagcaggagttaaatgcctttactaggaaagcagatgccgtgctgggttgcagtgtgaaggagcagcaggagagcttcagcagcctgccaccactcggttcccaaggattatcaaaggagatcctgctggcaaaagacttgggcagtgattttcagccacccgattttagagatctgcctgagtgggagccgcggatccgtgaggccttcaggactggagatctcgatagcaaacccgacccctctagatcatttcggccttaccgcgccgaagacaatgatagttacgcaagcgagatcaaggaactgcaactggtgctagcagaggcccatgactctttgaggggcttgcaggagcagctcagccaggaaagacagctgagaaaagaggaggcggacaatttcaaccagaaaatggtccagctgaaagaggaccagcaaagggctctactgcggagggagtttgaattacagagcctatcactgcagcgccggctggaacagaagttctggagccaagaaaaaaacatgctcgtgcaagaaagtcaacagtttaagcataattttctgctgctttttatgaagttacgttggtttttaaagaggtggcggcagggaaaggtcctgcccagtgaaggagacgactttcttgaggtgaactccatgaaagagttatacctcctcatggaagaggaggagataaacgctcagcatagcgacaacaaggcatgcaccggggacagttggactcaaaacaccccgaacgaatacattaagactctggcagatatgaaggtgactttgaaagaactctgttggctactacgggacgagcgcagaggtcttacagagctgcaacagcaattcgctaaagctaaggccacttgggagaccgagcgagcagaacttaaaggacatacatctcagatggaattaaaaaccggaaaaggcgctggggagcgagcaggcccggactggaaggcagcgctccagcgcgagagggaagaacagcagcacctgctggcagagagctacagtgccgtgatggaactgacccggcagttacagatttccgagagaaactggagtcaggagaagttgcaactggtggaacggctgcagggagaaaaacaacaggtggaacagcaggtgaaagagcttcagaaccggttgtctcagttgcagaaggctgctgacccgtgggtgttgaagcattcggagctggagaaacaggacaactcctggaaagagaccaggtcggagaagattcatgataaggaagctgtatccgaggtggagttaggagggaatgggctgaaacgcacaaaaagtgtgtcatccatgtctgagtttgagagtttgctggactgttctccttaccttgcaggcggtgatgcccgggggaagaagttacctaacaatcccgctttcgggtttgtttcttcagagcccggtgacccagagaaggacacaaaggaaaaaccaggactgagcagccgcgactgtaatcatcttggggccctggcctgtcaggatccacccgggtcccagaagctgccctttctcctgattcttgcgcccccccaacccccaccaatcctttag

SEQ ID NO: 51248 - DNA, 4272 bp, Artificial Sequence
  Description of Artificial Sequence: Synthetic coding sequence
atgctggagatgcgggacgtgtacatggaggaggacgtgtaccagctccaggagctccgccagcagctcgaccaggcttcaaagacctgtcggattctgcagtacagacttagaaaagctgagaggcggtctctaagggccgcccagaccggacaagtggacggggagctgatcagggggctcgaacaggacgtcaaggtatcaaaggacatcagtatgcggttacataaggagctggaggtggtggagaaaaagcgtgccaggctggaggaggagaatgaagagctgaggcagcggttgatagaaactgagctggcgaagcaggtactacagacagaactcgagcggcctcgggaacacagtctgaaaaaaaggggcactcggagcttgggaaaggccgacaagaaaaccctggtccaagaggatagtgccgatttaaagtgccaactgcattttgcgaaagaagaaagcgccctcatgtgcaaaaagttgaccaaactagcgaaagaaaacgactccatgaaagaggagcttttgaaatatcgctccctatacggcgacctcgattctgccttgagtgccgaagaactcgccgatgcgccgcatagccgcgagaccgagctgaaggtgcacctaaaactcgttgaggaggaagcaaaccttcttagtagaagaattgttgaactggaagtcgagaatagaggcctccgcgctgaaatggacgacatgaaggatcatggaggcggctgcggcggtccagaggcgcgactcgccttctcagctctcggggggggagagtgtggcgagtcactggcagagttgcgcagacatttacagttcgtcgaagaggaggccgagctcttaagaagatcctccgcagagctggaagaccagaacaagctgctcctgaacgagcttgccaagttccggagtgaacacgagctggatgtcgccctgtcagaggactcttgcagcgtgttgtccgagccaagccaggaagagctcgctgcagctaagctgcagattggcgagctatctgggaaagtaaagaaactacaatatgagaatagagttttgttgagcaacctgcagagatgcgatttggcctcatgccaaagcaccaggcctatgctcgagacagacgctgaggccggcgattcggcccaatgtgtgcctgcccctctgggggagacacacgaatcacatgccgtccgcctgtgcagagcacgggaagcggaggtgcttcccgggctaagggagcaggcagccctggtgtctaaggcaatcgacgtgctagtggctgacgccaatggttttacagctggcctacgcctgtgcctggacaatgaatgcgccgacttccgtctccacgaagcacctgacaactccgaaggtccccgcgacacaaagctgatccatgctatcctcgtcagactgtcagtactgcagcaggagcttaacgcctttacaaggaaggcagatgccgtgctgggttgctccgtcaaagagcagcaggaaagctttagctcccttcctccgctgggttctcaggggttaagcaaggaaatacttcttgccaaggatcttgggtccgatttccagccaccagattttagggacctccctgagtgggagcctcgcatacgagaagccttccggacgggggatctcgactcaaaaccggatccatctcggtcctttcgaccctatcgggccgaagacaacgattcctacgcctcagaaattaaagaacttcagttagtgctggctgaggctcacgatagtctgcgcggcctgcaggagcagctgtcacaggagcgccaactgcgcaaggaggaagcggacaactttaatcagaagatggtgcaactcaaagaggaccagcagcgggcactgctgagacgtgaattcgaactccagtctctgtccttacagcgcaggctggagcagaaattctggtctcaagagaagaacatgctcgttcaggagtcccaacaattcaaacataacttcttactgctgtttatgaagttacggtggttcttaaaacgatggaggcagggcaaagtattaccaagcgagggagatgacttcctggaggttaactctatgaaggaactgtatcttctgatggaagaagaggagataaatgctcagcactccgacaacaaggcttgtactggcgacagctggacacagaacaccccaaacgagtatatcaaaacactcgcagatatgaaggttaccttaaaggagctgtgctggctcctgcgggatgagagaagagggttgaccgagttgcagcagcagttcgcgaaggctaaagcgacatgggagacagagagagctgagctgaagggccacactagccagatggagcttaaaacaggtaaaggcgctggcgagcgcgcgggtccagactggaaagccgcgctccagcgggagagggaggaacagcagcatctgctggccgagtcatattcagccgtgatggagctaactagacagctccagatctctgaaaggaactggtcccaggagaagttgcagcttgtcgagcgccttcagggcgaaaaacaacaggtggagcaacaggtaaaggagcttcagaacaggctgagtcagttacagaaagcagccgatccatgggtgcttaaacactcagagttggaaaagcaggataactcatggaaagagacccggagcgagaaaattcatgacaaggaggctgttagtgaggtggagctgggcgggaacggattaaagcggactaaatccgtgtcctctatgtcagagttcgaatctctgctggattgcagtccatacctggccgggggcgacgccagagggaaaaagctccctaataaccctgcatttgggttcgtgtcctccgagcccggcgatccagaaaaagatactaaagagaagccaggcctgagcagccgcgactgcaaccaccttggggctctcgcttgtcaagatcctccaggcagacagatgcagagatcttacactgctcccgataaaacggggattagagtctactacagtcctcccgtcgctcgccgccttggcgtgcccgttgtccacgataaggaaggtaaaattattattgagcctggatttctgtttaccaccgcaaaaccgaaagagagtgccgaggccgatggcctggccgaaagtagctacgggaggtggctgtgcaactttagtcggcagcgcctcgatggcggctcagctggcagcccctcagccgcaggtccgggctttcccgctgctctgcatgattttgaaatgagtggtaacatgtccgatgatatgaaggaaattaccaactgcgtccggcaggctatgagatctgggtctctcgaacggaaggtgaagtccacctcatcacaaaccgtcggcctggcttcagtcgggacacagaccattcgtactgttagtgtgggactacagactgatccccctcggtccagtttacatggaaaggcctggagcccccggtcctcttcgttggtgagtgtgcggtcgaagcaaatctccagttccctcgataaggtgcattcacgaatcgagagaccatgctgtagtcctaagtatggcagcccaaagcttcagcggcggtcagttagcaaactggattcatccaaggacaggagcctgtggaacctgcatcagggtaagcagaatggctccgcctgggccaggtcaactaccaccagagacagtcccgttctgagaaacattaacgatggactttccagtttattctctgtggttgagcattcaggcagcaccgaatcggtctggaaattaggaatgtctgagactagggctaaacctgagcctcctaaatacggcatagtacaggaattttttcgaaacgtttgtgggcgcgccccatcccctacctcctccgctggagaggaaggtacgaagaagcctgagccgctgtctcctgcaagctatcaccagcctgagggtgtggccaggattttgaacaaaaaagcagcaaagttaggcagctcagaagaggtccgactgaccatgctcccccaagtcggtaaagacggcgtcctgagggacggcgacggcgccgttgtgctgcctaatgaggatgcggtctgcgactgctccacacagagcctgactagctgctttgcccgctcttctcgctcagcaataagacacagccccagtaaatgcaggctgcacccaagcgagagttcctggggaggcgaggaacgggcgttgcccccgtcagagtag

SEQ ID NO: 51249 - DNA, 3795 bp, Artificial Sequence
  Description of Artificial Sequence: Synthetic coding sequence
atgtgcaagaagctgaccaagctggccaaggagaacgacagcatgaaagaagagctactcaaatatagatccctgtacggggaccttgattctgcattaagcgcagaagagttggctgacgcaccccactcacgggaaaccgaactcaaagtccatctaaaacttgtcgaagaagaagcaaacctgctgtctcgaaggatcgtagaattggaggtcgagaatcgcgggctgcgtgctgagatggatgatatgaaagatcacgggggagggtgcggaggaccagaagccaggctggccttttccgccctcggaggaggtgaatgcggagagagcctggccgaattgagaagacatctgcagtttgtggaagaagaggctgagctgctgagaagatcctcagccgagctggaggatcagaacaaattgctcctgaacgagctggcaaaattccggtcggaacacgaactcgatgtggccctaagcgaggactcttgcagtgtgctgagtgagcccagtcaggaagaactggccgcagccaaactccagatcggagaactgtctgggaaggtgaaaaagcttcagtatgaaaatcgggtgctactgagcaatctccagcgctgtgatctcgcgtcatgtcagtccaccagaccaatgctcgaaactgatgctgaagccggcgatagtgctcaatgtgtgcccgctcccctgggcgagacccacgagtcccatgccgtgcgcttgtgtagagcaagggaagccgaagtgctccccgggcttcgtgagcaggcagccttggtgtccaaggctatagatgtgctggtggccgatgcaaacggtttcaccgcaggcctgaggttatgcttagacaacgaatgcgctgacttcaggcttcatgaggcgccggacaactccgaggggcctagagacactaaactgatccatgcgattctggttcgtctgtcagtgttgcagcaggaactaaacgcctttaccaggaaggccgatgccgtacttggttgttctgtgaaggagcaacaggaaagctttagctccctgcccccgctaggctctcaaggactatcaaaggagatcctgctcgcaaaggatcttggctcggatttccaaccgccggactttagagatttgcccgaatgggagccccgcatccgggaagccttcaggaccggtgatctggattcaaagcctgaccctagcagatcttttagaccctacagagccgaggacaacgattcctacgcctccgaaattaaagagttgcagctagtcttggcggaggcccatgactccctgagggggctccaagagcaactgtcccaagaacggcagctgagaaaggaggaggcagataacttcaaccaaaaaatggtccaattaaaagaggatcagcagagggccctgttaaggcgcgagtttgaactccaaagcttaagcctccagcggaggctcgaacagaaattctggagtcaagaaaaaaatatgctcgtccaggaaagtcagcagttcaagcacaacttcctgctgctgttcatgaagctgcgttggtttctaaaacggtggagacaaggcaaagtgctaccgtctgagggcgatgatttcctggaggttaactcaatgaaggagctttacctgctgatggaagaggaagagatcaatgcccagcactccgacaataaagcctgtaccggggactcatggacccaaaacaccccaaacgaatacatcaagacccttgcggacatgaaggtgacattaaaggagctctgctggttactgcgggatgaaaggcgcggcctcacagaactacagcagcagttcgccaaggccaaagccacgtgggaaacagaacgtgccgaactgaaaggccacacttcccagatggaacttaaaactggcaaaggtgccggagaacgcgctgggcccgattggaaagccgcattgcagcgtgaacgtgaggaacagcaacacctgctcgcggagtcttacagcgctgtcatggagctgactcggcagctgcagataagcgagcggaactggtctcaggagaaactacaactggtggagcggttgcagggggaaaagcaacaggtggagcaacaggtcaaggaactgcaaaaccgactgtctcagttgcagaaggccgctgacccgtgggtgctcaagcatagtgaattagaaaaacaagataatagctggaaggaaacacggagcgagaagatccacgacaaagaagccgtatctgaggtcgaacttgggggcaacggattaaagagaacaaagtctgtctcgtccatgtcggagttcgagtctctgctggactgttcaccctacctcgcaggaggggatgcaagaggcaagaaacttcctaataacccggcattcggattcgtgagcagcgaaccaggggaccccgagaaagatacaaaggaaaagccggggctgtcctcaagagattgcaaccacttaggcgctctggcctgtcaggatccccccggtaggcagatgcagcgcagttacactgcacctgataagactggcattagagtctactacagccctcccgtggctcggcggctcggtgttccagtggtacatgataaggagggcaagatcatcatcgagccaggcttcctctttaccactgctaagccaaaagagtcggccgaagctgacggtctagctgagtccagctatggaagatggttgtgcaacttctcccggcagagattagacggcggttcagctggcagcccatccgcagcaggtcccggctttcctgccgccctgcatgacttcgagatgtcaggtaatatgagtgatgatatgaaggagattacgaactgtgtcaggcaggctatgaggagtggtagcttagagaggaaggtgaaaagcacttcttctcagacagtgggccttgcctccgtcggcacacaaacaatccgtacagtatctgtaggtctccagaccgatccaccacgctcctccctccacggtaaagcctggagtcccagatccagtagccttgttagtgtccgctcaaagcagatcagttcatccctggacaaagtccacagtcggatcgagcgcccgtgctgttcaccaaagtacggaagccccaagttacagagacgctctgtgtcaaagctagattcctccaaggatcggagtctgtggaatcttcaccaggggaaacagaacggcagtgcctgggcaagatctacaaccacgagggattctcctgtgctgcgcaacatcaatgatgggttatcatccctgttttccgtggtggaacattcgggatccactgagtcagtgtggaagcttggtatgagcgaaactcgcgccaaaccagagcccccgaaatacggtatcgtgcaggaattttttagaaacgtgtgcggccgtgccccatctccaactagttccgcaggtgaggagggcacaaagaaacccgagcccttgtccccagcttcgtaccatcaaccagaaggggtggcaagaattctaaacaaaaaggcagccaaactggggagcagtgaggaggtgaggttgacaatgctcccgcaggttgggaaagatggagtgctgcgggacggggatggcgccgtggtattgcctaacgaggacgctgtgtgcgactgcagcacacaaagcctgacatcgtgctttgctcggtcttccagaagtgccattcgccactcccccagtaaatgcagactccacccatctgaaagcagctggggcggcgaggagcgcgccctgcccccatccgaatag

SEQ ID NO: 51250 - DNA, 237 bp, Artificial Sequence
  Description of Artificial Sequence: Synthetic coding sequence
atgggcagcggcctgcccctggtgctgctgctgaccctgctgggcagctcacacgggaccggccctggcatgaccttgcagctcaagttgaaggaaagttttctcacttcttcatcatacgagtctagttttttggagctgctggagaagttatgtctgcttctgcacctgcctagtggcactagcgtgaccctccaccacgctcgcagtcagcatcacgtcgtttgtaatacatag

SEQ ID NO: 51251 - DNA, 690 bp, Artificial Sequence
  Description of Artificial Sequence: Synthetic coding sequence
atgcccgccgccggcccccccctgctgctgctgggcacccccggctctggcaagacagctctgctcttcgctgctgcactagaggcagctggggaagggcagggtccagttctgtttctcacacgacgcccgcttcagtccatgccaagaggaactgggacgacgcttgatcctatgcgactccaaaaaattcgatttcagtatccaccttccacgcgggagctattcagattactgtgtagcgcccacgaagctccaggtccggccccctctctgctgttactggatggcttagaagagtacctggccgaggaccccgaaccgcaagaggctgcttacctcattgcactgctcttggacacagctgctcacttttctcatcgtttagggccggggagggactgtgggcttatggtggccctgcaaacacaggaggaagccggaagcggggatgtcctgcaccttgccctgctgcagagatactttccagctcagtgttggctccagcccgatgcacctggtccgggcgaacacggactgagggcgtgcctggaacctggaggtctaggccctcgcactgaatggtgggtgacatttcggtcagatggagaaatgatgatagctccatggcccactcaagcaggggacccctcctcaggcaagggatcctcttccggcggacagccttag

SEQ ID NO: 51252 - DNA, 2703 bp, Artificial Sequence
  Description of Artificial Sequence: Synthetic coding sequence
atgagcagcaaggagagctgcggcaagaaggagaccagccagcggaaggacacaacaactagttctcctaatttcggtgagaaggataagaaggagaggaagaccccagcctccagcacatcctccagttcaatcaggtctgttagtagtgagaaacgcaaactcaaatctgaccataccgatgtcctttactacaacatcaaacgcagacaggggctgaagaggctgtccgttgagattgacacactgcgccggcgacctaagataggatcttcctcgcagaggcctattaagctcaaggaggccagctactcaaacgacaatcagatcatacttcagtctcctagttctaatggcactaagaaggacattcataagtgcgtcgactttaagcccaaagatattaagctcacaaatgcaggaagcaagctagatcacggaattaagtctttatcaagtccaaagatcgcgagcgacgttaaaccgaaggcagagggacaagcaagcgaaaacaaatggtctcacctgttggtgcagcgagagaagatgaaagaactgaaaaaaggtcgtaatagtaaattccgagacaattctgagaagtgcgtgctggagaaatggaaacgcaatcaattttctcaggattacaactccaacaaaataattaaggagccactcgggtcaagacgccaaaaaatctctttcaaaatccccatcaagtcacgggatacacttcaaaagttggtcgaagagaacgtgtttaatatcgactccaacaacagcaaaaccaagcaggaggagcgcgaatacctagaatccagccaagtctcactgaacgtcactcggcagaagactgagcacctcctgagtgacttcacttacaagcgaaccgtgcatgagtggaagaggaagcaccactacgaccatcaggagtccaacgactctcactctagggagaacttgacccagtcatttgaagcaccctgttgcagcgtgagctccgagtctattcaggatgcggatcaagagatgcagattgtggaggaactgcacgcagcacgggtgggcaagtcagttgatcttcccggcgagctgatgagtatggaaatagatttggaagatgatgtgcactcttcttctgccaataatactagcgatcgaaaactcttaatagttatagataccaatatccttatgaaccatctgaaatttgtccggattctgaagacaaccgaagttcccggctttgataaactggtcttaataataccctgggtggtgatgcaggaactggatagaatgaaggagggtaaactacttaaacgggcccaacacaaggcgatacctgccgtgcacttcatcaacgattcattaaagaatcaggatcgcaaactatggggacagtctattcaacttgcgtctcagaaacattacggcctctccgatgaaaataatgatgatcgagtgttaaagtgctgcttgcagcaccaagagctgttcccatgctctttcgtaattctatgtaccgacgatcggaacctcagaaataaaggtctgattagcggcgttaaaagcttgtcaaaggaagagctgagtgcggagctgttgcacctgagtctgaacaccgatgtctgtcaccagccttgtattcctaagcaacagctgaaggccgaaactactccactcaaagagagttataaggaagaaagtaccaactcaggtctgtctatattactcgagtccatagtgtccgacctggaaaaaagcctcggtaccggattgtcaagtatacttgaaaccgaaatgaaaatcgccttcggaaatctgtggatggagatcctgtacctcaagcccccgtggacactgctgcatctgcttcagtgttttaagaagcattggctggctgtctttggcttagtgatggagaagaacctactgctaactatagagagcctgtacaagaatctgcgcaaagcaaataaggcggtcgacttcacgaccgttaagttccttctgcaggacagtagaagtctccttcatgcgttttctacacgttcaaattatgacgggattctcccacagacctttgctcaggtaaataatttgcttcagaccttcgcagaggttaaaactaaattgaagcccaactcctcggagaacaccgtgaccaagaagcaggaaggaacatctttgaagaattcccataaccaggaaataacagtattctccagctctcatctacctcagccatcgaggcatcaggaaatatggagtatcctggaatcggtgtggatcaccatatatcagaactccacagacgtcttccagaggcttgggtccaattcagctctcactacctcgaacatcgcgtcattcgaagaagcattcatttgtcttcagaagctgatggccgctgtgcgtgatatcttggaaggtattcagcggatacttgccccaaactccaactatcaggatgttgagaccctgtataactttttaatcaagtacgaggttaacaaaaacgtgaagttcacagctcaggaaatctatgattgtgtttctcaaaccgaatatagagagaagctcaccattggctgccggcaactggttgagatggagtatacaatgcagcagtgcaacgcatctgtgtatatggaggcaaaaaacaggggctggtgcgaggatatgcttaattaccgcatctag

SEQ ID NO: 51253 - DNA, 2703 bp, Artificial Sequence
  Description of Artificial Sequence: Synthetic coding sequence
atgagcagcaaggagagctgcggcaagaaggagaccagccagcggaaggacacaacaacctccagtccaaactttggagagaaggacaagaaagagaggaaaactccggcttcctcaaccagttcctcttccattcggagtgtgtcttctgagaagaggaaactcaaaagtgatcacacggacgttctctactataacatcaaaagaaggcaaggcctgaaaagactgagcgtcgagatcgatactctgagacgcaggcctaagatcgggagtagctcccagcgaccaatcaagctcaaagaggccagctattcaaatgacaaccagatcatcctgcagtccccttcatctaacggcacgaagaaggacatccacaaatgcgttgatttcaagccaaaggacataaagcttactaacgccggatctaagctcgatcatggtattaaaagtcttagctctccgaaaattgcaagtgatgtaaagcctaaagcagagggccaggcaagcgaaaacaaatggtcccatctgctggtccagcgcgagaagatgaaggagctcaagaagggcagaaactcaaagtttcgcgacaatagcgagaaatgcgtccttgagaaatggaaacgaaatcaattttctcaggactacaacagtaacaagataatcaaagagccactggggagcagacggcaaaagatctcctttaagattcctattaagtcccgcgatactctccaaaaactagtggaagaaaatgtttttaacatcgatagcaacaatagtaaaactaaacaggaagaacgcgaataccttgagagctcgcaggtcagtctgaacgtcacccgacagaagacagagcacttgctgtccgactttacatataagcggaccgtgcacgaatggaagcgtaagcatcactatgatcaccaagagtccaatgactctcatagccgggaaaacctgacacaaagctttgaagctccttgctgctccgttagtagtgaatctatccaggacgctgatcaggaaatgcagatcgtggaggagctccacgccgctcgggtggggaaatctgtggacctgccaggcgaattgatgagcatggagattgacctggaagatgacgtccacagcagttccgctaataatactagtgatcggaagttgcttatcgtgattgacactaatatcttgatgaatcatctgaaatttgtaaggattctgaagacaaccgaggtcccgggattcgataaactggtgctgataattccctgggtagttatgcaggaactggatcggatgaaagaaggcaaactgctgaagcgagcgcaacacaaagccatccccgccgtccacttcatcaacgactctcttaagaatcaagatcgaaagctctggggtcagtcaatccagctggccagtcagaagcactatggtctgagcgacgaaaataacgacgaccgcgtcctgaaatgttgtcttcagcaccaagagctgttcccatgcagcttcgtcattttgtgcaccgatgatcgcaacctcaggaataagggcctaatcagcggggtgaagagtctgtcaaaagaagagctgtctgctgaactgctgcacctgtctctgaacaccgatgtctgtcaccagccttgtattcccaaacaacagctgaaagcagaaaccacgccgttgaaggaatcttacaaagaggaatctacaaactctgggctgtctatcttgcttgagagtatcgtctctgatctagaaaagagcttgggcacgggactctcatcaattttggagaccgagatgaaaattgcattcggtaatctgtggatggaaatactctacctcaagccgccttggaccctgctgcatttgctgcaatgcttcaagaagcattggctggccgtctttggcctcgtgatggagaaaaacctcttattgaccattgaatcgctatacaagaacctaaggaaagccaataaagctgtggactttaccaccgtcaagtttctgctgcaggatagccggtcacttctgcatgcttttagcactcgaagtaattacgacgggattctgcctcagacatttgcacaagtgaataatctgctgcagactttcgccgaggtgaagaccaagctcaaaccgaactcctcagagaacactgtgactaaaaaacaggaaggcactagtctcaagaatagccacaaccaggaaattaccgtcttctcttctagccacttgccccagccatcccggcatcaggagatctggtccatcctggaatctgtgtggattacaatttaccagaactctacagatgtgtttcagcgcctgggtagtaacagcgcattaactacctctaatattgcaagtttcgaggaagctttcatctgtctgcagaagctcatggctgcggtgagagacatccttgagggcatccaacgcatactcgcacccaattctaactaccaagacgtggagacactgtacaacttcctgattaaatatgaagttaacaagaatgtgaagtttacggctcaggagatatatgactgcgtgagtcagacagaatacagagagaaacttaccataggttgccgccagctggtggagatggagtacacgatgcaacagtgtaatgccagcgtttatatggaggcaaagaacagaggttggtgcgaggacatgctgaactatagaatatag

SEQ ID NO: 51254 - DNA, 483 bp, Artificial Sequence
  Description of Artificial Sequence: Synthetic coding sequence
atgagcagcaaggagagctgcggcaagaaggagaccagccagcggaaggacacaactacaagctcccccaactttggggagaaggataagaaagaaagaaaaacacctgcctcttctacctccagttcaagtatccgctccgtaagcagcgaaaagcgcaagctgaagtccgaccacacggatgtgctctactacaacataaagcggaggcaaggcctgaagcggttatcagtagagatcgataccctacggaggagacctaaaatcgggagttcctcacagcggcctattaagctgaaggaggcttcttattcaaacgataatcagattatcctccagtctccgtcttctaatggtaccaagaaagatatccacaagtgtgtggactttaagccaaaagacattaaattgactaacgcaggcagcaagctcgaccatggcatcaagagtttgtctagtcccaagatcgcttccgacgtgtag

SEQ ID NO: 51255 - DNA, 1545 bp, Artificial Sequence
  Description of Artificial Sequence: Synthetic coding sequence
atgatgaacttcctgcggcggcggctgagcgacagcagcctgttcagttccctatctcaggctgtgaagcagacagcagctagtgccggtctagtggatgctcctggcgcagccccagccgccgccaggaaggcgaaggtgctcctcgtcgtagacgagccacatgcagattgggccaagtgctttcggggcaagaaggtcctgggagattatgatatcaaggtcgagcaggccgagttctcggaactgaatctagtggcccacgcagacggaacttatgcggtggacatgcaggtcttgaggaacggaactaaggtcgtaaggagcttccgcccagacttcgtcctgattaggcagcacgccttcggaatggcggagaacgaggacttccgacatcttatcattggaatgcaatacgccggtttgccatccatcaacagcctagaatctatttataatttttgcgataagccctgggtcttcgcccagttagtggctatttacaagacattgggtggagagaaatttcccctgatagagcaaacctactatcccaatcataaggagatgctaacactgccaactttcccagtcgtggtaaaaatcgggcatgcacatagcggcatgggcaaggtaaaagtggagaaccattacgattttcaagacatcgcctcagttgtagccttaacacagacttatgccacagctgaaccgtttattgactccaagtatgatatccgcgttcagaaaatcggcaataattacaaggcatacatgaggacgagtatatctggtaattggaaaacaaatacagggtctgccatgttggaacaaatcgcaatgagcgacaggtacaagttgtgggtggacacatgctcagagatgttcgggggtctggatatttgcgcagtaaaagctgtgcatgggaaagatgggaaggactacatctttgaggtaatggattgctctatgcctctcatcggggagcatcaggtggaggaccggcagttgatcactgaattggtgataagcaaaatgaatcagctcttgagtagaacccccgcgcttagtcctcaacgtccactcactacacaacagcctcagtcgggcactctcaaggatccagattcctccaaaacaccgccacagcgtcccccgccacagggtggtcccgggcagcctcaggggatgcagcctccggggaaagtgctgccaccacggaggctcccacccggtccctcactgcccccatcttccagtagttcaagctcgagctcctcctctgctcctcagcgtcccggcggccctaccacgcacggagatgctccatcgagcagtagctcgctcgcagaagcacagccacccttggcggcccctccccagaaacctcaaccacacccccagctgaacaaatcacagagcctgaccaatgccttttcatttagtgagtcctccttcttcagatcctcagccaacgaggacgaggccaaagccgagaccatacgatctctgagaaagtcattcgcatccttgttcagcgactag

SEQ ID NO: 51256 - DNA, 729 bp, Artificial Sequence
  Description of Artificial Sequence: Synthetic coding sequence
atggccggcaagctgaagcccctgaacgtggaggcccccgaggccaccgaagaggcagagggccaggccaaaagtcttaaaactgaggatcttcttgctatggtgatcaaacttcagaaggagggctccctggagccccagatagaggacttgatcagtcgcataaacgaccttcagcaggccaagaagaagagcagcgaggagttgcgagagactcacagtttgtgggaggcgctgcatagagaattagatagcttgaacggggaaaaggttcatttggaagaggttctcggtaaaaagcaggaagcactgagaatccttcagatgcactgccaggaaaaagagtctgaagcccagcgactggacgtaagggggcagcttgaagacttaatgggacagcacaaggacctttgggagttccacatgcttgagcaaagactggcccgggaaatcagggcattggaacggtccaaggaacagttactgtctgaaaggaggctcgtccgcgccaagctacgggaagtggagcggcgcttgcactcaccccctgaggttgaaggggccatggcagtaaatgacggcctaaaagccgaactcgaaatcttcggggagcaggtgcgcagtgccccggaggtgggcgcgggagagggagaggctggtcccgagctgcctcgtgcgagagacgaggaagatcctgaaccaccagtggccgccccagatgccctctag

SEQ ID NO: 51257 - DNA, 267 bp, Artificial Sequence
  Description of Artificial Sequence: Synthetic coding sequence
atggacgacgccgaccccgaggagcggaactacgacaacatgctgaagatgctatctgaccttaacaaggatttagagaaactgctcgaagagatggagaaaattagcgttcaggctacctggatggcgtatgatatggttgtaatgcgcacaaatcccacattggccgagagtatgaggcggctggaggacgctttcgtgaactgcaaagaggaaatggagaagaattggcaggaattgttacacgagaccaagcagagactgtag

SEQ ID NO: 51258 - DNA, 942 bp, Artificial Sequence
  Description of Artificial Sequence: Synthetic coding sequence
atgctgctgctggccgacatggacgtggtgaaccagctggtggccgggggacagtttcgagtagtgaaggaacctttgggatttgtgaaggttcttcagtgggtatttgccatttttgccttcgcgacctgtgggtcatactccggtgagctccaactgtccgtggattgtgccaacaaaacagaatctgacctgagcatcgaggtcgagtttgagtatccattccgactgcatcaggtgtactttgatgctcccacctgcagggggggcacgacaaaagtctttcttgtgggcgactactccagttccgcagagttctttgtgaccgttgccgtttttgccttcctgtacagcatgggcgcactcgccacgtatatcttcctacagaataaatatcgcgagaataacaagggccctatgttggacttcctggctaccgccgtgtttgcctttatgtggctggtgagttctagcgcctgggctaagggcctttccgacgtcaaaatggctactgatcctgaaaacatcatcaaagagatgcctgtgtgtagacaaacaggcaatacatgcaaagaactccgcgatccagtaactagcggcctgaacacctctgtggttttcggatttcttaaccttgttctatgggtgggcaatctgtggttcgtgttcaaggaaacaggatgggctgcacctttccttagggcgccacctggcgctccggagaaacagcctgctccaggggatgcatacggagatgctgggtacggacaagggccaggcggctacggtccccaggactcttatggaccacaaggcggctaccagcctgattacgggcagcctgccggctccggcggctcaggttatggaccccagggcgactatggtcaacaggggtatggaccccagggcgcacctactagcttcagtaaccaaatgtag

SEQ ID NO: 51259 - DNA, 1173 bp, Artificial Sequence
  Description of Artificial Sequence: Synthetic coding sequence
atggccgagcagctggccctggtgatcggcggcaccatcggcggcctcttgcttctgctgctaattggggcgagctgttgcctgtggaggcggttctgtgccacccttacatacgaagagctgccaggcacccctgcgatggccacgacagccgcctctagtgggcaaagagaccgcccctgtcagccccatgcccggacccaactgtcaagacctcccgccgttcccttcgtcgttcctcccactctccagggccgggactgggttcctctgcactccggtgagtgggccgacgccccatgggacccgtgtccggcaagtgagctgcttccacacacttccagcgggggcctaggcgacgcctgcatggtgggggctattaacccggagctgtacaagttccctgaggacaaaagcgagactgatttcccagacggctgtttggggcgcctgtggttctccgttgaatatgagcaagaggccgaacgcttgctcgtgggcctgataaaggcacagcatctgcaagccccgagtgaaacatgctcacctcttgtgaagctgtacctgctgcctgatgagcgcaggttcttacaatctaagacgaaaaggaaaactagcaatcctcagtttgacgagcacttcattttccaagtgagctcgaaaaccataacacaaagagtgcttaagttctccgtttatcacgtggacaggcaaagaaaacaccagctgctgggccaggtgctatttccgctgaagaatgagaccctcgtcggggattgcaggcgcgtaatttggcgcgatctggaggctgaatcactggagccaccatctgaatttggcgatcttcagttctgtttaagctacaatgattatttgtctcgcctgaccgtggtcgtgctcagggctaaggggctaaggttgcaagaggatcgcggaattgtatccgtatttgtgaaggtctctttaatgaaccacaataaatttgttaagtgtaagaagacctctgctgtattgggatccataaatccagtttacaacgagacatttagttttaaggcagacgctaccgagctcgataccgcctcgctttccctgaccgtggtccagaacatggagggggataagcaagctacaacggtggagctgtttctctttcatcttacctccggctag

SEQ ID NO: 51260 - DNA, 1833 bp, Artificial Sequence
  Description of Artificial Sequence: Synthetic coding sequence
atggcccaggagatcgacctgagcgccctgaaggagctggagcgggaagcgattcttcaggttctgtacagagaccaggcggtccagaatacggaagaagagcgcactagaaaactgaagactcacctccagcatctaaggtggaaaggcgctaaaaatacggactgggagcataaggaaaagtgctgcgctagatgtcagcaggttctggggtttttgttgcacagaggtgctgtgtgccggggatgttcacaccgagtgtgcgctcagtgtcgcgtctttttgcgggggacacacgcttggaagtgcacagtatgctttgaagatcggaatgtgaagatcaagaccggcgagtggttttacgaggagcgggcaaaaaaattccctacgggaggtaagcacgaaacggtggggggacagctgctgcagagttaccagaagctgtccaaaatctcagtcgtcccacccactcctcctccagtgagcgaaagtcagtgtagcaggtctccggggcgactgcaggagttcggtcagtttcgcggttttaataagtctgtggagaatctcttcctgagccttgctactcacgtgaaaaagctgtcaaaaagtcagaacgacatgacttctgaaaagcacctcttagctaccggacccagacaatgcgtcggccaaacagaaagacgatcacagagtgacacagcagtcaacgtcaccacaagaaaggttagtgctccggatattctcaaaccactcaaccaggaggatcccaagtgctcaactaatcctatcctgaaacagcaaaacctgccctcttctccagcaccctcgaccatcttctccggaggtttccgccacggatccctcatttccatcgactctacatgtaccgaaatgggaaacttcgacaacgccaatgtgactggggaaattgaattcgcaattcattactgctttaaaacacacagtttagagatatgtattaaagcttgcaaaaatctcgcttatggtgaagaaaaaaaaaagaagtgcaacccttacgtcaaaacctatctgctcccagatagatccagccaaggaaagaggaagaccggcgtgcagcggaacacagtcgatcccacctttcaggaaaccctaaagtatcaggtggccccggctcaactcgtcacgagacagctgcaggtgtccgtttggcacctggggacgctcgccaggagagtctttctcggtgaggttatcattcccctcgccacgtgggattttgaagactccacgactcagagctttcgttggcaccctctgagggctaaggccgagaagtacgaagattccgtcccacaatcaaatggtgagttgaccgtgagagcgaaacttgtgctgcctagcagaccgcggaagctgcaggaagcccaggaagggactgaccagccttccctgcacgggcagctgtgtctggtcgtcctgggcgcgaagaatctgcctgttcgcccggacgggactctgaattcattcgtaaagggatgcttgacgcttcctgatcagcagaaactccgccttaaatccccagtgctgcgcaaacaggcttgcccacagtggaaacacagttttgtgtttagcggcgtgactcccgctcagctgcgccagagcagtctcgagctcacagtgtgggaccaggcgttgttcggcatgaacgatcggttgctcggtgggacaaggctaggcagcaaaggtgataccgccgtgggcggtgatgcctgctctctctcaaagttacagtggcaaaaagttctttcgtctccaaatctgtggaccgacatgaccttagtgctccattag

SEQ ID NO: 51261 - DNA, 1629 bp, Artificial Sequence
  Description of Artificial Sequence: Synthetic coding sequence
atggcccaggagatcgacctgagcgccctgaaggagctggagcgggaagcaatactgcaggtgttgtaccgtgaccaggccgtccagaacacggaggaagagagaacacgaaaactcaaaactcatttacagcatctgcgctggaagggtgcaaagaacaccgactgggagcacaaggagaagtgttgcgctagatgccagcaggtactgggtttcctgctgcaccgtggggccgtttgtagaggttgctcacacagagtgtgtgcacaatgccgcgtgttcctgaggggcacgcacgcctggaaatgcactgtctgtttcgaggaccggaatgtgaagattaagactggagaatggttctacgaagaacgagctaagaagtttccaacgggcgggaagcacgaaaccgtgggagggcagttgctgcagtcttaccagaagttgtcaaagatctcggtggtcccaccaactcccccacccgtgagtgaatcccaatgcagtcggtcacctggacgtaaagtgtccgccccagacatccttaagccccttaaccaggaagaccctaaatgctctacgaatcctatactgaagcaacagaatctcccttctagcccagctcctagcactattttctcgggagggttcaggcacggtagcctaatatccatagactccacctgtaccgagatggggaactttgataacgccaacgtgactggtgagatcgagtttgccattcactactgctttaagacacattcattggagatttgtatcaaggcatgtaaaaatctggcgtacggtgaagaaaagaagaagaaatgtaatccttacgtcaagacgtatcttttgcctgataggagctctcaggggaaacgcaagacgggcgtgcagcggaatacagtagatcccacatttcaggagactcttaagtaccaggtggctcccgctcaattggtaacacgacagctgcaggtttctgtgtggcatctggggaccctagcgcggcgggtgtttttgggcgaagtgattattccactggctacttgggacttcgaggattccaccacacaaagcttcagatggcaccctctcagggccaaagccgagaagtacgaagacagcgttccccagtccaatggagagctgactgtgagagccaaacttgtactgccttctcggccccgaaagcttcaggaagctcaagaggggactgaccaaccctcattacacgggcagctgtgtcttgtggtgttaggagcaaaaaacctgcccgtgagacctgatggcacactgaactcctttgttaaaggctgcttgacacttcccgatcagcagaaactgcggctcaagtcacccgtgttacgcaagcaggcctgcccacaatggaaacacagctttgtttttagcggagtcaccccagcgcagttgagacaatcttcccttgagctcactgtctgggaccaggcactgttcggcatgaacgatcgccttttaggagggacgcggctggggagcaagggggatacggccgtaggtggggacgcgtgttcgctctccaaactccagtggcagaaggtgctgtcgagtcctaatctgtggaccgatatgacgctggtcctccattag

SEQ ID NO: 51262 - DNA, 1011 bp, Artificial Sequence
  Description of Artificial Sequence: Synthetic coding sequence
atgcggaacgagccccggaacttccagctggagggcagcctgatcagcattgatagcacttgtactgagatgggtaactttgacaatgccaatgtgaccggggagattgagttcgcgatccactactgctttaagacgcatagtctcgaaatctgtataaaggcatgtaaaaacctggcatatggagaggaaaagaaaaagaagtgcaatccttatgtaaaaacatacttgttaccggacaggagttctcagggaaaaaggaagaccggagttcagagaaacaccgtggatccaacattccaggagactctcaaatatcaggtggcacctgcccaattagttacccgccaattgcaggtgtctgtctggcacctcggtaccctggctcggagagtgtttcttggagaggtgattattcccctggcaacttgggatttcgaagacagcaccacacaatccttccggtggcacccacttcgcgccaaagctgagaagtatgaggattccgtaccacagtccaatggggaactaactgtgcgggccaaacttgtgctgccttctagaccccgtaagctccaggaggcgcaagagggcactgaccagcctagcctgcatggacaactctgtctcgtggtcttaggtgcgaaaaatctgccagttcgtcctgatggaaccttaaacagctttgtcaaggggtgcctgacacttcccgatcagcaaaaactgcgattaaagagcccggtcctacggaagcaggcctgccctcagtggaaacatagctttgttttctctggggtaacgcccgcccagttgagacagtcttcactagagctgacagtctgggaccaggcgttgttcggcatgaacgaccgccttctcggtggaacaagactagggtcgaagggcgataccgcagttggaggagacgcctgcagtctgtctaagctccaatggcagaaagtcttatcgtctcccaatttgtggaccgatatgacgttggtgctgcactag

SEQ ID NO: 51263 - DNA, 1704 bp, Artificial Sequence
  Description of Artificial Sequence: Synthetic coding sequence
atggcccaggagatcgacctgagcgccctgaaggagctggagcgggaagccatcttgcaagtcctgtacagggaccaagccgtgcagaatacggaggaagagaggaccagaaaactcaaaacacacttacagcatctccgctggaagggggcaaagaacaccgactgggagcacaaagagaaatgttgcgctagatgtcagcaggtattgggatttctgctgcatcgcggtgcggtctgccgaggatgcagccaccgcgtgtgtgcccaatgcagggtttttctgcggggtacgcacgcttggaaatgcaccgtttgttttgaagatagaaacgtcaagataaagacaggcgagtggttctatgaggagcgcgcaaaaaagtttccgacgggcggaaaacacgaaaccgttggggggcaattgctgcagtcctatcagaagctgtcgaagatctcagtcgtgcctccgaccccgccaccggtcagcgagtctcagtgttcgcgtagcccgggaagactgcaagaattcgggcaattccgaggattcaataagtcggtggagaacctgtttctgtccctggcaacccacgtgaagaaactctcaaagtcacagaacgacatgacctccgaaaaacaccttctggcaacagggccgcgtcagtgcgtcggtcagacagaaagacggtctcagagtgacaccgcggtcaatgtaaccacccgaaaggtgagtgcccccgatattctgaagccgcttaatcaagaggatccgaaatgcagcaccaatcctatcctgaagcagcaaaacctcccctcatctccagcccctagcaccatcttctcaggtggctttcgccatgggtctctcatcagcatcgacagtacctgcacggagatgggcaattttgacaatgcaaatgtaaccggtgagatcgagtttgccatccactattgcttcaaaacacacagtttggagatctgcattaaggcttgcaagaatttggcatatggtgaagagaaaaaaaaaaagtgcaatccgtatgtgaagacgtacctgcttcccgatcgctcctctcagggcaagagaaaaaccggagtgcagagaaatacagtggatccaacattccaggaaactttgaagtatcaggttgcacccgcccagctggttaccaggcagcttcaggtctctgtatggcacctgggaacactggcacgcagagtctttctcggggaagtgataatccctcttgcgacttgggatttcgaagattccaccacacaatcctttcgctggcatccgctgcgcgccaaagctgaaaagtacgaggattccgtcccccagtctaatggcgaattgactgtgcgcgccaaactggtgctcccctccagaccaagaaaacttcaagaagcacaggaggggacagaccaacctagcctccatggccagctgtgtctggttgtgctaggtgccaagaacttaccagtaagaccagatggaacactgaacagcttcgtgaaaggctgcctgaccttgccagaccagcagaaactgcgactcaagtctccagtgctgaggaaacaagcttgcccccagtggcgacatagctgctggcgggggtgtatgctgactatcgaagcccccgttgccgagtcaccgtttcagcctcagagcatggatagacacgattcttgtcctgcgctgacctag

SEQ ID NO: 51264 - DNA, 2193 bp, Artificial Sequence
  Description of Artificial Sequence: Synthetic coding sequence
atgagcaagaacagcgagttcatcaacctgagcttcctgctggaccacgagaaggagatgatcctgggcgtactcaagagagacgagtatctgaaaaaggttgaagataaaagaattagaaaactgaagaatgagctactggaggcaaaacgccggagcggaaagacacaacaagaggcctctcgtgtgtgtgtgcattgtcaccgtaacttgggcctgattttcgataggggcgatccatgtcaggcatgttccctgagagtgtgcagggaatgtagagttgcaggaccaaacggctcctggaaatgcactgtgtgtgacaaaattgcccaactgagaatcatcaccggcgaatggttctttgaagagaaggcaaaaagattcaaacaggtcaacgtcttggggaccgacgtggtgcgccagtcaatcctgagacgctcccccggcgctgaggaagtgcagtcccaggagcaaacacgtcaagacgccgagaaatctgatacaagtccagtggctggcaagaaagccagccatgacggccccaagcgcaagggctttctcctttctaagttccggtcagctacccgcggagagatcattacgcctaagactgatacaggaaggtcctactccttggacctcgacgggcaacattttcggtctctgaagtcaccacccggctctgaccggggcagtacagggagcagtgacctcaatgatcaagagcccggacctaggactcctaagtcctcccgaagcaatggtgttacccctggcacccaaagctcacccgcgccatccactcgcacagttacttcagtgatctcaagggagtatggcttcgaaaattctatggacctcgctgcaatcgaagggacctcacaggaacttacgaagagccaccgcaggaacacctctggtactcccagtatagccgtgtccggcacatccttgtcgtccgatcaaagcagatcagagttggatctgagcgaatcctttacggaggactccgaggataccgttagtattagaagtaagtcagtgcctggcgccctcgataaggattctctggaagaaaccgaggagtcaatagatgctctggtttcaagccagctatcaacaaatacccaccgattagcgagcgggctttctacaacaagcctgaatagtatgatgagtgtttactctgagaccggagactatggaaatgtgaaggtcagtggcgagattcttctgcatattagctattgttataagacgggagggctgtacatcttcgttaaaaattgcaggaacctggccattggggacgagaagaagcaaagaaccgatgcttatgtgaagagctacctgctgcctgataaatcaagaaataataaaagaaagaccaagatccgcacgggcaccaatccggaattcaacgagacacttaagtatactatctcccacacccaactggagactcggactttacagctgtcagtatggcactacgataggttcggacgcaatagttttttgggcgaggtcgagataccctttgactcctggaatttcgagaaccctaccgatgagtggtttgtgttacagccaaaagtggagtttgcccctgatatcggtctgcaatacaagggggaactgacagtggtcctgagatatattccgccagaggagaacttaatgctgcctccggaacagctgcagggaaataagaccttcaaaaaggggaagaaaaaagagtctcccgttatctccggtggaatcctcgaagttttcatcaaggaggcaaaaaacctcaccgccgtgaagtctggaggaaccagtgactcttttgtgaaagggtatctgctacctgacgactccaaagccactaagcataaaacgttagttatcaagaaaagcgtcaatccccagtggaatcacacatttatgttttcaggcatccatcctcaggatatcaagaacgtttgcctggaactgacaatatgggacaaagaggcttttagctcaaatatcttcttaggaggcgtgagattgaactccggatccggcgtttcccatgggaagaacgttgactggatggactcacagggtgaagaacagaggctatggcagaagatggctaataacccgggcacaccattcgagggcgtcctgatgctgagaagcagtatgggcaagtgcagactttag

SEQ ID NO: 51265 - DNA, 2193 bp, Artificial Sequence
  Description of Artificial Sequence: Synthetic coding sequence
atgagcaagaacagcgagttcatcaacctgagcttcctgctggaccatgaaaaagagatgatcctgggcgtcttaaaacgtgatgagtatctaaaaaaagtggaagacaaaaggattcggaaactaaagaatgagttgctggaggcaaaaagaaggtccggaaaaacccagcaggaagcttccagggtctgtgtgcactgtcatcggaatctggggctgatattcgatcgcggcgacccgtgtcaggcttgcagcctacgggtgtgcagggagtgcagagtcgccggacccaatggatcatggaagtgcaccgtgtgcgataagatcgcgcagttgcgcataatcactggcgagtggttttttgaagagaaagccaagcggtttaagcaggttaacgtgctagggacagatgttgtgcgccaaagcattttacggagaagccccggcgctgaagaagtgcaaagccaggaacagactcggcaggatgcggaaaagagtgacacatcccccgtggccggtaagaaagcctctcatgatggtcctaaacgtaagggttttctgctgtccaagtttagaagcgctacaaggggagaaatcatcacaccaaagacagataccggacgctcttatagtctagacctggacggacagcactttcggagcttaaagtctccaccaggatcggatcgcggaagtacaggttcatccgacctgaacgatcaagagcccggtccaaggactcccaaatcaagtcggtccaatggggtcaccccggggacacagtcatcccctgcaccatcgacacgcactgtgacaagtgtcatttcacgcgaatatggctttgagaactccatggacctcgctgccattgagggtactagccaggagctgacaaaatcccataggcgcaacacctcggggactcctagtattgccgtgagcggcacaagtctctcatctgatcagagccgaagcgagctggatctgtcagagagcttcaccgaagattcagaggacacagtgagcattagatctaagagtgtccctggcgcactggacaaagactctttggaggagactgaggagagtatcgatgctttagtgtccagtcaattatcaacaaacacccatcgtttggccagcgggctgagcacaacttccctgaattccatgatgtctgtatactctgagacaggtgattacggcaatgtaaaggtttccggtgagatacttctccatattagctattgttataagaccggaggtttgtatatctttgttaagaattgtagaaatctggctataggcgacgaaaaaaagcaacggaccgacgcttacgttaaaagctacttgctcccggataaatcccgaaacaataagcgcaagaccaagatcaggaccggcactaacccagagttcaatgagacactgaagtataccataagtcatacccagttggagactaggactctgcagctgtctgtgtggcactacgacaggtttgggcgaaattcctttctcggtgaagtggagatcccttttgacagctggaattttgagaatcccacagatgagtggtttgtgctccagcctaaagtcgagttcgcaccagacattgggctgcagtataagggagaattgaccgtggtgctgagatatatcccccccgaagaaaatctgatgttgccacctgagcagctgcaggggaacaagacgtttaaaaaagggaaaaaaaaggagtcaccagttatatcggggggcatactggaagtctttatcaaagaagcgaaaaatctgaccgccgtcaagagcggtggtacttctgattcctttgtaaaggggtaccttttgcctgatgacagtaaagccacgaaacacaaaaccctggttataaaaaagtccgtgaacccccagtggaaccacaccttcatgtttagcgggatccatcctcaggacattaagaatgtgtgtctggaacttacgatttgggacaaagaggctttctcatcaaatattttcctggggggcgtccgacttaactctggctcaggcgtgtcccacggcaaaaacgtcgattggatggattcacaaggcgaggaacaacgcctgtggcagaaaatggccaataatcccggaacccccttcgaaggagtactgatgttacgctcatctatgggcaaatgtcgactgtag

SEQ ID NO: 51266 - DNA, 2259 bp, Artificial Sequence
  Description of Artificial Sequence: Synthetic coding sequence
atgagcaagaacagcgagttcatcaacctgagcttcctgctggaccatgaaaaggaaatgatccttggggtgctcaaaagggatgagtatcttaaaaaggtggaggacaagcgtattcgtaagctgaagaacgagctgttggaggcaaaacggcggagcgggaaaactcagcaggaggcctctagggtatgcgtccactgtcatcggaatctgggattgatctttgaccgtggagacccttgccaagcatgctctctaagagtgtgccgtgagtgtagggtcgccggtccaaatggcagttggaagtgtactgtttgtgacaaaatcgctcagcttcgaatcattacaggcgagtggttcttcgaggagaaagccaaacgtttcaagcaggtcaatgtcctcggaaccgatgtggtgcggcagagcatacttaggcggagtccaggagcagaggaagttcagtctcaggagcaaaccaggcaggacgccgagaagagtgatacttctcctgtggcggggaagaaagcctcccacgacggtcctaagaggaagggtttcttactgagtaagtttagatcagctactagaggagaaatcatcaccccaaaaacagatactgggcggagctatagtctcgatttggacggacagcatttccgaagtctcaaatccccccctggatctgaccgtggatcaacaggaagttccgacctcaacgatcaggagccgggtcctagaacccctaaatcttcgcggtctaacggcgtaactcctgggacacagtccagcccagctccttccactcgcaccgtgacgtctgtcatttcaagagaatacggtttcgaaaattccatggatctggcagccatcgaggggacgtcccaagagctgacgaagagtcatcgacgcaacacgagcggcactccgtccattgcagtgagcggcacgagtttgagctcagaccaaagccgaagcgaactcgatctgtccgaatcgttcacagaagactccgaagataccgtgtccatccgcagcaagagcgtaccaggagccctcgataaagacagccttgaagagaccgaagaatccatcgatgccctcgtatcgagtcagctcagcacgaatactcacagactcgcttctggcctctcaacatccagtcaggccggctcagacaggaagtggacttacctgaacgtgcctgacgcagattcagatacaaccagccttaactcaatgatgtcagtgtacagcgagactggtgactacggcaatgtgaaggtctcaggggagatcctgttgcacattagctactgctacaaaactggtgggctctatatcttcgtgaagaactgccggaatctggctataggagacgagaagaagcagcggacagacgcttatgtcaaatcctacctgctgcctgacaaatcccgcaacaataaaagaaagaccaagatcaggaccggcacaaacccagagttcaacgagactctgaaatacacaatcagccacacacagctggagacgcgtaccctccagcttagcgtgtggcattacgatcgtttcggacggaacagttttctgggagaagttgagatcccgttcgactcttggaacttcgaaaatcctacagacgaatggtttgtgctgcagccaaaggtggaatttgccccagacatcgggctgcaatacaagggtgaactgaccgtggttctgagatacattcctcctgaagagaatctcatgttgccgcctgagcagctccaggggaacaagacgttcaaaaagggcaaaaaaaaggagtctccagtcatatccggtggcatcctggaagtgttcattaaggaagccaagaatctaaccgccgttaagagcggaggtacctccgactcgtttgtcaagggctaccttcttccggatgactccaaggccactaaacataagacattggtaattaaaaaatctgtgaacccacagtggaatcacacattcatgttcagcggcattcatccacaggacattaagaacgtgtgcttggagctgacaatctgggacaaggaggccttctcctccaatatcttcctcggcggggtgaggctgaatagcggatcaggggtgagccacgggaaaaatgtggattggatggattcccagggagaagagcaaaggctgtggcaaaagatggccaataacccaggaacaccttttgagggggttctgatgctccggtctagcatgggtaagtgcaggctctag

SEQ ID NO: 51267 - DNA, 3762 bp, Artificial Sequence
  Description of Artificial Sequence: Synthetic coding sequence
atgctgagctggcggctgcagaccggccccgagaaggccgagctgcaggagttgaacgctcgactttacgactacgtgtgtagggttagagaactggaaagagaaaacctgttgctggaggaggagcttagaggtcggcggggcagggagggactgtgggccgaaggccaagcccgatgtgccgaggaggcgcgcagcctcaggcagcagctggacgagctcagctgggctaccgccctggcagaaggtgagcgggacgccctgcggagggagctgcgcgaactccaacggctcgatgccgaggagcgagcagctagaggtagactggacgctgagctgggggcacagcagcgggagctgcaggaagcactgggtgcccgagcggcactggaagccctcctgggcagactccaagctgagaggcggggtctagacgccgctcatgagagagacgtgagggaactgagggcccgggcagcatccctaacaatgcatttccgggcccgtgccaccgggcccgccgcaccaccaccgcgcctgagggaggtgcatgatagctacgccctgttagtggccgagtcctggagggaaaccgtgcaattatacgaggacgaggtcagggagctagaggaggcacttagacggggtcaagagtcccgcctgcaggccgaggaagaaaccagactatgtgctcaggaagcagaggccctgagacgggaggcgctgggattggaacaactgcgcgcccgcctggaggacgccctgctgaggatgcgcgaggagtatggaatccaggcagaggaaagacagcgggtcatagactgcctggaggatgagaaggcgacacttaccctggccatggcagattggctacgagattatcaagacttgctacaggttaagacaggtctgagcctcgaagtggctacctaccgtgccctgctggaaggggaatctaaccccgagatagtcatctgggccgagcatgtcgagaatatgccaagcgagttccgcaacaaaagttatcattacacggatagtctcctgcagcgagaaaatgaaagaaacctgttcagcagacaaaaggcccctctcgcctcttttaatcacagctctgcactctactccaatctgtctgggcatagagggagccagacaggcacctcaatcggcggggacgcccgaagaggttttcttggtagcggttatagtagctctgccacaacccagcaggagaatagctacgggaaagctgtctccagccaaaccaatgtgagaacattctcgcccacttacggcttactgagaaacactgaagcccaggtgaaaacctttcccgacaggccgaaggcaggtgacactcgtgaagtcccagtgtacataggagaggattctaccatcgctcgcgagtcataccgagaccgaagggacaaagtcgcagctggggccagcgagtctacgcgcagcaatgaacggaccgtaatcctaggtaaaaagaccgaagtgaaagccacccgtgaacaggagcgcaatcggccagagactatacggaccaagcccgaagagaaaatgtttgattcaaaagagaaggcctctgaggaacgaaatttgcggtgggaagagctgacaaagctggacaaagaggctcgtcaaagggagtcccagcaaatgaaggagaaggctaaggaaaaggatagccctaaagaaaagagcgtaagggaacgtgaagtaccaatctcccttgaggtatcacaggataggagggccgaagtgtcccctaaagggctgcagacgcccgtcaaggacgctggagggggtaccggaagggaggctgaggcccgggagcttcggttccgcctgggcactagcgacgccacgggctccctccagggtgacagtatgaccgagactgtcgctgaaaacatcgttactagtatattgaagcagtttacccagtcaccagagactgaagctagcgctgattcctttcccgacactaaggttacctacgtggaccgtaaggagctgccgggagagaggaagaccaagaccgagatagtcgtcgagtccaagctcacagaagacgtggacgtcagcgatgaggcaggcttagactacttgctgtccaaggatattaaagaggtcggtttgaaaggaaaaagcgcagaacagatgataggcgacattatcaacctggggctcaaggggagggagggaagagctaaggtcgttaacgtcgagattgtggaagagcccgtctcctatgtgagtggcgaaaaacctgaagaatttagtgtgccatttaaggtggaggaggtggaggatgtgtcccccgggccgtggggattggtgaaagaagaagaaggatatggggaaagcgacgtcacttttagtgtgaatcaacacagaagaactaagcagccacaggagaataccactcatgtcgaagaagtcaccgaggctggagactcggagggtgaacagtcttactttgtgtctacccctgacgagcaccccgggggacatgatcgtgacgacggctctgtttatgggcagatccacatcgaggaggagagtactattcggtactcttggcaggacgagattgtgcagggcacgcgcaggagaacccaaaaggacggcgccgtcggagagaaggtggtgaaacctctggacgtcccggctccttctctggaaggggatcttggtagtacacactggaaagaacaggccagatcaggcgagtttcacgccgagcccactgtcatagagaaagagattaaaattccccacgagtttcatacttcaatgaaagggatctcatccaaagagccccgacagcagctggtggaggtcataggacaactcgaggagactttacccgagagaatgagggaagagttaagtgctttaacacgggaaggtcagggtggaccggggtccgtatcagtagacgtgaaaaaagtgcagggcgccggggggtctagtgtgacgctggtggctgaggttaatgtgagccagactgttgatgcagataggctggaccttgaggaattgtcaaaggacgaggcttcggagatggagaaagccgtcgagtccgtggtcagagaatccttgtctaggcagcggtctccagctccaggctctcctgacgaagaaggcggtgccgaggctcccgctgcaggaatccgcttccgccgatgggcgacccgcgagctttacatcccatccggcgagtctgaggtggccggcggtgccagccacagttctggccagaggacaccccagggacctgtcagcgctaccgtcgaagtgagtagccctaccggtttcgcccagagtcaggtcctcgaggacgtgagccaggctgcccgacatatcaagttaggaccctcggaggtgtggagaacggagcgcatgagttatgagggcccaacagccgaggtagtagaaatggacgtctccaacgtggaggctatccgttcacgcacccaggaggcaggcgcgctgggcgtgagtgacagggggtcctggcgagatgcagactccaggaacgaccaggccgtcggagtatctttcaaggcctcagctggcgaaggcgaccaagcacatagggaacaggggaaggagcaggccatgttcgacaagaaggtgcaactgcagcggatggtggatcagaggtccgtgatttctgacgaaaagaaagtggccctgctttacctcgacaacgaggaggaggagaatgatggccattggttctag

SEQ ID NO: 51268 - DNA, 3759 bp, Artificial Sequence
  Description of Artificial Sequence: Synthetic coding sequence
atgctgagctggcggctgcagaccggccccgagaaggccgagctgcaagagctgaatgcacggctctacgactatgtgtgtagagtgagggaacttgagcgggaaaatctgttactggaagaggaactgcgcggccgacgtgggcgggaaggtctgtgggctgaaggacaagctcgttgcgctgaggaggcgcgttctcttagacagcagctggatgagcttagctgggccacggccttagccgagggagaacgagatgccctgcgacgcgagttgagagaactgcagcggctggacgccgaagagcgcgctgcaaggggacgcctggatgctgaactgggagcccaacagagggaattgcaggaggccctgggggcccgcgcggctctcgaagcccttctcgggcgactccaagcagagagacgaggacttgatgctgcgcatgagcgtgacgtcagagagcttagggctcgtgctgcctccctgacaatgcactttagagcgagagcaactggccccgcggcgccccccccaagactacgagaagtgcatgactcctacgctctgctagtcgccgaatcatggcgggagactgttcaactgtacgaggatgaggtgagagaactggaggaggccttgcgtcgcgggcaggaatccagactccaagcagaggaggagactaggctgtgcgctcaagaagcggcattgcggcgggaggccttgggtctggaacagctgcgcgcccggctggaggatgcattgcttcgcatgcgcgaagagtacgggattcaggcggaagagcgccaacgagtgatcgattgtctggaggacgagaaggctactttaacccttgctatggcggactggctgcgcgactaccaggacctgttacaggtgaagacaggcctaagcctcgaagtagcaacttaccgggcgctgttagagggtgagtcaaaccccgagattgtgatttgggccgagcatgtggagaatatgccatccgagttccggaacaaaagttatcactatacagattccctgttgcagcgcgagaacgaacggaacttgttcagccgtcagaaagcgcccctggcttctttcaatcacagttccgccctctattctaacctgtcaggtcatcgaggcagccagacgggtacttccattgggggggatgcccgcaggggttttctggggtcggggtacagttccagcgccacaacacagcaggaaaactcctacggtaaggctgtatcaagtcagactaacgttcggacattcagcccgacttatggactgctccgcaataccgaagctcaggttaagacctttccagatagacctaaagccggtgacactcgagaagtgcccgtctatataggcgaggattccactatcgctagggaaagttaccgggaccggcgagacaaggtcgcggcgggcgcaagtgagagtactcgctcaaacgagcgtaccgtgatattaggtaaaaagaccgaagtgaaggctacccgggagcaggaaagaaaccggcccgagacaataaggacaaagccagaggagaagatgtttgatagtaaagagaaggcttccgaagagaggaatcttagatgggaagaactaacgaagctggacaaggaagcccgtcagcgagaatcacagcaaatgaaggaaaaggcaaaggaaaaggactctccgaaggagaagtcagttcgggaaagggaggtgcccatctcactcgaggtgagccaggacaggcgcgccgaagtgtctccaaaagggctgcaaacgccagtaaaggatgcgggaggtgggaccgggagggaagccgaggcccgagagttgcgcttcaggttgggcacctccgacgccacaggatctctccagggagatagcatgaccgagacagtggccgagaatattgtcacctcgatcctgaagcagttcacgcagtcacctgaaaccgaagcctccgccgattcctttcctgacacaaaggtgacttatgtggaccgcaaggagctgccaggcgaacggaaaacaaagactgagattgtagtcgaaagtaagctcactgaggatgtggacgtgtctgacgaggccggcctagactatttgctgtctaaagacataaaggaggtgggcctcaagggaaagtctgccgaacagatgatcggagatatcatcaacctgggactcaaaggaagagagggccgcgccaaggtcgtaaatgtggaaatcgtcgaggagcccgtatcttatgtctctggggaaaagcctgaggagttctccgtcccattcaaggtggaggaggtggaggatgtatccccagggccctggggacttgttaaggaggaggagggctacggagagtccgacgtaacattttccgtgaaccagcacagaaggactaaacagcctcaggagaataccacgcatgtggaggaagttactgaggccggggatagtgaaggagagcagagctatttcgtcagcacaccagacgaacatcctggagggcacgacagggatgatgggtccgtctatggacaaatccacatcgaagaggagagtaccatacgctactcatggcaggacgagatcgttcaaggcacccgcagacgaacacaaaaagatggcgctgtgggtgaaaaggtggtgaaaccactggatgtccccgccccaagcttagagggagacctgggctccacccattggaaggaacaagcgcggtccggcgaattccatgctgagcctacagtgatagagaaagagatcaagattccccatgaattccatacctcaatgaagggcatttcctcgaaagaaccacgccagcagttggtggaggttatcggacagttagaggagactttgccagagcgcatgagagaggagctctcggccctgacacgcgagggtcagggtggcccaggaagcgtgtccgtggacgtcaagaaagtgcaaggcgcaggaggtagtagcgtgacgttagtggctgaagtcaacgtgagccagactgtagacgcagatcgactagacttagaagagctctcaaaggacgaagcatctgagatggaaaaggcagttgaaagtgtagtgcgtgagagcctcagtaggcaacgatcccctgctcctggtagccccgatgaggagggaggggccgaagcacccgctgctgggatccgcttcaggagatgggccactcgggaactgtatattccaagcggtgaatctgaagtcgccggaggagccagccactccagtgggcagcgaacaccacagggcccagtttccgctaccgtcgaagtctcctctccgaccggattcgcccagtctcaggtactggaggacgtgagtcaagctgcacgccatattaaacttggaccctctgaagtgtggaggacagagcggatgtcatacgagggcccgaccgccgaagttgtagaaatggatgtgagtaacgtagaagccatacgctcccggactcaggaggctggcgccctgggtgtgagcgatcgtgggtcttggagggatgcagactcaagaaacgatcaggccgtgggtgtcagcttcaaagccagcgcaggtgagggggaccaggcacatcgagaacaggggaaggagcaggcaatgttcgacaagaaagttcagctccagaggatggtggatcaacgctcagttattagtgatgagaagaaggtggcgctactatatctggataacgaagaggaggagaacgatggccactggttttag

SEQ ID NO: 51269 - DNA, 4695 bp, Artificial Sequence
  Description of Artificial Sequence: Synthetic coding sequence
atgctgagctggcggctgcagaccggccccgagaaggccgagctgcaagagctgaatgcccggctctatgactacgtgtgccgtgtgcgtgagttggagagagaaaacttgctcttagaggaagaattgcgggggaggaggggaagggagggactgtgggcggaagggcaggcccgctgtgcggaagaggccaggtcactaagacagcagctggacgaactgagctgggcaacggcactggcggaaggggaacgcgatgccctgagaagggagcttcgcgaactacaacggcttgacgccgaggagagagccgccagggggagactggacgctgagttgggcgcccagcagagggaactgcaggaagcgctgggtgccagagctgccctggaagccctcctaggtcgactacaagccgagcggagaggcttggatgcggcgcacgaacgggatgtccgtgaactaagggccagagccgctagtctgaccatgcactttagggctcgggcaaccggacctgcagcgcctccgcctcggctcagggaagtgcacgattcatatgccttactggttgctgagtcatggagagagactgttcagctctatgaagatgaagtcagggagttagaagaagcgctgcggcgcggtcaagagagtaggctccaggcggaggaggagacaaggttatgtgcccaggaagctgcactccggcgcgaggctctgggccttgaacagctccgggcgcgtcttgaagacgccttgctgagaatgagggaggagtatggtattcaggccgaagagagacagagagtcatcgattgcctcgaggacgagaaagcaacgttgaccctcgcaatggctgactggctgcgggactaccaggatctcttgcaggttaagactgggctatctctcgaggtagccacctacagagccctgctggagggtgagagcaatcctgagattgtcatatgggctgaacatgtggaaaatatgccatccgaattccgcaataagagttaccactacaccgactcattacttcagcgggagaatgagcgaaatctcttctctaggcaaaaagcgcctttggcctcattcaatcacagctctgctctatatagtaatctaagcggccacaggggatcacagaccggcacatcaataggtggcgacgcacggcggggcttccttggctccgggtattcgtcttccgccaccacccagcaggaaaactcctacgggaaagccgtttctagccaaactaacgtgcggaccttcagccccacgtacggccttttgaggaataccgaggctcaagtaaagaccttccccgaccgccccaaagctggcgatactagagaagtgcctgtgtatataggagaggactccactatagctagagaaagttatcgggacaggagagacaaggttgccgctggggcttcagaatctacccgaagcaatgaacggaccgtcattctgggaaaaaaaacagaagtgaaggctacaagggaacaggaaagaaatcggcccgagaccatcaggaccaagccggaggagaaaatgttcgatagtaaggaaaaggcatccgaagagcggaatctgaggtgggaggaactgacaaagcttgataaagaggcccggcagagggaatcacagcagatgaaggaaaaagcaaaggagaaagactcacctaaagaaaagagtgtgagggagcgcgaagtgcccattagcctggaggtatcccaggaccgaagagcggaagtgtcacctaagggattgcaaactcccgttaaggatgcaggcggtgggacaggcagagaagccgaggctcgagagcttcgctttcggctcggcacctccgatgcgaccggctccctacagggggattccatgactgagaccgtagcagagaatatcgttacttctattctcaaacagttcactcaatcacctgaaacagaggcttctgctgattcttttcccgataccaaagtgacatatgtggatagaaaagagctgcctggagaaagaaagaccaagacggagatcgtagtggaaagcaaacttactgaggatgtggacgtttccgacgaagcaggcctggactatctcctgagcaaggatataaaagaagtcggtcttaaaggtaaatccgccgaacagatgattggagacattatcaatctgggcttgaaaggcagagaggggcgcgccaaggttgtcaacgttgaaatcgtcgaggagcccgttagctacgtaagtggtgaaaaacccgaagagttttccgtgccctttaaggttgaagaggtcgaagacgtgagcccaggcccttgggggctcgtaaaagaggaagagggctacggtgaaagcgatgtaacatttagtgtgaatcagcatcgccggacaaaacagccccaggagaacaccacccacgtggaggaggttactgaagctggggacagcgaaggtgagcaaagctacttcgtatccaccccagatgagcatcccggagggcatgatcgcgacgacgggtccgtatatggccaaatccatatcgaggaagaatccaccattagatacagttggcaggacgaaattgtgcagggaaccaggcggaggacccagaaagacggggctgtcggtgagaaagtcgtaaagccactcgatgtccctgcccctagcctggagggcgacctgggaagcacgcactggaaagagcaagcccggtctggcgagtttcacgcagagcccacagtgattgaaaaggagattaaaattccacacgagttccatacatcaatgaagggtatttcaagcaaggaaccccggcaacaattagtggaagtcataggccagcttgaagaaacactgcctgaacgcatgcgagaggagctctcggcccttaccagagaagggcaaggagggcccggaagtgtgtccgtggacgtaaagaaagtgcagggtgccggcggctcatctgttacactagtagccgaagttaacgtgtcacaaaccgtagatgccgaccgtctggacttagaagagttgagtaaggacgaagcaagtgagatggagaaagccgtggagagcgtggtaagggagagcctctcccggcagcggtcaccagcgccggggtccccggacgaagaaggcggagcagaagccccagcggccggcattcgtttccggcgctgggccacacgagaactgtatatcccatcaggggagtcagaggtcgccggaggcgcttctcacagttctgggcagcggaccccccagggccccgtatcggcgaccgttgaagtatcttcccccacaggcttcgctcaaagccaggtgctggaagacgtttctcaggccgccaggcacatcaagttgggacctagtgaagtatggaggaccgagcgcatgtcgtatgagggaccaaccgcagaggtggtggaagtatcggcaggcggggacttatctcaggccgcctcacctaccggtgcgagcagatctgtaaggcacgtgacattgggaccagggcagagcccgctgtcacgggaggtgattttcctgggtcccgctccagcttgcccagaagcttggggctctcccgagccagggccggcggagtcttctgctgatatggatggcagtggccggcacagtacattcggctgtagacagtttcatgccgagaaggagatcatttttcagggacctataagcgccgcgggtaaggttggcgactactttgcaacagaagaatccgtcgggacacaaacctccgttcgtcagcttcaactgggtcccaaggaaggcttttctgggcagattcagtttacagcccccctgagcgataaagtggaactcggcgttataggcgactctgtccacatggagggccttcccggctctagcacaagtattaggcacatcagcattggcccccagcggcatcagaccacacagcagattgtttatcatggcctggtgccacaactgggcgaatctggtgactctgaaagcacagtccatggcgaggggtccgcggatgtccatcaggcgacccacagccacacctctggtaggcagacagtaatgaccgagaaatcgacttttcagtccgtggtatctgaaagtcctcaggaggactccgccgaggatacctccggggccgaaatgaccagtggggtgtcccggtccttcaggcatatcaggctgggccctactgagaccgagacgtctgagcatatcgccatcaggggacccgtgagccgaacattcgtactggccggtagtgccgacagcccagagctgggtaagctggccgacagttccagaacgctccggcatattgccccaggccccaaggaaacatcctttacgtttcagatggacgtatcaaacgtggaggctatcagaagccgaacacaggaggcgggggcacttggggtgtcagatcgagggagctggagagacgcggactcccggaacgatcaggcagtcggagtgtcctttaaagcatccgccggagagggggatcaggcgcatagagaacagggcaaagagcaggccatgtttgacaaaaaagtgcagctgcaaagaatggttgatcaacgctcggtgattagcgatgaaaaaaaagttgctctgctctacttggacaacgaggaggaggaaaatgatggacattggttctag

SEQ ID NO: 51270 - DNA, 567 bp, Artificial Sequence
  Description of Artificial Sequence: Synthetic coding sequence
atgaacggcgacgacgccttcgtgcggcggccccgggtgggcagccagattcccgagaaaatgcagaaggctttcgacgatatcgccaagtatttctctgaaaaagagtgggagaagatgaaggcttctgagaagatcatttatgtttacatgaaacgcaagtatgaagccatgacaaagttgggcttcaaagccacacttcccccatttatgaggaacaaacgggtagctgacttccagggtaacgatttcgataacgaccctaaccgggggaaccaggtggagcacccgcagatgacctttggcagattgcaagggatattccccaaaatcacgccagaaaaaccagcagaagagggaaacgacagcaagggggtaccagaagctagtggccctcagaataacggcaaacagttaagaccatctgggaaactgaatacttccgagaaagtgaataagaccagtggaccaaagagagggaaacatgcctggactcaccgggtccgcgaacgcaagcagttagtgatttatgaggagatcagtgatcctcaagaggacgacgagtag

SEQ ID NO: 51271 - DNA, 885 bp, Artificial Sequence
  Description of Artificial Sequence: Synthetic coding sequence
atgaaggaccggctgcaggagctgaagcagcggaccaaggagatcgagctttccagagactctcatgtcagcaccactgagacagaggagcagggagtttttctccagcaggctgtgatctacgagcgtgaaccagtggctgaacgtcatcttcacgagattcaaaaactgcaggagagtatcaacaacctggccgacaatgtgcagaagttcggccagcaacagaagagcctggtggcttcaatgagacgcttctccctgctgaaaagagagagtaccatcacaaaggaaattaagatccaggcagagtatataaacagatccctcaatgatctcgtcaaggaggtcaaaaagtcagaggttgaaaacggtccttcttccgttgtgacacgcattctcaaatcacaacatgccgccatgtttcgacacttccagcagatcatgtttatctataatgataccatcgctgcaaaacaggaaaaatgcaagacctttatattgcggcaactagaggttgcaggaaaagaaatgagtgaggaggatgtgaatgacatgttgcatcaaggaaagtgggaagtttttaatgaatcactgttgaccgagatcaacataactaaggctcagctgagcgagatagagcagcgacacaaggagcttgtgaaccttgagaaccagattaaggatctgcgggatttatttatccagatttccctcctagtcgaggaacaaggtgagtctattaataacattgagatgaccgtaaattcaacaaaagagtatgtgaataatactaaggagaaattcgggctcgccgttaagtacaaaaaaaggaacccctgtcgtgtcctctgctgctggtgctgtccatgttgtagcagcaaatag

SEQ ID NO: 51272 - DNA, 393 bp, Artificial Sequence
  Description of Artificial Sequence: Synthetic coding sequence
atggagaccgtggtgaccaccctgccccgggagggcggcgtgggcccttccagaaagatgctcttactgttactactgctgggaccaggcagcggcttaagtgccgttgtatcacagcacccttcccgggtgatttgtaagtctgggacaagcgtgaacatagaatgccgttccctggattttcaggccaccactatgttctggtacaggcagctgcgcaagcaatctctgatgctgatggcaacttccaacgaagggagcgaagtgacttatgaacagggggtgaagaaggataagtttcccatcaaccaccccaacctaaccttttccgctttaacagtaacttctgcccacccagaagattctagtttttacatctgttccgcccggtag

SEQ ID NO: 51273 - DNA, 345 bp, Artificial Sequence
  Description of Artificial Sequence: Synthetic coding sequence
accggcacccggctgctgggctgggtggccctgtgcctgctggccgccgggtgcttccacgccaaggtgacgcagactcctggctatctggtcaagggtaagggacggaagactaagatgtactgtacccccaagaatggacatacctttgtgtgctggtaccagcaaaatcagaacaaggagttcatgttcctcattagcttccagaacgagcaggtgttacaggaaatggagatgcacaagaaaagattctctagccagtgcccaaaaaacccaccttgttcgctggcaatcctgtcatcagaaccaggggatacggctctgtacctatgtgccacatcgtag

SEQ ID NO: 51274 - DNA, 339 bp, Artificial Sequence
  Description of Artificial Sequence: Synthetic coding sequence
atgaccatccggttcctgcggcaggtggccttctacttcctggaggccgggctgaaagaggccgagatctatcagaccccacgtcacagggttataggcgccgggaagaagatcacactcgagtgtagccagacgatgggccatgacaaaatgtattggagccggtcccggaatggaataacgccccaccccccattcttgtgggtgaattctactgaaaagggcgacctgtgcagtgagtcaaccgtaagcagaatccgcatcgaacgctttcctcttacactcgaaagcgcctcccccagccacacatcccaatacctgtgtgcaagctcagaatag

SEQ ID NO: 51275 - DNA, 525 bp, Artificial Sequence
  Description of Artificial Sequence: Synthetic coding sequence
atggccgacgccgccgccaccgccggcgccggcggcagcggcaccagatccggatctaagcagtctaccaaccctgccgacaactaccacctggctaggaggaggacactccaagttgtggtgtcttcacttttaacggaagcggggttcgagagcgcagaaaaggctagtgttgaaaccctgacggagatgctgcagtcatatatctcggagatcggcaggagtgcaaagtcctattgtgaacacacagccagaacccagcccactctgtcggatatagttgtgaccttggtcgaaatgggtttcaacgtcgacactctgccagcctacgccaaacgcagccagaggatggttatcacagccccccccgtcaccaaccaacccgtgacaccgaaggctctgacagcagggcagaacaggccgcacccgccacatatcccctcccattttccagagttccccgaccctcatacctacatcaaaacaccagtctctgacgaggccctgggactgagggtggtgtag

SEQ ID NO: 51276 - DNA, 1017 bp, Artificial Sequence
  Description of Artificial Sequence: Synthetic coding sequence
atggccgacgccgccgccaccgccggcgccggcggcagcggcaccaggagcggctctaagcagtcgacaaaccctgccgacaattatcatttggcacgaagaagaacgcttcaagtggtggtgtcctctctgctcaccgaagccggtttcgaatcagccgagaaggcgagtgtggaaacgctgaccgaaatgctccagtcttacattagcgagattggtaggagtgcgaagtcttactgtgaacataccgctagaacacagcccaccctctccgacatcgtggtgactttggtagagatgggatttaacgtggatacgttgcctgcctatgcaaaaaggagtcaacggatggtgattaccgccccccccgtgacgaatcaaccggttacccccaaggcccttacagccggccagaatcggccacatcctccacatattccaagtcacttccctgagtttcccgatccccatacatacattaagacacctacatacagggagcccgtgtctgactaccaggtccttcgggaaaaggcggctagccagcgacgggatgtggagcgggccttgacccgcttcatggctaagaccggggagacacagtcgctgttcaaagacgatgttagtacctttcctctgatcgccgcccgccccttcaccattccctatttaaccgccctccttcctagtgaactggaaatgcagcagatggaagaaacagattcatctgagcaggatgagcagaccgatacagaaaatctcgcactgcatatttctatgatcgagtccagatcagttacccaggccggcgtccagtggcaggacttgggctcattgcagccccctcctcccggattcaagcgattttcttccttaagcctcctgtcttcatggaattaccggcggatactagaaccaagaagacggactccccttagttgtagccgtacaccaccatgtagggtggccggaatgggtagaaggacctcctctattactctcatttgcggccgatag

SEQ ID NO: 51277 - DNA, 936 bp, Artificial Sequence
  Description of Artificial Sequence: Synthetic coding sequence
atggccgacgccgccgccaccgccggcgccggcggcagcggcaccaggtccgggtccaagcagagcaccaaccccgccgacaattatcaccttgcccgccggcgcacactccaagtggtagtgtcatcactactgacggaagctggtttcgagtccgcggaaaaggcatctgtggaaaccttaaccgagatgctgcagtcatacatttcagagattggcaggtcagccaagagttactgtgagcacaccgcccgaacacagccaaccttgtctgacatagtggtgactttagtcgagatgggttttaacgtggacaccctccccgcttacgcgaaaagatctcagcgcatggtgatcacagcacctcctgtgaccaaccagccagtgaccccaaaggctctgacagctgggcagaaccgcccacaccccccccacatcccttctcactttcccgagtttcctgaccctcacacatatatcaaaacacccacctatagagaaccagtctctgactaccaggtgctgcgggaaaaagcagcttcgcagaggcgggacgtggaacgtgcattgacccgctttatggcaaagactggcgaaacccagagcctgttcaaagacgacgtgtccaccttcccattgatcgctgcccgcccatttacaatcccatatttgaccgcccttttgcctagtgagctcgaaatgcagcagatggaggaaactgactcttcagaacaggacgagcaaactgatactgaaaacttggctctccacatcagtatggaagactccggtgccgaaaaagagaatacctcggttctgcagcaaaacccgtccctgtcaggctcccggaacggggaggagaacatcattgacaatccatacctcagaccagtgaaaaaacctaagattcgaaggaaaaagccagacacattttag

SEQ ID NO: 51278 - DNA, 1017 bp, Artificial Sequence
  Description of Artificial Sequence: Synthetic coding sequence
atggccgacgccgccgccaccgccggcgccggcggcagcggcaccaggtccgggtcaaaacagagcaccaaccccgcagacaactaccacctggctcggagacgcactctgcaggttgtggtgtcatcactgctcaccgaagctggattcgagagcgccgagaaggcctccgtggaaacattgactgaaatgttgcagagttatatctccgaaatcggcaggtctgccaaaagctattgcgagcatacagctagaacccagccaaccctatctgatatagttgtgacattggtggagatgggctttaatgtggatacactacctgcttatgcaaagcgttcacagaggatggttatcaccgcaccacctgttacaaaccaacccgtcactcctaaagctctcacagctggtcagaatcgcccgcatccccctcacatcccctctcactttcctgagttcccggacccccatacatatatcaaaactcccacttacagagagccagtctcggactaccaggtgttacgcgaaaaagccgcatctcagaggagggatgtggagagggccttgaccagattcatggcaaagacaggagagacccagtctttattcaaagacgatgtttctacctttccgcttatcgccgcacgcccattcacgatcccttatttgaccgccctcttgcccagcgagttagaaatgcaacagatggaagaaaccgacagcagtgaacaagacgagcagactgataccgaaaacctcgcactccatatttcaatgatcgaaagccgctccgtaacccaggccggagtccagtggcaggaccttggttccctacagccgccaccccctgggttcaagagatttagctctctttctctgttgtccagctggaactatagacggatcctcgaacccagaagaaggaccccactgtcctgctcccgcacccctccatgccgggttgccgggatgggacgaaggactagctcaataaccctgatttgcggccgctag

SEQ ID NO: 51279 - DNA, 795 bp, Artificial Sequence
  Description of Artificial Sequence: Synthetic coding sequence
atggagagcggcaagaccgccagccccaagagcatgcccaaggacgctcagatgatggcccagattctgaaagacatgggcattaccgagtacgagccgcgcgtgattaatcaaatgctggaattcgcttttcggtatgtgactactatcttagacgatgccaagatttactcttctcatgcaaagaaagctaccgtggacgccgacgacgttagactcgctatccagtgcagggccgaccagagcttcacctcacctccacctcgcgactttttgctagacatcgccagacagaggaaccagaccccgctgcctttgattaagccttacagcggcccgcgcttgcctcctgataggtattgccttaccgcaccaaactatagactgaaaagcctgcagaagaaggcctccacctcagcaggccggattacagtccctaggctgagtgtgggctccgtcacttctcggccctctacacccaccctcgggaccccaactccccagaccatgagcgtgtccaccaaggttgggacgccaatgagcctgactgggcagaggtttaccgtgcagatgcctacgtcccaatctcccgcggtgaaggccagtatccctgcaacatccgccgtccaaaatgtgttaataaacccatcacttattggctcgaaaaatatcctgattacaaccaatatgatgtcctcccagaatactgccaatgagtcttcaaatgcccttaagaggaagcgagaggatgatgatgatgacgacgacgacgacgatgattacgacaacctatag

SEQ ID NO: 51280 - DNA, 1374 bp, Artificial Sequence
  Description of Artificial Sequence: Synthetic coding sequence
atggagttcctgctgggcaaccccttcagcacccccgtgggccagtgtttggagaaagccacagatgggtcccttcaatcagaggactggacattgaacatggaaatttgtgacattattaatgagactgaggagggccctaaagacgctatccgcgccctgaagaagcgcttgaacggaaatcgcaattaccgggaggtcatgctagccttgaccgcatgggctgacgcttttcgtagttccccagacctgactggtgtggtgcatatttacgaagagttgaaacggaaaggagtggaattcccaatggccgatcttgacgctctcagtccgatccatactcctcagcgcagcgtccccgaggtcgatcccgccgccaccatgccgagatctcaatcgcagcaaaggacttcagctggcagctattcttctccaccaccagcgccatattctgctccacaggcgccagccctctcagtgactggacccattactgccaactcagaacaaattgcaagacttcggagcgagctcgatgtagtgcgaggcaacacaaaggttatgtcggaaatgttgaccgaaatggtgccaggacaagaggattcttcggatctggaactgctccaggagctgaatcgcacatgccgtgctatgcagcaaaggatcgtggaattgatttccagagtgagcaacgaggaggtgacagaagaactactccatgtcaacgatgatttgaataatgtgttcctaagatacgaacggttcgaacgctatcgaagtggaagatcagtgcagaatgccagtaacggggtgttgaacgaagttaccgaagacaacctgatcgatctggggcctggatcaccggccgtcgtgtctccaatggtgggcaacactgcccccccttccagcttgtcctcccaattggctggtctggatctgggaactgagagcgtgtctggaacgttgtcgtccctgcagcagtgcaaccctcgtgacggctttgacatgtttgctcagaccaggggtaacagcctggccgagcagagaaagacagttacctacgaggatccacaggccgtgggaggcctggctagtgcgctagataaccgcaagcagagctccgaaggaatcccagttgcccagccctcagtaatggatgatattgaggtctggctgcgaaccgacttgaaaggtgatgacctggaagaaggcgtgactagcgaggaattcgacaagttcttagaagagcgtgcgaaggctgctgagatggttccggatctcccgtccccccccatggaagcccccgcccctgcttcaaacccctccggacgaaagaaaccagaacgcagtgaagacgccctctttgcactgtag

SEQ ID NO: 51281 - DNA, 1524 bp, Artificial Sequence
  Description of Artificial Sequence: Synthetic coding sequence
atggagttcctgctgggcaaccccttcagcacccccgtgggccagtgtctagagaaggcgacagacgggtcgctccagagcgaggactggactctgaacatggagatttgtgacatcattaatgagacagaagaaggtccgaaggatgcgatccgtgctctgaaaaagagactgaacggcaatcgcaattatcgggaggtgatgttggccctcactgtcttggagacctgcgtcaagaattgtgggcaccgtttccacatcctggtcgcaaacagagactttattgacagcgtcctcgtcaaaattatttcaccaaaaaataatccacccacgattgttcaggataaggtgctagctcttatccaagcttgggccgatgctttccggtccagccccgatctcaccggagtcgtgcatatttacgaggaactgaaaaggaagggggtggagtttcccatggcagatcttgatgctctcagtccgatccacacccctcagcgctccgtcccagaagttgacccagccgccaccatgcctaggtctcagtctcaacaacgaacatccgctggtagttattctagccccccacccgcaccatatagtgccccacaggcccctgctctgagcgtgactgggcctatcactgcaaacagcgagcagatcgcccgtctccgctctgagctcgatgtggtcagaggtaataccaaggtgatgtccgaaatgctgacagaaatggttcccggacaggaagactccagcgatctcgagctcctacaagaactgaaccggacctgtcgggccatgcagcagaggatcgtcgagctcatctccagagtgtccaacgaggaagtgaccgaggagctcctgcacgtcaatgatgacctgaacaatgtgttcctgcgctatgagcgcttcgaaaggtatcggtctggcaggtccgtgcaaaatgcaagcaatggggttctgaatgaagtcaccgaagataatctgattgacctgggacctggctccccagccgtggtgtcccctatggtaggtaacacagcccctccaagcagtctgagtagccaactggctggcctcgacctggggacagagagcgtaagcgggactctgagtagccttcagcagtgtaatccgcgggatggttttgatatgtttgcacaaaccagaggaaactccctcgccgaacaaagaaaaactgttacgtacgaagacccacaggctgtcggtggactggcaagtgccctggataaccgcaagcaaagcagcgaaggaatccctgttgcccaaccttcagtcatggacgatattgaagtctggctacggactgacttgaagggcgacgaccttgaagaaggggttacaagcgaagaattcgataaattcttagaagagagggccaaggcagcagagatggttcccgatctgccgagcccccccatggaagccccagcccccgcctctaatccttcaggaagaaagaaacccgaacgctccgaggatgcactgttcgctctgtag

SEQ ID NO: 51282 - DNA, 1389 bp, Artificial Sequence
  Description of Artificial Sequence: Synthetic coding sequence
atggagttcctgctgggcaaccccttcagcacccccgtgggccagtgcttggagaaggcgactgatgggagcctacaatctgaagattggactctgaacatggagatttgcgacatcattaatgagactgaggagggccccaaggacgccattcgggccctaaagaagcgactgaacggcaatagaaattacagggaagtgatgcttgccttgaccgttctggagacgtgtgttaagaattgtggacatagatttcacatcttggtggcaaacagagattttatcgattccgtgctcgtgaagatcatatccccaaagaataacccaccgacaatcgtccaggataaggtgttagccctgatccaaagcgttcccgaagtggatccagccgcaaccatgccacgatctcagtcacaacagcggacttcagcgggcagctatagttcccctccccctgcaccttacagcgcaccccaagcacccgcactgtccgtgacaggacccataactgcaaactccgagcagattgcacgtctcagatcagagcttgacgtggtgcgggggaacactaaggtaatgtctgagatgctcactgaaatggttccaggccaggaagattcctctgacttggaactcctgcaggaactgaatcgaacctgccgggctatgcagcagaggattgtggaactgatctccagagtgagtaacgaggaagttacggaggagctgctgcatgtgaatgatgatctgaacaatgtttttcttaggtatgaacggtttgagcggtaccgcagcgggcgcagtgtgcaaaatgcatcgaacggtgtccttaacgaggtcacggaagacaatctgattgatctgggacccggcagtccggctgttgtgagcccaatggtaggcaacaccgctcccccatcctccttatcttcacagctcgctggtttggatctcggaacagaatcggtcagtggaacgctgagttcactccagcaatgcaaccccagagacggcttcgatatgttcgcccagacgcgagggaattctttagcagagcagagaaagactgtgacctacgaggatcctcaggcggttggcggtctggcaagcgcactggacaatagaaaacagtcatctgaggggatccctgtggcccagccttccgttatggatgacatagaggtgtggctaagaacagatctcaaaggcgatgatctggaggagggtgttaccagcgaggaatttgacaagtttctggaggagagggccaaagccgcagagatggttcctgacctgccctccccccccatggaagccccagcacctgcaagcaacccatcaggccgtaagaaacctgagagaagcgaggatgcgctcttcgcactgtag

SEQ ID NO: 51283 - DNA, 1452 bp, Artificial Sequence
  Description of Artificial Sequence: Synthetic coding sequence
atggagttcctgctgggcaaccccttcagcacccccgtgggccagtgtctggagaaggcaacagacggcagtttgcagtctgaggactggacactgaacatggaaatatgcgacattatcaacgagacggaagaaggcccaaaagacgccataagagccctcaagaagaggcttaatggcaatcgaaattatagagaagtcatgctggcacttacagtccttgagacctgtgtaaagaactgcggccacaggttccacatccttgtcgccaatcgcgattttattgactctgtcctcgttaaaatcatttcaccaaaaaataacccaccaacaatcgtgcaggacaaagtcttggccctgatccaggcttgggctgacgctttccggagcagccccgaccttaccggagtggtgcatatctacgaggaactgaagaggaagggggtcgaattccccatggccgaccttgacgctctgtcccccattcacaccccccagcgtatcgctagacttaggtccgagcttgatgtggtccgtggaaatactaaggtgatgtctgaaatgctgactgagatggttcccgggcaggaggacagttcagacctagaactgctacaggaactgaacaggacgtgtcgcgccatgcagcagcgaattgtcgagttaatttccagagttagtaacgaagaggtgactgaggagctactacatgtgaacgacgatttaaacaatgtgttcctccggtatgagcgttttgagcggtacagatcagggcggagtgtccagaatgcgtcaaacggggttctgaatgaggttaccgaagacaacctgattgacctggggcctggatcacctgctgtggtttcgccaatggtgggcaacacagctcctccatccagtttgagctcccagttagcaggtttggatttgggaacggaaagcgtatccggcacactatcttcactgcagcagtgtaacccgcgggacgggttcgatatgttcgcccagacacgcggtaattctttagctgagcagcggaagaccgtgacgtatgaggaccctcaggcagtggggggcctagcctcagcactggataaccggaaacagtcaagcgagggaacattcctgtcctctgcccagaagcgaggaaggggcggagaaagcgatctagagcctattgactcctggctgatcacgcaggggatgattcccgtcgcccagccttctgtgatggatgacattgaggtatggctgcgcacagatcttaagggggatgacctggaagagggcgtgaccagcgaagagtttgataagtttttggaggagcgcgccaaagctgccgaaatggttcctgatctcccctcaccaccgatggaggcgccagctcctgcgagcaatccctctgggcggaagaaaccggagaggtcagaggacgccctgtttgcactgtag

SEQ ID NO: 51284 - DNA, 834 bp, Artificial Sequence
  Description of Artificial Sequence: Synthetic coding sequence
atggagttcctgctgggcaaccccttcagcacccccgtgggccagtgtctggagaaggccacggacggatctctccagtcagaggattggaccctcaacatggagatctgcgatattataaacgaaactgaagaaggtcctaaagacgcaattcgagctctcaagaagcggttaaacgggaatcggaactacagagaggtgatgttagcattgacagcctgggcagatgccttcagaagctctcctgacctgacaggcgtcgtacacatctatgaagagctgaaacgaaaaggggtagaatttccaatggcagacctcgatgccctgtcccctattcacacaccccaacgcagtgtgccggaggtggaccccgccgccacaatgccacgaagtcagtctcaacagcgaacatccgcaggcagttatagcagtccaccacccgctccctacagtgcgccacaggcgcccgccctgtcagtcacaggacccatcacagcgaacagtgagcagatagctcgcctccgaagtgaactggatgtggtcaggggcaacactaaagtaatgtccgaaatgcttactgagatggtgccagggcaggaagatagcagcgaccttgagctactacaggaactgaatcgaacctgtcgagccatgcagcagcgcatcgttgagctcatctcccgggtgagcaacgaggaagtgaccgaagaacttctccacgtgaacgacgacttaaacaatgtgttcctgcggtacgaaaggtgggaaccagacttttttttctttttctttctcgagaagatcgttgctatcactgagggatttctctcctag

SEQ ID NO: 51285 - DNA, 1170 bp, Artificial Sequence
  Description of Artificial Sequence: Synthetic coding sequence
atggagttcctgctgggcaaccccttcagcacccccgtgggccagtgccttgagaaggctaccgacggctcccttcagtcggaggattggaccctaaatatggagatctgtgacataattaatgagacagaggagggtccgaaggacgctatacgcgccttgaagaagagactgaacggtaatcgcaattatagggaggtcatgctggcgctgactgtcttggagacttgcgtcaagaattgtggccaccgcttccacattttagtcgctaatagggacttcattgactcagtccttgtcaaaatcattagtccaaaaaataatccccctacaatcgttcaggacaaagtgttggcccttatccaaattgcacggctccggagcgaactggacgtcgttagaggaaatacgaaagtcatgtccgagatgctgaccgagatggtgccaggtcaggaggactcctcagacttggagctcttgcaggaactaaaccgtacctgcagggccatgcaacagagaattgtcgaattgatcagccgggtatccaatgaagaggttacagaagaacttctacatgtgaatgatgacttgaacaatgtctttctgcgttatgagaggttcgagaggtataggagcggccgaagcgtacagaacgcgtccaatggggtgctgaatgaagtgactgaagataatctaatcgacctgggtcccggtagcccagctgtggtgtcgccaatggtcggcaataccgcccctccctccagcctaagcagccagctggccggcctggacctcggcactgaaagcgtgagtggaacactgtcttcacttcaacagtgtaaccctcgcgacggcttcgatatgttcgcccagacgcgggggaatagtttagctgagcaacgcaaaaccgtgacctacgaggatcctcaggcagtagggggcctggcctcagcactggataatcggaagcaatcatcagaagggaaaggtgatgatctcgaggagggcgtcacatcagaagagtttgacaagttcttggaggaacgcgccaaggctgccgagatggtgcctgatctcccaagcccacctatggaggcccccgcaccagcttcaaaccccagtggccgaaagaagccagaaagaagcgaggacgctctgtttgccttatag

SEQ ID NO: 51286 - DNA, 1167 bp, Artificial Sequence
  Description of Artificial Sequence: Synthetic coding sequence
atggagttcctgctgggcaaccccttcagcacccccgtgggccagtgcctggaaaaagccacggacggatccttacagtcggaggactggacgctgaatatggagatctgtgacattatcaacgagaccgaagaaggaccaaaggacgcaatcagggctctcaaaaaacgcctgaatggaaatagaaactatcgggaggtcatgttggcactgaccattgcgaggctgaggagcgaactggacgtggtgcggggcaacacaaaggtcatgagcgagatgctcacggagatggttccaggccaggaagactcctccgaccttgagttactccaggaactgaatcgcacatgtagggctatgcagcagagaatagtggagttgatctcgagggtcagcaatgaggaagtgacagaagaactgcttcatgtaaatgatgacctgaacaatgtgttcctgagatacgagaggttcgagcggtatcgctctggcaggtctgtacagaatgcctctaatggcgtccttaatgaagtgactgaagataatttgatagacctggggccggggtcaccagcagttgtgtctcctatggtgggaaataccgctccgccatcctcccttagcagccaactggccggcctggacctaggcactgagagtgtcagcgggactttgagttccctccagcagtgcaatcccagagacgggtttgatatgttcgcgcagacgcgcgggaattctctggcagagcagcgcaagacggtgacttacgaagacccacaggccgttggcgggttagcaagcgccctagacaaccggaagcagtcctctgaaggtaccttccttagcagcgcccagaaaagggggcgaggaggggagtcagatctcgagcccattgacagctggctgattacgcaggggatgatccccgttgcacagccaagcgtaatggatgatatcgaggtatggttgcggactgatctgaagggcgacgacctggaagagggcgtcacaagcgaagagttcgataagttcctggaagagagagcaaaagctgctgaaatggtacccgatttgcctagcccccctatggaagcccccgcacctgcctctaacccgtccggacgaaagaaacctgaaagatccgaggacgctttattcgcactctag

SEQ ID NO: 51287 - DNA, 1374 bp, Artificial Sequence
  Description of Artificial Sequence: Synthetic coding sequence
atggagttcctgctgggcaaccccttcagcacccccgtgggccagtgtttggagaaggcaaccgacgggagcctccagagcgaagattggacacttaacatggaaatttgcgacattatcaatgaaaccgaggagggacctaaggacgctatcagagctttgaagaagcgcttgaatggcaatcgcaattaccgggaggtgatgttagcactgacggcgtgggcagatgccttcagatctagccccgatctaacaggagttgtccatatctatgaagaattgaagcgaaaaggagtcgagttccccatggccgacctcgatgcgctgtcacctatccacactccacagaggagcgttcccgaagtcgacccagccgccacgatgccacgaagccaaagccagcaaaggacgtctgcgggcagttattccagccctccgcccgctccttactctgccccccaggcacccgccctgagcgtcaccgggccaataaccgcaaacagtgaacagatcgcacgcctaaggtctgagctggatgtagtaagaggcaacaccaaggtcatgagcgagatgctgacggaaatggttcccggtcaggaggacagctctgacttagaactccttcaggagctgaatagaacctgccgcgctatgcagcagaggatcgtggaactcatcagtagagtctccaacgaggaggtgacagaggaacttctgcacgttaatgacgacttaaacaacgtattcctgaggtatgagagattcgagaggtataggagtgggcggagcgtgcagaatgcctccaacggagtgctgaacgaggtgaccgaggacaatctgatagacctgggacccggatcccccgcagtagttagtcccatggtgggaaacactgcgcccccatcttctctgagtagccagcttgctggcttggaccttggcactgagtctgttagtggcacactgagtagcctccagcaatgcaatcctagggatggatttgacatgttcgcccagaccagggggaattcactggcagaacagcgcaaaactgttacttacgaagatcctcaggccgttggggggttggcctccgcacttgacaacaggaagcaatcttctgaagggatcccggttgcccagccgagtgtgatggacgatatcgaagtctggctccggactgaccttaaaggcgacgatctggaagaaggtgtgacaagcgaagagttcgataaattcctggaggaacgcgctaaggctgccgagatggtccccgatctgccaagccctcccatggaggcgcccgcccctgcgtccaatcctagcggaagaaaaaagcccgagcgttccgaagatgcactgtttgcactgtag

SEQ ID NO: 51288 - DNA, 2571 bp, Artificial Sequence
  Description of Artificial Sequence: Synthetic coding sequence
tgatgcaccaacgaggccctggtggacgagatcatgatgaccctgaaacaggcatttacagtggccgctgtgcaacagaccgctaaggcgcccgcgcagctgtgcgaaggctgtcccctccagagcttacataaactgtgcgagcgcatcgaagggatgaatagctccaagacaaaactcgagcttcagaagcatctcacaaccctcacaaaccaggagcaggccaccatcttcgaggaagttcagaaattgcggccaaggaatgagcagagggaaaatgagcttattattagcttcctgcgctgtctgtatgaggagaaacagaaggaacacattcacattggagagatgaagcagactagtcagatggctgccgagaatattggcagtgagctccccccatcggctacccgattccgcttagatatgctcaagaataaggccaagcgctcattaacagaaagtttggagtcaatcctgtctcgcggcaacaaggccagaggcttacaggaacactcaatttctgttgacttggatagcagtttgagcagcactctgagtaacacgtccaaagagccatcagtgtgtgaaaaggaagccctccccatatccgaaagctcattcaaactcctagggtcgtctgaggatctgtcctccgatagtgagtcccatctgcccgaggagcctgcaccactctctccccagcaggcctttcgccggagagctaacactctgtcacacttcccaattgaatgtcaggaacctccacagcccgcgcggggaagtcccggcgttagccagcgtaagctcatgaggtaccactcggtgagtactgagacaccacacgaaaggaacatatcctatcgcaacgctcttcggaagaaactccattcctcgtctagcgtccctaacttcctgaaatttcttgcccccgttgatgaaaacaacacctctgactttatgaacaccaagagagattttgagtccaaggccaatcatttgggagattctggagggacgcccgtcaaaacccgtagacactcatggcgccagcagatctttctccgagtcgccacaccgcaaaaagcatgcgacagtagctcaaggtacgaagattactcagagctaggcgagttgcccccaaggtcgcccctcgagcctgtttgcgaagacgggccttttggcccacctcctgaggagaagaagcggacgagccgagagctaagggaactgtggcagaaggctattcttcagcagatcttactcctgagaatggagaaggaaaatcaaaaattacaggctagtgaaaacgatctgctgaataagcgactcaagctggattacgaggagataacgccttgtctgaaagaggttaccactgtatgggagaaaatgttgagtacccccggcaggtcaaagatcaaatttgatatggaaaaaatgcactctgccgtgggtcagggcgtgcctaggcaccataggggcgagatttggaaattcttagcagagcagttccatctaaaacaccagttcccgtccaaacagcagcctaaagatgtgccatacaaggaactccttaagcaactgacatctcaacagcacgccatactgatcgacttaggcaggactttcccgacacatccctatttcagcgctcagttaggggctggacagctgtccctgtacaatatactgaaggcctactctctgctggatcaggaggtggggtactgccaaggactttctttcgtggctggaatcctgctcctccacatgtctgaggaggaggcctttaagatgctgaagtttctaatgttcgacatggggctgcggaaacaatacaggcctgacatgattatcctacagatccagatgtaccagctatctcggctcttgcacgattaccacagggacttatataaccacctggaggaacacgaaatcggtccatccctgtatgctgcgccatggtttctgacaatgtttgccagtcagttcccgctcggattcgtagctcgggtgtttgatatgatatttctgcaggggaccgaagtcatcttcaaggttgcactgtcactgcttgggagccataagcctctcattctgcagcacgaaaacctggagaccatcgtggactttataaagtctactctcccgaacctcggacttgtgcagatggagaagactattaaccaggttttcgagatggacattgccaagcagttacaggcatacgaggtggaataccacgtactgcaggaagaattgattgacagcagccccctgtccgacaatcagaggatggacaagcttgagaagactaattcaagccttcgaaagcagaacctggatctgctggaacaactgcaagtcgctaatggcagaatacagagcctggaggccaccatagagaagttgctatctagtgaaagcaagctgaagcaggcaatgctgactttggaactggagcggtctgctttgctgcagactgtggaggagcttcggagaagatccgccgaaccgagcgacagggagcccgaatgcacccaacctgagccaacaggtgattag

SEQ ID NO: 51289 - DNA, 2682 bp, Artificial Sequence
  Description of Artificial Sequence: Synthetic coding sequence
atgttccccctgaaggacgccgagatgggcgccttcaccttcttcgctagcgcccttccccatgacgtctgtggctcaaacgggttgccccttaccccgaacagcataaaaatcttgggacggttccagatcctcaagaccatcacccaccctaggctttgccagtacgttgacatttctcggggcaagcacgagcggctggttgtagtcgctgagcattgtgagagatcgctggaagatcttctccgtgagagaaagcccgttagttgtagtactgtactctgtattgcattcgaggtgctgcaaggtctccagtacatgaataagcatgggattgtgcacagagccctgagtcctcataacatcctgctagatcggaagggtcacattaagcttgctaagttcggattgtatcatatgaccgcccacggggatgatgtggacttccctatcgggtacccttcctacctcgctcccgaggtgatcgctcagggaatctttaagacaacagaccatatgccatcgaaaaagcctctaccttcaggacccaagagcgacgtctggagcctgggcatcattcttttcgaactgtgtgttgggagaaaactgtttcagtctcttgacatatctgaaaggctgaaattcctgttgactcttgattgcgttgatgacaccctgattgttcttgccgaggagcatggctgccttgacattattaaggagctgcctgagactgttatcgatcttcttaacaagtgcctgacttttcatccgagcaagaggcccacgcctgaccagctcatgaaggataaggtcttcagcgaggtttctcctctgtatactccctttaccaaacccgcatccctattttccagcagccttcggtgcgcagatctgacgctccccgaggatatctctcagttgtgcaaggatatcaacaacgactacctcgccgaacgctctattgaggaggtatactacctctggtgcctcgctgggggagaccttgaaaaagagttggtgaataaagaaattatcagatccaaaccaccaatttgtaccttaccgaattttctgttcgaagacggcgagtcttttggccaagggagagacagaagctctcttctcgatgacaccacagtcacactgagtctgtgccagttgaggaaccggttgaaagatgtcggaggggaggctttctaccctctgctggaagatgaccaaagtaatctcccacactcaaactcaaacaacgaattgtctgccgctgccaccttacccttgatcatccgcgagaaggatacagagtatcagctgaaccgcattatcttgtttgaccgcttattgaaagcttacccttataaaaaaaaccaaatctggaaggaggccagagtcgatatcccaccattaatgagaggcctgacttgggcggctcttctgggcgttgagggggccatccacgccaaatacgacgctatcgacaaggatacccccatccccaccgatcggcaaatcgaggtggatatcccgcggtgccatcaatacgacgagctactgtccagccctgaaggccatgctaaattccgtcgggttttgaaagcctgggtcgtctcccatcccgacctggtgtactggcagggattggattccctctgtgctccattcctgtatcttaacttcaataacgaagcccttgcctatgcatgcatgagcgctttcatccctaaatatctgtacaattttttcctgaaggacaactcccatgtgattcaggagtacttaaccgtatttagccagatgatcgcatttcacgatcccgaattgtcaaatcacctgaatgaaatcggattcatccccgatctgtatgccataccctggtttctcaccatgttcacccatgtgtttcctcttcacaagattttccacctgtgggacactctgctcctggggaacagctctttccctttctgcatcggtgtcgcaatcctgcagcagcttagggaccggcttcttgctaacggatttaacgaatgtatcctgttgttctcagacctcccagagattgatattgagcgctgtgtgagagaatccatcaatctcttctgttggacccccaaatcagctacttatcgccagcacgctcaacctcctaaaccatccagcgacagttctgggggtagaagttctgccccatatttctccgcagagtgtcccgatcccccaaagacagacctgagccgcgagtctattcctctaaatgatctcaagtccgaggtcagtccccgcattagtgccgaggacctcattgatctgtgcgagctaacggtcacaggacacttcaaaacaccaagtaaaaaaaccaagtctagcaagcccaaactgctcgtggtggatatacgtaattcagaagatttcatcagaggccacatctctggaagcataaacatcccattctcagccgcatttaccgccgagggggaattgacccaagggccttacacggccatgcttcagaattttaagggaaaggttatcgttatcgtggggcatgtcgcaaagcacacagcagaatttgccgcacatttggttaaaatgaagtatccaagaatctgtatcctggacggtggaattaacaagattaagccaacaggccttttgaccatcccctcaccacaaatctag

SEQ ID NO: 51290 - DNA, 2493 bp, Artificial Sequence
  Description of Artificial Sequence: Synthetic coding sequence
atgttccccctgaaggacgccgagatgggcgccttcaccttcttcgcatcagcacttccgcacgacgtgtgcgggagcaacggcctcccattaaccccgaactctattaagatcctcggccggtttcagatcctgaagacaatcactcaccccaggctgtgccaatacgtggacatctcccgtggtaaacacgaacggctcgttgtggtcgccgagcactgcgagcggagtcttgaggatttgctgagggagaggaagccagtgcgataccccagttacctggcccctgaagttatagcccagggcattttcaagactacagatcatatgccttctaagaagcccctcccttctgggcccaagagcgatgtgtggagtctggggatcatactgttcgaactctgcgtagggcgaaaactgtttcagagcctagatatctccgagaggttgaagtttctgctaacacttgattgcgtggatgacacattgattgtcctcgctgaggagcacggatgcttggacatcataaaagaactccccgagacagtaatagatctgctgaacaaatgtttgacatttcatccaagtaaaagaccaacaccagatcagctcatgaaagataaggtgtttagcgaagttagtcccctctacaccccttttacaaaacccgcaagccttttttccagctctctccgctgtgccgatctcactctgccagaggatatctcgcaactctgtaaggatattaacaatgactatcttgcggagagaagcattgaagaggtgtattacctgtggtgcctagccgggggtgatctcgaaaaggaactggtgaataaagagatcatcaggtctaaacccccaatctgcactctccccaacttcttgtttgaagatggagagagtttcggtcagggaagagacaggagctcgctgctggatgacaccactgtcaccctgagtctatgtcagctgaggaatagacttaaggatgtgggaggcgaggccttctaccccttgctggaggacgaccaatcaaacttgccccacagtaattccaataatgagctttctgcagcggctacactgcccctgataattcgagagaaggatactgagtatcagttgaaccgaatcattctcttcgatcggctcttaaaagcctacccctataagaaaaaccagatctggaaggaggctcgggttgacatccctccattaatgcgggggctgacctgggcagccctccttggtgtcgaaggggcaatacacgcaaagtacgatgctatcgacaaggataccccaattcctacagaccgacagattgaggttgacatcccccgctgtcaccagtacgacgaactgctaagcagccccgagggccatgcgaagtttcgccgagtcctgaaggcctgggtggtgtctcatcctgaccttgtctactggcagggcctggacagtttgtgtgctccctttctgtatctgaacttcaacaatgaagcactcgcctacgcctgcatgagcgcctttatccccaagtatttatataatttctttctcaaggataactcacacgtgattcaagaatatctgactgtattctcacagatgattgcattccatgatccagaattatcaaaccatcttaatgaaattggctttatccctgacttatacgcaatcccctggtttctgaccatgtttacccacgtctttccactccacaaaatctttcacctttgggatacgttactgctggggaactcaagctttccattctgtattggagtggcgatacttcagcagctcagagaccgattgctggccaatggatttaatgagtgcatcctccttttcagtgacctgcccgaaatcgatattgaacgatgtgtgagggagagtataaatctgttttgttggacccctaagtctgcaacttatcgccagcacgcccagcctcctaaaccctcgtcggatagtagcgggggccgatccagtgcaccctatttctccgcagaatgccccgacccaccgaagacggacctgagcagagaatcaatacccctgaacgacctcaagtcagaagtgagccccaggataagcgccgaggacctgatagacttatgcgagctgaccgtaaccggtcattttaagacgccatctaaaaagaccaaatcctcaaaacccaagctcctcgtggtagacatcagaaactccgaagactttatccggggacacataagcggatccatcaatattcctttcagcgccgcattcaccgccgagggagaacttacacagggaccctacaccgccatgttacagaattttaaggggaaggtgatcgtgattgtaggacacgtcgcgaagcacaccgccgagtttgcagctcatctggtgaagatgaaataccctcgcatttgtatcctggatggcggcattaacaagattaagcccaccggtctgctgactatcccatccccccaaatttag

SEQ ID NO: 51291 - DNA, 2565 bp, Artificial Sequence
  Description of Artificial Sequence: Synthetic coding sequence
atgttccccctgaaggacgccgagatgggcgccttcaccttcttcgcctcggccctgccacatgacgtctgtggtagcaatggcctgccccttaccccgaacagcatcaagattctgggcagattccagatccttaagaccattacgcaccctcgcctctgtcagtatgtcgacatctcgagaggcaagcatgaacgcctggttgttgtcgctgaacattgcgaaagaagcctggaggatctgcttcgggaaaggaaacctgtgagctgttcgaccgtcctttgtatcgcctttgaggtattacaaggattgcagtacatgaataaacacgggattgtccaccgggcactgagcccacataacattttgctggatagaaaaggtcatattaagctggccaagtttggcctgtatcacatgaccgcccacggcgatgatgtggactttcctattggatatccgtcctacttagcgccggaaggccgcaagctctttcaaagtctggacatatctgagcgtcttaagttcttgctaaccctcgactgtgtggatgacaccttgatagtcctcgccgaggagcacggatgtctggatattataaaggaactgcccgagacagtcattgatctcttaaacaagtgcttaacgtttcaccccagcaagaggccaacaccagatcagttgatgaaagacaaggtcttcagcgaagtatcccctctgtataccccatttacgaagcccgcgtctctgttctcgtcctcattgaggtgtgcagacctgaccctaccagaggacatctcacagctgtgtaaggatattaataatgattatctcgctgaacggtccatcgaggaggtgtactacctgtggtgtctggcaggcggtgacctggaaaaggaactggtcaacaaggagatcattagatcaaaaccaccaatatgtactctacccaactttttgtttgaggatggagagtcctttggacaaggcagggatcgtagcagtctcttggacgacacaactgtgactttgtccctctgtcaactgcgcaaccggctgaaggacgtgggcggcgaggcgttctacccactgcttgaggatgaccagagcaaccttccacatagcaattctaataatgaattgtcggccgctgccacacttccactgattatacgcgaaaaagacaccgaatatcaactcaataggatcattctgtttgacaggctgcttaaggcttacccatataaaaagaaccagatttggaaggaagcacgcgttgatattcccccactgatgcgcggcctgacatgggcggctctcctcggagttgaaggtgccatccacgccaagtatgatgccattgataaggatacgcccatccccaccgatcggcagatagaggtcgatatccccagatgtcatcaatacgatgagctactgagtagcccagagggacacgcaaaatttagaagagtgctcaaagcgtgggtggtgtcacaccccgacctggtctactggcagggcctcgatagtctgtgcgcgccattcctgtacctcaacttcaataacgaagctcttgcctacgcttgcatgagtgcattcattcctaaatacctgtacaacttcttcttgaaagacaattctcatgtgatccaggagtatttgaccgtctttagtcagatgatcgccttccacgatcccgaactgagtaatcacctgaatgaaatcggctttatacctgacctgtatgctatcccctggttcctaacaatgttcacccatgtgtttcccttgcacaagattttccatctgtgggatacattactcctgggaaatagttctttccccttttgcatcggcgtggccattctgcagcagctccgcgaccggctgttagccaacgggtttaatgaatgtatcctcctcttttcagatctccctgagattgacattgagagatgtgtgagggagtcaattaatctcttttgctggacgcctaaaagcgctacatatagacagcacgcccagccacctaaaccaagctccgactcctcgggaggcaggtctagcgccccctatttttctgctgaatgtcccgacccaccgaaaacagatctgagcagagaaagcattcctctcaacgacttgaagagcgaggttagtccccggatttctgccgaggatctgatcgacctgtgtgagttaactgtcaccggccattttaaaacgccctcgaagaaaaccaagtctagcaagcccaaactcctagtcgtggacattcgcaatagcgaggatttcattaggggtcacatttccgggtctattaatattcctttctccgcagccttcaccgccgagggtgagctgacccagggaccctatactgcaatgcttcagaatttcaaaggaaaggtcatcgtgattgtagggcatgtggccaagcacaccgctgagtttgctgcccacttggtcaagatgaagtacccaagaatctgtatactggacgggggaattaacaagatcaagccaacaggtcttctcactatcccatctccccagatctag

SEQ ID NO: 51292 - DNA, 2682 bp, Artificial Sequence
  Description of Artificial Sequence: Synthetic coding sequence
atgttccccctgaaggacgccgagatgggcgccttcaccttcttcgcatcagccttgccacacgacgtgtgcggctccaacggactgccacttacgcctaattccattaagatcttagggagattccagattctgaaaaccataacccaccctcgcctctgccagtacgttgacatctctaggggtaagcacgagcgtctagttgtcgtggcagagcactgtgaacgatctctcgaggacctgctccgagaaagaaagcccgtcagttgcagcacagtactgtgcatcgcctttgaggtcctgcaggggctgcagtatatgaacaagcatgggatcgtccaccgagcactgagtccacataatattctcctggatcgaaaaggacacattaaacttgccaagtttggactatatcacatgacggcgcacggcgacgatgtggactttccgattggatacccttcctatctggctccagaggtgatagcgcagggcatcttcaagacaactgaccatatgccttcaaagaaaccactgccgtctgggcctaagtctgacgtgtggtctttaggaatcattttgtttgagttgtgtgtcggtcggaagttgttccaaagtttagacataagcgagcgcctgaagtttctcttgaccttagattgcgtggacgatactctgatagttttagctgaagaacacggatgccttgatatcatcaaagagttgcctgaaaccgtaattgatttgcttaacaaatgcttaacgttccacccatcaaagcggcccactccagatcagctgatgaaggacaaagttttctccgaggtctcgcccctgtacaccccgtttactaaacccgcgtcactgttttcatcgagtctaagatgtgccgacctaacgttacccgaagacatctctcagctatgtaaagatattaataatgactatctagctgagagaagtattgaggaggtgtactacctgtggtgtctcgccggaggcgatttggaaaaggagttggtgaataaggaaatcattagaagtaaaccgcccatttgcacccttccaaactttctgttcgaagacggggagagttttggccagggccgagatagaagcagtctcctggacgacacaaccgtcaccttgagtctgtgtcagttgaggaaccggctcaaggatgttggcggagaagcgttttatccactgcttgaagacgatcagtccaatctacctcatagcaatagcaataacgaactatctgcggcagccaccctgccactaattatccgtgagaaagacaccgaatatcagctgaaccggattattctattcgataggcttctgaaggcttacccttacaaaaagaaccagatctggaaagaagctcgagtcgacatccctcccttgatgcggggcttgacctgggcagctctgctgggagtggagggagccattcacgctaagtacgatgcaattgataaggatacaccaattcccaccgatagacagattgaagtcgacatccctaggtgtcatcagtacgacgaactgcttagctcacctgaaggtcacgctaagtttcggcgtgttttgaaagcttgggtcgtttctcatccggacctggtctactggcagggtttagatagcctctgtgctcctttcctttatcttaatttcaacaacgaagctttagcttatgcatgcatgtcggcgttcatacccaaatacttgtacaactttttcctaaaagataactcccacgtgatccaggagtacctaactgtgtttagtcaaatgatcgcgttccatgaccctgaattgagtaatcatctgaatgaaatcggatttataccagatttatatgccatcccctggttcctgaccatgttcactcacgtgtttcccttgcacaagatctttcatctctgggacacccttcttcttggcaactccagttttcccttttgtataggggtagccattcttcaacagctccgcgaccggctgttggcaaatggctttaatgagtgtatcctgctgtttagcgacctgcctgaaattgatatcgagaggtgcgtccgggaaagtataaacttattctgctggacacccaagagtgcaacatacaggcagcacgctcagcctcctaagccttcttctgactccagtgggggccggtcaagcgcaccttactttagcgcagaatgtcccgatcctcccaagaccgatctgagccgcgagagcatccccctaaacgacctgaaatccgaggttagtccccgaattagcgccgaggatctcatcgacttatgcgagcttaccgtgaccgggcacttcaaaacaccgagcaagaagacaaagagttcaaaaccaaaactgctggtggtcgacattcgtaattctgaagacttcatcaggggccatataagtggaagtattaacatcccatttagcgctgcttttaccgctgagggagaactgacacagggtccttataccgctatgttgcaaaacttcaagggcaaagtcattgtgatcgtgggtcacgtggcaaagcacaccgcagaattcgcagcacatttggtgaaaatgaaataccccaggatttgcattctggacggtggcattaacaaaatcaagccaactggactgctgactatacccagccctcagatctag

SEQ ID NO: 51293 - DNA, 2682 bp, Artificial Sequence
  Description of Artificial Sequence: Synthetic coding sequence
atgttccccctgaaggacgccgagatgggcgccttcaccttcttcgctagcgccctcccccacgatgtgtgtggctcaaatggtctacccctcacgccgaacagcataaagatcttggggaggtttcagattttgaaaaccatcactcacccaaggctgtgccagtacgttgatatttccagggggaaacatgaaaggcttgttgtggtcgccgaacattgtgaacgcagccttgaagatctgctaagagaaaggaaacctgtgtcttgtagcacagtactttgcattgctttcgaggtgctccaggggctacagtacatgaataaacacggtatcgtccacagagcactttcaccccacaatatcttgttggaccggaaaggccatataaagctggccaagttcggcctttaccacatgaccgcacatggcgatgatgttgatttccccattggctacccttcctacttggcaccggaagtgatagctcagggtatttttaaaacgacggaccatatgccgagcaaaaagcccttgcccagtgggccaaaatctgatgtctggtccctgggaatcatactgtttgaactctgcgtgggcaggaaacttttccagtctctcgatattagcgaaaggctgaagttcctgcttacgctagactgtgtggacgatactcttatcgtgctggccgaagagcacggatgtctggacatcattaaggagctcccggaaaccgtgattgatctgctcaacaaatgcctgaccttccatccttctaagaggccaacaccagaccaactgatgaaagacaaggtcttctcagaggttagtccactgtataccccttttacaaagcccgccagcctgtttagcagctcactgcgctgcgctgacctgaccttgccagaggacatctctcagctctgcaaggatataaacaatgattatctggcagaacgctctatcgaggaggtgtactatctctggtgcctggctggtggcgatctggaaaaggagttggtgaataaggagattatcagaagtaaacccccgatatgtacacttcccaattttttgttcgaggacggggagagctttggtcaggggagggacaggtcatcactgttagacgacacgacagtcacactatctctttgccaacttcgcaatcggctcaaggacgttggcggggaggccttctaccctctgctggaggatgaccaatccaacctgccccatagtaactcaaataacgaactgtcagcggcagccacacttccactgataataagggagaaagacaccgaataccagctcaaccgaattatcctgtttgatcggcttctcaaggcttacccctataaaaagaaccagatctggaaggaggcccgggtcgacattccacccttgatgcgcggcctgacctgggcagcactgctgggtgtggaaggagctattcacgcaaaatacgatgcaatcgacaaggatacgcccatccctaccgacagacagattgaagtggatatcccccgctgtcaccagtatgacgagttacttagtagtcccgaaggacatgcaaaattcaggagggtgctgaaggcttgggtggttagccatcccgaccttgtctactggcaagggctcgattcgttatgtgcaccttttctatatctgaatttcaataatgaggccctcgcctatgcctgtatgtccgcctttattcccaagtacctctacaactttttccttaaagacaacagccacgtgatccaggagtatctcacagtcttctcacagatgatcgcatttcacgacccagaattgagtaaccatctgaacgagattggtttcatacccgatctctacgccattccctggttcctcaccatgttcactcatgtgtttcctttgcataaaatcttccatctttgggacactctgttactgggcaacagcagtttccccttctgtattggggtggctattctgcagcaacttcgagaccgcctgttagccaatggttttaacgagtgtatcctgttgttttccgacctgcctgagatagacatcgagcgatgcgttcgggagagtattaatctgttctgctggacaccgaagtctgctacctatcggcagcacgcccagcctccgaaaccttcctctgattcttctggtggacgttctagcgcaccgtatttctcggccgagtgtcctgacccgcccaagacagacctgagtagggagtccataccactgaacgatcttaagtctgaggtgtcgcccagaatttcagccgaggatctcattgacctgtgcgagctgactgtgaccgggcactttaagactccttcaaagaaaacaaaatcttcgaaacccaagcttctggtggtcgacattcggaacagcgaagatttcatccggggccacataagcggatcaataaatatacccttctctgctgcattcaccgccgaaggcgagttgacacagggcccatatactgcaatgttacagaattttaaaggtaaggtgatcgtgatcgtgggccatgtggctaaacacacagcagaatttgcggcccacctggttaagatgaagtatcctagaatttgtatactggacgggggtattaacaagataaagcccactggtttgctcactatcccttccccacaaatatag

SEQ ID NO: 51294 - DNA, 207 bp, Artificial Sequence
  Description of Artificial Sequence: Synthetic coding sequence
atgttccccctgaaggacgccgagatgggcgccttcaccttcttcgcgtccgccctgccccatgacgtctgtgggtccaacggtctgcctctcactcccaattccattaagatactgggaaggtttcaaattctcaagacaatcacccacccccgactgtgccaatatgtggacatctccagagggaagcacgagcgcctggtttag

SEQ ID NO: 51295 - DNA, 480 bp, Artificial Sequence
  Description of Artificial Sequence: Synthetic coding sequence
atgttccccctgaaggacgccgagatgggcgccttcaccttcttcgcttccgcattaccacacgacgtttgtgggagtaatgggcttccactcacaccaaattccattaagatcctgggaagatttcagatcctcaagacaatcacccatccacgcctgtgccagtacgttgatatcagccgcgggaaacacgagcggctcgtggtggtagccgaacactgcgaacggtccttggaagaccttcttcgggagagaaaacctgtctcttgctccacggtgctctgcatcgctttcgaggtgctacagggcctccagtatatgaataagcatggtattgtccatagggccctaagcccacacaacattctgctagacaggaagggccacatcaagcttgctaagtttggtctctaccatatgacagcacacggggatgatgtcgacttccccatcggctacccatcgtatctggctccatag

SEQ ID NO: 51296 - DNA, 318 bp, Artificial Sequence
  Description of Artificial Sequence: Synthetic coding sequence
atgttccccctgaaggacgccgagatgggcgccttcaccttcttcgcctctgcacttccgcacgatgtctgtgggtctaatggcttgccactgacccctaactccattaaaatcctgggcaggttccagatcttgaagaccatcacacatccaagactgtgccagtacgtggatatctcccggggcaaacatgaacgcttggtcgtagtggcggagcactgtgaacgaagcctggaggatttgctcagagagcgtaagccggtctcatgtagtaccgtactgtgtatagcattcgaggtactgcagggcttgcagtag

SEQ ID NO: 51297 - DNA, 753 bp, Artificial Sequence
  Description of Artificial Sequence: Synthetic coding sequence
atggagatggacggcgacccctacaacctgcccgcccagggccaggggaatataattattactaaatatgaacaagggcatagagcaggcgccgccgttgacctgggccatgagcaagttgacgtgcggaagtatactaacaacctcgggatagtgcatgaaatggagctgccgcacgtgtccgcgttggaggtgaagcagcggcgcaaggaatctaagcggaccaataagtggcagaaaatgttggcagattggactaagtatcgtagcacgaagaagctgtcccagagggtgtacaaagttattcccttagctgtgcgcggaagagcgtggtccttgttgcttgatattgatcgaatcaagtcccagaatcccggcaagtacaaggtgatgaaagagaagggcaagcgttctagccggattatccactgtatacagctggacgtttcccatacccttcagaagcacatgatgtttatccaacgtttcggagtaaagcagcaagagctgtgtgacatactagtggcctattcagcttacaatcccgaggtcggctatcatagagacctgtcacgaatcaccgcaatcctgctactctgtctcccagaggaagacgcgttttgggcactgactcagctacttgctggagagcggcattccctgtggtatagtacggcacagatcttgcccgggtctcgcggctcttacagaactcgctctcggtgttgcacatcaccctcccagaggagctag

SEQ ID NO: 51298 - DNA, 453 bp, Artificial Sequence
  Description of Artificial Sequence: Synthetic coding sequence
atgggccacctggacaaggagggcctgtgcacccagggcagcagcttctcttggctacttagggtgctgaacgacgggatctcgctgggactgaccccttgtctctgggatatgtatcttctcgaaggcgaacaaatgctcatgctcattacttcaattgctttcaaggttcagcgctcactgtatgaagagactaacaaagagacgtggggtcccgccacaccgcgggcacttaagggaactggtagggcacggcccatttgcgagagcttgcatagcagtttgcaggccctaacggcctctgagtcctccaggggtccctcactgctgcaaactccaccaagggttccgggtcaacaagctctcagccggggcgataagggcatcagcgtctcattatcccttcccagtctgcccagccggcgggggcggtgcggcaggattattggctag

SEQ ID NO: 51299 - DNA, 2286 bp, Artificial Sequence
  Description of Artificial Sequence: Synthetic coding sequence
atgcggcaggacaagctgaccggcagcctgcggcggggcggccggtgtctcaaacgacagggcgggggagtaggcacaattctctccaacgtgctgaagaagaggagttgcatttctagaaccgctcctcgcctactatgcaccctcgagcccggcgtggatacaaagctgaagttcacccttgaaccctcactgggacagaacgggtttcaacagtggtatgacgctctcaaggcagtcgcaagattatcgaccgggattcctaaagaatggcgccgcaaagtctggctcaccctcgccgatcattacctccactcaatcgcgatcgactgggacaagactatgcgctttaccttcaatgagagatctaacccagacgacgactcaatgggcattcaaatcgtgaaagacctgcatcggacaggatgtagctcttattgtggccaggaagccgagcaggaccgggttgtgcttaagcgggtgctactggcctacgcaaggtggaacaaaacggttggctactgtcagggcttcaatattttggccgctttgatcctggaggttatggaaggtaacgaaggcgatgcccttaagattatgatttatttgatcgacaaagtcctgccggagtcatatttcgtaaataacctgagggctctgtccgtcgacatggcagtttttagagacttacttaggatgaagctacctgagttgtcccaacatcttgacacactccagagaactgcgaataaggagtccggtggtgggtatgaacctcctcttacaaacgtatttaccatgcagtggtttctcactctgtttgccacttgcctgccaaatcagaccgtcctcaaaatatgggactccgtcttcttcgaaggcagcgagataattctgcgcgttagcctagcgatctgggccaagctgggagagcagatagagtgctgtgagaccgcagatgaattctactccaccatggggcgcctgacccaggagatgttggagaatgacctcctgcagagtcacgaacttatgcagacagtatacagtatggcaccttttcctttcccccagctcgcagagcttagagaaaagtatacctacaatatcactccattccctgccacggtgaaacctactagcgtctctggaaggcactccaaagcgcgcgattcagacgaagaaaatgaccccgacgatgaggacgccgtagtgaatgccgttggctgcctcggccctttcagtggattcttggcacctgaactgcagaagtaccagaagcagattaaggagcctaacgaggagcagtcactcagaagtaacaatatagctgaactcagcccaggcgctattaatagctgccgaagcgagtaccacgccgcattcaacagtatgatgatggaacgcatgacaacggatatcaacgcgcttaaacgacaatactctcgcatcaagaagaagcaacagcagcaagtccaccaggtatacattcgcgccgacaagggtcctgtaacaagtatcttaccatctcaagttaattcttcacctgtcatcaatcacctgttgttggggaagaagatgaagatgactaacagagccgcaaagaacgcggtaatccacatcccaggccatactggtggcaaaatttctcctgtaccttatgaggacctgaagactaaactgaattccccctggaggacccacatccgggtgcacaaaaaaaacatgcctaggacaaaatcacaccctggatgtggtgacaccgtggggttgatcgatgagcaaaacgaggcttctaagacaaacggacttggggccgccgaagcttttcccagcggctgcaccgctactgctggtcgggagggctcttctccagagggctccacaaggaggacgatagaaggccagtcccccgagcccgtctttggagatgccgatgtggatgtctcggcagtgcaagctaaactaggcgcccttgagcttaaccaacgcgacgcggccgctgaaacggagcttcgcgtgcaccccccctgccagcgccattgccccgagcccccgtcggctcccgaagagaacaaggctacctccaaggccccacagggctctaactccaagactccaatcttttcccccttcccctctgtgaagcccctccgaaaaagcgcaactgctcgcaacctgggactttacggtcctacagaaaggacgcctaccgtgcacttcccccaaatgagcagatccttcagtaagccagggggcggaaattccggtaccaaaaagcgctag

SEQ ID NO: 51300 - DNA, 2454 bp, Artificial Sequence
  Description of Artificial Sequence: Synthetic coding sequence
atgtaccacagcctgagcgagacccggcaccccctgcagcccgaggagcaagaggtggggatcgatcccctcagctcatactctaacaagtcagggggggatagcaacaaaaacggcagacggaccagctcgacattggactctgaagggacttttaattcgtatcgcaaagagtgggaggagctgtttgtcaacaacaattacctggctaccatccggcagaaaggaatcaacgggcagcttaggagctccaggtttcgttccatttgttggaagctgtttctgtgtgtactcccacaagataaatcccagtggatttcacggatagaggaactgagggcatggtattccaacataaaagagatacacatcactaaccctcgcaaggttgtcggtcagcaggatctcatgatcaataatcctttatctcaggatgaaggctctctttggaacaagttcttccaggataaggagctgcggtccatgattgagcaagatgtcaagagaacatttcccgagatgcagttcttccagcaggaaaacgtccgcaagatcctcactgacgtactattttgttatgcccgagaaaacgaacagctgctgtataagcaaggaatgcacgaactcctggcccccatcgtgtttgtgctgcattgcgaccatcaggctttccttcatgccagcgaaagcgcacaaccctccgaagagatgaagactgttctgaacccggaatacctggaacacgacgcctatgcggtgttcagccaactcatggagactgctgagccgtggttctccacattcgagcatgatggtcagaaggggaaagagaccctcatgaccccaattccatttgccaggccacaggaccttggtcccacaatagctatcgtaacaaaggtgaaccagatccaggatcatctgcttaagaagcacgacattgagctctatatgcacctgaacagactcgagatcgccccccagatctacggactgaggtgggtgcggctgctctttgggcgggaatttcccctccaggatctcctcgttgtgtgggacgcgttgttcgccgacggattgtcgctgggcttggtggactacatattcgtggcaatgctgttgtatatccgcgacgccctgataagctccaactatcagacatgcctgggactgctcatgcactacccatttatcggagatgttcacagcttaatacttaaagcgctgttcctcagggacccaaaacggaacccccgaccagtgacataccaattccatcctaacctggattactataaggcgcggggcgcggacttgatgaacaagagccggaccaacgctaaaggagctccgctaaacatcaataaagtgtctaatagccttatcaatttcggcagaaagttgatctcacccgccatggctccaggctctgcaggcggacctgtgcctggagggaactctagcagctcatccagtgtcgtgatccccacccggacctccgctgaagcaccaagccaccacctgcaacaacaacaacagcagcagcgtctgatgaaatctgaaagtatgcctgtccaactaaacaagggggacgtcgtcactggaagcgatgcacaggtgtccgtccctgttcagaccctcacagatcttcaggggctgtcctccaagaacatcagttccagcccctccgtggagtcccttcccggtgggcgggagttcacgggatccccaccatccagtgctactaagaaagattcatttttttctaacatctcaagatcacgcagccactcgaaaaccatgggaaggaaggagtcggaagaggagttagaggcgcagatctcttttttacaggggcagctcaacgacttggacgcgatgtgtaaatactgcgctaaggtaatggacacacacctcgtgaacattcaagacgtcatccttcaggagaacctagagaaagaggatcagattttggtctctctcgctgggctgaagcaaatcaaggatattctgaagggctcactccggttcaaccagagccagctcgaagcagaggaaaatgagcagatcaccattgccgataatcactactgcagcagcggacagggccagggccggggtcaaggacagtcggttcagatgtcaggcgcgatcaagcaggccagcagcgagacacccgggtgtacagatcgaggtaactcagacgattttatactgatttccaaggatgacgacggttcctccgcccgtgggtctttctccggccaggcacaacccctccgaactcttagaagcaccagtggcaagtcccaggcgcccgtgtgctctcctcttgtcttctctgacccgctgatggggcctgcttctgctagctcttctaaccccagctctagccccgacgatgactcctccaaggacagtggctttacgatagtgagccctctcgacatctag

SEQ ID NO: 51301 - DNA, 624 bp, Artificial Sequence
  Description of Artificial Sequence: Synthetic coding sequence
atgctggccctgcggtgcggcagccggtggctgggcctgctgagcgtgccacggtccgtgcccctgaggctacccgctgctcgggcctgttctaaaggctcaggcgacccctcctcctcatcttcatcgggaaaccccctcgtttatctcgacgtggacgctaatgggaagcctctcggtcgggtggtgttggagctgaaagcagacgtggttcccaaaacagcagagaatttccgggcgctttgtacaggagaaaagggttttggctataagggaagcacattccacagagtgataccaagctttatgtgtcaggccggcgattttactaaccataatgggacagggggcaaaagtatctacggatctagatttcctgatgaaaatttcacactcaagcacgtcggtccaggagttctttccatggcaaatgccggccccaacacaaacgggtcccaatttttcatctgtactataaaaacagattggcttgatggaaaacatgttgtctttggacatgtgaaagagggcatggatgttgtgaaaaagattgagtcctttggcagcaagtctggtagaacttccaaaaaaatagtaattacagattgcggacagctgtcttag

SEQ ID NO: 51302 - DNA, 444 bp, Artificial Sequence
  Description of Artificial Sequence: Synthetic coding sequence
atgggcttcatcttcagcaagagcatgaacgagagcatgaagaaccagaaggagttcatgctgatgaatgccagactgcagctggagcgacagctcattatgcagagtgagatgagggaacgtcagatggctatgcagatcgcgtggtcacgtgaatttctgaagtattttggtactttttttggactcgccgctatatcattgacggccggtgccataaaaaagaaaaagccagcctttctggttcctatcgttcccttgtcctttattctaacgtaccagtatgacctcgggtatggtaccctcctcgagagaatgaagggagaagcggaagacattctagaaactgagaagtccaagctccaactgccgagaggcatgattacctttgagtccatcgagaaggcacggaaagagcagtcaagattcttcatcgacaaatag

SEQ ID NO: 51303 - DNA, 1203 bp, Artificial Sequence
  Description of Artificial Sequence: Synthetic coding sequence
atgagcagcctgcacaagagccggatcgccgacttccaggacgtgttgaaggagccctctattgcattagaaaaactgcgggagctgtccttcagtgggataccctgtgaaggcgggctgagatgcttgtgctggaagattcttttgaactacctgccacttgaaagagcgagttggacatccatcctggccaaacagcgggagctgtacgcccagtttctcagagaaatgatcatacagccaggaatcgccaaggccaacatgggagtgtctcgggaggacgtcacctttgaagaccatccgctgaaccccaatcccgatagtcgctggaacacctattttaaagacaatgaggtgctgttgcagatcgataaggatgtaagacgtctgtgccccgacatctcattctttcagagagcaaccgattacccatgcctgcttattctcgaccctcagaatgagttcgaaaccctgcgcaagcgagtcgaacaaacaacactgaagagccagacggtagcacgcaatcgtagcggagtcactaacatgagctctccacacaagaacagtgtcccttccagtctgaacgagtatgaggtgcttccaaacggctgcgaggcccattgggaagtagtcgaacgcattctcttcatctatgcaaagctcaacccgggcattgcttatgttcagggaatgaatgagatcgtgggacccctgtactacacctttgctacagaccctaattctgaatggaaagagcatgcggaagcggacacctttttttgttttactaatcttatggccgaaattcgtgataatttcattaagtccctggacgacagtcagtgcggtattacttacaagatggagaaggtatactctactttgaaggataaggacgtagagctttacttaaagttacaagaacagaacataaagccccagttctttgcttttcgctggcttactctcctgctgtctcaagaatttcttctgccagacgtaatcaggatctgggactcccttttcgctgatgacaatcgttttgacttcttgttgttggtgtgctgcgcaatgttgatgctcatccgggagcagttgttagagggcgacttcactgtgaatatgagactcctacaggactaccccatcaccgatgtgtgtcaaattttgcagaaggctaaagagcttcaggattcgaaatag

SEQ ID NO: 51304 - DNA, 660 bp, Artificial Sequence
  Description of Artificial Sequence: Synthetic coding sequence
atgagcagcccccacaagaacagcgtgcccagcagcctgaacgagtacgaagtgctgcccaatggctgtgaggcacattgggaggtagtggaaagaatcttgtttatttatgccaaactcaaccctggtatagcatatgtgcaaggcatgaacgagatcgtgggcccactgtactatacgttcgccactgatccgaactccgagtggaaggaacacgccgaggccgatacgtttttctgtttcaccaatcttatggctgagattcgggacaacttcatcaagtccttggatgacagccagtgtggaatcacttataagatggaaaaggtgtatagcacactgaaggataaggacgtggagctgtatttaaaacttcaagagcaaaacattaagccccaattctttgcattccgatggttgaccttgctactgagtcaggagtttttactgccagacgtgattcggatttgggacagcctgttcgctgacgataatagattcgacttcctgctgcttgtttgttgtgccatgctgatgctcattagagaacagctgttggagggagattttaccgtgaatatgcggttgcttcaggattatcctattacagatgtgtgtcaaatacttcagaaggctaaggaactacaagactctaagtag

SEQ ID NO: 51305 - DNA, 2082 bp, Artificial Sequence
  Description of Artificial Sequence: Synthetic coding sequence
atgaccgacggcaagctgagcaccagcaccaacggcgtggccttcatgggtatcttggatggaaggccagggaatcctttacagaatctccagcacgtgaatttaaaagcacccaggctcctgtcagcaccggagtatggcccaaaattaaaattgagagcccttgaagaccgccactcactgcagagtgttgacagcggcatcccaacgttggagattgggaacccagagcccgtcccctgttccgccgtgcacgtacgcaggaagcagagcgactcagatttgataccagaacgggcatttcagagtgcttgcgccctccccagttgcgctccccccgctccaagctccacagagcgggaacagagcgtcagaaagagttctacatttccacggaccggatacgatagtgttaagctgtattcacccacttccaaggcactcactcgttccgacgatgtgtccgtatgttccgtgagctccctgggaactgagctgtccaccacgctcagtgtgagtaacgaagatatcctggatctcgtagtgacctcttcatcgtcagctatagtcacactggagaatgacgacgaccctcagttcactaacgtgaccttatcatcaattaaagaaacgagggggcttcatcagcaggactgtgttcatgaagcggaggaaggttccaagctgaaaattctgggccctttcagcaacttcttcgcgcggaaccttttggcgcgtaaacagagcgctagacttgataaacacaatgacctgggttggaagctgtttggcaaggcaccgctgcgggaaaacgctcaaaaggatagcaagcgtattcagaaggaatacgaggataaggccggccgtccgtccaagccccctagtccaaagcagaacgttcgaaagaacctcgactttgaaccactctcaaccactgcattaatcctggaggatcgccccgccaacttgccagccaagcctgcagaggaggctcagaagcacagacagcaatatgaagagatggtagtccaggcaaagaagcgtgagttaaaggaggctcagaggcgcaaaaaacagctggaagagagatgcagagtggaagagtcgatcggaaacgcagtgctgacctggaacaatgagatcctccctaattgggagacaatgtggtgttcacggaaggtgcgggatctgtggtggcaagggatcccaccaagtgtgagggggaaagtgtggagcttggctattgggaatgagctgaatatcacccacgaactgtttgatatctgtctggcaagagcaaaagaacgctggcgaagcttgtccactggaggctccgaggtggaaaatgaggatgccggattcagcgctgccgacagagaggcatctctagaactgattaaactggacatttctagaacttttcctaacctttgcatcttccagcagggcgggccatatcacgatatgttacactccatccttggtgcatacacttgttatcgcccggacgtggggtatgtgcaagggatgtctttcattgccgctgtgctgatcctcaacctggacacagcagacgctttcatcgcctttagcaacctcttgaacaaaccttgccagatggcattttttcgcgtggaccacggactgatgctcacatattttgccgcttttgaagtgttttttgaggaaaacctgcctaagttatttgcacatttcaaaaaaaataaccttacacctgacatctatctcatcgactggatctttaccctctattcaaagagcttaccgctggatctcgcttgcagaatttgggacgtgttttgtcgggacggggaggaatttctttttcggaccgcactgggcattctcaagctattcgaagacattctcaccaagatggacttcattcacatggcccagttcttgacacgattaccggaggacctgcccgcagaggaactcttcgcgagcattgccaccattcaaatgcagtcaaggaataagaaatgggcccaagttctgacagccctgcaaaaagactctagagagatggaaaaggggtctcccagcttaagacattag

SEQ ID NO: 51306 - DNA, 171 bp, Artificial Sequence
  Description of Artificial Sequence: Synthetic coding sequence
atgaccgacggcaagctgagcaccagcaccaacggcgtggccttcatgggaattcttgacggaaggcctggaaatcccctccagaatctgcagcacgttaacctaaaggcacccaggcttctgtctgctccagagtatggcccaaaattgaagcttcgcgcactcgagtag

SEQ ID NO: 51307 - DNA, 384 bp, Artificial Sequence
  Description of Artificial Sequence: Synthetic coding sequence
atgaccgacggcaagctgagcaccagcaccaacggcgtggccttcatgggaatacttgatggcagacccggaaatccattacagaacctgcagcatgtcaacttaaaggctcctaggctcctcagtgcccccgagtacggccctaaattgaagttacgggctctggaggatcgccacagcctacaatcagtggattctggtatccccacactggagatcggcaacccagagcctgtgccttgttcagccgtgcatgtacgcaggaagcagagtgacagcgacctgattcccgaacgcgccttccaatccgcctgcgcgttgccgtcctgtgcacctcctgctccatcaagcacagagcgggagcagtctgttcgcaagtcttag

SEQ ID NO: 51308 - DNA, 1023 bp, Artificial Sequence
  Description of Artificial Sequence: Synthetic coding sequence
atgtggtgcagccggaaggtgcgggacctgtggtggcagggcatcccacctagtgtgcggggaaaggtgtggagtctggccataggaaatgaactgaacatcactcatgagctctttgatatctgcttagccagagcgaaggaacggtggcggagcctatctacaggaggttccgaagtcgagaatgaagatgctggattctctgcagcagaccgcgaggcgtccttagaattgattaagctcgacatcagtaggacgtttcctaacctttgtatctttcaacaggtgttgattttcgtggacttccgtgtgggactgcagaaaagttttcagaaacgaaaggagcgggaaagcactaaacttcagcagctatggtcatggtgcctgggagggccttaccatgatatgctgcactctatactcggggcctatacctgctacaggcctgatgtaggatacgttcagggaatgtctttcatagccgcagtgctaatcctgaatttggataccgcggatgcttttattgccttctccaatctgctgaataagccttgtcagatggctttttttcgagtcgatcatgggcttatgctcacctatttcgccgcattcgaagtcttcttcgaggaaaatctgcctaaactctttgcccacttcaaaaaaaataacttgacccctgacatttatttaattgactggattttcactctgtacagtaagtccctccccttagatttagcatgccgcatatgggatgttttttgccgggacggcgaggaattcttgttccggaccgctcttggcatccttaagttatttgaggatattctgacaaagatggatttcattcacatggctcaatttctgactagactgcccgaagatcttccagccgaggagctgtttgccagcatcgccactatccaaatgcagtcccggaataaaaaatgggctcaggtgctgacggccctgcaaaaagattcccgcgagatggaaaaaggctctccttcactcagacattag

SEQ ID NO: 51309 - DNA, 2082 bp, Artificial Sequence
  Description of Artificial Sequence: Synthetic coding sequence
atgaccgacggcaagctgagcaccagcaccaacggcgtggccttcatgggcatcctagacgggagacccggaaaccccctgcagaatctgcagcatgtgaacctgaaagctcccaggctgctatccgccccggagtacggtcctaagctaaagctcagagcgctggaagaccgtcactcactccagtccgtagacagtggcatacccaccctcgagattggcaatcctgaaccagtgccctgcagcgccgttcacgtcagacggaaacagtccgactccgacctgattccagaaagggccttccagtcagcatgcgccctgccgtcatgtgccccccctgccccctcctcgactgagcgggaacagagcgtccggaaaagcagcactttccctaggaccgggtatgatagcgttaagctatattctcctacttcaaaggcccttacaaggagtgatgacgtgagcgtgtgttccgtcagttcacttggtacagaactgtccacaacgctgtcagtctccaacgaagacatccttgacctggttgtcacatcgtccagctcagccatagtcaccctggaaaatgacgacgatcctcagtttaccaacgtgactctctcctctatcaaagagacacgcgggctgcatcagcaggactgcgtccacgaggctgaggaaggatcgaagcttaagatactggggcccttttctaacttctttgctcgcaatctgttggccagaaagcaatcagcgcgcttggataaacacaacgacctgggatggaagttatttggaaaggcaccactgcgggaaaacgcccagaaagacagtaagaggatccaaaaagaatatgaagataaggcaggccgtccaagcaagcctccctcacccaaacagaatgtcagaaaaaatctggactttgaacctctgagcaccacagccctgatcctggaggatcgacccgcaaacctgcctgctaaaccggccgaggaggcacagaaacaccgccagcaatacgaggagatggtggtgcaagccaaaaagcgggaactgaaagaagcccagcgacgcaagaagcagctggaggagcgctgccgcgtggaggagagcatcggaaacgcggtactgacttggaacaatgaaattcttcccaactgggagaccatgtggtgttctaggaaagtcagggacctctggtggcaaggaatcccgccatcagtgcgaggtaaagtctggtctctcgccatcggcaacgaactgaatataacccatgagctgttcgacatttgtttggcccgggcaaaggagaggtggcgctccctgagtacaggggggtcagaagtggaaaatgaggacgccgggttcagtgcagctgacagagaggcctctcttgagctgattaagcttgacatctccagaacatttcccaacttgtgcatcttccagcagggtggcccgtaccacgacatgctgcattccatcctgggggcatacacttgttacaggcctgacgtgggctacgtgcagggcatgtcctttatcgcagccgtgttgattctgaatcttgacacagcagacgcgtttatcgcattcagtaatctgctcaacaagccttgtcagatggctttttttagagtagatcacggtctgatgctgacatattttgccgccttcgaagtgttctttgaggagaatctcccaaaactattcgcgcattttaagaaaaataacctaacgccagacatctacctgattgattggatctttacactgtactctaagtctctccctcttgatttggcgtgtaggatctgggacgtgttttgccgggatggtgaggaatttctgttcagaaccgccctgggtattttgaagctgttcgaggatattctcaccaagatggacttcatacacatggcacagtttctaacgcgcctgccggaggatttgcccgcggaagagctgtttgcttcgattgctaccatccagatgcagtcaaggaacaaaaaatgggctcaggttcttactgccctccagaaagacagcagagagatggagaagggatctccttcactgcgacactag

SEQ ID NO: 51310 - DNA, 1242 bp, Artificial Sequence
  Description of Artificial Sequence: Synthetic coding sequence
atggagtacgaggacaaggccggccggcccagcaagccccccagccccaagcaaaacgtgcgcaaaaacctggattttgagccactgtcaactacagcgctaatcctggaagatcgacccgccaacttgcccgccaaaccagccgaagaggcccagaaacatagacagcagtatgaggaaatggttgtacaggccaagaaaagggagttaaaggaggcccagcggcgtaagaaacagctggaggagcgttgtcgagttgaagagtcaataggtaatgccgtactaacatggaacaatgagattctgcctaattgggaaaccatgtggtgttcacgcaaggtgcgcgacctttggtggcaggggattcccccttctgttcgaggcaaagtatggagcctggccattggaaatgagttgaatatcacacatgagctgttcgatatctgcctcgctagggccaaggagcggtggcggagcctctctaccggcggctccgaggtggaaaacgaggatgctggctttagcgctgccgaccgggaggccagtttggagctgataaagctcgatatatcacgtactttcccgaacttgtgtatctttcagcagggaggaccttatcatgacatgctccactctatcctcggggcatatacctgttaccgtcctgatgttgggtatgtccaagggatgtcgtttatagcggctgtgctgattcttaatctggataccgcggatgctttcattgccttcagtaaccttttgaacaagccctgtcagatggcctttttcagggtcgatcatggtttaatgctgacatactttgctgctttcgaagtattcttcgaagaaaacctgccaaagctctttgctcatttcaagaagaacaatctcactcctgacatctatttaatcgactggattttcactttgtattccaaaagcttgccattggatctcgcctgtcgaatttgggacgtgttctgccgggacggcgaggagttcctgttccggactgctttaggaattctcaagttgttcgaagatatcttaacaaagatggacttcattcacatggcccagtttctcacccgtcttcccgaagaccttcctgctgaagagctgtttgctagcatcgccacaatccagatgcagtctcgcaataaaaaatgggcccaggtattgaccgcccttcagaaggacagcagagagatggaaaagggctctcccagcctacgccactag

SEQ ID NO: 51311 - DNA, 2304 bp, Artificial Sequence
  Description of Artificial Sequence: Synthetic coding sequence
atgagcctgggccggctgctgcggcgggccagcagcaaggccagcgatctactcaccctcacccctggtggatccggctctggttctccttcagtactggacggcgagatcatctattctaaaaacaacgtgtgcgtccacccgccggaggggctgcaagggctgggtgaacaccaccccggctatctttgtctgtatatggaaaaagacgagatgctcggggctacactgattctggcgtgggtgcctaactctcgcattcagaggcaagacgaagaagctctgcgatacatcacacctgaaagtagtcccgtgcgaaaagctcctaggccacgcggacggcgaactcggtcatccggtgcctcacaccaaccctctcctacagagctgagaccaaccctgacgccaaaagacgaggacatcctggtggtggcacaaagtgtgcccgaccgaatgctagcctcaccagcacctgaggacgaggaaaagctcgcgcagggactcggcgtagatggggctcagcctgcttctcagcccgcatgcagccctagtggaatattatccacggtctctccccaggatgtaactgaggaaggccgggagccacgtccagaggctggggaggaggatggatctttggagttaagcgctgagggggtaagccgtgacagctcattcgattcagactcagatacattttcatcccccttttgtttgagcccaatcagcgcagccctggccgaatcacgcgggtctgtgttcctggagagcgattcatctcctccatcctcatcagacgccgggctgcgattccctgacagcaacgggctgctgcagactccacgttgggacgagccccaaagagtgtgcgcgctcgagcagatatgcggggtgttccgtgtagacctgggtcacatgcggagcctcagactgttcttctcagacgaagcttgtacctccggccagctggttgtggccagtcgggagtcccagtataaagtgttccatttccatcacggaggactggataagctgtctgatgtgttccagcaatggaaatattgcacggaaatgcaactgaaggatcaacaggtggctcccgataagacttgcatgcagtttagcatcagacgcccgaaattgccttcctccgagacgcatcccgaagagtctatgtacaagcgcctgggtgtttccgcttggctgaatcatttgaatgaactaggacaggtagaggaggaatacaagctgaggaaagctatcttctttggcggtattgacgtctctattcgtggagaggtgtggcccttcctcctgcggtactatagccatgaaagcacttcagaagagcgcgaagccctgcgtctgcaaaagagaaaagagtattctgagattcagcaaaagagactctccatgactcccgaggaacacagggctttctggcggaacgtgcaatttacagtggataaggacgttgtgagaacagaccgaaataaccagttttttaggggagaggacaaccccaacgtggagtccatgcgtaggatactgctaaattatgccgtttacaaccctgctgtggggtactcacaggggatgtccgatctggtagcaccaattttggctgaagtactcgatgaatccgacacattctggtgtttcgttggcctcatgcaaaacaccatctttgtgagtagtccacgggacgaagatatggagaaacagctcttgtatctgagagaactgcttagactgacacacgtcagattttatcagcatctggtgagcctgggagaggatggcctccaaatgcttttttgtcacaggtggctcctgttatgtttcaaaagagagttccctgaggcagaggccctgaggatttgggaggcttgttgggcccactatcaaacagactacttccacctttttatctgcgtggccatagtggccatctacggggacgatgtcatagaacagcagctcgcaacggaccagatgctcctgcattttgggaacctggccatgcacatgaatggcgaactggtgctgcgcaaagcccggtcactcctctaccagttcagattgcttccccgcattccatgttctttgcacgacttgtgcaagctttgcgggtcggggatgtgggattcagggagcatgccagctgtggaatgcacaggacatcaccccggttctgaaagttgcccatatggcggcaccgtggagatgccgtccccaaagtctcttagagaaggcaagaagggaccgaaaacccctcaagatggattcggatttcgccgctag

SEQ ID NO: 51312 - DNA, 1218 bp, Artificial Sequence
  Description of Artificial Sequence: Synthetic coding sequence
atgaaggtggcccccgacaagacctgcatgcagttcagcatccggaggcccaaattaccttcctctgagacacatcctgaagagtcaatgtataagcgcctgggagtttctgcttggttgaaccatttaaatgaactcggacaggttgaggaagagtataaactgcgcaaagctatattctttggcggaatagatgtatctataaggggggaggtgtggccttttcttcttcgatattactctcatgaatcaacctccgaagaacgcgaggccctgcgtctgcaaaaaagaaaggagtactcggagatccaacaaaagaggttatctatgacccccgaagagcatcgggcgttttggagaaatgttcagttcactgtggacaaggatgtggtacgcacagatcggaataatcaattctttcggggggaggataaccctaacgtcgagtccatgcggcgaatcctcctgaactacgcagtgtataaccccgcggttgggtactctcagggcatgtccgacttggttgccccgatcctcgctgaagttttagatgaatcagacaccttctggtgtttcgttggacttatgcagaatacgatcttcgtctcctcgcctcgcgatgaggatatggagaagcagctgctgtacttgcgggagctccttaggctgacacacgtcagattctaccagcacctggtgtctctcggagaggatggcctgcagatgctgttctgtcataggtggctcctcctgtgttttaagcgagagttcccggaggccgaggcactccgcatctgggaagcctgctgggcgcattatcagacggattatttccatctcttcatctgcgttgcgatcgtagccatctacggcgatgacgttattgaacagcagctggcaactgaccagatgctcttgcatttcggaaatctcgccatgcacatgaatggcgagttagtgctgagaaaagcccgctccctcctgtaccagtttcggctgcttccaagaatcccctgttctctgcatgatctctgcaaactgtgtgggtctggtatgtgggatagtggtagcatgcccgccgtagagtgcactggccaccatcccggatccgaatcctgtccgtacggaggcacagttgaaatgccatccccaaagagcctgcgcgagggaaagaaaggtcctaagaccccccaggatggtttcggtttccggcggtag

SEQ ID NO: 51313 - DNA, 2154 bp, Artificial Sequence
  Description of Artificial Sequence: Synthetic coding sequence
atgggcgacctgcccccctaccccgagcggcccgcccagcagccccctgggcggcgcacgagtcaggcctcacagcgtcggcactccagagaccaagctcaagctctggccgcagaccccgaggagagacaacaaatccctcctgacgcccagcgtaatgcccccgggtggtctcagagggggtccctctctcagcaagagaacttattgatgccccaggtgtttcaggctgaggaggcccgtctcggaggtatggagtacccttcagtgaacactgggttcccctctgagttccagcctcagccttatagcgacgagagtcggatgcaggtggcagagctgacgactagcttaatgctgcagaggctgcagcagggtcagtcctctctgttccaacaactcgatcctacattccaggagcccccggtgaaccccctgggtcagtttaatctttatcagacagatcaattttctgagggagcacagcacggtccctacataagagacgaccctgcactacagtttcttccctcagaattgggcttcccacattactcggctcaagtgcctgaacccgaacctctggagctcgccgtgcaaaacgctaaagcttacctgctgcaaacctcaattaattgcgacctcagcctgtacgagcatctggtgaatctgcttaccaagatcctgaatcagagacccgaggacccactgagcgtacttgagagtctgaatagaactacgcagtgggagtggtttcatccaaagctggacacacttcgagatgaccccgagatgcagcccacatataagatggccgaaaagcaaaaagccctgttcactagaagcgggggcggtacggaaggcgagcaggagatggaagaagaggtgggcgagacgccggtcccgaacatcatggagaccgcattctactttgaacaagctggcgtcggcctctcctctgacgagagctttagaatcttcctggcaatgaaacagctggtggaacagcagcctattcatacctgcagattttgggggaagattctggggatcaaaaggagttacctggttgcggaggtggaatttagagaaggcgaagaggaggctgaggaagaagaggtagaggagatgactgagggcggcgaggtcatggaggcccacggagaggaagaaggtgaggaagatgaggagaaagctgtggacatagtgcctaagagcgtgtggaagcctcccccagtgatcccgaaggaagagtctcgatctggtgcaaacaagtatctctacttcgtgtgcaatgagccgggactgccctggactcggctccctcacgttaccccagcccagatagtcaatgctaggaaaatcaaaaagtttttcaccgggtacctggataccccagtggttagctatccacctttccctggcaatgaggccaactatctcagagcacagattgcaaggatttccgcagctacccaagtttcccccctgggcttttaccagtttagtgaggaggagggtgacgaggaggaggaagggggcgccggtagagactcttatgaagaaaaccccgattttgagggtatccctgttctagagctcgttgacagcatggccaactgggtgcatcatacccaacatatcctgcctcaggggaggtgcacttgggttaatcccctgcagaagacggaggaagaagaggatctgggagaagaggaggaaaaagctgatgaaggtcccgaggaggttgaacaggaggtgggccctcctcttttgacacccctgagcgaagatgctgaaatcatgcacctggctccttggaccacccggctgtcatgctctttgtgcccacagtactcagtggccgtggtgcggtctaacctctggccaggcgcctacgcctatgccagcggaaaaaaatttgaaaacatttacatcggctggggccataagtattcgccagagagcttcaatccggctctcccagctcccatccaacaggagtatccaagcgggccggagattatggaaatgtccgaccccacggtcgaggaagagcaggccttgaaagcagcccaggagcaagctctgggagccaccgaagaggaagaagaaggggaggaagaggaggaaggggaggaaaccgatgactag

SEQ ID NO: 51314 - DNA, 1848 bp, Artificial Sequence
  Description of Artificial Sequence: Synthetic coding sequence
atggagggcgccggctaccgggacaacgacgtgctgctgcactgggcccctgttgaggaggctggcgatagtacgcagatcttattttctaagaaagactcaagcggcggggactcttgtgcctcagaggaagaaccaacgttcgaccctgactacgagcctgattgggccgtaatctcgacagtgcggcctcagctctgtcacagtgagccaactcgcggagctgagcctagctgtccacaggggtcatgggcgttcagtgtaagcctcggcgagttgaagagtattcgaaggtctaaacccggcctgagctgggcctatcttgtcctcgtcactcaggctggggggtcacttccagctctgcacttccatagggggggtactcgggctcttttacgcgtcttaagtcgctatctcctccttgccagttccccacaggacagtcggctgtacctggtttttccgcatgacagtagtgctctatccaactcctttcaccatctgcagctcttcgatcaggactcctccaacgttgtatctcgcttcttgcaggacccatacagcacaaccttttcttcatttagtcgggtgactaatttctttcggggcgcccttcagccccagcctgaaggcgctgcttctgacctgccccctccgcccgacgatgaaccagagcccgggttcgaagtgatatcctgtgtcgagctggggcctcgccctacagttgagagggggccgccagtcactgaagaggagtgggccaggcacgtgggaccggaggggcggcttcaacaggtgcccgaactcaaaaaccgcattttttcagggggattatctccatctctgcgtcgtgaagcctggaaatttcttcttggctacctatcctgggagggtaccgcagaagagcacaaggcccatattagaaaaaagacagatgaatacttcagaatgaagctacagtggaaatctgtttcccccgagcaagagagaaggaactctctgctacacggctatcgcagcttgatagaaagagacgtgtctcggacagaccgcacaaacaaattctatgaaggccccgaaaacccaggcttgggactgttgaatgatatcctattaacctactgtatgtaccactttgacctgggttatgtccaaggtatgagcgacttgttgtcccctattctgtatgtcattcagaacgaggttgacgccttctggtgtttttgcggttttatggagctcgtgcaagggaacttcgaggaatcgcaggaaaccatgaagagacagctgggacgactactattactactacgtgttctggatcccctgctttgcgactttctggattcgcaggactcgggcagcctgtgcttttgttttcgctggttgctgatatggttcaaacgtgagttcccatttcccgatgttttgcgactgtgggaggtgctgtggaccggtctgcccgggccaaatttgcatttgctggtggcctgtgcaattctcgatatggagagagacaccttgatgctgagcggcttcggcagcaatgagatcttgaagcacattaatgaattgaccatgaaactgtccgtggaggatgttctcacccgcgcggaggcactccatagacagcttactgcttgtccggagctacctcataacgtgcaagagatactagggttagctcctcccgcagaaccacactcaccctcccccaccgccagtcccctgcccctcagtcctacaagggccccgcccaccccaccccccagtacagacaccgcacctcagccagattcatctcttgaaattctgccggaggaagaggatgaaggggcggattcctag

SEQ ID NO: 51315 - DNA, 1581 bp, Artificial Sequence
  Description of Artificial Sequence: Synthetic coding sequence
atgctgcaggaggagagcgacctgagcctgatcatcgcccagatcgtccagaaactgaagggttctaacctctactcacagcttgaaagacaggcttgggcttccctacagcggccggaaatcaagttagaatctttgaaggaggacattaaagaatttttcaagatctccgggtgggagaagaaattgcagaacgcagtctactcggaattatcggtgttccctctccccagtcacccagcggccccaccagaacacctgaaggaaccgcttgtctacatgcgtaaagcacaggggagttgggagaagagaatcttaaagtctctcaatagcatgtgcacagagctcagtattcccctggcccgtaaaagaccagtcggggagcagaaagaactcctgaacaaatggaatgaaatggggacagatgagcctgacctctcccttttccggcccgtgtacgccccaaaggatttcctagaggtacttataaacctgagaaaccccaattacgagaatggagatagcctgtccttcaggacgcatctgggtcttatacaggtgccactcaaagtgaaagacatacctgaactgaaggagtgtttcgtggagctgggcctgaatatcggtcagctcggaatcgacgattcgacacaagtcccacccgaactgtttgagaacgagcatgtgaggattggacagaaagtcctcgccgaacaggactctgccgctgctcagcagtacattcgtcagggcagccccaccgcattacgtgctgagctgtgggctctgattttgaacatatcatcccagcctgaagatgtcctttactacgagcagcttaaaaccaacgtgatacagcatgacctgctggtggattctttgatctataaagacgtcaagctcactgctagtaacgatgactactatttcgtatttgaggattatctctatcaggtgctgctgtgcttctcccgcgacacatccgtcctcagccactttgccttcaattcggctagcccccctaaatcatacatccggggaaaattgggcttggaagaatacgcggttttttacccacccaacggtgtgatccccttccatggcttttcaatgtatgtggcccctctgtgcttcctgtaccacgagccctcaaaactctaccagatctttagagagatgtatgtgagatttttctttagattgcacagtatcagcagtcatccatctggaattgtctctctatgcctcctgtttgaaaccttattgcagacgtacctgcctcagcttttctatcatctaagagaaatcggcgctcagcctctgagaatctctttcaaatggatggtacgtgccttttccggctaccttgctaccgatcagctcttactgctgtgggatcggatcctcggctataactcactggaaatcttagctgtcctcgcagccgctgtgttcgcctttcgggccgtgaatttaatggaagttacttcacttgctgctgctgaggcggtgctcgcagacctgagcacactgaaggtgatgccactgctccaaattttcttgttcgctaccgtaacgtag

SEQ ID NO: 51316 - DNA, 1386 bp, Artificial Sequence
  Description of Artificial Sequence: Synthetic coding sequence
atgctgcaggaggagagcgacctgagcctgatcatcgcccagatcgttcaaaagctcaagggctctaatctgtattcccagttggaaaggcaagcctggggcagctgggaaaaaagaatactcaagtctctaaatagcatgtgcacggaactatctataccattggcgagaaagcggcccgttggggaacagaaggagcttttgaataagtggaatgagatgggcaccgatgagccggacctttcgctcttccgaccggtgtacgcccctaaggacttcctggaggtcctgatcaacctacggaaccctaactatgaaaacggcgactctttatccttccgcacgcacctcggattgatccaagttcctctgaaagtgaaagacattccagaactgaaggaatgcttcgtagagctgggactgaacatcggccagctaggcatcgacgactccacccaggtgccccccgagctatttgagaacgaacatgtgcggatcggacagaaagtcctggctgaacaggattccgccgctgcacagcaatacatccgtcagggttctcctactgctctgcgggccgaattgtgggctttgatcctcaacatcagttcccagccagaggatgttctgtattacgagcagctgaagacaaatgtgatacagcacgatctgctagtggactcgttgatttataaggacgttaaactgaccgcttctaacgatgactattacttcgtcttcgaggactacctttatcaagtgctcctttgcttcagccgggacacttctgtgctctcccacttcgcctttaacagtgctagtccaccaaagtcttacattcgaggaaaacttggcctggaggaatacgctgtcttttaccctcccaacggggtgattcccttccacggattctcaatgtacgtcgccccactgtgcttcttataccacgaaccgtcaaagctgtaccagattttcagagagatgtacgtcagattttttttcaggttgcattctatttcctcccacccctccggcatagtgtccctgtgcttgctgtttgaaaccctacttcagacgtacctgccccagctgttttaccatctgcgcgagatcggcgcacagcctctgcggatctcattcaaatggatggtgagagcattcagtgggtacctagccacagaccagcttctgctcctttgggaccgaatcctgggttacaacagtctcgaaatcttagccgtgcttgccgccgcagtcttcgccttccgcgctgtgaatctgatggaggtgacaagtttggccgcagctgaggctgttctggctgacttaagcacgttgaaagtgatgccgttgctccaaatctttctgtttgccaccgtgacctag

SEQ ID NO: 51317 - DNA, 1011 bp, Artificial Sequence
  Description of Artificial Sequence: Synthetic coding sequence
atgaccaccctgagccccgagaacagcctgagcgcccggcagagcgcttcttttatcctcgttaagaggaagccccctatcgacaagaccgagtgggattctttcttcgacgagtctgggcacttggcaaagtcacgggacttcatctgtgtaaacatcctggagagggggctccatccctttgtgcggaccgaagcatggaagttcctcactgggtattttagttggcagtcctctcaggacgaacgactgactgtggactccatgaggcggaagaattataaggcactgtgccaaatgtatgaaaagatccaacccctcttagagaacctgcacagaaactttacagagacgcggaataacatcgcgagggatatacagaagatttacgataaagatccgttagggaatgtgctgatcgataagaaaagactggagaagatcctcctcttatcttatgtgtgcaatacacaggcagagtaccaacagggctttcacgaaatgatgatgctgtttcagctaatggtcgagcatgaccacgagaccttctggttgtttcagttttttctgcaaaaaaccgagcactcctgcgttatcaatattggcgtggcgaaaaatttagacatgctgtccacgctgattacattcttggaccctgtgtttgccgaacacctaaagggaaagggcgccggggccgtacagagtctgttcccatggttctgcttttgttttcagagggcctttaagtcttttgacgatgtctggcgtctgtgggaagtgctgctgaccgggaagccctgccggaatttccaggtgctcgtcgcgtactctatgcttcagatggtcagggagcaagtgctccaggagtcaatggggggggatgacatcctgttagcctgcaacaatctgatcgatctcgacgctgacgaactcatatcagcagcatgtgtggtgtatgccgagctcatccagaaggatgtcccccagacactgaaagattttttcctctag

SEQ ID NO: 51318 - DNA, 903 bp, Artificial Sequence
  Description of Artificial Sequence: Synthetic coding sequence
atgaccaccctgagccccgagaacagcctgagcgcccggcagagcgcctctttcatactggggctgcacccattcgttcgaaccgaggcgtggaaattcttgactggatactttagttggcagagtagccaagacgagaggctgaccgtggacagcatgagaagaaagaattataaggccctatgccagatgtatgaaaagatccagcctcttcttgaaaatctgcatcgcaacttcacagagacacgcaacaacattgcaagagatattcagaaaatttatgacaaggaccccctgggcaatgtcctgatcgacaaaaaaaggttagaaaagatcctactactgtcgtacgtgtgtaatacccaggccgaatatcagcaaggatttcacgaaatgatgatgctgttccaattaatggtcgagcatgatcacgaaactttttggctgtttcagttttttctgcagaagactgagcattcgtgtgtcatcaatatcggggtggccaagaatctcgatatgctgtccactttgatcactttcctggaccccgtgtttgccgagcacctgaaaggcaagggagcaggggcagtgcagagcctgtttccttggttctgcttctgttttcaaagagccttcaaatcttttgatgatgtgtggcgtctttgggaagtgttactgaccggcaaaccttgcaggaacttccaggtgttggtcgcgtacagtatgctgcagatggttcgggaacaagtcttgcaagaaagcatggggggagatgacatcctccttgcatgcaacaatctgatcgacctggacgccgacgaactgatctcagcggcgtgtgtggtatatgctgagcttatacagaaggatgttcctcaaacactgaaggattttttcctttag

SEQ ID NO: 51319 - DNA, 1554 bp, Artificial Sequence
  Description of Artificial Sequence: Synthetic coding sequence
atggccagcgacggcgcccggaagcagttctggaagcggagcaactcgaagctgccaggcagtatacaacacgtctacggagctcagcatccaccattcgatccattgcttcatggcacgttactccgctctaccgcaaaaatgcccaccacgcccgtaaaagcaaagcgggtctctacctttcaagagttcgaaagcaatacaagcgacgcgtgggatgctggtgaggatgacgatgaactacttgccatggccgccgaatcgctgaacagtgaggtggtcatggagactgcaaatagggtgctgcggaatcattctcagcgccaaggcaggcctacactccaggaaggtcctggcctgcagcagaagcctaggcccgaagcagagccgcccagtcctccttcaggtgatctacgactggtgaagtccgtgtctgaatcccatactagttgtcctgcggagtctgcctcagatgcggcccctctccagcggagccaatccctgccccacagtgcaacagtcacgctagggggaacctccgacccaagtactctgagttccagcgccctctccgagcgcgaagcctcccgccttgataagtttaaacagctcttggctggccccaataccgacctcgaggagctaaggaggctgtcgtggtccggaatccctaagccagtaagaccgatgacatggaaactcctctcaggctacctccccgccaacgtagatcgccgaccagccaccctccaacgaaaacaaaaagagtactttgcgttcatcgaacattattatgactcccgcaacgatgaggtccatcaggatacttatcgccaaatacacatagatatcccgcggatgtcccccgaggcactgattctgcagcctaaagttaccgagatttttgaacgtatcctgtttatttgggccatccggcatccggcctctggctatgtacagggtatcaacgatctcgtcacaccctttttcgtggtctttatttgtgagtatatcgaggctgaggaggtggataccgtcgacgtgtcaggcgtcccagccgaggtgctctgcaacatcgaggccgatacatattggtgcatgagtaagctcctcgatggaattcaagataattacacgtttgcccagcctgggatccagatgaaggtgaaaatgttggaagagcttgtcagcaggatcgacgaacaagtgcaccgccatctggatcagcatgaagtgagatatctccagtttgccttccggtggatgaacaacctgctgatgcgcgaggtgcccctccgatgtacaatacggctgtgggacacatatcagagtgaaccagacggattcagtcatttccatctttatgtctgcgctgcatttcttgtgcgatggcgcaaagaaattttggaggagaaggatttccaggagctattactgtttctacagaacctgcccactgcacactgggatgacgaggacatctctttactgctcgccgaagcgtacagactcaagttcgccttcgccgacgcacccaaccactacaagaaatag

SEQ ID NO: 51320 - DNA, 1320 bp, Artificial Sequence
  Description of Artificial Sequence: Synthetic coding sequence
atggccagcgacggcgcccggaagcagttctggaagcggagcaactccaagcttcctggcagtctgctacgctcaaccgcaaagatgcccacgacccctgttaaagctaaacgagtttccacgttccaggaatttgaaagcaacacgagtgacgcttgggatgcaggagaggacgatgatgaactcctggcaatggccgccgaaagccttaacagcgaggtggtcatggaaacagccaacagagtgttgcgcaaccatagtcaacgccagggtcgtcctaccctgcaggaaggtcctggactacagcaaaagccgcggccggaagcagagccgccttctcccccgtcgggcgaccttcgcttagttaagtctgttagcgagtcacatactagctgcccggctgaggagctgcgaagactgtcatggtcaggcattcccaagcctgtgcggcctatgacatggaaattgttatccggatatctgcctgcgaatgtcgaccgccggcctgcgacccttcagcgcaaacagaaggagtactttgcattcatcgagcactattatgactctcgaaacgatgaggtgcatcaggacacctaccgccagatccacattgacatccctaggatgtcccctgaagcgcttatcttgcaaccgaaagttactgagatattcgagcgtattctcttcatttgggccatcaggcacccagccagcggatacgtgcagggcattaatgatcttgtgaccccgttctttgtcgtctttatttgtgagtacattgaggccgaagaagtggacaccgtcgacgtttccggcgtgccggcggaggtcctatgcaacattgaagcagacacctattggtgcatgtcaaaactgttggacggtatccaggacaattacaccttcgcacaaccaggtattcagatgaaggtgaagatgctggaggaactcgttagtagaattgatgaacaagttcacaggcacctggatcagcacgaggtgcggtatttgcaatttgccttccggtggatgaacaacttgctaatgcgcgaggtccccctgcgctgtacgatcagactttgggatacataccagtcggaaccggacggattcagccactttcatctgtatgtgtgcgccgcgttcttggtccgatggagaaaagagattctggaagagaaagatttccaggaacttctgctgtttctccagaatttacccacagctcactgggatgacgaagatatctcattgctattggctgaggcataccgactcaaatttgcgttcgccgatgcccctaatcactataaaaagtag

SEQ ID NO: 51321 - DNA, 975 bp, Artificial Sequence
  Description of Artificial Sequence: Synthetic coding sequence
atgcccaccacccccgtgaaggccaagcgggtgagcaccttccaggagtttgaaagcaatacgagcgatgcctgggatgccggagaggacgacgacgagttacttgcaatggctgccgaaagcctgaatagcgaggtggtgatggagactgctaatcgggtgctgcgaaaccatagtcagcgacagggacggcccacgctgcaggaagggcccggcctgcagcagaagccaagacccgaagctgaaccccccagtcctccatctggcgatctccgccttgtgaagtctgtgagtgaaagccatacctcctgtcctgctgagagcgcatcagatgccgctcccttgcagaggtcccagtcattgccccattcggccaccgtcacactcggcggaacttcagatccaagcactctatcatcctcagccctgagcgaacgggaggccagccgactcgacaaatttaaacagttgctcgcaggccctaataccgacttggaagagttgagaagactcagctggagcggtatacctaaaccagtgagaccaatgacgtggaaattattgagcggctatctccccgcgaatgtggataggcggcccgccaccctgcaacgtaaacagaaagaatatttcgcgtttatcgagcactattatgattccaggaacgacgaagtccatcaggatacctacagacagatccacattgacatccccaggatgtctcctgaagccttgatcttacagccaaaggtaactgaaatctttgagaggattctgtttatctgggctatcaggcaccccgcaagcggatacgtccaggggataaatgatcttgttaccccgttctttgtggtgttcatttgcgagtacatcgccttcccaggttgcggcagacctcagatacctattctggctgtgatatggagggatgagccctatccacgcacagacgagcagatcatcctgaggaggtag

SEQ ID NO: 51322 - DNA, 1413 bp, Artificial Sequence
  Description of Artificial Sequence: Synthetic coding sequence
atgcccaccacccccgtgaaggccaagcgggtgagcaccttccaggagttcgaatccaatacctcggatgcttgggatgcgggtgaagatgatgatgagctgctcgctatggccgccgaatcacttaattctgaggtagtgatggaaacggccaatcgggtcctgcggaaccactcacagaggcagggcagacctactttgcaggagggccctgggttgcagcagaagcctcgacccgaagctgagcccccttccccgccctctggagacctccgccttgtcaaatcagtctccgaatcacacacttcttgcccagctgagagtgcttctgacgctgctcctctgcagcggagccagtctttgcctcacagtgcaacggttaccctgggtggaacaagtgatccgagtacactgtctagcagtgctttgtccgagcgtgaggcaagccgcttggacaagtttaaacagctgctggccggtcccaatactgatctcgaagaactgagaagactctcatggagcggtatcccgaaaccggtgagaccgatgacctggaagctgctctcagggtatctccccgcgaatgtggatcggcgacccgccactctccagagaaagcagaaagagtacttcgctttcatcgaacattattatgatagccggaacgacgaagtccaccaggatacctacagacagatacatattgacataccacgtatgtctccagaggcgttgatcctacagcctaaggtgacagaaatcttcgagaggatcctgtttatttgggccattcggcaccccgcttcaggctatgtgcaaggcataaatgacctggtgacccctttcttcgtagtgttcatctgtgagtatatcgaagcggaggaagttgataccgttgatgttagcggtgtgcctgccgaggtcctatgcaatatagaggccgatacgtactggtgcatgagtaagctgttggatgggattcaggacaactataccttcgcccagcccggaatacagatgaaggttaaaatgctcgaggaactcgtcagccgcattgatgagcaggtgcataggcatctagatcagcatgaggtgaggtatctccagttcgcttttcggtggatgaataacttactcatgcgggaagtgccattgcggtgcaccattcgattatgggacacttaccagtcagaacccgatggattctcgcactttcatctgtacgtgtgtgccgctttcctcgttagatggaggaaagaaattcttgaagaaaaggattttcaggagctccttcttttcctgcagaatcttcccacagctcattgggatgatgaggacataagcctgttgctggctgaagcttatcggcttaagtttgcttttgctgatgctccaaatcactacaagaagtag

SEQ ID NO: 51323 - DNA, 1377 bp, Artificial Sequence
  Description of Artificial Sequence: Synthetic coding sequence
atggccagcgacggcgcccggaagcagttctggaagcggagcaacagcaagctaccgggatctatacagcatgtgtatggcgcccaacaccccccctttgatcctctacttcacggaaccctgttacgcagtacagccaaaatgcccactacacctgtgaaggcaaagagagtgtcaaccttccaggaattcgagtcaaacacctccgatgcatgggacgcaggagaggacgacgacgagttactggctatggccgccgagagtctaaacagtgaagtcgtgatggaaacggccaaccgggtcctgcgtaatcatagtcaaaggcagggcagaccgacgctccaggagggccccggattgcagcaaaagcccagacctgaggcagaacccccatcaccacctagcggcgacctgcgtctggtaaaatctgtgtcggagtcacacacatcttgccctgcagaggagttgagaagactgagctggagtggtatcccgaagccagtgaggccaatgacatggaagttgctcagtggttacctaccagctaacgtcgaccggagacctgccaccttgcagcggaaacagaaggagtatttcgcatttattgaacactattatgattcgagaaatgacgaggtacatcaggatacctataggcaaatccacattgacatcccgaggatgtcccctgaggccctcattttgcagcccaaagtaacggaaatctttgaacggatcttgttcatctgggcaattagacacccggccagcggttacgtgcaggggatcaacgatctcgtgactccttttttcgtagtatttatctgcgagtatatcgaggcggaagaggtggatactgtggatgttagcggggtccctgccgaggtactctgtaacatcgaagcggatacgtactggtgtatgtctaaattgcttgacggtatccaggataattatacatttgcccagcctgggattcagatgaaagtgaagatgttggaggaacttgtgagccggatagacgagcaagttcatcgccatctggaccagcacgaggtacgctatctgcaatttgcctttagatggatgaacaatctccttatgcgagaagtgcccctgaggtgcaccatccgtttatgggacacctatcagagtgagccagacggcttttcccacttccatctctatgtgtgcgctgcattcctggttcggtggcgcaaagagatcttagaggaaaaggatttccaagagctgctcctgtttctccagaacctgcccaccgcacattgggatgatgaagacatctcgctgctccttgctgaggcgtatagactcaaatttgcatttgctgacgcgcctaatcattataagaaatag

SEQ ID NO: 51324 - DNA, 1518 bp, Artificial Sequence
  Description of Artificial Sequence: Synthetic coding sequence
atggccgccgagaacagcaagcagttctggaagcggagcgccaagttgccaggcagcatccagcctgtgtacggggcccagcacccacccctggaccctcggcttaccaagaattttatcaaggagcggtcaaaggtgaacactgttccgctgaaaaataaaaaggcaagctcattccacgagttcgcccgaaacacatctgatgcctgggacattggtgatgacgaagaggaggattttagcagcccctcttttcaaaccttgaattcgaaagtcgcgcttgcaacggcagcacaagtgctagagaaccattcaaaactgcgagtgaagcccgaaagatctcagtcgacaaccagcgacgtcccggccaactataaggtcattaagtcgtctagtgacgcccaactgagtaggaactcaagtgatacgtgccttcgcaatcccctccacaagcagcaaagcctccccctcaggccgatcatcccactggtagcacggatctctgaccagaacgccagcggagccccccccatgacagttcgggagaagacccggctggaaaaatttcgccaattactgagctcccagaatacggatttggacgagctccgaaagtgttcctggccaggggtgccacgcgaggtgcgacccatcacttggaggctcctgagtggttatctcccagcaaatacggaacgaagaaaactcaccttacagcgaaagcgtgaggagtactttggcttcatcgagcagtattacgatagtcggaacgaggagcaccatcaagatacttatcgccagatacacattgatatcccaagaaccaatcctctgatccccctgttccagcaacccctggtccaggaaatttttgagcgaattctattcatttgggccattcgacatccagcctcaggctatgtgcaaggcatcaacgatctggtaactcctttttttgtggtgtttctaagtgagtatgtagaagaagacgtggaaaacttcgacgtaaccaatctgagtcaagacatgctgcgatccattgaggcagacagcttctggtgcatgtcgaagctgctggacggtatccaagataactatacctttgcacagccgggcattcagaagaaggtgaaagctttggaagagttagtctccagaatagacgaacaggtgcataaccacttccgaaggtacgaggtggagtatctgcagtttgccttccgttggatgaacaacctattaatgcgagagctgcctctgcggtgcactatccgcctatgggatacatatcaatcagaacccgaggggttctctcactttcacctgtacgtgtgtgccgcgtttctaatcaagtggaggaaagagattttagatgaggaggacttccaaggtctcctcatgctcctccagaacctcccgactatacactggggaaatgaagagatcggcttactcctggccgaggcatacaggttgaagtacatgtttgccgatgcaccaaatcattacagacggtag

SEQ ID NO: 51325 - DNA, 2055 bp, Artificial Sequence
  Description of Artificial Sequence: Synthetic coding sequence
atggccgagggcgaggacgtgccccccctgcccaccagcagcggcgacggctgggaaaaggatcttgaggaagcactcgaagcagggggttgtgacctcgagacactacggaatatcattcagggacgcccgctcccggccgacctgagggccaaggtctggaaaattgctttgaacgtcgccggcaaaggagattctctggcttcgtgggacgggattttggacctccccgagcagaataccatacacaaagactgcctccagttcatcgatcagctgagcgtccctgaggagaaagcagcagagctgcttttggatatcgagagtgtgatcacattttactgtaagtctcgcaacatcaagtactcaactagcttatcttggatacacctacttaagcccctggtccatctgcagctgccgcggtctgacctatacaattgtttttacgcaatcatgaataaatatatccccagagattgttcccaaaagggaagaccatttcacctgttcaggttgcttattcagtatcacgaaccggaactgtgttcttatttggacactaaaaagattacgcccgattcctatgctttgaattggctcggctcattattcgcttgctactgtagcacagaggtcacccaggcgatttgggacggataccttcagcaagcagatccattctttatttattttctgatgctaattattctggttaatgctaaggaagtgatcctgactcaggaatccgattctaaagaagaggtgataaaattcttggaaaatactccaagcagcctgaatatcgaagatattgaagatctgttcagtctggcccagtactactgctctaaaacacctgcatcttttcgcaaagataatcaccacctcttcggatctaccctgctagggatcaaggatgacgatgccgacctgagccaagccctctgcttggcgatcagtgtgagcgaaatcctccaggccaaccagctccagggtgagggagtgcgattcttcgtcgtagattgcaggccggccgagcagtataatgctggacacctttccactgccttccatcttgactcagatctgatgttgcagaaccctagcgaatttgcccagtctgtgaaaagcttgctggaggctcagaaacagtccattgagtccggatctattgccggaggggaacacctgtgctttatgggctccggaagggaggaggaggacatgtatatgaatatggttctcgcccacttcctccaaaagaataaggaatatgtctcaatcgcttccggaggatttatggcactgcagcaacacctcgcagatattaatgttgatggtcccgaaaatgggtatggacattggatagcatcaacgtcagggtctaggagttcaatcaacagcgtggacggtgagagccccaatggctcttcagataggggcatgaaatccctcgtgaataaaatgactgttgctctcaaaacaaaatcagtgaatgttagagaaaaggtgatatcctttattgagaataccagcacacctgtggaccggcacgtttccagcagtgaccgggtgggaaagccttatcgtggggttaaacccgtgttttctatcggggatgaggaagagtatgatactgacgagatcgacagcagcagcatgtccgacgacgaccggaaggaagtggttaacatccagacatggataaacaagccagacgttaaacaccattttccatgtaaagaggtgaaagagagtggacatatgtttccctctcacctgctggtaaccgccacacatatgtactgtttgcgggaaattgtgtctcggaaaggtctggcatacattcagtctcgccaggctttgaactcggttgtgaaaattacatcaaaaaagaagcaccccgagctgataacatttaaatatggaaacagctcagcaagtggcattgagatactagccatcgagcgatatttaattcccaatgcaggcgatgccacaaaggctattaagcaacagattatgaaagtcctagacgcactagaaagctag

SEQ ID NO: 51326 - DNA, 2100 bp, Artificial Sequence
  Description of Artificial Sequence: Synthetic coding sequence
atggccgagggcgaggacgtgccccccctgcccaccagcagcggcgacggatgggaaaaagatctggaagaagccttggaggctggggggtgcgacctagagaccctgaggaacattatccagggcagaccactgcccgcagatctccgcgctaaagtgtggaaaatcgccctgaacgtggctggcaaaggagatagcttagcctcatgggatggcatcctcgatttacccgaacagaataccatccacaaggattgcctgcagttcattgatcagctctccgtgccagaggagaaggccgctgagttattattggacatcgagtccgtcattacattctactgtaagtcacggaacatcaagtactccacttccctgtcttggatccacctcctcaagcccctcgtgcacctgcagcttccaagaagcgacctctacaattgtttttacgccattatgaacaaatacatacctcgcgactgctctcagaaaggtaggccttttcatctgttccgccttcttatccagtaccatgagcctgagctgtgctcatatctcgatactaaaaaaatcacacctgatagttatgctctgaattggctcggaagtctcttcgcgtgttactgctccacggaggtgacccaagccatttgggatggctacctccaacaagcagaccccttctttatctactttttgatgctgataatcctggtgaacgccaaagaggtcattttgacacaggagagcgacagtaaggaggaagtgattaaatttttagagaatactccgtcatctctgaacattgaggacatcgaagacttgttttctctggcccagtactattgttccaagacgcctgcctcttttcgcaaggacaaccaccacctatttggaagcaccctactgggtatcaaggacgatgacgcggacctctcacaggcactctgccttgcaatctcggtctcggagatcctgcaggctaaccagctccagggggagggagttcggttctttgtcgttgattgcaggccagccgagcagtacaacgcaggacacttgagtaccgctttccatctcgactctgacctaatgctccaaaatcctagcgagttcgcccagagcgttaaaagcctgctggaagctcagaagcaaagtattgagtcagggagcatcgcaggcggagaacacctctgctttatggggtcaggtcgtgaggaggaggacatgtacatgaatatggtcttagcgcattttctgcagaagaacaaggagtacgtgtccatcgctagtggtggttttatggctttgcaacagcacttggccgacatcaacgtggacggacctgaaaatggctacggacactggatcgctagtaccagcggaagtcgctcctctattaacagcgtcgacggagagagcccaaatggttcttctgacagaggcatgaagtcactggtcaataaaatgaccgtggccctgaagacaaagtccgtaaatgttagagaaaaggtaatcagtttcattgaaaatacatccacacctgttgacagaatgagcttcaacctgccgtggcccgatcgcagctgtaccgaaaggcacgtgagctcctcggatagggttggcaagccatacagaggcgtcaaacctgttttctccataggtgacgaggaagaatacgatacagatgagattgatagctcttctatgtctgatgacgacaggaaggaggtggttaatattcagacctggatcaacaaaccagacgttaaacatcacttcccttgcaaagaggtgaaagagtcaggccacatgttcccaagccatctcctggtgactgcaactcacatgtattgtctgagggaaattgtgagtcgcaagggacttgcatatatccagagcaggcaggctctgaactcggtcgtgaagatcaccagcaagaaaaaacatccggagctgattaccttcaagtatggaaatagttccgcctccgggattgagatactggctatcgaaagatatctgattccaaatgccggcgatgccaccaaggctattaagcagcaaatcatgaaggtcctagatgcactggaaagctag

SEQ ID NO: 51327 - DNA, 1689 bp, Artificial Sequence
  Description of Artificial Sequence: Synthetic coding sequence
atgggctggtacttccggctggcccggaccgagcactacagccagaggttgccagctgtctactgggactgttcgcagaaaggtaggccctttcacttgtttcgacttcttattcagtaccacgaacctgaactttgctcatacttagataccaagaagataacccctgatagttatgctttaaactggctcgggtctctgttcgcgtgttactgctctaccgaagtaacccaggccatctgggacggatatctccagcaggcggaccccttcttcatatattttctcatgctgatcattctggtgaatgcgaaagaagtgatcctgactcaagaatcagactctaaagaagaggtcatcaagttcttggagaacacaccatctagcctcaatatcgaagacatcgaagacctgttctctctggcacaatactactgctcaaagacccctgcaagttttcgcaaggataatcatcacctctttggctccacgctgctggggataaaggacgacgatgcagacttatcccaggccttatgtctggcaatttcagtgtctgaaatcctgcaggccaaccagttgcagggcgagggagtacggttttttgtcgtggactgtcgccctgccgagcaatacaatgcaggacatctgagcacggcatttcacctggactccgatctaatgctgcaaaatccctcagaattcgcccagagcgtgaagtccctgctcgaggcacagaagcaaagcatcgagtccggttctatagccgggggcgaacatctttgtttcatgggaagtggccgggaggaagaagatatgtatatgaatatggtgttagcccatttcctgcagaaaaataaagaatacgtaagcattgcgagtggaggttttatggctctccagcaacatctggcagacattaatgtggatggccctgagaacgggtacggacactggattgcctctacaagtggaagtcgctcctccattaattccgttgatggcgagtcacccaatggatcttccgaccgtggcatgaaatcccttgtgaacaaaatgactgtcgccctgaaaaccaagtccgttaacgtccgtgaaaaggtcatttctttcatcgagaatacctctacacctgtggatcgcatgtcgttcaatctgccatggcctgacagaagctgcacggagagacatgtgtctagctccgatagagtcgggaagccctatcgtggcgtcaaacccgtgttctcaatcggggacgaagaagaatacgacaccgacgagatcgattcctcttcaatgtccgatgacgatagaaaggaggttgtgaatattcagacttggatcaacaaacctgatgttaagcatcacttcccttgtaaggaggttaaggaaagtggccacatgttccctagccatctactggtgacagccacccacatgtattgtctgcgagaaatcgtgagccgcaagggtctggcgtatatccaatcaaggcaggccctcaatagtgtggtgaagattacgagtaagaaaaagcaccccgagcttattaccttcaaatacggtaatagctccgcctcaggcatcgagatcctggctatcgagagatatctcattccgaacgcaggagacgccaccaaagccataaagcagcaaatcatgaaggtactggatgccctcgagtcctag

SEQ ID NO: 51328 - DNA, 753 bp, Artificial Sequence
  Description of Artificial Sequence: Synthetic coding sequence
atggagatggacggcgacccctacaacctgcccgcccagggccagggcaacattataatcaccaaatatgaacaaggacaccgcgccggagcagcggtggacctggggcacgaacaggtggacgtacgaaaatacaccaacaacctaggcattgtccacgagatggaactcccccatgtcagcgcactagaagtcaagcagagacggaaagagtcgaaacgcaccaacaaatggcaaaaaatgcttgccgattggacaaaatatcgctctacgaagaagttgtctcagcgcgtgtacaaggtcattccactggccgtaaggggtcgagcatggagcctgctgctggacatagaccgcattaagtctcagaaccccggtaaatataaggttatgaaggaaaaggggaagcggtcctcgaggatcattcattgtattcagttggatgtctcacatactctgcaaaaacatatgatgttcattcagcggtttggagtgaaacagcaggagctttgtgacatactcgttgcctactccgcgtataaccctgaagtggggtaccacagggatttgtctcgcataacagcgattctcctgctgtgccttcccgaggaggatgctttttgggcattaacccagctgctggctggagaaaggcatagtttgtggtacagtactgctcagatattgccagggtccaggggctcatatagaacccggagtcggtgttgcacctctccaagccaaaggagctag

SEQ ID NO: 51329 - DNA, 633 bp, Artificial Sequence
  Description of Artificial Sequence: Synthetic coding sequence
atggagatggacgaggaccccgacaacctgcccgcccagggccagggaaatattatcatcactaaatatgagcagggacatagagccggagcggcggtggatctcgggcacgaacaggtggacgtgagaaagtacactaataatctggggattgtacacgagatggagctgccccgggtctccgcccttgaggtgaagcagcgcagaaaagagagtaagaggactaataagtggcagaagatgttggctgattggacaaaatatcggtctactaaaaagctgtctcagcgggtttgtaaggtaatccccctggcagtgaggggccgggcgcttagtttgttactggatatagataagattaaaagtcagaatcccgggaagtataaagtgatgaaggagaagggaaaacggagcagtcgcattatccactgcatccagctagacgtctctcacacgctccaaaagcacatgatgttcatccagcggttcggggtgaagcaacaagagctgtgcgacattctcgtcgcctatagcgcctataatccagtatcgatcccgggccaacgctactcttggtacctttgtccttattctcaagcctgggttagtctgggaggggttgccacctcctag

SEQ ID NO: 51330 - DNA, 633 bp, Artificial Sequence
  Description of Artificial Sequence: Synthetic coding sequence
atggagatggacgaggaccccgacaacctgcccgcccagggccagggcaacattattattacaaagtatgagcagggtcaccgggccggcgccgccgtggatttaggacatgaacaggtggacgttcggaagtacaccaataatctgggtatcgtccatgaaatggaactccccagggtgtcggccttagaggtgaagcagcgacgaaaggagagcaagcgtactaacaagtggcaaaaaatgctggctgactggacaaagtaccgcagtactaaaaagttatctcagcgcgtgtgtaaggtgatcccactggccgttcgtggacgggcactgtctctccttctggatattgacaaaatcaaatctcagaatccaggaaaatacaaagtcatgaaagagaaaggaaagagaagcagccggatcatacattgcatccagttagacgtgtcccatacattgcaaaaacacatgatgttcatacagaggtttggggtgaagcagcaggaactctgtgacatcttggtcgcctattcggcctataaccctgtgagcatcccaggccaacgatattcatggtacctttgtccgtattcacaagcctgggttagtctgggcggggtggccacaagttag

SEQ ID NO: 51331 - DNA, 453 bp, Artificial Sequence
  Description of Artificial Sequence: Synthetic coding sequence
atgggccacctggacaaggagggcctgtgcacccagggcagcagcttctcgtggttacttcgggtcctcaatgatgggatttccttgggcctgacaccttgtctctgggatatgtacctgctggagggagaacagatgctaatgctgatcacctcaatcgccttcaaggtccagcgctcactgtacgaagagacaaataaagagacgtggggcccggcgacaccacgagccctgaaaggcactggaagggccaggccgatctgcgagtcactgcactccagtctacaggctttaacagcttctgagtcgtctaggggccccagcctgttacagactccccccagggtacccgggcaacaggctttgtcccggggagacaaggggatctctgtcagtttatctctcccgagtctgcccagtcggaggggaagatgcggccgaattatcgggtag

SEQ ID NO: 51332 - DNA, 246 bp, Artificial Sequence
  Description of Artificial Sequence: Synthetic coding sequence
atgggccacctggacaaggagggcctgtgcacccagggcagcagcttttcctggctcctgagggtcttaaacgacggaatctccctcggactgacaccttgtctgtgggacatgtacttgctggaaggagagcagatgttgatgctcatcaccagcattgcattcaaggtgcagcgacgtccgtctagggctcttgaggagcccgacccattcgtccgcgccagcactcccccttgtaagcgctag

SEQ ID NO: 51333 - DNA, 2892 bp, Artificial Sequence
  Description of Artificial Sequence: Synthetic coding sequence
atgcccggcgccggcgcccgggccgaggagggcggcggcggcggcgaaggggctgctcagggtgctgccgcggagccgggcgccggaccggcacgcgagcctgctcgcctctgtggctatttgcagaaattaagcgggaagggccccctgcggggttacagatctaggtggttcgtatttgacgcccgcagatgctatctgtattacttcaagtccccccaggatgccctgccgctgggccatttggatatcgcggatgcctgtttcagctatcaggggcctgatgaagcggccgagcctggcactgaaccaccggctcacttccaagtgcacagcgccggcgccgtgaccgtgctcaaagccccaaataggcaacttatgacatactggctgcaggaactccagcagaagagatgggaatactgcaatagtttggacatggtaaagtgggattcaaggacttcgcccacgcctggggactttcccaaaggattggtcgctcgcgacaacacagacctgatttatccgcaccctaatgcctcggccgagaaggccaggaatgttttggcagtggagacagtgccaggtgaactggtaggcgaacaagccgcaaaccaacccgcgcctggacaccccaatagtatcaacttctacagtttaaagcaatggggcaatgagctcaagaacagcatgagcagctttcggcccggcaggggccataatgattctcgccgcaccgtgttctataccaatgaggagtgggaactcctggatcctacacccaaggacttagaggaatcgatcgtgcaagaggaaaaaaagaagttgacccccgaaggtaacaagggagtgactgggtcaggatttccatttgattttggacgcaatccttacaagggtaaacggcccctgaaggatatcattggctcttacaaaaaccggcactcatcaggtgacccgtccagcgaaggaacatctggctccggcagcgtctctatcaggaagccagcaagcgagatgcaacttcaggttcagtcacaacaagaggaactcgagcaactgaagaaggatttgtccagccagaaagaactggtcaggctgctccagcaaacggtgagatccagccaatacgacaagtacttcacctcctccaggttgtgtgaaggagttcccaaggacactctggagctgctgcaccagaaagacgaccagattcttggcttgacaagtcagctggagcggttcagcctggagaaagaaagtctgcagcaggaagtgaggactctgaagtcgaaggtcggggagttgaatgaacaacttggaatgttgatggagacgatccaggcaaaggacgaagttatcatcaagctttccgagggcgaaggcaacggaccccctcctactgtagccccatctagtccatctgtcgtgccagtagcccgagaccaactggaactcgatcgccttaaggataatctgcaggggtacaaaacccaaaataagttcctgaacaaggaaatcctggagctgtccgctctgaggaggaacgcggagaggcgtgagcgggatttgatggcaaaatacagttcccttgaggccaagttgtgtcagattgagtcaaaatacctcatcctgcttcaggaaatgaaaacccccgtctgcagcgaggatcagggaccaaccagggaggttatcgcccagcttctggaggatgccttgcaggttgagtcacaagagcaacctgagcaggcctttgttaaaccccatttagtgagtgagtatgacatatacggatttcgcaccgtgcccgaagatgatgaagaagaaaagttggtagcaaaagtgcgggccctggatctgaagactttatacctgacagaaaatcaggaggtgtccaccggtgttaaatgggagaactactttgcttccacggtgaatcgcgagatgatgtgcagtccagagttgaaaaatttgatcagagccggaatcccgcatgagcatcgctccaaggtctggaagtggtgtgtagatagacacacgcgcaagtttaaagacaataccgagccagggcactttcagacacttcttcagaaggctctggagaaacagaacccagcttcaaagcagattgaattagacctgctgagaaccttgccaaacaataagcattattcttgccccacatccgaggggattcagaaactgaggaatgtgctcttagcattttcatggagaaacccggacatcgggtattgccaagggctgaatagattggtggccgtggccctcttgtatttggagcaggaggacgccttttggtgtctggtcacgatcgttgaggtcttcatgccacgcgactattatactaagaccctactgggatctcaggtcgatcaacgggtgttcagagacttgatgagcgaaaagctgcctaggcttcatggtcattttgaacagtacaaagtggactacacgttaattaccttcaactggttcctggtcgtatttgttgattccgttgttagtgacatcctgtttaaaatatgggattcattcctgtacgaaggcccaaaagttatctttcgattcgcgctggcgctttttaaatataaagaagaggagattcttaaactgcaggattcgatgagcatctttaagtatttgaggtattttacaagaacaattctggacgcaagaaagctcatcagtatttcttttggggaccttaacccatttcctctgagacagatccggaataggcgggcctaccacttggagaaggtgcggctggaattaaccgagcttgaagccatcagggaagatttcttgagggaaagagacacgagcccagataaaggagaattggtgagcgatgaggaagaggacacatag

SEQ ID NO: 51334 - DNA, 2745 bp, Artificial Sequence
  Description of Artificial Sequence: Synthetic coding sequence
atgcccggcgccggcgcccgggccgaggagggcggcggcggcggcgaaggagccgcacagggtgcagccgctgagcccggggccggcccagcacgtgaacccgccaggctatgtggatacctgcagaaactgtctggcaaggggccattgcgcgggtaccggtctcgatggttcgtgtttgacgcccgaagatgctacctctactatttcaaaagtcctcaggatgcactacctctgggacacttggacatcgctgatgcatgcttctcataccaaggaccagacgaggcagctgaaccaggcacggaaccccccgctcactttcaggtgcacagtgcaggcgcggtcacagtgcttaaggctccgaacaggcagttgatgacctattggctgcaggaactgcagcagaaacgctgggaatattgcaatagtctcgatatggtaaagtgggactccaggacctccccaactcctggtgactttcctaaaggcctggtggcaagggacaacaccgatctgatttatcctcacccgaatgcaagcgcggaaaaagccaggaacgtcttagccgtagagacagtacccggcgaattagtcggtgaacaggccgctaaccaaccagcccccggccatcccaacagcatcaacttctactcactcaaacaatggggcaatgaactcaaaaattcaatgagttcatttagaccaggaagaggtcacaacgacagtcggaggacagtgttttatacaaatgaagagtgggagctcctggatccgacgccgaaggatctggaggagtctatagtccaggaggaaaaaaaaaagctgacccccgaaggaaataaaggggtgactggctctggttttccgtttgacttcgggaggaacccctataaggggaaacggcccctcaaagacattatcggctcctataagaacagacactccagcggggacccgtccagcgagggcacttcagggtccggatccgtctcaattaggaaaccagcaagcgagatgcaactccaggtgcagagtcagcaggaggagctcgagcaacttaagaaggatctaagttctcagaaggagctggtgcggctattgcagcaaaccgtcaggtcttcccagtacgataaatacttcacatctagtcggttgtgcgaaggtgtgccaaaggacacgctggaactgctccaccagaaagatgatcagatcctaggcctgaccagccagttggagaggttcagccttgagaaagaatctctgcagcaggaggtaaggactctgaagtcgaaagtcggggagcttaacgagcagctcggcatgctcatggagaccatccaggctaaggatgaagttattatcaagctctcagaaggcgaggggaacggcccaccccctactgtggctccatctagcccttccgtggtgccagtggcccgggatcagttggagctggaccgacttaaagataacctacagggatacaaaacgcagaataagttccttaacaaggaaattctggagctaagtgctcttcgcagaaatgccgagcggcgggaaagagacctgatggctaagtactcttcactggaggcaaaactctgccagattgaaagcaagtatctcattcttctgcaggaaatgaagacccctgtgtgttcggaggatcagggtcccacccgcgaggtgatagctcaactgctcgaggacgctttgcaagtggaatctcaggagcagcccgagcaggcattcgtaaaaccccatttggtgtccgagtacgacatctacggttttcggaccgtacctgaagacgacgaagaagagaagttagtcgctaaagttcgggcattagacttgaaaaccctgtacctcacagaaaaccaagaagtaagcacaggcgtcaaatgggaaaattattttgcctcgactgttaatcgagagatgatgtgcagcccagagctgaagaacctgattagagctgggatcccgcacgagcacaggtctaaagtctggaaatggtgcgtcgatcggcatactagaaaattcaaagacaacaccgagcccgggcacttccagacacttctgcaaaaagccctggaaaagcagaaccctgcttctaaacagatcgagttggatctgctgcggactctccctaataataaacactacagttgccccacttcagaaggaatacaaaaattacgcaacgttttgctggcattcagctggagaaaccctgacattggatactgtcagggccttaatcggctagtggcagtggcacttctttatctcgaacaggaggatgccttttggtgcctcgttactatcgtagaggtgtttatgccacgcgactactacactaaaaccctcctcggcagtcaggttgaccaacgcgtcttccgtgacctgatgagcgagaaattgccacgcctgcacggacatttcgagcagtataaggttgactacaccctcatcaccttcaattggtttttggtcgtctttgttgattcggtggtttcagacattctcttcaagatctgggactcttttttatatgagggcccaaaagtgatcttcagatttgccttggcactcttcaagtataaagaagaggaaattctgaagcttcaggacagcatgagcatcttcaaataccttcgttattttaccagaactatcctggacgcccgctcagggacagacgcccctaccacctggcggaagtctggatggtcctag

SEQ ID NO: 51335 - DNA, 768 bp, Artificial Sequence
  Description of Artificial Sequence: Synthetic coding sequence
atggtgctggagctgaacgccagcgacgaccggggcatcgacatcatccgcggcccaatactaagcttcgccagtacacggacaattttcaagaaggggttcaagctggtgatccttgacgaggcggacgctatgacccaggacgcacagaatgccctacgtagggtgatagaaaagttcacagagaataccagattctgtctcatttgcaactatttatcaaaaatcatccctgcacttcagtcccgctgcacccggtttcgttttggccctctcacaccggaactgatggtgcctcgcttggagcatgttgtggaagaagaaaaagtggatatttcggaagatggcatgaaagcgctggtgacactgtcatccggggacatgcgtagggccctaaacatcctgcagagtaccaacatggctttcggcaaagtaaccgaggagacggtttacacttgcacaggtcatcccctcaaaagtgacattgccaacattctggattggatgctgaatcaggactttacaacagcttatagaaacattaccgaattaaaaactttgaaaggtctggccttgcacgatatcctcaccgagattcacttgtttgtgcacagggtggacttcccatccagtgtgcgcatccatctactaacaaagatggcagacatcgagtaccgcctgagcgtggggacaaatgaaaaaatccaactgagtagcctgatagcagcattccaggtgacgcgggatcttatcgtcgccgaagcatag

SEQ ID NO: 51336 - DNA, 1734 bp, Artificial Sequence
  Description of Artificial Sequence: Synthetic coding sequence
atgcggcaggacaagctgaccggcagcctgcggcggggcggccggtgcctgaagcgtcaaggggggggcgtgggcactatcttatccaatgtcctcaaaaagcgcagctgcatctctaggacggcgccccgtttgctgtgcacgctggaacctggcgtcgacaccaagctaaaatttactctagaaccatccctgggccagaatggattccagcagtggtacgacgcactcaaagcagtggccagacttagcaccgggatcccaaaggaatggaggcggaaggacctgcatcggaccgggtgcagcagctactgtgggcaggaggccgaacaggaccgcgtcgtcttaaagagagtgttgctggcctatgccaggtggaacaaaactgtggggtattgtcagggctttaacatcttggcggccctgatactggaggtgatggagggcaacgaaggtgacgctctcaagatcatgatataccttatagacaaagtgctgcctgagagttatttcgtcaataacctaagggcactctcagtggatatggcagtgttccgggatctgctgagaatgaaactgccagagctcagccagcatctggacacgctgcaaagaaccgccaacaaggagagtgggggagggtatgagcctccactaaccaatgtcttcaccatgcagtggtttttgaccttgtttgcgacatgtctccctaaccagaccgtgttaaagatttgggactcagtgttttttgaagggtctgagattattttacgggtaagcctggcgatctgggcaaagttaggcgagcaaatagagtgctgcgagaccgccgatgaattttatagtacaatgggtcgcctaacacaggagatgttggagaatgacctgttgcagtcacatgaactgatgcagactgtgtattcaatggcacccttcccttttccacagctggctgagctccgggagaaatacacatacaatatcactcctttccccgccacagttaagcctacttctgtatccggcagacacagtaaagctagagatagtgatgaggagaacgacccagacgacgaggacgcagtggtcaatgccgtcggatgcctggggcccttctccggcttcctggcccctgagctacagaaataccagaaacaaattaaagaacctaacgaagaacagagcttaagatctaataacattgctgagctgtcacctggcgccattaactcctgccgcagcgagtaccacgccgcatttaatagcatgatgatggagagaatgaccacagacataaacgccttgaagagacagtactctagaataaaaaagaaacagcagcagcaggtacatcaggtgtatatcagggcagacaaagggccagtgacttccattttgccatcgcaggtgaatagcagcccagttataaaccacctgcttttggggaagaaaatgaagatgacaaatcgggccgccaaaaatgctgttatccatatccctggtcacactggtggtaagatttcccccgtgccatacgaggatctcaagaccaagttaaattcaccatggcggacccacatccgtgtccataagaagaatatgccacgaacgaagtcgcacccaggttgtggcgataccgttggtctcattgacgagcagaacgaggccagcaagaccaacgggctgggtgctgctgaagccttcccttcagggtgcacagcggggcagggttag

SEQ ID NO: 51337 - DNA, 1914 bp, Artificial Sequence
  Description of Artificial Sequence: Synthetic coding sequence
atgcggcaggacaagctgaccggcagcctgcggcggggcggccggtgtttaaagcggcaaggaggcggtgtcggaactatcctctccaatgtgttgaagaaaagatcatgtattagtaggaccgcacccaggctgttgtgtacgctggagccaggcgtggatacaaagctgaagttcaccctcgaaccttccctgggacagaatggtttccagcagtggtatgacgcattaaaagccgtggcgcggctgtccacaggtatcccaaaagagtggcgtcgaaaggtttggctcaccttggcagaccattacctccattccatcgctattgattgggacaaaacaatgcgcttcacttttaacgagaggagtaaccctgacgacgattctatgggcattcaaattgtgaaggacctacatcgaaccggctgctcttcatactgtggccaagaagctgagcaggacagggtggttctgaaacgggtccttcttgcctatgctaggtggaacaaaactgtcggatactgccaggggttcaacatcctggctgcattgattcttgaagtcatggaaggaaacgagggcgacgccctcaagatcatgatttacctaatcgacaaggtgctgccagaaagctatttcgtaaacaatctccgcgctctttccgtggacatggccgttttcagggatctgctccggatgaagctccctgagctctctcagcacctggatacactccagcggaccgcaaacaaggaaagtgggggtggctatgaaccacccctgactaatgtgttcactatgcagtggttcctcaccctcttcgcaacctgcttacctaatcaaaccgtcttaaaaatatgggattcggtgttcttcgaggggagcgaaatcatcctccgtgtcagccttgcaatttgggcaaagcttggcgagcagatcgaatgctgcgaaacagccgatgagttctattctaccatgggacgcctgacgcaggagatgctagagaatgatctgctgcaatcacatgaactcatgcagactgtgtactccatggcccccttcccgttcccacagctcgcagagctgcgcgagaagtatacctataacattaccccatttcctgccacagtaaaaccaacaagcgtgagcggtagacattcaaaggcgcgagacagcgacgaggaaaacgacccagatgacgaagacgctgtcgtgaacgctgtgggctgcttaggacctttttcaggttttctggcacctgaactgcagaaatatcagaagcaaattaaggagcctaacgaggagcagagcctcaggtctaacaacatcgcagagctctctccgggggccattaattcctgccgcagtgagtatcatgccgccttcaacagcatgatgatggaacggatgaccaccgacatcaatgctttgaaaaggcaatactcacgaattaagaaaaagcagcagcagcaggtgcatcaggtatatatccgagctgacaagggtccagttacctcaatcttacccagccaagtcaattcatcccctgtcatcaatcaccttctgctgggcaagaagatgaagatgaccaatcgagccgccaaaaacgccgtgatccatatccctgggcatactggaggtaagatttccccggtgccctacgaggacttgaaaactaagctgaattcaccttggcggacacatattagagtgcataagaagaacatgccacgtacgaagtctcaccccgggtgcggggacacagtgggactgatcgatgagcaaaatgaggcttctaaaacaaatggccttggagccgcagaagcattcccctctgggtgcaccgctacagcaggtcgagaaggctccagccccgagggaagctcctcttataagagcctgcagatgatttag

SEQ ID NO: 51338 - DNA, 2388 bp, Artificial Sequence
  Description of Artificial Sequence: Synthetic coding sequence
atgtaccacagcctgagcgagacccggcaccccctgcagcccgaggaacaggaggtgggtatcgaccccctttctagttacagcaacaaatcaggtggtgatagtaataagaatggtcgccggacaagctctactcttgattcagagggaacattcaatagctaccgaaaagagtgggaagaactctttgtgaacaacaactatttggctaccataaggcagaaagggataaacggtcagttgaggagctcaaggtttaggagtatctgctggaaactctttctgtgtgtcttgcctcaagacaagagtcagtggattagtcgtatcgaggaacttcgggcttggtattccaatataaaggagatccacataaccaatccaaggaaagtagtcggccagcaggatctgatgattaataaccccctgagccaggatgaggggtccttgtggaataagttcttccaggacaaggaattgcgctcaatgatagaacaggatgttaagcggactttccccgaaatgcagtttttccaacaggaaaatgtgcgcaagatcctgaccgacgttttgttctgctatgctcgtgagaacgagcagttgttgtataagcaggggatgcacgaactcttggcaccaatcgtgtttgtactccactgcgatcaccaggcctttctccatgcctccgaatccgcacagcccagcgaagagatgaagaccgtgctcaaccctgaatatctggaacacgatgcatatgctgtgttctctcaactcatggagactgccgagccatggttcagcactttcgagcatgacggccagaagggcaaggagaccctcatgacaccaattccattcgcgagaccacaggacctcggaccaaccattgctattgtgactaaagttaatcagattcaggatcatctgctcaagaaacacgatattgagctctatatgcatcttaacagactggagattgccccccaaatctacgggctgcggtgggtaagactcctctttggtcgggagttcccattgcaggatttgcttgttgtgtgggatgcgctttttgctgacgggctcagcctgggactcgtcgactacatatttgtggccatgctcctgtatatcagagatgccctgatctcctcaaattatcagacatgcctgggactattaatgcattacccattcatcggtgacgtgcatagtctgattttaaaggcactctttttacgcgaccccaaaagaaatcctaggcctgtgacatatcagtttcatcctaatctggactattacaaggcgcgcggtgctgatttgatgaataagtcaagaaccaacgctaaaggagcccctctaaacattaataaggtgagtaatagcctgattaatttcggtagaaaactgatcagcccggccatggcacctggcagcgcgggcgggcccgtgcctggtggcaactcgtcttcctcttcatctgttgtaattcccacccgtacatccgccgaagcgccttctcatcacctgcaacagcagcagcagcagcagcgactgatgaagtccgagtcaatgccagttcaactgaacaagggcctgtcctccaagaatatcagctcatctccatccgtggaatctctgcctggaggcagagaattcacaggtagcccaccctcctctgctactaaaaaagatagcttcttttccaacatcagtcgtagccgctcccactctaagaccatgggcaggaaggaaagtgaggaggaactggaggctcagatctctttccttcaaggtcagctgaacgacctagatgcaatgtgcaaatattgcgctaaagtgatggatactcacctcgtgaacatccaggatgttatcctgcaggagaaccttgaaaaggaagatcaaatactcgttagcttggccgggctcaaacagataaaggatattctcaaaggttcactgaggtttaaccagtcccagctcgaggccgaggagaatgaacagataactattgcggataatcattattgctcctccggtcagggtcaaggacggggacagggccagagtgtccagatgagcggcgccatcaaacaggctagtagcgagacgcctggttgcacagataggggcaactcagacgactttatcctcatctcaaaggacgatgacggaagcagcgcacggggttctttctcaggacaggcacaacccctgcggacactccggtccaccagtgggaagtcccaagccccagtgtgctcccctctcgtcttctccgatccactgatgggacctgcgtccgcatcatccagtaatcccagcagcagcccagatgacgattcctcgaaagattcaggcttcacgattgtcagccccctggatatctag

SEQ ID NO: 51339 - DNA, 552 bp, Artificial Sequence
  Description of Artificial Sequence: Synthetic coding sequence
atgtaccacagcctgagcgagacccggcaccccctgcagcccgaggagcaggaagtaggaatcgatcctctgtcctcatatagcaataagtccggaggagatagtaacaagaacgggagaagaaccagttccactttggactccgaggggactttcaatagctataggaaggagtgggaggaactattcgtgaataacaactacttggccaccattcgccagaaaggaatcaacggccagctgcggtctagtaggttcaggagcatctgttggaagcttttcctttgtgtcctgccccaggacaaatctcagtggatctctcgcattgaggaactgcgagcgtggtacagtaatatcaaagaaattcacattacgaaccctaggaaagtagtgggacaacaggacctcatgatcaataatccattgtctcaggatgagggtagtctctggaacaagttttttcaggacaaggagcttcggtccatgatcgagcaagacgtaaaacgtacattcccggaaatgcagttcttccaacaggaaaatgttcgatag

SEQ ID NO: 51340 - DNA, 2388 bp, Artificial Sequence
  Description of Artificial Sequence: Synthetic coding sequence
atgtaccacagcctgagcgagacccggcaccccctgcagcccgaggagcaagaggtggggatagatcccctgtcgtcctactccaacaagtccggcggagatagcaataaaaacggtcgaaggaccagctcgacccttgattccgaggggacttttaatagttaccggaaagagtgggaagaactgttcgtcaataacaactacctcgcaacaatccgccagaagggcataaacgggcagctgcgcagctcgaggttcagatccatctgttggaagctgttcctctgtgtgttaccccaggacaagagccagtggatcagccgcattgaggagctgcgggcttggtacagtaatattaaggagattcacattaccaaccctagaaaagtagtgggccagcaggatctgatgatcaataacccactgtctcaagatgaagggagtttgtggaacaaatttttccaggataaagaattgaggtcgatgatcgaacaggatgtaaagaggacgttccccgagatgcagttttttcagcaggaaaacgtgagaaaaattctgactgatgtactgttctgttatgcccgcgagaatgaacaattgctgtataaacaggggatgcatgaattgcttgcgcctatagtcttcgtattgcactgcgatcaccaggccttcctgcacgcaagcgagtccgcccagcctagcgaggaaatgaaaaccgtgctcaaccccgaataccttgagcatgacgcttacgccgttttcagccaactcatggagaccgcagagccttggttttctacctttgaacacgatggtcagaaagggaaagaaaccttaatgactcctattcccttcgcccgcccacaggatttggggcccactatcgctatcgtgaccaaagtgaatcagatacaagaccacctgttaaagaagcatgatattgagctgtacatgcacttgaaccgcttagagattgctccccaaatttatggtctccgctgggttaggctgttattcggccgcgagtttcccttacaggacttgttagtggtgtgggacgcccttttcgccgacggactgtcactgggactcgtcgattacatcttcgtagcaatgctgctgtacatcagggacgctctgatcagctccaattaccaaacctgcctggggttgctgatgcactaccctttcataggggacgtgcactccctgatcctcaaagcactgtttttgcgcgatccaaagaggaacccacggcccgttacctaccagttccatccaaatctagactactataaggctcggggagctgatctgatgaacaaatctaggactaatgccaagggggccccattgaacatcaataaggtctcaaactcccttatcaacttcgggcggaaattgataagccctgctatggctccaggaagtgccggtggccctgttcctggaggcaatagcagttcatccagctctgtggtaattcccacccgcacttccgccgaggcacctagccaccatcttcaacaacagcagcagcagcagcgcctcatgaagtccgaatcaatgcctgtgcagctgaacaaaggactgagttccaagaatatttcatcaagccctagcgtggaatcactcccaggaggtagggaattcactgggtccccaccgtcaagtgccacgaagaaggacagttttttcagcaacatctccaggtcacggagtcattcaaaaaccatgggcagaaaggaaagtgaagaagaattggaagctcagatctcgttcctgcagggacaactcaacgaccttgacgcaatgtgtaaatattgcgccaaagtgatggacacccatttggttaacatccaggatgtgatcctccaggagaacctggagaaggaggaccagattctggtttctcttgcagggctgaaacagatcaaggatatcctgaagggaagcctgagatttaaccaaagtcagctggaagcagaggaaaacgagcaaattacgatagctgataatcattactgcagttcaggccagggccaggggcgaggacaaggccagtcagtgcagatgagtggcgccattaagcaggcctcctccgagactccagggtgtactgatcgaggaaatagtgatgatttcatcttaattagcaaggacgacgacggttccagtgccagggggtcgtttagcggccaggcccagcctctgcgaacgttgagatcgacatctggaaagagtcaggcaccagtgtgcagtcccctcgtgttttccgatcccctcatgggacctgcgtccgcgtcatcgtccaacccatcctcatccccagatgatgactcctcaaaggacagtggcttcaccatcgtctccccattagatatttag

SEQ ID NO: 51341 - DNA, 267 bp, Artificial Sequence
  Description of Artificial Sequence: Synthetic coding sequence
atgtaccacagcctgagcgagacccggcaccccctgcagcccgaggagcaagaagtgggcattgacccgctatcttcatacagtaacaagtcaggaggggactctaacaaaaatggtaggcgcacgagtagcactctggacagtgaagggacgtttaattcctatagaaaggaatgggaagaactttttgttaacaacaattacctcgctacaattcgtcaaaagggaatcaatggtcagctaaggtcgagccgctttcgaagctag

SEQ ID NO: 51342 - DNA, 3423 bp, Artificial Sequence
  Description of Artificial Sequence: Synthetic coding sequence
atgtggctgaagcccgaggaggtgctgctgaagaacgccctgaagttgtgggtgactcagaaaagcagctgttattttatactccaacgccggagggggcacggagaaggcggtggacggcttaccggccgtctcgtgggcgcgctggacgccgtgctggacagcaacgcaagggtcgccccattcaggattttgttgcaggtgcctgggagccaggtatatagcccaatcgcttgcggggccaccctagaggagattaatcagcattgggactggctcgaacagaacctcctccacaccctcagtgtgttcgataataaagacgatatcgcaagctttgtcaaggggaaggtgaaggctctgattgcagaagaaacgtcctcacgtcttgcagaacaggaggaggaacctgagaaattccgcgaagcgctcgtgaaatttgaggctcggttcaacttccctgaagccgaaaaactggtaacttactattcatgctgctgttggaagggtagagtcccacgtcaggggtggctgtacctctccatcaaccacctttgcttttactctttctttcttggcaaggagctaaagctagttgtcccctgggtagacatccaaaagttagaacggacctcgaacgtctttctgactgatactattcgaattacaacacagaacaaggagcgcgatttttccatgttcttgaacttagatgaggtgttcaaggttatggagcagctggctgacgttaccctccgcaggctgctggacaatgaagtgttcgatctggatccggaccttcaggagccaagtcaaatcacaaagagggatttggaggctagggcgcagaatgaatttttccgcgccttcttcagactgccccgcaaggagaagctgcacgctgtggtggactgcagtctgtggactcccttcagcagatgccacacgaccgggagaatgttcgctagtgactcctatatatgctttgccagccgggaagacggctgctgtaagatcatactccccttgcgggaggtggtgagcattgagaagatggaggatacctctcttttacctcacccaatcattgtgtccattcgctctaaggtggcttttcagttcattgagctgagagatcgagactccctggtcgaagcactgttagcaagattgaagcaggttcatgcgaaccaccctgtccattatgatacttctgcagatgacgatatggccagcttggtatttcatagtacaagtatgtgtagtgatcataggttcggtgacttggagatgatgtcttctcagaattccgaggagtctgaaaaagaaaagtccccactgatgcaccccgatgctctggtgacggccttccagcagtccggatcccagagccctgatagcagaatgtcaagagagcagatcaaaattagcctgtggaatgatcatttcgtggagtacggaagaacagtttgtatgttcagaactgagaaaattcgcaaactggtggctatgggcatcccggagtccctgagggggaggctctggctgcttttcagcgacgccgtcacagatttggcatcccaccctggctactatgggaacctcgtggaagagtcactcggcaaatgctgccttgttactgaggaaattgaaagagacctccatcgcagtctcccagaacaccccgcattccaaaatgagaccggcatcgccgctctgagaagagtcctcacagcctatgcccatcggaatccgaaaataggatattgccaatctatgaacatcttgacttccgttctcctgctgtatactaaagaagaagaagccttctggttgctagtcgctgtatgtgaacggatgctccccgactacttcaaccatcgtgttattggtgctcaagtagaccagtcggtgtttgaggagcttatcaagggacacctccccgagttggcagaacatatgaatgatctttctgcactcgcctccgtgtctctaagttggttcctgaccctgttcctgagcatcatgcctctcgagtccgcagttaatgtggtggactgcttcttctatgatgggattaaggcgatattccaattagggctggcagtacttgaggccaatgcagaggatctttgctccagtaaggacgacggtcaggctcttatgattctgtctcgtttccttgaccacattaagaacgaagattcaccggggcctccggtaggcagccatcacgccttcttcagcgacgatcaggagccttatcccgttaccgatatctctgatctaattcgagacagttatgaaaagtttggcgatcaaagcgtcgaacagatcgagcatctaaggtataagcaccggatcagagtactacaggggcacgaagatactaccaaacaaaatgtgctgcgcgttgtgatccctgaggtctccatcttgcctgaggatctggaagagctgtatgacttattcaagagggaacacatgatgagttgctactgggagcagcctcgacctatggccagccgacatgacccctcccgcccttatgctgaacagtatcgcattgatgcccggcagttcgcccatctgtttcagctagtcagcccatggacatgcggtgctcacacagaaatcctcgcagagaggaccttcaggctgctcgacgataacatggaccagctcatcgagtttaaggccttcgtctcttgtctggatataatgtataatggcgaaatgaacgagaaaatcaaactgctgtatagactgcacattccgcccgcactgacagagaatgatcgtgattcccagagtcccttgcgtaacccactgctttcgacatcccgtccacttgtgtttgggaaacccaatggcgacgccgtggattaccagaagcaactaaaacaaatgatcaaggacctggcaaaagagaaagacaagacggagaaggaattgcctaaaatgtctcagcgagaatttatccagttctgcaagaccctctattcaatgtttcacgaggatccagaggaaaatgacctgtatcaggccattgccaccgtgacgacgttgttgctgcagataggcgaggtgggacagcggggaagctcctcaggctcttgctctcaggagtgcggcgaagaactcagagcctctgccccgagcccggaagactctgtgtttgcagacacaggaaagacacctcaggattcgcaggcatttcctgaggccgcagagcgcgactggactgtgagcctggagcacattcttgcaagcttgctgaccgagcagagtctcgtgaatttctttgagaagccactggacatgaagagtaagttagagaacgcaaaaatcaaccagtacaaccttaaaaccttcgaaatgagtcaccagtcgcagagcgaactcaaactgtctaatctctag

SEQ ID NO: 51343 - DNA, 3468 bp, Artificial Sequence
  Description of Artificial Sequence: Synthetic coding sequence
atgtggctgaagcccgaggaggtgctgctgaagaacgccctgaagttgtgggtgactcagaagtccagttgctatttcattctacagaggaggcgaggacacggagagggaggaggtaggctaacgggccgactggtgggagcacttgacgcggtcctggactccaacgcaagagtggcacctttcagaattttgctccaggttcccggctctcaggtttattcccctattgcctgcggcgagctattgaatgggtctgatgtctactgggctattgccacaggagccactctggaagaaataaatcagcactgggactggctagagcagaacctcctgcatacgctgagtgtatttgacaataaggatgacattgccagcttcgtgaaaggcaaagtcaaagcactgattgccgaggagacttcaagcagactcgcagagcaggaggaggaacccgagaaattccgggaggcgttggtgaagttcgaagcgcgtttcaatttcccagaggctgaaaaacttgtgacctactacagctgctgctgctggaaagggcgcgtgcctcgtcaaggatggctatacctgtctatcaatcatctttgcttttactccttctttctcggcaaagaactgaagctagtagtgccttgggtagacatccagaaactcgaaaggacttctaacgtttttttgacggacaccatccgaattacgacacagaacaaagaacgggacttttcaatgtttctgaatctggatgaagtgttcaaagtcatggaacagctggcagatgtcacacttcgccgcttactggacaatgaagtgttcgatctggatcccgacctgcaggagccctcacagatcacaaaacgggacctcgaggctcgtgcccagaacgagttctttagggcctttttccggctacctagaaaagagaagctgcacgctgtggtggattgctcattatggacccctttcagtaggtgtcataccaccgggcgcatgttcgcctccgattcttatatctgttttgcctcgcgagaggacgggtgttgcaagatcatcttgcctctaagagaagtggtctcgattgagaaaatggaggacacctcccttcttcctcacccaattattgttagcatccgctcaaaagtggccttccagtttattgaactccgggatcgtgatagcctcgtggaggctcttctggccagacttaagcaagtgcacgcgaaccatcctgttcactatgatacttcagcggatgatgacatggcatcacttgtgtttcactctacaagtatgtgtagcgatcatcggttcggcgatctggaaatgatgagcagtcagaactctgaagaaagtgaaaaagagaagtccccactcatgcatcctgatgccctggttaccgcattccagcagagtgggtctcagagtcccgattctcgtatgtctcgtgaacaaattaaaattagtctgtggaatgaccacttcgtcgagtatggacgtacagtgtgtatgtttaggactgagaagatcagaaaactggtagcaatgggcatccctgaatccctgcgcggtcggttgtggctgctgttctcagatgcggtgaccgacttagctagccatccggggtattacggtaacttggtggaggaatctctgggaaagtgttgtcttgtgaccgaggagattgagcgggacctccaccgttcattgcctgaacaccccgcgtttcaaaacgaaactgggattgccgcgcttcgacgggtgctcacggcctacgcccatcggaatccaaagattggatactgccagtcaatgaacatcctcacctcagtacttctcctctacacgaaagaagaggaggccttctggctgctcgtggcagtctgtgaacggatgctgcccgactacttcaaccacagggtgatcggggcccaagtcgatcagtccgtgtttgaagagctaattaagggtcacctccctgagctcgcagagcacatgaacgacctgtctgccttggccagtgttagcctaagttggtttctgacgttgtttctgagtatcatgcccctcgagtctgctgtaaacgtggtggactgtttcttctatgatgggataaaggccattttccagctaggcctagcagtcctggaggcgaatgcagaggatctatgttcttccaaagacgacggccaagccctgatgatccttagtcgttttctggaccacataaaaaatgaagattctccgggtccaccggtgggaagccatcacgccttcttttctgacgaccaggagccttatcccgttaccgatataagcgatttgattagggatagttatgagaagtttggtgaccagtctgttgaacagattgaacaccttcgctacaaacataggattcgggtactccaaggtcacgaggatactactaaacagaacgtgctgcgggtggtcattcctgaggttagcattctcccagaggatctagaagagctctacgatttattcaagagagaacacatgatgtcctgctattgggagcagcctcgccctatggccagccgacatgatccgtctcgtccttacgccgagcagtatcgaatcgacgcacgacagttcgctcacctgttccagctcgtgagcccatggacctgcggggcccacacagagattctggcagaacggaccttccggctcctggacgacaatatggatcagctgatcgagttcaaagcattcgtgtcctgcctcgatatcatgtacaacggggaaatgaatgaaaagatcaagctgctgtaccgcctgcacattccacccgctctaaccgaaaatgatcgggacagccagtccccactgaggaacccactattatctacttcccgccctctcgtctttggcaaaccaaatggcgatgctgttgattaccagaaacagctgaagcagatgatcaaggacctcgctaaagagaaggacaaaaccgaaaaggagttgccaaaaatgagccagcgtgagtttattcagttctgcaaaacactctattccatgtttcatgaggacccagaagagaatgatctttatcaggctatcgccacagtgacaaccctcctacttcaaatcggggaagtcggccagagagggagtagctccggcagctgtagtcaagaatgcggcgaggagctaagggccagtgcccctagtcccgaggacagcgttttcgctgataccggtaagacaccccaagattctcaagcctttcctgaggccgccgagagagactggactgttagccttgagcatatacttgctagcttattgacggaacagagcctcgttaacttcttcgagaaaccactggatatgaagtctaagctagagaacgccaagattaatcaatacaatctgaaaacattcgagatgagtcatcagtcacagtccgagctgaagctctccaacttgtag

SEQ ID NO: 51344 - DNA, 1899 bp, Artificial Sequence
  Description of Artificial Sequence: Synthetic coding sequence
atgtggctgaagcccgaggaggtgctgctgaagaacgccctgaagttgtggctgatggagcgttccaatgactatttcgttcttcagcgccggagaggatacggcgaggagggcggtggtgggcttacaggccttctggtgggaacgctggacagcgtgctcgattcaaccgcaaaagtggctccttttcgaatcctacaccaaacacctgacagccaggtctacctgtcgatcgcctgcggggcaaaccgggaagagatcacaaagcactgggactggttggaacaaaacatcatgaagactttgtcggtattcgattctaatgaggatattaccaattttgttcaggggaagatacgcggcctcatcgccgaggagggcaagcactgctttgctaaagaggacgatccggaaaagttccgcgaggctctcctgaagttcgagaagtgcttcgggctgccggagaaggaaaaacttgtcacatattattcatgctcctactggaaaggcagagtgccctgccaggggtggctgtacctgtcaacaaatttcttaagtttttatagctttctgcttggatccgagataaagttgattatttcctgggatgaagtaagtaagctagagaaaacttccaacgtcatcctcactgagagcatccacgtatgtagccagggagaaaaccattacttcagtatgttcctgcatatcaatcaaacgtacctgcttatggagcagctggccaactatgcaatcaggcgactgtttgacaaggagacattcgacaatgacccagtcctgtacaacccccttcagatcactaaaagagggctcgaaaatcgcgcccactccgagcagtttaatgccttctttagattacctaaaggggaatcactcaaggaagtacacgagtgcttcttatgggttcccttttctcattttaacacccacgggaagatgtgtatcagcgagaattacatttgttttgcttctcaagacggtaaccaatgcagcgtcatcatcccactgcgcgaagtgctggcgatcgataaaactaacgatagttccaagagcgtgattatcagtattaagggcaaaaccgctttcagatttcacgaagtcaaggactttgaacagctggtggccaaactacgactacggtgcggggccgctagcactcagtaccacgatatctctaccgagctcgctataagttccgaaagcactgagccatcagacaattttgaggtgcagtccctcacgagccagcgcgaatgctcaaagaccgtaaatacagaagctcttatgacagttttccacccccagaatctcgaaaccttgaactccaaaatgttgaaagagaagatgaaagaacagtcctggaaaatcctttttgctgaatgcgggagaggggtgagcatgttccgcaccaaaaaaacccgggatctggtcgtgagaggaatccccgagaccctccgaggcgagctgtggatgttattttccggggccgtgaacgatatggccaccaatcccgactattataccgaggtggttgagcagagtctgggcacatgtaacctcgcaaccgaagagatcgagagggaccttcggaggtcactacccgagcacccagccttccaaagtgatacggggatatcggccctcaggagggtactaacggcatacgcctaccgaaacccaaagataggatactgccaggccatgaatatactgacttcagtgctgcttctgtacgcaaaagaggaagaggccttttggcttcttgtcgctgtgtgcgagaggatgctaccagactactttaatcgtcgaatcataggcagcgatgattttatgccgttggtgagaattcaaggccagtgcgtgatcggagagaaatag

SEQ ID NO: 51345 - DNA, 3363 bp, Artificial Sequence
  Description of Artificial Sequence: Synthetic coding sequence
atgtggctgaagcccgaggaggtgctgctgaagaacgccctgaagctgtggctgatggagaggagtaacgattacttcgttttgcaaaggcggcgcggatatggagaggaaggggggggtggattgacaggcctgctcgtcggaacgctggattcagttcttgattctaccgccaaagttgctccctttcgcatcttacaccagacccccgatagccaggtgtacctatctattgcttgcggcgcgaacagggaggaaatcaccaaacactgggattggttagagcaaaatatcatgaaaactttgtcagtttttgatagcaatgaggatattaccaatttcgtgcaaggaaagatccgcggcctgatcgccgaagagggcaagcactgttttgcgaaagaagacgacccagaaaagttccgcgaggcactcctaaaattcgagaagtgtttcggactccctgagaaagagaaactcgttacgtattactcatgctcctactggaaaggacgggtgccatgccagggctggctttacctgtcaactaattttctctcattttacagctttctcctgggctctgaaatcaaactaattatctcatgggatgaggtctcaaaactggagaagacttccaatgttattcttacagaatctattcacgtatgctcccagggcgagaatcattatttcagcatgttcctgcacatcaatcaaacctatctccttatggagcaattggcaaactatgccatacgcaggttattcgataaagaaacatttgacaatgatcctgtgctgtacaacccacttcagattacaaagaggggactcgagaatagggcacacagcgagcagtttaacgctttttttcggttgcccaagggcgaatctttgaaggaagtgcacgagtgtttcctgtgggtccccttttcccacttcaatacacatggcaagatgtgcattagtgaaaactatatatgttttgcgagccaagatggcaatcagtgttcagtgattattcccttgagagaggtgcttgctatcgataaaacaaacgactcctccaagagcgtcatcatctccattaaaggcaaaacagccttccgcttccacgaagtgaaggattttgagcagttagtagcaaagttgcgtctcaggtgtggagccgcttccactcagtatcatgacatctccaccgaactggccatcagttccgagagcactgagccgagcgacaattttgaggtgcagtccctgacctcccagcgtgagtgtagtaagacggtgaacaccgaagcgctgatgacagtttttcaccctcagaacctggagaccctgaactcaaagatgttgaaggagaagatgaaggaacagtcttggaagatcctgtttgcggagtgcggacgcggagtgtcaatgtttcgaacgaagaaaacgagggacctggtggtgaggggaatccctgaaactttgaggggcgaattatggatgttattttccggcgcagtaaatgatatggccacaaacccggactactacaccgaagtggtcgaacagagtcttggcacatgcaaccttgcaacggaggaaatcgagcgagatctcaggcgtagtcttccggaacacccggcatttcaatccgatacaggtattagcgcactgcgccgagtgctcactgcatacgcctatcggaacccgaagattggatactgccaggccatgaatattttgacctccgtgctcctgctgtatgctaaagaggaggaagccttttggctcctagtggccgtctgcgagcgcatgttgcctgattactttaatagacgcattatcggggccctcgtcgaccaggctgtatttgaggaactgatccgggaccatttgccccagctgaccgaacatatgaccgatatgaccttcttttctagtgtctcattgtcttggtttttgacgctattcatatccgtgttacccattgagtctgcggtgaacgtggtggattgctttttttacgacggaattaaggctattcttcagctgggactggctatcctcgactataatctggacaaattactgacctgcaaggatgacgctgaggccgtcacagcactgaacagattctttgacaacgtgactaataaagattcacctctgcctagtaatgtgcagcagggcagcaatgtgtcggatgagaagaccagccacacaagggtagatattacggacctgattcgggagtccaacgagaagtatggtaatatcagatacgaggatatccatagtatgaggtgtcgaaaccgcctttacgtgattcagactctcgaagaaactactaagcagaatgttctgcgagttgtgtcacaagacgtgaaattatcactgcaggaattggacgaactatatgtgattttcaaaaaagaactgtttctgtcctgctattggtgcctgggatgtccagtgctgaaacaccatgacccttcacttccttatctggaacagtatcaaattgattgtcagcagttccgagccctctatcatttgctctccccatgggcccactccgccaataaggactccctagcactgtggacattccgcttattggacgaaaactcagattgcctcatcaactttaaagagtttagctccgccatagacatcatgtacaatggcagctttacagagaagcttaagttgctatttaagttgcatattcccccagcttatactgaagtgaagagtaaggacgcctcaaagggggatgagctgtctaaggaagaacttttgtatttttctcagcttcacgtgtctaagcccgctaatgagaaggaggctgaatcagcaaagcacagccccgaaaaaggtaaaggaaagatcgatatccaggcttacttgagccagtggcaggacgaactgttcaaaaaagaggaaaacatcaaagatcttccacgtatgaatcagagtcaattcattcagttctcaaagacgctgtacaacctgttccacgaagatcctgaggaagagagcctctatcaggctattgcagtcgtgacttcccttttgctccgcatggaagaagttggaaggaaattacactcaccaacaagctctgccaaaggtttcagcggaacagtttgcgggtctgggggaccctctgaggagaagaccggaagtcatcttgagaaggatccttgtagctttcgcgaagaaccacaatggagctttgcctttgagcagattctagcaagtttgctgaatgaaccagccctggtgcggtttttcgagaaacccatcgacgtgaaggccaaactggagaacgcgaggatatcacagctgagatccaggacaaaaatgtag

SEQ ID NO: 51346 - DNA, 654 bp, Artificial Sequence
  Description of Artificial Sequence: Synthetic coding sequence
ttcaaccggttcttcgacaacgtgaccaacaaggacagccccctgccatccaatgtccagcaggggtctaatgtttcagatgaaaaaacatcccatacaagagtggacatcaccgacctgatccgggagtctaatgagttgagagtggtgagccaagacgtcaagctctccctgcaggagctggatgagctctacgtgatcttcaagaaagaactgtttctctcttgctactggtgtttaggctgccctgtgctaaaacatcacgacccaagcctaccctacttagaacaatatcagatcgattgccagcagttcagagccctgtaccatcttctctctccctgggcccatagcgccaataaggactctctggccctgtggaccttccggttgctcgacgagaactccgactgccttattaacttcaaggagtttagcagcgctatagacatcatgtataacggtagcttcactgaaaagctgaagttgttattcaaactccacatcccgcccgcgtacacggaggtaaaaagcaaagatgcaagtaaaggcgacgagctgtcgaaagaagagctgctgtacttttctcagctgcacgtttctaagcctgcaaacgaaaaggaggccgaatccgctaagcacagtcccgagtag

SEQ ID NO: 51347 - DNA, 3801 bp, Artificial Sequence
  Description of Artificial Sequence: Synthetic coding sequence
atgtgggtgaaccccgaggaggtgctgctggccaacgccctgtggataactgagcgcgcaaacccatacttcatactccagaggcgaaaagggcatgcgggggatggtggggggggcggcggcctggcaggactgttagtaggcaccctcgatgtcgtgttggattcgtcagcacgtgtggcaccctatagaatcctttaccagacacctgattctctggtgtattggacgatcgcatgtggcgggtcccgaaaggagatcaccgagcattgggaatggctcgaacagaatctcctccagactctgtccatcttcgaaaatgagaatgacatcactacattcgttcggggcaaaattcaagggataattgccgaatacaacaagattaacgacgtcaaagaggatgacgataccgagaaatttaaagaggccatcgtcaaatttcaccgattattcggtatgcccgaggaggaaaagttggtcaactactattcatgctcgtattggaaaggcaaagtgcctagacaaggttggatgtacttgtccattaatcacctttgtttctactccttcctgatggggcgggaggctaagctggtgatccgatgggtggatatcacacagctggagaaaaatgccactttactgctgccagatgttataaaggtatccaccagaagctcggaacattttttttcagttttcctgaatatcaacgagactttcaagctgatggagcaattagcgaacatcgccatgcgccaactgctagataatgaaggtttcgaacaggatcgtagtttgcccaagctaaaacggaaatctcctaagaaagttagcgcgcttaaacgggatcttgatgcaagggctaagagcgaaaggtatagggcactttttaggctgcccaaggatgagaagctggacgggcacaccgattgtactctgtggacacctttcaacaagatgcacatcttgggtcaaatgttcgtcagtactaattatatctgttttaccagcaaggaagaaaacctgtgtagccttataattccattacgcgaggtcacaattgtcgaaaaagccgactcctctagcgttctgccttctcccctcagtattagcacccgcaatcgaatgactttcttattcgcaaacctgaaagacagagatttcttggtccaaagaatttccgactttctgcagcagactacatccaagatctacagtgataaggagttcgccggctcctataactccagcgacgacgaggtgtactcaagaccttcctctctggtctcctctagcccccaaagatcaaccagctctgatgccgatggggagaggcagttcaatctgaatggcaacagcgtgcctacggctacccaaactctgatgacaatgtatcgaaggcggagccctgaggagttcaaccccaaactcgctaaggagttcctaaaagaacaggcctggaagattcatttcgcggagtatggacagggcatctgtatgtacaggactgagaagacacgtgagctggttttgaaaggcatccctgagagtatgcgcggggagctctggttgctgctgtccggagcaattaacgagaaggccacgcatcctggttactacgaggatctggtggaaaaaagcatgggcaagtacaatcttgcgacggaagaaatcgaacgcgatctgcaccggtctcttccagagcatccggctttccaaaatgaaatggggattgcagccctccgacgggtcctgaccgcctacgcgtttaggaatcccaacatcggatattgccaggctatgaatatagtcacttcggtgctcctcctgtatgccaaggaggaagaggccttttggttgctggttgccttatgtgaaaggatgctcccagactactacaacacccgagtggtgggcgcgttagtggaccaaggggtattcgaagaactggctcgagattatgtgccccagctgtatgattgtatgcaagatcttggtgtcatcagtaccatctcattgtcgtggttcttgacactatttcttagcgtaatgcccttcgagagtgctgtggtggtggtggattgctttttctacgagggcattaaggtgattttccagctggctctcgctgttctggacgccaacgtagataaactgctgaactgcaaagatgacggtgaggcaatgactgtactggggcgctacctggacagcgtgaccaataaagactccaccctccctccaatcccccatctacactcgttgttgtccgacgacgtagaaccctaccctgaggttgatatcttccggctgatccgcaccagctacgaaaagttcggcaccatccgcgccgacctgattgaacagatgaggtttaaacagcggctcaaagtaatccagactcttgaagacacaacaaagcgtaatgttgtaagaactattgttactgaaacatcgttcacaatcgacgagctggaggaactttatgctctcttcaaggctgaacacctcacgtcttgttattggggcggctcatccaacgcccttgatcgccatgatccgagtctgccctatttagaacagtaccgaatcgacttcgagcagtttaaggggatgtttgccttgctctttccatgggcatgtggaacacactcagatgtcttagcaagtagattattccaattactcgacgagaacggggacagcttgattaattttcgagagttcgtgagcggccttagcgccgcgtgccacggggatttgaccgagaagctgaagctgctgtataagatgcatgttttacccgaacctagctcagaccaagacgagcctgattcagcttttgaagcaactcagtacttctttgaggacatcacccctgaatgtacccacgtcgtgggtctggatagtaggagtaagcagggagctgacgacggcttcgtaactgtctccctcaaaccggataagggaaaaagggctaactcacaggaaaatagaaactacctgaggctctggacaccagaaaacaaatcaaagtccaagaacgcgaaagacctgcccaaactgaaccaaggtcagttcatcgaactgtgcaagaccatgtacaacatgttctctgaggatcccaacgagcaagagctgtaccatgccacagcagcagtcacatccctgctgctggagatcggcgaagtaggaaaactgttcgtggctcagcccgccaaagaaggcggctctggaggcagtgggccgagctgccaccagggaatccccggcgtcctgttccctaaaaaggggccaggtcagccctacgtggtggaatcagtggaacccttgcctgcatctctggccccagactctgaagaacactccttaggaggtcagatggaagacatcaagctcgaagactctagcccaagggacaacggcgcatgtagctctatgttgatctcagacgacgatactaaggacgatagcagtatgtcttcttattctgttctcagcgccggaagccatgaggaggacaagctccactgtgaggatataggtgaggacaccgtgctggtgcgcagcgggcagggaaccgcagcactcccaagaagcacgtctctcgaccgggactgggctattacttttgagcagtttttagcctccttgctgaccgaaccagcccttgtgaagtatttcgataaacctgtttgtatgatggccagaattaccagcgcgaagaatatacggatgatgggtaagcccctcaccagcgctagcgattacgagatttccgctatgtccgggtag

SEQ ID NO: 51348 - DNA, 1848 bp, Artificial Sequence
  Description of Artificial Sequence: Synthetic coding sequence
atggagagcatgttcgaggacgacatcagcatcctgacccaggaggccctgggcccctccgaggtctggctggatagtcccggcgatccatctctcggcggcgacatgtgcagcgcttcgcattttgctctcatcactgcctacggtgacatcaaggagagactgggtggtctcgaaagggaaaatgccacgttgagaaggcgcctcaaggtctacgaaatcaagtatcctctgatttccgattttggtgaagagcacggtttctcactttatgagattaaagatggaagcctgctggaggtggagaaagttagcctgcagcaaaggttgaatcaattccagcacgagttacagaagaacaaggaacaggaggagcagctgggcgagatgatacaggcctacgagaagttgtgcgtcgagaagagtgacctcgagacggaacttagggagatgcgggctctggtcgaaacacatctgcgccagatttgcggacttgagcagcagcttcgacagcagcagggcctgcaagatgccgccttctccaacctgagccctccccccgcccctgccccaccctgcaccgatcttgatttacattatttagctctccgtgggggaagcgggctgtcacacgctggctggcccggctctacaccaagtgttagcgatcttgagcggaggcgccttgaggaagcactcgaggccgcccagggagaggcgaggggcgctcagttacgagaagaacaactgcaagctgagtgcgaacggctccagggggaattaaaacaactgcaggagaccagagcccaggacctcgcttctaaccaatccgaacgggatatggcttgggttaaacgcgttggcgacgatcaggtgaacctggccctcgcctacaccgagcttacagaagagctgggtcggctgcgggagctctcgagcctgcagggacggattctccgtaccctgctgcaagagcaggctcgcagcggagggcagaggcactcccctctcagccagcgacactcccccgccccccaatgccctagcccctcacctccggctcgggcagcacctccatgtccaccatgccagagccccgtccctcagcgaagatcccccgtgccaccctgcccctcgccccagcaaaggcgatcacccgcttctccctcctgcccaagccccgtcccccagcgtcgatcaccggttcccccatcctgccaatccccttccccgcaacgacgcagcccagtgcctccctcttgcccagccccacagcctaggcctccccctccccccccaccaggcgagcgcaccctagccgagcgcgcctacgccaagcccccctcccaccacgtgaaggcaggatttcagggccggagatcctattctgagcttgccgaaggagcggcctacgctggcgcaagtcctccatggctgcaggcggaggccgctacgctgccgaaacctagagcctacgggagcgagctctatggaccgggacggccactgagcccacgtcgcgcattcgaaggcatacgattaagattcgagaagcagccttcagaggaggacgagtgggccgtgccaaccagtccaccatctcctgaggttgggacaattcgctgtgcatcgttctgcgccggattccccatacccgagagccctgcggcaacagcttacgcacacgccgagcacgctcagagctggccatccattaatctgctgatggagacagtaggaagcgacattcgatcctgtcccctctgccagctgggcttccctgttgggtatcccgatgacgccctgattaagcacatcgactctcacctcgagaatagcaaaatttag

SEQ ID NO: 51349 - DNA, 672 bp, Artificial Sequence
  Description of Artificial Sequence: Synthetic coding sequence
atggagagcatgttcgaggacgacatcagcatcctgacccaggaggccctcgggccaagtgaggtgtggcttgactctcccggcgatcctagcttgggaggcgatatgtgcagtgcttcgcactttgctctcatcacagcttacggagatattaaagagagactaggtggcttggaaagagagaacgctacactaagacgccggctgaaggtctacgagattaaatatcctctgatctccgacttcggtgaggaacatggcttttcactctacgaaattaaggatggctcgctgttagaggtggaaaaggtgagcctgcagcaaaggctcaaccaattccaacacgagttgcaaaaaaataaagagcaggaggaacagctgggagagatgattcaggcctacgaaaagctgtgcgtcgaaaagtctgaccttgagaccgaactgcgcgagatgcgcgcccttgtagagacccatcttcgtcagatatgtgggctggaacagcagctgcggcagcaacaaggtctccaggacgcagcattcagcaacctgagtccaccccggcgcgcccgagcagtgctggcagtgcaccagttagccgatggggatggaggcctacgccacccgcagctgccaccacttccggctggcttcccttgtagggtccctgggtag

SEQ ID NO: 51350 - DNA, 1062 bp, Artificial Sequence
  Description of Artificial Sequence: Synthetic coding sequence
atgctggagggccagctggaggcccgggagcccaaggagggcacccatccagaggatccctgcccaggggctggcgccgctatggagaaaactccagctgccgcagaggtccctagggaagattccaacgcaggcgagatgccttccctccagcagcagatcacttccctgcatcaagaattggggagacagcagtcgctgtgggccgacatccatcggaagctgcaaagccacatggatgctctccggaaacagaaccgggagctccgcgaggagctacgcggactacaacgccagcaatgggaagcgggcaaaaaacctgccgccagccctcatgcaggaagggagtctcacacactagctcttgagcccgcattcggaaaaatcagtccattgtccgccgacgaggagaccaccccaaagtatgccgggaggaaatctcagagcgccacattattgggacaacgttggtccagcaaccacctcgccccacctaaaccaatgagcctgaagacggagcgcattaactctggcaagacgcccccacaggaagaccgggagaaatctccccctggccgaagacaggatcgctctccggcccctactgggcgaccaactccgggtgcagagaggcgagaggtgagcgaagacggcaaaatcatgcatccctccagccgctctctgcaaaacagcggagggcgcaaatccccggttcaggcaagccaggccgcaactctgcaggagcagaccgccgctgcgggagtggcagaccgttcctccagtgtactgggctccagtgagggtgggttcctctccagggtgcaggctgaggagttcgcctcctcgagcccagattccgccgagcggcaaaacctaccagttaatcctccgtcctcacttgaaatcgctcaggcgatggacaccaaaatgaaaaaggaagaggtccaggaagagaagaggcaccccaacggaaaagccgacgattgccggcgtagcggcttcccatctgagtttccgggcgccctgcatgctgccccaagtcgccaggacatgggcccatag

SEQ ID NO: 51351 - DNA, 1125 bp, Artificial Sequence
  Description of Artificial Sequence: Synthetic coding sequence
atgaaggtggacatggccaacttcgccatcagcagcatccggccccacttgatgcagcagtcagtggaatacgagaggaagaaattccaggagatcttagagagacagccgaattctttggatttcgtgactcagtggctggaagaagcctcggaggatttaatgactcagaagtacaagcacgcgctgccagtggggggaatggcagccggctccggagatatgcctaggctctcacctgtggctgtgcagaactatgcttacctgaagcttctgaaatgggatcacctccagcggccatttcctgaaactgtgctcatggaccaaagccgtttccacgagctgcagttacagctggaacagctcacaattctgggcgctgtcctcttagtcaccttcagcatggctgcacccgggatctctagccaggcagattttgccgagaaacttaagatgatcgtaaagattctccttacagatatgcacctaccttctttccatcttaaggacgtattaaccactataggagagaaagtatgtctggaggtgtcttcatgtctatcactgtgcgggagctccccattcaccacagataaggagacagtgctcaagggccagatccaagccgtggccagccccgacgaccctataaggagaatcatggagagccgaatacttaccttcctggaaacgtatttggcctccgggcaccagaagccgttgcctactgtccctggtgggttatccccggtgcagagggagctggaagaagtggcaattaagtttgccaggctggtgaattacaataagatggtgttttgcccttattatgacgccatcctgcgtaaacgatggatatcattcgggaatttttttggctcttcgaataccgatatgagcccctggaattgcaggacggactacccaatgtcactacatatccgctttccaaaaaaccatgtgatcgaagcccccatgactattcaactctgctttcaggaaccttgcaacaaagctttatcactgctgaacattcctctggaggccaaaggcatccttgaccggtctttcctgcagagacgtctcaagccctaccggattagattctgctgccgagcactatag

SEQ ID NO: 51352 - DNA, 1530 bp, Artificial Sequence
  Description of Artificial Sequence: Synthetic coding sequence
atgagcgagaacctggacaagagcaacgtgaacgaggccggcaagtcaaagtctaacgactctgaggaaggcctggaggatgcagttgaaggggcagatgaggcactccagaaagcgataaaatctgacagtagttccccacagagggtgcaacgtccacatagtagcccaccaagattcgtgactgtcgaggagctgctggaaaccgccagaggagttacaaacatggcactcgcacatgaaattgtggtaaatggagatttccagatcaaaccagttgagctaccggaaaattcactgaaaaagcgcgttaaagagatagtgcacaaagccttttgggattgcctgagcgtacagctcagtgaagatccacccgcctacgaccatgcaataaaactcgtgggcgaaatcaaggaaacactgctcagttttcttctgccaggccacacacggttacgcaaccaaatcacagaggtgctggacttggacctgatcaagcaggaggccgaaaatggcgcactcgatattagcaagctggcagaatttatcattggaatgatggggaccctctgtgcccctgctcgagacgaggaggtgaagaaactgaaggacatcaaggagattgtcccactctttcgcgaaattttctctgtgttagatctgatgaaggtggacatggccaacttcgcaattagctcaattcgcccacacctgatgcagcagagcgttgagtatgagaggaaaaaattccaggagattctggagcggcagccgaactcgctcgactttgtaacccaatggctcgaggaggccagcgaggaccttatgactcagaagtataagcacgccctgcctgtgggggggatggccgccggctccggcgatatgccaaggctgtctcccgtggcagtgcagaattacgcatatctgaaactcctgaagtgggaccacctgcagcgtcctttcccggagaccgtgctgatggaccagtcacgttttcatgaattgcagctccaacttgaacaactgaccattcttggcgccgtgcttctcgtgacattctccatggcagcacctggaatcagctcacaagctgacttcgccgaaaagctgaagatgatagtgaagatcttgctcaccgatatgcatcttccgagctttcacctcaaagatgtcttgaccacaatcggcgagaaagtatgtctggaggttagctcctgtctgagcctgtgcggcagtagccccttcaccaccgataaggaaaccgtactgaagggccagatccaggcagtggcttccccagacgatcccatccgtcgcatcatggagtcaagaattctgacattcctggaaacatatctggcctcaggacatcaaaagccattacccactgtgcccggagggctatccccggtgcagcgtgagctggaagaagtcgccatcaagttcgcacggctggtgaactataacaagatggtgttttgcccttattacgacgccatacttagtaagattctggtcagaagctag

SEQ ID NO: 51353 - DNA, 1530 bp, Artificial Sequence
  Description of Artificial Sequence: Synthetic coding sequence
atgagcgagaacctggacaagagcaacgtgaacgaggccggcaagtcaaaatccaatgacagcgaagaggggctggaggatgccgtggagggagcagatgaggctctccagaaagctattaaaagcgatagttcctcaccacaaagagttcagcgtccccatagctctcccccaaggtttgtgaccgtcgaagagctcctggagaccgcccgaggcgttaccaatatggccctggcacatgaaattgtcgtgaatggggatttccaaataaaacccgtggaactccctgaaaattccctgaaaaagagagtgaaggaaatcgtccataaggcgttctgggattgcctgtctgtccagctctcggaggaccctcccgcatacgaccatgcgattaagctagtgggcgagatcaaagagaccctgctgtccttccttctccctggacacactcggttacgcaatcagattaccgaggtcttggatctggacctcattaaacaggaggccgaaaacggcgcccttgatatttcgaagctcgccgaatttattatcggcatgatgggaactctgtgcgctcccgcacgggacgaggaagtaaagaagctcaaggacattaaggaaattgtgccactttttcgcgaaatcttttccgtattagatttaatgaaggtggacatggcaaatttcgcaataagttcaatccggccccacctcatgcagcaatccgtggagtacgaacggaagaaattccaggagattttagagcggcagcccaacagcttggacttcgtaacccagtggttggaagaggcgagcgaggacctgatgacacagaaatacaaacacgccctgcccgtggggggcatggccgctggtagtggcgacatgccaagactgtccccagtggctgtccagaattatgcgtacctcaagctgcttaaatgggaccatttgcagcgcccattccctgaaaccgtgttgatggatcagagccggttccacgaattacaactccagctggaacaactaacgatcctgggcgcagtgctgttggtgacatttagtatggccgctccagggataagcagccaggcagacttcgcagaaaaattgaagatgatcgtcaagattttacttacggacatgcacttgcccagcttccatctgaaagatgtcttgactacgatcggggagaaggtttgcctggaggttagttcttgtctgagcctctgcggttccagcccatttaccactgataaggaaaccgttctgaagggacagatccaggccgttgccagcccggatgaccctatcaggcggatcatggaatccaggatcctaacattccttgaaacttacttggccagtggccaccagaaaccattaccaacggtacctgggggactatcgcccgtccagcgcgagctggaagaagtcgccataaaattcgccaggttggtgaattacaacaaaatggttttctgcccttactatgacgcaatcctttccaagattctggttcggtcatag

SEQ ID NO: 51354 - DNA, 165 bp, Artificial Sequence
  Description of Artificial Sequence: Synthetic coding sequence
atgagcgagaacctggacaagagcaacgtgaacgaggccggcaagtcaaagtctaatgattctgaagaggggctggaggacgcagtggagggcgcagacgaagccctccagaaagcaataaaatctgattcttcctccccacagagagtccaacgaccacattag

SEQ ID NO: 51355 - DNA, 435 bp, Artificial Sequence
  Description of Artificial Sequence: Synthetic coding sequence
atgagcgagaacctggacaagagcaacgtgaacgaggccggcaagtcaaagtctaatgattccgaagaaggcctggaggacgcagttgaaggtgcggatgaagctctccagaaagcaatcaagagcgattccagtagtcctcagagggtccagcggccacactcctctcctccacgatttgtcactgtcgaagagcttctggagaccgctaggggcgtgactaatatggcccttgcacatgagatagtggtgaacggcgactttcagataaagcccgtagagctccccgagaactcccttaagaagcgcgtgaaggaaatagtgcataaagccttctgggattgtctatccgtccaacttagcgaagatccaccagcctacgatcatgcaatcaagctggtcggagaaattaaagagactttgttgtccttttag

SEQ ID NO: 51356 - DNA, 1530 bp, Artificial Sequence
  Description of Artificial Sequence: Synthetic coding sequence
atgagcgagaacctggacaagagcaacgtgaacgaggccggcaagtcaaaaagtaacgactctgaagaaggactggaagacgccgttgagggagcagatgaggcgttgcaaaaagctatcaagtccgactcgtcctcaccccaacgcgtgcagcgtccgcacagttctcctcccaggtttgtcaccgttgaagagctgcttgagactgcacggggtgtcactaacatggccctggcacacgagatagtggtgaatggtgactttcagatcaaacccgtggaactacccgaaaacagtctaaagaagcgcgtgaaagagatcgtgcacaaggctttctgggattgtctgagcgtgcagctgagtgaagaccccccagcttatgaccatgctatcaaactagtcggggagattaaggagacgctactctcttttttacttcccggccatacaaggttacggaatcaaattaccgaagttctagatctcgatctgataaaacaggaggctgagaatggtgccctcgacatatcaaaactggctgaattcatcatcgggatgatgggaactttgtgcgctcctgctcgggatgaggaagtgaagaaactaaaggatattaaggaaatcgtgcctcttttccgggaaatttttagtgtgcttgacctgatgaaggttgacatggctaactttgctattagttccattcgtccgcatctgatgcagcagagcgttgaatacgagcggaagaaatttcaagagatcctggagcgccagcctaattcccttgacttcgtgactcagtggctcgaggaagcgagcgaagacttgatgacgcagaaatataagcatgcactgcccgtaggcggcatggccgcggggagtggcgacatgccccgcttgtcacccgtggctgttcagaactacgcctacctgaagctgttgaagtgggaccacttgcagcgaccgttcccagagacggttctgatggatcaaagcagattccacgaattacagctgcaacttgaacagctgacaattttaggggccgtcctgctggtcactttcagtatggcagctccagggataagtagtcaggccgatttcgcggagaaactgaaaatgattgtgaaaatactgctcacagatatgcatctgccttcatttcatttgaaggacgttttgaccaccattggagaaaaagtttgtctggaggtgagcagctgcctatcgctctgtgggagctccccttttactaccgataaagagaccgtcctgaaaggccagatacaagcagttgcctcgcccgatgaccccatccgtaggatcatggaaagccgcattctgacatttctggaaacgtatctggcaagcggtcatcaaaagccactaccaacagttcccggagggctaagtccagttcagcgcgagctggaggaggtggccatcaaatttgctaggctggtgaattacaataagatggttttttgcccttattatgacgcaatactgagtaagattttggttcggagttag

SEQ ID NO: 51357 - DNA, 1560 bp, Artificial Sequence
  Description of Artificial Sequence: Synthetic coding sequence
atgcccttcaacggcgagaagcagtgcgtgggcgaggaccagccctcggactctgattccagcaggttcagcgagtcaatggccagcctcagcgattatgaatgctcccgacagtctttcgcaagtgatagcagttcaaaaagcagctcgcccgctagcacgtccccccccagagtcgtaacttttgatgaggtgatggctaccgccagaaatttgtccaatctaactttggcgcatgaaatcgccgtgaacgagaatttccagctgaaacaggaggccctgcccgagaaatcactcgccggccgggtcaagcatattgttcaccaggctttctgggatgtgctggactccgagctgaatgctgaccccccagaatttgaacacgccattaagctctttgaagaaatccgggaaattctgttgagttttctgactccgggtgggaatcggctgagaaatcaaatctgcgaagtcctggataccgatctgatccggcagcaggccgaacactctgcagttgacatacaggggctagccaactatgtgatcagcacaatgggcaaactttgcgcacccgttcgagacaatgacattagagaactgaaggccactggcaatatcgtcgaagtgttgagacaaatcttccacgtcctggacttgatgcagatggatatggcgaactttacaatcatgtctctgcgcccccacttgcagaggcagctcgtggagtatgaaaggaccaaatttcaggaaattcttgaagaaaccccctccgccctcgaccagactactgaatggataaaggagagcgtcaacgaggagttgttttcccttagcgagtccgccctgacccctggcgctgaaaacacttcgaagccatctctgtctcccaccctggttctcaataattcatacctgaaactcctccagtgggattatcagaagaaagagctccctgaaaccttaatgacagacggagctcgtttacaggagctgacagaaaagttaaatcaattaaaaattattgcttgtctcagtctgatcactaataacatggtgggtgccattactggtggacttccagagcttgccagtcggcttactagaattagcgctgtgcttctggagggaatgaataaagagacattcaatctgaaggaggtcctgaacagcatcggaatccagacttgtgtggaagtcaacaagactttgatggagagggggctgccgaccctgaacgctgagattcaggctaatcttatcggtcagttcagttcaatcgaggaggaagataatcctatctggtctctcattgacaagaggattaaactttatatgcggagactgctgtgcctgccctcaccccagaagtgtatgccccccatgcccggagggctggcagtgatccaacaagagctggaggccctagggtcccagtacgccaacattgtcaaccttaacaagcaggtgtatggcccgttttacgccaacatcctgcggaagttgttattcaatgaggaagcgatgggtaaagtagacgcatcccctcccacgaattag

SEQ ID NO: 51358 - DNA, 294 bp, Artificial Sequence
  Description of Artificial Sequence: Synthetic coding sequence
atgcccttcaacggcgagaagcagtgcgtgggcgaggaccagcccagcgactctgatagttctaggttctccgaatctatggcctccctgtctgattatgaatgctctaggcagtcgttcgctagcgactctagctctaaatcatccagccctgctagcaccagtcctccgagagtggtgacattcgacgaagtcatggcaacagcgaggaacctcagcaatctgaccctagcgcatgagattgctgtgaatgaaaactttcagctgaagcaagaagccctcccagagaagtag

SEQ ID NO: 51359 - DNA, 57 bp, Artificial Sequence
  Description of Artificial Sequence: Synthetic coding sequence
atgcccttcaacggcgagaagcagtgcgtgggcgaggaccagccctctgactcctag

SEQ ID NO: 51360 - DNA, 399 bp, Artificial Sequence
  Description of Artificial Sequence: Synthetic coding sequence
atgcccttcaacggcgagaagcagtgcgtgggcgaggaccagcccagcgactccgatagcagccgatttagcgaaagcatggcaagtctgtccgactatgagtgctcccggcagtccttcgccagtgattccagcagcaagagcagctcacccgctagtacgtctccccctcgggtagtgaccttcgacgaggtgatggccacagctcgaaatttgagtaacttgaccctggctcacgagatagccgtaaacgagaacttccagctgaagcaagaagctctccccgagaagagcctcgcgggccgtgtgaaacacatcgtgcaccaggctttttgggatgttttagacagcgaacttaatgcagacccacccgagttcgagcacgctatcaagctgtag

SEQ ID NO: 51361 - DNA, 705 bp, Artificial Sequence
  Description of Artificial Sequence: Synthetic coding sequence
atgcccttcaacggcgagaagcagtgcgtgggcgaggaccagccctccgacagtgactcctcgaggttctccgagagtatggcgagtttatctgactatgagtgttcaaggcagtccttcgcaagcgacagcagctcgaagtcctcatcacctgcatccacaagcccgccgagagtagtgacatttgatgaagtcatggcaacagcgcggaatctctctaatctgacactggcccacgagatcgccgtaaatgagaactttcaactcaagcaggaagcactgccagagaagagcctggccggaagagtaaagcacatcgttcaccaggcattctgggatgttctcgatagtgagttgaacgctgacccccctgagtttgagcacgcaatcaagctgtttgaggaaattagagagatcctgctgtccttcctgacccccgggggcaaccgcttaaggaatcagatctgtgaggtcctggacactgacttgatcagacagcaagctgagcactccgccgtggatatccagggactggcaaactatgtcatctctacaatgggcaaattgtgtgcaccagtgagggacaacgatatccgggagctgaaagccactggaaacatcgtagaagtgctgaggcagatcttccatgtcttagatctgatgcagatggacatggccaatttcactataatgtccctccgctag

SEQ ID NO: 51362 - DNA, 57 bp, Artificial Sequence
  Description of Artificial Sequence: Synthetic coding sequence
atgcccttcaacggcgagaagcagtgcgtgggcgaggaccagccctccgattcatag

SEQ ID NO: 51363 - DNA, 540 bp, Artificial Sequence
  Description of Artificial Sequence: Synthetic coding sequence
atgatgatgagcgacaacgccaagggccgggccgcccacagctggaagaaaaggggctccatcagcagcttaagcaatcatgagttttggcgcaaggagatccatggtcgcattaaagacagcatgtccacggtctcttatatggaagagccaagtcaacgcgatgacatttccagactcaccgtccagatggagaatacgtaccaactcggcccccctaaacacttccctgtcgtgacggtgaatcacattctcaaagatgtcgtgacctcatacctgcaggtggaagagtatgagcccgagctctgccgccaaatgactaagacgatcagcgaggtaatcaaggcacaggtgaaagacttgatgatccccagatataagctaatcgtgattgttcacattggacagttgaatagacagtctatcttgattggcagtaggtgcctctgggatcccaagtcagatactttctcctcatacgtgtttcggaacagttccctctttgcgctggccaacgtatacgcagtttatctggagtag

SEQ ID NO: 51364 - DNA, 429 bp, Artificial Sequence
  Description of Artificial Sequence: Synthetic coding sequence
atggccaccagcatcggcgtgagcttcagcgtgggcgacggcgtgccagaggccgagaagaacgccggggagccagagaacacctacatactgaggcctgtattccagcagcgatttcggccaagcgtagtgaaagattgcatccacgccgtgctgaaggaggagctggccaacgccgaatattcccccgaggagatgcctcagctgactaagcacttatcggagaatattaaggacaagcttaaggagatgggtttcgaccggtacaaaatggttgtgcaagtggtgatcggggaacagcgtggtgagggtgtgtttatggcaagtcgatgcttttgggacgctgataccgataattacacacacgacgtgtttatgaacgatagccttttttgtgtggttgcagccttcggatgcttttattactag

SEQ ID NO: 51365 - DNA, 255 bp, Artificial Sequence
  Description of Artificial Sequence: Synthetic coding sequence
atggccaccagcatcggcgtgagcttcagcgtgggcgacggcgtgcccgaggccgagaagaacgccggtgagcctgaaaatacctacatcctacggcccgtgtttcaacagcgatttcggccctcggtggtgaaagactgcatccacgccgtgttgaaggaggagctggctaatgccgagtactcacccgaggagatgcctcaattaacaaagcaccttagtgagaacattaaggataaaaagaagaagaaatag

SEQ ID NO: 51366 - DNA, 1053 bp, Artificial Sequence
  Description of Artificial Sequence: Synthetic coding sequence
atgagcgccgcctgctgggaggagccctggggcctgcccggcggcttcgccaagcgcgtgctcgttacaggaggcgctggctttattgcctcacacatgatagtgagcctggtcgaggactacccgaactacatgatcatcaatttggataaacttgattactgcgccagcctcaaaaacctggagaccatatcaaataagcagaattataagtttatccagggggatatttgcgacagccatttcgtgaagctcttatttgagacagagaagatcgatatcgtgctgcactttgcggcccagacccacgtggacctatcgttcgttcgcgccttcgagtttacgtacgtcaacgtgtacggcacacacgtactggtctctgccgcacatgaagcaagagtcgagaaattcatatatgtgagcaccgatgaagtctacgggggaagtcttgataaagaatttgacgagtccagcccaaagcagccgacaaacccctatgccagttccaaagctgctgcggaatgtttcgtgcaatcctattgggagcaatataaatttcccgtcgtaatcacacggagttccaacgtatatggcccacatcagtaccctgagaaagtgatccctaagttcatttctctgctccagcacaataggaaatgctgtatccacggatccggactccagacccggaatttcctgtatgcaacagacgtcgttgaagccttcttaactgtgctgaaaaagggcaaacctggcgaaatctacaacattggaactaactttgagatgagtgtggtccagcttgctaaggagctgattcaactgattaaggagaccaatagtgaaagcgaaatggaaaattgggttgattacgttaacgaccggccaactaatgacatgcgatacccgatgaaaagcgagaagattcatggcctgggatggagaccaaaggtcccttggaaagaaggtatcaaaaaaacaatcgagtggtacagagagaattttcacaactggaagaatgtggagaaagccctagagccttttccagtctag

SEQ ID NO: 51367 - DNA, 4236 bp, Artificial Sequence
  Description of Artificial Sequence: Synthetic coding sequence
atggccagcatcagcgagcccgtgaccttccgggagttctgccccttgtactacttgctgaatgccattccaacgaaaatccagaaaggcttcagaagcattgtggtgtaccttaccgcgcttgacacaaatggcgactatatagccgtaggatcctcaatagggatgttgtacctgtattgtcgtcacttaaaccagatgagaaaatacaacttcgaggggaaaaccgaatccatcaccgttgttaaactgctttcatgctttgacgatctggtggccgcgggaacggccagcggccgtgtcgctgtgtttcaacttgtaagctctcttcccggtaggaacaaacagttaaggcgattcgatgtcacgggcatccataagaattctataactgcgctggcctggtcaccaaacggcatgaagctgttcagcggcgacgataaaggaaaaatcgtgtacagcagtttggacctggaccaggggctctgcaactctcaactggtgctcgaagagcccagctcaattgtgcaactcgattactcccagaaggtccttctagtgagcacacttcagaggtctctcctgttctataccgaggagaagagcgtgcggcaaattgggacccaacctcgaaagtctacaggcaagtttggtgcctgcttcattccaggcctgtgtaagcagagcgatctcaccctctacgcctctcgcccaggactgaggctgtggaaagcagatgtgcacggaaccgttcaggccaccttcatcctgaaggatgcattcgccggaggggttaagccattcgaacttcacccccggcttgaaagtcctaactccgggtcatgctccctcccggaacgccacctgggcctggtatcctgcttctttcaggaggggtgggtgctgagctggaatgagtatagcatctacctcttggacactgtcaaccaggctacagtagccggattagagggatcgggcgatattgtgagtgtgagctgcacggaaaatgaaatcttttttctgaaaggggatcgcaacatcattaggatcagcagcaggcccgaggggcttacctccaccgtgagggatggactggagatgtcagggtgcagcgaacgagtgcatgtgcaacaggcagagaaacttcctggagcaacagtgtcggaaacccgcctccgggggtccagcatggcctctagtgtggcttccgaacctcggtctcgctcaagttctcttaatagtacagactcaggcagtggcctgttaccccctggtctgcaagcaactcccgaactcgggaaggggtcccagcctctgtcccagagatttaacgctataagctccgaggactttgaccaggagctggtcgtgaagcccattaaagtgaagcgtaaaaagaagaaaaagaagactgagggcggctccagatcaacctgccacagtagcttagaatcaacaccctgttcagaattccccggagatagccctcagtctctgaacacagatctgctgtcaatgacctcaagcgtccttggtagctcagtggaccagctcagtgcagagagtccagaccaggagtcttcatttaatggggaagttaacggcgtgccgcaggaaaataccgacccagagaccttcaacgtgctcgaggtgtccggcagtatgcctgacagcctcgccgaagaggacgacatccggaccgaaatgccccactgtcatcacgctcatggacgggagctcctgaacggtgcacgcgaggacgtggggggatcagatgtgactggactcggagacgagccttgccccgcagacgacggcccaaactctacccaacttccatttcaggaacaggattccagtcctggggcacatgatggagaggacatacagccaatcggccctcagtcaaccttttgcgaagtgcccttattaaattctctgacggttcccagtagtctatcttgggccccttccgcagaacaatggctgccaggtacacgggccgatgagggcagtccggtcgagccttcgcaggaacaagacatccttacaagcatggaggcatctggacatctgagcaccaacttgtggcacgcagtgactgatgacgatacggggcagaaagagatccccatcagcgaacgcgtgctggggtccgtgggcggccaacttactcctgtgtctgctctggccgctagcacccacaagccgtggctggagcaaccacccagagaccagaccctgacgtcatccgatgaggaagacatttacgcacatgggctgcccagctcttcctccgagacctcagtgactgaactgggaccatcgtgtagccaacaggatctgtcccgtctgggggctgaggatgccggcctcctaaaacctgaccaatttgcagaatcctggatgggttattcagggcccggctatggaatactgtctctcgtcgtatccgagaagtatatatggtgtctcgactacaagggaggactattttgttccgctttacctggggccgggctcagatggcagaaatttgaagatgcagtacagcaagttgcagtcagtccgtccggcgctctgctctggaagattgaacagaaatcgaatcgggcatttgcttgtgggaaagtaacgattaagggaaagagacactggtacgaggccttgccccaggcggtgttcgtcgccttgagtgacgacactgcctggatcattagaactagcggcgacctatacctgcaaacagggctttctgtcgatcggccctgtgctcgggctgttaaagttgattgcccttacccattgagccagatcacagctagaaataatgtggtatgggccctgacagaacagagagccctgctataccgtgaaggggtctcttctttttgccccgagggcgagcagtggaagtgtgatatcgtctctgaaaggcaagctttggaaccagtctgcataaccttgggtgaccaacagactctgtgggccctggatatccatggaaatctgtggtttcggactggtattatttcgaaaaaaccacagggggatgacgatcattggtggcaggtttctattactgactacgtggttttcgatcagtgttccctatttcaaaccatcatccacgccacgcacagtgttgcgaccgccgcgcaagctccggtcgaaaaagtggcggacaagctcagaatggcattctggtctcagcagcttcagtgtcaaccaagccttcttggggtgaacaattctggggtgtggatctcctcagggaagaacgagttccacgtcgccaagggatccttgatcggcacttattggaatcacgtcgtacccagaggaacagcctccgctacaaaatgggcgttcgtgctcgcttcagcagcaccaactaaggagggcagcttcttgtggctgtgtcagtcttcaaaggatttatgcagcgtaagtgcgcagtctgcacagagccgaccatcaacagtgcaactcccccccgaggctgagatgcgcgcctacgcagcctgtcaggatgccctgtgggctttagactcactagggcaggtgtttattcgcaccctcagcaagagttgccctacaggaatgcactggactcgtctggatctgagtcaattgggagccgtcaaactgacatccctagcttgtggaaaccagcacatatgggcctgtgattcaagaggaggtgtgtactttagagtcggcacacagccactgaatccgtcgctaatgctacccgcctggatcatgattgagcccccagtccaacccgccggggtaagcttggtatcagtgcactcgtctcctaacgaccagatgctctgggtgcttgacagtcgatggaacgtgcatgttcggactggcattactgaagagatgccagtggggaccgcttgggaacacgtgccaggtttgcaagcctgccagctggctctgagcactaggacagtctgggccagatgccctaacggtgatctcgctagacgatacggggttacagataagaacccggccggggattactggaaaaaaatccccgggagtgtgtcctgctttaccgtgacagcatctgacgaactatgggccgtagggccgcccgggtatctcctgcagcgactgacaaaaactttctcccattctcacgggacacagaaatcatcccaagcagcgatgccccatcccgaagatctagaagacgagtgggaggtgatttag

SEQ ID NO: 51368 - DNA, 2202 bp, Artificial Sequence
  Description of Artificial Sequence: Synthetic coding sequence
atggccagcatcagcgagcccgtgaccttccgggagttctgccccctgtactacctgttgaatgccatccccaccaagatccagaaggggtttcgaagtatcgtggtgtatttgaccgctcttgatacaaacggagactatatagccgttggtagcagtatcggcatgctgtacctatattgtcgccacctgaatcagatgagaaagtataacttcgaagggaagaccgagagcatcacagtggtgaagctgctctcatgttttgacgatctcgtggcagctggtacggctagtggcagagtggcagtattccagctggtctcctccctgccaggtcggaacaagcaactccgaaggttcgatgtaaccggcatccataagaactctatcaccgctctggcctggtctccgaatggcatgaaactctttagcggggatgataagggcaagatagtttatagcagcctggacttggatcagggcctttgtaactcccagctcgtcctggaagaaccaagcagcattgttcaacttgactattcgcaaaaggttctgctcgtctctactctccagagaagtttgctgttttataccgaagagaagagcgtgagacagatcgggacgcaaccccgcaagtctaccggtaagttcggggcctgttttattccaggactgtgtaagcaaagtgatctcacactgtacgcttcaagacccggcttgcgtctgtggaaagccgatgtccacggaaccgtgcaggctactttcatcctaaaagacgcctttgccgggggtgtgaagccttttgaactgcatccccggctcgagtctcccaactccggctcatgttcactgccggagagacatctgggcttggttagttgctttttccaggaggggtgggtcctttcttggaacgagtactcaatctacttgttggatactgtgaaccaggctacagtggccggcctggaggggtcaggcgatatcgtctcagtgtcttgcactgagaatgagattttttttctgaagggcgatcgcaacatcattcgtattagcagccgccctgagggcttaactagtacggtgcgagacgggctggagatgtccggttgttccgaaagggtccacgtacaacaagcggagaagcttccaggggccaccgtgagtgaaacacggctcagaggatcaagcatggcctcctctgtggccagcgaacctcgatccaggagtagctctcttaattctacagactccggaagtggactccttccccccggtctacaggccactccagaactaggcaaaggttcacagccactgagccaacgcttcaatgcaatttcgagcgaagactttgatcaggaactggtggtaaaaccaataaaggtgaaacgaaagaaaaagaaaaaaaagacagaggggggcagccgctcaacttgccactcctccctggaatcaacaccctgctccgagttccctggagactcccctcagtctctcaatacagacctgctgtccatgacgtccagcgtactggggtcctccgtcgaccaactttcggccgaaagccctgaccaagaatctagcttcaacggagaggtgaacggcgtccctcaagagaacaccgaccccgagactttcaacgttctcgaggtaagtggatcaatgccggattctctggctgaggaggacgatattcgtactgaaatgccccattgccaccacgctcatggccgggagctgttgaacggcgctcgggaggatgttggaggctcggacgtgactggcctaggcgatgagccctgtccggctgatgatggcccaaattccaccccccaacatacaacacacctgacctcccatcattccaccccccaccataccacaccccactgcaccatccctcaccacataagccctcatcactctacaccacatcatactacccatcatacgcctcaccgcaccgccccacatcgtacagccccctatctagcaacatcccatcacacgactccccatcacacctcactccctactcacggggccggttgtcctccacctggggaacacactagcgccgaaactgtgaagcctgatgggtgtaaatggaatttggacgtgtgcacatgcgtcccaggccgtgatggtacgggaggttgtatggggagaggcggagccgaacagggcagcctcacatag

SEQ ID NO: 51369 - DNA, 3804 bp, Artificial Sequence
  Description of Artificial Sequence: Synthetic coding sequence
atggccagcatcagcgagcccgtgaccttccgggagttctgccccctttactatctattgaatgccattcccaccaaaatccagaagggtttcagatcaatcgtcgtgtatctgacggcccttgacaccaacggggactacatagcggtaggatcctctatagggatgctgtatctgtactgccgccatctgaatcaaatgcggaaatataacttcgaggggaagaccgagtctatcaccgttgtcaagctacttagttgctttgatgatctggtagctgctggaacagcaagcggccgagtggccgtgtttcaactggtgtcgtccttacctgggagaaacaagcagctgcggcgatttgatgtcactggcattcataagaacagtatcacagctttggcatggagtcccaatggcatgaagctgtttagcggagacgacaaaggaaagattgtttactcctccctcgatctcgatcagggtctgtgtaattctcaactcgtgctggaggaaccatcaagcattgtgcaattagattactcacaaaaggtactcctcgtctctacactgcagaggagtctcctgttctacactgaggagaagtcagttcgacagataggaacacagcctcgaaagagtaccggcaagttcggagcctgcttcatcccgggcctgtgtaagcagagtgatctcaccctgtatgcatccaggcctggattgagactgtggaaggcagacgttcacggtacagttcaggccaccttcatcctgaaggacgcctttgccggaggagtgaagccgtttgaacttcatcctcgcctggagtcgcctaatagcggctcctgctctttacccgagagacatctgggcctggtttcatgtttttttcaagaaggatgggtgctgtcttggaacgagtatagtatctacctcctggacaccgtcaaccaggccacagttgcaggtttggaagggtccggcgatatcgttagtgtatcttgtacagaaaacgagattttctttctgaaaggggatagaaatataatccggatttccagtcgacccgagggtctgaccagcaccgtaagggatggcttggagatgtcgggatgctcagagagggtacatgtacagcaggccgagaagctcccgggtgcgactgtgtcggagacccgcctcagaggtagcagcatggcctcaagtgtggcttctgagcctcggagccgatcctctagtttgaattcaactgactctggttccgggttgctacccccagggctccaggccacccctgagctgggcaaggggtcgcagcctctgagccagcggtttaacgctatcagctccgaggactttgatcaggaacttgtggtgaaaccaatcaaggtgaagcggaagaaaaaaaaaaagaaaaccgagggtggatcacgcagcacctgccactcaagcctggagtcaactccttgcagtgagtttcccggggatagccctcagtcactgaacacagatttgcttagcatgacttcctcagtgctgggctcctctgtggaccagctttcagctgagagtcctgaccaggaaagcagcttcaacggggaggtgaatggcgttcctcaggagaataccgaccccgaaacttttaacgtactcgaagtaagtgggtctatgcccgactcattggccgaagaggacgacatcagaaccgagatgccacactgtcatcatgctcacgggcgtgagttactgaatggagcacgggaagacgtgggcgggagtgacgttactggactcggagacgaaccgtgccccgccgacgatgggcccaactcaacacaactcccgttccaggagcaggactctagccctggcgctcatgatggcgaagatatccagccgattgggccccagagcaccttttgtgaggtccctctgctcaacagcctgaccgtgcctagcagtctgagctgggcccctagcgccgaacagtggttacctggcacacgcgccgacgagggctcccccgttgagcctagtcaggagcaggatatcttaacttctatggaagcatcaggccatctgtcaacaaacctgtggcatgccgttacagatgacgatacagggcaaaaagaaatacccatctcggaacgtgttctggggagcgtggggggccagctcacccctgtatcagcactcgctgcttcgacccataagccttggctggaacaaccccctagagaccagaccttgacatcctctgacgaggaggacatctacgcacacgggctcccgtctagtagtagcgagacttctgttactgaactgggtccctcttgcagccaacaggacctgtcccgacttggagctgaggatgccggactgttaaagccagaccaatttgccgaatcgtggatgggttatagcggccctggctacgggattctcagcctcgttgtctctgaaaaatatatctggtgtctagactacaagggcggcctgttctgtagtgccctgccaggtgctggccttcgatggcagaagttcgaggacgcggtgcaacaggtggccgtgtcccctagcggggcacttctgtggaagattgaacagaagtccaatagagcattcgcctgtggcaaggtgactatcaagggtaaaagacactggtacgaagctctcccccaggccgtgttcgtggcactatccgacgacaccgcctggatcattcggacatctggcgatctgtacctccaaactggccttagtgtggatcggccttgcgcccgcgcagtaaaggtcgactgtccctaccccctgtcacagatcacagcccggaacaatgtagtctgggccttaacagagcagagggcgctgctttacagagagggtgtgtcaagtttctgccctgaaggcgaacagtggaagtgcgacatcgtcagtgagcgccaggccctcgagccagtctgcattacactgggcgaccagcagactctatgggccctggatattcacggtaacctgtggttccggacaggaatcatttctaagaaaccgcagggcgatgacgaccattggtggcaggtcagcatcaccgactatgtggtatttgaccagtgctcactttttcagaccatcatacacgctactcattcagtcgctacagccgctcaggcccccgtggaaaaggtggcggataagttgcgcatggctttttggtcacagcagctccaatgtcagccttcactgttgggtgtgaacaattccggagtatggatcagttcaggaaaaaacgaattccacgtggctaagggctcccttatcggaacatactggaatcacgtcgtgccccgcggcaccgctagcgcaacaaaatgggccttcgtcctggcatccgcggcccccaccaaagaagggtcatttctctggctgtgtcaatctagcaaagacctgtgcagcgtaagtgcacagagcgcccaatcccggccgtcaacggtgcagcttccacctgaggccgaaatgagggcctatgccgcatgtcaggatgccctgtgggcattagactcacttggccaggtgttcattaggacactgtccaagtcctgcccaaccggcatgcactggacacgcttagatctatcccagctgggagcagtgaagctgacttctttggcgtgtggtaatcagcacatttgggcctgcgatagtcgtgggggtgtgtatttccgcgttgggacgcagcctttaaatcctagcctgatgttgccagcctggatcatgatcgagccacccgtgcaggtctcaaggtcatag

SEQ ID NO: 51370 - DNA, 453 bp, Artificial Sequence
  Description of Artificial Sequence: Synthetic coding sequence
atggacagccggaagctgagcccccggggcaagaagctggagagccatctgtcccaggagcatcggcgcccccctctagggcttatcgccgcctgggggcagccctcaatccagtcatctgtgcagcagggtctccagacccaagactgggtgtgcgagcctccagagcgcaggcgtccaggacgtcggtggtctgttagcattgatgaacgcagaagactcgcaactctgggggggcgcgaaagacctggagcagcaggtacccagctccattgtcgcgatgtggtgcaaatggttgcacagctggtatcagaggacgtggataaggatgtgctcttgccacaccccttgcggtcaaccgagtcaaccaacgccttccaagctttcctggctcggtccgctcccttctggcataatgcaacatttgaggcctccaggtcccctccctcgtag

SEQ ID NO: 51371 - DNA, 621 bp, Artificial Sequence
  Description of Artificial Sequence: Synthetic coding sequence
atggacagccagcaggaggacctgcggttccccggcatgtgggtgtcattgtactttgggatcttggggctgtgtagcgtgatcaccggcggctgcatcatcttcctgcactggcgaaagaacctacgcagagaggagcatgcccaacagtgggttgaagtcatgcgagcagccaccttcacatatagtccattattgtattggatcaacaagcggcgccggtatggaatgaacgcggccatcaatacaggtccagcccccgccgttaccaaaaccgagaccgaagttcagaaccctgatgtgttatgggacctagatataccagaaggacggtcgcacgccgatcaggacagcaatcctaaggctgaggccccagcacctctgcagccagccttgcaactggctcctcagcagccgcaggctcggagcccgttccctttacccatttttcaagaggtcccatttgctccacccctttgcaatttgcccccgttgttgaaccattccgtgagttatccactggctacatgccccgagaggaacgtcctcttccacagccttctcaaccttgcccaggaggaccattctttcaacgccaagccctttccaagtgagttgtag

SEQ ID NO: 51372 - DNA, 1176 bp, Artificial Sequence
  Description of Artificial Sequence: Synthetic coding sequence
atggccggccggagcctgtgcctgacccggagcagcgtgcccggcactccatttcctccaccggtccagcagccaagcacgccagggcctgacttattggcactggaagaggaatacaagagacttaatgccgaactgcaagctaagactgccgacgtggtgcagcaggccaaggaaataatccgggacagacaggaagtgagatcacgacccgtctccacgcagatgaaaagttgcgatgatgaggatgattatagcctgaggggtctgctgccgagcgagggcatagttcatttgcactccgagaccaagcctaaaacaaagaacatcgaccctgtgaataaagtgcagaataagctgcattcggcgaacaaaggtaggaaaacaaactcttctgtgaaactaaaatattcagacgtccagaccgctgatgacgtagccattccagaggacttctccgattttagcttggcaaaaaccattagcaaaattgagggacagctggaggaggaaggcctacctgagtatatagatgatattttttcaggtgtatccaacgatatcggcacagaggcccaaataaggtttcttaaggcaaagctgcacgtgatgcaggaagagctggacaacgtagtttgcgaatgcaacaaaaaagaggatgagattcaaaacttgaagtcccaggtaaagaattttgaagaggatttcatgagacagcagcggaccatcaatatgcagcagtcccaggtggagaaatacaaaacactcttcgaggaggcaaacaagaaatatgacgggttgcagcagcagttgagtagcgttgaaagggagctggaaaataagaggcggctgcagaagcaggcagccagctcacagtccgcaacggaggtcagactcaaccgcgctctcgaggaggcggaaaagtataaactggaactgtcaaagctgaggcagaacaataaagacattgctaacgaggagcataagaaaatagaggttctaaaatctgaaaataaaaagcttgaaaagcaaaagggggagttgatgattggatttaagaagcagctgaagctaattgacgtccttaaaagacagaaaatgcacatcgaagctgctaagatgctttcttttacagaagaggagtttatgaaggcattggagtgggggaactcctag

SEQ ID NO: 51373 - DNA, 951 bp, Artificial Sequence
  Description of Artificial Sequence: Synthetic coding sequence
atgaagagctgcgacgacgaggacgactacagcctgcggggcctgcttccctctgagggaatcgttcatttacacagcgaaactaagcccaaaaccaagaacatcgatccagtcaacaaagtgcagaataagctgcacagcgctaacaagggccgcaaaactaactcatctgtgaaactgaaatattcagacgtgcagacggcggacgacgtggccatcccggaggacttttccgatttttctctggcaaagacaatatccaaaatagaaggtcagctcgaagaggaaggcttgcccgagtacatcgacgacatattcagcggagtgtccaatgatatagggactgaggcccagattagatttttgaaagcgaagcttcatgtcatgcaggaagagctggataacgtggtgtgcgagtgtaataaaaaagaggatgaaatccaaaaccttaaatcacaggtaaagaattttgaggaagactttatgcgccaacagcggaccattaacatgcaacaatctcaagttgagaagtataagaccctttttgaggaggccaacaaaaagtatgatgggctccagcagcagctgtctagcgtggagcgcgagctcgagaacaagcggcgcctccagaaacaggcagcatctagtcaatccgcgacggaagttaggttgaacagagctctggaagaggccgagaaatataaattggagctgagcaagcttcgccagaacaacaaggacatcgcaaacgaggagcacaaaaaaattgaggtgctgaagtctgagaacaagaaattggaaaagcaaaagggcgaattaatgatcggtttcaagaaacaactgaaactgatcgacgtgctgaagaggcagaagatgcatatcgaggctgctaaaatgcttagcttcacagaggaggaatttatgaaagcactcgaatggggaaacagctag

SEQ ID NO: 51374 - DNA, 828 bp, Artificial Sequence
  Description of Artificial Sequence: Synthetic coding sequence
atgagccagaagcggcagaccaagttccagaacggcaagagcaagacgagcgagaattcgtccgcaaagcgcgagaaaggcatggtggtcaattcaaaagaaatctctgacgccgtcggacagagcaaatttgtgctggaaaaccttcgccactataccgttcaccctaatctggcccagtactacaagccactcaaggctaccgctctccagaaattcctggcccagaatcgaaagaacacatcctttatgttgaaagtcacacaatatgaccaggataagacattattgatcatgacaaataatccaccaccctgctcaattacccagcaggataaagaatcagcttcaaagtatttttcaaaggagctccttttaaaagtcatggagagccaccaccagcacaagccaaccgagaacctgtggcttccaaggatgccacagaagaagaaattgagatctaagctgaaacctatattccctttgatcctgtccgacgaccccacttccaagagagagcagtggtttaggttttcaactgacaacgatttcaagagcgaggggaaatatagcaaggtatatgcgctgcgcacacagaagaagatgtacccccagttaacgttcgcacctgtgcacgagagggacatgcgcaaagatgccagcaaaaagtccgcttctgaaaggcccatttccaaagtgatacgtgagcctctcactctggcgtcacttctggaagacatgcccacacgcacggcaccgggtgaatctgcttttcgaaacggcagggcacctcaatggatcatcaaaaaggcgacggtgatcggctag

SEQ ID NO: 51375 - DNA, 927 bp, Artificial Sequence
  Description of Artificial Sequence: Synthetic coding sequence
atgcggcccgagggcagcctgacctaccgggtgcccgagcggctgagacagggattctgcggtgtgggtcgtgccgcgcaagcgctagtctgtgcctctgctaaggagggaactgcattcaggatggaagctgttcaggaaggtgctgccggggtggagagcgagcaggcagcgctgggagaagaggccgtgcttctgctcgatgacatcatggccgaggtcgaagtagtggcagaagaagaaggcttagtcgagcgccgtgaagaagcccagagggctcaacaggctgttcctggccctggtcctatgacccctgaaagcgccctggaagagttgcttgccgttcaagttgaactggagcctgtgaacgcccaggcccgcaaggcatttagcaggcagagagagaaaatggagagacgaaggaaaccccacctggatcgcagaggcgcagtcattcaatcagtgccgggattttgggccaacgtcatagctaatcaccctcagatgagcgcacttattactgacgaggatgaggacatgttaagctacatggtgtcgttagaggtcgaagaagaaaaacaccccgttcacctctgtaagatcatgttattctttcgctccaatccttatttccaaaataaggtgatcacaaaggagtatctggtaaatatcaccgaataccgggcctcccatagtacacccattgagtggtacccagattacgaagtcgaggcatacagacgtcgtcaccataactccagcttaaacttttttaattggttctctgaccataatttcgcagggagtaataagatcgccgagatcttatgcaaagacctgtggcggaatcctctacaatactacaagcgaatgaagccacctgaagaagggacggagacatctggcgatagtcagctgctgagctag

SEQ ID NO: 51376 - DNA, 441 bp, Artificial Sequence
  Description of Artificial Sequence: Synthetic coding sequence
atgcggcccgagggcagcctgacctaccgggtgcccgagcggctgcggcagggcttttgcggcgtgggcagagccgctcaggctctggtagaactggaacctgtgaatgcccaggctcgcaaagcattcagccgacagcgggagaagatggaaaggaggagaaaaccacacctggatcgaagaggagcggttattcaaagcgtgccaggattctgggccaacgtgatcgcgaatcacccacagatgagcgccctgataacggacgaagacgaagacatgctgagctacatggtgtcactggaggttgaggaggagaagcaccccgtacatctctgcaagattatgctgtttttcagaagtaacccctatttccaaaataaagtcatcactaaagagtatctggttaatatcacggagtaccgagcctcacattcaacatag

SEQ ID NO: 51377 - DNA, 885 bp, Artificial Sequence
  Description of Artificial Sequence: Synthetic coding sequence
atgcggcccgagggcagcctgacctaccgggtgcccgagcggctgagacaagggttttgtggcgtcggtcgcgcggcccaggcccttgtctgcgcttcggccaaagagggcacggccttccggatggaagcagtccaggaaggagcggctggagttgagtctgagcaggccgcattgggtgaggaagctgtgcttttgttagacgacatcatggccgaagttgaggtagtggccgaggaggagggtctggttgaaagacgcgaggaggcccagcgcgcacagcaggcggtgcctggcccgggtcctatgacgcccgagtctgcgttggaagaattgctagctgtacaggttgagttggagcccgtcaacgcacaagcccggaaggcattcagccggcagagggagaagatggagcggcgcagaaaaccacacctggacaggagaggcgctgtgattcagagcgtgcccggcttttgggccaatgttatcgccaatcacccccagatgtccgctctaattaccgacgaagacgaagatatgttatcttatatggtgagcctggaggttgaagaagagaaacatcccgtgcatctttgcaaaatcatgctgttcttccgctctaatccttacttccagaataaagtgataacaaaagaatatctcgtgaatattaccgagtaccgagccagtcattcaacacctatcgaatggtaccccgactacgaagtggaggcctatcgccgtcggcaccataattctagtctcaacttctttaattggttctcagaccacaattttgccggctccaataaaatcgccgaatctcccgaccggtcgtatgttcggacttgtggggcgatcccatgcaacaccactaggggttag

SEQ ID NO: 51378 - DNA, 927 bp, Artificial Sequence
  Description of Artificial Sequence: Synthetic coding sequence
atgcggcccgagggcagcctgacctaccgggtgcccgagcggctgcgccagggctcttgcggtgttggacgcgctgcccaggccctcgtctgcgcctctgctaaggaaggaactgcttttagaatggaggccgtgcaggagggagctgccggtgttgagagcgagcaggcggctttgggagaggaagcagtgctgctgctggatgatataatggcagaagtcgaggtggtcgccgaggaggagggactggtggagaggcgcgaagaagcccagcgggctcaacaggccgtcccgggtcctggccccatgaccccagagagtgccctggaagagttgcttgctgtccaagtggaactggagcctgtgaatgcacaggcgcggaaggcgttttctcgacagcgggagaagatggagcgccgccggaaaccacacctggaccggaggggcgctgtcatccagagtgtgcccgggttttgggccaatgtcattgccaatcaccctcagatgtcagctctgatcaccgacgaggatgaagatatgctgtcttacatggtcagcctagaggtggaagaagagaaacacagagttcacctttgtaagatcatgctgtttttcagatccaatccctacttccagaacaaggtgattacgaaagagtacctggtcaatatcacggaataccgcgcttcccacagtacacctattgagtggtatcccgattatgaggtggaagcataccgacggcgccaccacaactcgagtctgaacttttttaattggtttagtgaccataactttgcaggtagcaacaagatagccgagattctgtgcaaggatctttggaggaatcccctgcagtattacaagcgtatgaaaccccctgaggagggaactgagacatccggtgactctcagctcttgtcctag

SEQ ID NO: 51379 - DNA, 795 bp, Artificial Sequence
  Description of Artificial Sequence: Synthetic coding sequence
atgcggcccgagggcagcctgacctaccgggtgcccgagcggctgcgccaggggttctgcggtgtcgggagagctgcccaggctctcgtttgcgcctctgccaaagagggtacagccttccggatggaggcggtgcaagaaggggcagccggggtggagtctgaacaggccgccctcggcgaagaagctgtcctgttgctggacgacatcatggcggaggtggaggtcgtggccgaggtggaagtggtggctgaggaagagggcctagttgagaggagagaagaggctcagagggctcagcaggcagtgcctggtccggggcccatgaccccggaatcagctctggaagaactgctggcagtccaagtggaattagagcctgtgaacgcccaggcgcgaaaggcattctcccggcagcgagagaagatggaaagacggagaaaacctcatctcgataggagaggtgccgtgatccaaagcgttccaggattctgggcaaacgtcatcgctaaccacccccagatgagcgctctcattaccgatgaagacgaggatatgctgagctacatggtcagcctggaggtggaggaagaaaaacacccagtccacctctgtaagatcatgctcttctttaggagtaacccttactttcagaacaaagttatcacgaaagagtacttggttaatatcactggcgataggtggctccccggctgggtggtggaaggtcgctggtgggtcgatcattgtcagcgagacccggccccattccctcagaagcttctgagcctgtag

SEQ ID NO: 51380 - DNA, 516 bp, Artificial Sequence
  Description of Artificial Sequence: Synthetic coding sequence
atgcggcccgagggcagcctgacctaccgggtgcccgagcggctgagacagggtttctgcggagtggggcgtgctgcacaggccctggtggagctggaacccgttaatgcccaggcgcggaaggcatttagcaggcagagagagaagatggagcgccgacggaaaccacatttggacaggaggggagcagttatacagtctgtgcccggtttctgggcaaacgtgatagctaaccaccctcagatgtccgccctcataacagatgaagatgaagacatgctgtcttatatggtgtcccttgaagtagaggaagagaaacaccccgtgcacctctgcaagatcatgcttttttttcgctctaatccatacttccaaaataaggtgattacaaaagaataccttgtgaatatcacaggagatcgttggctgccagggtgggttgtggaagggaggtggtgggtagatcactgtcagagggacccagcaccttttcctcagaagctcctttccctctag

SEQ ID NO: 51381 - DNA, 927 bp, Artificial Sequence
  Description of Artificial Sequence: Synthetic coding sequence
atgcggcccgagggcagcctgacctaccgggtgcccgagcggctgcgacaggggttttgcggagtcggtcgggctgctcaggcacttgtgtgtgcatcagcgaaagagggcaccgccttccgcatggaagctgtgcaggaaggggccgcaggagttgaatctgaacaggccgctcttggggaagaggccgtgcttctgctggacgacatcatggctgaggtcgaggtcgtggcggaagaggaagggctggtggagagaagggaggaggcccagcgggcccagcaagcagtcccaggtcccggccctatgacccctgagtcggcactggaggaacttttggccgtgcaggttgagctcgagccagtcaacgcccaggcgaggaaggcattctctagacagcgggagaagatggagagaagaagaaagccacatctagaccggcggggcgcagttatccagtccgtgcctggcttttgggccaacgtcattgctaatcacccacagatgtccgcgctgataacagatgaagatgaggacatgctgtcctacatggtgtctttagaagtggaggaagaaaaacatcccgtgcatctctgcaagattatgctgttcttcagaagcaatccctactttcaaaataaggtcatcaccaaggaatatttggtcaacataactgaatatcgagccagccactcaacccccattgaatggtacccggactacgaagttgaagcctatcggcggcgccaccacaattcgtccctgaacttctttaattggttcagcgatcataatttcgcgggctctaacaagatcgcagaaattctgtgcaaggatctctggaggaacccgctgcagtactataagcgaatgaagcctcccgaagagggcactgaaactagcggcgattcccagctactttcttag

SEQ ID NO: 51382 - DNA, 927 bp, Artificial Sequence
  Description of Artificial Sequence: Synthetic coding sequence
atgcggcccgagggcagcctgacctaccgggtgcccgagcggctgcgccaagggttctgtggggtcgggagggccgcacaggccctcgtttgcgcaagcgctaaggagggcactgccttcagaatggaggctgtgcaggagggcgccgcaggagtggaaagtgaacaggcagccctgggtgaggaggcagtgctcttgcttgatgatatcatggctgaggtcgaggtggttgcagaggaagagggactagtcgagcgccgggaggaagcgcagcgtgcgcaacaggccgtccccggccccgggccgatgacccccgagtctgccctggaagagctcctggcagtgcaggtcgagcttgagcctgtgaatgctcaagcccggaaagccttcagccgccagagagaaaaaatggaacggaggcggaagccgcacctggatagaagaggtgcggttattcaatcggtacccggcttctgggctaatgtcatcgccaatcatccgcagatgagtgcattgataactgacgaagatgaagacatgctgtcatatatggtgagccttgaagtcgaagaagaaaagcatcccgttcacctctgtaaaatcatgctcttcttcagatctaatccctactttcagaacaaggtaatcaccaaggagtatctcgtaaacatcacagagtacagagcaagtcatagcacaccgattgagtggtacccagattacgaggtagaagcctatcgcagacggcaccacaacagttctctgaactttttcaattggtttagtgaccacaattttgctggctctaacaaaatcgccgagattttatgcaaggacctgtggaggaaccccctccagtactataagcggatgaaaccccctgaggagggaacagaaacttctggagactcccagctgctttcttag

SEQ ID NO: 51383 - DNA, 903 bp, Artificial Sequence
  Description of Artificial Sequence: Synthetic coding sequence
atgcggcccgagggcagcctgacctaccgggtgcccgagcggctgcgccaggggttctgcggagtaggtcgggctgctcaggcgctcgtctgcgccagtgcgaaagagggcactgccttcagaatggaagcagtgcaggaaggcgcggctggtgtggaaagtgagcaggccgccctgggcgaagaggctgtactactcctcgacgatataatggccgaggttgaggttgttgcggaagtggaggtcgtggccgaggaggaggggctggtagagcggcgtgaggaagcccagcgggcccaacaggccgtgcctggacccggacccatgacaccagaatctgccctagaggaactgctggctgtccaagttgagctcgaaccagtaaatgcgcaggcacgaaaagctttctctcgccagagagagaagatggagagaaggcgtaagccccatcttgatcgaagaggagccgtcatccagtccgttccaggtttctgggcaaatgtgatcgccaaccatccgcagatgtctgctttgattactgacgaagatgaggacatgttgtcgtacatggtcagccttgaagtcgaagaggagaagcatccagtgcacctgtgcaaaataatgctgttcttcaggtcaaacccatacttccagaataaagtcattaccaaggagtacttagtgaatatcactgagtacagggcgagtcactctacgccgattgaatggtaccctgactacgaagtcgaggcctatcgtaggagacatcacaactcctctttgaacttttttaactggttctccgaccataatttcgcaggcagcaataagatcgccgaatcacctgaccgttcttatgtgagaacttgcggggccataccctgcaataccacacgaggctag

SEQ ID NO: 51384 - DNA, 945 bp, Artificial Sequence
  Description of Artificial Sequence: Synthetic coding sequence
atgcggcccgagggcagcctgacctaccgggtgcccgagcggctgcgtcagggattttgcggggtgggacgggcagcacaagcgctagtctgcgcctctgccaaagagggaacggcgttccggatggaggcagttcaggagggcgccgcgggagtggagtcagagcaggcagcccttggggaagaggctgtgttgctgctagacgacattatggccgaagtcgaggtcgtcgctgaggtagaagtggtggcagaggaggaggggttagtggagcggagagaggaagcacaaagagcccagcaggccgtcccagggcctggccccatgaccccggagtcagcgctggaagagctgctggccgtgcaggtggagctcgagcctgtgaacgcccaggccaggaaagctttctctagacagcgggaaaaaatggagaggagaagaaaaccccacctcgaccggcgcggtgctgtcatacagagtgtgcctggcttctgggcaaacgtgattgccaaccatccccagatgtccgcactaattacagatgaggatgaggacatgctgtcctatatggtgtcgctggaagttgaagaggaaaagcatcccgtgcacctctgcaagattatgttgttctttcgctccaacccgtattttcagaacaaggtcatcacaaaggaatacttggtcaatatcactgagtacagagctagtcattccacccctatagagtggtaccccgactacgaggtggaagcctacaggcgacggcatcacaatagcagtctgaacttcttcaactggttcagcgatcacaattttgcaggttcaaacaagatagctgaaatcctgtgtaaagatctgtggagaaacccgctgcagtactacaaaaggatgaagccaccggaggaaggcactgagacctcaggtgacagtcagttgctgagctag

SEQ ID NO: 51385 - DNA, 927 bp, Artificial Sequence
  Description of Artificial Sequence: Synthetic coding sequence
atgcggcccgagggcagcctgacctactgggtgcccgagcggctgcggcagggattttgcggagtcggacgcgccgcacaggctcttgtgtgtgccagtgctaaagaggggactgcattcaggatggaagccgtgcaagagggtgccgctggcgtggagtccgaacaggccgcactgggagaggaggctgtcctgctgctagatgacattatggctgaagttgaggtagtggcggaggaggaagggttggtggagagaagggaggaagcgcagagggcccagcaggcagttcccgggccgggcccaatgaccccagagtctgctttagaggagctgctcgctgtgcaggtcgaactggaacctgtcaacgcacaagctcggaaggcatttagccggcagagagagaaaatggagcgaaggaggaagccacatctagatagaaggggagcggtaatccaatccgtccctggtttttgggccaatgttatcgccaaccacccacaaatgtccgccctgatcaccgacgaagacgaggacatgctgagctatatggtctcgcttgaggttgaggaagaaaagcaccctgtccacctctgcaagattatgctgttcttccgatccaatccctatttccaaaataaggtgattactaaagaatacctagtcaacatcacagagtaccgcgctagccacagtaccccaatagagtggtatttagactatgaagtcgaggcttaccgcaggaggcatcataactcttcactgaatttctttaattggttctctgaccacaatttcgcgggcagtaataaaatcgcggagattctgtgcaaggatctctggaggaatccactccaatattacaagaggatgaaaccacctgaggaagggacagagacatcaggggactcacagcttcttagctag

SEQ ID NO: 51386 - DNA, 942 bp, Artificial Sequence
  Description of Artificial Sequence: Synthetic coding sequence
atgcggcccgagggcagcctgacctactgggtgcccgagcggctgcgacagggattttgcggagttggcagggctgcccaagcgcttgtgtgcgccagcgctaaagaaggaaccgctttccggatggaggccgtgcaagagggggcagccggcgttgaatccgagcaggcagcactgggtgaagaggctgtacttctgctggatgatatcatggccgaagttgaagtagtcgcagaggtggaagtggtggctgaagaagaaggtctagtggaaaggagggaagaggctcagcgagctcagcaggccgtgccaggaccggggccaatgactcccgagtccgcactcgaggaattactggctgtgcaggtagaattggaacccgttaacgctcaggcccgaaaggccttcagcaggcagcgagaaaaaatggagcggagtaagccgcaccttgatcgacggggagcggttatccaatccgtacctggcttctgggctaatgtaatagccaatcatcctcagatgtccgccctgatcacggacgaggacgaggatatgctcagctatatggtgtccctcgaggtagaggaggaaaagcacccagttcatttgtgcaagataatgctgttcttccggtcgaatccctactttcagaataaagtgatcacaaaagagtaccttgtgaatatcactgagtatagggctagtcactcaactcccatcgagtggtacccagactatgaggtggaggcataccggagaagacatcataactcttctctaaacttttttaattggttttccgatcacaactttgcgggctcaaacaagattgctgaaattctgtgtaaggatttgtggcgcaacccacttcagtattataaaaggatgaagccccctgaggaggggactgagacctctggcgatagtcaattgttgagctag

SEQ ID NO: 51387 - DNA, 885 bp, Artificial Sequence
  Description of Artificial Sequence: Synthetic coding sequence
atgcggcccgagggcagcctgacctactgggtgcccgagcggctgaggcaaggcttttgcggcgttgggagggccgcccaggccttagtctgcgccagcgccaaggagggaacggcctttcgaatggaggccgtgcaggaaggggctgcgggtgtcgaatctgaacaagctgctttgggggaggaagccgtgctattgcttgacgatataatggccgaagtcgaggtcgttgcagaagaggaggggctggttgagagacgtgaggaagcacagcgcgctcaacaggccgtgcctggccccggcccaatgactcctgagtctgcccttgaggaacttctggctgtgcaagtggaactggaacctgtgaatgcccaggcaaggaaagctttctcacgacagcgggagaaaatggagcgaaggcgcaaaccccacctcgacaggagaggtgctgttatccagtcggtccctgggttttgggccaacgttatagccaatcatccacagatgtccgccctcattacggacgaggatgaagacatgttgtcctatatggtgagcctggaagtcgaggaggaaaagcatcccgtccatctctgcaaaatcatgctgtttttccggtcgaacccatacttccagaataaagtgattacaaaagagtacctcgttaatattacagagtatagggcgagccacagcactccgatcgagtggtatttagactacgaagttgaagcctatcgccgccgacatcacaattctagtttgaatttctttaattggttctccgaccacaattttgccggtagcaataagattgcagagagccccgacaggagctatgttcgtacctgtggtgccattccttgcaacacaactcggggttag

SEQ ID NO: 51388 - DNA, 927 bp, Artificial Sequence
  Description of Artificial Sequence: Synthetic coding sequence
atgcggcccgagggcagcctgacctactgggtgcccgagcggctgcgacaagggttctgtggagtgggacgcgctgcacaggccctggtctgcgcctccgccaaagaaggcactgcctttagaatggaagctgtccaagagggcgctgccggtgtcgagagcgagcaggctgctttaggcgaagaagccgttttgcttctggacgacattatggccgaagtggaagtggtcgctgaggaggagggccttgtcgagcgacgcgaggaagcccagcgcgcacagcaggccgttccagggcccgggcctatgaccccagagagcgctcttgaggagctattggctgtgcaggtggagttggagccggtgaacgctcaggctaggaaggctttctcgaggcagcgtgaaaaaatggagaggcgcagaaaaccacatctggaccggagaggagccgtcatccaatccgttccaggcttctgggccaacgtcattgctaatcacccacagatgtccgccttaataactgatgaagatgaagatatgttgtcatacatggttagccttgaagtggaggaagagaaacaccccgtacacttgtgcaagatcatgctgttcttccggtcaaatccctatttccagaataaagtaatcacaaaggaatacctcgtgaatataactgagtatcgggcctcccactccactcccatagaatggtatcctgactatgaagttgaggcgtaccgcaggcgccaccataattctagcctgaacttcttcaattggttctcagaccacaactttgccggctcaaataagatcgcagaaattctctgtaaagatctctggagaaacccacttcaatactataaaagaatgaaacctcctgaggagggaacagagacatcaggtgactctcagctcctgtcctag

SEQ ID NO: 51389 - DNA, 621 bp, Artificial Sequence
  Description of Artificial Sequence: Synthetic coding sequence
atgacccccgagagcgccctggaggagctgctggccgtgcaggtggaactcgagcctgtgaatgctcaggcaagaaaggccttctcccgtcaaagagaaaaaatggagcggcggagaaagccacacctggataggagaggcgccgtgattcagtccgtgccaggtttctgggcaaacgtgattgctaatcacccgcagatgtctgccctgattacagatgaagacgaggacatgctgtcatatatggtgtcactggaagtggaggaggaaaagcatccggtacatttgtgtaagattatgttgtttttccggagtaacccgtacttccaaaacaaagtgatcaccaaagagtatcttgtgaacattacagagtacagagcgtcacactcaactcccattgagtggtacctggactatgaggtggaggcctaccgacggaggcatcacaatagttccctgaatttcttcaattggttctccgatcacaatttcgccgggtcaaataaaatcgccgagatcctgtgcaaggatctgtggcgtaatcctctgcagtattataagaggatgaagccaccggaggaaggaaccgaaacttcaggggagcctttggtgggtacttag

SEQ ID NO: 51390 - DNA, 828 bp, Artificial Sequence
  Description of Artificial Sequence: Synthetic coding sequence
atgagccagaagcggcagaccaagttccagaacggcaagagcaagacaagcgagaactcatcagctaaacgcgagaagggtatggtggtgaattctaaggaaatttcggatgcagtcggacaatcaaaatttgtgctggagaatctcagacactacactgtgcatccaaacctggcccagtactataaacctcttaaggcgacggcgctgcagaagttcctggcgcagaacagaaagaatactagctttatgctcaaagtgactcagtacgatcaggacaagactcttctcattatgacaaataatccaccaccgtgttcgatcactcaacaggataaagagtccgcctcgaagtatttttccaaggaattattgctcaaagtgatggagagccatcaccagcacaagccaacagaaaatttgtggttgcctagaatgccccagaaaaaaaagcttagaagtaaactgaagccgatcttccctttgatattgagtgacgaccctacaagcaagcgcgagcagtggttccgctttagcacagacaatgactttaaatccgagggcaagtactctaaggtgtacgctctcagaacccaaaaaaaaatgtatcctcaactcactttcgcaccggtccacgagcgcgacatgcgtaaggatgcaagcaagaaatctgcctcagaacgcccaataagcaaggtcatcagggagcccttgaccctcgcaagtcttctggaggatatgccaacccggacagccccaggagaaagcgcctttagaaatggcagggctccccaatggataatcaagaaagcaaccgtgatcggttag

SEQ ID NO: 51391 - DNA, 177 bp, Artificial Sequence
  Description of Artificial Sequence: Synthetic coding sequence
atgagccagaagcggcagaccaagttccagaacggcaagagcaagaccagcgaaaattcaagcgccaagagagaaaaaggcatggttgtaaattctaaggaaatctcagacgcggtgggccagtccaaatttgttctggaaaacctccgccattataccgtccatcctaacctctag

SEQ ID NO: 51392 - DNA, 231 bp, Artificial Sequence
  Description of Artificial Sequence: Synthetic coding sequence
atgagccagaagcggcagaccaagttccagaacggcaagagcaagacgagtgaaaatagctctgcaaagagggaaaaaggtatggtcgtgaactccaaagaaatcagtgatgctgtgggccagtccaaatttgtgctcgagaaccttcggcactatactgtccacccaaacctagctcaatactacaagcccctaaaggcaacagccctgcagaagttcctggcccagtag

SEQ ID NO: 51393 - DNA, 828 bp, Artificial Sequence
  Description of Artificial Sequence: Synthetic coding sequence
atgagccagaagcggcagaccaagttccagaacggcaagagcaagacctcagagaatagctccgctaagagagagaaaggaatggttgtcaattccaaggaaatctcagatgctgtcggacaatcaaaatttgtacttgaaaacctgcgtcactacaccgtccatccaaacctcgctcagtactacaaaccattaaaggcgactgccttgcaaaaattcctggctcaaaacagaaagaacaccagttttatgttaaaagtcacccagtacgaccaggacaaaacgctcctcattatgacgaacaacccaccaccatgcagtatcacccagcaagacaaggagtccgcttcaaagtactttagtaaggaattgttgctgaaagtaatggaatcccatcaccagcataaaccaaccgagaatctttggttgcctcggatgcctcagaaaaagaagctgaggtctaagttaaagcctatctttccactgatcttgtccgatgaccctaccagcaaacgggagcagtggttcaggttctcgacagataatgactttaaatcagaagggaagtactctaaggtgtacgccctcaggacacagaaaaaaatgtacccccagctgacgtttgcacccgtacacgaacgcgacatgcggaaagatgcaagtaagaagtccgcaagtgaacgcccaatcagtaaggtgattcgcgaaccactcactctggcctcccttctcgaagacatgccaacacggacggcccctggcgagtctgcattccgtaacggtcgggccccccagtggataattaaaaaagctaccgtcataggatag

SEQ ID NO: 51394 - DNA, 1230 bp, Artificial Sequence
  Description of Artificial Sequence: Synthetic coding sequence
atggccctgcggcccgaggaccccagcagcggcttccggcacagcaacgtggtggcatttatcaacgaaaagatggccagacacacaaaagggcctgaattctaccttgagaatatatccctatcttgggaaaaagtagaagacaagctgagggcaattcttgaggacagcgaggtgccctctgaggtcaaggaggcatgtacctggggttcgttggctctgggcgtcaggtttgctcatcgccaggctcagctacagcggcaccgcgtgaggtggctacatggcttcgccaagctacataaatcggctgcacaggccctcgcaagcgatttaaagaagctgagagaacagcaggagaccgaacgcaaagaagcagcgagcagactgcgaatggcccaaacgtcattggttgaggttcagaaagaacgagataaagagctggtgagtccccatgagtgggagcagggggctgggtggcccggcctggcaaccgctgggggcgtgtgcactgagggcgctgctgaagaggaagaggaggccgccgtcgctgcagcaggggccgccgggggaaaaggcgcagaagaagaacagcgagatgtagaggtggtagccgcgccagttgaggctatggcccctcccgtggaggccggcgccgcacccatggagacacaattcccacacgtggaggctcgcgcagcctctatggaaactacagaaaagctggagcggatcctcctccagctgctgggagacgccgatcaggaaaagtatacatactgggggcagaaggagggagaccttaggagcgttgaaactgcaacttcttatttttcagggacaactaacccgtggtcaagagcgagttccgagcctcttccagtgcagctcccagcctcttacagctacagttacagctccccttttagctcatttagtgacattcccaccatcagcccacctcaggcgacggtgacagccccagttcctccccagctgcctagtgactgggaagctttcgatacaagcctgtggtcagatggcggaccacaccgaatcgatcatcaggaacacccccgcgaccggaggtactctgaaccccatcagcagcgccctcccgtgtacagacggccaggggattgggattgtccctggtgtaatgctgtcaactttagccgccgtgatacttgctttgattgcgggaaaggcatctggctgcagaaaccgcactag

SEQ ID NO: 51395 - DNA, 2637 bp, Artificial Sequence
  Description of Artificial Sequence: Synthetic coding sequence
atgtacgagggcaagcacatccacttcagcgaggtggacaacaagcccttatgcagctattctcccaaactgtgtaaacagcggagacttaacggatacgctttctgtatccgccacgtgttggaggacaaaaccgctccttttaaacagtgtgaatacgtggccaagtacaacagtcaacgatgtacaaatcctattcctaagagcgaagaccgaagatactgcaatagccacctgcaggtcttaggatttatccctaagaaagagcgcaagaagaagaatgatccgatcgatgaagtgaaggttaggcaccagatggataccatggctttttcactgaccgtccccaccttagctttgaagatgccaaacggattagatggtatgtccctaagcccccctggtgctagggtccctctgcactacttggaaaccgaacttgaggaccctttcgcatttaatgaagaggacgacgatctgaagaagggtgcgaccgtcagaaaaaaactgcagagcaagctcgctcaaaaccggcaacgacagcgcgagacggaaattttaaaggtgaggcaggaacacttctcgcccccccctgcacccagccagcagcagccgcctcaacagcattcccaccttagccccttgtcaacctctctgaagccaccagcccccccccagggcagcgtctgtaagtcaccccagccccagaacacgtccttacccatgcagggggtcgcccctacaacccatacaatagcccaggcacgccagctgtcacataagagaccactgcctcttcttccatcatctcgcgcccccacagttgacccaccacgcactgacaggattctgatgaaagctacagcgttttcaccccactttagctgcatatctcgtctgcagcggctggtgaagctgtgtactcagaagcatcaactagatacggatctgttcccccatcttgggctcgactggtcagaggagagcggagaggagcctgaggattccgaacaggcctcgccttaccaggttgcttggtctatccgcgaaaccctccgatatcagagacacgccagcgacgatgacgacgccgagtcacgctctagcagggtgactcagctgtgtacctatttccagcagaagtataagcatctgtgtagactggagcgcgccgagtcacgccagaaaaagtgcagacacaccttccggaaggccttactacaagccgccagcaaggagccggaatgtacaggacaactgatccaagaactccggagagctgcttgtagccggacctctatcagccgtaccaaactcagggaggttgaaccagcggcctgctctgggacagtgaagggggagcagtgcgccaataaggccctgcccttcacacggcactgtttccagcatattctgctgaaccacagtcaacaactcttttctagctgcacagcaaaatttgctgacggccagcaatgcagtgttcctgtgtttgacatcacacaccagacaccgctttgtgaggagcatgccaaaaaaatggacaattttctgaggggcgataactcacggaaggtgcaacaccaacagcagaggaagccacggaagaagacaaagccccccgctcttaccaaaaaacacaagaaaaagcggcggagaggacctcgacgccctcagaagccaatcccgccagccgtgcctcagggaaacctcagtatgccggccagcgtgtctctcccagttgaggcatctcatattaggtctccctctaccccggaactgagtgctgacgaacttcccgatgatattgccaacgagataacggacataccccatgacttggagctaaatcaggaagatttctcagacgtgctgccccggctgccagatgacctccaggacttcgattttttcgaagggaaaaatggggacctgctccctacaactgaggaggcagaggagctggaaagagcgcttcaggcggttacttccctggagtgtcttagcaccatcggtgttttagcccaaagcgacggcgtccctgtgcaagagctgagcgaccggggaatcggggtattcagtactgggactggggcatcaggcattcagtctctgagtcgcgaggttaatacagaccttggtgagctgttgaacggcagaattgtgcacgacaatttttcctctttggagctcgacgaaaacttattgcgcagcgccacgctgtcgaaccctcctactcccctggcgggccagatccagggacagttcagcgcgcctgccaatgtcgggctgacatcagctacgctgatctcgcaaagcgccctcggtgagcgtgcttttcctgggcagtttcatggcttgcacgacggtagccatgcttcccagcgtccacatcctgctcagctcctcagcaaggcagacgatctgataaccagtcggcaacaatattcgtccgatcacagccattccagcccacacggctctcactatgactctgaacacgtcccgtccccatactcagaccacattacaagccctcatactacatcctacagcggcgataacatggccgctccggtgtgtttccgcggataccataggccagcctctgtggcatgggggcttttactgaactag

SEQ ID NO: 51396 - DNA, 4983 bp, Artificial Sequence
  Description of Artificial Sequence: Synthetic coding sequence
atggacagcggccccgtgtaccacggcgacagccggcagctgagcgcctcaggtgtgccagtcaatggcgcgagggaacccgcaggcccctctctcctcggcactggaggcccttggcgcgttgaccagaagcccgactgggaggcggctcccggccccgcccataccgcccgtcttgaggacgcccacgatctggtcgctttcagtgcagtggcagaggcagtgtctagctatggcgccctgtcaacacgcctgtacgaaacttttaaccgggagatgagcagggaggcggggaataacagtcgaggccctcggcctggccctgagggctgtagcgcagggtctgaggatcttgacaccttgcagactgctctagctctggctcgtcatggcatgaagcctcccaactgcaattgcgatggcccagagtgcccagactaccttgagtggctggaggggaagatcaagtcagttgtcatggagggcggggaggaaagaccgcgtctgccaggtccgctgccgccaggggaagccggccttcctgcaccctctaccagaccccttttaagctcagaagtgccacagatatctcctcaggaggggctgccattgagtcaatctgcactcagtatcgcaaaagaaaagaacatttctctacagacggctattgccatcgaagcactgactcaattgtctagcgccctcccacagcctagccactcaaccccccaagcttcttgccccctacccgaggcactctcgcctccagccccattcagatctccacaatcttacctcagagctccctcctggcctgtagtccccccggaagagcacagtagttttgcacccgactcgagcgccttcccacctgctacacccagaactgagttccccgaggcgtgggggaccgataccccccccgcgacacccaggtcatcttggccaatgccccggccttctcccgatccgatggcagagctcgaacaattactcggatctgcttccgattatattcaatctgtcttcaaacgaccagaagccctgcctaccaagcccaaggtgaaagtcgaggctcctagcagctccccagcccctgcaccatctcccgtcctgcaaagagaagctcctacacccagctccgaacctgacacacaccagaaggctcagacagcgctgcagcagcatttgcatcacaagcgttcactcttcctagaacaggtacacgacacgagcttccctgctcctagtgagcctagtgctcctggatggtggccacctccttcgagtccggttcccagactacccgacaggccacctaaagagaagaaaaagaaattacctactcccgccggaggacccgttggaacggaaaaagccgcgccaggaatcaagccatctgttcggaagccaatacagataaagaaatcccgccctcgagaggctcaacccctctttccaccagtgcgtcaaattgtgctggagggcttacgcagccccgctagccaggaggttcaggcccaccccccagcccccctacccgcttcccagggtagcgcagtaccactgcctcccgagccttccctggcgttgttcgctccctccccaagccgggattcccttctgccgcccactcaagaaatgcgcagccctagtccaatgacagccctgcaacctggatctactggtcctctaccccctgccgatgacaagctcgaggaactcatcaggcaattcgaagctgaattcggcgactccttcggcctccctggccctccatcagtccccatccaagaccctgagaaccagcagacgtgcctgccagccccagagagcccctttgccaccagatcacctaagcagattaagatcgagagctccggcgcagtgacagtgctgagtaccacatgcttccattctgaagagggtggtcaggaggcgactcccaccaaagccgaaaaccccttgactcccactttgtcgggatttctggagtcccccctgaaatacctcgacacgcccaccaagagcttgttagacacaccagctaagagggcacaagctgagttcccaacatgcgactgcgtcgagcagatcgtggagaaggatgaaggcccttactatacgcatcttggatccggtcctacagttgcttccatccgggaattaatggaagagagatatggcgaaaagggtaaagctatccgcatcgagaaagttatatacacggggaaggaaggaaaaagctctcgcggatgtcctattgcaaagtgggtaatacgcaggcatactctggaagagaaactgctgtgtctggtgagacatcgggcggggcatcattgccagaacgccgttattgtgatcttaatactggcatgggagggcatccccaggagcctgggtgacactttgtaccaggaacttacagacacactgcgaaaatatgggaaccctacatctaggagatgcggactcaacgacgatagaacgtgtgcctgtcaggggaaggatcctaacacctgtggggcttcgttcagtttcggttgctcatggtcgatgtactttaacgggtgcaagtacgctaggtcaaagacgccccgcaagttccgtctcgccggtgataaccccaaggaagaggaggttttgaggaaaagcttccaggacctggcaacagaagtggctccactttacaagagacttgcccctcaagcttatcagaaccaggtgactaacgaggagatcgccatcgattgtcggcttggtctgaaggagggaaggcccttcgcaggtgttacagcctgcatggacttttgcgcccacgcgcacaaggatcagcataatctgtataacggttgcactgtcgtatgcacactgactaaggaagacaatagatgtgtgggcaagataccagaagacgagcagctgcacgtacttccactatataagatggccaatactgatgagtttggatctgaggaaaatcaaaacgcgaaagtcggttctggggcaatacaggttctgactgctttcccccgcgaggtgcgaagactgccggaacctgccaagagctgtcgacaaaggcaactcgaggcccgaaaagccgccgccgaaaaaaagaagatccaaaaggagaagcttagtacccccgagaaaattaagcaagaggctctggaactcgccggaatcaccagtgaccccggattgagccttaagggaggactcagccagcaaggcctgaaaccaagcctaaaggtggaaccccaaaaccatttcagtagcttcaaatactcgggcaacgccgtggttgaatcctatagcgttcttggtaactgcaggcctagtgatccgtactcgatgaattctgtgtatagttatcattcttattatgcccagcctagcctgacctccgttaacgggttccactcaaaatacgcactccccagcttcagttattacggtttcccttcttcgaatcctgtgttccctagccagttcctgggtcctggcgcttgggggcacagcgggagctcagggagctttgaaaagaaacctgatctccacgccttgcataactcactctctcccgcttatggcggcgcggaattcgcggaattaccatcacaagcggtcccaaccgacgctcatcaccccacgccccaccaccaacaaccggcttaccctggcccgaaggaatacctgcttcctaaggcaccccttcttcattcagtcagtagggatccctcgcccttcgcacagtcatccaattgctataataggtctatcaaacaggagccagtggatccactgacacaggctgagcccgtgccccgggacgccgggaaaatgggtaagacccccctcagtgaggtgtcacaaaatggcgggccctcccatctgtggggccagtattctgggggcccatcaatgtctcccaagaggacaaacggggtaggcgggagctggggagttttcagttccggagaaagcccagcaatcgtacctgacaaactgagctcctttggcgcttcatgcctggctccaagccactttactgatggtcagtggggcctgtttcccggtgaaggccagcaggccgccagtcattccggtggtcggctgcggggcaaaccctggtcgccttgtaaatttgggaatagcacttcggctctggcgggtccatcgctgaccgagaagccttgggcgcttggcgcgggtgatttcaactctgctctaaaaggatctcccggattccaggacaaactgtggaacccgatgaaaggagaagagggccgcattcctgcagccggtgcttcccaactggaccgggcctggcaaagttttggactgccactggggtcctctgagaagttgttcggggccctaaaaagtgaagaaaagctttgggaccccttttccttggaagagggacctgcggaggagccgccatccaagggcgctgtcaaagaggagaaaggaggcggcggagccgaagaagaagaagaagagctgtggagcgacagcgaacataattttctggacgagaatattggaggcgtcgccgtggccccagcgcatgggtccatcctgatcgagtgcgcgcgccgagagctccatgctaccacacccctaaaaaagccgaataggtgccaccccacacgaatctccctggtcttctaccaacataagaacctgaatcagcccaaccatggactggccctgtgggaagctaagatgaaacaactggccgagagagcccgggctcgacaggaggaagccgccagactcggcctgggacaacaggaggctaagttgtacggcaagaaacggaaatggggagggacggtggtcgccgaacctcagcagaaagagaagaagggcgtcgtccctacacgccaggccctggcggtgccgaccgactctgcagtcacagtttcaagctacgcttacaccaaggtgacaggcccttacagtcgctggatctag

SEQ ID NO: 51397 - DNA, 759 bp, Artificial Sequence
  Description of Artificial Sequence: Synthetic coding sequence
atgacccacgacaagagctggcggcggtgcagcatcagcggcagcacaaaatgtcgctgtggatcccggattgccgggcccaatgccctgggctctggcggctcgaggtctagctcttcttcaagccgcagtattttgtcttctagcatcctcagttcttctatccctagttcatccagcagcagcagtagtccatccagcagtccgtcttctagctcccccagctcttctcattcttcgtccagtccttcctctagctcctccacgagtagcccctcgtcttcatcctccagtagttcttcatctccatctagctcaaactcaagcagctctagctcttctagcagcccttcctccagcagcagttcatcttcatcttctccgtctagctcctcttcaagcccctcttcctctagttcatcttcctcctcttcgccaagttcatcctctagcagcccctcctccagctcctctagtagtagctcttcctcgtctagtcctagctcctcctccccttccagttctgggtcatcccctagtagctctaatagtagcccatcttcctcgagctcctctcccagcagttcaagttcttctccctctccaaggtcaagcagtcccagcagctctagtagctccacttcgtctccctcttcatcatcgccttcgtcgtctagtcccagttctagctgcccttcagctgccctgggtcgcaggccccagtcccctcagagcagtcactgtgccccatttccctag

SEQ ID NO: 51398 - DNA, 759 bp, Artificial Sequence
  Description of Artificial Sequence: Synthetic coding sequence
atgacccacgacaagagctggcggcggtgcagcatcagcggcagcaccaagtgtaggtgcggtagtagaattgccggcccaaacgcactgggctcgggtgggtccagatcttctagttcatccagtagatccatccttagctcaagcatattaagttcctctatacccagcagcagttcttcctcttcaagcccgtcctccagtccctcttcctcttctcccagttcctcccactcatcctcaagcccctctagttcatctagcacctcaagcccctcttcatccagtagctcatcttcgtcttcgccctcctccagtaactcatcatcttcctccagcagtagcagccccagctcctcctcttcctcctcctcttcgtcaccatcatcgtccagctcttctccctccagctcttcaagcagctcctctagtagtccatcatctagcagctctagtccctcatctagcagctctagcagctcatcttctagcagttccccttcgagcagctccccctcgtcatcaggatccagtccctcttccagcaattctagcccgtcatcatctagtagttcaccaagctctagctcgagttccccaagccccaggtcctctagcccaagctcctcatctagctctaccagctctccgtccagcagcagtcccagttcttcaagccccagctcgagctgtcccagcgccgccttgggtcgccggccacaatcccctcagtccagccactgtgcaccattcccctag

SEQ ID NO: 51399 - DNA, 759 bp, Artificial Sequence
  Description of Artificial Sequence: Synthetic coding sequence
atgacccacgacaagagctggcggcggtgcagcatcagcggcagcactaaatgtcgttgcgggtcgagaattgcgggcccaaatgctctaggttccggcggttcccgcagctctagcagtagttccagatccatactgtcttccagcattctctcctccagcatcccatcttcctcctcctcgagcagctctccctccagctcaccttccagtagcagcccaagttcgtcacattcctcttccagcccctcttcctcgtcatccacaagctcaccatctagtagcagctcctcatcctctagctctccttccagctccaacagcagctcctcctcttcttcatcaagtcctagctcaagctctagtagcagttcctcttctcctagcagttctagttcttcccccagctccagttcgagctcctcttcaagcagcccctcaagtagcagctcatctcccagtagcagctcttcctccagtagcagtagcagtagttcccctagctcgtctagcccttcatcctccggatctagcccttcttctagcaactcatcacctagctcatcatccagtagcccttcatcttcatcttccagcccaagtccccggtccagctccccttcttctagtagctcatctacgagctctccgtctagctctagccccagcagctcaagccccagctcatcctgtccaagtgctgctctggggagaaggccacagagccctcagtcatcacactgcgcgccgttcccgtag

SEQ ID NO: 51400 - DNA, 156 bp, Artificial Sequence
  Description of Artificial Sequence: Synthetic coding sequence
atgacccacgacaagagctggcggcggtgcagcatcagcggcagcacgaagtgtcgctgtggaagtcggattgccgggcccaatgctcttggcagcggagggtcccgttctagcagttcctccagcagatcgattctgagcagttccatattgtag

SEQ ID NO: 51401 - DNA, 66 bp, Artificial Sequence
  Description of Artificial Sequence: Synthetic coding sequence
atgacccacgacaagagctggcggcggtgcagcatcagcggcagcaccaagtgccgatgcggatag

SEQ ID NO: 51402 - DNA, 228 bp, Artificial Sequence
  Description of Artificial Sequence: Synthetic coding sequence
atgacccacgacaagagctggcggcggtgcagcatcagcggcagcactaagtgccgctgcggaagtaggattgctgggccaaacgcgttaggcagcggcggctcccgcagctccagctcttcgtccaggtccatcctttcatctagcatcctctcatcctccatcccttcaagttccagctcaagcagcagtccctcgtcttccccttcctcatcttcaccttcttag

SEQ ID NO: 51403 - DNA, 132 bp, Artificial Sequence
  Description of Artificial Sequence: Synthetic coding sequence
atgacccacgacaagagctggcggcggtgcagcatcagcggcagcactaaatgcaggtgcggctcacgcatcgctggtccaaatgctctgggaagcggcgggagcaggtctagcagctccagctcccgttag

SEQ ID NO: 51404 - DNA, 117 bp, Artificial Sequence
  Description of Artificial Sequence: Synthetic coding sequence
atgacccacgacaagagctggcggcggtgcagcatcagcggcagcaccaaatgcaggtgtgggagcagaattgctggtcctaatgcccttggctcgggtgggtcaaggagtagttag

SEQ ID NO: 51405 - DNA, 39 bp, Artificial Sequence
  Description of Artificial Sequence: Synthetic coding sequence
atgacccacgacaagagctggcggcggtgcagcatctag

SEQ ID NO: 51406 - DNA, 63 bp, Artificial Sequence
  Description of Artificial Sequence: Synthetic coding sequence
atgacccacgacaagagctggcggcggtgcagcatcagcggcagcactaaatgcaggtgctag

SEQ ID NO: 51407 - DNA, 453 bp, Artificial Sequence
  Description of Artificial Sequence: Synthetic coding sequence
atgacccacgacaagagctggcggcggtgcagcatcagcggcagcaccaagtgccggtgtggatctcgcatagccggacctaacgccttgggatccggcggatcaaggtcctctagctcctccagtagatctatactgtcctcaagcatcttgtccagctcgatcccttcctcaagcagtagcagttcttctccatccagttcaccctcgtcctccagtccatcatcttctcatagcagcagctccccaagcagctctagctccacctcctcaccttctagctcctcatcctctagctccagctctccttcctccagcaattccagttcatcgagctccagttcaagcccatcgtcctcatccagttctagtagctcaagcccctcctcctcatcctccagtccgtcctcctccagcagctccagcagtagctccccctcatctagcagttag

SEQ ID NO: 51408 - DNA, 747 bp, Artificial Sequence
  Description of Artificial Sequence: Synthetic coding sequence
atgctgcggaacaacaagaccatcatcatcaagtacttcctgaacttgatcaatggtgctttcctggtcctaggcctgctctttatgggttttggagcctggctccttttggatagaaacaattttcttacagccttcgatgagaataaccactttatcgtgcctataagtcagattctgatcggtatgggctcgtccacagtgctgttttgtctcctgggatacatcgggattcataacgagatcagatggctgttaattgtgtatgccgtcctcattacatggactttcgctgttcaagtagtgctgtcggcctttatcataaccaagaaggaggaggtgcagcagctctggcacgataagatcgactttgttatcagtgaatacgggtccaaggataagcccgaggacattacgaagtggaccatcctcaacgcactgcaaaagacactgcagtgttgcggacagcacaattacaccgactggatcaagaataagaataaagagaattctggtcaagttccgtgctcatgtaccaagagtacccttaggaagtggttctgtgatgaaccactgaatgccacgtatctggagggctgcgagaacaaaatcagcgcatggtataatgtgaatgtgctgaccctgattggtattaatttcggtcttcttacttctgaagtctttcaggtttcactgactgtgtgttttttcaagaatattaaaaacatcatccatgccgagatgtag

SEQ ID NO: 51409 - DNA, 267 bp, Artificial Sequence
  Description of Artificial Sequence: Synthetic coding sequence
atgctgcggaacaacaagaccatcatcatcaagtacttcctgaacctgattaacggtgcgttcctggtgcttggacttctgttcatgggcttcggcgcctggctgttgctggatcggaataatttcctcaccgcgttcgatgagaataatcattttatagtgccaatttctcagattttgatcggcatgggaagctctacagttctcttctgtctgctgggttatatcggtatccataacgagatccgttggttgttgattgtttag

SEQ ID NO: 51410 - DNA, 7128 bp, Artificial Sequence
  Description of Artificial Sequence: Synthetic coding sequence
atgcacatcctgttccagaagggcatgctgaagcgggtgaagaagctgctggatctgctggtgaaattcgacatcaacttcaatctaaagaacaaggaggggaaggacgcccgccatagaattaagaaaaatgatagcctgctactcgcctggaataaggcactgatggaaaatcgtcgtaggtcccgtcaagacagcgctgcccacctgggtaagctctctaagtctactgctcccggacacaccagccagcttaagtctcagggatccttcaagtcagtcccctgtggcgcaacagcgcggactctaccagaaggcagcgccgtgcccgacagctgggagacactacccggcacgcaggttacgcgaaaggaaccaggcgcgctgagaccttgctcactgagggactgtctgatgcaggacatcaccgtcctcattcaacaggtcgaagtcgatccatccttcccagaggactgcctccagagctccgaacctcttgaggctggagccggcaaagaagggaagaaggacgacaaaccaacactgggggcaggagccccagattgttctgaagtcggtgaggggcatgcacaggtgggtttgggggctctccaactggtacccgacgacaaccgcggcaaggaaggaaatgatgatcaggacgactggtctacccaggaaattgaggcatgtttgcaagacttcgataatatgacgtgggaaatcgaatgcacaagtgagatgcttaagaaactctcttccaaggtgatgaccaaggtgatcaagaagaagatcatcctcgcgatccaacagctgggtaatggtgaatggactcaagggctgcagaagcgtctcaagcatctgaaaggaagtatccagctttttgaagccaagctggacaagggggctaggatgctctgggagctggctatcgatttctccccaaggtgctccgagaatcccgagaaaataattgctactgaacagaacacttgtgccatggagaagtccggcaggatatatactgagatcatccgcatatgggacattgtgctggatcattgtaaactggcagactctattaaagccatctgcaatgcttacaatcggggactgagctgtgtgctgcggaagaagctgaagggaattaataaggggcaggtctcggccaatatgaagatccaaaagcgcattccacgctgctacgtggaagacactgaggccgaaaagggccgagagcacgtgaaccctgagtatttcccacccgcatctgccgttgagactgagtataacatcatgaagttccactcattttccaccaatatggcattcaatatcctgaatgatactacagccactgtagagtatccattccgcgtcggggagcttgagtacgccgtaattgacctgaaccccagaccgctggagccgataatactcatcggtagatcagggacgggcaaaacgacatgctgcctttacaggctctggaaaaaattccacgtctactgggagaaagctgaacaggccgggtccccactgctggcgaaacaggtgtggctgaagagacgactcgaggtggagccgggcaaggagagtcccggcggcgaagaagaagaggaggaggaggatgaggaagaggaagatagcatcgaagtggagaccgtcgagtccatagacgaacaggagtatgaagcatgtgctggaggggcgggtgtggagcccgcaggtgacggccaagcagctgaagtctgtgccccagaacaccctcaccaactggagcatttacaccagatcttcgttaccaagaaccacgtgctgtgccaagaagtccagagaaacttcatagagctgtctaagagtactaaggccacatcccactacaagccattagatccaaacatccataagctacaagacctgcgggacgagaactttcctctttttgttacctcaaaacagctgctgcttcttctcgacgccagcctgcccaagccattcttcctgcggaacgaagatggaagcttaaagcggaccatcatcggttggagtgcacaggaagagtccaccatcccgagttggcaggaggacgaggaggaggccgaagtggacggagattatagcgaggaagataaagcagttgaaatgcggacaggcgacagcgatccgagggtatacgtgacattcgaggttttcaagaacgagatttggccaaaaatgacgaaaggccgtacggcctacaaccccgccctcatttggaaagagatcaagtcttttcttaaagggagctttgaagctctcagttgtccgcatggcaggttaacagaggaagtttacaaaaagctgggccggaagcgctgccccaatttcaaagaagatagatctgagatatatagtttgttttccttgtaccaacagatccgaagccagaagggctactttgatgaggaagatgtgctgtacaacatctctagacgcctgtctaagctgcgcgtcttaccctggagcattcatgaattgtatggagatgagattcaggacttcacccaggcggaacttgcactactgatgaagtgtattaatgaccctaactctatgtttctgaccggggacacggctcagagcatcatgaagggggttgccttccgatttagcgacctcagaagcctgttccactatgccagtaggaatactatcgacaagcaatgcgcagtgagaaaacctaaaaagatacatcaactctaccaaaactaccgttcacatagcgggatcctgaatctggcatctggggtcgtggacctgttgcaattctactttcccgagtctttcgaccgactgccacgcgactccgggctgtttgacgggcccaaacctactgtccttgagtcttgcagcgtaagcgaccttgccatcctgctcagggggaacaaacgcaagacccagccgatagagttcggcgcacaccaggtgatcttggtggctaacgagacggccaaggaaaagattcctgaagaactgggattagctctcgtactaaccatatacgaggctaagggtttggagtttgacgacgtgttactatacaatttttttaccgactcagaagcctataaggagtggaagataattagctctttcacacccacctcaactgatagccgggaggagaatcgccccctcgtcgaagtcccactggacaagccgggatcctcacaagggcgttctctgatggtgaaccccgaaatgtataaattgcttaacggcgaactgaagcaattgtacacagcaataactcgggcacgggtgaatctgtggatcttcgacgagaatagagagaagcgcgcccccgctttcaagtattttataagaagggacttcgtgcaggtcgtgaaaacagatgaaaataaggacttcgacgactccatgtttgtgaaaacttcaacacctgccgagtggattgctcaaggcgattactacgcaaaacaccagtgttggaaggtcgccgccaagtgctaccaaaagggaggcgctttcgaaaaagagaagctagcgttagcccatgacaccgccctctccatgaagtctaagaaagtgtcacctaaggagaagcaactcgaataccttgagttggcaaaaacctacctcgaatgcaaagaacccaccttaagcctgaagtgtctctcctatgccaaggaattccagttgtccgcccagttgtgcgagcggctcggcaagatccgggatgccgcctatttttataaacgaagtcagtgctacaaagatgccttcagatgttttgagcagatacaggaatttgacctagctctgaaaatgtattgccaagaagaactgtttgaggaggctgctatcgccgtggagaaatatgaggagatgctgaagacaaaaacactccccattagtaaactgagctacagtgcatcacagttctatttggaggcagccgcaaaatatttgtccgctaataagatgaaagagatgatggccgtcttgagcaagctcgatatcgaggaccagctggtgttcctgaaaagcagaaaacgtttggctgaagctgccgatctgttaaaccgagaaggccgacgagaagaggctgcgttactaatgaaacagcacgggtgtctgctggaagctgctcggctgaccgcagataaggactttcaagcaagctgccttctgggcgccgctagactgaatgtggcccgggatagtgacatagagcatactaaggatatcctgcgcgaggcacttgatatttgctaccagaccgggcagctgtccgggatagccgaagcacacttccttcaaggtgtgatattaagagactttcaaaagctgcgggacgctttttttaagtttgacaccctcaaccattctgcgggtgtcgtggaggccttatacgaggcggcatcccaatgcgaagctgagcccgagaaaattctgggactagcccctggtggactggagatcctgctctcacttgtgagagccttaaagagggtgaccaataacgcagaaaaagagatggtcaaaagctgcttcgagttttttggcattagccaggttgacgccaaatactgccagattgcccaaaacgaccccggccccatattgaggattatcttcgacctggatctcaacctaagggagaaaaagactaaagatcattttttaatcatgacggatcaggtcaaactggcgttaaacaaacacctcttgggaaggctgtgtcaaatcaccaggtccctgctgggtaagacttatagaggtgtctgcatgcggttcattgttgggttgaaatgtgaggacgagaattgcgaacactttcatcgcccattacggaggtgtgaggcaaaatgcctggtgcagtcaaaaatgaatctagtagcaatcaatggcttgttacttgaggccaaaaaagtgttccctaaaattctggcggaagagctcaaggagatcgattatattctgagcaccgatatgtatggcctatgtaaatcaatacttgatgtgctgttcccgaagcacttccatcagagagtgctgagcgaaaacccaatggcgtgcaaagaaattctgaagccaaattacaagtcgtttcgattctacagatttgccctaaaagagtatatccacttcctgtttgaaaacgagtctgctaggaatcggcgagagagtacagacctgtggctcagtgctatgcaggctttcctcttgtcctcaaattacccagaggaattcgagaaactgctacaccaggaggaagataattataaccgtgagctgaaggcattggaaagcgagaaagacgaaagggggcggggtcgtggatctaggattaagggaattgagggaaagttcgggatgttggcacccaacagagatgacgagaatatggacaagacgcacctgtgcttcatacgactgctcgagaactgcatcgatcagttctatgtatatcggaacccagaagattacaagaggctattcttccggttcatgaacgttttgatcaagcggtgcaaggagcctctcatcccatcgatcggaaatactgtagcgctcttggagtttcaatttatacactgtggcgtggtccttgcacgcctgtggaaaaacgtcattctgtgccttcctaaatcttacattgccctgctccactactgggaattcctcttttccaagaaggataaagagctcggagacgtcttctccattatccaagagtataaacccaaagacgtgacccgagcaattcaggatttcaggttccacttgtcctatctggctaaggttttgtgcggatacgaaaatgtgaacttcaacgtcttattggatgccttctccgagatcgattatgtagtctccggggaagctgaacgtaccctcgtgctttgcctcgtaatgctggttaatgcggaagagatccttcagccgtattgtaagcctctgctctaccgacatttccgggagatagagtcgaggcttcagctcatgtcaatggactgccccggacaggtcccagagcgccttctgaaagttgtgaaaagggtgctagtcgccgtgaatgttaagtcagttgcagaggccttacaggacctattgtttgagagagacgaagagtatctcatggactgtgattggcggtgggaccctgtgcacacaaaaggatccattgtgagagggctgtattacgaagaagtgaggctgaaccgcttactgtgtctggaccctgttgactattttgccgaaccggagtgcgagtttggtcaagatgagatggacgagctggcactagaagacagagaccatgtactcgcaaccattcttagccaaaaacagagaaaagcgtccattcagagaaagctcagaagggcatgtttggttgtgtcactgtgtatcagttggaggcgcagagtgggtacccagatggagagggtaagggaggaggcgcgcgagcctcgggcaggcaatttcaagaaggcagatgtggacagaacccagtgcgatctttgcggggtcaagttcacccgaggtccagaaaattacttttcacccagtaaggcctttgagggcgccgctagtgaggtggctgtcctgtctcgtgccgaattagagagagaggagtgtcaggaacgtaactccgaatcttacgaacagcacattcacctggagcaccatcaacggcaacaagtcgcttatcagaaatactctgagttcttccatgagaaggtggatcctgctatcgatgagggaaagctggttgtccaagatatcgagcagtctgtgtggatccactctcacgtcggatcaaaggaacactctcacatgctccagaaagtacaggagcacatcaaacgggtctccgacatggttgaagacctctatcgcagaaaggcttgggccggcgctgaagaggccatgacacgactcgtgaacatcctaatcctgagcgtccgtgacgcccgggactggttgatgaaaaccgaaacccggcttaagaaggagggcatagtgcaagaggatgattatgaaaatgaggttgaagactttggcgaactccgccctagaaggcgtagtcgtaaatgtggtaaacaaagaaagtactag

SEQ ID NO: 51411 - DNA, 7128 bp, Artificial Sequence
  Description of Artificial Sequence: Synthetic coding sequence
atgcacatcctgttccagaagggcatgctgaagcgggtgaagaagctgctggacctgctcgtaaaattcgatattaactttaatctgaagaataaagaaggcaaagatgcacgccaccgcatcaaaaagaacgattccttgttgctcgcttggaacaaagcgttgatggaaaatcgaagacggtcaaggcaggacagcgcggcccatctggggaagctctccaaatcaaccgcacccggccatacctcccagctcaagagtcaggggagctttaaaagtgtgccatgcggcgctactgccaggacccttcccgaagggagtgctgttccagactcatgggagaccctgcctgggactcaggtgacccgcaaggagcccggggcgctgaggccatgtagtcttcgggattgtctcatgcaggacatcactgtgctgatccaacaggtcgaggtggaccctagcttccccgaggattgcctccagtcaagtgagcccctggaagccggcgcaggtaaagaagggaagaaggacgacaagccaaccctcggggctggcgccccagactgctcagaagtgggggagggccacgcccaggtgggactaggtgctctccagctcgtgcctgacgataatcggggaaaggagggcaatgatgaccaggatgattggtcaacccaagaaatcgaggcctgcttacaggacttcgacaacatgacctgggagatcgaatgtacatctgaaatgctcaagaagttgtcatccaaagtgatgaccaaagtcatcaagaagaagattatcctggccattcagcagcttggcaacggcgagtggacacagggcctgcagaaaaggctgaagcatctgaagggcagcatccagttgtttgaggcaaaactcgataagggtgcccgtatgctttgggagctggctatcgacttcagccctagatgtagcgagaatcctgagaagattatcgccaccgagcaaaatacctgcgccatggagaagtccgggaggatttacactgaaatcattaggatctgggacatcgttctggaccattgtaaactggcggactctattaaggccatttgtaatgcatacaatcgggggctgagctgtgtgctgagaaaaaaattaaaggggattaacaagggtcaggtgtccgctaatatgaaaatccagaaacggatcccaaggtgctatgtagaggatacagaagcagaaaagggccgcgaacacgtgaatcccgagtacttcccccctgcttctgctgtcgaaacagagtacaacattatgaagtttcacagcttctcaacaaacatggcctttaatatactgaacgatactaccgctaccgtggaatatccctttcgtgtaggtgaacttgagtacgcagtcattgacctgaacccccgccccctggaacctattattctcattgggcgatccggcaccggcaagaccacgtgctgtctatacagactctggaaaaaatttcatgtatactgggaaaaggccgaacaagccgggagcccactcctcgcgaagcaagtctggctgaagcggcgcctggaagttgagcctggcaaggaaagtcccgggggagaggaggaggaagaagaggaggacgaggaagaggaggacagcatcgaagttgagacggtggaatccattgatgagcaggagtatgaagcatgcgccgggggagcaggtgttgaacccgctggagacggacaagcggccgaagtgtgcgcacccgagcacccacatcaactcgagcacttacatcagatttttgttaccaagaatcatgtcctgtgccaggaggtgcaaagaaattttattgagctgagcaagtccactaaggccacctctcactacaaacccctggacccgaatattcacaagctccaggacctgcgcgatgaaaattttccgctcttcgtgacctcgaagcagcttctactgttgcttgacgccagtctccccaaaccattctttctccgaaatgaggatggatccctcaagaggaccatcataggctggagtgcgcaggaggaatctacaatcccctcttggcaggaagatgaggaagaggccgaggtggatggtgattatagcgaggaggataaggcagtggaaatgagaacgggagattccgacccacgggtgtacgtgacttttgaggtcttcaaaaacgagatttggccgaaaatgaccaagggcagaactgcttacaatccagccttaatctggaaagagattaagagtttcttgaaggggtcgtttgaggccttgtcctgcccccacggccggctcactgaggaagtttacaagaagctgggcagaaagagatgcccaaatttcaaggaggaccgcagtgaaatctactccctgtttagtttataccagcagatccggtcccagaaaggttacttcgacgaggaagatgtcctgtacaacatatctcgcaggctgagtaaactgcgcgtgcttccctggtcgattcacgaactgtacggtgatgagatccaggattttacccaagccgagcttgcacttttgatgaaatgtataaacgaccccaacagtatgtttttaacaggagatacagcccagtcgattatgaaaggtgtcgcatttcgcttcagtgacctccgaagcctcttccattacgcaagtcgtaacaccatcgacaagcagtgtgccgtccggaagcctaagaagatccaccagctgtatcagaactatcgctcccactctggtatcttgaacctagcctccggcgtagtggacctccttcagttttatttcccagagtcattcgacagattaccacgtgattctgggcttttcgatggccctaaacctacggtgctcgaatcttgtagcgtttccgatctggctattctgctcagaggcaataaaagaaagacacagcctatcgaatttggcgcgcaccaagttatcctcgtggccaatgagacggccaaggaaaagattcctgaggaactgggtttggccctggttttaaccatctacgaagctaagggattggaattcgacgacgtcctactgtataatttcttcacagactctgaagcttataaagagtggaaaattatctcctctttcacccccacttccaccgacagccgggaggagaaccggcccctcgtagaggtacctctggacaagcccggttcctctcaaggacggtcattgatggtcaaccccgaaatgtacaaactcctgaacggggaattgaagcagctgtatactgccatcacccgtgctcgggtgaacctgtggatctttgatgagaacagagagaagagggcgccagccttcaaatactttataagacgagatttcgtgcaggtggtgaagacagatgagaacaaagattttgatgactccatgtttgttaaaaccagtactcctgccgaatggatcgcccagggcgattattatgcgaagcatcagtgctggaaggtggccgccaaatgttatcagaagggaggggcatttgaaaaggaaaaacttgcactcgctcacgatacagccctctccatgaagtcaaaaaaagtaagtcctaaagaaaagcagcttgagtatttggagctcgcaaaaacgtacctggaatgtaaagaacctactctcagtcttaagtgcctgtcttatgctaaagaatttcaactgtctgctcagctgtgtgaacggctgggaaaaattcgagatgccgcgtatttctataaacgctcacagtgctataaggacgctttcaggtgctttgagcagatccaggagtttgatctggccctgaagatgtactgccaagaggaactctttgaagaagcagccattgcggtggaaaaatatgaggagatgctcaagactaaaacattacccatttccaagctgagttactcagcgagtcaattctatctcgaagcagcagccaaatacctttctgcaaacaaaatgaaagaaatgatggccgtactatctaaactggatattgaggaccagcttgtctttctgaagtcacggaaacgcctggcggaagcggccgatctgctaaacagagagggcagacgggaggaggccgccctgttgatgaagcaacacgggtgcttactggaggctgcacgattaactgccgacaaggatttccaggcctcgtgtctgctcggagcggccaggcttaacgttgcccgagattccgacatcgaacatacgaaagatatattacgcgaggctctggatatttgctatcaaaccggtcagctgtccggtatcgctgaagcacacttcctgcagggtgtgatcttacgggacttccagaagctacgagatgctttctttaaattcgatacattaaaccattctgcaggggtggtggaagccctctacgaagcggccagccaatgtgaggcagagcccgagaaaattttgggtttagctcctggaggactcgaaatcctcctgagcctcgtccgcgcactaaagcgagttacgaataacgccgagaaggagatggtgaagtcctgttttgagttttttggtatctcacaagtagacgcaaagtactgtcagatagcgcaaaacgacccaggtccaattttgaggatcatctttgacctagacttgaacttgagagagaaaaaaacaaaagatcacttcctcatcatgacggatcaggtcaaactcgccctaaataagcaccttttaggacgcctctgtcagataaccaggtctctgctgggcaaaacgtatcgaggggtgtgtatgagatttatagtcggactcaagtgtgaggacgagaactgtgagcactttcatagaccattgcgcagatgcgaggccaagtgtttagtgcagagcaagatgaacctggtggcgatcaacggactcctgctcgaagccaaaaaagtgtttccaaaaatcttggccgaagagctgaaggagatcgactatattctgtccaccgatatgtacggactgtgcaagtcaatactggacgtgctgtttcctaagcacttccaccaaagagttctttcagagaaccctatggcctgtaaagagatcctaaagcccaattacaagtcattcagattctacagatttgctttgaaggaatatatccacttcctctttgagaatgaaagcgcaagaaacagaagggagtccacagacttgtggctatccgcaatgcaggcattcctcttatctagtaattaccctgaggaatttgaaaaactcctgcaccaggaagaggataattacaatcgggaattgaaagccctcgaatcagagaaagacgagcgcgggcgtggaaggggaagccggattaaaggcatcgagggaaaattcggtatgctagcccccaaccgggatgatgaaaacatggacaaaactcatctctgctttatccgactgctcgaaaactgcattgaccaattttatgtttacagaaaccctgaagactacaaacgactgttttttcggttcatgaacgtactgattaaaaggtgcaaagaacctctgattccgtcaatcggtaacactgtggctctcctggaattccagttcatacattgcggcgtagtgctcgctaggctgtggaagaacgtgatcttatgtctccccaaatcctacattgctctgttacattactgggaattcctgtttagtaagaaggataaggaacttggggatgtgttcagcattatacaggagtacaagcctaaagacgtgactagagcaattcaggactttagatttcatctgtcttatctagctaaggtgctttgtggttacgaaaacgtaaatttcaacgttctgttagatgccttctcggaaatcgactatgtagtcagtggggaagcggagcggacattggttctttgtctggtgatgctggtgaacgctgaggagattctacagccctactgcaagccactcctttatcggcatttcagagagatcgaaagtaggcttcaattaatgtccatggactgtccagggcaggtcccagagcggttgctgaaggtagttaagcgtgtcctcgtcgccgtgaacgtaaaaagcgtggctgaggccttacaagatctattattcgagcgggatgaagagtatctcatggactgcgattggcgatgggaccccgtgcatactaaggggtccatcgtacgcggcctatattacgaggaagtacgtctcaataggcttctgtgtctcgatcctgtagactattttgccgaacctgagtgtgagttcgggcaagacgagatggatgagctggccctcgaagaccgagaccatgtccttgccaccatcctgagccaaaagcagaggaaagccagcatacagcgaaaattgcgccgggcatgtcttgttgtgtctctgtgcatttcttggcggaggcgcgtcggtacacagatggagagggttcgggaggaggcaagggaacctagagccggaaatttcaagaaggccgatgtcgatcgcacacaatgcgatctgtgcggcgtcaagttcaccaggggccccgaaaattatttttctccatccaaagccttcgagggcgcagccagtgaggtggcggttttgtcccgggccgagttagaaagagaggagtgccaggagcggaactccgagtcctatgagcagcatatccacctcgagcatcaccaaagacagcaggtggcttatcaaaaatacagtgagttcttccacgagaaagtcgacccagctatcgacgagggaaagctggtagtacaggatattgaacaaagtgtatggatccattctcatgttggaagtaaggaacattctcacatgcttcagaaggtccaagagcacataaagagggtttcagatatggtcgaagacctatacagacggaaggcttgggctggcgctgaagaagctatgactaggttggtcaatattctgattttgtccgtgagggatgcccgggattggctgatgaagaccgaaaccaggcttaagaaggagggcatagtgcaggaggacgactacgaaaatgaagtagaggactttggtgaactgcgtccccggcgccgcagccggaaatgtggcaaacagagaaaatattag

SEQ ID NO: 51412 - DNA, 8778 bp, Artificial Sequence
  Description of Artificial Sequence: Synthetic coding sequence
atgtgggacccccgggccgcccgggtgcccccccgggacctggccgtcctgctttgcaataaatctaatgcatttttctcgctgggcaagtggaacgaggcatttgtcgcggccaaagagtgtttacagtgggatccaacctacgtgaaaggctattaccgagctgggtatagcctcctgcggctccaccagccttatgaagctgcccgcatgtttttcgagggactccgactagtgcaaaggtcgcaagaccaggctccggtcgctgacttccttgtgggcgtgttcacgaccatgagcagcgattcaattgttcttcagtcattcctcccttgcttcgaccatattttcaccaccggtttcccaacggaagtgtggcagtctgtgatagaaaagctagccaagaaaggactctggcacagcttcttactactttcggccaaaaaggaccggctcccacgaaatattcatgtcccagaactctcactcaaaagtctctttgaaaagtacgtcttcatcgggctatacgaaaagatggaacaggttcctaagctggtccagtggctgatcagcatcggtgccagcgtggaaaccattgggccctaccctttacacgctttaatgcggctctgcattcaggcccgagagaaccacttgtttcgatggctcatggatcacaaaccggaatggaagggccgcatcaatcaaaaggatggcgacggctgcaccgtgctccacgtcgtggctgcacattcacctggctacctggtgaagaggcagacggaggacgtgcagatgctgttacgattcggggccgatccaacgttactagatagacaatcccggtcggtggtggatgtactgaagagaaataagaattttaaagcgatcgaaaagatcaattctcatcttgagaaactggcaacatgctctaaggatttaagcggtttcagtaatggagacgggcccaccagtgagaatgacatttttaggaaggtgctggaacagctggttaaatatatgaactctggcaatcgactgcttcacaagaatttcctcaagcaggaggtagtgcaacgcttcctgcgcctcctgtctacattacaggagattccaccggacctggtgtgcgacataaaccaagactgtgccacaactgtcttcaaattccttctcgagaagcagagatggccagaggtgctacttcttctgacaagaaaagtgtcaggagaaccaccgctaggagactgccttattaaggattgtaattttagcgaccttgatatttgcacaattattccccacctctctacctgggatcagcgcaagaaacagctgcttggatgtcttattgacagcggagctcttcctgatggactacaagagtcccaggaacgccccgtcgtgacgtgcctgaagcacgaggattttgaactggctttccttcttcttaccaaaggcgcagatccgagagctatttctcttacagaaggcgatacacccctgcacgccgcgctccacatatttcttgaaataaaagcagatattggctttagtttcctttcgcacctgctcgatctgttctggtctaaccctacagagtttgattacctcaatccgaatgtgcaggactccaacggtaacacattgatgcatatccttttccagaagggcatgcttaagcgcgtgaagaaactcctagacctgctcgtgaagttcgatattaatttcaaccttaaaaataaggaaggcaaagacgcccggcatcgaataaagaagaacgattcgttactcctggcttggaataaggcactgatggaaaacaggcggcgctcaagacaggattctgctgcccacctcggtaaactgagtaaatctaccgctcccggacacaccagccaactcaagtctcagggctccttcaagtccgtgccttgcggcgccaccgctcggactttacccgaaggtagtgccgtgccagacagttgggagacgctcccggggacacaagttacacggaaggaaccaggtgccctgcgtccttgctcactgcgcgactgcctaatgcaggatatcaccgttttaattcaacaggttgaggtcgacccaagctttccggaggactgtctccagagcagcgaaccattggaggcaggtgctggcaaggaaggtaaaaaggacgacaaacctacactaggagccggagctccggactgttccgaagtgggggagggccacgctcaagtcggtctgggggcactacaacttgtcccagacgacaacaggggcaaggagggcaacgacgatcaggacgactggtcaacccaggaaatagaagcttgtcttcaggatttcgataacatgacatgggagattgagtgcacctccgaaatgctcaaaaaactcagctccaaggtcatgactaaggtcatcaagaagaagattatccttgctattcagcagctgggtaacggcgaatggactcagggtctgcaaaagaggctcaaacacctgaaaggctccatccaactgttcgaagcaaagctggacaagggagctaggatgttgtgggaactcgcaatagatttctctcctaggtgttccgagaaccccgaaaagatcattgctaccgaacaaaacacatgcgccatggagaagtccgggagaatttatacagagatcattcggatttgggacattgttctggatcactgcaagcttgcagactctataaaagcaatttgtaatgcttataacaggggcctgagttgcgtgctgaggaaaaaacttaaaggaatcaacaaaggacaggtgagcgcgaatatgaagatacagaaacgaatcccacggtgctacgtcgaggatacagaagccgaaaagggcagagaacacgtaaatcccgagtacttcccgcccgctagcgccgtagagactgaatataacatcatgaaatttcactctttctcaacaaacatggcgtttaacatcctcaatgataccaccgctaccgtcgaatatccgttccgggtgggtgagctggagtacgccgtgatcgatctgaatccccgcccgttggagcctatcatcctgatcggcagatccggaacaggcaagacaacttgctgcctgtacagactttggaagaaattccacgtgtactgggaaaaggccgagcaggccggcagcccgctgttggcaaaacaggtgtggctcaagcgccgactggaagtcgagcctgggaaggagagtccaggcggggaggaagaggaggaggaggaagacgaagaggaggaggacagcatcgaagtggaaaccgttgaatctatcgacgagcaggaatacgaagcatgtgctggaggggcgggagttgaacccgctggcgacgggcaggcagcggaggtctgcgcgccagagcatcctcatcagttagagcacctccatcagattttcgtgacaaaaaatcacgtgctgtgccaggaggtgcagaggaacttcatcgagctttctaagtcaactaaagctaccagccattataagcctctggaccccaacatccataagttacaggatttgcgggatgagaacttcccattgttcgtaacgagcaagcagttattgctcctgttagacgcgagcctgccaaagcctttctttctacgcaatgaggacggatcactaaagcggactattatcgggtggagcgctcaggaggaaagtaccattccatcatggcaggaggacgaagaggaggcagaggtcgacggtgattatagtgaggaagacaaagccgttgagatgagaaccggggattctgacccaagggtgtacgtcacattcgaggttttcaagaacgaaatctggcctaaaatgactaaagggaggacagcttataatccagcgttgatatggaaggagatcaaatctttcctgaaaggatcgtttgaggccctttcctgccctcacggccgcctgactgaagaggtctacaagaagctggggcggaaacgctgccccaatttcaaggaggaccgtagtgagatatactcactgttcagtctgtatcaacagatcagatcacagaaagggtatttcgacgaggaagacgtgctctacaacatctctcgcaggctgtctaagctgcgcgtgctgccttggtcgatacacgagttatatggcgacgagatccaggactttacccaggccgagctcgccttgctcatgaagtgcataaacgaccctaatagtatgtttctcaccggagatactgcccaatctatcatgaagggagtcgcctttcgtttctccgatctgcgctcactctttcattacgcctctcgaaacacaattgacaaacaatgcgcagtaagaaagccaaagaaaattcaccagctgtaccagaactacaggtcccatagcggtatcctgaacttagcctccggagttgttgacctgttacaattctactttcccgaatccttcgacagactgcctcgagattccggcctgttcgatggaccaaagccaactgtgctcgagtcgtgtagcgtgagtgatttagctatacttcttcgcgggaataaacggaagactcaacccatcgaatttggggctcaccaggttatcttggtggcaaacgagactgccaaggagaagatccccgaggagttaggcctggctcttgtcttaacaatttatgaggccaaaggtctggaattcgacgacgtccttctttacaactttttcacggattccgaagcctataaagaatggaaaataataagttcatttacacccaccagtaccgactccagggaagagaataggcccctggtggaggtgcctcttgataaaccaggctcgtcccaggggcgcagtctgatggtgaacccggagatgtataaactattgaatggcgaactgaaacagctctataccgccatcacgagggcaagagttaatctgtggatatttgatgagaacagggagaagagagctccagcgtttaagtatttcattcggcgcgattttgttcaagtggtaaaaacggacgagaacaaagacttcgatgatagtatgttcgtgaagacctccacaccggcagaatggattgctcagggcgactattacgccaaacatcaatgctggaaggtggctgccaaatgctatcaaaaagggggggcatttgagaaggaaaaactcgctcttgcacacgacaccgccctcagtatgaaaagcaaaaaggtctccccgaaggagaaacagctggaatacctcgagctggccaagacatacctggaatgcaaggagcccacgcttagcctgaagtgcctttcatacgcaaaagagtttcagctaagcgcccagctatgtgaacgccttgggaagattcgggacgcagcgtatttctataagcgaagccagtgctataaagatgcgtttcgctgttttgaacagatccaagaatttgatctggctctgaagatgtactgccaggaagaactgtttgaagaggccgctatagccgtcgagaaatacgaggagatgctgaaaacaaaaactcttcctattagcaaactgtcttatagcgccagtcagttctaccttgaagcggctgccaaatatctgtccgctaataaaatgaaagagatgatggcagtcctttccaaacttgacattgaggatcagcttgtgttcttaaaatcccgcaaaagactcgctgaggctgccgatctgcttaaccgagagggccggagggaggaagccgccctgctcatgaaacagcacggttgcctacttgaggctgccaggctgactgcggataaagactttcaggcctcctgcctcctgggggctgcccgcctgaatgttgcccgcgactcagatatagagcacactaaagatatcctccgtgaagccctggatatatgttaccagaccgggcagctgtctggtatagccgaggctcatttccttcaaggggttattttgagggacttccaaaaactcagggatgctttcttcaaattcgataccttgaatcactccgcaggagtcgtagaggctctttacgaagcggcctcccagtgcgaagcggagcctgagaaaattcttgggctcgcccccggggggctcgaaattctcctgagcctggtcagggctcttaaacgggtgactaataatgccgagaaggagatggtgaagtcctgctttgagttctttgggataagccaggtggacgccaaatattgccagatcgcgcaaaacgacccaggccccatcctgaggatcattttcgacttggacctcaacctaagggagaaaaagacaaaggatcactttttaatcatgactgaccaggtgaaactggcactgaataagcacttgctgggacgactctgccagatcacgcgatccctgttgggcaagacatatcgaggtgtctgtatgcgatttattgtcggcctgaagtgcgaagacgaaaactgtgaacactttcatcgcccacttagacgttgcgaggcgaagtgtctggttcagtctaagatgaacctggtggccattaacggtcttctgctggaggccaagaaagtgtttcccaagatcctggccgaggaacttaaagagatcgattatatcctctctacagatatgtatgggctatgcaagagcattttggacgtcctctttcccaagcactttcaccagagagtcctttctgaaaaccctatggcatgcaaagaaatactgaagccgaattacaaaagttttcggttttatcgctttgccctcaaggagtacatccatttcctttttgagaatgaaagtgctagaaacagacgggaatctaccgatctgtggttaagcgctatgcaagcttttctgctgtcaagcaattatcctgaggagttcgagaaactgttgcaccaggaggaagataactataacagagagttgaaagcactggaatcagaaaaagacgagagagggcggggaaggggtagccgtattaaaggcatagagggaaagtttggcatgttggctcctaaccgagacgatgagaatatggataaaacccacctttgtttcattcggctactcgaaaactgcattgaccagttttatgtctacaggaacccagaagactataaaaggctgttttttcggttcatgaacgtgctgatcaaaagatgcaaggaaccactcatcccgagcattggcaacacagtagccctgttggaattccagttcattcattgcggagttgtcctggctaggctgtggaagaacgttatactgtgccttccaaagagctacatagcactgctccattactgggagtttcttttctcgaagaaggataaggagctcggtgacgtgttctcaattattcaggagtacaagcccaaggatgtgaccagggcgatccaggattttaggtttcatctgtcatatctggccaaagtcctgtgtgggtacgagaacgtcaatttcaatgtgctcctagacgcgttctcggagattgattatgtcgtgtccggagaagccgaacggaccctcgtgctgtgcctggtaatgttagtgaatgcagaggagatccttcagccgtattgtaaacctttgctctaccgccatttccgcgaaattgaatccaggcttcagctgatgagcatggactgtcctggtcaggtgcctgaaagattactaaaggtggtgaaacgagtgcttgtagccgtgaatgtgaaaagtgttgctgaagccctgcaggacttactcttcgaacgggacgaggagtaccttatggattgcgactggcgctgggacccagtgcataccaagggctcaatagtgagagggctctactacgaggaggtgcgcctcaaccgactcttatgtcttgaccccgtggactactttgccgagccagaatgtgagtttgggcaggatgagatggacgaactcgccctcgaggatcgcgaccatgtcttggctactatcctttcgcaaaaacagagaaaagcatcgatccagcgcaagcttcgtagagcttgtctggtggtttcactgtgcatctcctggagacggagagtggggacccagatggagagagtgcgcgaggaagcccgtgagccgcgcgccggcaacttcaagaaagccgacgtggatcgaacacagtgtgacctttgcggagtcaagttcacaagaggacccgagaactactttagcccgagcaaagcatttgaaggggctgcatcagaagtcgctgttctcagccgtgccgaactcgaaagagaggagtgccaggagcgaaacagcgagtcttacgaacaacatatccaccttgaacaccatcagcgccagcaggtcgcctaccagaaatatagtgaatttttccacgaaaaggtagatcccgccatcgacgagggtaagctggtcgtgcaggacattgagcagtcagtctggatccacagccatgtgggaagcaaagagcatagtcatatgctccagaaggtgcaggaacacatcaaaagagtgagtgatatggttgaggacctgtatcgtcggaaagcgtgggctggtgcggaagaggcgatgacacgccttgtgaatatccttatactctcagttcgagacgccagagactggttgatgaagaccgaaacccgattgaaaaaggagggcattgttcaagaagatgattacgaaaatgaagtggaggattttggcgagctgagacctcggagaagaagcagaaaatgtgggaaacagcggaaatattag

SEQ ID NO: 51413 - DNA, 2583 bp, Artificial Sequence
  Description of Artificial Sequence: Synthetic coding sequence
atggcccccgccggctgctgctgctgctgctgcttctggggcggcgccgtcgctgccgcgggggcagcacggagggttctgcttctgcttctcttaggagtcctctccgccggcctgcggcctggtgccttagccaccgaacattattccccactgtcccttctgaagcaggagttacagcaccgacaacaacaagaagcaccagcagggggcgggggttgcagcccccagtcaggcgactggggcgaccagtatagcgctgagtgcggggagtcatcctttctgaactttcatgacagtgactgtgaacccaagggttccagcccgtgcgattctttactgagcctgaacaccgaaaagattctctcccaggccaaaagcatcgccgagcagaagaggtttccctttgccaccgataacgacagcactaacgaggaattagccatcgcatacgtgcttattggaagcggactgtatgacgaagcgatacgccatttttcaaccatgttacaggaggaacctgacctggttagtgccatatatggtcggggcatagcctacgggaagaagggactgcatgatattaaaaatgctgagctggccctctttgagcttagcagggtgattaccctcgaaccggatcggccagaggtcttcgagcagcgggccgagatcctttcacctctgggaaggatcaatgaagctgtgaatgatctcacaaaggccattcagttgcagccctccgccaggctgtacagacaccgtgggaccctctacttcatctctgaggactacgcaaccgcacatgaagactttcaacaaagcctcgaattgaacaaaaaccagcccatcgctatgctgtataaaggtcttaccttctttcaccgcgggttgctgaaggaggcaatagaaagctttaaagaagctctgaaacaaaaggttgacttcatcgatgcctacaagtccctgggacaggcctaccgcgagctgggtaatttcgaagccgcaaccgagagttttcagaaggccctgcttttgaatcagaaccacgtgcagacgttacagttgaggggaatgatgctgtaccaccatgggtctctgcaagaggctctgaaaaattttaagcggtgccttcagctggagccttacaacgaagtgtgccagtacatgaaaggtctgagccacgtggcaatgggacagttttacgagggaatcaaagctcagacgaaagtgatgctcaatgatcccttgccaggccagaaggccagccctgagtacctgaaggtcaagtatcttcgcgaatactcgagatatctgcacgctcacttagataccccattgaccgaatataatatagacgtcgatctgcccggctcatttaaggaccactgggccaagaacctgccctttctgattgaggattatgaggaacaacccgggcttcagcctcacatcaaagatgttttacaccagaactttgagtcttacaagcctgaggtgcaggagctcatttgtgtggcagatcgcttagggagtttgatgcagtatgagacacctggattcttgccgaataaaagaatccatcgggcgatgggactggccgctttggaggtgatgcaagctgtgcagcgcacctggactaactctaaggtacggatgaacgggaagaccagacttatgcagtggagagatatgtttgatattgcagtaaaatggcgacgaatcgctgaccccgaccagcctgttttatggcttgatcagatgccggctagatcattgtccaggggctttaacaatcacatcaatctgattagggggcaggtgattaatatgagatacctcgagtacttcgagaagattttacatttcatcaaagaccggatacttgtgtatcatggggctaataaccctaaaggactgctggaagtacgcgaggccctggagaaagtgcataaggtggaggatttgctccccataatgaagcagtttaacaccaagaccaaagatgggttcacggtgaacaccaaggtgccttcactgaaagatcaaggaaaagagtacgatggattcacgatcaccataacgggtgacaaagtcgggaatatcctattctccgtggaaactcaaactaccgaggaaaggacgcagctctaccacgctgagatcgacgctttgtacaaggacctgacagccaaaggtaaggtgctcatcttatcttctgagttcggggaggccgacgccgtttgcaatctgatcctgtctttagtctattatttctataatcttatgcccctgagccgcggctcatccgtgatcgcttatagtgttatcgttggagccctgatggcgtccggcaaggaggtggctggcaagattccgaagggtaagctcgtggactttgaagccatgaccgctcccggttcagaagcattctccaaagtggccaaaagctggatgaacttgaaatcaattagccccagttataaaacccttccttccgtgtctgaaacattcccaacgctgagatccatgatcgaagtgctgaatactgactcaagccccaggtgtttgaaaaagctttag

SEQ ID NO: 51414 - DNA, 2421 bp, Artificial Sequence
  Description of Artificial Sequence: Synthetic coding sequence
atggcccccgccggctgctgctgctgctgctgcttctggggcggcgctgtcgcagcagcgggtgctgcgcggcgggtactcctcctcctcttgttgggcgtgctgtccgcgggccttcgacctggcgccttggccaccgagcactactctcccctctctctgctcaaacaggaactgcagcaccggcagcagcaggaagccccggccgggggcggtggctgcagtccccagtctggagactggggagaccagtacagcgccgaatgtggcgagtcttcctttctgaattttcatgattctgactgcgaaccaaaaggcagctcgccttgcgatagccttctcagcctaaacactgagaagatcctcagccaggctaagagtatcgctgaacagaagagattcccgttcgccaccgacaatgattctactaatgaagagctggctattgcctatgtcctgatcggcagcggcctctacgacgaggcaattaggcacttcagtacaatgttacagatcctgtcccctctgggaagaattaatgaagcagtaaatgatctaaccaaggctatccagctgcagccgagcgctagactgtacagacatcgggggaccctgtattttatatccgaagattacgctacagcgcacgaggactttcagcagtctttggagctcaataaaaaccagcctatcgctatgttgtacaaggggctaacattctttcaccgcggactcttgaaggaagctattgaatcctttaaggaggccttgaaacagaaggtagattttattgatgcctataagtcactgggacaagcttacagagaactcggcaacttcgaagccgctacagaatcattccagaaagcgctcctcctcaaccagaaccacgttcagactcttcaattacgtggcatgatgctttatcaccatggctcactccaggaggccctgaagaacttcaagaggtgcttgcagctggaaccgtacaatgaggtgtgccagtacatgaaagggctgagtcacgttgcgatgggtcagttttacgaggggattaaggcccagaccaaagtgatgctgaacgaccccctgcctggccagaaggccagccccgaatatctgaaggttaaatatctacgggaatactcacggtatctgcacgcacaccttgatacccctctgactgaatataatatcgatgttgatctaccaggctcatttaaagaccattgggccaaaaatctgccatttctgatagaggactacgaagaacagcccgggctgcaacctcatatcaaggacgtcctgcatcagaacttcgagtcatataaaccagaggtccaggagttaatttgtgtggccgatcgattgggctctcttatgcagtacgaaacccctggtttcctgcctaacaaacggattcatagagccatgggacttgcagccctcgaggtcatgcaggctgttcagcgcacctggacaaacagcaaggttagaatgaacggcaaaactagattgatgcagtggagggatatgtttgacatagctgtgaagtggcggcgtatagctgaccccgaccagcctgtgttgtggcttgaccagatgccagctcgatctttgtcacgtggatttaacaatcacatcaatctcatcagggggcaagtaattaacatgaggtatctggaatatttcgaaaaaatccttcactttattaaagaccggatcttagtgtaccacggcgcaaataatcctaagggactgctggaggtgagagaggcgctggagaaagtccataaagtggaagatctgctccccatcatgaagttcaacaccaagactaaagatggcttcactgtcaataccaaagtcccatccttaaaggaccaaggtaaggagtacgacgggtttacaatcacaattactggggacaaggtgggaaacattctgtttagcgtggagacccagactaccgaagagaggacacaattgtaccacgcggaaattgacgccttgtacaaggatctcactgccaaagggaaggttctcattcttagctcagaatttggagaggccgacgcagtatgtaacctgattctcagcctcgtctactacttttataatctgatgcctctgagtcgcggcagtagcgttattgcgtatagtgtgattgtgggagctctgatggcaagcgggaaagaagttgctgggaagatccctaagggcaaactagtggacttcgaggctatgaccgcgcccggttcagaagccttctctaaggtggccaagtcttggatgaatctcaagtccatttcgccatcttataagacactgccctcggtgagtgagacatttcctaccttgaggagcatgatcgaggtcctgaataccgactcctcacctcggtgtctcaagaagctatag

SEQ ID NO: 51415 - DNA, 2424 bp, Artificial Sequence
  Description of Artificial Sequence: Synthetic coding sequence
atggcccccgccggctgctgctgctgctgctgcttctggggcggcgccgtggccgccgctggggcggcgcgcagggtgctcctcctcctcctgctcggcgtgctcagcgctggcttgcggcccggcgccttggctactgagcattattcacccctgtccctcctaaaacaagagcttcagcaccgtcagcaacaggaggcacccgcagggggaggagggtgcagcccacagtctggcgactggggcgatcagtactctgctgagtgcggcgaatccagtttcctgaatttccacgacagtgactgcgagcccaaagggtcttcgccctgtgatagtctcttatcacttaatacagagaagatcttgagtcaagcaaaatctatcgccgaacaaaagcggttcccatttgctaccgataacgattctaccaacgaagaactggctatagcttacgtcctgattggcagtgggttgtacgacgaggcaattcgacacttctcaacaatgctgcagattctgtccccgctcggtcgaatcaacgaggccgtgaacgacctcactaaggccatccaattacagccttccgcgcgcttgtatcgccatcgggggacactctactttattagcgaagactacgccaccgcccacgaggatttccaacagagcctggagctgaataagaatcagccaatcgctatgctatataagggccttacgttttttcatcgtggattgctgaaagaggctatcgaatccttcaaggaggccttgaagcagaaggtggacttcatcgacgcctacaagtctctagggcaggcatacagggaactgggtaatttcgaagcagccaccgaatctttccaaaaggcgctgctgctgaaccagaatcatgtgcagacactgcagcttcgcggaatgatgctgtatcaccatggctcactgcaggaagccttaaaaaatttcaagcgctgcttgcagctggagccatacaatgaggtgtgccaatacatgaagggcctgtctcatgtggcgatggggcaattttatgaaggcatcaaagcacagaccaaagttatgctgaacgaccctttgcccggccagaaggcgtcacctgaatatctgaaagttaagtatctcagagagtattcaagatatctgcacgcacacctggatacgccattaaccgaatataatattgacgtggacctcccagggtcttttaaagatcactgggcaaaaaacctaccatttttaatcgaggactacgaggaacagcctggcctgcagccccacattaaggatgtgctccaccaaaatttcgagagctacaagcccgaggttcaggagctcatttgcgtggcggaccgtctgggctcgctcatgcagtatgagacgcctggctttctgccgaacaaacggatacaccgggccatgggcctggcagctctggaagtgatgcaagctgtgcagaggacgtggacaaatagcaaggttcgaatgaacggtaagactcgcctgatgcagtggcgggacatgttcgacatagctgtcaagtggagacgcatagcagatcccgaccagccagtgctgtggctggatcagatgcccgctaggagcctgtccaggggcttcaacaaccatattaacctgattcgtggccaggtcatcaacatgcgctacttagaatactttgaaaagatcttacattttatcaaagatagaatcttagtgtatcacggggccaataacccaaaaggactgcttgaggtccgcgaggcactcgagaaagttcataaggtggaggatctgcttcctatcatgaaacagttcaataccaagactaaagacggcttcacagttaataccaaggtccctagcttaaaggaccaaggaaaggagtatgacgggttcaccattaccatcaccggggacaaggtaggcaacatcctcttcagtgtggaaacacagactacggaagaacgtacccagctttaccacgccgagatcgacgctctctataaagacctgacggccaaagggaaggtcctcattctctcatcggagtttggtgaggcggacgcagtttgtaacttgatactctcattagtgtactacttctacaaccttatgcccttgagccggggcagctctgtgattgcatatagcgtgatagtgggtgcactgatggcttcaggcaaagaagtggccgggaagattcctaaggggaaactcgtcgacttcgaagctatgacagcgccgggtagcgaggcattcagtaaggtagcaaagtcatggatgaacctaaagtctattagcccctcctacaagacactgccgagcgtttccgaaacgttcccaactctccgctctatgattgaggtgttaaataccgacagtagccctcggtgcctgaaaaaactttag

SEQ ID NO: 51416 - DNA, 2313 bp, Artificial Sequence
  Description of Artificial Sequence: Synthetic coding sequence
atggaccgggacctgctgcggcagagcctgaactgccacggcagcagcctgctgtcactgctcagaagcgaacaacaggataaccctcatttcagatccctgctcggcagtgccgccgagccagctagagggccgccgccccaacaccccttacaaggccggaaggaaaagagagtggacaatattgaaattcagaagtttatttccaaaaaagctgatttgctctttgccctgagctggaaaagcgatgctccggccacatcggagataaacgaagattcggaggatcactacgccattatgcctcctcttgagcaattcatggaaatcccatccatggacaggcgggagctgttctttcgcgatatcgagcggggagacatagtgattggccgtattagctccatcagggaattcggtttctttatggtgctgatctgcctcggatcaggtattatgcgcgacattgcacacctggaaattaccgccctgtgcccattgcgggatgtaccctctcatagtaaccacggggatcctctgtcctactatcagacgggggatataatccgggccgggattaaagacatcgacaggtatcacgaaaaactcgccgtcagtctctattctagtagccttcccccacacttgtccggtatcaagctgggcgttatatcgtctgaggagcttcctctatattatcgtcggtctgtggagctcaacagtaacagcctggaatcttacgaaaacgtgatgcagagcagtttgggcttcgtgaatccaggcgttgtcgagttcctgctggagaaacttgggatcgacgagtctaaccccccttctctgatgcgcgggctccagtcaaaaaacttctctgaagacgattttgcttcagccttgcgtaagaaacaatccgcatcttgggctctcaaatgtgtgaagatcggagtggattacttcaaggtagggcggcacgtggacgcgatgaacgaatataataaagctctggaaatcgacaagcagaacgtggaagccctggttgctaggggcgccctgtacgcaaccaaaggctctctgaacaaggctatcgaggatttcgagctggccttagaaaactgtccaacacaccggaacgccagaaagtatctgtgccagacactggtcgagcggggaggacagttagaagaggaagagaagtttctcaacgccgagagttactacaaaaaggcattagccctggacgagacattcaaagatgccgaggatgctctgcaaaagctgcacaagtatatgcaaaagagcttggagctgcgcgagaagcaggcggaaaaggaggaaaagcaaaaaactaagaaaattgagacaagtgcagaaaagctgagaaagctgctgaaggaggagaagcgtttgaagaaaaagagacggaagtcgacgagctccagttccgtgtcctcggctgatgagagcgtctccagctctagctcaagctcttccagcggtcataagcggcacaagaaacacaaacgcaacagatccgagtcttccaggagttcaaggaggcactcctcacgggccagttctaaccagatcgatcaaaataggaaggatgaatgctacccagtcccagccaacaccagcgccagctttctcaaccacaagcaggaagtcgaaaagctgctgggaaagcaggacaggctgcagtacgagaaaactcagatcaaggagaaagaccggtgtcctctgagcagcagctctctcgagatccccgatgactttggcgggagaagcgaggatccccgggatttttacaacagctataagactcaggcaggcagctcaaagaccgagaagccttacaagtcagagagacattttagcagcaggagaaactcttccgattcattttgtagaaattcagaggataaaatttatgggtaccgcagattcgagaaagatattgaggggcggaaagagcactaccggcgctgggagccaggctccgtgcgacactctacctcacctgcttccagcgagtacagctggaagtccgtggagaagtataaaaagtacgctcattcaggcagtcgggacttctctcgccacgaacagagataccgactgaacaccaatcagggggagtacgagcgcgaagataactacggtgaggacatcaaaactgaggttcccgaagaggacgcactgtcttcaaaagagcacagcgagagcagcgtgaaaaagaatttaccccagaacctgctgaatatcttcaatcaaattgccgaattcgaaaaggaaaaaggcaacaagtccaagaactag

SEQ ID NO: 51417 - DNA, 1962 bp, Artificial Sequence
  Description of Artificial Sequence: Synthetic coding sequence
atggaccgggacctgctgcggcagagcctgaactgccacggcagctccctcctgtcactgttacggtccgagcaacaagataatccccactttcgctctctgctcggcagtgccgcagagccagctcggggacctccgccccagcacccactgcaaggacgaaaagaaaaacgggtggacaatattgaaattcagaagtttatctctaagaaggctgacctcctgtttgctttgagttggaagtctgacgcgccagctacaagcgagatcaacgaagacagcgaggatcactacgctatcatgcccccgctggagcagtttatggagatcccgagcatggatcgacgcgagctgttctttagagatatcgaacggggggatattgttattggccgaatctctagcattcgagaatttggcttcttcatggtcctgatctgcctgggatcgggaattatgagagacatcgcccacctagagattactgccctgtgcccactgcgggatgtgccgtcccactctaatcatggcgaccctttgtcttactatcagacgggggatatcataagagcagggatcaaggacatagaccgttatcatgagaagctggccgtgagtctctatagcagcagtcttccaccccatctatccggaatcaagctgggtgtgataagttcggaagagctgcccctctactaccggagaagtgttgaacttaactctaattccctggaaagctacgagaatgtgatgcaatcttctctggggttcgttaacccaggggtagttgaatttttgttagagaagctgggaatcgacgagagcaatcctccgtccttaatgcgggggctgcagtcaaagaacttctcagaagacgatttcgcctcggcgctcagaaagaagcagtctgcaagttgggcactgaaatgcgtgaagattggggtggactatttcaaggtggggcgtcacgtcgatgccatgaacgaatataataaggctctagaaattgacaagcagaatgtggaagcccttgttgccagaggggccctgtacgccactaaaggatctctgaacaaggcgatcgaggattttgagcttgctctcgaaaattgccccacccaccgcaacgcccgaaaatacttatgtcagacacttgtggagcggggaggccagttggaagaggaagaaaaatttctgaacgccgagtcttactacaagaaagccttagcccttgatgaaacattcaaggatgctgaagatgcgctgcaaaagcttcacaagtacatgcagaaaagcctagaactgcgagagaaacaagctgagaaagaagagaagcagaaaacaaagaaaatcgaaacctcggctgagaaactgcgcaaattgctcaaagaagaaaagcgtcttaagaagaaacggcggaagagtacatctagctcatcagtctctagtgctgatgagtcagtcagcagtagttcctcctcgagctccagcggacacaaaaggcacaaaaagcataagcgaaatcggtccgaaagtagtcgatctagtcgccggcacagctctcgagcttcatcaaaccagatcgaccagaataggaaagatgagtgctatcccgttcccgccaacactagcgcttccttcctgaatcacaaacaagaagtggagaaattactaggaaaacaggaccgactgcagtacgaaaagacccagattaaagagaaggacagatgtccactgtcatcatccagtctcgagattccagatgacttcggagtctactcatatttgtttaagaagcttaccatcaagcagccacaggctggtccatctggtgacatccctgaggaaggaattgtcatcattgacgattcctcaattcacgtgaccgaccctgaggaccttcaggtgggtcaggacatggaagtcgaagactctggaattgacgaccctgaccatgggtag

SEQ ID NO: 51418 - DNA, 1320 bp, Artificial Sequence
  Description of Artificial Sequence: Synthetic coding sequence
atggaccgggacctgctgcggcagagcctgaactgccacggcagctccctgctgtcgttgttgaggtcagagcagcaggataaccctcattttcgaagtttactggggtccgccgcagagcccgcacggggccctcctccccagcaccctttacaagggagaaaggagaagcgcgtggacaatattgaaatccagaaattcatcagtaagaaagctgatttgctgttcgccctttcttggaaaagcgatgcgccagcaacttctgaaataaacgaagatagtgaagatcattatgctattatgcctcctctagagcaattcatggagataccgagcatggacagacgggaactgtttttcagggacattgaaagaggagatatcgtaatcggccggatctccagtattagagagtttgggttcttcatggtactgatttgcctcggctctgggatcatgcgcgacatcgcccacctggaaattaccgcactgtgtcccctcagagatgtgccaagtcattctaatcatggagatccgctatcatactatcagacaggcgacatcattagggctggcatcaaggacatcgataggtatcacgagaagctcgcagtgtctctgtactcatccagcctaccacctcacttgtccgggatcaagctgggtgtgatcagctccgaagaactgccgctctactatcgtagaagcgtggaattaaacagtaattcattggaatcttatgagaacgtgatgcagtcatccttggggttcgtgaaccccggagtggttgagtttctcctcgaaaagctgggcatcgacgagagcaaccccccatcacttatgcgcgggctgcagtccaaaaatttttctgaggatgattttgctagtgccctaaggaagaaacaatcggcaagttgggccctgaagtgtgttaagattggcgtagactacttcaaggtggggagacacgtcgacgctatgaacgagtacaataaggccttagaaatcgacaaacagaacgtcgaagccctggtggcacggggcgctctgtacgctacaaaggggagcctgaacaaggcaattgaggattttgagctcgcacttgaaaactgcccgacccaccgcaacgcccgaaagtatctctgccagaccctcgtagaacgtggtggtcagctcgaggaagaggagaagttcctgaacgccgagagctattataaaaaggccctggcccttgatgaaaccttcaaagacgctgaggatgctttgcagaaactgcataaatacatgcaggtgataccatatttcttactggaaatctag

SEQ ID NO: 51419 - DNA, 1125 bp, Artificial Sequence
  Description of Artificial Sequence: Synthetic coding sequence
atggcctggctggacagccggaacaccagcctgcccagcctgggcttttgcctgctattgcttcccttgcatccagctccacttctccctacgacacccacacctgccctatgcccaggtctggtccactctcagggccatcctagcgcttgtccccatttccctcatagttactctaggggccaacagtgtttagagcaggcggattgggagacagccgtgctcttgttctccagggccctgcatctggatccacaactgggccagtgcctgttcgagcagtgcgcttttcttgacgctcttaatgtatttagtcatgcggcagaactgcagcctgaaaagccctgttttcggtatcgctgcatggcctgtctgctcgcactaaagcagcatcaggcctgcctgacattgattacaaatgagctgaagcaggataccacaaatgccgacgtctacattttccgggcacgcctgtacaacttcctccagaagcctcatctgtgttaccgagatttacactcggctcttttgctaaacccaaagcatccacaggcgagaatgctccttcaaaagatggttgctcaggctcagcaggcccggcaggatgccggcatactagctgtgcaggggaagcttgcccgaaccgctgccgatcagccctgccaccgtgaacagccctccggaccgcagagtcttcctctgccaggtcaccatgtaccaaccgcacccggcgtcagatggggatccggaggactgcctgaaggggccgggcacggggaccgaggcccaggaggacacggagcagcagggacggccccagcggttgccgacctgcaacgactatgcagagcacttctccaggcaggacggctgccaggcggacgtgcagctgccgaacagggtcctcctggacgggcagccggagagagaacgttacaccagcctcgaagacagttccaaaaggcagagaatcacttctccaccgcaatccggcacaaccctcagaaagctcaatattacctctaccgcgcaaaatcaaggcaactcctgcaaaatatctttggcgcaaggcaggacgtggccactgtcttactcttgaatccaaaacaacccaaagatgcatag

SEQ ID NO: 51420 - DNA, 1230 bp, Artificial Sequence
  Description of Artificial Sequence: Synthetic coding sequence
atgcacggcctgagccccggcccccaggccgccagcggcctgccccacgcccatcatcagcgggccgaagccggccatcaccaacgacggtgtttgcacctgccaggacagacactccagctttcacccgaggctccacctttgcttcctggacctgcccagaggctggctgtcgagtcccaggctcccgccggtcaggacgccgcaccagaggatggtggacccggccccgctggggcacctcgatgtggcgatccaggatgcgccggccaggcagctgcccgcaccgctgcggaccaaccttgccaccgggaacagccctccggcccgcagtcacttccgctgcctggccatcacgtaccaacagctccgggagtgcgctggggtagcggtggcctacctgaaggagccggccatggggataggggccccggagggcatggcgccgctggcaccgccccagcggtggcagacctccagcgcctttgccgtgcattgctgcaggcgggtcgtctccctggcgggagagccgccgcagagcaaggccctccaggaagagccgctggagagcggacgctccaccagcctcgcaggcagtttcaaaaagcagagaaccatttttctacggccatacgccataaccctcaaaaggcccagtactatctgtacagggccaaatcacgacagcttttacaaaacattttcggcgcacggcaggacgtcgctactgtacttctccttaaccccaagcagcccaagctgagcctgctgatgaccaacttgttcccaggaatgagcgtcgaagaggtcttaagtacccagatcgcccacttagctagactgcaactcgagcaaatggtcgagggctcattgcaggcaggaagcccacaggggatcgttgggatgctcaagcgccacgaacttgaaagacaaaaggccttggcccttcaacactcttggaaacaaggagagcctctgatcgcaactagcgaggagttgaaggcaacccctgagattccccaagtgaagcccggctcgagtgaaggtgaggccgaagcccctgaggaggaagaggagaaggagaaagaaaaaaaagaggtcagtggcgtgcaggctagggctagaagtccctggggcttgggtcacagcgtgcctcaacccagagctgaaggatgccggccggtggagtccgggtttcaggcttggctctgcacccccagcgccgtctag

SEQ ID NO: 51421 - DNA, 2622 bp, Artificial Sequence
  Description of Artificial Sequence: Synthetic coding sequence
atgaccgacagcgacgaggacgccctgaaggtggaccagggcccctcacgggacattcctaagccctgggtgattcccgcacccaagggaattctgcagcacatctttggtaccagccatgtttttcaatccatttgtgatgttaaacccaaagtgactgggctgaccgtgcccctcaaggtccgagaatactacagtcggggccagcagtgcctggagcaggctgattgggaaaccgcggtactcttgttcagcagagctctgcaccttgacccccagctggttgatttctatgcactgagggccgaggcataccttcagctgtgtgacttctccagcgccgcacagaatctcaggcgcgcatattcactgcagcaggataattgcaagcatctcgagcgtctgaccttcgtcttatacttgcagggccagtgcctgtttgagcagtgcgctttcctcgacgcattgaatgtgttttctcacgccgctgaactccaacctgagaagccgtgcttccgataccggtgcatggcctgcctgttagctctgaagcagcaccaggcatgtctgaccctgattacaaatgaactcaagcaggatacaaccaatgcagatgtctatatttttcgcgctcgcttatacaatttcctgcagaaaccccacctgtgttatcgcgacctgcactcagccttgctcttaaatcccaagcatccgcaggccagaatgctgttgcagaaaatggtagctcaagctcagcaggctaggcaagacgctgggattttggctgtacagggcaaactgcagcacgcattgcagcggataaatcgagccatagagaacaacccattggatcctagtcttttcctgtttagaggaaccatgtatcgcaggctacaagaatttgatggggccgtggaggactttctgaaagtgctggacatggttacagaggatcaggaggacatggttagacaagcgcagcgtcagctcctgttgacctataacgatttcgcagtccactgctataggcaaggtgcataccaggagggcgtcctgctgctcaacaaagcccttcgagatgagcaacaggagaagggactctatatcaataggggcgactgcttctttcaattaggcaatctcgcttttgccgaagcagactaccagcaggctctcgccttatctccgcaggacgagggcgccaacactagaatgggcctgttacaggaaaagatgggcttttgcgagcagagacgtaagcagttccagaaagcagaaaaccacttctctactgccattcgtcataatccgcaaaaagctcagtactatctgtatcgtgccaaatcacgccaattgttgcagaatatcttcggagctagacaggacgtggctacagttctgctcctgaacccgaagcagccaaagctatcacttcttatgactaacctttttccgggcatgtctgttgaggaagtgctgtcaactcagattgcccacctcgcccgcttgcagcttgaacagatggtagaaggttctctccaggccggctcccctcagggaattgtgggcatgcttaaaagacatgagttggagcgacagaaagcattggcccttcagcactcttggaagcagggcgagcccctcatcgcgacttctgaagaacttaaggccactccagagatcccacaggtgaagcctggatcctctgaaggcgaggccgaagccccggaggaagaggaggaaaaagagaaggagaagaaggaggagaaaaagtcagagctgatcccctctaaggtagcaagcctctcagattcatacctcgaccagacttcctcggctagttccatgtcctttcgcaccacgggaacttctgaaactgaaatgagcgccatctgtcaagagtaccggagcacaagcgctaccgcggttactttttccgacagcagtctgttgaagactcaatcttcggatagtggaaataatagagaggctctgtctcatggtccgcgcaagatcaaggcaactcaaggccagcgacaaagcctgtcaaagacggaaccaacacagtcccagcgtcggaacagtagcaagactaaggctactattcataaacgtaactcctctaaaacaaaggccacacagtcccagcgaagaaacagttccaagactagagcaacgcagggtcagggtcaaagctctagcaagacggaggctactcaaggccaacgtcagagttcttccgagatcgaggctacacaagggccgcgccaggaaccctctaagacgaaaacaacgagaagccctagacagaggccacgaaaagtgaaagctgcaaggggccggagttggcggcctagcaaagtggacgcgacacaaggtcggtcacgggggcttctgagatcctcaacaaagacagaagctttctatgatagcaattggagtctgtctaagactgagtatgcccaaggacaggggcagcgcagcagcaaggccgaaggagctcaaggcaagagtcaaggcatgtcctcaactagcagtaaagcggagtcaacatgggggccatccccctccctttcgaaaactgaggttgatcaggacctcacatattatgaagctgtttag

SEQ ID NO: 51422 - DNA, 726 bp, Artificial Sequence
  Description of Artificial Sequence: Synthetic coding sequence
atggcctgcctgctggccctgaagcagcaccaggcctgcctgacccttataacaaatgaactcaagcaagacacgactaacgctgacgtctacatattccgggcacggttgtataatttcttacagaaaccccacctctgttatcgtgatctgcattctgcactcctgctcaatcctaaacatccacaggcccgcatgttactgcagaagatggtggcccaagcccagcaagctagacaggatgccgggatcctggcggtccaggggaagctgcagcatgcacttcaacggattaatagagctatcgaaaacaatccgcttgacccgagcctgtttctgtttagaggcactatgtatagaagactccaggagttcgacggcgcggtggaggactttctcaaagtgttggatatggtcacggaggaccaggaggatatggtccgtcaggcacagcgtcaacttctgcttacgtacaacgactttgccgtgcattgctacagacagggcgcctaccaggagggtgttctgttgttaaataaggccctgcgcgatgaacagcaagaaaaggggctctatattaatcggggcggggctcagcgccctgggcactgggggggtggagtgagaggctcgctggccattagcaaagcccctacagggcatttacgcccattgggcggccgtcgcaaaggcgaaagaaaggaagcccgcgaggaggaaatgtag

SEQ ID NO: 51423 - DNA, 3426 bp, Artificial Sequence
  Description of Artificial Sequence: Synthetic coding sequence
atggccgccgccgtgggcgtgcggggccggtacgagctgcccccctgctctggacccggatggctgctatccttgtccgccttgttaagcgtggccgcacggggtgccttcgctacgacccactgggtggtcactgaggacgggaagatccagcaacaggtggactctcctatgaatctcaagcatccgcacgacctggtcatactgatgaggcaggaggccacagttaactacctcaaggaactggagaagcagctggttgctcaaaaaatccacatagaagaaaacgaggatagggacacaggactggaacagcggcacaacaaggaggatccggactgtataaaagcaaaagtacctctcggtgacctcgacttgtacgacggcacatatatcacactcgagtctaaggacatctcaccagaggattacattgataccgaatcgcccgtgccccccgatcctgagcaacctgattgcacaaagattttggaactgccctattccattcacgcattccaacatcttcgcggggttcaggaacgagtcaacctgagcgcaccactgctgcccaaggaagatcctattttcacatatctaagcaaacggttaggacggtcaattgacgacatcggtcacctgattcacgaagggctgcaaaagaatacctcttcctgggtgctctataatatggcatctttttattggcggattaaaaatgagccataccaagttgttgagtgtgccatgcgggccctccacttttcttcgagacataacaaagacatcgcattagtaaatttggccaacgtacttcaccgcgcccacttttccgcagacgctgcagttgtggtacacgctgcacttgacgatagcgatttcttcacttcgtactacacactcgggaatatctacgccatgctgggcgagtacaatcactctgtgttgtgctacgaccatgctctccaggcccgccctggttttgaacaagcaatcaaacggaagcatgctgttctatgccagcagaaattggaacagaagttagaagcgcagcaccgcagcttacagagaacactgaatgaactgaaagagtatcagaagcagcatgatcactaccttcgtcagcaagagatcctagagaaacacaagctgattcaggaagagcagatcctaaggaatattatacatgagacccagatggccaaggaggcacagctgggaaaccaccagatttgcagattagtgaatcaacagcactcgctgcattgccagtgggatcagcccgtgcggtaccaccggggcgacatcttcgagaatgtagactacgtccagttcggggaggattcctccacctcctcaatgatgagcgtaaattttgacgtacagtcaaaccaatcagacattaatgacagtgttaagtcctccccagtagcacactcaatcttgtggatttggggcagggactccgatgcttacagggataaacagcacatcctatggccgaaaagagctgactgcactgagtcttaccctagagtgccagtaggcggggaattgcccacttacttcttaccacccgaaaacaaggggcttagaatccacgaactaagtagcgacgattacagcactgaagaagaggctcagacccctgattgctcaattaccgatttcaggaagtcccataccttatcatacttagttaaggaactggaggtcaggatggacctcaaggcaaagatgcccgacgatcatgcgagaaaaatattgctgagtcgcataaacaattatacgatccctgaagaagaaatcggcagtttcctatttcacgcaatcaataaacctaacgcccctatttggctaattctgaatgaggccggcctctattggagggctgtgggtaatagcactttcgccatagcttgtctacagcgagccctgaacctcgcacccttacagtatcaggacgtaccactggtgaacctggccaacttgcttatccactacgggctgcacctggatgcgacaaaactcttactccaggccttagcaatcaacagttccgagcccttaacttttctgtcgctgggtaacgcttatttggcgcttaagaacatcagtggagccctagaagccttccgccaggccttgaaactgacaaccaaatgcccagaatgtgagaattccctgaaactcatccggtgtatgcagttttacccattcttatataatatcacgtcgagcgtctgtagtggtacggtcgtggaagagtcaaacggctctgacgagatggagaactcagacgagactaagatgagtgaagagatcctggcactagtggatgagttccaacaagcctggccattagagggttttggcggcgcactggagatgaagggcaggcggttggatctacaggggataagagtgctcaagaagggcccgcaggatggcgtcgcccgtagctcatgttatggcgattgccgctctgaagacgatgaggccacagagtggattacctttcaggtgaagcgggtaaagaaacccaagggcgaccacaagaaaactcctgggaaaaaggtggagaccggacaaattgagaatggccatcgatatcaagcaaatctggagattaccgggcctaaggtggcaagccccggcccccagggcaagaagcgagattaccagcgactgggctggccatctcccgacgagtgcctgaagctacgctgggtggagttgaccgccattgttagcacctggctcgctgtaagcagcaaaaacatcgacatcaccgaacatatcgacttcgcaactcctatccagcagcccgctatggaacccctttgtaatggaaacctccctactagcatgcatactctggatcatttacatggggtttccaatagagcctctctccattacaccggggagtcacagctcaccgaggtgttgcagaacttgggcaaagaccaatatccacagcagtccctggaacagatcggaactagaatagctaaagtgctcgagaagaaccagaccagctgggtgctatcttccatggccgctttatactggagggtcaagggacaggggaagaaggccatcgactgtttgcggcaggccctgcattacgcccctcaccagatgaaggacgtccctctgatttctctcgcaaacattcttcacaacgccaagctgtggaacgatgctgtaatagtcgccacaatggcggtggagatcgccccacatttcgctgtgaaccatttcacactgggtaatgtgtatgtcgcgatggaggagttcgaaaaagcccttgtttggtatgagagcacgctaaagctgcagccagaatttgtacctgccaaaaatagaatccaaaccatccagtgccatctgatgctgaagaagggaaggagatcgccatag

SEQ ID NO: 51424 - DNA, 2871 bp, Artificial Sequence
  Description of Artificial Sequence: Synthetic coding sequence
atggccgccgccgtgggcgtgcggggccggtacgagctgcccccctgctccggacctgggtggcttctgagcctgagcgctcttttgagcgttgcggcccggggagctttcgctactacccattgggttgtcacggaggatggtaaaattcagcagcaggtagattcccctatgaacttgaaacacccccacgatctcgtcatcctgatgcgtcaggaggctacagtcaattaccttaaggaacttgagaaacagctggtagcacagaaaattcacatcgaggagaacgaggaccgcgatacaggcttagaacagcggcacaataaagaagaccccgactgcattaaagctaaagtgccattgggcgacctggatctgtacgacggcacatacattactctggaatctaaggatatttcccctgaggactacatcgacaccgaaagccccgttccccctgatccggagcaacccgactgcacgaaaattctcgagctgccttactcgatacacgcatttcagcatctgcgtggtgtacaggaaagagtaaacctgagcgcgccgctgctgcccaaggaggacccgattttcacctatttaagcaagcgtctgggcaggagtatcgatgatattggtcatctcatccacgaaggccttcagaaaaacacgtctagttgggttctctataatatggcctcattttactggcggattaagaacgaaccttaccaggttgtggagtgtgctatgagggccctccactttagttcgcgtcacaataaagacatcgccttggttaatctggctaacgtcctgcaccgcgcccatttttctgccgatgctgccgtcgtagtgcacgcagcactggatgactcagatttcttcactagttattacaccctcggaaatatttatgccatgctcggcgagtataatcactcagtattatgctacgaccacgcgctgcaggcgcgacccgggttcgaacaggccattaagcggaagcatgctgtgctgtgtcagcagaaactggagcaaaaattggaagcccagcaccgctcactgcagcggaccctaaacgaattaaaagaatatcagaagcaacatgaccactacctccgacagcaggagatactcgagaagcacaaacttatccaggaggagcagatcctgcgaaacatcatccacgagacgcagatggcaaaggaagcccagcttggcaaccaccagatctgtaggttagtcaaccagcagcactctttacactgccagtgggatcagcccgttagatatcataggggggacatctttgaaaacgtcgattatgtccagttcggagaggattcctctaccagctcaatgatgtctgtgaactttgacgtgcagtcaaatcagtccgacattaacgacagcgtgaaatcctctcccgtggctcacagcattctttggatctggggcagagacagcgatgcatacagggataagcagcatattctctggccaaagagagcagactgtaccgagtcgtatccccgcgtccctgtaggaggtgagctcccaacctattttctgccccctgaaaacaagggcctccgcatccacgaactgtcatctgatgactactctacggaggaagaagcacaaactcccgactgcagcattactgacttccgaaagtcacacacgttaagctacctggtgaaagagctggaagttagaatggacctgaaggctaaaatgcccgacgaccacgctaggaaaatcctcctgagccgtattaacaactataccatcccggaggaagagatcggatcatttctattccacgctatcaataagccaaatgcccctatttggcttattctgaatgaggccggtctgtattggcgtgctgtagggaattcaacatttgcgattgcctgtctgcagagggccctcaatctggctcctctgcaatatcaggacgtaccgctcgtgaatctggccaaccttctgattcattacggactgcatcttgacgctacgaagctactgttgcaggcacttgctataaattccagtgaaccactaacattcctgtctctgggaaacgcatatcttgccctcaagaatatttcaggggcactcgaagcgtttcggcaggctctgaaattgactactaagtgtcccgagtgcgagaactccctaaaacttatccgatgcatgcaattctacccattcctgtacaacataacctctagtgtgtgctcaggcaactgccatgagaaaactttggacaatagccatgacaaacagaagtatttcgacaactcacagagcttagatgccgctgaggaggagccttccgagagggggaccgaagaggaccccgtgttttccgtcgagaacagcggtcgggactcagatgcgctcaggctggaaagtaccgtagtagaggaaagcaacggctccgatgagatggagaactctgatgaaacaaagatgtccgaggaaatcttagcactcgtggacgaattccagcaggcctggcctctggaaggattcggcggcgctctggagatgaaaggccgcagactcgatcttcaggggatccgggtgctgaagaagggaccccaagatggcgtggcacgtagctcctgttatggggattgccgcagtgaggacgacgaggccacagaatggatcactttccaggttaagcgggtcaaaaagcctaaaggcgatcataagaagacccccgggaaaaaggtggagactggccaaatagaaaatgggcacaggtaccaggccaatctggagatcacgggtcctaaggtggcctcccctggaccacagggcttattggactggaaaactagaaaagtgccgtag

SEQ ID NO: 51425 - DNA, 3366 bp, Artificial Sequence
  Description of Artificial Sequence: Synthetic coding sequence
atggagcaggtgcccagcgccggccggctggtgcagatcaccgtgacagaggggtatgacctgaagggtttcaagggagacacacctgtcacctttataagggccgagtttaaccaggtcgtcctcggcgatagcgctaaaatcaccgtgagcccagaaggtagcgcaaagtacaactttactagctcatttgagttcaatcctgagggcgggataacctctgacgacctggcccacaagcccgtctttctgactgtaaccgaggtgctgccaaaagaaaagaagcagaaagaggagaaaacactgattctgggacaggccgtggtggatttgctcccactcctggaagggcagagtagttttcaaactaccgtgcctctccatccggtgcagggtagcccactcgagacgcccagaagcagcgctaagcaatgctccctcgaggtaaaggtcttagtggcagaaccattactgaccacagctcaaatttccggggggaatctgctcaaagtaactcttgaggcggcctactcagtcccggagtcctttattccaacagggcctggccaaaactacatggttggtctgcaggtcccatcccttggagagaaagattacccgattcttttcaagaatggaacgttgaagttgggcggagaacgagaacctgttccaaggcccaaaaagtggcctattgccaatattctggcgccaggggccaacaacattccagacgcatttatagtgggcggcccctacgaagaagaggagggtgaactgaaccacccagaggacagtgagtttaggaaccaagcagagtgcatcaagaagaggatcatctgggatctcgagtcgcgatgttacctggatccgagtgcggtggtatccttccagaaaaggattgctgactgtcgactttggccagttgaaatcacccgggttcctcttgtgacaattccaaaaggaaaagccggtaagacagaaaagacagacgaggaagcccagcttagttttcatggtgtggcctacgtgaacatggtgccactgctatatcccggagttaaacgcattcggggagcttttcatgtttatccctatctagacagtgtagttcacgagaagaccaagtgcctcctctcccttttcagggacattggacatcacctgatacataataataagataggcggcattaacagcctcctgagtaagcaggctgtctctaagaacttgaaagaggacaaaccggtgaaagagaaggacatagatggcaggccgagacctggtgacgtgcaggccccctctatcaagagtcaaagcagcgacactcctttggaaggcgagcctccactgtctcacaatcccgagggacagcaatacgtggaagccggcacctacatcgtgctagagattcagctggataaggccctcgtccctaaacgtatgcctgaggagctagcccggcgtgtgaaagagatgattccaccaagacccccactcacaagacgaaccggaggagcccagaaagctatgtctgattaccacattcaaatcaagaacatctcgagggccattcttgacgaatactatcgaatgttcgggaagcaggtcgcgaaactggagtctgacatggatagcgagactctggaagagcaaaaatgccagctatcctatgaactgaattgtagcggcaagtactttgccttcaaggaacagctcaagcatgctgtcgtgaagatcgtgagagacaagtacttgaaaaccactagtttcgagtcccaggaggagctgcagacatttatcagcgagctgtacgtgttcttagtggatcagatgcatgtggcacttaaccagacgatgcccgatgatgtgcagggcactgttgccaccatctacaccagcagtgagcaactccagttgtttgcctttgaggcagaggtgaacgagaacttcgaaatggcagctgcttactacaaggagaggttagtacgcgaaccgcagaatctggaccactggctcgattacggagccttctgtctcctaaccgaagataacattaaagcccaagagtgcttccagaaggcattgtcactgaatcaatcgcacattcactctctcctgctgtgcggagtactggctgtgttactggagaactatgaacaggccgaaatcttttttgaggacgccacctgtttagaacccaccaacgtggtcgcttggacgttgcttggactctactacgagatccaaaataacgatattcgaatggaaatggccttccatgaggcgtccaaacagctgcaggcacggatgttgcaggctcaggtcacaaagcagaagtccaccggcgtcgaggacaccgaagaaagggggaaaagggagtcttctctgggcccatggggaattaccaatggctctgccacagccatcaaggtggaagctcccgccggaccaggggccgcccttagtattctggacaagtttcttgaggagtccagcaagctgcagagcgatagccaggagcccatcctcacaacccaaacctgggatccttctattagccaaaagccctcaaataccttcatcaaagagatccctaccaagaaggaggcgtccaagtgtcaagactcaagtgccctccttcacccagggttgcattacggtgtgtcccagacaacaactatattcatggaaaccatccacttcctcatgaaggtcaaggcagtgcaatacgtccacagagtcctggctcatgagcttctgtgtccacaagggggtccttcttgtgagtactatctcgtgttggcccaaacccatatcctgaagaagaatttcgcgaaggcggaagaatatctgcagcaggccgcgcaaatggattatctgaatcccaatgtgtgggggctgaagggtcacctgtacttcttaagcggcaatcacagcgaagcaaaagcctgctacgagagaaccatttcttttgtagtggatgcgagtgagatgcacttcatcttcctccggctaggactaatctatctcgaagagaaagaatacgaaaaagctaaaaagacatatatgcaggcttgtaaacgaagccccagttgcttgacctggctgggcctgggaatcgcgtgttacagactggaagagctgaccgaggccgaggacgcactctccgaggccaacgcactgaacaactacaatgcggaggtctgggcctacctcgcactggtctgcctgaaagtcggtaggcagctcgaggctgaacaggcctacaagtatatgatcaaactgaagctgaaagacgaggccctcttggcagagatccatacactccaggagacggtgggtttcggcaatccaagcttttag

SEQ ID NO: 51426 - DNA, 1086 bp, Artificial Sequence
  Description of Artificial Sequence: Synthetic coding sequence
atggagcaggtgcccagcgccggccggctggtgcagatcaccgtgactgagggttacgatctgaagggatttaaaggagacacccccgtaacctttatccgcgccgaatttaaccaagttgtactgggggactcagcaaagatcacagtgagccctgagggatcggcaaagtacaattttacgtctagcttcgagttcaatcctgaggggggtatcacgtctgatgacctggcccacaaaccagtcttcttgaccgttacggaagtgctgcctaaagaaaagaaacagaaggaggagaagacgctgattttgggccaggccgtggttgacctccttcctctgctggaagggcagagctccttccaaaccacagtgccactacatcctgtccagggctctccactggaaactccccgctcttcagctaaacaatgctccttggaggtcaaggtgctcgtggctgagcctctgctgacaactgctcaaattagtggtgggaatctgctgaaggtgacactggaggccgcctactccgtcccagaatcattcatcccaacggggcccggccaaaactatatggtcggcctacaggtcccaagtctgggggagaaggactatccgattctgtttaagaatggaacactgaacgggaatcactccgaggccaaagcctgctacgagcggaccatttcttttgtggtagacgcgagtgagatgcacttcattttcctgcgcctgggtctcatttacttagaggagaaagagtatgaaaaagcaaagaagacatatatgcaggcatgcaagcggtcaccctcatgtcttacctggttgggactgggtatcgcttgttatcggctcgaagagcttaccgaggctgaagatgccttatccgaggcaaatgctctgaataattataatgccgaggtgtgggcttacctggcactggtgtgccttaaagtggggaggcagctcgaggccgagcaggcttataagtacatgataaagttgaagttgaaagacgaagccttgctggctgaaatacacactctacaggagactgtcgggttcggaaatcctagcttctag

SEQ ID NO: 51427 - DNA, 3366 bp, Artificial Sequence
  Description of Artificial Sequence: Synthetic coding sequence
atggagcaggtgcccagcgccggccggctggtgcagatcaccgtgaccgagggatacgatctaaagggatttaaaggcgacacacctgtaactttcattagggctgagtttaaccaggtggttctgggggatagtgcaaaaattacagtatcacctgagggatccgcaaaatataattttacttcaagctttgagtttaaccctgaaggggggatcacatccgatgaccttgcccacaaacccgtcttcctaacagtgacagaggtactcccaaaggaaaaaaaacagaaggaagagaaaaccttgatcttgggtcaggcggtcgtggatctgctgccattactagaaggccagtctagcttccaaactacagtgccactgcaccctgtgcagggatcccctctggagacacctagatcatctgcaaaacagtgttctctggaagtaaaggtgctagtggcggaacctctgctgactacggctcagattagtggcgggaatctactcaaggtaacactggaagcagcatactcagtccccgagtccttcatacctactgggccaggtcaaaactacatggtcggcctgcaggtaccatctctgggggagaaggattacccgattctttttaagaatggaacacttaagcttggaggggagagagagcccgtgccacgcccaaaaaagtggcctattgccaacattctcgcacctggggcgaacaatatccccgacgctttcatcgtgggcggcccctatgaagaagaggagggggaactcaatcatccagaagacagcgaatttcgcaaccaggcagaatgcattaagaagaggatcatctgggatctggagagtcggtgctatcttgatccttccgcagtagtttcattccagaagcgaatcgccgattgccgcctctggcccgtagagatcacacgcgtcccgctggtaactatcccaaaaggcaaggccggcaaaaccgaaaaaaccgacgaagaggcccagctgtcgtttcatggggtggcctacgtaaatatggtaccccttctttatccaggcgtgaagagaatacggggggcgtttcatgtatacccctatctggatagcgtagttcatgaaaagacgaaatgcttattatccctgtttagagacattggccaccacctcattcataacaataaaattggtgggatcaactccctgctgagcaaacaggccgttagcaagaatctcaaagaggacaagccagtgaaggaaaaggacatcgatggacgacctcgtccaggggatgttcaagcgcctagtatcaagtcccagtcctctgacaccccattggagggagagccaccactgagtcataatcctgaaggacagcagtatgtggaagctggcacctatatcgtattggaaatccagttggacaaggcacttgtgcccaaaaggatgcccgaagaactcgcccgcagagtgaaagagatgatccctccaagaccgcccttgactcgcaggacaggcggcgcacagaaggccatgtcggattatcatattcagattaagaacattagtagggccatcctcgatgaatattaccggatgtttggtaagcaagtggcgaagctggaatctgacatggactcagagactctagaagagcagaaatgtcagctcagttatgagctgaattgctccggcaagtactttgcatttaaagagcaactcaagcacgcagtggtaaagatcgtcagggataagtatttaaaaacaacctctttcgaatcacaggaggagctccagacatttatttccgaactctatgtgtttttggtagaccagatgcacgtagccctcaaccagacaatgcctgatgatgtccagggcacagttgcaaccatttacacatcctcggaacaacttcagctgttcgcttttgaggccgaagtgaacgaaaatttcgagatggctgctgcatattacaaagagcgattggtgagggagccacaaaatttagaccactggcttgactacggcgccttctgcctgctgactgaggataacatcaaggcccaagagtgtttccagaaagccctgtccttgaaccaatcccatatccacagtctgctcctgtgtggtgtcttagctgtgttattggagaattatgagcaggctgagatattttttgaggatgccacatgtctggagccaaccaatgtggtggcctggaccctacttggcctgtactacgaaatccagaacaatgatattcggatggaaatggcatttcacgaggcaagcaagcagctgcaggccagaatgctccaggcccaggttactaaacaaaaaagcacaggggtcgaggatacagaagaacgcggcaagcgcgagtcatcactggggccatgggggattaccaacggttccgccactgccatcaaggtggaagctcccgcgggacccggcgctgccctgagcatccttgataagtttctggaagagtcctccaagctacagtctgatagccaagaacccattctcaccacacagacgtgggacccctcaatctctcagaagccatccaacacattcatcaaggagattccaacgaaaaaagaagccagcaagtgccaggattcctccgctctactgcaccctggactccattacggtgttagccagacaactactatctttatggaaacaatccactttctgatgaaagtcaaggccgtccaatatgtgcacagagtcctcgcacacgaactgctgtgcccacaaggcggacctagttgtgaatactacttggtactagcacagactcacatcctgaaaaaaaatttcgccaaagctgaggagtatctgcagcaggcggctcagatggattatctgaaccccaatgtctgggggctcaaaggtcacctttactttctgtcagggaatcattccgaagcgaaggcctgttacgagcggactatttctttcgtcgtggacgcctcagagatgcattttatcttcctccgcctgggactgatctacctcgaagagaaagagtacgagaaggcaaaaaagacatatatgcaagcttgtaaacggtcacctagctgcttgacctggctcggcctcgggattgcctgttacaggctggaagaactgacagaagccgaagatgcgctcagcgaggcaaacgcgctgaataactacaatgccgaagtgtgggcgtacctagccctagtttgcctaaaggtcgggcgccaactggaggccgagcaagcctataaatacatgataaagttaaaacttaaagatgaggctctgctcgcagaaatccacaccctgcaagagaccgttggatttgggaacccctccttttag

SEQ ID NO: 51428 - DNA, 1758 bp, Artificial Sequence
  Description of Artificial Sequence: Synthetic coding sequence
atggagcaggtgcccagcgccggccggctggtgcagatcaccgtgacagaaggatacgacctaaagggattcaagggtgatacacccgtgactttcattcgcgcagagtttaaccaggtggtcctcggcgactccgcaaagattactgttagcccagaagggtccgccaagtacaacttcaccagctcttttgagttcaatccagagggtgggattacatctgatgacctggctcacaagccagtttttcttacggtgaccgaagtactgcctaaagagaagaaacagaaggaagaaaagaccctcatactggggcaggccgtggtcgacctactgccactcttagagggccagagttcctttcagactactgtccctctgcacccagtacaaggtagcccactagaaacccccagatcatcggcaaaacagtgttcccttgaggtcaaagtactcgttgcagaacctctcctgaccaccgctcagatctcaggggggaacttactgaaggtgaccctcgaggcggcctatagcgtgcccgaaagttttattcccaccggtcccggacagaattacatggtcggcctgcaggtaccttcactcggagagaaagattatccgatcctgttcaagaacggcacactgaagctgggaggagaaagagaacctgttcctaggccaaagaagtggccaatcgcaaacatactggcccctggcgccaataatattccggatgctttcatcgtcggtggtccatatgaagaagaggaaggggaactgaaccatcctgaggattccgagtttcgaaatcaagccgaatgcatcaaaaagaggatcatatgggatctcgagtctaggtgttatctagacccctccgccgtggtctcgttccaaaagagaattgctgactgcagactctggcctgtcgaaattacacgtgtgccattggtgacgattcctaaggggaaggccggaaaaaccgaaaagaccgatgaggaagcccaactgtcatttcatggtgtggcatacgtaaatatggtcccactcctgtatccaggcgtgaaacgcataagaggggcttttcatgtttatccctacctcgactccgtggtgcacgaaaaaaccaagtgtctgctgagtctcttcagggatatcgggcatcatctgatccataacaacaagatcggggggatcaattctctgctctccaaacaggcagtaagcaagaatctgaaagaggacaagccggttaaagagaaagatatcgatggaaggccgagaccgggggacgtgcaggccccttccattaagtctcagagcagcgatactcctctggaaggggagccacccttaagccacaatcctgaaggccagcagtacgtggaggccggtacatatattgtactggaaatccagctggataaggccttggttcccaagcgaatgccagaagagcttgcccgacgggttaaagagatgatcccacctagacctccattaacccgtcgtactggcggcgctcagaaggccatgtcggattatcacatccagattaagaacatctctagggccattctggacgagtactataggatgttcggcaagcaggtggccaagctggaatccgacatggattctgagactctcgaggagcaggcatataagtatatgattaagctcaaacttaaagatgaggctcttcttgcagagatccacacgttgcaggagactgtaggctttggcaaccctagtttttag

SEQ ID NO: 51429 - DNA, 360 bp, Artificial Sequence
  Description of Artificial Sequence: Synthetic coding sequence
atggagcaggtgcccagcgccggccggctggtgcagatcaccgtgactgaaggttatgatctgaaaggcttcaaaggggatacacctgtaacctttattagggctgagttcaatcaggtggtgctgggcgactcagccaagatcacagtgagtcccgagggctctgccaaatacaatttcacaagttccttcgagttcaatccagaggggggtataactagcgacgatctggcgcacaaacccgtgtttctgacagtgaccgaagtgttaccaaaagagaagaagcagaaggaagagaagacgcttattctgggacaggcggtagtggatctgctgccgctgctggagggacagagctag

SEQ ID NO: 51430 - DNA, 3276 bp, Artificial Sequence
  Description of Artificial Sequence: Synthetic coding sequence
atggagcaggtgcccagcgccggccggctggtgcagatcaccgtgactgaggggtacgatctgaaaggattcaaaggagacaccccggtgacatttataagggcagaattcaatcaggttgtgcttggggactcagcaaagattacagtgtctcctgaggggtcagcgaagtataactttacttcctcatttgaatttaatcccgagggaggcataacctccgatgatctggctcacaagccggtgtttcttactgttaccgaggtgctgcccaaagagaagaagcaaaaggaagaaaagaccctgatcctgggccaggcagttgttgatctcctacctctcctcgagggacaatcttcgttccagactactgtcccccttcaccctgtgcagggctcaccactcgaaactccgcggagctcggccaaacagtgcagtctcgaagtaaaggttctggttgccgagccgctgctcaccacagcccagatcagcggaggaaatctcctgaaggtcactctggaggcagcttatagcgtacctgaatctttcattccaaccggtcccgggcagaactacatggtgggtttgcaggtgccatcgctgggggagaaagactacccaatcctcttcaagaatggcaccttgaaactggggggggaacgagagccagtgccaaggccaaaaaagtggcctattgcgaatatcctggcaccgggggcaaacaatattccagacgcttttatcgtaggcggaccttacgaggaggaggagggagaactgaaccatcccgaggatagtgagtttagaaaccaggcggaatgcatcaaaaagcgcattatttgggatctggagagtcggtgctacttggatccctctgctgttgtgtcttttcagaaacggattgccgattgccggctatggccagtggaaatcacgcgcgtacctctcgtcacgattccgaagggaaaggctggtaagaccgaaaaaacggatgaggaggcccaattatcctttcacggagtggcctacgtcaacatggtgcccttattataccccggagtgaagcggatcagaggcgcattccatgtgtacccttatctggactccgtcgtgcacgagaagacaaaatgcctcctcagccttttccgtgacattgggcaccaccttatccataataacaagattggtggtattaattctctcctatctaagcaggctgtttctaaaaatctcaaagaagataagcctgtgaaagagaaggacatcgatggcagaccccggcccggcgatgtccaagccccatctatcaaatcacagtctagtgatacccctttagagggggaacctccgctatcacacaaccccgaaggtcagcagtatgtggaggctggcacttatatcgtcctggaaatacagctggacaaagctctcgtccctaagaggatgccagaggagctggccaggcgagtaaaggaaatgatcccgccgcgccctccattgacacgtcggactggaggtgcccagaaagctgtgtccgattaccacatacaaataaagaacatcagccgcgccattctcgatgaatactaccggatgttcggtaagcaggtggctaaactcgaaagcgatatggatagcgagacattagaggagcagaagtgccaattgtcttatgaacttaattgctccgggaagtacttcgccttcaaggagcagctcaagcacgccgttgtcaagatcgtgcgagataagtatctgaagactacttcattcgagtcacaggaggagctgcaaacattcattagtgaactgtacgtcttcctggtcgatcagatgcacgtagcgctgaatcagacgatgccagatgacgtgcagggcaccgtggcgaccatttacacctcctcagagcagttgcagctctttgccttcgaggccgaggtgaacgagaactttgagatggcggctgcttattataaagaacgccttgttagggaacctcagaatttggatcactggttagactacggagctttctgtctgctaacggaagataacattaaggcccaggaatgttttcagaaggcgctatccttgaaccagtcgcacatccattcactgctcctctgtggcgttctagccgttctattggagaactatgagcaggccgagatattcttcgaagacgcaacttgcctggaaccaacaaacgtcgtcgcctggacgctactcgggttatactacgagattcagaacaatgacatcagaatggaaatggcctttcacgaagccagcaaacagctacaagcacgtatgctgcaggcgcaagtcactaaacagaagagtacaggggtggaggataccgaggaacgcgggaagagggagagctcactcgggccgtggggcatcaccaacggatccgccacagctatcaaggtggaagccccagccggacccggcgctgcgttatcaatcctcgataaattcctggaagaaagcagtaagctgcagagcgactcccaggagcccattttgacgacacaaacctgggacccctccatcagccagaagccctctaacacttttattaaggagattccgaccaaaaaagaggcatccaaatgccaagatagttcggctttacttcatcccggcctgcactacggcgtctcccagaccaccaccatcttcatggaaacgatccactttctgatgaaggttaaagccgtccagtatgtgcaccgtgtcctggcacacgaactattgtgtccccagggcgggcccagctgtgaatactacctcgtgctggcacaaactcatattttaaagaaaaacttcgcgaaggctgaagaatacttacagcaagctgctcagatggattaccttaatccaaatgtttggggcctcaaaggacatttgtacttcctgtccggaaatcactcagaagcaaaagcctgctatgagcgcaccatcagcttcgtggttgacgcgagcgagatgcattttatattcctccggcttggactgatttacctcgaagagaaggagctggaggaactgacagaagccgaggacgccttaagcgaggccaacgccctgaacaactacaatgccgaagtctgggcctatcttgctctggtgtgccttaaggtaggaagacagctggaagcggaacaggcttacaagtatatgataaaactgaagcttaaagatgaggcactgcttgccgagatccacaccctgcaagagacggtaggttttggcaacccctccttttag

SEQ ID NO: 51431 - DNA, 3366 bp, Artificial Sequence
  Description of Artificial Sequence: Synthetic coding sequence
atggagcaggtgcccagcgccggccggctggtgcagatcaccgtgaccgaaggatatgaccttaaaggatttaaaggagacacacccgtgacattcatcagagcggagtttaaccaagttgtactgggggattcagcaaagattacagtatcccccgaaggtagtgccaagtacaattttactagctcatttgagttcaacccggagggtgggatcaccagcgacgacctggcccataaacccgtttttctgacagtgactgaagtgctccccaaagaaaagaaacagaaggaagagaaaactttaattctgggtcaggctgtggtcgaccttctcccactgcttgaagggcaatcttcctttcagacaacggtcccgctccatcccgtccagggcagtccactagagacgcctcggagctcagcaaagcagtgttctttagaagtgaaggtgctcgtcgccgaaccacttctgaccactgcccagatatcggggggcaatctgctaaaggtgacccttgaggcggcgtattcagtgcccgaaagcttcatccctacgggacccggccagaactacatggtgggcctgcaggtgccatcactcggcgaaaaggactatcccattctgttcaaaaatggaacactgaagctaggcggcgagagggagcctgtacctaggcctaaaaaatggcctatcgccaacatcctcgcccccggagcaaataatattccagacgcctttatcgtcggtggcccttatgaggaggaggagggagagctgaaccatcccgaggattcggagttccggaaccaggctgagtgtatcaaaaagcgcatcatatgggatctggaatctaggtgttatctggatcccagcgccgtggtgtcctttcagaaacgcatagcagattgcaggctctggcccgtcgagatcacccgggtgcccctggtcaccattccaaagggtaaggcgggaaagacagagaagactgacgaagaggcccagctcagctttcatggggtcgcttacgtcaacatggtgccactgctgtaccccggggtcaagaggattcgaggcgcgtttcacgtgtatccctacctagactccgtggtgcatgaaaaaaccaaatgcctgcttagcctcttccgtgatatcgggcaccatttaatccataataataagattggagggatcaattctctgctgagcaaacaggcggtttcaaaaaatttaaaggaagacaaaccagtgaaagaaaaagacatcgacgggagacctcggccgggtgacgtgcaggcccccagtattaaaagccagtcttcagacacccctcttgagggggaacctccactgtcacataaccccgaaggccagcagtatgtcgaggccggtacctatattgtgctcgaaatacagctagacaaggccctcgtgcccaaacgcatgcctgaagaactggcccgaagagttaaggagatgatcccgccacgcccccccttgactaggagaactggcggagcgcagaaagccgtcagcgactaccacatacagataaaaaacatttcgagggccattctagacgagtattatcggatgttcgggaaacaagtggccaagctcgaatccgatatggattcagaaacattggaggagcagaagtgccaactgtcctacgagctcaactgtagcgggaaatattttgcattcaaagaacaacttaaacatgccgtagttaagattgtccgcgataagtacctcaaaacaacaagttttgagtcccaggaggaacttcagacgtttatcagcgagctgtatgtgttcctggttgatcagatgcatgtagctttgaaccagacaatgcccgatgatgttcaaggcactgtggctacaatttatactagtagtgagcagctccaactctttgcctttgaggcagaggtcaacgagaacttcgaaatggcagctgcttattacaaagagcggctggtgagggaaccacagaatctggatcattggttggattacggtgccttctgtctcctaaccgaagacaacattaaggcccaggaatgtttccagaaagcgctcagccttaatcagtctcacatccatagcctgctcctgtgcggcgtcctcgctgtgttgttagaaaactatgagcaggctgagatattttttgaagacgcaacatgtctggagccaacgaatgttgtggcttggaccctattaggattgtattacgaaatacagaacaatgatatcagaatggagatggctttccatgaggcttccaagcagctgcaggcgcgcatgcttcaggctcaggtcaccaagcaaaagagcacaggtgtggaggatactgaagaacgagggaaaagggagagcagtctggggccatggggtatcactaacggtagtgctacagcaatcaaagtcgaggcaccagccgggcccggcgctgccctgtcaatcctggataagttccttgaggagagctccaagcttcagtcagacagtcaggaacctatcctaacaacacagacgtgggatccctcgatttcgcagaagcccagtaacacgttcataaaggaaattcccaccaagaaggaggcatccaaatgccaggatagcagcgccctccttcacccgggattgcactatggcgtgagtcaaaccacaactatatttatggaaacaatacactttctgatgaaggtgaaagcagtgcagtacgtgcatcgtgtcttagctcacgagctgctatgtccccaaggcggtccatcctgcgaatactacctggttctggcccagactcacatcctcaaaaagaacttcgcgaaagccgaagaatacttacaacaagctgctcaaatggattatctgaaccctaacgtctgggggctcaagggtcacctgtactttttgtccggaaatcactccgaggctaaagcctgctatgaacgcaccatcagcttcgtcgtggacgcttctgagatgcactttatcttcctccgcctagggcttatatacctagaggagaaagaatacgagaaagctaagaaaacttacatgcaagcctgcaagaggtccccctcttgccttacctggctgggcctgggaatcgcgtgttatcgactcgaggaactgacagaagctgaagatgctcttagtgaagctaacgccttgaacaattacaatgcagaagtttgggcgtacctcgctctggtgtgcctcaaagtgggaagacagctggaggctgagcaggcatacaagtatatgatcaaactcaagctgaaggacgaggctctcctggcagaaatccatacattacaagagaccgtggggttcgggaatccaagtttttag

SEQ ID NO: 51432 - DNA, 1497 bp, Artificial Sequence
  Description of Artificial Sequence: Synthetic coding sequence
caggaggagctgcagaccttcatcagcgagctgtacgtgttcctggttgatcagatgcatgtcgcattaaatcagacaatgcccgatgacgttcagggcaccgtcgctaccatttacacaagctctgagcagctgcagctattcgcctttgaggccgaagtgaacgagaattttgagatggccgccgcctactacaaggaacgactggtgagagagccacagaatctggaccactggttggactatggagcattctgcttactgaccgaggataatattaaagcacaggagtgtttccagaaagcactcagtctgaatcaatcccacatccactctttactgttgtgtggtgtgctcgccgtattattggagaattatgaacaggctgaaatcttcttcgaagacgctacctgcttagagcctacgaacgtcgtcgcatggacactgttaggcctatactatgaaatccagaacaatgacattcgaatggaaatggcattccacgaggctagcaagcagctccaagctcggatgttgcaagcgcaagtgacaaagcagaagagcacaggagtggaggataccgaggaacgcggtaagcgcgagtcatcattagggccatggggcatcaccaatggtagcgccacggccataaaggtcgaggctcctgctggcccgggagctgctttgtctatcttggacaagttcctggaggaaagctctaagctacagagcgattcacaggagccgatactgacaacacaaacctgggaccccagtatttcccagaaaccctctaacactttcattaaagagattcctaccaagaaggaggccagtaagtgtcaggacagtagcgcgttgctccatcctggcttgcattatggcgtttcccagaccactacaatctttatggagaccattcactttcttatgaaagtcaaggctgtgcagtacgtccacagagtgctcgcccacgaattgctatgtccccagggggggccatcctgcgagtattatctagtactagcacagacccacatcctgaaaaaaaacttcgcaaaggccgaagagtacttacagcaagcggcgcagatggattacctcaaccccaacgtatgggggttgaaggggcacctgtacttcctgagtggaaaccacagcgaagcgaaggcgtgctacgagcgaacaatctcatttgtcgtcgatgcctccgaaatgcacttcattttcttaagactgggcctgatttacctggaggaaaaagaactggaggagctgactgaggctgaggacgccctaagcgaggccaacgcgctgaataattataatgcggaggtgtgggcttatcttgccttagtgtgcctgaaagttggacgacaactcgaagctgagcaggcctacaagtacatgataaagctgaaactaaaggacgaggcactcctcgctgagatccacacacttcaggagacagttgggtttgggaacccatccttttag

SEQ ID NO: 51433 - DNA, 3966 bp, Artificial Sequence
  Description of Artificial Sequence: Synthetic coding sequence
atgagcagcaacgacagcagcctgatggccggcatcatctactactctcaggagaagtactttcatcatgttcagcaagccgcggcagttggcctcgagaagttttccaatgatcctgttctcaagttcttcaaagcctacggggtgcttaaagaagagcacatccaggatgctatcagcgacctcgagagcataaggcaccaccccgatgtgagtctctgtagcaccatggcgctgatctatgcgcacaagagatgtgaaattattgatagagaggccatccaggaactggaatactctctcaaggagatcagaaaaaccgtgtcgggcacagcgctgtactacgccggactgtttctgtggctcatcggcaggcatgataaggctaaagagtacatcgatcgaatgttgaagatatcacgggggttccgcgaagcctacgtgcttcgagggtgggtggacctaacatcagacaaacctcacactgccaagaaggccatagaatatttggagcagggcattcaggatactaaggatgtgctggggctcatgggaaaggctatgtatttcatgatgcaacagaattacagtgaggccctggaggtggtgaaccagataacggtgacctccggatcattccttccggcactagtgctgaaaatgcagcttttcctagccagacaagattgggagcagacggtcgaaatggggcatcgcatcctcgagaaagacgaaagcaatatcgacgcctgtcagatccttaccgttcacgagttggcccgcgagggaaacatgaccacggtgtcttccctgaaaacccagaaagccactaatcacgtccgcaatctgattaaagcactcgagacacgagaacctgagaacccttcccttcacttaaagaaaatcattgtcgtatcacgactctgcggctcacatcaggtaatattaggcctcgtgtgcagttttattgagcgcacttttatggctacacctagctatgttcacgtggcaaccgagctgggctatttgtttatccttaagaaccaggtcaaggaagcccttctgtggtattccgaagccatgaagctagataaggatgggatggctgggctgactggaatcatactgtgtcacatcctcgaaggacacttggaggaggctgaatatcggctggagtttcttaaggaagtgcaaaagagcctgggcaagagcgaagtgctcatctttctgcaagccctcctcatgtctaggaaacataaaggcgaagaagagacaactgcgcttttgaaggaggccgtagagctgcatttctcctctatgcagggcatacccctgggatccgagtacttcgaaaaattagacccttactttctggtttgtatagctaaagaatacctcctgttctgtcctaagcaacctcgcttacccggacagatcgtgagtccactcttgaagcaggttgcggtaatcctcaatccagttgttaaagcggctcctgcactcatcgacccgttgtacctgatggcccaagtgaggtactactcaggggagctggagaatgcacaatcaattttacagaggtgcctggaactggaccccgcaagcgtcgatgcccaccttcttatgtgtcaaatttacttggctcagggtaatttcggcatgtgcttccactgcttagagcttggcgtaagtcataattttcaggtacgggatcacccgctgtatcatctaataaaagccagagccctgaacaaggccggcgactacccagaagccatcaagacactgaaaatggtgatcaaactccccgccctgaaaaaggaggagggacgtaagtttctacggccgagcgttcagccctcccagcgagcatccattctcctggaactagtcgaggcactgcggctcaatggagagctgcatgaagcgacaaaagtcatgcaggatacaatcaatgaattcggcggaacacctgaagaaaaccgaataacgatcgccaacgtcgacctggtcctgtccaaagggaacgtagatgtagctctgaacatgttacggaacatcttgccaaaacagtcctgttacatggaggccagagaaaaaatggctaacatctacctgcaaactctccgggatcgccgtctatatatccggtgctacagggagctgtgtgaacacctgccggggcctcacacttctcttctattaggagatgcccttatgagcatcctggaaccagagaaagctctcgaggtgtatgatgaggcatatagacagaatcctcatgatgcatcactggcctctcgtattggacacgcctatgtgaaggctcaccagtatacagaggccattgagtactatgaagcagctcaaaagattaatggccaggactttctgtgttgcgacctcggaaagctattactgaaactcaagaaagtcaataaagccgagaaagtgcttaaacaggctctggagcatgacatcgtgcaggacatcccatccatgatgaacgatgtgaagtgcctgctgctcctggccaaagtgtataaaagccataagaaagaagcagtgattgaaaccttgaataaggccttagacctacagtcccgtatcctgaagcgggtgcctcttgaacaaccggaaatgatccctagccagaagcagttggcggcaagcatctgtattcaatttgccgaacactacctagcagagaaggagtacgacaaagccgtgcagtcatacaaagatgtcttctcttatctgcccaccgataacaaagtgatgctcgagctagcccaactttacctgctgcagggtcacctggatctgtgcgaacaacactgtgccatactgctgcagacagagcagaatcatgaaaccgcctctgtcctgatggcggacttgatgttccgcaagcagaagcacgaggctgcgattaatctgtaccaccaagtcctcgagaaagcacctgacaacttcctggttctgcacaaactgattgaccttctgaggaggagtgggaagctggaggatattccagcattcttcgagctggccaaaaaagtctcatcaagagtccccctggagcctggcttcaattactgtcgcggtatctattgttggcatatcggccagcccaatgaagcacttaagttcctgaataaagccagaaaggattcgacctggggacaatctgctatatatcacatggtgcagatatgcttaaaccccgacaacgaggtagtggggggagaagcctttgagaaccaaggagccgagagcaactatatggagaaaaaggaactggaacagcagggagtctctaccgcagagaagctcctgagggagttctatccccactcagactctagccagacacagctgagacttttgcaaggactatgtaggcttgccacccgggagaaagcgaatatggaggctgcactgggcagctttatccagatagctcaggccgaaaaggacagtgttcccgcactgcttgctctggcacaggcttatgtctttttgaagcagattcctaaggcccgaatgcagcttaaacgattggcaaaaactccttgggttttgtctgaagctgaggatctagaaaaaagttggctgctcctggccgatatctactgtcagggttctaagttcgatctagcactggaactactgcgaaggtgcgtccagtacaacaagagctgctataaggcatacgaatatatgggtttcattatggagaaagagcagagctataaggacgccgtgactaattacaaactagcttggaagtacagtcaccatgctaatcccgccatcgggttcaagctggcgttcaactatctcaaggataagaagttcgtggaggcgatagagatctgtaacgatgtgctgagagagcacccagactatccaaagatacgagaggagatactggaaaaagccaggcgatcactgaggccatag

SEQ ID NO: 51434 - DNA, 3912 bp, Artificial Sequence
  Description of Artificial Sequence: Synthetic coding sequence
atgagcagcaacgacagcagcctgatggccggcatcatctactactcgcaggaaaaatactttcatcacgttcagcaagccgcggcggtgggattggaaaaattctccaacgatccagttctgaagttcttcaaggcctacggggtcctgaaggaggagcatatccaggatgccattagcgacctcgagagtatcaggcaccatcctgacgtaagtctttgcagtacaatggccctgatctacgcacataaacgatgtgagattattgatcgtgaagcaatccaagagctggaatatagcctgaaagagattagaaagacggtgtcgggcactgctctgtactatgctgggctcttcttgtggttgattggtaggcatgacaaggcaaaagagtacatagatcggatgctgaaaatcagcagaggatttcgtgaggcttacgtgttgcggggatgggttgatctcacatctgacaagcctcacaccgccaaaaaggcaattgagtatctggaacagggtatccaggacacgaaagatgttttggggctgatggggaaggctatgtatttcatgatgcaacagaactactccgaggcactggaggtggtcaatcagattacggtaacttccggttcgtttttgcctgcacttgttctcaagatgcagctgtttttagcgcgccaggactgggagcaaactgtggaaatgggtcatcgtattttggagaaggacgaatccaacatcgacgcctgccagatccttacagtccacgagctggctagggaaggcaacatgacaaccgccactaaccatgtgcgcaatctgatcaaagcgcttgaaacaagggagccggaaaatccatccctgcatctgaagaagatcattgtagtgagccggctgtgcggcagccatcaagtaatcctgggtctggtatgttctttcattgagcggactttcatggctacaccatcttatgttcatgtggcaaccgaactcggatacttgttcatccttaaaaatcaagtaaaagaggcattactgtggtatagtgaagcaatgaaacttgacaaggacggcatggcgggcctgaccgggatcattctctgtcacatactggaaggtcacctcgaggaggtgcagaaatctcttggcaaatcagaggtcctgatttttttgcaggcattgctgatgagccgaaaacacaaaggtgaagaagagaccacggcacttctgaaagaggccgtagaactccacttcagctcaatgcagggcatcccactgggcagcgagtacttcgaaaaattagatccctatttcttagtctgtatcgccaaggagtacctgctgttttgcccgaaacagcccaggctgcctggtcagatcgtatcccctttattaaagcaggtcgccgtgatcctgaatcctgtagtcaaggcagcgcccgcactaatcgaccccctgtatctcatggcgcaggtgaggtactattccggggagctcgaaaatgcgcagtccattctacagcggtgtctggagctggaccctgcctcagtcgacgcacatttgcttatgtgccaaatataccttgcgcaaggaaattttggaatgtgtttccactgtctggagttgggcgtttctcacaatttccaggttcgggatcaccctctgtatcacctgattaaagcccgagctctcaataaagccggggattatccggaggcaattaagactcttaaaatggttattaaactgccagccctcaagaaggaggagggccggaaatttcttcggccttccgtacaaccctctcagcgagctagcatcttattagaactggtggaagcacttcgcctgaacggcgagctccacgaggcgacaaaagtgatgcaagacaccataaacgagttcggtggcacacctgaggagaaccgaattacaattgcaaatgtcgacttggtcctatctaagggtaacgtggacgtggcccttaatatgctgcgaaatattctgccgaagcagtcctgttacatggaagcccgcgagaagatggcaaatatctacctacagaccctccgggaccgacggctctatattaggtgttacagggagctttgcgagcacctccccggcccccacactagcctcctgctgggtgacgccctgatgtccatcctcgagccagagaaagcactggaggtatacgatgaggcctatcgtcaaaacccacatgacgcttccctggcctctcgcattggacacgcctacgtgaaggcccatcaatacactgaagcaatcgagtattatgaagctgcccagaagattaatggccaggacttcctgtgctgcgatctggggaagctgctcttgaagctcaagaaggtcaataaagccgaaaaagttttaaagcaggctctggaacacgacatagtgcaagacattcccagtatgatgaatgatgtgaagtgtctactgttgctcgctaaagtctacaaatcccacaagaaggaagccgtgattgagactcttaacaaggctctcgatctgcagtcccgcatcctgaagcgcgtccccctagagcagccagagatgatccccagccagaagcaactggcggctagcatatgtattcagttcgccgagcattatcttgcagagaaggagtatgataaagctgttcagtcctataaagacgtgttcagctacctgcctacagacaataaagttatgttggagctcgctcagctatatctgcttcagggacacctcgatctgtgtgagcagcactgcgccatacttctccagaccgagcagaaccacgagacagcttcagttctaatggctgatctaatgtttcgtaagcaaaaacacgaggctgccatcaacttgtaccaccaggtcctcgaaaaggcccccgacaatttcttagtcctgcataaactgatcgatcttctccgcaggtccggcaaattagaggatattcccgcattttttgaactggcgaaaaaagtgtctagcagggtgcccctggaacctgggttcaattattgccgtggtatatactgctggcatatcggccagccaaacgaggccctgaaattcctgaataaggcaaggaaagactctacgtggggccagtctgcaatctatcacatggtccagatttgtttaaatccagataacgaggtggtgggaggtgaggccttcgagaaccagggtgcggagtctaactacatggagaaaaaagagcttgaacagcagggtgtaagcactgcagaaaaactgctgagggaattttaccctcacagtgactcttcccaaacgcagcttcgcctgctacagggcttgtgtcgcctcgcaactagggagaaggccaatatggaggcagctctcggctcctttattcagatcgcccaggcagaaaaggactcagtgccagcgcttctggcccttgctcaggcttatgtgtttcttaaacagatcccaaaagccaggatgcagctgaaaaggcttgccaagaccccttgggtgctgagcgaagctgaagatctcgaaaagtcatggttgctgctggctgacatttactgtcaagggagcaaatttgatttggcactggagctcctgaggagatgtgtgcagtataacaaatcatgttacaaggcttacgagtacatgggttttatcatggaaaaggaacagtcttacaaggacgctgttacaaattacaaactcgcctggaagtacagccaccacgcaaatcctgcaattggctttaagctggctttcaattacttgaaagacaagaagtttgtcgaggccatcgagatctgcaatgacgttttgcgtgaacatcccgactaccctaaaattcgggaggaaattctggagaaggccagacgatcgcttcgcccctag

SEQ ID NO: 51435 - DNA, 3963 bp, Artificial Sequence
  Description of Artificial Sequence: Synthetic coding sequence
atgagcagcaacgacagcagcctgatggccggcatcatctactactcacaggaaaaatatttccaccatgtgcagcaggcagcggctgtggggttagaaaagttcagtaatgaccccgtattgaagttctttaaagcttacggcgtcctgaaggaggaacacattcaggacgccattagcgacctggaatctattaggcatcatcctgatgtaagcttatgcagtactatggccctcatttacgctcacaagcggtgcgagatcatcgacagggaggccattcaagagttggaatatagcttaaaagagattcgtaagactgtgtccgggacagccctgtactacgccgggctgtttctgtggcttatcggccgacacgataaggcaaaagagtatatagatcgaatgctgaaaatcagtcgtggatttagggaagcttacgtgctgcgtgggtgggtggacctgactagtgacaaaccccatactgccaaaaaagccatcgaatatctggaacaggggatacaggatactaaggacgtgcttggtctcatgggcaaggctatgtatttcatgatgcaacagaattactccgaagcattagaggtcgtgaaccagatcaccgttacctctggcagctttctcccagcccttgtcctgaagatgcagttgttccttgccaggcaagattgggagcagactgttgagatggggcatcggatactcgagaaagatgagagcaatatagatgcatgtcaaatcctgactgtgcacgagctcgcccgtgaaggtaatatgactactgtctcctccctaaagacccagaaagcaaccaaccacgttcggaacctaatcaaggcgctggagactagagagcctgagaatcccagtttacacctcaagaaaattatagtggtttccagattgtgtggaagtcaccaggttatccttggactggtctgcagtttcatcgagcgcacattcatggcgacaccctcatacgtccacgtagccacagagctaggctacctgtttatcctgaagaatcaagttaaggaagctctcttgtggtattcagaggctatgaaactcgataaggacggaatggcgggattaacgggaattatcctgtgtcatattctggaaggacacttagaagaggccgagtacaggctggagttcctgaaagaggtgcaaaaatctctcggcaaatccgaggtactcatattcctccaggctcttttgatgtcccgcaaacacaagggagaggaagagaccactgccctcttaaaggaggctgtggaattgcacttttcatccatgcagggtatcccactcggaagcgagtattttgagaaactcgacccctatttcctcgtgtgcatcgcaaaagaatacttactcttctgtccaaaacagcctaggctcccgggccagatcgtttcccctctgttgaaacaggtggcggtcattcttaatcccgtggtgaaggcagctcccgccctgatagacccactttacctaatggctcaggttcggtattactcagagctcgagaacgcccagtcaatcttacaacgctgtctggagctggatcccgccagcgtggatgcccatcttttgatgtgtcaaatctacctggcccagggtaacttcgggatgtgcttccattgtcttgagctgggcgtgagccacaacttccaggtaagggatcaccctttgtaccacctgatcaaggcccgggccttgaacaaagctggagactaccccgaggccatcaagacccttaagatggtgatcaaactcccggcccttaagaaagaagagggcaggaagtttcttcgccctagcgtgcagcccagtcaacgagctagcatccttctggagttggtagaagccctgagactgaatggggagctccacgaagctactaaagtcatgcaagacacaatcaatgaatttggaggcactcccgaggagaacagaattacgattgctaatgtcgatctagttctcagcaagggaaatgtggacgttgcgctgaacatgttgaggaatatcctgccgaagcagagctgttatatggaagcccgggaaaaaatggcaaatatatatctgcagactttgcgtgaccggaggctctatatccgatgttatcgagagctgtgtgaacaccttccgggaccacatacatctctgctcttgggagatgcactcatgagtatcttggagccagagaaggcgctggaggtttacgacgaggcatatagacagaatccccacgacgcatcactggcatccagaatcgggcacgcatacgtgaaggctcaccaatatacagaagccatagagtactacgaggctgcacagaagatcaacggacaggacttcctgtgctgcgaccttggcaaacttttgttaaaactcaaaaaggtaaacaaggcagagaaggtcctcaagcaggcactggagcacgacatagttcaagacattccaagcatgatgaatgatgtaaagtgcctgctgctgctagccaaagtctataagagtcacaaaaaagaggccgtaattgagacactcaataaggcgctggacctccagtccaggatcctgaagagagtgccgctggagcagccagagatgattccaagccagaagcagctggctgcttccatctgcattcagtttgctgaacactaccttgcggaaaaggaatacgacaaagctgtccagagctacaaggatgtgtttagttacctgcccacagacaataaagtgatgttggaactcgcacagctgtacttgctgcagggccacctggacttgtgtgaacagcactgtgccattctcctccaaactgaacaaaatcacgaaacggcttccgttctgatggcagaccttatgttccggaagcagaagcatgaggctgcaataaatttgtatcaccaagtgcttgagaaagctcccgacaattttctcgtactgcataagctgattgatttgctgcgacgaagcggaaagttggaagacatacccgctttcttcgaactggctaaaaaggtgagcagcagagttccactggagcctggttttaattattgtaggggaatttactgctggcacattggacagcctaatgaggccctcaagtttctcaacaaagcgaggaaggatagcacgtggggacagagcgcgatctaccacatggtacagatctgcttaaatcccgacaatgaagtggtaggcggagaggcatttgagaatcagggcgccgagtctaattacatggaaaagaaggagcttgaacagcagggtgtctcaacagccgaaaagctgttgcgggagttttatccccactccgattcatcgcagactcagctgcgactactgcaagggctgtgtaggctagcaacaagagagaaggcaaatatggaagccgctctgggctccttcatacagattgcccaggcagagaaagacagtgtccccgccctactggctcttgcccaggcttatgtgtttctcaaacagatcccaaaggcgcgcatgcaactgaagcgactggccaaaacaccttgggtcctttcggaggccgaggatctggaaaaatcatggctgctgctggcagatatttactgccagggctctaagtttgatctagcgctggaactgcttcggagatgcgtgcagtacaataaatcttgttataaagcttatgagtacatggggtttattatggagaaagagcaatcatataaggacgctgtgaccaattacaaattggcgtggaagtactctcatcacgctaaccctgccatcgggtttaaactggcatttaactacctgaaggacaagaaattcgtcgaagccattgaaatttgcaacgacgtgttacgggagcatcccgactaccctaaaattcgcgaagagatactcgagaaagcaagaaggtctctacgtccatag

SEQ ID NO: 51436 - DNA, 3819 bp, Artificial Sequence
  Description of Artificial Sequence: Synthetic coding sequence
atgagcagcaacgacagcagcctgatggccggcatcatctactactcacaggaaaagtacttccatcacgtacagcaggctgccgccgtggggctggaaaaattttcaaacgacccagtgttgaagttctttaaggcatatggggtcctgaaagaagaacacatccaggacgccattagcgacctggagtctattcgacatcacccggatgtcagtttgtgttcaacaatggcactgatctatgcccataagcgatgcgagatcatcgacagagaagcaattcaggagttagagtatagcctgaaggaaatcagaaagacggtcagtgggactgccctgtactatgccggcttattcctatggctgattggacgccacgacaaggctaaggagtatatcgacaggatgcttaagatatctagagggtttcgagaagctatgtacttcatgatgcagcagaactatagcgaagctctggaggtggtcaaccagataactgtgacaagtggctcgttcctgcctgctctagtgctgaagatgcagctgttccttgccaggcaagactgggaacagactgtggaaatgggacacaggatactggagaaagacgagagtaacatcgatgcatgccagattctcactgtgcacgagcttgccagagagggcaatatgacgaccgctacgaaccacgtcaggaatctgattaaagcgcttgagacccgcgagccagagaacccctcccttcatctcaaaaagatcatcgtggtgagccgattgtgcgggtctcaccaggtgatactgggactggtctgttcctttatagagaggaccttcatggctacccctagctacgtgcacgtggccaccgagctcggttaccttttcatcctgaagaatcaagttaaggaggccctattatggtactccgaagcaatgaagctggacaaggacgggatggcaggcctcaccggcatcattctgtgtcatattttggagggccacctggaggaagcggagtatcggcttgaattcttgaaggaggttcagaaaagcttgggcaagagcgaagttctgatttttctgcaggcactgctcatgtcacgcaagcataaaggcgaagaggagaccacagcgttactgaaggaagccgttgaactgcactttagctctatgcagggtattcctctggggtcagagtacttcgaaaagctcgatccctacttcctggtgtgtatcgcaaaggaatatctgctcttctgcccaaaacagcccagattgcccgggcagatcgtaagccctctcctgaagcaggtagccgtcatccttaatcctgttgtgaaggccgctcccgctctgattgatccactctatttgatggcccaagtacggtattactccggggagctggagaatgcacaatccattctgcagcgctgtctggaactggacccggcaagcgttgatgcccatctcctgatgtgtcagatctacctggctcaaggcaatttcggcatgtgtttccactgtctggaactgggcgtatcacataactttcaagtgcgagaccacccgttataccatctgattaaagctagagctctgaacaaggcaggtgactacccagaagccatcaagaccctgaaaatggtgatcaagctgcccgctctgaaaaaggaagagggcaggaagtttttgaggccttccgttcagccgagccagcgcgccagcatccttcttgagctagtcgaagcccttcgtctcaacggcgaactgcacgaagcaacaaaggtaatgcaggacaccatcaacgagtttggagggacccccgaggagaatcggattaccattgccaacgttgatctcgtgctctccaaggggaacgtcgatgtcgcacttaacatgcttagaaatatccttcccaaacagtcctgttacatggaagcccgggagaaaatggccaacatttacttgcagacgctcagggacaggagactctacataagatgctacagagagctttgcgaacacttacccggcccccatacgtctctgctgctgggggatgcgctcatgtcgattctggagccagaaaaggcacttgaggtttatgacgaggcttatcgacagaaccctcatgatgcctccttggcctctagaatcggccacgcatacgtgaaagcgcatcagtatacggaggctatcgaatattacgaggccgctcaaaagattaatggacaagacttcctctgttgcgacctgggtaagctgcttctcaagctcaagaaggtaaataaggccgaaaaggtccttaagcaggccctggaacacgatatcgtccaagatattcccagcatgatgaacgacgtgaagtgcctgcttctgttggcaaaagtatataaatcccataaaaaggaggcagtcatcgagacactgaacaaagcactcgacctacagtcacgcatattaaaacgcgtgccactcgagcaacccgagatgatccccagccagaaacagttggctgcaagcatctgcatccaattcgcagaacactacctagccgaaaaggagtatgacaaggccgtgcaatcttataaagatgttttttcatatttgcctactgataataaagttatgctggagctcgcccaattatatctgctgcagggacaccttgacctgtgcgagcagcattgtgcaatcctgctacagactgaacaaaatcacgagactgcttcagtgcttatggccgatttgatgttccgcaagcagaagcatgaagccgccataaacctttaccatcaagtcctcgagaaagctccggataacttcctggtgttgcacaagctgattgacctattgcggagatccggtaagctggaagacatccctgccttcttcgaattggcgaagaaagtttccagcagggttccactggagccaggctttaattattgccggggcatctactgctggcacatcggacaacctaacgaggcgctgaaattcctgaacaaggccagaaaagactccacgtggggtcaatccgctatctaccacatggtccagatttgcttgaatcctgacaatgaggtagtagggggcgaggccttcgagaaccagggagccgaatccaactacatggagaaaaaggaattggaacagcagggggtgagcacagcagaaaaactgcttcgtgagttttaccctcactcagactcctctcaaactcaactaagactgctacagggcctctgcaggcttgccacacgtgaaaaggcaaacatggaggcggctctgggctccttcatccagattgcacaggctgagaaagacagtgtgcccgcactcctggcattggcccaggcctacgtttttctgaagcagattcccaaagcaagaatgcaactgaagaggttggccaagactccgtgggtgctgtccgaagcagaggatctcgagaagagttggcttctcctggccgacatctattgtcagggctctaaattcgacctggccctggagttactgagacggtgcgtgcaatataacaaatcctgttataaggcctatgagtatatggggtttatcatggagaaggagcaatcatacaaagatgcagtcacaaactacaagttggcttggaagtacagccaccacgcaaatccagccattggttttaagctcgcattcaactacctgaaagacaagaagtttgttgaggctattgagatctgcaatgacgtgctgcgggaacatccggactaccccaaaattcgggaggaaatcctggaaaaggcgagacgcagcctccggccttag

SEQ ID NO: 51437 - DNA, 1119 bp, Artificial Sequence
  Description of Artificial Sequence: Synthetic coding sequence
atggccgagctggaggccgtggccgacgacctggacgccctgatcgatgacctcgactatctccctggccacttccatctagagatgcagttaaattttgaacctagaagcccagccccacagcgcgcaagagacctgaagctgcagagagagggcctccgacaggaactccagctggccgccgccccacaaagaccggctgtgcgccacctgctcggagccttcgcattttatctcgaagaactggacgaggcacgcgagtgttttctcgaggtcgcacatgagcacccgggtaatctcaacgcatgggctaatttggcccatgtttacggaaggttggggcaggaggaggaagaagaggcgtgcgcagcgagattagccgatctgatggggctggcagaggagcccgaggctgcgggcgatccccagcttcgcgctgcccgatgtctggctgagcaggggtacgcccacggttttgatgtgggctgcgcatccccagaagagagagccagaggcctcgctgcaggaattgcactttacgacaaggcattgggttacgggcagcaaatcccaatggaggagaaacgtggatggtatttcacaatggcaacgttatacatacgactcgacggtatttttctcgaacttggttcggaggagcaaaaacggcttcccgcatttaacaggaccctggctttgctcaggcaggttctgaaaagcgaggacccccgtcaccgtgctcttgcatggtgttacctgggaatgctgctcgagcgtaaagatacctttagcaccacgcctatgggtgtgcacgattgcggctactccgggaccgacccactcgattgttttggtaaggctattgaaattgccaagaaccagccccccatactcaatcggctggctaaaattttctacttcctgggaaagcaggatatggccattggcacctgtaacatggccctggacgtgctcagggatccggagctgaactggcaagcctactgcacccgggccaagcggcggggcctgactatgctaccacgtcttgtgtctaacagctgggcacaggcggtgctgccccctagacctccaaaggtgttggagtttcaggtgtag

SEQ ID NO: 51438 - DNA, 1710 bp, Artificial Sequence
  Description of Artificial Sequence: Synthetic coding sequence
atggccgagctggaggccgtggccgacgacctggacgccctgatcgacgacctcgattatctgccaggacacttccatcttgagatgcagttaaatttcgagcctaggtctcccgcaccccagcgtgcgcgagacctgaaactgcagagagaaggtttgcgtcaggaacttcagctggctgcagcacctcaaaggcctgctgttagacacctgcttggagctttcgctttctatttggaagaactagacgaagctagggaatgctttttggaggtggcacatgagcaccctggaaacctcaacgcttgggccaacttggcacacgtgtacggaaggctaggccaggaggaagaggaggaggcttgtgcagccaggctggctgatttaatggggctggccgaggagcctgaggctgcaggtgacccacaactgagggctgcacgctgtctggctgagcagggatacgcacatggctttgacgtgggctgcgctagccccgaagaacgcgcccgggggctagctgccggcattgcgctgtacgacaaagcactgggctatgggcagcagatccccatggaggaaaaacgcggatggtactttacaatggcaacattatacatccggcttgatggcatttttttagagcttggctcagaagaacagaaaaggctgccagccttcaaccgaacactcgcccttcttcggcaagtactgaagtcagaggaccctcgccatcgtgccctggcgtggtgctacctggggatgctactagagcgcaaagataccttttccactacccctatgggcgtacatgactgtggttactccggaaccgacccgctcgattgctttggaaaagcaattgagatcgccaaaaatcagccccctatcctgaatcgcctcgccaagattttttatttcttgggaaaacaagatatggccatcggcacatgcaacatggcacttgatgttctgcgagaccccgagctcaattggcaggcttattgcaccagagccaagatccatatccgggcgtatcttcacgacctcaagagagccaaaatgggtctgggagggatgccggatagaaaccatctggcctgtgcgaaggctgatctcgaagaggtggtgcgagtgtgccccggattcaaggcctatttagacattggtcaggtgtattactatatgggagtggatgctgtgcaggagctccttgccgtggatgaagccgctttgaatcaggctctggtcttcttggctaaggcaggggagagtgaactcggcgctacgctgccggagctgcaattgctgaggggcaagtgcttgcgcattaagggggaggacgccaatgctgcggcatgtttcaaaagggcagtcgaacttgacgacgcggggtcatcccacaccgacgggttcggctgcttactggaagcgctgctggcacagtggtcacaggcccagctgagtgatggtgaactgggtagagaggttgatgcctggcttcgccgagcgcaagacaaatacccagctgccaggctgcgtcaggaactccagagagtttggaggggccatactgacgaggttctgggacttgctcgcgcactggtagcgcaaggaagacccgctctggttagacttctgttcgagacaatggagagagaaggggagggtgccagcgcacctagagacagacgcgctgtctctttttag

SEQ ID NO: 51439 - DNA, 1344 bp, Artificial Sequence
  Description of Artificial Sequence: Synthetic coding sequence
atgcaggagagccaggagacccacatcagcaaccacctggacgaggtggttgctgccgtctcaataacccacaggaagaaatttcaaaacaaattgttgcagactgcattattccaacccccccgggagaagctgcacctctgtgaggaaaaagctaaaagctatagcaatagccatgaatataaacaggcggtacacgaacttgtgcgttgtgttgctctcactcggatttgctacggcgactcccattggaaacttgcagaggcccatgtgaatttagcacagggctatctgcagcttaaaggcttgtctctccaggccaagcagcacgctgagaaggcccgccagatacttgcgaactccatagtgcctccttactccgaaaataccgacgttttcaagttttcaatcgagctcttccacaccatgggacgtgccctgctgtcactgcagaaatttaaggaggctgctgagaatttgacaaaagcagagaggttatccaaggagctgctccagtgtgggaggatcataaaggaggaatggattgaaattgaggcacggattagactgagctttgctcaggtgtaccagggacaaaaaaaaagcaaggaagccctgtcccactatcaagccgccctagagtacgtcgagatatccaaaggcgaaacttctcgcgaatgtgtgccaattctgcgagagttggccggcgtggagcaggctctgggcctgcacgacgtttctataaatcacttcttgcaagcacatctaataatcctcagccggagcccatctcaggtcgaggccgctgacagcgcccacatcgtagcgcacgctgcagtcgcgagcgggaggcatgagcaccatgacgtggccgaacagtacttccaagagtctatggcacatttaaaggactccgaggggatgggtcgcaccaaattccttagcatccaagatgaattctgccatttcctacagatgactggccagaaggaaagagctacctcaattttaagagaatctctagaagccaaggtcgaagcctttggtgacttttcaccagaggtcgcagagacatatcgactgctggggggagcagatttggcacagggaaatcactcaggcgctcggaaaaagctcaaaaaatgtcttcaaattcaaaccctgctctatggaccccaggacaagcgtactctggcaacccaacaagctatgggtatgctgagtacagccccaaaggttgcgtccaagccacgccaggcatctaaagccaaagtggcattctgcacaagcatcccccaagacactctattgggcaaggcccgccctggtacaaccgctgactag

SEQ ID NO: 51440 - DNA, 1182 bp, Artificial Sequence
  Description of Artificial Sequence: Synthetic coding sequence
atgcaggagagccaggagacccacatcagcaaccacctggacgaggttgttgcggctgtcagcatcacacatagaaaaaaatttcagaataagctgttgcaaacagcgctgtttcagccacccagagaaaagctgcacttgtgtgaagagaaagcgaaatcatactcgaacagccatgagtacaaacaggctgtacacgagctcgtgagatgtgtggccttaactaggatctgctacggggactctcattggaaattagccgaagcacatgtgaatcttgcccagggctaccttcagttgaaaggactctcacttcaagctaaacagcatgctgagaaagcgcgacaaattcttgctaactccatagtgcctccctatagcgaaaacacagatgttttcaaattctccatagaacttttccatactatgggacgagccctcctatctctgcagaagtttaaggaggccgcagagaatctaaccaaggccgagcggctgtctaaggagttgctgcagtgtggtagaatcataaaggaagaatggattgagatcgaagcccggatcaggctttcgttcgcacaagtgtaccagggtcagaagaagagtaaagaagccctttcacactaccaggctgctctggaatacgtcgagatttccaaaggcgagacatccagggagtgtgtccccatactacgtgagctagccggcgtggaacaggccctgggtctgcacgacgtttcgatcaaccactttctccaagcccatttgatcattctaagccggtcaccctctcaggtcgaagctgccgactccgctcatatcgtagcgcatgcagctgttgcctcaggcaggcatgagcaccacgatgtggccgaacagtattttcaggagagcatggctcatcttaaagattctgaggggatgggaagaactaagttcctatccattcaagatgaattttgccactttctccagatgacaggccaaaaggagcgcgccacaagcatcctgcgagaatcccttgaagccaaggtcgaagccttcggagacttctccccggaagtagccgagacttataggctgctaggcggagcagacttagctcagggtaatcacagcggcgcccggaagaagctgaagaagggagatctgagctttctgttgtccgccaccctgccctag

SEQ ID NO: 51441 - DNA, 1344 bp, Artificial Sequence
  Description of Artificial Sequence: Synthetic coding sequence
atgcaggagagccaggagacccacatcagcaaccacctggacgaggtagttgcggccgtgtctatcacacatcggaagaagttccaaaataaattgttacaaacagctctgttccagcccccgagagagaaactgcacctatgtgaagaaaaggccaaatcatattctaattctcacgaatacaagcaggctgtccacgaattagtgcgctgtgttgccttaacacgaatttgctatggggattcccattggaagctcgccgaggctcacgtcaatctggctcaaggttatctgcagttaaaaggcctgagcctccaggccaagcagcacgccgagaaggcgcgccaaattctcgcaaactccatcgtaccaccatactcagaaaatacagacgtgtttaagttctccattgagttatttcacactatggggcgggccttattaagcttgcagaaattcaaagaggcagcagagaatcttactaaggctgaaagactttccaaagaactactgcaatgtggtcgtatcattaaagaagaatggatcgaaatagaggctagaattagactcagctttgcacaggtataccaaggccaaaagaagagcaaggaagccttgagccactaccaagccgcactggagtatgtcgagatttctaaaggcgagacaagtagagagtgtgttccaatccttcgggaactggctggagtagaacaggctttgggactacatgatgtctccatcaatcacttcctacaagctcatttgatcatccttagcagaagcccatctcaggtagaggctgctgactccgctcacattgtcgcgcacgccgcagtggccagtgggcgacatgagcatcacgacgttgccgagcaatatttccaagagtctatggcccacttgaaggactctgaggggatgggcaggaccaaattcctgagcattcaggacgagttttgccacttcctgcaaatgaccggccagaaagagcgtgccactagcatcctgagagaatcactggaggcaaaagttgaggctttcggcgacttctcaccagaagtggctgagacttaccgtcttctcgggggagcagacctagcgcagggaaaccattcaggggcgagaaagaaattaaaaaaatgcctgcagattcagacactcctgtacggccctcaggacaagcgcacacttgccacccagcaggcaatggggatgctgtctaccgcacccaaggtggcatccaagcctcgacaggcgagcaaagcaaaagtggccttttgtaccagtataccccaggacaccttgttgggcaaagccaggccagggacaactgctgactag

SEQ ID NO: 51442 - DNA, 1344 bp, Artificial Sequence
  Description of Artificial Sequence: Synthetic coding sequence
atgcaggagagccaggagacccacatcagcaaccacctggacgaggtggtggccgccgtgtcaataacgcaccgtaaaaagtttcagaataagctgttgcagacggccctctttcaacccccacgtgagaagctccatctctgtgaggaaaaggctaagagttactcaaactcacatgagtataaacaggccgtccacgagctggtgcggtgcgtggcactgacacgtatctgctacggggacagccattggaagttagcagaggcccacgtgaatctcgcccaaggttacctacagctgaaggggctctcgctccaagcaaagcagcacgctgaaaaggctagacagatcctggcaaacagcattgttcccccatacagcgagaacacagatgttttcaaattctccatagagttgttccacaccatgggtcgcgcgttactcagcctccaaaagttcaaggaggcggccgagaatctcacgaaggctgagagactctccaaagaattgcttcagtgtgggagaattatcaaagaagagtggatcgaaatagaggcccgcatacgactctcattcgcgcaggtgtaccaggggcaaaagaagagtaaagaagctttgagtcattatcaagccgcgctagaatatgtggaaatctccaagggcgagaccagccgcgagtgcgtccctatattaagggagttagccggagtggagcaggccctgggccttcacgacgtgagcattaaccacttcctgcaggcacacctcattatactgagcagatcaccaagccaggtggaggccgccgactccgcccacattgtggcacacgccgcagtcgcatccggacgacatgagcaccacgatgtggccgaacaatatttccaggaaagtatggcccatctcaaggattccgagggtatgggaagaacaaaatttttatcgattcaggacgaattttgtcatttcttacagatgaccgggcaaaaagagcgcgcaaccagcatcctcagagagagtctggaggccaaagtggaggcattcggcgatttctctcccgaggtggctgagacttaccgtcttttggggggagccgacctcgctcagggaaaccacagtggggcccgcaagaagctgaaaaagtgtcttcagatccagacacttctgtacggcccccaggacaagcgaaccctggccacgcagcaggccatgggaatgctgagcaccgcgccaaaggtggcttcgaagccaaggcaggctagcaaagccaaggttgctttttgtacatcaatacctcaggacaccttactgggaaaagccagacccggaacaacagcggattag

SEQ ID NO: 51443 - DNA, 1344 bp, Artificial Sequence
  Description of Artificial Sequence: Synthetic coding sequence
atgcaggagagccaggagacccacatcagcaaccacctggacgaggttgtggccgctgtgtcaatcacacaccggaagaagtttcagaacaaactactccagaccgctcttttccagccacctagggaaaaactgcatctgtgtgaggaaaaagctaaaagttatagcaactcacatgaatataagcaggccgttcacgagctcgttcgctgcgtggcgctgactagaatatgctacggagattcccactggaagctagccgaggcacatgtgaatcttgctcagggatatctgcaattgaagggattaagcttgcaggccaagcagcatgccgagaaagcaagacagatccttgcaaatagcattgtgccgccttactccgagaacacagatgtgtttaaattcagcatcgagctcttccatacaatggggcgtgccttgctgtcactgcagaaattcaaagaggctgcagagaatcttaccaaggctgagaggttgagcaaagaactcctccagtgcgggcgaattattaaggaggagtggattgagattgaagcacgtattcgcctatcatttgcacaggtgtatcagggtcagaaaaagtccaaggaggccttgagccattatcaagctgcacttgagtatgtggaaataagcaaaggggagacatctcgagagtgtgtccccattctgcgggaactcgccggagtggagcaagctctgggcctgcacgacgtatccattaaccacttcctacaagcccacctcatcattctttcccgatcccctagccaggtggaggcggccgacagtgcacatattgtggcccacgcagcagtagcctcaggccgccacgagcatcacgatgttgccgaacaatacttccaggagtccatggcccacctcaaggatagcgagggaatgggtagaacgaaatttctgtccattcaggacgaattctgtcatttcttacaaatgaccggtcagaaggagagagctaccagtattctgcgggagagcttagaggctaaggtggaagcttttggagacttttctcctgaggtcgccgagacatatagactgctgggcggcgctgatctcgcacaagggaaccattccggagccagaaagaaactgaaaaagtgcctgcaaatccagactctgttatacggtcctcaggataagcgaaccctggccacacaacaggcaatgggaatgctgtccaccgctccgaaagttgcatctaaacccaggcaggctagcaaagccaaggtggccttctgtacttccatccctcaggacacacttctcgggaaggcacgaccaggcaccacggccgactag

SEQ ID NO: 51444 - DNA, 171 bp, Artificial Sequence
  Description of Artificial Sequence: Synthetic coding sequence
atgcaggagagccaggagacccacatcagcaaccacctggacgaggtggttgcagccgtcagcattacacatcggaagaaattccaaaataagcttctgcagacagctctgttccagcctccacgggagaagctacacttatgcgaggagaaggcaaagtcatacagctag

SEQ ID NO: 51445 - DNA, 1344 bp, Artificial Sequence
  Description of Artificial Sequence: Synthetic coding sequence
atgcaggagagccaggagacccacatcagcaaccacctggacgaggtggtggctgctgtttccataactcacagaaagaagttccaaaacaaactgctgcaaaccgccctatttcagccgcccagggaaaagttgcatttatgtgaagaaaaagccaagtcttactcaaactcacacgaatataagcaggctgtgcacgagttggtgcgctgcgtggccctgacccgaatctgttacggggactcccactggaagttggccgaggcacacgtcaatttggctcagggctacctgcagttgaagggcttaagcctgcaggccaagcagcacgctgaaaaggctagacagattttagctaattctattgttcctccctatagcgagaacactgacgtgtttaagttcagtatcgaattgtttcacacgatggggagagccctgctatctttacaaaagttcaaggaggctgcagaaaatctgaccaaagctgagagactctccaaagagctgctgcaatgtggcaggattatcaaagaagaatggattgagattgaggcaagaatccgcctctctttcgcccaagtgtaccaaggccagaaaaagtcaaaggaggccctctcgcactatcaggcggccctagaatacgtcgagataagcaaaggggaaactagcagggagtgtgtaccaatcttgcgagagctggctggagttgaacaggctcttggactccatgatgtgtcaatcaaccatttcctccaagctcatctgattattctctctaggagcccttcacaggtagaggcagccgattcggcccacatagtcgcccacgcagctgtagccagcggcagacatgagcatcacgatgtggccgaacagtattttcaggagagcatggcccacctgaaggattccgaaggaatgggccggacaaagttcctgagtattcaggatgaattctgtcatttcttacagatgaccgggcagaaggaaagagcaaccagcatactgagggaatccttggaagctaaggtcgaggcatttggagacttctctcccgaggtcgccgaaacttatcggcttctggggggcgccgacctggcccaggggaatcactcaggagcccgaaagaaactcaaaaaatgcctccagatccagacgctactctacgggcctcaagataaacgcacactggccactcagcaagcaatgggcatgctgtccaccgcccctaaagtggcctccaagcccagacaggcttctaaggcgaaagtcgctttttgtacaagcatcccccaggatacattactcggaaaagcccgaccgggaacaactgccgactag

SEQ ID NO: 51446 - DNA, 1344 bp, Artificial Sequence
  Description of Artificial Sequence: Synthetic coding sequence
atgcaggagagccaggagacccacatcagcaaccacctggacgaggtggtggcagccgtttcaattacccacaggaaaaaattccagaacaagttgctgcagaccgccttatttcagcccccaagagagaaactccacttatgtgaggagaaagctaaaagttattctaactcccacgagtacaagcaggctgtgcatgaactggtccgctgcgtggcgctcacaaggatctgctacggtgacagccattggaagttggccgaagctcacgtcaatctggcccaaggatacttgcagctcaagggtctgtcactgcaagccaaacagcacgccgagaaagcccgtcagattctggccaattccattgtgcctccttacagtgaaaataccgatgtgttcaagttctcaatagagctgttccatactatggggagagctctgctgagtttgcagaaatttaaggaagccgccgagaacttaaccaaagccgaacggctgagtaaggaactgctgcagtgtggcagaatcattaaagaggaatggatcgagatagaggcaagaataaggcttagtttcgctcaggtgtaccaaggacagaagaaatctaaggaagccctgagccactaccaggctgctctggagtatgtcgaaatctctaaaggcgaaacctctcgagaatgcgtgccaatccttagggagttggcaggagtggagcaagcgctaggattgcatgatgtcagtattaaccattttctgcaggcgcacctgattatcctgtctcgatctcccagtcaggtggaggctgccgatagtgcacacatcgtagcccacgcggccgtagcttccggacgacatgaacaccatgatgtggcagagcagtatttccaggaatccatggcgcacctcaaagatagtgaaggaatgggaaggactaagttcttgagtatccaggatgaattttgccatttccttcagatgaccggccaaaaggagcgggccaccagtatactgcgggagtccttagaagctaaagtggaagccttcggtgatttctccccggaggtggccgagacctaccgcttactcggtggagctgacctcgctcaggggaaccactctggtgctcgaaagaagctgaagaaatgtctgcagatacaaactctcctgtacgggccacaggacaaaaggacactcgcaactcagcaagctatgggtatgctttcaaccgcacccaaagttgccagcaaaccccgccaagccagtaaggctaaggtcgccttctgtacttctattcctcaggataccctgcttggaaaggcccggcccggaaccaccgctgattag

SEQ ID NO: 51447 - DNA, 162 bp, Artificial Sequence
  Description of Artificial Sequence: Synthetic coding sequence
atgcaggagagccaggagacccacatcagcaaccacctggacgaggtagtcgcggccgtgtctattacacaccgcaagaagttccagaataaactgctgcaaacagcgctatttcagccgcctagagagaagctccacctctgcgaagaaaaggccaagtag

SEQ ID NO: 51448 - DNA, 456 bp, Artificial Sequence
  Description of Artificial Sequence: Synthetic coding sequence
atgcaggagagccaggagacccacatcagcaaccacctggacgaggtggttgctgcagttagcatcactcaccggaagaaatttcagaacaaattgttacagaccgccctgttccaacctccaagggaaaagctccacttatgtgaggaaaaggccaagtcctactcaaactcgcatgagtataagcaggcggtgcatgagctggtgagatgcgtagcactgacaagaatctgttatggcgactctcactggaagctcgcagaagcacatgtcaatttggcccaaggctatcttcaactgaaaggtctcagcctacaggctaagcagcatgctgagaaagcacggcaaatcttagccaactccattgtgccgccctatagcgagaatacggacgttttcaaatttagtattgagttattccataccatgggtcgcgccctgctgtccctgcagtag

SEQ ID NO: 51449 - DNA, 252 bp, Artificial Sequence
  Description of Artificial Sequence: Synthetic coding sequence
atgcaggagagccaggagacccacatcagcaaccacctggacgaggtggttgccgccgtgtccattacccacaggaagaaatttcagaataagctgctgcagactgccctgtttcagcccccgagagagaagctgcacctgtgtgaagaaaaagccaagtcatacagtaactcacacgagtacaagcaagccgtccacgaattggtcagatgtgtagcactgacccggatctgctacggggattcacactag

SEQ ID NO: 51450 - DNA, 348 bp, Artificial Sequence
  Description of Artificial Sequence: Synthetic coding sequence
atgcaggagagccaggagacccacatcagcaaccacctggacgaggtcgttgcagccgtcagcatcacccaccgcaagaagtttcagaacaagctgctgcaaaccgctcttttccagccacctagagagaaattacacctttgtgaggagaaggccaaaagctactcgaactcccacgagtacaagcaggcagtccatgaattggtgaggtgcgtggcccttaccaggatctgctacggagacagccattggaaactcgcagaggcacacgtaaatttagcgcaggggtatttgcaactaaagggtctgtccctgcaggcaaagcagcatgctgagaaggccaggtag

SEQ ID NO: 51451 - DNA, 474 bp, Artificial Sequence
  Description of Artificial Sequence: Synthetic coding sequence
atgcaggagagccaggagacccacatcagcaaccacctggacgaggtggtggctgcagtgagcatcactcacagaaaaaagtttcagaataagctactccagaccgcactgtttcaaccgcccagggagaaacttcatctctgcgaagagaaagccaagagctactccaacagtcacgaatacaagcaggctgtgcatgagctggttcggtgcgtcgccctgactcgcatttgctacggagactcccattggaagctagccgaggcccacgtgaatctggctcaggggtatcttcagttgaaggggttgtccctacaggccaagcagcacgctgagaaagctagacagattcttgccaatagcatcgtacctccctactccgagaacacagatgtgttcaagttcagcatagagctgttccacacaatgggccgagcactcctatctctgcaaaagttcaaagaagcagcttag

SEQ ID NO: 51452 - DNA, 1344 bp, Artificial Sequence
  Description of Artificial Sequence: Synthetic coding sequence
atgcaggagagccaggagacccacatcagcaaccacctggacgaggtggttgcagccgtgagcatcacacaccggaagaagtttcagaacaagctcttacagactgccctcttccaaccacctcgcgaaaagctacacctttgtgaagagaaggcaaagtcctatagcaactcccatgaatacaaacaggccgtccatgaactggtacggtgtgtggctctgactcgaatctgttatggggactcccattggaaactggctgaggctcacgtgaatctagcgcagggatacttgcagctcaagggtctttctctgcaggccaagcagcacgcggagaaggcgcgccagattctggctaacagcatcgtgcccccatattcggaaaatacagacgtcttcaagttcagcatcgaactctttcacaccatggggcgcgccttactgagcttgcagaaattcaaagaggctgctgagaacttaacaaaagcagagcgcctgagcaaagaattactgcagtgcgggaggatcattaaagaggagtggatcgaaatcgaagcgagaatccgtctaagctttgcacaggtgtatcaaggacagaagaagtcaaaggaggccctgtcgcactatcaggcagccctggaatatgtggagatatccaagggcgaaacgagccgggaatgtgtgcctatccttagagaactggccggcgttgaacaggcgctcgggctgcatgatgtgtccatcaatcactttcttcaggctcacttgataattctctctcgttcaccaagccaggtggaagctgcggatagtgctcacatcgtcgcgcacgcggccgtggcatctgggcgccatgagcaccatgacgtggcggagcaatacttccaggaatctatggcacaccttaaggattctgagggtatgggcaggacaaaattcctgtctatacaagacgagttttgccacttcctgcagatgaccgggcagaaagagcgggccacctcaatactgagagaaagcctcgaagccaaagtggaagccttcggcgatttctcccccgaggtggctgaaacctatcgactccttgggggggccgatctggcgcagggcaaccacagtggtgccagaaaaaagctgaagaagtgccttcagatacagactctcctgtatgggccccaggacaaaaggacattagccactcagcaggccatggggatgttgtccaccgcccctaaggtggcgagtaaacctagacaggccagcaaggcaaaagtggccttttgcacaagcatcccacaggacaccctcttaggaaaggctcgcccaggcacgacagccgactag

SEQ ID NO: 51453 - DNA, 1344 bp, Artificial Sequence
  Description of Artificial Sequence: Synthetic coding sequence
atgcaggagagccaggagacccacatcagcaaccacctggacgaggttgttgcggccgtgagtatcacccacaggaagaagttccagaacaagctgcttcaaactgcactgttccagccccccagagagaaactacacctgtgtgaggagaaagccaagtcctacagcaactcgcacgaatacaaacaggctgttcatgagctcgtgcggtgcgttgcattaacaaggatctgctacggtgattctcactggaagctggccgaggctcatgtgaacctagctcaggggtacctacagttgaaagggctgtcactgcaggccaagcagcacgctgagaaagcccggcagatcttagctaatagcatagttcccccttacagtgagaacaccgacgtcttcaagttctccattgagctgtttcatactatgggccgcgctcttttgtcccttcagaaatttaaagaggcagccgaaaacctgacaaaagcggagagactgagcaaggagctgctgcagtgcgggcgcattatcaaagaagaatggatcgaaatagaagcccgaattagactgtccttcgctcaggtctaccagggtcagaagaagtccaaagaggccctttcccactatcaggccgctctggagtatgtcgaaatttctaagggggagacgagccgggagtgtgttccaatactcagggagctggctggggtagaacaggcccttggtctccatgatgttagtatcaaccacttcttacaagcgcaccttattatattgtcaagaagcccatcacaagttgaagctgcagatagcgcccacatcgttgctcacgccgccgttgcaagtggtaggcacgaacatcatgacgtcgcagaacagtactttcaggaatcgatggcccatctgaaggattcggaaggcatggggcgaacaaaattcctcagcatacaagatgagttttgtcattttttgcaaatgactggtcagaaagaacgggccaccagtattttacgcgagtcacttgaggctaaagttgaagccttcggtgatttctcgccggaagtggctgagacttatcgactgctaggcggggctgatcttgcccagggaaatcactcaggggcgaggaaaaagttaaaaaagtgcctacagattcagacactgctctatggaccccaggacaagagaaccctcgctacacagcaggccatgggtatgctgtctactgcccccaaagtggcctctaaaccaagacaggcttcaaaggccaaggttgcattctgcaccagtattcctcaggacacactgctggggaaggccaggcctggaactactgcagattag

SEQ ID NO: 51454 - DNA, 1344 bp, Artificial Sequence
  Description of Artificial Sequence: Synthetic coding sequence
atgcaggagagccaggagacccacatcagcaaccacctggacgaggtcgtggcagcggtgagtattacccatcgcaaaaagttccagaacaaattgctgcagacagccctgttccagcccccaagggagaaactccacctttgcgaggaaaaggctaaatcatatagcaactctcacgagtacaaacaggctgtgcacgaactggtgcgttgcgtggcactcacccgaatatgctatggtgattcgcattggaagcttgcggaagctcatgtgaaccttgctcagggctacctgcagctgaagggcctctctttgcaggcgaaacagcacgccgagaaggcaagacagattcttgcgaattcgatcgtgccgccatacagcgagaataccgatgtgttcaagttttctatcgagctgtttcatactatgggaagagcgctcttgagcctacaaaaattcaaggaggccgccgaaaatttgacgaaagccgaacggcttagcaaggagcttttgcagtgcggtcgcattatcaaggaggagtggatcgaaatcgaagcgcgtattcgcctaagctttgcccaggtctatcaaggtcaaaagaaaagtaaggaagccctcagtcactatcaggctgctctggagtatgttgagatttcaaagggcgagacgtcacgcgaatgtgttcccattctgagggagctggctggggtggagcaagctttgggccttcacgacgtgtctattaaccacttcctgcaggcacatctgataattttatctcggtccccatcacaggtcgaagcagccgactccgcccacattgtcgcccatgccgcagtggcatctgggagacatgaacaccacgacgtggctgaacagtattttcaagagagcatggcacatttgaaagactccgagggtatgggacggacaaagttcctgagtatacaggatgaattctgtcattttctgcagatgactggccaaaaagagcgtgcaacctcgatcttacgtgagagtctggaagccaaagtcgaggcctttggagatttttcccccgaggtggccgaaacttatcggttgcttggaggcgctgacctggctcagggtaatcatagtggcgcacggaagaagctgaagaagtgcctccagatccaaacccttctgtacgggcctcaggacaaaaggacgctagcaacacaacaggctatggggatgctgagcacagcgcccaaggtcgcatcgaaaccaaggcaggctagcaaggcaaaggtggcattctgcactagcatacctcaggatacacttctgggcaaggccaggccagggacaaccgccgattag

SEQ ID NO: 51455 - DNA, 1344 bp, Artificial Sequence
  Description of Artificial Sequence: Synthetic coding sequence
atgcaggagagccaggagacccacatcagcaaccacctggacgaggtagtggctgctgtttcaatcactcaccgtaaaaagttccagaataagttgctgcagaccgccctttttcagcctcccagagaaaaacttcacttgtgtgaggagaaggccaaatcttattccaactcgcacgaatataagcaagcggtgcacgaattggtccggtgcgtggctctaactagaatctgttacggagacagccattggaaacttgcggaggcccatgtcaatctcgcacagggctatctgcaattaaagggcttgtccctgcaggctaagcagcatgctgaaaaagcacgtcagatcctagccaactccattgtccctccctattccgagaacacagatgtgttcaaattctctatcgagctttttcacaccatgggccgtgccctgctgagcctgcagaaatttaaggaagccgctgaaaatctgaccaaggccgagcggttgagcaaggagctgctgcaatgtggccgaatcattaaggaggaatggatcgaaatagaggcacggatccgtctaagctttgcccaggtatatcagggacaaaagaaatcgaaagaggcactgtcccattaccaggccgccctggagtacgttgagatcagtaagggtgaaacctcccgggagtgcgtgccgatcctgcgtgagcttgccggggtggaacaggctttagggctgcacgacgtgagcattaaccacttccttcaggctcacctgattattctgagtaggtcaccctctcaagtagaggccgcagactccgcacacatagtggcacatgcagctgtggcttccggccgtcatgagcaccatgatgtggccgagcagtatttccaggaaagtatggctcatctcaaggatagtgaaggaatgggtcgaaccaaattcctgagcatacaggatgagttttgtcacttcctccaaatgactggacagaaggagagggcgaccagcattctgagggagtcacttgaggctaaggtcgaagctttcggtgactttagccccgaagtcgccgaaacgtaccgcctactgggcggagcagacctagcgcaaggcaatcatagcggcgcaagaaagaaactgaagaagtgtctgcagattcagacactcttgtacggaccccaggataaaaggacgctcgccactcagcaggctatggggatgcttagcacagcccctaaggtggcctccaagcctagacaggcgagtaaagctaaagtggcgttttgtacgtcaattccacaggacaccctcttagggaaagcacgacctgggactacagcagattag

SEQ ID NO: 51456 - DNA, 1086 bp, Artificial Sequence
  Description of Artificial Sequence: Synthetic coding sequence
atgcaggccagccccatccggatccccaccgtgagcaacgacatcgattgggacttctgtttccatatgtcgcagcagacagagattccagcccaccagcagacagacgagctctatccaacaggcggatgcggggagtccgaagaagagaccaaggccaaggagaaagaaaaggcgatagactgtatgtctcaccccaaggaaaagctcgcccagtcccagaagaaagttgcccagctcataaaggaaaagatgaatacacaggctaataaggaactaataagatgtgtcatactatctaggataatctttggcgatcaccactggaaatgtgcacgggccctggccaatctcgcctacggctacctgaccctgcgcggcctccctgtccaggcaaagaagcacgctacatcagctaaaaacacgttgcttacatggaaggctaacaccacgagcaataaggagaaagaggagatcctggaagccttggtcaaactctactacacgctgggggttgcctggctacttcaaaatcgggggcgggaagcttatttcaatctgcagaaggccgagaggaacatgaaggaacttaaggaattgtataaaggcggcgtgtgtgagctccaagtcagtgagaacgacctgacgctggctctagggagagcttccctggcaatacatagactgaatctcgctttagcatactttgaaaaggcaatcggcgatgtaattgccgctaaaggcgaccggacttccgatctgatctcactttatgaagaagccgcccagatcgaacagctccgcaggaaccacaaccaagcaatccagtacctgcagcaggctcatagcgtgtgcgtttcactcttcaccgaggtgagtcctaagactgccgagatgtccgcacttctggccaaggcctatgccatgtctggtgaggcccaacaccgggatgccgtggagatatactttattcgctctatcaacgcctatcgggcaacactgggctctgaagacttcgagactctctcaaccacagaagaattctgcaagtggttggtgcagaacggggagaagcaggataaatag

SEQ ID NO: 51457 - DNA, 1086 bp, Artificial Sequence
  Description of Artificial Sequence: Synthetic coding sequence
atgcaggccagccccatccggatccccaccgtgagcaacgacatcgattgggatttctgtttccatatgtctcagcagacagaaattccagcacaccagcagaccgatgagctgtatccgactggcggatgcggcgagtcagaagaagaaacaaaagctaaagaaaaggaaaaggcaatcgattgcatgagccaccccaaagagaagcttgcccagtcacagaaaaaagtggcacagctgattaaggagaagatgaacactcaagccaataaggagctgattcggtgtgtgatactatccaggatcatttttggtgaccatcactggaaatgtgcccgggctctcgcgaacctggcctacggatatctcactttgcgcgggctgccagtgcaagccaaaaaacacgcaacctccgctaaaaatacattgcttacctggaaggcaaacaccacatcaaacaaggagaaggaagaaatattggaagccctcgtgaagctctattatacattaggggtggcctggctgctgcagaatagatgtcgagaagcctactttaacctacagaaagccgagaggaatatgaaagagctgaaggagctgtacaaaggtggcgtgtgcgaactgcaagtatccgaaaacgatctgacccttgcacttgggcgagcttcattggccattcaccggctgaacctggccttagcatattttgagaaagctataggagacgttatcgctgccaagggagaccgcacatccgacctgatatccttgtatgaggaggccgcccaaatcgaacaactgaggcgaaatcacaatcaggccatccagtatttacaacaggcacattcagtgtgtgtgtcccttttcacagaagtctcccctaagacagcagaaatgtctgcactcctcgccaaggcttacgcaatgtcgggagaggcacaacaccgggacgccgtggagatttattttatccgatctattaacgcctacagggcaacacttgggtcggaagattttgaaactctgagtacgaccgaagaattctgcaagtggctcgttcagaatggcgaaaagcaggatagatag

SEQ ID NO: 51458 - DNA, 1068 bp, Artificial Sequence
  Description of Artificial Sequence: Synthetic coding sequence
tgaagcaccgagcggcggctgctgggccacctgtacaacgacctggggctgggatacagccagctccaactcttccctctggctgtcgaggcattcttgcaagccctcccgctgtgttgggtgccaggagagcaggcaaccgtactgcgaaacctggggatggctcacaacgctctcggtaactaccaggaagcccgagaattccatcaaaaagcagctgatctgcacggctctgtgggccagcgctgggagcaaggacgctcatttgggtcattagccttcgctctttcccagctcggcgaccacaaggctgctcgtgataactatctgcacgctctgcaggctgcccgcgattcaggcgatatgaagggccagtggcaagcttgcgagggcctgggtgcagccgctgccagattgggacagtacgaccaggcgctcaagtattacaaggaggccctggcccaatgccaaaaggagccggattccgtgcgagagcggctcgtagcaaaactggcagatacggtccgaacgcggctcgcgcaagtcggactggttcagacccatactctgactagcgctccaggaagattacaggcacctgggggggcgtctcaggcagaaggaacacctgccaaggcggggagctcaaccgccggagttcagcaccggtcttcgtcgggatgggaagatgaagagttcgaggagggacaccagaagaaaaaggaggagcgttccgcaaatgtgccagtgcgagcaggtcctggaagacctgaattgtgttttctaccaggaactgttaatcacagccaccatttggcttccagctgtccaacttttacaaagcacactccttgtagagggaccgttctcgggaaagccagcatctattctcccggcccacgtgcacatttgccatttgtgggtccagggccaccacgggccgaataccccagcatcttagtgccaaatggcccccaagcaaacagaagttcccgctggcctagagaatcactctctcgaagcagacagagacgacccatggagagcggaatatgtacgatcgtgtag

SEQ ID NO: 51459 - DNA, 1749 bp, Artificial Sequence
  Description of Artificial Sequence: Synthetic coding sequence
atgagcagccccaaccccgaggacgtgccccggcggcccgagcccgagccatctagttcaaataaaaaaaagaagaagcgcaagtggctcagacaagaggcgtcgattcaggccctcactagagcaggccacggtgccctgcaggccggccagaatcacgaagccttaaataactttcaacgagcattcctcctggcttcaaaggctccacaaacaagagatacacctgtgttgcaggcctgcgccttcaatcttggcgccgcctacgtggaaacaggtgacccagctaggggtcttgagctgctgctgcgcgcccaccccgaagagaaagcccagggaaggcggcacggcgatcagtgctttaatgtggctctggcctatcacgccctcggtgagctgccccaggctttggcttggtaccatcgggcactgggccactaccaaccccagggagatcagggcgaagcctgggccaaaatgggggcctgttaccaggcactgggacagcctgagctggcagctcactgcctccaggaagcgagccaggcttatgcccaggaacggcagctgcgcgctgccgccctcgctctgggcgccgccgcaggatgtatgctcaagtccggccgccatcgagtcggagaagttgtccaggtactggagaaatcccgccgactagccgagcggtcgaccgaacggaggctgttaggacatctttacaatgacctcggcctggggtactcacaattgcagctgttccctcttgctgtggaggcttttctgcaagccttgcccctgtgctgggttccaggcgagcaggccacagttctgagaaacttgggcatggcccataacgcactggggaactatcaggaagcacgagaatttcaccaaaaggctgcagacctgcacggctccgtggggcagcgatgggagcagggaagaagctttgggagtctggccttcgctttgagtcaactaggcgaccacaaagcagctcgcgacaactatctgcacgccctccaggccgctagagattccggggacatgaagggacagtggcaggcctgtgagggcctaggtgcagcagctgcgcgcctgggacagtatgatcaagccctaaaatactacaaggaggccctggcccaatgtcaaaaggagcccgactcagtccgagaacggctggtcgctaagctggctgacaccgtccgcaccagactggcacaagtgggattagtccaaacccacacactgacatctgctcctggtagattgcaggctcccggcggtgcttcccaagctgagggaacgcctgccaaggccggtagcagtactgccggagtgcagcatcggtcttccagtggatgggaagacgaagagtttgaggagggacatcaaaaaaagaaggaggaaaggtctgccaacgtgccggtcagggctggccccgggcggcccgagctttgtttcctgccagggaccgttaatcacagtcatcacctggcttcttcttgtccgacatttacaaagcatactccgtgtagaggaaccgttctgggaaaggcgagtatctactcaccagggccaagagcacacctgccatttgtcggccccggccctcctagagcagaatacccctctattcttgtgccgaatggtccgcaggctaatcgaagcagccgctggccgagggagtcactcagtcgtagccggcagcgccgtccaatggagagcgggatctgtacaattgtgtag

SEQ ID NO: 51460 - DNA, 1749 bp, Artificial Sequence
  Description of Artificial Sequence: Synthetic coding sequence
atgagcagccccaaccccgaggacgtgccccggcggcccgagcccgaaccttcttcctccaataaaaagaagaaaaagaggaaatggcttaggcaggaagcgtccatacaggcccttacacgtgctggacacggagcactgcaggcgggacagaaccacgaggcactgaacaacttccagcgggcctttcttctcgctagtaaggcacctcaaaccagggataccccagttttgcaggcttgtgccttcaacctaggcgccgcttacgtggaaaccggcgatcccgcacgcggactggagctgttgctgagggcgcatcctgaggaaaaagcacaaggcagacgccatggagatcaatgtttcaatgtcgctctggcctatcatgcattgggggaactgccccaagctctggcctggtatcaccgcgccctcggtcactaccagccgcagggggaccagggcgaggcgtgggcgaaaatgggagcatgttaccaggccttgggccaaccagaattagcagcacactgccttcaagaggcctcgcaggcatatgcgcaggaacggcagctccgcgctgccgccttagccttgggagccgctgccggctgcatgctgaaatccggtaggcatcgggtcggtgaagtggtacaggtccttgagaagtcccgaaggttagccgagcgctctacagagcgtagattactgggccacttatacaatgatctaggtctcggatatagtcagctgcaattatttcccctggccgtggaagcttttctacaggccctgcccctctgttgggtgccaggcgagcaagctacagtgttacggaatcttgggatggctcataacgccctaggaaactatcaggaggcacgtgagttccaccagaaggcggctgacctccacggttccgtgggacagagatgggaacagggacgtagtttcgggtctctggcctttgccctaagccagctgggggatcataaagccgccagggataattacctacacgcactgcaagcagcacgggactccggcgacatgaaaggtcaatggcaggcctgtgaggggctgggagcagccgccgccagactgggccagtatgaccaggcattgaagtattacaaggaggccctggcacagtgtcagaaggaacctgactccgtacgggagcgcctcgtcgcaaagctggccgatactgtgagaacccgcctggcccaagtgggactggttcagacccatacgctgaccagcgctccgggacgtttacaggctcccggcggcgctagccaggctgaagggacccccgccaaggctgggagttccacagccggtgtacaacatcggagtagttctggatgggaggacgaggaatttgaagagggccaccaaaagaaaaaagaagaaagatctgccaacgtccctgtcagggcgggaccaggcaggcctgaactctgtttcctcccagggacagtgaaccactcacaccacctcgcctcatcatgcccaacattcactaagcatacgccctgtaggggaacggtgttagggaaggcgtcgatctattctcctggtcctcgggctcatctcccatttgtgggtcccggaccaccccgcgccgagtatccatccatcttagttcctaacgggccgcaggccaatcggagcagcagatggcccagggaatccctctctagatctcgccagaggcgccccatggagagtgggatctgcacaatagtttag

SEQ ID NO: 51461 - DNA, 552 bp, Artificial Sequence
  Description of Artificial Sequence: Synthetic coding sequence
tgacacctgtacaacgacctgggcctgggctacagccagctgcagctttttcctcttgccgtggaggcctttctccaggcactacccctgtgctgggtccctggcgagcaagccactgttctgcgaaacctaggaatggcccacaacgccttgggcaattaccaagaggccagagaatttcatcagaaggctgccgatctgcatggttctgttggtcagaggtgggaacaggggcggagctttgggtcgctagctttcgcgctgtctcaactcggagatcacaaggccgcacgagacaactacctgcacgcgctacaggcagcccgtgactctggcgcccggttttgtgctcggaccgccggggggcaggccggaaggcaccgagaagacgcccttggcccaggtggtgcaggaccggactcccacccggatttcggatccggaaagacacccggatctagatggggtcagcccgggggcggtgatcctagcaagggtcgcaaacagcattcacgttgtccagcacagatctttcagtgggttggaaggtag

SEQ ID NO: 51462 - DNA, 2019 bp, Artificial Sequence
  Description of Artificial Sequence: Synthetic coding sequence
atgagcgaccccgagggcgagaccctgcggagcaccttccccagctacatggccgagggggagaggctgtacctatgcggagaattcagtaaggctgcccagagcttttcgaatgcgctgtatctccaagatggggacaagaattgcttggtggcgcgctctaagtgctttctcaagatgggagaccttgaaaggtcactaaaagacgccgaggccagcctgcaaagcgatcccgccttttgcaagggcatcttgcagaaagccgagactctctataccatgggcgatttcgagtttgcactcgttttctatcaccggggatataagctgcgccctgatcgtgagtttagggttggaatacagaaggcgcaggaagccatcaacaattcagttggtagccctagctctataaaactggagaataaaggagatctgtcttttctctctaagcaggcggaaaatataaaggctcagcagaagccccagccaatgaagcatttactgcacccaacaaaaggcgagcctaaatggaaggccagtctcaagagtgaaaaaacagtcagacagctgcttggggagctttacgtagataaggaatatctggaaaaactgttactagatgaagatttgatcaaggggacaatgaagggaggattgactgtcgaagacctgataatgaccggcataaactatcttgatactcatagtaatttctggagacaacagaagcctatctatgctcgagaaagggatcggaaactgatgcaggagaagtggctccgcgaccacaagcggcgcccctctcagactgcccactacatcttaaaatccctcgaggatatagatatgttgctgacttccgggagtgctgagggttctttgcagaaggccgaaaaggtcctgaaaaaggtgctggagtggaataaggaggaggttccgaacaaggatgaactcgttggcaatctctattcgtgtataggaaacgcgcaaattgagcttgggcagatggaggccgccctccagagtcaccgcaaggacctggaaatcgccaaggagtacgatttgccagacgctaagagtagggcgttggataacattggtagagtattcgctagggtggggaaattccaacaagctattgatacgtgggaagaaaagatcccactggccaaaacaaccctggaaaaaacgtggctgttccacgagatcggccgatgttacttggagctcgatcaagcttggcaggctcagaactacggcgaaaagagccagcagtgtgccgaggaggaaggagacatagagtggcagctcaatgctagtgtgctggtggcacaagctcaggtcaagctgcgcgacttcgaatctgcagtgaacaactttgagaaggcactcgagagagccaaattagttcataacaacgaggcccaacaggcgattatatcagcactggatgacgccaataaaggcattattagggagctgagaaagactaactacgtggagaacttgaaggagaaatcagagggcgaagctagcctctacgaggacaggattatcactcgggaaaaggatatgcgacgcgttagagacgagcccgaaaaagtggtcaagcaatgggaccacagcgaggatgaaaaagagactgacgaagatgacgaggcatttggggaggcactgcagtctccagcttccgggaaacagtctgtcgaggcaggaaaggcccgaagcgaccttggggccgtcgcaaagggcttgtcgggtgaactaggtactaggtctggggaaactggtcgaaagctcttggaggccggtcgacgagagagccgagagatttacaggcgcccttcaggggaacttgaacagaggttaagtggtgagttctcgcgccaggagccggaggagttaaagaaattgtcagaggtcggacgtcgggagcctgaagagttaggtaagactcagtttggcgaaataggcgagaccaagaagactggaaatgaaatggagaaggaatacgaatag

SEQ ID NO: 51463 - DNA, 1464 bp, Artificial Sequence
  Description of Artificial Sequence: Synthetic coding sequence
atgatgctgagccgggccaagcccgccgtgggccggggcgtgcagcacaccgataagcgaaagaaaaagggacgaaaaatcccaaagctggaagagctcctcagcaaacgagacttcactggcgctattaccctcctcgaattcaaacgacacgtcggggaagaagaggaggacacaaacttgtggattggttactgcgcgttccacctgggtgattataaacgagctctcgaggaatacgagaatgccaccaaagaggaaaactgtaatagcgaagtttgggtgaatctcgcgtgtacatacttttttctgggtatgtataagcaggccgaagccgcgggcttcaaggcgagcaaatcacgcctacagaaccgcctcctgtttcacctggctcataagttcaatgatgaaaaaaagctcatgtccttccaccagaacctgcaggatgttactgaggatcagctgtctttggctagtattcattacatgcgatctcactatcaagaggctattgatatttataaacgcatactcctagacaatcgggagtatctcgctcttaacgtttacgtggctctgtgctactacaaattggactactacgacgtgagccaagaggtgctcgccgtatatcttcagcagattcccgatagcaccatcgccctgaacctaaaagcgtgcaaccattttcgcctgtacaatgggagagccgctgaggcagaacttaagtccctcatggacaatgcatcaagttcattcgaattcgctaaagagctgattcggcacaatctcgttgtgtttcgaggcggcgaaggtgccttgcaggtgctccctccgctggttgatgttatccctgaagcacgcctcaatctcgtgatttattacctgagacaggacgatgtccaagaggcctataatctgatcaaagacctggagcccacaacaccacaggagtacatcttgaaaggcgttgtcaatgctgcacttggccaggaaatgggaagcagagaccatatgaagatcgcgcagcagtttttccagctcgtgggcggttctgcatctgagtgcgacactatacccggccgccagtgcatggcttcctgtttttttctgctcaagcagtttgacgatgttttaatatatctgaatagcttcaaatcctacttttacaatgacgacattttcaacttcaactatgctcaggcaaaggccgctacaggcaacacgtctgagggcgaggaggcattcttgctgattcagtccgagaaaatgaagaatgactatatttacctgagttggctcgcaagatgttatattatgaataagaagccccgcctggcctgggaactgtatctgaaaatggagacttctggagagagcttctctctgcttcaattaatcgctaatgactgttataaacgtgacccatccagaagcgctcccttcaccgagaagcaccggtag

SEQ ID NO: 51464 - DNA, 1665 bp, Artificial Sequence
  Description of Artificial Sequence: Synthetic coding sequence
atgatgctgagccgggccaagcccgccgtgggccggggcgtgcagcatacggataagaggaagaaaaaaggcaggaaaatccccaagcttgaggagcttctgtccaagcgcgacttcacaggggctattactttactcgagtttaagcgacacgtgggggaggaggaggaggacacaaatctctggatcggctattgcgcatttcatttaggggactataagcgggccctcgaagagtacgagaacgccactaaagaggaaaattgcaatagtgaagtttgggtaaatctggcttgcacctatttcttccttggcatgtacaagcaggcagaagctgccggatttaaagcgtccaagagcaggctgcaaaaccgacttctgtttcacctcgcacacaagttcaatgatgagaagaagcttatgtccttccaccaaaaccttcaggatgtgactgaggaccagcttagtttggcttctatccattacatgcgttcccattaccaagaggctatcgacatctacaaacggattttgctggacaaccgcgaatacctggcactgaacgtgtacgtcgcgctctgttactacaaactggactattatgatgtgtcccaggaggtactagctgtgtatctacagcaaattcccgactcaaccatagcgttaaatcttaaggcttgtaaccattttagattatacaatggcagggccgccgaggccgaactgaagagccttatggataatgcaagctcctcatttgaattcgcaaaagaactgattagacataatcttgttgtctttagaggaggcgaaggcgcacttcaggttctgccaccactcgtggacgtcatcccagaggccaggctcaatctcgtaatttattacctgcgccaggacgacgtacaggaagcctacaatctcatcaaggatcttgaacccacaactccacaggaatacattctgaagggcgttgtcaacgcagcactgggccaggagatgggtagcagagatcacatgaagatcgcacagcaattttttcagttagtgggggggtccgcctccgagtgtgacacaattccaggccgccagtgtatggcttcgtgctttttcctgctgaagcagttcgacgacgtactgatatacttgaatagctttaagtcttacttttacaatgatgatattttcaacttcaactacgcacaggccaaagccgccaccggcaatacctctgagggtgaagaggcatttctgttaattcagtctgagaagatgaagaatgattacatttaccttagctggctcgcacggtgctacataatgaacaagaagccacgcctggcctgggaattgtacctgaagatggagacctccggggagtcattcagtttgctccagctcatcgctaatgactgctataaaatgggccagttttattacagtgcaaaggcttttgatgtacttgagaggcttgatccaaaccctgagtactgggaggggaaaagaggcgcctgcgtgggcatttttcagatgataattgccggccgcgaacctaaggagaccctgcgcgaagtgctgcacctcctaaggtcaaccggtaacacccaggttgaatacatgatccgtatcatgaagaagtgggcaaaggagaatcgggttagcatatag

SEQ ID NO: 51465 - DNA, 1572 bp, Artificial Sequence
  Description of Artificial Sequence: Synthetic coding sequence
atgatgctgagccgggccaagcccgccgtgggccggggcgtgcagcacaccgacaagagaaagaagaaagggagaaagatcccaaagctcgaggaacttttgagcaaaagggactttacgggagccataacactgttggaagagtacgagaacgcaacaaaggaggaaaactgcaattcagaagtgtgggtgaacctcgcatgcacatattttttcctcggcatgtataagcaggccgaggctgctggatttaaagcaagtaaatccaggctgcagaatcggctgttatttcatctggcacacaaatttaatgatgagaaaaaattgatgtctttccatcagaaccttcaagacgttacagaggaccaactctctctggcttccatccattatatgcggtcacattaccaggaggccatcgatatttacaaacggattctactggataacagagagtacctagccttgaacgtgtatgttgctctgtgttactacaaattagattactatgacgttagccaagaagtcctggccgtgtatttgcagcagattcccgactccactattgccctgaacctcaaggcctgtaaccactttaggctgtataacggcagagccgctgaggcggagcttaaatcactcatggacaatgcaagttcttcgttcgaatttgcgaaagaactgatccggcataatctagtagtgtttcggggaggcgagggcgctttgcaagtgctcccccctctggtggacgttataccagaggcaaggctgaatctggttatttactacctcagacaggatgacgtacaggaggcttacaatctgataaaagatttggaacccactaccccccaagaatatatcctgaagggtgtcgttaacgccgcactgggacaggaaatgggctctcgggatcacatgaaaattgcacagcaattctttcagctggtgggaggctcagccagtgaatgtgatacaataccagggcgccagtgtatggcctcctgcttctttttacttaagcagttcgacgatgtgctcatctacctgaacagcttcaaaagctacttttacaacgacgacatatttaacttcaattacgcccaagctaaggctgctactgggaatacaagcgagggggaagaggctttcctactaatacaaagcgagaagatgaagaacgactacatttatttgtcctggttggcccgctgttacatcatgaacaagaagcctagactagcctgggaattgtatttaaaaatggagacctctggagagtccttctcactgctccagttgatcgctaacgactgttataagatgggacaattctactactcagctaaagcctttgacgtactcgaacggctcgacccaaaccccgaatattgggaaggaaaaaggggtgcctgcgttggcatattccagatgatcattgccggaagagagccgaaagaaaccttaagggaggtgctccatttactgaggtccacgggcaacacacaggtggagtacatgatccgtatcatgaagaaatgggctaaggagaatcgcgtgtcaatttag

SEQ ID NO: 51466 - DNA, 2532 bp, Artificial Sequence
  Description of Artificial Sequence: Synthetic coding sequence
atgtggacccccgagctggccatcctgcggggcttccccaccgaggccgagcgacagcagtggaaacaggaaggagtcgtaggatcagaatccggctcatttttacaactcttgctggaggggaactacgaagcgatatttttgaatagcatgactcaaaacatcttcaattccacgaccacagctgaggagaaaatcgattcctatttggaaaagcaggtggtcacttttctcgattattccaccgatctggatacaactgaaaggcaacagctgatatttctgctgggggtgtcttctctgcagctcttcgtgcagtctaactggacgggacctcctgttgatctacaccctcaggacttcctctcctcagtgctatttcagcagttctcagaagtgaagggacttgacgctttcgtgctaagcctcctgacactggatggggagtccatatacagcctcactagtaagcccattctgctgctactggctcgtattatcctggttaacgtccgccataagctgaccgctattcagtccttgccctggtggactctgaggtgcgtcaatattcatcagcacctgctggaggagcggagccctctactgttcacgttagcagagaactgtatcgaccaggtgatgaagcttcaaaatcttttcgttgacgactctgggagatatttggccattcagttccacctggaatgcgcgtatgtgtttctctactactacgaataccgcaaagcaaaggaccagctggatattgccaaggatatctcacagctgcagattgatctcaccggagcactgggaaagagaacacgtttccaagaaaactacgtagctcagctcatcctggacgttagacgagaaggcgatgtcctctccaactgtgagttcacacccgcacccaccccccaggagcaccttacaaagaatctggagctcaatgacgacactatcctgaatgatatcaaacttgctgactgcgagcaattccagatgcctgatctttgcgccgaggaaatcgccatcatccttggtatttgcactaatttccaaaagaataatcccgtacacacactgaccgaagtcgaactgcttgccttcacttcctgtctattgtcccagcctaagttctgggccatccagaccagtgccctcattctgcggacgaagttggagaagggcagtacccgtcgcgtggagcgggcaatgcgtcagacccaggcactggcagaccagttcgaggataaaacaacctcggtgctggaacgcctgaagatcttttactgctgccaggtgcccccacactgggcaattcagagacagctcgcatccctcctgtttgaactggggtgcaccagttctgccttgcagatctttgaaaaactggaaatgtgggaagacgtggtcatctgctacgagcgcgcagggcagcacggcaaggcggaggaaatcctgcgccaggaattggagaaaaaggagactccatccctctactgcttactgggcgatgtactgggagatcacagttgctatgataaagcttgggaactgagccggtaccgtagtgcccgcgcccagagatcaaaagctttgctgcacctccgtaacaaggaattccaggagtgcgtcgagtgcttcgagaggagtgtcaagattaaccccatgcagctgggtgtctggttttcactgggatgcgcctatctcgccctggaagactaccagggctcagcaaaggcgtttcaacgttgcgtgaccctggaacccgacaacgctgaagcatggaacaatctctccactagttacattagactcaagcagaaggtgaaagcctttcggaccctccaggaggcgctgaagtgtaactatgaacattggcagatatgggagaactacatcctgacgtcaactgacgtaggcgagttcagcgaggctatcaaagcgtaccatagactgctcgatctgagggacaaatataaggatgtgcaagtactcaagatccttgtgcgagcggtaatagatggcatgacagacaggagcggcgacgtagctacagggctgaaaggaaagctgcaggaattattcggcagagtaacctccagagtcacgaatgatggggaaatatggcgcctgtacgcccatgtgtacggaaatggacagagcgaaaaacctgacgaaaacgagaaggcctttcagtgtcttagtaaggcttataaatgtgatactcaatcaaactgttgggagaaggacattacgtcattcaaagaagtggtccagcgcgccttgggactggcacatgtagctattaagtgctccaaaaacaaaagctcaagtcaggaagcagtccagatgcttagctcggtgcgcctgaatctgcgtggcctgctgtcaaaagcgaagcagctctttacagatgtggccacaggagaaatgtctagggagctggccgatgacatcaccgccatggacactctagtgacggagctgcaagatcttagtaaccagtttaggaatcaatattag

SEQ ID NO: 51467 - DNA, 7446 bp, Artificial Sequence
  Description of Artificial Sequence: Synthetic coding sequence
atggagcagagccccccccccgcccccgagcccacccagggccccacccccgcacgttctcggcgaagaagagagcctgaaagcccccccgcgtccgcaccaattcctcttttcggagcagacacaatcggtcagaggtcccccgacggccccgtgctgagcaaagctgagtttgtcgaaaaagtgcgccagtccaatcaggcatgccacgatggcgacttccacacagctattgtgttgtataatgaagccctggcggtggacccgcagaattgtatcctctacagtaacagatccgctgcatacatgaagatccagcagtacgacaaggcgctagacgatgctatcaaggcccggctcctgaatccaaagtggccaaaggcatacttcagacagggggttgctctacagtatctgggaagacatgcagacgctctggccgctttcgcttcagggcttgcccaggatcccaaaagcctccagcttctggtgggaatggtagaggccgctatgaagtcaccgatgcgggattctctcgagcccacatatcagcagctccagaagatgaaattggacaagtccccctttgtcgtggtgtcagtcgtgggccaggaactcctcactgccggccatcacggcgcctccgtcgttgttctggaagctgccctgaagattggcacatgttccttgaagctcagagggtctgtgttctcagccttaagctctgcttactggtccctgggaaacacagaaaaaagtaccggttacatgcagcaggatctcgatgtcgctaaaaccctcggagaccagaccggcgagtgtagggcccacgggaacctgggtagcgcattcttttccaaaggcaactatcgggaggccctgactaatcacagacaccagctggtcctggctatgaagctgaaagacagagaggccgcttcttcagccttatcgtctcttgggcatgtgtataccgcgatcggggactacccgaatgctcttgcgagtcacaagcagtgcgtgctcctcgcaaagcaatcaaaggacgagttgtcagaggcgagggaactcggaaacatgggagcagtttacatagccatgggcgactttgaaaacgcggttcagtgtcatgagcagcacctgaagattgccaaggaccttgggaataagcgagaggaggctagggcgtacagtaacctcggctccgcatatcattacaggaggaatttcgataaagccatgtcttaccataattacgttctcgagttggctcaggaacttatggagaaagctattgaaatgcgcgcttatgccggcctgggccatgctgcccgctgtatgcaagacttggagagggccaaacagtatcacgaacagcagttagggattgcagaggatctgaaagaccgtgcagccgaaggaagggcttcttcgaatttgggtatcattcatcaaatgaagggcgactatgacaccgctctcaagctccataagactcacctttgtattgctcaggagttgtcagactatgctgctcaggggagggcttatggaaatatgggaaacgcatacaacgccttggggatgtacgatcaggctgtgaagtatcaccgccaggaattacagatcagcatggaggtcaacgaccgggcttcgcaggcctccacacacggaaatctcgcagtggcctatcaagccttgggcgctcacgacagagcgctccagcattaccagaaccatttgaacattgccagggaactgagagatattcagtctgaagcccgggccctaagtaaccttggcaattttcactgttcgaggggcgagtacgtacaggcggcaccctactacgaacagtacctgaggctcgccccggatttgcaggacatggaaggcgagggcaaagtgtgtcacaatctgggctatgcccattactgcctcgggaactaccaggaggccgtaaagtactatgaacaggacctcgcccttgctaaggacctgcatgataaacttagccaggccaaggcctattgcaatctgggtctcgcctttaaggctttgttaaacttctcaaaggccgaagagtgccagaagtatctgctgtccctcgcacagtcactcaataattctcaggccaaatttagagctctggggaatctgggcgacatcttcatatgtaagaaagatatcaatggcgccattaagttttatgaacagcaacttggcctggctcaccaggtgaaggataggcgcttggaagctagcgcctatgccgcccttggaactgcttaccggatgattcagaagtatgataaggctctgggatatcacacccaggagttagaggtttaccaggagctgagtgacctgcccggagaatgccgggctcatggccacctggctgccgtgtacatggcactcggcaaatacaccatggcattcaagtgttacgaagaacaactggacctcggccagaaacttaaagatccttctctcgaagcacaagtgtacgggaatatggggattaccaagatgaacatgaatgtcatggaggaagctatcggatacttcgagcaacaactggctatgttgcagcagctgtctggaaatgagtctgtgctggatcgcggacgggcctacggcaatttgggtgactgctatgaggcgttgggggattacgaggaggcaatcaagtattatgagcagtacctgtccgtcgctcagtcactcaataggatgcaagaccaagccaaggcctacaggggtctcggcaacggccatagagcaatgggttctctgcagcaggccctggtctgcttcgagaaaagacttgtggtggcccacgaactgggagaggcatttaataaggcccaggcctacggcgagttgggcagcttgcattctcagctaggcaactacgagcaagctatctcgtgcctggaaaggcagctgaacattgccagagacatgaaagaccgggcactcgagtccgacgctgcctgcggcttgggcggggtataccagcaaatgggggaatacgacacggctctgcaataccaccagctggacctgcagatagcggaggagaccaataatcctacctgccaaggacgcgcctatggaaacttaggactaacatatgaatcccttgggactttcgaacgcgccgtagtgtatcaggagcagcatctgagcattgcggcacagatgaatgatttagccgccaaaactgtatcctacagctcgctcggccggacccaccatgcactgcagaattacagccaggctgtgatgtatctgcaagaaggcctgcgtctggccgagcagctggggcgaagggaggacgaggccaagattcggcacgggttggggctgtctctttgggcgtctggtaatctggaggaagctcagcaccagttatatcgggcgagtgccctttttgagaccatcaggcatgaggcccaactttccacagactacaaactgagcctctttgacctgcagacctccagttatcaagcactgcaacgggttctggtatcactgggacatcatgatgaagccctggctgttgccgagcggggacgcacaagagcctttgccgacctgctggtagagaggcagacagggcagcaagatagtgacccatatagcccagtgaccatcgaccaaatcctcgagatggtgaacggccagaggggtttagtcctgtactatagcctggctgccgggtatctttacagttggctcctcgctccaggcgccggcattgtgaaatttcacgaacactatctaggggaaaacactgtggagaattcatcggatttccaagctagcagttccgtgaccctgccaactgcaaccggctccgcccttgagcaacatatcgcctcagtgcgggaagcactcggggtggaatcccactactccagggcatgcgcctctagtgaaaccgagtctgaagcaggagatattatggaccagcagttcgaggagatgaataacaagctcaatagcgtcactgacccaaccggattcctgaggatggtgcgcaggaacaatctgttcaacaggtcgtgtcagagcatgactagcttattttccaatacagtgtcccccacccaggacggtacatcctccctgccaagaaggcaatcaagttttgctaagcccccactgcgggcgctttatgatttgctgatcgcacccatggaaggtgggctcatgcacagctccggtccagtggggagacaccgccagctgatcctggttttggagggcgagctctacctgatccctttcgcactcttgaagggcagctcttcgaacgaatacttgtatgaaaggtttggattgttggccgtgccgtccattagaagcctatccgttcagtcaaaatctcacctgaggaaaaaccccccaacatatagcagctcaacctcaatggctgccgttatcgggaaccccaaacttcctagcgccgtgatggacagatggctatgggggccgatgcccagcgcggaggaagaggcgtatatggttagtgagttgctggggtgtcagcccctggtaggatctgtggccacaaaagagcgagtcatgtctgcattgacgcaggctgagtgcgtccacttcgcaactcacatctcctggaaactttccgcactcgttctgaccccatccatggacggaaatcctgccagttctaaatctagcttcgggcacccttatacaatcccagagtcattgagagtgcaagatgatgcatcggacggagagagcatttcggactgtccccccctacaagagttgttgctcacagccgctgatgtccttgatcttcaactgcccgtcaagctggtggtcttaggctcatcccaagagtctaactccaaagtgacagcggacggcgtcattgctctaacgagagctttcctcgctgcgggcgcacagtgtgtactcgtaagtttatggcctgtccctgtggcagcatctaaaatgttcattcacgccttctactcctcactgttgaatggactgaaagcttccgcggcgctaggggaagcgatgaaagtcgtgcagagcagtaaggctttctcacaccccagcaactgggccgggttcatgcttatcggttcagacgttaaacttaacagtccatcttccctgataggtcaagcactgacagagatcctccaacacccggagagagctcgcgatgcactcagagtgttgctgcatcttgtggaaaaatccctgcagaggatccagaatggccagaggaacgccatgtacacgagccagcagtctgtcgagaataaggtaggtggtattccgggatggcaggccctactcaccgctgtgggattcaggttagatccgccaacctctggcctccctgcagctgtttttttccctacctccgatccaggcgatcggcttcaacagtgcagctccacgctccagtccttactcggcctgcctaatccagccctgcaggccttgtgtaagctgatcacggctagcgagaccggcgagcagctgattagccgcgccgttaaaaatatggtgggtatgttacaccaggtgctggtccagctgcaggccggggagaaagagcaagatctggcttcagccccaattcaggtgtctattagcgtgcagttatggagattgcccggctgccatgagttcctcgccgccctggggtttgatctgtgcgaggtcggtcaggaggaggtaatactgaaaacagggaagcaggctaatagacgcactgtgcacttcgcactgcagtctctcctcagtctctttgacagtacagagctacccaaacggctgtctctggattccagtagtagccttgagtctttggcttctgcccaatctgtgtcgaatgccctcccattgggttatcagcagcctccattcagcccgaccggagccgactccatcgctagtgatgccatctccgtgtactctctgtcttctattgcgtcttcaatgagctttgtgtctaagcccgagggcggatcagagggtggtggtcctgggggacgccaggatcatgacagatcaaagaatgcttatctgcagcgctcgacactgccaaggtcccaactacccccacaaacgaggcctgcagggaacaaagacgaggaagaatacgaagggtttagcattatttcaaacgagcccctggcaacataccaggagaatcgtaacacctgtttcagccctgatcataaacagccgcagccaggcaccgccggaggtatgcgggtgagcgtcagctctaagggctcaatttcgaccccgaattccccggtgaaaatgacactgataccctcacccaatagtccattccaaaaggtgggaaagctggcttctagcgacaccggcgagagtgaccaatcaagtacagaaaccgattccacagttaaaagccaggaagagtcgaaccctaaactggatccccaggagttggcacagaagattctggaagaaacccagtctcatctgatcgctgtggaaagactgcagcggtccggggggcaggtaagcaagagtaacaaccccgaagatggagtgcaggcaccctcttcgacagcagtattccgcgcttccgagacatcggcatttagcaggcccgtgctcagccatcaaaagtcccagccctcccctgtcacggtgaagcccaaaccacccgcgagaagctcctccttaccgaaagtcagctcagggtatagttccccaacaacctctgagatgtccataaaagactctccctcccaacactccggacggccctctcctggttgtgacagtcaaacaagccagctcgaccagccactctttaaactcaagtacccaagctcaccctattccgcacacataagcaaaagcccgcgtaacatgagtccatctagcgggcatcagtccccggcaggttctgccccttcacccgctctgtcatactcctccgccgggtccgcccggtcatcccctgccgacgcgcccgacatagacaagctcaagatggccgcaatcgacgaaaaggtccaggccgttcataacctgaagatgttttggcagagtacaccacagcacagtactgggcccatgaagatcttcagaggtgctcctggcacgatgacatcaaagcgtgacgtgctctccctactgaacctcagccccagacacaacaaaaaagaagagggggtggacaaattagagcttaaggaactttcactgcaacagcatgacggagcaccacctaaggcccctccaaacggccactggcgaaccgaaaccacaagcttgggctcactccccctgcccgctgggccccctgctactgctcctgcccggcctcttcgcttaccatctggtaacggatataagtttttatcccccggccggtttttccctagcagcaagtgttag

SEQ ID NO: 51468 - DNA, 1428 bp, Artificial Sequence
  Description of Artificial Sequence: Synthetic coding sequence
atgaccaccctgccccccctgcccatgacccggcccaagctgaccgcattggctcgccaaaagttaccgtgtagtagccgcaagatcccaagatctcagcttattaaagagaaagacgacatcgaccattacctggaggtcaattttaaagggctgtccaaagaagaagtagccgcataccgcaactcctacaagaaaaacatctgtgtagacatgttgagagacgggtaccataaaagtttcacagagctcttcgccctcatggagcgctgggacgcactgagggaggctgctagggtcagatccctgttttggctccagaagccactcgaggaacagcccgataagttggattatctgtaccattacctcaccagagctgaagacgcagaaaggaaggaatcctttgaagatgtgcataataatttatatgcactggcctgctactttaacaattcggaggacaaatgggttagaaatcacttctacgagcgatgtttcaaaatcgctcagctaatcaagatcgattgtggtaagaaggaggcagaggctcatatgcatatgggcctgctatatgaagaggacgggcagctgctcgaagccgcagagcactacgaggcatttcatcagctgacccaaggacggatttggaaggatgaaaccggcaggagtctcaatctgcttgcctgcgagagccttctgcggacatacaggcttctcagcgataaaatgttagagaacaaagagtacaaacaggcaatcaagattctgataaaagcatctgaaatcgctaaggaaggttccgataagaaaatggaggcagaggcaagttattacctcggcctggctcacctggcggccgaagagtatgagacggctctgaccgtgctggatacatactgtaaaatttctaccgacctggatgatgacctgtctctgggccgggggtacgaagcaattgcaaaagttctacagtcacagggcgaaatgaccgaagccataaagtaccttaaaaagttcgtgaaaattgcgcggaacaactttcagagcctggatttagtccgggcaagcactatgctcggagatatctacaacgagaagggctactataataaagcaagcgaatgtttccagcaggcttttgatacaacagtcgagcttatgagcatgccactgatggatgaaacaaaggtccactatgggattgctaaagcccatcagatgatgctgaccgtgaataattatattgagagtgcggatctcacatccctcaactatctgctcagctggaaagagagccgcggcaatattgagcccgatcccgtgacagaagaattcaggggctctaccgttgaggcagttagtcagaacagcgaaaggctggaagagttaagccggtttccgggcgaccaaaagaatgagacatag

SEQ ID NO: 51469 - DNA, 960 bp, Artificial Sequence
  Description of Artificial Sequence: Synthetic coding sequence
atgaccaccctgccccccctgcccatgacccggcccaagctgaccgctcttgctcgccagaagcttccatgttcaagcaggaagattccccggagtcaactcattaaggagaaggatgatatagaccattatctcgaggtcaactttaagggcttgtccaaggaggaagtggctgcttaccggaattcttacaaaaagaacatttgtgtggacatgttacgtgatggttatcacaaatccttcaccgaactattcgcactgatggagaggtgggatgccctgcgggaggcggcccgtgtccgatcactattctggctccagaagccattagaggaacagccagataagctggattacctctaccattatcttactagggcagaggatgctgaacgcaaggagtcttttgaagacgtgcacaataatctgtatgcactagcctgttatttcaacaacagtgaagacaaatgggtcagaaatcacttttacgagcgttgcttcaaaattgcccagcttattaagattgactgcgggaagaaggaagctgaagcacacatgcacatgggtctgctgtatgaggaggacgggcagctgcttgaggccgccgaacactatgaggcatttcaccagctgacccagggaaggatttggaaagacgaaactggaaggtcattgaatctgctggcctgtgagagtctcctgagaacttatagactgctcagtgacaagatgctagaaaataaggaatataagcaggctatcaagatcttgatcaaagcctccgagattgccaaagaggggtcagacaagaagatggaggctgaagccagctactacctcggtctcgcccatttagccgctgaagagtatgaaaccgcactgactgtgctggacacatactgcaagtccccccagacatggatgatgatttctgtctggggggaggccatgaagccgtag

SEQ ID NO: 51470 - DNA, 1506 bp, Artificial Sequence
  Description of Artificial Sequence: Synthetic coding sequence
atgatccccatgttcaccgtgaccctggaggacagcggcaccctgtggaaatccctgcacagtagttctgagtcagagatgaccacactgccccctctccctatgacccgcccaaagcttactgctctcgcgcgacagaagctgccgtgctcgtcccgtaagattccccgatcccagctcataaaagagaaagatgacattgatcattatctggaagttaacttcaaggggctctccaaagaggaggtcgctgcgtacagaaatagctataaaaagaacatttgcgttgatatgctgcgagacgggtatcacaaatccttcactgagttgttcgccctaatggagcggtgggacgccctccgggaagccgcccgggtccgaagtctgttttggttacagaagccactcgaggaacagcccgacaaactggattatctatatcactacttgacccgcgcagaagacgccgagagaaaggagagttttgaggatgtccataacaatctgtatgcacttgcctgttatttcaataacagtgaggataagtgggtacgcaatcatttctatgaacgctgctttaaaatcgcccagctcataaaaatcgactgtgggaagaaagaagccgaagcccatatgcacatgggcctgctctatgaagaagatggccagctactggaggccgccgaacactatgaagccttccaccagttgacccagggtagaatctggaaagatgagaccggaagaagcctaaacctcctggcctgtgagagtctgctgcgtacctaccggctgctaagcgacaaaatgctggagaataaggagtataagcaggcgatcaagatattaatcaaggctagcgagattgcgaaggaggggagcgacaagaaaatggaagctgaagcctcttattacctgggactggcacatctggcggctgaagagtatgaaacagcactgacggtgcttgacacatactgtaaaatatcaacagaccttgatgatgatctgagcctcgggcgtgggtacgaggctatcgccaaggtgctgcagagccagggcgagatgacggaagccattaagtatctcaaaaagtttgttaaaatcgccagaaataacttccaaagcctggacctcgttcgcgcttcaactatgctgggagacatctataacgagaaagggtactataacaaagcctctgagtgtttccagcaagccttcgacaccactgtcgagcttatgtctatgccgctgatggatgaaacgaaagtgcattatggcatcgccaaggctcatcagatgatgctgactgtcaataattacattgagtctgccgaccttacttcattaaactatctcctaagctggaaagaatcccgcggtaatattgagccagacccggtaacagaggaatttaggggatccacagtagaggctgtgtcacaaaactccgagaggttggaagagctctcgcggttcccaggcgaccagaaaaatgaaacgtag

SEQ ID NO: 51471 - DNA, 81 bp, Artificial Sequence
  Description of Artificial Sequence: Synthetic coding sequence
atgaccaccctgccccccctgcccatgacccggcccaagctgaccgcactggctcgccagaaattgccttgctctagctag

SEQ ID NO: 51472 - DNA, 1425 bp, Artificial Sequence
  Description of Artificial Sequence: Synthetic coding sequence
atgaccaccctgccccccctgcccatgacccggcccaagctgaccgcccttgctcgacaaaaactcccctgctcaagcaggaaaatcccccggtctcagctcatcaaagagaaggatgacattgaccactacctggaggtgaattttaaggggctctccaaagaggaagtggccgcttaccgcaatagctacaagaagaacatatgcgtcgatatgctgcgcgacggataccataaaagcttcacagaattgtttgcattaatggaacggtgggacgccctccgcgaggccgctcgggtgaggtccctgttctggctgcaaaagcccctggaagaacagcccgacaagctggattatctgtatcactatctcacacgggctgaagatgccgagaggaaagagtcatttgaagatgtacataacaatctgtatgccctcgcctgctactttaacaacagtgaggataagtgggtgcgtaaccatttctatgagcgctgcttcaagatcgcccaactcatcaagatcgactgcggaaaaaaagaagctgaggcccatatgcatatgggtctcctttatgaagaggacgggcagctgctggaagccgccgagcactatgaggcctttcatcagctaacacagggaagaatttggaaagatgaaacagggaggtcactaaatttactggcatgcgaatccctcctgcggacttaccgactactatccgacaaaatgttggagaataaggagtataagcaagccattaaaatcctgattaaagcctcagagatcgcaaaagagggttctgacaaaaaaatggaggccgaggcatcttactacctgggccttgcacatctcgcagccgaagaatatgaaaccgccctgactgttttggatacatactgcaaaatcagcacagatctggatgacgacctgtccctgggccgtgggtacgaagctatcgccaaggtgctccagagccagggcgagatgaccgaagccataaaatatctgaagaagttcgtcaagattgcgagaaacaatttccaatcgttggacctcgtgagggcctctacgatgctgggcgacatttacaatgagaaagggtactataataaggcatcggaatgctttcagcaggccttcgataccacggtcgagctcatgtcaatgcccttgatggacgagaccaaagtccactacgggatcgccaaggcccaccagatgatgctgacagtcaataattacattgaaagcgccgatctgacaagcctgaactatcttctttcttggaaggagtccagaggcaatatcgaaccagatcctgtgacagaatttcggggaagtaccgtcgaagcagtcagccagaactcagagcgcctggaggagctctctaggttccctggagaccagaagaatgaaacttag

SEQ ID NO: 51473 - DNA, 1506 bp, Artificial Sequence
  Description of Artificial Sequence: Synthetic coding sequence
atgatccccatgttcaccgtgaccctggaggacagcggcaccctgtggaaatctctccattctagctccgagtcagagatgacaacattgccacccctgccaatgacaagacccaaattgaccgcactagcccgccagaagctcccatgcagctctcgcaaaattcccaggtcccagctgatcaaggagaaggacgacatagaccactatttggaagtgaacttcaagggcctgtctaaggaggaagtggcagcctacagaaattcgtacaaaaaaaacatctgtgtggatatgctgagggatgggtaccataagtccttcacagaactattcgcattgatggaaagatgggatgccctgagagaagcagctagggtgagatccctgttttggctccagaagcctctggaagagcagcccgacaagctggactatttgtaccattaccttacgagagccgaggacgccgagagaaaggaaagtttcgaagacgtacataacaacctctatgcattggcctgttattttaataattccgaggacaaatgggttaggaatcatttttatgaacgatgttttaagatcgcccagcttattaagattgactgcgggaagaaggaggctgaagcacacatgcatatgggtcttctgtacgaagaagatggccagttgcttgaggcagctgaacactacgaggccttccatcaactcacccagggcagaatctggaaggacgaaacggggaggtccctgaacctgttagcgtgtgagagtctgttgaggacatatcgcctcttatcagacaagatgcttgaaaataaagaatacaagcaggccatcaagattctcataaaggccagcgagatcgccaaggaaggatccgataaaaagatggaagccgaggcctcttattacctcgggctagctcatcttgccgctgaggaatacgaaacagcattaactgttctcgacacttactgtaaaatcagcaccgatctggacgacgatctgagcttgggccgtggttatgaggctatcgcaaaagtcctgcaatcccaaggagagatgacagaggcaataaagtatctcaagaaattcgtgaaaatcgctcggaacaacttccagtcactggatctggttagagcctccacaatgttaggagacatttacaatgagaaaggctactataacaaagcctctgaatgttttcagcaggcatttgatacaactgtcgaactcatgtccatgccgctgatggacgagaccaaagttcactacggcatagcgaaggcgcatcagatgatgttgaccgttaacaactatattgagagcgcagatttgacaagtctgaactatcttttgagttggaaggagtcccgaggcaacatcgagccagacccagtgacagaggagtttcgggggtctacagtcgaagctgtgagtcagaatagcgagcggttggaagagctctcccgattcccgggggatcagaagaacgagacctag

SEQ ID NO: 51474 - DNA, 282 bp, Artificial Sequence
  Description of Artificial Sequence: Synthetic coding sequence
atgatccccatgttcaccgtgaccctggaggacagcggcaccctgtggaaatccctgcactcttcatcagagagcgaaatgactaccctcccgccacttccgatgactcgacctaagctcactgcccttgctaggcaaaagctgccctgttcctcccgcaagattccacggagccagctgatcaaagaaaaagacgacatagatcattacttggaagtcaactttaagggactgtctaaggaggaagtggctgcttataggaactcttataagaaaaattag

SEQ ID NO: 51475 - DNA, 1998 bp, Artificial Sequence
  Description of Artificial Sequence: Synthetic coding sequence
atggccggcctgagcggcgcccagatccccgacggcgagttcaccgccctggtgtaccgcctcattcgcgacgctcgctatgctgaggcagtgcaactcttgggacgggagttgcagcggagtcctcgctcaagggcgggactgtcactgctgggctactgttactatcgtctgcaggaattcgcccttgctgcagaatgttatgagcagctggggcagctgcatcccgagctcgagcagtaccgcctgtatcaggcccaggcactttacaaggcctgcctgtatcccgaggcgactagagtagcatttctactactcgataatccagcctatcacagccgcgtgttgcgcctccaggcagctatcaaatactcagaaggggatctgccaggaagcaggagcctcgtcgagcaactgctttccggcgaaggcggtgaggagtcgggtggggacaacgaaacagatggacaagtgaatctgggttgcttactctacaaggaaggacaatatgaggcagcatgtagtaagttcagcgccaccttacaggcctctggataccagcctgacctctcttataacctcgcgctggcttactactcttctagacagtatgcgtctgctctcaaacacatcgcagaaattatcgagagaggcatccggcaacacccagagctcggcgtgggaatgacaacagaaggttttgacgtccgcagcgtcggaaacacccttgtcctccaccagaccgctctggtggaggcattcaacctgaaagcagctatagaataccagctgaggaactatgaggtggcccaggagaccctcaccgacatgcccccaagagcagaagaagagctggaccctgtcacactgcacaaccaagcattgatgaacatggacgccagacctacagaaggatttgaaaaacttcagtttctgctgcagcagaatccatttccacctgaaacatttggaaacctcctgctcctctactgtaagtacgaatatttcgacctagctgccgacgtgctcgccgagaacgcacacctgacttataaattcctgaccccatatctgtacgacttcctggatgcactgattacgtgccagaccgcacccgaagaggcctttatcaagttggatgggctggccgggatgttgacagaacagctgcgccgcctcactaaacaggtgcaggaggcgagacacaacagagatgacgaagcgatcaaaaaggcagtcaatgaatacgatgagactatggagaaatatatcccagtgctcatggcacaagcaaaaatctattggaaccttgagaactatcccatggtggagaaagtgtttaggaaatctgtcgaattctgtaatgaccatgatgtgtggaagctgaacgttgcccacgtcctctttatgcaggaaaacaaatataaggaagccattggattctacgagccgatcgtgaaaaagcactatgataacatcctgaacgtcagtgcgatcgtcctggcgaacctctgtgtctcttacattatgacgagtcagaatgaagaagctgaagaactgatgaggaaaatcgagaaggaggaagagcagctgagctacgacgatcccaacaggaagatgtaccacttatgtatcgtcaaccttgtgattggaactctgtattgtgctaagggcaattacgagttcggaatctcgcgagtaattaagagtctggagccctataataagaagctagggacagacacatggtattacgcgaagcgctgcttcctgtccctcctcgagaatatgtcaaaacacatgattgtgattcacgatagcgtcattcaggagtgtgtacaatttctgggccactgtgagctttatggcaccaacataccagctgttatcgaacaaccacttgaagaagaaaggatgcacgtgggcaaaaacaccgtgaccgacgaaagtagacagctaaaagcattgatttacgaaattatcggatggaacaagtag

SEQ ID NO: 51476 - DNA, 381 bp, Artificial Sequence
  Description of Artificial Sequence: Synthetic coding sequence
atgtaccacctgtgcatcgtgaacctggtgatcggcaccctgtactgcgccaaaggcaactatgagttcggcatcagcagggtgataaagtcattagagccatataacaaaaagttaggtacggacacctggtattacgcaaaacgttgtttcctgagcctgctggagaacatgagtaaacacatgatcgtcatacatgacagtgttatccaggaatgtgtgcaattcctggggcactgtgaactgtacggtacaaatatcccagctgttatcgagcagcctttggaggaggagcgcatgcacgtgggtaaaaacaccgtaactgacgagagcaggcagttaaaggccctaatatacgagattattggatggaataagtag

SEQ ID NO: 51477 - DNA, 1998 bp, Artificial Sequence
  Description of Artificial Sequence: Synthetic coding sequence
atggccggcctgagcggcgcccagatccccgacggcgagttcaccgctgttgtgtacagactgatccgtaacgcgcgctacgccgaagccgtgcagctgctgggaggcgaactacagaggtccccacgctctagagccgggctttcactgctgggctattgctattacagattacaggaatttgcccttgcggcagagtgttatgagcaactgggacagctacatcctgagctggaacaatatagactgtatcaggcccaggcactctacaaggcatgcctctatgccgaggctaccagggtagcctttcttctcctggacaatcctgcctaccacagtcgagtgcttaggctccaggccgccattaagtatagcgagggtgatctgccgggttcacggtccctggtcgaacagctgccaagcagagagggcggagaggagagcggtggcgaaaacgagacggacgggcagatcaacctgggctgccttttatataaggagggacagtacgaggcagcttgctccaagtttttcgcagctctgcaagcctcaggttatcagccagacctgagctataacctggccctggcctactatagctcccggcaatacgcatcagcccttaagcacatcgccgaaattatcgagaggggcattcgccagcaccctgaactgggcgttggtatgacaaccgaggggattgatgtgcggtcagtggggaacacccttgtgcttcatcaaaccgctctggtcgaggcattcaatctgaaagctgccatagagtaccagctgcggaactatgaagccgcccaggaagccctgacagatatgcccccacgcgctgaggaggaactcgatccagtcacactgcataatcaggcgctgatgaacatggatgcccgccccacagaggggtttgagaaactgcagtttctcctccagcagaatcctttcccacctgaaactttcggcaacctgctgctgctttactgtaagtatgagtatttcgatctggctgcagacgtcctagccgaaaacgcccatctgatatataagttccttaccccctatctgtacgacttcctggatgcagtcatcacctgccaaaccgcgcctgaggaagctttcatcaaattagatggcctggccggaatgctcacagaggtgctgagaaagcttacgatccaggtccaggaggccagacataatcgggacgacgaggcaatcaagaaggccgtcaatgagtacgacgaaaccatggagaaatacataccagtcctgatggcacaggcgaagatatactggaatctagagaactacccgatggtcgaaaagatcttccgcaaatctgtcgagttctgtaatgatcatgatgtgtggaagctgaacgtggcccacgtcttgttcatgcaggagaacaaatacaaagaagctatcggattctacgagcctatcgtcaagaagcactatgacaacatactgaatgtgtcagctattgtgttggccaacctctgtgtttcttatattatgacatcccagaatgaagaggccgaggagctaatgaggaagatcgaaaaggaggaggagcaactatcctacgatgatcccgataagaagatgtaccacctatgtatcgtgaacctggtcattgggactctctactgtgcgaaaggcaattatgacttcggaatttcaagagttatcaaaagcttggaaccgtacaacaagaaactgggcaccgatacttggtactatgcaaagcgctgcttccttagtttgctcgagaatatgtctaagcacactattatgctgagagattctgttattcaggagtgcgtgcagtttctcgaacactgcgaactccacggccggaacatccccgcggttattgagcagccacttgaagaggaaagaatgcatgtgggcaaaaacacagtgacctacgagtcccggcagctcaaggctcttatttatgagataatcggttggaacatctag

SEQ ID NO: 51478 - DNA, 1857 bp, Artificial Sequence
  Description of Artificial Sequence: Synthetic coding sequence
atggccggcctgagcggcgcccagatccccgacggcgagttcgccctggctgcagaatgttacgagcagcttgggcagctgcacccagagttagagcaataccggctatatcaggctcaggccctgtacaaggcctgcttgtacgccgaggctaccagagtggcgtttctactactggacaaccctgcctatcattccagggtgcttaggcttcaagctgctatcaagtactccgagggagacctccctgggagcaggtccctggtggaacagctgccttcccgtgagggaggtgaggagagcggcggagagaacgagacagatgggcaaatcaatctggggtgccttctgtacaaggaagggcaatatgaagccgcctgctcaaaatttttcgccgctctacaagcatccggataccaaccagacctgagctataaccttgccctggcctattattcttctaggcaatacgcaagtgccctgaagcacatagccgagattatagaaagagggatcagacagcacccagagctcggagtgggcatgacaacagaggggatcgatgtgagaagcgtgggaaacacactcgttctgcaccagacagccttggtggaagcctttaacctgaaagccgcaatcgagtatcagctgcggaactatgaagcggcccaggaggccttaacggacatgccacctcgtgcggaggaggagcttgatcctgtgacgctacataatcaggctctgatgaacatggatgcccggccaactgaaggctttgagaagctccaatttctcctgcagcagaaccccttcccaccagaaacattcgggaatcttctcttactatattgcaaatatgaatacttcgatctggcggccgatgttcttgccgagaatgctcaccttatttataagttcctgaccccctacctctacgatttcctggacgcagtgatcacctgtcagactgctcccgaagaagccttcattaagctggacggtttggccggaatgttgactgaagtgctccgcaagttgaccatacaggtccaggaagctcgccataaccgggatgacgaagccattaagaaggccgtcaatgaatacgatgaaactatggagaaatatattccagtgctgatggcacaggctaaaatttattggaacttggagaactatccgatggtggaaaaaatttttcgcaaaagtgtggagttttgtaacgatcacgatgtttggaaactgaacgtagcacatgtcctgttcatgcaggagaataagtataaagaggccattgggttctatgaaccaattgtcaagaaacattacgacaacatccttaacgtctccgcaatcgtgctggcaaacctctgcgtctcctatattatgaccagccagaacgaggaggctgaagaattaatgcggaaaattgaaaaggaggaggaacagcttagctacgatgaccctgacaaaaagatgtatcacctttgcatcgtgaatcttgtgatcgggacactttattgcgctaagggcaattacgactttggcattagcagggtcatcaaatctttggagccctacaataagaaactgggcacggacacctggtactatgccaagcgttgttttcttagcttgctggaaaatatgtctaaacataccattatgctgcgggacagcgtgattcaggaatgtgtgcagttcctggagcactgcgaactacacggccgaaacattcccgccgtaatcgagcagcctttggaggaggagagaatgcacgtgggcaagaacacggtgacttatgaaagccgccagttgaaggcactgatatatgagattatcggctggaacatttag

SEQ ID NO: 51479 - DNA, 468 bp, Artificial Sequence
  Description of Artificial Sequence: Synthetic coding sequence
atggcccccatccccaagaccgtgggccggatcaagctggactgctccctgagacctagctgtccccttgaagtcgctgccgctccaaagctgtgcaaagagtttggacctgaagattatggggaggaagacatcgtggatttcctacggaggcttgtggagagcgaccctcagggacttcaccggatacacgtggacgggtcatcaggccggctgcagttgtggcaccatgattacctgctgggccaccttgatgacgaagggaagtctacagggcagtcagatcgtggtaaaggtgcagaggggctgggtacttactgtggcttgcggaagagcttcctgtatccaccctttccgcaagtgccctctaagcactgcttcgaggtaccctggccagtcagcaccctggctttgtcatttatgagccctaaaccacctcagccagcacctctgcccgactccgagtag

SEQ ID NO: 51480 - DNA, 858 bp, Artificial Sequence
  Description of Artificial Sequence: Synthetic coding sequence
atggcccccatccccaagaccgtgggccggatcaagctggactgctcgttgcgcccatcgtgccccctcgaagtggctgctgccccgaagctgtgtaaggagttcggtcccgaggattatggcgaggaggacattgttgacttcctgcggaggctagtcgaaagcgatccacagggattgcatcggatccatgtggacggctcctccggccgactgcagctatggcatcacgactatctgctgggacatctggacgacgagggaaagtctacgggtcagagcgatagagggaagggtgccgaagggcttggcacttactgtggcctcagaaagagctttctatatcctccccaagaatctgagccttgtccgcaaagtcctagcgctagcgccacattcccgtctgtgagcgattctttgttgcaggtcgctatgccacaaaagctgctcgtgaccgaggaagaggcaaacaggctcgccgaagaactggtggctgaagaagaacgtatgaagcagaaagcggagaaaaagagactaaaaaaaaaacggcagaaagaaaggaaaaggcaggagagattggagcagtactgcggggaacctaaggcatctacaacatcagatggagacgagtctccaccctcaagccccgggaacccagtgcagggccagtgcggagaggaagaagactcactcgacttgtcctccaccttcgtgagccttgctctgaggaaggtaggcgattggcccttaagtgctcgacgcgagaagggactcaaccaggaaccacaggggcgtggccttgctcttcagaagatgggccaagaagaagaaagtccccccacaacatccccttgttag

SEQ ID NO: 51481 - DNA, 603 bp, Artificial Sequence
  Description of Artificial Sequence: Synthetic coding sequence
atgccccagaagctgctggtgaccgaggaggaggccaaccggctggccgaagagctggttgcagaagaagagaggatgaagcagaaggccgagaaaaaaagactgaagaaaaagagacagaaggagcgcaagcgccaggaacgcctggaacagtactgcggcgaacctaaggccagcaccactagcgatggggacgaatctccaccctcttctccaggaaacccagtacagggccaatgtggcgaggaagaagatagcttggacctcagctcaactttcgtgtctttggccctgcgcaaggtgggagattggccgctctcggcgagacgggagaaaggactgaaccaggaaccacagggacgcggccctctggcttgtctgcactcctgcatcattctgcacgtgactgaggccacccccacttctcccagcccgagattgagagtagagggaccaatcctgagctctccacggacccttcagagagcaggcaccagctgggatctcgggtcctctatctgcctgagacctgatgagggggctcctgtcccacacagggctggaccatgcatctacccattggtgggagatatcgtatggtag

SEQ ID NO: 51482 - DNA, 741 bp, Artificial Sequence
  Description of Artificial Sequence: Synthetic coding sequence
atgcccctgcggatcctggactacctgctgggccacctggacgacgagggcaagagcactggtcagtctgacagaggcaagggcgccgaaggactgggaacctactgcggcctcaggaagtcctttttatacccgccccaggaatcagagccctgtccacagagcccttccgcgtccgcgaccttccccagcgtcagcgattcacttcttcaggttgctatgccacagaaacttctggtcacagaggaggaggcgaatcggctggcggaggagctcgtagcagaggaggaacgaatgaagcagaaggccgaaaagaagcgtctgaagaaaaagcggcaaaaggaacgaaaacggcaggaacggttagagcaatactgtggtgagccaaaagccagtactacatccgatggggatgagagccccccaagcagccctgggaatccggtccaggggcagtgcggcgaggaggaggattcactcgatctgagctcgactttcgtgtctctggccctacgaaaggtgggggattggccactgagtgcacggagagagaagggtctcaatcaggaaccacagggacgcgggttggcccttcagaagatggggcaggaagaggaatcccctcccagagaggagcgacctcaacaaagcccaaaggtgcaggtgagatggctgaaaaacctaatacaacttgagccgtggaagggccataaagaattgctgggaagacacagagtttag

SEQ ID NO: 51483 - DNA, 2514 bp, Artificial Sequence
  Description of Artificial Sequence: Synthetic coding sequence
atggcccggggcgagcggcggcggcgggccgtgcccgccgagggcgtgaggactgcagaaagagctgcacgtgggggtccaggtcgaagagatggtcgtggcggtggacctcggtctaccgccggaggcgtggccctcgctgtcgtcgtgttgtcactagcgctcggcatgtctgggagatgggttctagcatggtaccgcgcacgacgggcggtgaccctccattctgctccaccggtgcttccagcggattcttcctcccccgccgtcgcccctgacttgttttggggcacctatcgacctcacgtctatttcgggatgaaaactcggtcgcccaaacctctactcactggccttatgtgggcccagcagggaacaacaccaggcacccctaagctgcgccacacctgtgagcagggcgacggcgtcggaccttacggctgggagtttcacgatggactgtccttcgggagacagcacattcaggacggagcccttaggctgaccacagagttcgtgaaaagacctggggggcagcacggcggagattggtcctggagagtgaccgtagaacctcaggattctgggacatccgccttgccgcttgtgagcttattcttttacgtcgtcaccgacggcaaggaggtgttgttgccagaggttggtgccaaagggcaactgaaattcatctccggacacacatcagagttaggggactttcggttcacactcctgccccctacatcaccgggggatacagcccccaaatacggttcttacaatgtgttttggaccagcaaccccggtttacctctgttgactgaaatggtgaagagtcgcttaaattcatggtttcagcatagacctcctggcgcccctcctgagcgatacctcggacttcctggctcccttaagtgggaggataggggcccaagcggacaaggtcagggtcagtttttgatccagcaggtgactttgaagatcccaatttccatagagtttgtgttcgaaagcggcagtgctcaggccggcggcaaccaggccctgccccggttagctgggtccctgcttacgcaggcacttgaatctcacgctgaaggcttcagagagagatttgagaagacattccaactgaaggagaagggcctcagctcaggggaacaggttctgggccaggccgccttatctggccttctcgggggcatagggtacttttacggacaggggctggtacttcccgacattggggtcgagggcagcgaacagaaagtggatcccgccctattcccccccgttccactctttaccgcggtgccttcgaggtccttcttcccccgcggctttctatgggatgagggatttcatcagctggtggttcagcggtgggacccctctctgacaagagaagcccttggacattggctgggactgcttaatgcggatggctggattggaagggaacaaattctaggagacgaagctagggccagagtgcccccagaatttttggttcagagagcggtgcatgccaatcccccaaccctcttgttaccggtggcccacatgttagaggtaggggatccagatgacctggcctttcttaggaaggccctgccgaggctacacgcctggttctcatggctccatcagagccaagctggccccctgcctctcagctaccgctggagggggcgagacccagccctacccacactccttaaccctaagacccttccttccggcctggacgactacccccgggcttcacatcctagcgtgactgaaagacacctggatctccgctgttgggtcgccctcggggctagagtgctcacccggctggctgaacatttaggggaggccgaggtggctgcggagttgggacctctggctgcttcccttgaagcagccgagagcctcgatgagctgcactgggcacccgaactcggagtgtttgcagatttcggtaatcacacaaaggccgtgcagctaaagcctcgaccacctcagggactcgtgcgggtggtgggccggccccagcctcagctgcagtacgtcgatgctctgggctacgtgagcctgttcccacttctcctccgtctgctggatccaacttcgtctagactggggccactgctggatatcctggccgattctcggcatctgtggtcccccttcggactgaggagcttggctgcgtcatcctctttctacgggcagcggaatagcgagcacgatcctccctactggcgtggtgcagtgtggcttaacgtgaattacctggccctaggagccttacaccactatgggcaccttgagggtccacatcaagctcgagccgccaaacttcacggtgaattacgggctaatgtcgtgggcaatgtttggcggcagtatcaggccaccgggtttctgtgggaacagtactccgaccgggatgggcggggcatgggttgcaggccttttcacggatggacctccctggtcctgttggcgatggcagaagactactag

SEQ ID NO: 51484 - DNA, 456 bp, Artificial Sequence
  Description of Artificial Sequence: Synthetic coding sequence
atggagggccagcggcaggagagccacgccaccctgaccctggcccaggcacactttaataatggagagtatgccgaagcagaggcattatacagcgcctacatccgaagatgcgcctgtgccgcttcatccgatgaaagtcccggctcaaagtgcagcccagaggatcttgctaccgcctacaataaccgagggcagattaaatattttagggttgatttttacgaggcaatggacgattacacaagcgccatcgaggtccagcccaatttcgaagtgccctactacaatcgcggacttatcctgtatcggctgggatacttcgacgatgcacttgaagacttcaagaaggtccttgacctcaacccgggcttccaggacgccactctgtcccttaagcagaccatcctggacaaagaggagaaacagcgcaggaacgtggccaaaaattactag

SEQ ID NO: 51485 - DNA, 789 bp, Artificial Sequence
  Description of Artificial Sequence: Synthetic coding sequence
atggccagcttcggctggaagcggaagatcggcgagaaggtgagcaaggtgacatctcagcaattcgaagcagaggccgcagacgagaaggatgtcgtagataatgatgaggggaactggctccacgctataaagcggagaaaagaaatcctgctggagggatgtgccgaaaaaagcaagcaactcaaggacgagggagcatctctcgccgagaacaaaaggtacagggaggcaattcagaagtgggatgaagctctgcaattgacgcctaacgatgcaacgctgtacgagatgaagtcccaagtgcttatgagccttcacgagatgtttccggccgtgcacgccgctgaaatggctgtgcagcagaatcctcactcctgggaatcctggcagaccctgggccgagcccagctagggctgggagagatcatcctcgccataaggtcttttcaggtcgcactccatatttacccaatgaaccccgagatctggaaggaggacttgagctgggccagaaccttacaagagcaacaaaaggttgctcagcgtataaaaaagagtgaagccccagctgaggtgacccacttctccccaaagagtatccccgattacgatttcgaatctgatgagatcgtcgccgtttgtgcggctatcgcagaaaaagagaaaacagttagcgcaaataaaaccatggtgatcgtaagtgcttctggggccatcgagacagtcactgagaaagaggacggagcaactcctccagacggcagcgtgttcatcaaggctcgttag

SEQ ID NO: 51486 - DNA, 1701 bp, Artificial Sequence
  Description of Artificial Sequence: Synthetic coding sequence
atgctgcagcggagcccccgggccggccccagccgggcccagggccgtcgtgaagcggccgaaactggaggtcccaccacgcaggagggcgtggcatgcggagtccatcagctggctacacttctgatggagctggacagcgaggatgaggccagccggctattggccgcagacgccctctaccggctgggaaggctggaagagacccacaaagctcttctcgtggccctcagcagacggccccaagctgccccagttctcgcgcgcttggcactgctccagttgcgcaggggcttcttttatgacgcaaaccagctcgtgaagaagctggtgcagtctggtgacacggcttgtctgcagccaaccctggatgtgttttgccacgaggacaggcagttgttacagggtcactgtcatgcccgggcgctcgccattttgagagctcgtcctggaggcgctgatggaagagttcataccaaagaagctattgcctacctgagtctcgcaattttcgcagccgggtcacaggcctctgaatcactgctcgcaagggcacgatgctacgggtttctggggcagaagaaaacagccatgttcgacttcaataccgtcctcagagccgaacctggcaatgtccaagcactatgtggaagggctttagtccatcttgccttggaccagttgcaggaagccgtggacgatatagtcagcgccctgaaactcggtccaggaaccgtagtgccagaactccgaagcctgaagccagaggcacaagcactaataacacaggggctatattctcactgcagggctttgctgtctcaattgccagacaccggagcccctctggaagacaaggacacgcaggggctgctcgctgtgggtgaggccctgatcaagattgactccggccagccgcactggcacttgctcttggcagacatcctgatggcacagggatcctatgaagaggccggaacccatctggagaaggccctgcatcgcgctccaacaagcgaggctgcccgcgcacgcctgggtctgctccagttgaagaagggagacgtgcctggtgcagcgagagatctgcaaagtttggcagaagttgatgctccagatctctcctgcctcctgcacctcctcgaagctagcgaacggcaaagcctggcccaggccgcagcgcaggaagccggtactttactggacgctgggcagccccggcaggcactcggatactgtagcctgtcagtgctggcatctggatctagtgcttgtcatctcaggttgagagccacttgtctggcagaactccaagagttcggacgggccttgcgagacctggaccacgtactacaggaggcactaggcgatggggacctcccccgtcgggctgaggacttttgccggcaagggaggttactgttgagtctgggtgacgaggccgcagctgcaggggccttcgctcaagctctgaaactggctccttcgctcgcccagaactctctgtgtaggcagccaggaagagcccctacggcgagaatgttcctgctgcggggccagtgctgtctggaggagcagagacatgcagaggcttggaccgctgtggaaagtggattactggtggacccagatcacaggggccttaaaagactgaaagcccggattcgccgggaggccagctcaggatgctggcttcaatag

SEQ ID NO: 51487 - DNA, 570 bp, Artificial Sequence
  Description of Artificial Sequence: Synthetic coding sequence
atgggcacccccaacgaccaggccgtgctgcaggccatcttcaaccctgatacaccttttggagatatagtcggccttgacttgggcgaggaagcagaaaaagaggaacgcgaggaagatgaagtgtttccacaagcgcagctcgagcagtccaaggctctggagcttcagggtgtgatggcagccgaagcgggcgatctaagtaccgctctcgaaaggtttgggcaagccatatgcctgctgccagagcgggcctctgcttacaacaacagggctcaggccaggcgcctgcagggtgatgtggcgggggccctggaggacctggagcgggctgtggagcttagtggcgggagggggagggccgcccggcagtcatttgttcagagggggctccttgcaaggctgcaaggacgggatgatgacgctagaagagatttcgaaagggctgccaggctcgggtcaccatttgcccgccgacagctggtgctgcttaacccatatgcggctctgtgtaatcggatgctggctgacatgatgggccaactgagacgaccacgagactcgcgctag

SEQ ID NO: 51488 - DNA, 393 bp, Artificial Sequence
  Description of Artificial Sequence: Synthetic coding sequence
atggccgccgaggccggcgacctgagcaccgccctggagcggttcggccaggctatctgcctcttgcccgagcgcgcctcagcatacaataaccgggctcaggctaggcgtcttcagggcgatgtcgcaggagccctggaagacctggagagggctgtggagctgtcaggaggtaggggtcgcgccgcccggcagtcattcgtgcagcgaggactcttggcgaggctgcaagggagagacgatgacgcgagacgagatttcgagagggcagctcggctgggctctccatttgcgagaagacagctggtacttctgaatccttatgcagctctctgtaatcggatgcttgcagacatgatgggtcagctcagaaggcccagggatagccgttag

SEQ ID NO: 51489 - DNA, 4695 bp, Artificial Sequence
  Description of Artificial Sequence: Synthetic coding sequence
atgagcagcaaggaggtgaagaccgccctgaagagcgcccgggacgctattcgaaacaaggagtacaaagaagccttaaagcactgtaagactgtgttgaaacaggaaaagaacaattacaatgcatgggtatttatcggcgtggcagccgctgaattagagcagcccgatcaggctcagagtgcatacaaaaaggcggcggagttggagcctgatcagttactggcatggcaggggctcgctaatctgtacgagaaatacaatcatattaatgccaaagatgacctgccaggtgtctaccaaaaactactggacctctatgagtctgtggataagcagaagtggtgcgatgtgtgcaaaaagctggtcgatttgtactatcaggagaagaagcacctggaagtcgcaaggacctggcacaaattgattaagacacggcaggagcaaggcgctgaaaatgaggaactgcaccagttgtggcgcaagctgactcaattcctcgccgagtctacggaagatcagaataacgagacgcagcagctgctatttaccgcattcgagaatgcactgggactgtctgataaaatcccctcggaggaccatcaggttctttaccgtcactttatccaaagcctcagtaagttcccacatgaatcggcccgactgaaaaaagcttgcgaaggaatgattaatatctatccgacggtacagtatcccctggaagtgctgtgtctccacttgatagagtctggcaatctgaccgatgaggggcaacaatactgctgccggctggtcgagatggattcaaagtctggcccaggccttataggcctgggaatcaaagcactccaggataagaaatatgaggacgccgtgcgcaatctgactgagggcctaaaagaaagtcccgtctgtacatcgggctggtatcacctggctgaagcccaggtgaaaatgcacagaccaaaggaggcagttttgtcatgttctcaggccttgaagattgtggataatctaggggccagcggtaactcattataccaacgaaatctctgtcttcatctgaaggccgaagccctgattaagctaagcgactatgattcatcagaagaagctattagaaccctggaccaaatttcagatgccgataacatcccagggcttctggtgcttaaaagccttgcatacagaaataaaggcagtttcgacgaagccgccaagatcatggaagacttgttgtcttcgtatccagacctagccgaagtgcacgcactcgaagccctcatacattttactaaaaaggactatttgcaagccgagaagtgcttccaaagagcactcgaaaaggataccgaggtagccgaatatcattaccagctaggccttacatattggtttatgggggaagagactcgtaaggataagacaaaggccctgacacactttctgaaggccgctcgcttagacacctacatggggaaagtcttttgttacctggggcactactaccgggacgtggtgggggataagaacagggctcgtggttgctaccgtaaggccttcgaattggatgatacagacgcagagtcaggagccgcagccgtggatctgtccgttgagctagaggacatggaaatggctctggctattttaactaccgtgacccagaaggcaagcgcaggcaccgccaagtgggcctggttacggcgcggactttattatttgaaggcaggtcaacatagtcaggcggtcgccgacctacaagctgcactccgagcggatcccaaagactttaactgctgggaaagccttggggaggcctatctgtctcgcggcgggtacactactgcgctcaaatcctttacaaaagcctccgagttgaatcccgagtccatttactcagtattcaaggttgcagcgatccagcagatcttggggaaatacaaggaagctgtggcccagtatcagatgatcattaaaaagaaggaggattatgtacctgccctaaaaggcctgggcgagtgccacctgatgatggccaaagcagctctcgtggattatctggacggcaaggccgtggactacatagaaaaggcactagaatactttacgtgcgccctacagcatcgagcagacgtctcatgcttgtggaaactggccggggacgcatgtacatgcctctacgctgttgctcccagcaaggttaacgtgcatgttctgggagttctcctgggccagaaggaggggaagcaggtactgaagaaaaatgagttgctgcacttagggggaagatgttatggtcgagccctgaagctgatgtcaactagtaacacctggtgcgacctcggcattaactattatcggcaggcccagcacttagccgagacagggtcgaacatgaacgatttgaaagagctcctggagaaaagtctccactgtctgaagaaggctgtgaggctggattcgaacaaccatttgtactggaatgccttgggagtggtggcgtgttactctgggattggtaattacgctttagcccagcactgcttcatcaaaagcattcagtctgagcagatcaacgcagtcgcctggacgaaccttggcgttctctacttaacaaacgagaacatcgagcaggcacacgaggcctttaagatggcacaatccctggatccctcctatcttatgtgctggataggccaagccctgatagccgaagccgttggcagctatgacactatggacctcttcaggcacaccaccgaactgaatatgcatacagagggcgctttagggtatgcatattgggtttgcaccactctccaggataagtcaaaccgggagaccgagctgtaccagtacaatattcttcagatgaacgccataccagcggctcaggtcattcttaataagtacgtggaaagaattcagaattacgcccccgcttttacaatgttggggtatctgaatgagcatttgcaactcaaaaaagaggcggcaaacgcctatcaaagagcgatcctgcttctacaaactgctgaagaccaggacacatataacgtcgccatcaggaactacgggaggctgctatgtagcaccggcgaatacgacaaggctattcaggcatttaagtccactcccctggaggtcctcgaagatataattggcttcgcgctggctctgttcatgaaaggcctttacaaggaatcaagtaaagcctacgaacgggcgttgtctattgtcgagtctgagcaggacaaggcccacatactcacggccctcgccattacagagtataagcagggcaagactgacgtagctaagactcttttatttaaatgcagcatacttaaagaacccaccacagagtctctgcaggcactgtgcgctcttggcctcgccatgcaagacgccactctttcaaaggccgctctgaacgagcttctgaaacacattaagcacaaggactcgaattaccagcgctgcttgttgactagcgctatctatgctttacaagggagatctgttgcagtgcagaagcagattagcaaggctgtgcactccaatcccggcgaccccgcactgtggtccctgctgtctcgggtggtggcgcagtacgcacaacgcaacgcaaagggcggcgtggtggccggaaatgtggcccacatcttggacagtaatcacggaaaaaaagcactcctttatactgctgtgaaccagctggccatgggaagttcaagtgctgaggatgagaagaacacagctcttaagacaattcagaaggcggcactgctgagtcctggggatcccgcgatttgggcaggattaatggctgcgtgccatgccgatgataagttagcactcgtcaacaatactcagccaaaaaggattgatctgtatctcgccctcctctctgccgtttcagcctccatcaaggacgaaaagttctttgaaaattataatcagtctctggaaaagtggtccctgtcacaggctgtaaccggcctgattgatacaggccggatcagtgaggccgagaccctgtgcactaagaatctcaagtccaatcccgaccagcctgcagttatcctcttgttgcgccaggtccagtgcaaacccttgctagaatctcagaagccactgccagacgccgtgctggaggaacttcagaagacagtcatgtccaatagtacaagcgtgccggcatggcagtggttagcccatgtgtatcagtcccagggaatgatgagggcagctgagatgtgttatcggaagagtctgcaactcgccagtcagcgtggtagctggtcaggaaaattgtcaagtttgctgaggcttgcacttctggcactaaaagtgtgcatggccaacatctcaaatgatcactggccatcactagtgcaggaggccaccactgaggctctcaagttgtgcttttgtcccctcgcggtcttgcttcaggccctcttacaatttaagcgtaaaatgggtgcaagggagactcgtagactcttggagcgagtcgtctatcagccgggctaccctaagtccatcgctagtacagcgagatggtacttgttgaggcacctttatgccaaagatgactacgagctgatcgatgtgctagtcaacaacgctaaaacacacggcgacaccagagcacttgagctgaaccagaggctgagttctcagtag

SEQ ID NO: 51490 - DNA, 288 bp, Artificial Sequence
  Description of Artificial Sequence: Synthetic coding sequence
atgagcagcaaggaggtgaagaccgccctgaagagcgcccgggacgctatacgaaacaaggagtataaggaggccctcaagcactgcaaaacggtccttaagcaggaaaagaacaactacaacgcgtgggtgttcattggagttgcagccgccgaactcgaacagcctgatcaggctcagtccgcttacaaaaaagcagcggaattggaacctgaccaactgctcgcctggcagggactggcaaatctgtatgagaagtataatcacatcaacgcaaaggacgattag

SEQ ID NO: 51491 - DNA, 1236 bp, Artificial Sequence
  Description of Artificial Sequence: Synthetic coding sequence
atggccgccgccagccccctgcgggactgccaggcctggaaggacgcacgtctgccactctctacaacaagcaatgaagcttgcaagctgtttgacgccacccttacccagtacgtgaagtggaccaacgacaagagtctgggggggatcgagggatgtctgtcaaagcttaaggccgctgaccctacattcgtgatggggcacgccatggccacagggttggtgctgatcggcactggctcctctgtgaaactggataaagagttggacttggcagtcaagactatggtggagatatctcggacgcaaccgctgaccaggcgggagcagctccacgtcagcgcggtagagacatttgcaaacggctacgtgaaaggcatttactcatttggcctgatggagactaacttttatgaccaggcagagaagctggcaaaagaagctctctcaatcaatccaacagacgcatggagcgtgcacactgtcgcgcatatacacgaaatgaaggcggaaattaaggatggacttgagtttatgcagcattcagagacattttggaaggattctgacatgttagcgtgtcataactattggcactgggccctgtaccttatcgaaaaaggagaatatgaggctgccctcactatttacgacacccacattctgccctccttacaagcaaacgacgcaatgctggatgtcgtggattcctgcagtatgctctataggctgcagatggaaggcgtgtctgtgggccagcggtggcaggatgtgctccccgttgccagaaagcatagcagagatcatattcttctattcaacgacgctcactttctgatggctagcctcggagcgcacgatcctcagaccacacaggagctgttaactactctgagggatgcctctgagagccccggagaaaattgccagcacctcctggccagagacgtcggcctgcctctttgccaggctctagtggaagctgaggatgggaatccagacagagttctcgaacttctcctcccaatcaggtatcgcattgttcaattaggcggatccaatgcacagagggacgtctttaatcaactgcttatccatgctgctcttaactgcacttcaagtgtgcataagaatgtggctcgaagcttgttgatggagagggacgcgctgaagccaaatagccctttaaccgagcgacttatcagaaaggctgccaccgtccatttgatgcagtag

SEQ ID NO: 51492 - DNA, 1410 bp, Artificial Sequence
  Description of Artificial Sequence: Synthetic coding sequence
atggccgccgccagccccctgcgggactgccaggcctggaaggacgcccgacttccactctccaccactagcaacgaggcgtgtaagctgttcgacgccactctgacacaatacgtcaaatggacgaacgataagagcctgggggggatcgaagggtgtctcagtaagctgaaggcagctgatcccaccttcgttatgggtcacgcgatggctactggactcgtcttgattggcactggctcctctgtcaaactggacaaagagctggacctggctgtgaagacgatggtggagatcagtcggacacaacctctaactagaagagaacagctccacgtgtcagctgtcgagacatttgccaatggcaacttccctaaggcttgcgagctgtgggaacaaattctgcaggatcaccctaccgatatgctggctctgaaattctcacacgatgcctacttttacttaggatatcaggaacaaatgcgggactcagtggctaggatctatccattctggacccccgacatccccctgtcctcctacgtcaagggaatatattcgttcgggctcatggagaccaacttctacgatcaagccgaaaagctcgctaaggaggctctgagcattaatccaacggatgcttggtcagtgcacactgtcgcacacattcacgagatgaaagcagagatcaaggacgggttggagttcatgcaacacagtgagaccttctggaaggattccgacatgttagcctgtcataattattggcattgggccctgtatctgatagagaaaggggaatatgaggcagctttgactatatacgatacgcacatcttgcccagtcttcaggcaaatgatgcgatgctagatgtagtggactcttgttcaatgttataccggctccagatggaaggcgtgtctgttggtcaacgttggcaggatgttctccctgttgcgcggaagcattccagggaccatatcctgcttttcaatgatgcccactttctgatggcctcacttggagcccatgatcctcagaccactcaggagctgttgactaccctgagggacgcatctgagtcccccggcgagaattgtcaacatttattggcccgggacgtgggactgccactgtgtcaggctttggtggaagcggaggacggaaatccagatcgggtactggaactgctgcttcccattagatatcggattgtgcagttaggaggcagcaatgcccagcgtgatgtgttcaaccagctcctgatacacgcggcactgaattgcacgagcagcgtccacaagaacgtggcacggagtcttctgatggaaagggacgctttgaagccgaactcaccactcacggaaagactgattcgcaaagctgccactgtgcatctaatgcagtag

SEQ ID NO: 51493 - DNA, 1263 bp, Artificial Sequence
  Description of Artificial Sequence: Synthetic coding sequence
atggacagcagccccagcctgcccctgatccggacccccgagagctcactgcatgaggctctcgaccagtgcatgaccgctttagatctgttcctcaccaaccaattttcagaggctctgagctaccttaaaccccggacaaaggagtcaatgtatcattctctcacgtacgctacaatcttagaaatgcaggcgatgatgacatttgaccctcaggatatactgctggctggcaacatgatgaaggaggcgcaaatgctctgccaaagacataggcggaagtctagcgtgaccgacagcttctcctctcttgttaacagacccaccctcgggcagtttacagaggaggaaatccacgctgaagtgtgctatgcggagtgcctgctacagagagccgcgctgacatttcttcagggatcctcccatggaggagcagtgaggccccgggcattgcatgatccaagtcatgcctgctcttgcccgcccggcccaggtcgtcagcatctattcttactgcaggatgaaaacatggtctcattcattaagggagggattaaggttcgcaacagttaccagacctataaagaattggacagcctggttcaatcctctcagtactgcaagggtgaaaatcacccccacttcgaagggggggtaaagctgggggtcggcgctttcaacctcacactgtccatgctgccgacaaggattctcaggttgttggagttcgtagggttttccggcaataaggactacggtctgctgcaactggaggagggggcttcaggccacagttttagatcagtcctgtgtgtcatgttgctgttatgctaccacacgtttctcaccttcgttctcggcaccggcaatgtgaacatcgaggaggccgagaaattactgaaaccatatctgaacagatatccaaaaggtgcaatttttctctttttcgccggacggatcgaagttataaagggcaatatagatgctgtcagtgatggcgggcccggacgcggctggggttccctcggggtttcacagacctcgagaaaatccggtacctgcgatattctgagagaccggattgactgggggagaggtggaggccaagaaaggaccaatcagagagccggggctggggaggctctgctcgccgagcagccgggtaagacaagggaggaggaggcttttgtcgtgccagggatactcactggacgttaccgtaccgcggcgctccaatggcgggaggtggagggaggggcctag

SEQ ID NO: 51494 - DNA, 1737 bp, Artificial Sequence
  Description of Artificial Sequence: Synthetic coding sequence
atgggccagaagggccacaaggacagcctgtacccctgcggcggcactcctgaatccagtttgcacgaggcgctagatcagtgtatgacagctcttgatttattcctcactaaccaatttagcgaagcgctcagctacctcaaacctaggacaaaagagagcatgtatcatagcctaacttatgcgactatcttagagatgcaggccatgatgacctttgatccccaggatatcctccttgctggcaatatgatgaaagaagcccagatgctgtgccagcgccatcgcagaaaatcgagcgtgaccgattcattctcttcattggtgaacagacccaccctggggcaatttacagaggaagaaatccatgcagaagtgtgctatgccgagtgcctgctgcagagagccgccttgacttttctgcaggacgagaacatggtgagctttatcaaggggggcatcaaagtccgcaatagctatcagacatacaaggagctggacagcctggtacagtcctcccagtattgtaagggtgaaaaccaccctcacttcgagggtggcgtcaaattgggggtaggagcatttaacctcacactttccatgctcccaaccagaatcctaagactactggagttcgtgggcttcagtggaaacaaggattacgggctgctgcagttagaagagggtgctagcggacactcttttcgctccgtgctttgtgtgatgcttctgctctgttaccacaccttcttgacgttcgtattgggtaccggaaacgtcaacatcgaagaggcggagaagctgctcaagccgtatctcaaccgctacccgaaaggagctatcttcctcttcttcgcaggccggattgaagtcataaaggggaatatcgacgcggccatccgtcgctttgaggaatgttgtgaggctcagcaacactggaaacagtttcaccacatgtgctattgggagctgatgtggtgtttcacgtataaaggccagtggaagatgtcatatttctatgcagatctgctctcaaaggaaaactgttggagcaaggcgacgtacatttacatgaaggccgcatatctgtccatgtttgggaaagaagaccacaaacccttcggcgacgacgaggttgagttatttagagcggtacctggcctgaagctaaagattgccggtaagtctttaccaacagaaaagtttgccatcagaaaatcacggcggtattttagctccaatcctattagcctcccagtccccgcgcttgaaatgatgtacatctggaatggatatgccgtgattggcaaacaaccgaaactgaccgacggaatccttgaaatcattaccaaagctgaagaaatgcttgaaaaaggacctgagaatgagtactcggtggatgatgagtgcctggtgaaactgttgaagggcctgtgcttaaaatatctgggaagagtccaggaagctgaggagaattttagatctattagcgccaatgagaaaaaaataaaatatgatcattatctgatacccaacgctctgctagagttggccctgctccttatggaacaggaccgcaacgaggaggcaatcaagctgctggagagcgctaaacagaactataagaattattcaatggaatcccggacacacttccggatacaggcagcgactctgcaggccaaatcctctctcgagaatagctcacgtagcatggtctcctctgtgagcctgtag

SEQ ID NO: 51495 - DNA, 1746 bp, Artificial Sequence
  Description of Artificial Sequence: Synthetic coding sequence
atggccttcctgaccacctggaaggaggccgccagcggcaagagcgatcgcaggactcccgagagttctcttcacgaagccctagaccagtgtatgactgcactcgacctgtttctgaccaatcaatttagtgaggcattgtcatatctgaagcctcgtacaaaagaatctatgtaccactctctcacttacgctacgattctcgagatgcaggctatgatgacattcgatccacaagatatcctgcttgctgggaacatgatgaaggaggcccaaatgctgtgccagagacaccgcaggaaatcatccgtgaccgatagttttagctccctggtgaacagacccacactgggacaatttactgaagaggaaattcatgcggaggtgtgttatgcggaatgcctgttacagcgcgccgccttaaccttcctgcaggatgagaatatggtctctttcattaaagggggtattaaagttaggaatagctaccagacatacaaggagcttgattctctcgttcaatcatcacagtactgtaagggcgagaaccatccccattttgagggcggcgtcaaacttggagtgggcgcgtttaacctcacactgtctatgttgcccacaagaatacttcggttactggagtttgtcggtttcagcggtaataaggattacggattgctccagttggaagagggagccagcggacactccttcagatccgttttatgcgtgatgctgctactttgttaccacactttcctgaccttcgtgcttgggacaggcaatgtaaacatcgaagaagcagaaaagttactcaaaccatatttgaaccgttaccctaagggcgctatctttctgttcttcgccggaagaattgaagtcattaagggcaacatcgacgccgcaatcaggagatttgaagagtgttgtgaagctcaacaacattggaagcaattccatcacatgtgttactgggagttgatgtggtgtttcacctataaggggcaatggaagatgagttatttctacgctgatttactgtccaaggagaattgttggtccaaggcaacctatatctatatgaaggcagcctatctcagtatgttcggaaaagaggatcataaacccttcggggatgatgaggtagaactgttcagggctgtgcctggcctgaaattgaagattgccgggaagagcctccctacagagaaattcgcgatcaggaaaagcagacggtactttagtagtaaccccatctcgctgccagtcccggcactggaaatgatgtatatctggaacgggtacgcagtgattgggaagcagcctaaactgactgatgggatacttgaaattattacaaaggccgaggagatgctggagaaaggcccggaaaatgagtacagcgttgatgacgagtgtctggtcaagctgttgaagggactatgtctcaagtacctagggagagttcaagaggctgaggagaacttcaggtccatctccgcaaacgagaagaagattaaatatgaccattatttaatccctaacgccctcctggagttggccctgcttttgatggagcaagaccgtaatgaggaggccattaagctgctggagtcggcaaaacaaaattataagaactattctatggaatctcgcacccactttagaatacaggccgccactttacaggcgaaaagtagtctggaaaatagtagcagaagtatggtgtcttctgtaagcctgtag

SEQ ID NO: 51496 - DNA, 1842 bp, Artificial Sequence
  Description of Artificial Sequence: Synthetic coding sequence
atgggccagaagggccacaaggacagcctgtacccctgcggcggcacacccgaatcgagccttcacgaggccttggatcagtgtatgactgcactggacctctttcttaccaaccagttttctgaggccttatcctatctgaagccaagaaccaaagagagcatgtaccacagcctgacctatgctactattctggagatgcaggcaatgatgacctttgacccccaggacatcttactggccggaaatatgatgaaggaagcccagatgctctgtcagcgccacaggcggaagagttcagtaacagattccttcagctccctggttaatagacccacactcggccagtttactgaagaagagattcacgcagaggtatgttacgccgaatgccttctccagcgcgcagccttgacctttctacaggggagcagtcacggaggcgctgtgaggccgcgcgctctgcacgacccatctcatgcctgctcatgcccaccaggaccgggtcgccagcacttattcttgctgcaggatgaaaatatggtctctttcattaaaggaggcattaaggttcgtaatagttatcagacgtataaagagctggattctctagttcaaagctcacagtattgtaagggtgaaaatcacccacacttcgagggtggcgttaagctcggcgttggagcctttaatctgactttgagtatgctaccaacgaggatcctgaggctcctggaatttgtggggttttcgggtaacaaggattatggcctcttgcagctggaagagggagcctctggccacagcttccgaagtgtgctgtgtgtaatgctgctgctgtgttatcacactttcctgacttttgtccttggcactgggaacgtgaacattgaagaggccgaaaaactgctcaaaccctacctcaacagataccccaagggagctatctttctcttttttgcaggtagaatcgaagtgattaaaggcaatattgacgcggcgatacgccggttcgaagaatgttgtgaggcccagcaacactggaagcagtttcaccatatgtgctactgggaactcatgtggtgctttacctataaggggcagtggaagatgtcctatttctacgcagatcttctgtcaaaggaaaactgctggtcgaaagccacatacatatacatgaaagccgcttacctctcaatgttcggaaaagaagaccacaagcctttcggtgacgatgaggtggaactgtttcgggcggttccagggctaaagctgaaaattgccgggaagagtctcccaacagaaaaattcgccattcgaaagagcagaaggtacttttccagtaacccaattagtctgccagtcccagcgttggagatgatgtacatttggaacggttatgccgtgatcggaaagcagcctaaattaaccgacggcattctggaaataattactaaggctgaggagatgctggaaaaagggccggagaacgagtattcagtggatgacgagtgtctggtcaagcttttgaagggactctgcctcaagtatctaggccgggtgcaggaggccgaagagaacttcaggagcatctcagccaacgaaaaaaaaattaagtacgatcactatctcatcccaaatgccctcctcgaacttgccctgctgctgatggagcaggacagaaatgaagaagccattaagcttcttgaatctgccaagcagaattacaagaattattctatggagtctcgcacgcacttcagaatccaagctgctaccttgcaggctaaaagctccctggagaattcctctcgctcgatggtgtcaagcgtgtctctgtag

SEQ ID NO: 51497 - DNA, 1734 bp, Artificial Sequence
  Description of Artificial Sequence: Synthetic coding sequence
atgaccagcgccggcggcgcccccggcgccctgcccgccggcaccccggaatcttccctccatgaggccctcgatcaatgtatgaccgcactggatctttttctaacgaaccagttttctgaagccttgagctatttgaaaccccgaaccaaagaaagcatgtaccacagtttaacttacgccaccatactggaaatgcaggcaatgatgacttttgacccacaggacattctactagcaggcaatatgatgaaggaggcgcagatgctgtgtcagcggcatagacgcaagtcatctgttactgatagctttagctcacttgttaataggccaactctcgggcaattcaccgaagaagagatccatgctgaagtgtgctatgccgagtgtctgcttcagagagccgctctcaccttcttgcaggatgaaaacatggtgtctttcatcaagggtggaatcaaagtgcgtaattcttatcagacttacaaagaactggactctttggtgcagtcctcacaatactgtaaaggagagaatcacccccacttcgaaggcggagtcaaactgggagtgggggctttcaacctgacattgtcaatgctgcccacccgcatcctgaggctgctggaattcgtcgggtttagtggtaataaggactatggcctgttgcagctggaggaaggagcctccggacattcgttccgcagcgtgctttgcgtaatgcttctcttgtgttaccacacatttttgacttttgtgctcggcaccggtaatgtgaacatcgaggaagccgagaagctcctcaagccttacctaaatcggtatcctaagggggcgatctttctattttttgccggacggatcgaagtgattaagggaaatatagatgcagcgatcagaaggttcgaggaatgttgtgaagctcagcagcactggaagcagttccatcacatgtgctactgggaacttatgtggtgtttcacatataaggggcagtggaaaatgtcatatttctacgcagatctgttatccaaggagaattgttggtcaaaggctacttatatctatatgaaggccgcttacctgagtatgttcggcaaggaggatcataaacccttcggtgatgatgaggtcgaactgtttcgcgcagtgccggggttgaagctaaagattgccgggaagagtctgcccactgagaaattcgcaatacgaaaatctagacgttacttttcctctaatcccatctcactgcctgtaccagcactggagatgatgtatatatggaatgggtatgccgtgatcggtaaacagccaaagttaacagacggcatcctcgagattataacaaaggcagaagaaatgctcgagaagggccccgagaacgaatacagtgtggacgacgagtgcctggtaaaactactgaaaggattgtgcctgaaatacctgggtagagtccaagaggcagaagaaaactttcgcagcattagtgccaacgagaagaaaatcaagtatgatcactacctcattccaaacgccctcttagagctggcgcttctgttgatggaacaagatagaaacgaggaggcgataaagctcttggagagtgctaagcagaactacaagaactacagtatggaatcaaggacccactttcggattcaggctgcaactcttcaagccaaatcctctctggagaatagctccagatctatggtctcttccgtctccttgtag

SEQ ID NO: 51498 - DNA, 339 bp, Artificial Sequence
  Description of Artificial Sequence: Synthetic coding sequence
atgaaggccgcctacctgagcatgttcggcaaggaggaccacaagcccttcggcgatgatgaggttgaactgtttcgggcggttccggggcttaagttaaagattgcaggcaagagcttaccgaccgaaaagttcgccatccgcaaatccaggagatacttctcatccaaccctataagcctgcctgttcccgctctggaaatgatgtatatctggaatggttacgccgtaatcggaaagcaaccaaagctgacggatggcattctcgaaatcatcacaaaagccgaggaaatgctggaaaaagggcccgaaaacgaatatagcgtagatgatgagtag

SEQ ID NO: 51499 - DNA, 666 bp, Artificial Sequence
  Description of Artificial Sequence: Synthetic coding sequence
atgaaggccgcctacctgagcatgttcggcaaggaggaccacaagcccttcggtgatgacgaggtggaattgtttcgcgccgtccccggcttgaaactgaaaattgcgggcaagagccttccgacagagaaattcgccattagaaaaagtcgtaggtacttctctagtaaccccatatcgctgccagtgcctgctcttgaaatgatgtacatctggaacggctatgcggtgatcgggaaacagcctaagctcaccgacggcatactagaaatcattacgaaggcagaggagatgttagagaagggccctgagaatgaatatagcgtagacgatgaatgcttggtaaaattgctcaaaggactgtgccttaagtatctagggcgcgtgcaggaggccgaggagaacttccggtctatttcagccaacgaaaaaaaaattaaatacgaccattacctgatcccgaatgctttactggagttagcccttctccttatggagcaagatagaaatgaggaggctattaagctcctggaatcagcaaaacagaattataagaactactcgatggagagtcgcactcactttaggattcaggctgccactctacaggcgaagtcttccctagagaactcttcacgctcaatggtctcaagtgtgtccttatag

SEQ ID NO: 51500 - DNA, 1569 bp, Artificial Sequence
  Description of Artificial Sequence: Synthetic coding sequence
atgagcttcggcgccagcttcgtgagcttcctgaacgccatgatgacgttcgaagaggagaagatgcagcttgcttgtgacgatctaaagaccacagagaagctctgcgagagcgaggaggccggagtaatcgagactatcaaaaataagattaaaaaaaatgttgacgtcagaaaatcagccccatcaatggtggaccggctacagagacagatcattattgcagactgtcaggtgtatctggcagtgctgagcttcgtaaagcaggagctgtccgcctacataaaaggaggctggatccttcggaaggcctggaaaatctataacaagtgctatttggacataaacgcactacaggagttatatcagaaaaaactcaccgaagaatcactgaccagcgacgccgcgaatgacaaccacatcgtggccgaaggcgtgagtgaggagagcttgaataggctgaaaggggctgtttcgtttggttacggtctgttccacctctgcatttctatggtgccaccaaacttgctgaaaattatcaacttacttggcttccccggcgaccgattgcagggcttgagttctctgatgtatgcctctgagtccaaagatatgaaggctcccctggcaacgctagcattgctttggtaccacaccgtggtgcgtccgttcttcgcactcgacggctcagataacaaggcgggtctcgatgaggccaaagagatcctcctcaagaaagaggctgcttaccccaatagttccctctttatgttttttaaaggtcgtatccagaggctcgaatgtcaaatcaatagcgccctcacatccttccacacggccctcgaactggccgtcgaccagagagagatccaacatgtctgtctgtatgagatcggctggtgctcgatgatcgaactgaatttcaaagatgcattcgattctttcgaacgtctgaagaatgaaagtcgttggtcccaatgttattatgcatacttgaccgccgtgtgccagggagccacgggagacgtggatggagcacagatagtgtttaaggaagtgcagaagctcttcaagcgcaagaacaaccagatcgaacagtttagtgtgaagaaggccgaacggttcagaaaacaaacacccaccaaggcgctatgcgttctcgcaagtatcgaggtcctctacctctggaaagccctcccgaactgctcttttccaaacttgcaaagaatgtcccaagcgtgccatgaggtagatgactcgtctgtggtagggcttaagtacctactgctgggcgctatacacaagtgtctgggcaactctgaggatgctgtccagtatttccagagagctgtcaaggatgaactctgtcgccagaacaatctctacgtgcagccatacgcatgctatgagcttggctgcctcctactggacaagcccgaaaccgttgggcggggtcgcgccttactgctccaggcaaaggaggatttttccggttacgactttgaaaatcgcctgcatgtacgcatccacgcagcgctggcctcactgcgcgagctggtgccgcaatag

SEQ ID NO: 51501 - DNA, 1752 bp, Artificial Sequence
  Description of Artificial Sequence: Synthetic coding sequence
atggccggcagcgagcagcagcggccccggcggcgggacgacggcgatagtgacgccgcggccgccgccgctgcccccttgcaggacgctgagttggcgctggcaggaatcaacatgttgcttaacaatggattccgagagtcggaccagcttttcaaacagtaccgaaatcattcaccactaatgagcttcggggctagttttgtctccttcctgaatgcaatgatgacctttgaggaggagaaaatgcagctcgcttgcgacgacctcaaaacaactgaaaaactttgcgaatctgaggaagcgggggtaattgagaccattaagaacaagattaagaaaaacgtagacgtcagaaaaagtgctccatctatggttgaccgtttgcaacggcagatcatcattgccgactgccaagtgtacttggcagtgctatcattcgttaaacaggagctgtcggcatatatcaaggggggatggattctgcgtaaggcttggaagatctataacaagtgttacctggacattaacgcgctccaagaactgtatcagaaaaagctgaccgaagaatccttgacctcagatgccgctaatgacaaccacatcgttgctgaaggagttagcgaggagtctttaaacaggctaaagggagcagtgagtttcggctatggactgtttcatttgtgcatttcaatggttcccccaaaccttctgaagatcatcaatctgttaggcttcccaggggataggttacaggggctgtcatctctgatgtacgcttccgagagcaaagatatgaaggcccccctcgcaacccttgcgctcttgtggtaccacacagtcgtgagaccctttttcgcgctggatggctctgataataaggccggccttgacgaagctaaggagatattactgaagaaagaggcagcatacccgaattcatcattgtttatgtttttcaaaggccggattcagaggctcgaatgtcagatcaactcggctctgaccagtttccatacagcactcgagctcgcagttgatcaaagggagattcaacacgtttgtctctacgagatcggttggtgctctatgatagaattgaactttaaggacgcctttgattccttcgaaaggctcaaaaacgagagtcgctggagccagtgttattacgcttacctgaccgcagtgtgccagggcgctactggggatgtggacggcgcccagattgtgtttaaggaggtccagaagctattcaagcgcaagaacaaccaaatcgagcagtttagcgttaagaaagcagaacgatttagaaagcagactcccaccaaggccctttgcgtcctcgcatcgattgaggtcttatacctgtggaaggcattaccgaattgcagcttcccgaacctgcagagaatgtctcaagcctgccatgaagttgacgattcttccgttgtggggctgaagtacctcctactcggcgcaattcataagtgtcttggcaacagtgaagatgcagtccaatatttccagcgagccgtcaaagatgaactgtgtcgccagaataacttgtatgttcagccgtacgcatgttacgagctcgggtgtctgcttttagacaaacctgagacagtcggccgcggcagggctcttctgctccaggcaaaagaggacttttccggatatgattttgaaaataggctccacgtcagaatacatgctgccctggccagtctgagggagttggtgccgcagtag

SEQ ID NO: 51502 - DNA, 831 bp, Artificial Sequence
  Description of Artificial Sequence: Synthetic coding sequence
atgcacgcccccttccggatcagctgccaggtggtgtggctgttcaaaatttatcttctgatgtgccagatcaactctgcgctgacttcctttcacacagctctggaactggctgtcgaccagagagagatccagcacgtatgtctctacgagatcggttggtgttccatgatcgagctgaacttcaaagacgcattcgacagtttcgagcggctgaaaaatgaatctcgatggtcacagtgttattacgcctacttgaccgccgtgtgtcaaggcgcaactggagatgttgacggggcacagattgtcttcaaagaagtgcaaaagctctttaagcgcaaaaacaatcagatcgagcagttctccgtgaaaaaagctgagcggtttaggaaacagacaccaacaaaagccctgtgtgttcttgctagcattgaagtgctgtacctttggaaggctctccctaattgcagctttccaaacctgcagagaatgtctcaggcgtgccatgaagtggacgactcttcagtggtggggttgaaatatctgctcctgggcgccattcacaaatgtcttggaaatagcgaggatgccgtccagtacttccagagggcagtcaaggatgagctctgtaggcaaaataacctctatgtacagccctacgcatgttacgaacttggctgtctgctgctggacaagcctgagaccgtgggccgcggacgggctttgctgctccaggcaaaagaagactttagtggctatgacttcgaaaatcggctgcacgtgcgaatccatgcagcactggcttctttgcgcgagctggtgcctcaatag

SEQ ID NO: 51503 - DNA, 231 bp, Artificial Sequence
  Description of Artificial Sequence: Synthetic coding sequence
atggccggcagcgagcagcagcggccccggcggcgggacgacggcgatagtgacgcggcagcggcggcagccgccccattgcaggatgctgagttagccctggcgggcatcaacatgctgttgaataacggcttcagagaaagtgaccaactgttcaaacaataccgtaaatctttcttaacaagcgaaaagacttcagccctgccgggagagacgcaacgtaggctctag

SEQ ID NO: 51504 - DNA, 2631 bp, Artificial Sequence
  Description of Artificial Sequence: Synthetic coding sequence
atggccgaggaggagggccggctgcacagcgtgcagggcctgctgtccctgcaggatctccaaaacgttaacacgccactgatgcgcaaacttgcacggctgaagctgggcctggtggagatggccctcgatatgttacagttcatttgggaagaggcacatggacagcagtctgagcaggggtccctggagaaactcctagcagattacctgcagaatacaagcgattacacctccgtgggactgcagtggtttacactgaagagaaccctggctcacggggccctggcccagctcggaagcttacagcctctgtctgtgggatgtgttgagatccgtgccagactgctcgggttagctggtagggcactgcatctgctcgccatgcaagccgaccccgtgcacccaacatgctactgggaagccggcccgagcgtgggcgcaaaactgtctggcctcaaatctctggaactcgaggtagaggaagagggcgctactaagagtagtagagacccgcccgcttccagagccgcgcctgaggagcactgtcggcggggtgaagacctgaagaggcgtatggtgttggcacaacagtacctagcacaagcttcagaggtattgctccaatgcctacaggtggctttagggagcggtcttcttgacgtggcagccgcggcgagtttggaaatggtagagtgtgtgggaacactggacccggcgaccacttgtcaatttctagccctgagccaatcttgtagcgccagcgaaaccatgagagacgtcttattagccgcaaccgccaacacatcctcttcacagctggctgctctattgcagctccagcatcagctgcgatgtcaggacaggaccacaacttccttgggcgcacgggttgaacagcgtcttgccgccgtgtctaaagcctggcagaacctgtgcgttacagagcagcatttcaatcttttgaacgaaatgcctcctaccttctggattttgtttcttcacctgagtggtgatcgaagtaggttatatggggccgcttacgagaagccgaagtttataacagccgcgaagggtaaggttcaagcagtgggaggtagttgtaaggttatgcgcttggctatttcaccgaccgcgttttcacacctgcttgcatgcgctcaacagttcagaaagcagacgcaggcccaggtgtactctgaagatatggctcttaacattggctctgagccggaggggcttcaggtggaagagaaagaacggcccgtccagaggctgagctcagtactggggcctctggaggaactcttgcagcccttattccccctgctctccttgagcaaagcgagggtccagacaccagccgtggttgccgatagcggaaaatccaagggaaaagacaaggaaaggaaaacctctacaggacagcactctaccgtacagccagaagtggctgacaaaatagtactggttgcagataggcatcttctagaacttccacttgaaggtttatctgtgtttgacgaaggtacgatctcatcagtgtcccgggagttctcgctgcagatgctatggaatcgattacataaggaggagacagagggcggcgtgaagaaagaaggtcgaagtagagatcctaaaaaaagatcgctcgccaagaaggggaggaagggttctattccccgaactatccccccggattgcattatcgtggactcagataacttcaagttcgttgtggacccctacgaagaagctcagggccccgaaatgctgacacctgtgtcaatcacacaggacattttagaacggtttcaagacacatttacctcccgctgggcaggccacctcgggtccaagcatttcccaagtcaagcgcagtgggagcaggcgttgggctcctgctccggattctttttttacggcatggaaagttttcttagccatattctggtcgagcgcttggttgctatgaatctccaggaatgccaggtggcagtgctgctagacttagcacggtcttatcaatcactaaaacggcatatggagtcggttgaacacaggcgtagtgttgggcgatgggaggcgaattggaggaacagtgcaagcccttctgaagacgaatggcgtaggggtggtgagccgcgccgcggcttttctgaccttgaagggcaggcggccgccgcgcctaagctgcgagcgcccagccaccatgcacagctgggcccggtgtgggccgcggccccaagtcaccgcgttgtccaggcctggacctgcctcccctccgcagccggcgccccagccctggccagcgcactgggctccgctccactgcctactcatccacaccttcccgcccctatcccaagtagccaactggccttgccctttctgggcctgagtcccgctttaggcgcggcgagcgctcgcgacccaccccccgctaccagccggaaagcagcggcatggacatcttcatcagcatgcctgtgtgctccgtggggccttcgccgcggctggtcatgcgtatctagcagaggccaggacaagggcggtctgcccttggcagcacttgttcttagttgcctggatcagaagaccatacagacagtgtcgctgttccttatctag

SEQ ID NO: 51505 - DNA, 4593 bp, Artificial Sequence
  Description of Artificial Sequence: Synthetic coding sequence
atggacctggtgatcacccaggagctggcccgggccgagagccagcaggacgccgctagtctcaaaaaagcctacgaactaattaagtcagcaaacctaggcaaaagtgagttcgacccctctgaatccttctctcccgacctgttcgtgctgtgtgccgagcaggctcttaagatgagacagccagaggtgtcagaggattgcatccaaatgtattttaaggtgaaggcgccaataactcagttcctagggagagctcatctgtgtagggcccagatgtgcgcacctaaatcagcagagaatctcgaggagttcgagaattgtgtgacagagtatatgaaggccattaatttcgccaagggcgaaccccgctactatttcctggtgtataatgcttccgtgctgtattggcaaatggtgcgcccgtttctaaaacctggctaccggcatcacctgatccctagcctgagtcaaatcatcaatgtcctctctcaaacggaagaagaagataaagaatggcgggcagagctgatgttggagttactggagtgctacctccaggcaggccgaaaggaagaagcagctaggttctgctcaaccgctgccccctttatcaaatctcacgtgccacagaagtatcggcagatattctcagtgatggtcagacacgagctgatggacgaactccagttaaaggaagagaaaaagaattccatcagcctttccgtgaccttctacatcaatatgctgaaagctaaggccgaacagaatgacctgccaggcgatattagcgttatcctacggaaagcctataggcacctagggcattacaaccatcagcgcttccccagcataagcgaggaaaagatgctcctgctgtttgagctagcccggttctcactcaccttaaaatgcatggaaattagctctgcctgtctgtccgatcttaagaagatggaatctaaagatccaggcaaattgatagagatggaatgcctggagtgcgagagcgaagccctgcggctcgagtccaagatgaaggtgtataatagggcggccgtagaggcacaactagacattattcagcggctggacgttgcattacagcgggctgtgcggctgggagacccaagagtcattcatgtggtttgcgccacccagtggaatacctgtttacccctcctccaacacaacctacggcaccacctaagaaaacctctcgctggcgtggcagatgtactcgagaagctggattcactgatgactctcctccgatgtcaggtgcacatggaaatggcccaaatcgaggaagatgaggacagactggagcccgcgacagaacaccttcgcaaggctgcccgactcgatagcttagggctctatcgggaccgtattcaaatggctagtacacgactgcgcctctgtaccactctttatcaggcccctgaacgcgccgaagataaagctatcatggccgtcgaacaggctaaaaaggctacacccaaggacagcgtccgcaaaaaaagagctctcttggtgaacgcagggctcgccctggccccggacgcctttcaaatcgttctggactccgagaacgaggctaaggtctcaactgggaaaaaccggggccggttcacatacctgtgcgcaaaagcatggcatcacaccgtgtccgttgataaagccgcgggacatctgaggcgtctgggaaatgagaatgacaaagagaggatccagatatgggctgaactggctaaagtggccaggaaacagggcgtctgggacgtgtgcaggaccgcatctagattttgtttactttacgataacgtcaaggttaagaagctgaggttgcgtagaggaaagaagaaacgcggcagagacggaagcgtgcaggacacatggtcacagcccgaggtcgttctgcaacgacaggtatgccctgacctgctgcgaaaattcgcggaggtcgggttcattcatgctgaggcaaccgtgcacctgctgcgctccgagggggtggagctgaacgaccgcgccatcccacctgaggatctcagccagcaccccgcaggatatgtgcccgagccaccggaggtgaacgctgaatggattacataccgcacttggatcgagtcactgagtcgatgcgcgatgaataattggttgcgtagcgcagagattggtcaagaaattcaggaggcctggatagtgcagaacgcggttgtgtatgtgttaaatcacaatcaccatctgattttggcggggaggcagaaggagctggtagacgccctgtaccacctcctatccatcgtgaaagcaacaggacattcaggcgaccctgtgatgttagtgaccctttgcaacactctggccagaggactgataattagctggatcccagtccaggctgccgagaaaagcagaaagttcatgcggcccaatgcgttccactccccactggatgcaggggcgaccagtgagattaagactgccgtcgaggtctgtgaattcgcgctaaatctaaccaatggctccgcaccggaggagactgtcccaacggggactcgccagcagctcattgctacttgggtgaaagctaagcagctgttacagcaacagattggacccagactaggaacagaagagcagggaaccaacgaggatgtaagttcggtgactagagtcctggtcgccctcgagatgtatagttgcaacggcttaggcctcatggattttacagttcccagcttagctcagctagtgaaaatggcaagtgagtgcaattggtccgatccccttgttgagctccagacccttacaagattaacacatttcgctcacgcggcccgagaccatgaaactaccatggcgtgtgctcacagagctctagaaatgggcatcaagtatctcaaaaaatttggccccgaggagagccggttagtggcagaaatgctctgtaccgctactgctatacagggcaggtctattatggagaatctgaaagggagaaagcagctgaggctggtcgcagcaaaggcattcaccgagtccgccaggttcggtggaatcgctggtagctcagccttggtaatgctcgccgcacggcattattggaatgcgtggctgccactccttagcagcgcagtatataggaagaaagcaaagggcgcgctgaaacgtctgataggaattattaacaaaacagaggcccgcaagcaggagaaaggcaaaacactgctgctgcaccaatggccaaccgccgactttcaaggagggggcaccaccgaggggtacttccttcccggtgcagaggatgacctggctcttcgcgcagcattgtatggactcctctttcacagccacgcagatcaagatgattgggagggtggcctgaaggtgttagatgaggcagtacaggtcttgccacgcacagctcacagattgctaattttcaaacatatggtaattgtgaaagccaagctaggccagaatttctcaatggagatccagaaattcaaagctgagtcggaagattacctggcgcggatgtggcaccgtctggccctgaattcccctagcgtgtccggggaattggcgtgctacaacaatgcaatccaggccctgcagaaaccagagatggagtggcaaaaagtggagtatctgatggaatttggccagtggctgcaccacaggcattttcccctggaggacgtggtgttccacttacgttgggctgttgagatcctcctcgctatgaaaccacccggagacgtgcctgagcctcagccaactcccgatggggagtacgttgctgtcgaaatgcctcctagatctcccgtaagcgaagccgaggaagccgtgtctttagaacaactgcgctctgttcgtcagttagaggcgttggcaagagtgcacatcctgctcgccctggtgctctccccaggggctgaaggatacgaagattgttgtctggcagcttatgcctttttcaggcacatatggcaggtctccctgatgactgcgggtaagagcgtgttggaaaaccggcccctggctgccacaagctctcacctcttgttaccgaagaaagaaaaagaaaacgagaggtctaaagagaaagaaaaagaacgtagcaaagagaaggaaaatgaacggtccaaagagaaggacaaggagaaaggaaaagaagaaaaagttaaagagccaaaacagtctcagtcacctgcccccattaaacagctggaggatctgccaatgtccattgaagaatgggcaagctactcatgtccagaggaggtgctctcggtgctgaaacaggatcggtccgactcaacagtgaacccgtcgtcaattcaaaaacctacatattcattatacttcctggaccatctggtcaaagctctgcagaagatgtgcctgcatgagttgacagtaccggtcctccaactaggcgtactaatctccgatagcgtggtaggttcaaagggactctctgatctatatcacttacggtgggtccagctccttttcaggtcagtgatcagtcctaagcagaacaagaataagcaacacgtcaaagttctgatcctctag

SEQ ID NO: 51506 - DNA, 1218 bp, Artificial Sequence
  Description of Artificial Sequence: Synthetic coding sequence
atggacctggtgatcacccaggagctggcccgggccgagagccagcaggatgccgccagtctcaagaaagcttacgaattaatcaaatctgccaacctgggcaaatctgagtttgacccttccgaatcctttagtcctgacctgtttgtgttatgtgctgagcaggccctgaaaatgcggcaaccggaagtgtcggaggattgcatccaaatgtacttcaaggtgaaagctcccataacccaatttctgggaagagctcacctgtgtcgcgctcagatgtgcgcccccaagagcgcagagaacctggaggagttcgaaaattgtgtaacagagtacatgaaagctatcaatttcgctaagggcgagccccggtactactttcttgtttacaacgcctccgtgctgtattggcagatggtgaggccctttctcaagcccggctatagacatcatttgattccctcactgtctcaaattattaatgttctgtcacagactgaagaagaagacaaggaatggcgcgccgagctgatgttagagctccttgagtgttatctacaggccggtagaaaggaggaagccgcccggttctgctctacggcggcccctttcatcaaatcacatgtgccacagaagtaccgacagatcttcagtgtgatggtacgacacgaactgatggacgagctacaactcaaagaagaaaagaaaaactctatctccttatctgtcacattttacattaatatgttgaaagccaaggctgaacagaatgatctacctggcgacatatccgtgatcctgcggaaggcatatcgccacctggggcactacaaccatcagcgctttccttcaatttccgaggaaaaaatgctgctgctgttcgaactcgcgaggttctctctgacactgaaatgcatggagatatcttccgcctgtcttagcgatctgaagaagatggaaagcaaggtgtctggattcatgacactcctaccgggagacgaggctctccttacagtgcaactggataaacggcaacgcaaggaggaacagttcacccgcccgcggccacctggcctgcgctccgtggtaggcacgctgccctcatttttaccagtcttctgtacagttgctgtacggtggtgtttgcagttctacacgtgcccgtttctattcacttttcttgtggccacaggaccccagcatcactcttgcttttag

SEQ ID NO: 51507 - DNA, 8148 bp, Artificial Sequence
  Description of Artificial Sequence: Synthetic coding sequence
atggacctggtgatcacccaggagctggcccgggccgagagccagcaagatgctgcatctctcaagaaagcctatgagctgataaagagtgccaacctcgggaagagcgaattcgatccatctgagtccttttcacccgatttgtttgtactgtgcgctgagcaggctctgaagatgaggcagcccgaagtgtctgaggactgtatccaaatgtacttcaaagtgaaggcccctatcacacagttcctcggccgcgcccatctctgtagagctcagatgtgtgctccaaagagcgccgagaatcttgaagaattcgaaaactgcgtgaccgagtacatgaaggctattaacttcgctaagggagagccccgctactacttcctcgtgtataacgcaagtgtcttgtactggcagatggtgcggcccttcttgaaacccggataccgacatcatctgattccaagcttgagtcagatcattaatgtgctgagtcagacagaagaggaagataaagagtggcgcgcagaattgatgctggagcttcttgaatgctatctgcaggctgggagaaaggaggaagcggctcggttctgcagcactgctgcacctttcattaaatcgcatgtgccacaaaaatatcgccagatcttctctgtcatggtgaggcacgagcttatggatgaactgcaattgaaagaagaaaaaaaaaactctatttccttgagtgttacattctatatcaatatgttgaaggcaaaggctgagcagaacgacctgcccggcgacatttctgtgatcctgaggaaggcatatcgacacctgggtcactacaaccaccagcggtttccatcaatctctgaggaaaaaatgctgctgctcttcgaactcgcaagattctcacttactctcaagtgtatggagatttcgtcggcgtgtctttccgatctgaagaagatggagtctaaggaccctggtaagctgatcgagatggagtgcctggagtgtgaatcagaggccttgagacttgaaagcaagatgaaggtgtacaatagagcagctgtggaagcccagcttgatattatccagcggttagatgtggccttgcaacgggcggtgcgccttggcgacccccgagtcatccatgtcgtgtgcgctacacagtggaatacttgcctgcccctactgcagcataacctcagacaccatcttcgcaagcccctggccggggtagccgatgtcctggagaaactggacagcctcatgaccctgcttaggtgtcaggtgcacatggaaatggcccagatcgaggaggacgaggaccgcttggaacccgcgacagagcatctgaggaaggcagcacgactcgacagccttggtctgtacagggacagaatacaaatggcttctactaggctaagactgtgcacaaccctctatcaggcgcccgaacgtgctgaagataaggcaataatggctgtggagcaggccaagaaggccactcctaaagatagcgtacgcaagaaacgggcattgttagtaaacgctgggctcgctctggcacccgacgctttccagattgtcctcgactctgagaacgaagcaaaagtttcaactggaaaaaatcgcggtaggtttacctatctgtgtgcaaaagcatggcaccatacggtcagcgtggacaaggctgccggacacttgcgtaggctaggcaacgaaaacgacaaagagaggatccagatatgggccgagcttgccaaggtcgcgaggaagcaaggagtctgggatgtatgccgcacagcctcccggttttgcctcctctacgacaatgtgaaggtgaagaagctgcggttacggaggggcaaaaagaagagagggcgcgatggcagtgtgcaagatacctggtcacagcccgaagtcgtgctgcaacgacaggtatgcccagatctcctgaggaagttcgccgaagttggtttcatccatgccgaagcaacagtccatctcctccgcagtgagggggtggagctcaatgaccgagctataccccccgaggacctctctcagcaccctgcaggttatgttcccgaacctccagaggttaatgctgaatggattacgtatagaacgtggatcgaatccttgtccaggtgtgccatgaacaattggctgcgtagtgccgagattggccaggagattcaggaagcctggatcgtgcaaaatgccgtcgtatacgttcttaaccataaccaccacttgattctcgccgggcgccaaaaagagctggtcgatgccctgtatcacctgctttcaattgtgaaggccacagggcactctggcgatcctgtgatgttggtgaccttgtgcaacacactcgctcgagggttgataatctcgtggattcctgtgcaggcagcagagaaatcccgaaagttcatgcgcccaaatgcctttcactcccctctcgacgcaggggcaacttccgagatcaagaccgcagtggaggtgtgtgaattcgccctcaatttgactaatggaagcgcacctgaagagactgtgcctactggtaccagacagcagctcattgccacctgggtgaaggccaagcagctgctgcaacagcagatcggcccacgccttgggaccgaggaacaggggacaaacgaagatgtctcatcagtgacccgcgtcctggtcgctctagagatgtactcctgtaacggccttgggctgatggacttcaccgtaccatctctcgcgcagctggtgaagatggcttccgaatgtaactggtccgacccactggttgaactccaaaccctgacgagactgactcacttcgctcatgccgccagggatcacgaaaccaccatggcgtgcgctcatagggctcttgaaatggggattaagtacctgaagaagtttggacccgaggaaagccgtctagtggcagagatgctgtgtaccgcgaccgccattcagggacgatctattatggagaatctcaagggccggaaacagttgcgcctcgtcgctgccaaggcctttacggagagtgctcggttcggtggtatcgccggctccagtgcattggtcatgttagccgccagacattactggaatgcttggcttcccctgctgagcagtgccgtttacaggaagaaagccaaaggagccttgaagagacttatcggaattattaataagaccgaggccagaaaacaggaaaaaggaaagacactcctccttcatcagtggcccaccgccgatttccagggaggagggactaccgagggctatttcttgccaggtgctgaggacgacctagccctgcgggccgctctgtacggcttgctgtttcattctcatgctgatcaagacgattgggaagggggactgaaagtgctggatgaggctgttcaggtgttgccgaggacggcacataggctgctgattttcaagcatatggtcatcgtcaaggcaaaactcggacagaatttctccatggaaattcagaaattcaaggcggaatccgaggattacctcgcccggatgtggcaccggctcgctctgaactcccccagcgtgtctggagaactagcttgctataacaacgcaatccaagcactccaaaaacctgaaatggagtggcagaaggtagagtacctgatggagttcggccagtggctgcaccacaggcactttcccctggaggacgtggtattccaccttaggtgggctgtggaaatcctgctcgccatgaagccgccaggcgacgtgccagagccccaaccaacacctgacggcgaatacgtcgctgtggagatgccaccgcggtcccccgtcagcgaggccgaagaggccgtgagcctggaacaactacggtctgtgcgtcaactggaagcactagctcgcgtccatattctcctggcgctcgtacttagtcctggggcagaggggtacgaggattgctgcttggccgcctacgccttttttaggcacatctggcaagttagcctcatgactgccggtaagtcagtactggagaatcggccactagccgccaccagcagtcacctgctgctgccgaaaaaagagaaggagaacgagcgctcaaaggagaaagagaaagagcgatccaaggaaaaagagaacgagcgaagtaaggagaaagacaaggagaaaggcaaggaggagaaagtgaaagaacccaagcagagccagagccccgcacctatcaaacaactcgaggatctccctatgagcattgaagagtgggcatcctactcttgtccagaggaggtgctatccgtgctcaagcaagaccgttccgattcaactgttaacccatctagcattcaaaaacctacatacagtctgtacttcttggaccacttggtgaaggcccttcagaaaatgtgtctgcacgaactcacagtacctgtcctgcagctcggagtcttgatctcagacagtgtggtgggttccaaaggcttgtctgacctgtatcatctgagactcgcacacgcgtgttccgagttaaagctgcgcgaagctgccgcccgccacgaggaagcagtgggtcaggtctgtgtatccgagctggaacaggcatcttgccgtaaagagattgccctgaaaaaagaaaagaacaaagagcccctgctggaggagtctcttcctgcactcaatgagcagaccctgccagtgcagcctggagaaatcaaacctttagatgctaaagacaaaatcctcaaaatgaacggggaaaccggccgagatctggacggcacatcttttcctcacctgtggatgctgaaggccgaagttctgttagagatgaatctctaccagcccgccaggttgcttctttccgaggcttatctggcctttcaggagctagacgaaccttgtgcagaggcccagtgcctgttgctgctcgctcagctggccaataaggaaaagaactacgggcaggccaagaagatgattgcacaggcgcagcacttgggcgggtcagaagagttctggtataacagcactctcacactggccgaagctctcctctccatggagcactctggacgggaggccacagtgtgccatatcttccagaagctaattaacgcattcaagatactgaagaaagagaggccaaaccgtctccctcttctagaatttatgatcaccgaccttgaggctcggtgtctgtcattgcgtgtgagagtggcccagcattcggccgtcaccgaaccaactgagtgtagcctgctgttaaaggagatggacgacggtctgttagagatcgaaagaaagtttatcgattgcggctgcaaagagaactgtgtcgacgtcaaattggagagggcgaaaatcaaacgactacgcgcacagaatgagaaagacgaagagcagaaaaccgcctactatttagaggcatatggactggcccagggcgccgtggcagaggaagaagggcgactccatagcatccaaggactgtacggattagctcagggtgctatggcggaggaggagggccggctacactccgtccagggtctgctgtcgttgcaagatctccaaaacgtgaatactccactgatgcgcaagctggctaggcttaaactgggcctagtggagatggccctggacatgctgcaatttatttgggaagaggctcatggccaacagtcagaacagggtagtctggagaagctgttggctgattaccttcagaataccagtgattataccagtgtggggctccagtggttcacactgaagcgcacccttgcgcacggggctctggcccagcttgggtccctgcagccactgtctgttggatgcgtggaaattcgggcgcgcctacttggcttggcagggcgggcactccatctgctggccatgcaagctgatcccgtgcatccaacgtgctattgggaagcgggcccctccgtgggggccaaattgtctgggctgaaatcccttgagctcgaagtggaggaagagggagccaccaagtctagtcgggacccacctgcttctcgagctgctccagaagaacactgcagaagaggagaagatctgaagagacgtatggtcctcgcccagcagtaccttgcccaggcgtccgaggtcttgctgcagtgtctgcaggtggctttgggtagcgggctcctggatgtcgccgccgccgccagcctggaaatggtcgaatgcgtaggcactctcgatcccgccacgacatgccaatttctcgccctgtcacagtcctgcagtgcatccgagaccatgagggatgttctcctcgctgcaactgctaacacatccagcagccagctggcggccttattgcagctacaacaccagcttagatgccaggaccggactactaccagcctcggcgcccgcgttgagcaacggttggcggccgtgagtaaggcttggcagaatctgtgtgttaccgagcagcatttcaatctgttaaatgagatgcctcccaccttttggatcctcttcctacaccttagtggagaccgcagccgactatatggagccgcttatgaaaagccaaagttcatcacagccgctaagggaaaggtgcaggccgtgggtgggtcttgcaaagtcatgaggctcgctatctctccaacggccttctcacatctgctagcgtgcgctcagcagtttcgcaagcaaacgcaggcccaggtatattccgaggacatggccttaaacattggcagtgagccagaaggactccaggtcgaggaaaaagagcggcctgtacagaggctatcctctgtactgggcccattggaggaacttctccaaccactgttccctttgcttagtctgtctaaggctcgggtgcaaacccctgccgtcgtagcagactccggcaaatccaaaggcaaagataaggaaaggaagactagcacagggcagcacagcaccgtacaacctgaggtagccgacaagatcgtgctggtggctgatagacacttgctcgagctcccccttgagggccttagtgtcttcgacgagggaacaattagtagcgtcagcagggaattttccttgcagatgctgtggaatcgacttcacaaggaggagacagaagggggagtgaagaaggagggaaggtcccgggatcctaaaaagcgctcactcgccaaaaagggccggaagggaagcattcctcgaacgattcctcccgattgcattatcgtggattctgacaactttaaattcgtcgtcgacccatacgaggaagcccagggccctgaaatgttgacaccagttagcataacgcaagacattctcgagcgtttccaagatacctttaccagcagatgggccggccatcttgggtctaagcatttcccttctcaagcgcagtgggagcaggcgctgggaagctgtagtggattctttttttatgggatggagtctttcctgagccacattttggtggagcgcctggtcgccatgaatctccaagaatgtcaggtcgccgtgctgctggatctagcgcgcagctatcagtctcttaagaggcatatggagagcgttgaacaccggcgtagcgttggacggtgggaggctaactggcgtaatagcgctagcccttctgaagacgaatggcggcgtgggggagagcctcgaagaggcttctcagatcttgagggacaggcagcagccgccccaaagcttagagccccaagtcatcacgcccaattggggcctgtttgggcggccgcaccaagccacagagtcgtgcaggcctggacctgcctaccgagtgcagcgggcgcccccgccctcgcatcagcgctgggcagcgcccccttgcctacacaccctcatctcccagcccccatcccatcttcccagctcgcccttccctttctgggcctctcgcctgctctgggagccgcttctgcccgagaccctccacccgccactagtcgaaaggcagcagcgtggacctcaagctccgcctgcctgtgcgctccctggggactacgtcggggctggagctgcgtgagctcccgcgggcaggacaaaggtggattacctctcgccgctcttgtgctgtcctgcctggatcagaaaaccatacagactgtcagcctcttcttaatttag

SEQ ID NO: 51508 - DNA, 1563 bp, Artificial Sequence
  Description of Artificial Sequence: Synthetic coding sequence
atgatgaagtactacgacctggccaagttcaccatctaccagatcgcagaaatggataaaggtctgtccgagctatccccaatgcagcaagccctgatctatagcttttgcgaaaaccacgacaaggccatcgaggtgctagatgggatcagctggaatcgggcagaaatgaccatgtgcgcacttctggcaaaagtgcagatgaaggctaagaggacaaaagaggcagtggaggttctaaaaaaggcactggacgctatatcacactctgataaagggcccgatgcaactgcaatcagtgccgactgtctgtataacctgggcctgtgttatatggaagaaggcaatctgcagatgacatacaaactcgccattacagatctgaccacagctattagcatggacaagaacagctataccgctttttataatagagccctttgctacactaagatacgcgagctccaaatggcacttactgattacggcattgtgttgttgcttgacgccacagaaactgtgaagctgaatacattcctcaacagaggactaatatacgttgagcttgggcagtatggcttcgctctggaagattttaagcaagcagcactaatctcacgtacaaatggctccctctgccacgccaccgcaatgtgtcaccaccggatcaatgaatttgaggaagccgttaactttttcacatgggcattaaagatcaatccctgtttcctggacgcatatgttggtagaggcaattcgtatatggagtatggccacgacgaggcaactaaacaagcccagaaggattttttaaaagcgctgcacatcaaccctgcttacattaaggcccgcatcagtttcggctataaccttcaggctcaggggaaattccagaaggcatggaaccacttcactatcgctattgacactgatcccaaaaattacttggcctatgagggccgggccgtcgtgtgcttgcagatgggtaataatttcgccgcaatgcaagacatcaatgcagcaatgaagatctccaccacggctgagttcctcaccaataggggcgtgatccatgaattcatggggcataaacagaatgcaatgaaagattaccaagacgctatcactttaaatcccaagtactcgctggcttattttaacgcagggaacatttatttccaccacagacagtttagccaggcatcagactatttcagtaaagccctcaaattcgaccccgaaaacgagtatgtcctgatgaacagggctatcaccaataccattctaaagaagtacgaagaggccaaagaggacttcgctaatgtgatagaatcgtgcccattctgggcagccgtgtatttcaacagagcacatttctactattgtctgaaacagtatgagctggctgaggaggacctgaacaaggcactgagtctgaagcccaatgatgcactagtttataatttcagagccaaagttaggggaaagatcggtctgatagaggaggccatggctgattataatcaggccttggacctggaggactacgccagcgtcatatag

SEQ ID NO: 51509 - DNA, 1611 bp, Artificial Sequence
  Description of Artificial Sequence: Synthetic coding sequence
atggacaagggcctgagcgagctgagccccatgcagcaggccctgatctatagtttctgcgagaaccacgacaaagctatcgaggtgctagacggtatcagctggaaccgggccgaaatgaccatgtgtgcactgctcgctaaggtgcagatgaaagccaaacggactaaagaggccgttgaggtgctgaaaaaggccctagatgcaatcagccactctgacaagggccctgacgccacggccatcagtgccgattgtctgtataatctaggactctgttacatggaagagggcaacctgcagatggccttcgactcattcacgaaggccgtgaaggctaatcccgatttcgcagaatccttttaccagaggggactatgtaaggtaaagctgcacaaggacagtagcattctggacttcaatcgtgcaatcaccctcaatcccaaacactaccaggcctacttgtcgcgagtcgccttctatggtcttaagggcagatactcaaaagctatacttaattgtaacaaggcaattaagatttaccctgagagtgtgagagcgtacttgtataggggcgtgctgaaatactacaacaagacctacaagctggcaattacagacctcactacagctattagtatggataaaaattcatacactgcattctacaatagggcgctctgctacaccaagattagagagctgcaaatggcgctgaccgactatggcatcgtgttattgttggacgccacagagaccgttaagctcaataccttcctgaatcgaggcctcatctacgtggaactgggtcaatacggctttgcgttggaggactttaaacaagcggctctaatctctagaacgaacggcagcctctgtcatgctacagccatgtgccatcacagaatcaatgaattcgaggaggctgttaacttctttacctgggccctgaaaatcaatccctgttttctagatgcctatgtgggacgtggtaattcctacatggaatacggacacgatgaagccacaaagcaggcccagaaggattttcttaaagcgttgcacattaatcccgcatatattaaggccaggataagctttggatacaacctacaggcgcagggcaaattccaaaaggcctggaaccatttcactatcgccatagacaccgaccccaaaaattaccttgcatacgaagggagggccgtggtttgtctacagatgggtaacaacttcgcagctatgcaggacatcaacgccgctatgaagatctcgacaacggctgagttcctgacaaatcgcggtgtaattcacgagtttatgggtcacaaacagaacgccatgaaagactaccaggatgcaatcaccctgaacccaaagtacagcctggcgtactttaatgccggtaatatctattttcatcatcgacagtttagccaggaggagagcctaggtctggcgtggtccctctcactggattcattcttgcggacgggaggagccactttttcctccggagtgaacccgctccagacccttcaccggcggatgagtatcttaagtccgctgcccccaacatgcccccgggacgaaatggatttcacgtcctag

SEQ ID NO: 51510 - DNA, 1563 bp, Artificial Sequence
  Description of Artificial Sequence: Synthetic coding sequence
atgatgaagtactacgacctggccaagttcaccatctaccagatcgcggaaatggataaaggcctctccgagctatctcctatgcagcaagctctgatttacagcttttgcgagaatcatgataaagccattgaggtactggacgggatctcctggaatcgagcagagatgacgatgtgtgctctactggccaaagtgcagatgaaggccaagcggactaaggaggctgtggaggtgttaaaaaaagcccttgacgcaattagccactcagacaaaggaccagacgccactgcaatctcagccgattgcctgtacaacttgggactgtgttatatggaagagggtaatctgcagatgacatataagctggccataaccgatttaacaacggcgatcagtatggataagaactcttatactgcattttacaatcgggccctgtgctacactaagattcgcgaattacagatggccctcacggattacgggattgtactgttgttggacgccaccgaaaccgtgaaactgaatacctttctgaacagagggctcatctacgtcgagctgggacagtatggatttgcactcgaagacttcaaacaggccgctttgataagcagaacaaatggatccttgtgtcacgcaactgccatgtgccaccaccgtatcaacgagtttgaagaggccgtgaatttttttacatgggcactcaaaatcaatccctgttttctggacgcctatgtcggacgaggtaattcctatatggagtacgggcacgacgaggccacgaaacaagcccagaaggattttcttaaggcactgcatattaacccagcttatatcaaagcacggatctctttcgggtacaacctgcaagcccaaggtaagtttcagaaggcatggaaccacttcaccatcgctatcgacactgatcctaagaattacctggcctacgaagggcgcgcagttgtttgcctgcagatgggaaataatttcgcggccatgcaggacatcaacgctgcaatgaagattagcacaacagctgagtttctgaccaataggggcgtgatacacgaatttatggggcacaagcaaaacgcaatgaaggattatcaggacgccatcactttaaaccctaagtactccctcgcctatttcaatgccgggaacatttacttccaccatcggcagttctcacaagccagcgattacttctccaaggcgcttaagtttgaccccgagaacgaatatgtattgatgaaccgcgctatcacgaacaccatattgaagaagtacgaggaggccaaggaggacttcgcaaacgtcatcgagtcgtgtcccttctgggccgccgtgtacttcaaccgggcccacttttactattgtttgaaacagtacgaactcgcagaggaggatctgaataaagcgttgtccctgaagcccaatgatgctctagtgtataactttcgcgctaaggtgaggggcaagatcggacttatcgaggaagctatggccgattacaaccaggccctggatctggaggattacgcttcagtcatttag

SEQ ID NO: 51511 - DNA, 2532 bp, Artificial Sequence
  Description of Artificial Sequence: Synthetic coding sequence
atggccaccaagaaggccggcagccggctggagaccgagatcgagagatgtcgctccgaatgccagtgggagagaatccctgagctggtcaagcagctcagcgccaagcttattgccaacgacgatatggcagagctgctacttggcgaatcaaagttagagcagtatttaaaggaacaccccttgaggcaaggtgccagtcctcgcgggccaaaaccccaactcactgaagtgaggaagcatctgacagccgctctagatcgcggcaacttaaaatccgagttcttgcaggagtccaatctgattatggcaaagctaaactacgtcgaaggcgactacaaggaggctctgaatatctacgcccgcgttgggctggatgatcttcctctcacagccgtgccaccttacagactgagagttatcgccgaggcatacgccaccaagggactttgcctagaaaagttgcctattagctctagtaccagtaatctacacgttgatcgagagcaggatgtcatcacatgctatgaaaaagccggagatattgcacttctgtacctgcaggagatagagagggtgattctcagtaacatccagaatagatctccaaagccaggcccagccccgcacgaccaggaattgggattcttcctcgagaccggattgcagcgcgctcatgtcctgtatttcaaaaacgggaacctcactcgcggcgtgggtagattcagagaattgctgcgggcggttgaaacacgcaccacccaaaatctaagaatgaccatcgcccgccagcttgctgagatactgctccgaggaatgtgcgagcagagctattggaaccctcttgaagatccaccatgccagtctccactagatgatcctctcaggaagggagctaacacaaagacctacaccctgacacggcgagccagagtgtactcgggcgagaacatattttgcccccaggaaaacactgaagaagcgctgctcttattacttatttcggaaagtatggccaatagagatgccgttctgtccaggatccctgaacacaaaagcgatcgcttgatttcactgcaaagcgctagcgttgtgtacgacttgctgactatcgccctgggtcgcagagggcagtatgaaatgctgtcagagtgccttgagagggcaatgaaattcgcatttgaagaattccacttatggtaccaatttgcactgagcctaatggccgctggcaaaagcgcccgcgcagtgaaagtgctcaaagaatgcattaggcttaaacctgacgatgccacaattccactgctggctgctaagctttgcatggggtctctgcattggttggaggaggctgaaaaattcgcaaagaccgtggtagatgtgggggaaaaaacctctgagttcaaggccaagggctatctggccttgggactgacctatagcctccaggcaacagacgctagcctgaggggcatgcaagaggtcctgcagcgcaaggctcttctcgcttttcagagggcacattccctgagtcccaccgatcaccaggccgctttttacctcgcactgcagctcgccataagcagacagatacccgaggcactcggatatgttcgccaagctctgcagctgcagggcgacgacgcaaattccctgcatttacttgcattgctgctaagcgcccagaagcactaccatgacgccttgaatatcatcgacatggcactttctgagtacccggaaaattttatccttctgttcagcaaagtgaaattgcagagcttatgcagaggacccgatgaggctctgctcacttgtaagcatatgctccagatttggaagagctgctacaatctgaccaatccatcagacagcgggcgtggctctagcttgcttgaccgaacaattgccgatcgcaggcagctaaacacaatcaccctcccggacttcagcgaccctgagacaggatcagttcatgcaacatctgtggccgcttcaagagtcgagcaggctctgagtgaggtggcttcctcattgcaatcatctgcaccgaagcagggccccctccatccctggatgacgcttgcacagatctggctgcacgctgcggaagtctacattggaattggcaagcccgctgaagctacagcctgtacacaggaagccgcgaacctcttcccgatgtctcacaacgtactttacatgcgcggacagattgccgagctgagggggtccatggacgaggcaagaagatggtatgaagaggcccttgccattagccccactcacgtgaaatcaatgcagcgtctggccctcatcctgcatcagttgggccgctattccctggctgagaagattttgcgcgacgcggtgcaggttaattcgactgcacatgaggtctggaacggtctgggggaggtcttgcaggctcagggcaacgacgccgccgcaacagaatgtttcctgaccgcgcttgagctggaggccagtagcccagccgtgcctttcaccatcatcccacgggtgctgtag

SEQ ID NO: 51512 - DNA, 2583 bp, Artificial Sequence
  Description of Artificial Sequence: Synthetic coding sequence
atggccaccaagaaggccggcagccggctggagaccgagatcgagagatgtaggtcagagtgtcagtgggaaaggatccccgaattggtgaaacagttgtctgccaagctcattgcaaacgatgacatggcagagttgctccttggggagtcaaagctagagcagtacttgaaagagcacccacttaggcaaggtgcttcgccccggggcccgaagcctcagctgacggaagttcgcaagcatctgacagctgcattggatagaggcaatctgaagagcgaatttttgcaggaatccaatctcatcatggcgaagctgaactacgttgaaggcgattataaggaagcactcaacatctatgctcgagtgggactggacgacctgcccttaacggctgtgcctccctacagactccgggtgatagccgaagcctacgcaacaaaggggctttgcctggaaaaactgccaattagcagctccacctccaatttgcatgtggatagagagcaggatgtcatcacttgttacgaaaaagctggtgacattgccctgctgtatctccaggaaattgaaagggtgattctgagtaatatccagaaccgcagtcccaaaccaggccctgcaccccatgatcaggagctgggattttttcttgaaacgggcctgcagcgggctcacgtgctatatttcaagaatggcaacctcactcggggggtgggtcggttccgcgagctgctgcgcgctgtggaaacaaggaccacccagaacctgaggatgacaattgcccggcagctcgctgagatccttctgagaggcatgtgtgaacaaagctactggaatcctttggaggaccccccatgtcagtcacccttggatgatccactgcgcaagggcgctaatactaaaacttacacactgacgaggcgggcaagagtctacagcggagaaaacatattctgccctcaggaaaacactgaagaagcattattgctcctcttgatctctgagagcatggctaatcgggacgctgtcctttctcggattccggagcacaaatctgaccgtctcatatctctccaatccgcaagcgttgtgtacgatctgctcaccatagccttgggcagaagaggacagtacgaaatgctcagcgaatgtttggagcgggcgatgaagtttgcgttcgaggagtttcacctgtggtatcagtttgcactgtcgctcatggccgcaggaaagtccgctcgggccgtcaaggtcctcaaggagtgcatcaggcttaaaccagatgacgcaacaatacctctgcttgcagccaagctttgcatgggaagcctgcactggctagaagaggctgaaaaattcgccaagaccgtagtggacgtcggggaaaaaacttccgaatttaaagccaaggggtatctggcactgggcttaacttactccctgcaggcgactgacgcgtctcttcgcgggatgcaagaagtgttgcagcgaaaggccctgctcgcgttccaacgggcccatagcctctccccaacagatcatcaggcggctttttatctggcgctacagctggcaatctcccgccagatacctgaagcacttggatatgtaaggcaggctctgcagctgcagggcgacgacgcgaactcactgcatcttctagccctcctgctctctgcacagaagcactaccacgatgctctgaacataatcgacatggctctgagcgaatatccagaaaacttcatccttctgttcagcaaggtgaaactccagagtctgtgtagagggccagacgaagccctcctcacatgtaaacacatgctacagatctggaaaagctgctacaatttaacaaatcccagcgactcgggccgaggttctagcctgcttgatagaactatcgccgatcgcaggcagctgaacacaataactctgccggattttagcgacccagaaaccggaaactccccagaagcatatttccacgggtttccttccttgttcagcgtttctagtgtacatgccactagtgtggccgcatctcgcgtcgaacaagccttgtctgaggtcgcctcttcactccagtcttctgctcccaagcagggaccactgcacccctggatgactctggctcagatctggctccacgccgccgaagtatacatcgggattggtaaaccagccgaagccacagcttgcacccaggaagccgccaatcttttcccaatgtcccacaacgtcctctacatgcgaggacagatcgcagagctgcggggctctatggatgaagcacgcaggtggtatgaggaggcactcgccataagtcctactcacgtgaagtcaatgcagagactggcgctcatcctccaccagctgggaagatactcactagccgaaaagattctcagagatgcagtccaggtcaactctacagcacacgaggtgtggaacggactcggcgaggtacttcaggcacaagggaacgacgcggccgctacggaatgttttcttaccgcgctggagctcgaagcttccagccccgcagtcccttttactatcattccacgagttctgtag

SEQ ID NO: 51513 - DNA, 1257 bp, Artificial Sequence
  Description of Artificial Sequence: Synthetic coding sequence
atgaccatcgcccggcagctggccgagatcctgctgcggggcatgtgcgagcagtcttactggaaccctttagaagatccgccgtgtcagtcaccactcgatgaccccctgcgaaaaggcgctaataccaaaacatacacgctgaccaggcgcgcccgcgtatacagcggagaaaatatcttctgcccccaggagaacacggaagaggctctgctacttcttctcatctcagagagcatggcgaatagagatgcggtgctgtccagaattcccgagcataaaagtgatcgtctgatctcactacagtctgcctctgtcgtttatgacttactcaccatcgccctgggcagaagaggtcaatacgaaatgctgtccgagtgccttgaaagggcaatgaaattcgcattcgaggagttccacctttggtaccagtttgctctctcgctcatggccgccgggaaatccgccagagcggtcaaagtcctgaaagagtgcattcgcctgaagccagacgacgccactatacctctcctggctgcgaagctctgtatgggctccctgcactggcttgaggaggctgagaagtttgccaagactgttgtcgacgtcggcgaaaagacctcagagtttaaggccaaaggctacctggccttgggattaacttactccctccaagccacggatgcatccctccgagggatgcaagaggtgctccagagaaaggccctcttggctttccagcgggctcactctctgagccctacagaccatcaggctgctttttatctggccttgcagcttgccatctcccgtcagataccggaggccctgggatacgtccgacaggccctccagcttcagggcgacgacgccaacagcttgcatctgctcgccctgctgctgtctgcccagaaacactatcatgatgctctgaacattatcgatatggctctctccgaatatccggagaacttcatccttttatttagtaaggtgaagctccagagcttatgtcgggggccggacgaagctctcttgacttgcaagcacatgcttcaaatctggaagagctgctacaaccttactaatccctccgactccgggcggggttcttctcttttggacagaacgatcgcggacagacgccaactgaatactatcacactgcctgatttctccgaccccgagaccggcaaccagtgctcttggatcgccttcggggaaatgctggtggatatggggatccagtgcatttag

SEQ ID NO: 51514 - DNA, 993 bp, Artificial Sequence
  Description of Artificial Sequence: Synthetic coding sequence
atccccgaggccctgggctacgtgcggcaggccctgcagctgcagggagatgacgctaacagtctgcatctgttggccctgctgctctctgcacaaaaacattatcacgacgcgttaaacataatcgacatggcactgtccgagtacccagagaactttatcctcctattttcaaaagtaaaacttcaaagcctctgtagaggccctgatgaagccctgctcacctgcaagcacatgctgcagatttggaagtcttgctacaacctgacgaatcccagtgactcgggcaggggcagtagccttcttgatagaacaattgcggatcgtaggcaattgaacacgattactttaccagactttagtgacccagaaaccgggaactctccggaagcatacttccatggatttcctagtctcttctcagtcagctccgtccatgccacaagcgtcgccgcatctcgcgtggaacaggcactgagtgaagtcgcctcctccctccagagttccgcgcctaaacaggggccattgcatccgtggatgaccctagcacaaatatggctgcacgccgcagaggtgtatataggtatcggaaagccagctgaggcaacggcttgcacccaagaagctgctaatctcttccccatgtcccacaacgtcctgtacatgaggggacagattgccgagttgagagggagcatggacgaagcccgtaggtggtatgaggaggctttggccatatcacccactcacgttaagtctatgcagcggcttgctctcatcctgcaccaactgggacggtacagcttagccgaaaaaattctccgcgacgctgttcaggtcaattcgaccgcccacgaggtgtggaacggcctcggcgaagtcttgcaagctcagggcaatgatgcagccgcgactgaatgttttttaaccgctctcgaacttgaggcatcgagccccgcagtaccttttaccatcatcccacgggtactctag

SEQ ID NO: 51515 - DNA, 720 bp, Artificial Sequence
  Description of Artificial Sequence: Synthetic coding sequence
atgcagcggggcgccctgagccccgtgctgatgctgagcgccgccccggaaccacccccacggcctccccccgccctgagccccccaggcagtgggccggggtctggcagtcgtcacggttccgcgcgtccgggccccacaccagaaccaagcgggtctcttggagcggctcttgactcctcgctgcgggcggcagttgcctttaaggctgaaggccaaagatgctaccgagagaaaaaattccgcgaagcaatcgggaagtatcacagagctctgctgcaattaaaagctgcccagggcgcaagaccttcagggctgccagcacccgcccccggacctacatcgtctcccgggcccgcacggctatccgaggagcagcgtcggcttgtcgagtccaccgaggtcgaatgctatgactccctgacagcatgtctgctgcagtccgaattagtaaattacgagagggtaagggaatactgtctcaaggtcctcgagaaacagcagggcaactttaaagcaacctatcgggctggaattgcattctaccatctcggcgactatgcgcgtgcacttcgctacctccaagaggcgcgttcgagagaaccaactgatacaaatgtccttcggtacatccagctgacccaattgaagatgaacagatgctccttacaaagggaggactctggggctgggtctcaaacacgcgatgtgattgggtag

SEQ ID NO: 51516 - DNA, 516 bp, Artificial Sequence
  Description of Artificial Sequence: Synthetic coding sequence
atggagaagcggctgcaggaggcccagctgtacaaggaggagggcaatcagcgctaccgcgaaggcaaatacagagatgcagtttcccggtaccatagagccctcttacagctccgcggtctggacccttcgctgcccagcccgcttcccaatctcgggcctcaaggccccgcactcaccccagagcaggagaacatactacacaccacccagacagactgttataataatctcgctgcttgtctgctgcagatggagcccgtgaattatgaaagagtaagggagtattcccagaaggttctggagcgacagcccgataacgctaaagccctgtaccgagcaggggtcgctttctttcacctgcaagattacgaccaagcccggcattatctcctggccgctgtgaacagacagccaaaggatgctaacgtgaggcgatatttgcagcttacacagagcgagctctcctcttatcaccgcaaggaaaaacagctgtacctggggatgtttggttag

SEQ ID NO: 51517 - DNA, 648 bp, Artificial Sequence
  Description of Artificial Sequence: Synthetic coding sequence
atgctgaacaaggaggaggagctggagctgctggaggccctgtggagcttttccacttcccccgctcactctctgctgctgccagggcgaggcggggccggccccattgaacgtaggaagccagttagtcaagcatttagcagaccccagcaattcctgagtcgggcacttctggagttcttcggcaaatcccatccacccccccacagactcttccgcaagtccctaaatgtaggactgcactacagccacatacctttcctcactacctgcctccactttctgaggaaacgacttcagaaaggggaggtcggtctcagcgtggaaacttctaagcctcaggtccctgtgggcgggttatcacgcaagaaggtgccacaggagccttgggccacggtgatggagaagcgcctgcaggaagcccagttgtacaaggaggaagggaaccaacggtatagagagggtaagtatcgggacgcagtgtcccgataccaccgtgctcttctgcaacttcggggtctcgacccctctcttcctagccccttgccgaacctcggtcctcaggggccggcactaacgcccgaacaagaaaacatcttgcatacgactcagacagattgttacaacaacctggctgtagtgaaatag

SEQ ID NO: 51518 - DNA, 423 bp, Artificial Sequence
  Description of Artificial Sequence: Synthetic coding sequence
atggagaagcggctgcaggaggcccagctgtacaaggaggagggcaaccagcgctatcgggaggggaaataccgggatgccgtgagcagatatcacagagctttactgcagctgcgtggcctcgacccctccttaccaagtcccctgcccaatttaggtcctcagggaccggccctcactcctgaacaggaaaatatcttgcacaccactcaaaccgattgctataataatttggctgcttgtttgttgcagatggagccggtcaattacgaaagggtccgtgagtactcacagaaggtgctggaacggcagccggataacgccaaggccctctacagagccggagtggcctttttccatctccaggactacgatcaggcccgtcattacttgctggccgcagttaatagacaacccaaatag

SEQ ID NO: 51519 - DNA, 516 bp, Artificial Sequence
  Description of Artificial Sequence: Synthetic coding sequence
atggagaagcggctgcaggaggcccagctgtacaaggaggagggcaatcagaggtaccgcgaagggaagtatcgggatgctgtgagccgttatcatagagccctgcttcagctgcgcggactggacccttcacttcccagccccctccccaacctcggaccacagggccctgctctcacccctgagcaggaaaacatcctccacaccactcaaacagactgctacaataatctggccgcatgcctccttcaaatggagcctgttaattacgagcgagttcgggaatacagccagaaggtgttagaacgccagcctgataatgcgaaggctctgtaccgggccggcgttgcctttttccatttacaagattacgaccaggcaaggcactacttgcttgcagccgtcaatcgtcagccaaaagatgcaaacgtccgcaggtacttacagctcacccagagtgagctttctagctatcatagaaaagagaaacagctgtatttaggaatgtttggttag

SEQ ID NO: 51520 - DNA, 6003 bp, Artificial Sequence
  Description of Artificial Sequence: Synthetic coding sequence
atgttccggaacagcctgaagatgctgctgaccggcggcaagagctctcggaagaacaggtcgtcagacggcggcagtgaggagcccccggaccgtcgccagtcttccgttgacagtcggcagtcacgctcaggccagggcggaattagtactgaaagcgattgcgcctttgaaccagactacgctgtcccgcctttgccggtttcagaaggcgatgcagagcaggaattgggcccgcctcccagcgtagatgaagcagcaaacaccttaatgacacgccttggctttctgttgggcgaaaaagtaacagaggttcagcccggcgaccagtattctatggaggttcaggacgaaaatcagacgtcagcgattacccagcgcataagtccatgcagcaccttgacgtcatcgaccgcgtcccccccggcctcctctccttgcagtacactgcccccaatctccacgaacgcaacggccaaagactgcagctacggggccgtcacaagcccaacaagcaccctggaatctagagattccgggattattgccaccctcactagctatagtgaaaatgtcgaaaggacaaagtacgctggagaatcttcaaaagagcttggcagtggaggcaacataaaaccatggcagtcccagaagagttccatggactcttgcctgtatcgcgtggatgaaaacatgacagcctccacgtatagcctgaataagatcccagagaggaatctggagaccgtgctctcacagtccgtccagtccatccctttgtatctgatgccccgccctaatagtgtggctgccacaagttccgcccatctcgaggaccttgcctatctggatgagcagcgccatacacccttacgtacatcgctccgcatgcctcggcaatctatgggcggggcacggacccaacaggacttgcgagtccgcttcgctccgtacagaccccccgacattagcctgaaaccccttctctttgaagtgccctccatcaccactgagagtgtgttcgtgggtcgagactgggtgttccatgaaatcgacgcccagctgcagagtagcaatgctagcgtaaaccagggggtggtcatagtggggaatatcggattcggaaagacagcgattatcagcagattagttgctttgtcctgtcacggtaccagaatgagacagattgcttcagacagtccacatgcgtctcccaaacatgttgatgccaaccgagagctccctcttacccagcctcctagcgcccacagttccatcacctctgggtcttgcccagggacacccgaaatgagaagaagacaggaggaggccatgcgaaggctcgccagtcaagtggtcgcctaccactattgtcaggctgataatgcatatacctgtctggtgcccgagtttgtgcataatgtagccgctctcctttgcaggtctccccagttgaccgcctaccgcgagcagctgttacgagaaccacacttgcagagtatgttatccctgagatcatgtgtccaggaccccatggccagctttcggaggggagttctggaacccctggaaaatctccataaagaaaggaagattcctgatgaagatttcatcattttgatagacggtctgaatgaggccgagtttcataagccagactatggggataccattgtgtctttcctttccaaaatgattggaaagtttcccagttggttgaagcttatagtgacagtgcggacatcactgcaggaaataactaaactccttcccttccacagaatttttctggaccggctggaggaaaacgaggcaatagaccaagatctgcaagcctatattttgcatcgaattcactcaagtagcgagattcagaacaatattagtctaaacggaaagatggataatacaacgttcggcaagttgagcagccatcttaagaccctgagccagggctcttatctctaccttaaactgactttcgacctgatcgagaaggggtacctggtgctgaaatcatcctcgtacaaggtggtgccagtcagtttatcagaggtctacctcctacagtgtaatatgaaattccctactcagagctcttttgaccgagttatgcccctgcttaacgtagctgtcgcatcactgcatcccctgacagatgaacacatatttcaggccatcaatgcgggctccatcgagggaacccttgaatgggaagatttccagcagaggatggagaacctgagcatgtttcttatcaaaagacgggacatgacccggatgttcgtacacccatcattccgggagtggcttatatggagagaggagggcgagaagacaaagtttctgtgcgaccccaggtcgggacacacactgttagccttctggttcagtcgccaggagggcaaacttaatcggcagcagacaattgagctggggcatcacatcctgaaggcccatatttttaagggactgagcaagaaggttggggtgtcatcaagcatcttgcaaggattatggatttcatactcaactgaggggttgtccatggccttggcttccttacgcaatctctacacccctaacatcaaagtcagcaggttgctcatactgggcggggccaatattaattaccgcaccgaggtgctcaataacgcccccatcctgtgtgtgcagagccacctgggttataccgaaatggtggcgctgctgctcgaatttggggcaaatgtcgacgcatccagcgaaagtggactaacccccctgggctatgcagcagcagcagggtacctatccatcgtcgttctgttatgcaagaagcgggccaaagtggatcacttggataagaacggacagtgcgccctcgtgcatgccgccctgagagggcatctggaagtggtaaaattccttatccagtgtgactggaccatggccggtcagcagcagggcgttttcaagaagagccacgcaatacagcaggcacttatcgcagccgccagcatgggctataccgaaatagtatcttacttgctggacctgcctgaaaaagatgaggaggaggttgaacgtgcgcagatcaactcatttgactctttatggggcgaaactgcgttgacagcagcagctgggcggggcaaattagaagtttgtagacttctgctggagcagggtgccgccgtggcccagcccaaccgaaggggagccgtccctttgttctcaaccgtgcgccaaggtcactggcagattgtggacttactcctgacccatggtgccgacgtcaatatggccgataaacagggacgcactcccctgatgatggccgcttctgaaggacacctaggtacagtagatttcctgctggcccaaggcgccagcatcgcgctgatggacaaggaggggctgacggctctttcatgggcctgcctgaagggccacttaagtgttgtgagatctctcgtggacaatggcgccgctacggatcacgcagacaagaatggcagaacccctctcgacctggccgccttctacggcgatgcagaggtagtgcagttcctggtcgaccacggtgcgatgattgaacacgtggactattccggtatgcggccactggatcgcgctgtcggatgtagaaatacatccgttgtggtaaccctgctgaaaaagggcgccaaaataggctgccagacgctcccaagccgtcctcggggacccgctacctgggccatggcaacatcaaagccagacatcatgatcatccttctttctaaactgatggaggaaggagatatgttttacaaaaaaggcaaagttaaggaagccgcgcagagataccaatacgccctgaaaaagtttcccagagagggattcggcgaggacctcaaaaccttccgagaactgaaagttagcttactacttaatctgagcagatgccggcgaaaaatgaacgatttcggtatggctgaagagttcgccactaaggcacttgaactgaagccgaagagttatgaagcctactacgctagggccagggctaagagaagctcaagacagttcgccgccgcattggaagaccttaatgaagccatcaaactttgtcccaacaatagggaaattcaaaggctgttactcagagtagaggaagagtgcaggcagatgcaacagccacaacagccacctcctcctccccagccacagcaacagcttccggaggaagccgaacctgagcctcagcacgaagatatctattcagtccaggacatttttgaggaagagtacctcgagcaagacgtcgagaatgtgagcatcggcctacagactgaggcccgtccctcgcaggggctccctgtgatccagtcaccaccatcatcgccccctcacagggattcagcatatatctcttcgtcacctctgggatcacaccaagtgtttgatttccggtctagctcttctgtcgggtctcctactagacagacgtatcagtccacgtcgccagcactctctcccacacaccagaactcccattatcggccgtcgcctccccacacgagtcccgcacatcagggcggttcctacaggttcagccctcctcccgtcgggggccagggcaaagaatacccgtcccctcctccttctcctttaagaagagggccccagtaccgggccagtccacctgccgagtccatgtccgtatacagatcccagtccggctctccggtgcggtatcagcaggagacatcagtgtctcagctgccaggcaggcctaaatcgccactgtctaagatggcccaaaggccgtaccagatgccccagctgcccgttgctgtccctcagcaagggctgcgcctccagcctgcaaaggcccagattgtgagatcgaaccagcccagcccagctgtgcattctagcactgtcattcctacaggcgcttacggacaagtggcacattctatggcgagtaagtaccagtcgagccagggggacatcggtgtttcccaaagcaggctggtgtaccaaggtagtatcggcgggatcgtgggtgatgggagacctgtgcagcatgtgcaggccagcctaagcgccggcgccatctgtcagcacggtgggttgacaaaagaggatttaccgcagcgtccaagtagtgcttaccggggcggggttcggtactctcaaactccacagattggacgctcgcagagcgcttcatactatccggtgtgtcacagcaaactggaccttgaacgctcaagcagtcagctagggagccctgacgtgagtcatctgataagaaggcccatctccgttaatccaaacgagatcaagcctcacccgcctactcctaggcccctgctgcactcccaaagtgtggggcttaggttctccccatctagcaactccatctcaagtaccagcaatctgactcctacattcaggccctcctcttcaatccagcagatggagataccactgaaacccgcatacgaaagaagctgtgacgagttgtcacctgtgagtccaactcagggtggctatcccagcgagcctactagaagcaggaccaccccctttatgggcattatcgataagactgctaggacccagcagtatcctcacctgcaccagcagaacaggacttgggcagttagcagcgtggacaccgttcttagcccaacatcgcccgggaacttaccccagcctgaaagcttttcaccacccagttcaatttctaacatcgcgttctacaataagacaaacaatgcacagaacggtcatctcctggaggatgactattacagtccacacggcatgcttgccaacggatccaggggtgatctcctggagagggtctcacaagcgtctagctacccagacgtgaaggtcgcccgaactttgccagttgcgcaggcgtatcaagataatctctaccggcagcttagtagagattcccgccagggtcagacatccccaatcaagccaaagcgcccctttgtggagtctaatgtctag

SEQ ID NO: 51521 - DNA, 5973 bp, Artificial Sequence
  Description of Artificial Sequence: Synthetic coding sequence
atgttccggaacagcctgaagatgctgctgaccggcggcaagagcagccgaaagaatcggagttccgatgggggaagtgaggaaccccctgatcgtcggcagtcttcagtagactccaggcagagccgaagcggtcagggcggaatctccacagagtccgactgtgctttcgagcccgactacgcagtgccaccccttccagtatctgagggggatgccgaacaagagctggggccccctccatccgtggacgaagcggctaacacactcatgactcggctgggcttcttgttgggggaaaaggtgacagaagtccagccaggcgaccaatactccatggaagttcaggacgaaaaccagacctcagcaattactcagaggatttcaccttgttccacgctgacatcttccacagccagcccccctgctagctcaccttgttccactctgcctcccatctccaccaatgcgacagcaaaggactgctcttacggagctgtgacgtccccaacatccaccctggagtctcgggattccggcattatcgccacgctgacgtcatacagtgagaacgttgagagaactaagtacgcaggagagtcttctaaggagttgggcagcggtggcaatatcaagccatggcagtcgcagaagtcctctatggattcgtgcctttaccgggtggatgagaacatgactgcaagcacttattcgctgaacaaaataccagagcgaaacttagagacggttctgtcccagtctgtacagtccatacccctttatttaatgcccagacctaacagcgtcgcggccacatccagtgctcatctggaagacctggcctacttagatgagcagcgccacacgcccctgcggacgtctctgaggatgccgcgccagtctatgggcggggctcgaacgcagcaggacctcagggtccgattcgctccctaccgaccccccgatatctcacttaagcctctcctgttcgaagtgccttcgataactaccgagagcgtgttcgtgggcagagactgggtttttcacgaaatcgacgcccagctccagtcatccaacgccagcgtgaaccagggagtcgtgattgtgggaaacatcggttttggtaaaacagctataatatcaaggttggtggctctgtcttgtcacggcacccggatgagacagatcgcttctgattcaccacacgcatcaccaaaacacgttgatgccaatcgggagctgccacttacccagccgccatccgcccactctagcatcacatcaggtagttgtcccggtaccccggagatgaggcgacgtcaggaggaagccatgcgacgattggcgtctcaagtggttgcctatcactactgtcaggcagataatgcttacacctgcctcgtacctgaattcgtacacaatgtagcggccctcctatgtaggtccccccagctcactgcctatcgggagcaactgctcagggagccccatttgcaatctatgctgagcctgaggagttgtgttcaggaccctatggcgtcatttaggaggggggtgcttgagcccctcgaaaacctgcacaaggagagaaagatccccgatgaggattttattatcctcattgatggtttgaacgaggccgagttccacaagccagactacggagatacaattgttagctttctgtccaaaatgattggcaagtttcctagctggttgaagctgattgtgaccgtcaggacttctttgcaggagattactaaactgctgccatttcaccgcatcttcctggaccggctcgaggaaaatgaagcaatcgatcaggacttgcaggcctacattctccatcggatccactctagctcagagatccaaaacaacatctcgcttaatggcaagatggacaacaccacatttggcaaattgtccagccatctgaagactctgagccaaggcagttatctctacttgaagctgacattcgaccttatcgaaaagggctatctggtcctgaaatcatccagctacaaagtcgttcctgtgagtctctctgaggtgtaccttctgcagtgcaatatgaagttccctacacaaagttcattcgaccgcgtcatgccccttctgaacgtcgcagtcgcttctcttcatcctcttactgatgaacatatcttccaggccattaatgcgggctcgattgaaggaacgctagagtgggaagactttcaacagagaatggagaacctctctatgttcctaatcaagcgccgggacatgactaggatgtttgtccacccatccttccgtgagtggctcatatggcgagaggaaggcgaaaagaccaaattcctttgcgacccccggagcgggcataccctcctagccttttggttcagccgccaggagggaaaactgaatcgccagcagaccatcgaactaggccaccatatcctcaaagcccatatattcaagggcctaagcaaaaaggtcggggtttcaagcagtattcttcagggactctggatttcatatagcacagaaggactatctatggcactggcgagcttgcgtaatctgtacacccctaatataaaagtctctagactgctgatcttgggcggcgctaatataaattaccgaactgaggtgctgaacaatgccccaattctgtgtgtccaaagtcaccttggttacacagagatggtggctctgctgctcgagttcggtgctaatgtagatgcttcttctgagagtggtctgactcctcttggatacgctgccgccgccggctatctgtctatcgtggttttactgtgcaaaaagcgggctaaggtggatcatctagataagaatggccagtgtgccctagtgcacgctgctctgagaggtcaccttgaggttgtcaagttcctgatccagtgtgattggacaatggcggggcagcaacagggcgtcttcaaaaaatcccatgcaatccaacaggctcttatagccgccgcctctatgggctatacagagatcgtctcttatctgctggaccttccagagaaggacgaggaggaagtggaaagagctcagataaactctttcgactcactgtggggggaaaccgccctgaccgctgccgcgggtaggggcaaacttgaggtttgccggctgcttcttgagcagggcgcagccgttgctcagccaaaccgcaggggggcagtgcccctgttctcaaccgtccggcaggggcattggcagattgtagatctgcttctgacccacggagcggacgtcaatatggctgataagcaggggaggacccctctgatgatggctgcttccgaaggccatctcggcacagtcgacttcctcctggcgcaaggtgcctccattgcgcttatggacaaggaaggactgacagcgctatcttgggcatgccttaaaggccacctgagtgtcgtacgatctttagtcgataacggcgctgctactgaccatgctgacaagaacggccggactcctctggatctggctgctttttatggtgacgcagaggtggtccagttcttagtggaccatggtgctatgattgaacatgtggattatagcggcatgcgccccctggaccgggctgttgggtgtcggaacacaagcgtggtcgttaccttgctgaaaaagggtgctaagataggacctgccacttgggcaatggccacgtctaagcccgatattatgatcattctgctgtccaaacttatggaggaaggagacatgttttacaagaaggggaaagtcaaagaggccgctcaaagataccagtacgctctcaagaagtttcctcgcgaagggttcggagaggatcttaagacatttagggagctgaaggtgtccctgctgctgaacttatcgcgctgcagaaggaaaatgaacgatttcgggatggcagaagaattcgcaaccaaggctctggagttaaaacccaaaagctacgaggcctactatgctcgagccagggccaaaaggagttcccgtcagttcgccgcagctctggaagatctgaacgaggctatcaagctctgccctaacaatcgggagatccagcggctgctgctgcgagttgaagaagagtgccgtcagatgcagcagcctcagcaacctcccccgcccccacagcctcagcagcagctgcctgaagaagcggagcccgagccccaacatgaagatatatatagtgtgcaagacatttttgaggaagaatacctagagcaggatgtggagaatgttagcataggccttcagacggaggctaggccgtcgcagggactccctgttatccagagccccccttctagcccaccccaccgggatagtgcatatatatcatctagcccgctgggaagtcaccaggtgtttgactttcggagctcctccagcgttggatcccctaccaggcagacctaccaatccacttcacccgcacttagccccacccatcagaattcacattatagaccctcccctccccacacctcacctgctcatcaagggggctcctatcggtttagcccccccccagtcgggggccagggaaaggaatacccgtctccaccacccagccccctccgtaggggacctcaatatcgagcatccccacctgcagaaagcatgagtgtgtatcgaagccagagtgggtcacctgttcggtatcagcaggagacctctgtttctcagctgcccgggcgtcctaagagccccctgtctaaaatggcgcagagaccgtatcaaatgcctcagctaccggtggccgtcccacaacagggactgaggcttcagcccgccaaggcccagatcgtgagatccaaccagccttccccagctgtccattcttcaactgtgatccccaccggcgcttatgggcaggtggcgcatagtatggcatccaagtaccaatcaagccagggagacatcggggtttctcagtctcgcctcgtttaccagggtagcattggcgggattgtgggtgatggcagaccagtccaacatgtccaagctagtctgagtgccggcgcgatttgtcagcatggcggtctgaccaaagaggacctgccccagcgcccttcctccgcttataggggcggggtacgctactcacagacacctcagataggtaggtcccagagtgcttcctattatccagtgtgccatagcaagctggacctcgaaagatcaagcagtcaattaggcagcccagacgtgagtcatctgattagacggccaatctcagtaaacccaaatgaaatcaagccacacccgcccacgcctcgacctctccttcacagtcaatccgttggactccggttctccccaagcagcaatagcattagttccacgagcaatctgacaccgacattccggccctcctcttctatacagcagatggagataccactaaaaccggcctacgaacgctcctgtgatgagctatctccggtgtcccctacccagggtgggtacccttccgaacctacccggagtcgcacaacccccttcatgggcatcatagacaagacagccaggacacagcaatatcctcatttgcaccaacagaatagaacatgggccgtgtcaagcgtcgacaccgtattgagccctacttctcccggtaacctgcctcagcccgagtctttttcacctccttcctcaataagcaatatcgccttctacaacaaaactaataatgctcagaacgggcatctattggaggacgattattactccccccacgggatgctagcgaatggatcacgcggcgacctgttagagcgggtgagtcaagctagttcttaccccgatgtgaaggtggccagaacgctgccagtcgcccaagcctatcaggacaacctgtacagacagcttagccgtgacagccgtcaaggccagacctcccctattaagcctaaacgcccattcgtggaatccaacgtgtag

SEQ ID NO: 51522 - DNA, 468 bp, Artificial Sequence
  Description of Artificial Sequence: Synthetic coding sequence
atgagcgacagcgacctgggcgaggacgagggcctgctgagcctggctgggaaaagaaaacgcagaggaaatttgcctaaagaatctgtcaagatcttgcgggactggctgtatctccatcgctataacgcctatccttccgagcaagagaaattgtctctgagtggccaaactaacctgtcagtcttacaggacgaattcttagacgtaatctattggttccgacagatcattgcggtagtacttggggtgatttggggggtgctgccactgcgcgggtttctaggcattgcaggtttttgtctcattaacgccggggtgctgtatctgtacttctcaaactatctgcaaattgacgaagaggaatacggaggtacgtgggaactgactaaagaggggtttatgacctcttttgccctgtttatggtgatatggattatcttttataccgccattcactatgactag

SEQ ID NO: 51523 - DNA, 1398 bp, Artificial Sequence
  Description of Artificial Sequence: Synthetic coding sequence
atggagaaccaggagttcctgagcagcagcgcccccagcgaggtgaccgatggacaggtaagtaccgagattagtacctgttctgaggtgtttcagaagccgattgtgctacgaattctggatacgcacagagagctggaagaatccgaagacccagaaaagcatgaaaaccctgaggagcctgaagaagtgcgggagcaggatcaacgggatgaaagtgaagagtgtgacgaaccccacgaatcttatgaaccacacgccccatacgccccccacaagcccagagattcttacgccccctatgagcttcacggccctcacgcggctccgaagctgctaaaagccagagagccacggcagctccgtcatactcgtgaaccgcggaagagccgagaagctaaggaaaccgaactgttgccatcggccgcagtgatgatcagcccaagcctgatcacacgcgccccccctcgaccacagctttcttttctaggagctaatcccgtgtcttgcgacttcgtaagaaaatgtttcagttctaggaagaggactccaaacctctctaagcctaaaaaacaatggggcacaccggaccgcaaactattctggggtaaccaagatccaatcagacccgtgtctcagggcgctctcaaagcccagttgaccaagcggttagaaaatctggcacaacctaaggaagtgtcttgccattacgtcccaaatcgcgcccagtactaccattcctgtggtcgggaaagcgtaatttgggagatcactcctcctgccctgtttcgccaaccatccaaacgaatacagagactgtcacagcctaacggtttcaaacgccagtgtctgctgaacaggcccttcagtgataattcagcccgcgattctttgcggatcagtgatccaagtccgcggattctgcagctctcagtggctaagggcacagaccctaactaccacccaagtaagaagatgcagactaagatctctttgtccacgctgtcagcgattgcgactccccgcatcattgaactcgcacaccccaggataaaactcgagggcctgtgctatgaacggcaacgcagcgagctcccaatacggccagttccgccggccgccatgatagctaagccatcacctagaactattgcacttgccaagtcaaagagtgtgcaccaagattacctgccagatagagacgcccactggcctgtctcgtatgccaccacacattccaaagcttccccgaggatacaggagctggccaatccaaacaagagagcccctgtgagaattgtttattacgatcctgacgtcttcaaaaccaaacctgcggccctcaaagcgcagtgctcccaacgaatctgggagttgtcacaaccactgacccggtag

SEQ ID NO: 51524 - DNA, 318 bp, Artificial Sequence
  Description of Artificial Sequence: Synthetic coding sequence
atggcccagggcctgatcgaggtggagcggaagttcctgcccggcccgggcaccgaagaacgcctgcaggaactgggcggaacgctcgaatacagagttacctttcgggacacatactatgacactccggagctgagtcttatgcaggctgaccactggcttaggagacgggaagattctggatgggaacttaagtgtccaggggccgccggagtactgggcccccacacagaatataaggaattaacggccgaaccaacaatagtcgcccagttatgcaaggtgtgtctacatagacggcaacatcagcccagctag

SEQ ID NO: 51525 - DNA, 753 bp, Artificial Sequence
  Description of Artificial Sequence: Synthetic coding sequence
tgatacgccctgcccaacgccagctggtgcagcgacatgctgagcctctaccaggagttcctggagaagacaaagtcatccgggtggattaaactgcctagcttcaaatccaacagagaccacattcgcggactgaagctgccctcaggcttggctgtatcttcagataagggcgactgccggatctttactcgctgtattcaagtcgagggacagggatttgagtacgttatctttttccaacccacacaaaaaaaatcagtctgtctgtttcagccggggagttatctggagggccccccaggctttgctcacggtggctctctcgccgcaatgatggacgagacattcagtaaaactgcatttcttgcaggcgagggtctctttacattaagcctaaacattagatttaaaaacctgatcccagtggactctttggtggttatggacgttgagttggacaaaatcgaggaccaaaagttgtatatgtcttgtatcgctcacagctcatggaagaagagcctaccctccaattctcattgcgcctgcaggagggccactgcctctcccgcctgtctgttgccccctgcctccccagcttgtctgctccctccggcatctcccgcctgtctgttgccaccactgcccgcgagttgcttactgcccccgctccccgcgtcatgtttactgcctcccctccccgcctgggacccgtccaagtctagggagggctccagctcttccaactggtag

SEQ ID NO: 51526 - DNA, 402 bp, Artificial Sequence
  Description of Artificial Sequence: Synthetic coding sequence
atgcgggacctgagcgagcggcggctgggccagcccgagctgaaggctgagcagcagatgccgctcgagccagtacgagccagattatcagtcggactcgcatgttgctgcagtcacactactgccgaggcttcaagcctcgagcacggcgacaaggtgtttgggcagggattcccatccccactggaagaaattaaacgactgctcaagattagccgggcgctgcaggcccgctcagtgccaagcacacaagaaaaagcaaaatgtctgtcgggggagcccgggcaaccagaaggcaaggggcaggagacttaccccggacccgggaaagtcgaaggcaaggcggagcctgcaatgcggaaagacgacgtgtgccccggcatgaaatgcatcagcggctag

SEQ ID NO: 51527 - DNA, 402 bp, Artificial Sequence
  Description of Artificial Sequence: Synthetic coding sequence
atgcgggacctgagcgagcggcggctgggccagcccgagctgaaggctgaacagcagatgcctctggagcccgtgcgagccaggctatcagtgggcctggcgtgttgttgctcccacacgacagctgaggcttcttcactcgaacacggtgacaaagtctttgggcaggggttccccagccccctcgaggaaattaagaggctcctgaaaatttccagagctctgcaggctagatctgtgccgagcacacaggagaaagctaaatgcctgtcaggcgagccaggccagcccgaaggcaaaggtcaggaaacatatcccggccctggcaaggtcgagggtaaagcagaaccagccatgcggaaggacgacgtctgccccggaatgaaatgcatcagcggatag

SEQ ID NO: 51528 - DNA, 1551 bp, Artificial Sequence
  Description of Artificial Sequence: Synthetic coding sequence
atgcccagcagcaccagccccgaccagggcgacgacctggagaactgtatcctgaggttctctgacctggacttgaaagacatgagcctgattaatccttcgagcagcctgaaggcggagcttgacggctcgaccaagaagaaatacagctttgctaaaaagaaggccttcgccctttttgttaagaccaaagaagtgcccacaaagcgatcttttgagtgtaaggaaaaactgtggaaatgctgtaggcagctgttcacagaccaaacatcaattcatagacacgtggctacccagcatgccgacgagatttatcatcaaacagccagcattctaaagcagctagccgtgacactgtcgacaagtaagtctttgtcatctgccgatgaaaagaaccctctgaaggagtgcctgccacacagtcatgacgtttctgcctggctgcccgacatcagctgttttaatcctgacgaactgatatctggacagggttccgaagagggggaggtgctgctctactactgttaccacgacctcgaggaccctcaatggatttgcgcatggcagaccgccctatgtcaacatcttcacctcaccggcaagattaggatcgcggccgaagggatcaatggcacagtgggagggtccaagctcgcaaccaggttatatgtggaggtaatgctctccttcccactcttcaaagatgacctgtgcaaagacgactttaaaactagtaagggcggcgcccattgtttcccggagctgcgggttggagtattcgaggagatcgtgccgatgggtatttcacctaaaaaaatctcctataaaaaaccggggattcatctgagtcccggagaattccataaggaagtagaaaagttcttatcgcaggctaaccaagaacagagcgacaccatactacttgattgccgtaacttctacgagtccaagataggcagatttcagggctgcctcgcacccgatattcggaaattctcttacttccctagctacgtcgacaaaaacttggaactctttcgagagaagcgagtgcttatgtactgcacgggtggcattcggtgtgagagaggtagcgcctacttgaaagccaaaggggtatgtaaggaggtcttccagctgaaaggtggtatccacaagtacctggaagagtttccagacgggttttacaaaggaaaactctttgtgtttgatgagcgctacgccctttcatacaatagcgatgtggtctctgaatgttcttactgtggtgcacgctgggatcagtataaactgtgctccacccctcagtgcagacagctggtgctgacctgtcctgcctgtcaaggccagggattcactgcatgttgtgtcacctgtcaggacaaaggctcccgaaaagtgtccgggccaatgcaggacagtttcaaggaggagtgtgagtgtactgcgcgccgcccccggatcccaagggaactgctgcagcacgtgcgacagcccgtgtccccagaaccgggccccgatgccgacgaagatggacccgtcttgatgtag

SEQ ID NO: 51529 - DNA, 504 bp, Artificial Sequence
  Description of Artificial Sequence: Synthetic coding sequence
atggacctgtgcctggccgacagcagcgtgagcgcccccgccccccacaggcaagggatccaccttagcccaggcgagttccacaaagaggtagaaaagtttctgtcacaagctaaccaggagcagtctgacactatcctcctggactgcaggaacttttacgagtccaaaatcggtagattccaggggtgcctcgcgcctgatatcagaaagttctcgtacttccctagctacgtggataagaacttggaactctttcgtgagaagagggtgttaatgtactgtaccgggggcatcaggtgcgagagggggagcgcctacctgaaagcaaaaggggtatgtaaggaggtcttccaactgaaaggcgggattcataaatacttggaagaatttcccgacggattttacaaggggaagctgtttgtgtttgacgagcggtatgctctgtcttacaacagcgatgtcgtttcaggaaggtccgcccaggcccagtcaccgaactag

SEQ ID NO: 51530 - DNA, 219 bp, Artificial Sequence
  Description of Artificial Sequence: Synthetic coding sequence
atgctgagcttccccctgttcaaggacgacctgtgcaaggacgacttcaaaacatcaaagggcggcgcccattgtttccccgagttgcgggtcggtgtgtttgaggagatcgtcccaatgggaatctcacccaaaaagattagctacaaaaaacctggaatgctggctttcagaaggctatgtttcaactcgcaaggccagaacctgatagacaagtag

SEQ ID NO: 51531 - DNA, 504 bp, Artificial Sequence
  Description of Artificial Sequence: Synthetic coding sequence
atggacctgtgcctggccgacagcagcgtgagcgcccccgccccccataggcagggaatccatctctctccaggtgagtttcataaggaggtcgaaaagttcttgtcccaagctaatcaggagcaaagtgataccattctgttggactgcagaaatttctatgagtccaaaatcggcaggtttcaaggttgccttgctcccgatattcggaagttctcatatttcccctcatacgtcgataaaaaccttgagctctttcgagaaaaaagagttctaatgtattgcacaggtggaatcagatgtgaaagaggctcagcctatctcaaagcgaagggagtgtgcaaggaggtcttccagctgaaaggagggatccacaagtacctggaggagttccccgatggcttctataaggggaagttattcgtgttcgacgaaagatatgctctcagctacaactccgatgttgtcagtggtagatcagcccaggcgcaatcaccaaactag

SEQ ID NO: 51532 - DNA, 648 bp, Artificial Sequence
  Description of Artificial Sequence: Synthetic coding sequence
atgctgagcttccccctgttcaaggacgacctgtgcaaggacgacttcaaaactagtaagggtggcgcacactgttttccggaactaagggtgggtgtttttgaagagatcgtgcccatggggatttcccccaagaaaatttcttacaagaagcccggcatccatttatcgcccggcgagtttcacaaggaggtcgagaagtttctgagtcaggccaatcaggagcagagtgacacgatacttctggactgccggaacttctacgagtcaaaaatcggccgatttcagggatgtctcgcgcctgacatccgtaaattctcctatttcccatcctatgtagacaagaaccttgagctgtttcgtgaaaaaagagtgctgatgtactgtaccggagggatcagatgtgaaagaggctccgcctacctgaaggccaaaggcgtctgcaaagaggttttccaactcaaagggggtattcacaaatatctggaagagtttccggatggtttctataaggggaaactatttgtcttcgacgaaaggtatgcgttaagctacaactctgacgtggtctccgaatgctcatattgcggagctcggtgggaccagtacaaactctgtagtaccccacagctcgacacacttccatag

SEQ ID NO: 51533 - DNA, 339 bp, Artificial Sequence
  Description of Artificial Sequence: Synthetic coding sequence
atgtacgtgttcatcatgatggccttccccagcagccccgagtgcagctattgcggggcacggtgggatcagtacaaactctgttctaccccgcagtgtagacagttggtcctgacttgccccgcctgccagggacaaggctttaccgcatgttgcgttacatgccaggacaaaggatcaaggaaagtctcagggccgatgcaagactccttcaaggaggagtgcgaatgcaccgccagaaggcctcggataccaagggagctattacagcacgtgaggcagccagtgtctcctgagcccggaccagacgcggacgaagacggtcctgtgttaatgtag

SEQ ID NO: 51534 - DNA, 711 bp, Artificial Sequence
  Description of Artificial Sequence: Synthetic coding sequence
atgagcgaggccccccgggccgagaccttcgtgttcctggacctggaagccacaggcctcccaagtgtagaacctgagatcgcagagctgtcattattcgcggtacatcggtcctccttggaaaacccagagcacgacgagagcggtgccctggtgctgcctcgtgtcctggacaaactgaccctttgcatgtgcccagaacggcctttcacggcaaaagcgagtgagattacaggcctctccagtgagggcctggctcgttgtaggaaagcagggttcgacggagcagtggtgaggacgttgcaggctttcctgtcacggcaggcaggcccgatatgtcttgtggcacataacgggttcgactacgatttcccgctgctgtgtgccgagctgagaaggctcggcgctcggctgccccgcgatactgtttgtcttgataccttgccagctttaagagggttggaccgagcacatagtcatggcacccgagcacgaggccgtcagggctactcactgggctcactgttccatcggtattttagagccgaaccttccgccgcacactcagccgaaggggacgtccacacactgctcttaatcttcctccacagggccgcagaactattggcctgggcagacgaacaagcccgggggtgggcccatatcgaacctatgtatttgccccccgacgaccccagcctcgaggcttag

SEQ ID NO: 51535 - DNA, 2232 bp, Artificial Sequence
  Description of Artificial Sequence: Synthetic coding sequence
atgctgcacttcaaccggtgccaccacctgaagaagatcacccagaaatgcttctcctccattcatgtgaaaacagataagcacgcccagcgtttcctttcaaggaccttcgctttggcagagctgcgcaagtcttggtactctacccattctctagtgggcgacaaaaacatcatcctgatggggcccccaggggccggaaagacaaccgtgggacgtatcataggacaaaagcttgggtgttgcgttattgatgttgacgatgacattctagaaaaaacctggaacatgtccgtgtcagaaaagttgcaggacgtcggtaatgaacagttcctggaggaagaggggaaggccgtacttaatttttcagcaagcggaagtgtgattagtctgaccggctcaaacccaatgcatgacgcatcaatgtggcacctgaaaaagaacggaatcatcgtgtatctagatgttccacttctcgatctgatatgcaggcttaagttaatgaagactgaccggatcgtcgggcagaacagcgggacatcaatgaaagacttactgaaattcagacggcaatactacaagaagtggtatgacgcccgggtattctgtgaatccggggcctcccctgaggaagtcgctgacaaagtgctgaatgcaatcaagaggtaccaggatgtcgacagcgagacctttatcagcacacgccatgtgtggcctgaagactgtgaacagaaagtttccgcaaagttcttctccgaagcggtgatcgagggcctcgctagcgacgggggcctattcgtgccggcaaaggagtttcccaaattgtcttgtggagaatggaaaagtctagtgggcgcgacctacgtggaaagagcccagattcttcttgaacgttgcattcatccagcggatatccccgccgcaagacttggggaaatgatcgaaacggcctacggagagaactttgcgtgttctaaaatagcacccgtgaggcatcttagcggaaatcaatttatcctcgagctgtttcacgggccaaccggatcgtttaaggatttgtcgctccagctcatgcctcatattttcgcacattgcatcccacctagctgcaactacatgatactggtagctacctccggtgacactgggagtgccgtccttaatgggttcagccgcctcaacaagaatgacaaacagcgtattgcagtcgtcgccttcttccctgaaaatggggtctctgatttccagaaggctcagattatcggttctcaacgcgagaacgggtgggcagtaggtgtagaatccgacttcgatttttgccagacagccattaaacgtatcttcaatgacagcgatttcactgggtttctgactgtggaatacgggactatactgtctagtgccaacagcatcaattggggacgcctgttgcctcaagtagtgtaccatgcaagcgcatacctggacttagttagtcagggctttatctcctttgggtcccctgttgacgtctgcatccctaccgggaactttggaaatattctggcggcggtatacgctaaaatgatgggcatcccaatccggaaatttatctgtgccagcaatcagaaccacgtccttactgatttcataaagacaggccattatgacttgcgggagcggaagctcgcccagacctttagtcccagtattgatatcctcaaatcaagcaatctggaacgtcacttacacctcatggcgaataaggacggccagctgatgacagagctgttcaaccggctggaaagtcaacatcattttcagatcgagaaagccctggtggaaaagctgcagcaggactttgttgccgattggtgcagcgaaggtgagtgtctggcggccatcaactcaacttataacacaagcggctacatcctagaccctcacactgccgtcgctaaggtggtcgccgaccgagtgcaggacaagacatgtcccgtgatcatcagctctacagcccactatagtaagttcgccccagctatcatgcaagcgctcaagatcaaagagataaacgagaccagctcttcacagctgtacttacttggtagctacaacgcgctccctcctttacacgaggcactgttagagcgcacaaaacagcaagagaaaatggaataccaagtctgtgctgcggatatgaacgttctcaagtcacacgtcgagcaacttgtccaaaatcagttcatctag

SEQ ID NO: 51536 - DNA, 2232 bp, Artificial Sequence
  Description of Artificial Sequence: Synthetic coding sequence
atgctgcacttcaaccggtgccaccacctgaagaagatcacccagaaatgcttttcctcaatccacgtgaagaccgataagcacgcgcagcgattcctctctagaacgtttgcactggcagaactgaggaagtcatggtacagcactcactcactcgtcggcgacaagaatattatactcatgggaccgccgggggccggtaaaaccaccgttggccgtattataggccagaagctcggatgttgtgtaattgacgtggacgacgacatcttagaaaagacatggaacatgtcagtcagtgaaaagctgcaggacgttggaaacgagcagtttctggaggaggagggcaaggccgtgctgaattttagtgcctccggatctgtgatttctttgacagggtcgaatcctatgcacgatgcaagtatgtggcacctgaagaaaaatggaataatcgtgtatctagatgtgcctctgctagacttgatctgccggctgaaactgatgaagaccgataggatcgtcggtcagaactctggcacatccatgaaagacttgctgaagttcaggcggcagtactacaaaaaatggtacgatgcacgagtcttttgtgagtcaggtgccagcccggaggaagtggccgacaaggtgctgaatgcgataaagaggtaccaggatgtggattcagaaacgttcattagtacccggcatgtttggcctgaggactgtgaacagaaagtgtcggccaagttcttctcagaggcagttatagaaggactcgcctccgatggaggactcttcgttccagcgaaggagtttcccaaactgtcctgcggcgaatggaaaagcttagtcggggctacttacgttgaacgagcacagatcctgctggagcggtgcattcaccctgccgacatccccgcggccagactaggtgaaatgattgagaccgcgtacggtgaaaatttcgcctgcagtaagatcgcacccgtgagacacctgagcgggaaccagtttatcctggagttgttccatgggcctaccggctcatttaaggaccttagccttcagctgatgcctcatattttcgcccattgcatccccccatcttgtaattacatgatcctggtggctacatccggtgatactggcagtgctgttctgaatggtttctcaagattgaataagaatgacaagcagaggatcgccgttgtcgccttctttcctgaaaatggtgtgagcgatttccagaaggcacaaatcatcgggtcccaacgggaaaacggctgggccgttggcgtcgagagtgactttgacttttgtcagaccgccattaaacgaatctttaatgacagcgactttactgggtttctaacagtggaatacgggacaatcctgagtagcgctaatagcatcaattggggtcggctcctgccacaggttgtatatcatgccagtgcttacctggatctggtgtcacagggcttcatttccttcggtagcccagtagacgtttgtattccaacaggtaacttcggcaatattctggccgccgtatatgccaagatgatgggcatccctatccggaaatttatttgtgcatctaatcagaatcacgtgctgacagatttcatcaagaccggccactatgacctgcgcgagcggaaattggcgcaaactttctcccccagtattgatattctgaaatccagcaacttggaacgacatctgcacctgatggcaaacaaggacggccagcttatgacagaactgttcaataggttagaaagtcagcatcacttccagatcgagaaggcactggtggagaaacttcagcaggacttcgtggccgactggtgcagcgaaggcgagtgtctagccgctattaactcaacgtacaatacatccggctatattctggatccccacacagcggtcgccaaagttgtggccgaccgggtccaggacaagacttgtcctgtaatcatctccagcactgcacactactcaaagttcgcacccgcaattatgcaggccttgaagattaaagagatcaatgagacttctagtagccagctgtatctgctcggctcttataatgccttgcctccactgcacgaggcccttttggaacgcactaagcaacaggagaaaatggaatatcaggtttgtgcagccgacatgaacgtactcaaatcccatgttgagcaactggtgcaaaaccagtttatttag

SEQ ID NO: 51537 - DNA, 2301 bp, Artificial Sequence
  Description of Artificial Sequence: Synthetic coding sequence
atggccgccgaggccctggccgccgaggccgtggccagccggctggaacgccaagaggaggacatcagatggctgtggagtgaagttgaacgccttcgggacgagcaactgaatgctccatattcttgtcaggcagaaggcccctgtctcactcgggaggttgcccagctgagagctgagaattgtgacttacgccaccgtctgtgcagtctgcgtttatgcctggccgaggaacgtagtcggcaggcaacactagaaagtgcggaacttgaagccgcccaggaggccggggctcagccaccaccttcccagtcccaagacaaagacatgaagaagaaaaaaatgaaggagtctgaggcagactctgaagtcaaacatcagcctatttttataaaggagagactcaagctgtttgagatactcaaaaaagaccaccagctgttattggcgatctatggcaaaaagggtgatacatccaatatcatcaccgttcgtgtagctgacgggcagacagtacaaggagaagtctggaagacgacgccatatcaggtggccgctgagatcagccaggaattggctgagtcgacagttattgctaaagtgaatggcgaattgtgggatcttgataggccactggaaggggatagtagtttagagctgctcaccttcgataatgaagaggcccaggctgtctactggcattccagcgcccatatcttgggagaggccatggaactgtactacggaggtcacctatgctacggcccccccatcgagaacgggttctactacgatatgttcattgaggatcgggccgtgagttccaccgaactgtctgccctcgagaatatctgcaaggcaatcatcaaggagaaacagccgtttgagagattagaggtgagcaaagagattctcttggagatgttcaaatacaacaagtttaaatgtaggatcctcaacgaaaaagttaataccgcaacaactaccgtttaccggtgcggaccactcattgacctctgtaaggggccccacgtgagacatacaggtaaaatcaagaccatcaagatattcaaaaactcctcaacctactgggaggggaacccagagatggaaactctccagagaatttacggaatcagcttccccgacaacaagatgatgcgagactgggagaagttccaagaggaggcaaagaatagagaccaccgcaagataggtaaagaacaggaactgttttttttccacgatttgagtcccggcagttgcttctttttgccacggggcgcctttatttacaacacactgacagactttattcgcgaggagtaccacaaacgcgatttcacagaggtgctgtcccccaacatgtacaattccaaactttgggaggcctccggtcactggcagcactacagtgagaacatgttcacattcgaaatcgagaaagatacattcgccctgaagcctatgaactgcccagggcactgcttaatgtttgcacaccggccccgtagttggcgcgagatgccaataagatttgctgatttcggcgtgcttcatcgtaacgagctgtccggcacactatcagggctgacccgagttaggcgcttccagcaggacgacgctcatatattctgtaccgtcgagcagattgaggaagagatcaaaggctgtcttcagtttctccagtctgtgtactcaacttttggattcagtttccagctcaatttgagtacacgcccagagaacttcctaggggagattgagatgtggaatgaggctgagaagcagctccaaaactccctcatggacttcggggaaccttggaagatgaaccccggagatggcgctttctatggccccaaaatcgacatcaaaatcaaggacgctataggtagataccaccaatgcgcaactatacagctagatttccagttgccaatccgattcaacttgacatatgtgtctaaagatggtgacgataaaaaacgcccagtgataatacatcgcgccatactgggctctgttgagcgcatgatagccatcctttcagagaactacggcggaaagtggcctttctggctttctccaaggcaggtgatggtcattcccgtcggtccgacttgcgagaaatacgcactccaggtgagcagcgagttttttgaagaagggtttatggccgatgtggacttggatcactcctgcaccctgaataaaaagattcggaacgctcagcttgcccagtacaatttcatcctcgaccgcttcctgcctagcgtctggcaggaagcctggctgtag

SEQ ID NO: 51538 - DNA, 4830 bp, Artificial Sequence
  Description of Artificial Sequence: Synthetic coding sequence
atgttccccaagagcaacctgaccgtgacctgctgggtgtggcggtctatgcgaaagctgttcttattgctcagtctgctgctaagtcacgccgcccacttggagggcaagaaagacaaccaatttatctggaaacctggaccttggggcaggtgcacgggcgattgcggcccggggggtgtgcagtcgcgcgccgtatggtgctttcatgtggacggatggacgagccacctgtcgaactgcggcgaatccaaccgtcctcctaaggaacggtcctgttttcgggtatgcgactggcatagcgatctcttccaatgggaggtatcagactggcatcactgcgtgcttgtcccttacgctaggggagaggtgaaacccaggacagccgagtgtgttactgcgcagcatgggctccagcacaggatggtgaggtgcattcagaaactgaatcgcactgtggtggcaaatgagatctgtgagcactttgctttgcaacccccaacagagcaggcatgccttatcccctgcccccgagattgtgtggtgtctgagttcctcccctggtctaattgcagcaagggctgtggtaagaagcttcaacaccgaaccagagccgtcatagcaccccccctgttcgggggcctgcaatgtccaaatttaaccgagtccagggcatgtgacgctcctatctcatgccccttgggtgaagaagaatatacgttttctctgaaggttgggccttggagtaaatgtcggctgcctcacctgaaggagattaatccatcaggtcggaccgtcttggacttcaacagtgactctaacgaacgcgtgacatttaaacaccaatcctacaaagcccaccaccactctaagagttgggctatcgaaataggttaccagacccgccaagtctcttgcactaggtctgatggccagaacgctatgctgtctctatgcttacaggactccttccctctgactgttcagtcctgcattatgccaaaagattgcgagacatcccagtggtcctcatggagcccttgtagcaagacctgccggtccggaagccttctgcccggattccggagtcgcagtcgcaacgtgaagcacatggccattggaggcggcaaagagtgccctgagctcctggagaaggaagcctgcattgttgagggcgagctgctgcagcagtgtccacggtattcgtggagaaccagcgaatggaaggagtgccaagtaagcctgctattggagcagcaggatcctcactggcacgttactggcccagtatgcggcggcggaatccagacacgcgaagtgtattgtgctcagtccgtgcccgctgcagccgcactgagagcaaaggaagtctccaggccggtggagaaagcactgtgtgtcggacccgccccgttgccatctcagctgtgcaacatcccttgcagcaccgattgcattgtctctagctggtctgcatgggggctttgtatacatgagaactgtcacgatcctcagggaaagaaaggcttcagaacacgccagcgacatgttctgatggagagtacaggccccgctggccactgtccacatttggttgagtccgtcccttgtgaggacccgatgtgttaccggtggctcgcgagtgaaggaatctgctttcctgatcacggtaaatgcgggctcgggcacagaatcctgaaagcagtttgccagaatgaccgcggtgaggacgtgtctggatctctgtgtcctgtaccccctcccccagagcgaaagagttgtgagatcccctgtaggatggactgtgtgttaagcgagtggaccgagtggtcatcttgtagccaatcctgctcaaacaagaacagcgacggtaagcagacgagatcccgaactatacttgcacttgcgggcgagggggggaagccctgtcctcctagccaagctctgcaggagcatcgtctgtgtaacgaccatagctgcatgcagcttcactgggagacgtctccctggggaccgtgttctgaggatactcttgtgaccgccctcaacgcaacaatcggctggaatggtgaggctacatgcggggttgggatccagacccgacgcgttttctgcgtgaagagccatgtcggacaggtcatgacgaagaggtgtcctgacagtacgaggccagaaacagtcagaccttgttttctcccgtgcaagaaagactgtatagtgaccgccttctccgagtggaccccctgccccaggatgtgtcaagcaggaaacgcaaccgtcaaacagtctcgataccgtatcataattcaggaggccgcaaacggcggccaggaatgtccagacactttatatgaggagcgcgagtgcgaggacgtcagtttgtgtcccgtttacaggtggaaacctcagaagtggtcaccgtgtatcctggtgcccgagagtgtatggcagggaatcactggatctagtgaagcctgcggcaagggactccagacccgagcggtcagctgcatttcagacgacaaccgcagtgccgaaatgatggagtgtttaaagcagaccaacgggatgcctctgctggtgcaggagtgtaccgtgccgtgccgagaggattgtacttttacagcctggtctaagttcactccttgttccaccaattgcgaggcaaccaagagccggcgacggcagctgacaggtaagagccggaagaaagagaagtgccaagatagtgacctttacccactggtggagacagagctgtgcccctgtgacgagtttatctctcagccctacggtaactggtcggattgtatcttacccgagggacggcgggaacctcataggggcctgcgcgtgcaggccgatagcaaggaatgcggcgagggtctccggttcagggcagtggcctgttctgataagaatggcaggcccgtcgatccaagtttttgttccagttcaggctatattcaggaaaaatgcgtcattccctgcccttttgattgtaagctgtccgattggagcagttgggggagttgttcgtcctcctgtggtatcggagtgagaattcggagtaaatggttgaaagaaaaaccctataatggggggcgcccttgccctaagctggatcttaagaaccaaaacgcacaggttcacgaggccgtcccatgttacagtgagtgcaaccagtactcctgggtagtagagcactggtcgtcatgtaagattaacaatgagctcaggtctctgcggtgcggaggagggacacagagcaggaaaatccggtgtgtgaacaccgcggatggagaggggggggctgtcgatagcaacctttgcaatcaggatgaaataccccccgagacccagagctgctctctcatgtgccccaacgaatgcgttatgtcggaatggggattatggagcaagtgccctcagtcatgcgaccctcataccatgcaaagaaggaccaggcacctactgcgcccttccttgaactcacggacatgtgccgaagattcacaagtgcagccatgcctactcaatgagaactgttttcagttccaatacaacctgaccgagtggtctacttgtcagctctctgagaacgccccatgcggccagggtgtgagaaccaggctcctgagctgcgtgtgcagcgacggaaagcccgtatcaatggaccaatgcgagcagcataacctcgagaaaccacagaggatgtccatcccatgtctcgtggaatgtgtcgtgaattgtcagctttctggatggaccgcatggaccgaatgtagccagacttgtggccatgggggtaggatgtcaaggactaggtttatcatcatgcccacacagggagagggaagaccatgcccaaccgaacttacccaagaaaagacatgtccagtgacaccctgctacagttgggtgctcggcaattggtccgcgtgtaagctcgagggaggcgattgtggtgaaggcgtacagatacgaagtctcagctgcatggtgcatagcggctctatcagtcacgccgcaggtagggtcgaggatgcgctctgtggtgaaatgccgttccaggactcaattcttaagcagttgtgcagcgtgccatgtccaggagattgccatctgactgagtggtccgagtggagcacctgtgagcttacatgtattgatgggagatcttttgaaaccgtgggtagacagtcccggagccgaacctttattatacagtcttttgagaaccaggattcgtgtccacagcaagttctcgagacccggccctgcacagggggaaaatgttatcactacacatggaaggccagcctgtggaacaacaacgaaaggacagtgtggtgccagcggtctgatggcgtgaatgttacaggcgggtgttccccacaggctagacccgcagcaattcgccagtgtatcccagcctgtaggaagcccttttcatactgcactcaggggggcgtctgtgggtgcgagaagggctataccgagattatgaagagcaacgggtttctggactattgtatgaaggttcctggttcagaggacaaaaaagccgatgtgaaaaatctcagcggcaagaacagaccagttaactccaagattcatgatatcttcaaagggtggtctctgcagcctctggatccggacgggcgcgtgaaaatctgggtttacggcgtgtccggtggggcgttcctgattatgatcttcctgattttcacctcctatcttgtctgtaagaagccgaaaccccatcagtctactcctcctcaacagaaaccactgactttggcctatgatggcgatctagacatgtag

SEQ ID NO: 51539 - DNA, 4737 bp, Artificial Sequence
  Description of Artificial Sequence: Synthetic coding sequence
atgcacaacaccgccgacgaggtggtgctgtaccacaagctggccggcccttgggggcgttgcaccggtgactgcggtccggggggggtccagtcccgagctgtttggtgtttccatgttgacggctggacctcacacctgtcaaattgcggggagtctaataggccgcccaaagagcgttcgtgcttccgcgtctgcgattggcacagcgatttgtttcagtgggaagtgtcagattggcaccactgtgtcctcgtgccgtacgctagaggcgaggtgaagcctagaacagccgagtgtgtgacagctcagcacggtctgcaacatcgaatggtgcggtgcatccagaagcttaatcgcaccgtggtggctaacgagatatgtgagcatttcgctctccagcctccaacagaacaggcatgcctgatcccttgtcctagggactgcgtggtttcagaatttttgccctggtctaactgctctaaggggtgcggtaagaaactccagcatcgaactcgtgccgtgatcgcaccccccctgtttgggggtctgcagtgtcccaacctgactgaaagcagagcctgcgatgctcctatatcttgccctctgggagaagaggagtacacattcagtctgaaagttggaccatggtcaaaatgccgtctcccacacttaaaggaaataaatccttccgggcgtacagtgctggattttaactccgattcgaacgagcgtgtcacttttaaacaccagtcctataaagctcatcaccattcgaagtcgtgggctatcgaaatcggttatcagacccgtcaggtatcctgcactcgatccgatggacagaacgcaatgctgagtctgtgtcttcaagattcttttccactgactgtccagtcttgcataatgcccaaagattgcgagacatcgcagtggagcagttggtctccatgttcaaaaacctgccgcagtggatcccttctgcctggattcagatcccggtctcgcaacgttaagcacatggcaatcggtggtggaaaggagtgccccgagctgctggagaaggaggcctgcattgtcgagggtgagctcctgcagcagtgtccaagatattcatggaggacgagcgagtggaaagagtgccaggtcagtctgctgcttgagcagcaggacccacattggcatgtgactggccctgtgtgtggtggggggatccagacacgcgaggtgtattgtgctcagtccgtccccgccgccgccgcccttcgggcgaaggaagtgagcagaccggtggaaaaggccctctgcgtcggccccgcccccctgccttcacagctctgcaacatcccttgttcaacggattgcatcgtgagcagctggtcggcttgggggctatgtatccacgagaattgtcacgacccgcagggtaagaagggcttcaggacgcggcagaggcacgtgctgatggagagcaccggccccgccggccattgcccgcacctcgtggaatctgtcccttgtgaggatcccatgtgttatcgatggctggcgagtgagggcatctgtttccccgaccacggaaaatgcgggctcggacacagaatcctcaaagccgtgtgccagaacgacaggggggaggacgtgagcgggtcactctgtcccgtgccaccaccccctgaaagaaagagttgcgagattccctgtcgcatggactgtgtgctgtcagagtggaccgagtggagctcatgttctcagagctgctccaataagaacagcgatggcaagcagacaaggtcccggacaatattagccttggccggcgagggaggtaaaccatgcccccccagccaggccctgcaagagcatcggctttgcaatgatcacagctgcatgcagttgcactgggaaacgagtccttggggcccatgctctgaagatacccttgttaccgctttgaacgcgactatcggttggaatggagaggcaacttgtggtgtcggaattcagactcgtcgggtgttttgcgtgaagtcccacgtaggccaggtgatgactaaacgctgcccagactctacaagacccgaaactgtccgtccgtgtttcctaccctgcaagaaggattgcatcgttacagcgttcagcgaatggactccctgccctaggatgtgccaagctggcaatgctactgtcaaacaatccaggtatagaatcattatacaggaggccgccaatggcggccaagagtgcccggatacactctacgaggaaagagagtgtgaggacgtgtctttatgccctgtgtaccgttggaagcctcagaaatggtctccttgcatcctggtgcccgagtctgtttggcagggcattactggctcttcagaggcttgcggaaagggccttcagacaagagctgtgtcctgtataagtgacgataacaggtcggctgagatgatggagtgtctaaagcaaactaacggaatgcctttgctggtgcaggaatgtactgtaccttgccgggaggactgtaccttcaccgcgtggtccaagtttaccccgtgcagcacaaactgcgaggctacaaagagtaggcgcagacagctcaccggcaagtctcggaaaaaagagaaatgtcaggacagtgacctgtaccccctggtcgagacggaattgtgtccctgtgacgagtttatctcccagccctacggaaactggtccgactgcattctcccagagggccgaagggagcctcaccgcgggctgcgggttcaggcagatagcaaggagtgcggagagggcctccggttcagggccgttgcctgtagcgacaagaacgggcgaccagtggacccgtccttctgctcatcaagtggctatatccaggagaagtgcgtcataccatgcccttttgattgtaagctatcagattggtcgagctggggcagctgctcttcttcatgcggaattggagtccggattagatccaagtggctgaaggagaagccctacaatggtggaaggccttgtcctaaactggacttgaagaatcagaatgcccaggtgcacgaagccgtgccctgctattccgaatgcaatcaatattcatgggttgtcgaacactggtccagctgcaagatcaataacgagctacggtcactgagatgcggaggaggcactcagtccaggaaaatccgctgtgtcaatacagccgacggagagggtggcgctgttgacagcaatctgtgcaaccaagatgagatccccccagagactcaatcttgctcattgatgtgcccgaatgaatgcgtgatgagcgagtggggcctttggagtaagtgtccccaaagttgtgacccacatacaatgcagcggcggacgaggcacctgctgcggccctcgctcaactcccgcacgtgtgctgaggatagtcaagtgcaaccttgcttgcttaatgagaattgcttccagttccagtacaacctgaccgaatggtcgacctgtcaactgtcagagaacgcaccttgtggacagggtgtcaggacacgattgttaagttgcgtgtgctctgacggtaaaccagtctctatggatcaatgtgagcagcacaacctggagaaaccccagcggatgtctattccctgcttagtagagtgtgtcgtcaattgtcagctctcagggtggactgcctggaccgagtgcagccagacctgtggccatggcgggcggatgtccagaacacgttttatcatcatgcccactcagggcgaaggtaggccatgcccgacagagctcacacaagagaagacctgccctgttacaccttgctacagctgggtgttaggtaattggtccgcctgtaagctagaaggcggagattgtggagaaggagtgcagataagatcactgtcctgcatggtccactctgggagcattagccatgccgctggaagagtagaggacgccctttgcggggagatgcctttccaggactccatcctgaaacagctgtgctctgtcccgtgtcccggcgattgtcacttgacggagtggagcgaatggtcgacatgcgaattgacctgtatcgatgggcgttcctttgagacagtcggacggcaatcacggagtaggactttcatcatccagagcttcgagaatcaggactcttgcccacagcaggtgttagaaacgcgtccttgtactggtggtaaatgctaccactacacttggaaagcctcactatggaacaacaatgaaaggacagtttggtgccagcgaagcgacggggtcaatgtgaccggtggatgctcaccccaagcccggcccgccgctattaggcagtgtattcccgcgtgtcgaaagcccttctcctactgtactcagggcggggtttgcgggtgtgaaaaaggatatactgaaatcatgaagtccaacggattcttggattactgtatgaaggttccaggaagtgaggacaagaaggccgacgtgaagaatctgagtggaaagaataggcccgttaatagcaaaatacatgacatcttcaaaggatggagtctccaacccctcgaccctgatgggcgggtgaaaatttgggtgtacggggtgtcaggtggcgctttccttataatgatttttctcatttttacttcttacctcgtctgtaaaaagcctaaaccacaccagtcaacccctcctcagcagaaaccgcttaccttagcgtatgacggagacctggacatgtag

SEQ ID NO: 51540 - DNA, 1002 bp, Artificial Sequence
  Description of Artificial Sequence: Synthetic coding sequence
atggtgcggtgcatccagaagctgaaccggaccgtggtggccaacgaaatatgcgaacactttgcactgcagcccccgactgagcaagcatgcctgattccctgtccccgggattgtgttgtatctgagtttctgccctggagcaattgctcaaaagggtgtggtaagaagttacagcaccgcactagagccgtcatcgcaccacccttatttggagggttgcagtgtcctaatctgactgagtcccgggcctgtgacgctcctatctcatgccctctgggggaggaagaatacacattcagcttgaaagtagggccctggtcgaaatgtcgactgccccacctgaaggagatcaatccttcaggaaggacagtcctggacttcaacagtgattccaacgagcgtgtgacattcaaacaccagtcctacaaggcacaccatcactctaaatcgtgggcgattgaaatcgggtaccagacgcggcaggtcagctgtactagatctgacggccagaacgcgatgttaagcctctgcctacaagattctttccccttgacagttcagtcctgcattatgcccaaagattgcgaaacgtctcagtggagctcttggagtccatgttccaagacctgtcgttccgggagcttactgcctggattcaggtctcgatctagaaatgtgaagcatatggccataggtgggggaaaagaatgccccgagctcctggagaaagaggcttgcattgtcgaaggagagctgctccagcagtgcccgcggtactcatggcgcacaagcgaatggaaagagtgtcaacaagtttttggaactatcaccaacgagttgtacggcgcatctgttcagatggccctgatgtcccaggaagcagcccccctgaggcccgtgctgttgccattcggcagtgccttccagcctgccgagaatttgtccccgaccgtacatcgcgtggagagcgtggtagttcggagagccatacagaggtag

SEQ ID NO: 51541 - DNA, 1062 bp, Artificial Sequence
  Description of Artificial Sequence: Synthetic coding sequence
atggccgcccccgcccagcagaccacccagcccggcggcggcaagagaaagggcaaggcccagtacgtgctggccaagcgtgcccgccgatgtgacgctggcggtccacggcagctcgagcccggtcttcagggcattcttattacatgcaacatgaacgagcggaagtgcgtagaggaagcgtatagtttattgaatgagtacggtgacgatatgtacgggcctgaaaaatttacagataaggatcaacaaccaagcgggagcgagggcgaagatgatgatgctgaagcagcactgaagaaggaggtcggtgacataaaggcaagcaccgaaatgagattacgccggtttcagtcagtggagagcggcgctaacaacgtggtattcattcgcactctgggaatcgaacccgagaagctcgtgcatcatatattgcaggacatgtataagactaagaagaaaaagacccgagtcatcttaaggatgctccccatttccggcacatgtaaagcctttctggaggatatgaaaaaatatgccgagacttttttggaaccctggttcaaagcaccaaataaggggacctttcagatcgtctataagagcaggaacaacagccatgtcaatagggaagaagtgattcgggaactggcgggtatcgtgtgtaccctgaacagtgagaacaaggtggatctcactaatccacagtatacagttgtggtggaaattataaaagccgtctgctgcttaagtgtagtgaaggattacatgctgtttcgcaagtacaacctccaggaggttgtgaaaagcccaaaggacccaagccagctaaacagtaagcagggcaacggcaaggaggccaaattggagtccgcagataaatctgaccagaacaacacagctgaggggaagaataatcaacaagtgcctgaaaataccgaggaacttgggcagaccaaaccaacttctaatcctcaggttgtaaatgaggggggcgccaagcctgagcttgcatctcaggcaacagagggcagcaagtctaatgagaacgacttcagctag

SEQ ID NO: 51542 - DNA, 1062 bp, Artificial Sequence
  Description of Artificial Sequence: Synthetic coding sequence
atggccgcccccgcccagcagaccacccagcccggcggcggcaagcggaagggaaaagcccagtatgtgctggctaagcgcgcccgcagatgcgacgccggcggaccacgacagctggagcccgggctccagggcatactgattacttgcaatatgaatgaacgcaaatgtgtcgaggaagcttactcccttctgaacgagtacggagacgatatgtatggccccgaaaaatttactgataaggaccagcagccatcggggagtgaaggagaggacgatgatgccgaggcagctctgaagaaagaagtaggcgatataaaggcgagcacggagatgaggttgcggaggttccaatccgtggagagtggtgcaaataacgtagtatttatcaggaccctcggtatcgagcctgagaaattggtgcaccacattctgcaggatatgtacaagacaaagaaaaagaagacccgcgttatattacggatgctcccaatctcagggacttgcaaagccttcctcgaggatatgaagaagtatgccgaaacatttctggaaccttggttcaaagcaccaaacaagggcacctttcagattgtatataagagtcggaacaatagccatgtgaatcgtgaagaggttattcgggagctcgccgggattgtgtgcacgcttaattctgagaacaaggtggatctcacaaacccccagtatacagtggtcgtcgagattattaaagctgtttgctgcctgtccgtggttaaagactatatgttgtttcgaaaatataatctgcaggaggtagtaaagagccccaaagacccctcacaactcaactcaaagcagggtaacggaaaagaggcaaaactggaaagcgccgacaaatccgaccagaacaatacggccgaaggcaaaaacaatcagcaggttcccgagaacactgaggaacttgggcaaaccaaaccaacgagcaatccacaggtcgtgaacgaaggcggggccaaacccgaattggcctctcaggctaccgagggcagtaaatccaacgaaaatgacttctcttag

SEQ ID NO: 51543 - DNA, 1320 bp, Artificial Sequence
  Description of Artificial Sequence: Synthetic coding sequence
atggccgccatgctgcccctgctggacagcggctgcagccgggaggcagggcaggaagccggacttggcagagtatctcttcaccccttccacgattgccggccagccctcggtcccggcgcggcgcggaatgaagcatcccgccctgcaaggggcgggcggaggtcctaccctacaagccccgtgcgagccggagatcgtcgcgggaggcagcaacagcgccgtaacgtgagcttgagttcacagtttgctcacactatggcagccccagcccagcagacaactcagcccgggggaggaaaaaggaagggcaaagcccagtacgtactggctaaaagggcgcgccggtgtgacgctggagggcctcgccagctggagcccggtctccagggcattcttatcacgtgtaacatgaatgaacgtaaatgtgttgaggaagcatattcacttttaaatgagtacggggatgatatgtacggacctgagaagtttacagacaaggatcaacaaccaagcggctccgaaggggaagacgacgacgctgaggcagcactgaagaaggaagtaggagacatcaaagcttcgaccgaaatgcggctgaggcggtttcagagcgtggagagcggcgccaacaacgtagtcttcattaggacactcggaatagaacccgaaaagctggtccaccatatcctgcaagacatgtataagaccaaaaagaagaaaactagagttatcttaagaatgctccccataagcggaacatgcaaggcttttctggaggacatgaagaagtacgccgagaccttcctggaaccttggtttaaagcccccaacaaaggtactttccagatcgtgtacaaatctcgcaacaattcacacgtgaaccgggaggaagtgattcgcgagctcgctggcatagtctgcacattaaactcggagaacaaggtcgacctgaccaacccgcagtacactgtggttgtggagataatcaaggccgtatgttgcctgtcggtggtcaaagactacatgctgttccgcaaatacaatttgcaggaagtggtgaagtcacctaaagatccttcacagctgaattcgaagcagggcaacggaaaggaagccaaattggagtcagcagataagagtgaccagaataacactgccgaggggaaaaacaaccagcaagtccccgagaacacagaagagctgggccaaaccaagccaacatccaacccacaggtggtgaatgagggtggcgctaaacctgaactggcatcacaggctacggaaggatcaaagtcgaacgaaaacgactttagctag

SEQ ID NO: 51544 - DNA, 1524 bp, Artificial Sequence
  Description of Artificial Sequence: Synthetic coding sequence
atgtgcgacatcgaggaggccaccaaccagctgctggacgtgaacttgcatgagaatcagaagtccgtgcaggtgactgagtcagatctgggcagcgagtccgagctcttggtcacaatcggcgcgaccgtccccactggattcgagcaaaccgcagccgatgaggtgcgggaaaaactgggatcttcatgcaaaatctcacgtgatcggggtaaaatttactttgtcatatccgtggagtccctggcacaagtgcactgtctaaggtctgtagacaacctttttgtcgtcgttcaagaattccaggactaccaatttaaacagacgaaagaggaagttctgaaggatttcgaagaccttgcagggaagctcccatggagtaatccattgaaggtgtggaagatcaatgccagtttcaagaagaagaaggcaaaaaggaaaaaaatcaaccagaacagctctaaggagaagattaataatggccaggaagtcaaaatcgaccagcggaacgtcaagaaagaatttaccagccatgcacttgactcgcacatcctagactactatgaaaatcccgcaattaaggaagacgtttctaccttgatcggagatgatctggctagctgtaaagatgaaactgatgagtcatcaaaggaggaaacggagcctcaggttcttaaatttagagtcacatgtaatcgggccggcgagaagcattgctttacatctaatgaggcagcccgcgactttggtggcgctgtgcaagattatttcaagtggaaagccgacatgactaacttcgatgtggaagttttgctcaacatccacgacaacgaagtcatagttggaatcgcactgactgaagagagtttgcatcggcgcaacattactcactttgggcccactacgctgcgatcgaccctggcctacggaatgctgagactgtgcgatcctctgccctacgatattattgtggaccccatgtgtggcactggcgctatccctatcgagggggcaaccgagtggtcggattgttttcacattgcaggagacaacaaccccctggcggtgaatagagctgccaacaatatcgcctccctcctgactaaaagccagatcaaagagggcaagccttcctggggcctacctatcgatgcggtccagtgggacatatgcaatctcccactccggacaggatccgtggacatcattgtgaccgacctgccttttggtaagagaatgggttcaaaaaagaggaactggaatctgtatccagcctgtctgcgggaaatgtctcgcgtgtgcacccctaccacaggccgggccgtcctcctgacccaagacacaaaatgcttcacaaaggctctcagtggaatgcgccacgtttggagaaaagtggacaccgtgtgggtgaacgtcggaggcctgcgggctgctgtttatgtgttgattcgcaccccgcaggccttcgtgcacccctcagagcaggatggggagcgaggcactctgtggcagtgtaaggaatag

SEQ ID NO: 51545 - DNA, 126 bp, Artificial Sequence
  Description of Artificial Sequence: Synthetic coding sequence
atgtgcgacatcgaggaggccaccaaccagctgctggacgtgaacttgcacgagaaccagaagtctgtccaagttacagaatcagatctcggctcagagtcagagctcctggtgaccatcggctag

SEQ ID NO: 51546 - DNA, 372 bp, Artificial Sequence
  Description of Artificial Sequence: Synthetic coding sequence
atgtgcgacatcgaggaggccaccaaccagctgctggacgtgaaccttcacgaaaatcaaaagtccgtgcaggtgacagaatctgacctcggtagtgagtcagagcttctggtcaccattggtgctacagtaccaaccggatttgaacaaacagccgctgatgaggtgcgagaaaagctcgggagttcatgcaagattagccgagaccgtggtaagatatacttcgttatttcagtcgagtctctggcccaggtccactgtctccggagtgtggacaacctcttcgttgtggtgcaagagtttcaggactatcagttcaagcagaccaaagaagaagtcctcaaggattttgaggacctcgccggtaaatag

SEQ ID NO: 51547 - DNA, 1524 bp, Artificial Sequence
  Description of Artificial Sequence: Synthetic coding sequence
atgtgcgacatcgaggaggccaccaaccagctgctggacgtgaaccttcacgagaatcagaagagcgtgcaggtaactgagtccgaccttggctcagaatcggaactacttgtgacgattggggcaacggtgccaaccggcttcgagcagacagcagcagatgaggttcgggaaaagctggggagcagctgcaaaatcagtagagaccgaggaaaaatctactttgttatcagtgtggaaagcctcgcccaggtgcattgcctacgctccgtggacaatttattcgtagtcgtgcaggagttccaggattatcagttcaaacagactaaagaggaggtgctgaaggactttgaggacctcgctggaaagctgccttggagcaacccattgaaggtgtggaagatcaatgcatcttttaaaaagaaaaaggctaagcgcaagaagattaatcagaactcctctaaggaaaaaataaacaacggtcaggaggtgaaaattgatcagcgcaatgtgaagaaggaatttacctcgcatgccctggacagtcatattctggactactatgagaaccctgctatcaaggaggatgttagcactcttatcggggatgatctggcgagctgtaaagatgaaaccgatgagtcctcaaaagaagagacagaaccccaggtcctcaagttccgggtcacctgcaacagagctggagagaaacactgttttacttcaaacgaggcggcccgggactttggcggggccgttcaggattatttcaagtggaaggcagatatgactaattttgacgtcgaggtcttgctgaacatacatgacaatgaagtcattgtcggtattgccctgaccgaggagtcactgcataggaggaacatcactcattttggacctaccactctccgcagtaccctggcttatggcatgttgaggttgtgtgacccacttccttacgatataatcgtcgacccaatgtgtggcaccggcgctatccccatcgaaggtgcaaccgaatggtccgattgctttcatattgctggggacaacaatcccctcgccgtcaaccgagctgcaaacaacatcgcatctttattaacgaaaagccagataaaggaggggaaaccctcttggggtctgccaattgacgcagtacagtgggatatatgtaatctgcccctacggaccgggagcgtggacattattgtgactgatctgccttttggaaaacgcatgggtagtaagaagagaaactggaacctgtatcctgcttgcttgcgagaaatgtcccgcgtttgtacccccacaacgggcagggctgtgctgctaacgcaggataccaaatgcttcactaaagctctaagcgggatgcgtcatgtgtggcggaaagtagataccgtatgggttaacgtcggaggactacgcgcggctgtttacgtgctgatccggactccacaagcatttgttcaccctagcgagcaggacggcgagcgtggcaccctgtggcagtgcaaagaatag

SEQ ID NO: 51548 - DNA, 1524 bp, Artificial Sequence
  Description of Artificial Sequence: Synthetic coding sequence
atgtgcgacatcgaggaggccaccaaccagctgctggacgtgaacctgcatgagaatcaaaaaagcgttcaagttacagagtccgatcttggcagtgaatcagagttgcttgtcacaatcggagcaacagttccaaccgggttcgagcagacagccgcagacgaggtgcgtgaaaaacttggtagctcttgcaagataagtcgtgaccgcggaaagatttactttgtaattagcgtagagagcttagcacaagtgcactgcctgcgcagtgtcgataatctgtttgtggtagttcaggaattccaggactaccagttcaaacagacaaaagaagaggtactgaaggatttcgaggatcttgccggcaagttaccatggtccaatcctctgaaagtgtggaaaatcaatgcgtcattcaagaagaaaaaagcaaagaggaaaaagatcaaccaaaactctagtaaagagaagataaataatgggcaggaagtgaaaatcgaccagaggaatgtcaagaaggaatttacctcgcacgcccttgattctcatatattagactactatgaaaaccctgcaattaaggaggacgtgtccacccttatcggtgatgacctggctagctgtaaagacgaaaccgatgagtccagcaaggaggaaactgagccccaagtcctcaaatttcgcgtaacctgcaatagggccggggaaaagcattgttttacctccaatgaggccgcccgggacttcggcggcgccgtacaggactacttcaagtggaaagcagatatgacaaactttgatgtcgaggttcttctaaatatccacgacaacgaagttatcgtaggaattgcattgaccgaagagagtctgcaccgccgaaatattactcatttcggtccaaccacacttcgaagcaccctggcttatggcatgctgaggttgtgtgaccctttgccgtacgacataatcgtcgatcctatgtgcgggactggagcgattcccatcgaaggcgcgaccgagtggtcggactgctttcacatcgccggggataacaacccattggctgtgaacagggccgccaataatatcgcatctctcctaaccaagtcacaaattaaagagggaaaaccttcttggggtttaccaatcgatgcggtccagtgggatatctgcaacctgcccctcaggactggaagcgtggatattatagttacagatctcccatttggtaaacgcatgggaagtaagaagcgaaactggaatctgtacccagcatgtctgcgcgagatgagtcgggtctgtacccctaccactggacgggcggtgttattaacgcaggatactaaatgctttactaaggcactgtctggcatgcgacacgtgtggaggaaggttgataccgtttgggtcaacgtcggaggcctgcgagccgccgtgtatgttttaatccgcacaccgcaagccttcgtgcacccgtctgagcaggatggagaaagagggacgctttggcaatgcaaggaatag

SEQ ID NO: 51549 - DNA, 1566 bp, Artificial Sequence
  Description of Artificial Sequence: Synthetic coding sequence
atggaggccagcgtgctgagccccaccagctgggagaagcggcgggcctggctcaggcagagccgcaattggcagacccaggtcctggaagaggaggcagcggcagcccttcaggacgtgccagatcccgagcctagcagcctcgatgatgtattccaggagggcaaccctatcaacaagatcgaagactggctgcaggactgtgggtactctgaggagggattttcagaggaggctggacagttcatttacaatggtttttgctcccacggcacctcttttgaagacgacttaacacttggcgcagaggccacgttgctggctgccaatggaaagctgttttctcggtccttccttgagactgcgcggccctgtcagctgttagacctcggttgcagtttagctagctctagcatgacaggaggcacaaacaagactagctcaagtatttccgaaattctcgacaaggttcaggaagacgccgaagatgtactgttctctctgggcttcggacaggaggatcataaggacacaagcaggatccccgcgaggtttttcacgacgccttcccaggccaagggcattgattttcaactgttcctgaagagccaggtgcgcaggatcgaaatggaggatccatgccttatgctggcttcccgctttaagcaggtgcagaccttggccgttacagctgacgctttcttctgcctctatagttacgtttcaaagacaccagtacaaaagtttaccccttctcatatgttctggaattgtaaccaccctaccgatgttccatctattaggatcttgtcgcgggaaccagagccccagtcccctcgcgatcgactacgaaaggctatctccaagatgtgcctctatacttgccctagggacaggccccctcctccccacaatactccgaagagaaactcgctggaccaggtggtcctggaggtgatggacaaggtgaaggaggaaaagcagttcctgcaacaggattcagatcttggccaattcagccaggaggatcctgtacctcccgccgaaggtaagaagctgccaacgagtccttatccttgcgtgttctgttgcgaggaggagactcaacagcgcatgagcacggtcttggccccttcccagaccctggattcaaatccgaaggtgccatgctgcacgcactctcttcctatcgaggaccctcagtggagtaccgacccggcccagatccgacgcgaactttgcagtttgcccgccaccaacactgaaacacatcccgccaaagacgagaccttctggaagagaaaatctagagcacgcaaatccttgtttcagaaaaaccttatggggagaaaagttaagtccctcgacctctcaatcactcagcaaaaatggaagcagagtgttgaccgtccagagctacgtaggagcctgagccaacagccccaggatacctttgacctggaagaggttcagagcaactcagaggaagagcaatcccaaagccgatggccatcacggccgcgccaccctcaccaccaccaaacatttgcaggcaaggacagttag

SEQ ID NO: 51550 - DNA, 1152 bp, Artificial Sequence
  Description of Artificial Sequence: Synthetic coding sequence
atgaccggcggcaccaacaagaccagcagcagcatcagcgagatcctggataaagtccaagaggacgccgaggacgtgttgttctcactcggattcggccaggaagaccacaaggatacatccagaattcccgctaggttttttacaacaccttcgcaagcaaaaggaatagacttccagttgtttctgaaaagtcaggtgcgcaggattgaaatggaggatccatgcttaatgctcgcaagccggttcaaacaggtccagacactggccgttactgcagatgcattcttctgcctctacagttatgtgtcgaagactcctgtacagaaattcactccttcccacatgttctggaattgcaaccatccgaccgacgtccccagtattcggattctctcacgagagccagagccacagagccccagagatcgtctacgtaaggcgatcagtaaaatgtgtctgtatacatgccccagagatcgccctcctccaccacataataccccgaaacgtaatagccttgatcaggtggtactggaggtgatggacaaggtgaaggaggagaaacaatttctccagcaggactccgatttgggccagttttcccaagaagaccctgtccctccagcagaagggaagaagctacccactagtccctacccctgtgtcttctgctgcgaagaggagactcagcaaagaatgtccacagttttagccccatcgcagacgctcgatagcaaccccaaagtcccctgctgcacacactccttacccatcgaggacccccaatggtctaccgaccccgcacagattagacgcgaactgtgctctcttcccgccacaaacaccgaaacccacccagcaaaggatgagaccttttggaagcggaagtcccgggctaggaagtctctgttccagaagaatttgatgggaagaaaagtcaagtctctggatctcagtataacacaacaaaaatggaaacagtctgtcgacagaccagaactgaggcggagcctctctcagcagccacaggataccttcgatctggaagaggtgcaatctaatagcgaggaggaacagagccaatcgagatggcccagccggcctagacatccccaccaccaccaaactttcgccggcaaagacagctag

SEQ ID NO: 51551 - DNA, 249 bp, Artificial Sequence
  Description of Artificial Sequence: Synthetic coding sequence
atggaggccagcgtgctgagccccaccagctgggagaagcggcgggcttggctccgacagagtcgaaactggcagactcaggtgctggaggaggaagctgccgcagccctgcaggacgtccctgatccagagccttcttccctggatgatgtatttcaggagggcaacccgatcaataagatcgaagactggctgcaggattgcggatacagcgaagaggggttttccgaggaagcaggacagttttag

SEQ ID NO: 51552 - DNA, 147 bp, Artificial Sequence
  Description of Artificial Sequence: Synthetic coding sequence
atggaggccagcgtgctgagccccaccagctgggagaagcggcgggcttggctgcggcagtcaagaaactggcagacccaggtgctggaagaggaagccgcggccgccctgcaagatgttcctgaccctgaaccctcttctctgtag

SEQ ID NO: 51553 - DNA, 138 bp, Artificial Sequence
  Description of Artificial Sequence: Synthetic coding sequence
atgagcgacaagcccgacctgagcgaggtggagaagttcgaccggtcaaagcttaagaagacgaatacagaggagaaaaatacgttgcctagcaaggaaactatccagcaggaaaaagagtgcgtccaaacaagctag

SEQ ID NO: 51554 - DNA, 588 bp, Artificial Sequence
  Description of Artificial Sequence: Synthetic coding sequence
atgcccaacttcctgggcctgcaccgggcccggagcttcaccgtgctgtgcttttggagcactgctgatgtcctcaacgcctccggccccagacgccagtggcatcccctagcctcctgctcaagttggtccagacctcaatcccaaggctccactcccggcgtcctctgcaagacaggtatgggccgagagccgatccccgagactcagtgtcatttcgcaaactctatgtgcagtctgcacgtctctgtgccatatttcgggaactcccctaacatctctaacttcttccgatggtccctggccctaagtcccaggcaatggtgcgacctaggcagtcttcaacccccgagccctcggttcaaagggttctcttgcttatctctcccgtctagctgggactatcgtagggcgccttctcccgccaacttctgcatacttgtggaaatggggttccaccatgtcggacaagccgacctggagctcctgactagcgccgacctacctaccagtgcatcacagagcgctggtatcaccggtgtttcacaccacgcttggccgcaaaccctctcgcttcttctctactag

SEQ ID NO: 51555 - DNA, 795 bp, Artificial Sequence
  Description of Artificial Sequence: Synthetic coding sequence
atggcccccaccggcctgctggtggccggcgccagcttcctggccttcaggggactacattggggcttaagacggcttccaactcctgagtccgcagcaagagaccggtggcagtggtggaatttgtgcgtatctctggctcactctctcctgtcaggcacgggcgcacttctgggcctgtccctttacccccaaatggctgccgacccaatccacggacatcccagatgggcgcttgtgctggttgcagtatcagtggggtacttcctggccgacggtgccgacctgttatggaatcagacactgggaaaaacctgggatttattgtgtcatcatctggtcgtggtgtcatgtctttccaccgccgttctctccggccactatgttggtttttccatggtatcacttttgctcgagttaaattctgcatgtctccacctgcgcaaactgctccttctgtcccggcaagctccatctttagctttttcggtgactagttgggccagcctggctactctggccctgttcagactggtgcccctggggtggatgtctctttggctgttccggcagcatcaccaggtgccacttgcactggttaccctgggtgggatcgggctggtgactgtgggcatcatgtctattatccttggaatccggatactagtcaacgacgtactgcagtcaaggcctcaccccccatctccaggccacgagaaaaccaggggtacgcgaactcggagagataacggacccgtgaccagcaattccagcacgctatctctcaaggattag

SEQ ID NO: 51556 - DNA, 3561 bp, Artificial Sequence
  Description of Artificial Sequence: Synthetic coding sequence
tgatgcgccgcccccgcccccctgaccagcgccgagcgggagctgcagcagatacggatcaatgaggtgaagacagaaatatctgtggaatccaagcaccagaccttacaggggcttgccttccccctacagcccgaggctcaacgcgctctccagcagctcaagcagaagatggttaactacatccagatgaaactggacctcgaaagggaaacaatcgagctggtgcataccgaaccaacagatgtggcccagttaccgtcaagggttcccagggacgcggccagataccattttttcctatataaacatactcacgagggggatcccctggagtcagtggtgttcatatactcaatgcccggttataaatgctctatcaaagagaggatgctttactctagctgcaagtctagactactggatagcgtggagcaggactttcacttggaaattgccaaaaaagggttttgtaggagcgccctgcatccactgagcttgcttgtccaggcgatcatgctggccatgacattagcgctcggcaccctgccagctttcctaccatgtgaactgcagccacacgggctcgtcaactgcaattggctattcttgaagagcgtgccacacttttccatggctgcccccagagggaatgtcacatcactcagcctgtcatctaaccgaatccatcatctgcatgacagcgatttcgcccatctaccttccctgcggcatctcaacctcaaatggaactgcccacccgttggcctgagccctatgcatttcccctgtcatatgacaattgaaccctccaccttcctggctgtgcctacactagaagagctgaacctgtcctacaataacatcatgactgtgcccgccctgccaaaaagccttatttcactgtcgctatctcacacaaatatactgatgttggattccgcctctcttgcggggttgcacgcactacggtttctattcatggacggaaactgctattataaaaacccgtgtagacaggccctcgaggttgcgccaggcgccctgcttgggctgggcaacctgacccacttatcacttaagtacaacaacctgaccgtagtccctcgcaatctgccatcgagcctggaatacctgctgctaagctacaacagaatagtaaagctggcaccagaggacttggccaatctgacagcattaagggtgttggacgtgggcggcaattgccggagatgcgatcatgctcctaacccatgtatggagtgcccacggcacttccctcaactgcatccggacaccttctcccacctatctcgcttagagggtttggttctcaaggatagcagtttgtcctggctgaacgctagctggtttagagggctcggcaaccttcgtgtacttgatctatccgagaattttttgtacaagtgcattactaagaccaaggccttccaaggactgacacagcttcgtaagctgaacctcagttttaattatcagaaacgcgtgagttttgcccacttgtcgctcgcgccctccttcggttcattggtggccctgaaggaactagatatgcatggaatattttttcgaagcctggacgagaccacccttcgccctttagcaagactgcctatgctgcagaccctacggttgcagatgaacttcatcaaccaggcacaacttggcatcttcagggcattcccaggattgagatatgtggacctatccgataatcggatttctggtgcctctgagctgactgcgacaatgggtgaggccgatggaggggagaaggtttggctgcagccaggggacctggcgcctgcccctgtagacactcctagctctgaagacttccgccccaattgctctactctgaatttcaccctggacctgtctcgcaacaaccttgtgaccgtacaaccagagatgttcgcccaactgtctcacctccaatgcctgcgtctgagccacaactgcatttcacaagccgtcaacgggtcgcagttcctgccactgaccggactccaggttctcgatctgtcgcataacaagctcgacctgtaccatgagcacagctttactgaactgcctagattggaggccttggatctgagctataatagccagccattcgggatgcagggggtcggacacaacttttcttttgtggcccaccttcgcactctgagacatctgtcactagcccacaacaatattcacagtcaggtgtcccagcagctgtgtagcaccagtctcagagccctcgacttctccggaaacgctcttgggcatatgtgggctgagggcgacctttacttgcacttttttcaggggctctccggattgatctggctggatctatctcagaatcgcttacacacactgctgccccagacccttcgaaatctccctaaatctctacaggttctgcgtttgagagataattacttggcattcttcaaatggtggagtctgcactttctcccaaaactcgaagttctggacctggcaggaaatcagttgaaggcacttaccaatgggagtctccccgccggaacacggctcaggaggctggacgtgtcatgtaactccatctctttcgttgctccaggttttttttcaaaagctaaagaactgagagagctcaatttgtctgcgaacgctcttaaaactgtggaccactcttggtttgggccattggcctctgctttgcagattctggacgtgtcagccaacccgctgcattgcgcttgcggagccgccttcatggacttcctgctagaggtgcaggccgccgtgcccggcctccctagcagggtgaagtgcggctcacctggccagctgcaaggactctcgatcttcgcccaggaccttagattgtgtctcgacgaggcgctgtcttgggattgtttcgcactctcactcctcgcagtggctcttggactgggagtgcctatgcttcatcacctgtgcggctgggacctatggtattgcttccacttatgtctggcgtggctcccctggagaggacgtcagagcggcagggatgaggatgcgctaccctatgatgctttcgtcgtatttgataaaacccagagcgctgtcgccgattgggtatacaacgaactcaggggccagctcgaagaatgtcgcggacggtgggcccttcggctgtgcctagaagaacgggattggctgccagggaaaactctattcgagaacttgtgggccagtgtatacgggtccagaaaaacactattcgtcctagctcacactgacagggtgtcagggctgttgagagcctcgtttctgttagcacagcagaggctgctggaggacaggaaggatgtagtcgttcttgtcatccttagccccgacggccgacggtcaagatacgtgagacttagacaacggttatgcagacaaagcgttctgctgtggccccatcagccctcgggtcagcgttccttctgggcccagcttggaatggccctgacacgtgacaaccaccatttttataatcggaatttctgtcaggggccgactgctgagtag

SEQ ID NO: 51557 - DNA, 1113 bp, Artificial Sequence
  Description of Artificial Sequence: Synthetic coding sequence
atggccggcgccgagaactggcccggccagcagctggagctggacgaagatgaagcctcttgttgcagatggggagcacagcacgctggagcccgggaactggccgccctgtactctcctggaaagcggctccaggagtggtgcagcgtcattctgtgtttctctctgatcgcacataatcttgtacatctcctgttgctcgcacgttgggaggatactccactggttattctgggagtcgtggccggtgcactgattgccgattttttgtctggcctggttcactggggcgccgatacatgggggagcgtcgaactgcctattgtcggtaaagccttcattcgaccatttcgcgagcaccatattgaccctaccgcaataacgcgacacgattttatcgagacaaatggagacaattgcctggttaccttgctccccctcctcaatatggcctataaattccgaacccacagtcccgaggccttggagcagctctacccatgggaatgtttcgtcttctgtctaataatctttgggaccttcacaaaccagattcataagtggagccacacttattttggcttacctcgatgggtcactctgctgcaggattggcacgtgattctcccacgcaagcatcacaggattcatcatgtgagtccacacgagacctacttctgcataaccacaggcgtcaaagttccacgtaattttagactgctggaggagctggaagagggacaaaagggagttggggatgggaccgtcagttggggactcgaggacgacgaggatatgacactcacgagatggaccggaatgatcattggacccccgcgaacaatctacgagaatagaatctatagtctgaagattgagtgcggtccaaaatacccggaagcgcccccatttgtgcgctttgtgacgaagataaacatgaacggcgttaattcttcaaacggggtggtcgacccccgcgctatatctgtgctggccaagtggcaaaatagctactccatcaaagtcgtactacaggaactgcgccgtctgatgatgagcaaagagaatatgaagctccctcagccaccggagggccagtgctattccaactag

SEQ ID NO: 51558 - DNA, 978 bp, Artificial Sequence
  Description of Artificial Sequence: Synthetic coding sequence
atggcccacttcgtgcagggcaccagccggatgatcgccgccgagtcttctacagaacacaaggagtgcgccgaaccgtcaaccaggaagaatcttatgaattcactagaacagaaaattaggtgtctggaaaaacagagaaaagaactgctcgaggtcaaccagcagtgggaccagcaattccggagcatgaaggaactctacgagcgaaaggtagctgagctgaaaacaaaactcgatgcagctgaacggtttctgagcacacgtgagaaagaccctcaccagcggcagcgcaaagacgatcgacagcgggaggatgaccggcaaagagacctgacacgggaccggttgcaaagggaggagaaggaaaaggagagactcaacgaagaactgcatgaactgaaagaagaaaataaattgctcaaggggaaaaacaccctcgccaacaaggagaaagagcactatgaatgcgaaattaagaggctcaacaaggccttacaggacgccttaaacatcaaatgctcctttagtgaggactgtctgagaaagtcaagagttgagttctgccatgaggaaatgagaactgagatggaggtcttgaagcagcaggttcaaatctacgaagaggactttaagaaagagaggtctgaccgcgagcggctgaaccaggagaaggaagaattgcagcaaattaacgaaacctcgcagagccagctgaacaggctgaattcacagattaaagcatgccagatggagaaagagaagctggaaaagcaattaaagcagatgtactgccccccgtgcaactgtggactcgttttccacctgcaagacccatgggtgccaactggtcccggcgccgtacagaagcagagggagcatccacccgattaccagtggtacgccctggatcaactgccgccagacgtgcagcataaggccaatgggctgagtagtgtgaaaaaggtgcacccgtag

SEQ ID NO: 51559 - DNA, 978 bp, Artificial Sequence
  Description of Artificial Sequence: Synthetic coding sequence
atggcccacttcgtgcagggcaccagccggatgatcgccgccgagtcctccactgagcataaggagtgtgcagagcctagtactagaaagaacctcatgaactctctggagcagaaaatcagatgtctggaaaagcagcggaaggagctccttgaagtgaaccagcagtgggatcagcagttccgtagtatgaaggagttgtatgagaggaaagtcgccgagctcaagaccaagctggatgccgcggagcggtttttgtctacccgggagaaagaccctcaccagcggcaaagaaaggatgataggcagagagaggacgataggcagcgggatttgacaagagatagactgcaacgtgaagagaaagagaaggaacgcctcaatgaagagctgcatgagctcaaggaggagaataagctgttgaaagggaagaataccttggcaaacaaggaaaaggagcactatgagtgtgagatcaaacgcctgaataaagccttacaggatgcgctcaacattaaatgtagttttagcgaagactgcctgagaaagtcacgggtggaattttgtcacgaggagatgagaacagagatggaagttctgaagcaacaggtgcagatttacgaagaagacttcaaaaaagagcggtccgatcgtgaacggctaaaccaggaaaaagaagagctgcagcagatcaatgagaccagtcaatcacaactgaatcggctgaattcgcaaatcaaagcctgtcaaatggagaaggagaaactggaaaaacagctcaagcagatgtactgtccgccgtgtaactgtggcctggtctttcacctacaggacccgtgggtgcccactgggcccggcgcagtccagaagcagagggaacaccccccagactatcagtggtacgcacttgatcagctgccccctgatgtccagcacaaggccaatggattgtctagcgtcaagaaggtgcatccttag

SEQ ID NO: 51560 - DNA, 1110 bp, Artificial Sequence
  Description of Artificial Sequence: Synthetic coding sequence
atgaacaagaacgagaagcacgacgacaagctggtgatgttcaccaaccagagcgaggattctgaaagatgcgaaagcatggaactggacaaaaagatacaggacctcattgagagaaacgcttctccccatcccaagcgcttcacccccgaagctatgccaactcatcgtaacctgtgctctctcaagactcccggcaaaactgcttcaatggctcatttcgtccagggtacctcccgcatgattgcggccgagtcttcaaccgaacataaggagtgtgcggagccctcaacccggaaaaacttaatgaactctcttgaacagaagatcagatgtctagaaaagcagcggaaagagttattggaggtgaaccaacaatgggatcagcaattcaggtccatgaaagagctgtatgagcggaaggttgccgagctgaaaaccaaactcgacgccgccgaacgcttcctcagtactagggaaaaagacccgcatcaacggcagagaaaggacgatcgccagcgcgaggacgataggcagagggatctcacacgtgaccgtttgcagagagaggagaaagaaaaggagcgcctgaatgaagagctgcacgagctcaaagaagagaataagttgcttaagggcaagaacaccttggcaaacaaggaaaaagagcactatgagtgtgagataaagaggttgaataaagctctgcaggacgcccttaacatcaaatgtagcttcagtgaggactgtcttaggaaatctcgggttgaattctgccacgaagagatgcgtactgagatggaggtgctaaagcaacaggtccagatatatgaggaggatttcaagaaggagaggtctgacagggaacggttgaaccaggagaaggaggagctccagcagattaacgagaccagccagagccaattgaatcggttaaactcacagattaaggcatgtcagatggaaaaggaaaagcttgagaaacaattaaagcaaatgtactgccctccatgtaactgcggtcttgtgtttcacctacaggacccctgggtgcctaccgggccaggcgctgtgcagaagcagcgggaacatccggtgtacccccagtag

SEQ ID NO: 51561 - DNA, 1029 bp, Artificial Sequence
  Description of Artificial Sequence: Synthetic coding sequence
atgagcgaggagagcgacagcctgcggaccagccccagcgtggcctctttgtcagagaacgaattgcctccgccccctgagccacctggttacgtctgttcattgacagaagatctggtgaccaaagcccgagaggagctgcaagagaagcccgagtggcgtctgcgagacgtacaggctctccgcgacatggtgcgtaaggagtaccccaacttgagcaccagtcttgatgatgcttttcttctacgcttcctccgcgctcgaaaattcgactacgacagagcactccagctgcttgtgaactatcattcctgtcggagaagctggccggaagtgtttaacaatcttaaaccaagtgccctcaaggatgtgctcgcatctgggtttcttacagtgttgccacacaccgacccacgcggctgccatgtggtgtgcatcaggcctgataggtggattcctagcaactaccccattaccgaaaatatcagagctatttaccttacactcgaaaagctgatccagtctgaggagactcaggtgaacgggatcgtcatcctggcagattacaagggagtgtctttgtccaaagcatcccatttcggcccatttattgccaagaaagtcattggcattctgcaggatggctttccaattagaattaaggccgtacacgtagtgaatgagcctaggatttttaaggggatatttgctataatcaagcccttcttaaaggaaaaaatagctaataggttctttctccatggtagcgacctgaacagcctgcataccaatctacctaggagtattctgcctaaggaatatggcggtactgccggagagctggatactgccacctggaacgccgtgctgctcgccagcgaggacgacttcgtgaaggaattttgccaacccgtaccagcttgcgatagtattttggggcagaccctcctgccagagggactgacatcagacgcacaatgtgacgactcactacgcgctgtcaagagccaactttatagctgctactag

SEQ ID NO: 51562 - DNA, 1029 bp, Artificial Sequence
  Description of Artificial Sequence: Synthetic coding sequence
atgagcgaggagagcgacagcctgcggaccagccccagcgtggccagcctctcggaaaatgaactgccgccccctccggagccacctggatatgtttgttccctcaccgaggatctcgtgactaaggctcgagaagagctacaggagaagcctgaatggcgccttcgtgatgtccaggccctccgggacatggttagaaaggagtatcctaatttgtcgacatctctggatgacgcgtttctgctcaggttcctacgggcaaggaagtttgactatgatcgcgcactccagcttctggtgaactatcatagctgccgtagaagctggcccgaagtattcaacaatctgaagccttctgccctcaaggatgtgcttgcctcagggttcctaactgttctgccgcatactgacccacggggctgtcacgtggtgtgcattcggcccgataggtggataccttccaactacccaatcacagagaacataagggcgatatacctgaccttggagaagctcattcagagtgaggagacccaggtgaacggaatagtgattctggcggactacaagggagtaagcctcagtaaagcctctcacttcgggccgtttatcgctaaaaaggtcataggcatcctgcaagatggctttcctatcaggataaaggccgtgcacgtcgttaatgagcctagaatcttcaaaggcattttcgctatcatcaaaccttttctcaaggaaaagattgccaataggttctttttacacggcagcgacctgaattcactgcatactaacctgccacgatcaatcctgcccaaggaatatggaggcacagctggagaactcgatacggccacctggaacgctgtactgctggccagcgaagatgattttgtgaaagaattctgtcaacctgtcccagcctgcgattccattctgggtcagactttgttgccggagggtctcacttctgacgcccagtgcgatgacagcctccgcgccgtaaagtcccagctttatagctgctactag

SEQ ID NO: 51563 - DNA, 840 bp, Artificial Sequence
  Description of Artificial Sequence: Synthetic coding sequence
atgagcgaggagagcgacagcctgcggaccagccccagcgtggcctcactgagcgagaacgagctgcccccaccccccgagcctcctggctacgtatgcagtcttacggaagatcttgttaccaaagcccgggaagaattgcaagaaaagcctgagtggagactgagggatgttcaggcgctgcgggatatggttcgaaaggaatatccaaacttgagtacgagtctggacgacgccttcctcttgagattccttcgtgcgcgtaagttcgactatgatagagccctccagctactggtgaactatcacagctgcaggaggtcctggccagaggtgttcaataatctcaagccgtctgcactgaaagacgtgcttgccagcggatttttaactgtactaccgcatacggatcctaggggctgtcacgtcgtgtgcattagaccagatcgctggattccaagcaattatcctataaccgagaatattagggctatctaccttacgctggagaagttgatacagagtgaggagacccaggatgggttccccattcggattaaagctgtccacgttgtcaacgagccccgcatttttaaaggcatatttgcaatcatcaagcccttcctcaaagaaaagattgcaaatagattttttctccacggctctgatcttaattcattgcatacaaatctgcccaggtcgatccttcccaaggagtatggcggcactgcaggcgagctcgacacagccacatggaacgcggtgctgctggcaagcgaagacgattttgtgaaggagttttgtcagccggttccagcctgtgatagcatcttgggctag

SEQ ID NO: 51564 - DNA, 309 bp, Artificial Sequence
  Description of Artificial Sequence: Synthetic coding sequence
atgcgggccagcccctgcatcagccagcccgccgccagctggcacccgcggccctctgcactgcgacccacggccgggtctggtccagacacccggactcctgggaccgttgaggatggttctgcaccgtgtccggccttccgttctcccgctgtaagtccctgtggtgaggaaccgtgctgtttccagatttcaccagcagaagaaaccctagaattaggaaggctcgtttctcctggctgtcataagtccagtgcaccacaggagcggcgtctagaccctagagcgagatgcgttgtgcatatatag

SEQ ID NO: 51565 - DNA, 375 bp, Artificial Sequence
  Description of Artificial Sequence: Synthetic coding sequence
atgcgggccagcccctgcatcagccagcccgccgccagctggcacccccggccttccgcccttcgccccaccgccggctccgggcccgatactagaactccaggcaccgtggaagatggctcagccccctgcccggctttccggtcgcctgctgtgagcccatgcggggaggagccttgctgcttccagatatcaccagcagaagagacactggagctgggcagactggtctctcccggcaactgtgacacgctgtccccccgtgctgcagggttttacgcttgtcacgtaaggtctctgatcccttgtcgctccaccaaaggccgatggcccttgaccgcatccgccgctggcctctccagtttcagtggctag

SEQ ID NO: 51566 - DNA, 1131 bp, Artificial Sequence
  Description of Artificial Sequence: Synthetic coding sequence
atggacggcgaggagcagcagcccccccacgaggccaacgtggagcccgtggtgcccagtgaggcctccgagcccgtaccccgcgtattatccggagatcctcagaatttgtctgatgttgatgctttcaatcttttacttgagatgaagctgaaacgacgcaggcagagacctaacctgccccggactgtcacacagctggtggccgaggacggatccagagtctacgtcgtcggcaccgcccacttctctgacgactccaagcgtgacgtggtgaaaactatcagggaagtgcagcccgacgtggttgtcgtggagctatgccagtatcgagtctccatgctgaaaatggatgagagcacccttttgcgggaagctcaggaattgtcactcgaaaagctccagcaggccgttcggcagaatggactgatgtccggactcatgcaaatgctgcttctgaaggtttcagctcatattactgagcagcttgggatggcacctggcggagaatttcgggaagcgttcaaggaagcctccaaggtccctttttgtaagtttcacctaggggaccgtcccattcccgtgacattcaagagagccatcgccgccctgagcttctggcagaaggtccggctagcctggggcctttgctttctttcagatcctatctcgaaagatgatgtcgagcgctgcaaacaaaaagatctcctggaacaaatgatggccgagatgattggcgagttccccgatctgcaccgcactatcgtttcagagcgagacgtgtatttgacatacatgctccgacaagccgcacgtcggctggagttaccccgcgctagcgacgctgagccccgcaagtgtgttccatcagtggttgtgggggtggtgggcatgggccatgtgccaggaatagagaagaactggtctaccgatctgaacattcaagagattatgacagtgccccctcctagtgtgtctggccgggtaagtagactcgctgtgaaggctgcttttttcggtctcctgggttatagcctctattggatgggtagaaggactgcttcactggttctgtcgctgcctgcagctcagtactgcctgcaacgagtaactgaggccagacataaatag

SEQ ID NO: 51567 - DNA, 1131 bp, Artificial Sequence
  Description of Artificial Sequence: Synthetic coding sequence
atggacggcgaggagcagcagcccccccacgaggccaacgtggagccggtggtacctagcgaggctagtgagccggttccacgggtgctatccggcgacccccagaatctgtctgatgtcgacgcctttaacctactgttagagatgaagctgaagcgacgaaggcagaggcctaacctgccccgaacagtcacgcagttagtggctgaagacgggtcacgagtctatgtggtcgggactgctcattttagcgatgatagcaagcgcgacgtcgttaagacaatacgggaggttcagcccgatgtcgttgtcgtggagctgtgccagtatcgcgtcagtatgttgaagatggatgagagtacattgctgcgagaggcccaggagctgagtctcgagaagctgcagcaggcggtcagacagaatgggcttatgagcgggctcatgcaaatgctgctgctgaaagtctcagctcatatcactgagcagcttgggatggcccccggcggcgaattcagagaggcttttaaggaggcctctaaggtccctttctgcaaatttcacttgggtgatcgaccgatccctgttacatttaaaagggcaatcgccgcgctgagcttttggcagaaggtgcgactggcttggggactatgcttcctgagtgaccctattagtaaggatgatgttgagcgatgtaagcagaaggatctgttagaacagatgatggcagaaatgattggcgaattcccagacttgcatcgtaccatcgtgtcagaaagagatgtttatctgacttatatgttgcgccaggccgctagaagactggaattgcctcgggcgtcagacgcagagcctaggaagtgcgtgccctccgttgtcgtaggggtggttgggatggggcatgtacccgggatagaaaagaattggagcacagacctgaatatacaggaaattatgacagtgccacccccgtccgtatccggaagagtaagcaggctcgccgtgaaagccgctttcttcgggttactgggatacagtttgtattggatggggaggaggacagcgtcactagtgctgagcctccccgccgcacagtactgcctccaaagagttactgaagccaggcataagtag

SEQ ID NO: 51568 - DNA, 1131 bp, Artificial Sequence
  Description of Artificial Sequence: Synthetic coding sequence
atggacggcgaggagcagcagcccccccacgaggccaacgtggagcccgttgtgccctctgaagcttcagagcctgtcccaagggtgctgagcggcgatcctcagaatctgtccgacgtcgacgcgttcaacctgctcctggaaatgaagctcaagcggcgccggcagcgacctaatctgcctaggacagtgacccagctggttgctgaggatggatcacgagtgtatgtggtgggtactgcccatttttccgatgactcaaagcgcgacgtggttaagacaattcgagaagtacagccagatgtcgtggtggtggaactttgccaatacagagtctctatgttgaaaatggatgagtcaacactgcttcgcgaagctcaagaattgtcgctggagaagctccaacaggcggtgcgacaaaacggattgatgagtggtctaatgcagatgctgctgctaaaagtcagtgcgcacataactgagcagctgggtatggccccggggggagaattccgcgaagccttcaaagaagccagcaaggtccccttttgcaaattccacctaggggatagacccatccccgtgaccttcaagagggctattgcggctctctcattctggcagaaagtgcgcctagcttggggactgtgttttctatcggatcccatctccaaagatgatgtggagagatgcaaacagaaggacctccttgagcaaatgatggcagagatgataggagagtttcccgatttgcatagaacaatcgtttcagagagggacgtttacttgacatacatgttaaggcaagctgctcggcggttagaactgcccagagcctctgatgctgaacctcggaagtgcgtcccctctgtcgtagtcggtgtggtgggcatgggacatgtacctggtatagagaaaaactggtcaactgatttaaacatccaagaaataatgactgtccctccaccatcagttagcggtagagtgtcacggctcgccgttaaggccgcattctttggcctgttagggtacagcctctattggatgggtaggagaacagcttccctggtactgtccctacctgccgcccaatactgtttgcagcgggtcaccgaggctcggcacaaatag

SEQ ID NO: 51569 - DNA, 1554 bp, Artificial Sequence
  Description of Artificial Sequence: Synthetic coding sequence
atgcacgccgccctggccggccccctgctggccgccctgctggccactgcacgcgctaggccacagccgcctgatggcgggcagtgtcgccctcctggcagtcagcgagacctgaactctttcctgtggacaattcgccgagaccctccggcttatctgttcgggactattcatgttccctatacgcgagtatgggactttatcccagacaatagcaaggctgcctttcaggcaagtacccgcgtgtactttgaacttgatctcacagacccctatacaattagcgccctggcttcatgtcagctcctcccgcatggtgagaacttgcaggacgtcctcccccatgagttatattggcgcctgaaaagacacctggactacgtgaagttgatgatgcctagctggatgacccccgctcagcgggggaaaggactgtacgccgattatctctttaatgcaatcgctgggaactgggagagaaaacgcccggtgtgggtaatgcttatggtgaattcacttaccgagcgggatgtgagattcaggggggttccggtcttggatctgtatcttgcccagcaggctgaaaagatgaagaagactactggcgctgtggagcaggtggaagaacagtgccaccctctcaacaatggacttaatttctcccaggttctgtttgccttaaatcagaccctactgcagcaggagtcagtgcgagctgggtcccttcaggcttcctacacaactgaagacctgatcaagcactataactgcggtgacttgtcggcagtgatctttaaccacgacacgagccagcttcccaatttcataaacaccactctgccaccccacgagcaggtgacagcacaggagatcgacagctacttcaggcaggagttaatatataagaggaatgagcgcatggggaagcgcgtcatggcactcctgcgggagaacgaggataagatttgttttttcgctttcggtgctggacacttcttgggcaataatacggtgattgatatcctgcgtcaggccgggctggaagtggaccacacccctgcaggacaggcgatccacagtccagccccacagtccccagcccccagccctgaaggaacgtcaacaagtccggcccctgtcacgcccgcagccgccgtgcccgaagcccctagtgtcacgcccacggcccctcctgaggacgaagatccagctctgtccccacatctgctactgcctgactctctgagccaactcgaagaattcggcaggcaacgcaagtggcacaagcgccagtcgacacaccagaggccacgacagttcaacgacctgtgggtccgcattgaagatagcacaacagcctctcccccaccccttcctttacagccaactcattctagtggtacagctaaacctccgtttcagctgtctgatcagctccagcaacaggatcccccagggcccgcgtcctcaagtgctccgacgttagggctgctgccggccatagccacgactattgctgtgtgcttcctgctgcattctctgggtccttcatag

SEQ ID NO: 51570 - DNA, 555 bp, Artificial Sequence
  Description of Artificial Sequence: Synthetic coding sequence
atgaccagcttcgaggacgccgacaccgaggagaccgtgacctgccttcagatgaccgtataccaccctggtcagctgcagtgtggcatattccaatccattagttttaaccgagaaaagctcccgtcatcagaagtggtaaagttcgggagaaatagcaacatctgccactacacctttcaggacaaacaggtttcccgggtgcagtttagccttcagttgtttaaaaagttcaatagttcggttctgtcattcgaaatcaagaatatgagcaaaaaaaccaacctgattgtggacagccgggagctggggtacctgaataaaatggaccttccctatagatgcatggttcggtttggggagtatcagtttctcatggagaaggaagacggggagagtcttgaattttttgagacacaatttattctctcaccccggagcctactgcaggagaataactggcctccgcacaggcccatccctgagtatggaacgtactccctgtgcagctcacagtctagttcccctaccgagatggatgaaaacgaatcctag

SEQ ID NO: 51571 - DNA, 255 bp, Artificial Sequence
  Description of Artificial Sequence: Synthetic coding sequence
atgaccagcttcgaggacgccgacaccgaggagaccgtgacctgccttcagatgacagtctatcacccaggccagctgcagtgtggcatattccaaagcatctccttcaaccgcgaaaagctgccatcctccgaggtggttaaattcggtaggaacagcaatatctgtcactacacatttcaggacaagcaagtttcgagagtccagttttcacttcagctgtttaaaattcagcagctgtcgtccttactttag

SEQ ID NO: 51572 - DNA, 555 bp, Artificial Sequence
  Description of Artificial Sequence: Synthetic coding sequence
atgaccagcttcgaggacgccgacaccgaggagaccgtgacctgcctgcagatgactgtttatcaccccgggcaactgcagtgtggcattttccaatcaatctcttttaatagggaaaaacttccttcttccgaggtggtcaaattcggtagaaattccaatatatgccattatacctttcaggataaacaggtctctcgagtgcagttctccctgcaactctttaagaagttcaactcctctgtgttgtcatttgagattaaaaacatgtccaagaagacaaatcttatcgtcgactcacgtgaactgggatatctcaataaaatggacctgccatataggtgtatggtgaggtttggcgagtaccagttcctgatggagaaggaagatggggaaagtttggaattttttgaaacgcagtttatcctaagcccaaggagcctcctgcaagagaataactggcctccacatcgacccatcccagagtatggaacttacagcctatgcagctcccaaagttcaagcccaacagagatggatgagaacgaatcatag

SEQ ID NO: 51573 - DNA, 552 bp, Artificial Sequence
  Description of Artificial Sequence: Synthetic coding sequence
atggagaagccctacaacaagaacgagggcaacctggagaacgaggggaagcccgaagatgaggtggagccagacgatgagggaaaatcagatgaagaggagaaaccggacgctgaaggcaagaccgagtgcgaaggcaagagaaaagccgaaggggagcccggggatgaaggccagcttgaggacaagggaagtcaggaaaaacaaggcaagtctgagggggagggtaagccccagggcgaaggaaaacccgcttcacaggccaaacccgaaggccagccaagagccgccgaaaaacgccccgcgggcgattatgtcccgcggaaagctaaaaggaaaacggaccggggaaccgacgatagtccgaaggacagtcaagaggacttgcaggaacgacacctcagttctgaggagatgatgagggaatgtggtgatgtttccagagcgcaggaggaactgagaaagaagcagaagatgggcggattccactggatgcaacgcgatgtccaggatccgtttgctcagggcgacaatggggtatccggcgaatag

SEQ ID NO: 51574 - DNA, 1641 bp, Artificial Sequence
  Description of Artificial Sequence: Synthetic coding sequence
atggccgccggcagcaccaccctgcgggccgtgggcaagctgcaggtgagactggcgactaaaaccgagcctaaaaaactggaaaaatacctgcagaagctcagtgccctaccgatgacagcagatatactggcagagactggtatccgtaagactgtgaagcgcctgcgaaaacatcagcatgtcggggattttgcccgcgatctcgcagcaaggtggaagaagctggtgctggtggacagaaatacgggtccagatccacaggaccctgaagaatctgccagtcgccagaggtttggcgaggctcttcaggagcgagagaaggcttgggggttcccggagaacgctaccgccccccggagccctagccatagccctgagcacagacgaaccgctcgtcggacgccccccggacagcagagaccccacccccggagtccctctagggagcctcgtgcagagagaaagagaccccggatggccccggcagatagtgggccacacagggatccgcccacaaggacagcccccctccccatgcctgaagggccagagccagccgtgcctggggaacaacctggccgcggacatgcacatgcggcccagggggggcctctgctgggacaaggatgtcagggccagccacaaggggaggcagtcggttcccactcaaaagggcacaagagtagccggggagcctccgcccagaaaagccctccagtacaagaaagccagtctgaacgcctgcaggccgccgttgcagacagtgctggaccaaagaccgtcccctctcatgtcttctctgagctctgggatccatcggaagcctggatgcaggccaactacgatctactgtccgcgttcgaggcaatgacttctcaagcaaaccctgaggcactttctgccccaaccctgcaggaggaggcggctttccctggccgacgggtgaacgccaagatgccagtgtactcagggagccgcccagcctgccaacttcaggttccaacactgcgccaacaatgcctgcgtgtgccgagaaacaatccagacgctctgggcgacgttgagggagtgccttattcggcactggaacctgttctcgaaggttggactccggaccagccttatcgtactgagaaagataatgcagcgctggcgcgtgagacagatgagctctggcgcatacattgtctgcaggattttaaagaggaaaaacctcaagagcatgaatcgtggagagaactgtacctgcgtctgcgggatgccagagagcagcggttgagagtggtgacaactaagatccgctctgcgagagaaaacaagccttccgggagacagacaaagatgatatgcttcaacagcgttgctaagacaccatatgacgcctcgaggcgccaagagaagtcagccggcgccgctgatccaggcaacggcgaaatggagcccgcacccaaaccagctggcagttctcaggcacctagtggactgggcgacggagatggcggaagcgtttctggcggcggttcaagtaaccggcacgccgcgcctgcagataagactcgcaaacaggccgccaagaaagttgcaccgctgatggctaaagctatacgcgactacaaggggcggttttccaggcgctag

SEQ ID NO: 51575 - DNA, 1761 bp, Artificial Sequence
  Description of Artificial Sequence: Synthetic coding sequence
atgcaggccggcgcccggttccagcggcggcggcggcagctgcagcaacaacaaccaaggcgcagacaaccactcctatggcccatggatgctgaaccccccccaccccctccatgggtgtggatggtccctgggtccgctggactgctcaggctcagcgccggggttgtggtccctcctgttttactggccagcgccccaccccccgcggctcctcttctacctggccttcccgggtggcccgccccatcagaaccagtgctgccgctcttacccctgcctagcgcacctgactccgccgctgcagccgctgcacatccatttcctgccttgcacggacagtggctctttggtgggcacagcccttctctcggcctcccaccatcatcaactgtggagctagtgccagtgtttccgcatctttgtccttctgccttagccactcccattgggaagagctggattgataaacgtataccaaactgcaaaatattctttaataactcctttgcactggatagcacttggattcatccagaagaatcccgcttctttcacggacacgaaaagccacgcctcctggccaaccaggtcgccgtctccctgagtcggccggcgccagccagtagacctcttcctactgtcgtcttggctccccagcccattccaggcgggtgccacaactccctgaaagttacgtcatcgcccgccatagcaatcgcgaccgcagctgcagccgctatggtgtctgtggatcccgagaacctgagaggacctagcccaagctccgtgcagccccgccattttcttactcttgctccaataaaaatccccctccgtactagccctgtgagtgatacacgaaccgaaaggggaagggtagcacgaccccctgccctgatgctcagggcccagaaatcgcgggatggcgacaaggaggacaaggagccaccacccatgttgggcggaggggaagactctacagctcgggggaaccgaccagtagcgtccacccctgtacccggttcaccatggtgtgtcgtgtggacaggggatgaccgtgttttttttttcaacccaaccatgcacctctcagtttgggagaaacctatggatctgaaagacaggggggacctaaataggatcattgaggatccaccccacaagaggaagctcgaagcccctgctaccgacaactctgatggctccagcagcgaagacaatagagaggaccaggacgtcaagacaaaacgcaatcgcaccgagggttgcggcagccccaaaccagaagaagccaagagggaggacaagggtactcgcactccccctccacagatactgcttcctctagaggaacgggtgactcattttcgtgacatgctgctggagcggggagtgagcgcgtttagtacatgggagaaggagctacataaaatagtgttcgacccaagatacctcctgctgaatagcgaagagagaaagcaaatctttgagcaatttgtgaagacaagaattaaagaggagtataaggagaagaagtctaagttgcttctagcgaaggaggaatttaaaaagcttttagaggagagcaaagtgtccccgcgcacaacatttaaggagttcgctgagaaatatggccgggaccagcgcttcagacttgttcagaaacgcaaggaccaggaacacttctttaaccagttcatcctgattctgaaaaagagggataaagaaaatcgcctgcgccttcggaagatgcgttag

SEQ ID NO: 51576 - DNA, 504 bp, Artificial Sequence
  Description of Artificial Sequence: Synthetic coding sequence
atggaccggggccggcccgccggcagccccctgagcgccagcgccgagcccgcaccgcttgccgcggccatcagagactctcgacctggccgaaccgggccgggacccgccgggcctgggggcgggagtcgttcaggcagcggccgccctgctgcagctaatgctgctcgtgagagatctcgggtgcagacccttcggcacgcgtttctcgaacttcagcggactttgccatctgtccctcccgataccaagctttctaagttggacgtgctcctcctggcaactacctacatcgcgcacctaactcgctcactgcaggacgatgcagaggcaccggccgacgccggactgggcgctctgaggggcgatggctatctccatccagtcaaaaagtggccgatgcgctcccgtctctacatcggcgcaacaggacagttcctgaaacacagtgtctccggagaaaagacaaaccacgacaacaccccgactgactcacagccgtag

SEQ ID NO: 51577 - DNA, 11580 bp, Artificial Sequence
  Description of Artificial Sequence: Synthetic coding sequence
atggccttcgtggccacccagggcgccaccgtggtggaccagaccacccttatgaagaaatacctgcaatttgtagcggctctaacagacgtaaacaccccggatgaaacaaagttaaagatgatgcaggaagtgtccgagaattttgagaatgttacctccagcccccaatattccactttcttagagcacattattcctagatttctcacattcctgcaggatggggaagtgcaatttctccaggagaagccagctcaacagctccgtaaactcgtgcttgagataattcacaggatccccactaacgaacaccttagaccccacactaagaatgtcttaagcgtaatgttccggtttctggagacagagaatgaagaaaacgtccttatatgtctgcgcattattatagaattgcataaacagtttagaccaccaatcactcaggagattcatcacttcttggatttcgtgaaacaaatctacaaggaattgccgaaggtggtcaaccgatactttgaaaatccccaggttataccagaaaatactgtgcctccccctgagatggtggggatgatcactaccattgccgtaaaagttaaccctgagagagaggattctgagactcgaactcacagcatcattccaaggggtagcctgagcttgaaggtactcgcagaattgccaattatcgtggtccttatgtaccagctatacaaactgaacatccacaatgttgtggccgagttcgtacccttgatcatgaatacaattgccattcaggtttccgcccaagctaggcagcacaaactctataataaggagctgtacgctgatttcattgcagcgcagattaaaacgctctcattcctagcatacatcatccggatttaccaggagctagtgaccaagtactcacagcagatggttaagggaatgctacagctgctgagcaactgtcccgctgaaaccgcccacttgcgaaaagagttgctcatagcagccaaacacattctgactaccgaactgagaaatcagttcattccctgtatggataagctgtttgatgagtcaattttgatcgggtcaggatacacagcccgagagaccctgagacctctggcctattccaccttggccgacctggtgcaccacgtgaggcaacacctgcccctgagtgatctctccctcgcagttcagctctttgcaaagaacattgacgacgaaagtcttccctcgagcatccagactatgtcttgcaaacttctcctgaatttggtcgattgcattaggagtaagagcgaacaggaatctgggaatgggcgcgacgtgctgatgaggatgctggaggtgttcgtgctcaagtttcatacaatcgctcgttatcaactgtcggcgatcttcaagaagtgcaaacctcaatctgaactgggcgccgtagaggctgcactgcccggcgtgcctacagctcccgccgctcctggacccgcccctagtccagccccagtcccagcgccacctccccctccacctcctccgcctccggccacccctgttactcccgctcctgtgccacctttcgagaaacagggtgagaaggataaggaagacaagcagacatttcaagtcaccgactgccgttcactggtgaaaaccctggtgtgtggcgtgaagactataacctgggggattacatcttgcaaagctccgggagaggcccaatttattcccaataagcagctccagcccaaggaaactcaaatttacatcaagcttgtgaagtatgccatgcaggctctggacatctaccaggtacagatcgccgggaatggccagacatatatacgcgtcgccaattgtcagacggtccgcatgaaagaggaaaaagaggtcctggagcactttgcaggagtgttcacgatgatgaatccgctgacttttaaagaaatctttcagactaccgtcccatacatggtcgaaagaatctctaaaaactatgccctgcagatagtcgccaattcctttctagctaacccaactactagcgcactgtttgctaccatcctcgtagaatacctgctggataggctgccagaaatgggctctaacgtggagctgagtaacttgtacctaaaattattcaagctggttttcgggtctgtcagtcttttcgcggccgagaatgagcagatgttaaagccacatctgcacaaaattgtcaactcatctatggaactcgcccagaccgccaaagagccgtataactatttccttcttctccgcgccctctttcggtccatcggcggcggatcgcacgatttgctgtaccaggagtttttgcccctcctgcctaatctgcttcaaggtctgaatatgctgcagtctggtttgcacaagcagcacatgaaggatctttttgtcgaactatgcctgacagtgcctgtgcgactgtcttcgctgctcccatatctacctatgttaatggatcctttagtctcagcactgaacggctcccaaacccttgtgagccagggcctgcgaactctggagctttgcgtggacaatctgcagcccgactttctatacgatcatatacagcctgttcgcgctgaattaatgcaggctttgtggcggacccttaggaaccccgcagactcgatatctcacgtcgcttatcgagtcttaggcaagtttggggggagcaatcggaaaatgctgaaagagtctcagaaactgcattatgtggtaaccgaagtacagggtccatccatcacagtcgaattttccgattgtaaggcctcgctacagctaccaatggagaaagcaattgagacagccctggactgcttgaagtctgctaataccgagccctattacagacggcaggcttgggaagttatcaagtgttttctcgtggccatgatgtctctggaagacaataagcacgcactctaccagcttctcgctcacccaaacttcacggaaaaaaccatacccaacgttatcattagccacagatacaaggctcaggacacgccggcacggaaaacgttcgaacaggcgttgacaggagcttttatgtccgcggttatcaaagacctgcggccaagcgctttaccatttgtggcctcattgattcggcattatacaatggtcgccgtggcccagcaatgtgggccattcctgctaccatgctaccaggtgggctctcagccttccacagccatgtttcattctgaagagaatggaagtaagggcatggaccccctggtgctcattgacgcgattgccatctgcatggcctatgaggagaaggagctgtgcaagataggcgaggttgcactggctgtaattttcgatgttgcaagcatcattctgggctcgaaggaaagagcgtgccagcttccgctgtttagttacatagttgagaggttgtgcgcctgttgttacgaacaggcctggtacgcaaaacttggtggtgtagtgagcatcaagttcctgatggagaggttgcccttgacctgggtgctgcagaaccagcaaacattccttaaggcacttctgtttgttatgatggacttgactggcgaggtgtccaatggtgcagtcgccatggctaaaaccacactcgagcagctgctgatgaggtgcgcaactcccctcaaggacgaagaaagagctgaggagattgtggcagcccaagagaagtctttccatcatgttacccatgatctggtgagagaggtcactagccccaatagtacggtgcgtaagcaggcaatgcatagcttgcaagttttggcccaggtcactggcaaatctgtgactgtgattatggagccccacaaagaagtgctacaggacatggtgcccccaaaaaagcatttattgagacatcagccagcgaacgcacagatagggctaatggaagggaatactttctgcaccaccctacagccacgactgttcactatggatttaaatgtggtcgaacacaaagtgttctacacggagctcttgaacctgtgtgaagctgaagacagtgccttgactaaattaccgtgctataaatcactgccttcccttgtccccctccggatcgcggctctcaacgctctggccgcctgtaactaccttccccagtcaagagaaaagatcatcgccgccctattcaaggccctgaattccaccaatagcgaactccaggaagcaggagaggcctgcatgaggaagttcttggagggcgctactattgaagtggaccagattcatacccacatgaggccactcctaatgatgctgggagactacagatctctcacgctcaacgtggttaatcggctgacttctgtgacacgcctctttcctaactccttcaacgacaaattctgtgatcaaatgatgcagcacctgcgcaagtggatggaagtagttgtgatcacccacaagggagggcagcggagcgatggaaacgaatcgatatcagaatgtggccggtgccccctgtcgccattttgccagttcgaagaaatgaagatatgtagcgctatcattaatctgttccacttaatacctgcggctccacagaccttggtgaaacctctcttggaggttgtcatgaagactgaaagagctatgctgatagaagccggttctccattcagagagcctctgatcaagtttctgaccaggcatcccagtcaaaccgtggaattatttatgatggaggcgaccctgaacgatcctcaatggtctcgtatgttcatgtcttttctgaagcataaggacgcaaggccgctgcgcgatgtccttgctgctaacccgaaccggtttatcacactccttttgccgggtggggcccaaactgccgttaggcccgggtccccatccacatcaactatgcgccttgatctgcaatttcaagctataaaaatcatctcaattattgtgaaaaacgatgacagttggctggcttcacagcatagtcttgtctcccagcttagacgagtgtgggtcagcgaaaattttcaggaacgtcatagaaaggaaaacatggcagccaccaactggaaagaacccaaattactggcttactgtctgctcaactactgcaagcggaactacggcgacatagaacttctgttccagctgctgcgggcatttaccggtcgctttctgtgcaacatgactttccttaaggagtacatggaagaggagattccaaaaaactactcaattgcccagaagcgcgctctgttctttcgctttgtggacttcaacgatccaaacttcggagatgaacttaaggcaaaagttctgcagcacatcctcaaccccgctttcctgtattctttcgaaaaaggcgaaggggagcagctgttgggacccccaaacccagagggcgataatcctgaatctattacctctgtatttataacaaaggtgctggatcccgaaaaacaagccgacatgctggactcgctaaggatttacttgctacagtacgctacacttctcgtggaacatgctccccaccatatacacgacaacaataaaaaccggaactctaagctgcgccggctgatgacgtttgcttggccatgcctgctctcaaaggcatgcgtggatccagcttgtaagtactccggtcacctgctccttgcacatatcatcgccaaatttgccatacataagaagatcgtcttgcaggtgttccacagcttactgaaagcccatgccatggaagctcgcgcgatcgttcgacaagcaatggctattctgactccggcagtgcccgccaggatggaagatggccaccagatgttaacccattggacccgaaaaatcatcgtcgaggagggccacactgtgccccagctcgtccatatcctgcatttaattgtgcagcacttcaaggtctactaccctgtcaggcaccatttagtgcagcatatggtgtcagctatgcaaaggctggggttcactccgagtgttaccatcgaacagcggcgactcgctgtggatctcagtgaagtggttataaaatgggaactgcagagaataaaagatcagcaaccagattccgatatggatcccaactcttccggagagggagtgaattcagtgagcagttctatcaagcgcggactgtcagtggacagtgcacaggaagttaaaaggtttaggacagctaccggtgccatctcagcggtgttcggtcggtctcaatctctgccgggagcggacagcctgctcgccaagcctatagataagcaacacactgacacagtggtaaactttctcattcgcgttgcatgccaggtcaacgacaataccaataccgccggttctcctggagaggtgctgagtcgccgatgtgtgaacctgctgaaaacggcccttcgtcccgatatgtggccaaaaagtgagcttaagctacagtggtttgacaaactcttgatgaccgtcgaacagccaaaccaggtcaactacggtaacatctgtacaggcctggaggtcctttcattcctcctcaccgtgttgcaaagtccagccattctttcgagcttcaaacctcttcagcgggggatagctgcttgtatgacttgcggcaacacgaaagtgcttagggcagtgcacagtctgctttcacgtcttatgtctatttttccgacagaaccttcgacctccagtgtggcctccaaatacgaggaactggagtgcctttacgccgcagtgggcaaagtgatatacgagggtctgacaaactatgaaaaggcaaccaatgctaacccaagtcagctatttggcactctgatgatattgaagtccgcctgcagtaacaatcccagctacatcgacaggcttatcagtgtttttatgagatcactgcagaaaatggtccgcgagcacctcaacccacaggcggcctctggaagcacagaggctacaagtgggacaagcgaattagtgatgctgagcctggagttagtgaagacaaggctggccgtcatgtccatggagatgagaaaaaactttattcaggcgatattgacctctctgattgagaaatcgccagacgccaaaattctccgcgccgttgtgaagattgtcgaggaatgggtcaagaacaacagtccaatggccgccaatcagactcccaccttgcgggagaaatctatactgcttgttaaaatgatgacgtatattgagaagagatttcccgaggacctcgagctcaacgcccaattcctggacctggtcaattacgtatacagagacgaaactcttagcggctcagagcttactgccaagttagaacctgcattcctctccggcctgcgctgcgctcagccactcattagagcaaaattttttgaagtgttcgacaatagcatgaagcggagagtctatgaacgcctgttatacgttacctgctctcagaactgggaagctatgggaaatcacttttggattaaacagtgtatcgaactgctcctggcagtctgcgaaaagtctactcctatagggacctcctgtcaaggtgccatgctgcctagcattacaaacgtgatcaatctcgctgattcgcacgacagagccgcattcgcgatggtgacacatgtgaaacaagagccccgtgaaagagaaaattcggagagtaaggaagaggatgtggagatcgatatcgagttggctcctggggaccagaccagtacccctaaaactaaggagctgagcgagaaagacatagggaaccagctgcacatgctgacaaacaggcacgacaagttcctcgacaccctgagagaagtcaagaccggtgcgttgctcagcgcctttgtccagctttgtcacataagcacaactctggctgagaagacctgggtccagctcttcccaaggctgtggaagatcctctcagacaggcagcagcacgccctagccggcgagatatccccattcttgtgctcgggttctcaccaagtgcagcgcgattgccaacccagcgccttgaattgcttcgttgaggccatgtcccagtgcgtgccacctatcccaataaggccatgtgtgctaaagtacctggggaagacccacaacctgtggtttcgttccacgctcatgctggagcaccaggcgtttgagaaagggcttagcctccagattaagccaaagcagacgacagaattttacgaacaggaaagtatcaccccgccacaacaggaaatccttgatagtctcgccgaactgtattccctccttcaggaagaagatatgtgggccgggctctggcaaaagaggtgtaagtactctgagacagccacagccatcgcctacgaacagcatggtttcttcgaacaggcccaggagtcatacgagaaagcaatggacaaagctaagaaggaacacgaacgtagtaacgcctcaccagctatcttccctgagtaccagttgtgggaggaccactggattcgctgctctaaagaattgaaccagtgggaggccttaaccgagtacgggcagtccaagggccacatcaatccctatcttgtcctcgagtgtgcttggcgagtgagcaactggaccgccatgaaggaagctctggtgcaagtggaggttagctgtccaaaggagatggcctggaaagtgaatatgtatcggggctacctcgccatttgtcaccctgaagagcagcagctgagttttatcgagcgacttgttgagatggcatcgagcctggccatacgggagtggcgccggttgccccatgtagtctcgcacgtacatacaccactactacaggccgctcagcagatcatcgaacttcaggaggccgctcagataaacgccggtcttcagccaacaaatctgggccgtaataacagcctgcacgatatgaagactgtggtgaaaacatggcgcaatcgcctacctatcgtgagtgatgacctgagtcactggtcatcgattttcatgtggaggcagcaccactatcaagggaagccaacctggtctggtatgcactcctcaagcatagtcacagcatacgagaactcttcacagcacgatccctcctcaaataacgctatgctaggtgtgcacgctagcgcctcagctatcatccagtacgggaaaatagctcggaaacagggcctggtgaacgtcgccctggatattttatctcgtatacatactatccccacagtgcccatcgtagattgctttcagaagataagacagcaagttaagtgttatcttcaattggcgggcgtgatgggcaagaacgaatgtatgcagggcctcgaggttatagaatctactaatcttaagtatttcacaaaggagatgaccgcggagttttacgccctgaaagggatgtttctggcacagatcaataagtcagaggaagccaataaggcattctctgccgcagtgcagatgcacgacgtgctggtaaaagcgtgggcaatgtggggtgactacctggaaaatattttcgttaaagagagacagttgcatctcggagtaagcgcgattacttgctacttgcatgcatgtaggcatcaaaacgagtctaagagccggaagtacctcgccaaagtcctgtggctgctaagtttcgacgatgataagaacacactggccgacgcagtagacaaatattgcatcggggtgcccccaatccagtggcttgcctggatcccacagttactgacatgtctggtagggtccgaaggcaagttattattaaaccttataagccaagtggggcgggtgtacccacaagcagtgtattttccaatccggacgctgtaccttacccttaaaattgagcaaagagaacgttataagtctgatccaggccccatcagagccaccgctcctatgtggcgttgttcccggatcatgcacatgcaaagggaactgcaccccacgctgttgagcagtctagaaggtatcgtggaccagatggtgtggttccgggaaaactggcatgaggaggtgctacgacagctgcagcagggtttggcgaaatgttacagcgtggctttcgaaaaatcaggcgccgtctccgatgcaaaaataactcctcacaccctcaacttcgtgaagaaactcgtgtcgacttttggagtgggcttggagaacgtgtccaacgtgtccaccatgttttcctccgcagcttccgaaagcctcgcgagacgcgcacaggctactgcacaggatcctgttttccagaaactgaaagggcagttcacaacggatttcgacttctctgtgcctggcagcatgaagcttcataaccttatttcaaagctcaaaaagtggattaagattctggaggcaaaaactaagcagctgccgaagttttttctgatcgaggaaaaatgtcgattcctgagcaatttctctgcacagaccgctgaggttgagatccccggtgaatttctgatgccaaaacccacacactactacattaagatagcacggttcatgccacgcgtggaaattgtgcagaagcacaacaccgctgcaagaaggctgtacataaggggccataatggcaaaatctacccttacttagttatgaatgacgcctgccttactgagtctaggcgcgaggaacgtgtgttgcagctccttcggctcctcaatccctgcttggagaagcggaaagaaacgaccaaacgtcacttattctttacagtccctcgtgtcgttgcagtgtccccacaaatgagactggtagaggacaaccctagctcattaagtctagtggagatatacaagcaacgttgcgcaaaaaagggcatcgagcacgacaatccaatttccaggtattatgaccgactggctaccgtccaggcgcgtggcactcaggcctcgcatcaggtgctcagagatatcctcaaagaggttcagtctaacatggtcccgcgctcgatgctgaaagagtgggcccttcatacattcccaaatgccaccgactattggacgtttcgcaagatgtttaccatccagctggccttaatcgggttcgcagaatttgtcctgcacctcaatagattaaacccagagatgttgcagatagcccaggacactggcaaattgaacgtggcatactttcgctttgacatcaacgacgcgaccggagatctcgatgcgaaccgacccgtcccctttcgcctaacccctaatatctcggagttcctcacaactatcggcgtgagcggcccccttaccgccagtatgatcgctgtggcccgctgcttcgcccagcccaatttcaaggttgacggtatcctgaagacggtcctgcgcgacgagatcatcgcttggcacaaaaagactcaggaggatactagcagtcccctttcggccgcaggccagcccgagaacatggactctcagcagctggtgtcactggtgcagaaggctgtgactgcgattatgacccgactccacaacctggcccaatttgaaggtggtgaatcgaaggtcaatactcttgttgctgcagccaactctcttgacaacctgtgccgcatggaccctgcgtggcatccatggttgtag

SEQ ID NO: 51578 - DNA, 951 bp, Artificial Sequence
  Description of Artificial Sequence: Synthetic coding sequence
atgggcgagagcgccgccgccaccgccagcctgttccagcggcggaggagaggaagaggaggcagagtgacatttccagggggattaaaggggtctgccaggtttcttagttttggcccgccgtttcctgcacctccagctcccccctttccagccgcacctggtccatggctgcggaggccactgtttagtctgaagttatctgacactgaggatgtgttcccacgtagggccggccctcttgaggtaccagccgacagccgggtattcgtgcaagctgctctcgcaaggcccagtccaaggtggggcctggccctgcaccgttgttcagtcactccatcctctcgccctgcccctgggcctgctctcgctctactgcgcgaaggctgccctgctgataccagtgttgctttccccccaccaccgcctccgagtcccggagcggcccgacctgcgaggttcagcttccgcctacgccctgtcttcaacgcatcggtgcaattcctgcattgtcagctgtcacgctgcaggcgtttgcgcggagtcagaagggcccccgcccctcttacaccccccccgcccccccccccatcccgatgtctgccccaggatgaggcctgcgcagacaccggctctgggagcgccgaaggccttgccgcagacggacctcatctgcacactttaacccagccgattgtggtcacggtgcctaggcccccccccagacccccaaaatctgttccaggacgggccgttcgaccggagcctcctgcacctgcccccgccgcgctcgagccagcccctgttgttgccctggtcctggctgctttcgtgttaggagctgcgctcgcagcagggctaggtctggtctgcgcgcatagcgctccccacgcccctggcccgccagcgagggcatcaccctctggccctcagccacgccggagccagtag

SEQ ID NO: 51579 - DNA, 600 bp, Artificial Sequence
  Description of Artificial Sequence: Synthetic coding sequence
atggccaaccggggccccagctacggcctgagccgggaggtgcaggagaagatcgagcagaagtacgatgcggatctagagaacaagctcgtcgattggattatcctgcaatgtgcagaggatattgagcatccaccacctgggcgtgcccacttccagaagtggttgatggacgggacagtattgtgtaagctgatcaacagcctgtatccacccgggcaggaacctataccaaagatttctgagtcgaagatggcattcaaacagatggaacagatcagccagttcctgaaggctgccgaaacttatggagtacgtacaacagacatcttccagaccgtggacctgtgggagggtaaagacatggccgccgtccaacgaactttaatggcgctgggctcggtggccgtaaccaaggacgacggttgttaccgtggggaaccatcatggtttcacagaaaagcccagcagaataggcgcggatttagtgaggaacagctccgccagggccaaaatgtgataggtctgcagatggggtccaataagggcgcatcccaggctgggatgaccggctacggcatgccacgccagattatgtag

SEQ ID NO: 51580 - DNA, 600 bp, Artificial Sequence
  Description of Artificial Sequence: Synthetic coding sequence
atggccaaccggggccccagctacggcctgagccgggaggtgcaggagaagatcgaacagaaatatgacgctgatctcgaaaacaagctggtggactggattatcttacagtgcgccgaggatatagaacacccacccccaggccgcgcgcacttccagaagtggctgatggacgggaccgtcctttgcaaattgatcaattctctgtatcccccaggccaggaacccattccaaagatctccgagtccaagatggcatttaagcagatggagcagatctcccaatttctcaaggctgctgagacatacggagtccgtacaaccgatattttccaaacagtggatctttgggaggggaaggatatggctgccgtgcagagaacactcatggctttaggaagcgttgctgtcactaaagacgatggctgctatcggggtgagccttcctggtttcatagaaaggcccagcagaacagaagaggattctcggaagaacagctgaggcagggccaaaacgtgataggcctccagatggggtccaataagggggcctcgcaggcagggatgacaggctacggtatgccccggcagatcatgtag

SEQ ID NO: 51581 - DNA, 600 bp, Artificial Sequence
  Description of Artificial Sequence: Synthetic coding sequence
atggccaaccggggccccagctacggcctgagccgggaggtgcaggagaaaattgaacagaaatatgatgccgacctggagaacaagctagttgactggattattctccaatgtgctgaagatatcgaacacccccccccaggccgcgctcatttccaaaagtggctgatggacggtactgtgctatgcaagttaataaactcactctaccctcccggccaggaaccaattcccaaaatatctgagtctaagatggcctttaaacagatggagcagatcagccagtttcttaaggccgccgagacctatggggtgcggactaccgatatctttcaaacagtggacctgtgggaagggaaggacatggctgcagtgcagaggaccctgatggctctgggcagtgtggccgtcaccaaagacgatggctgctacagaggggagccatcgtggttccaccgaaaagctcagcagaaccgtcgaggctttagcgaagagcagttgcgacaggggcagaacgtgattgggcttcagatgggttccaataagggcgctagccaggctggaatgactggctacggaatgccacggcaaattatgtag

SEQ ID NO: 51582 - DNA, 600 bp, Artificial Sequence
  Description of Artificial Sequence: Synthetic coding sequence
atggccaaccggggccccagctacggcctgagccgggaggtgcaggagaagatcgaacagaaatacgacgccgacctggagaacaaactggtggactggatcatcctgcagtgcgctgaagacatcgagcatccaccccccggtcgggcacatttccagaagtggctgatggacggcacagtgctatgcaaactgataaattctctatatccgcccggtcaagagcccattcctaagattagtgagtccaaaatggcctttaaacagatggagcagattagccagtttttgaaggcagcggaaacttatggagtccgcacgacggatatatttcagaccgtcgacttgtgggaaggaaaagatatggctgcggtgcaaaggacacttatggctctcggcagtgtcgcagtgaccaaagatgatggatgctatcggggtgagccttcctggttccacagaaaagcacagcagaacagacgcggtttttccgaggaacagctgaggcaagggcagaatgtaattgggctgcaaatgggttccaataagggtgcatctcaggcaggtatgaccggctatggcatgcctagacagatcatgtag

SEQ ID NO: 51583 - DNA, 666 bp, Artificial Sequence
  Description of Artificial Sequence: Synthetic coding sequence
atggccaaccggggccccagctacggcctgagccgggaggtgcaggagaaaattgagcagaagtatgatgccgatcttgagaataaactcgtggattggatcatactgcagtgcgccgaagacatcgaacaccccccccctggccgagcccatttccaaaagtggctgatggacggcactgttctctgtaagctgattaactctttatacccacctgggcaggagccaatccccaagataagcgagtcgaagatggctttcaaacagatggagcaaatcagtcagtttttgaaagcagcggagacctatggcgtgaggacgacggacatctttcaaaccgtcgatctctgggaggggaaggacatggccgcggtgcaacgcaccttgatggccctcggctctgtggctgtgactaaggacgatggttgctacagaggcgaaccctcatggttccataggaaggcccagcagaaccgcaggggtttctctgaagagcagctgcggcaggggcagaacgtaattggcctccagatgggatctaacaaaggggccagccaggccggcatgacagggtacgggatgcccggacgatcttgcaggacaagacatctccctctggttgaaagaacgaacgtgccacaccatggcctttacgaaaaaaaatag

SEQ ID NO: 51584 - DNA, 2520 bp, Artificial Sequence
  Description of Artificial Sequence: Synthetic coding sequence
atgaagaagtggagcagcaccgacctgggcgccgccgccgaccccctgcagaaagacacttgcccagaccccttagacggagaccccaacagtcggccccctccagcaaaaccccagctgtccacagccaagtcccggactcgcctgttcggtaaaggggactcggaagaagctttccctgtagactgtccccacgaggaaggggaactggattcctgtcctaccatcacggtatcccccgtgattactatccagcgtccaggcgatggccctacaggtgccaggctcctgtctcaggattcagtggctgcctctactgaaaagacgttgaggctttacgatcgccgcagcatcttcgaagctgtcgcgcagaacaattgtcaggatctggagtctttgctactgtttctgcagaaaagcaaaaagcatctcacagataacgaattcaaagatcccgagacagggaaaacatgcctactcaaagccatgttgaacctacacgatggccaaaataccacgatcccgttgcttttagagatcgctcgtcagactgattcccttaaggaactagtaaacgctagttacacagacagctattacaaagggcagacagcattgcatatagctattgaaagaagaaatatggcactggtgaccctgttagtggagaacggagccgacgtgcaggccgccgcacacggcgatttctttaaaaagacaaaaggaaggcctggtttctattttggagaacttccgctgtcactggcagcatgcacaaatcagctcggtatagtcaaattcctgctccagaacagctggcaaaccgccgatatatcagcaagggacagcgtgggtaataccgtattgcacgctctggtcgaggttgccgataatacagcagataatacaaaattcgtgaccagtatgtataatgagatcttgatgttaggggcaaaactgcatcccactttgaagctagaagagctgacaaacaagaagggaatgacacctctggccctcgcagcggggacaggcaaaattggggtgttggcctacatcctacagcgggaaatacaagagcctgaatgtcgtcacttatcccgaaagtttaccgagtgggcctacggccccgttcacagttctctctacgacctgagctgcatcgacacctgcgagaagaatagtgtacttgaggtcattgcctactcttcaagtgagacgcctaacagacatgacatgctgctggtggaacccctgaatcgactgttgcaggacaaatgggatcggttcgtaaagcgcatattctactttaactttctggtttactgtttgtatatgattatcttcaccatggccgcatattatcggccggtggatgggctgccaccgttcaagatggaaaaaaccggagattactttcgtgtgaccggcgagatcttaagtgtcttgggaggtgtgtactttttctttagggggattcagtacttcttgcaaagaagaccttccatgaagacactcttcgtggactcctactccgaaatgctgttctttctgcaatccctgttcatgctcgcaacagtcgtactctatttcagccacttgaaagaatacgtggcttcaatggtgttcagcttggctttggggtggactaacatgctgtactacacgagaggatttcagcaaatgggcatttacgctgtgatgatcgagaagatgattttgcgggacctatgtcgattcatgtttgtgtacatcgtgtttctttttggcttctcaaccgctgtcgtcactctgatagaggacggaaaaaatgattcattacctagtgagagtacttcccaccgctggcgcggccccgcctgccgacctcccgattccagctacaactctctttactctacctgcctcgaactcttcaagttcaccattggaatgggcgacctagaatttacagaaaactacgacttcaaagcagtgtttataatcctgctgctcgcctatgtgatattgacatatatacttttattgaatatgctgatcgcactcatgggcgagactgtgaacaagatcgcccaggaaagcaaaaacatctggaaactccaacgcgctattacgatcctcgacactgagaagtccttcctcaaatgcatgaggaaagcttttcgcagcgggaaactgctccaggtgggctacactcctgatgggaaggacgactacagatggtgttttcgagttgacgaggtgaactggaccacctggaatactaatgtagggatcattaatgaggatcccggcaattgtgagggcgtcaagcggactcttagttttagcctccgatcaagccgagtgtctggccgacactggaaaaattttgcgctcgtgcctctcctgcgcgaagccagtgctagagatcggcagtccgcccagccggaagaagtgtacttaagacagttcagcgggtcattaaaacctgaggacgcggaagtttttaaaagccctgcagcctccggcgagaagtag

SEQ ID NO: 51585 - DNA, 1791 bp, Artificial Sequence
  Description of Artificial Sequence: Synthetic coding sequence
atggccgacgccgaggcccgggccgagttccccgaggaggcccggcctgaccggggtacgcttcaggttctgcaggacatggcatcaaggctccggattcattcaatccgcgctacttgctccacatcaagtggccacccaactagttgctcctctagtagtgaaattatgtcagtcctgttcttctatattatgagatacaagcagtcggacccagagaaccctgacaacgaccgtttcgtcctggcaaaaaggctctccttcgtcgacgttgccaccgggtggttgggacagggcctgggtgtcgcttgcggcatggcctatacagggaagtactttgaccgcgcctcgtatagagtgttttgtttgatgtccgatggtgagtcttctgagggctctgtatgggaagcaatggccttcgcctcatactatagcctcgataatctggtggccattttcgacgtgaataggctcggtcattcaggcgctctgcctgctgagcattgcattaacatctatcagcggcggtgcgaggcatttggttggaacacctatgttgttgacggcagggatgtggaggctctctgccaggtgttttggcaggcctcccaggtgaaacacaaacccacagcagtggtggctaagacttttaaaggtaggggcacacccagtattgaggacgcagaatcctggcatgctaagcctatgccccgagagagggctgacgccattatcaagcttatcgagagccagattcaaaccagtagaaatctagatcctcagccacccatagaggactcgcctgaagtcaacattactgacgttaggatgacaagccccccggactaccgcgtgggcgataagatcgccactcgcaaagcctgcggactcgcccttgccaaactcggatatgcgaacaacagggtcgttgtgctggatggggatacgcggtatagcacattctcagagatattcaacaaggagtatcctgagcgattcatcgaatgctttatggctgagcagaatatggtcagcgtcgctttgggctgcgcttcacgcggccgcaccattgctttcgccagtacttttgcagcgttcctgaccagggccttcgatcatatacgaatcggcggccttgccgaaagcaacattaacatcataggctcacattgcggtgtctctgtgggcgatgacggggccagccagatggccctggaggatattgccatgttcaggaccatcccaaagtgcacaatattttatccaacagacgctgtgagtacagaacacgctgtagccttggctgccaatgccaaaggcatgtgctttattcgaaccactaggcctgagaccatggtgatctacactccacaggagcggtttgagattggacaagccaaagttctgaggcattgcgtttctgacaaagttacagtcattggggcagggattacagtctatgaggcactggcggctgcagatgaactcagtaagcaggacatctttattagagttatagacttgttcaccatcaaacccctcgatgttgctaccattgtgagcagcgccaaagctactgaggggcgaattatcacggtagaagatcattacccacagggcgggatcggggaagccgtgtgtgccgctgtttctatggacccagacatccaggtgcactccctggcggtctccggggtaccacagtcggggaaatccgaagaactgctggatatgtatgggatcagcgcaaggcatattatcgttgcagtcaaatgcatgcttcttaactag

SEQ ID NO: 51586 - DNA, 1500 bp, Artificial Sequence
  Description of Artificial Sequence: Synthetic coding sequence
atgtggagccggcggcagggccggctgcggcccaccgtgtgcggcgtcgaagagctccgccgtaggaggcgggaacgggaagcagctctgaggaaagctcgtagggaacaacagcttgtgtctaagaggctcttgcgcaatgatgcccccgaagaagccggagagggatgcgtggccgctattctcggcgaaacagaggtccagcagtttctgagacaggcccagcgaggtaccgaggaaaaggagcgagaaggagcacttgtttcactgcggaggggcctgcagcatcccgagacacagcagactttcatcagactggaaggcagcatgcggacactggtaggcctgctgacatctaatcaggctttgctgcagctggaagcagctaggtgtctgcacgaactcagccatagcgagcagtccacagtcgcggaggcctgtctgcctgccaccagctatctcttgacctacctctcttctcactcttcggatttcatcgaattatgcctttacaccctcgggaacttaattgtcgaatctgaagctgtccgacgccaattgctcccccagggtatcgttccggcgctcgctgcgtgtatacaaagccctcacgtcgcagttctggaggcgcttggatatgcgctgagccaacttctgcaagccgaagaggcccccgagaaaatcatccccccggctagtgcctcctcttcgatcctggcatcaaccctgccccaacacatgttgcaaatgttgcagcccggacccaaactgaacccaggggtggccgtggagtttgcctggtgtctacactatataatatgctcccaagtcagcaatcctcttcttataggtcacggggctctcagcacactcggactactgttgctggatctagcaggtgccgtacagaaaacagaggacgcgggactggagctgctggcatgtcctgtgctgagatgcctgtcaaatcttttaaccgaagcagccgtggaaaccgtaggagggcagatgcagctgagagacgaacgggttgttgctgctcttttcatactgctccagttctttttccaaaagcagcccagccttctgcccgaaggcctctggcttctaaataatctcacggcaaattctccttccttttgcacatccctgctttccttagatctgattgaacccctattgcagcttctgcctgtcagcaacgtcgttagcgtgatggtgctgacggtactctgtaacgtcgctgaaaagggtccagcttactgtcaacgactttggcccggccctctcctccctgcgttactgcatactctggccttttccgacactgaggtagtgggtcaatcactggaattgcttcacttgttgttcctgtaccaaccagaagccgtgcaggtgtttctccaacaaagtgggctgcaggccctcgagcggcaccaggaggaggcccaactacaggatcgggtgtatgccttgcaacagaccgcactgcaggggtag

SEQ ID NO: 51587 - DNA, 1482 bp, Artificial Sequence
  Description of Artificial Sequence: Synthetic coding sequence
atgtggagccggcggcagggccggctgcggcccaccgtgtgcggcgtggaggagttacggaggcgcagacgagagcgggaggccgctctgcggaaggcacggcgtgagcagcagctcgtctcgaaacgactcctgcggaatgacgctccggaggaggccggggagggatgcgtagctgctatcctgggtgaaaccgaggtccagcaatttttacggcaagctcagcgtgggacagaagagaaggagcgggagggagccctggtttccctgagaagagggctgcagcacccagagactcagcagacattcataagactcgagggcagcatgcgtacactggtcggactcctgacttctaatcaggcgctgcttcagctggaagctgcacgatgcctccatgagcttagtcatagcgaacagagtaccgttgccgaagcctgtctgccagccaccagctaccttctgacctatctcagcagccattcttccgatttcattgaactgtgcctatatacattagggaatctcatcgtcgaaagtgaagcggtgaggcgtcagctgctcccccagggaatcgtacccgcactggcggcctgcattcagtccccccacgtcgctgtgttagaggcattgggatacgccttgagccaattgctgcaggccgaagaagctcctgaaaaaattatccctagcatcctggctagcacactgccacagcacatgttgcaaatgctacaacccgggcctaaattgaaccctggagttgctgttgagttcgcttggtgtctgcactacattatttgttcccaagtttcaaatcccctgctgatcggacacggcgccctaagcacgctgggcctcttattgctggatctcgcgggagcagtccagaagacagaagacgccggcctagaactcctggcatgccccgtgcttagatgcctatcaaaccttctcactgaggcggctgtggagactgtgggtgggcagatgcagctgcgggacgaaagggttgtggctgcactgttcattctactccaattctttttccagaagcaaccgagtctgctcccggagggtctgtggttgttgaacaatcttaccgccaactcaccttcattctgtacttcactcctgtctttggacttgatcgaaccactgttacagctgctccctgtgtccaacgtcgtgtccgtaatggtgctgacagtgctttgtaatgtggcagaaaaaggcccagcttactgtcaaagactctggccaggccccctgttgcctgccttgttacatactctggctttttcggatacagaggtcgtgggacagagtctcgagcttctgcacctgctctttctttatcagcctgaggcggtgcaggtgtttctgcagcagtctgggctccaagcattagaaagacatcaggaagaggcccagctgcaggaccgggtgtatgccttgcaacagaccgccctccaagggtag

SEQ ID NO: 51588 - DNA, 357 bp, Artificial Sequence
  Description of Artificial Sequence: Synthetic coding sequence
atgtggagccggcggcagggccggctgcggcccaccgtgtgcggcgtggaagagctgcgccggcggagaagggagcgagaagcagccctgcggaaggccagacgcgagcaacaacttgtgtctaagcggctactgagaaacgacgccccggaagaagccggcgaggggtgcgtggctgccattctcggtgaaaccgaggtgcagcagttcctgcggcaggctcagagagggaccgaggagaaggagagggaaggggcattggtgagtctccggcgcgggcttcagcacccggagacacaacaaaccttcatcagatctgtgtggatggtgtggtggcgtgaggagcttggactgtag

SEQ ID NO: 51589 - DNA, 762 bp, Artificial Sequence
  Description of Artificial Sequence: Synthetic coding sequence
atgctgcagatgctgcagcccggccccaagctgaaccccggcgtggcagttgagttcgcctggtgcctccattatattatatgttcacaggtgtctaatcccttactcatcggacacggcgctttgagcacgctgggtctcttgttgctggacctggccggcgccgtgcagaaaactgaagacgccggacttgaactactggcttgtcctgtgctcaggtgtctgtccaatttgttaactgaggcggccgtcgagactgtcggggggcagatgcaactgagagacgagcgtgtagtcgccgcgctgtttattctgttacagttcttcttccagaaacagccatccttgttgccggagggcctctggcttctgaataatctgacagccaatagtccgagtttttgcacatcactcctgagcctcgacctcattgagcctctcctccagcttttgccagtctcaaatgtagtgtcagtaatggtgcttaccgtgttgtgcaatgttgccgagaaggggcctgcttactgtcaaagactttggccagggcccttattacccgctttgttgcatactctcgcattcagtgacaccgaggtggtggggcagtcacttgagctgctgcacttgctcttcctatatcagcccgaggccgtccaggtctttttgcagcagagtggacttcaggctctggagagacaccaagaggaggctcagttgcaggaccgagtatacgcacttcagcagactgccttacagggatag

SEQ ID NO: 51590 - DNA, 903 bp, Artificial Sequence
  Description of Artificial Sequence: Synthetic coding sequence
atgctgcccctgctggccgccctgctggccgccgcctgccccctgccaccagtgcgaggcggagccgctgacgcccctggcctgcttggtgtgccgtctaatgccagtgtcaatgctagttctgctgatgaacctatagcccctcggttgctagctagcgctgcccctgggccaccagagagaccgggacctgaggaggctgcagctgccgcagcaccttgcaatattagcgttcagcgtcagatgctttcctctctacttgtaagatgggggcgcccgcgtgggtttcaatgcgatttactcctgttttcaaccaatgcccacggtagagctttttttgctgctgctttccatagggtgggccctcccttgctcatcgaacacctcggcctggccgccggtggtgctcagcaagacctgagactctgtgtgggctgtgggtgggttcgaggacggcgtaccggacgcttgcgtccggctgcggccccttccgcagcagctgcaacagccggcgccccaaccgcactgcctgcttacccagcagcagagcccccagggcctctgtggctccagggggagccactgcacttttgttgcttggatttctccttggaggagttacagggcgagccaggatggagattaaacaggaagcccatagagtccaccctggtcgcctgctttatgacactggtgatcgtcgtgtggagtgtggccgcactgatttggcccgttcctataatcgcgggcttccttcccaatgggatggaacaacggagaaccactgcgagcaccactgctgctacaccggccgccgtcccagccggaactaccgcggccgccgctgcagctgccgcagcagccgctgctgccgccgtcacttcgggagtggccacaaaatag

SEQ ID NO: 51591 - DNA, 2526 bp, Artificial Sequence
  Description of Artificial Sequence: Synthetic coding sequence
atgcccctggccgcctactgctacctgcgggtggtgggcaagggcagctacggggaggtgacactcgtgaagcaccgtcgagacggcaagcagtacgtgattaaaaaactgaatttgcgtaatgcctcctcccgcgaaaggagagcggcggagcaagaagcacagttgctttcccagcttaaacaccccaacatcgtcacttacaaagaaagctgggagggcggagatgggctgctgtacattgtaatggggttttgcgaaggcggtgatctctaccgtaagctgaaggagcagaaggggcaactcctacctgagaaccaggtcgttgaatggtttgtccaaatcgcaatggccctccaataccttcatgagaaacatattctgcaccgagacctcaagacacagaacgtatttttgactcgcaccaacatcattaaagtcggggacctcgggatcgcccgggtgctcgagaatcactgtgatatggcgtccactttgatcggcaccccttactacatgtcccccgagctgtttagcaacaaaccgtacaattataagtcagatgtctgggccttgggctgctgtgtatatgaaatggccacactgaagcacgcatttaacgcaaaagacatgaattccctcgtctatcgaattatagagggtaaactgcctccgatgcccagagactactcacctgaactggcggaattaatcaggacaatgctgagcaaaaggccggaagaacgccccagtgtaagatccatcctcaggcaaccctatattaagcggcagatatcgttctttttggaggcaaccaaaattaaaaccagcaagaataacatcaagaacggtgactctcaatccaagccgttcgccacagttgtttcgggcgaagccgagagcaatcacgaagtgattcacccccagcccctgtcgtccgaaggctcacaaacttacattatgggagagggtaagtgcctctcccaggagaagccccgggcatctggactattgaagtctcctgctagtctgaaggcacacacgtgtaaacaagacctcagcaataccaccgagctcgccaccatttcttccgtgaacatcgatattctgccggcaaagggacgagattcagtctctgatgggtttgttcaggagaaccagcctaggtatcttgatgcatcaaatgaattgggcggtatctgtagcatttctcaggtggaagaagaaatgcttcaagacaataccaagtcgtccgctcagccagaaaatttgattcccatgtggtctagtgatatcgtgactggcgaaaaaaatgagcccgtcaaaccattgcagccactgataaaagaacagaagcctaaagaccagtccctggctctgtctcctaagctcgagtgttcagggaccatcctcgctcacagtaacctacgactccttggatctagtgattctccggccagcgctagccgagtggctggaattactggcgtgtgccaccacgctcaagaccaggtggcgggtgaatgcatcatagagaagcagggtcgtatccatcctgatctgcagccccacaacagtggaagcgagccatccctcagccgtcagagaagacagaagaggcgggagcagacggaacacaggggggagaagcgccaggtgcgcagagatttgttcgcgttccaagagagtcctccccgctttctcccatcccaccctatagtgggcaaggtggatgtcacgtctacgcagaaggaggctgaaaatcagcggcgagtcgtgaccggatccgtttccagttccagaagcagcgaaatgtcatccagcaaggatagacccctgtcggccagggagcggagacggttgaaacagagccaggaagaaatgtcaagcagtggcccatcagtgcgcaaagcttcactcagtgttgcggggcccggtaaaccccaggaggaggaccagccgctgcctgcacgcagactgtcatccgattgctccgtgacgcaagaacgtaaacagatacactgcctatctgaggatgagctgagctcctccacctcttccacagataaatcggatggagattacggagaaggcaaagggcaaacaaacgagattaatgctctggtgcaacttatgacccaaacgctgaagctcgattccaaggagagctgtgaagacgtgccagtggcaaacccagtctccgagttcaagctacacagaaaataccgagacacgcttattttgcacggcaaggtcgccgaggaggctgaggaaatccacttcaaagagcttccatccgccatcatgcctggttctgaaaaaatccgccggctggtggaagttctgcgcaccgacgtcatccgcggcttgggcgtgcagctgctcgagcaggtttacgacttgctggaggaagaagatgaatttgatagggaggtgcggttaagagaacacatgggcgagaaatacacaacctattccgtgaaagctagacagcttaagttttttgaagagaatatgaatttttag

SEQ ID NO: 51592 - DNA, 486 bp, Artificial Sequence
  Description of Artificial Sequence: Synthetic coding sequence
atggccaaggaggagccccagagcatcagccgggacctgcaggagctccaaaaaaagctgtccctgctcattgacagctttcaaaacaactccaaagttgtggctttcatgaaaagtcccgttggacagtacttagattctcacccatttctggcctttactctcctggtctttatagtcatgtcagcggtgcccgtcgggtttttccttttgattgtagtgctcacaacacttgccgctctgctcggcgtcatcatcttggagggcctggttattagcgtgggcggcttttcactactgtgcattctctgcggtcttgggttcgtctcacttgccatgtcaggaatgatgatcgcctcgtatgtggtggttagttcccttattagctgttggttcagtccacgtcccctgacccagcaaaatacatcctgtgattttctcccagcaatgaaatctgcagaattcgagggcctgtaccaggagtag

SEQ ID NO: 51593 - DNA, 558 bp, Artificial Sequence
  Description of Artificial Sequence: Synthetic coding sequence
atggccaaggaggagccccagagcatcagccgggacctgcaggagctgcagaaaaagctgtcactgctcatcgattcgttccagaataactcgaagttgcctcagcacagtagaatttctctagattccgatgacggggtgagtaggttgggcagcgctggcagtaaggtcgtggcctttatgaagagtccagtgggccaatatctggatagtcaccctttcctggcatttacactcctcgtgttcatcgttatgtctgcagttccagtgggattctttctattgatagtggtcctgacaaccctggcggccctccttggcgtgattattctggagggactggtgattagcgtgggcggattttctctcctgtgcattctttgcggccttggctttgtgtctttggccatgagtggaatgatgatagcctcctatgtcgttgtgtcctctttgattagctgttggttctccccaaggccactgacccaacaaaatacctcctgtgacttcctgcctgccatgaagtccgctgaattcgagggcctgtaccaggaatag

SEQ ID NO: 51594 - DNA, 885 bp, Artificial Sequence
  Description of Artificial Sequence: Synthetic coding sequence
atggccgccggccggctgctgctgtacaccggcctgagcctggccctgtgcgctctgggaatgctcgcagtggctatttgttcagaccactggtacgaaaccgatgcccggaaacatcgcgaccggtgcaaggcgttcaataccaggcgcgtagaccccggcttcatctacaacaataataataatctccccctgagggcttctcggtctagactcgatcgttgggagggcaagctcctcagagctagaaataggcgacagctctttgctatgtccccagccgatgagtgtagcaggcagtataattcaaccaatatgggattgtggcgaaagtgtcaccgacaaggattcgaccctgaaattgccgcgctgattagaaagggcgagattgagagatgcacctacatcaagtatcattactcctctgccaccattcctcggaacttgacttttaacattactaagactattcgtcaggatgaatggcatgcactgcacctgcgacgcatgacagcggggtttatgggcatggccgtggccattatacttttcggttggatcatcggcgtcctggggtgttgctgggataggggcttgatgcaatatgtggctgggctgcttttcctgatgggtggaactttctgtatcataagcctttgcacatgtgtggccggcatcaatttcgagttgtctcggtaccccaggtacctgtacgggctgcctgacgatatctcacacggctatggctggtctatgttttgcgcttggggggggctaggcctcacgcttatctctgggttcttctgtacactcgccccttctgtgcagcctgtccccaggaccaattatcctaaaagccggcctgagaacggtacagtgtgttag

SEQ ID NO: 51595 - DNA, 1053 bp, Artificial Sequence
  Description of Artificial Sequence: Synthetic coding sequence
atgaacctgcggggcctgttccaggacttcaaccccagcaagttcctgatctacgcttgtctactgctgttcagtgtcttactggcgctccggttagatggtatcattcagtggtcttattgggcggtgttcgcccctatttggctctggaagctgatggttatcgtcggtgcctccgttgggacaggcgtatgggcacgtaacccccaataccgcgcagagggggaaacatgtgtggaatttaaggctatgctgatcgccgtcgggatccacctgcttctgctgatgttcgaggttcttgtgtgcgatcgtatcgaacgcggttcgcacttctggcttttagtttttatgcccctcttcttcgtgtcccctgtgagtgtcgctgcttgcgtgtggggttttaggcacgaccggtccctcgaacttgagatcctctgctcggtcaacatactgcagttcattttcattgctctgcggctggataagatcattcactggccgtggctcgtggtatgtgtgcctctgtggatcctgatgagttttctgtgtctggtggtcctctattatattgtgtggagcgtgctgttcctgaggtctatggacgtcatcgcggaacagagaagaacgcatatcacaatggccctgtcttggatgactatcgttgtaccgttgctcacgttcgaaatcttgcttgtgcacaaactcgatggccacaatgccttttcctctatcccaattttcgtacccctgtggctttccctcatcacactgatggcaacaactttcggacagaaagggggcaatcattggtggttcgggatccggaaagacttctgtcagttccttttggagatcttcccttttttgagagaatatggtaatatctcatacgatctgcatcacgaagacaacgaagagacagaagagacacctgtgccagagcctcccaaaatagctccgatgttccgcaagaaagctagggtagtgatcacccaatcaccaggaaagtatgtgttacccccacccaaactcaatattgagatgccagattag

SEQ ID NO: 51596 - DNA, 876 bp, Artificial Sequence
  Description of Artificial Sequence: Synthetic coding sequence
atgaacctgcggggcctgttccaggacttcaacccccgggccgagggcgaaacctgtgtcgagttcaaggcgatgttaatcgctgttggcatccacttgttgttactcatgttcgaggttctggtgtgcgacagaattgagagagggtctcacttttggctgctcgtgttcatgcccctgttcttcgtgtcacccgtgtctgtcgctgcatgcgtgtgggggttccgccatgaccggtcattagaactggaaatactatgctctgtgaacattctccaatttattttcatcgcactgcggctggacaagattatccactggccctggctcgtcgtgtgtgtgccactctggatactcatgagctttttgtgccttgtcgttttgtactacattgtgtggtccgtgttatttctaagatccatggatgtaatcgctgaacagagaaggacacacattaccatggccctttcttggatgaccatcgtggttcccctgcttactttcgagatacttctggttcataaacttgacggacacaatgccttcagctcaattcccatctttgttccactgtggcttagtctcattacactcatggccacaacgttcgggcagaagggaggtaaccattggtggtttgggatcagaaaagacttctgtcaattcctcctggagatctttcctttcctgcgcgagtatgggaacatctcctatgacctccaccacgaggacaatgaggagaccgaagagacacccgtccctgaacctcccaagatcgcccccatgttccgtaaaaaggctcgcgtggtaatcactcagtctccaggcaaatatgtgcttccaccgccaaaactcaacattgagatgcctgactag

SEQ ID NO: 51597 - DNA, 519 bp, Artificial Sequence
  Description of Artificial Sequence: Synthetic coding sequence
atgagcttcctgtgcctggtggtgctgtactacatcgtgtggagcgtcctatttctgcgctctatggacgtgattgcagagcagaggcggacccacatcacaatggctctcagctggatgacaattgtagtgccattgttgacatttgaaatactactggtccataagctcgacggtcacaacgcgttcagctccatccccattttcgtgcccctctggctgtccctgattactctcatggctacaaccttcggtcagaaaggaggtaaccattggtggtttggcatcaggaaggacttctgtcagttcctgctggagatattcccatttctgcgagagtatggaaatatctcctacgatttacaccacgaggacaatgaggaaacagaggaaacccctgtgcctgaacccccaaagatcgccccaatgttcagaaaaaaggccagagttgtgattacccagagtcctggtaagtacgtcctgcccccgcccaagttgaacatagagatgccagactag

SEQ ID NO: 51598 - DNA, 1254 bp, Artificial Sequence
  Description of Artificial Sequence: Synthetic coding sequence
atgggcccccggcagggccggtggtggctgctgctgtggctgccccccctggctacacttcctgtgcgcggcgaggcagccgcagcggccctaagtgtccgaagatgcaaggcccttaaagagaaggatctcattcgtactagcgagtctgactgttactgctacaaccaaaactcccaggtcgaatggaagtatatttggagtaccatgcaagtgaagataacctctcccggattgttccgcatagtgtatatcgccgagaggcacaactgtcagtacccagaaaacatcctgtcttttattaaatgcgtaatccacaacttctggattccgaaagagtccaacgagatcaccattattataaacccttatcgcgaaacagtgtgtttcagcgttgaacctgtgaagaaaatttttaattacatgatccatgtaaatcgcaacataatggatttcaaactctttctggtgttcgtcgctggagtgttcttatttttctacgctaggactctgagccagtcacctacgttttattactcttccggcaccgtgctgggcgtgctgatgacgctcgtgttcgtgttgctcctagtgaaaagattcatcccaaaatactctaccttttgggctctgatggtggggtgctggttcgcctccgtgtatatcgtttgccagttgatggaggacctcaaatggctatggtacgagaataggatatatgtgctcgggtatgtgttgatagtcggatttttctcttttgtcgtatgctacaagcacggacccctcgctgatgacagatcacgctccctcctgatgtggatgctgaggctgctcagcctggtgctggtgtacgccggggtcgcagtgccccagtttgcctacgcagccattatcttgcttatgtcttcttggtctctccactaccctctgcgggcgtgctcctacatgagatggaaaatggaacagtggttcacctctaaagaattggtcgtgaagtacctcactgaagatgaatacagagagcaggccgacgccgaaacgaattccgccttggaagaactgagaagagcgtgtcggaaacccgatttccctagctggctggtggtctctaggctacacaccccatcgaagttcgctgactttgtcctggggggatcccacttatcaccagaagaaatctcccttcacgaggaacagtacggattagggggagccttcctcgaggagcagctgttcaacccctctacagcgtag

SEQ ID NO: 51599 - DNA, 822 bp, Artificial Sequence
  Description of Artificial Sequence: Synthetic coding sequence
atggagcggcgggagcacctgaccctgaccttccacagccccgaggtccccaagatcaagggcaacagaaagtaccagcggcccacagttccggctaagaagcacccatctgcttccatgagctgtcagaggcagcagcagcttatggaccaggcccatatttacattcgcacgctgtgcggatctttgtgtagtttcagcctccttatgctcatcgctatgagccccttgaactgggttcagttcctcgtgatcaagaatgggctggaactctatgcaggtttgtggactttatgcaatcatgagctgtgctggagccacacgcccaaaccaccatactacctgcaatactcccgcgcatttttcctgatatcggtttttaccatcctgacagggctgggctggctcttctcttcctggatcctcaaccggggaagcatgaccaccaatctcgacctgaaggtgtctatgctgtcttttatctcggcgacctgtctcttgttgtgcctgaacctgtttgtcgcacaggttcactggcacacccgcgatgccatggaaagtgatctgctttggacgtactacctaaattggtgcagcgacatattttacatgttcgcaggaattatttctctgttgaactatcttaccagtcgttcacccgcatgcgatgagaacgtaaccgtaattcccacagagcgcagccggctgggcgtgggcccggttactactgtgtcacctgccaaagacgaaggcccccgatctgagatggaatccctttctgttcgtgagaagaacttgccaaagagcgggctgtggtggtag

SEQ ID NO: 51600 - DNA, 585 bp, Artificial Sequence
  Description of Artificial Sequence: Synthetic coding sequence
atgaagggcctgtaccaggccgccggccggatcctggtgaccctgggcatactctctgtctgttcaggtgtgattgcattctttccagtgttcagctataaaccatggttcaccgggtggagcgtccggattgcttgtcctatctggaacggtgccctggccattacaaccggcgtgttgctgctgctggcttatagagaatggactcagaggtatcttggggaggctacttttacttttgtgatcttgtcaattatgggctgtcctttgcactttgctattgctctagagtcggctctcctcggaccttattgcttttatagctttagcggtatcgccggaactaattacctgggatacgccgttacttttccttacccctacgctaagtttccccttgcttgcgtggacccacctcactatgaggagtaccacctgacacttcaagccctggatctgtgtctctctttcactcttttgtgcacttctctgactgttttcattaagttatccgctcggctcatacagaatgggcatattaacatgcagctcccggcgggaaaccctaacccatttagtccatag

SEQ ID NO: 51601 - DNA, 453 bp, Artificial Sequence
  Description of Artificial Sequence: Synthetic coding sequence
gcctgccccatctggaacggcgccctggccatcaccaccggcgtgctgcttttattggcttatcgcgagtggacgcagcggtatcttggcgaggccactttcactttcgtgatactcagcataatggggtgcccattgcattttgccattgctctcgagtcagccttgctggggccttattgtttttacagcttttctggtattgccggtaccaactatcttggttatgcagtaacgtttccatacccctacgctaagttcccgctggcatgcgtggacccacctcactatgaagagtatcatttaactctacaggctttggatctctgcctcagctttacactcctgtgcaccagcctgaccgtgtttataaaactaagcgcaaggctgattcaaaatggtcatatcaatatgcagttacccgcaggcaatcccaacccattcagtccctag

SEQ ID NO: 51602 - DNA, 876 bp, Artificial Sequence
  Description of Artificial Sequence: Synthetic coding sequence
atggcccggagctacggcggccgggtgctggccgccatgaccctgttaggtatcgcggccgcggtgctcgcagctcttggagcccaattgctcttccagctccaagcaggtcgcgctgaacttcgcggcctccgagccgaagggctgggacaggagctcggagcgggccccgggctgcccgaggatgccgctggcacactactgcctctagcagcggccctcgcggccctagtgcttgtccttgggttcacctgcctgttgttagccgccttatgcggacatctgggggcagagttggcacgcgggcctggacctcggaggtcggattggttcttatatgattgtagacttctcagacacgtcgctctgggtctgttttgctgtggaatatctgtctacctggctgccctgtctatatatgcattactacttttcgagatcgagacaggggcggctgcagcgtccatcctgggctctggtaccctagtgctggtggccgtgttaacgcacacccttctccgggcagcgagggctgcccgacggggcctgcacgaattgtctcccccctcattcgaggatgatttggcaagaccggctgaggtctcaaaagcatcccctcgtgctcagccacagcagggaattcaccgcagaaccccttatagcacctgtcccgagcctggtgacccattcggctccatggctaccgcaaccgcgcccgccgcactcgaaggcggctgggaatcaagcctgccagcttcaagaatgcaccggaccttaagcgccggtctcggccattgggacggggttacgcatgagatgcgcaggatgctgggtcatcggccaggctccatggggaaggattccactctggtgtag

SEQ ID NO: 51603 - DNA, 1056 bp, Artificial Sequence
  Description of Artificial Sequence: Synthetic coding sequence
atggccagcggccggctgatcaagttcgtggtgttcgagctgctggagtttgccgccttctccataccaacgcttgttatcacggagcagtttgctacagcgtaccaggggacaagggccagatccgataacactcattactggcttattatctcttgttccatagcatatgtggctctggtgactctgcttatttgggttccggtcaaggtgatcctgcataaaaagcgctacatataccggaagattaaggggtggaggcccgtcctaatgatgtgtgttgtcctgacgactcttccatgcttgacgttctctattgccgtcaccgaagtccagaaatcaatcaacggcagcgctgacgtgctcccagacatgttgcctgatctgcccgtgtccctggtgctgttgtccttgatcatggttgacatcattgaaaaactgaggatctatccactgcgcggaagccaaaagtcttctgaaaatggccatattcatagcacttccctgcagcatataaagaccgttactgagcaagtgcggcagagccccgagaacgcagcctcaccacaggctacaaactcaacccaggtgagtcagccatctggggccatgacacggtcacaagaaagtgtctttatgggcccccaggagccttcatgcgactcgggcatcctccgcatgatgtccagacgagacgtcagggctgaattgtttctatggtctttcctattgtggagcgacacaattgaaatggttcgggtcgccggtcatcccaatgtgtataaatcatcctggctgtaccccgtttacatcttttcatttatcagcctactgaggatcacgtttactccccagaatccacttcttaattctctctcagtgctcttgcaagacctgcctttcgtcttcgtgaggctcggtctgattatcgccctggggaccataacccccgtccttggcctgtgtaaaaacattctggtaactctgagttatatctatttcaactacttaactaggattagaatcttttcagcctttgaaatgagtccattctag

SEQ ID NO: 51604 - DNA, 531 bp, Artificial Sequence
  Description of Artificial Sequence: Synthetic coding sequence
atggccgccgcccccgccgtgtgcgccagccagggcagcccccccggcgcaccctccgcacctgcggctgctcctgcccctgccgcaggactgggtaggtgcaggatggctctgctgctggctgttgcgttggacgttgccggtatggccgctctacttactggagttttcgcccaattgcaggttcgggggagggattttggtgacctcctgatttattccggggctctcctcgtgtttttaagcctgctcgggtggattctgtggtacacgggaaacatagaaataagcagacaggaactggagcgcgactacgggttgcggccttctgctctcgcgcgtctggcacgcaagctgtcaagacggtggtctgcccccgctgcggctgggcagagacccgcgccaggtagcagacgcgccaggagggcagcacgcgcgcccccacctcctgcggcaggctcgagacgcgtccgactccagctggccaccttagaggccggccccggcgcggcaggggcaggctctgagtag

SEQ ID NO: 51605 - DNA, 588 bp, Artificial Sequence
  Description of Artificial Sequence: Synthetic coding sequence
atgcgggtgggcacctggatctgcctgcccggccggcccggccggtgccgtaaacagcatgacttaggcaattgccccgaggtgccaggaatttttaagaccttggctttatcccctggagctcccgatatgatgcaacagccacgtgtcgagacagatactattggcgccggggagggacctcaacaggccgttccttggtccgcatgggtgacccgtcacggctgggttaggtggtgggtgtcacatatgccacccagttggatacaatggtggtctacatccaactggcgccagcctctacagcgcctgctatggggccttgaaggtatactctatctgctccttgcgttgatgttgtgccatgccctgttcactaccgggtcacacttgctttcttcactgtggcccgtcgtcgcggccgtctggaggcatctcctgccagctctgctgctattagttctgtcggccctgccagccctactgttcactgcatcattcctgttactcttctccacactgcttagcttagtcggtctgctcacatctatgactcatcctggagacactcaggacctggaccagtag

SEQ ID NO: 51606 - DNA, 765 bp, Artificial Sequence
  Description of Artificial Sequence: Synthetic coding sequence
atgacccggctgtgcctgccccggcccgaggcccgggaggaccccattcctgtcccacctcggggcttgggggccggcgagggctcaggaagccctgtgagaccaccagtgtccacctggggaccttcctgggctcagttgctcgattccgtgttatggctcggagccttgggcttaacaattcaggctgtcttctctaccacaggtcctgccctactgctgctccttgtatcgtttctgacctttgatctcctgcataggtgcacaagacacgatgccgccgctgcatccggcgatcgttaccatcggggctggcggggagctaccgccgggagtgccctggtctctcttggtcacgaagcttggcttggagcgctcgtaggagaaccacatgcacccgaactggatccagtagtagagcacttggaactcgccgcgactgccgctgcgccagccgtgggcagtggtggggacactctaccagctgccgggacagatgtcgtgccatgtactttgcatcattggctcccacccgccgagctgctggtagcctgccgagggagaggggtggcacctcctgccacagggtcacccgctgccggcgcccagtgctccgcctgtcctccactgcatggattgctgcctgcggctctgctacacaccgctgagccatgtggccccccccatttacacgactcaccccgtcggcactcaggcttcggcagcattgagggccagccacaccccaccgcttgtgtgtgctag

SEQ ID NO: 51607 - DNA, 459 bp, Artificial Sequence
  Description of Artificial Sequence: Synthetic coding sequence
atgatgcagcagccccgggtggagaccgacaccatcggcgccggcgagggaccacagcaggccgtcccatggtctgcctgggtgacaagacacggctgggtgcgatggtgggtcagccacatgccaccttcctggattcagtggtggtctaccagtaactggcgccaacccttgcagcgcctcctctggggcctggaaggcatcctttatctgctcctagccctgatgctctgtcacgcactgttcacaaccggctcgcatttgctgagttcactgtggccggttgttgcagccgtgtggcgtcaccttctgcctgcattactgctgcttgtgctgtccgcgctcccagccctgttatttactgccagtttcctcctcctgtttagcaccctcctgtccctcgttggccttttaacctccatgactcaccctggagatacccaggatctggatcaatag

SEQ ID NO: 51608 - DNA, 969 bp, Artificial Sequence
  Description of Artificial Sequence: Synthetic coding sequence
atggccctgccccccggccccgccgccctgcggcacaccctgctgctgctgccagccctgctgagctcaggctggggcgagcttgagccccagattgatggccagacctgggctgagagagccctccgagagaatgagcggcatgcattcacttgtagggtggccggcgggccaggaaccccccggctggcatggtaccttgatggccagctccaggaagccagcacttctcggctgttgagtgtgggtggagaggcctttagcgggggcaccagtacgtttacggttactgcacatagagctcagcatgagctgaattgctcattgcaggaccccaggtctggccggtccgccaatgcatccgtgatcctgaacgtccagttcaagcccgagatcgcgcaggtaggggctaagtatcaggaagcccaaggtccaggcctcctcgtcgtgttgtttgctttggtccgcgctaatccgccagccaatgtcacttggattgaccaagatgggccggtcacggtgaatacttcagactttctggttctcgacgcccagaactatccgtggcttacgaatcataccgtacagctgcaactgaggagcctagcacataatttaagtgttgtggcgaccaacgacgtcggtgtcacatccgcaagcctgccagcgccaggcccgtctcggcacccgtcccttatttccagtgacagcaacaatctgaagctaaataacgtgagactcccccgcgagaatatgtctctaccatctaatctgcaattgaatgatctcacccctgactctcgggctgtgaaaccagccgaccggcaaatggcacaaaacaacagccggccggaattgctagatcccgaacccggaggactgctgactagtcaggggttcatcaggcttcctgtcctgggctacatttaccgcgtgagctcagtctcctctgatgagatctggctctag

SEQ ID NO: 51609 - DNA, 969 bp, Artificial Sequence
  Description of Artificial Sequence: Synthetic coding sequence
atggccctgccccccggccccgccgccctgcggcacaccctgctgctgttaccggcgctactgtcttcaggctggggtgagttggagcctcaaatcgacggacagacttgggccgagagagccctgagggagaatgagcggcacgctttcacctgccgggtagcaggcggccctggcactcccagacttgcatggtacttggatggccagttgcaggaagcctctactagtcgcctgcttagcgtcggcggggaagcgttttccggaggcacaagcacgtttaccgtgaccgcccatagagctcagcatgaactgaactgctccttgcaagatcccaggagtggccgctccgctaacgcttctgtgattctcaacgtgcagttcaaacctgagatagctcaggtgggtgctaagtaccaggaggctcaggggcccggactgctggtcgttctcttcgcactggttcgggctaacccacctgccaacgtaacgtggattgaccaggacggcccagtaaccgtcaacaccagcgactttctagtgttggatgcccagaattacccatggctgacaaatcataccgtacagttacagttaaggtccctcgcccataatctgagcgtggtcgccactaatgacgttggggtgacgtcagcttctctccccgccccagggccttctaggcacccctcattaatatcatccgactccaataacctaaagctgaacaacgtcagattgccgagggaaaatatgtcattgccttctaatctgcagctgaacgatctcacaccagattcacgggcggtaaaaccggcagatcgacagatggcgcagaataactccaggcctgagctactggaccccgagccaggcggactcctaactagtcagggctttataagactccccgtcttgggatacatctaccgcgtctcgtcagtatccagcgatgagatctggctttag

SEQ ID NO: 51610 - DNA, 660 bp, Artificial Sequence
  Description of Artificial Sequence: Synthetic coding sequence
atggccgccgaggaccgggagatgatggaggcccggggcgccggcgagagctgcccaactttccctaaaatggtgcccggagactctaaatctgaagggaaacccagggcctacttggaggccgagtcccagaaacccgattcttcctatgattacttggaagaaatggaggcctgcgaggatggcggctgccaaggacccctcaaatccctgagccccaagtcttgccgggcaactaaaggacaagccggcgatggacctaaaccagccgagctgccgcccacccccggtactgaacggaacccagagatggaactggaaaaggttcgcatggaatttgagctcacacgactgaagtatctgcacgaaaagaaccagagacagcggcaacatgaagtggtgatggagcagctccagcgcgagcggcaacacgaagtcgttatggaacagctacaacaggaggccgcccctcggctgttcagtggggggctccaaaactttctcctacctcaaaatcagttcgctatgttcctgtattgctttatcttcatacacattatttatgtgaccaaggagatggtcttctttttattcgctaagcattatctgttttgcattgccgctatattactctgccttataaagaccttttggagctag

SEQ ID NO: 51611 - DNA, 1320 bp, Artificial Sequence
  Description of Artificial Sequence: Synthetic coding sequence
atgggcgaggcccccagccccgcccccgccctgtgggactgggactatttggatagatgtttcgcgcgccaccgggtgtgtatctcttttgggctgtggatatgtgcctcatcatgttggatcgcagcccacgctctgctgctatacctccgctgtgcacagaagccccggcaggaccaatctgcactgtgtgctgcctgctgtcttctgacatccctctgtgacactgttggcgctcttttagcccgccagctgacaattcaagtgtttaccggcgcctatctggccgccatcgacctcgtgaacttcatgtttatcctttttcctgtctgcggctctaagttcaagagcaacagcgatagagaggcaagagaacggaagaggaggaggcagttgagagcaagtgtctttgccttggccctgccgttatcgctgggtccatgctgggcactgtgggtcgccgtacccaaagccagcgctacaatcaggggccctcagcgaaggcttctggcgagcttgctccaggaaaatactgagatcctcggctatttgctgggaagcgtggccgcctttggtagttgggcttctaggatccccccactgtctcgcatttgtcgaggcaagacttttccttccatccacctctggaccagactgctttcagccctggccgggctgctgtacgcatccgctatagtggcccacgatcagcatcccgagtatctgctcagggccaccccttggttcctgaccagtcttggacgagcagctctggaccttgccataatatttctctcctgcgttatgaaatctaagatgcggcaagctcttggcttcgccaaagaggccagggaaagtcccgatacccaggctctattgacttgtgcagaaaaggaggaggaaaatcaggagaacttggactgggttcctttgactacgctcagtcactgcaaatctcttagaaccatgacagctatctcaagatatatggagctgactatcgagcccgtgcagcaggctggatgcagcgcgactagactgccaggagatggacaaaccagcgcgggagatgcgtccctccaagaccccccatcataccctcccgtccaggtgattagggctagggtttcaagcgggagctctagcgaggtgtctagtattaactcggatctggaacagaagtactgggaggccttaaattcagagcaatgggaccctgaggacgtcaacttagagggatcaaaggaaaacgtcgaactgctcgggtcccaggtgcatcaggattctgtgcgcaccgcccatctgagtgacgacgattag

SEQ ID NO: 51612 - DNA, 342 bp, Artificial Sequence
  Description of Artificial Sequence: Synthetic coding sequence
atgttcatcctgttccccgtgtgcggcagcaagttcaagagcaactccgaccgggaagcaagggagaggaagcgtcgcaggcagttgagagcctctgtgtttgctctcgcattgcccctgagtctgggaccctgctgggcgctgtgggtcgccgtccctaaggcgtccgccactatacgcggacctcagagaagacttctagcatctttgcttcaggaaaatactgagatactggggtatctgttggggagcgttgccgcctttggaagttgggcgagtcgtatcccccccttgtcgagaattgtccgaccaggggtaggtatgggcttgtgggtgacatag

SEQ ID NO: 51613 - DNA, 1287 bp, Artificial Sequence
  Description of Artificial Sequence: Synthetic coding sequence
atgggcgaggcccccagccccgcccccgccctgtgggactgggactatctggacagatgctttgcccgacaccgagtatgcatttcgtttggtctctggatctgcgccagctcctgctggatagcagctcatgctcttctgctctacttaaggtgcgcccagaaacctagacaggaccagagcgctctgtgcgctgcctgctgccttcttacctcattgtgcgacacagtcggggccctccttgctaggcagctgacaatacaggtgtttaccggggcctacttagcggcgatcgatttagtgaactttatgtttatcctctttccagtgtgcggctccaaattcaagtccaactccgatagggaggccagagagcgaaaaagacgccggcagctgagagcctctgtttttgcactcgctctgccattgtccctcggcccctgttgggcactatgggtggccgtccctaaagcatcagcgacgattagggggcctcagcgcagattgctagcatctctgttacaggagaacactgaaattctggggtacttacttgggagcgtagctgcattcggatcatgggcatctcgtattccacccctcagtcgtatttgcagaggcaagaccttccctagtatccacctgtggacacgcctactgagcgccttggccggactgctgtatgcatcagctatcgtcgcccatgaccagcaccccgagtacttgctaagagcgactccctggttcctgacgtctctgggcagagcagcactcgacctggcaatcatcttcctgagctgcgttatgaagtcaaagatgcgccaggcactcggttttgccaaagaggctagagaatcgcctgatacccaggcactcttgacatgcgcagagaaagaagaggaaaaccaagagaatctcgactgggtacctctaaccaccctcagccactgcaagagcctgcggaccatgaccgcgatatctaggtatatggaattgacaatcgaacctgtacaacaggccggctgtagtgcaacgcggctcccgggagacggccaaactagtgccggcgacgcatccctccaggacccgccatcctatcctccagtccaggtgatccgagcccgcgtttcaagtggttccagttctgaggtgagtagcattaactctgacctagaatgggatccagaggatgtgaatctggaaggttcaaaggagaacgtagagctgctgggctcgcaggtccaccaggacagcgtgcgcacagcccacttgtccgacgacgattag

SEQ ID NO: 51614 - DNA, 1191 bp, Artificial Sequence
  Description of Artificial Sequence: Synthetic coding sequence
atgggcgaggcccccagccccgcccccgccctgtgggactgggactatcttgaccgctgtttcgctcgccacagggtatgtattagctttggcctttggatttgcgccagctcttgttggatcgccgcacatgctcttctcttatacctccggtgtgcgcagaagccgcgccaggatcagtctgcgctttgcgccgcatgctgcctgttaacaagcctatgtgacaccgtgggtgctctgctggctcgacagctgaccatacaagtgtttaccggcgcatatttggccgcaatcgatctggttaactttatgtttattcttttccctgtctgcggttccaagtttaaaagcaacagtgaccgcgaggcccgtgagaggaagagaaggcgtcaactgcgggcctcagtgttcgccctagctttgccactttcactgggcccatgctgggccctttgggtcgccgtgccgaaggctagtgccacaattcgcggaccacagaggcgcttgctggccagcctcctccaggagaatactgagatcctgggatacctgttgggatctgtggctgcatttggatcctgggcctctcgtatacctcctctgtcacgcatatgccgcgggaagactttcccttccattcacctctggactcgtctactgtcagccctggcaggacttctttacgccagtgccattgtcgcgcatgaccagcatcccgagtacctcctgcgcgcaacaccctggtttctgacatcgctgggcagggccgcgctggacctcgcgattatctttctgtcgtgtgtcatgaaatccaagatgcgccaagccctggggtttgcgaaagaagctagggagagccccgatactcaggccctacttacctgtgcggaaaaagaagaagaaaaccaagagaatctggattgggttccactaaccactctttcacactgtaaatctctcagaacaatgaccgcgatcagtaggtatatggagctgaccattgaaccagtgcagcaggccgccgtgcctcccgggtgccaggttacagggcggagggcaccagaaatgcgaccttgcaggacgccgcgccgaacactgcctttcaggagtagcggtccaggttgcctcccggctgccccccttagatcgcctcccagcactcccacttggtctgggacacttaagatgtag

SEQ ID NO: 51615 - DNA, 1428 bp, Artificial Sequence
  Description of Artificial Sequence: Synthetic coding sequence
atgggcgaggcccccagccccgcccccgccctgtgggactgggactacctggatagatgtttcgcgcgccatcgggtctgcatttcctttgggctttggatctgcgcaagttcctgctggatcgctgctcacgccctgctgctgtatttgcgctgtgcccagaaacctcgccaggaccaatccgcattgtgcgccgcctgctgtctgctaacctcactgtgcgataccgtcggagccctactagctagacaactgactatccaggtattcacaggtgcttatttggcagcaatagacctagtaaacttcatgtttatcttgttcccggtttgcgggtccaaatttaaaagcaacagcgatagggaggcgagggagagaaaacggagaaggcagctgagagcatcagtgtttgcacttgccctccccctcagcctcggaccttgttgggccctttgggttgcggtgcccaaagcctccgccactatccgaggcccccagaggcgcctgctggcttctttgctgcaggaaaacacggagatattgggatatctgctgggatcggtggccgctttcggttcctgggcttctaggataccaccactttcacgcattgctccaccccccacactgggcataacaacccagcatgagatttggcggggccagatgtcaaaaccttctcagtctcccagccgctcaccaagcgggcactggagagccgctgcccagcgccaagtgctcggtacagaaatgtgcagaggcaaaactttcccatcaatccacttgtggacacggctgcttagcgctttagctggcctgctgtatgcaagcgcgattgttgcgcacgaccaacatcccgaatacctcttaagagctaccccttggtttttgacctcccttggacgcgctgccctggaccttgctatcatatttctgtcatgcgttatgaaatccaaaatgaggcaggccctggggttcgccaaggaggccagagagagcccagacacccaagccctgctgacctgtgccgagaaggaagaggagaatcaagagaacctggattgggtccccctaactactctgtcccattgcaagtctcttcgaaccatgacagcaatcagccgatacatggagctgaccattgaacccgtgcaacaagccggatgttctgcaacgcggctgccaggggatgggcagacttctgctggggatgcctcactgcaggatccaccctcctatccacctgtacaagtcatcagggccagagtctcaagtgggtctagctcagaagtaagctctattaacagtgacttagagtgggatccagaggatgtgaaccttgagggaagcaaagaaaacgtggaactgttaggaagtcaggtgcatcaggactcagtccgtacagcacacctctcagatgacgactag

SEQ ID NO: 51616 - DNA, 1317 bp, Artificial Sequence
  Description of Artificial Sequence: Synthetic coding sequence
atgggcgaggcccccagccccgcccccgccctgtgggactgggactatctggatagatgtttcgctcgccaccgagtctgcattagctttggactctggatttgcgcttcctcctgctggatcgccgcccacgccctccttctgtatctgcgatgtgcccagaaaccccggcaagatcaaagtgctctgtgtgcagcctgctgtcttctgaccagtctgtgcgatacagtgggggcactgctggccaggcagttgacaatccaggtcttcacaggggcctacctggctgctattgacctcgtgaacttcatgtttatcctgttccccgtctgcggaagcaaatttaaatccaactcagaccgcgaggccagagagcggaaacgccgaaggcagctgcgcgctagtgtgtttgcactcgctctccccctgtcactgggcccttgctgggccctgtgggttgctgtgccaaaagctagtgcaaccatcagaggacctcagcgcagacttctagcgtcgttgctgcaggaaaacactgaaattctggggtatcttttagggtcggtggctgcatttggaagctgggctagcaggattccgccactcagtcgcatatgcagagggaaaacctttccaagcatccatctatggacacggcttctaagcgcactggcaggactcctgtacgccagcgccatcgttgctcatgatcagcatccggaatacctcctgcgagcaacgccttggttcctgaccagcctgggccgagccgcactggacctggcaatcatctttctatcttgcgtcatgaaaagtaagatgcgccaggcgctcggcttcgccaaagaggcacgggagagcccagatacccaagcattgctgacgtgtgcagagaaagaggaagagaatcaggagaatctggattgggtccctctgacgacgctgtctcattgtaaatccctgcgcaccatgacagcgatctcgagatacatggagttgactattgagcccgtgcagcaggccggctgcagcgctaccaggttgcccggggacggccagacaagcgccggcgatgccagtttacaggatcccccctcttaccccccggtgcaggtcatccgcgcccgagtttcctctgggtcgagtagcgaggttagctccatcaactctgacctggaaaaatactgggaggcacttaattctgaacagtgggaccctgaggatgtgaatctggagggcagcaaagagaatgtggaactgttgggcagccaggtgcaccaggactctgtgcgtacagcccacttgagcgacgacgactag

SEQ ID NO: 51617 - DNA, 477 bp, Artificial Sequence
  Description of Artificial Sequence: Synthetic coding sequence
atggccggcttcctggacaacttccggtggcccgagtgcgagtgcattgactggtccgagcgtcgtaatgcagtagctagcgtggtggcaggaatcctgttttttaccggctggtggatcatgatcgacgctgctgtcgtgtatcctaaaccagaacaactgaaccatgctttccatacatgcggagtcttttccacactcgcattctttatgattaacgcggtcagtaacgcccaggtgaggggagatagttacgagagcggttgcctaggcaggactggggcacgggtatggctgttcattggttttatgctcatgtttggatcgcttatcgcaagcatgtggattctattcggcgcatacgtcacacagaataccgacgtttatccaggactggccgtttttttccaaaacgcactgattttcttttccacactgatttacaaatttggccgaacagaagaattatggacatag

SEQ ID NO: 51618 - DNA, 831 bp, Artificial Sequence
  Description of Artificial Sequence: Synthetic coding sequence
atgtaccggatcagccagctgatgagcacccccgtggccagcagcagccgactggagagagagtacgcaggagaactttcgcccacttgtattttccccagcttcacttgtgacagtctcgatggctaccattctttcgagtgcggtagcattgaccccctcactggatcccattacacctgccggcgttctcctaggctgctcacgaacggatactacatatggaccgaggacagcttcctatgtgataaggatggaaatataacacttaaccccagtcagacaagcgtgatgtataaagagaacctcgtgagcacaagcaagtcctggctccacggttcgatattcggagacatcaacagcagcccttccgaggacaactggctcaaaggtaccaggcgacttgataccgaccattgtaatggtaacgccgacgatcttgattgctcttcgctgaccgacgattgggagagtgggaaaatgaacgccgaaagtgtcatcacttcctcgagttcccatatcatctctcagcctccaggcgggaatagtcatagcctgagcctgcaaagccaacttaccgcgtctgaacgcttccaggaaaattcatccgaccactcagaaacacgtctgctgcaggaagttttttttcaggcaattctgctagctgtgtgcctgatcatctccgcctgcgccagatggttcatgggcgaaattctggccagtgtcttcacctgctcattgatgataacagtcgcttacgtgaagtccttattcctgagcctggcctcttacttcaagaccactgcatgtgcccgcttcgtaaagatctag

SEQ ID NO: 51619 - DNA, 699 bp, Artificial Sequence
  Description of Artificial Sequence: Synthetic coding sequence
atgtaccggatcagccagctgatgagcacccccgtggccagcagctccagactcgaaagagaatatgccggagagctctctcctacttgcatattcccctcattcacttgcgactccctagatggctaccactcctttgagtgcggctccatcgatcctttgacgggctcacattacacctgtcgcagaagcccacggcttctgactaacggatactatatctggacagaagacagttttttgtgtgataaagatggaaatataaccctgaatccctcccagacgtctgtaatgtacaaagagaatctggtccgcatcttcaggaagaagaaacggatttgtcacagcttctctagtttgtttaatctgagcacttcaaagtcgtggctgcacggcagtatcttcggggatatcaacagctctccctccgaggacaactggctgaaaggcacaaggcggctggacactgatcattgcaatgggaacgaaaccaggctgttacaggaggtgttcttccaggctattcttctggccgtctgtctcatcattagcgcatgtgctcggtggttcatgggtgaaatcttggccagcgtgtttacttgctccttgatgatcaccgtggcgtatgtaaagtcgctctttctgtctttggcgtcatatttcaaaaccacagcttgtgctaggttcgttaaaatatag

SEQ ID NO: 51620 - DNA, 300 bp, Artificial Sequence
  Description of Artificial Sequence: Synthetic coding sequence
atgtaccggatcagccagctgatgagcacccccgtggccagcagctctaggctcgagcgagaatatgccggcgagttgagccccacatgcatcttccctagcttcacctgcgactctcttgacggatatcattcctttgagtgcgggtctatcgaccctcttaccggaagccactacacctgtcggcgatctcccagactgctgacaaacgggtactacatctggacggaagatagtttcttatgcgataaggacgggaacataacgctgaatcccagccagacctccgtcatgtattag

SEQ ID NO: 51621 - DNA, 279 bp, Artificial Sequence
  Description of Artificial Sequence: Synthetic coding sequence
atgtaccggatcagccagctgatgagcacccccgtggccagcagctcaagactggagagggagtacgctggagagttgtcacccacttgcatcttcccttcttttacctgcgacagcctcgacggctaccattctttcgaatgcggtagcattgatccgttaacaggctcgcactacacttgtagacgatctccccgtctcctcaccaatggttactatatttggaccgaagattcttttttatgcgacaaggacggtaacatcacactgaatccttag

SEQ ID NO: 51622 - DNA, 666 bp, Artificial Sequence
  Description of Artificial Sequence: Synthetic coding sequence
atgggcaccctggtggccaagctgctgctgcccaccctgagcagccttgctttccttcccaccgtaagtatagctgccaagaggagatttcacatggaggctatggtctacttattcacactgtttttcgttgcgttgcaccacgcgtgtaatggacctggcttgtcagtattgtgtttcatgcggcatgacattctcgagtatttctcagtgtatggaacagcactttctatgtgggtgtctctgatggccctggctgattttgatgaaccaaagagaagtacattcgtgatgtttggggttcttacaattgcagtgcggatctaccacgatcggtgggggtacggagtttactctgggcctatcggcactgcgatcctgattattgcagccaaatggctgcagaagatgaaggaaaaaaagggattatatcccgataaaagtgtctacacgcaacagataggacccggcctctgtttcggtgccctagccttgatgttacgtttttttttcgaagattgggactacacctatgtacattcattttatcattgcgctttagcaatgtcctttgtgttgctacttccgaaagtaaataagaaggctggatctcccggcactccggcaaaacttgactgttctaccctctgctgcgcttgcgtttag

SEQ ID NO: 51623 - DNA, 555 bp, Artificial Sequence
  Description of Artificial Sequence: Synthetic coding sequence
atgtggcggctggccctgggcggcgtgttcctggccgccgcccaggcgtgcgtgttttgccgcctgccggcgcacgacctgagtggaagactggcaagactgtgttctcagatggaagcccgccagaaagagtgtggcgcttcaccagacttttctgccttcgccctggatgaggtcagcatgaacaaggtgactgagaaaacacaccgcgttctacgcgtgatggaaatcaaagaggcggtctccagtctgcccagttactggtcttggctccggaaaaccaaattgcccgaatacacccgcgaggccctttgccccccagcatgtccccttcccctcctgtcaccggcagggggctccacaactttatacaactgcagcacgtgcaaaggaaccgaagtgagctgctggccaaggaaacgatgtttccccggctcccaggacttgtgggaagctaaaattctactcctgagcattttcggagccttcctcctgcttggagtgctcagcctgctggtggagtcacaccatctccaagccaagagcgggctatag

SEQ ID NO: 51624 - DNA, 612 bp, Artificial Sequence
  Description of Artificial Sequence: Synthetic coding sequence
atgtggcggctggccctgggcggcgtgttcctggccgccgcccaggcgtgtgtcttttgtaggctgcctgcccacgatctaagcggccgactggcccgcctatgctcccagatggaggccaggcaaaaggagtgcggagcgtctccagattttagcgctttcgccctcgacgaggtgagcatgaacaaggtgacggagaagacacatcgcgtgctacgcgtgatggaaatcaaagaggccgtttctagtctgccaagctattggagctggctacgaaagacaaaattgcctgagtacactagagaagcactttgcccgcccgcatgcagagggtcaacaaccctctataactgtagcacctgtaaaggcacagaagtgtcttgctggccgcgcaaaaggtgttttcccggttccctgggatcccaagacagcgcccccctgcacttgaggagctttccagcctcgggatgctcagaacctcctgggggagtgcctcctccccctagtaagaaatggcttgtgaaaactctcaaaacaagccaaccacccgctctccgaggcatgcattctcaactgcctcacccactcgaagggaaccagagcgccccctag

SEQ ID NO: 51625 - DNA, 1755 bp, Artificial Sequence
  Description of Artificial Sequence: Synthetic coding sequence
atgcccggccggacctgggagctgtgcctgctgctgctgctgggcttggggctaggctctcaggaggctctgcctcccccgtgcgagtccgaaatctattgccacggtgaacttttgaaccaggtccagatggccaagctctaccaggacgacaaacagtttgtggatatgccactgagtatcgcacccgagcaagtattgcaaacgttcacagaactcagccgagatcataatcattcaatcccgcgcgagcagctgcaggccttcgtgcacgagcacttccaggccaaggggcaggagctccagccctggacacctgcagattggaaggattcccctcagttcctccagaaaatctcagatgccaagctgcgcgcctgggccggccagttgcaccagttatggaaaaagcttggcaaaaaaatgaaaccggaggtgctgtcccacccggagcggttctccctgatctactcggagcacccctttattgtgccaggaggccgctttgttgagttctactactgggactcttattgggtcatggagggcctgctgttgtcggagatggccgagacagttaaggggatgctgcaaaatttcctcgacctcgtgaaaacttacggccacgttcctaacgggggccgagtgtactatttgcagaggtcccaacctcctctgctgacattaatgatggattgttacttaacccacacgaacgacactgccttcttgcaagaaaacattgaaacccttgctctggagcttgatttctggactaagaatcgtaccgtctccgtcagcctggagggcaagaactatctgctgaatcggtattacgtgccttacggtggacctagacccgagtcttacagcaaggacgtggaactggctgacaccctgcccgagggggacagggaggccctgtgggcagaacttaaagctggcgctgagtccggttgggacttttcatccaggtggttaattggggggccaaacccaaacagcctgagcggcatccgcactagcaagctggtgcccgtagaccttaacgcgtttctgtgccaggcagaagagctgatgtctaacttttactcaagacttgcagggaacgatagccaagccactaaataccgcatactgagaagccagaggttggccgccctaaacaccgtcttatgggacgagcagaccggcgcttggttcgactatgatctggagaagaaaaagaagaatagggagttttacccatcaaatctcacccctctgtgggccggctgcttctccgaccccggtgttgccgacaaggcgctgaagtacttggaggacaacagaatcctcacataccagtacggcatcccaaccagtttacagaagaccgggcagcaatgggattttccaaatgcttgggctcccctgcaagacctagtgatccgagggctggctaaagcccctctcaggcgagcccaggaagttgcattccagttggcacagaactggattcggaccaattttgatgtgtattctcagaagtctgccatgtatgagaagtacgacgtgtcaaacgggggccagcctgggggcggaggggaatacgaggtgcaggagggatttggctggactaatggggtggtccttatgctgttggataggtacggggaccggctcaccagtggagctaaactggcattcctggagccacactgcctcgctgctacgctgctcccctccctgctgttatctctgctgccatggtag

SEQ ID NO: 51626 - DNA, 2715 bp, Artificial Sequence
  Description of Artificial Sequence: Synthetic coding sequence
atgccccagctgctgcggaacgtgctgtgcgtgatcgagaccttccataagtacgcatccgaagattcaaacggggccaccctgacaggacgggaacttaagcagttaatccagggcgagtttggagacttcttccaaccatgtgtgctccatgcggttgagaagaactctaatctgctaaacatcgactcaaacgggatcatttccttcgatgagtttgtgctagcgattttcaacctgctgaacctttgttacttggatatcaaatctctgctctcctctgaattgcgtcaggtgactaagccagaaaaggaaaaactagacgacgtagatgtgcaggccactactggcgatggccagtggacagtgggcacatcccctacacaagagaagagaatgctgcccagcggcatggcatcaagttcccaactcattcccgaagagagtggtgccgtgggaaacaatcgagtcgatccatggcgtgaagccaagacccataactttccaggggaagcttccgagcacaatgacccgaaaaataagcaccttgaaggcgatgagcaatcacaggaggtggcccaggatatccagaccactgaagataatgagggacagttaaagaccaataaaccaatggccggatccaagaagactagttcacctacagagcggaagggtcaggacaaggaaatctctcaagagggagatgaaccagcacgagagcagtctgtgagcaaaattagagatcaattcggggagcaggaagggaatttggctacccaatccagcccacctaaggaagccacccagcggccctgcgaggaccaggaggtaagaacagaaaaagaaaagcactccaatatccaagaaccgcctctccagcgcgaagatgagccctcttcacagcacgcagatctaccagagcaggctgcggctcgctcccccagccagacccaaaagagtaccgacagcaaggatgtttgtcgcatgtttgatactcaggagcctggcaaggacgcggaccagacgcccgctaagacaaaaaatctgggcgagccagaggactatgggcggaccagtgaaacacaggagaaggagtgcgagacaaaagatctcccagtacagtacggatctaggaatggaagtgagacaagtgacatgagagacgagagaaaggagaggcgcggccctgaggctcacggtactgcaggtcagaaagaaagagatagaaagacaaggccactggttctagagacccagacacaggatgggaagtatcaggaactgcaaggactgtctaaaagcaaagacgccgaaaagggaagcgaaactcagtacctaagctccgaggggggtgatcagacacaccctgagctggaagggacggccgtgtccggggaggaggccgagcatactaaggagggcacggccgaggcattcgtgaactcaaaaaacgccccagcggccgagcgcaccctcggggcgcgggaaaggacacaggacttggcacccctagagaagcagtcagtaggagaaaacactcgcgtgaccaagacgcacgaccagcccgtggaagaggaggatggctatcagggcgaagacccggaatcacctttcacacagagcgatgagggctcgtccgaaactcccaactccctcgccagcgaggaaggaaatagttcctccgagaccggtgagttaccggtgcaaggtgacagccagtcccagggggatcaacacggagaaagcgtgcagggaggccacaataataacccggatacccagcggcagggcacaccgggcgaaaagaatcgcgccctggaggctgtcgtgcctgctgtcaggggagaagacgtgcagttaaccgaggaccaggaacagcctgctagaggagagcacaaaaaccaaggccctggcactaagggtcccggagctgccgttgaaccaaacggccaccctgaggcccaggagagcacagccggggatgagaataggaagtccttagaaatagaaatcaccggcgcccttgacgaggattttaccgaccagctctcactaatgcagctgcccggtaagggcgatagccgaaacgaacttaaggtgcagggaccatcctccaaggaagagaaaggccgcgctacagaggcccaaaatactctgctcgagtctctggacgaggacaattctgcttcccttaagattcagttagagacaaaggaacccgtcacttcggaggaagaggacgaaagccctcaagagctcgccggcgaaggaggagaccagaaaagccctgccaaaaaggaacacaatagcagtgtaccgtggtcgtccctggaaaagcagatgcagcgtgaccaagaaccctgtagtgtggaacgaggcgctgtatacagttctcccctataccagtatctgcaggaaaagatcctccagcagacaaacgtgacccaggaggagcatcaaaaacaggtccaaattgctcaagcctcaggccctgagctctgtagcgtgtcactgaccagtgagatttcggactgttcggtgtttttcaattatagccaggccagtcagccctatactcggggccttcctctcgacgagtcaccggctggggcacaggagacccctgccccacaagctctcgaggataagcaaggacaccctcagcgcgagaggctcgtgttacagagagaggccagtacaacaaagcagtag

SEQ ID NO: 51627 - DNA, 1248 bp, Artificial Sequence
  Description of Artificial Sequence: Synthetic coding sequence
gagatcgccaagcagctgcaggccgtgaagcggaagatccgggacgaaagtctttgccctcagcaccacgaggctctttccttattctgttacgaggaccaagaggccgtttgcttgatttgcgccatttcgcacactcatcgggcacacactgtcgtgcctttagacgacgccacacaggaatataaggagaagttgcaaaagtgcttggagcccttagaacaaaagctgcaggagattacccgctgcaagagctccgaagagaagaaacctggcgaacttaagaggctcgtggagagcaggaggcagcagatcttgagggagtttgaggagctgcatcgccgacttgacgaagaacagcaagttctgctctccaggttagaggaggaggaacaagatatcctgcagcgtctgcgtgaaaatgccgcccacctgggggacaaacgccgcgatctggcgcacctggctgcagaagtcgaagggaagtgcctgcagagcggattcgaaatgctgaaggatgtgaagtctactctcgaaaaatgcgaaaaggtcaagacgatggaagttacttcagtaagcattgaactagaaaaaaatttttcaaacttccctcggcaatacttcgcccttcggaaaatcctcaaacagctgatcgcagatgtcacactggatccagaaaccgctcaccctaatctggttttaagcgaagataggaaatctgtgaaatttgtcgaaacgcgactgcgggatctcccagataccccacggcgttttacattctatccttgtgtgctagccaccgaaggattcactagcggccggcattactgggaggtggaagcagcgcactgcgtgctcgcacaagatcccgaaaatcaggcacttgccaggttctactgttacaccgaacggacaattgcgaagcgcctggtgctgaggcgcgatccttcggtcaagaggactctttgcaggggttgcagcagcctgctggtacctgggctgacctgcacacagcgccagcggcggtgtaggggccagcggtggacagtccaaacatgtcttacatgccaacgttcccagagattcctgaacgacccgggtcacttactgtggggcgataggccagaggcccagctgggaagccaggccgatagcaaaccactccagccccttcctaataccgcccattccatatctgacagactccctgaggaaaaaatgcaaacccagggtagttcaaatcagtag

SEQ ID NO: 51628 - DNA, 1602 bp, Artificial Sequence
  Description of Artificial Sequence: Synthetic coding sequence
atggaggagaagggcagcaagcggggcctggaggccgccggcaaggccggtctggccactgccggccctggcttgctgccccgaaaacctcctggtcttgccgcggggcctgccggaacatatggaaaggcagtgtcacctcccccttctcccagggcaagccctgttgccgctttgaaggccaaagtcatacagaaactggaggacgtatcaaagccgccagcttacgcctacccagcgaccccttcctcgcaccctacctcgccaccccccgcctcccctccaccaactccagggatcacccggaaggaagaagcacctgagaacgttgtggaaaaaaaagacctggagctcgagaaggaggccccctcaccatttcaggctctctttagcgacattcctcccagatatccattccaggctctgcctccacactatggtcggccctatccctttctgttgcagcccacagccgcggccgatgctgacggtttggcccctgatgtgcccctgccggccgatggccctgagcgccttgcactatctcccgaagacaaacctatacggttaagcccttctaaaattactgagcctttgagggaagggccagaggaggaacctctggcagagcgggaagtgaaagccgaggttgaggatatggacgagggccccacagagcttccacccctggagtcgcctctgcccctgcctgctgccgaagcaatggccacccccagtccggccggcggttgcggcggcggtctacttgaggcccaagccctttccgcgaccggccagtcctgtgctgagcccagcgaatgtcccgacttcgtggagggacctgagccacgagtagattccccaggtagaacagaaccatgcactgccgctctggatttgggggttcagctaacgcccgaaaccctcgtggaggcaaaagaggaaccagtcgaggtgccggtagccgttcccgtggtagaagctgtgcccgaagaagggctagcccaggtcgcgcccagcgaaagtcaacccactctggaaatgtctgattgtgatgttccagctggagaagggcaatgcccctcactcgagccccaagaggccgtacccgtgctgggttccacttgcttcctggaggaggcctcaagcgaccagttcctgccctctctggaggaccctctagctggcatgaatgccctggccgctgcagccgagctaccccaggctcgccccctgccttctcctggtgcggccggggcacaggctttggagaagctagaagctgccgaatcgcttgtcctggaacagtcctttttacacggcatcaccctgctctccgaaatcgccgaacttgagctggagagacgctctccaccgcagggtttgcctccttgtatggggcaaggcagcccaatgcccgctggtctgcctgactgtgctaggggtcccgcgcccactttgtctggctggcctcggctcggggaacagtccagagtcggccttcagccaggcgtgagtgtgaagggaacccggtggagaggccctggaacagggcctccatggagtaagccgagccactaccggaaacctcagtggtgttag

SEQ ID NO: 51629 - DNA, 8907 bp, Artificial Sequence
  Description of Artificial Sequence: Synthetic coding sequence
atggacggccgggacttcggcccccagcggagcgtgcacggccccccacctcctctgctttctggacttgccatggattctcacagggtcggcgctgctaccgcgggccggctccccgcttctgggctccccggccccctgccaccaggaaagtatatggccgggctcaatctccatcctcatcccggagaagcattcctggggtcctttgtggcctcgggaatgggtccaagtgcctctagtcatggctctccagtacctctgcccagcgacttgtcgttcagatcacccacgccatcaaacctccctatggttcagctgtgggccgcacatgctcacgaaggttttagtcatttacctagcggcttgtacccgtcctacctgcacttgaaccacctcgaacctcccagcagcggcagccctctgctcagccagttaggccaaccttctatttttgacacacaaaagggccagggacctggcggcgatggcttttatttaccaaccgccggagcccccggctccttacattcccacgccccttccgctcgtacccctggaggtggccacagttctggggcccccgctaaaggttcatccagccgcgatggcccagccaaggagcgtgctggcaggggcggcgagccacccccactcttcggcaaaaaagaccctagagctcgaggagaagaggcatcaggacctcgcggggtggtagacctgacacaggaagcacgagcggagggccgtcaggatagagggccaccaaggcttgccgagaggctctccccttttctcgcggaatcaaagaccaaaaatgctgccttgcaaccatctgttttgaccatgtgtaacgggggggctggtgatgtcggcctccccgctctagttgccgaggccggccgggggggggcaaaagaggccgcccgccaagacgaaggggcacgtttactgcgtaggaccgagactctcctgcctggacccaggccctgtccctccccacttcctccgccgcctgccccacccaagggcccccctgcgccaccggcagctacaccagccggggtgtacactgtgtttagagagcaagggcgagagcatcgggttgtggccccaacttttgtgcccagcgtcgaagccttcgatgaacgcccaggtcctatccagatcgcaagccaggcaagggacgctagggcacgcgaaagggaggcagggcgaccaggcgtcctgcaggctccgcctggcagtccccgacctttagacaggcccgagggcctgcgcgaaaaaaattccgttattcgaagcctgaaaaggccaccacccgctgacgctcctaccgtcagggcaacacgcgcctcccccgatccgcgagcatacgtaccagctaaagaacttcttaagccagaggccgaccctagaccctgtgagagagcaccaaggggcccagccggccccgccgcccagcaggcagcaaaactctttgggctggaaccaggcaggccgccaccaaccggccccgagcacaaatggaaaccttttgaactgggtaatttcgctgctacccagatggctgttcttgcggcacagcaccaccactcgagggcggaggaagaggctgcagttgttgccgcctcgtcaagcaaaaaggcctatctcgacccaggagcagtgttgcctcgttctgccgcgacttgcgggcggccggttgctgacatgcactccgccgcacacggctctggcgaagccagcgcgatgcagagtcttataaagtatagcggaagttttgccagagatgcagtggccgtcagaccaggtggctgcggtaaaaagtccccattcggtggcctcgggaccatgaagccggaacccgcacccacaagcgccggtgcatccagggcccaggccaggctcccacactcgggtggaccggcagcaggcggaggccgacagctcaaacgggaccctgaacgccctgaatcagccaaagccttcggccgagagggcagcggcgcacaaggcgaagccgaggtgcggcaccctcctgtgggcatcgcggtggctgtcgctaggcaaaaggacagtggcgggtcagggcggttaggaccggggctcgtggatcaggagaggagcctgagcttgtcaaacgtcaagggacatggcagagccgacgaggattgcgtggatgatagggctcgccatagagaggagcggctgctaggtgcgcgtttagatagggatcaggagaagctgctccgagagagcaaagagttggctgacttggcccggctacacccgacatcttgtgctcctaatggattgaatccgaacctgatggtcactggtggaccagctctcgcaggcagcgggagatggtcggctgatccggccgcacatcttgctacacacccctggctacctagaagtggcaatgcctctatgtggcttgccggccatccctacgggttagggccccctagcctgcaccaggggatggcccctgctttcccccccgggctcggaggatcacttcctagcgcctaccagttcgtgcgggacccccaatcaggtcagctcgtggtcatccctagcgaccatttgcctcacttcgccgagttaatggagagagcaacagttccacctctgtggccagcactttatcctccggggcgatcaccactgcaccatgctcagcagttgcagctgttcagccagcaacacttcctccgacagcaggagtttttgtaccttcagcagcaggccgcccaggccttggagctccagcggagcgcgcaactggtgcaggagcgccttaaagcgcaagagcacagggccgagatggaggagaaggggtcgaaacggggacttgaagcagccggtaaggctggcctagctacagcggggcccggactcctcccaagaaaacccccgggacttgcggccggacctgccggcacctacggaaaggctgtaagcccaccaccatcaccaagagcatcccctgttgcagccttaaaggccaaggtaattcaaaaacttgaagacgttagcaagcctcctgcctatgcatatccggccacaccgtcctcccacccaacttctcctcctcctgcctctccaccgcccactccgggaatcaccagaaaggaggaggcacctgagaacgtggtggaaaagaaagacttggaactcgagaaggaggccccctccccctttcaagctcttttcagtgatatccccccgagatacccatttcaggctctgccaccccattatggcagaccgtatcctttccttctgcagccaacagcagccgccgacgctgatgggttggcccctgacgtgcctctgccagcagacgggccagagcggctggccctctctcccgaggacaagcccatccgactgagcccgtcgaagattacagagcccctaagagaaggacctgaagaagagccattggccgaaagggaggtgaaagcagaggtggaagacatggacgagggaccgaccgaactgccacctctggagagtccattgccgctgccagccgcggaggcaatggccacccctagtccagccggaggatgcggcggaggactgctcgaagcacaggccctttcggcaacaggtcagagctgtgctgagccctcggagtgccccgacttcgtagagggccctgagccccgggtagacagtccagggaggactgagccctgtacagctgcactggacctcggggtccagttgacacccgagaccctggtggaggccaaggaggagcctgtggaagtccccgtcgccgtccctgtggtagaggcagtccctgaggaaggcctggcccaggtcgcaccgtcagaaagccagccaaccctggagatgtcggactgtgacgtgcccgccggggaaggccagtgtccgagcttggaaccacaggaggccgtccccgtgctgggtagtacttgtttcctcgaggaggcgtccagcgatcagtttctgccgtccttggaggaccccttagctggaatgaatgcactcgcagctgcagcagaactcccccaggctaggcccctgcccagccccggggcggctggggcccaggcgctggaaaagcttgaagccgctgaatcattggtactggagcagagctttctgcacggcatcacacttctctctgagatagctgaactggaattagaaaggagatctcaggaaatgggtggagccgagcgagccctggtggctagaccatcactcgagtccctgctggctgcaggttcccacatgctcagagaggttctggacggcccagttgtcgatcccctgaagaacctgcgattacctcgggagctgaagcccaataaaaaatatagctggatgcgcaaaaaagaagaacgaatgtacgcaatgaagtcatcacttgaagatatggacgccctcgaattggactttcgcatgaggctagccgaggtccagcgacagtataaggagaagcagcgagaactggtcaagttgcagcgaagacgagactcagaagaccgtcgcgaggaaccccaccggtcactagcccggcgcggacccggaagaccccgtaaacgtactcatgctccgtctgctctgtcaccccccagaaagaggggcaaaagcggacactcctctggaaaactttccagcaagtcccttttaacttccgacgattatgagctgggcgcgggtatacggaaacgccataaaggaagtgaggaagagcacgatgccctcatcggtatggggaaggctcggggccggaaccagacgtgggacgaacacgaggcctctagcgactttatcagtcagttgaagattaaaaaaaagaagatggccagcgaccaagaacagttagcatctaaactggataaagcattatcactgactaaacaggataaactcaagtccccattcaaattttccgactccgccgggggcaaatctaaaacatctggggggtgtggccgctacttaacaccatacgactcactcctgggcaaaaacagaaaggcactcgcgaaaggcctcggacttagcctgaagtctagcagggaaggcaagcataaacgagctgccaagactcgcaaaatggaggttgggtttaaggcgagggggcaaccgaaaagtgctcattctcccttcgccagtgaggtttcatcgtatagctacaataccgatagcgaggaggacgaggagtttctgaaggatgagtggcccgcccagggtcccagctcgtcaaaattaacccccagcctcttgtgctcgatggtggccaaaaattcaaaggccgctggtggcccaaaactgacgaagagggggctcgctgcccctcgcacacttaagcctaagcccgcaacttcccgaaaacagcctttttgcctgcttctcagagaggcagaggccaggtccagttttagtgattcttcagaggagtctttcgatcaggatgaatcgtcggaagaggaggacgaggaagaggaactagaggaagaggacgaagcatccggcggcggttatcgcctgggagctagggaacgggccctttcgcccggcctcgaggagagcggcctcggtctgttagctcggttcgccgcctccgctttaccttctcctaccgttggcccctccctaagcgtggtacagctggaggctaaacagaaggccagaaagaaagaggaacggcaatccttgttgggcacggagttcgagtacacagatagcgagtccgaagtgaaagtgaggaaacgaagtccagccggattgctgagacccaagaagggcctaggcgaaccgggcccgagtttggcagcacccacgccaggggctagaggaccagatcccagctcccccgacaaggccaaacttgcagtagaaaagggacgtaaggcgaggaagctcaggggtcctaaagagccaggcttcgaggctggaccggaggctagcgatgacgacctttggacacggagaagatccgagcggatcttcctgcatgacgctagcgctgccgcccccgctccggtaagcaccgcgcccgcaacgaagacaagccggtgcgccaagggaggacctctttccccaaggaaggacgcaggcagagccaaagataggaaagacccaagaaaaaagaaaaaaggaaaggaggctggccccggagccggattacctcccccccgggcgccagccctgccaagtgaagcccgcgccccccacgcctctagtctcacagcagctaaacgctcaaaagctaaagccaaaggcaaagaggtgaaaaaggagaacagaggcaaaggcggcgctgtgtcaaagctgatggagagcatggctgcggaggaggatttcgagcctaaccaggacagctcattctccgaggatgaacatctaccaaggggcggggctgtggaacgcccactaactcctgctccaaggtcctgtataatcgacaaagacgagctcaaggatggactacgggtcctgatcccaatggatgacaagctcctctacgctggacacgttcagaccgtgcacagtcctgatatttatcgggtggtggtggaaggcgagcgcggtaaccgtccccacatttactgtctcgaacagctcctgcaggaggccataatcgatgtcaggccagccagcactcgatttttgcctcagggaaccaggatagctgcctactggagccaacaatacaggtgtttgtaccccgggacagtcgtgcgggggctcctggacctcgaggacgacggagatttaattactgtggagttcgatgacggtgacaccggaaggattcctcttagtcatatcaggctactccctccggactacaaaatccagtgcgctgaaccaagtcctgccctgctggtgccatccgcaaagagaaggagcagaaaaacctctaaagacaccggagaagggaaggacgggggaaccgccggcagcgaggaaccgggcgcgaaggcgagaggacgcggtagaaaacccagcgccaaggcaaaaggcgggcgcgccgcgacactagaggaaggaaaccccacagacgaggttccctcaacaccactggctctcgaaccatcatcaactcccggttctaaaaagagtcctcctgagcccgtcgataaacgtgccaaagcccctaaggcacgtcccgctccccctcagccctctcccgctcccccagctttcacaagctgtcctgcacccgagcccttcgcggagctacccgcaccagctacatctctggcccccgcacctctcataacaatgcccgctacgagacctaaacctaagaaagcaagagcggctgaagaaagcggagccaaaggcccacgaaggcccggagaggaagccgagctgctcgtgaaactcgaccatgaaggcgtcacgtctccaaagagcaaaaaagctaaggaggccctgctcctgcgagaggatcccggtgctgggggctggcaagagcctaaatcactgcttagccttgggagttaccctccggcagcagggagctccgaaccaaaagccccctggcctaaagcgaccgacggggatctggcgcaggaacctgggccgggccttacctttgaagactccggcaatcccaagagccccgacaaggctcaggccgaacaagatggagctgaggagtctgagtccagttcaagctcttcttcaggatctagttcctcatccagcagtagttcatcctctggaagcgagaccgagggggaagaagaaggggacaagaacggagacggaggctgtggcacaggaggtcgcaattgtagtgccgcctcgagtagggcagcaagtccagcatcttctagcagttcatcctcctcatcaagcagcagctcgagttccagttcctcatcttcctcctctagtagcagctcttccagcagcagctcctcgagcagcagtagtagcagctcatcctcatcaagtagcagctcatcttcctcttcttcttcaagctctagctctagcagcacaactgatgaggactccagttgcagctcagatgacgaggccgcacctgctccgaccgcaggcccctctgcccaggctgcactgcccacgaaggcaaccaaacaggcgggaaaagcccgaccgtctgcccactctccagggaagaagacgcccgcaccacaaccgcaggcccctcctccccagcccactcagccactgcaacccaaggcccaggccggcgcgaagtccagacctaaaaaaagagaaggggttcatttacctacgacaaaggaattggctaaacggcagcgcctcccgtctgtggaaaaccgacccaagatcgcggcctttctgcccgccaggcagttgtggaagtggtttgggaaaccaacacagcggcgcggaatgaaggggaaggcccgcaagctgttttacaaggcgattgtgagaggtaaagaaatgattcgcattggagattgtgctgtgttcctgtctgctggccgccccaatctcccatacattggcagaattcaatccatgtgggagtcatgggggaacaatatggtggttagggtgaagtggttctatcaccctgaagagacctcaccgggcaagcaattccatcagggccaacactgggaccagaaaagctcgagaagtcttccagccgctctcagggtgagcagccagaggaaggatttcatggaaagagccctctaccaatcatcccatgtggacgagaatgatgtgcaaactgtctctcacaaatgccttgtggtcggcttggagcagtatgaacagatgttaaagaccaagaagtaccaggattccgaaggactgtactaccttgccggcacttatgaaccaaccaccgggatgatcttctctaccgacggggtgcctgttctctgctag

SEQ ID NO: 51630 - DNA, 3939 bp, Artificial Sequence
  Description of Artificial Sequence: Synthetic coding sequence
atggaggagaagggcagcaagcggggcctggaggccgccggcaaggccggcctggcaactgccggacccggcctgttgccacggaaaccaccagggcttgctgcaggcccagccggcacttatgggaaggcagtgtcacctccaccatccccaagagcctcacctgtggccgcccttaaggccaaggtgatacagaaactggaggatgtttccaaaccacctgcttatgcttaccccgcgacaccttcttctcacccaacctctcctccccctgcttctcctccacccacaccagggattacgcggaaagaggaagcaccagaaaacgtggtcgaaaagaaggatctggagttggagaaggaagccccttcaccatttcaggctttgtttagcgacatccctcctcgttacccatttcaggcacttcccccgcactatggtcgaccttatccttttctgctgcagccaactgccgcagccgacgctgatgggcttgctccagacgtcccgctgcctgccgacggtcccgaacgcttggcactctcgcccgaagacaagccaattcgcctctctcctagcaaaattacagagccgctgagggagggaccagaggaggaaccccttgcagagagggaggtgaaggcggaagtcgaggacatggacgagggtccaaccgagctcccaccattggagtctccactacctctgccggccgccgaggcaatggcgacaccatccccagctggcggctgtggcggcggtctactagaggcccaggctctctctgctactggccagtcatgcgcagagcctagtgagtgccctgatttcgtggagggtcctgagccacgcgtcgatagtcccggtcgcacggaaccctgcaccgcggcgctcgatcttggggtccagttgaccccagagacccttgtcgaggcgaaagaagagcctgtagaggttcccgttgccgtgccagtagtcgaggctgttcctgaggagggtctggcgcaagtggctcccagtgaatcacaacctaccctggagatgtccgattgcgacgttcccgctggggaaggacagtgtccttctctggagccccaggaggctgtgccagtcctcggtagcacttgtttcctggaagaggcatctagcgatcagtttctacctagtctagaagacccgctggctggtatgaatgccctggcagccgccgccgagctgccccaggcccgaccccttccttcgcctggagccgctggggcacaggctttggaaaaacttgaggccgcggaaagcctcgtgctggaacaatcatttctgcacggaattaccctcctgtccgagatagctgagctggagttagagaggagatcgcaagagatgggcggggcagagcgggcactggtggctcgcccctcgttggagtccctgttggctgcagggtcacacatgctgcgcgaagttttggacggccctgtggtcgacccccttaagaatctgcggctccctcgcgaactgaaacctaataaaaagtacagctggatgcgaaagaaggaagaacggatgtatgccatgaagtcctctctggaagacatggatgctttagaactcgattttagaatgcgcctggccgaggtacagaggcagtataaagagaaacaacgcgagctggtgaagttgcaaaggagaagggatagcgaagaccgcagggaagaacctcacagatcgctggctcgtcggggccccgggagaccccgtaaaaggacgcatgcaccctcagccttgagccctccaagaaagaggggtaaatccggacattcctctggcaaactcagttctaaaagcttgctcacatcggatgattacgagttaggagccggcatcagaaagaggcacaaaggctcggaggaggaacacgacgcactgatcggcatggggaaagctcgtggccgcaatcaaacatgggatgagcacgaagccagctctgacttcattagtcagctgaagattaaaaaaaaaaaaatggctagtgaccaggaacagctggcttctaagctggataaagccctgtctctgactaaacaggataagctaaaaagcccctttaagttttccgacagcgcaggcggcaagtccaaaacatccggaggctgcgggcggtacctgactccatacgacagcctgctaggaaaaaatcgcaaagcgctggcaaaggggctgggactctccctgaaatcgtctcgtgaaggcaagcacaaaagagccgcaaaaactaggaaaatggaggtaggctttaaagccagggggcaaccaaagtctgcccatagtcctttcgcgagcgaagtgtctagttatagctacaacacagattccgaggaagacgaggagttcctgaaggatgaatggcccgctcaggggccctcctccagcaaattaacgccttcccttctctgttctatggtggctaagaactctaaagctgctgggggaccaaagcttacaaagagggggctggctgctcctcgtacactcaaacccaagcccgcgaccagtcgaaagcagcccttttgcttgttgctcagagaggctgaagccagaagcagtttttcagatagcagcgaggagtctttcgatcaggatgaatctagtgaagaagaagacgaggaagaagaactggaggaggaagacgaggcatctggcgggggctataggctcggagcacgagaacgtgccctttctccaggactggaagagagcggcctgggcctccttgctaggtttgccgccagcgcattaccgagtcctaccgtgggacccagcctctcagtggtccagctggaggctaagcagaaggcccgcaagaaggaagaaaggcagagcctactgggaaccgaattcgagtacacagactctgaaagcgaagtgaaagtgagaaaacgtagtccagcaggactcctcaggcccaagaaggggctcggagaacccggacctagtttagctgcaccaaccccaggtgcgcgcggccctgatccttcttcccccgataaggcgaaattagcagtggagaaggggagaaaggctcggaaactgcgcggccccaaggaaccggggtttgaagccgggccggaagctagtgacgatgatttgtggacgcgccgtcgctctgagcgcatctttctgcacgacgccagtgccgctgctcccgcaccggtcagtaccgccccagccaccaagacatctagatgtgcaaaaggcgggcccttgtcaccaagaaaggacgcagggcgggctaaggaccgcaaagacccacggaagaaaaaaaaaggcaaagaggcaggacccggcgcaggcttgccgccgccccgagcacccgctttgccatcagaagcaagagctcctcctccgccccctcccccccccccccctcaccccccgctcccccctccccctttacctccgcccccattaccccttaggctgccccccctgcctcctcctcctctgccacggccccatccacctccgcccccgccgttaccccctctgcttccccctcctcagacgagaacacttcctgcagctagaacaatgcggcaacccccaccacctcgacttgccttgccaaggcgcagaaggagcccgcctcgcccaccaagcagacctgccagaaggggccccagacctactccacaagcccggaggcgtccgcgcccttcgccaagaaggttgctgcgcagcccccattcgctgtgttccccacgcctgaggccaggaccgcgtgctgatccccgccgggagagagcaagcactagcccacccccgcgctcatggccaagcgggtctgcatgccgcccttggcggacaggcccgagatctcccccatcttgtcagccagggagtagtgggagtggcagcgcgtctccccccagtggggtggcttag

SEQ ID NO: 51631 - DNA, 912 bp, Artificial Sequence
  Description of Artificial Sequence: Synthetic coding sequence
atggacggccgggacttcggcccccagcggagcgtgcacggcccccccccccccttgctgagtggcctggccatggatagtcatcgggtaggagctgcgactgccggccggctgccagcaagcggcttgccgggtcctcttccccccgggaaatatatggccggcctgaatctgcatcctcaccctggcaaatgcccagcgccttgcccttccccaccggtgttcccgggccgctctaccagacccggcccaccagtgcacagcagaccgggccttggggacagcccgagcgtggggcatggcggagcgggccgtttgggctcacaaggttgggagactccaggccccggcgcaaaggccgtggaatctgttgcccgcttgggctacctctttcgatctgtcttgggccctcgcgaacccaaggccggagtagtggctcgagcaacaggagccatcccaataccaggggcgccagcagcccgggcttgggctggggtcttcaaaatttgggcccggaaagaacagacaggacccgcaccccgggaaacaccacttccggaactagagtccttcagttggcagactttgctcctcgccctggtaggccctccggggttttgttctcagttgcaccatagtcgtcgtgccggcagcttagcggtcacagaacgcagaggcatgagggaatacgcagggggttgcgggtcgaccgtgacccctgcgttggggccctggccacgcggtggacgtgatgctccattttttcctggccgtactgcggctcttggtacttgcacccctgtggggggacggcgccctagaccatccggcactccctgctttccagcaagaaagcgggtgcgtcgatgtgggagggacacagagaccgggccttctaggtcaagaacgtag

SEQ ID NO: 51632 - DNA, 8907 bp, Artificial Sequence
  Description of Artificial Sequence: Synthetic coding sequence
atggacggccgggacttcggcccccagcggagcgtgcacggcccccctccgccgctcctgtctggtctggcgatggactcccacagggtgggcgctgccaccgcagggagattgcctgcaagtggactccctggtcctctgcctcctggcaaatacatggccggtctgaacctgcacccccatccaggagaagcgtttttgggatcatttgtcgcctctggtatgggccctagcgccagctcccatggctctccagtccctctccccagcgacctgtctttccggtccccgacccccagtaatctgcctatggtgcagctgtgggccgctcatgcccacgaaggtttttcccacctcccgtcggggctttatccaagttacctgcatcttaatcatctggaacctcccagttccggctcaccattgttgagccagctggggcagccatccatcttcgatacacagaagggccagggccccggtggggacgggttctatctccccaccgcaggtgcccctgggtcgttgcattctcacgctccctcagcacgcacacccggcggtggtcactctagcggggcaccggccaagggttcctccagccgagatggacccgcgaaagagagggctggccgggggggggagccccctcctctgtttggcaagaaagatcccagggctaggggtgaggaggctagcggtcctaggggtgtcgttgacctcactcaggaggcccgagctgaaggacggcaagatcgcggaccaccaagattagccgaaaggcttagcccatttttagccgagagcaaaacgaaaaacgccgccctgcagccgtcagtcttgaccatgtgcaacgggggagcgggcgatgttggcttgccagcccttgtggctgaggcagggcggggaggagctaaggaagcagcccgccaggacgagggcgctaggctattacggcgcactgaaacgttgttgcctggaccacgaccttgcccctcaccgttaccgccacctcccgcaccacccaaaggccctcctgcccctccagctgcaacccctgccggcgtgtatactgtgtttagggagcaaggccgcgaacaccgagttgttgctcccacattcgtgcctagcgtagaagccttcgacgagcggccaggccccattcaaatcgcaagccaagccagagacgcgcgggctcgagagcgggaagcaggtaggccaggagtgctccaggccccgcctggaagccccaggcctcttgatcgacccgaggggctacgcgaaaaaaactctgtgattcgctccctgaagagaccaccgcccgccgatgcaccaacagtgcgtgctacacgggcctccccagatcccagggcttacgttcccgctaaggagcttttaaagccagaagccgaccctcgaccgtgcgagcgggcgcctaggggcccagccggaccggccgcgcagcaggccgcaaagctgttcggcctggagcccggccggcctccgccgacaggacctgagcataagtggaagcctttcgaactcgggaacttcgcggccactcagatggctgttttggccgctcaacaccaccacagtcgggctgaagaggaggcagctgttgttgccgcttcctcatctaaaaaagcatacctggaccctggggccgtgttgccgcggagtgccgctacctgtggccgccccgtcgctgacatgcactcagccgcacatggcagcggggaggccagcgctatgcagtcattgattaagtacagcggctcatttgcccgggatgcagttgctgttcgtccaggaggctgcggaaagaagagtcccttcgggggccttggtacaatgaaacctgagcctgcacccacctccgcaggggcatctcgggcccaggctcgcctgcctcacagcggtggacccgccgccggtggaggccggcagctgaaacgggaccctgagagacccgagagcgccaaagcattcggccgggaggggtctggcgcccaaggcgaagctgaggttcgacaccctccggtaggaattgcagtcgctgtggccaggcaaaaggacagtggggggtcaggccgtctgggtccaggactcgtagaccaagaacggtccctcagcctgtcaaacgtgaagggccacgggcgcgcggacgaagactgtgttgacgatagagccagacaccgagaagagaggctgctaggagcacgtctggaccgagatcaggagaaattgctccgagaatccaaagaactggcagatctcgctcgactccacccaacctcttgcgcaccgaacggccttaaccccaatctcatggttaccggcggtcctgccctggccggctccggaagatggtcagccgacccagcagcacatctcgctactcacccatggcttccaagatcaggaaacgcatccatgtggctggctgggcacccatacggtcttggcccaccaagcctccatcaaggaatggctcccgccttccctccggggctcggcggttcactccctagcgcgtaccagtttgtaagagacccccaaagtggacagttggttgtaatcccctctgaccacctaccccacttcgccgaattaatggagcgagcaacggtcccccctctttggccggctctgtatcctcccggcagatcccctttacaccacgcacaacagctgcaacttttttcacaacagcactttctccgacagcaagagttcttgtatctgcaacagcaggcagcccaggcactggagctccaacgaagtgcccagctagtgcaggaacggttgaaagcgcaagagcaccgggcggaaatggaagagaaaggctccaagcgcggactggaagcggctgggaaggctggcctggcaaccgctgggccgggcctgctgcctcgcaagcctccgggactcgctgcgggaccagcgggaacttacggcaaggcggtctctcctcccccctctcctcgggcttcgccagttgctgccctgaaggccaaggtcatacaaaaactggaggacgtgtccaaaccaccagcatacgcctacccagcgactccttcctctcaccctacctccccaccgcccgcctctccacctccgacccccggcattacccgtaaggaggaagcccccgagaatgttgtagagaagaaggatctggagctggaaaaagaggccccctccccatttcaagcactcttcagcgatatacccccgcgttatccttttcaggcactgccccctcattatggccggccctaccctttcctcctgcagcctaccgccgccgctgatgctgacggcttagctcccgatgtgcccctgccagctgacgggcccgagcgtctagcactgtcacccgaagacaaacctattagacttagtccatctaaaataacagaacccctgcgcgaaggacctgaggaggagccgctggctgagagggaggtgaaggccgaggtcgaagacatggacgagggaccaaccgagctgcctcccctcgagtcgcctctgcccctacccgcggcagaagctatggccactccttctcctgccggcggctgtggcgggggcctcttggaggcacaggcccttagtgccaccggacaaagctgcgcagagccgagtgaatgccccgatttcgtggagggccctgaaccaagggttgacagtcctggccgcactgaaccttgtactgccgcgttagatctgggagtgcaactgacccctgaaaccctcgtcgaggctaaagaggagccagttgaagtccctgtggccgtgccggtggtagaagcagtccctgaggagggacttgcccaggtcgcccctagcgagagccagcccacccttgagatgtcagactgcgatgtgccagccggcgaaggacagtgtccttctctcgagccgcaggaggcagttccagttctggggtcgacctgcttccttgaagaggcctctagcgaccagtttctgccctccctggaagatcctcttgcgggtatgaatgccctcgcagcagctgcagagcttcctcaagcacgacctctgccctcacccggggcagcaggggctcaggcactggagaaactggaagccgcagaaagcctggtccttgaacagagctttctccacggcattactttgctgagtgagattgccgagctggaactggagcgccgatcccaagaaatgggcggcgcagagcgcgcgctggtggcacgccccagtctggaatcattactggcagccggatcccacatgctgcgagaagtactcgacggaccggtcgtcgatcctctgaaaaaccttcgtctgcccagagaactgaagccaaacaagaagtactcctggatgagaaagaaggaggaaagaatgtacgcgatgaaaagcagtctggaagatatggacgcacttgagttggatttccgtatgaggctagctgaggtgcaacgacagtacaaagagaagcagagagaactggtcaagctccaacgacgccgcgatagcgaagaccggcgggaggagccccacagatctctggcgcggaggggcccaggcaggccccggaaaagaacccatgcccccagtgcattgagccctcccagaaagcgaggcaaatccggacactcttctggaaagcttagcagtaagagtctgctcacatctgacgactacgagctgggcgcaggcattaggaaaaggcacaagggcagtgaggaggagcacgacgctctcattggtatgggaaaggctagaggcaggaatcagacttgggatgagcatgaggcctctagcgattttatcagccagctgaagatcaagaagaagaagatggcctcagaccaagagcagctggcttccaagctggataaagccctctctctgaccaaacaggataaactgaagtccccattcaagttctccgactctgccggcggaaagtctaaaacatctggtggatgtgggaggtatttgacaccctacgattcactcctgggcaagaaccggaaagccttggcgaagggactaggcctttcactcaaatcttcaagagagggcaaacataaacgagctgctaagactcgcaaaatggaagtgggcttcaaagctagagggcaacccaagtcagcccactctccatttgcctcggaagtgtcttcatattcatataatactgactccgaggaggacgaggaatttctcaaggatgagtggcctgctcaggggccatcaagttccaagcttaccccctcactgctctgttccatggtggctaagaatagtaaagccgccggtggccctaaattgaccaagcggggcctagcagccccaaggactctcaagcccaagccagccaccagcaggaaacagcccttctgtctgttactgcgggaagctgaggctcggagctccttctctgacagcagcgaggagtctttcgaccaggacgaatcctctgaagaggaggacgaagaagaagagttggaggaggaggacgaggcgtcggggggtggttataggctgggcgcccgggaacgcgctttatctcctggtctagaggagtccggcctgggattactagctaggttcgccgccagtgcgctgccgtctcccaccgtgggaccctctctgagtgttgtgcagctcgaagccaaacagaaagcccgcaaaaaggaagaaagacagagcctcctgggtaccgagtttgagtatacagactccgagagcgaggtcaaggtgagaaaaagatctccggcaggcctcctgcggcctaaaaagggcttgggagaacccggccctagcttggcagcacctaccccaggcgccagaggacccgatccctcatcaccagataaggccaaattggctgttgagaagggacgtaaagcgcgcaagctcagaggccctaaagagcccggcttcgaggctggaccagaagcctcagacgacgatttgtggacccgccgacgcagcgagagaatatttctccatgatgcttcagccgctgcacctgcccccgtctctaccgcccccgccaccaagacaagccggtgtgcaaaaggaggaccgctcagtcctcgaaaagacgcgggccgggctaaagatcgaaaagatccccgtaaaaagaaaaagggcaaagaagccggtcctggagccggtctgccccccccgagagcgcccgccctgcctagcgaggccagggctccgcacgcctctagtctaacagcggcaaaaaggtccaaggctaaagcgaagggaaaggaagtgaagaaagagaacagaggcaaaggtggcgcagtcagcaaacttatggaatccatggctgccgaggaggatttcgagcccaatcaagactccagtttcagcgaggatgagcatctgccccgcggaggcgctgtggagcgtccattaaccccagcccctagatcgtgcattatcgataaagacgagttaaaggacggcctgcgtgttctgatcccaatggacgataagcttctctacgccgggcacgtgcaaacagtgcattctccagacatctaccgcgtcgtggttgaaggtgaaaggggcaaccgccctcacatttattgcctggagcagctgctccaggaagcaattattgatgttcgtcctgcttccacgcgattcctgccacagggcacaagaattgcagcttactggagccagcagtacagatgcctgtacccaggaaccgtagtgaggggactacttgacttagaagacgatggggatctcattacagttgagtttgatgatggagacaccggcaggatcccactgagccacattcgattactgccacctgattataagattcaatgtgcagagccttctcccgctcttctcgtcccctcagctaagaggagaagccgcaagactagcaaggataccggggaggggaaagacgggggaacggcggggtccgaggaacccggcgcgaaggcaaggggtaggggaagaaagcctagcgccaaagcaaaaggcgacagagcggccactcttgaagagggaaatccgacagatgaggtacccagcacccccctagccctcgaacctagctcaactcctggatccaaaaagtcccctccggagcctgtggataagcgggccaaggcccccaaagcccgccccgctccacctcaaccttctcccgccccccccgcttttacgtcttgtcccgctccagagccctttgctgagttacctgcacctgctacgtccttagcccctgcaccgctgattacaatgccagccactcgacccaagcccaaaaaggctcgggcagctgaggagtcaggcgccaaaggtccacgcaggccaggtgaggaagctgaactgctggttaaactggatcatgagggcgtcacttcccctaagtcaaagaaggctaaagaggcactgctcctccgcgaggatccaggtgccggcggatggcaggagcccaaatcactgctgtcactggggtcttaccctcccgctgccggttcctctgagcccaaggccccttggccaaaggcaaccgatggggatcttgcacaggaacccgggccaggcctgaccttcgaagacagtggcaatcctaaaagcccagataaagcccaggccgagcaggatggtgccgaggagtccgaatcatcatcctcaagtagttctggctcctcgtcgagctcgtcgagctcatctagctccgggtctgaaacggagggagaagaagagggcgacaagaacggtgacggtgggtgtggaacagggggacggaactgcagcgccgcttcttccagagccgcctctcctgcctcaagcagttccagttctagcagcagctccagttcatcttccagttcctcgtcaagctccagctcaagttcatccagctccagcagcagctcaagcagcagctccagctcgtccagcagcagcagtagcagtagctcttcctcttcctcaagttcgagcagcagctcctcttctacaactgatgaggacagcagttgtagcagcgacgacgaagcagcacccgcaccgaccgcagggccctccgctcaagccgctctacccacaaaggccaccaagcaggcggggaaagcccgcccttccgcacattctccagggaagaagacccctgctccccagcctcaggcaccaccgcctcaacctacccagccgctgcagccaaaggcgcaggccggcgcgaagagtcggccaaagaagagagagggcgtccatctgcctactacgaaggagcttgccaaacgccagaggttgccttccgtcgagaaccggcctaaaatcgccgccttccttcccgctagacagctgtggaaatggttcggcaaacctacccagcgacgaggcatgaagggcaaagcaagaaagctgttttacaaagcaatcgtgagaggtaaggagatgatccgaattggagattgcgccgtgttcttgtcagcggggagacctaaccttccttacatcgggagaatacagagtatgtgggagtcttggggaaataatatggtggtgagagtgaaatggttttatcatcctgaggaaacctcacccggaaagcaatttcatcagggccagcactgggatcagaagtcaagcaggagcctgcctgcagcactgagggttagtagccagcggaaagattttatggagagagcgctgtatcagagcagtcacgtcgatgaaaatgatgtacagaccgtaagccataagtgcttggttgtgggccttgagcagtacgaacagatgctgaagactaagaagtatcaggacagtgaaggcctctattatctcgccggaacatacgaaccaacgacaggaatgatcttttcaaccgatggtgtgcccgtactgtgttag

SEQ ID NO: 51633 - DNA, 504 bp, Artificial Sequence
  Description of Artificial Sequence: Synthetic coding sequence
atgatcaaggactgcggcgccacctgggtggtgctgggccacagcgaaaggagacatgtcttcggggaatccgacgagctgatcggccagaaagtggcgcatgctctagcagagggccttggcgtgatagcttgtataggggagaagctggacgagagggaagctgggataacagagaaagtggtgtttgagcagaccaaagtgatcgcagataacgttaaggattggtccaaagttgtgcttgcgtatgaaccggtttgggccatcggaaccggcaagactgccacacctcagcaggcacaggaggtccatgagaaactgagaggctggctgaaatccaatgtgtctgatgcagtcgctcaatctaccagaatcatttatggcggtagcgtgaccggtgccacatgcaaggaacttgccagccagcctgacgtcgacggcttccttgttggaggcgcctctctaaagccggagttcgtggacatcataaatgccaaacagtag

SEQ ID NO: 51634 - DNA, 1398 bp, Artificial Sequence
  Description of Artificial Sequence: Synthetic coding sequence
atgcccgccacccccagcctgaaggtggtgcacgagctgcccgcctgtactctctgtgcaggacctctggaggatgccgtaaccatcccatgcggacatactttctgtagactctgccttccagccctgagccagatgggcgcacaatcaagtggcaaaattctgctctgccctctctgccaagaggaagaacaggcagagacgcccatggcccccgttccactcggccccttaggagaaacgtactgtgaagaacacggggagaagatctactttttctgcgagaatgacgccgagtttctgtgcgtgttctgtagggaggggcccacacatcaggcacacaccgtaggctttctggatgaggccatacaaccctatagggataggctgaggtcacgactagaagctctgtctaccgaaagggatgaaatcgaagatgtaaagtgtcaggaggaccagaagctgcaggtgcttctgacgcaaattgaaagtaaaaaacatcaggtcgaaacagccttcgaacgactccaacaggagctagaacaacagcggtgcttgctcctggcacgcctgagagagctggagcagcagatttggaaggaacgcgacgaatacatcacaaaggtaagcgaagaggtgacccgcctgggggcccaggtcaaagaactggaggagaaatgccagcagccagcatccgagctgctgcaggatgtacgagtgaaccagtccagatgcgagatgaagacatttgtgtccccagaggcaatctcacccgaccttgtgaagaagatccgcgactttcaccggaagatcctgacgctgcctgaaatgatgaggatgttcagcgaaaaccttgcgcatcacttagagattgattctggggtcatcaccctggacccccaaacggccagccggagcctggtcttatccgaggacaggaaaagcgtgaggtacacaagacagaaaaagtcactccccgactcacctttaagattcgatgggttgccggctgtgcttggttttccggggttctcatctgggagacaccgttggcaagtggatcttcaactgggagacggtggcgggtgcactgtgggagtagcaggtgagggggtcaggaggaagggggagatgggtctgtcagccgaggatggagtatgggcagtgatcatttcccaccagcagtgctgggcctccacttctccgggaacagacctgccactgtctgagatacctcggggcgtccgagtggccttagattatgaggccggccaggtcacactgcataatgcacagacccaagaaccgatctttacctttacagcctcattctccgggaaagtgttcccctttttcgctgtgtggaagaagggatcgtgtctgacactgaagggttag

SEQ ID NO: 51635 - DNA, 348 bp, Artificial Sequence
  Description of Artificial Sequence: Synthetic coding sequence
atgcccgccacccccagcctgaaggtggtgcacgagctgcccgcctgtactctctgtgccggacccttggaggatgcagtgaccattccatgtggacacacattttgcagactgtgtctaccagctctgagccaaatgggagcccagtcatccggcaagattctgctgtgccccctgtgtcaggaggaagagcaggccgagactcccatggctcccgtccctctggggccgttgggagagacctattgcgaggaacatggcgagaaaatttacttcttctgcgagaacgatgccgagttcctctgcgtgagtgagtgtaggactactgatggatttggctgtgcatag

SEQ ID NO: 51636 - DNA, 1398 bp, Artificial Sequence
  Description of Artificial Sequence: Synthetic coding sequence
atgcccgccacccccagcctgaaggtggtgcacgagctgcccgcctgcacactctgcgcaggacctcttgaggacgctgtgactattccatgcggccacacattttgtcgtttgtgtctgccagcactgagtcaaatgggggcccaaagttccggcaagattttgctctgccccctctgccaggaggaggagcaggctgagacacccatggccccggtcccactggggcccctgggggagacatactgcgaggaacacggagaaaaaatttattttttttgtgaaaacgatgctgagtttctgtgcgttttctgtagggaggggccaacacatcaggcccatactgtggggtttttggacgaggccatccaaccttaccgcgaccgcttacgctcgcgccttgaggcgctgtcaacagaaagagatgaaatcgaagatgtgaagtgtcaggaggaccagaaactacaggttctcctgactcagattgagtctaaaaagcaccaggtcgagaccgctttcgagcgtctacaacaggaactcgagcaacaacgctgcctgctgctggccaggttgcgcgagttggagcaacaaatctggaaggagagagacgaatatataaccaaagtgtcggaggaggtgacccggcttggcgcacaggtgaaggaactcgaggaaaagtgtcagcagccggcaagcgagttactgcaggacgtccgggtcaatcagtccagatgcgagatgaaaacttttgtctctccagaagctatttcaccagacctcgtgaagaaaattcgcgattttcacaggaaaattctgacattgcctgaaatgatgcgtatgttcagcgaaaatttggcccatcatctggaaattgattctggagtgataacattagatccgcagactgcatcccgcagcctggtcctgtccgaagatcggaaatctgtgagatataccaggcagaagaagtcactcccagactctcccctgagattcgacggattgcccgcagtgctcggatttcctggattttccagtggcaggcatcggtggcaggtcgacctccagctcggagatggaggcgggtgcactgtcggtgtcgcaggcgagggcgtacggcgaaagggggaaatggggctgagcgcagaagacggagtgtgggcggtcataatctctcatcaacagtgctgggcatccacgtcacctggaactgaccttccgctgtcagagatcccacgtggggtaagggtcgccctagattatgaggctggccaggtgaccctgcacaatgcccagacccaggagcccattttcacattcaccgcgagtttttccggcaaagtgtttcctttttttgcagtgtggaagaagggttcctgtcttacacttaagggctag

SEQ ID NO: 51637 - DNA, 1191 bp, Artificial Sequence
  Description of Artificial Sequence: Synthetic coding sequence
atggcccccgtgcccctgggccccctgggcgagacctactgcgaggagcacggtgagaaaatctatttcttctgcgagaacgatgcagaatttctgtgtgtgttctgtagggagggccccacccatcaggcacacacagtgggctttcttgacgaagcgattcagccatacagagaccgcctacggagccgattggaggcattatccactgagagagatgagatcgaggacgtgaaatgtcaggaagaccagaaactgcaggtactccttactcagatcgaaagtaagaaacatcaggttgagacagctttcgagaggctgcagcaggagttagagcagcagcggtgcctcctgctggcccgcttgagagaactggaacagcaaatttggaaagagcgggatgagtacattactaaagtctctgaagaggtgacacgcctgggtgcacaggtcaaagagctcgaggaaaagtgtcagcagcctgcgtcagagctcttgcaagtgattagggagggcctacacggttgtgaaatgaaaactttcgtcagcccagaggcgatcagtccagatctggtgaagaagatccgcgacttccacagaaagatcctgacgctccccgagatgatgcggatgttcagcgaaaacctagcgcaccacctggagattgattccggggtcatcacactagacccccaaacagcgagtagatcactagttctgtccgaagatcggaaatctgtccgctataccaggcaaaagaagtccctgcccgattctccccttaggttcgacgggctgcctgcagtcttggggttccctggcttttcttccgggcggcatcgttggcaggtcgatcttcagcttggtgatgggggtggctgcaccgtaggggttgccggtgaaggtgtgaggaggaaaggcgaaatgggtctttctgctgaggacggggtttgggctgtgatcatttcacaccaacagtgctgggcctcaacttcgccaggcacagatcttcccctttcagagataccaagaggagtgcgcgtggccctggattatgaggctggccaggtcacattgcacaatgcccaaactcaagagccgatctttacctttaccgccagcttctccggaaaggtgtttcccttttttgccgtctggaaaaaggggtcatgcttaacccttaaaggctag

SEQ ID NO: 51638 - DNA, 1398 bp, Artificial Sequence
  Description of Artificial Sequence: Synthetic coding sequence
atgcccgccacccccagcctgaaggtggtgcacgagctgcccgcctgtaccctttgcgcagggcccctggaagacgcagtgacaatcccctgtgggcacactttttgcagactgtgtctgccggccttaagccagatgggtgcccagagcagcggaaaaatcctactgtgtccactatgccaagaggaggaacaagccgagacacctatggccccggtccccctcggaccattgggtgaaacctactgtgaggagcatggcgagaagatttattttttctgcgaaaatgatgcagagttcctatgtgtgttctgccgagagggcccaacacatcaggcgcacacagtgggctttctggacgaggcaattcagccttaccgggacaggttacggagccggctggaggctctctctactgagcgggacgagatagaggacgtgaaatgtcaggaagaccaaaagcttcaggtccttctcacccaaatcgagagtaaaaaacaccaggtggaaactgcattcgaaagactgcagcaggagctggaacaacagcgttgtttattgcttgcgagattgagggaacttgaacagcagatctggaaagaacgggacgagtacattaccaaggttagcgaggaggtgacacgcctgggcgcacaagtaaaggagttggaagaaaagtgccagcagcccgcttccgagcttctccaagacgtgagggtaaaccaaagcagatgtgaaatgaagaccttcgtcagccctgaggcaatcagtcctgacctggtgaagaagatacgggatttccaccgcaaaatactgacactacccgaaatgatgcggatgttttcagagaatctggctcaccacctagagatagacagcggcgtgatcacacttgatcctcagactgcctcacgaagtctggtgctgtcagaggatcggaaatcagtcagatacacaaggcagaagaagtctctgcctgattcgccgctccggtttgacggactccctgctgtactggggttccccgggtttagctccgggcggcaccggtggcaggtagatctgcagctgggcgacggtggtgggtgtaccgtgggggtggctggggaaggcgtccgacggaaaggggagatggggctgtctgctgaagacggtgtatgggctgtcattattagccatcagcagtgctgggcctctactagcccaggtaccgatctcccactctccgaaatcccccgcggagtaagggtggccctggattacgaagctggacaggtcaccctccacaacgctcagacacaggagcctatcttcacgttcacggcatcattctctgggaaggtgttcccttttttcgccgtgtggaagaagggatcctgcctgacactgaaggggtag

SEQ ID NO: 51639 - DNA, 1398 bp, Artificial Sequence
  Description of Artificial Sequence: Synthetic coding sequence
atgcccgccacccccagcctgaaggtggtgcacgagctgcccgcctgcactttgtgcgctggcccgcttgaagatgccgttaccatcccctgtggacacactttctgcagattgtgtctgccagctctatcacagatgggggcccagagttcagggaaaattctcctgtgccctctgtgccaggaggaagaacaagcggaaaccccgatggcacctgttcccctgggaccgctgggcgagacttattgtgaagagcatggagagaagatttatttcttctgcgaaaatgacgccgagtttctgtgcgtgttttgccgcgaaggccccacacaccaagctcatacggtaggcttcctggacgaagcgatccaaccctacagggatagactacgttcccgcctcgaggccctgtcaaccgagcgcgacgagattgaggatgttaaatgtcaagaggatcagaaactacaggtgcttctgacccaaattgaatcaaagaagcaccaggttgagactgcctttgagaggctccagcaggagcttgagcagcagcggtgtctactgcttgcacggctccgggagctggaacaacagatttggaaggagcgcgatgaatacataacgaaggtgtctgaggaggttacaagactgggagcccaggttaaggagctcgaggagaagtgtcaacagcccgccagcgaactgttgcaagacgtgagagtgaaccagagccgctgcgaaatgaagacattcgtcagtccggaagcaatttcacctgacttggtgaagaagatacgtgatttccacagaaaaatcctcaccctgccagagatgatgcgcatgttcagtgaaaatttggcgcaccatctcgaaatcgatagcggtgtcatcacattagatccccagaccgcctcacgctctctggttctgtcagaagatcggaagagtgtgcggtatacaagacagaagaaatcgcttcctgattcacccctacgttttgatggactacctgccgtgctcggtttccccggcttctcctctggcagacacaggtggcaggtggacctccagcttggggatggcggaggttgtacagtgggagtcgccggcgagggcgtaaggcgcaaaggagaaatgggcttgtccgcagaagacggagtgtgggctgtgataatctcccaccagcagtgttgggcctcaacttcgcctgggaccgacctcccactgagcgagatcccaagaggggttcgcgtggcgctggattacgaggctggacaagtgacgttgcacaatgctcagacacaggagccaatctttactttcacggcgtcgttttcaggaaaggtatttccttttttcgctgtttggaaaaaggggtcctgtttgacactcaaagggtag

SEQ ID NO: 51640 - DNA, 495 bp, Artificial Sequence
  Description of Artificial Sequence: Synthetic coding sequence
tgaaagaagcaccaggtggagaccgccttcgagcggctgcagcaggaactcgagcagcagcgctgtttactgctggcaaggctgagagaactggaacaacagatatggaaggagagggacgagtatatcaccaaagtgtctgaggaggttacaagactgggggcccaggtaaaggagctcgaggagaagtgccagcaacccgctagcgagctactccaggatgtgcgggttaaccagagccggtgcgaaatgaagactttcgtgtcacctgaggccatttccccagatctggtcaagaaaataagagatttccatcgcaaaatcctaacactgcctgagatgatgcgtatgtttagcgaaaatctggcccaccacctcgaaatcgattccgacagacaacccgaaccgggctccctcggcagacaagaggtgtccgaggttcacccggcagaagaagagcccgctcgccagcctccagccctgagaaggccttag

SEQ ID NO: 51641 - DNA, 495 bp, Artificial Sequence
  Description of Artificial Sequence: Synthetic coding sequence
tgaaagaagcaccaggtggagaccgccttcgagcggctgcagcaggaactggagcagcagcgctgtctcttgctcgcccgtttgagggagttggagcagcagatctggaaggagcgtgatgaatacatcactaaagtgtcagaggaggtcactaggttgggtgctcaggtgaaagaacttgaagagaagtgtcagcagcctgcatcggagctgctacaagatgtccgcgttaatcaatctcggtgcgagatgaaaacatttgtgagccctgaggcaatctcacctgatctggtaaagaagattagagactttcacaggaagatactgaccctgccagagatgatgaggatgttcagtgaaaatctggcgcatcatctcgagattgatagcgatcggcagcctgagccgggctctctgggtcgccaggaggtgagcgaggtgcaccccgccgaagaggagccggctagacagccacctgctctgcgacggccatag

SEQ ID NO: 51642 - DNA, 495 bp, Artificial Sequence
  Description of Artificial Sequence: Synthetic coding sequence
tgaaagaagcaccaggtggagaccgccttcgagcggctgcagcaggaactggaacagcaacgttgcctgctgcttgcccgcctccgagaactcgagcagcagatctggaaggaaagagatgagtatattaccaaggtctctgaagaagtgacaagattgggggcgcaggtgaaggaactggaagaaaagtgtcagcagccggccagcgaattgctgcaggacgttagggttaaccaatcccgatgtgagatgaaaaccttcgtgagtcccgaggccatatctcctgatcttgttaaaaaaatccgcgacttccaccgtaagatcctgacgcttcccgagatgatgaggatgttcagcgaaaacctcgcacatcacctagaaattgatagcgaccgtcaacccgaaccgggctccctgggacgccaggaggtctctgaagttcaccccgccgaggaggaaccagcaagacagcctcctgccctgagaagaccgtag

SEQ ID NO: 51643 - DNA, 495 bp, Artificial Sequence
  Description of Artificial Sequence: Synthetic coding sequence
tgaaagaagcaccaggtggagaccgccttcgagcggctgcagcaggaattggagcagcagcggtgcctgttgcttgctagattgagagagcttgagcagcagatctggaaggaaagagatgaatacattactaaagtcagcgaagaggtcacccgtctaggtgcccaagtgaaagagctggaggaaaagtgtcagcagccagcctccgagctgctccaggacgtacgggtgaaccaatcacgttgcgagatgaaaactttcgtgtcacctgaagcgatttccccagatttagttaagaagatcagggacttccaccgcaaaatacttacactgccagaaatgatgagaatgttttccgagaatttggcacatcacctggagattgacagtgacaggcagcctgagcctggcagtctgggacgtcaagaagtgtccgaggttcaccccgcagaggaggagccagcgcggcagcctccagcactacgaagaccttag

SEQ ID NO: 51644 - DNA, 1398 bp, Artificial Sequence
  Description of Artificial Sequence: Synthetic coding sequence
atgcccgccacccccagcctgaaggtggtgcacgagctgcccgcctgtaccctgtgtgccgggcccctggaagacgcggttacaatcccgtgtggccacacattttgcaggctgtgcctgccagccttgtcacagatgggggcccagtcttcagggaagattttgctgtgtccactttgccaggaagaggaacaggcagaaacgcctatggcacccgttccgctcgggccgcttggggagacatactgtgaagagcatggagagaaaatatattttttttgcgagaacgatgctgagtttctgtgtgtgttctgcagagagggccctacgcatcaagcacacactgtcggcttcctcgatgaagcaattcagccttatcgcgaccgactccgttctagactcgaggctctgtccaccgagcgagatgagattgaagacgttaagtgtcaagaagatcaaaaacttcaggtgttgttgacccaaattgagagcaaaaagcaccaggttgagactgcctttgaacggctgcagcaggaactggagcagcagcgctgtctcctactggctagactgagggaactcgagcaacagatttggaaggagcgagacgaatacataactaaggtcagcgaagaggtgaccagactgggggctcaagtgaaggaactagaggaaaagtgtcagcagcctgcctccgaactgttgcaggatgtgcgggtgaaccagtcccggtgcgaaatgaaaacttttgtctcacccgaggctatcagccccgatctggtgaaaaagattcgggatttccatcgcaagatccttactctacccgagatgatgagaatgttttcagaaaacttagcccaccatctcgagatcgactcaggagtcatcactctggacccccagaccgcctcgcggtcactagtgttgtccgaagataggaagtcagttaggtatacccgacagaaaaagagcttgcctgactccccgctgaggtttgatggattgcctgcagtcctgggcttccctggcttctcctctggtagacacaggtggcaagtcgatctgcagttgggtgatgggggagggtgtacggtgggagtggcaggtgaaggagtacgcagaaaaggtgaaatgggcctctcagctgaagacggagtctgggcagttataatttctcaccagcagtgctgggcctcaacctccccaggcactgatcttcctcttagcgagatcccccgcggggtgcgcgtagcgctggactatgaggcaggccaggtcactttgcacaatgctcagacccaggagcccatattcactttcactgccagcttctctgggaaggtgttccctttctttgctgtatggaagaaggggtcatgcctgactctaaaggggtag

SEQ ID NO: 51645 - DNA, 495 bp, Artificial Sequence
  Description of Artificial Sequence: Synthetic coding sequence
tgaaagaagcaccaggtggagaccgccttcgagcggctgcagcaggagctggagcagcaacgatgtctgctgttggcaaggctgcgtgagctggaacagcaaatttggaaggaacgagacgagtacatcacaaaagtaagcgaggaagttactcggctgggcgcccaggtcaaggaactggaggaaaagtgccaacagcctgcctctgagctgctgcaggatgtgagggtcaaccaatcccgctgtgagatgaagacatttgtgagtccagaggcaattagtcctgacctggtaaaaaagattagggacttccatcgtaaaatcctgacactgcccgaaatgatgaggatgttcagtgaaaacctggctcatcatctcgagattgacagcgacagacagccggagccaggctctctcggacgacaggaggtgtccgaggtgcacccagcagaggaggagcccgccaggcagcctcccgcactcaggcgtccctag

SEQ ID NO: 51646 - DNA, 1398 bp, Artificial Sequence
  Description of Artificial Sequence: Synthetic coding sequence
atgcccgccacccccagcctgaaggtggtgcacgagctgcccgcctgtaccctgtgcgccggcccattagaggatgcggtcaccatcccatgcgggcacacattctgcagactttgtctaccggccctctctcagatgggcgcccagtcgagcgggaagattctcctgtgtccactgtgccaagaggaagagcaggctgaaacaccaatggcacctgttccacttggtcccctcggtgagacctactgcgaggaacacggagaaaaaatatatttcttctgtgagaatgatgctgagttcctgtgcgtcttctgcagagaagggccaacccaccaggcccatacagttggatttctcgatgaggcaattcagccctacagggatcgcctgcggtctcgcctcgaagctctcagtacagagcgcgatgaaattgaggatgtgaagtgccaagaagaccaaaaactacaggtgctcctgactcagatagagagcaagaaacaccaggtggagacggcattcgaaaggctccagcaggagttggaacagcaacgctgtttgctactggcgcggctacgagaactagagcaacaaatctggaaggaaagagacgaatacatcaccaaagtgagtgaagaggtgactcgactgggtgctcaagtgaaagaactggaggaaaaatgccaacaaccagcatccgaactcctgcaggacgttagagtgaatcagtcacggtgcgagatgaagacatttgtgtcacccgaagcaatctccccggacctggtgaaaaagattagggatttccatcgaaaaatcttaacacttccggagatgatgagaatgttctctgagaacttagctcaccacctcgaaatcgactctggagtcatcaccctggatccccagaccgcgagccgctctctcgtactctccgaagatagaaagtctgtgcgatacaccagacaaaaaaaaaatctccctgactctcctctgaggttcgacggcctccccgccgtccttggttttccgggcttctcctccggcaggcacaggtggcaggtggaccttcagctgggcgacgggggtggctgcacagtgggtgttgcaggggagggagtccgcagaaagggcgaaatgggtttgagcgccgaagacggcgtatgggccgtgattatatcacaccagcaatgctgggcctctacctcccccgggacggatctgccattgtctgaaatacccaggggcgtcagagtcgccttagattatgaagctggtcaggttacactgcacaatgcccaaactcaagaaccgatttttacttttacggcctctttcagtggtaaagtctttccttttttcgcggtgtggaagaagggaagttgcctcacactaaagggctag

SEQ ID NO: 51647 - DNA, 1398 bp, Artificial Sequence
  Description of Artificial Sequence: Synthetic coding sequence
atgcccgccacccccagcctgaaggtggtgcacgagctgcccgcctgtacgctttgtgcgggaccactggaggacgcagtgactatcccgtgtggacacactttctgtagattgtgtctgcccgcactttcacagatgggggcccagtctagtggaaaaattctgctttgcccactgtgccaggaggaagaacaggctgagacacccatggcacctgtgcctttgggccccttgggcgaaacatactgcgaagaacacggtgaaaagatctacttcttctgtgagaacgacgctgagttcctgtgcgtgttctgcagagagggcccaactcaccaggcccacaccgttggctttctggacgaggccatccagccatatcgcgaccgactcagatcccggctcgaagcactcagtactgagcgggacgaaatagaggacgtgaaatgtcaggaggaccaaaagctgcaagttttactgacacagatcgagtcaaagaagcaccaagttgagacagccttcgagcggctccagcaggagcttgagcagcagagatgtttacttctcgcccgtcttcgcgagcttgagcagcagatctggaaagagagagacgaatatattacaaaggtatctgaggaggttactaggttgggagctcaggtgaaagagctcgaggaaaagtgccagcagcccgcctcagaactcctgcaggacgtgcgcgttaaccagtccaggtgcgagatgaaaacgttcgtcagcccagaagcgatttcccctgaccttgtaaaaaagatacgcgacttccatcggaagatcttaacgctcccagagatgatgaggatgtttagtgagaatttggctcaccacctggaaatcgatagcggggtcatcactttggacccacagacggcatccagatctctcgtgctcagtgaagaccggaagtccgttcgctacacgcgccagaagaagaatctgcccgactctccccttcggtttgatggactcccagccgtcctgggattccccgggttctcttccggtcgacaccggtggcaagtagatctacagctgggtgatggtggcggatgtactgtgggggtggccggagagggggtgcgccgtaaaggagaaatgggcctttccgccgaggacggcgtttgggccgttattattagccatcagcagtgttgggccagtacaagccctgggacagatctgccactgagcgagattccccgaggcgtccgcgtggcgctcgattatgaagcaggacaggtcacgttgcacaacgcccagactcaagagcctatcttcacctttacagcgtcgttctcaggtaaagtctttccgtttttcgccgtgtggaaaaagggttcctgccttactctcaaagggtag

SEQ ID NO: 51648 - DNA, 1398 bp, Artificial Sequence
  Description of Artificial Sequence: Synthetic coding sequence
atgcccgccacccccagcctgaaggtggtgcacgagctgcccgcctgcaccctttgtgccggccccctcgaagacgcagtcacaattccctgcggacatacattctgtcggttatgtctgcccgccttgagtcagatgggcgctcagtcttccggcaaaatcctgctatgtcctctctgtcaggaagaggaacaggcggaaactcccatggcgcccgttcccctcgggccccttggagaaacttactgtgaagaacacggcgagaagatttacttcttttgtgagaacgatgccgaatttctctgtgtcttctgtagagagggtccaacacaccaagctcatacagtgggattcctggacgaagctatacagccctatagagataggctgagatctaggcttgaagccctgagtactgagagagatgagattgaagacgttaagtgccaggaagaccagaaactgcaagtactcctgacacaaatcgaatctaagaaacatcaggtagaaacagccttcgagcgactgcaacaggaactcgagcagcaacgctgtctactgctggctcgcctgcgggagttagagcagcagatctggaaggaacgcgatgaatacatcaccaaagtgtctgaagaggtaacgcgcctgggcgctcaggttaaggagttggaagagaaatgtcaacagcccgcctccgagctgctccaggacgtgcgggtgaaccaaagccgatgcgaaatgaagacatttgtctcccccgaagcaattagtccagatctggtgaagaaaatcagggactttcatagaaaaatcctgaccttaccggagatgatgcgtatgttttcggaaaaccttgctcaccatttggagatcgacagtggcgtgatcaccctggacccccagacggcaagccgctctctggtgctaagtgaagatcgtaaaagcgtaagatatactcgtcagaagaagagccttcccgatagtcccctccggttcgacggtctgcctgctgtcctcggtttccccgggttcagctccggacggcatagatggcaggtggacctgcagctgggtgatgggggggggtgcaccgtgggcgtcgccggcgagggcgtgagacgcaagggtgaaatgggactgagcgcagaagatggggtttgggccgtaataatcagtcatcagcagtgctgggcctccacttccccaggcacagatctcccactaagcgaaatcccaaggggtgtccgagtcgccctcgactacgaggccggacaggtaaccctgcacaacgcccaaacacaggagccaatcttcaccttcacggccagtttttctgggaaagtattcccattctttgccgtctggaaaaagggctcatgcttgacactgaaggggtag

SEQ ID NO: 51649 - DNA, 495 bp, Artificial Sequence
  Description of Artificial Sequence: Synthetic coding sequence
tgaaagaagcaccaggtggagaccgccttcgagcggctgcagcaggaactcgaacagcagaggtgtctcctgttggctcggctccgggagctcgaacagcagatctggaaggagagagatgagtatatcacaaaggtctcagaggaggttacccgcctcggagcgcaggtgaaggagctggaagaaaagtgtcagcagcctgcctctgaactcctgcaggacgtccgggtcaaccagtctcggtgtgaaatgaagacgttcgtctccccagaagccatttcacctgatctggtgaaaaagattcgggattttcatcgtaaaatcttaacactgcccgaaatgatgagaatgttctctgaaaacttggcacaccaccttgagattgacagtgaccggcaaccagaacccggcagccttggcagacaggaggtgtccgaggtgcatcccgccgaagaggagcctgctcgacagccacccgcactgcgtcgcccttag

SEQ ID NO: 51650 - DNA, 495 bp, Artificial Sequence
  Description of Artificial Sequence: Synthetic coding sequence
tgaaagaagcaccaggtggagaccgccttcgagcggctgcagcaggagcttgagcagcagaggtgtctcctgcttgcccgactgcgggaattggagcagcagatttggaaagaacgcgacgagtatatcactaaggtctcagaggaggtgaccagactcggggcccaggtgaaggagttggaagagaaatgccagcagccagctagcgaacttttacaggatgtacgagtcaatcagtcacgctgtgagatgaaaactttcgtaagccccgaggccatttcacccgacctggtgaaaaaaatccgggatttccataggaaaatccttactctccccgaaatgatgagaatgtttagcgagaatctggcacatcacctggaaatagattccgataggcagcccgagcccggttccctaggaagacaggaggtcagtgaggtccatccggcagaagaggagcctgctagacagccacccgcccttcggcgcccctag

SEQ ID NO: 51651 - DNA, 495 bp, Artificial Sequence
  Description of Artificial Sequence: Synthetic coding sequence
tgaaagaagcaccaggtggagaccgccttcgagcggctgcagcaggagctggagcaacagagatgtctgctcctggcaaggcttcgcgagcttgaacaacaaatatggaaggaaagggacgaatacataacaaaggtgtctgaagaggtaacacggcttggagcgcaagtcaaagagttagaagaaaaatgtcaacagcctgcttctgaactgctgcaagatgttcgggttaatcaatctcgatgcgagatgaaaaccttcgtgagccctgaggcaatcagtccagacctggtgaaaaaaatacgtgacttccataggaagatactgactctgcccgagatgatgagaatgttcagcgagaacttggcccatcatctggagatagattcggatcggcaacctgaaccagggtctttgggaaggcaggaggtatcggaggtccaccctgctgaggaggagccagcccgacaaccacccgctttgaggcgaccttag

SEQ ID NO: 51652 - DNA, 1191 bp, Artificial Sequence
  Description of Artificial Sequence: Synthetic coding sequence
atggcccccgtgcccctgggccccctgggcgagacctactgcgaggaacatggcgaaaagatatacttcttttgcgaaaacgatgcggaatttctgtgcgtgttttgcagagaaggccctacacaccaagcccacactgtggggttcctcgacgaagctatccaaccctatagggatagactgagatcccgtctggaggccctgagcaccgagagagatgagatagaagacgtcaaatgccaggaggatcagaaacttcaagtgctccttacccagattgagtcaaagaagcatcaagtggagactgctttcgagcggctgcagcaggagctggagcagcagcgctgcctcctattggctaggttacgggagctggagcaacagatttggaaagagagagatgagtatattaccaaggtaagcgaggaggttactaggctaggggcccaagtaaaggagctcgaggagaaatgtcagcagccagcttctgagctgctgcaagtgattagagagggacttcatgggtgcgagatgaaaaccttcgtgtcgcccgaggcaataagtcctgatctagtcaagaaaattcgagacttccaccgcaagattctaacactgcccgagatgatgcgcatgttctcagagaatctggcccaccacctggagattgactccggagtcattacccttgaccctcagactgcctcgcgcagcctggtgttgtcggaggatcgaaagagtgtgcgatatacacggcagaaaaagaatttgcctgattccccactccggtttgatggtctgccagcagtgcttgggttccccggcttttcctctggtagacaccgatggcaggtggacctgcagctgggtgacggcggcggctgcactgtgggcgtagcaggcgagggcgtgaggagaaagggcgagatggggctgagcgccgaggacggggtgtgggctgtgatcatcagtcaccaacagtgctgggcaagcacctctcctgggaccgatttacctttgagtgagatccctcggggagttcgtgttgccctggattatgaggctggccaggtcacactacataatgctcaaacacaggagccaatattcacattcacagcatccttttccggcaaggtgtttcctttctttgcggtctggaaaaaaggcagttgcctcactctgaaaggctag

SEQ ID NO: 51653 - DNA, 348 bp, Artificial Sequence
  Description of Artificial Sequence: Synthetic coding sequence
atgcccgccacccccagcctgaaggtggtgcacgagctgcccgcctgtacactatgtgccggacctctggaggacgcagttactattccgtgcggacataccttctgtcggttatgccttccggctttatcgcagatgggtgcgcagtcaagcggaaaaatacttttatgccccctctgtcaagaagaagaacaggcggagaccccaatggcccctgtgcccctcggaccgctgggcgagacttactgtgaagaacacggcgaaaagatctatttcttttgtgagaacgacgccgaatttttatgcgtatccgagtgcagaaccacagacggattcggctgtgcttag

SEQ ID NO: 51654 - DNA, 348 bp, Artificial Sequence
  Description of Artificial Sequence: Synthetic coding sequence
atgcccgccacccccagcctgaaggtggtgcacgagctgcccgcctgcacactttgtgccggccctctggaggacgctgtgactatcccgtgtggtcataccttctgtagactgtgtctccccgccctgtctcaaatgggtgcacagtcctccggtaagatccttctgtgtcccctttgtcaggaggaggaacaagccgaaacccctatggccccagttccgctggggcccctgggcgaaacttactgcgaagaacacggagaaaagatctattttttttgtgaaaacgatgctgaattcctttgcgtctcagagtgtagaacaaccgacggcttcggatgcgcctag

SEQ ID NO: 51655 - DNA, 1191 bp, Artificial Sequence
  Description of Artificial Sequence: Synthetic coding sequence
atggcccccgtgcccctgggccccctgggcgagacctactgcgaggaacatggagaaaaaatatatttcttttgcgaaaatgatgccgagttcctgtgcgttttttgtcgcgaagggccaacacatcaggctcacactgtcggatttctggacgaagccattcagccctatagagataggctcagaagccgcctggaggctctctctaccgagagggacgaaattgaggatgtgaaatgtcaagaggatcagaaactgcaggtcctgttgacacagatcgagagcaagaagcaccaggtggagacagcctttgagcgcctccagcaggaattggaacaacaacggtgtctcctgttggctaggttacgagaacttgaacaacagatctggaaagagagagacgaatatatcactaaggtgtcagaggaagtgacacgtttaggtgcccaggtgaaagaactggaagaaaaatgtcaacagcccgcgtcagagctgctccaagtcattagggagggcctgcatggatgcgaaatgaaaacctttgtttctcccgaagctatttctccggatttagttaagaagatccgggatttccaccggaaaatacttaccctcccagaaatgatgcggatgttctctgagaatctggctcatcacctggaaatcgactcaggggtgatcaccctggacccccaaactgctagccggtccctggtgctgtccgaggaccggaagtctgttcgctacacgagacagaaaaagtctctgcctgattcacccctgaggtttgacggtctgccagccgtgctggggtttccagggttttcttcaggccggcataggtggcaggtggatcttcaactgggggacgggggggggtgcacggttggtgtcgccggcgagggagtccgcagaaagggcgaaatgggcctgtccgctgaggacggagtgtgggccgtaataataagccatcagcaatgttgggcgtcaacctcccccgggacggacctccccctttctgagattcctcggggcgtcagagtagccttggattatgaggcaggccaggtgactttgcataatgcccagactcaggagcctatttttaccttcacggcttccttcagtggaaaagtgtttccctttttcgccgtctggaagaagggctcctgtcttactcttaagggatag

SEQ ID NO: 51656 - DNA, 1191 bp, Artificial Sequence
  Description of Artificial Sequence: Synthetic coding sequence
atggcccccgtgcccctgggccccctgggcgagacctactgcgaggaacacggagagaaaatctacttcttctgcgagaacgacgcggagttcctgtgcgtgttctgcagggagggccccacccaccaagcccacactgtcggtttcctggatgaagcgatccagccctatcgcgataggctgaggtctagactggaggccctgagcaccgagcgcgacgagatcgaggacgtgaaatgccaggaagaccagaaactgcaggtgctcctgacacagattgaaagcaaaaagcaccaggtagagactgcatttgaacgactgcagcaggaattagagcagcagcgctgcctgctcctagccaggctaagagaactcgagcagcaaatttggaaagaaagggatgagtacatcacgaaagtgtccgaagaagtcacccggctcggcgcccaagtcaaggaacttgaggagaaatgtcagcagcccgcaagtgaactactccaggtcattcgggaagggctgcacggatgtgaaatgaagaccttcgtgagccccgaggccatatctcccgacctggtcaagaaaatccgcgacttccaccgcaagatacttactttgccagaaatgatgcgaatgtttagcgaaaacctcgcccatcacttagagattgacagtggcgtcatcactctagacccgcagaccgctagcaggagtttggtactctccgaagaccgcaagtccgtgcggtatacaagacagaagaaatctctgcccgactcaccgctaagattcgacggcttgcccgccgtgctaggtttcccagggttttcgtccggccgccatcggtggcaagtggatctgcaactcggagacggtggcggctgtaccgtgggcgtagccggagagggagttagacggaaaggtgaaatggggctcagcgcagaggatggtgtgtgggctgtcatcataagtcaccagcagtgttgggccagcacatcccctggcacggatttgccccttagcgagattccgagaggtgtgcgggttgcccttgattacgaggctggacaagtgactcttcacaacgcccagacccaggagcccatcttcaccttcaccgcatctttttccgggaaggtctttccattctttgctgtgtggaagaagggttcttgcctcactctcaaaggttag

SEQ ID NO: 51657 - DNA, 348 bp, Artificial Sequence
  Description of Artificial Sequence: Synthetic coding sequence
atgcccgccacccccagcctgaaggtggtgcacgagctgcccgcctgtacactatgcgcaggacctctcgaggacgccgttactattccatgcggccacacgttttgtaggctctgcctacccgctttgagtcaaatgggggcccagtcatctgggaagatcctgctatgccctctgtgccaggaggaggaacaggccgagacacctatggcccccgtgcccctggggcctctgggagagacatattgcgaggagcatggcgaaaaaatctacttcttttgcgagaatgacgccgagtttctgtgcgtgagtgaatgtcggacaacggatggttttggatgcgcttag

SEQ ID NO: 51658 - DNA, 348 bp, Artificial Sequence
  Description of Artificial Sequence: Synthetic coding sequence
atgcccgccacccccagcctgaaggtggtgcacgagctgcccgcctgcactctgtgcgctggcccactggaggacgcagttacgatcccttgtggacatacattttgcaggttgtgcctgcctgccctcagtcaaatgggagctcagagctctgggaaaatcctgttgtgtcccctctgccaggaagaggaacaagccgaaacgcctatggctccagtacccctgggccccctcggcgagacctactgtgaggagcacggtgaaaaaatttacttcttttgcgagaacgacgctgagtttctctgtgtaagcgagtgtcgaaccacagatgggtttggctgcgcttag

SEQ ID NO: 51659 - DNA, 1191 bp, Artificial Sequence
  Description of Artificial Sequence: Synthetic coding sequence
atggcccccgtgcccctgggccccctgggcgagacctactgcgaggaacacggagagaagatttactttttttgcgagaatgatgcggagttcttatgcgtgttctgtagagaagggccgacacaccaggcccatacagttggattcctagacgaagccatccaaccttacagagacagactgcgtagtcgactagaagcactgagcacagaacgtgatgagatagaagacgtgaaatgccaggaggaccaaaagttacaggtgctcctgacccagatcgagagcaagaaacaccaggtggagaccgcctttgaacggctacagcaggagctcgaacagcagcggtgcctgctgctggcacgcctgagagagctggaacagcagatctggaaggaacgagacgaatacatcacaaaagtttccgaagaagtaactagacttggcgctcaggtgaaagagctcgaggaaaagtgccagcaaccagccagcgagctgctccaggttattcgggaaggattacacggctgcgagatgaagactttcgtaagtcctgaagcaatctccccagatctggtcaagaagatccgggacttccatagaaaaatcctgacactgcccgaaatgatgcgcatgttttcggagaatctggcccaccacctcgagattgattctggggtgataaccctggatcctcagactgcctctagatccctagtcttgtccgaggatcggaagtctgttcgctatacgagacagaagaagagcttgccagatagtcctttaagattcgacggtctcccagccgtgctcggctttccgggcttttctagcggcaggcatcgttggcaggtggatcttcagttgggcgacgggggcggctgcactgtgggagtggccggcgaaggcgtgaggagaaaaggtgaaatggggctgtctgcggaggacggcgtgtgggctgtgatcatcagccatcagcagtgttgggcttcaacaagcccaggaaccgatctaccgcttagtgaaattccgagaggcgttcgtgtggctctggattacgaggccggccaggtcacgctgcataatgcccagacgcaagagcccatttttactttcaccgctagcttcagtggaaaggtttttccattctttgccgtgtggaagaaggggtcttgcctgaccttgaagggttag

SEQ ID NO: 51660 - DNA, 1191 bp, Artificial Sequence
  Description of Artificial Sequence: Synthetic coding sequence
atggcccccgtgcccctgggccccctgggcgagacctactgcgaggagcatggcgaaaagatatattttttctgcgagaatgatgccgaattcctctgtgtgttctgtagggagggaccaacgcatcaggctcacacggtcggctttctcgacgaagcaatacagccttatagagaccggctgagaagcaggctggaggcattgtccactgagagagacgaaattgaggacgtaaaatgtcaggaagaccagaagcttcaagtccttttgacgcagatcgaatcaaagaagcaccaggttgaaacggcctttgaacgactccagcaggagttagaacagcagaggtgcctgttgctcgcacggctccgagagctggagcagcaaatctggaaagaacgggatgaatatattacaaaagtaagtgaggaagtcacacggttaggggcccaggtgaaagaattggaagaaaaatgtcagcagccagcctccgaactgcttcaagtgatacgggaaggtctgcacggctgtgaaatgaagacctttgtaagccccgaggccatctcccccgatctggtgaaaaagatacgagactttcacagaaaaatcctgacacttcctgagatgatgaggatgttctcagaaaatctggcccatcatctggaaatcgattctggtgtgattacgctcgacccacagacagcctcacggtctttggtgttaagtgaagatcgaaagtctgtgaggtacacgcgccagaagaagaacttaccggactctccccttcgcttcgacggcctgcccgcggttctcggcttccctgggttttctagtgggcggcaccgctggcaggtagacttgcaactaggagatggggggggatgtacagtaggggtggcaggagaaggtgtgagaaggaagggagagatgggcctcagtgcagaggatggggtctgggccgtgataatatcacaccagcagtgctgggcctctactagtcccggtacagatctgcccctttccgagatacccaggggggtgcgcgtcgccttggactatgaagctgggcaagtgactttacataatgctcaaacccaggaacccatattcacattcaccgcgagcttttcaggtaaagttttcccattcttcgcagtgtggaaaaaggggagctgtctcaccctgaaaggctag

SEQ ID NO: 51661 - DNA, 1191 bp, Artificial Sequence
  Description of Artificial Sequence: Synthetic coding sequence
atggcccccgtgcccctgggccccctgggcgagacctactgcgaggaacatggggagaaaatctacttcttttgcgagaatgatgccgagtttctgtgtgtgttttgccgggaaggaccaactcatcaggcgcacacagtgggattcttggacgaggcaatccagccatatcgcgaccggctcaggtcccgcctggaggcattgagcacggagcgcgatgagattgaagacgttaagtgccaggaagaccagaagcttcaggttctgctcacacagattgagtctaaaaaacaccaggtggaaaccgcctttgagagacttcaacaggagctggagcagcagcgctgtctcctgttggcgagactgcgggaacttgaacagcagatctggaaagagagagacgagtatattaccaaggtgtcggaggaagtcacgcggctgggcgcacaagtaaaggaactggaggagaagtgtcagcagcccgctagcgagctactgcaggttatcagggaaggcctccacggttgcgagatgaagactttcgtgagtccagaagctatttcccctgatctggtaaaaaagatacgcgatttccaccgtaaaatcctgaccctgccggagatgatgcgaatgttctcagagaatttggctcaccacctcgagatagattccggcgtgatcaccctggatcctcagactgcgagtagaagtctggtgctgtccgaagatcgcaaaagcgtccgatataccagacaaaagaagtcccttcctgatagccctttacgcttcgatgggctacccgccgtgctcggtttccctggattttccagtggcagacaccggtggcaggtggacctgcagttgggagatggtggagggtgtacagttggtgtggccggtgagggagtgaggaggaagggagagatgggtttgtctgccgaggatggcgtgtgggccgtcattatttctcatcagcagtgctgggcgtctacatccccaggcaccgatttaccactctctgagatacccaggggtgtccgcgtagccctggactacgaggctggccaggtgactctgcataatgcgcagacacaagagccaatatttactttcaccgcctcttttagcggtaaagtctttccgttcttcgccgtttggaaaaagggctcttgtttaacactgaaggggtag

SEQ ID NO: 51662 - DNA, 348 bp, Artificial Sequence
  Description of Artificial Sequence: Synthetic coding sequence
atgcccgccacccccagcctgaaggtggtgcacgagctgcccgcctgtactttgtgtgccggccctctggaggacgccgtgaccatcccgtgcgggcataccttttgtaggttatgtcttcctgctctgtcccagatgggcgcacagagcagcggaaagatcttgctctgtcccttatgccaggaggaggaacaggccgagacccccatggcacccgtccccctcggacctctgggtgagacctattgtgaagaacacggtgagaagatttatttcttttgtgagaacgacgccgagtttctgtgcgtgtcggagtgtaggacaactgatggatttggctgtgcctag

SEQ ID NO: 51663 - DNA, 1191 bp, Artificial Sequence
  Description of Artificial Sequence: Synthetic coding sequence
atggcccccgtgcccctgggccccctgggcgagacctactgcgaggagcacggcgaaaagatttactttttttgtgagaatgacgccgagtttctctgtgtgttctgcagggaagggcccacgcaccaggcacacaccgtcgggtttttggacgaggctattcagccgtatagggataggctaagaagtcggcttgaggctctgtctactgagagagacgaaatagaagacgttaaatgtcaggaggaccaaaagctgcaagtgctgctcacgcagattgagtcaaaaaagcaccaggtggaaactgcctttgaacgcctgcagcaagaactcgaacagcagagatgtctgctgctcgccagactgagagagcttgagcagcagatctggaaggagcgcgatgagtacattacgaaagtgtctgaggaggtaactaggctcggagcccaagtcaaagaactagaggagaagtgccagcaacccgcatctgaactgttacaggttatcagggaggggttacatggttgcgaaatgaagacatttgtctccccggaagccatatctccagatctcgtgaagaagattagagattttcaccgcaagattctgacattgcctgagatgatgagaatgtttagcgaaaatttggcacaccacctggagatagattccggcgtcatcaccctcgacccgcaaactgcctccagatccttagtgttaagcgaggatcgcaagtccgtgagatacaccagacagaagaagtcattaccagacagcccgcttaggtttgatgggctccctgcggtactcggcttccctggtttttcctcggggcggcacaggtggcaggtggatctgcaacttggggatggaggaggctgcacggtcggggtggcgggcgaaggggtgagaagaaaaggagagatgggtctgtctgccgaggatggcgtgtgggccgttataatttcacatcagcagtgttgggcaagcacatccccaggaaccgaccttcccttaagtgaaatcccacgtggagttagggtggcgctcgactacgaggccggccaggtgacgctacacaacgcgcagacacaagaacctatttttacgttcaccgcctcattttctggtaaagtgttcccattttttgccgtttggaagaagggtagctgcctgaccctcaaaggatag

SEQ ID NO: 51664 - DNA, 348 bp, Artificial Sequence
  Description of Artificial Sequence: Synthetic coding sequence
atgcccgccacccccagcctgaaggtggtgcacgagctgcccgcctgcacattgtgtgcgggtccactggaagacgctgtcacaatcccttgtgggcacactttttgcagattgtgtctgccagccctgtcacagatgggagcccaaagttctggaaagattctcctctgtcccttgtgccaagaagaggaacaggcggagacaccaatggccccagtaccccttgggcccttgggggagacatattgtgaagagcacggggaaaagatatattttttctgtgaaaatgatgccgaattcctctgcgttagtgagtgtcgcactaccgatggtttcggatgtgcttag

SEQ ID NO: 51665 - DNA, 348 bp, Artificial Sequence
  Description of Artificial Sequence: Synthetic coding sequence
atgcccgccacccccagcctgaaggtggtgcacgagctgcccgcctgcactctatgtgctgggcccctggaagatgcagtgaccatcccttgcggccacacattctgtcggttgtgtctcccagctctcagccagatgggtgcccagtccagcgggaagatcctgttatgcccactgtgtcaggaggaggagcaggccgaaactcccatggcaccggtgccactcggcccccttggagagacatactgcgaagagcatggcgagaagatctactttttctgtgagaacgacgcagagttcctgtgtgtctcagaatgccgaaccaccgatggttttgggtgtgcatag

SEQ ID NO: 51666 - DNA, 1434 bp, Artificial Sequence
  Description of Artificial Sequence: Synthetic coding sequence
atggaggccgtggagctggcccggaagctgcaggaggaggccacctgttcaatctgtctcgattactttactgacccagtgatgaccacgtgcgggcacaacttttgtagagcttgcattcaactttcttgggaaaaagcccgcgggaaaaaaggtcgtcggaaacggaagggatcttttccttgccccgaatgtcgtgagatgtctccgcagcgcaacctcctcccaaatagactgttgacaaaggtggcggaaatggctcaacagcatcccggtcttcaaaagcaggacctatgtcaggagcatcatgagccactaaaactcttctgccagaaggaccagtcacccatctgcgtcgtttgtagggaaagcagggagcatcggttacatcgcgtattacctgccgaagaagcagtccaaggttataaactcaagcttgaggaagacatggaatacctgagggagcagattactcgaaccggcaatctgcaggctcgcgaagagcaaagcctggctgaatggcaaggtaaggttaaggaacgaagagagcgaatagtgctagagtttgaaaaaatgaacctgtacctggtcgaggaagaacagagattgttgcaggccttggagacagaggaagaagagacagccagccgtctcagagagtccgtggcttgtctcgataggcaaggacactcattggagctactgttgttgcagttagaggagcggagcacgcagggcccactgcaaatgctccaggatatgaaagaacctcttagcaggaagaataatgttagtgttcagtgtccagaagtcgccccaccaacccggcctcgtaccgtttgccgcgttccagggcagatagaagttttgcggggcttcctcgaggatgtagttcccgatgctacaagtgcttacccctacctcctcctttatgagagccgacagagacgataccttggttcttccccagaaggttctggattttgctctaaggatcgctttgtggcctacccctgcgccgtggggcagactgccttctcatctggtaggcattactgggaggtgggcatgaacattaccggcgacgccctctgggccctaggggtttgtagggacaatgtgtccaggaaagaccgcgttcccaaatgtcccgaaaacggtttctgggtcgttcagctcagtaaaggcaccaagtatctctcaacgttctccgcccttaccccagttatgctgatggaacctccaagccacatgggcatcttccttgatttcgaagcaggcgaggtaagcttctacagtgttagcgatgggtctcatttgcatacctatagccaagccactttccctgggccacttcagcctttcttctgtttaggcgccccaaagtccggtcagatggtgatatccacagtgacgatgtgggtgaaggggtag

SEQ ID NO: 51667 - DNA, 528 bp, Artificial Sequence
  Description of Artificial Sequence: Synthetic coding sequence
atggaggccgtggagctggcccggaagctgcaggaggaggccacctgctctatttgtctggactattttacagaccccgtgatgacaacttgtgggcataacttttgtcgggcatgcattcagctcagctgggaaaaggcccggggcaagaagggccgacgcaagcgcaagggatcttttccctgtcctgagtgccgtgaaatgtcacctcaacggaacctgctacccaatcggctgcttaccaaagtggccgagatggcgcagcagcacccagggctgcagaaacaggacctctgtcaggaacaccacgaacctttgaaactgttttgtcagaaggatcagagccctatctgcgtggtctgtcgcgaatcccgcgagcatcgcctccatcgggtgctgcccgcagaagaggccgtccaaggctacaaattaaagcttgaagaggatatggaatatctgcgcgagcagataacaaggaccggaaatctccaggcacgcgaggaacagtcccttgcagaatggcaatag

SEQ ID NO: 51668 - DNA, 1434 bp, Artificial Sequence
  Description of Artificial Sequence: Synthetic coding sequence
atggaggccgtggagctggcccggaagctgcaggaggaggccacctgttcaatatgtctcgactattttacagaccccgtgatgacaacttgcgggcataacttttgccgtgcatgcattcagctttcctgggaaaaagcccgaggcaagaaaggccggagaaaacgaaagggaagctttccatgtccagaatgcagggagatgagtcctcaaaggaacctgctgcctaatcgcctcctgacaaaagtggcagagatggcacaacagcatcctggtctgcagaaacaagatttgtgtcaagaacatcacgagccattgaagctgttctgccaaaaggaccagtcgcctatttgtgtggtgtgccgcgagagtagagagcaccgccttcatagggtgctgcccgccgaagaagcggtacagggctataaattaaagctagaggaggatatggagtatctgcgggagcagatcacccggacaggcaacctccaggccagggaagaacagtccctagccgagtggcagggaaaagtcaaagaacgtagggaacgtatagtgctggaatttgagaaaatgaatttgtacctggtagaggaggaacagaggctgttgcaggcactcgaaaccgaagaagaggaaactgcttcgcggctacgagagtcagttgcttgtttggatagacagggccactctctcgagctgttgctgctacaactggaggaaagatcgacccagggaccattgcagatgttgcaggatatgaaggagcctctgtctcgtaagaataatgtttccgttcagtgtcctgaagtcgcaccccccactaggcctcgcacggtctgtagggttccaggccagatcgaagtgctgcgtgggtttcttgaggacgtggtgccagacgctacaagtgcgtatccgtacctcctgttatacgagagtcgacaaagacgatacctgggttcctccccagaggggtccggcttctgtagtaaggaccggttcgtggcctacccctgtgctgtaggccaaacggcattcagtagtggcagacactattgggaggtcggtatgaatatcacaggagacgcactgtgggccctgggggtctgccgggacaatgtgtcccgtaaagaccgggtgcccaaatgccccgaaaacggattctgggttgttcaattgagcaaggggaccaagtacctgtcaaccttcagcgcacttacaccagtgatgctcatggaacctcccagccacatgggcatcttcctggatttcgaggccggggaggtgagcttttacagtgtgagcgacggaagccaccttcatacatactctcaagcgactttcccgggtcctctccagcccttcttctgcttaggagcccccaaaagcggacagatggtcattagcactgtgacaatgtgggtgaaaggctag

SEQ ID NO: 51669 - DNA, 1434 bp, Artificial Sequence
  Description of Artificial Sequence: Synthetic coding sequence
atggaggccgtggagctggcccggaagctgcaggaggaggccacctgttcaatatgtttggattatttcactgaccccgtgatgaccacatgcggacataacttctgccgggcttgtattcagctgtcttgggaaaaggctcgcggaaagaaaggacgtagaaaacgcaaagggtcctttccatgccctgaatgccgggagatgtccccgcagcggaacctgctgccaaaccgcttgctcactaaggtggcggagatggctcagcagcaccccggtctccagaagcaggatctctgccaggagcaccacgaacccctcaagcttttctgccagaaagatcagagcccaatctgtgtcgtgtgcagagaatccagagagcataggcttcaccgggtattacccgccgaggaggctgtgcagggctataagctgaaactggaggaggatatggaatacctcagagagcagattacaaggacgggtaaccttcaggccagagaggagcagagtctagccgagtggcaggggaaagtgaaggaacgcagggagaggattgtgctggagttcgagaaaatgaatctgtatcttgtggaggaggagcagcgcctactgcaagccctggagactgaggaagaggagactgcatcccggctgcgtgagtctgttgcatgcctcgatcgacaaggtcattccctagagctgctgctgttacagttggaggagcgatctacacagggcccgctccaaatgctccaggacatgaaagaacccctctccaggaagaacaacgtgtctgtgcagtgccccgaagtggcaccgcccaccaggccacgaaccgtctgccgcgtgccagggcagatcgaggtgctacgcggtttcctcgaagatgttgtgcctgatgctacatccgcctatccatatctcttactctacgagagccgacagcggaggtacctgggaagtagccccgaggggagcggcttttgctcaaaggatcggttcgttgcctacccttgtgcggtaggacagaccgcgttttcctccggacggcattactgggaagtgggcatgaacatcactggagacgctctgtgggccctgggcgtctgtcgagacaacgtctcccggaaggaccgcgtacccaagtgcccagagaatgggttctgggtggtgcagcttagcaaaggtaccaaatatctgtccacgttcagcgccctaacacccgtgatgctgatggaacctccctcccatatgggtatctttctagatttcgaagccggagaggtgtctttttacagcgtatctgacggatcacacctccacacatactcccaggccacatttccaggcccccttcaaccattcttttgcctgggggccccgaaatctggacagatggtcatctctacggtaaccatgtgggtgaaaggatag

SEQ ID NO: 51670 - DNA, 1032 bp, Artificial Sequence
  Description of Artificial Sequence: Synthetic coding sequence
atggaggccgtggagctggcccggaagctgcaggaggaggccacctgctccatttgcctggattacttcacagacccggtgatgacgacatgcgggcataatttctgtagggcttgcattcagttgagctgggagaaggcccggggcaagaaaggacgtaggaagcgaaaggggagtttcccctgcccagaatgcagagagatgagtccacaaagaaatctcctgcctaatcggcttctgacgaaagtagccgagatggcgcaacagcatccagggttgcagaaacaggatttgtgtcaggagcaccacgagccactgaagctgttctgtcagaaagatcaaagccccatttgtgttgtctgtcgcgagtcgcgcgagcataggttgcacagagtgcttccggcagaagaggccgtccaggggtataaactgaagctggaggaagacatggaatacctgagagaacaaataacccggactggcaacttgcaagcccgcgaggagcaatcactggccgaatggcaggggaaggtgaaagaacggcgggaaaggatcgtgctcgagtttgaaaaaatgaatctgtatttagtggaagaggagcagcgtctgttgcaggcactcgagaccgaagaagaagagaccgcgagtcggcttagggagtcggtggcctgcctcgataggcaggggcatagtctggagctgttgctgctgcagctggaagaacggagtacccagggtccactgcaaatgctacaggacatgaaggaaccactgagtagaaagaataacgtgtcggtccagtgcccagaagtggcaccaccaacacggcctagaacggtctgcagagtacctggccagatcgaggtactgagaggctttctggggaagtgggctcccagagcaaggacctccgatcccgggtccctgggcgacgcgccgttataccccctggccagtgaggcgactaatggaggcggatcaacgagcgccctgccgggcgatggtcactggctgttcacagtccctagttag

SEQ ID NO: 51671 - DNA, 153 bp, Artificial Sequence
  Description of Artificial Sequence: Synthetic coding sequence
atggaggccgtggagctggcccggaagctgcaggaggaggccacctgttccatttgcctcgactactttactgatccagttatgacaacctgtggacacaatttttgcagggcttgcatccagctgtcctgggaaaaagccagagggaagtag

SEQ ID NO: 51672 - DNA, 1398 bp, Artificial Sequence
  Description of Artificial Sequence: Synthetic coding sequence
atggccagcaccaccagcaccaagaagatgatggaggaggccacctgtagcatctgcctaagcttaatgaccaacccagtttctattaactgtggacattcttactgccacctttgcatcacggacttcttcaagaacccctctcaaaagcagttaaggcaggaaacgttttgttgtccgcagtgtagggctccttttcatatggatagtctgcgcccaaacaagcagttaggctctctgattgaggctctcaaggagacggaccaagaaatgtcatgtgaggagcatggggagcaatttcacttgttctgcgaagatgagggccaactcatatgctggcgatgtgagagggctcctcaacacaaggggcacactactgccttggtcgaggatgtgtgtcagggctacaaagagaagctgcagaaagcggttactaaactgaagcaattggaagaccgctgcacagaacagaagctctctaccgctatgcgcatcacaaagtggaaggaaaaagttcagatacagagacagaagatccggtccgattttaagaacctccaatgctttctgcacgaagaggagaagtcctatttgtggcgactggaaaaagaagagcagcagaccctgtcgcggctgcgtgattatgaagccggactaggcctgaaaagcaacgagttaaagagccatatccttgagctggaagaaaagtgtcaggggtccgcccagaagctactccaaaacgtaaacgatacgctgtctcgatcatgggccgtgaaactcgagactagcgaagccgtgtctctggagctgcatactatgtgcaacgttagcaaactgtatttcgatgtgaagaagatgctgcggtctcaccaggtatccgtcaccctcgatcccgacactgcccaccatgagctgatactgagcgaggatcggcgacaggtgacgagagggtacacccaggaaaatcaggataccagctcgcgacggtttaccgcgttcccatgtgtgctgggatgcgaaggattcaccagcggacgaaggtactttgaagtagatgttggtgaaggaactggttgggatctcggagtttgtatggagaatgtgcagagagggactgggatgaagcaggaaccccagtcgggattctggactttaaggctgtgtaagaaaaaaggatacgtggcgttaacgagtccacccacatctcttcacctgcacgaacagcctttactcgtggggatcttcctggattatgaagctggggtagtttccttctataacgggaataccggatgccacatctttacgttcccaaaggcttcttttagcgacacgctgagaccatactttcaggtttaccagtattcgccactgtttcttcccccgcccggcgactag

SEQ ID NO: 51673 - DNA, 1398 bp, Artificial Sequence
  Description of Artificial Sequence: Synthetic coding sequence
atggccagcaccaccagcaccaagaagatgatggaggaggccacctgtagcatttgcttaagcttaatgaccaacccagtcagtatcaactgcggccattcctactgtcacttgtgcattactgacttctttaagaaccctagtcagaaacaactccgacaggagacattttgttgcccacagtgccgcgcacctttccacatggattctctacgacctaacaaacagctgggaagccttatcgaggcattaaaggagacagaccaggaaatgtcttgcgaagagcacggcgagcagttccacttgttttgcgaggacgagggacagctgatctgttggagatgtgagcgagcacctcagcacaaagggcacaccaccgcccttgttgaagacgtgtgccagggatacaaagaaaagctgcaaaaggccgttactaaactgaaacagcttgaggaccgttgcacggaacagaaactctccaccgctatgcggatcacaaaatggaaagagaaggtgcagattcagaggcagaagatccgaagcgatttcaaaaatctccagtgctttctgcatgaggaggaaaaaagctacttgtggcgcttggagaaagaggagcagcagacgctaagtcggctgagggattacgaagctggcctgggtctgaagtccaacgaattgaagagtcatattttggagctggaagagaagtgtcagggctcggcacagaagttgttacagaacgtgaatgataccctctctcggtcgtgggccgtgaaactggagaccagcgaagcagtcagcttagagctccacacgatgtgtaacgtgtctaagttgtattttgatgtcaagaagatgctgcgctctcaccaggtgagtgtgactcttgacccagacacggctcaccacgaactcattctcagtgaagataggcggcaggtgactaggggctatactcaggagaaccaagatactagcagccgccgattcacagccttcccctgcgtgctgggatgtgaggggtttaccagcggcagaaggtatttcgaagtggatgtgggggaaggaaccgggtgggacttgggggtctgtatggagaacgttcagcgcgggaccggcatgaaacaagaaccccagtccggtttttggactctgcgactgtgcaagaagaagggttacgttgcactgacttctccccccacatcactacacttacatgaacagcccctattggtagggatctttctggactacgaagccggcgtcgtctccttctacaatggaaacactggatgtcacatttttacatttccgaaagcaagtttctccgatacactgagaccatacttccaggtttatcagtatagtccgttgtttctgccccctcccggcgactag

SEQ ID NO: 51674 - DNA, 1398 bp, Artificial Sequence
  Description of Artificial Sequence: Synthetic coding sequence
atggccagcaccaccagcaccaagaagatgatggaggaggccacctgttcaatttgcctgagcttgatgactaatccagtgagtatcaactgtgggcactcctactgtcacctgtgtattactgacttctttaagaacccttcacaaaagcaactgcgccaagagaccttctgttgcccacaatgtcgcgctcctttccacatggattcgttgagaccaaacaaacagctcggatcactgattgaagcgctcaaggaaaccgaccaggaaatgtcctgtgaggagcatggagaacaattccacctgttttgtgaggacgaagggcaactgatttgctggcggtgtgagcgggcgccacagcacaaaggccacacaactgcgttggtagaggatgtctgccaaggatataaggaaaaactgcagaaggccgtcacgaagcttaagcaacttgaagatagatgtaccgaacaaaagttatccactgctatgcgcatcacaaaatggaaggaaaaagtgcagatccagaggcagaagatccgatcagatttcaagaacctgcagtgcttcctacatgaagaggaaaagagttacctgtggcgccttgagaaagaggagcagcagacactgtcccggctgcgggattatgaagccgggcttggacttaagtcgaacgagctcaaaagccatatcctggaactggaagagaagtgccaaggatccgcccagaaattactgcagaatgtgaacgacacactttcccggtcctgggctgtgaagctggagacatcggaggcagtttctcttgaactgcacactatgtgtaatgtcagcaaattgtacttcgatgttaagaagatgctgcgaagtcaccaggtctcagtgactctggaccctgatacggctcatcacgagctgattctgagtgaagatcgtaggcaggtcacacggggctatacacaggagaatcaagatacaagttccagacgcttcaccgctttcccttgcgtgttggggtgtgaaggatttacctcgggcaggcgctactttgaggtagatgtcggtgagggtactggctgggacctgggtgtttgcatggagaatgtgcagcgtggaactggtatgaagcaggaaccacaaagtgggttctggactctgcggctgtgcaaaaagaaggggtatgtggccttaactagcccaccgacttccttgcacctgcacgaacagccactgctagttggcatctttctggattatgaagcaggagtggtctctttttacaacggcaacacagggtgccatatatttacattccctaaggccagcttctctgacactctccgaccgtactttcaggtgtatcagtactcccccctgttcctcccgccgccaggcgactag

SEQ ID NO: 51675 - DNA, 690 bp, Artificial Sequence
  Description of Artificial Sequence: Synthetic coding sequence
atgatccccctgcagaaggacaaccaggaggagggcgtgtgccccatatgtcaggagagcctcaaagaagccgtctccaccaattgcggacatctcttctgcagggtgtgcctgacacagcacgtcgagaaggcgtcagcctctggggtcttttgctgccccctctgcagaaagccttgctccgaagaagtcctcgggacggggtatatctgtcctaaccatcagaaacgcgtgtgccgcttctgcgaggagtcacggttattgctctgcgtagaatgcctggtgtctccagaacacatgtcacaccacgaactgactatagagaatgctctctcacattacaaagaacgcctcaaccggagatcaaggaaactccggaaagatatcgctgagctacagagactgaaagcccaacaggagaagaaacttcaggccctgcagcagtggttagggcagctcgagcacatgccagccgaagccgcccgaattttggacatctcccgggctgtgacccagctgagatccctggttattgatctggagcgaacagcaaaagaactggacaccaataccctcaagaacgcgggcgatctcttgaatcgaagcgcccctcagaaattagaagttatttatccccagctggagaaaggtgtcagcgaactcctgcttcagccacctcagaagctgtag

SEQ ID NO: 51676 - DNA, 777 bp, Artificial Sequence
  Description of Artificial Sequence: Synthetic coding sequence
atgatccccctgcagaaggacaaccaggaggagggcgtgtgccccatatgccaggagtccttgaaggaagcagtatcaacaaactgtggacacttgttctgccgcgtctgcctgacccagcatgttgaaaaggctagtgctagcggggttttctgttgcccactgtgtcgcaaaccatgttccgaggaggtgttgggtacaggctacatttgtccaaaccatcagaagcgtgtgtgccggttttgcgaagagtcccggttactgctctgcgtggagtgcctcgtgtctcccgagcacatgagccatcatgaactcacaattgaaaacgccctgtcccattacaaggagcggctgaacaggcgcagccgcaagttgagaaaggatattgctgaacttcaaagattaaaagcacaacaggagaaaaagttgcaggctctccagttccaggtcgaccatgggaaccataggctggaggccggacctgaatcgcagcatcagacaagggaacagctcggggccctccctcagcagtggcttggacaattggaacacatgccagccgaagctgccaggatcctcgacatctcacgggcagttacgcaactccggtctttggtcatcgacctggaacggactgccaaagagctcgataccaatactctgaagaatgccggagacttactgaaccggagcgctcctcagaagctcgaggttatctacccccagctggaaaaaggcgtttctgagctgctgctacagccccctcaaaaactgtag

SEQ ID NO: 51677 - DNA, 777 bp, Artificial Sequence
  Description of Artificial Sequence: Synthetic coding sequence
atgatccccctgcagaaggacaaccaggaggagggcgtgtgccccatctgtcaagagtctctgaaggaggccgtctccacaaattgtggacatcttttctgccgagtttgtctcacacaacatgtagaaaaagcttcggcctctggtgtcttttgctgtcccttgtgtcggaagccttgctcagaggaagtgttggggaccggctacatttgccccaatcatcagaaaagggtatgcagattttgcgaggaaagccggctcctgctgtgtgtagagtgccttgtgagccctgaacatatgtcccatcatgaactgacaattgaaaatgctctaagccactacaaagagcgcctgaataggcggtcccgcaagctgcggaaggacatcgctgagctccagcgactgaaggcccagcaggagaagaaattgcaggccctccagttccaggtcgatcacggcaaccacagactcgaggccggcccggagagccagcatcaaacgcgggagcagcttggcgctctcccccagcagtggctggggcagctggaacacatgcctgccgaagctgcacgtatcctcgacatttcaagagcagtgacacagctaaggtccttggtaatcgacttggagagaacagccaaagagctcgatactaacaccctcaagaatgccggggacctcttaaacagaagcgccccacagaaacttgaagtgatctaccctcagttagagaaaggcgtctccgagctgctactgcagcccccccagaaattgtag

SEQ ID NO: 51678 - DNA, 777 bp, Artificial Sequence
  Description of Artificial Sequence: Synthetic coding sequence
atgatccccctgcagaaggacaaccaggaggagggcgtgtgccccatctgtcaggagagcctgaaagaggctgtgagcaccaattgcggccacctgttctgtagggtttgtctgacccagcatgtcgaaaaagcatcagcatcaggggtgttctgttgcccactctgtcgcaaaccctgctctgaagaagtgttgggaactggctatatctgccctaatcatcagaagcgtgtctgccggttttgtgaggaatctaggcttctgctctgtgtcgaatgcctggtatctcctgaacacatgagtcatcacgagctgactatcgagaacgccctaagccactacaaagagaggctgaatcggcgttctcgtaagctgcggaaggatatcgctgagttgcaaagactgaaggcgcagcaggaaaaaaaactgcaggctctccaattccaggtggatcacggcaaccatcgcctggaggcaggacccgagtctcaacaccagaccagagaacaattaggagctctgccgcagcagtggttagggcagctggaacacatgccagcagaggccgcccggattctggatatcagccgggcggtcacgcagctgcgttccttagtaatcgatcttgaacgcacggccaaggagctggataccaacaccctgaaaaatgccggcgatcttctgaaccggtcggctccgcaaaaattggaggtcatctacccccagctcgaaaagggggtgtcagagctgcttcttcaaccgcctcaaaagctctag

SEQ ID NO: 51679 - DNA, 690 bp, Artificial Sequence
  Description of Artificial Sequence: Synthetic coding sequence
atgatccccctgcagaaggacaaccaggaggagggcgtgtgccccatatgtcaggagtcgttgaaggaggcagtctcaaccaactgcggccacctgttttgtagagtttgcctcacacaacatgtggaaaaggcctccgcctccggcgtgttctgttgtccactctgtaggaaaccttgtagcgaagaggtgctgggaactggttacatctgcccaaaccatcaaaagcgtgtgtgtagattttgtgaggaaagcaggttgctgctgtgtgtcgagtgcctggtgagtcccgaacacatgtcgcaccacgaactcacgatcgaaaatgctctctctcattataaggagcggctgaatagacgctccaggaagttacgaaaggacatcgctgagctgcaaaggttaaaagctcagcaggaaaaaaaactgcaggcattgcagcagtggctcggacagctcgaacatatgcccgctgaggcagcacgtatcctggatattagccgtgctgtgacacagctccgcagtctggtgattgatctcgagagaactgcgaaggaactcgataccaacaccctcaagaatgctggagacctattaaaccggagcgctccccagaagttggaggtgatttatccccagctagagaagggcgtctctgaattgctccttcaaccaccacagaaactctag

SEQ ID NO: 51680 - DNA, 690 bp, Artificial Sequence
  Description of Artificial Sequence: Synthetic coding sequence
atgatccccctgcagaaggacaaccaggaggagggcgtgtgccccatatgtcaggagtctctgaaagaagccgttagtactaattgcggacacctgttttgtcgggtttgtctaacacagcacgtcgagaaagcatctgcctcaggggtgttctgctgtccactgtgcagaaagccttgctccgaggaggtcttaggcaccgggtacatttgcccgaaccaccaaaagcgagtgtgtagattctgtgaggaaagcaggttattgctgtgtgtagagtgtctggtatccccggaacacatgagtcaccacgagttaacgatagaaaacgcgctttctcattacaaagagcggctgaaccggcggtcgaggaaactgcggaaagacattgccgagctgcagaggttaaaagctcagcaagaaaagaagctgcaggccctgcagcaatggctgggccagttggagcacatgccggctgaggctgccaggatcttggatattagccgcgctgtcacacagctcagatccctcgtgattgacctcgaaaggatggccaaggagcttgatacaaacacgttgaaaaacgccggggacctgctcaatagaagcgcccctcaaaaactggaagtgatctatccccagttaaagaagggagtgtctgagttgttgctgcaacctccgcagaagctgtag

SEQ ID NO: 51681 - DNA, 690 bp, Artificial Sequence
  Description of Artificial Sequence: Synthetic coding sequence
atgatccccctgcagaaggacaaccaggaggagggcgtgtgccccatttgtcaggagtccctgaaagaagccgtatccactaattgcggccatctgttttgcagagtatgcctcactcagcacgtggaaaaggcgagcgcctccggggtgttctgttgtccactatgtcgaaagccttgctcagaagaagtgcttggcactgggtacatttgtccaaaccaccagaagagagtgtgtcgtttttgcgaagaatcaagactcctactatgcgttgaatgccttgtctcacctgagcacatgtctcatcatgagctgacgatcgagaacgctttgtcacactataaagagcgtttgaatagacggtccagaaaactccgaaaggacatcgctgagctacaaaggttgaaagcacaacaggaaaagaagcttcaggcacttcagcagtggctcgggcagttggagcacatgcccgccgaggcagctcgtatactggacatctcccgcgcagtcacccagctgcgatccttggtgatcgatttggaaagaacagccaaggagctcgacaccaacactctgaagaacgcaggcgacttgctgaaccggtctgcgcctcaaaaactggaggttatttatccgcaattggagaaaggcgtgtcagaactgctgttgcaacctccacagaagctctag

SEQ ID NO: 51682 - DNA, 777 bp, Artificial Sequence
  Description of Artificial Sequence: Synthetic coding sequence
atgatccccctgcagaaggacaaccaggaggagggcgtgtgccccatctgccaggagtccctgaaagaagccgtctccaccaactgtgggcatttgttctgccgggtatgtctaacgcagcacgttgaaaaggcttctgcaagcggcgtgttttgctgtccactgtgtcgcaaaccttgttcagaagaagtcttggggaccgggtatatatgtccaaatcatcagaagcgagtttgccggttctgtgaagagtctcggctcctgttatgtgtggagtgccttgtgagtcccgaacacatgagccaccacgagttgaccatcgaaaatgctctttcccattacaaggaacggcttaataggagatcgcgtaaattgagaaaggatatcgccgagctacagagactgaaagctcagcaggagaagaagctccaggctttacagttccaggtggaccacggcaatcatcgtctggaagccggacctgagagtcagcaccagacgagagaacagctgggggcccttcctcagcagtggctgggccagctagagcacatgccggccgaagcggccagaatcctggacatttcaagagcggttacacagctgcgaagtctggtgattgacttggagagaatggccaaggagctcgacacaaacacccttaagaacgccggggacctgttgaatcggtcagcacctcaaaagctagaagtgatctatccacagttaaagaaaggagtcagtgaactgctgctgcagccaccccagaagctgtag

SEQ ID NO: 51683 - DNA, 690 bp, Artificial Sequence
  Description of Artificial Sequence: Synthetic coding sequence
atgatccccctgcagaaggacaaccaggaggagggcgtgtgccccatctgccaggaatcccttaaagaagcagtttctaccaactgtggacatttgttctgcagggtgtgccttacacagcacgtcgaaaaagcatctgcgagcggggtgttctgttgcccactttgccggaagccgtgctccgaggaggtgctaggaacaggctacatctgtccaaaccatcagaagagagtgtgccgattttgtgaagagagccgattgcttctatgcgtggagtgcttggtcagcccggagcatatgtcccatcatgagctaaccatagaaaacgcactgagccattataaggagaggcttaacagacggagtcggaaactgcgcaaagatattgccgagctccagcggctcaaggcccaacaggagaagaagctccaagctcttcaacagtggctcggtcagcttgagcatatgccagccgaggccgcccgcattttagacatttcccgcgcggtcacccagctgcggtcactggtgatcgatctggagcgcaccgccaaggaactagatactaacaccctgaagaacgccggggacctgctgaatagatctgctcctcaaaagctggaagtaatttatccacagctggaaaaaggagtgagtgagctcctgctgcagcctcctcagaagctgtag

SEQ ID NO: 51684 - DNA, 777 bp, Artificial Sequence
  Description of Artificial Sequence: Synthetic coding sequence
atgatccccctgcagaaggacaaccaggaggagggcgtgtgccccatttgtcaggagagtctgaaagaagccgtttctaccaactgcggccacttattctgtcgagtgtgtttgacacagcacgtagagaaggccagcgcttcaggtgtgttctgctgccctctgtgcagaaaaccgtgtagcgaggaagtgctcgggacgggctatatttgtcccaatcatcaaaagcgagtgtgtaggttctgcgaggagtcccggttactgttatgtgtggagtgcctcgtgtcgcccgaacacatgtcccaccatgagcttacaattgaaaatgcactgtcacactataaggagaggctgaatagaaggtccaggaagctgcgcaaggatatcgccgagctgcaacgtctgaaggcccagcaagagaaaaagctgcaagctctgcagttccaggtcgaccacggcaaccaccgcctggaagccggccctgagagtcagcatcagacacgggagcagctgggcgcactgcctcagcaatggttgggccagctggagcatatgcctgctgaggctgcacggatcctggatatcagcagggctgtgacacagctccgctcactggtaatagatctggaaagaatggcaaaggaactggacacaaacactttaaaaaatgcaggggacctcctgaatagaagcgccccgcagaaattagaggttatctaccctcaattaaaaaagggagtgagcgagctgctcctccagcccccccaaaaattgtag

SEQ ID NO: 51685 - DNA, 777 bp, Artificial Sequence
  Description of Artificial Sequence: Synthetic coding sequence
atgatccccctgcagaaggacaaccaggaggagggcgtgtgccccatatgtcaggaatcactcaaagaagccgtgtctaccaattgcgggcacctgttctgccgtgtctgcctcacccagcatgttgagaaggcttctgcctcaggcgttttctgctgccctctgtgcagaaaaccatgctcagaagaggtgttaggcactggctacatatgccccaatcatcaaaagagagtctgtcgcttttgcgaagaatcccggcttctgctgtgtgtcgagtgtttagtttcccccgagcatatgtcccaccatgaacttacaattgaaaacgccttatcgcattgcaaggaacgcctcaacagaaggagccgaaaacttcgtaaagatatcgccgaattacaaaggcttaaagctcagcaggaaaaaaaacttcaggccctccagttccaggtcgaccacggcaaccaccgcctggaagccgggccagaatctcaacatcagacaagagaacagctgggggctctgccacaacagtggctcggacagctggagcatatgcccgcagaagcagccagaattctcgatatttcaagagccgtgacgcagttgaggtcactagtgattgatcttgagcgaaccgctaaggaattagacaccaataccctgaaaaacgccggcgacctgctgaataggtctgccccccagaagctggaagtgatatatccccaattggagaagggagtgtctgaactgctgcttcagccaccacagaaactgtag

SEQ ID NO: 51686 - DNA, 777 bp, Artificial Sequence
  Description of Artificial Sequence: Synthetic coding sequence
atgatccccctgcagaaggacaaccaggaggagggcgtgtgccccatttgtcaggaatcactcaaagaagcggtctccaccaactgtggtcacctattctgcagggtctgcttgacccagcacgtcgaaaaagcttctgccagcggagtgttttgttgtccactttgtagaaaaccttgctcagaagaagtccttggaacagggtatatttgccccaaccatcagaagagagtatgccgcttttgtgaagaaagtcggctgctgctgtgcgtggaatgcctggtatcacccgaacatatgagccaccacgaattaacaatcgaaaacgcgctctctcattacaaagaaagattaaatcggcgttcaagaaagctcagaaaggacattgcagaactgcagagactgaaagcccaacaagagaagaaactgcaagcattacagtttcaggtcgaccacggaaaccaccggctggaggctgggcctgaaagtcaacaccagactcgggagcagctcggggcgctcccacagcaatggttaggacaattggagcatatgccagcagaagctgcccgaattctggatatatccagagcggtaacgcagctgaggtcactggtaatcgacctggagcggacggctaaagaactggacaccaacaccctgaagaatgccggggacctgctgaaccggagcgccccgcaaaagctggaggtgatctatccacaacttgagaaaggggtgtccgaactccttcttcaaccaccccaaaagctttag

SEQ ID NO: 51687 - DNA, 777 bp, Artificial Sequence
  Description of Artificial Sequence: Synthetic coding sequence
atgatccccctgcagaaggacaaccaggaggagggcgtgtgccccatctgtcaggagtccttgaaggaagcagtaagtacaaattgtggccacctgttctgtcgcgtgtgtttaacccagcacgtggagaaggcgtctgcctcgggggtgttttgttgccctctatgtcgaaaaccatgttctgaagaagtgcttgggactggttacatctgtcccaaccaccagaagagagtctgccgattctgcgaagaatcgcggctcctgctgtgtgtagagtgtctggtcagtccggaacacatgagccatcacgaactgactattgaaaacgcgttgagtcattacaaggagagactcaacaggcgcagccgtaagctgcgcaaggatatagcggaattgcagagactgaaagcacaacaggaaaaaaagctccaggctcttcagttccaggtggaccatggaaaccataggttggaggctggacctgaatcacagcaccagaccagggagcagttaggcgccttgcctcagcagtggctcggacagctcgagcacatgccagccgaggccgccagaatcctggatatctcgagggctgtgacgcagttgaggagcctggtgattgatctggagaggactgccaaagaactggacactaacactctcaagaatgctggcgatttgctcaaccgctctgctccgcagaagctcgaggtgatttacccccagctggaaaagggtgtatcggaactgctgttacagcctccccaaaaattatag

SEQ ID NO: 51688 - DNA, 690 bp, Artificial Sequence
  Description of Artificial Sequence: Synthetic coding sequence
atgatccccctgcagaaggacaaccaggaggagggcgtgtgccccatctgccaggagtctctcaaggaggctgtcagtacgaactgtggacacctgttctgtcgagtctgcttgacacaacatgtcgagaaagcttctgcgtccggggtcttctgttgcccactgtgtagaaaaccatgctctgaagaggtgctgggaacgggctacatctgtcctaatcatcagaaacgggtttgtcgattctgcgaggagtctcgactgcttttatgtgtggaatgtttggtgagcccggagcacatgtcacaccatgagctgaccatagaaaacgctctgagccattacaaggagcgactgaacaggcgtagtcggaaactgcggaaggacattgctgagctccaacggttaaaggcacaacaggagaagaagctccaggcactccaacagtggcttgggcagctcgagcatatgccagccgaggccgccaggattctcgatatctcacgggccgtgacccagctgcggagcctggttattgatctcgaaagaaccgccaaagaactggacactaacacacttaaaaatgcaggcgacctgcttaacaggagtgcgccccagaagcttgaggttatctacccacagctggaaaagggcgtgagcgagcttctgctgcaaccaccacaaaagctgtag

SEQ ID NO: 51689 - DNA, 777 bp, Artificial Sequence
  Description of Artificial Sequence: Synthetic coding sequence
atgatccccctgcagaaggacaaccaggaggagggcgtgtgccccatctgccaggaatcactgaaagaagcggttagtaccaactgtggccacctcttctgccgcgtgtgtttgacgcagcatgtggagaaagcaagcgcctctggcgtgttttgttgccccctctgtcgcaagccatgtagtgaggaagtgttggggacaggttatatctgccctaatcaccagaaacgagtttgtcgcttctgcgaggaaagcagattgcttctctgtgtggaatgtctggttagccccgagcacatgagccaccacgagctgaccatcgagaatgccctgtcccactataaagagaggcttaatagacgtagccgcaagctccgaaaagacattgccgagcttcagagactgaaggcccagcaggagaaaaaactgcaagctctccagtttcaggtggatcacggtaaccaccgtttggaggccggccccgagtctcagcatcagacaagggaacagctgggagctctcccccagcaatggcttggacaactggagcacatgcctgcggaagccgctcggattcttgatatctccagggccgttacacagctgagatcactcgttatcgacctggaaagaaccgcaaaagaacttgacaccaatactttgaagaacgcaggcgacctactaaacaggagtgccccccaaaaactggaggtcatctatccacagctcgagaaaggtgtttccgaactgctactccagcccccgcagaagctatag

SEQ ID NO: 51690 - DNA, 690 bp, Artificial Sequence
  Description of Artificial Sequence: Synthetic coding sequence
atgatccccctgcagaaggacaaccaggaggagggcgtgtgccccatctgtcaggaaagcctgaaggaggctgtttcaaccaattgcgggcatctcttttgtcgtgtgtgtcttacacagcacgtggagaaggcgtcagcctccggcgttttctgctgtcccctgtgtagaaagccttgcagcgaagaggtgctcggcaccggatatatttgccccaaccaccagaagagggtctgccgattctgcgaggagtccaggctcctgttatgcgttgaatgcctggtgagtccagagcatatgtcacaccatgaactcacgatcgaaaacgctctgagtcattgtaaggagcgactgaataggaggtccagaaaactgagaaaagatatagcagagcttcagcgcctgaaggcacagcaggagaaaaagttacaggctcttcagcaatggttaggtcagttggagcacatgccggccgaagctgcccgaatcctggacattagcagggcagtgacccagctgcgctctttggtaattgacctcgaacgcacagcaaaagagctggatacaaacacacttaagaacgcaggtgatctgctaaaccgatctgcaccacagaaactggaagtgatttatccccaactcgagaagggcgttagtgagctgctccttcaacccccacaaaaactgtag

SEQ ID NO: 51691 - DNA, 690 bp, Artificial Sequence
  Description of Artificial Sequence: Synthetic coding sequence
atgatccccctgcagaaggacaaccaggaggagggcgtgtgccccatatgtcaagagtcactgaaagaagctgtctctaccaactgtggacatctgttctgtagagtctgcctcacgcagcacgtggaaaaggcttcggcaagcggcgtgttctgctgcccactgtgcaggaaaccatgctccgaggaggtgctgggcaccgggtatatttgccctaatcaccagaagcgggtctgtcggttttgcgaagaatcacgcttgctcctgtgcgttgaatgtttggttagccccgagcatatgtcccaccatgaactcacaatagaaaatgccctttcacattataaagaacggctgaaccgaaggtccagaaagctgcgaaaggatatcgcagaactacagaggctgaaagcccagcaggagaaaaagcttcaggccttgcagcagtggctggggcaactcgagcatatgcccgcagaggccgcgagaatcctggacatctccagagcggtgactcagctgcgctccctggtcattgatctcgagcgtatggccaaggaactcgataccaacactctgaagaatgctggtgacctgctgaaccggagcgcgccgcaaaagctcgaggtcatctacccacaattgaagaagggcgtgtccgagctcctactgcagccgccacagaagctatag

SEQ ID NO: 51692 - DNA, 777 bp, Artificial Sequence
  Description of Artificial Sequence: Synthetic coding sequence
atgatccccctgcagaaggacaaccaggaggagggcgtgtgccccatatgtcaggagagcctcaaggaggcagtgtccacaaactgtgggcacctattttgtcgggtgtgcctgacccagcacgtggagaaggcttccgcctctggggtcttctgttgtcctctctgtcggaaaccctgttccgaagaagtgctgggtaccggctacatatgccctaaccaccagaaacgggtctgccgcttctgtgaggagagcagactgctgttgtgtgtcgagtgtttggtgagccccgaacacatgtcacaccacgagttgactatcgagaatgcactgtctcattacaaagaacgactcaacaggcgctcacggaaactgagaaaggacattgcagaattgcagcggctcaaggctcagcaggagaaaaagctccaggccttacagttccaggtcgaccacggcaaccatcgcctggaggcaggccccgaatcccaacaccagactagagaacagctcggagcacttcctcagcaatggctcggccaactcgagcatatgcccgcagaagccgctcgcattttggatatcagcagggcagtgacacagctgcgctcattggtgattgatctggaaagaaccgccaaggaactggacacaaacaccctcaaaaacgccggagacctgttgaacaggagcgctccccagaagctcgaggtgatatatcctcagcttgagaaaggagtcagcgaactgcttttgcaacccccccagaaactctag

SEQ ID NO: 51693 - DNA, 777 bp, Artificial Sequence
  Description of Artificial Sequence: Synthetic coding sequence
atgatccccctgcagaaggacaaccaggaggagggcgtgtgccccatttgtcaggaaagtctgaaagaggctgtgtccaccaactgcggccatttgttttgtagagtgtgtttaacgcagcatgtcgaaaaagcctccgcatcaggagttttttgctgccctctgtgcaggaaaccgtgctccgaagaggtactggggaccgggtatatttgcccaaatcaccagaaaagggtctgtcggttttgcgaggaatcccgattgcttctgtgtgttgagtgtttagtgtctcccgaacacatgtcacaccacgaactaaccatcgagaacgctctgtcccactgtaaagaaaggttaaaccggaggtctaggaagctcagaaaagacatcgctgagctccagcgcttaaaggctcagcaggagaaaaagttacaggcgctgcagtttcaggtggatcacggtaatcatcggctggaagcagggcccgaatcacagcaccagacacgggagcagctcggtgctctccctcaacagtggcttggacaacttgaacacatgcctgcggaggcagcccgaatcctagatatcagcagggctgtcactcaactcagatcattagtcatagacctggaacgcaccgctaaggaactcgataccaacactttgaaaaatgccggcgacttgctgaaccgcagcgcgcctcaaaaacttgaggtgatctatccacagctggaaaagggtgtgtccgaactgctgctgcagccaccgcagaagctgtag

SEQ ID NO: 51694 - DNA, 777 bp, Artificial Sequence
  Description of Artificial Sequence: Synthetic coding sequence
atgatccccctgcagaaggacaaccaggaggagggcgtgtgccccatttgccaagagtcactgaaggaggcagtcagcacaaattgcgggcacctattctgtcgtgtttgtttaacccagcatgtggagaaggcctcagcctccggggtcttttgttgtcccttgtgtcggaagccttgtagtgaggaagtgctggggactgggtacatttgtccaaaccaccaaaagagggtgtgccgattttgcgaggagtctaggctgctgttgtgcgtcgagtgtctggtgagccccgaacacatgtctcatcatgagctcaccattgagaacgccttatcacactataaagaacggctgaataggcgctccaggaagctgaggaaagatattgccgaattgcagcgcctcaaagcccaacaggagaagaagttacaagccctgcagttccaggtggaccacggcaatcatcgtcttgaggcaggccccgagtcacagcaccagacaagagaacagttaggagcactgccccaacagtggctcggacagctggaacacatgcctgccgaagcagctaggattctcgacatttcacgggccgtgactcagctaagatctctggtgattgacctcgagaggactgcaaaggaactggatacgaatacactcaagaacgctggcgaccttctgaatagatccgctccacagaagcttgaggtaatttacccgcagctggagaagggcgtaagcgagctgttactccagccccctcagaaactctag

SEQ ID NO: 51695 - DNA, 777 bp, Artificial Sequence
  Description of Artificial Sequence: Synthetic coding sequence
atgatccccctgcagaaggacaaccaggaggagggcgtgtgccccatctgccaggagagcctcaaagaagccgtgagtactaactgtggccaccttttttgtcgcgtgtgcctgactcaacacgttgaaaaagccagtgcgtcgggggtgttttgttgtcctctttgtcgaaagccctgctcagaagaagttctgggaaccggatacatttgcccaaaccaccagaaacgtgtctgccgattctgcgaggagtcgagactgttgctttgcgttgagtgtttggtatccccagaacatatgagccaccatgaactgacaattgaaaatgccctgtcccactacaaagagaggctcaaccgacggagcagaaaactgcggaaagacattgctgaattgcagcgtctgaaagcccaacaggaaaaaaaactacaggctctccagtttcaggttgatcacggcaatcaccgcttggaggcaggccctgaatctcagcaccaaacccgtgagcagctcggtgccctgcctcagcaatggctgggacagctggagcatatgccagccgaggctgctagaattctagacatcagtagggcggtgacacagcttcggtcactggtgattgatctcgaaaggactgccaaggagctggataccaacactctcaagaacgccggagacctcctgaataggtccgcgcctcagaaactagaagtgatttatccacaactggaaaagggcgtgtctgaactgctcctccagccccctcagaagctgtag

SEQ ID NO: 51696 - DNA, 2172 bp, Artificial Sequence
  Description of Artificial Sequence: Synthetic coding sequence
atggagaccgccatgtgcgtgtgctgcccctgctgcacctggcagaggtgttgtccacagctgtgttcttgtctctgctgtaagttcatattcacatctgagaggaattgtacttgttttccatgcccctataaggacgagcgcaactgtcagttctgccactgcacatgctcggaatcacccaattgtcattggtgttgttgtagctgggcaaacgatcccaactgcaagtgctgttgtacagcatcttcaaatttgaactgctactactacgaatcaaggtgctgtagaaacaccattattaccttccacaagggtaggctcagatcgatacacacatcctccaagaccgccctgcgaaccggttcctcagacacccaagttgacgaggtgaagagcattcctgccaattcgcaccttgtgaatcatctgaactgccccatgtgcagcaggcttcgcctgcacagctttatgctgccatgtaaccactctctgtgtgaaaagtgccttcgacagctccagaagcacgcagaggtaaccgagaacttcttcatactgatctgcccagtgtgtgacaggtcacattgcatgccttattctaacaaaatgcagcttcctgagaattacctccacggtcgccttacaaagcgctacatgcaggaacatggttatctcaagtggcgttttgataggtcttctggtcctattctctgtcaggtctgcaggaacaagaggatcgcttacaagcgctgtataacctgtcggctgaacctttgtaacgattgccttaaggcctttcatagtgatgtcgccatgcaggaccacgtattcgtggatacatctgcggaggaacaggacgaaaagatctgtatccatcatccaagttcaaggattatcgagtattgcaggaacgacaataagcttctgtgcactttttgcaagtttagcttccataatggacacgatacgatctctcttattgacgcctgctccgaaagagccgcctccctgttctctgcgatcgccaaatttaaagccgtgaggtatgagattgataatgacttgatggaatttaatattctaaaaaactcctttaaagcagataaagaggccaaaaggaaggagatccgcaacggtttcctgaaattgaggagtattcttcaggaaaaagaaaaaatcatcatggagcagattgagaacctggaggtcagccgacagaaggaaattgaaaagtatgtgtacgtaactaccatgaaggtaaatgagatggatggacttattgcatattccaaagaggccctaaaggagacaggacaggtagccttcctgcagtctgcaaagattctggtggatcagatcgaagatgggattcagacaacttatagaccagacccacagctgagattacactcaattaattatgtcccactggattttgtagagctgagttctgcaatacacgaactctttcctaccggacctaagaaggtgcgcagttcaggcgactccctaccttcgccctaccccgtccactcggaaacaatgatcgcccggaaggtgacctttagcacccattccctggggaatcagcacatctaccagaggagttccagcatgttgtccttctctaacaccgataaaaaggctaaagtgggacttgaagcatgcggtcgggcccagtcagcaactccagccaaacccactgacgggctatacacttattggagcgcaggtgctgacagccagtctgtgcagaactccagcagcttccataattggtactccttcaacgacggttcagtgaagacgccaggaccaattgtgatctaccagaccctagtttatccgagagccgccaaggtttactggacctgccccgctgaagacgtggactcttttgagatggagttctatgaagttatcaccagccctcccaacaatgtgcagatggagttatgcggtcagattagggatattatgcagcagaacctggagctgcataatcttacccccaacactgagtacgtgttcaaggtaagagctatcaacgataatggacccgggcagtggtcagacatttgtaaggttgttacccccgatggacatggcaaaaaccgcgctaaatggggactactgaaaaacattcagtccgccctgcaaaagcacttttag

SEQ ID NO: 51697 - DNA, 1341 bp, Artificial Sequence
  Description of Artificial Sequence: Synthetic coding sequence
atggacagcgacttcagccacgccttccagaaggagctgacctgcgtgatctgtctgaactacctggttgacccagtcacaatttgttgcgggcacagtttttgtcgaccttgcctgtgtctatcatgggaggaggcacaaagccccgccaactgtcctgcttgtagagaaccaagccccaagatggacttcaaaaccaacattctgctgaagaacttggttacgatagcacgtaaagcgtcgctgtggcaatttctgtcgagtgagaagcagatttgtgggacacacagacagacgaaaaagatgttttgcgacatggacaagagtctcctgtgtttattgtgtagtaactcccaggagcacggcgcacataaacatcatcctattgaggaggctgcagaggaacacagggagaagctcttgaagcagatgcgtattctatggaagaaaatccaagagaatcagcgcaatctatatgaggaggggcggacagccttcctttggcgagggaacgtcgttctgagggcccaaatgatccgcaatgagtatcgcaagctgcatcctgttctgcacaaagaggagaaacagcacctagaacgcctaaacaaggaataccaggagatctttcagcaactccagcggtcatgggtcaaaatggaccaaaagtccaaacaccttaaagaaatgtaccaggaactgatggagatgtgccacaagccggacgttgagcttttgcaggacctaggagatatcgttgcacggagtgaaagcgtgctgctccacatgcctcaacctgtgaaccccgagttgaccgccggccccataacaggacttgtgtaccgactgaatagattccgggtggagattagcttccactttgaggtcaccaatcacaacatacgccttttcgaagatgtgcggtcatggatgtttagacgtggaccgcttaacagtgaccgctctgactacttcgcagcgtggggggcccgcgtgttctcttttggcaagcactattgggagctggacgtggacaattcttgtgattgggcgcttggcgtctgcaacaacagctggatccgcaaaaacagcaccatggtgaactcagaagacatctttttgttgctctgtctgaaggtcgacaatcattttaacttgttaaccacttctcccgtgttcccacactatattgaaaaacccctgggcagggtcggcgtcttcctagactttgaatccggttccgtttcttttctcaacgtcaccaagtcaagtttaatttggtcctaccctgccggttccctcaccttccccgtgcggccattcttctacaccggacaccgctag

SEQ ID NO: 51698 - DNA, 2280 bp, Artificial Sequence
  Description of Artificial Sequence: Synthetic coding sequence
atggccgagggcgaggacatgcagaccttcaccagcatcatggacgctttggttcggatctctacctccatgaagaatatggagaaggaactgctctgtcccgtgtgtcaagaaatgtataaacagcctctggtgctgccttgcacccacaacgtgtgccaggcttgtgcacgcgaggttctgggacagcaggggtacattggccatggcggtgatccttcttccgagccaacttctccagctagcacaccctctacacgctcccctcggctctctcggagaacactgcctaagccggatcggctggataggttgctgaaaagcggtttcggtacttaccccggaaggaaaaggggagcattgcatccccaggtaattatgtttccttgcccagcatgccaaggcgacgtagagttgggcgaaaggggtctggctggactgtttcgtaaccttacattggagcgcgtggtcgagaggtacaggcagtctgtgtcagtgggcggtgctattctgtgtcagctgtgcaagcccccgcccctagaggccaccaagggctgcactgagtgtcgcgccactttttgtaacgaatgctttaaacttttccacccgtgggggacacaaaaagctcagcatgagccaactctccccaccctttcctttcggcccaaaggattgatgtgtccggatcataaagaggaggtgacgcactactgcaaaacctgccagaggctggtatgtcagctttgccgggttaggcggacccattctggacacaagatcactcctgtgctgtcagcttaccaggccttaaaggataagttaaccaagtctctgacctacattctggggaatcaggataccgttcagacccagatctgcgagttggaggaagccgtaaggcatacagaggtttctggtcaacaggccaaggaggaagtctcccagctggttcggggtctgggggctgtcctggaagagaaacgtgccagcctcttacaggccattgaagaatgccagcaggaaagactggctaggcttagcgcacaaattcaggagcatagatcgctcctggacggctctggtctggtgggctatgctcaggaagtcctgaaggagaccgaccagccatgttttgtgcaggcagccaagcagctccataatcggatcgctcgggcaaccgaggccctccagacattccggccagccgcttccagcagttttaggcactgccaacttgacgtcggtcgagagatgaagcttctgactgaacttaatttccttcgcgtacctgaggctccagtaatcgacacacaacgaaccttcgcgtatgatcagattttcttgtgctggcgtctgcctcctcattccccgccagcatggcactatacagtggagttcagacggaccgatgtgccggcccaacctggccccacacgctggcagagacgggaggaggtcagaggcacgtctgcgcttctcgaaaatccggatacaggatccgtttacgtcttaagggtgcgggggtgcaataaggccgggtacggggagtattcagaggacgtgcacttgcacactcctcctgcccctgttcttcattttttcctggattcacggtggggggccagtcgcgaacgactagctatcagtaaagatcaacgcgctgttaggtctgtgcctggcctcccattgctgctagctgcagaccgcctacttacaggctgccacctaagcgtcgacgtggttctgggcgacgtggccgttacccagggacgttcctactgggcatgcgcagtggacccagcttcgtacttggtgaaggtgggggtggggctagaatccaagttgcaagaaagctttcagggtgcacccgatgtgatctctcccagatatgaccccgattccggtcatgattccggggccgaagatgctaccgtcgaagcctctcctccatttgcattcctaaccatcgggatggggaagatactgttgggtagcggggcatcatcgaacgcgggactcacaggtagggacggaccgaccgcaggatgcaccgtcccactgccccctcgcctgggaatttgcctcgactatgaaagagggcgggtaagctttctcgacgccgttagtttccgcggtctgctcgagtgccccttggattgcagtggcccagtttgccctgctttttgttttattggtggaggagccgtgcagcttcaggagcccgtcgggacaaagcccgaaaggaaagtgacgattgggggctttgctaagctagattag

SEQ ID NO: 51699 - DNA, 2211 bp, Artificial Sequence
  Description of Artificial Sequence: Synthetic coding sequence
atgaagaacatggagaaggagctgctgtgccccgtgtgccaggagatgtataagcagcctttagtcctcccctgcacccataacgtgtgtcaggcttgtgcaagggaagtgctgggccaacagggttatatcggacatggcggcgatccatcctctgagcccaccagccctgcaagtaccccaagtacccggagccctcgtctatcaaggcgaactctgccaaaaccagataggcttgaccgtctcctaaaaagcggctttggaacgtacccgggcagaaagagaggggccctccacccccaagtgatcatgttcccatgccccgcctgccagggggacgttgaattgggagaacggggcctggcaggactgttccgtaatctgactctggagagggtcgtcgagagataccgccagtccgtgtcagttggcggcgctatcctgtgccagctgtgtaaacccccacccctagaggcaacaaaaggttgtacggagtgtcgcgctactttctgtaacgaatgtttcaaactgttccatccctgggggacgcaaaaggcccagcacgagcctacgcttccaacattgtctttcagacctaaaggattgatgtgccctgatcacaaggaagaggtgactcattactgtaagacatgtcaaagactagtgtgtcagctttgccgggtgcggcgtacacactcaggacataagatcactccagtcctgagtgcctaccaggctctcaaggataaactgacaaagagcctgacctacattctaggtaaccaggataccgtgcagactcagatctgtgaactggaagaggccgtgcgtcatactgaggtgagtggacaacaagctaaggaggaggtgagccaattagtcagggggctgggagcggtgttagaagagaagcgagcctcactactgcaggccatagaggagtgtcagcaggaaagactggcaagactgtccgcacagattcaagaacatcggagcctgctggacggatctggtctcgttggctatgcccaggaggtgcttaaagagaccgaccaaccatgtttcgtgcaggccgccaagcagctgcataatcgcatcgcaagagccacagaggctcttcagaccttccggcctgctgcctcaagttcgtttcgccactgtcagctggacgtgggacgtgaaatgaagctgttaaccgaactgaacttcctgagggtgccggaagcccccgttatcgatactcagaggacattcgcctacgaccaaatcttcctttgttggcggctgccaccccactcccctccagcatggcactatactgtggagtttcgacggactgatgtgcccgcacaacccgggccaacgcggtggcagcggcgcgaggaggtgaggggcacttcggccctcctggagaatcccgacacaggatccgtgtacgtgctgagagtacgtgggtgcaacaaggcggggtatggcgaatacagcgaggacgttcatttgcacactccaccagctcccgtgctacacttttttctggatagtcgatggggcgcatcgcgagagagactggcgatctcaaaggatcagagggccgtgcgctcggttcctggcctcccgttgctcctggctgccgaccgattgcttaccggttgccacctctcagtggatgttgtgctgggagacgttgcggtgactcagggcaggtcttattgggcctgcgccgtggaccccgcatcatatctagttaaagtaggggttgggttagagagcaaactccaggagtcatttcagggagcccccgatgtgatctctcccagatacgatcccgatagtgggcatgattccggggcagaagacgctactgtggaagcgtcacctccgtttgcctttctgactattggcatggggaaaatcttgctcggttccggggcctcgtccaatgcagggctcaccgggagagacggccccacggctgggtgcaccgtgcccctgcccccccgcctgggcatttgtctagactatgagagggggcgcgtgtcctttttagacgccgtgtctttcagaggactcctggaatgccccctggattgcagtggacctgtctgtccggctttttgttttatcggcggcggcgctgtgcaactacaagagcccgtagggaccaaacctgagcggaaggtgaccattggcggatttgccaaactggactag

SEQ ID NO: 51700 - DNA, 1935 bp, Artificial Sequence
  Description of Artificial Sequence: Synthetic coding sequence
atggccgagggcgaggacatgcagaccttcaccagcatcatggacgccctcgtccggatttccacctctatgaagaacatggagaaagagttgttatgtccggtgtgtcaagaaatgtataagcagcccctggtcctgccctgtacgcacaatgtctgccaggcttgcgccagagaagttcttggacaacagggctatattggacacgggggggatccttcttcagaaccgaccagccctgcaagtacgccctccactcgttcacctcggctcagtcgccgtacactcccaaagcccgaccggttggacagactcctgaagagcgggtttgggacctaccccggaagaaagcggggcgcgctccacccacaagtgataatgttcccatgtcctgcttgccaaggagatgttgagctcggagagaggggcctcgcaggattgttccgaaacctcactctggaaagggtggtggagcgctaccgtcaatctgtctcagttggaggggcgattctttgtcagctttgtaagcccccccccctggaggcgaccaaaggatgcaccgagtgcagagcgacattttgcaacgagtgttttaaactttttcacccctgggggacccagaaagctcagcacgagcccacactgcccaccctctcattccgacctaaaggcctgatgtgcccagaccacaaagaggaggtgacacactactgcaagacctgtcagaggcttgtgtgtcagctgtgtagagtgagaagaacccattccggtcacaagatcactcctgtgctcagtgcttatcaggccctcaaagataaactgacaaaatcattgacttacattttgggcaaccaggacacggtacagacacagatatgtgagctcgaagaggcagtgcggcacactgaggtttccgggcagcaggctaaggaagaggtatctcaactggtcagaggcttgggcgcggtgcttgaagagaagcgcgcaagtcttctacaagctatcgaagaatgccagcaggaaaggctcgcccgattatcagcccagatccaggaacataggagtctcttggatggctctgggctagtggggtacgctcaggaggtcctcaaggagacggaccagccatgttttgttcaggcagccaaacaacttcacaatcgaatcgcccgggctaccgaggcgctccagacattcaggcctgcggctagttcgtcttttcgccattgtcagctagatgtgggtcgcgagatgaagctgctcacggaactgaatttcctgagggtccctgaagctcctgtcatagacacccagagaacctttgcatacgatcagatcttcctgtgctggcggctgccaccccacagcccccccgcctggcactacaccgtggaattcagaaggacagatgttcccgcccagcctggcccaacaagatggcagcgccgcgaagaggtcaggggcacctcagccctactggagaatcctgataccggctctgtttatgtcctccgcgtgagagggtgcaacaaggccggttacggcgaatactccgaagacgtgcatctccatacaccccctgctcccgttctgcacttcttcttagactctagatggggggcctcgcgcgagcgcctggctatatctaaggatcaaagggccgtgcgaagtgtgcctggcctgccccttttactggccgccgaccggctgttgaccggatgtcatctgtcagtggatgtggttctaggagacgtcgccgtgacccaggggaggtcttattgggcatgcgctgttgatccagcaagctatctggtgaaagtgggcgtcgggctcgaatccaaattacaagagagcttccaaggagcgcccgatgtgatttctccccgatccgaccccagcgggcgggatggggtctggggaagctggtgggaatag

SEQ ID NO: 51701 - DNA, 1656 bp, Artificial Sequence
  Description of Artificial Sequence: Synthetic coding sequence
atggccgagggcgaggacatgcagaccttcaccagcatcatggacgccctggttaggatctctacgagtatgaagaatatggaaaaggagctgctgtgcccggtttgtcaggagatgtataaacagccacttgtgctaccatgtacacacaacgtctgccaggcttgtgcaagagaggtcctcgggcagcaggggtacatcggacatggcggggatccttcttccgagcctacgagtcccgccagcactccttccaccagaagcccccggctttctcgccgaacactgccaaagcccgaccggctcgaccgtttgctaaaatccggcttcggtacctaccccgggcgcaagagaggagcattgcatccccaggtgatcatgtttccgtgtcctgcttgccagggtgatgtggaattgggagagaggggtctcgcagggcttttcaggaacctgacgttagagcgagtggtcgaacgataccggcagagcgtgtccgtgggaggagctatcctatgccaactgtgcaagccccctcctctcgaagcaaccaaggggtgtacagagtgcagagcgacattttgtaacgaatgttttaagctattccatccttggggaacacaaaaagctcaacacgaacctacgctgcccacgctgtccttcagacctaagggcctaatgtgtccggatcacaaggaagaagttacccattactgtaagacctgccaacgactggtatgccaattgtgccgcgttcgtaggacacactcaggccacaagatcacgcctgtgcttagtgcataccaggcgctcaaggacaagcttaccaaatcactcacctatattctgggcaaccaggacaccgtgcagacccagatctgtgagcttgaagaagcggtgcgacacaccgaggtgtcaggccagcaagctaaggaggaggtttcacaacttgtgagaggattgggagctgtcctagaagagaagcgcgcttcactgctgcaggctattgaggagtgtcaacaggaaaggctggcaagactctctgcccagattcaggagcacagaagcctcctggacggtagtggactggtgggatatgctcaagaggtattgaaggaaacagatcagccgtgctttgtacaggctgctaaacaactgcacaacaggatagcacgggcaaccgaagcgctacagactttcaggcctgctgccagttcatcatttcgtcattgccagctggatgtcggacgggagatgaaattgcttaccgagcttaattttctgagggtccctgaggcacctgtgatcgatacccagagaacattcgcctatgatcaaatctttctgtgctggagactacccccacactcccccccagcatggcattatactgtggagtttcgccgcacggacgtgcctgcccaaccgggaccgacgaggtggcagcgtcgagaagaagtgcggggaaccagtgcactgttggagaatcctgatacaggctctgtgtacgtcctcagggttcggggctgcaacaaggctggctatggcgaatattcggaggatgtacacctccacacacctcccgcccctggcatccaaaatctggccagacgtggtggcgcgtgtttgcaatttcagttgctgggtagactgcgctag

SEQ ID NO: 51702 - DNA, 1497 bp, Artificial Sequence
  Description of Artificial Sequence: Synthetic coding sequence
atggccgagggcgaggacatgcagaccttcaccagcatcatggacgcactagtgcggatttcaaccagcatgaaaaatatggaaaaggaattgctctgtcccgtgtgccaggaaatgtataagcagccactggttttgccatgtacacacaatgtgtgtcaggcttgcgcacgcgaagtgctgggacagcaagggtatatcggacatggcggagatccaagttcggaaccgacaagcccagcttcaacaccttctacccggagtcctcggctgtccagacgaacactccccaaaccggacagactggaccggcttctgaaaagcggattcggaacttatcccggacgcaaaaggggggcactgcacccccaggtgattatgtttccatgcccagcatgccagggcgatgtcgagttgggcgagcgcgggttggccggcctgttcaggaaccttaccctggagcgggtggtcgagaggtatcggcagtctgtgtccgtcggcggcgcaatcttgtgtcagctctgtaaacctcctcctttggaagcaaccaagggctgtacggagtgccgggctaccttctgtaatgagtgctttaagctttttcacccttggggaacgcaaaaggctcaacacgaaccaactctgccgaccctgagctttcgacctaagggtctgatgtgccctgatcacaaagaggaagttacccattattgcaagacatgccagaggctagtgtgtcagttatgcagagtgcggcgaactcattccggtcataaaattaccccagtgctgagtgcttatcaggctttgaaagataagttgacaaaaagcctgacatacattctggggaaccaggacaccgtgcagactcaaatttgcgaactggaagaggccgtgcgccacacggaagtctctggacagcaagctaaagaagaggtatcacagcttgtaaggggcctcggcgcagtgttagaggaaaagcgtgcgtcccttctgcaggccatcgaagaatgccaacaagaacggttggcacgcctctccgcgcagatacaggagcacaggagcctactagatggatcaggattagtcgggtacgcgcaggaggtgctgaaagagacagaccagccctgtttcgtgcaagctgcgaagcagctgcacaatcggatcgctcgcgcgactgaggctctgcagacattccggccagccgctagctcttcttttcggcattgtcagcttgacgttgggcgagaaatgaaattactgacggaacttaatttcctgcggggctgcggccaccgcggactgtgcagtggagccccgcagtgtttgaggccacccagcctcacaccttctgcgccccttccaatgatccggagtagctgcgcagggggttgcccacccatccaccacctccctgggacaattcctctctcctcaggcgcccggatgtgtctgctctcacaggcccctcccgccgggtccggcgggagaagatag

SEQ ID NO: 51703 - DNA, 2154 bp, Artificial Sequence
  Description of Artificial Sequence: Synthetic coding sequence
atggccgccaagcggggcaccaagaccagcatgaagaacatggagaaagaactcctgtgtccggtttgccaggaaatgtataaacagcctctggttttaccatgcacgcacaatgtgtgtcaggcatgcgctagagaggtcctgggtcagcagggctacatagggcacggaggtgaccccagtagcgagccaacttctccagcttctactcctagtacaaggtcaccacggctgagtcgacggaccctgcccaaaccggaccgcttagacagacttctgaagagtgggtttggaacctaccctggtcgaaaaagaggagctcttcacccccaagtcatcatgttcccttgtccggcctgtcagggggacgttgagctgggggagcgagggctcgccggtctgtttcgtaatctgacactcgagagagttgtggaacgttaccgccaatccgtgagtgttggaggcgcaattctatgtcagctctgtaaacccccaccactggaagcaaccaagggctgtacggaatgcagagcgaccttctgtaacgagtgtttcaaacttttccacccttggggcacccagaaggcccagcacgagcctaccctgccaaccctgagcttccgacccaaaggcttgatgtgtcctgaccataaggaagaggtgacgcactattgtaagacctgccagagactcgtttgtcagctgtgtcgagtccgtcggacccatagcggacataagatcacaccagtattgtctgcataccaggctcttaaagataagctgactaagtctttgacatacatcctcgggaatcaggacactgttcagacacagatctgcgagttggaggaaaagcgagcatccttgctgcaggcaattgaggagtgtcagcaggaaaggttagctcggctgtctgcccagattcaggagcaccgaagcctgctcgatggttccggcttggtaggttatgctcaggaggttcttaaggaaacggatcagccctgcttcgtacaggcagctaaacagctgcataatcgcattgctcgagccactgaggctctacagaccttcagacccgcagcctcatcctcatttagacattgccagctggacgtcggtagggaaatgaagttactgacagaactcaactttctgcgagtgccagaggcaccagtgattgacacccagcgtacttttgcatacgaccagatttttttatgctggcgccttcctccccactcacctcccgcatggcattataccgtagagttccgaaggacagatgtgccagctcagcccggcccaacaagatggcagcgtcgtgaagaggttcggggaaccagcgctctccttgaaaatcccgataccgggagcgtgtatgtgttgcgcgtgcgaggatgcaataaggctggatatggagaatattctgaggatgtacacttgcacacaccccctgcacctgtgctccacttttttctggatagtagatggggggcctcacgtgaacgattagctattagcaaggatcagcgcgccgtgcgttccgtccctgggctccctctgctcctagctgctgatcgattgttgaccggctgccatctgtccgtggatgtagttctgggggatgtcgccgtgacgcagggtcgcagttattgggcatgcgcagttgacccggcgtcctatctagtcaaagtgggagttggccttgaatccaaactacaagagagtttccagggtgcgcctgatgttatttccccacgttacgatcccgatagtggacacgacagcggcgccgaagatgcaaccgtggaagcctccccacctttcgccttcctcaccattggaatgggtaaaatcctcctggggtcaggggcgagctctaacgcaggactcacaggtcgggacggacctactgccggctgtaccgtccccttgcctccgagactgggcatctgcctcgattacgagagggggcgcgtgtccttcctagacgcagtatcttttcgggggttgttggagtgccccctcgactgctcggggcccgtatgtccagccttttgcttcatcggcggtggtgccgtgcagttgcaagagcccgtgggcacaaagccagagcgaaaggtgacaatcggtgggtttgccaagctcgattag

SEQ ID NO: 51704 - DNA, 1518 bp, Artificial Sequence
  Description of Artificial Sequence: Synthetic coding sequence
atgcggcggggcggcatcctgggccaccggcccggcccccaggccttcttagtcccgggagcctccgcggcgactctttataagaccagcatgaagaatatggagaaagagttgctctgccccgtttgtcaggagatgtataagcagcccctggtgctgccatgcactcataacgtctgtcaggcgtgcgccagggaggttctgggccagcagggctacatcggacatgggggcgacccttcctccgagccaacgagccctgcaagcacacctagcacccgttccccacgattgtctagacgaaccctgcccaagcccgatcggctcgacaggctgcttaaaagtggttttggtacatatccagggagaaagcgcggagccttacacccgcaagtgattatgttcccttgtccagcttgtcagggggatgtagaactgggagaaagaggcctggccgggttgtttaggaacctgacgctggaaagggtggtggagagatatcggcagtcagttagtgtcggaggagccattctctgccaactctgcaagccgcctcctctggaggccaccaaggggtgtaccgaatgtcgcgccaccttttgcaacgagtgctttaaattattccacccatggggcactcagaaagcccagcacgagcccactctgcccactctgtccttcagaccaaagggcctcatgtgtcccgatcacaaagaagaagtaacgcactattgtaagacatgccaacgtctggtatgccagctgtgtagggttagacggacgcactcaggccataagatcactcccgtgctatccgcctaccaggccttgaaggataagctcaccaaaagtctgacatatattcttggcaatcaggataccgtgcagacacaaatctgtgaactcgaagaagccgtgaggcataccgaagtctctgggcagcaggcgaaggaagaggtgtcacagctggtccgcgggctgggggctgtcctggaggagaaacgcgccagtctcctccaagcaatcgaagagtgtcaacaggagaggctggccaggctcagcgctcagatccaggagcacagaagtctcctggatggctctgggctcgtgggttacgctcaggaggtgttgaaagaaactgaccagccctgtttcgttcaggccgcaaaacagctgcacaatcggatcgctagagctaccgaggcactgcagacatttcgccctgccgcttcctcctcattcagacactgccagctggacgtcgggagagaaatgaaactcctgactgaactcaacttcctgcgggggtgcggccaccggggtctgtgcagtggggcccctcagtgcctgcgacctccctcattgaccccatccgccccactgccaatgattcgtagctcttgtgctggcggatgcccccccattcaccatttaccaggaaccattccactgtcctcaggcgcccggatgtgccttctctcacaggccccccccgcgggcagcggtggcaggcggtag

SEQ ID NO: 51705 - DNA, 1902 bp, Artificial Sequence
  Description of Artificial Sequence: Synthetic coding sequence
atgttcccctgccccgcctgccagggcgacgtggagctgggcgagagaggcttggcaggcctgtttaggaatctcactcttgagagagtagttgagaggtatcgccagtcagtctctgtcggtggcgctatactatgccagctttgcaaaccaccacctcttgaggctaccaagggatgcacagaatgtcgcgctaccttttgcaatgagtgctttaagttgtttcatccatggggcacccagaaagcccaacacgaacctactctacctacactgagctttcggcccaagggactgatgtgtccagaccacaaagaggaggttacgcactactgcaagacttgtcagcgcctcgtctgtcagctgtgccgcgtgcgaagaacacactcaggacataagatcactcctgttctgtccgcataccaggcactaaaggataaactgacgaaaagtcttacctacatccttggcaaccaggataccgtgcagacacagatctgcgaacttgaagaggccgtaaggcatacggaggtctcaggccagcaagcaaaggaggaggtgtcacagctggtgcggggtctgggtgctgtgcttgaggagaagagagcctctctgctccaggccatagaggagtgccagcaagagcgcctcgctaggctcagcgcgcagattcaggagcacaggtcactgctggacgggtcaggattagtcggatatgctcaggaagtgttaaaggagacggatcagccttgctttgtccaggctgccaaacagttacataatcgtatcgcaagagcaacagaagccctacagacattccgccccgcggcctcctcttcgttcaggcactgccagttggacgtcggaagggaaatgaagctgctcaccgaattgaatttcctgcgggttccagaggccccagtgattgatacccagaggacctttgcttatgatcagatctttctgtgctggcgtctgccaccacatagtccccccgcgtggcactacaccgttgagttccggcggacggatgttcccgctcagcccggtcctacacgttggcagcggcgagaggaagtgcgaggcactagtgctcttctggagaatccagataccggctctgtgtatgtgcttcgcgtgcgcggatgtaacaaggcagggtacggagagtactctgaagatgtgcacctgcacacaccccctgccccggtgctgcattttttcttggattccaggtggggtgcctcccgcgaaagattagcgatatccaaagatcagcgagccgtccgttctgtgccgggtttaccattgctgctcgctgctgacaggcttctcaccggctgccatctctccgtggacgttgtgctcggagacgtcgcagttacccagggaagaagctattgggcctgcgcagtcgaccccgcttcatacctggtgaaggtgggcgtgggactggagagtaagctgcaggagtcttttcagggggcccccgatgtgatcagtccgagatacgatcctgacagcggtcatgacagcggagcagaggacgctaccgtcgaggcctccccaccgtttgcttttcttaccatcggtatggggaagatcctgttgggcagcggcgccagcagtaatgctgggctgacggggagggacgggccaacggctgggtgcaccgtgccactgcctcctcgcctcggcatctgccttgactacgagagaggcagggtgtccttcctggacgccgtttcttttaggggcctgctcgaatgtcccctggactgctctgggcccgtttgtccagcattctgcttcatcgggggaggagcggtgcagttacaggagcccgtaggcaccaaacccgaacggaaagtaactatcggtggctttgccaagctggattag

SEQ ID NO: 51706 - DNA, 675 bp, Artificial Sequence
  Description of Artificial Sequence: Synthetic coding sequence
atgagccggcggatcatcgtgggcaccctgcagcggacccagcggaacatgaacagcgggatctcacaggtgttccagcgcgaacttacgtgtccaatctgtatgaactatttcatcgacccggttacaatagactgcggccactccttttgtcgaccctgcttctatctgaactggcaggacatcccgatcttgacgcagtgcttcgaatgtattaagactatacaacaacgcaacctgaaaaccaacatccgcctcaaaaaaatggcttccctggcacgtaaagcatctttgtggctgttcctgagcagcgaggagcaaatgtgtggaattcaccgcgagaccaagaaaatgttttgcgaagttgatcgttctctgctatgcctcctttgcagcagcagtcaggaacatagatatcacagacattgcccagccgagtgggctgctgaagaacactgggaaaagctcctgaaaaaaatgcagagtctgtgggaaaaggcctgtgagaatcagcggaatttgaacgtggagactacacggatcagccactggaaggcatttggtgatattctgtataggagcgaatcagtcttattgcatatgcctcaacccctcaatctagcattacgtgccggacccattactggtctccgtgatcggctaaatcagttctag

SEQ ID NO: 51707 - DNA, 1359 bp, Artificial Sequence
  Description of Artificial Sequence: Synthetic coding sequence
atgaacagcggcatcctgcaggtgttccagggcgagctgatctgccctctctgcatgaattatttcatcgatcctgtaaccattgactgtggtcattctttttgtaggccatgtttctaccttaactggcaggatatcccattcctcgtccagtgttccgagtgtactaagtctactgaacagatcaacctcaaaactaatattcatctgaaaaagatggcatctctcgctaggaaagtaagtctttggctgttcctgagcagcgaagagcagatgtgcggcactcaccgggagactaaaaagatattttgcgaggtcgatcgatcactcctctgcctgctttgctcttccagccaggagcaccgttaccatcggcatagacccatcgagtgggccgccgaagaacatagggagaagctgcttcaaaagatgcagtctctatgggagaaagcatgcgaaaaccataggaatctaaatgtggagaccactcgtacaaggtgctggaaagattacgtgaacttgcgtttagaggctattcgcgcagaataccagaaaatgcccgcatttcatcacgaagaggagaaacacaatctggaaatgcttaaaaaaaagggtaaagaaattttccacagactgcacctaagcaaggccaaaatggcacacagaatggaaatcctgcgcggtatgtatgaagaattgaacgaaatgtgccacaagccagacgtcgagttgctgcaggcctttggggatattttgcataggagcgagagtgtgttgctccacatgccccaacctctgaaccctgaattgagtgccggaccaattactggtctccgggaccgacttaaccaattccgcgttcatatcactctccaccatgaggaagccaacaatgacatcttcctctatgaaattctgcgctccatgtgtatcgggtgtgatcaccaagatgtcccttactttaccgcaacacccagaagcttccttgcatggggagttcagacttttacttctgggaaatattactgggaggttcacgtgggagacagttggaactgggccttcggcgtctgcaacatgtacagaaaagagaaaaaccaaaatgagaaaatcgatggtaaagcagggctatttctacttggatgcgtcaagaatgatattcagtgcagcctgtttaccacctcaccgctcatgcttcaatacatccccaaaccaaccagtagggtgggcttgtttcttgactgcgaagcaaagaccgtgtcctttgtcgatgtgaaccagtcaagcctgatctacactattcccaactgttcattttctcccccacttcggccaattttctgttgtattcacttttag

SEQ ID NO: 51708 - DNA, 1341 bp, Artificial Sequence
  Description of Artificial Sequence: Synthetic coding sequence
atgaacagcggcatcctgcaggtgttccagggcgagctgatctgccccctgtgcatgaactatttcattgatcccgtcaccatcgactgtgggcacagcttttgtcgaccatgtttttatctcaactggcaggacatcccttttctcgtccagtgctccgaatgtaccaagagcaccgagcaaatcaatttgaaaacgaatatacatcttaaaaagatggcaagcctggctaggaaagtctctctttggctgttcctgtccagcgaggagcaaatgtgcggaacacacagagagaccaagaaaatcttttgtgaggttgatcggtctctgctctgcctcctctgctcttcctcacaggagcatcggtaccacaggcaccgaccaatagaatgggcagccgaggaacaccgcgaaaaactcctgcagaagatgcaatctctctgggagaaggcatgcgagaaccacagaaatcttaacgttgagacaacccgcacccgctgttggaaagattacgtgaatctccggctggaagcaattagggcagagtaccaaaaaatgccggcctttcaccacgaagaagaaaagcacaacctcgagatgctgaaaaagaaaggaaaggaaatattccaccggttgcacttgagcaaggctaaaatggcacatcgcatggagatcctgcgaggcatgtatgaagagttaaacgagatgtgtcataaacccgatgtagagctgctccaggatctgggcgatatggtggcccgcagcgaaagtgtgctgctgcacatgctgcagccggtaaacccggaactgccaactggccctattaccggacccgtggaccggttgaatcatttccgcgtggaaatttcctttacgtgggagggaacaaactataatatcggactgttcgaggacgtccgttcactcatgttccggcgcgggtccttaaattctgaccgctctgactatttcgctgcttggggggcttgggttttttcgtcgggcaagcattactgggagctggatgtggacaacagctgggattgggctctgggcgtttgcaaggatagctggattaggaaaaattctaccatgtttaactcgaaggatatctttttgctgttatgcgtcaaggttgataaccactttagtttgttgactacctccccaatgtttccgcactatgtggagaagcccctagtcagggtaggggtctttttgaactttgaaagtggctcagtcagctttctcaacgtaactaaaaactctctcatttggaattaccccgctggaagcttgaattttccggtgcggagcttcttctatacaggacatcgatag

SEQ ID NO: 51709 - DNA, 1359 bp, Artificial Sequence
  Description of Artificial Sequence: Synthetic coding sequence
atgaacagcggcatcctgcaggtgttccagggcgagctgatctgccctctgtgtatgaattatttcattgatcccgtgacgatcgactgtgggcactctttttgccgtccctgtttctacctaaactggcaggacatcccattcctcgtgcaatgttcggagtgcacaaaatctactgagcaaataaacctgaagaccaacatccacctcaagaaaatggcctcactcgctcggaaggtctctctctggttatttctgagcagtgaagaacagatgtgtggaactcaccgggagaccaagaagatattttgcgaggttgatagatccctcctctgcctgctgtgctcttccagccaggaacacagatatcacaggcacagacccatcgagtgggctgctgaagagcacagggagaaactccttcagaagatgcagagtctgtgggaaaaggcctgcgagaaccacaggaacctcaacgtcgagacaacccgcacacgctgctggaaagactacgtgaatctgaggctcgaggctataagagcggagtaccagaaaatgcctgcttttcaccacgaggaggaaaagcataatctggagatgctgaagaagaaaggcaaagagattttccaccggcttcatcttagcaaagccaagatggcccatagaatggagatccttcgtggtatgtatgaagagttaaacgagatgtgtcacaagccagacgtggagctcctccaagccttcggagatatcctccaccggtccgagtccgtgctgttacacatgcctcagcctctcaaccctgaactctcagccgggccaataactgggctcagagatcgactgaatcagtttcgagtacatataacactacaccatgaggaagcaaatagtgacatattcctctacgaaatacttcgctccatgtgcattggctgtgatcaccaggatgtaccgtatttcacggctacaccgagaagctttctcgcctggggcgtgcagacattcacgtctgggaagtattactgggaggtacacgtgggagactcatggaattgggcctttggagtatgtaatatgtacaggaaagagaagaaccagaacgaaaagattgacggcaaggaaggactcttcctcttgggatgtattaaaaatgatatccaatgctccctgttcaccacttcaccactgatgctgcaatatatccccaaacccacatcccgcgtgggattgtttctggattgcgaggcaaaaactgtctccttcgtcgatgtcaaccagtcttcgctgatctacaccattccaaattgcagcttcagccccccacttcgaccaatcttctgctgcattcacttttag

SEQ ID NO: 51710 - DNA, 894 bp, Artificial Sequence
  Description of Artificial Sequence: Synthetic coding sequence
atggccggctacgccaccacccccagccccatgcagaccctgcaggaggaggcagtctgtgccatttgcttggactatttcaaagatcccgtgtccataagttgtggtcacaatttttgccgaggctgcgtaacgcagctctggagcaaagaggacgaggaggaccaaaatgaagaagaagacgaatgggaggaggaagaggacgaggaggcggtaggcgccatggatggctgggacggctctatcagggaggttctgtaccggggaaacgcagatgaggagctcttccaggatcaagacgatgacgagttatggctcggtgactctggcatcacgaattgggacaacgtcgactatatgtgggatgaggaggaggaggaggaggaggaggaccaagactattatttgggcggtcttcgacctgatctgagaattgatgtttacagagaagaagagatcctcgaggcatacgatgaggacgaggatgaggagctgtaccccgatatacacccacctccctcattgcctctcccgggccagtttacgtgtcctcagtgtcgtaaatcattcacccgacgctcgtttcgccctaatcttcagctagccaacatggtccagatcatcaggcaaatgtgtccaaccccctatagaggtaacaggtctaatgatcagggcatgtgctttaaacaccaggaagccctgaaactgttctgcgaggtcgacaaggaggcaatctgtgtagtttgcagggagagcaggtcacacaaacagcactctgtgctgcccctggaggaggtagttcaggagtatcaggagataaagctggagacgacacttgtcggcatcctgcagatagaacaagaatctatccattcaaaagcttataaccagtag

SEQ ID NO: 51711 - DNA, 1461 bp, Artificial Sequence
  Description of Artificial Sequence: Synthetic coding sequence
atggcctgggccccccccggcgagcggctgcgggaggacgcccggtgccctgtttgtctagatttcctgcaggaacctgtatctgtggattgtggacactcattttgtttgagatgtatttctgagttttgcgagaagtccgatggggcccagggcggcgtttacgcctgcccacagtgccgcggtcctttccggccatcgggcttccgccccaacaggcagctcgcaggactagtagaatccgtgcggaggctcgggctgggcgccggcccaggagctagaagatgcgcccgacacggcgaagacctcagcagattttgcgaggaagatgaggcagccctgtgctgggtttgcgatgcgggccccgaacacagaacccataggacagccccactgcaagaagcagccgggtcatatcaggtgaagttacagatggcactggaactgatgagaaaggaactggaggacgccctgactcaagaggcaaacgtcggcaaaaagaccgtcatatggaaggagaaggtcgagatgcagcgccagcggttccgcttggaatttgagaaacataggggtttcctcgctcaggaagaacaacgccagctcaggaggctggaggctgaggagagagccactcttcaacggctgagggagtcaaagtcaaggttggtacagcagagtaaagcactgaaagagctggccgatgaacttcaagagaggtgtcaacgacctgctttgggcctcttggagggagtgcgcggggtgctcagtcgcagcaaagccgtaacacggctggaagccgaaaatatacctatggagctgaagacggcctgctgcatccccgggcggagagaactgctaaggaaattccaagttgacgtgaagctggatcctgccacagcccacccctcgctcctgctgacagccgatctgcgaagtgttcaagacggtgaaccgtggcgcgatgtgccgaacaatccagagagattcgatacgtggccctgcatcctgggcctccaaagtttttcatcaggccgacactactgggaggttctggtgggggagggagccgagtggggcctgggagtctgccaggataccctgcccagaaagggcgaaacaactccgagccccgagaatggggtgtgggctctgtggctgttaaagggcaatgagtacatggttctcgctagccccagtgtcccgttgctgcagctggagtcaccaagatgcattggtatattcctggattacgaggctggtgaaatatccttttacaatgtaaccgacggtagctatatctacaccttcaatcagctcttttcaggcctgcttcggccttacttttttatatgtgacgctactcctcttattctccctccaactactatcgctggctccggaaactgggcctcccgggaccacctggaccccgccagtgatgtgagggatgatcacctgtag

SEQ ID NO: 51712 - DNA, 1416 bp, Artificial Sequence
  Description of Artificial Sequence: Synthetic coding sequence
atggagttcgtgaccgccctggtgaacctgcaggaggagagcagctgtcctatctgtctggaatatttaaaagacccagtgactattaattgcggccacaatttttgccggtcctgtttgagtgttagttggaaggatttagacgataccttcccctgcccggtgtgtcggttctgtttcccttacaagtcatttcgcagaaacccccagctgaggaatctcacagaaatcgcgaaacagcttcaaatccgcaggagcaagagaaaaagacagaaagagaatgccatgtgcgaaaaacacaatcagtttctcaccctcttttgcgttaaggacctcgaaatcctgtgtacccaatgctctttctcaaccaagcaccagaagcattacatctgccccatcaagaaagccgctagctaccatcgggagattctcgagggcagtctggagcctctgagaaacaacatagaaagggtggaaaaggtgattattctgcagggatcaaaatctgtagagctgaagaagaaggtcgagtacaaaagggaggagattaacagcgagtttgagcagattagacttttcttacagaatgagcaggaaatgatcctccggcaaatccaagatgaggaaatgaacatcctcgccaagctgaacgagaatctggtggagctgtcagactatgtgtctacccttaagcacttgctgagagaagtagaggggaagtccgtccagtctaatttggaattattgacacaggctaaatccatgcaccataagtaccagaaccttaagtgtcctgagttgttttcttttcgcctaaccaagtacgggtttagtctaccaccacagtatagtggcctcgatagaattattaaaccctttcaggtcgacgttattctcgacctaaacacagctcaccctcaattgcttgtctcagaggatcggaaggctgtaaggtatgagaggaaaaaaagaaatatctgctacgaccccaggcggttctacgtgtgccctgccgtgctggggagtcaacggttctcttcaggccgacattattgggaagttgaggttggtaataaacccaaatggatactgggcgtgtgtcaggactgcctgctcaggaattggcaagaccaaccttcggtgttagggggattctgggctattgggaggtacatgaagagtggctatgtcgctagcggtccaaagacaacccagcttctgcccgtggtgaaaccctcgaagattggaatttttttagactatgagttgggggacttaagtttctataatatgaacgacaggagcatcctctatactttcaatgattgctttacagaggccgtttggccctacttctacaccggaaccgatagcgagccactgaagatttgctcagtctccgacagcgagaggtag

SEQ ID NO: 51713 - DNA, 273 bp, Artificial Sequence
  Description of Artificial Sequence: Synthetic coding sequence
atggagttcgtgaccgccctggtgaacctgcaggaggagagcagctgtcccatctgtctcgaatatctgaaagatcctgtaaccattaattgtggccataacttctgtcggtcgtgcctgtccgtctcttggaaagatttggatgacacctttccctgcccggtgtgcaggttttgcttcccatacaagtcatttagaaggaaccctcagctgaggaatttaacggaaatcgcaaaacaattacagataagaaggagcaaacgaaagagatag

SEQ ID NO: 51714 - DNA, 1416 bp, Artificial Sequence
  Description of Artificial Sequence: Synthetic coding sequence
atggagttcgtgaccgccctggtgaacctgcaggaggagagcagctgtcctatttgtttggaataccttaaggacccagtgaccatcaattgcgggcataacttttgccggtcctgtttatcagttagctggaaagatctcgacgatacatttccctgtcccgtttgtcgcttttgtttcccttacaagtcttttcggaggaacccccaacttcgcaacctgaccgagatcgcaaagcagctgcaaattcgtaggtctaagcggaagcgccagaaagagaatgctatgtgtgagaagcataatcagttcttgacattgttttgcgtgaaagacctagagattctgtgtacccaatgttctttttcaactaaacaccagaaacattacatatgccccattaagaaggctgctagctaccaccgggaaatcctggaaggctccttggagcccctgcgcaataacattgaacgggtcgagaaagttattatcctgcaagggtcaaagagtgtggaactgaagaaaaaagttgaatacaaaagagaagagatcaattctgagtttgagcagattaggttattcttacaaaatgagcaagagatgattctgaggcagatccaggatgaggagatgaacattctggccaaactcaacgagaacctcgtggaactgagtgactatgtctctactctcaagcacttgttaagggaagttgaaggcaagagcgtgcagtcgaatcttgagctgcttactcaagcgaagagcatgcaccacaagtatcagaacctcaaatgcccggaattatttagcttccggcttactaagtatgggttcagcctgcccccgcagtatagtggattggaccgcataatcaaaccgtttcaagtggacgtgatattagatcttaacacagctcatccgcaactgcttgtgagtgaggaccgcaaggccgtccgatacgaacgcaagaaaaggaacatttgctatgatccaaggcgattttacgtgtgtccagccgtactgggatcacaaagattctcttccggccggcactactgggaggtggaagtgggcaacaagccaaagtggattctcggggtatgccaggattgcctgctccggaattggcaggatcagccaagcgtgctcgggggcttttgggccattgggaggtacatgaagtccggctacgtagcatcgggtcctaagacaacacagcttttgcccgtcgtgaaacccagcaagataggcattttccttgactatgagctcggggacctgagtttttataacatgaacgataggtccatactgtacaccttcaacgactgtttcactgaagcagtctggccgtatttctacacggggactgatagcgagccgctcaagatttgtagcgttagcgattccgagaggtag

SEQ ID NO: 51715 - DNA, 1416 bp, Artificial Sequence
  Description of Artificial Sequence: Synthetic coding sequence
atggagttcgtgaccgccctggtgaacctgcaggaggagagcagctgcccaatttgtctagagtaccttaaggaccctgtgactattaattgtggccacaacttttgccgcagctgcctgagcgtaagttggaaggatttggacgataccttcccttgtccagtatgccggttttgcttcccctacaagagctttaggaggaaccctcagctcaggaacctcactgaaatagccaaacagctacagatccggcgttcaaagcggaaacggcagaaagaaaacgctatgtgtgaaaaacacaatcagttcctaaccttgttctgcgtgaaggacttggagatactctgcacccagtgctcctttagcactaagcatcagaaacactatatctgcccgataaaaaaggccgccagctaccacagggagattctggagggtagcctcgagccccttcgcaacaatattgagcgggtcgaaaaggtcattattttgcaagggtcgaaaagcgtggagctgaaaaagaaggtagaatacaagagggaggagatcaacagcgaatttgaacagatccgtttattcctccagaatgaacaagagatgatccttcgtcagattcaggacgaggagatgaacattctggcgaaattgaatgaaaacctggttgaacttagcgactacgtctcaacgctaaagcacttactccgggaagtggaggggaagtccgttcaatccaacctggagcttttaacacaggcaaagagcatgcaccacaagtaccagaatttgaagtgccccgaactcttctctttccgcttgactaagtacggtttttccctgcccccccagtactcgggtctggaccgaatcatcaaacccttccaggtggacgtaattctagacctgaacacagcacatccgcagttactggtgagcgaggaccgcaaggcggtgcggtatgaaaggaagaagcgcaatatatgttacgatcctcgacggttttacgtgtgccccgcagtcctgggatcgcagcggttttcttccggtaggcactactgggaagtcgaagtagggaacaaacctaagtggatcctgggcgtctgtcaagactgcctgctgcgcaattggcaggaccagccaagcgttctgggtggcttctgggcaatcggccggtatatgaagtcagggtatgtggctagcggaccgaagactactcaactccttcccgttgttaagcccagcaaaatcggcatcttcttagattacgaactcggagacctgtcattctacaatatgaacgatagatctatactctatacgttcaacgactgctttaccgaggctgtttggccttatttttacacaggcactgacagtgagccactgaagatttgcagcgtcagcgactccgagaggtag

SEQ ID NO: 51716 - DNA, 630 bp, Artificial Sequence
  Description of Artificial Sequence: Synthetic coding sequence
atggagttcgtgaccgccctggccgacctgcgggccgaggccagctgcccaatttgcctggattacctcaaggatcctgtgaccataagctgtgggcacaatttttgcctcagctgtattatcatgtcctggaaggatctccacgacagcttcccatgccccttttgtcatttttgttgtccagagcgtaagttcatctctaatcctcagctgggctctctgactgagatcgctaagcagctgcagattcggtcaaaaaaacgcaagcgccaagaagagaagcacgtctgcaagaaacataaccaggtactcacctttttttgtcagaaggatcttgaactcctctgcccgagatgttctttaagtacagaccaccagcaccattgtgtgtggccgatcaaaaaggcagcaagctaccatcggaagaagttggaggaatataatgctccttggaaagagcgagtcgagctgatcgagaaagtcattaccatgcagactcggaagagcttggagcttaagaagaagatggagagtcccagcgtcacaaggctcgagtgctcatgtaccatctccgcgcactttaacttacggttaccagggtcatccgactcatctgccagcggctcgtag

SEQ ID NO: 51717 - DNA, 1428 bp, Artificial Sequence
  Description of Artificial Sequence: Synthetic coding sequence
atggcctgcagcctgaaggacgagctgctgtgcagcatctgcctgagcatttaccaggaccctgtctccctgggctgcgaacattatttttgcaggcggtgtataaccgaacactgggtccggcaggaggctcaaggcgccagagattgccccgagtgcagacgaaccttcgctgagcccgccctagcaccctccttaaagctggcaaatattgtcgagaggtactcttcctttcctctggatgccattctgaatgccaggagggccgcccggccttgtcaggcacatgataaggttaagcttttctgtcttacagacagagccctattgtgtttcttttgcgatgagcctgcacttcacgaacagcaccaggtgaccggcatcgacgatgcattcgatgagttgcagcgggagctgaaagaccagcttcaagccctgcaggactctgagcgcgagcacacagaagccttgcagctgctgaagcgccaactggcagagaccaaatctagcaccaaaagcctacggactaccatcggggaagctttcgagagattacaccggctcttgcgggagagacagaaggcaatgctggaggaattggaggccgatacagcaagaacgctgacagacatcgagcagaaggtccagcggtactcccaacagctaaggaaggtccaggagggagcccaaattctgcaggagaggctggccgagacagaccgacataccttcttggctggagtggcaagtctaagtgagcgcttaaaaggcaagatccacgaaaccaatctgacttacgaggacttcccgacctccaagtacacaggccccctgcagtataccatctggaaatccctgttccaggacatccacccagtccctgctgctcttacgctcgatcccgggaccgcccaccagcggcttatcctgtctgacgattgcacgatcgtggcctatgggaacctgcatccacagccacttcaagactcacctaagcgctttgatgttgaggtatctgtcttaggcagcgaagcgttttcttcgggggtgcattactgggaggttgtcgtagcagagaaaacgcagtgggttatcggcttggcccatgaagcagcgtctaggaagggatctatccaaatacagcccagtagaggcttctactgtatcgtaatgcacgatggcaaccaatacagcgcctgcaccgagccatggaccagattgaacgttcgggataagctggataaggttggcgtgtttcttgactacgatcaggggttgttgatcttttacaacgccgacgatatgtcatggctctacacgttcagagagaaattccccggaaagttgtgcagttacttctcacctggccagtcacacgcaaatgggaagaatgttcaaccgctgaggataaacacagttagaatctag

SEQ ID NO: 51718 - DNA, 1185 bp, Artificial Sequence
  Description of Artificial Sequence: Synthetic coding sequence
atggcctgcagcctgaaggacgagctgctgtgcagcatctgcctgtccatataccaagaccctgtgtcactgggatgcgagcattatttttgcagacggtgtatcactgagcattgggttagacaggaggcccagggggccagggattgtcccgaatgccgccgcaccttcgccgaacctgcactcgccccctctctgaagttggcaaatattgtagagagatacagctcattcccactggacgcaatcctcaatgcaagaagggcggcccgcccctgtcaagcacacgacaaggttaagctcttttgcctgactgatagggctctgctgtgtttcttctgtgacgagcccgctctccatgaacagcatcaggtcactggtattgatgatgcgttcgacgagctgcagcgcgaattgaaagatcaactgcaagccctccaagatagtgaacgtgagcacacagaggcactgcagcttcttaagcggcagctggcagagaccaaatcgtcgactaaatccctgcggacgactattggggaggcgttcgaacgcctgcaccggctgctgcgggaacgtcaaaaggccatgctggaggaactcgaggccgacacggcccgaaccctcacggatatagaacagaaggtgcaacggtactcgcagcagctgagaaaggtgcaggaaggagcacagattctccaagagagactggccgagactgaccgtcatacattcctggccggcgtcgcgagcttgtccgagaggctcaaaggcaagatccacgaaaccaatttgacgtatgaggacttccctacaagcaagtacaccggaccacttcagtacaccatttggaagtctctgtttcaggatattcaccccgttcctgccgccttaacccttgatcctggtacggctcatcagaggttgatattgtccgacgactgcactatcgtcgcctatggaaatctacatcctcagccactgcaggacagcccaaagagattcgacgtggaggtctctgtgctgggcagcgaggccttttcaagcggggtgcattactgggaggtcgttgtagctgaaaaaacgcagtgggtgataggtctcgctcacgaagctgcttctagaaagggttctatacagatacagaacctgggttgtaagggtgtttgggagatgtcttttccatag

SEQ ID NO: 51719 - DNA, 1185 bp, Artificial Sequence
  Description of Artificial Sequence: Synthetic coding sequence
atggcctgcagcctgaaggacgagctgctgtgcagcatctgcctgtccatttaccaggaccctgttagcctggggtgcgaacattatttttgccgtcggtgcattacagaacattgggttcgacaggaggctcagggcgcccgcgattgccccgagtgtcgccgaacttttgccgaacccgccctcgcccccagtcttaagcttgcaaacattgttgaacgttactcctccttccctctagacgctattctgaacgcaagacgggctgcgcgaccatgccaggcacatgacaaagtcaaactcttttgtctgacagatagggccctactgtgttttttctgcgatgaacctgcactgcacgaacaacatcaggtgacaggcattgatgatgcatttgacgagttgcaacgggagcttaaggaccagctgcaagccctacaggacagtgagagagagcacacagaagctttgcaactgctgaagcgccaacttgccgaaacaaagtccagcactaaaagtcttcgcaccacgattggggaggcctttgaaagactgcaccgcctgttgagggaaagacaaaaggccatgttggaggaacttgaagccgataccgctcgtactttgacagacatcgaacagaaggtgcagagatatagccagcagctgagaaaagtccaggaaggggcacaaatcttacaggagaggctggccgagaccgaccggcacacgtttctggcgggcgtagcttctctgtctgaacgcttaaaagggaaaattcacgagacaaatctgacctacgaggattttcccacctctaaatatactggtcccttgcagtacacaatttggaagtctctgtttcaagatattcatccggtacctgctgcgcttacactggatcctggtacagctcatcagagactcattctcagcgacgactgtacaatagtagcgtatgggaaccttcatccccagcctctgcaggactcgccaaagagatttgatgtggaagtctctgtgctcggtagcgaagcgttcagctctggagtacactactgggaagtcgtcgtggctgagaaaacacagtgggtaattggattggcacatgaagccgcgtcaagaaaaggctccatccaaatacagaacctaggatgcaaaggagtgtgggaaatgtcctttccatag

SEQ ID NO: 51720 - DNA, 1428 bp, Artificial Sequence
  Description of Artificial Sequence: Synthetic coding sequence
atggcctgcagcctgaaggacgagctgctgtgcagcatctgcctgtcgatctaccaggatcctgtaagcctgggctgcgaacactatttctgtcggcgctgcatcactgaacactgggtgaggcaggaagcacagggtgctagagactgtccagagtgtcgaagaacctttgccgagccggctctcgcgccgtctctcaaactcgcgaatatcgttgagaggtatagttcttttccactggatgcgatcctgaacgctcgtcgggctgctagaccatgtcaggcacacgataaggtgaagttgttctgtttgaccgaccgtgcactactgtgcttcttttgtgacgaacccgctctccatgaacagcaccaagtcactggtatcgatgacgcattcgacgagctccagcgggagctgaaggatcaattacaagctctccaggattctgagcgggagcacacagaggccttgcagttgttgaagagacagctggctgagaccaagtcatcaaccaagagcctgcgtacaacaataggggaggcatttgagagactacatcgtcttctgcgggagagacaaaaggcaatgctggaagaacttgaggctgacacagcccggacgttaactgatatagagcaaaaggtccaaagatactcccagcagctccgcaaagtgcaggagggggctcaaatcctgcaggaacgcttggccgaaactgatagacatacgttcctcgcgggggtggcgtccttgtccgaacggctcaaagggaaaatccacgagactaacctaacatatgaggatttccccacatctaaatacacagggccactgcagtatacaatatggaagagtctcttccaggatatccacccagtgcctgccgccttgaccctggacccagggaccgctcaccaacggctcatattatcggatgactgcacaatagtggcctacggaaacttgcatcctcagccattgcaggacagtcctaagagattcgacgtggaggtgagcgtgttggggagcgaagccttctcttcgggagtccactactgggaagtagtggtggcggagaagactcagtgggtgatcggtctcgcgcacgaagccgcttcccggaagggctcaatacaaattcaacccagtagagggttctattgcatcgtgatgcacgatgggaatcagtacagcgcgtgcaccgaaccctggacccgtctcaatgtgagggataaattggacaaagtcggcgtgtttctcgattatgatcagggcctgctgatcttctacaatgcggacgatatgagctggctctacaccttcagagaaaaattccccgggaagctgtgttcatacttctccccaggacagtcacatgccaacggaaaaaacgtgcagcccctgagaatcaataccgtcagaatatag

SEQ ID NO: 51721 - DNA, 1065 bp, Artificial Sequence
  Description of Artificial Sequence: Synthetic coding sequence
atgcccgagaagaccgccgtggaccagccctggacccaggccctgagagagctgaaggaccaactgcaagccttgcaggacagtgaaagggaacacactgaagccttacagctcttgaaaaggcaactggccgagacaaaatctagcactaaatctctgcgcacaacaatcggagaagctttcgaacgcctccataggctcctgcgtgagaggcagaaggccatgttggaggagctggaagctgatacagcacggaccttaacagatattgaacagaaggtacagaggtatagtcagcagctgagaaaagtacaggagggcgcccagatactgcaggagcgccttgctgagaccgatcgtcatacatttttagccggggtagcgtctttgtccgagaggttaaaagggaagattcacgagaccaatttgacgtacgaggactttcctactagcaagtacacaggtcctctccagtatactatctggaagtcactgtttcaagatatccatcccgtgcctgctgctctgacactcgatcccggaactgcccaccagcgattgattctgtctgatgactgtactatcgttgcatatggaaacctgcatccccagcccctccaagacagtcccaagcgctttgacgtggaggtgagtgtacttgggtcagaagcctttagttctggggttcattattgggaggttgtcgttgccgaaaaaacccaatgggtgatcggcttggcgcacgaagcagcgtccaggaagggaagcatccaaattcagcccagccggggtttttattgtatagttatgcacgacgggaatcagtacagtgcttgcactgagccttggacaagactgaacgtgagggataagcttgataaagtcggtgtgttccttgattacgatcaggggttactaattttttacaacgctgatgacatgagctggttgtataccttccgtgagaagtttcctggcaaactctgcagttatttttcaccaggtcagagccacgccaacggaaaaaatgtgcaacccctgcgcatcaacactgtgcgcatctag

SEQ ID NO: 51722 - DNA, 1350 bp, Artificial Sequence
  Description of Artificial Sequence: Synthetic coding sequence
atggacagcgacgacctgcaggtgttccagaacgagctgatctgctgtatctgcgtgaattactttatcgaccctgtcactatcgactgcgggcattctttctgcaggccctgtctttgcctctgttccgaggaagggcgtgcgcctatgcgctgtccctcatgtcggaagacctccgaaaagcccaattttaatacaaacctcgtgctgaagaaactgtcctccctcgctaggcaaaccagaccgcagaacattaattcgtccgacaatatctgtgttctacatgaggaaacaaaggagctgttttgcgaggcagacaaacggctgctgtgcggcccttgttccgagtcccctgaacatatggcccacagccacagtcctatcgggtgggctgccgaggaatgtagagagaagcttatcaaagagatggactatctttgggagattaaccaggaaacccgaaataacctgaaccaagaaaccagcacctttcattctctcaaagattacgtctccgtacgtaagcgcattatcaccattcagtatcagaagatgcctatttttctcgacgaagaagagcagcgccacctccaggcgctggagagggaagccgaagaactgtttcagcagcttcaagattcccaggtccgtatgacgcagcaccttgagcgaatgaaggacatgtatcgtgaactgtgggagacctgccacatgccagacgtggtgctgctccaagacgtccggaatgtgtctgccaggacagatttagcccagatgcagaagccccagccagtgaatccagagttaacttcatggtgtatcactggggtgctcgacatgctgaacaattttcgcgtggactctgcattatcaaccgagatgattccttgttacattagtttgtctgaagatgtgcgctacgttattttcggggatgaccatttatcagctcccactgatccacagggagtagattcgttcgcagtttggggcgcccaggcctttaccagcggtaaacattattgggaagttgatgtgaccctatctagcaattggattcttggggtgtgcagggatagtcggaccgcagacgccaacttcgtaattgattcagatgagcgtttcttcctgatcagcagtaagcgcagtaatcattacagcctctctaccaactccccacccttgattcaatatgtgcagagaccattggggcgagtcggagtgtttctggattacgataacggcagcgtttcattcttcgacgtttcgaagggcagcctaatttatggctttccgccatcatccttttcaagccccctgcggccctttttctgctttggttgtacctag

SEQ ID NO: 51723 - DNA, 1344 bp, Artificial Sequence
  Description of Artificial Sequence: Synthetic coding sequence
atggacagcgacaccctgcgggtgttccagaacgagctgatctgctgcatatgcgtgaactattttatcgaccccgtcacaactgattgtgtgcactccttctgcagaccctgcctgtgtctctgttccgaggaaggccgtgcccccatgcgctgtccactatgtcgcaagattagtgaaaagcccaatttcaacaccaacgtcgcactgaagaaactggcctcactggccaggcagactcggcctcagaatataaactcctccgataacatctgtgtcctgcacgaagagacaaaagagttattttgtgaggcggataaacgtctactttgtggtccatgcagcgagtctccagagcatatggcgcatagccacagtccgattggctgggctgcggaggagtgccgggtgcagaaactgattaaggagatggattatctctggaagatcaaccaggagacgcagaacaacctcaaccaggaaaccagcaaattctgcagcctcgtggaagataaaagaaacagaatcgtgtatcgctatcagaagatgcacatttttcttgatgaggaggagcagcgtcatctgcaggctctggaacgcgaagcaaaagaactgtttcagcagttacaagattctcaagtgcgtatgacccagcatctcgagggcatgaaagacatgtatagagagctatgggagacttatcatatgcctgatgtggaactcctgcaagacgttggcaacataagcgcacggacagacctggcccagatgccaaaaccacagcccgtcaatccagaactaacttcctggtgcattacaggcgtgctggatatgttgaataactttcgagttgataacgccctgagcactgagatgacgccgtgctacatctcactctcggaggatgtgcgacgggttattttcggagatgaccataggtccgcccctatggacccacagggagtggaatccttcgccgtttggtgcgcccaggcttttacctccgggaagcattactgggaggtggacgtgactcatagtagcaattggatcttaggtgtgtgcagagattcgcgcaccgccgatacaaacatagtgatcgactccgataagacgtttttcagcatttccagtaagacctccaatcattattcacttagtaccaatagccctcccttaattcagtacgttcagagaccgctggggtgggtaggcgttttcctcgactacgataatggatcagtaagcttctttgatgtgagtaaagggtcactgatctacggattccctccctctagcttcagttctccactgcggcccttcttctgcttcggctgtacatag

SEQ ID NO: 51724 - DNA, 1554 bp, Artificial Sequence
  Description of Artificial Sequence: Synthetic coding sequence
atggccgcccagctgctggaggagaagctgacctgcgccatctgcttaggactgtaccaagatccagttactctcccctgtgggcataacttctgtggtgcctgtatccgggactggtgggaccgatgcgggaaagcatgcccagaatgccgagaaccttttccggatggcgccgaactgcgtcgtaacgttgctctgtctggcgtcttggaagtcgtaagggccggaccagcaagagatcccgggcccgatcctggccccggtccggaccccgcagctagatgcccgcggcatggccgacccttagagttattctgtcggaccgagggtcgttgtgtgtgtagcgtgtgcaccgtgagagaatgtagattacacgagcgagctctgctggacgctgaacgcttgaaacgcgaggctcagctgcgtgctagtttagaagtaacccaacagcaggccacacaggcagaggggcaacttctcgagttgcgcaaacagtcatctcagatccagaacagtgcctgcattctggccagctgggtgtctgggaagttctcatccctcctgcaggcactcgagattcagcacactacagccctccggagcatcgaagttgctaagacccaggccctagcccaggcccgggacgaggagcagcgcctgagagtgcatttagaagccgtggctaggcacggttgccgaattcgagaactcctggagcaagtggatgagcagacattcttgcaggaatcccaattactccaaccacccgggcccttagggccacttacacctctgcaatgggatgaggatcagcagttgggcgatctgaagcagctgttgtcccgactttgcggcctgctgttagaagaaggcagccacccaggcgctccagcaaaaccagtcgacctggcccccgtagaagcgcctggtcctctcgctcccgtgcccagcaccgtgtgtcctcttcgcagaaagctctggcagaattataggaacctgaccttcgaccctgtgtccgcgaatagacatttttacctgagccggcaagaccagcaggtgaagcattgccggcagtctcggggtccagggggaccgggcagcttcgaactctggcaggtgcagtgtgcgcaatcattccaggccggtcatcattactgggaagtgagagcaagcgatcattccgtgacccttggggtgagctacccccagctcccaagatgcagactaggcccccacaccgacaacattggcagaggcccctgcagttggggactctgcgtccaggaggattcactccaggcttggcataatggcgaagcccagcgactgccaggagtatcaggaaggctcctgggcatggacctggatttagccagcgggtgtcttacattctattctttagagccccagacacaacccctctacacgttccacgcattgtttaaccagccattgaccccggtgttctggttgctggaaggaaggaccctaacactgtgccatcaaccaggcgccgtcttccctctcggaccccaagaagaagtactgagctag

SEQ ID NO: 51725 - DNA, 1407 bp, Artificial Sequence
  Description of Artificial Sequence: Synthetic coding sequence
atgagcaccgccgacctgatggagaacctgcgggaggagctgacctgtttcatatgcctggattatttcagctctcccgttacgacagagtgtggacattctttttgccttgtgtgtcttttgcgcagttgggaggaacataatacccccctctcttgtcctgagtgctggcgcactctggagggacctcatttccagtctaatgaacgactcggcaggctcgcctcgatagctcggcagctgcgctcgcaggtcctccagagcgaggatgagcaggggagctacggaaggatgccaactactgccaaggcactgtctgacgacgagcaaggcggttctgccttcgtggcccagtcgcacggcgctaaccgggtccatttgtccagcgaggcagaagagcaccaccgggaaaaactgcaggagattcttaatttactgcgggttcgtaggaaggaggcccaggcggtgctgactcatgagaaggaaagggtcaagttgtgccaggaggagacgaaaacctgtaaacaggttgtcgtaagtgaatatatgaagatgcatcagttcttgaaagaagaggagcagctccagctgcaactgttggagcaggaagaaaaggaaaatatgcgcaagttgcgcaacaatgagattaaactgactcagcaaatcaggagtttgagtaaaatgatcgcacagatagaaagctcttctcagagttccgcatttgaatcgttggaagaggtccgcggtgctttggagaggtccgaaccattgctgttacagtgcccagaggcaactacaaccgaactctctttgtgtcggattaccgggatgaaggagatgctaaggaagttttcaacagaaattacactcgatcccgctacagcaaacgcgtatctggtgctcagcgaggatcttaaaagcgtcaaatacggaggcagccgacagcagctgcccgacaacccagagcggttcgatcagtctgcgacggttctaggaacgcagatcttcacctctggtcgccactactgggaggtggaggtcggcaacaagacagagtgggaggtgggcatctgtaaggatagtgtgagtagaaaaggcaacctcccgaaacctcctggagacttgttctcgctgatcgggttgaaaatcggagacgattattccctgtgggtcagcagccctctgaaaggtcaacacgtccgagagcccgtttgcaaggtcggggtcttcttggattatgagtctggccatattgccttctacaatggaactgacgaatcattaatctactctttccctcaggcctccttccaggaggctttgcgaccaattttttccccttgcctgcctaacgaaggaactaatacagaccccttgaccatctgtagtctgaattctcatgtgtag

SEQ ID NO: 51726 - DNA, 1164 bp, Artificial Sequence
  Description of Artificial Sequence: Synthetic coding sequence
atggtgtgcggcatccaggaggccgccgagaactaccggaagctgttccaagaaattctcaacacgagtcgcgaaaaacttgaagccgccaagtctatactgacggacgagcaagagcgtatggccatgatccaagaggaggagcagaactttaaaaaaatgattgagagcgagtactcaatgcgcctcagactgctgaacgaagagtgtgagcagaatctccagagacagcaggaatgcataagtgatttgaatctgagggagactttgctgaatcaggccatcaagctggcgactgaactggaagaaatgtttcaagaaatgctgcagcgcctcgggcgcgtgggccgggagaacatggaaaagctgaaggaatcagaggctcgcgccagtgaacaggtgcgcagcctactcaaacttatcgtggagttggagaaaaagtgcggcgagggcacattggctctgctgaagaacgccaaatatagcttggaaagatcaaagagcctcctactcgaacatttggagccagcccacatcactgacctctcgctgtgtcacattcgcggactatcatccatgttccgggttctgcagcgccaccttacgctggatccagaaacagctcacccatgcctggctctctctgaggatttgaggaccatgagactacgccatggccagcaggatggagcgggcaatcccgagcggctggacttctccgcaatggtcttggccgccgaaagtttcacgagcggccgacattattgggaagtggatgtcgagaaggcaacccgctggcaggtcggcatatatcacgggagtgctgacgccaaggggagtactgcaagagcgtctggagaaaaggttttactgaccggatccgtcatgggcactgagtggaccctgtgggtgttcccacccctgaaaagactgttcctggagaagaaactagatacagtgggagtgtttctggactgtgagcatggccagatttctttctacaacgtgaccgagatgtcactgatctacaactttagccactgtgcgttccagggcgccctgcggccagtcttttccctgtgcatccccaacggggacacctcccccgatagcttgaccatcctgcagcacggaccttcctgcgacgctacagttagcccctag

SEQ ID NO: 51727 - DNA, 666 bp, Artificial Sequence
  Description of Artificial Sequence: Synthetic coding sequence
atgagcaagcggctgagcccccagctgcagcacaacatcaccgaggatgcctactgcgaaacacacctggaacccacccgactattctgcgatgtggaccaaattactctgtgttcaaagtgcttccagagccaagagcataagcaccacatggtgtgtgggatccaggaggcggcagagaactataggaagttattccaagagatcctgaacacctcgagggaaaagctggaggccgctaaaagcattctcacagatgagcaagaaaggatggctatgattcaggaggaggaacagaattttaaaaaaatgattgagtctgaatacagtatgagactacgactgctcaacgaggagtgcgaacagaatctgcagcgtcagcaggagtgtatcagtgacctcaacctgagggagacgctgttgaaccaggcaatcaagcttgctaccgagttggaggaaatgtttcaagagatgctccagaggctaggcagggtcggtcgagagaatatggagaagctgaaagaatctgaggcccgtgcttcagaacaggtgcgaagtttgctcaagctgatcgtcgagctagaaaagaagtgcggcgaaggaacgttggcgcttctcaaggtccgctgctgggagaaggaaaataagattcattctagtatctag

SEQ ID NO: 51728 - DNA, 1173 bp, Artificial Sequence
  Description of Artificial Sequence: Synthetic coding sequence
atgtgcatctgccacctgccctgccggcccgtgaagcccaacatcattggtgagcaaataactagtaaaatgggcgcacactaccattgcattatctgttccgccacaatcaccagacgcaccgatatgctgggccatgtccgaaggcacatgaacaaaggcgagactaagtccagttacattgccgcaagcacggcgaaacccccaaaagagatactgaaggaagcagatacggacgttcaggtgtgcccaaattatagtatccctcaaaagacagattcttatttcaaccctaagatgaagttgaatcggcagttaatcttctgtacactggcggcacttgctgaggaacgaaagcctttggaatgtctggatgcctttggggctaccgggattatgggccttcaatgggccaaacacctgggaaacgccgtcaaggtgaccataaacgatctgaacgagaacagcgttaccctgatacaggaaaattgtcatctgaacaagctcaaggtggtggtggacagcaaggaaaaggaaaagagtgatgacatacttgaggagggtgagaagaacctaggaaacattaaggtgactaagatggatgctaacgtgctgatgcacctgagatcatttgactttatacatctcgacccctttggtacttcagtcaattatttggatagtgccttccgaaacattcgcaacctgggtattgtgtcagtcactagcaccgatatcagctccctgtacgctaaggcccagcatgtggccagacgccactacggatgtaacattgtacgcactgagtactacaaagagctggccgctaggatcgtcgtggccgccgtcgcaagggctgcggctcgatgcaacaaaggaatcgaagttctctttgctgtagcactggaacatttcgttctggtagtggtacgcgttcttcgaggaccaacttctgctgatgagactgctaagaagattcagtatttgattcactgccagtggtgcgaggaaagaatattccaaaaagatggcaacatggtcgaggattacagcgccaacttcgtcatctcatataccggcttcccattcgtcaatcgccaggatatcaggaagactcatatcgatagttgcctggttacagtcatggaagcgtgcctggagcggcaacagtag

SEQ ID NO: 51729 - DNA, 2202 bp, Artificial Sequence
  Description of Artificial Sequence: Synthetic coding sequence
atggagaacatggccgaggaggagctgctgcccctggagaaggaggaggtggaagtggcacaggttcaagtcccaaccccagccagggactcggcgggcgtccccgcgccagcccccgacagcgctcttgattctgcacccactccagcatccgcacctgcccccgctcccgctctcgcacaagcgcccgcgttgtcaccgtccctcgccagcgcaccagaggaagcgaagagcaaacgccacatatctattcagagacagctggctgacctggagaacctggcgtttgtcacagatggcaattttgacagcgcatcatcactgaattctgataacctggatgctgggaaccgtcaggcgtgcccattgtgccctaaggaaaagttccgggcctgcaattcccacaaacttcggcgccaccttcagaatcttcattggaaagtttctgtggaattcgaaggataccggatgtgcatctgtcacttaccatgcaggcccgttaagccaaacatcataggagagcaaataacaagcaagatgggcgcccattaccactgcattatttgctcggccaccatcacacgacggacagacatgctgggccatgtgcggcggcacatgaacaagggcgaaacaaaatcaagttacattgctgctagcacagctaaaccccccaaagaaatcctgaaagaggcagatactgatgtccaagtttgccccaattacagcatcccccaaaagacggattcctactttaaccccaaaatgaaattgaataggcagctgattttttgcaccctcgccgcgttagctgaagaaagaaaacctctggaatgtttagacgcatttggcgcaaccggcatcatgggcctgcagtgggcgaaacatctggggaatgccgtaaaggtgaccatcaatgatctaaatgaaaacagcgttaccctcattcaagagaattgccacctgaacaaactaaaagtggtggtggacagcaaggaaaaggagaagtcagacgacatcctggaggagggtgagaaaaacctgggcaacattaaagttactaagatggatgccaatgtcctcatgcacctcaggtcatttgacttcattcacctggaccctttcggtacttcagtgaattacctggattctgcattcagaaatatacgcaacttgggcatcgttagtgtcacgagcactgatatctccagcttgtacgctaaggcccaacatgtcgcccggcgccattatgggtgcaacattgttcggacagagtattataaggagttggcagcccgcatcgtcgtggccgcggtcgccagggcagcagccagatgcaataaaggcatcgaggtgctgtttgcggtcgctcttgaacactttgtgctggttgtagttagagtgcttcgcggacccacctcagccgacgagacagccaagaaaatacaatacttgatccattgtcagtggtgtgaggagagaatcttccagaaagatgggaacatggtagaggaaaacccttaccgacagcttccatgcaactgccatggatcgatgcccggaaaaaccgcaattgaactgggcccactttggtccagttctctttttaacaccgggtttctaaaacgcatgctctttgaatccctgcatcatggcctggacgacatccagactttaataaaaaccttgatctttgagagcgaatgcacacctcagagtcagttctcaatacatgcctcctccaatgttaataaacaggaggagaacggagtatttattaaaactacagacgatacaacaacggacaactatatcgcgcagggcaaacgtaagtctaacgagatgatcacaaacctggggaaaaaacagaaaacagacgtatctacggagcatccccccttttactacaacattcatcgacacagtattaaggggatgaatatgcctaagctgaagaagttcctctgctacctttctcaggccggattcagagtttctagaactcattttgatccaatgggagtcagaacagatgcaccacttatgcagtttaagtccatactattaaaatactccaccccgacatacaccggggggcagagcgagagtcacgttcaaagtgcttccgaggacactgttactgagagagtggaaatgagcgtcaatgacaaagctgaagcctctgggtgtcggcgctggtag

SEQ ID NO: 51730 - DNA, 639 bp, Artificial Sequence
  Description of Artificial Sequence: Synthetic coding sequence
accagcgtgaactacctggacagcgccttccggaacatccggaacttaggcatagtgtcggtgacaagtaccgatatcagctcattgtacgccaaagcccagcacgtggctagaaggcattacggatgtaatatcgtgcggacggaatactacaaggaactagccgcacgaatcgtagtggctgccgttgcccgagcggcagcacgctgcaataagggcatcgaggtactgttcgctgtcgcgttggaacatttcgtcctagtggtggttagagtgctccggggacctacatccgccgatgagactgccaagaagatccaataccttattcactgccagtggtgtgaagagcgcattttccagaaggatgggaatatggtcgaggagaacccttacagacagctgccatgcaactgtcatggctctatgcccgggaagacagcaattgagctcggacccctgtggtcctcatccctttttaacacagggttccttaagaggatgctatttgagagcctgcaccacggcttagacgacattcagactctgataaaaaccctgatttttgagtctgaatgtactccccaaagccagttttcgatccatgcttcttcaaacgtgaataaacagggagattag

SEQ ID NO: 51731 - DNA, 1392 bp, Artificial Sequence
  Description of Artificial Sequence: Synthetic coding sequence
atggccctgagctgcaccctgaaccggtacctgctgctgatggcccaggagcatcttgagttcagacttccagagattaaaagcttactgttacttttcggcgggcaattcgcgtcctcacaggagacctatggcaaaagcccattctggattttaagcattcctagcgaggatatcgcccggaatcttatgaaaaggacagtgtgtgcaaagtccatttttgagttgtgggggcacgggcagtctcctgaggagttatatagcagccttaagaactaccctgtcgaaaagatggtgccgtttttacactccgacagcacatacaaaattaagatccacaccttcaacaagactttgacacaagaggaaaagatcaagcggatagatgcccttgagttcctccccttcgaggggaaggttaacctcaaaaagcctcagcatgtctttagcgtgctggaggactatggcttagatccaaactgtattcctgaaaacccccacaacatatactttggacgatggattgccgatggacaacgggaactgatagagtcgtactcagtgaagaagaggcactttatcggaaacacttccatggacgctggcctgtctttcattatggccaatcatgggaaagttaaggagaatgacatcgtgttcgacccatttgtgggaaccggaggcctgctgattgcctgtgcccatttcggtgcttacgtttacggaaccgacattgactataacactgtacacggactgggcaaggcgacacggaagaaccagaagtggaggggtcctgacgagaacattcgagccaatttgcgtcagtacgggctggagaagtactatctcgatgtgctggtaagtgacgctagcaaaccatcttggcggaaggggacctacttcgacgctatcataacagatccaccatacggtatacgcgaatcaacccgcagaacgggatcacaaaaagaaatccccaagggtattgaaaagtgggaaaagtgccctgagtctcacgtaccggtgagcctgtcttatcatctgtcagatatgttcttggacttgctcaatttcgctgcagagaccctggtgctggggggtcgactagtatactggcttcctgtatacactccagaatacactgaggagatggtgccctggcacccctgtcttgaactcgtatccaattgcgagcagaagctttcatcacacaccagccgcaggttaatcactatggagaaggtgaagaagtttgaaaatcgggaccaatactcccacctcttgagtgaccattttcttccttaccagggccataactctttccgagaaaaatatttttccggagtgactaaacgcattgccaaggaggagaagtcgacacaggagtag

SEQ ID NO: 51732 - DNA, 1377 bp, Artificial Sequence
  Description of Artificial Sequence: Synthetic coding sequence
atggccctgagctgcaccctgaaccggtacctgctgctgatggcccaggagcatctggagttcagattacccgagataaagagcctgttgcttttattcggtggacaattcgcttcgagtcaggaaacatacgggaaatcaccgttttggattttgagcatcccttcggaagacatcgctcggaatcttatgaaacgtacagtgtgcgccaagtctatttttgagctgtggggccatggccagagtcccgaggaactctatagtagcttgaagaattaccccgttgagaagatggtcccttttctccatagcgattctacatacaagatcaaaatccacactttcaacaagacactgactcaggaagagaagataaagcgaatcgacgccctggaattcctgcctttcgaggggaaggtgaacctcaagaagcctcaacacgtgttctcggtgctggaggattacggactcgaccctaattgcattccagagaacccacacaacatctacttcggtaggtggatcgccgacgggcaacgcgaactgatcgaaagttacagtgtcaagaaacgtcacttcatcggcaacaccagcatggatgccggcctctcttttattatggccaatcatggcaaggtgaaagaaaacgacattgtctttgacccgtttgtcggcacagggggcctactgatcgcctgcgcccacttcggagcttatgtttacggcaccgacatcgattacaacaccgtgcatggcctcgggaaagctacccggaagaatcagaagtggcgcggtcccgatgagaacattcgggccaatcttcggcagtatggcctcgaaaagtactatttggacgtgcttgtgtctgacgcgtcaaaaccaagttggcgaaagggtacatacttcgacgctataattactgaccccccatacggaatccgagaaagtactcggagaaccggtagtcagaaggaaatccctaagggcattgagaaatgggaaaaatgcccagagagtcacgtgccagtcagtctgtcttatcacctgagcgatatgttcctggacttgcttaactttgccgccgagaccctggtgctgggtgggcgtctggtgtactggttgcctgtgtacacacccgaatataccgaggagatggtgccatggcacccatgtcttgagctcgtgagcaactgcgagcagaaattatcttcccatacatcccgacggttgattactatggagaagaatcgcgatcaatacagtcatcttctaagtgatcactttctgccatatcagggacataatagctttcgcgaaaagtatttctccggcgtcactaaaagaatcgccaaggaggaaaagtcgactcaagagtag

SEQ ID NO: 51733 - DNA, 282 bp, Artificial Sequence
  Description of Artificial Sequence: Synthetic coding sequence
atgaagcggaccgtgtgcgccaagagcatcttcgagctgtggggccatggtcagagtcccgaagagctgtattccagccttaaaaattatccagtggagaaaatggtgccctttctccactctgactcgacctacaagatcaagattcatacattcaataaaaccctgactcaggaggagaaaattaagcgcattgatgcactagaatttctgccattcgagggtaaggtcaatttaaagaagcctcaacacgtgttcagtgtcctagaggattacggttag

SEQ ID NO: 51734 - DNA, 405 bp, Artificial Sequence
  Description of Artificial Sequence: Synthetic coding sequence
atgaagcggaccgtgtgcgccaagagcatcttcgagctgtggggccacgggcagagcccagaggaattgtacagttctctgaaaaactatccggtggaaaagatggtcccttttttgcattccgattccacatacaagatcaagatacacaccttcaataaaactctgacccaagaagagaagattaagcgtattgatgcgctggagtttttgccatttgagggcaaggtaaaccttaaaaaaccccagcacgtgttcagtgtgctggaggattatgggctcgaccctaactgcatcccggaaaatcctcacaacatctattttggccgatggatcgcggacggccaaagagagctgatcgaatcgtactccgtgaagaagcgccattttatcggaaatacttag

SEQ ID NO: 51735 - DNA, 774 bp, Artificial Sequence
  Description of Artificial Sequence: Synthetic coding sequence
atggccctgagctgcaccctgaaccggtacctgctgctgatggcccaagaacatttggagttccggctgcctgagattaagtccttgctcctgctgttcgggggccagtttgcaagttcgcaggagacttatggaaagagcccattctggatcctaagcatcccaagcgaggacatcgcacggaatttgatgaagaggaccgtttgcgcgaagtccatctttgagttatggggccacggccagagcccagaagagctctactcatctctgaagaactaccccgttgagaaaatggtgccttttcttcacagtgactcaacctataagataaaaattcacacatttaataaaacactgacccaggaagagaaaatcaagaggatcgacgcactggagtttttaccattcgaagggaaggtgaatctgaagaagccacagcacgttttttcagtactggaggactacggactcgaccccaattgtattcccgagaacccccacaatatctatttcggacggtggatagctgatgggcagcgcgaacttatcgaatcgtactcagtaaagaagaggcacttcatcggcaacacatctatggatgccggtctgtcatttattatggccaatcacggcaaagtgaaggaaaatgacattgtattcgatccattcgttggaactgggggcctcttgattgcctgtgcacattttggtgcttatgtctatggaactgacattgactacaataccgttcacggattagcatgctctacttag

SEQ ID NO: 51736 - DNA, 513 bp, Artificial Sequence
  Description of Artificial Sequence: Synthetic coding sequence
tgactgagcttcatcatggccaaccacggcaaggtgaaggagaacgacatcgtgtttgacccgtttgttggcaccgggggtctcctgattgcatgtgcacattttggcgcctatgtttatggcactgacatagattataacacagtgcacgggctggggaaagcgacccgtaagaatcagaaatggagggggcctgacgagaatatcagggcgaacctgcgccagtacggtcttgagaagtattacctcgacgtactggtaagtgatgccagtaaaccatcatggaggaagggaacttattttgatgccattattaccgaccccccctatggcatccgcgaatcaacccggaggaccggcagccagaaggagatccctaaggggatcgagaagtgtcccgaatctcacgtgccggtgtctctgtcttatcatctgagtgacatgttcctcgacctgcttaacttcgctgccgagactctcgttctcggcgggcggctggtttactggctctag

SEQ ID NO: 51737 - DNA, 378 bp, Artificial Sequence
  Description of Artificial Sequence: Synthetic coding sequence
atgaagctgctgacccacaacctgctgagcagccacgtgcggggcgtgggttcacgcggattccccctgaggctacaggcgacggaagtcaggatatgccctgttgagtttaaccccaacttcgtggccaggatgatacctaaggtcgaatggtctgcctttctggaggcagccgataacctcaggctgattcaggtacctaagggccccgtggagggctacgaggaaaatgaagagtttctaaggactatgcaccaccttttactggaggtggaggttatcgaagggacacttcagtgtcctgagtctggcagaatgtttcctattagtcgcggcataccaaatatgctgctgtccgaggaggaaactgagtcttag

SEQ ID NO: 51738 - DNA, 1347 bp, Artificial Sequence
  Description of Artificial Sequence: Synthetic coding sequence
atgcgggagaacgtggtggtgagcaacatggagcgggagagcggcaagcctgtcgccgtcgtggcagttgtcacggaaccatggttcacccagaggtatagggaatatcttcagagacagaagctgttcgatactcagcacagagttgagaaaatgccagacggcagcgtggccctgcccgtcctaggcgaaacattacccgaacagcacttgcaggaactgcggaaccgcgtggcaccgggaagcccatgcatgctgacacagctccctgatccagtgcccagcaaacgagcacagggttgtagccccgcccagaagttgtgtctcgaggtgagccggtgggttgaggggcgaggcgtgaagtggtccgctgaattggaagccgacttaccacgatcctggcagagacacggcaacttattgctactttctgaggactgtttccaggccaagcagtggaagaatttaggaccggaactctgggaaactgtggctctcgccctgggggtgcaacggctggcaaagagaggacgggtttcccctgacggcacgcgaacacctgcagtgactttgcttttgggcgaccacggttgggtcgaacacgttgataacgggatcaggtacaagtttgatgtgacccagtgtatgttctctttcgggaacatcaccgaaaaactcagagtggctagcctgagttgcgctggtgaagtgttggttgatctctacgcaggcatcggctattttacccttcccttcctggtccacgctggagctgccttcgttcacgcctgtgagtggaacccccacgccgtcgttgctctcaggaacaacctggagatcaatggggtagcagaccggtgccagatccactttggcgacaaccgtaagttgaaattatcaaacattgccgaccgagtcatccttggcctgatacctagcagcgaagaaggctggccgatagcctgccaagtcttacgccaggatgccggcggaattctgcacatacatcagaacgttgagagcttcccaggaaagaacctgcaggctcttggggtcagcaaagtggaaaaggaacactggctgtatcctcagcagatcaccactaatcagtggaagaacggagcaacccgggactcgcggggcaagatgttgtctcccgccaccaagcctgaatggcaacggtgggccgagagtgcagagaccaggatagccacactgttacagcaggtgcacggaaagccgtggaagacccaaatcctccacatccagccagtaaagtcttatgccccacacgtagaccacattgttctcgacctggaatgctgcccgtgcccgagcgtaggctag

SEQ ID NO: 51739 - DNA, 1434 bp, Artificial Sequence
  Description of Artificial Sequence: Synthetic coding sequence
atgctgatggcctggtgccggggccccgtgctgctgtgcctgcggcagggacttggtacaaattcctttctacacgggcttggccaagaacccttcgagggagcccgctcactgtgttgccggagcagtccaagagatctgcgggatggagagagggaacacgaagccgctcagcgtaaagcacccggggcagaaagctgtccatctctgcctctgagcatctccgacatagggacggggtgtttgtcaagtctggaaaatctgcgactcccaaccctccgcgaggaaagcagtccacgggaactcgaagacagcagcggagaccaggggcgctgtgggccgactcatcagggcagcgaagacccttccatgctttctcaggcccagtctgccactgaagtcgaggaacgacatgtatctccctcctgtagcacttctcgcgagcgcccatttcaggctggcgagctgatcttggcggagacaggagagggagaaactaagttcaaaaagttgtttagattgaataactttggtctgttaaactctaactggggagctgtcccttttgggaagatagtgggcaagttccccggccagatattgcggtcatcctttggcaagcagtacatgctgagaaggccagccctcgaagactacgtggtgctgatgaaaagaggtaccgccattacatttccaaaagacatcaatatgatactgagcatgatggacataaatcccggggatacggtgctggaggccggatccggaagcggcggaatgagtttatttctcagtaaggccgtgggctcccaggggcgggtgatatccttcgaggttcgtaaggatcatcacgacctggctaagaagaactataagcactggcgcgactcatggaaactatcccacgtcgaagaatggcctgataatgtggatttcattcacaaggacattagtggagccacggaggatatcaaaagcttgacctttgacgccgtggctctggacatgcttaatccccacgtcacactgcccgtgttctacccacacctcaagcacgggggggtttgtgcagtgtatgttgttaacatcacccaggtcattgagctgctggacggtatccgcacatgtgaacttgcattatcctgcgaaaaaatcagtgaggtgatcgttcgtgactggctcgtgtgtttggccaaacagaagaacggtattctggctcagaaagtagagagcaagataaacactgatgtgcaactggacagccaggagaaaatcggcgtgaagggggagctattccaagaggatgaccatgaagagagccattccgactttccttatggatccttcccctatgtcgccaggcccgtgcactggcaacccggccacaccgcattcctggtgaaactgaggaaggtcaagccgcaacttaactag

SEQ ID NO: 51740 - DNA, 933 bp, Artificial Sequence
  Description of Artificial Sequence: Synthetic coding sequence
atgctggtggtggaggtggccaacggccggagcctggtgtggggcgccgaagcagtgcaggcgctccgggagaggctcggagtaggagggaggacagtgggagccctccccagagggccaaggcagaattcacggctgggtttgcctttgcttctgatgccggaagaagctagactccttgctgagatcggcgctgtgacccttgtctcagcccccaggcccgactcccggcaccatagcctcgcactcacatcctttaaacgccagcaagaggagtctttccaggaacagtccgccttggcggccgaggcccgtgagacacggcggcaggagttgctagagaagatcaccgaaggacaggcggcaaagaagcaaaagttagagcaggcatcgggcgcgagctcctctcaggaagcaggaagctcccaggccgctaaagaagatgagacctcagatggccaggcgtctggtgagcaggaagaggccggaccaagcagcagccaggcagggccgagcaacggggtggcccctctgccccggagtgcactgctcgtgcagctggctacagccaggcctcgacccgtcaaggctagaccactagactggcgggttcagtccaaggattggccccatgccggaaggcctgcccacgagcttcgctatagtatctaccgggacctgtgggagcggggcttctttctgagtgccgcaggcaagtttggcggagactttttggtctatcccggagacccccttcgattccacgcccactatattgcccagtgctgggcacctgaagacactattccactgcaagatctcgtggcagcaggtcgcttaggcacctctgtgcgcaagaccctgctcctgtgctctccccagcccgatggcaaagtggtgtacacaagcctgcagtgggcttctctgcagtag

SEQ ID NO: 51741 - DNA, 933 bp, Artificial Sequence
  Description of Artificial Sequence: Synthetic coding sequence
atgctggtggtggaggtggccaacggccggagcctggtgtggggcgctgaggcagtccaagcactgagggagcgccttggcgtgggcggccgcaccgttggggctttgcctaggggtccccggcagaacagccgattggggttacccctactcctaatgccagaggaggcgcggttgttagccgaaatcggggcagtgactctggtcagtgccccgaggcccgatagccgacatcattccctggctctgacaagctttaaacgccagcaggaggagtctttccaggaacagagcgccctggcagccgaggcacgtgaaactagacggcaggaactcctagaaaagatcactgaaggtcaagccgcgaagaaacagaagctggagcaggcaagcggagcctcctcttctcaggaagctggaagcagccaagctgctaaagaggatgagacatctgacggccaggcatcaggggaacaagaggaggcggggccaagcagttcccaggccggcccttccaacggggtggctcctttgccaagaagcgcactgcttgtccagttggccaccgcccggcctcgccccgtgaaggctagacctctggattggcgcgtgcagtcgaaggactggcctcacgcgggccggccagctcatgaactgagatactcaatatacagagatctctgggagcgtggattcttcctatctgcagcaggaaagttcggcggcgacttcctggtatacccaggagatccactccgcttccacgctcactatatcgcccagtgctgggctcctgaagacacaatccctctgcaggacctggtcgccgccggcaggttgggcacttctgtgagaaagacgctcttattgtgttcgccacaaccagacgggaaggttgtctatacgtctcttcagtgggcctcacttcagtag

SEQ ID NO: 51742 - DNA, 933 bp, Artificial Sequence
  Description of Artificial Sequence: Synthetic coding sequence
atgctggtggtggaggtggccaacggccggagcctggtgtggggcgcagaagccgtgcaggctttgcgcgagcgcctgggggtgggcggcagaacagtcggcgctcttccccgcggccctaggcaaaactcacggcttggtcttccattgctcctgatgcctgaagaggcccgcctactggctgagattggcgccgtgacactcgtcagtgccccaaggccagattcgaggcaccacagtctcgctctcaccagttttaagcgacagcaggaagagtcattccaggaacagtcggcgctcgctgctgaggctcgcgagacacggcgtcaggagctcctagagaaaattaccgaaggccaggctgccaagaagcaaaagctagaacaagcctctggcgctagcagctcccaagaagccggatcatctcaggcagccaaggaagacgaaaccagcgatggacaggcctccggcgaacaagaggaggccggtccgtcttcgtctcaggctggtccaagtaatggagtcgccccactcccgcggtccgccctcctggttcagttagccacagcccgcccgcggccagtcaaagcccggcctctggattggcgcgtgcaatccaaggattggccacatgccgggagacctgcccatgaactgcggtactctatttacagggacctctgggagcggggctttttcttgtcagcggctgggaagttcggcggggattttctggtctatccaggtgaccctctgcggtttcatgcccattacattgcccaatgttgggcgccggaggatactatccctctccaggacctggtggccgcagggagactgggtacatccgtgcgaaagactttactgttatgcagcccccagcccgacggcaaagtggtctacaccagtctgcaatgggcatcgctgcagtag

SEQ ID NO: 51743 - DNA, 933 bp, Artificial Sequence
  Description of Artificial Sequence: Synthetic coding sequence
atgctggtggtggaggtggccaacggccggagcctggtgtggggcgctgaggccgtccaggcccttcgcgagcgtttgggagtcggaggccggaccgtgggcgctctgccacgtggcccgcgccagaacagccgcctgggattaccactgctcctgatgcctgaagaggcccgtttgctagctgagatcggcgcagtgacattggtgtctgctccacgccccgactcccgacaccactcattggccctgactagctttaagagacagcaagaagaaagcttccaagagcagagcgccctcgcagctgaggctcgcgagacaagacggcaggagctgctcgagaaaataacggaagggcaggctgcgaaaaagcagaagctcgagcaggcgtccggggccagtagctctcaagaggcggggtcaagccaggcagccaaagaagatgagaccagcgacgggcaggcgtccggggagcaagaggaagcaggaccctcaagctcccaggcgggcccatctaacggcgtcgctcccctgccaagaagcgcgctgctagtccaactggccactgctcgaccgcggcccgttaaggcccgccccctggattggcgcgttcagtcaaaggactggccccacgctggaagacccgctcacgaacttcgctattcaatctaccgtgacctttgggagcgcggttttttcctgtctgcggcgggaaaattcggaggggattttttggtgtatccgggtgatccattgcggttccacgcccactacatcgcccagtgttgggcacccgaggataccatccccctccaagatcttgtcgcggctggtaggctgggcacctcagtgagaaaaacactgctgctgtgttctccacagcccgatggcaaagttgtctatacgagcctacaatgggcctcactgcagtag

SEQ ID NO: 51744 - DNA, 933 bp, Artificial Sequence
  Description of Artificial Sequence: Synthetic coding sequence
atgctggtggtggaggtggccaacggccggagcctggtgtggggcgctgaggctgtgcaagctctgcgcgaacgcctcggtgtggggggcagaaccgttggtgccctgccccgcgggcccaggcaaaatagcagactgggacttccactgttgctcatgcccgaggaggctcggttactcgcagaaattggagccgttacactggtctcagcccccagacctgattcacggcatcactcactggcactaacttcctttaagcgacagcaggaggagtcttttcaggagcaaagcgctctggccgccgaggccagggagacaaggcgccaggagctcctggagaagattactgagggacaggccgccaaaaagcaaaaactggagcaggcttcaggagcatccagctcccaagaagccgggtctagtcaggcagccaaggaggacgagacctctgatggacaggcttccggagagcaggaagaagccggtcccagttccagccaagctgggccgtccaacggtgttgcccccttgcctcggagtgcactcctggtgcagctagctactgcccggcctcgtcctgtgaaagcaaggccccttgattggcgcgtccagagcaaagactggcctcacgcagggaggcctgcccacgagctgaggtactcaatctatcgcgatctgtgggaaaggggattcttccttagtgctgcaggcaagttcggaggggactttttggtctatcccggagaccccctcaggtttcatgcacactatatcgcacagtgctgggcaccagaagacacgattcctctgcaggatctcgtcgcagctggccggcttgggacgtcagtaagaaagacactgctgctgtgttccccccagccggacggaaaagtagtgtatacaagccttcagtgggcctctctccagtag

SEQ ID NO: 51745 - DNA, 933 bp, Artificial Sequence
  Description of Artificial Sequence: Synthetic coding sequence
atgctggtggtggaggtggccaacggccggagcctggtgtggggcgctgaagccgtccaggccctacgagagcgactgggggtaggcggcagaactgtcggggctctccccaggggccccagacagaatagccgcctgggcttgccactgttactgatgccagaagaggcccgcctccttgccgaaatcggtgccgtaaccttggtatcggcacctcggccagatagtaggcaccactcacttgcacttacgtcgttcaagcggcagcaggaggagtctttccaggagcaatcagcactggccgccgaggcccgtgagacacgccgccaggaactcctggaaaaaataaccgaaggccaagccgcaaaaaagcagaagctggaacaggcaagtggggcctcgtcgagccaggaagcagggtctagccaagcagctaaggaagacgaaacatccgacggccaggcctccggcgagcaggaggaggccggcccttccagtagtcaggctggtccaagcaatggtgtggcccccctgcctaggagcgccttgctggtccagctggctactgctcgaccccgccctgtcaaagcgagacctttggattggagggtgcagtccaaggattggccccatgccgggaggcccgcccatgaattgaggtatagcatataccgggatctgtgggagcgagggtttttcttgtccgccgctggcaagtttggaggggactttttagtctaccctggcgatccacttcgatttcatgcccactacatcgcacagtgctgggcccctgaggatacaatcccacttcaggatctggtggcagcaggcaggctgggaacgagcgtaaggaaaacattgcttctttgctccccccagcctgacggtaaagtggtgtacacaagcctgcagtgggcctcccttcagtag

SEQ ID NO: 51746 - DNA, 933 bp, Artificial Sequence
  Description of Artificial Sequence: Synthetic coding sequence
atgctggtggtggaggtggccaacggccggagcctggtgtggggcgccgaagccgtgcaggcacttagggagagactgggagttggggggagaactgtgggggctctgccgcggggcccacggcaaaacagcagactggggcttcctctgttactgatgcctgaggaggcccgcctgttagctgaaattggcgccgttaccttggtctcagcgcctaggcctgacagccgacaccacagcctggcactgacatcatttaaaagacagcaggaggagagtttccaggagcaaagcgctctcgcggctgaggcccgagagacacgcaggcaggaactgctggaaaaaatcactgagggccaagccgcgaagaagcagaagctggagcaggcctctggggcctcttcctctcaagaggccgggtctagtcaggccgctaaggaggatgaaaccagcgatggccaagcctcaggcgagcaggaggaggcgggcccctcctccagtcaggctggacccagtaatggagtcgcccccctccccagatcagcccttcttgtgcagttggcgaccgcccgtcccaggccggttaaagccaggcctctggactggcgcgtgcagtctaaggattggccccacgccggaaggcctgcgcatgaactcagatattcaatctatcgcgacctctgggagaggggatttttcttgtctgcagcagggaagttcggcggagactttctggtgtacccaggcgacccattgaggttccacgcgcactatattgctcagtgttgggcccccgaagacaccattccccttcaggacctggtcgctgccggacgactaggaacttccgtgcggaaaactctgctactatgtagcccccagccggacggaaaggtcgtatacacttctctgcagtgggcgagcttgcagtag

SEQ ID NO: 51747 - DNA, 933 bp, Artificial Sequence
  Description of Artificial Sequence: Synthetic coding sequence
atgctggtggtggaggtggccaacggccggagcctggtgtggggcgctgaagctgtgcaggctctgcgggagcggctgggtgtgggaggtcggactgttggggctctccccaggggacctaggcagaattcccggctgggactcccgctccttctgatgcccgaggaggcgcgcctactggccgaaattggcgcggtaaccctagtcagcgctcctcgccctgatagcaggcaccactccctggcactgacttctttcaaacgccagcaggaagagagcttccaagagcaaagcgcccttgccgcagaagctcgcgaaacccgtagacaagagcttctggaaaaaattacggaagggcaagcagccaaaaaacaaaagctggagcaggcgtcgggtgcctccagctctcaggaagccggatcctcgcaggctgcaaaggaggacgaaacttcagatggtcaagcgtctggagagcaggaagaagccgggcccagttccagccaagccggcccgagcaacggagtagcacctttgccacggtcggccctgctggtccagctggccacagcccgacctcggcccgttaaagctcggccactggattggagggtgcagagcaaagattggcctcacgccgggagacccgcgcacgagctcagatattcaatctaccgtgatctctgggagagaggcttcttcctttcggcggctggaaaatttggcggtgacttcctggtctaccccggagaccctttaaggttccacgcccactatatcgcacaatgttgggcccccgaagacaccatccccctgcaggacctggtggcagcaggacggctggggacctccgtgcggaagactcttttactgtgctccccgcagccggatggcaaggtggtttataccagcttacagtgggctagcctgcagtag

SEQ ID NO: 51748 - DNA, 933 bp, Artificial Sequence
  Description of Artificial Sequence: Synthetic coding sequence
atgctggtggtggaggtggccaacggccggagcctggtgtggggcgcggaagccgtgcaagccctccgtgagagactaggggttggtggtcggactgttggggccctgcctcgcggtcccaggcagaacagccggctgggcctgccgctgctgctcatgccagaagaggcgcgactcctggcggagatcggtgccgtgacactcgttagcgcccctcgaccagactctagacaccactccctcgccttgaccagttttaaacgacagcaggaggaatcctttcaggagcaaagcgctctggctgcagaggcaagggagacacgacggcaagaactgttagagaagatcacggaaggtcaagcagctaaaaaacagaagctggaacaggccagtggggcgagtagttcccaggaggccggtagtagccaggctgccaaagaagatgaaacatccgacggacaagcctccggcgaacaagaagaggcaggcccctcgagctcccaagcgggtccgtcaaatggagtggcccctcttccgaggagtgcgctgctggtgcaactcgccaccgcgagaccccggccggtgaaggcccgcccgctagattggagggtgcaatccaaggattggccccacgccggtcgcccagcccacgaacttcgttacagcatctatagagatttgtgggagagagggttctttctgagcgctgccggaaaatttggcggagacttcctggtgtatcccggagatcccctccgcttccatgcccactatatcgcccaatgttgggctccagaagatacaatccctctgcaagatctggtggccgctggtaggctcggtacatctgttaggaagaccctcctgctatgttccccacagccagatggcaaagttgtttatactagcctgcaatgggcttccctccagtag

SEQ ID NO: 51749 - DNA, 933 bp, Artificial Sequence
  Description of Artificial Sequence: Synthetic coding sequence
atgctggtggtggaggtggccaacggccggagcctggtgtggggcgcagaggctgtgcaggcgctcagggaaagactaggagtgggaggacggacagtcggtgcgctaccaagagggccacgccagaacagcagacttgggctgccgctcctcctaatgcccgaagaagctagattattagctgaaatcggcgccgttactctcgtaagcgcaccacgacccgacagtaggcaccacagcctggcactgactagctttaaaaggcagcaggaggaatcatttcaggagcagtcagctctggcagcggaggctcgcgaaacaaggcgtcaggagctgctggagaagattaccgagggccaggcggccaaaaaacaaaaactggagcaggctagtggcgcttcttcctcccaagaggcaggttcctcccaagctgctaaggaggacgagaccagcgatggacaggcaagtggcgagcaggaggaggctggtccatctagcagccaggctgggccctctaacggtgtcgctccgctgccccgttcggcactgctggtgcaattggctaccgcaaggcctagacctgtaaaagcacggccgttggactggcgtgtgcagtcaaaggattggcctcacgccgggcgtcctgctcacgagctcagatattctatctatcgggacctttgggagcgtggcttctttctgtccgccgcgggcaagttcggtggcgactttctggtgtatccaggcgaccccctgcgcttccatgcccactatatcgcccagtgctgggcccctgaggacacaatcccgctgcaagatttggtggcagcaggccgcctgggcaccagcgtacggaaaaccctgctactgtgtagcccccaaccagatggaaaggttgtctataccagcttacagtgggctagcttgcagtag

SEQ ID NO: 51750 - DNA, 933 bp, Artificial Sequence
  Description of Artificial Sequence: Synthetic coding sequence
atgctggtggtggaggtggccaacggccggagcctggtgtggggcgccgaagccgtgcaggcactcagggaaagactcggcgtggggggacgcacagtgggtgcactgcctagagggccacgccagaactcacgactgggcctgcctcttctgctgatgcctgaggaagcaagacttctcgctgagataggagccgtcacacttgtctctgcaccccgaccggactcccggcatcattcattggctctcacttcattcaaaagacagcaggaggaatccttccaggagcagagcgctctcgcagcagaagcccgtgagaccagacggcaggagctgttggaaaagatcaccgaggggcaggctgccaagaaacagaagttggagcaagcctctggagcctcgtcaagtcaagaagcaggatcgagccaagcagcaaaggaagacgaaacatctgacggacaggcgagtggggaacaagaagaggctggacctagtagcagtcaagccggtccctccaacggtgtagctcctcttccccgatctgccctgcttgttcagcttgccacagctagaccacgcccagtcaaagctagacctctggattggcgcgtacaatctaaggattggccgcacgccggcaggccagcccacgaactaagatactctatctatcgtgacctatgggaacggggattcttcctcagtgcagctgggaagttcggcggggatttcctggtgtatccaggtgatccactcagattccatgcccattatatcgcccagtgttgggccccggaagacactatcccattgcaggatttagttgccgccggcagactggggacatctgtccgtaaaaccctcttgctgtgttcgccccaacctgacggcaaagtagtgtacacaagcctacagtgggcgagcctgcagtag

SEQ ID NO: 51751 - DNA, 933 bp, Artificial Sequence
  Description of Artificial Sequence: Synthetic coding sequence
atgctggtggtggaggtggccaacggccggagcctggtgtggggcgccgaagcagtgcaagctcttcgggagcgattaggtgtgggaggacgaacagtgggcgccctgccaaggggcccaagacagaattcacgactaggtctgccattgctcctgatgccagaggaggcgcggctgttagccgagatcggggcagtgacactggtgtcagcaccacgcccagatagccgacaccattcactggccctgacctcattcaagcggcaacaggaggaaagctttcaggagcagagcgcattagccgcagaggcccgggaaacacgccgacaggagttactagagaagatcacagaagggcaggccgcgaaaaagcagaagttagagcaggcctccggggcttcaagttcccaggaggccggtagctcgcaggcagctaaggaggatgaaacttcagatggccaggccagcggagagcaggaggaagctggaccaagctctagccaggccgggccaagcaatggtgtggctccactgcctagaagtgcactacttgtgcagttagctaccgctcgccctcgtccagtgaaagccaggcctttggactggcgggtgcagtcaaaggactggccccatgccggaaggcctgcccatgaactgagatacagcatatatagagacctgtgggaacgcggcttcttcctgtccgccgcaggcaagttcggtggagactttctcgtgtacccgggtgaccctctgcggtttcacgcacactacatcgctcagtgttgggctcctgaagacacgattccactgcaggaccttgtggcggcgggccgcctgggaacaagcgtgcggaaaacactgctgctctgtagcccgcagcctgatggtaaagtggtatataccagtctgcagtgggccagcctgcagtag

SEQ ID NO: 51752 - DNA, 2199 bp, Artificial Sequence
  Description of Artificial Sequence: Synthetic coding sequence
atggaccccagcgccgacacctgggacctgttcagccccctgatctctctgtggatcaatagattttatatctatttaggcttcgccgtgtccatcagtctatggatctgcgtgcagatcgttatcaaaacccagggtaagaacttgcaggaaaagagtgtgcccaaagctgcacaagaccttatgacaaatggctacgtgagtctgcaggagaaggacatcttcgtgagcggcgtgaagatcttttacggctcccagacaggtaccgccaagggctttgctactgttctggcagaggcagttacatctcttgaccttcctgtcgcaattattaatcttaaggagtacgacccagatgatcatctgatcgaagaggttaccagcaagaacgtgtgcgtttttctcgtcgctacctacacggatggtctccccacggagagtgcagagtggttctgcaagtggctggaagaagcctctatagatttcaggttcggaaagacatacttaaaaggaatgaggtacgctgtatttgggctgggcaatagtgcctacgccagccactttaataaagtgggaaagaatgttgataaatggctctggatgcttggggcgcaccgcgttatgtcgcgcggtgaaggagactgtgacgttgtcaagagcaaacatggatctattgaggcagacttccgggcctggaagacaaagtttatctctcagctgcaggcgctccagaagggagagcgtaagaaaagttgtggtggccattgtaagaaagggaaatgtgagagccaccaacacggcagtgaagagagggaagagggaagccatgagcaggatgaattacaccaccgggacacagaagaagaagagccatttgagagcagttctgaagaggaatttggtggggaggaccatcagagcttgaacagcatcgttgacgttgaagacttaggcaaaataatggatcatgtcaagaaggagaaaagagagaaggagcagcaggaggagaagtccgggctttttcgcaatatgggaaggaacgaagatggggaaaggcgggcgatgataacccccgccctgcgggaagctttgacaaagcaagggtaccagctcattgggtcccacagtggagtgaaattgtgtaggtggacgaagtccatgctgagagggaggggcgggtgttataagcacaccttctacgggattgagagtcacagatgtatggagacaacaccctccctcgcctgtgccaacaaatgcgtcttctgttggcggcaccacacaaatcccgtcggcaccgagtggcgctggaagatggaccagcctgagatgatcctgaaggaggcaatcgagaaccaccagaacatgataaaacagttcaaaggagtgcctggtgtcaaggctgagaggttcgaggagggcatgacggtcaagcattgtgcactgagcttagttggcgagcccatcatgtatcccgagatcaatcgtttccttaagctgctccatcagtgcaagatctcatcattcctggtcactaatgcacagtttcccgccgagatcaggaacctcgagcccgttacccagctgtacgtgtccgtggatgcatccaccaaagattctcttaagaaaatcgaccggccactgttcaaggatttctggcagaggtttctagattctctcaaggccctggctgtgaagcagcaacgaacagtttatcgcctgactctcgtaaaagcttggaatgtcgacgaactgcaggcctacgcacagctggtgagcctggggaatccggattttatagaagtgaaaggagtgacatattgtggggaatccagtgcatccagtctcactatggcacacgttccgtggcacgaagaagtggtccagtttgtgcacgaactggtcgatctcatccctgagtacgaaatcgcttgtgagcacgagcacagcaactgtctgttgattgcccacaggaaatttaagataggaggagagtggtggacttggatcgactataatcggttccaggaactgatccaagagtatgaggacagcgggggttcgaaaaccttttccgcaaaggattatatggccaggacacctcactgggctctctttggggccagtgaaagaggattcgatccaaaggatacgagacatcaacgcaagaataaaagcaaagctatctctggctgctag

SEQ ID NO: 51753 - DNA, 1017 bp, Artificial Sequence
  Description of Artificial Sequence: Synthetic coding sequence
atggaccccagcgccgacacctgggacctgttcagccccctgatcagcctctggatcaatcggttctatatttacttaggatttgccgtgtcgatctctctgtggatttgtgtacagattgtgatcaagactcagggatttgctactgttttggccgaggcggttacttcactcgacctgcctgtggcaatcattaatctcaaagaatacgatcccgatgaccatttgattgaggaggtgacctcgaagaatgtctgtgtgttcttggtcgctacctataccgatgggctacccacagaaagcgcagaatggttctgtaagtggctcgaggaagccagtattgattttcgcttcggcaaaacctatttgaagggcatgcgatatgctgtgttcgggcttggtaatagcgcctacgccagccatttcaataaagtgggcaaaaatgtggacaagtggctgtggatgctgggcgcacatagggtgatgtcccgcggcgaaggcgactgtgacgtcgttaagtcaaagcacggctccatcgaggctgacttccgggcctggaagacaaagtttatctcccagcttcaggcattgcagaaaggagagcggaagaaatcatgtgggggacactgcaaaaaggggaaatgtgagtcacatcagcacggatccgaggagagagaggaggggagtcatgaacaggatgaactgcatcaccgagacacagaagaggaagaaccctttgaatcctctagcgaagaagagttcggcggcgaagaccaccaatctttgaactctatagttgacgtggaagacctcgggaagatcatggaccacgtcaaaaaggagaagcgcgagaaagaacaacaggaagaaaagtccggcctatttaggaacatggggcgcaatgaggatggggagaggcgcgctatgattacaccggccttgcgggaagccctcacaaagcaggtgcacgcccctagagaaaggcgcctcctgcagactcatattctgtggaattag

SEQ ID NO: 51754 - DNA, 531 bp, Artificial Sequence
  Description of Artificial Sequence: Synthetic coding sequence
atggaccccagcgccgacacctgggacctgttcagccccctgatcagtttgtggatcaatcggttttacatctacctaggatttgcagtcagcatttccctgtggatatgtgtgcagatcgtgattaaaacgcagggatttgctaccgtgcttgccgaagcggttactagccttgacctgcctgtggccataattaatctgaaggagtatgatccggatgaccaccttattgaagaggaggaggagccttttgagagttcctctgaagaggaattcggaggcgaggaccatcagtcattgaacagtattgtggatgttgaagatctaggaaaaataatggatcacgtgaaaaaggagaaacgggaaaaggagcagcaagaagaaaaaagcgggttattcagaaatatgggacgaaatgaggacggtgagcgtagggccatgataacccctgctctgcgggaagcgttgactaagcaggtacacgcaccccgagagcggagacttctgcagacccacatactgtggaactag

SEQ ID NO: 51755 - DNA, 780 bp, Artificial Sequence
  Description of Artificial Sequence: Synthetic coding sequence
atggaccggagcgccgagttccggaagtggaaggcccagtgcctgtcaaaggccgacctgtcacgaaaagggtcagttgacgaggatgtagtcgagcttgtacagttcctgaacatgcgtgatcagtttttcacaacttcttcctgtgccggcagaatccttttgctggatagagggatcaacggattcgaggtccagaaacagaactgctgctggcttttagtcacccataagctgtgcgtgaaagatgatgtcatagtggcattaaagaaggcaaatggggatgcaaccctgaagtttgaacccttcgttctgcatgtccaatgtcgccaattgcaggacgcgcagatcttacatagcatggcgatcgacagcggttttagaaactcaggtatcacggtggggaagcgcggaaaaaccatgttggctgtccggtctacacacggcctcgaggtgccattgagtcataaaggaaaacttatggttactgaggagtatatcgacttcttgcttaacgtagccaatcagaaaatggaagagaacaagaaaaggatcgagcggttctacaactgtctccagcacgccttggaacgcgagactatgaccaatctacaccctaaaataaaagaaaagaacaactcttcatatatacataagaaaaaacgcaaccccgagaaaacgcgagcacagtgcattacgaaggagtcagatgaagagttagaaaatgatgacgacgacgatctgggcataaatgtgaccattttccccgaagattattag

SEQ ID NO: 51756 - DNA, 528 bp, Artificial Sequence
  Description of Artificial Sequence: Synthetic coding sequence
atggaccggagcgccgagttccggaagtggaaggcccagtgcctgtcgaaggccgatctatctaggaaagggtcagtggatgaagatgttgtcgaacttgttcagttcttgaatatgcgcgaccagttctttacgactagcagttgtgctgggcgaattctgctgctggacagggccgtgcggtcaacccacgggttggaggtgcccctgtctcataagggaaaactgatggtgaccgaagagtacatagattttctcctaaacgttgccaaccaaaagatggaagagaataagaagaggatcgagcgtttttataattgcctgcaacacgctctggagcgggagacaatgactaacttacaccctaaaatcaaggaaaaaaacaactcctcatacattcacaagaagaaacgcaatcccgaaaaaacaagggctcagtgcatcacgaaggaaagcgacgaggaactggagaacgacgacgacgacgatctgggtattaacgtgactatttttcccgaagattactag

SEQ ID NO: 51757 - DNA, 681 bp, Artificial Sequence
  Description of Artificial Sequence: Synthetic coding sequence
atggaccggagcgccgagttccggaagtggaaggcccagtgcctgagtaaagcagacctgtcaaggaaaggctctgttgacgaggacgtggtggaactcgtgcaatttttaaatatgagggaccagttcttcaccacatcctcgtgtgccggacgcattctgctcctggaccgcgggattaatggtttcgaggtgcagaaacagaactgttgctggcttctggtgactcacaagctgtgcgtgaaagatgatgtccactccatggctatagattcggggttcagaaacagtggaattaccgttggcaagcgaggcaaaaccatgctagccgttcggtccactcacggactggaggtcccattgagtcacaagggaaagctgatggtaacggaggagtatatcgatttcctgctcaatgttgcaaaccagaaaatggaagaaaacaaaaaaaggatagagagattctataactgcttgcagcacgctctggagagggaaactatgactaacttacaccccaagataaaggagaaaaataactccagttatatccacaagaagaaacgaaacccagaaaaaactagggcacagtgtatcaccaaggagtcagatgaagagctggagaatgacgatgacgatgatctgggaatcaacgtcaccatttttccggaggactactag

SEQ ID NO: 51758 - DNA, 948 bp, Artificial Sequence
  Description of Artificial Sequence: Synthetic coding sequence
atggccggccagcacctgcccgtgccccggctggagggcgtgagccgggagcagttcatgcagcacctgtacccacagaggaaacctttggtcttagagggcatcgacctcggtccttgtaccagcaaatggacagttgattatttgtcccaggtgggtggtaaaaaggaagtgaagattcatgttgcggccgtcgcgcagatggacttcattagcaagaatttcgtgtaccgcaccctgccctttgaccagttggtgcagcgagctgccgaagagaaacataaggagtttttcgtgagcgaggacgaaaaatattatttgaggtctctgggggaagatccacgtaaggacgtcgcagacatcagaaaacagtttcccctgctgaagggcgacatcaaattcccagagttttttaaagaggaacagtttttctctagcgtgttcagaatctcatccccagggctgcagctgtggacccattacgacgtcatggacaacctcttaatacaagtgaccggcaagaaacgggttgttctgttcagtccaagggacgcacagtacctttatctgaaaggcaccaagtctgaagtgttgaatattgacaatccggacctggcgaagtatccattgttcagcaaggctagaaggtatgaatgcagcctggaggccggtgatgtgctattcattcctgcgctgtggtttcataacgtcatttccgaagaattcggtgtgggggtcaatatcttttggaaacacctcccgtccgagtgctacgacaagactgacacctatggcaacaaggaccctacagctgcctccagagcggcccagatcctcgatagagccctaaagacgctcgctgaacttcccgaggaatatagggacttttacgccaggaggatggtgcttcacatccaagataaggcgtattccaaaaattccgaatag

SEQ ID NO: 51759 - DNA, 825 bp, Artificial Sequence
  Description of Artificial Sequence: Synthetic coding sequence
atgctgaacctgctgctgctggccctgcccgtgctggccagccgggcctacgctgctcccgcacctggacaagctctccagagggtaggaatcgtgggaggacaggaagcgccccgaagcaagtggccctggcaggtgtccttgcgagtgcgcgaccggtactggatgcacttttgcggtggtagcctgatccaccctcaatgggtgctgaccgctgcacattgtgtaggccccgacgtgaaggacctggccgcactgcgcgttcagttaagagaacaacacctgtattaccaagatcaattgcttccagtgagtagaatcatcgtccaccctcaattttataccgcacagataggagccgacatcgccctcctcgaactagaggagcccgtcaatgtaagctctcacgtgcacactgtgaccctacctcctgcttcagaaacgtttccaccaatgccttgttgggttacaggatggggtgatgtagacaatgacgagagactgcctccacccttccctttaaagcaggtgaaggttccgatcatggaaaaccacatatgcgacgccaagtaccatctcggcgcctatactggggacgatgtcaggattgtcagagacgatatgctatgtgccggcaatacccgacgggatagctgtcaaggtgactctggcgggcccctggtctgtaaagtaaacggcacctggttgcaggctggtgtcgtcagctggggcgaagggtgcgcacagccaaataggccaggaatctatacccgtgtgacatattacctcgattggatccaccattatgtccctaagaagccctag

SEQ ID NO: 51760 - DNA, 2271 bp, Artificial Sequence
  Description of Artificial Sequence: Synthetic coding sequence
atgagcaagatgcccgccaagaagaagagctgcttccagatcaccagcgttacaacagcccaggtggccacctctattacagaggatactgagtcactggatgacccagacgaatcaagaaccgaagatgtgtcttccgaaatttttgacgtgagccgggccacagactacgggcccgaggaagtatgcgagcgttcctcctccgaagagactctcaacaacgttggggacgcggaaacccctggtaccgtatctcctaatctcctgcttgacggacagttggccgcagccgctgcggcccctgctaatgggggaggagtagtttcagctcggagcgtaagcggagcacttgcctccacattagcagcggccgctactagcgctccggcccctggcgccccaggaggaccccagctcgccggctcctctgccggccctgtgactgccgcgccgtctcagccccctacgacatgtagctctcgattcagagtgataaagctcgaccatggttcaggcgagccttataggagggggcgctggacctgtatggagtattacgaaagggattctgattccagcgtgttgacacgaagcggggattgtatacgacatagctctaccttcgatcaaactgctgagagggacagcggtcttggtgccactggaggatcggtcgtggttgttgtggcctctatgcagggcgctcacggacccgaaagtgggactgattcatcacttaccgctgtgtcccaattgcctccatctgagaaaatgtcccagccaaccccagctcaacctcagtctttctccgtgggacagccgcagccaccaccccccccggtcggtggagccgtggcccagtcttccgcaccactgccaccctttcctggcgcagcgaccggcccccagcctatgatggccgctgcacagcctagccagccacaaggtgccggacctggtggtcagacgctccccccgacaaatgtgaccctcgctcagcccgccatgagcctccccccacaaccaggacccgcggtgggagcaccggccgctcagcaaccccagcagttcgcgtatccccagccacagattcctcccggacaccttcttccagttcaaccatctgggcaaagtgaatacctgcagcagcacgtggccggactacagccaccaagtccagcacagccaagtagcacaggggccgccgcgagccccgccacagccgctacactgccagtggggactggacaaaacgcttcaagcgtaggggctcagttgatgggtgcctccagtcagccaagcgaggcaatggctccacgaactggcccagctcaggggggacaggtcgccccatgtcagcctaccggggttccccctgctactgtggggggggtggtacaaccctgcctgggacctgctggcgccggccagccccagtcagtgccgcctccccagatgggaggaagtggtccattgagtgcagtgcctgggggcccacacgccgtagtgcccggggttcctaatgtcccagccgccgtaccagcacctagtgtaccctctgtttcaacgacttcagtaacaatgcctaacgtgccggcgcccctcgcccaatctcaacagctgagcagccacacacccgtgtccagatctagttccatcatacagcacgtggggctgcccctggcccccgggacccacagcgcaccaaccagcctccctcagagcgatttgagccagttccagacacaaacccaaccactggtgggtcaggttgatgacacacgaagaaaaagcgaacctttgccgcagccacccctgagcttgatcgccgagaataagcctgtagtaaagccgcctgtggccgattctctcgctaacccactgcagcttaccccaatgaactcgctggctacatctgtgttcagcattgcaatccccgtggacggtgatgaagatagtgcctccggggggggagttgtggcgatcgataacaagattgaacaagccatggatctcgttaagtcacacctcatgtatgctgtcagggaagaggtggaggtcctaaaagagcagatcaaagaactcgtggagcgtaactctctcttggagagagaaaatgctctcctaaagtctctgtcctcaaatgaccagttgagccagctgcctacgcagcaggccaatcccggtagtacaagccagcagcaggccgtgatagcccaacctccgcagccaacacagcctccccaacagccgaatgtatcttccgcatag

SEQ ID NO: 51761 - DNA, 2343 bp, Artificial Sequence
  Description of Artificial Sequence: Synthetic coding sequence
atgagcaagatgcccgccaagaagaagagctgcttccagatcacctctgtaacaacagctcaggttgctacatcgatcacagaggataccgagtcattagacgaccccgacgaatctcgcaccgaggacgtgtcctctgaaatttttgacgtctctagggcaacagactacggacctgaggaggtctgcgagcggtcatcctctgaggagaccttaaataacgttggggatgcagagacacccggaacggtgtctccaaatttgttgctggacggccagctggccgccgctgcggcggcccctgcgaacgggggtggagtggtttctgctcgctccgtaagcggggcactggccagcacactggctgcagctgccacctcagcaccggcacccggagcccctggcggcccacagttagcgggatcttccgcagggcccgtcactgctgctccctcccagcctcctacgacctgttcctctaggtttagggtaattaagctggaccacgggtccggagagccatataggcggggtcgttggacttgtatggagtattatgagagagatagtgacagttcagttctgacccggagcggagattgcataagacattcctcaactttcgatcaaacagcggaacgggatagcggcctgggagcgacgggcggctcagtcgtagtggtagtagcaagcatgcagggagcacacggtccagaatcgggaaccgactcaagcctgactgcagtcagccagctcccaccatctgagaagatgtcccaaccaaccccggcccagccccaaagtttctctgtgggccagcctcagcctccacctccccctgtcggcggcgccgttgctcagagttccgctcccctccccccatttccgggcgctgccaccggtccccagccaatgatggctgcggcacaaccatctcagccccagggggcagggcctggggggcagacccttcctcctacgaatgtcacactggcgcagccagcgatgagcctccctccacaacccggccccgcggtcggggccccggcagcccagcagcctcagcagtttgcttacccccaaccacagattccacccggtcacctcctccctgtgcaacctagcggccagagtgagtatctgcagcagcacgtcgcaggtctgcagcctcctagtcccgcacaaccatcctcaacaggtgccgccgcttcccctgctacagcagcaactctgccagtgggcactggacagaacgcaagctcggtcggcgcacagctgatgggagcgtcatcccagccttcggaggccatggcgcccagaacagggccagcgcagggggggcaggttgccccttgtcagcctactggggtgccacctgccacagttggaggagtggtccagccatgcctcggacccgctggcgcgggacaaccacaaagcgttcccccccctcagatgggcggcagtggcccactctctgccgtacccggcggtccccacgccgttgtgccgggggtccctaacgtccctgctgctgtccctgcgccctctgtccccagtgtctctacgacatcagtgaccatgccaaatgtgccagcacctctggcccagagtcagcaactgtcctctcacacccccgtcagtagatcttcgagcatcattcagcacgttggcctgccacttgcaccggggacccatagtgcccctacctctctgccccaatctgatctctcccagtttcagactcagacacagcctctggttggccaggtggatgacactcgccgaaagtcagagccactgcctcaaccaccactctcgcttattgcagagaataagcctgtggtcaaacccccagtcgctgatagccttgctaatcccctgcagcttacccccatgaatagcttagccacctctgtattttccatcgctatccccgtagacggtgatgaggataggaaccccagcactgcattttaccaggcattccacctcaatacccttaaagagagcaaaagcttgtgggatagcgcatctggcggaggagtagtggctatagacaacaagatagagcaggccatggacttagtgaagtcgcatctgatgtatgccgtgcgtgaggaggttgaggtgctgaaggagcagataaaagagctggtggaacggaattctctgctagagcgggaaaacgcactgctcaagtctctgtcatccaatgatcagctgtcacagttgcccactcagcaggctaatccaggaagtacatctcaacagcaggccgtgatcgcgcagccgccccagcccacacaaccccctcagcagccaaacgtctccagcgcatag

SEQ ID NO: 51762 - DNA, 690 bp, Artificial Sequence
  Description of Artificial Sequence: Synthetic coding sequence
atgcccaacgtgcccgcccccctggcccagagccagcagctgagcagccacactcctgtgtccagatccagtagcattatccagcacgtcggtttgccgttggctcccggcactcacagcgctccgacttcactgcctcagagcgacctcagccagttccagacgcaaacccagccactcgtgggccaggtggatgatacacggcgaaaaagcgagccactgcctcaaccacccctgtcacttattgccgagaataaaccggtagttaaaccccctgtggccgattcgctggctaatcctttgcagcttacaccaatgaatagcttagcaacatcagtcttttctatcgccatccccgtcgacggagatgaagacagtgcctctggcggaggggtggtggccatcgataataaaattgagcaggctatggatctggtcaaaagtcaccttatgtatgcagtccgggaggaggtggaggtgctgaaggagcagatcaaagagctcgttgaaagaaactccctcttggaacgggagaatgcattgctgaagagccttagcagtaatgaccaactgagccagttgccaactcaacaggccaacccaggatcaacctcccaacagcaagccgtgattgcccaacctccgcaaccaactcagccccctcagcagcccaatgtgtcttctgcttag

SEQ ID NO: 51763 - DNA, 576 bp, Artificial Sequence
  Description of Artificial Sequence: Synthetic coding sequence
atggccggcgccgccgaggacgcccgggccctgttccgggccggcgtctgtgccgcactggaggcctggcccgcactgcagatcgcggttgagaatggttttgggggcgtgcactcacaggagaaagctaaatggttggggggggccgttgaggactattttatgcggaatgctgacctggagttagacgaggtggaggatttcctgggcgaactgctaaccaatgaattcgacacggtggtcgaagacggcagtttgccacaggtaagtcaacaactccagaccatgtttcatcattttcaaaggggcgacggcgccgcccttagggagatggcctcctgtatcacccaacgcaaatgcaaagtaacagcgaccgcactcaaaaccgcgagagaaaccgacgaggacgaagacgacgtggattctgtggaagaaatggaggtgacggccaccaacgacggcgcagccaccgatggcgtatgccctcagccagaaccgagcgatccggacgctcaaactattaaagaagaggacatcgtggaagatgggtggactattgtgaggcgaaaaaagtag

SEQ ID NO: 51764 - DNA, 801 bp, Artificial Sequence
  Description of Artificial Sequence: Synthetic coding sequence
atgatgaagaccctgagcagcggcaactgcaccctgagcgtgcccgcgaaaaattcttatagaatggttgtcctgggggcctcccgggtaggaaaaagcagcatcgtttctaggttcctgaacggtcgcttcgaagatcagtatactcccacaatcgaagacttccacaggaaggtgtacaacatcagaggggatatgtaccagttggacattctggatacctccgggaaccatccatttccggccatgcgccgcctgagcatactgaccggtgatgtgttcatactggttttttccctggataaccgcgagagctttgatgaggtgaaacgcctgcagaagcagatcctggaggtcaaaagttgtctaaaaaacaagaccaaagaagctgccgagcttcccatggtcatctgtggcaacaagaacgaccacggcgagctctgccggcaagttcctaccaccgaggcagaactacttgtatcgggtgatgaaaattgtgcctactttgaagtgtccgctaaaaagaacacaaacgtcgatgaaatgttctatgttctgtttagcatggctaaacttcctcatgaaatgtcacctgctctccaccggaagatcagcgtccagtatggagacgctttccaccctcggcctttttgcatgcgacgggtcaaagagatggatgcctacggtatggtttcccccttcgccagacgccccagcgtcaattccgatctgaagtacattaaggctaaagtgctccgcgaaggccaggcaagagaaagggataaatgcactattcagtag

SEQ ID NO: 51765 - DNA, 636 bp, Artificial Sequence
  Description of Artificial Sequence: Synthetic coding sequence
atggaggccgagcggggccccgagcggcggcccgccgagcggagcagcccaggtcagacacccgaagaaggagctcaagcgttagccgagttcgccgccctacatggtcctgctttgcgggcgtcaggcgttcctgagcgctactggggtaggctgctgcataagctggaacacgaagtctttgacgccggtgaggtctttggtatcatgcaagttgaggaggtggaggaggaagaggatgaggcagcacgggaagtgcgcaagcaacagcctaacccaggcaacgaattatgttacaaggtgatcgttactcgtgaatccgggttacaggccgcacatcccaatagcatcttccttattgaccacgcatggacttgcagagtcgagcacgccaggcagcagctccagcaggttccaggtctcctgcacagaatggccaatctcatgggcattgaattccatggcgaactcccctccacagaagcagtggcccttgtgctcgaggaaatgtggaagttcaaccagacgtacaggcacgtgtgtcgtagaccacacgcggaggtcggacagcgtcccaggtggaaggcaggggacgccgctgctgaccccggtggagaattgcagccccgcctttag

SEQ ID NO: 51766 - DNA, 1380 bp, Artificial Sequence
  Description of Artificial Sequence: Synthetic coding sequence
atggagcccagcacctgccggaccatggagagcgaggaggactacgttgaggagaaggagtctgagaaatgtgtgaaggaaggggttacaaacccctccaattcgagccagcaggctctgctgaaggccgattataaggctctgaaaaatggagtgccttcccctattatggccacgaaaatccccaaaaaggttattgctcccgtggacaccggtgacctcgaagccgggaggagaaagcggcgcagaaaaagacgcagtctggctattaacctgactaactgcaagtatgaaagcgttcggagagcggcccagatgtgcggtctgaaggaagttggcgaagacgaggagtggacactgtattggacagattgtgctgtgtccttggagcgagtgatggacatgaagaggtttcagaaaatcaaccacttcccaggcatgactgaaatctgcagaaaagaccttctggccaggaatctcaaccgcatgtacaaactctatccttctgaatacaacatctttccaagaacgtggtgcttaccagccgattacggcgatttccaatcatacggcaggcagagaaaagccagaacctatatctgcaagccagactcagggtgccaggggcgaggtatatttattacaaggaaccctcgcgaaatcaagccaggggagcacatgatttgtcagcagtacatatctaaaccccttctcattgacggattcaagttcgacatgagggtctacgtgctaataacatcgtgcgatcctctacgcattttcacatatgaagaggggctggcacgcttcgctacaaccccatacatggagccctcccataacaatctcgacaatgtgtgtatgcacctgacaaattatgctattaacaaacacaacgagaattttgtgcgggacggagccgttgggtccaagcgcaagctctcaactctgaacatatggctgcaagagcatagctacaatccaggcgagctgtggggcgatatagaagacataattatcaaaacaattatttctgcacacagcgttcttcgccacaattatcgaacctgcttcccacagtacctgaatggagggacctgtgcttgcttcgaaatcctaggctttgatatcctgttggaccataagcttaaaccatggttgctggaggttaaccactctccttcctttacaactgactcatgcctcgatcaagaagtgaaggatgccctcttatgcgacgccatgacccttgtgaatcttagaggctgtgataagaggaaagttatggaggaagataaacgccgcgtgaaggagcgactctttcagtgttaccgtcaaccacgggaatcccgatgcgcaaggtgcttggcttgtgtttag

SEQ ID NO: 51767 - DNA, 2448 bp, Artificial Sequence
  Description of Artificial Sequence: Synthetic coding sequence
atggagcccagcacctgccggaccatggagagcgaggaggactacgtggaagaaaaagaaagcgagaagtgtgtgaaggagggcgtaaccaatcctagcaacagcagccagcaggccctgctgaaagctgactacaaggccctgaaaaatggagtgccttcacctattatggctacaaaaatcccaaaaaaggtcattgctcccgtggacaccggggacctcgaagcggggcggcgcaaacgacgccggaaacgccgaagcttagcaataaacttaactaattgcaaatacgagtctgtgaggagggctgcacagatgtgcggactcaaggaggtaggcgaggatgaggaatggaccctgtactggacagattgcgctgtaagtctggaaagggtcatggacatgaagagattccagaagattaaccatttcccagggatgaccgaaatatgccgcaaggatctgctcgcccgaaacctcaatcgcatgtataagctctaccccagcgaatacaacatctttccacgaacttggtgcctgcccgccgactacggcgattttcagtcatacggtcgtcagcgcaaagcgagaacctatatatgcaagcccgactcaggatgtcagggtcgcgggatttttattactcgcaatccaagagaaattaaacccggggagcacatgatatgccagcaatacatctctaagcctctcctgattgatggcttcaagttcgatatgcgggtgtacgtgttgattacttcctgcgatccacttaggatcttcacctatgaagaaggtctcgcccgttttgctaccacaccctacatggagccatcccacaataatcttgacaacgtatgcatgcacctaaccaattacgctatcaacaaacacaacgagaacttcgtgagggacggcgccgttggcagcaaaagaaaacttagcacactgaacatttggctccaggagcactcatataacccaggcgagctttggggcgatattgaagatatcatcatcaagaccattatctctgcccactcagtattgcgccacaattatcggacctgcttccctcagtacctgaacggaggaacctgcgcctgtttcgaaattcttggctttgatatcctcctggaccacaagctcaagccttggctgctggaagtgaaccattcgccaagcttcacaacagacagctgcctggatcaggaggtgaaagacgccctgctgtgcgacgccatgactctcgtgaatctgaggggttgcgacaaaagaaaagtgatggaggaggacaaacggcgcgtcaaggagcggctattccagtgttaccgacagccgcgagagagcaggaaggaaaagaccgaaagcagtcacgttgcaatgttggaccaggaacggtatgaggactctcatctgggcaagtaccgccggatctacccagggccagatacagaaaagtatgcccgcttttttaagcacaacggcagcttatttcaggagaccgccgcctcgaaagcacgcgaggaatgtgctaggcaacagctcgaggagattcgcttaaaacaggaacaacaagagacttctgggaccaagaggcagaaagcccgtgatcagaaccagggcgaatctgccggagaaaagtctagacccagagctggcctacagagcttaagcacgcacctggcttatcgaaatcggaactgggaaaaggaactgctgcccgggcagttggatacgatgcgcccacaggaaattgtagaagaggaagaattggaaagaatgaaggccctgttgcagagggagacacttatcaggagtctgggtatcgtggagcaactaactcggttacagcacccggggccacagggacagaagaagttgcacgagtctagagaccgccttggctctcaggagcttaagagtatgtccttggtcctgctggtactgctgaggggtgctgccacagagcaaggggccccacactttttacatcccgtcttgccccatgagagcatacctcggattttgggcgcacttccgtccatgaacgccgccattccacacgtgccaaggtatcacctgcaaccaaaaaatttcaactggacgggggaacctgccgcaatcaattcctgttccctgtctatgaagaaagcggggaggtgttactttagcagcgccagaatccggctgacctctcagggacaagccagtcgaaggctggaagctataaatcgtgtcctggcaggttcagttccacctactctcacacccaagcaaggctattttcttcagcccgagagggtcgcctcagatagctggactgagtgcacattgccttcgatggtgaattcagagcatcgggccgccaaagtgccactctgccctgccagtgcccctatgctccagcgatcccgggctctgttgaacattaatcaatttcgctag

SEQ ID NO: 51768 - DNA, 1779 bp, Artificial Sequence
  Description of Artificial Sequence: Synthetic coding sequence
atgcggggccgggacctgtgcagcagcacccagagccaggccctgggaagcctccgtactacaactcccgccttcaccttaaatataccttctgaagccaaccacactgagcagccgcctgccggactcggcgcccgactgcaggaagctggggtcagcataccccctaggaggggccgccctactcccaccctggagaaaaagaagaagccccacttaatggcagaagatgagccgagtggtgccttattgaaacccctcgttttcagagtggatgaaacaacacctgctgtcgttcagtctgttcttctcgagcgtggctggaacaagtttgataaacaagagcaaaatgccgaagattggaacttgtactggagaacctccagctttcggatgaccgagcacaattcagttaagccatggcagcagttaaaccatcatcccggaaccacaaaactgactcgcaaagactgccttgccaaacacctgaaacatatgcggaggatgtacggtacctccctttatcagtttattcccctgacgttcgtcatgccaaacgattacactaaattcgttgctgagtattttcaggagaggcaaatgctagggacgaaacactcttactggatatgcaagccggccgaactttctcgcggtagaggaattctgatcttttctgattttaaagactttatctttgatgacatgtacattgttcagaaatacataagcaacccactgctgatcggacgctacaaatgtgatctgaggatctacgtgtgtgtgaccggcttcaaaccactcactatttacgtataccaagagggcctggtcaggttcgccacagagaagtttgacctgtccaatctgcaaaataactacgcgcacctgacgaactcctctataaataaaagcggcgccagttatgaaaagatcaaagaagtaatcggtcacggctgtaaatggaccctaagccgcttcttcagctacctgcgtagctgggacgtggatgatcttctgctgtggaagaagatccatagaatggtgatcctgacaatactggccatcgccccctccgttccattcgctgcaaactgtttcgaactgtttggcttcgatatcctgatcgacgacaacctgaagccatggcttcttgaagtgaattacagtcccgctcttaccctcgactgttcaacagacgtcctggtgaagaggaagctggtgcacgatatcattgacctgatctacctgaacggcctcaggaatgagggccgggaagcgtctaacgcaacccacggaaactccaacatcgacgctgcgaagagcgacaggggagggttagatgccccagactgtctcccctatgacagcctgtccttcacttctcgaatgtataacgaagacgattcagtggtcgagaaagcagtatcagtgcgcccggaggccgcgcccgcaagtcagctcgaaggcgaaatgtccggccaggatttccatctgagtactagagaaatgccgcagtctaagcccaaacttagatcccgacacacaccccacaagacccttatgccttatgcaagccttttccaatctcactcttgcaaaacaaagacctccccttgcgtgctgtccgaccggggtaaggcacctgatccacaggccggcaattttgtgttagtgtttcccttcaatgaagccaccctcggcgccagcagaaatggtcttaacgtgaagagaatcatccaagagcttcaaaaactgatgaataagcagcactcttag

SEQ ID NO: 51769 - DNA, 1560 bp, Artificial Sequence
  Description of Artificial Sequence: Synthetic coding sequence
atggccgaggacgagcccagcggcgccctgctgaagcccctggtgtttcgggtagatgagactactccagcagtggtgcaaagtgtcttactagaacgcgggtggaacaaatttgacaaacaggagcaaaacgctgaagattggaacctctactggcgcacatccagcttcaggatgacagagcataattctgtgaaaccctggcagcagctgaatcaccatcctggcactaccaaacttacacgcaaagactgcttggctaagcatctcaagcacatgcgccgcatgtacgggacatccttgtaccagtttattcccctcacattcgttatgcctaatgattacactaaattcgttgccgagtattttcaagagcgtcagatgctcggtaccaagcacagttactggatctgcaaacccgccgaattgagtcgtgggcggggcatcctgatcttttcagacttcaaggacttcatctttgacgacatgtacatcgtacagaagtatattagtaacccactcttgatcggacgttataagtgtgacttacggatctacgtctgtgtgacgggctttaagccactgactatctatgtttaccaggagggactcgtgcggttcgcaaccgagaaatttgacttatctaacctccagaataattacgctcatctgacaaactcttctattaataagtctggtgcaagctatgagaaaattaaggaggttatcggccatggctgtaagtggaccctgagtcggttcttcagctacctgcgatcttgggatgtggacgatttgttgctgtggaaaaagatccataggatggttatacttacgatcctagcgatcgcgccatctgttccatttgccgccaattgctttgagctgtttggcttcgacattctaatcgacgacaacttgaagccatggcttcttgaagttaactactcacctgccctaacgctcgactgttccactgatgtccttgttaagaggaaactcgtgcacgacatcattgacctaatttatttgaacgggttacgtaacgaaggaagggaggcaagcaacgccacgcacggtaatagcaacatcgacgcggcaaagagcgataggggcggactcgacgcccccgactgccttccttacgactcgttgtcctttacttcaaggatgtacaacgaagatgactctgtggtagagaaggctgtgagcgtgaggcctgaggcggctcccgcttcacagttagagggggagatgtcagggcaagatttccatctaagtacacgggaaatgcctcaatctaaacctaagctgcggtcccgtcatactccacacaagaccctgatgccctatgcctcacttttccagagccactcctgcaaaactaagacctccccttgcgtcttgtcagatcggggaaaggcccccgacccacaagcaggcaactttgtgcttgtgtttcccttcaatgaagctactctcggcgccagccgcaacgggctaaacgtgaagagaattatccaggagctacaaaaattgatgaacaaacagcactcatag

SEQ ID NO: 51770 - DNA, 2013 bp, Artificial Sequence
  Description of Artificial Sequence: Synthetic coding sequence
atgcccagcctgccccaggagggcgtgatccagggccccagccccttggatctcaataccgaactgccttatcagtccactatgaaacgcaaagttcgtaagaagaaaaagaagggaaccataacagccaatgtcgccggaactaaatttgagatcgtccggttggtcatagatgaaatgggatttatgaaaacccccgacgaggacgagacctccaacctgatttggtgtgatagcgccgtgcagcaggagaaaatttcagaactgcagaactatcaacgcattaatcacttcccaggtatgggagagatctgtcgaaaggatttccttgctcgtaatatgaccaagatgatcaagtctcggcccctggactacactttcgttccgcgcacttggatttttccggccgagtatacacagttccagaactatgttaaggagttgaaaaaaaagcgcaagcaaaaaacattcatagtaaagcccgctaacggtgccatgggccatggaatcagtcttattcgcaatggagacaagctgccctcgcaggaccaccttattgtacaggagtacatagagaaaccattccttatggaggggtacaagtttgatctgcgaatatacatacttgtcacttcttgtgatcccctaaagatcttcctgtatcatgatggtctggtccggatgggaaccgagaaatatatccccccaaatgagagtaacctcacgcagctgtacatgcatctgactaactacagtgttaataagcacaatgaacatttcgaacgcgatgaaacggagaacaaaggctcgaagcgttccattaaatggttcacagagttccttcaagctaatcaacacgacgtcgccaaattctggagcgacatttccgagcttgtggtgaaaacgttgattgtggcggaaccacacgtgttgcacgcataccggatgtgccgtcctggacaacccccaggtagcgaatctgtgtgtttcgaagtactcggctttgatattctcctggatagaaaactgaagccatggctgttggagatcaatcgagcaccctcattcgggacggatcagaagattgactacgacgtcaagagaggtgtgctcctgaatgctcttaagttactcaatattcgcacctctgataaaagacgaaacctggcaaagcagaaggccgaagctcagcgacgtctttacggacagaacagtattaagcggctgctgcctggatcctcggactgggagcagcagagacaccagctggagcggagaaaagaggagctgaaagagcggctagcccaggtacgcaaacaaattagccgcgaagagcacgagaatcgccacatggggaattatcggcgcatctacccaccagaggataaagccctgcttgaaaagtatgaaaacctgctggcggtggcgttccagaccttcttatccggtcgcgcagcatccttccagcgggaattgaacaaccctctgaaacgtatgaaagaggaagacatcttagacctgctggaacagtgcgagattgatgacgagaaactgatgggcaagaccaccaaaactcggggtcccaaacctctctgctccatgccagagtccacggaaatcatgaaaagaccaaagtactgcagtagtgattcaagctatgattcttctagctcctcatcagagagtgatgagaatgagaaagaggagtaccagaacaagaagagggagaagcaggtgacatacaacttaaagccctctaaccactacaagttgatccagcaacctagctcaatccggagaagtgttagctgtccccgttctatctccgcacagtcccccagttccggcgatacacgaccattctctgcacagcaaatgatctcagtgtcaagacctaccagcgctagccgatcgcactctctgaatagggcctcctcctatatgagacatctaccgcacagcaacgacgcgtgtagcacaaattcccaggtcgtagcaatcatacgtcaatag

SEQ ID NO: 51771 - DNA, 1710 bp, Artificial Sequence
  Description of Artificial Sequence: Synthetic coding sequence
ctgggccagcggcagctgttccaggccctgcgggtggagcaccggtctcctgaaccttggttgccacgggccgttggcggacgccggcgggctcccgatcaccagtgtagactgccatcacggggcggccgaccccgtggtagctgtgaagcaagggagcacctgggcgatagacttcagcgcggtcgcgaggaccccggttgggcttttctgactcgagaactggtggtgaagacactgattgtggctgaaccccacgtgttgcacgcgtaccggatgtgccgccctgggcagccacccgggagtgagagcgtgtgcttcgaagtgttgggattcgacattttattggatcgtaagctgaagccatggctgcttgagatcaacagagctccctccttcgggactgatcagaagatcgactacgatgtgaagcgcggcgtgctactgaatgccctcaagttgctaaatattcgcacaagcgacaagcgccggaatttagctaagcagaaggcggaggcacaaaggcgtctctatgggcagaattcaattaaacgcttgctgccaggttcttcagactgggagcagcagaggcatcagctagaacggagaaaggaagaattaaaagaaagactggcacaggtgagaaaacagatttccagggaggaacacgagaaccgccacatgggtaactaccgccgaatctatccgcccgaggacaaggccctcctggagaaatatgaaaacttgctggccgtggcctttcagacatttttgtctggccgtgcagcctcttttcagcgtgagctgaataatcccctgaaaagaatgaaggaggaagacatcttggacctgcttgagcagtgcgagatcgacgacgaaaagctgatgggtaagaccacaaaaacgcgaggaccaaagccgctctgtagtatgcctgaatcaaccgagatcatgaagagacccaagtattgtagttcagactcctcatatgacagttcaagtagttcgtctgaaagcgacgagaatgagaaggaagagtaccagaacaaaaaaagagaaaagcaggtcacatataatctcaagccttccaaccactacaagcttatccagcagcccagttctattcgaaggagcgtgtcttgccctagaagtattagtgcacagtctccatcgtctggagatactcgccccttttctgctcaacagatgatttccgtgagcagacctactagtgcttccagaagccatagtctgaacagagccagtagctatatgcgccatctgcctcattccaatgacgcttgctccacaaactcccaggtgtctgaatccctgcgacagttaaagaccaaagaacaagaagacgacctgacatcacaaacgctcttcgttttgaaggatatgaaaattcgctttcctggcaagtccgatgcggaatccgagctactaattgaggatatcattgacaactggaaatatcataagactaaggtagctagctactggttaatcaaactcgattcagttaagcagcggaaggtcttggatattgtcaagacgtccattagaaccgttctcccaaggatatggaaggtacctgacgtcgaagaggtgaacctgtataggatcttcaatagggtgttcaaccggcttctgtggagccggggacaaggcctgtggaactgcttctgcgatagcggttacctgtag

SEQ ID NO: 51772 - DNA, 1101 bp, Artificial Sequence
  Description of Artificial Sequence: Synthetic coding sequence
atgagctggaacatcagccacccccagctgagcgacaagctgttcggtaagaatggggtgctcgaagaacagaagagcccggggtttaaaaagcgggagactgaggtatatgttggtaatttgccactggacattagtaaggaagagatactgtaccttcttaaggactttaaccctttggacgtgcataaaatacagaacggttgcaaatgcttcgcattcgtggacctgggatccatgcaaaaggttactttggccattcaggaactgaacggcaagttgttccataaaaggaaactgtttgtgaatacgagcaagagacccccgaaaaggacacctgacatgattcagcagcctcgcgctccacttgtcctggagaaagcaagtggagagggatttggtaagaccgccgccatcatacagctggcgcccaaggccccagtggatctgtgtgagaccgaaaagctgcgggccgcgttctttgccgtgcctctcgagatgcgaggcagctttctggttctactgctgcgagagtgcttccgagatctgtcatggctggccttgatccattccgtgcggggagaggccgggttgcttgtgaccagtatcgtacctaaaacacctttcttctgggctatgcacgtcacggaagccctgcaccagaacatgcaggcgcttttttccaccctggcacaggctgaagaacagcagccctatctggaggggagtactgtcatgagaggcacacggtgtttagccgaatatcatttgggggactatggccacgcctggaaccgatgttgggttctggacagagtcgacacttgggccgtagtcatgtttatagatttcggccagttggcaacaatccccgttcagtccttgcgttccctggattctgatgacttttggaccattccccccctaacacagcctttcatgttggagaaggatatccttagcagttatgaggtggttcataggattctgaagggtaagatcacaggcgccctcaacagcgccgtaaccgcccctgctagcaatttggcagtggtgccccccctcttacccctgggatgtctccaacaggcagccgcttag

SEQ ID NO: 51773 - DNA, 1056 bp, Artificial Sequence
  Description of Artificial Sequence: Synthetic coding sequence
atgagctggaacatcagccacccccagctgagcgacaagctgttcggaaaaaacggcgttctggaagaacagaaatcccccggattcaaaaagcgggagaccgaggtttatgtcggcaatctgcccctcgacatatctaaggaggagattttgtatttacttaaagatttcaaccctttggatgtgcataaaatccagaacggatgcaagtgctttgcattcgtggatctaggcagcatgcaaaaggtgactttagccattcaggagctgaatggaaaactgtttcacaaacggaaactctttgtgaacacaagtaagagaccacctaagcgcacccccgacatgattcagcaacctcgcgccccactagttctcgagaaagcatccggggagggctttgggaagaccgctgccataattcagcttgcaccaaaggcccccgtggacctctgcgagacggaaaagctgagagctgccttttttgcagtgcccctggagatgagaggcagcttcctcgttttgttattgcgcgaatgttttcgcgacctgtcctggctcgcattgattcatagcgtccggggagaagccggtctgttggtgacaagcatcgtgcccaaaacccctttcttttgggccatgcatgttactgaggccttgcaccaaaatatgcaggccctcttctctacactggcacaagcagaggaacagcaaccttatctggagggttctaccgtgatgcgaggaacccgatgcctcgccgagtatcaccttggtgattacggacatgcctggaaccgctgctgggttctcgaccgggttgacacctgggcagtcgtcatgttcattgactttggacagttagctaccatacccgtgcagagcctgaggagtcttgattctgatgatttctggaccatcccaccccttacacagcctttcatgctggaaaaggacattttgagctcctacgaggtggtgcaccgtattctcaaggggaagattaccggcgctttgaactcagccctgcacattttgaagttcgaagagtcaaagtag

SEQ ID NO: 51774 - DNA, 1188 bp, Artificial Sequence
  Description of Artificial Sequence: Synthetic coding sequence
atgctgcagctgctggtgctgaagatcgaggaccccggctgcttctgggttatcatcaagggatgtagtccctttctcgaccatgatgtggattatcagaaattaaactccgcaatgaacgacttttacaactctacatgtcaggacatcgagattaagcccttaaccttagaggaaggacaagtatgtgtcgtctattgtgaggaactgaaatgctggtgccgagccatcgtgaagtccatcacgagttctgctgaccaatatctggccgaatgcttccttgtggacttcgccaaaaacattccagttaagtctaagaacattagagttgtagtcgaatccttcatgcagctgccctatcgcgccaagaagttctctctgtattgcaccaagcccgtaaccctgcatatcgacttctgccgggattcaacagatatcgtgcctgccaagaagtgggataatgccgcaatccagtattttcagaacctcctcaaggcaactactcaggtagaagcccggttatgcgccgtggaagaagacaccttcgaggtttacctgtacgttactatcaaagacgaaaaagtgtgcgtgaatgatgacctggtcgccaaaaactacgcttgctatatgagcccaacaaaaaataaaaacctggactaccttgagaaaccacggctgaatattaagtccgctccctcttttaacaaactgaaccctgccttaacgctgtggccaatgttcttgcagggtaaggacgttcaaggtatggaggatagccatggggtgaacttccctgcacagagcctgcagcacacttggtgcaaaggaatcgtgggcgacttgaggcccacagccacagctcaagacaaggctgtcaagtgtaacatggacagtctgcgcgactccccaaaggacaagtctgaaaaaaaacatcactgcatatcactcaaagacactaataagcgagtggagtctagtgtgtattggccagccaagcgcgggatcacaatctacgccgatccggacgtgcctgaagcatcagctctttcccaaaagtcgaatgagaagccactgagacttaccgagaagaaagagtatgatgagaagaatagctgcgttaaattacttcagtttctcaaccccgaccccctccgggccgacgggattagcgacctacagcagacctag

SEQ ID NO: 51775 - DNA, 3534 bp, Artificial Sequence
  Description of Artificial Sequence: Synthetic coding sequence
atgctgcagctgctggtgctgaagatcgaggaccccggctgcttctgggtgatcatcaaggggtgtagtccatttttggaccatgacgtggattatcagaaactcaacagcgctatgaacgacttctacaactccacttgtcaggatatcgagattaaacctctgaccctggaggaaggccaggtgtgtgtagtttactgcgaagaattgaagtgctggtgccgagccatcgtgaagtctattacgtcaagcgcggatcagtacttagccgagtgcttcctggttgattttgccaaaaatatcccagtgaaaagtaaaaatatccgtgttgtggtcgagagcttcatgcagttaccatacagagctaagaagttttcactgtactgcaccaaacccgtgacccttcacattgacttctgtcgagactcaacggacatcgtgcccgcaaagaaatgggataacgccgccatccagtattttcagaacctgctcaaggctaccactcaggtggaagcgaggttgtgcgccgtagaagaagatacttttgaagtctatctgtatgtgaccataaaagacgagaaggtgtgcgtgaacgacgacttagttgccaagaactacgcatgctatatgtcacccactaagaataagaacctggactacctcgagaaaccccgtctcaatattaaatcggcaccctcattcaataagctgaaccccgctctcactctgtggcccatgttcttgcaggggaaagacgtccaggggatggaggactcccacggcgtgaactttccggcacagtccctgcaacacacctggtgcaaggggatcgtgggagacctaaggccgacagcaaccgcacaagacaaggcggtgaagtgtaacatggacagtctgagggattctcctaaagacaagagtgagaagaaacatcactgtatctccctaaaggacacgaataagcgtgttgaatctagcgtatattggcctgccaagagaggaattacgatttatgccgaccccgatgtacctgaggcctccgctttatcacaaaagtcaaatgaaaaacctttgcgactgactgaaaagaaggagtacgacgaaaagaattcatgcgtgaaactgctgcagttcctaaatcctgatccactacgggctgacggaatcagtgatttacaacagctccaaaagctcaagggattgcaacctcctgtggtcgtgctccgtaataagatcaaaccatgtctgaccattgatagttcacccctcagcgctgatcttaagaaggcattacagaggaacaagttccctggtcccagtcatacggagtcatactcgtggccacccatcgcccgaggatgtgatgtggtggtgataagccattgtgagagcaatcctcttctttacttactgcccgttctgacggtactgcagactggcgcttgctacaagtcccttccatcaaggaatggccccctcgccgttattgtgtgcccgggctggaagaaggcacagttcattttcgagctgctgggtgagtacagcatgtccagcaggccactccaccccgttctcctgaccatcgggttacataaggaagaagccaagaacacgaagctccctcgcggctgtgacgtcattgtaaccactccatattcactgcttagactgcttgcatgccaatccctgctgtttcttagactgtgtcatttaatactggatgaagtggaggtgctgttcctcgaggctaacgagcaaatgtttgcaatccttgataactttaagaagaacatagaagtcgaggaacgggagagtgccccgcaccagattgtcgctgtgggagtgcactggaacaaacatattgagcatctaatcaaggaattcatgaacgatccttatattgttatcacggccatggaggaagcagccctctatggtaatgtccagcaagtggttcacctgtgcttggagtgtgaaaaaacctcttctcttttgcaggccttggatttcatacccagtcaggcccagaaaactctgatttttacttgtagcgtagctgagactgagatcgtatgcaaagttgtcgaatcgagcagcattttctgcttgaagatgcacaaagagatgattttcaaccttcagaatgtgctggagcagtggaagaagaagctgagctccgggtctcaaattatccttgctttgacagacgattgcgttcccctcctcgccatcacagatgctacttgcgttatccacttttcattccctgcgtcgccaaaggtcttcggcggccgcctatattgcatgagcgatcacttccatgcagaacagggatctcctgctgagcagggtgataaaaaggccaaaagcgtgcttctcctaacggagaaggacgctagtcacgcagtgggcgtcctcaggtacttggaaagggccgatgcaaaagtccctgccgagctgtacgagttcaccgctggcgtgttagaggcaaaggaagataaaaaggcaggacggccgctctgtccctaccttaaagctttcggcttctgcaaagacaagagaatctgcccggatcgccatagaattaaccccgagactgatcttccacggaagctgagctctcaggccctgccttcatttgggtatatcaagattatacccttctacattctgaacgccacaaactacttcggcaggatcgtagacaaacacatggatctttacgctacactgaacgcagagatgaatgagtattttaaagattctaataagactaccgtggagaaagtggaaaagttcggcctgtatggcttagccgagaaaacactgtttcatagggtgcaggttttggaggtcaatcagaaagaagacgcttgggctttggacgacattttagttgagttcatagacgaaggtaggacaggtcttgtgacccgggaccagctgctccacctgcctgaacattttcacactctgcccccacaggccgtggagtttatcgtgtgcagagtgaaacccgcggacaatgagatagagtggaaccctaaggtgaccaggtatatccaccacaagattgtcggaaagctgcacgacgctaaggtgatacttgccctgggtaacacggtctggattgatcctatggtgcacatcaccaatctgtcctctcttaaaacttcagtcatcgattataacgtgagagcagagattctcagtatgggcatggggatcgacaatcctgagcatatagaacagctgaagaaacttcgcgaggatgctaaaatccccgcatgcgaggaatctctatctcagaccccaccgagagttaccggcacttcccccgcacaagatcaggaccatcccagtgaagagcaggggggacaaggcactccccctgccgaggatgctgcatgtctccagtccccccagcccgaggacaccggtgccgaaggtggggctgagagtaagacctcaagcgagaaccagaagcccggtggctacctcgtgtttaaacggtggctctcctctaataggtag

SEQ ID NO: 51776 - DNA, 561 bp, Artificial Sequence
  Description of Artificial Sequence: Synthetic coding sequence
atggacaccttcagcaccaagagcctggccctgcaggcccagaagaaactgctgagtaaaatggcttcaaaggccgtggtggcagttctggttgacgacacttcttccgaggtactggatgagctttaccgggcgacaagggagttcacccgttcccggaaagaagctcagaaaatgctgaagaacttggtcaaagtagccctgaagctgggtttgctattgagaggagaccagttgggaggcgaagagctcgcgctgctgcggcgcttccggcatagggccaggtgtctggcaatgactgcggtcagttttcaccaggtcgactttacctttgatcgcagggtactggctgctggcctgctggagtgtcgcgacctgcttcatcaggctgtgggacctcacctgaccgccaaatcccacggccggattaaccatgtgttcggccacctggcagattgtgactttctcgcagccctgtatggaccagcagagccgtatcggtctcacctacggcgcatctgtgaaggccttggccgtatgttagatgaagggagcttgtag

SEQ ID NO: 51777 - DNA, 561 bp, Artificial Sequence
  Description of Artificial Sequence: Synthetic coding sequence
atggacaccttcagcaccaagagcctggccctgcaggcccagaagaagctcctttctaaaatggcaagcaaagctgtggtagctgtgttggtagatgatacctcctccgaggttttggacgaactctaccgggccaccagggagtttactcgctccagaaaggaggctcaaaaaatgctcaagaatctggtcaaagtggcacttaaactggggttactgctcagaggggatcaactgggcggcgaagagctggccctgctcaggcggtttagacaccgcgcgcgttgtctggccatgacagcagtgagcttccaccaagtggacttcacatttgaccgtagggttcttgctgcggggttgcttgagtgcagggatctgctgcaccaggccgtcgggccccatttaaccgccaagagccacgggagaatcaatcatgtcttcggacacctcgccgattgcgacttcctggcagctttatatggtcctgctgaaccatatcggagccacctgcgccggatctgcgaagggcttggccggatgcttgacgaaggatccttgtag

SEQ ID NO: 51778 - DNA, 879 bp, Artificial Sequence
  Description of Artificial Sequence: Synthetic coding sequence
atgggcaagccccggcagaaccccagcaccctggtgagcaccctgtgcgaagctgaaccaaaggggaagctatgggttaatggatatgcagggacacagggcacacgcgacgccaccctccagacaaggttaatccccctgtccttccacctccaacggggcaaaggtcttgcagcccctttgagcgcactctccgcaccgagactgccagagagacctgctgatggccgtgtcgctgttgacgcccaacctgcagcccgcagcatggattcagactcaggagagcaatctgaaggtgaacccgtcaccgcagcaggccccgatgtgtttagcagcaaaagcttggctctccaggcacagaagaagattttaagcaaaatcgccagtaagacagtcgcgaacatgctgatcgacgacacatcaagtgaaatttttgacgagttgtacaaggtgaccaaagagcacacacacaataaaaaggaggcgcacaagatcatgaaggacttaattaaggtagcaatcaagatcggaattctctaccgcaacaatcaattttcccaggaggagctcgtgattgttgaaaaatttagaaagaaactgaatcagactgccatgaccatcgtgagtttctacgaggtcgagtatacttttgatagaaatgttctgtcaaatttgctgcatgagtgtaaggatctcgtgcatgagctggttcagcgccatttgacaccacgaactcatggtagaatcaaccatgtctttaaccatttcgccgacgtggaattcctgtcaacattgtattcactagacggcgattgcaggcctaacttaaagagaatttgcgagggtatcaacaagctgctcgatgagaaggtgttgtag

SEQ ID NO: 51779 - DNA, 411 bp, Artificial Sequence
  Description of Artificial Sequence: Synthetic coding sequence
atgccccacgcccggaccgagaccagcgtgggcacctacgagagccactctacgtctgagctggaggacctaacagagccagagcagagagagttgaaaactaaactcaccaaactggaagccgagattgtaacattaaggcacgtgcttgctgctaaagaacggcgttgcggcgagctgaaacggaagctcggactaacggcactcgtggggttgagacagaatctgtcaaagtcctggcttgacgtgcaggtgagcaacacatacgtgaagcaaaagacaagcgccgccctgagcacgatgggtactctaatttgtcgaaagcttggtggggtgaaaaagtcagccacatttcgcagcttcgaggggctcatattcaataaatacactctcaatcaggggaggaattag

SEQ ID NO: 51780 - DNA, 423 bp, Artificial Sequence
  Description of Artificial Sequence: Synthetic coding sequence
atgccccacgcccggaccgagaccagcgtgggcacctacgagagccatagcacctctgaactggaagatctgacggaaccagagcagcgagaattgaagacaaaacttactaaactggaagctgaaatagtgaccttgcgtcatgtgctcgcagctaaggagcgtaggtgcggagagctgaaaagaaaactcggccttacagcgctggtggggctgcggcaaaatctgtcgaagtcctggctcgatgtgcaggtgtctaatacttacgtgaagcaaaagacatctgctgctttatcaacaatgggtaccctgatctgccgtaaacttggtggagtaaagaagtcggcgacctttcgatcatttgaaggcctaatggggacaattaagtcaaaggtgtctggcggcaaaagggcctggccctag

SEQ ID NO: 51781 - DNA, 399 bp, Artificial Sequence
  Description of Artificial Sequence: Synthetic coding sequence
atgccccacgcccggaccgagaccagcgtgggcacctacgagagccactccacctcagagctcgaggacctcacggaacccgagcagagagaactgaaaacaaaattgacaaagctcgaagccgagatcgtgacactgcggcatgtgcttgccgccaaagagaggagatgcggagagttgaagcggaaactcggattaacagctctggtcggcctcagacagaacttgagcaaatcctggctcgacgtccaggtgagcaatacgtacgtgaagcaaaagacctcagcagcactgtcaacaatgggtaccctgatatgtcgtaaactgggcggcgtcaaaaaatccgccacctttcgctcattcgaggggaaccccaaaggtgaaggctccagaatttag

SEQ ID NO: 51782 - DNA, 999 bp, Artificial Sequence
  Description of Artificial Sequence: Synthetic coding sequence
atgctggccgtgcacttcgacaagcccggcggccccgagaacctgtacgtgaaggaagttgccaagccttcgcccggtgagggagaagtgctgcttaaagtagccgcctcagcactgaaccgcgcggatctgatgcaaagacaggggcagtacgaccccccccccggtgctagcaacattctgggcctggaagcttctggccacgtcgcagagctggggcctggctgtcagggccactggaagatcggtgacacagctatggctttgctccctggtggcggccaggcgcagtatgtgaccgtgcccgaggggctacttatgcctatacctgagggcttaacccttacacaggctgcagccattcctgaggcgtggcttaccgctttccagctactccatttggttggaaacgtccaagccggagactacgtgctgatacacgccggcctgtctggtgtaggcactgccgcgatccagttgacccgcatggctggtgccatacctctggtgacagcaggttctcagaaaaagctgcagatggcagaaaagctcggagccgcagctggattcaactacaagaaagaggacttctccgaggctaccctgaagttcactaaaggagcaggggtgaatctgatactcgactgtatcggcggaagttactgggagaagaatgtgaactgtcttgcactcgatggcaggtgggtgctgtatgggctgatgggtgggggagacattaacgggcctttgttcagcaaactgctgttcaagcgagggagtctgatcactagcttgttgcggagtagggataacaagtacaaacagatgctcgtgaacgcatttaccgaacaaatccttccacacttttctacggagggaccacagcggttgctgcctgtgctggatagaatctatcccgtgacggaaatacaagaggcccataaatacatggaagccaacaagaacattggaaaaattgtgttggaactcccacagtag

SEQ ID NO: 51783 - DNA, 747 bp, Artificial Sequence
  Description of Artificial Sequence: Synthetic coding sequence
atgctggccgtgcacttcgacaagcccggcggccccgagaacctgtacgtgaaagaggttgcaaaacctagtcctggtgagggtgaggtcctgctgaaggtcgctgcttctgcactgaaccgggcagatctgatgcagaggcagggtcagtacgaccctcctccgggcgccagtaacatcctgggcctggaggcatccgggcacgtcgctgaactaggccccggttgtcagggccattggaaaattggcgatacggcgatggccctcctgccgggcggtggtcaggcccagtacgttaccgttcccgaggggctgctgatgcctattccagagggactgaccctcacccaagctgccgcaatccctgaagcgtggctcacagccttccagttactccatcttgtcggcaacgtacaggctggggactatgtgttgatacatgccggactgagtggcgttggtaccgcagcaatacagttgacaaggatggccggcgccattcctcttgtaactgcaggcagtcaaaagaagcttcaaatggccgagaaactgggcgccgccgctggattcaactataagaaggaagatttttctgaggctacgctgaaattcacaaaggtgcaggccaatgccggtgaatgttttcatggcgcgaattcggcttccctgttgcatgggggcccaccgaccagcgcggcaggaagtggccagaatctgccctccgataggaaccctgggggcccttag

SEQ ID NO: 51784 - DNA, 999 bp, Artificial Sequence
  Description of Artificial Sequence: Synthetic coding sequence
atgctggccgtgcacttcgacaagcccggcggccccgagaacctgtatgtgaaagaagtcgctaaaccctcccccggggagggagaggtgctgctgaaggtggccgcatcagctctgaacagggcggacttgatgcagcgccaggggcagtatgatcccccaccaggggcctccaacatccttggccttgaggcaagtggccacgtcgccgagctggggcccgggtgtcagggccactggaagatcggggacactgctatggctctgctgcccggtggcggccaggcccaatacgtgacagttcccgagggcctgctcatgccgatccccgaaggtttgacgctgacgcaggcggccgccatccccgaggcttggctcacagcttttcagcttttgcacttggtcggaaacgtgcaagctggtgactacgttttgatccatgccggccttagtggcgtggggaccgctgcaatacagctaactagaatggccggcgccattcccctagtgactgccggtagccagaagaagctgcaaatggcagaaaaactcggcgccgcagccggcttcaattacaagaaagaggatttctcggaagcaactctaaagtttacgaagggtgccggggtgaaccttatccttgattgtatcggtggcagttattgggagaagaatgtgaactgcctggccctcgacggacggtgggttctgtatggtttgatgggggggggagatattaatggaccactgttttccaagctcctgttcaaacgaggcagcctcatcaccagcctcctgagatcccgggacaacaagtataagcagatgctcgtgaacgccttcacagaacagatcctgcctcacttctccacagaaggcccacaaagactgctgccagtgctggacaggatttatcctgtgacagagatacaagaagcccacaaatacatggaggcgaataagaacatcggcaagatcgtgctggaattaccccagtag

SEQ ID NO: 51785 - DNA, 651 bp, Artificial Sequence
  Description of Artificial Sequence: Synthetic coding sequence
ttcgacaagcccggcggccccgagaacctgtacgtgaaggaggtggccaagccatcaccaggtgaaggcgaggtgctactaaaggtcgccgcatctgccttgaatagagccgatcttatgcagcgtcagggacagtatgaccctccacccggcgcgtcaaacatcctcggcctggaggcttctgggcatgttgccgagctgggtcctggctgccaaggtcattggaagattggcgacaccgccatggcactccttcccgggggaggtcaggcccaatacgtgactgtgccagaagggctccttatgccgatccccgagggcttgacgctgacccaggccgctgccatccctgaggcctggctcactgcgtttcagctgctgcacctggtgggcaacgttcaggccggggactacgtgctgatccatgcgggtctgtctggcgtggggacagccgccatccaattaaccaggatggctggcgctattccgctcgtcactgcaggaagccagaaaaagctgcagatggccgagaagcttggcgccgcggcggggtttaattacaagaaagaagacttttcggaggccacgttgaaatttacaaaaggcaaacaactgctgctgcagttctcccgtaacctgcgcgacgactag

SEQ ID NO: 51786 - DNA, 261 bp, Artificial Sequence
  Description of Artificial Sequence: Synthetic coding sequence
atgggcagcagcagcgaggccagcttccggagcgcccaggccagctgctcaggagctagacggcagggattggggcgtggcgatcagaacctgtcagtcatgcctcccaacggcagagcccaaacccatactcctggctgggtaagcgatcccctcgttcttggcgctcaagtgcacggcggttgccgtgggatcgaggctctaagtgtttccagcggctcatggtcatccgcaactgtgtggatactgacagtgcagtag

SEQ ID NO: 51787 - DNA, 363 bp, Artificial Sequence
  Description of Artificial Sequence: Synthetic coding sequence
atgggcagcagcagcgaggccagcttccggagcgcccaggccagctgtagcggagcaaggcggcaagggctcggtcgcggcgaccaaaacttgagtgtgatgccgccaaacggccgggcccagacacacactcctggatgggtaagtgatcccttagtcttgggcgcacaagtgcacggagggtgccggggcatcgaagccctctctgtctctagcggatcctggagtagtgctacagtttggatcctgacaggcctcagccggccatttttgcctggagccactgtattaagagatcgcccacttggctcagcttttgagctatcctacgaccagaaaaaggccccccttcgtctgcagtag

SEQ ID NO: 51788 - DNA, 837 bp, Artificial Sequence
  Description of Artificial Sequence: Synthetic coding sequence
  Description of Combined DNA/RNA Molecule: Synthetic coding sequence
atgctgcggagcctgctgctgcacagcctgcggctgtgcgcccagaccgcctcctgtctggttcttttcccaagattcttaggaaccgccttcatgttgtggctgctggactttctttgcattagaaaacacttcctcggcagaaggcggaggggccagcctgagcctgaggtcgaactcaattctgaaggagaggaggtgcccccagatgatccgccaatttgcgtgagcgacgataaccgattgtgtactctcgccagcttgaaggccgtgtggcacggacagaaacttgactttttcaaacaagcccatgagggcggacctgccccaaactcagaagtagtcctcccagatggtttccagtctcagcacatcctggattatgctcagggcaacagaccgctggtactcaacttcggcagttgtaccugaccccccttcatggcccggatgtctgccttccagaggctcgtgacaaaataccagcgtgacgtggatttccttatcatctacattgaggaggcgcatccttctgatggatgggtgacgaccgattctccttatatcattccacagcacaggagtctcgaggatcgggtgtctgctgctcgggtcctgcagcagggcgcccccgggtgtgccctcgtgctcgatactatggcaaactcctctagctccgcatatggagcctactttgagcgtctgtatgtgattcagtccgggacaatcatgtatcaggggggacgagggccagacggttatcaggtctccgagttgcgcacctggctggagaggtacgacgagcagctgcacggcgctagacccaggcgcgtttag

SEQ ID NO: 51789 - DNA, 4209 bp, Artificial Sequence
  Description of Artificial Sequence: Synthetic coding sequence
atgcaccagaccctgtgcctgaaccccgagagcctgaagatgagcgcttgctccgactttgtggaacacatctggaagcctggctcatgcaagaactgtttctgtctgagatccgaccaccagctggttgccgggccgcctcagcctcgtgcaggctccctgcctccccctccccggctgccaccacgtcccgagaattgtcgtttggaggacgaaggggtcaactcaagcccctattctaaaccgaccattgccgtcaagcccaccatgatgtccagcgaagcatccgatgtttggactgaagccaacctgagcgcagaggtgtctcaggtgatttggagaagagcccccggcaaactccccttgcccaaacaagaagacgctcctgtggtgtatttggggtcatttcgcggagttcagaaaccagcaggtcccagcacaagccctgatgggaatagcagatgccctccagcctatacaatggtggggctacacaacctcgaacctcgaggtgagcgtaacatcgctttccacccagtgagcttcccagaagaaaaggccgtccacaaagagaagcccagcttcccttaccaggacagacccagtacccaagagagcttcaggcagaaactggccgccttcgccggtactacctcaggatgtcaccaggggcctggacctctcagggagtcgctcccttctgaggatgacagcgatcaaagatgctcccccagcggtgatagtgagggaggcgagtactgtagtatcctggattgctgcccaggtagccctgtggcaaaggcagcgagccaaaccgccgggtcacgaggccggcacggaggccgggattgctccccaacttgttgggaacaaggtaagtgctcaggccctgccgaacaagagaaacgtggcccgtcatttccgaaggagtgttgttcacagggtcccaccgctcacccatcctgcttgggtcctaagaagttatcgctcacttctgaggccgctatatcctccgacggcctgtcctgcggctccgggagcggctccggcgcctcgtcaccctttgtgccgcatttggagtccgattactgttcactcatgaaggagcctgcgccagaaaaacagcaggacccgggctgtccaggagtgacacccagtagatgcctggggctgacaggggaacctcagcccccggcccaccctagagaagcaacccagcctgaaccaatttacgcagaatctacgaaacggaaaaaggcggccccagtgccgtcgaagtctcaggctaaaattgagcacgccgcagcagcacagggacaaggtcaggtttgtaccggtaacgcgtgggctcagaaggcggcatctggctgggggagagactcaccggaccccacaccacaagtttcagccaccattaccgtgatggcagcccatcccgaagaagatcaccggactatctaccttagctcaccagacagcgcagtcggcgtgcagtggccccgaggacccgtgtcacagaattccgaggtcggcgaggaggagacaagcgctggtcaaggattgagctctcgagagtctcacgctcactcagcctcagaaagcaaacccaaggaacgaccagctatcccacccaagttgtcaaaaagcagccctgtcggcagtccagtgagccctagcgcgggggggcctccagtaagcccgctggccgacctttctgacgggagttccggtggttcctcaatcggcccacagccgccgagtcaaggccccgcagatccagcaccttcatgccggacaaatggcgtcgctatcagcgatccatctcgatgtccccagccagcggcttcatcagccagcgaacagcgcaggccgcgatttcaggccggaacttggtcacgtcaatgcaggattgaggaggaggaggaagtggagcaggagctcctctcccatagctggggcagggaaacgaaaaacggaccaaccgaccatagcaactccaccacctggcacagacttcaccccactgacggctctagcggacagaactcaaaagttggaactggaatgagcaaatctgcaagcttcgcgtttgaattccctaaagaccggtcgggcatcgagaccttttctcccccacctcccccccctaagagccggcacctgctgaagatgaacaaatctagttcagatctcgagaaggtgtctcagggatcggcagaatcattgtccccctccttccgtggggtgcacgtctctttcacgaccgggtccactgactccctagcgtcagattctaggacttgtagtgacggggggccctcttcagaactggcccactccccgactaattctgggaagaaactgtttgcaccggttccatttcctagtggatctacagaagacgtgtcaccttctggcccccagcaacccccaccgctcccgcagaaaaagattgtctcgagagccgcttcttcacctgatggattcttttggacccagggctcacctaagccgggcaccgcttcccctaagctgaacctgagccattcagagacgaatgtacatgacgagagccacttctcatactctctttctcctggcaaccgccatcatccggtctttagctcatctgaccccctggagaaggcctttaaggggagcgggcactggctcccggccgctgggcttgcaggtaaccgcgggggatgtggaagtcctggacttcagtgcaagggcgcgcccagcgcctcatcctcacagctatcagtgagtagccaggccagcaccggttcaacgcagctgcaactgcatggtctgttgtctaatattagtagcaaggaggggacatacgcaaaacttggcggactatacactcaatctctcgcccggctggtcgctaagtgtgaagacttatttatgggaggacagaagaaggagctgcactttaacgaaaacaactggagcctatttaaattgacttgtaacaaaccttgttgtgatagcggcgatgccatttattattgcgcaacctgttctgaagacccggggtctacttacgcagtgaaaatatgcaaggcccctgaacccaaaactgtgtcatattgctccccaagcgtgccggtgcacttcaacattcaacaggactgcgggcactttgttgcctccgtcccctcctcaatgctaagctcccctgacgcccctaaggatccagtgcccgcccttcctactcatccaccagcccaggagcaagactgtgtcgtggtgatcacacgtgaggtacctcatcaaacagcctccgatttcgttcgagattcggccgcaagccaccaggctgagcctgaggcatatgagcggagagtttgctttctacttctccagctgtgcaacggactcgaacatttgaaggaacacggaatcattcacagggatctatgtctggagaacctcctgctggttcactgcaccttgcaggcaggtccgggtcctgctccagccccagctcctgcacctgcagcagccgccccaccctgttcctccgcggcccccccggccggggggactctctctcccgccgccggacctgcttcacccgaaggcccaagggagaagcaacttccgcgcctgatcattagcaactttctgaaagcaaagcagaaacctggcggcactcctaaccttcaacagaagaagtcacaagctcgcctggcgcctgagatagtgtccgcatcacagtatcggaaattcgacgaattccaaaccggcattctgatatacgagctcctgcaccagccaaatcctttcgaggtgcgagcgcagctccgggagagagattatcggcaggaagacttaccgccgcttcctgctctgagcctttattccccgggtctgcagcagttagctcatctgcttctggaggccgatcctattaagcggatcaggatcggggaagctaaacgagtcttacagtgtctactgtggggccccagacgtgagctggttcagcagcccggtaccagtgaagaggccttatgtggcaccctgcacaattggattgatatgaaacgagccctcatgatgatgaagttcgccgagaaggccgtcgaccgacggcggggtgtggagctggaggattggctgtgctgtcagtaccttgcaagtgctgagccgggggctcttctgcagagcctgaagctgttacaattgctgtag

SEQ ID NO: 51790 - DNA, 4209 bp, Artificial Sequence
  Description of Artificial Sequence: Synthetic coding sequence
atgcaccagaccctgtgcctgaaccccgagagcctgaagatgagcgcatgcagcgactttgtcgagcacatctggaaaccaggctcctgtaagaactgcttttgtttgaggtccgaccaccagttggtggcaggacctcctcaaccaagagcaggaagtctgccccccccaccccggttgccaccaagacctgagaactgtcgacttgaggacgaaggagtgaacagtagcccctattcaaaaccgaccatcgcggtgaagccaaccatgatgagctccgaagcatccgacgtgtggacagaagctaatctctctgcagaggtttctcaagttatctggaggcgggcaccaggtaagctccccctgcccaagcaggaggacgccccagtcgtgtacctagggagcttccggggagtgcagaagcctgcagggccctccacatcacctgacgggaattcacggtgtcctcctgcatacactatggtcggtctacataatctggaaccccgcggcgaacggaacattgcatttcacccggtgtcttttcctgaggagaaggctgtgcacaaggaaaagccctctttcccataccaggaccgcccctctactcaggaaagcttccggcagaaactggccgcttttgccggaaccacgagcgggtgccatcagggacccggacctcttcgggagagcctcccttccgaggacgactctgaccagcgctgcagccccagcggcgattctgagggcggcgagtactgtagcatacttgactgttgccctggatcccctgtggcaaaggctgcaagccagacagccgggtctcgcggacgacacggcggacgtgattgttcccctacatgctgggaacagggcaagtgtagcggccccgctgagcaagaaaagagggggcccagctttcccaaggagtgctgcagccaaggccctactgcccatccttcttgcttaggccctaagaaattatcgctgacgagcgaagccgcgattagttccgacggactgtcttgtggatctggctctggctctggcgcctcttccccatttgtgccccatcttgagtccgattattgtagtctgatgaaggagcctgccccagaaaaacagcaagaccccgggtgccctggcgtgaccccctccagatgcctgggcctgactggtgagccccaacctccagcgcaccctagggaggcaacccaaccggagcctatctacgccgagtctaccaaacggaagaaagccgccccagtgcccagtaaatcccaagccaagatagagcatgccgccgcagcacaggggcaaggccaagtatgcaccggtaatgcttgggctcagaaggctgccagcggctgggggcgcgacagtccagatccgacccctcaagtgtcagccacaattacagtcatggccgcacaccccgaggaagatcacaggacgatatacctttctagccctgattccgcagtgggggtgcagtggcctagaggacctgtgtcacagaattccgaagttggcgaagaggaaacatccgccggacaaggactttctagtcgcgagagtcacgcgcattccgcttccgaatccaagccaaaggagcgtccagccataccccccaaactctccaagagtagcccagtaggctccccagtcagcccgagcgcaggcggaccaccggtctccccactggctgacttgtcagatggtagctcgggcggatcttcgatcgggcctcagccccccagccagggacccgccgaccccgccccctcttgcaggaccaatggcgtggcaatctctgatccgagcagatgccctcagcctgcagctagtagcgccagcgagcagcgacgaccccgtttccaggcaggcacctggagcaggcagtgccgaatagaggaggaggaagaggtggaacaggagctgctgtcacatagctggggacgagagaccaaaaacggccccaccgatcatagtaattcaaccacatggcataggctccacccgaccgacgggtctagcggacagaacagcaaagtgggcactggcatgagcaaaagcgcgtcttttgcctttgaattcccaaaagaccgatctggaattgaaacattctctcctccaccacctcctcccaagtcccggcatctgctgaaaatgaacaaatcgagctccgatttagaaaaggtcagccagggatccgcggagagtttatccccctccttcaggggcgtccatgtgtcatttactaccgggagcaccgatagcctagcaagcgattctagaacctgttccgacgggggacccagttccgaactcgctcattctccaactaattccggaaaaaagttgttcgcacccgtgccattccccagcggtagcaccgaagacgtgagcccatcaggccctcagcagccacccccactccctcagaaaaaaattgtgtctcgtgctgcatcgtcgcccgacggcttcttttggactcagggttctcctaagccaggcactgcctctccaaagctaaacctgtctcacagcgagactaatgttcacgacgagtcccacttcagctactcactgagccccggtaatcgtcaccatccggtgtttagctcaagcgaccctctggagaaagcttttaaagggtccggtcactggcttccagccgccggacttgcaggcaataggggtggctgcggctcccccgggctccagtgtaagggagcccctagcgcatcttctagccaactcagcgtttcctcacaggccagtacagggtctacacaattgcagctgcatggattactgtcaaatatttcctctaaggagggcacatacgccaaacttggaggcctgtacacccagagcttggccaggcttgtcgccaaatgcgaggacctgtttatgggcggtcagaaaaaggaactgcattttaacgaaaataactggtctctgtttaaacttacatgcaataaaccttgttgtgactctggagatgcaatttattactgcgccacatgttcagaggatccaggcagcacctacgccgtcaaaatatgcaaggctccagagcccaagacagtgagctattgttctccttctgtgcccgtccactttaacattcagcaagattgtgggcattttgtcgcgtctgtaccatctagtatgctctcttcccctgatgccccgaaagaccccgttccagccctgccaactcatccaccagctcaggagcaggattgtgttgtagttattacccgggaggtaccacaccagacggctagcgactttgtccgcgacagcgccgcttcccaccaggcagagcctgaggcatatgaaagacgggtctgctttcttctcctgcagctctgtaacggtttagagcatctaaaggaacacggcattatccacagggacctgtgtctggaaaatctccttttagtgcactgcaccctgcaggccggaccgggtcccgcacctgcccccgcgcccgcacccgccgcggcggcccctccatgtagctctgcagcgcctcccgccggggggaccctgagcccggctgccggtccagcctctccagaaggtccaagggaaaagcaactgccgaggctgattattagcaattttctgaaagccaagcagaagccgggcggtacaccaaacctgcagcagaaaaaaagccaagctaggttagcaccagaaatcgtctcggcctcacagtatcgtaagttcgatgaattccagacagggatccttatatacgagctcctgcatcaacccaacccttttgaggtccgagcccagcttagggagcgggattatagacaggaggatttgccccccctccccgccctgtccctgtactcacccggtctacagcagctcgctcaccttctactggaggcagatccgataaagaggatccgtatcggagaggccaaaagggtgcttcagtgtctcttgtggggaccacgacgtgaattagtacagcaacccggcacttccgaggaggccctgtgcggtaccctccacaactggatcgacatgaagcgagcgcttatgatgatgaagttcgctgagaaggcagtggacaggcgccgcggtgtcgaactagaagactggctctgttgtcaatacctcgcatcagcagaacctggcgcattgttgcagtcattgaaactgctgcaactgctctag

SEQ ID NO: 51791 - DNA, 1416 bp, Artificial Sequence
  Description of Artificial Sequence: Synthetic coding sequence
atgagcgacttcgacgagttcgagcggcagctgaacgagaacaagcaggagcgggacaaagaaaaccggcaccgaaagagatctcactctaggtcacgaagtcgcgaccggaaacgaagaagcaggtcaagagacaggcgcaatcgagatcagcgcagcgcatctagggatagacgccgcaggtcaaaacctttaacccgtggcgcgaaggaagagcacggcggactcatccgcagtcctaggcatgaaaagaaaaaaaaggttcgcaagtactgggacgtcccacctcccgggtttgagcacattacgcctatgcagtacaaagcgatgcaagccgcaggtcagattcctgctaccgccttgctgccgaccatgacacccgatggactggccgtcaccccaacaccggtccctgtggtgggcagccagatgactaggcaggccagaaggttgtacgtagggaatatcccgtttggcatcacggaagaggcaatgatggactttttcaacgctcagatgcggcttggcggcttgacgcaggctcccggtaacccagttctcgctgtccagatcaatcaggataagaattttgctttcctcgaatttaggtcagtggacgagacaacccaggccatggcatttgacggtattatattccaggggcagtcgttgaaaattcggcggccccatgactaccagcctctaccagggatgtccgaaaacccttctgtgtatgtgcctggtgttgtgagtaccgtggtcccagatagtgctcacaagctcttcattggcggactgccgaactaccttaatgatgatcaggtcaaagaactgctgacttctttcggtccactgaaggcgttcaacctggtgaaggactccgctacaggcctcagcaaaggctatgccttctgtgaatatgtggacataaatgtgactgaccaagccattgccggcctgaacggcatgcagctaggtgataaaaagctcctcgtgcagcgcgcctctgtcggcgcaaagaacgctaccttgtctacaatcaaccagacacccgtcacactgcaggtacctggtctgatgagcagtcaagtacagatgggcggacatccgaccgaggtcctgtgcttgatgaatatggtgttgccggaggagctgcttgatgatgaagagtacgaggaaatcgtggaggacgtgcgcgacgagtgtagcaaatacggccttgtaaagtctatcgagatcccccggcccgtggacggggtggaagtcccgggctgtggaaagattttcgttgagttcacttctgtgttcgattgtcagaaagccatgcagggcctcactgggcgcaaattcgctaatagggtggtagtcactaaatactgcgaccccgatagttatcatcgccgcgacttctggtag

SEQ ID NO: 51792 - DNA, 783 bp, Artificial Sequence
  Description of Artificial Sequence: Synthetic coding sequence
atgtggcacgccatcagccggaccagccggatgagccagagcggctgcccttccggcctgctcgcggacaagaacatctcctcctccgctactcgtgtcatagtaaaaaccgcgggcaatcaaaaggacttcatggtggccgacgatatttccgtcagacagtttaaggaaatgttgcttgcgcacttccaatgtcaaatggatcaacttgtacttgtgtttatgggatgtctcctgaaagatcatgacactctttctcaacgggggataatggacggccacacgatttacctcgtcattaagtccaaacagggctcccggtcactagcccacagctttcgtgacctgccaactaatgacccctgccaccgagaccggaacaccaaagcaaatgacaccctcaacaaagttaaccatacaagtaaagctaatacagctatgatatctactaagggacaaagccatatctgtgccacccggcagccagcctggatccccgctctcccatccattgaactgacccagcagctccaggaggagtataaggacgcaaccgtctctctaagctctagtagacaaacactgaagggagacctccagctttccgacgagcagtcatcctctcagatcactggcggtatgatgcagctcctcatgaacaatccatacctcgctgcacagattatgttattcacatccatgcctcagctctctgagcaatggaggcagcagctgccaaccttcctccagcaaacccagatcagcgacctcctcagcgcgtag

SEQ ID NO: 51793 - DNA, 1428 bp, Artificial Sequence
  Description of Artificial Sequence: Synthetic coding sequence
atgtggcacgccatcagccggaccagccggatgagccagagcggctgcccttcgggattgctcgccgataagaatatctcttcttctgccacccgtgtcatcgtcaaaaccgccggaaaccaaaaagattttatggtggcagacgatatttccgtacgacagtttaaagagatgctgcttgcgcactttcaatgccagatggaccagcttgtcttagtgtttatgggttgcctcttaaaagaccacgataccttgagccaaaggggcataatggacggtcacaccatatatctggtcatcaagtcaaaacagggatctaggtctctggcccactcttttcgcgacctcccaactaatgacccctgccatcgcgacagaaacactaagggaaactcatccagggttcaccaacccactggaatgaaccaggctccagtggagctcgcccatttcgttggctccgacgcccctaaagtacatacccagaatctggaggtgagtcatccagagtgtaaagcgcagatgctcgaaaaccctagcattcagcgtttgctgtccaatatggagtttatgtggcagttcataagcgagcacctggacactcagcagctaatgcagcaaaaccccgaagtgtcacgtttgctcttggacaattctgagatcttgctgcagactctggagttagcacggaatctggccatgattcaggagatcatgcaaattcagcaaccttcgcagaatctggaatacccactgaacccccagccttaccttggactcgaaacaatgcctggcggaaataatgccctcggccaaaattacgccgacatcaacgaccagatgctgaatagtatgcaagatccttttggcggaaaccctttcacggcactacttgctggtcaggtgctcgaacaggtgcagagtagcccaccacctcccccacccagccaagaacagcaggaccagctgacacagcaccccgctactagagtgatctataatagtagcggcgggttcagcagtaatacatctgcaaacgatacacttaataaagtcaaccacacctccaaagctaacacagctatgatcagcacgaaaggccagagccatatttgcgccaccaggcaacccgcttggatacctgctctgccgtccattgaacttacgcagcagctccaagaagaatacaaggatgccaccgtcagcttatctagcagtcgacagacactgaagggggatctacagctctccgacgaacagagcagctctcagatcaccggcgggatgatgcagttgctgatgaataacccatacctggccgcacagataatgttgtttacaagtatgccccagcttagtgaacagtggcgacagcaactgcccacttttttacaacagacacaaatttcagatctcctgagtgcatag

SEQ ID NO: 51794 - DNA, 1146 bp, Artificial Sequence
  Description of Artificial Sequence: Synthetic coding sequence
atgaacgccctggacggcgtgcccttcaagctgcccaagggcttcgttataggaacagagcccctccccgggcctgagctgagcgtaccagcctgtggagaggttctcctaggttctatgcacgactttagcctggaacggaccgctctattctgggtagaggccgccggccaggggcccagcccctatcagtgcggtgaccccggtacagcgtctgcacctcctgcctggctactgcttgtcagcccagagcatggcttggctcctgctccaactaccattcgggacccagaggcgggccaccaggagcgacccgaggaagaaggagaagacgaggccgaggcttccagcgggtctgaagaggagcccgctcctagctccctccagcctggatcacccgcgagccctggccctgggcggcggttgtgttctctggacgtcctgcgcggagtccgcctggagctcgccggagcccgccggcggctttccgaagggaaactggtctctcgccctcgagccctcttgcatgggttaagaggacacagagccctctccctttgccctagccctgcccagtcgccaaggagtgcaagtcctcctgggcccgctcctcagcacccagctgctccggccagccccccccggccctcgacagctggagctatcccaccgctgcgttcacataaacctacagtggcctccctctccccttacacatgtttaccacctctcggcggcgcaccccagcctctgaatccccacaagtctcatcccgatacggctgcggacctgctttcagcgctgagccaggaagagcaggatctaataggcccagtggttgccctcggttatccacttcgccgcgctattatcgcgctccaaaagacaggacggcagagcctgtcccaattcctgtcctatctgagtgcttgcgacaggctgctccggcaaggctacgaggaggggttggtcgatgaggccatggagatgttccaattttccgagtcgcaagccggagagtttctcaggctgtgggagcaatttagcgacatgggctttcagcaggacagaattaaagaggtgctactggtgcacggcaaccgacgcgaacaggctttggaggagctggtggcttgcgcccagtag

SEQ ID NO: 51795 - DNA, 1146 bp, Artificial Sequence
  Description of Artificial Sequence: Synthetic coding sequence
atgaacgccctggacggcgtgcccttcaagctgcccaagggcttcgttatcggaaccgagcccttgccgggacccgagctttctgtaccagcctgcggcgaagtgttgctggggagtatgcatgacttttcattggagcggaccgctctcttttgggtggaagctgcaggccagggacccagcccataccagtgtggcgatccaggcaccgccagtgcacctccagcctggctgcttctcgtgtcgcctgagcatggtctggctcctgcgccaaccaccattcgcgaccccgaagccgggcatcaagaaaggcctgaggaggagggtgaagatgaggctgaagcttcttctgggtcagaagaggaacccgcgcccagtagccttcagccagggagcccggcatccccgggaccaggtcgacggctgtgtagtctggacgtgttacgcggcgtccggctggagcttgctggggcgagacggcgcctgtccgaaggcaagttggtgtcccgccctcgcgctctgctgcatggcttaagaggacaccgggccctgtccctgtgtccaagccccgcccaatccccccgatcagcgtctccccccggccccgcacctcagcaccccgctgcaccagcttccccccctcgaccttctacggccggagcaatacctcccctgcggtcccataaacccaccgtggcatccttatccccgtacacttgtttgccacctctcggaggggccccccagcctctcaatcctcacaaaagccatccggacacagctgctgatcttctttctgctctgagccaggaggagcaagacctcatcggaccagtggtcgcattaggatatcccttgcgaagagccatcatcgcgcttcagaaaactgggagacagagcctgtcccagtttctttcatatctctcagcgtgtgaccgattgctccggcagggctacgaggaaggtctggtggatgaggcgatggaaatgtttcaattttcagaatcccaagcaggagagttcctgcggctttgggagcagttcagcgatatggggttccagcaggacagaattaaggaggtgttattagtacacggcaataggcgcgaacaagctctggaggagctcgttgcatgcgcacaatag

SEQ ID NO: 51796 - DNA, 1746 bp, Artificial Sequence
  Description of Artificial Sequence: Synthetic coding sequence
atgatgaccagcgtgagcagcgaccactgccggggcgcccgggagaaaccacagattagtgctgcgcagtccactcagccccaaaaacaggtggttcaggccacagcagaacagatgcgcttggctcaggtcattttcgacaagaacgattccgatttcgaagccaaggtgaagcaactgatggaagtcaccggaaagaatcaagacgagtgtattgtagctctccatgattgtaatggggatgtgaataaggcaatcaatatcttgctggagggcaacagcgatacaacatcatgggagacagtgggttgcaaaaaaaagaacttcgccaaagagaattccgagaataaggagaacagagagaagaagaaacacaccggggacctgacatcgagtccgctgtcccagctgtcaagctcgttaagtagccaccaatctagtttgtccgcacacgcagctttaagtagcagcacctctcatacacatgcctccgtggagagtgctagcagccaccaatcttctgcaacattttctacagcggcaactagcgtgtcatcctccgcatctagcggcgcctctctcagctcaagcatgaacactgctaacagtttatgcctcggaggtactcccgcaagcgcctcctcatcttcctcaagggcggcccctctggtcactagtgggaaagcccctccaaacctgcctcagggggtgcctcctctgttgcacaaccagtatctggtaggacctgggggcttgctgccagcttatcctatctatgggtacgacgaacttcagatgctccagtctagattgcctgtggattactatgggattccgtttgcagcaccaaccgcattggcctcacgtgacggatccctcgccaataacccgtatcccggagatgtaaccaagttcggtcggggcgacagcgcatcaccagcccccgccacaacaagcagcgccacggccgaacctattactgaccccccccactctcctgcagctttacgggaaagctgtaccgctacttggagctacaccggcttgccgtattacactggcatgcctagtgctttccagtacgggcctacgatgtttgtgcctcccgcatcagcaaagcaacacggggtgaatttgagcactcccactcccccttttcagcaagcaagtggatatggacagcatgggtactcaacaggctacgatgatctaacccaagggactgccgctggagattactccaaaggggggtatgctggatcttctcaagcacctaacaaatccgctgggagcggccccggcaaaggggtgtctgtttcttcaagcacgacaggcctccccgacatgacaggcagtgtctacaataaaacccagacctttgacaaacaaggcttccacgccgggactccccctcctttttccttgcccagcgtgctaggatccactggccccctcgcctccggtgccgccccaggttatgctccccccccgttcctccacatcctcccggcacatcagcagccacactcccagttattacatcaccacctgcctcaggatgcccaatctggctccgggcagcgtagccctgccccctgttcgccttccttgaagccacctaatttaccaacgttgagcatattggacaaactgaaccctgaggaaaggggtgggctgggccagggtttatcatgggctggagagaataccagggcccgtatctgggagccctctgccttatcatag

SEQ ID NO: 51797 - DNA, 3360 bp, Artificial Sequence
  Description of Artificial Sequence: Synthetic coding sequence
atgatgaccagcgtgagcagcgaccactgccggggcgcccgggagaagccacagatttctgctgcgcagagtacacagcctcagaagcaggtggtacaagcaacagccgagcaaatgcggctcgcgcaagtgattttcgacaaaaacgattctgatttcgaggccaaggtgaagcaactaatggaggtgacaggaaagaaccaggatgagtgcatcgtagcattgcacgactgtaacggggatgttaacaaggctatcaacattctgctcgaggggaacagcgatacaaccagttgggagacggtcgggtgcaaaaagaaaaatttcgccaaggagaactcagagaacaaggagaaccgcgaaaagaaatctgagaaggaatccagtaggggtcgtggcaataacaatagaaaagggagaggcggtaacaggggacgagagttccggggagaagagaatggaattgactgtaaccaggttgataagccaagcgaccgcgggaagcgagcgcgcggtagaggattcggcagggggagagggcggggcgctggtaggttctctactcagggtatgggaacgttcaaccccgccgactattccgattccaccagtacagatgtgtgtggtacaaaacttgttgtttgggaagcggcacagaacggggccgacgaagggaccgagctggcaagcaatacacataatatagcacaggatctctccaacaagagttcctatggactcaagggtgcatggaagaactccgtggaagaatggaccactgaggactggaccgaggatctgagcgagaccaaggtgttcacagcctcctcggccccagccgaaaatcacatcctccctggccagagcatcgatctggtcgctttgctccagaagccggtaccccactcacaagccagtgaggctaatagctttgaaacgtcgcaacagcaaggtttcggacaggctctcgtcttcaccaattcacaacacaacaatcagatggccccagggactgggtcaagtactgcggtcaatagctgtagcccacagtcactgagttctgtcctcgggagcggattcggggaactcgccccaccgaagatggccaatattactagtagccagattctggaccaactgaaggcccccagcttaggccagttcaccaccacaccatcgacccagcagaactccacctcccatccgacgacgactacgagttgggatctgaagcctcccacatcgcagagcagcgtcttgtcccacctcgattttaaaagtcaacccgagccttccccagtcctatctcagttgtcacagcgacagcagcaccaaagtcaagccgtgaccgttcctcctcctggcctggagagtttcccctctcaagctaaactacgcgagtccacccccggcgatagcccatctactgtgaacaaactgctgcagctgccctccaccaccattgaaaatatttctgtgagtgtccatcagccacagcccaaacacatcaaactcgcaaagaggcggatacctccagcatcaaagataccagcctccgccgtagagatgcccggtagcgctgacgtgactgggctaaacgtgcagtttggggccttggagttcgggtctgagcccagcctgtccgagttcggatccgctcccagttccgagaatagcaatcagatcccaatatcactttatagcaagtctctctcagaacctctaaacacgagcctttccatgacctcagctgtgcaaaatagtacatacactacctctgtgatcacctcttgctcattgacatccagttccttaaattcagcttcccctgtggccatgtcatcttcctatgaccagagtagcgtacacaaccgcatcccttatcagtctcctgtgagttcctctgagagcgctcccggcacaattatgaatggccacggtgggggccgctcacagcagacactggatactcctaaaaccactggcccccctagcgcactgccgagtgtgtcttctctgccctccacaacctcctgtacggccttgctgccgtctacctcacagcacacgggtgacctgacgagcagtcccttatcccagctgtcaagtagccttagttcacatcaaagctccttgagtgcccatgcagcgttgtcatctagcacttcacacactcatgcttcagtggagtcggccagcagtcaccagagctctgctaccttcagtacggctgccacctccgtttcatcttccgcctcttcaggggcatccttgagttccagcatgaacaccgctaattccttatgcctggggggcactccagcctcggctagttcttcgtcttcacgggccgcccctttggtaaccagtggaaaagcacccccaaacctccctcagggcgtgccccctctgctgcacaatcaatatcttgtcgggcccggaggccttctgcccgcctaccccatctatggctatgacgaacttcagatgctgcagtcccggctccccgtggattactatggcatccctttcgccgccccaactgcgttggcttctcgcgatggcagtctggcaaataacccctacccaggcgacgttaccaagttcgggcgcggtgacagcgccagccccgcccccgccactacaccagcccaaccccaacagtctcagtcccagacccaccatacagcccagcagcccttcgtgaatcccgcccttcctccgggctatagttacacaggcttaccctactataccggcatgccatccgccttccagtacggacccactatgtttgttcctcctgcgagcgccaaacagcacggtgtgaatctgtcaacccccacccccccgttccagcaggccagcgggtacggccaacacgggtacagcaccggatacgacgatttaacccagggcaccgccgccggcgactattcaaagggagggtacgctggctcttcccaagccccaaataagtctgcagggtccggccctggcaaaggagtgagcgtgtctagctctaccactggtctcccagatatgaccggttccgtgtacaataagactcagaccttcgataaacaggggttccatgccggcacccctccccctttctctctgcctagcgtgctgggaagcacaggacccctcgcaagcggggccgcccctgggtacgcaccacctccgttcttgcacatcctacctgcccatcagcagccgcatagtcagctgctgcaccaccacttaccccaggatgcccaatctggtagtggccagcggagccagccaagtagcctgcagcccaagagccaggcttctaaacctgcctatggcaacagcccttactggaccaactag

SEQ ID NO: 51798 - DNA, 978 bp, Artificial Sequence
  Description of Artificial Sequence: Synthetic coding sequence
atggccaacatcaccagcagccagatcctggaccagctgaaggccccatcgctgggccagttcacaacaactccatccacccagcagaactctacctcacaccctacaaccacgactagctgggacctcaagcccccaacctctcagtctagcgtgctgagccatctcgactttaaatcacagccagagcctagtccagtcctaagccagctgagccagcgtcagcagcatcaaagccaggctgtgacggtacctccaccagggctagaaagctttccttctcaggcaaagctgagggagtcaacccccggggacagccccagcactgtgaacaagctgctccaactgccctcaactacgattgaaaacatctccgtgagtgtgcaccaacctcagccaaaacacatcaagctggctaagcgcaggattccccctgcttccaagattccagcctctgccgtggaaatgccaggcagcgccgacgtaactggcctgaacgtgcaattcggtgccctggagtttggaagtgagccatctttaagcgaatttgggtccgccccatctagtgagaactcaaaccaaataccaatttcactgtattcaaaatcactgagcgaacctctgaacacatccttgtcaatgactagtgccgtgcagaactccacttacaccactagcgtgatcacaagctgttcccttacttcctccagtcttaattccgcgagcccagttgccatgtcatctagttacgatcaatcctctgtgcacaatcgcataccgtaccagagcccagtttcctcgtccgaatctgcacccgggactattatgaacggccatggcgggggcaggtcccagcagaccttggacagcaaatattcttcaaagctactgttgtcttggctggtgcccacaaaacagcgcaaaagaatcgcacatgtgatgtggaagacaccggtaggccagtggttgatcaggtag

SEQ ID NO: 51799 - DNA, 1077 bp, Artificial Sequence
  Description of Artificial Sequence: Synthetic coding sequence
atgaacaccgccaacagcctgtgcctgggcggcacccccgccagcgccagtagctcatcaagccgagctgcgccgctcgtcacatcgggtaaagcacccccaaatctgcctcagggcgttcctcccttgctgcacaatcagtatctggtcgggcccggtggtctgctgcctgcttatcctatttacggctacgatgaactgcaaatgctgcaatctaggctgccagtggattattacggtataccttttgccgcccccactgctctagctagtagagatgggagcctggctaataatccctaccctggagatgttaccaagtttggcaggggtgattcagcatctccagctcccgccactacccccgcgcagccccaacagtcacaatcacagacgcaccacacagctcaacagccattcgtgaaccctgccctccctccaggctatagctataccgggcttccttattacacaggaatgccttcagcctttcaatatgggcccaccatgttcgttccccccgcctccgcaaagcagcacggcgtaaatttatccactcccacaccaccatttcaacaggcctcggggtacggccagcatggctactcaaccggttatgatgatctgacgcaagggaccgctgcaggtgactacagtaagggcggatatgcagggtccagccaggcacctaacaaatctgccggctcagggcccggcaagggagtctcggtgtcctctagcaccaccgggttaccagacatgaccggctctgtgtataacaaaacccagacttttgataaacagggcttccatgccggaaccccccctccgtttagcctgccctccgtcctcggaagtaccggcccattggccagcggtgcagctcccggctacgcacctccgccttttctgcacattttacctgcccaccagcaaccacacagtcagttgttgcatcatcatctcccacaggatgcccagagtggcagtggccagcgctcacaaccaagcagcctgcagccaaaatcccaggctagcaagcctgcctacggcaattctccctattggaccaactag

SEQ ID NO: 51800 - DNA, 3360 bp, Artificial Sequence
  Description of Artificial Sequence: Synthetic coding sequence
atgatgaccagcgtgagcagcgaccactgccggggcgcccgggagaagccccagattagtgcagcacagtctacacagccgcagaagcaagtcgtccaggctacagctgaacagatgcgtttggcccaggtgatcttcgataagaatgacagtgatttcgaagctaaagttaagcagttgatggaagtaacaggaaagaaccaggatgagtgtatcgtggcattgcacgattgcaacggagacgtgaataaagcgatcaacatacttctcgaaggaaattctgatactacatcatgggaaactgttggctgtaaaaaaaaaaactttgcaaaagagaacagcgagaataaagagaaccgagagaagaagtccgagaaggaatcatcccgcggacgcggcaataataaccggaaagggaggggcgggaaccggggccgggagttccgcggtgaggagaacgggattgactgcaaccaagtcgataagccgagtgacagagggaagcgggcccgcggaagaggctttggtcgcggccgcggtcggggtgctggtaggttctctactcaggggatggggaccttcaacccagctgactattccgatagtacatcaacggacgtatgcggtacaaaactggtggtgtgggaggccgcccagaacggcgctgatgaagggacagagcttgccagtaacacccacaacatagcgcaagatctgtcgaacaagtccagttatgggcttaaaggcgcttggaaaaactctgtcgaggagtggaccacggaagactggacagaggatttgagtgagacaaaggtgtttactgccagtagcgcacccgcagagaaccacatcttgcctggccagtccatagacctggtcgctctgctgcagaaacccgtgcctcactctcaagcatctgaggctaatagtttcgagacgtctcagcagcagggttttggccaggcattagtttttacgaattcacagcacaataaccagatggccccggggaccggcagtagtactgcagttaactcttgctcgcctcagagtctgagttccgtcctgggtagtggcttcggtgagctggcacctcccaaaatggccaacatcacaagctcccagattctcgatcaacttaaagcaccgagcttaggtcagtttaccactaccccgtcgactcagcaaaattctacatcgcatcccacgactacaaccagttgggatctgaaaccaccaacttcccagtctagcgtgctgtctcacttggacttcaaatcccagccagaaccctcccctgttcttagccagttatctcaacggcagcagcaccagagccaggccgtgaccgtacccccccccggcttggaaagtttcccctctcaagctaaacttcgggagtctacaccaggcgatagtccgtcaactgttaacaagctcctgcagctaccttcaaccaccattgagaacatatctgtgagtgtacatcagccccaacctaaacatatcaagctggcgaaaaggcgcattccgcctgccagcaagataccagcatcggccgtggaaatgcccgggtcagcggacgtaactggcctgaatgtgcagttcggcgcactcgagtttggcagcgaaccgagcctgtccgagtttggttctgccccatcctctgagaattctaatcagattcccatttcgttgtatagtaagtccctatccgagccactgaacacgagtctcagcatgacatccgctgtccagaattcgacatacaccacttcagtgattacaagctgtagcctgactagcagctcattaaactccgcgagccctgtggcgatgtcatcgtcttacgatcagagtagcgttcataaccggatcccatatcagtcacctgtctcctccagcgaatcggcacctggcacaatcatgaatggacacggtggggggcgatcacagcagacactggacacccctaaaaccactgggcccccttccgcccttccttccgtgagctcactgcctagcaccacgtcctgcactgctctacttcctagcacgagccagcataccggagacctgacttcatcccctctaagtcagctctcttcctctcttagctctcaccagagttcactgtcggcccatgctgcacttagttcttcaaccagccatacccatgcctccgtggaatccgctagttcacaccagtcatcagctacctttagtacagctgcaactagtgtttcaagcagtgcctcatcaggtgcttctctgtcatcctctatgaatacagcaaatagcttatgcttgggcggcactcctgcctccgcctcttcttcctcctcacgcgccgcccctctagttacgagtggcaaagcccctccaaacttgccacagggcgtgcctcccttactacataatcagtacctagtgggccccggaggccttcttccagcatatcccatatatggatatgacgagctgcagatgcttcagagcagattgccagtggattactatggcatcccctttgcagctcccacagcactggcctcccgcgacggatccctagcaaacaatccctaccctggcgatgtcacaaagtttggacggggtgatagtgccagcccagctcctgccaccaccccggcccagccccaacagagtcaaagccagactcaccacactgcacagcagccatttgtgaacccagccctgccacctggatattcatacaccgggctcccctattacacaggcatgcccagtgcttttcagtatgggcccacaatgtttgtgccgccggcctccgctaagcagcatggtgtcaaccttagcacccctacacctccctttcagcaggcaagcggatatggacagcatgggtattctacaggctacgatgacctgacacagggcaccgctgcaggcgactactctaaagggggctatgctgggtcaagtcaggccccaaacaagtctgcaggttccggccctgggaagggcgtgagtgtcagcagtagtaccacaggcttgcccgatatgaccggttcagtgtataacaagacccagacatttgataagcagggatttcatgcggggactcctcctccgttcagtctcccatccgtcctgggctctactgggcccttggccagtggcgcggctcccggctatgcacctccgccctttctgcacatcctgcccgcgcaccagcagcctcactcccagctcctgcatcaccaccttcctcaggacgcccaatccggctcgggtcagaggagtcagccgtctagcttacagccgaagagccaggcctccaaacccgcgtacggcaattctccctactggaccaactag

SEQ ID NO: 51801 - DNA, 2559 bp, Artificial Sequence
  Description of Artificial Sequence: Synthetic coding sequence
atggacagcaagggcctgggccggatcctgtggaagagcggccagcagaagactgggctgaaaatcattgacctcgtcgcgttgctgcagaagccagttccccactctcaagcgtctgaggcgaacagcttcgagacatcccagcagcagggctttggtcaagccctggtcttcacaaacagccaacacaataatcaaatggcccccggcacagggtcaagtaccgccgtcaactcttgctctcctcagtcgctcagcagcgtactcggaagcggtttcggagagttagctcctccgaagatggctaatataacctcaagtcagatcctcgaccagctgaaggcgccctccctgggacagttcaccactactccaagtacgcagcagaactctacctcccatccgaccaccactacctcctgggacctgaaacctccgacatctcagagcagcgtcctatctcatcttgactttaaatctcagcctgagccatcaccggtcttatcccagcttagccaacggcaacagcatcagtcccaggcagtcacggttccaccgccgggactggaatccttccctagtcaggccaagctccgcgagagcactccaggagacagcccctctaccgtgaacaaacttctgcagctgccgtccaccaccattgagaacatctctgtgagcgtgcatcagcctcagcccaaacacataaagctcgcgaaaaggaggataccccccgcaagcaagatacccgccagtgctgtcgagatgcccggatcggccgacgtgacaggtcttaatgtccagttcggcgccctggaattcggcagcgagccctccctgtccgaatttggatccgccccgtcttctgagaactccaatcaaataccaatatcattatacagtaaaagtctcagtgagcctcttaatacgtctttgtcgatgacgtctgccgtgcagaatagcacttacacaacctcggtgataacatcctgtagtctgacgtccagctcactgaacagcgcctccccagtggccatgtcctcctcttatgatcaaagctccgttcataatcgcataccatatcagtcacccgtcagtagctcagaatccgcccccggcacaataatgaatgggcacggagggggacgtagtcagcaaactcttgacacacctaaaaccacgggtcctccatctgcccttccatctgttagctcccttccctcaacaacttcttgcacagcactccttccatccacaagccagcacacaggcgacctcacgtcctccccccttagtcagctgtcgtcaagcctgagcagccatcagtcctcgttgtcagcccacgccgctctgagttcctcgactagtcacactcacgcctctgtcgaaagcgcaagctctcaccaatcttcagccacattctctaccgccgcaacgtctgtgtcgagcagcgcatctagtggcgcatctctgagtagctctatgaatactgccaatagcctgtgtcttgggggcacaccggctagcgcaagttctagttcaagccgcgctgcccccctcgtgacctccggaaaagcccccccaaatctgcctcagggtgtgcctcccctccttcataatcaatacctggtgggccctggaggtctcctgcccgcgtatcccatttatggttatgatgagttacagatgctgcaaagcagactgcccgtcgactactatgggatcccgttcgctgcaccaaccgccttggcgtcccgggatggctcgctagccaacaacccgtaccctggggacgtgaccaagttcggccggggagacagcgcgtcacctgcaccagccacgacacctgcgcaaccccaacagagccagagccaaactcatcataccgcccagcagcctttcgtgaacccagctttgccccccgggtactcctatactggcctgccatactatactggcatgccaagtgctttccaatacggaccaaccatgtttgtgccgccagcctccgccaagcaacacggagtcaatctttccaccccgaccccgccttttcagcaggccagcgggtatgggcagcacggctatagcaccggctacgatgatctgacacagggcactgccgctggcgattactctaaaggaggctacgcagggtcctcccaggcccccaataagtcagcaggtagcggacccggcaaaggcgtaagcgtttctagcagcacaacaggcctgcctgacatgacaggttctgtgtataacaagacccaaacattcgataaacaggggtttcatgccgggaccccccccccattcagcctgcctagtgtgcttgggagtacgggacccctggcttccggggccgccccgggctatgccccacctccattccttcacatcctgccagcccaccagcagccacattctcagctattgcaccaccatcttccacaagacgcacaaagtggatctggccaaagatctcaacccagtagcctgcagcctaagtcccaggcatcaaaaccagcttatggaaacagcccttattggaccaactag

SEQ ID NO: 51802 - DNA, 1023 bp, Artificial Sequence
  Description of Artificial Sequence: Synthetic coding sequence
atggaggtgaccggcaagaaccaggacgagtgcatcgtggccctgcacgattgtaatggggacgttaacaaagctataaacatacttctggaggggaattctgacaccacttcgtgggaaacagtcgggtgcaaaaagaaaaactttgccaaggaaaatagtgagaataaagaaaatcgggagaagaaatccgagaaggagtcttcacggggcaggggaaacaataacaggaaaggacgtgggggaaacaggggtcgagagtttagaggagaggagaatggtatcgactgcaaccaggtggataagcccagtgatagaggcaaaagggcccggggccgcgggttcgggagagggagagggcggggagccgggagattctccacccagggaatgggcacctttaatccagccgactatagcgacagtacaagcacagacgtgtgcggcaccaagctggtcgtgtgggaggcggctcagaacggcgctgacgagggaacaggtgcctggaaaaactctgttgaggaatggacgaccgaagattggaccgaggatctgagcgaaaccaaagtatttacggcctccagcgctcctgccgagaatcacatcctgccagggcagagtattgatttggttgccttactgcagaagcccgtccctcattcacaggcctccgaagctaattcattcgagacatcacagcaacagggattcggccaggctctcgttttcactaactctcagcataacaaccaaatggcacctggcaccgggtccagcaccgcagtgaatagttgttctccccagtcactatcatcggtcctggggagcggctttggtgagcttgcccctcccaagatggccaacattacctcctctcaaatactcgaccaattgaaggcacctagtctagggcaatttactaccacacccagcacccagcaaaattccacaagtcaccccaccactactacctcctgggacctgaaaccccccacatcccagtctagcgtgctgagccactag

SEQ ID NO: 51803 - DNA, 1239 bp, Artificial Sequence
  Description of Artificial Sequence: Synthetic coding sequence
atgatgaccagcgtgagcagcgaccactgccggggcgcccgggagaaaccacagatatccgccgctcagagcactcagccccaaaagcaagttgtgcaagcgaccgcagagcaaatgaggctggcacaggtgatattcgacaagaacgattcggattttgaagccaaggtgaagcagctgatggaggttactgggaaaaaccaggacgaatgtatcgtggctttgcacgattgcaacggcgatgtgaataaggcgatcaacatacttctcgaggggaactccgatacgacgagctgggagactgtgggctgcaaaaagaagaactttgccaaggagaattctgagaacaaggagaatcgagagaagaaaagtgagaaggaaagctctcgaggacggggaaataacaaccgaaaagggaggggtgggaatagagggcgggaattccggggtgaggaaaacgggattgattgtaaccaggtggacaaaccctcggaccgcggcaaacgagccaggggccgggagctggcatcgaatacacacaatatagctcaggacctgagcaataagtcctcttatggtcttaagggagcctggaagaacagtgtggaggaatggacgaccgaggactggacagaagatttgtcggaaactaaagtgttcactgcttcaagtgcccccgcagagaatcacattctgcccggacagtccattgaccttgtggctttactccagaagcccgtgcctcattcacaggcatccgaagctaattcctttgagacaagccagcaacagggttttgggcaggctctggtgttcacaaattctcagcacaacaatcagatggcccccgggacgggcagttccaccgcagttaacagctgttccccacaaagtctctcctcagtactgggatcaggttttggtgagctggcccctcctaagatggccaatatcactagctcgcagatcctggatcaactaaaggccccatcactggggcaattcacaactactccctccacacagcagaattcaacatcacaccccactaccacaaccagttgggaccttaagcctccaacatcccagagtagtgttctatcccatctcgattttaaatcacagcccgaaccgtctccggttctatctcagttgtcccagcgccagcagcatcagtctcaggccgtcactgttcccccgcccggactggaatccttcccttcccaggcaaaactttag

SEQ ID NO: 51804 - DNA, 2061 bp, Artificial Sequence
  Description of Artificial Sequence: Synthetic coding sequence
atgatgaccagcgtgagcagcgaccactgccggggcgcccgggagaagccccagatcagtgcagcacagtcaacccagccacagaagcaggtggtgcaggcaactgctgagcagatgagactggctcaagtgatattcgacaaaaacgactctgacttcgaagccaaagtgaaacagcttatggaggtgacagggaagaatcaggacgagtgtatcgtggcacttcatgactgtaatggggatgtgaacaaggcaattaacatactcttagaagggaattcagacacaacgagctgggaaacggtcgggtgtaagaaaaagaattttgccaaggagaattccgagaacaaggagaatagggagaaaaaatccgaaaaggaaagctcccgggggagaggtaacaacaataggaaagggaggggcgggaatagggggagagagtttcgtggagaggaaaacggcatagattgtaaccaggttgacaagccgagtgaccgtggcaagagggcccgtgggcgcgaattggcgagtaacacccataacatcgcacaggatctcagtaacaaatcctcatatggccttaagggcgcatggaagaacagtgtcgaggaatggacaacagaggactggacagaagatctgagcgagaccaaggtttttactgcgtctagtgcacccgcggagaatcacattctgcctggacagtccattgatttggtggcgctgctgcagaagccagtcccacattctcaggcgagtgaagctaatagttttgagacttctcaacaacaagggtttggtcaggcattggtgtttacaaacagccagcacaataatcaaatggctcctggaacagggagttccaccgcggtcaatagctgtagtcctcagtctctgagtagcgtgttggggtccggctttggggagctcgcgccgccaaagatggcgaatatcacctcaagtcagattttagatcagctgaaagcaccatccttagggcagtttaccactacaccttctacacagcagaacagcacatcacaccccacaactaccacttcatgggacctgaaaccccccacctctcaatctagcgtgttatcccacctcgacttcaagagtcaacctgagccctctcccgtgctcagccaactatcacagcgtcagcagcaccagtctcaggcagtgaccgttccgccccctggtctagagagttttccaagtcaggccaaactgcgtgaatcaacccccggagactcacccagcactgttaacaaactgttgcagttaccttcaaccaccatagagaacatttctgtgagtgtgcatcagcctcagcccaagcatattaagttagctaagcggcggataccaccagcttctaagattcctgcaagtgccgtcgagatgcctgggtcagccgacgtgaccggcctcaatgtacaattcggagccctagagttcggatcagagccctccctcagcgaatttggcagcgctccatcctccgaaaactccaaccaaattcctatatccctgtactctaaatcgctctcggagcccctcaacacttccctctcaatgacatccgcagtccagaattccacgtataccacctccgtcattactagctgctcgctgacaagctccagcttgaacagcgcctcgcctgtggccatgtcatccagttatgatcagtccagtgtgcacaatagaatcccctaccaatccccagtttcctcttctgagagcgctcccggtactattatgaatggtcatggaggtggtcgcagccaacagaccttagatactccgaagacaacaggcccaccatccgcattgccctccgtcagcagtctcccaagcacaacctcctgcacagccctcctcccaagcaccagccagcacacgggcgacctgacctccagccctctgtcacagctctcatccatgcctgtgtggcgtgctcccctgccaacaagcccgcagcctccaagcccccggcaacggccgccctcacaggtcccccacccgcaggcccctgcctgccccgtcgcttag

SEQ ID NO: 51805 - DNA, 831 bp, Artificial Sequence
  Description of Artificial Sequence: Synthetic coding sequence
gagaaggagagcagccggggccggggcaacaacaaccggaagggccgaggcggaaacagaggcagagagttcagaggtgaagagaatggaatcgattgcaaccaggtagacaaaccgagcgaccgcggtaagcgtgcccgtggccgtgggttcgggcgtggaaggggacgaggcgctggcagattcagtacccaggggatgggtacctttaatcctgctgattattccgacagcacatcgaccgatgtctgtggtaccaaactcgtggtctgggaggcagctcagaacggggcggatgaaggtaccggcgcttggaaaaactcagtcgaagagtggaccaccgaagactggaccgaggacctcagcgaaaccaaagtcttcacggcctcctcagctccagccgagaaccacatcctgccgggccagtctatcgacctcgtggctttgctccaaaagcccgttccacacagccaggcctctgaagccaatagttttgagactagccagcagcaaggctttggacaggctctagtatttacaaacagccagcataataatcagatggcccccggaaccggttcttcaactgccgtgaacagctgcagtccacagtctcttagctccgtgcttggctctggattcggagaacttgcaccccctaagatggcaaatattacttccagccagatactggatcagcttaaagcaccctcgctggggcagtttaccacaacgccgagcacacagcaaaactcaacatcgcacccgacaaccaccacatcttgggatcttaaacctcctaccagccaatcaagcgtactttcccattag

SEQ ID NO: 51806 - DNA, 3087 bp, Artificial Sequence
  Description of Artificial Sequence: Synthetic coding sequence
atgcggctggcccaggtgatcttcgacaagaacgacagcgacttcgaagcaaaagtcaagcaactgatggaggtcacgggcaagaatcaagacgagtgcatcgtagcccttcacgattgcaacggagatgtgaataaggccatcaatatactgctagagggaaactccgatactacatcttgggaaacagtgggatgtaagaaaaagaacttcgctaaggaaaattctgagaacaaggagaaccgagagaaaaagagcgaaaaggaaagctccagaggccgagggaacaacaacagaaagggtagagggggtaaccgggggagagaattcaggggcgaagagaatggtatagattgcaaccaagtggataagccctcagacagagggaagagagcaagaggcagagagctcgcctcaaacactcacaacatcgcccaggatctcagtaataagtcttcatacggtctgaagggggcctggaaaaatagcgtggaagagtggactacggaggattggactgaagatctgtccgaaaccaaggtcttcacggcctcttctgcccctgccgagaatcacattttgccagggcaaagtatagatcttgtcgcacttctccagaagcctgtgccccactcccaggcttccgaggcaaattcatttgagacaagccaacaacagggcttcggacaggcactcgtgttcacaaacagccagcacaacaatcagatggcccccgggacaggaagctccaccgcagtgaatagctgctcaccccagtccctgtcttctgtccttggctctgggtttggggaacttgctcccccaaagatggccaatattacatcctcccagatcctcgatcagctgaaggcgccatctctaggacaattcacaacgactccatcaactcagcagaacagtacttcccaccccaccacgacgaccagctgggatcttaagccgcctacaagccagtcatccgtgctgtctcacctggactttaagtcccaaccagagcctagtcccgtacttagccaactgagccagaggcaacagcatcagtcccaagccgttactgtgcctccgcccggtctggagtcttttcccagccaggcaaaactgagggaatctacacccggagacagcccctctacggtcaacaagctgctccagcttccctccacaacgattgaaaacattagtgtgagtgtgcaccaaccacagcctaagcacattaagctcgctaagcggagaatacccccggcttctaagattcccgcctctgcagtggagatgccgggatcggctgatgtcacgggacttaacgtccagttcggcgcactcgagttcgggtcggagccatctctgagtgaattcggctctgccccttcgagcgagaattcaaatcaaatacctatatcattatactccaaaagcttgtcagagcccttaaacacatcgctatctatgacttctgccgttcagaactccacttatacgacctcagtgataacatcttgttccttgacgtcatccagcctaaactcggcctcaccggtggccatgtcatcatcctatgatcagtcttccgtccacaatagaattccctatcagtccccagtatcgtcctcggagagcgcccccggtacaatcatgaatggccatggcggcggcagaagccagcagacactcgatacacccaaaactaccggtcccccttccgccctgccctccgtgtcctccctaccaagcacaactagctgtactgctctccttccttccacttctcagcacaccggggatctgacatcatcaccattatctcagctgtccagctctctctcctcgcaccaatccagcctctccgcacacgctgccctgtcaagttctacctcccatactcacgccagcgtggagtctgcctcctctcaccaatctagcgcaacattctccacggctgccacctcggtgtctagctctgccagctctggggcttcacttagctcgtctatgaacactgccaacagcctctgtctgggaggcaccccagcttctgcaagcagtagttcaagccgggctgctccgctcgtcacttctggaaaggcgccaccaaacctcccccaaggcgtgccgcccttactccataatcagtatctggtcggccctggaggcttgcttcctgcctatccgatttacggttatgacgagctccagatgctccagtcacgcctcccagtagattattacgggatcccatttgcggctcctacagcccttgctagcagagacggctcccttgctaacaatccctacccaggggatgtgaccaagttcggtcggggggacagcgccagtccagcacccgcgacaacaccagcccagcctcagcagtcgcagtcccagacacatcataccgcccagcagccatttgtaaaccccgcattgcctcccggctactcctacaccggcctgccctattatacgggcatgccatctgcgttccagtatgggcccaccatgttcgtccctccagcaagcgcaaaacaacacggcgtcaatctctctacgcctactccgccattccagcaggccagcggatacggccaacacggatactccactggctatgatgatcttactcaagggaccgccgccggtgattatagcaaagggggttacgccgggtctagccaggccccaaataagtccgcaggcagcgggccaggaaaaggtgtaagtgtatcctcaagtacaaccggcttacccgacatgactggatcggtttacaataagacacaaacattcgacaagcagggctttcatgcaggcacaccaccccccttctctctccctagtgtgttaggatcaaccgggccactggccagcggtgccgccccgggctatgccccacctcctttcctgcatatcctgcctgcgcatcagcagccacattcccagctactacaccaccacttaccccaggatgctcaatctggtagcggacagcgttcgcagccttcttcactacagccaaagtcccaggcctccaaacccgcatatggtaactcaccatactggaccaactag

SEQ ID NO: 51807 - DNA, 3360 bp, Artificial Sequence
  Description of Artificial Sequence: Synthetic coding sequence
atgatgaccagcgtgagcagcgaccactgccggggcgcccgggagaagccacaaatctccgcagcccagagcacacagccccagaagcaggtggttcaggcaaccgccgagcagatgagactcgcccaggttatctttgataagaatgacagcgacttcgaggccaaagtgaaacaactgatggaagtcacaggtaaaaaccaggatgagtgcatagtggccctgcacgactgtaacggtgacgtgaacaaggcaataaacatactgttggaaggtaacagtgacacaactagctgggaaaccgtgggctgtaagaaaaaaaacttcgccaaggagaacagcgagaacaaagagaacagggagaaaaaatcagagaaggagagtagcaggggccggggcaataacaatcgtaagggtcggggcggtaacagaggaagagagtttcggggcgaagaaaacgggattgactgcaatcaggtggacaagcccagtgataggggcaaaagggccaggggcagaggattcggcagaggtcgcgggagaggcgctggtcgctttagtacccagggcatgggaacatttaatcccgccgactattcagacagcacatcaaccgatgtctgtgggacaaagctggtagtttgggaggccgcccagaatggcgccgacgagggcactgaactcgcatctaatactcacaatattgcacaggatctatcaaataagtcgtcttacggtttaaaaggggcctggaaaaatagcgtcgaagagtggaccactgaggattggactgaagacctgtccgagacaaaagtcttcacagccagcagtgcccctgctgaaaaccacatcttgcctggccagtctatcgaccttgtcgccctgctgcagaaaccagtgccccactcgcaagcctccgaagcaaacagctttgagacgagccagcagcagggattcggtcaggctctggtctttacaaactcccaacataacaaccagatggcaccagggaccggaagcagcaccgcagtgaatagctgctccccccagtccctgagttcagttctgggctctgggttcggggagttagcacccccgaagatggcgaatatcacctcttctcaaatattggatcagctgaaggcaccgagcctcggacaatttaccaccaccccctctacccagcagaattctacctctcatccaacaactacaacaagttgggatctgaaaccacctacatctcagtctagcgtgctatcacatctagatttcaagtcacagccagagccatctccggtccttagccagctctcacaaagacagcagcatcagagccaggccgtgacagtgccgccaccagggttggagtcatttccctcacaagccaagctccgcgagtccacccctggggattctccgagcactgtgaataaactcctgcaactgccatcaaccactatcgaaaacatcagcgtgtcagtccaccagcctcaacctaagcacatcaaactagccaagagacgaattcctccagcctcgaaaatacctgctagcgcagtggagatgcctgggagtgcagacgtgaccgggctaaatgtgcaattcggtgctctggagttcgggtccgaaccctccttgtcggaattcggatctgctccctccagtgaaaattccaaccagattccgataagtttgtactcaaaaagcctgagtgaacccctgaacacctcactctccatgacatccgctgtgcagaactctacatacactacatcggtgatcacctcctgttctctcacctccagctccctgaactctgcatcaccagtggcaatgagctcatcatatgaccagagcagcgtccacaaccggatcccttatcagagtcccgtcagttcgtccgagtcagcacccggaacaattatgaacggtcatggtggcggtaggtctcagcaaacactagatacccccaagaccactggccctccatcagctctgccgtcagtgagctcccttccttcaacaactagctgtaccgctctcctgccttccaccagccagcataccggagatctcacttctagccccctgagccagctatcctcttccctatccagccaccagtcaagcttgtctgctcacgctgcactctcctcttcaacatctcacactcacgctagtgtcgagtcggcgtcttcacaccagagttcagctactttctccactgcagccacatccgtgtcatcctcagcctctagcggggctagcttgtcttccagcatgaacactgcaaactctctgtgcctgggggggactcctgcgtccgcctcatcttcatcgagcagagccgcccctctggtgacaagcggcaaggcacctccaaacctgccacagggcgttcctcccttgttgcataatcagtacctggtgggtcccggcggactgctgcctgcataccctatatacggctatgatgagctccagatgttgcagtcaagactccctgtcgactattatggcatcccttttgctgcacctaccgccctcgcttctagggatggctcactggccaataacccttacccgggcgatgttacaaagtttggcagaggcgactccgcttcccccgcccccgctactaccccggcccaacctcagcagtctcagtcgcagacacaccatacagcccagcagccttttgtgaatcccgctctgccccctggatactcgtataccggcttgccttactacaccgggatgcctagtgctttccagtatgggccgaccatgtttgttccccctgcttccgccaaacagcacggggtcaacctgtcaacacctactcccccgtttcagcaggcgagcggatatggacagcatgggtatagcacgggatacgacgacttgacccagggaactgcagcgggcgactacagcaagggcgggtacgccggctctagtcaggcccctaacaagtctgccggttctggcccaggcaaaggagtctctgtatcctctagcaccactgggctgccggacatgaccggcagcgtctataataaaacgcagacttttgacaagcagggattccatgcaggcacccctccccccttctcgttgccatcagttctgggatccaccgggcctctcgctagtggagccgcccctggctatgctcccccaccttttttacatattctgcccgcacatcagcagccacacagccagctgctccatcaccatctgccacaagacgcccagtccgggtcagggcagcgctcccagccaagctctttacagccaaagtcccaggcgagtaagcccgcttacggcaattccccatactggaccaactag

SEQ ID NO: 51808 - DNA, 2625 bp, Artificial Sequence
  Description of Artificial Sequence: Synthetic coding sequence
atgcggctggcccaggtgatcttcgacaagaacgacagcgacttcgaggcaaaggtgaagcagctgtccgaaacaaaagtttttaccgcgtcttcagcccccgccgaaaatcatatcttacctggtcaaagcattgatctggtggccctgttgcagaaacccgtgcctcacagtcaggcctcagaggccaattctttcgagaccagtcagcaacaggggtttggtcaggccctcgtttttaccaattcacaacataataatcaaatggctccaggaacagggtccagtactgccgtgaattcatgctcaccccaatctttgtcctcggttctgggttccgggtttggagagctggctccaccaaagatggccaacattacatcctctcaaattctggaccaattgaaggcgccttcccttggtcaattcaccaccaccccgtctactcagcagaatagcacttcgcacccgactaccacaactagctgggacctcaagccacctacatcacagtcctcggtgctatcacaccttgactttaaatcacagcctgagccttcccctgtcctgtcccaactgagtcaaaggcagcagcatcaaagtcaagccgttaccgttccaccaccaggtctggaatcttttcccagtcaagcaaagctgagagagagcaccccaggggactctccatccactgttaataagttactgcagctgccctcaaccacaatcgagaatatttctgtgagcgtgcaccaacctcagcccaagcacattaagttagccaaacgtagaattccccccgcatctaaaattcccgcaagtgctgtcgagatgcctgggtctgcggatgtaaccggactgaacgtgcagttcggagcactggaattcggcagcgaacctagtttatctgagtttggctccgctccttcatctgaaaattcaaaccagatccctattagtttatactcaaagtcactgtcggaacctctcaacacctccctgtctatgacttccgcagtgcagaattccacctatacaactagcgttatcacgagctgcagtctcactagcagctccctgaactccgcttcgccagtagcaatgtcctcttcctacgaccagtcttccgttcacaaccgcatcccctaccaatcgcctgtttcaagctcggaaagtgcacccggtacgataatgaacgggcacggcggcggcagaagccagcagaccctggataccccaaaaacaaccggccctccgtccgctctgccttctgtcagctcgctcccaagtactaccagttgcactgccctgctcccgtcaacctcccagcacactggggatcttacctcaagtccacttagccagctatcctcctccctgtccagccaccagtcctcacttagcgcccacgccgccctgtcgtcatcaacttcacacactcatgccagtgtggagtccgccagtagccaccagtcctctgcgacttttagtactgctgccaccagcgtctcttcttcagcctcatcaggggcttccctgtccagctctatgaatacagcaaacagcctgtgcctgggagggacccctgcctcagcaagcagctcgtcgagcagagctgcccctctggttacatccggtaaggcgccgcccaacttaccccaaggtgtgccgcccctcttgcacaatcaatacttggttggccctggtggactcttaccggcgtaccctatctacggctatgacgagttgcaaatgctgcagtcccgtcttccagtggattactacggaatcccctttgcagcgccgaccgcgctcgcaagccgcgatggttctcttgccaacaatccataccccggggatgttactaaatttggccggggtgatagcgcttccccagcccctgctacgacaccagcccaaccccagcagtctcaaagccaaacacatcacaccgctcagcagccatttgtcaaccccgcactgcctcccggatacagttataccggacttccatattataccgggatgccgtccgccttccagtatggccccaccatgttcgtcccccctgctagcgccaaacagcatggagtcaatctctcaactccgacaccaccctttcaacaagccagcgggtatggacagcacggctatagtactggttacgacgatctgactcaggggaccgccgccggggattatagcaagggcgggtatgcggggtcttcacaagctcccaataagagtgccggatcaggaccgggaaagggcgtgtcggtgtccagctccaccaccggactccctgacatgaccggcagcgtgtataataagactcaaacgttcgataagcagggctttcacgctggcacccccccgcctttctccctcccctctgtgctgggcagcaccggacccctagccagcggcgctgcacctggctacgcaccccccccatttctgcatatcctgccagctcatcagcagccacatagccaactcttacaccaccatctgcctcaggacgcccaaagtggcagtgggcagcgatcccaacctagctcgttacagccgaagagccaagcaagcaagccagcgtatgggaactctccttactggactaattag

SEQ ID NO: 51809 - DNA, 1593 bp, Artificial Sequence
  Description of Artificial Sequence: Synthetic coding sequence
atggaggacgacagcctgtacctgggcggcgagtggcagttcaaccactttagtaagttgaccagcagtcggccggacgccgctttcgcagagatccagcggacaagtttgcccgaaaaatcgccactcagttgtgagaccagagtggatctatgcgatgacctggctcccgtcgcccgccagctagcaccccgagaaaaactccccctgtcgtcacgccggcctgcggcggtgggggccggtctgcagaatatggggaacacctgttatgttaatgctagcttacagtgcctgacctacacacctccactcgctaattacatgctatcaagagagcactcccagacctgtcaccgtcataaggggtgtatgttgtgcactatgcaggcgcacattacacgggcccttcacaatcccggacatgttattcaacctagtcaggcgctggccgcaggtttccaccggggcaagcaggaggacgcgcacgaattcctgatgttcacagtagatgctatgaaaaaagcgtgcctgcctggccataaacaggtagaccatccgtcgaaggacactacactgatccatcagattttcggaggttactggcgatcccaaatcaagtgtttgcactgccacggcattagcgatactttcgatccttacttggacattgccctcgacattcaggcggcccagtccgtgcagcaagctttggaacaattggtcaagccggaggagctgaatggggagaacgcctatcattgtggtgtctgtcttcaacgggctccagcctccaaaactctgactctgcatacctccgccaaggtgcttattcttgtgctgaaacgtttctcagacgtgacaggtaataagatcgccaagaacgtccagtaccctgaatgcttagacatgcaaccatatatgagtcaacagaataccggacccctcgtgtatgtcctttatgccgtgttggtccatgccgggtggtcctgccataacggacactacttctcatacgtgaaggcccaggagggccaatggtataaaatggacgacgcagaggtgaccgcggcttccatcacgtcagtgctgtcacaacaagcttatgtactattctacattcagaaatctgaatgggagagacacagcgagtccgtgtctaggggacgggagccccgcgccctgggggcagaggataccgatcgaagagccacccagggcgagctaaagagagatcacccctgtctccaagcacccgagctggatgaacatttggttgaaagggcgactcaagagtctaccctcgaccggtggaaattccttcaagagcagaacaagacgaagcctgagtttaacgtgagaaaggtcgagggtactctccctccagacgttctggtgatccaccagagtaagtataagtgtggaatgaagaatcatcaccctgagcaacaatcctctttactgaatctcagttctagtacaccaactcaccaggaatctatgaacactggtacccttgctagtttaaggggacgagcccggcgaagtaaaggcaaaaacaagcattctaagcgggccctgctagtgtgccagtag

SEQ ID NO: 51810 - DNA, 684 bp, Artificial Sequence
  Description of Artificial Sequence: Synthetic coding sequence
atgggcaactgcgtgggccggcagcggcgggagcggcccgccgcccccggccacccacgaaagcgggctgggcgcaacgagcccctcaaaaaggagcgactaaagtggaagtctgactatcctatgacagacggtcagttaagatctaagagagacgagttttgggacaccgcacctgccttcgaaggaaggaaggagatttgggacgcactgaaagcggctgcctacgccgctgaagcgaatgaccacgagttagcccaggccattttggatggggcttctataaccctgcctcacggcactctgtgtgagtgttatgacgaacttggtaataggtaccaactaccaatctattgtctatcccctcctgtaaacttgcttctggagcatactgaggaggaatcactggaacccccagaaccaccaccatcagtgcggcgggagttcccccttaaagtaagactcagcactgggaaagacgtgcggctctccgcctctctgcctgacacagttggccaacttaagcgacagcttcacgcccaggaagggatcgaaccctcatggcagcgatggtttttttccggcaaattgctgactgataggacccggctgcaggaaacaaagattcaaaaagattttgtgattcaagtgattattaatcaacctcctcccccccaggactag

SEQ ID NO: 51811 - DNA, 3261 bp, Artificial Sequence
  Description of Artificial Sequence: Synthetic coding sequence
atggccaccgtgggcgagtggagctgcgtgcggtgcaccttcctgaatcccgctggccagagacagtgctccatctgcgaggcgccgaggcataagcctgacctgaaccacatccttcgactctcggtagaagaacagaaatggccatgtgctaggtgcacattcagaaattttctaggcaaagaggcatgtgaggtgtgtggcttcacccccgagcctgcacccggcgccgccttcttgccagtgctgaatggcgtgctgcctaagccgccagcaatccttggagagcccaaaggctcttgtcaggaggaggctggtcccgtccgaacggcaggactcgtggctacagaacccgcacgaggccagtgtgaagataaggatgaggaggagaaggaggaacaagaagaagaggaaggcgcagcggaacctagagggggttgggcctgcccgcggtgcaccctgcacaatacccccgtcgcctctagttgtagcgtatgcgggggcccaaggcgcctaagtctccctcggattccacccgaagcactggtggtccccgaggtcgtggctcccgccgggttccacgtagttcccgccgcaccaccgcccggcctgcctggcgagggagcagaggctaacccgcccgccacctctcaaggccctgcagccgaacctgagcccccacgcgtccctccattttcgcccttttcctccacactgcaaaacaatccagtgccacggtctcgtcgggaagtccccccacagctccagcctccagtacccgaagccgctcagccttcccccagtgccggatgcagaggggctccccagggtagtggctgggctggagccagtagactagcggaactgcttagtggaaagcgcctctctgtactggaggaagaggctacagaaggcggaacttccagggtggaggccggctcgtccactagcgggtcagatatcattgatctcgctggagacactgtcagatatacccccgcctcccctagctcacctgattttaccacctggagctgtgccaagtgcacgcttcgaaaccccaccgtggcaccgcgctgcagtgcctgcgggtgtagcaaactccatggctttcaggagcacggcgagcctcccactcattgcccagactgcggagctgataagccttcaccctgtggacggtcctgtggcagggttagttcggcacagaaagccgctcgggtgcttcccgagagaccaggacagtgggcctgtccagcatgcacccttctcaatgccctgcgtgccaaacactgtgctgcttgccacacgccccagttgttagtggcccaaaggagaggggccgcccccctgcgacgcagagaatctatgcacgtcgagcagaggcggcagaccgacgaaggggaggccaaggccctttgggagaatatcgttgccttttgtcgcgagaacaacgtctccttcgtcgatgatagcttcccccctggccctgaaagtgttggcttcccagccggcgacagcgtacaacagcgagtccgccaatggctgagaccccaggaaataaactgtagtgtgttccgcgatcacagagctacgtggagcgtattccacaccctgagaccaagcgatatattgcaaggccttctgggtaactgttggttcttgtcagcactggcagtcctggcagagcggcctgatttggtcgagcgagtgatggtgacaagaagcttgtgtgcggagggcgcgtaccaagtgcgtctgtgcaaggacgggacctggacaaccgtgctggtggatgacatgctcccttgcgacgaagcggggtgcctcctcttttcacaagcccagagaaagcaactatgggtggctttgatcgaaaaagcactggccaagcttcacggatcatacttcgcactgcaggctggacgggccatcgagggcctggcgactcttacgggcgcaccatgcgaatccctcgccctccagctaagttcaacgaaccccagagaggaaccagtggacaccgatcttatctgggccaagatgttgagtagtaaggaggcaggctttctcatgggcgcctcttgtggcggagggaacatgaaggttgacgacagtgcatatgaaagcttgggcctcagaccacggcatgcctactcaattttggatgtgcgggatgtgcagggtacccggttgcttagattgcggaatccttggggccggttcagttggaacgggtcttggagtgatgaatggccacactggcctggccacctccgtggtgagcttatgccacatggaagttctgagggtgtgttttggatggagtacggcgattttgtacgctacttcgactcagtggatatttgtaaggttcatagcgactggcaggaggctagagttcagggatgttttccttcttcggccagcgcgccagtcggcgtgactgcactcactgtgctggaaagagcctcccttgaatttgcactgtttcaggagggctcaaggcggtcagacgccgtggatagtcacctgctcgacctgtgcatcctcgtattcagggccacatttgggtctggaggccacctttcccttggccggctgttagcacacagcaaaagggccgtcaaaaagtttgtttcatgcgacgtaatgctcgagcccggcgagtatgctgtggtttgctgtgccttcaaccactggggccccccactgccaggcacccctgccccgcaggcttcatctccgtccgcgggagtgccgcgcgccagtccggaacctcccggccatgtgctcgcagtgtatagttcacgattagttatggtggagcctgttgaggctcagccaacaaccttagccgacgctattatactcttgacagaatcgcggggcgagaggcatgagggcagggaggggatgacctgctattatctgacacacgggtgggccggtttgatcgttgtagtggagaatcgccaccccaaggcttacctgcatgtccagtgtgactgcactgattctttcaacgtggtgagtactagaggatctttgcgcacccaggactcggtgcctccattgcaccgccaggtgctcgtgatcctatctcagctggaaggtaatgccggattttctatcactcatcgcctggcacatagaaaagccgcccaggcctttttgtccgactggaccgcctccaaggggacacactctcctcccctgacgcctgaggtcgctgggcttcacggcccgaggccactgtag

SEQ ID NO: 51812 - DNA, 930 bp, Artificial Sequence
  Description of Artificial Sequence: Synthetic coding sequence
atggccgccgccggcgcccccgacggcatggaggagcccggcatggacacagaagctgaaacagtagccacagaggctcctgctcgccccgtgaattgcctcgaagctgaggctgccgctggagctgccgccgaggatagtggcgctgcccggggatccctacagccagcccctgcccagccacccggagatcctgctgctcaggcctctgtttcgaatggagaggacgccggtggcggcgctggtagggagctcgtggacttgaagatcatttggaataaaaccaaacatgacgtcaaatttccgctcgattctaccggcagcgaattgaagcagaagattcattccatcactggcctgcctcccgcgatgcagaaagtcatgtataaggggcttgtaccggaagacaagaccttgcgtgagatcaaagtgacctcaggcgcgaagatcatggtggtcggttctaccatcaacgatgttctggccgtgaatacaccgaaggatgctgctcagcaagacgccaaggcggaagagaacaagaaggaaccactttgccgccagaagcagcaccgaaaggtcctcgataagggtaaacccgaggacgttatgccctcagtgaaaggggctcaggaacgtcttccgaccgtgcctctgagcggtatgtacaataaatctgggggaaaagtaagactgacctttaagctggagcaggaccagctgtggatcggtacaaaggagagaacagagaagctcccaatgggcagcatcaagaacgtggtgtctgagcccattgagggtcacgaggactatcacatgatggcgttccagctgggaccaaccgaagcctcctactattgggtatattgggtcccaacccaatacgtagatgcaattaaagacacagtcttaggcaaatggcagtacttttag

SEQ ID NO: 51813 - DNA, 561 bp, Artificial Sequence
  Description of Artificial Sequence: Synthetic coding sequence
atgcagaaggtgatgtacaagggcctggtgcccgaggacaagaccttgagggaaatcaaggtaacgtcaggtgccaagatcatggtcgtcggctcaaccatcaatgacgtgctggcagtaaatacacccaaggatgcagctcagcaggacgccaaggccgaagagaacaagaaggaaccactgtgtagacagaagcagcacagaaaggttctggataaaggcaaacctgaggatgtaatgccttcagtaaagggcgcccaggaaaggctgcctaccgtgcctttaagcggcatgtacaataaatccggaggtaaggtgcggctcacattcaagctggagcaggaccaactgtggatagggacaaaggaacgcactgagaaactcccaatgggatccatcaaaaatgtagtatctgaacccattgagggccacgaggactaccatatgatggcctttcagctgggcccaacagaggcctcctactattgggtttactgggtgccaactcagtacgtggacgcaatcaaggacaccgtgttaggcaagtggcagtacttctag

SEQ ID NO: 51814 - DNA, 2127 bp, Artificial Sequence
  Description of Artificial Sequence: Synthetic coding sequence
atgttcaccctgagccagaccagccgggcctggttcatcgaccgggctaggcaggcacgcgaagaacgcctcgtccagaaagagcgcgagcgggccgccgtcgtcatccaggcccacgtacgctcctttctctgtagatcccgcttgcagagggacatcagacgcgagattgatgatttttttaaagccgacgaccctgagagcactaagagaagtgcgctgtgcatttttaagattgccagaaagctgctgtttctgttcagaattaaggaggacaacgaaaggttcgagaagctctgcagaagcatcctctcctccatggatgcagaaaacgaacccaaagtgtggtacgtgagcctggcctgtagcaaagatctcacgttactgtggatacaacagataaagaacatcctctggtactgctgcgatttcctgaagcagctcaaaccagaaatactgcaagattcccggttaatcaccttgtacctcaccatgttagtaacatttaccgacacatctacttggaagatacttagaggcaagggtgaatcccttaggccagctatgaatcatatctgtgccaacatcatgggtcatttaaaccagcacgggttctattcagtgctgcaaatcctgttaacccgcggtctggcccgcccaagaccttgtctctctaaagggacactcaccgccgctttctcgttggccctccgccctgtcatcgccgctcaattttccgacaacctcattagaccctttcttatccacattatgagcgttcccgcattggttacacatcttagtaccgtcacacctgaacgcctgacagttctggaaagtcacgacatgctgcgaaaattcattattttccttcgggaccaggaccggtgcagagatgtctgtgagagccttgaaggatgccacacactctgtctcatggggaatcttctgcacctgggctccctgagcccacgggtgctagaagaggagactgacgggttcgtgtctttgctaactcagacactttgttattgcagaaaatacgtttcccagaaaaaatctaaccttacacactggcatccagttctgggctggttcagccagtctgtagactatgggctgaatgaaagtatgcaccttataactaaacagttgcagttcctctggggagttccgctcatcaggatttttttttgcgacattctgtccaaaaagctgctggagtctcaggaaccggctcacgcccagccagcatctcctcagaatgttctacccgtcaagagcttattgaaacgggcattccagaagagtgctagcgtaaggaacatactgaggcccgttgggggaaaacgggtggattcagctgaagttcagaaagtgtgtaatatttgcgtgctctatcagactagcctgactactctaacccagatccgcttgcagattctcactggcctgacgtacctggatgacctcttgcccaagctatgggccttcatttgcgaactgggtccacacggagggctgaagctgttcttagaatgcctaaataacgacacagaggagagcaagcaactgctggccatgctgatgctcttttgtgattgctcccggcacttgatcactatcctggatgatattgaggtctacgaggagcagatctcatttaagctggaagagctggtaacgatatcaagttttcttaattcgtttgtgttcaaaatgatctgggatggaattgttgaaaatgccaagggagagacactggaactctttcaaagcgtgcacggttggttgatggttctatacgagagggattgtcggaggcgtttcactcctgaagatcattggctgagaaaggatctgaagccgagcgtgttgtttcaggaactggatagagataggaagcgcgcacagctgatcctgcaatacattcctcacgtgattccacacaagaaccgcgtgttgttattccgcaccatggtgacaaaagaaaaagagaagctggggctcgtcgaaacttcaagtgcttccccccacgtgacccacatcactatccgccgctcccgcatgctcgaatcactgtttgaatgtccttggcctttggtaatcaatgctgaatcctgttag

SEQ ID NO: 51815 - DNA, 735 bp, Artificial Sequence
  Description of Artificial Sequence: Synthetic coding sequence
atgttcaccctgagccagaccagccgggcctggttcatcgaccgggcccggcaggcacgtgaagaacggctcgtgcagaaagagagagaacgggccgctgtggtgatccaagcccatgtgaggagttttttgtgtcgatcgcgcttgcagagagacattaggagggagatcgacgactttttcaaggcagacgatcccgagtctacaaagagaagtgctttgtgtattttcaagatcgcccggaagctccttttcctgtttaggatcaaagaggataatgaacgctttgagaagctctgccgttccattctatctagtatggatgccgagaatgagcctaaagtttggtatgtgtctcttgcctgtagtaaagatctgactctgctatggatacagcaaataaaaaacattctctggtactgttgcgatttccttaaacagctgaaacctgagatcttgcaggatagcagactcatcactttatatctcacgatgcttgtgaccttcacagatacctctacctggaaaatcctaagaggcaaaggcgagagcctgaggccagcaatgaaccacatatgtgctaatataatgggccacctgaaccagcatggattctattcggtgctccagtgttgtgatggcctgttccctgatctggtctcctacgccccgcataataaccctgtcagatggtccgttggcaggtcttggtacgattggcagctgagccgctag

SEQ ID NO: 51816 - DNA, 3207 bp, Artificial Sequence
  Description of Artificial Sequence: Synthetic coding sequence
atgttcaccctgagccagaccagccgggcctggttcatcgaccgggcccgccaagctcgtgaagaacgcctagtacaaaaggagagagagagggctgctgtggttattcaggcccatgtgaggagctttttgtgcaggtctcggctgcagagggacattcggagggagatagatgacttcttcaaggcggacgacccggaatctacaaagcgcagtgcactttgcattttcaaaatcgctagaaagctcctgttcctgttccgtataaaagaggacaatgagcgttttgaaaaactgtgtagatccattctgagttctatggacgcagaaaacgagccaaaagtgtggtacgtttccctggcttgctcaaaggatttgactctgctgtggatccagcagatcaaaaacatactatggtactgctgtgattttcttaagcagcttaaacctgagatcctccaggactccagactgatcacactatatttgacgatgctagtgaccttcaccgacacctctacttggaaaattctccggggaaagggagaatctttgagacctgctatgaaccatatctgcgctaacatcatgggacacctcaaccaacatggtttttactccgtgctccagatattgctaacacgcggattggcgaggcccaggccatgtttatccaaaggaaccctgacagccgccttctccttggccctgcgcccagtcatcgctgcacagttttctgataatcttatcagaccattcttgatccacatcatgtccgttcccgccctcgtgacacacctgagtaccgttacacccgagcggttgactgtgcttgaatcgcatgatatgttacggaagtttatcatattcctgagggaccaggatcggtgtagagacgtgtgcgagagcctagagggttgccacactctctgtctgatgggaaatctgttacaccttggttctctctcacctcgggtactggaagaggagacagatggtttcgtgtctttgctgacacaaactttgtgttactgccgtaaatatgtatctcagaaaaaaagcaaccttacccattggcatccagtgctgggctggttttcccaatccgttgactatggtctcaacgagtcaatgcatttaataactaaacagctgcagtttctgtggggggtccctctaattcgaatcttcttttgtgatattctctcaaaaaagctcctggagtcccaggagccagcacacgcacagcctgcaagtcctcagaatgttttgccagtgaaatcccttctcaaaagggcctttcagaagagcgcctccgtccggaatatactgcgaccagttggtggaaagcgggtggactcggccgaggtccagaaagtttgcaatatatgcgtcctttaccagaccagccttacaacacttacacagatcagacttcaaatactgacagggctgacatacctggatgatctgctgcccaagttatgggcatttatctgcgagctgggccctcacggaggacttaagctgtttcttgagtgccttaacaatgacactgaggaaagcaagcagctgctggcaatgctgatgctgttttgtgactgctcacgtcatcttatcacgattttagacgacatcgaggtctatgaagagcagatcagttttaagctcgaggaactggtgaccatatcatccttcctcaatagtttcgtcttcaagatgatttgggacggcatcgtggagaatgcgaaaggcgaaaccctggaactcttccagagcgttcacggatggctgatggttctgtacgaaagagactgcaggagaagattcaccccagaggatcattggctgcggaaagaccttaaaccctccgttctgtttcaggagctcgaccgcgacagaaagcgagcccagctgatccttcagtatatccctcatgtgattccacacaaaaatagggtactgttgtttcgcaccatggtgacaaaggaaaaagaaaaactgggattagtggagacatcaagcgcctcaccacacgtaacgcacattaccatccgcaggtctcgtatgctggaagatggctatgagcagctgcgacagctctctcagcacgcaatgaaaggagttattcgcgtgaagtttgttaacgacttgggggtcgatgaggccggaattgaccaggatggcgtgttcaaggagttccttgaggaaatcattaagcgtgtttttgatcctgctttgaatctgtttaagaccacgtctggagatgaacgtctatacccatcaccaacatcttacattcacgaaaactacctgcagttgttcgaatttgtgggcaaaatgctagggaaggcagtctacgagggtattgtggtagatgtccccttcgcttcgtttttcctgtcgcaattattaggccaccaccatagcgtgttttacagttccgtcgatgaactcccctcactcgactcggaattctacaagaatctgacctccatcaagcgttacgacggcgatatcaccgatctggggttaactctgagttacgacgaggatgtgatgggccagctggtgtgccacgaactgattcctggcggcaagaccatccccgtcacaaatgaaaacaagattagttatatccacctgatggctcatttcaggatgcacacccagatcaagaatcagacagccgcccttatatccggattcaggtccatcattaagcctgagtggatcagaatgtttagcactcccgaactgcagcgcctcattagcggagacaatgctgaaatagatctagaggacctgaaaaagcacactgtgtactatggcggattccatggctcacaccgagtgattatctggttgtgggacatactcgcatctgattttacccccgacgaacgcgctatgttcctgaaattcgtgacaagctgtagtcggccccctttactcggctttgcttacctgaagccccccttctccattaggtgcgtcgaggtctctgacgaccaggatacaggcgatacgctgggaagcgtcttgagaggattttttactatcagaaagcgcgagccaggcggccggcttcctacctcttccacctgttttaacttgctcaagctacctaactattccaaaaagagcgtcctgcgcgagaaacttcgctatgcaatcagtatgaataccggttttgaactctcatag

SEQ ID NO: 51817 - DNA, 3207 bp, Artificial Sequence
  Description of Artificial Sequence: Synthetic coding sequence
atgttcaccctgagccagaccagccgggcctggttcatcgaccgggcaagacaggctagggaggagcgcttggtgcagaaagaaagagagcgtgctgcagtcgtgatccaggcacatgtccgcagctttctttgtcggtcacggctgcagagggatattcgacgggaaattgacgatttcttcaaagccgacgatcccgaaagtacaaagcgatctgcgttgtgcatttttaagatcgccaggaagttgctgtttctgttccgcatcaaggaagacaatgagaggtttgagaaactctgccgcagcatcctgtcctccatggacgctgaaaacgagcctaaggtgtggtacgtcagcctggcctgctcaaaagatctgaccctgctttggattcagcagatcaagaatatattatggtactgctgcgattttctcaagcagttaaagccggaaatccttcaggatagcaggttaatcaccctatatctcaccatgctcgtaaccttcacagacacgagtacctggaaaattcttcgaggaaagggcgagtcactgaggccggccatgaaccacatatgtgctaacatcatggggcatctcaaccaacacgggttctattccgtactacagattctcctgacaagaggactggcacgaccccgcccttgcttaagtaaaggcactttgacagctgccttttcgctagccctcaggccggtaatcgccgcacagttctcagataatctgattagaccgttcctgatccacataatgagcgtccccgcccttgtcacgcacctgagcactgttacacctgagagattgacagtgcttgaaagccacgacatgttgcgaaaatttatcattttcctgagagatcaagaccgctgtagagatgtgtgcgagtcactggagggctgtcatactttatgccttatgggaaacctgctccacctggggagcctcagcccacgagtcttggaagaggaaacagatggattcgtgagtctgctgactcagacactctgctactgccggaagtatgtgtcacagaaaaaatccaacctgacccactggcatcccgtcctgggatggtttagtcagagtgtggactacgggctaaacgaatccatgcatcttatcacaaagcagttacagttcttatggggtgtaccgctgattcggattttcttctgcgatattttgtctaaaaaactgctggaatcccaggaacctgctcatgctcagcccgcttcaccccagaatgtcctgcccgtgaaatctctcctgaagcgtgcgttccagaagagtgctagtgtgcgcaacattctcaggccagtcggaggtaaaagggttgattcagctgaggtgcagaaggtttgtaacatttgcgtgctctaccagacctcactgaccacattgacacaaattcggctgcaaatcctgaccggcctgacttacctcgacgatttactgcccaaactgtgggcattcatctgtgagctcggaccacatggtggtctgaagttattcctggaatgcctgaataatgatactgaggagtctaagcagctgctagcaatgctgatgcttttctgcgactgcagtaggcacctgatcactattctggatgacatcgaagtgtatgaagaacagattagcttcaagctggaggaactggtgaccatcagcagcttcttgaatagcttcgtgtttaaaatgatatgggacgggattgtggagaacgccaagggggagacactggagctttttcagtcggtgcacggatggcttatggtgctgtatgaacgagactgtcgcaggagatttacccctgaagaccattggctgagaaaggacctgaagccctccgtactttttcaggaactggaccgcgataggaagcgcgcccagctcatcctgcagtacattccccatgtgatcccacacaaaaacagggtcctgttgttccggacaatggtgactaaggagaaggagaagcttggccttgtggagacctccagcgctagtccccatgtcacccacattaccattcgtagaagccgaatgttggaggacggttatgaacagttacggcagctcagccagcatgccatgaagggagtcatccgggttaagttcgtcaacgacctgggtgtggacgaggctggcattgaccaagatggcgtatttaaagaatttctggaggaaattatcaaacgcgttttcgatcctgccttgaacctattcaagaccaccagcggggacgagcggctgtatccgtcgccaacatcttatatccacgagaactatttgcagctctttgagttcgtggggaagatgttgggaaaggccgtttacgagggcattgttgtggacgttccttttgccagttttttcttaagtcaattgctgggccatcatcattccgtgttctactccagcgtggatgaactaccatccctggactccgagttctacaagaacctgacaagtataaagcgctacgacggcgacattacagacttaggcctgaccctaagctacgacgaggacgtgatgggtcaacttgtttgccatgagctgatccccggaggaaaaacaatccctgtcaccaatgagaataaaattagctatatccacttaatggcccactttcgcatgcatacgcagatcaagaatcagacggccgctctgatctcaggctttagaagcattattaagccagaatggattcgcatgtttagtaccccagaattgcagagactgatctccggagataacgcagagatcgatctggaggacctcaagaagcacaccgtgtattacggcgggtttcatggcagccaccgggttattatatggctctgggatatcctagctagcgattttacgcctgacgagcgcgccatgtttctcaagttcgtgaccagttgttcccgtccacctctattgggcttcgcttacttgaaaccccccttctccatacgatgtgtcgaggtcagcgatgaccaggacaccggagacaccctgggctcagtgctgcgcggctttttcactatcagaaaacgcgagccaggcgggagattgcccacatcaagcacatgctttaacctgctgaagctgcctaactacagcaaaaagtctgttttgagagaaaagctccgatacgctattagtatgaacactggatttgagctcagttag

SEQ ID NO: 51818 - DNA, 456 bp, Artificial Sequence
  Description of Artificial Sequence: Synthetic coding sequence
atgttcagcacccccgagctgcagcggctgatcagcggcgacaacgccgagatcgaccttgaggatctaaagaagcacactgtgtattacgggggcttccacgggagccacagggtgatcatctggctctgggacatcctcgccagcgattttacaccagatgagagggccatgttcttgaaattcgtgacgtcttgttctcgacctcccttactcggcttcgcatatctcaagccacccttctctatccgctgcgtagaagtgtccgatgaccagcagggacgacaactcgacccttctgaaccctccgaggagggccctaccgttcttacggccggggaaccggcgtcccccagagagacggcacacggattgagtcccctaagcgccgctccattctcattccttccgcagggcagagtcccaggtgtgggcgtaggcacctgctgcttctag

SEQ ID NO: 51819 - DNA, 735 bp, Artificial Sequence
  Description of Artificial Sequence: Synthetic coding sequence
atgttcaccctgagccagaccagccgggcctggttcatcgaccgggcacgacaagcgagagaggagcgtcttgttcagaaggagagagagagagccgctgtggtcatccaagctcacgtccgctccttcctgtgcagatctcgcttgcaaagagacattcgcagagagatcgacgatttctttaaggccgacgatcctgaaagcacaaaacggtcagctctgtgtatttttaagatcgcacgtaaactacttttcctgttcagaattaaggaagacaatgagaggttcgaaaagctgtgccgctccattctcagcagcatggatgctgaaaatgagcccaaggtgtggtacgtttccctggcttgttcaaaagatcttaccttgctgtggattcaacagattaagaatatactctggtactgttgtgacttcctcaagcagctgaaacccgagatcctgcaggattcccgccttataacgttatatcttaccatgctggtcaccttcacagacacctccacttggaaaatccttcggggaaagggcgaatccctgaggccggctatgaatcacatatgtgccaacatcatgggtcacctcaaccagcacgggttctactccgtcctgcagtgctgtgatggcctcttccctgacttagtcagttatgccccacacaataaccctgttcggtggtcagtaggcagatcatggtatgactggcaactatcacggtag

SEQ ID NO: 51820 - DNA, 1017 bp, Artificial Sequence
  Description of Artificial Sequence: Synthetic coding sequence
atgaagggcgtgatccgggtgaagttcgtgaacgacctgggcgtggacgaagcaggaatagatcaggatggcgttttcaaagaatttctggaggaaattattaagcgtgtttttgatcccgcactcaatctcttcaaaacgacttctggagatgagagactctatcccagccctaccagttatatacatgagaattatctgcaattattcgagttcgttggtaagatgctgggcaaagcagtttacgagggcattgtcgttgatgtgccctttgcatctttcttcctgtctcaattactggggcatcaccacagtgtcttctatagttccgtcgacgaactcccttccctagattctgagttctacaagaacttaacatcaatcaagaggtacgatggcgacatcaccgacctgggtctgactctttcttacgatgaggatgtgatggggcagttggtttgtcacgaactcattccagggggcaaaactattccggttactaatgagaataagatcagttacattcacctgatggcccactttcgtatgcatactcagattaagaaccagactgccgccttgatttccgggtttcggagtattattaagcccgaatggatccgtatgttttctacacccgagctgcagcgcttaattagcggcgataacgctgagattgacctggaagatctgaagaaacataccgtatactacggcgggttccacggaagtcaccgtgtgatcatttggttgtgggatattctggctagcgattttacccccgacgagcgggctatgtttctaaaatttgtgacttcatgttctcgaccccccctgctggggtttgcctatctcaagccgcctttctctattagatgtgtagaagtgtccgacgaccaggctgtacacgtgcaggctcgctgctttataagctctctggctaagggagagggcaagccgagtgggcttagaagttccgtctgcctgaagccaggacccctttgggtgctaaaatag

SEQ ID NO: 51821 - DNA, 2619 bp, Artificial Sequence
  Description of Artificial Sequence: Synthetic coding sequence
atgttcaccctgagccagaccagccgggcctggttcatcgaccgggctcgtcaggctcgtgaagaacgcctggtccagaaggaaagggaacgggctgctgtcgtgattcaggcccatgtgcggtctttcctgtgccggagtcgcctgcagcgggacattcgccgcgagatcgacgacttcttcaaagctgacgacccagagtctaccaagaggagtgcgctgtgcatcttcaagatagcccgcaagcttctgttcctgttcaggattaaggaggataacgagcgtttcgaaaagctgtgtcgtagtatattgtcttccatggacgccgaaaatgaacctaaagtctggtatgtgtctttggcctgctctaaagaccttaccctactgtggatacagcagatcaaaaacattctgtggtattgttgtgatttcttaaagcagctcaagcccgagatactgcaagactcaagactgattacactgtacctgactatgttggtaacctttaccgacactagcacctggaagatccttcggggtaaaggtgagtctctccgacctgccatgaaccacatctgcgccaacatcatggggcatctgaatcagcacggcttctactctgttctgcagatcctgctgacaaggggccttgcccgtcccaggccctgcctgagcaaagggaccctgacagcggccttttcactggcattgagacccgtgatcgccgcccagtttagcgacaatctgatacgtcctttcctgattcatatcatgagtgttcccgctcttgttacacacttgtcaacggtgactccggaaagactcacagtgctggagagtcacgacatgctcaggaagttcatcatctttcttagggatcaagatcgttgcagggacgtgtgtgagagtttggaaggatgccacacactgtgtctgatgggcaatctgctgcatctaggcagcctgagtccacgcgtactggaggaagagacagatggtttcgtctctttactgactcagactttatgctattgccgaaagtatgtttctcagaagaaatccaatcttacacattggcatcccgtcctggggtggttctctcagtccgtggactacgggctaaacgaaagcatgcatttgattacgaaacaactccaatttctctggggcgttcctttaattcgcatctttttttgtgacatactcagcaaaaaactgctcgaatctcaagagccagcgcacgctcaaccagcatccccgcaaaacgtacttccagtgaagtctctgctcaaacgcgccttccagaagtctgccagtgtgcgcaatatcctccgacctgtgggcggaaagagagtcgattccgctgaggtgcagaaagtgtgtaacatctgtgttttgtaccaaacgagcctaactacactgacacagatccgcctgcaaatcttgactgggctgacgtatctggacgatctgctgcccaagttgtgggcctttatttgcgaacttggcccacacgggggtctgaaactgtttttggagtgtctgaacaatgataccgaggaaagcaaacaactgttggcaatgctgatgctgttttgcgactgctcccgacacctgatcaccattctggatgacatcgaggtttatgaagaacagatctccttcaagctagaggagctggtgaccatttcttcattcctgaattccttcgtgttcaaaatgatctgggatggtattgttgaaaatgcaaaaggcgaaaccctcgagctcttccaaagcgtccacgggtggctaatggtgttatacgagcgcgactgccgaaggcgcttcacccctgaagaccactggctccggaaggatctcaagccttcagtgctattccaggaactggacagagatcgtaagcgggcccagctgatcctgcagtacatccctcacgtgattccccacaagaacagggttctcctatttcgaacaatggtcactaaagagaaagaaaaattaggtttagtagagacgagttctgcctcaccacatgtcacacacatcaccatcaggcggtcaaggatgctggaggacgggtacgagcagctgagacagctgtcgcagcacgccatgaaaggggtgatccgggtgaagttcgtgaatgatttaggggtggacgaagctgggattgaccaagatggtgtgttcaaggaattccttgaagaaataatcaagcgggtctttgatcctgcattgaatctgtttaagaccacgtctggcgacgagagactgtacccgagccccaccagctatattcatgagaactaccttcagctgttcgaattcgttggtaaaatgctggggaaggccgtgtacgagggtatcgtggttgatgtgcctttcgcgtctttttttttgtctcagctgttggggcatcaccattccgtgttctacagctccgttgatgaacttcctagtctcgattccgaattttataagaatctcacaagtatcaagcgatacgatggcgacatcacagacctgggattgacgctctcatacgacgaagatgttatgggccagctggtgtgccacgaactgattcccggcggaaagacaatcccggtgacttag

SEQ ID NO: 51822 - DNA, 735 bp, Artificial Sequence
  Description of Artificial Sequence: Synthetic coding sequence
atgttcaccctgagccagaccagccgggcctggttcatcgaccgggctagacaggccagagaggagcggctggtgcaaaaggagagggagcgggcagctgtggtgatccaggcccacgtgcgaagctttttgtgcagaagtcgtctgcagcgggatataaggcgagagatcgacgatttctttaaggcagacgaccctgaaagcaccaaacggagcgctctttgtatcttcaagatcgcaagaaaactcctctttctattccgtatcaaggaagataatgaaagatttgagaagctgtgccgatctattctgtcatccatggacgccgaaaatgagcctaaagtatggtacgtctcattagcctgttccaaggatcttactctgctgtggatccagcagatcaaaaacattctgtggtactgctgtgattttctgaagcagctgaaacctgagattctccaagactcaaggttgatcaccctctatctgaccatgcttgtgacctttaccgatacttccacgtggaagattctccgtgggaagggggagagccttagaccggcaatgaaccatatatgcgctaatatcatgggacacttgaatcagcacggattttatagtgtgctgcagtgttgtgacggcctgttcccagacctcgtgtcttatgcaccccacaataatcccgtccggtggagtgtggggcgatcctggtatgactggcagctttcccgttag

SEQ ID NO: 51823 - DNA, 2946 bp, Artificial Sequence
  Description of Artificial Sequence: Synthetic coding sequence
atggccgagggcggcgccgccgacctggacacccagcggagcgacatcgcaacattgttgaagacctctctgagaaagggagatacatggtatctggtcgattcccggtggttcaaacagtggaaaaaatatgttggcttcgacagctgggataaatatcagatgggcgaccagaacgtttatcccggacctatcgacaacagcggcctgctgaaggacggcgatgcccagagcctcaaggaacaccttatagacgagctggactatatccttctgcctactgaaggctggaacaaactggtttcttggtataccttgatggaagggcaggaacctatcgccagaaaggtggtcgaacagggtatgtttgtgaagcactgtaaggtcgaggtttacttgaccgagctgaaactttgtgagaacggtaacatgaataacgtcgttactaggcgcttcagcaaagctgacacgatcgacactatcgagaaagaaatccggaaaatcttcagtatacctgatgagaaagaaacccgactctggaacaaatacatgtcaaacacctttgaaccattaaacaaacctgattccaccatccaggatgcaggcctgtatcagggacaagtgttggtgatcgagcagaaaaatgaggatgggacgtggcctaggggtccctctactcctaagtctcctggcgccagcaatttttccaccctaccaaaaatctctccttctagcctgtcaaataattataataatatgaacaatagaaacgtaaaaaatagcaactactgtctgccgtcctatacagcttataagaattatgactacagtgagccagggcgtaacaatgagcagccgggactgtgcggactgagtaatttggggaatacttgtttcatgaatagtgccatccagtgcctgtctaatactccccctctgaccgaatacttcctgaatgataagtatcaggaggagttgaatttcgacaatccgcttggcatgagaggagagatcgccaaaagctacgccgaactcatcaagcagatgtggtctggtaaattctcctacgtgacacctagggcgtttaagacacaggtgggccgcttcgcccctcagtttagcggataccaacaacaagattgtcaggagctcctggcctttctcctggatggactgcatgaagatttaaaccggatacggaagaaaccatatatccagctgaaagacgcagatggaaggccagacaaggttgtggctgaagaggcctgggagaaccatctaaaacgcaacgattctatcatcgtcgacattttccacggcttattcaaatccacactggtgtgccctgaatgtgcgaagatctctgtgacgttcgatccattctgttacctcaccctgcctttaccaatgaagaaagagagaacactggaggtctaccttgtgcgtatggatcccctgactaagccgatgcagtacaaagtggtggtgcccaagatcggcaatatacttgacctttgcacagctctctcagctctgtcaggcatccctgcagacaagatgattgtgacagatatatataaccaccgcttccatcgtattttcgcaatggacgaaaacctgagctctatcatggaacgagacgacatctatgtatttgaaatcaatattaacaggaccgaggatactgagcacgtgattatccccgtgtgcctgcgagagaaatttcggcattcctcttacacgcaccacaccggatcctccttgtttggacaaccctttctcatggcagtgccgcggaataataccgaggacaagttgtataacttattgcttctgcgaatgtgccgctatgtgaaaattagtactgagactgaggaaacagagggatctctgcactgttgcaaggaccagaatatcaatggcaacggcccaaacgggattcacgaggaggggtctccctccgagatggaaaccgatgaacctgacgatgagagcagccaggatcaagaactgccaagtgaaaatgagaattctcaaagtgaggacagcgtcggcggtgacaacgacagcgaaaatggcctctgcaccgaagacacatgtaagggacaattaacagggcacaaaaaaagattgttcacattccagttcaacaacctggggaatactgatatcaactatattaaagatgatactaggcatattagatttgacgatcggcagcttcgcctggatgagagatcattccttgcactggattgggaccctgacctgaagaaaagatacttcgacgagaatgccgccgaggacttcgaaaaacacgagtccgtcgagtacaaacctcctaagaagccttttgttaaattgaaggattgcattgaactgtttaccacaaaagagaagttgggtgccgaggacccctggtattgccccaactgcaaagagcaccagcaggccactaaaaagctggatctctggagcctgcccccagttcttgttgttcaccttaagaggttctcctatagccggtatatgagagacaaactagatacccttgtagatttccctattaacgacttagatatgtctgagtttctgataaatcctaatgcaggcccttgcaggtataacctgatcgccgtgtctaatcactacggaggaatgggaggcgggcactacacggcctttgcaaaaaacaaagacgacggtaagtggtattacttcgatgactcttccgtctcaactgcctccgaggaccagattgtttctaaggctgcctacgtgttgttctatcagcggcaggataccttcagcggaacaggatttttccctctagaccgagaaacaaagggggccagtgccgctaccggtatacccttggagtcagatgaggattcgaatgacaatgataacgatattgagaacgagaattgtatgcacaccaattag

SEQ ID NO: 51824 - DNA, 2859 bp, Artificial Sequence
  Description of Artificial Sequence: Synthetic coding sequence
atggccgagggcggcgccgccgacctggacacccagcggagcgacatcgcgaccttgctaaaaaccagtttgcgaaaaggtgatacttggtacctggtggattcccgttggtttaaacagtggaaaaaatacgtcgggtttgacagctgggacaaataccagatgggtgaccagaatgtgtatcctggacccattgacaacagtggcttgcttaaagatggcgatgcccagtccctgaaggaacacctcatcgacgagctggactacattttgttgcctacagaaggctggaacaagctcgtgagttggtatacccttatggaagggcaagaaccaatcgcccggaaggttgttgagcaaggtatgttcgtcaagcattgcaaagtcgaagtgtacctcacagagcttaaactgtgtgaaaacgggaacatgaacaatgtggtgacccgccgattttcaaaggctgacaccatcgatactatcgaaaaggagatacgaaagattttctcaattccggacgaaaaggagactagactgtggaataaatacatgagcaacacatttgaaccgcttaacaagcctgacagtacgattcaggatgccgggctctatcaaggtcaggtcctcgtcatcgagcagaaaaacgaagacggaacctggccacggggcccttctacaccaaatgttaaaaacagtaattactgtttgcctagttatacagcctacaaaaactatgactactcagaacccggaagaaacaacgagcagcccggactctgtggcctctcaaaccttgggaatacttgctttatgaatagcgctattcagtgtttatccaatacccctcccctgactgaatattttctgaacgataagtaccaggaagagctcaattttgacaaccccttagggatgaggggtgagattgctaagtcttacgctgagctcattaagcaaatgtggagcgggaagttttcttatgtcactcccagagccttcaaaacccaggtgggccgatttgcaccccaatttagtgggtaccaacagcaagattgccaggagcttctcgcattccttcttgacgggctgcatgaggatttgaaccggattcgcaaaaagccatacatccagttaaaagatgctgacggccggcccgataaagtggtggccgaggaagcctgggaaaatcatctcaaacgaaatgattccatcattgtggatatcttccatggccttttcaagtcaactctggtctgtccagagtgcgctaagatctctgtgacattcgaccctttttgctacctcacactgcctctaccgatgaaaaaggagaggaccctggaagtatatctggtacggatggaccctttaacaaagccgatgcagtataaagtggtggtccccaagattggcaacatcctggatttatgtaccgcgctgagcgccttatcgggtatcccggccgataaaatgatagttaccgatatctacaatcatagattccacagaatattcgcgatggacgagaacctctccagtataatggagcgtgacgacatctatgtctttgagatcaacattaataggactgaggacacagaacatgtgattattcccgtctgccttagggagaagtttcgacactcttcctacacccaccatacaggcagtagcctttttggacaacctttcctcatggcagtgccccgcaataacactgaggataagttatacaatctgctcttgctgcggatgtgcaggtacgtcaagatcagtacggaaacggaagaaaccgaagggagcttacactgctgtaaggaccagaatatcaatggcaacggaccaaacggcattcatgaggaggggtcacccagcgaaatggagactgatgagccggacgatgaatcgtctcaggaccaggagttgccgagcgagaacgagaatagccagtctgaggattcagtcgggggggataacgacagcgaaaatggcttgtgcactgaagacacatgtaagggccagctcaccgggcataaaaagagattattcacctttcagttcaacaatttaggaaatacagatatcaactacatcaaagatgacacaaggcatatacggtttgatgataggcagctgaggcttgatgaacgatctttcctggcgctagattgggacccggacttgaagaagcggtactttgacgaaaatgccgctgaagattttgagaagcacgagtctgtcgaatacaagccccccaaaaagccttttgtgaagcttaaggactgcattgagctctttacgaccaaagaaaagctaggagctgaagacccttggtactgcccaaactgtaaagagcatcagcaggcgaccaaaaagctggacttatggtccctcccccctgtacttgtcgtgcaccttaaaagattcagttatagccgctacatgagggataagctagacacactggtggactttccaatcaatgaccttgacatgagtgagtttctcatcaatccaaatgcaggaccctgtagatacaacctgatcgccgtatcaaaccactacggggggatgggggggggccactatacggcttttgcaaaaaacaaagacgatggaaagtggtactactttgatgatagttctgtatccacagcgtccgaggaccagattgtttccaaagctgcatacgtcttattctaccagaggcaagacacgtttagcgggaccggtttttttccattggaccgagaaacaaagggggctagcgccgccaccggaattcccctggaatctgacgaggacagcaacgacaatgataatgatatcgagaatgaaaactgtatgcacaccaattag

SEQ ID NO: 51825 - DNA, 2871 bp, Artificial Sequence
  Description of Artificial Sequence: Synthetic coding sequence
atggccgagggcggcgccgccgacctggacacccagcggagcgacatcgccacactgctcaagaccagcctgcgcaagggcgatacctggtacctggtcgactcccggtggtttaagcagtggaaaaaatacgtgggcttcgactcttgggataaatatcagatgggagaccagaacgtctaccccggtcccatcgacaactccggcttgcttaaggatggagacgcccaatcgctgaaagagcacttaatcgatgagctggattatatcttgctccctacggaagggtggaataagctggtatcgtggtatacactgatggagggtcaggagcccatcgctcggaaagtcgtggagcagggcatgtttgtgaaacattgcaaagtggaagtgtacctcacagaactgaagctgtgtgaaaacggtaacatgaataatgtcgtgacaagacggttcagtaaggccgatactattgacacaattgagaaggaaattagaaagatcttcagcatacccgatgaaaaggagacacgtctctggaacaaatatatgtcaaatacttttgagcccttgaataagccagactctacgatccaggacgcaggtctctatcagggacaagtgctgttcatcgttttggtgattgagcagaaaaacgaggatgggacatggcctcgcggcccctctacacctaatgtgaaaaactccaactactgtctgccatcatacaccgcatacaaaaattacgactactcagaaccaggccggaacaacgagcagcctggcctatgtggtctgtctaatttggggaatacctgctttatgaatagcgcgatccaatgtctgagcaacacacccccccttacggaatattttctcaacgacaaatatcaggaggagctgaattttgataatcctctcggcatgaggggcgagatcgctaagagttacgcggagttgataaaacagatgtggtctgggaaattctcttacgtcacacctcgagccttcaaaactcaagtggggcggttcgctccacaattttcgggctaccaacaacaggattgtcaagaactcctggcattcctcctggacggtctgcacgaggacttgaatagaatccgaaagaagccttatattcagctgaaggacgccgacggtcgacctgataaggtagtggcagaagaggcctgggagaaccacctcaagcgcaatgactcaattattgtagatatcttccacggattgttcaaatccaccttggtatgtcctgagtgtgccaagatcagcgtcacttttgaccctttttgctatctaaccctgcccttgcccatgaagaaggaacgcaccctggaggtttatctcgtgaggatggaccctctgacaaaacccatgcagtacaaggtggtagtgccaaaaatcggaaatatcctggacctgtgcacagccctcagtgccctgtctggcatacccgcagacaagatgattgtaacagatatttataatcaccgttttcaccgaatctttgctatggacgaaaatctgtcttccattatggagcgggatgacatctacgtgttcgagatcaacatcaacagaaccgaagatacagagcacgtgatcattccagtctgtctcagagagaagtttcggcactccagctacacgcatcatacagggagctccctgttcggacagcctttcctcatggccgttccaagaaataacacagaagataagctgtacaaccttctgttgcttagaatgtgtcggtacgtcaagataagtacagagactgaggagactgagggctctctacactgctgcaaagatcagaatattaatggaaacgggccgaacggcattcacgaggagggcagccccagcgaaatggagactgatgaacctgatgatgagtctagtcaggaccaggaactccccagtgagaatgaaaactcacagagtgaggacagcgtgggaggggacaacgactccgagaatggactttgtactgaggacacctgtaaaggccagttgaccggccacaaaaagaggctgtttacctttcagtttaacaatttgggcaataccgatatcaactatattaaggacgacacacggcacatcagattcgatgacaggcagctgaggctggacgagcgcagcttcctggcactcgattgggatcccgatctgaaaaagaggtattttgacgagaacgctgcagaggactttgagaaacatgagtccgtcgagtacaagccacctaagaagccttttgtcaagcttaaagactgcattgaactatttactaccaaagaaaaactcggagctgaggatccctggtactgcccaaactgcaaggagcaccagcaggcaaccaaaaagctggacctttggagtctgcctcctgtccttgtcgtacatttaaagagattcagctacagtaggtacatgcgggataagctcgacacccttgtggattttccgatcaacgacctggacatgagtgaattcctgatcaacccaaacgccggcccctgtcggtataatctcatcgccgtgtctaatcactatggtgggatggggggcggccattatacggcctttgccaaaaataaggacgacggaaaatggtattatttcgatgatagcagtgtgtccactgcctctgaggaccagatcgtgtcgaaggccgcctacgtgttattttaccagcgacaggatacattcagcgggactggattcttcccgttggatcgggaaacaaaaggagcatcagccgcaactggcatccccctggagtccgacgaggactctaatgataacgataacgatatcgaaaacgaaaattgcatgcatactaactag

SEQ ID NO: 51826 - DNA, 708 bp, Artificial Sequence
  Description of Artificial Sequence: Synthetic coding sequence
atggccgagggcggcgccgccgacctggacacccagcggagcgacatagccaccctactgaaaacaagtttgcggaagggagatacgtggtaccttgttgactctcgttggtttaagcagtggaagaaatatgtaggattcgattcatgggataagtaccagatgggcgatcagaacgtctatcctggacctatcgataacagcgggctgctgaaggacggcgatgctcagagtctaaaggaacaccttatagatgagctcgattacatcctgctcccaaccgagggatggaataagctggtttcgtggtacacattgatggagggacaggaaccaatcgctcgcaaagtcgtggagcagggaatgttcgtaaagcattgtaaggtggaggtgtatcttaccgaacttaagctgtgcgagaacggaaacatgaacaatgttgtaacacgccgcttcagcaaagccgatacaatagacaccatcgagaaggagattagaaaaattttttctatccctgatgagaaggaaacaaggttgtggaacaagtacatgtcaaatacgttcgagcccctgaacaagcctgattccaccatacaggatgccgggctttaccagggccaggtgctggttatcgaacagaaaaatgaggatggaacatggcctaggggaccatcgacccccaaaaagcctttggaacagagctgctag

SEQ ID NO: 51827 - DNA, 2769 bp, Artificial Sequence
  Description of Artificial Sequence: Synthetic coding sequence
atgatcagcctgaaggtgtgcggcttcatccagatctggagccagaaaaccggaatgactaagttgaaagaggccctgatcgaaaccgttcagcgccaaaaggaaataaaattggtagttacctttaagagcggaaagttcatcaggatctttcagctctcgaacaacataagaagcgtggtgttacgccactgtaagaagagacagtcacatttgaggctgaccctgaagaacaacgtcttcctgttcattgacaagctgtcctacagggacgccaaacagcttaacatgttcctggatataatccaccagaataaaagtcagcagcctatgaaaagtgatgacgactggagcgtgtttgagagccgtaacatgctgaaggagatcgataaaacctctttttactccatctgcaataagccaagctatcagaagatgccactctttatgagcaaaagcccaacccacgtgaaaaaaggtattcttgagaaccaggggggcaagggccagaacactttgtcaagcgacgtacaaactaatgaagatattctgaaggaagataatcccgtgcccaataagaagtataagaccgactcgctgaagtatattcagtcaaatcggaagaacccaagctctttggaggacttagaaaaagaccgtgacctcaagttgggcccaagctttaacacaaactgcaatggtaatccaaatctcgatgaaacggtgttagccacgcagacattgaatgctaagaacggtctgaccagccctctagaaccggagcactcccagggcgaccctagatgcaacaaggctcaggtccccctggactcgcactcccagcagctgcagcagggctttccaaacctcggaaatacctgttacatgaatgccgttctgcagtccctgttcgcaatacctagctttgccgatgacctgctgacacaaggcgtgccttgggaatacattccatttgaggccctgatcatgactctgacacagctgctggccttgaaagatttttgttccactaagatcaagcgtgagttactggggaatgtgaaaaaggtgatctcagctgtggcagaaattttctccggcaacatgcagaacgacgcccacgaattcctgggacagtgtctcgatcagttaaaagaggacatggagaagctcaatgcgaccctcaacactggaaaggaatgcggcgacgaaaatagcagccctcaaatgcatgttggcagtgcagccaccaaggtattcgtgtgtcccgtggtcgccaattttgaattcgaactgcaacttagcctcatttgtaaagcctgcggtcacgccgtgttaaaagtggagcctaataattacctttcaattaacctccatcaggaaactaaaccccttccactgagcattcagaactctctggatctattcttcaaggaggaggaactagaatataattgccagatgtgcaagcagaaatcatgtgttgcccggcacactttcagccgcctaagccgggtgttaatcatacacctgaagaggtatagctttaataatgcgtggcttctggtgaagaacaacgagcaggtttatatccccaaatcgctcagcctgtccagctactgcaatgagtccaccaagccaccactaccgctatccagctcagcacccgtgggcaagtgcgaggtcctggaagtttctcaggagatgatcagcgaaattaactcacccctcactccatctatgaagttgacatctgagtcctccgacagcctagtgctgccagtagaacctgacaagaacgccgatctgcagagattccagcgagactgcggcgatgcctcgcaggagcagcatcaacgcgacctggaaaacggatccgctctcgaaagcgagctggtgcacttccgggatagggccattggcgaaaaggagctacctgtagccgactcactgatggaccagggggacatttccctgcctgtgatgtacgaagatggtgggaaactgatttcttcgccagataccagactggtggaagtgcacttgcaagaagtcccccagcatccagaactgcaaaagtacgagaaaacgaatacgttcgtggaattcaactttgattcagtgactgaatctacaaacgggttctacgattgtaaagagaatcgcatcccggaggggtcacagggtatggccgagcagttgcagcaatgcatcgaagagagcatcatcgacgagttcctgcagcaggcaccacccccaggcgttagaaaactggacgcacaagagcacaccgaggaaactctgaatcaatctacagaattgagactccagaaggctgatcttaaccacctgggggcgttaggctcagacaatccagggaacaaaaacatcctggatgccgagaacacccggggcgaggcaaaggagctcactagaaacgtcaaaatgggggaccctctgcaagcttacagactcatctccgtcgtgtcccacatcgggtcctcacctaattccggccattacatctctgatgtgtacgactttcaaaagcaggcctggtttacatataatgatctgtgcgtatccgagatttcggagaccaagatgcaggaggcacggcttcactccggatacatctttttctacatgcacaacgggatattcgaagagctgttgcgcaaggccgagaattctcggttgccaagcactcaggctggcgttatcccacagggcgaatatgagggtgactcactgtacaggcccgcatag

SEQ ID NO: 51828 - DNA, 786 bp, Artificial Sequence
  Description of Artificial Sequence: Synthetic coding sequence
atgagcggcgagatcgccatgtgcgagcccgagttcggcaacgacaaggcccgggagccttctgtgggaggccgctggcgagtctcgtggtatgaacggttcgtgcaaccttgtctagttgagctcctgggctctgcactgttcatcttcattggatgcctgtcagtgatcgaaaatggaaccgatacgggccttttgcaacccgcattggctcacggcctggcactcggtctggtcatcgcgaccctgggaaatatatctggtgggcacttcaacccagcagtgtccctcgccgctatgctgattgggggattgaatctcgtgatgctgttaccgtactgggtatctcagctcctaggagggatgctgggagccgcgctggctaaggcagttagccctgaggagcggttctggaatgctagcggtgcagccttcgttactgtgcaggaacagggacaagtggcgggtgcccttgttgccgaaattatactgacaacactgctggccttagccgtttgcatgggggctattaacgagaagactaaaggcccccttgccccctttagtataggcttcgccgtgacagtcgacatcttggccggcggcccggtgtcaggcggctgtatgaacccagccagagcattcggccccgccgtcgtagctaaccattggaatttccattggatctactggctcggcccattactagccgggttgctggtaggtcttctgatcagatgttttatcggagatggaaagacacggctgatcctgaaggctcggtag

SEQ ID NO: 51829 - DNA, 1332 bp, Artificial Sequence
  Description of Artificial Sequence: Synthetic coding sequence
atgagccagcgggacggcgtgtgcggcagccacgaggtggccggcgctgcgtcacccggcgcagatggtgggctctcactggctgcttactgtaagaacagcgtggacggcctctggtactgctttgatgactctgacgtgcagcaactctccgaagacgaagtctgcacccagacagcttatatactcttttaccagcgcagaactgcgatccctagttggagtgccaacagcagcgtggctggaagtacttcctcaagcctgtgtgagcattgggtctccaggctcccaggctccaaaccagcatcagttaccagtgctgcctctagccgcagaacgagccttgcgtcgcttagcgagagcgttgaaatgaccggcgagagatctgaagacgatggaggctttagcacaagaccttttgtccggtccgtgcagcgacagagtttaagcagcagatccagtgtgacaagtcccctggctgtgaatgagaactgtatgagaccaagttggagcctgtcagccaaactgcagatgaggtccaatagtccgtctcgcttctctggtgatagtccgattcattcctcggcaagcacccttgaaaagatcggtgaagcagccgatgataaagtctccatctcctgctttgggtcactcagaaacctgtcaagttcctatcaggaaccaagcgacagccatagtaggcgggaacacaaggcagtagggagagcccccctcgctgtcatggaaggtgtgtttaaagatgagagcgacacaaggcgacttaactccagcgtcgtggacacccagagtaagcatagcgcacagggggaccgactgccaccactgagtgggccttttgataacaataatcaaatagcctacgtcgaccagagcgacagcgtggacagttctcccgtcaaggaggtaaaagcccctagtcatcctggaagcctggctaagaagcccgagtccaccactaaacggagcccgagctcaaaagggacttctgagccagagaaaagcctgcggaagggccgtcccgcactagccagccaggaaagctccctgagctctaccagcccgagcagtcctcttccagtcaaagtgtctctgaaaccgagcaggtccagaagcaaggcagattcctcttcccggggctcgggtaggcatagctcacctgcccccgcccagactcaattcccttccggcgaacctggcccctcaaggggaggacaggggggtcgagaggcacgtgctgagcttctgcacggacaaccagcgctcccccagcataagcaccaggtctggttcgaagagggtcagcaggtatag

SEQ ID NO: 51830 - DNA, 10185 bp, Artificial Sequence
  Description of Artificial Sequence: Synthetic coding sequence
atgcggcggaagaacagctactacgtgtggcagatcttccagatccagttcccactgtatactgcctataagcataatacccatccaacaattgaggatatttcgacacaggagagtaacatcctgggggccttttgcgatatgaacgacgtggaagtgcccctacacctgctcagatatgtgtgcctcttttgcggaaaaaatgggctcagcttaatgaaggactgcttcgagtatgggacccccgaaactcttccctttcttatcgctcacgcattcataacagtggtgtctaatatacgtatttggctgcatattcccgctgtgatgcagcacatcatcccttttagaacttatgtgataagatacctatgtaagctgtccgaccaggagctccgccaaagtgccgctcgcaacatggccgatcttatgtggagcaccgtgaaagaacctcttgacacaacactatgtttcgataaagaaagcttagacctcgcatttaagtattttatgagccccacgctgaccatgagactggcgggcctgagccagattacaaatcaactacacacgttcaatgatgtgtgcaataacgagtctttggtaagcgatactgagaccagtattgctaaggagctggccgactggttgattagtaataatgtagtggaacacattttcggacctaacctgcacatcgaaatcattaaacagtgtcaggtgatcctgaattttctggcggccgaggggaggctgtccactcaacatatcgactgcatttgggctgccgcccagcttaagcactgctctcggtacatacatgatttgtttccttctctgattaaaaaccttgaccccgtgccgctgcggcacttactgaatctggtatctgccctcgaaccctccgtgcacacggagcagacactttatttagcatccatgttaattaaggcactgtggaacaatgccttggctgccaaagcccagctgtctaaacagtccagcttcgcttccctgttgaataccaacatccccatcgggaataagaaagaagaagaagagctccggaggacggcaccgagcccctggtccccggcagcaagccctcaaagctctgataattccgatacgcaccagagcggtggatcagacatcgaaatggacgaacaactgatcaaccgcacgaagcatgttcagcagcggctgtccgacaccgaggaatcaatgcagggttcaagtgacgagacagctaatagtggagaggacggcagttccggtcccggctcgtcgagcggacactccgatggctcgtccaacgaagtgaattcttcccacgcatctcagtcagcgggctccccaggatccgaggtgcagtctgaggacatcgccgatatcgaagctttaaaagaagaagatgaggatgatgaccacggtcataatccccctaaatctagttgcggtactgatctgagaaatagaaagttagaaagtcaagccgggatttgcctgggggactcgcagggaatgagtgagagaaatggcactagctctggcactggcaaggacctcgttttcaacacagaatcccttccgtcggtcgacaacaggatgaggatgctagacgcgtgttcacattcagaagaccccgagcacgacatttccggcgaaatgaatgcgactcacattgcccaaggatctcaagaatcctgtataaccagaaccggggacttccttggtgagacaatcggcaacgagttattcaattgcagacagtttatcgggccccagcaccatcaccatcaccaccatcaccaccaccatcacgatgggcatatggtggacgatatgttgtcagccgacgacgtttcatgctcatcctcccaagtgtctgccaaatccgagaaaaatatggccgatttcgacggcgaggaatcaggctgcgaggaagaactggtgcagattaatagccacgccgaacttacatcacatctgcagcagcatctgcctaacctggccagcatctaccatgagcacctgtcgcagggcccagtggtgcacaagcatcagttcaacagcaatgcagttacggatattaacctggataacgtctgcaaaaagggcaacaccctgctatgggatatcgtccaggacgaggatgctgtcaacctctctgaagggcttatcaacgaagctgagaaattgctgtgctcccttgtctgctggttcaccgatcgccaaatacggatgcgcttcatcgaaggctgtcttgaaaacctgggtaataatcgatccgtggtgatctccctgcgcctgctacctaaactcttcgggactttccagcagtttgggtcttcttacgacactcattggattacaatgtgggccgagaaagaattgaacatgatgaaactgttctttgataatctggtctactacatccagactgtgagagagggacgccagaaacatgctttgtattctcacagcgctgaggtgcaggttcggctccagtttctcacttgtgtgttcagcaccctgggatcacctgatcatttccggctctccctggaacaggtggatatcctgtggcattgccttgtcgaggatagcgagtgttatgacgacgcattgcactggttcctgaaccaggtgaggagcaaagaccaacatgcgatgggcatggagacctataaacacctcttcctggagaaaatgccccaactgaagcctgagaccatttcaatgacggggctgaatctgtttcagcacctatgcaatcttgcccggctagctacaagtgcctatgatggttgcagtaactcagaactgtgcggcatggaccagttctggggtatagccctgagggcacagagcggagatgtgtcaagggcagctatccagtatatcaactcttattacatcaacggcaaaacaggacttgagaaggagcaggaattcatttctaaatgtatggaatccctgatgatagcgtctagcagtctggaacaggagtctcatagttccctaatggtcattgaacgcggacttctgatgctgaaaactcatctcgaagcattccggagacggtttgcataccacctgcgacagtggcagattgagggcacagggataagcagccatctgaaggctctttccgacaagcagtccctgcccctcagggtggtctgccagcctgcagggcttcccgataagatgactatcgagatgtacccctcagatcaggttgctgacctgcgtgctgaggtaacacactggtacgagaaccttcaaaaagagcagataaaccagcaggcccagctacaggaatttgggcagtctaacagaaaaggtgagttccccggtggattgatgggacccgtccgaatgatcagtagcggccacgaattaacgacagactacgatgagaaagccctgcacgagcttggatttaaagatatgcagatggtgttcgtgtccctgggggcacctcggagagagcgcaagggagaaggagtgcaactgccagctagctgtctgccacctccacagaaggacaacattcccatgttgctcctgctgcaggaacctcacctgaccaccctgttcgacctgcttgaaatgctggcctcctttaaaccgccgagcggtaaggtcgccgtggacgactcggagtcccttcggtgtgaggagctccatctacacgctgagaatctcagtcgacgtgtttgggaacttctgatgctgcttcctacctgtcccaacatgctcatggcctttcagaatatatccgatgagcagtctaacgacggtttcaactggaaggagctgctgaagattaagagcgcacataaactgctgtatgccctcgagattatcgaggcgctgggaaagcctaaccgccgaattcggagggaatcgactggtagctacagtgatctgtaccctgactccgacgattcatctgaagatcaggtcgagaacagtaagaattcgtggtcttgcaaattcgtggcagccggcggactccagcagctacttgagatttttaattctgggatcctggaacccaaagagcaggagtcctggacggtgtggcagctagattgcctcgcctgccttttaaaactgatctgccagttcgcagtggaccctagtgatctggatctggcctaccatgacgtgttcgcctggagcggcatcgctgaatcgcaccggaagagaacatggccaggcaaaagcagaaaagcagccggcgatcacgccaaaggattacatattcctagattgaccgaggtgttcttggtcttggtgcagggcacctctttgattcagaggttaatgtcagtcgcctacacttatgataatctggcccctcgcgtgcttaaggctcagagcgaccaccgcagtagacatgaggtctcccactactccatgtggcttctggtttcatgggcacactgctgttccctggttaagagctctctcgctgattccgaccaccttcaagactggctgaagaagctgactctgttgatccccgaaacggccgtgcgtcacgagtcctgcagtgggctatacaagttgagcctgtccggactggacggaggggattcaatcaatcggagcttcctacttcttgcagcaagcacactgttgaagtttctgccagacgcacaggccctcaaacctattagaatcgacgattacgaagaagagcccattctgaagcctgggtgcaaagagtatttctggcttctgtgcaagctggtggataacattcatatcaaagacgcatcacagactacactcttggatctggacgctctggcaaggcacctggccgattgtatccggagcagagaaattctagaccatcaggacggcaacgtggaggatgacggacttacggggttgttaagattggcgacaagtgtggtcaagcataaacctccgttcaaattcagcagggaaggacaagagtttctgcgcgacatcttcaatctgctgttcttgctgcctagtcttaaagataggcaacaacccaaatgtaaatcacatagtagcagagccgcagcttacgatctcttggtagagatggttaagggctctgtagaaaactaccgactgattcataactgggttatggcccagcacatgcaatcgcacgcaccctacaagtgggactactggccccacgaagatgtgagggccgaatgtcgctttgtgggtctgacgaaccttggagctacatgttatctggcttcaaccattcagcagctgtacatgataccagaagcccgccaagcggtgtttacagccaagtattctgaagacatgaaacacaagaccactctgcttgagctccaaaaaatgttcacctacctaatggaatccgaatgcaaagcatacaatccacggccattctgcaagacctatacgatggataaacagcctctcaacacgggggagcagaaagatatgacagaattttttactgacctcatcaccaaaattgaagaaatgagcccagagctgaagaataccgtgaaaagcttatttgggggagttatcactaataatgtcgtaagtttggactgtgaacatgtttcccagacggccgaggaattttacaccgttaggtgccaagtggccgacatgaagaatatatacgagtccctggacgaggtcaccatcaaagatacccttgagggagataatatgtatacctgctcacactgtggtaagaaggtgcgagctgagaagagggcatgctttaaaaagctgccacggatattgagctttaacacgatgcgttatacatttaatatggttaccatgatgaaggaaaaagtaaacacccactttagttttcctctgagactggacatgactccttatacagaagatttccttatggggaaatcagagcgcaaagaagggttcaaggaagtgtctgatcacagtaaagattcagagtcatacgagtacgacctgatcggagtcacggtgcatacaggaactgccgatggaggtcactactactcatttattagggacattgtgaacccccacgcctataaaaacaataaatggtatctctttaatgatgctgaggttaaaccatttgattctgctcagctggcatcggagtgctttggaggagaaatgacaacaaaaacttatgatagcgttacagacaagttcatggatttctcgttcgaaaagacccactctgcttacatgctgttttacaagagaatggaacctgaagaagagaatgggcgagagtacaaattcgatgtctcctctgagttactcgagtggatctggcatgacaacatgcagtttctccaggacaaaaacatattcgagcatacctactttgggtttatgtggcagctgtgcagttgcatcccttcaaccctgcccgatccaaaagccgtcagtcttatgacggcaaaactcagtacttctttcgtgctcgaaacgtttatccactccaaagagaagcctaccatgctccagtggatcgaactcctaaccaagcaatttaacaactctcaggcggcatgcgagtggtttttggaccgaatggcagacgatgattggtggcctatgcagattcttatcaagtgtcccaatcagatcgtgagacaaatgtttcagagattgtgtatccacgtcattcagcgacttcgtcccgtgcacgcgcacctgtacctgcagcctggtatggaggatggctccgatgacatggataccagcgtcgaagacatcggcggtcggagctgtgtaacgcgctttgtgcggaccctgctgctcataatggagcatggggttaagccccactctaaacatctgaccgagtattttgcattcctctacgagttcgccaagatgggagaagaggagtcacagtttctcctctctctccaggcgatttccacaatggttcacttttacatgggcacaaagggacccgaaaatcctcaggtggaagtgttgtccgaggaggagggcgaggaggaggaagaagaggaagatatcttgagtttggccgaggaaaaatatcgtcccgcagctcttgagaaaatgattgccctcgttgccctgttggtcgaacagtctcgcagcgaaagacacctaactctttcccagacggatatggcagctctaaccggcggaaagggcttccccttcttgtttcagcacatccgggacggcatcaatataagacagacgtgcaatttgatctttagtctctgccgttacaataatcgattagccgaacatatcgtgagtatgctctttacctccatcgccaaactgacacccgaagcagccaatcctttctttaagctcctcacaatgttgatggagtttgctggggggccgccagggatgccaccgtttgcaagctatatcttacagcggatttgggaggtgatcgagtacaatccaagtcagtgcttggactggttggcagtccagaccccaagaaataagctggcccactcatgggttctgcagaacatggagaactgggttgagagatttctgctggcacacaactacccccgggttaggacatccgcagcctacctgctggtgagtctgattccctcgaacagtttccgccagatgttccggtccacaaggtccctccacatcccaacccgggatttgcctttatcccccgacaccactgtggtattgcatcaagtgtataatgtcctactggggttgctgagcagggcaaagctttatgtcgatgcagcagtccacggcactaccaaacttgtcccatacttctcctttatgacttactgcctaatatccaagaccgaaaagctcatgttcagcacttacttcatggatctatggaacctgttccaacccaaactctcagagcccgccattgccaccaatcataacaagcaggcactgttgagtttttggtacaatgtgtgcgcagattgtccagagaacattaggctgattgtgcagaatccagtcgttaccaagaatattgccttcaattatatactcgccgaccatgatgaccaagatgtggtcttatttaacagaggaatgctgcccgcttattacggaatccttaggctgtgctgtgaacaaagccccgcattcactaggcagcttgcaagccaccagaatattcaatgggcctttaagaatctaacccctcatgcctcacagtacccgggggcggtggaggagctctttaatctgatgcagctgtttatcgcacagaggcctgacatgagggaggaagagctcgaggacattaaacagtttaagaagacaaccatttcctgttatcttaggtgcctggacggacggtcctgttggaccacgctaataagcgccttcagaattctgctcgagagcgacgaagatcgcttactggtggtgttcaatcgtggtctcatactgatgacggagtcctttaacaccctgcatatgatgtaccacgaggccaccgcctgccacgtcaccggggatttggtggaattactcagtatattcctatctgttctgaaatccacaaggccatatctgcagagaaaggatgtgaagcaggctctgattcaatggcaggagcgcatcgaattcgctcacaagctgcttacactgctgaattcatattcaccgcctgagttgcggaatgcctgcattgacgtactaaaagaactggtcctgctgagccctcatgatttcttacacaccctcgtcccattcctgcaacacaaccattgcacttaccaccattctaacattcccatgagcttaggaccatatttcccctgtagagaaaacattaaactcattggaggcaagagtaatatcagaccaccgcggcccgagctgaatatgtgtctgctgccaacgatggttgaaactagtaaaggcaaagatgacgtctatgatcggatgctgctcgactatttcttttcataccaccagtttatacatttgctgtgccgagttgctataaactgcgaaaaatttacagaaacgcttgtcaaacttagtgtgctggtggcttacgaaggcctaccgctacatcttgccttattcccaaaattgtggaccgaactgtgccagactcaaagcgctatgtcaaagaattgtattaagttgttgtgcgaggaccccgtcttcgccgaatacatcaagtgtattctgatggatgagcgcactttccttaacaacaatatagtgtataccttcatgacacactttctactgaaggttcagagtcaagtgttcagcgaagcaaactgcgctaatttaatcagcactctgatcacaaatttgataagtcagtaccagaacctccagtccgacttcagtaatcgagtggagatttcaaaggcttccgcatcccttaatggcgaccttcgcgccctcgccctactgctgtctgtacacacgccaaagcagctgaacccagctcttatccccaccctgcaagaattgttgtcaaagtgccgcacctgccttcagcaacggaactctttgcaagagcaggaagctaaggagaggaagacaaaggacgatgagggcgccaccccaattaagcggaggcgagtgagcagtgacgaagaacacaccgtcgattcttgcatctctgatatgaaaaccgaaacacgggaggtgttgacacctacctccacatccgataacgagacacgcgatagtagcatcatcgatcctggtacagagcaggacttgccttctcccgaaaattcgtccgtgaaggagtatagaatggaggtgccttcgagttttagtgaggacatgtctaacatacggtcacagcatgccgaagagcaatccaataatggaaggtatgacgactgcaaggagtttaaggatctccattgctctaaagatagtaccctggcagaagaagagagcgaatttccgtcaacgagcatctcagcagtgctaagtgacctggccgacctgcggtcctgtgatggacaggcattaccttcacaggatcccgaagtggcactgagtttgagctgtgggcactcgaggggattatttagccacatgcagcaacacgatattctagatacattgtgccgaacaatcgaaagcacaatacacgtggtgactcgcatctcagggaagggaaatcaggctgccagctag

SEQ ID NO: 51831 - DNA, 9936 bp, Artificial Sequence
  Description of Artificial Sequence: Synthetic coding sequence
atgcggcggaagaacagctactacgtgtggcagatcttccagatccagttccccttatatactgcttacaaacataatactcatcctaccatcgaagacattagcacacaggagagcaacattcttggcgccttttgcgacatgaatgatgttgaagtcccgctgcatctacttcgctacgtatgtttattctgtggaaagaatggcctctcactcatgaaggactgcttcgaatacggcaccccagagacactcccttttctcattgcccacgcttttattacagtggtatccaatatacgcatttggttacatatcccggcggtcatgcaacatatcatccccttccggacgtatgtgattcggtacttgtgtaagttgtcagaccaggagcttagacaatccgccgcacgcaatatggccgacctaatgtggtccactgtgaaagagccactcgatacaactctatgttttgacaaggagtcactggatttagccttcaagtactttatgtcacccactctcactatgcgactggccgggctctcccaaatcactaatcagctgcacacattcaacgacgtttgtaataatgagtctctcgtgagtgacaccgagacatctatcgccaaagagctggccgactggctgatctcgaacaacgtggtcgaacacatcttcggtcctaatttgcacatcgagatcattaagcagtgccaggttatactcaacttcctggccgccgaaggccggttgtctacacagcatattgactgtatctgggccgccgcgcagcttaagcactgctcccgctatatccatgatctatttccttccctgatcaagaacttagatccagttcctctccgtcacctgctcaacctcgtcagcgcactcgaaccctctgtccacaccgagcaaaccttgtacctggcctcaatgctgattaaggcgctctggaataatgccctggccgccaaagctcaactgtcaaaacaaagcagcttcgcctctctcttaaacaccaacattcccatcggtaacaaaaaggaggaggaagagctgcggagaacagctccctccccatggagccccgccgctagccctcagagttcggataattccgatacccaccagagcggcggttctgacatcgagatggatgagcagctgataaaccggaccaaacatgtgcaacaacgcctctctgataccgaagaatctatgcaaggctcttctgatgaaactgccaacagcggggaagacggctcatcaggtcccggtagctcaagcggacactcagacgggtcaagtaacgaggtgaactcaagtcatgccagccaaagtgccggatcccctggctcggaggtccaaagcgaggacattgccgacattgaggctctaaaggaggaagacgaggatgatgatcatggacacaacccccccaagtcctcctgtggaactgacttacggaataggaagctagagtcccaggcaggtatctgcctgggggacagtcagggcatgtccgaacgcaacggaacatccagcggcactggtaaagacctcgtttttaatacggagtctctgccctctgtggataacagaatgagaatgttagatgcatgctcgcacagcgaagacccggagcacgatatcagtggggaaatgaatgctactcacatagcccaaggcagccaagagagctgcataacaagaacgggggacttcttgggcgagactatagggaatgaactgtttaactgtaggcagtttattgggccccagcaccatcaccaccatcatcatcaccaccatcaccatgacgggcacatggttgatgatatgttaagtgctgatgatgtatcatgttcctctagccaggtcagtgccaaatcagagaaaaacatggctgattttgacggcgaggaaagcggctgtgaggaagagttagtgcagataaacagccatgcagagctgactagtcacctgcaacagcacctgccaaacttggctagcatctaccatgagcacctctctcagggcccagtcgtccataagcaccaatttaactccaatgccgtgacagacattaacctagataatgtctgtaagaagggcaataccctcttgtgggacattgtacaggacgaggacgctgtgaatctcagcgaggggttgataaatgaggctgagaagcttttgtgttccttagtctgctggttcacagacagacagatcaggatgcgttttatcgaggggtgcctggagaacctgggcaacaatagaagtgtggttatatccctgcgcctcctccccaagttgtttggaacattccagcaattcggctcttcgtatgatacccattggatcaccatgtgggccgaaaaggaattgaatatgatgaaactgtttttcgataaccttgtatattatatccagaccgtcagggaaggccgccagaagcacgctctgtattcacatagcgccgaggtccaagtgcgcctgcagttcctgacctgcgtattcagcacactgggaagccccgaccattttaggctgtccctggaacaagtcgacatcctctggcactgtctcgtggaagactccgaatgctatgatgatgctctgcattggtttttaaaccaagtgagatccaaggatcaacacgcaatggggatggagacatataagcacctttttttagagaaaatgcctcagctcaaacctgagacaatcagcatgactgggttaaacctcttccagcacctatgcaatctggcccgcttggccaccagtgcctatgatggctgtagcaacagtgaactgtgtggcatggatcagttctggggcatcgcgttgagggcccagtccggtgatgtgagtcgcgcagccatccagtatataaattcctactatattaacgggaagactgggcttgaaaaagagcaggagtttatctctaagtgtatggaatctctgatgatcgcttcttcctctctggagcaggagtcccacagctcactaatggttatagagcgcggcctgctaatgctaaagacccatttagaagccttccggagacgttttgcttaccacctgaggcagtggcagatcgagggtactgggatcagctctcacctgaaagcgctctccgataagcagtctctgccacttcgagtcgtgtgccagcctgcagggcttccagacaagatgactatcgaaatgtatccctcagatcaagtggcagacctgagagcagaagtcacacactggtacgaaaatcttcaaaaggagcagattaatcagcaagcacagcttcaggaattcgggcagtccaatagaaaaggagagtttcccggagggttgatgggtcccgtaaggatgatatccagtggacacgaactgacaaccgactacgacgagaaagctcttcatgaattgggattcaaagatatgcagatggtgtttgtttcactgggtgccccaaggagggaaaggaaaggggagggagtgcaactccccgccagctgcctgccccccccccagaaggacaatattcccatgttactgctgctacaggagcctcatctgactactctgttcgatttactcgagatgctggcaagcttcaagcccccttccggcaaggtggcagtggatgatagcgaatccttgaggtgcgaggaactgcacttacatgctgaaaacctctcacgaagggtctgggagttgctcatgctgctccccacctgccccaatatgctgatggccttccagaacatctctgacgagcaaagcaacgacggctttaattggaaggaacttctaaagataaagtcagcccataagctactctacgcacttgagattatcgaagcactgggaaaacctaatcgtcggatacggcgcgaaagtacaggatcttattctgacctgtaccctgacagcgacgattcgagcgaggatcaggttgagaacagcaagaacagttggagttgtaaattcgtcgccgccggcggcctgcagcaactcttggaaattttcaatagtggcatccttgagcctaaagaacaggaatcatggactgtgtggcagttagattgcctggcgtgcctgctcaagctgatatgtcagtttgcagtcgacccatcggacttagaccttgcctatcacgacgtattcgcatggtctggcattgcagagagccaccgtaagaggacttggcccgggaagtctcggaaggccgccggggatcacgccaaggggctccacatcccccgcttaacagaggtttttctggtcctggtgcaggggacctccctgatacagagacttatgagcgttgcgtacacttacgacaacttagctcctcgggtactgaaagcccagtctgatcataggtctcgccatgaagtgtcccattacagtatgtggttattggttagctgggcccactgttgcagtctggtcaaatcctctctagccgactccgatcatctccaggattggctcaagaagctgactcttcttattcccgagacagcggtcagacatgagtcttgcagcggcctctacaaactctccctttcaggattagacggtggagactccattaatcgaagctttctccttctggcggcttcaacattactgaagtttttacctgatgcccaggcattaaaacccatcagaatagacgactacgaagaagaacctatactgaagccagggtgtaaagagtacttttggctgctgtgcaagctcgtggataatatccacatcaaagacgccagccagacaaccttgctagatctcgacgccttagcccggcaccttgctgactgcatcagaagtagagagattttggatcaccaggacgggaacgttgaggacgacggcttgacaggcctcttaagactcgctacttccgtcgtcaaacacaaaccaccgtttaagttctccagagaaggtcaggaatttcttagagatatcttcaacttactattcctcttgccctcactcaaggacaggcaacaaccaaaatgcaaatcacacagctctcgggccgccgcctatgacctgctggtggagatggtaaagggctccgtcgagaactataggctaatccataactgggttatggcacaacacatgcagtcccacgcaccatacaaatgggattactggccacacgaggatgtgcgcgctgagtgccggttcgtcggcctcacaaacctgggggccacctgttatctcgcctccaccattcaacaactgtacatgattccagaagcaagacaggcagtgttcactgccaaatacagcgaagatatgaagcacaaaacaaccctgctggaactgcagaagatgtttacatacctcatggaatctgagtgcaaagcgtataatcccagacccttctgtaagacatatacgatggacaaacagccactgaatacgggtgagcagaaggatatgaccgagttcttcacagatctgatcacgaagatcgaagaaatgagtcctgagctgaagaatactgtgaaatcacttttcgggggtgtgataactaataacgtcgttagcctggactgtgaacacgtatcacagaccgccgaagagttttacaccgtcaggtgccaggtggccgacatgaagaatatctacgaatctcttgacgaggtgaccataaaggatacccttgagggtgacaacatgtacacatgcagccactgtgggaagaaagtgagagccgaaaaaagagcatgtttcaaaaagttaccaagaatcctgtcattcaacactatgaggtatacttttaatatggtgacaatgatgaaagaaaaggtaaatactcacttttcatttcctctgcgtctagatatgaccccctatacggaagactttctgatggggaagtcagagaggaaagaaggatttaaagaagtgagtgatcactctaaagattccgagtcctacgagtatgatcttataggtgttactgtgcatacaggaaccgccgacggaggccactactacagctttatcagagatatcgttaatccccatgcctacaaaaacaacaaatggtacctgtttaacgacgcagaagttaagccctttgactcagcccaacttgcctccgagtgcttcggcggtgagatgacaacaaagacttatgatagcgtcaccgacaaattcatggacttctcctttgaaaaaacccacagtgcctacatgttgttctataagagaatggagcccgaagaagagaacgggagggagtataaatttgacgtgtcttccgagctcctagaatggatctggcacgacaacatgcagttcttgcaggataaaaacattttcgagcacacttactttgggttcatgtggcagctgtgctcttgtatccctagcacactgcctgatcccaaggcggtgtctcttatgaccgctaaactgtcaaccagtttcgtactagaaacattcattcattcaaaggagaaaccgactatgctacagtggatcgaactgctcaccaagcaattcaataactcccaggcagcttgcgagtggttcctcgataggatggccgacgatgattggtggcctatgcagatcctcattaagtgtcccaaccagattgtgcgtcaaatgttccaacggctatgcatccacgtaattcagaggctgcgaccggtgcatgcccatctctatctgcagcctggcatggaagatggcagtgacgacatggacacctccgtggaagacatagggggcagatcttgtgtgactcgctttgtgaggacactcctactcattatggagcacggtgtcaaaccgcattccaaacatctcacagagtacttcgcgttcctctacgaatttgccaaaatgggggaggaggaaagccagtttcttttatcccttcaggccatcagcacaatggtccacttttatatggggaccaaaggaccagagaacccacaggtggaagtgctcagcgaggaggagggcgaagaggaggaagaagaagaagacatcctgtccctcgctgaggagaagtatcgtcctgcagctttagaaaagatgattgctctggtcgcacttttagttgagcaatctaggtccgaaaggcaccttactctgagccagacagacatggccgcgctcacgggaggaaaaggcttccccttcctcttccagcacattagagacgggatcaacatacgccaaacttgcaatcttatcttctcactgtgccgctacaacaatagacttgccgaacacattgtctccatgctgtttacctccattgccaagctgacgcctgaggccgctaaccctttctttaaacttctgactatgctaatggaattcgcaggaggtccgccgggcatgcccccttttgcgagctacatcctccagcggatctgggaggttatcgagtacaatccctcgcaatgtttagactggctcgctgtccagaccccacgcaataagctggctcacagctgggtactgcagaatatggaaaattgggttgaacggtttctattagctcacaactatccgcgcgtgaggaccagcgcagcttatctgcttgtgagcctcatcccttcaaactccttccgccagatgttccggtcgactagatcattgcacatcccgacacgagacctcccactttcccccgatacaaccgtggtcctgcaccaggtttacaatgtgcttctcggtctgctgagtcgggcgaaactctatgttgatgctgcagtgcacggcaccaccaagctggtaccttacttttcctttatgacatactgcctgatttccaaaaccgagaagcttatgttctccacttactttatggatctctggaatctgtttcagcctaaactgtcagagcccgcgatagccaccaatcataacaaacaagccttattgagtttttggtacaacgtgtgcgccgattgccccgaaaatattaggctgatcgttcagaatccagtcgtcacgaagaatatagcgttcaactatatactggccgatcatgatgatcaggatgtcgttctctttaaccggggcatgttgcccgcctactatgggattcttaggttgtgctgcgagcagtcaccagcgtttacgagacagttggctagccaccagaacatccagtgggcctttaaaaatctgacccctcacgcaagccaatatcctggagcggtggaggagctgtttaacctgatgcagcttttcatcgcgcaaagaccggacatgcgggaggaagagctggaagatataaagcaattcaagaaaaccacgatttcctgctatctaagatgccaggcacttatacaatggcaggagcgaatcgagtttgctcataaactcttgactctgctgaattcctatagtccccccgagctccggaatgcttgtatcgatgttttgaaggaacttgtcctgctgtcgccgcacgactttctgcacacccttgtcccttttctgcagcataaccactgcacatatcatcacagcaatataccaatgagcttagggccctactttccttgtcgggaaaatatcaagctgatcggaggcaagagtaatatcagaccacctaggccagagcttaacatgtgcctgctgccgacaatggtggaaaccagcaaaggaaaagatgatgtctatgaccgcatgctgctcgattatttcttctcctaccaccagtttatccatctgctgtgtagggttgcaattaattgtgaaaagttcaccgaaacattggtaaaattaagtgttttggtagcctacgagggtctccctctccacctggccctgtttcctaaactgtggactgagctttgtcaaacacagtccgccatgtctaaaaactgcataaaactgctgtgtgaggatcccgtgttcgctgaatacattaaatgtattctcatggacgagagaacctttctgaacaataacattgtgtacacttttatgacgcactttctactcaaggtacagtcacaggtcttctctgaagctaactgtgcaaatctgataagtaccctgatcacaaatctcattagccagtaccaaaaccttcagtccgatttctcaaatagggtcgaaatcagcaaagcatccgccagcttaaatggagacctgcgcgctttggctctcctgctctccgtgcatacacctaaacagcttaatcccgcgttgatccctactttgcaagagctgctgtcaaagtgcagaacatgtctccaacagcggaatagtctgcaggagcaggaggccaaagagcgcaagaccaaggacgacgaaggggctactccaattaagagaagacgggtttcaagtgatgaggaacatactgtcgactcctgtattagcgatatgaaaactgagacaagagaggtgcttacacccacttcaacatccgacaacgagaccagggacagctctatcattgatcctgggaccgaacaggatttaccaagcccagaaaattcttcggtgaaggagtatagaatggaggtaccctcatccttctctgaggatatgtccaacatcaggagccagcacgccgaagagcagagtaacaacggccggtatgacgactgcaaggagttcaaagaccttcattgcagcaaggattcaactttggcagaggaggaaagcgagtttccttcaacttccatctctgcagttctttcagacttggccgacctgaggagctgcgacgggcaggctctgcctagccaggatcccgaagtcgcactgtctttgtcgtgcgggcatagcagaggacttttttcccatatgcagcagcatgacatcctggataccctatgcaggactatagagtcaaccatccacgttgtcactcgcatttccggtaaaggcaaccaggcggccagctag

SEQ ID NO: 51832 - DNA, 10641 bp, Artificial Sequence
  Description of Artificial Sequence: Synthetic coding sequence
atgtgcgagaactgcgccgacctggtggaggtgctgaacgagatctcggacgtagagggaggggatggtctccagctccgtaaagagcacaccctaaaaatcttcacttatatcaattcatggacccagcggcagtgcctgtgctgttttaaagagtataaacatctggaaatcttcaaccaggtggtttgcgcccttattaatctcgtcattgcacaggtccaggtgttgcgggatcagctgtgtaagcattgcaccacaatcaacattgacagcacctggcaggatgaatcaaaccaagctgaggaaccactaaatatcgaccgcgagtgcaacgagggctctacagagcgccaaaagtccatcgaaaaaaagtctaactctacccggatctgtaacctcacggaggaggaatcatctaaatccagtgaccccttctctctgtggtccaccgatgaaaaggaaaagctgctgctttgcgttgcaaaaattttccaaatacagtttcctctgtataccgcatacaagcacaacacccacccaaccattgaagatattagcacccaggagagcaatatcctaggcgcgttttgcgacatgaatgatgtggaggtccctcttcacctgctcaggtacgtttgcctgttttgcggcaaaaacggcttgagcctgatgaaggattgctttgagtatggaacccctgaaactctcccctttctgatcgcgcacgcctttatcacagtcgtgtctaatatccgtatctggcttcacattcccgccgtgatgcagcatattatcccctttcgaacgtatgtgatccggtacctgtgtaaactgtcagatcaggaacttagacagtccgcagcgagaaacatggcagatctaatgtggagcaccgtgaaggaacctctggatactaccttatgcttcgataaagagagtcttgatctggcatttaaatatttcatgagcccaactcttacaatgagactcgcagggctcagccaaattactaaccagctgcatacctttaacgacgtctgtaataatgagagcttggtcagcgatacagaaacctcaatagccaaggaactagccgactggctgatttccaataacgttgttgagcacatctttgggcctaacctgcacatagagattattaagcagtgtcaggtcatccttaatttcctagccgctgaaggaagattgtcaacgcagcatattgactgcatttgggccgctgcgcagctcaagcactgctccaggtatattcacgatcttttcccatccttaatcaagaatctcgatccagttccattaaggcatctgctgaatctcgtctccgcgttagagccatctgttcatacagagcagaccctttatctggccagtatgctcatcaaggccctgtggaataacgccttggctgccaaagcgcagctgagtaagcagagttccttcgctagcctgctgaatacgaacatcccgatcggcaacaaaaaggaggaggaggaactgaggaggaccgcgcctagcccctggtcgccagcagcttcaccccagtctagcgacaactctgacacacatcagtctggcggttctgacatcgaaatggatgagcagctgatcaatagaacaaaacatgtacagcagaggctgtctgacaccgaagaatccatgcagggatcaagcgatgaaaccgctaacagtggagaagacgggtcgagcggaccgggcagctccagtggtcattccgatggctccagcaacgaggtaaacagcagtcacgcttcgcagtcagccggttcccctggtagcgaagtacaatccgaggatattgcggatattgaagctctgaaggaagaagacgaggacgacgatcacggacataaccccccaaagtcctcatgcggtacggatctgagaaatcgcaaacttgagtctcaggcaggcatatgcctgggcgacagtcaaggtatgagcgaaaggaacgggacatcatctggtactggcaaggacctggtgttcaacacagagtccctcccatcagtggataatcggatgcgcatgttggacgcctgttctcactccgaagatcccgaacacgatatttctggggaaatgaatgctacacatatcgcacaggggtcgcaggagtcatgcataactcgcaccggggactttcttggcgaaactattggtaacgaactgttcaactgcagacagttcattgggccccagcaccaccatcaccatcatcaccaccaccaccatcatgacggccatatggttgacgatatgctctcagctgacgatgtgagttgttcctcaagccaggtcagtgccaaaagcgagaaaaatatggctgattttgacggcgaggaaagtggatgtgaggaggaactcgtccagataaactcccatgccgagcttacttctcacctccagcagcatctgcccaacctggcgtcaatttaccacgagcacctgagtcagggcccggtagtacacaagcatcagttcaactccaacgccgttactgatatcaatctggataacgtgtgtaagaagggcaacacgctgctctgggacattgtgcaggatgaagatgctgtcaatttatccgaaggactaattaacgaggctgagaagctactctgtagcttggtgtgttggttcacggatcgccagatccgcatgagattcatcgagggttgcctggaaaatctcggcaataatcgttccgtggtgatcagcctgcgcctgctgcccaagctcttcggaacgtttcagcagttcggatcgagttatgatacccattggataaccatgtgggctgaaaaagagttgaatatgatgaagctgttcttcgacaacctggtttactacattcagaccgtaagggaggggcggcagaagcacgctctatattcccactccgcagaggtgcaggtgagactacagttcctgacttgcgtattttctactctcggaagcccagatcacttccgactgtcacttgagcaggtagacattctgtggcattgcctggtcgaggacagcgagtgctacgacgatgcgctgcattggtttctgaatcaagtgcggagcaaggaccagcatgccatggggatggagacctacaagcacctgtttctggagaagatgccccagctgaagccggagacgatcagtatgacaggtctgaacctgttccagcacctgtgcaatctggcaaggctggcgacatcagcatacgacggatgttctaacagcgagctttgtggtatggaccagttctggggaattgccctcagagcccaaagtggggacgtaagccgtgctgcgattcagtatatcaactcctattacatcaatggaaagacaggactcgaaaaagagcaagaattcatctcaaaatgtatggagtctttgatgatcgcttcatccagtcttgagcaagagagccactcgtcgctcatggtaattgagcgcggcctcctgatgctgaaaactcacctcgaggccttccgcagaagattcgcctatcaccttaggcagtggcagattgagggcactggaatttccagtcatctgaaagcactctcagacaagcagagcctccccttgagagtcgtgtgtcaaccagccggcctccctgacaaaatgactattgagatgtatccatccgatcaggttgctgacttaagggctgaggtcacccactggtacgagaacttacagaaggaacaaatcaaccagcaggcccagctccaagagtttgggcaatcgaataggaagggcgaatttccagggggcctgatgggaccagtgagaatgatttcttccggtcacgagctcaccaccgactatgatgagaaggctctgcacgaactgggcttcaaggatatgcaaatggtctttgtgtcattaggagctccacgacgggaaaggaaaggagagggcgtacaattgcctgcgtcttgtctgcccccccctcaaaaggataacatccccatgctgctgctgcttcaggagccacacctcaccaccctgtttgacttactggaaatgttggcctcctttaaacctcctagtgggaaggtggccgtggatgattctgagtctctccggtgcgaagagctacatttgcacgccgaaaacctttcccgtagagtgtgggagttacttatgctgctcccaacatgccctaacatgttgatggccttccagaacattagcgatgagcagagcaacgatggattcaactggaaggagttgctgaaaataaagtcagcccataagttattgtacgcactggagatcatcgaagcgctgggaaaaccaaatcggcggatccgacgcgagtctacaggctcttattcggacttgtatccagatagtgatgacagttcagaggaccaggtcgagaattcgaagaattcttggtcgtgtaaatttgtcgcagcaggaggactccagcagttgctagaaattttcaatagcggtattcttgaaccgaaagaacaggagtcatggactgtctggcagctggattgtctagcctgccttcttaagctgatctgtcagtttgcagtggacccctccgatttggacctcgcttatcacgacgtattcgcttggtcagggatcgcagaatcacacaggaagagaacatggccaggcaagagtagaaaagctgccggtgaccacgctaaaggcctgcatattcctaggctcaccgaggtttttctggtgctggtacaaggaacatccctgattcagcgcttaatgtcggttgcgtacacatacgacaacctcgcacccagggttctaaaggcacagagcgaccacaggtcacgtcatgaggtgtcgcactattccatgtggttactggtctcctgggcacactgctgttccctcgtgaagagttccctggccgatagcgatcacctccaggattggctcaaaaagcttacattgctgatcccagagactgcggtgagacacgaaagttgctctggactctacaaactgtccctgtcagggttggacggcggcgattccatcaaccgctcattcctgttactggctgcctcaaccctgcttaagttcttgccagatgctcaagcccttaagcccatcaggattgatgactacgaggaggaaccaatcctgaaacccggatgtaaagagtacttctggttactgtgcaagttggtggacaatatccacatcaaagacgcctcacagaccaccctccttgatctcgacgctctcgctcgccaccttgccgactgtatcaggtccagggagattcttgaccatcaggacggcaacgttgaggatgatggcctaacaggactgctgcggctggctacatcagtggtgaaacacaaacccccttttaagttctcccgagaaggtcaggagttcttgcgggacatttttaacctcctgtttctcttaccgtctttaaaggataggcaacagcccaagtgcaagtcacatagttcaagagcagccgcttacgatctgctggtggagatggtgaagggaagcgttgaaaattatagacttatacacaattgggtgatggctcagcatatgcagtcgcacgccccatataaatgggattactggccccatgaggacgtgcgggcagagtgccggtttgtcgggctcacaaacctcggggctacgtgctacctagcttccactatacagcagctgtatatgattccagaggctaggcaggccgtatttacggccaaatattcagaagacatgaagcataaaaccacgttactagagttacagaaaatgttcacgtacttgatggaatctgagtgcaaagcttataatccccgacctttctgcaagacttatactatggataagcagccccttaacactggtgaacagaaggacatgaccgagtttttcaccgatctgatcactaaaatcgaagagatgtctcccgagcttaagaataccgtgaaaagtcttttcggaggagtcatcacaaacaatgtggtatctttggactgcgaacacgtgtctcaaacggctgaggagttttatacggtgagatgccaagttgcggacatgaaaaacatctacgagtcactggacgaagttaccatcaaggacactctggagggagataatatgtatacgtgttctcactgcggcaaaaaggttcgcgcagaaaaacgtgcctgttttaaaaaactcccaagaatattgtcattcaatactatgcggtatactttcaatatggttacgatgatgaaggaaaaggtgaatacacacttttcttttcctctgagactggacatgacaccttataccgaggattttctcatgggtaaaagtgaacgaaaggaagggttcaaggaggtgtccgatcatagtaaagattcggaaagctacgaatatgacctgattggcgtaactgtgcacaccgggacggccgacgggggccactattactcctttatccgcgatatagtgaatccccacgcatacaagaataacaagtggtacctgttcaacgatgctgaggtcaaacctttcgattctgctcagctggcctccgagtgtttcggcggagaaatgacaacaaagacttacgactccgtcacagacaagttcatggacttctctttcgagaaaacacatagcgcttacatgctcttttacaagcgcatggaaccagaagaagaaaacgggcgggaatataaattcgatgtgagtagtgagctccttgagtggatttggcacgacaatatgcaattcctccaggacaagaacatatttgagcatacttacttcgggtttatgtggcagctctgtagttgtattccctcaacacttcctgaccctaaggccgtgtcgctgatgaccgcgaaactctcgacttcatttgtactcgaaacgttcatccattcgaaagagaagccaacgatgttgcagtggattgagcttctgacaaagcaatttaataatagtcaggcagcctgcgagtggttccttgacagaatggctgatgatgactggtggccaatgcaaatcttgattaaatgtcccaaccagatcgttagacagatgtttcagagactgtgcatacatgtgattcagcggctgcgtccagtccacgcacacctttatctgcaacccggcatggaggatggcagcgatgatatggacacatcagtggaggacatcggaggcagatcgtgtgtgacgaggttcgtaaggaccctcttactaatcatggaacatggcgtcaaaccacactctaagcacctaaccgaatatttcgcgttcttatatgaattcgccaagatgggcgaggaagagagccagtttctactctccctgcaagctatctcgacaatggttcatttttacatgggcactaagggacctgaaaacccgcaggtggaagttctgtctgaagaagaaggagaggaagaagaagaagaggaagatatcctgagcctagccgaggagaagtatcgcccagctgccctggagaaaatgattgctctggtggctctgttggttgaacagagtagatccgagagacatctgactctctcacaaaccgatatggcggccctgaccgggggcaagggctttcccttcctgtttcaacacattcgtgatgggatcaacatacgacagacctgtaatttaatcttctccctctgccgctataacaaccgtctcgctgagcatatagtgagcatgctgttcaccagtattgccaagctaacaccagaagctgctaacccttttttcaagctcctgactatgctgatggaattcgccggggggcccccgggaatgcctccatttgcctcatatattctgcagcgtatctgggaagtcatcgaatacaacccttcgcagtgcctcgactggctggccgtgcagactccgaggaacaagctcgcccactcctgggtcctgcagaatatggagaactgggtggaaagatttttgcttgcacacaactatcctagggttagaacatccgctgcttacctcctggtctcactgatcccatcaaactccttcaggcagatgttcagaagcacacggtcccttcacatacccactagggacttgcccttgtcaccagatacgacagtcgtacttcaccaggtgtataacgtgctgctcgggctgttgtcacgcgccaagttgtacgtagacgctgcagtccacggaaccaccaaacttgtcccctactttagtttcatgacttattgcctaataagtaagactgagaagctgatgttcagcacatactttatggatctgtggaacctgttccagcctaagctcagcgagccagccatcgccaccaatcacaacaaacaggccctgctttctttttggtataatgtgtgcgccgattgccctgagaacatcagattaatagttcaaaaccccgtggttaccaaaaacatcgccttcaattacattctggcagaccacgacgaccaagacgtcgtgctcttcaacaggggtatgctgcctgcatattacggcatcctacggttatgctgtgaacaatcccccgctttcactagacaactcgcgtcgcaccagaacattcaatgggccttcaaaaatctgactccccacgcttctcagtatcccggggctgtcgaggagttgttcaaccttatgcagttattcatagcccagagacctgacatgcgcgaggaggaattggaagacatcaagcaattcaaaaagaccaccattagctgctaccttcgctgcctcgacggaagatcctgctggacgacactcatttccgcctttcgcattctattggaatcagatgaggaccgtttgctcgtggtgtttaataggggattgatcttaatgaccgagtccttcaacacactccacatgatgtatcatgaggccactgcatgccatgtcaccggtgacctcgtcgaactgctgagtatctttctctcggtattaaagtctacaaggccatatctgcagaggaaggacgttaaacaggctctgatccagtggcaagagagaatcgaattcgcccacaagctcctgacattgctgaatagttactcaccacccgagttgcgaaacgcttgtattgatgtgttaaaggagctcgttcttttgtcacctcatgacttcttgcacacattagtaccctttctgcaacataatcactgcacgtatcaccacagtaatatccccatgtctctgggcccgtactttccttgtcgggagaatattaaactcattggcggcaagtctaatattcgtccccccaggccggagctgaatatgtgccttctgcctacaatggtagagactagtaagggcaaagacgatgtatatgaccgtatgttactcgattatttcttttcatatcaccagtttatacaccttctatgcagggtcgctataaactgcgagaagtttacggaaacccttgttaaactttctgtgctcgtcgcttatgagggtctccctctgcatcttgctttgtttcctaagctctggaccgaactgtgccagacccagtctgcaatgtctaagaactgtatcaagctgttatgtgaggaccccgtatttgccgaatacatcaagtgcatactcatggacgagcgcacttttctaaataacaacatcgtatatacatttatgacccactttctccttaaggtacaatcccaagtcttctccgaagcaaactgcgccaatctcatcagcaccctgattaccaacttgattagtcagtaccagaacctccagtccgatttctcgaatcgcgttgaaatctctaaggcgagtgccagcctgaacggcgacctgagggcccttgccctgcttctgtcagtgcataccccaaagcagttgaatcccgccctaattcctaccctgcaggagctgctgtctaagtgccgaacctgcctgcaacagagaaactcactccaagaacaggaggccaaggaaagaaaaacaaaagacgatgagggtgctacccccattaagaggcggagggtctcttcagatgaagagcacaccgtggacagctgtatttctgacatgaagacagaaacacgcgaagttctgacccctactagcacgtctgataatgagaccagagactcaagcatcattgacccaggaaccgagcaggatctaccctcccccgaaaatagcagcgtcaaagaatatcggatggaggtcccaagctcttttagtgaggacatgtctaacatacgctcacaacacgccgaggagcagagcaacaatggcagatacgacgactgtaaagagttcaaggaccttcactgttcaaaggacagcactcttgcagaggaggaatcagagttcccatctactagcatcagcgccgtattgtccgacctagctgacctgcggagctgtgatggccaggctctcccttcacaggatcctgaggtcgcgcttagcctttcctgtgggcattctagagggttgttttctcatatgcagcagcacgacatccttgataccttatgtagaacgattgaatctaccattcacgttgtgacccgaattagcggcaaaggcaaccaggccgcatcttag

SEQ ID NO: 51833 - DNA, 1815 bp, Artificial Sequence
  Description of Artificial Sequence: Synthetic coding sequence
atgcccggcctgcggcggcgggccagctggcgggtgagcatccccggctcctggcctagccagacccgggcccgcctcgtttcttcaacgtgggctacacatgctatgtccactgccagcttcagaccctatagctggagactttcaagctttcggcattgtgtactccggctgaccgaaaacaactcacagcccctcatgaccaaattgcagtggctgttcggatttctcgagcattcccagagacctgcaatctctccagaaaattttttatccgcttcctggactccctggttttctccaggtacccagcaagattgcagcgagtatctgaagtatctgttagatcggctgcacgaagaggaaaagactggtaccaggatatgtcagaagctgaaacaaagcagctcccccagtccccctgaagagccccctgcaccatcgagcacctccgtggagaaaatgtttggaggcaaaatagtaacccgcatttgttgtctttgttgcttgaacgtatcctcccgtgaggaagcttttacggatctatccttagcctttccacctccagagcgatgccggcggcggagacttggatctgtcatgcgtccgacagaggatattactgccagagagctgccacccccaaccagtgcccaggggcctggaagagtgggacccaggagacagcgcaaacattgcattactgaggatacaccacccacaagcctgtacattgaggggctcgatagtaaagaagccggggggcaatcctcgcaagaggaaagaatcgagcgggaagaagagggaaaagaggagaggacagaaaaggaggaagtcggcgaggaagaggaaagtactcgcggagaaggggaaagggagaaggaggaggaggtcgaagaggaggaggagaaggtggagaaagaaactgaaaaagaggccgaacaggaaaaggaagaggattccctcggtgcagggacacatcctgatgcagctatcccttctggcgaaaggacttgcggatcagaagggtcccgcagtgtgctcgatctggtcaattatttcttatcccccgagaagttgaccgccgagaatcggtattattgtgaatcatgtgcaagcttgcaggacgcagaaaaggtggtggagctaagtcaaggcccttgttacctgattctgactttgcttagattcagttttgacctcagaaccatgagaagacgcaaaatactcgatgatgtctctatccctctcctgctaagactgccactggcaggcggcaggggccaggcatacgatctgtgtagtgtagtcgtgcacagcggagtatcgtcagaatccggccattactactgctacgctcgggagggagcggctaggcccgcagccagcctaggtacagctgaccggccagaaccagaaaaccagtggtatctgtttaacgacacaagagtctcattctcatcttttgagagtgtctctaatgtcacctccttcttccctaaagatacagcgtacgtgttgttctaccgacaaagacccagagaggggcccgaggccgaattggggtcaagcagggttcgaactgaaccaaccctacataaggacctcatggaggccatcagcaaggacaacatcctctaccttcaggagcaggagaaagaagctcgtagcagagcagcttatatctctgccctccctacatccccccattggggcagagggtttgatgaagacaaagatgaggatgaagggtctcccggaggatgtaatcccgcaggaggtaatggcggggacttccacaggttggttttttag

SEQ ID NO: 51834 - DNA, 3057 bp, Artificial Sequence
  Description of Artificial Sequence: Synthetic coding sequence
atggacaagatcctggaggccgtggtgaccagcagctaccccgtgtcggtaaagcaagggctcgttaggagagtactggaggcagcccgtcagccgttggagcgagaacagtgcttagcacttctcgctctaggcgcccgcctgtacgtcggcggtgctgaagaacttcctcggagagtgggctgccagctactgcatgtagcaggccggcatcatcccgatgtgtttgcagagttcttctctgctagacgtgtgctgcgccttctgcaggggggagcggggccacccgggccccgcgccttggcttgcgtgcagctgggtctgcaactcctgccagaaggcccagcagcagacgaggtgtttgccctgctgaggcgggaggttctgcggaccgtttgtgagagacccggacccgccgcctgcgcccaggttgcccgcctgctggcacggcaccccaggtgtgttccggatggaccccacaggcttctgttctgccagcagctggtgaggtgtctgggcagattccgctgtcccgcagaaggtgaagagggagcggtagagtttttggaacaggcacagcaagtgtcaggcctcctcgctcagttgtggagagcacaacccgcagcaatcctaccttgtcttaaagagctgtttgctgtaatttcttgcgctgaagaggaacctccatcgtccgctctcgcttcagtcgtccagcacctcccactggagcttatggacggtgtcgtccgaaatctgagcaatgacgacagcgtgaccgactcacagatgctaactgccatttcgaggatgattgactgggtttcttggcccctcgggaagaacatagacaagtggattatcgctctgttgaaggggctggcagcggtgaagaagttttccatcctcattgaggtcagcttgacaaaaattgaaaaagtgttctctaagctattataccccatagtgcggggggctgctttgtctgttctcaagtatatgttgctgaccttccagcattcacacgaagcatttcacctgctcctcccacacataccacccatggtggcctccctcgtcaaggaggactcaaactcaggaacatcatgtctggagcagttagcggagttggtacactgcatggtgtttcggttccctggattccctgacctgtacgaacccgtgatggaggccattaaggacctgcatgtgccgaacgaggatagaatcaagcaactgttaggacaggatgcatggacttcccagaagagtgaactcgcaggtttttacccacgtctcatggctaaatcggatactgggaagatagggttgatcaatctgggcaacacttgttacgttaattccatcttacaggccctgtttatggcaagtgatttccgccattgtgttctgaggctcacagagaataacagccagcctcttatgacgaagctccaatggctcttcggcttcttggagcatagtcagcggccggcaatatcaccggagaattttttgtctgcgtcttggacgccctggttctcgccaggtacccaacaagattgctctgaatacttaaaatatctgctggacagactgcacgaggaggaaaaaactggcacaaggatctgtcaaaagctgaagcaatcttcctcaccaagtccacccgaagagcctcctgcgccttcctctacttcagtggaaaaaatgtttggcgggaagatcgttactaggatttgttgcctttgttgccttaacgtctcttctcgcgaagaggccttcaccgatctcagccttgcatttcctcccccagagaggtgtcggcggcgacgcttaggctcagtgatgagaccaacagaggatattaccgcccgtgagctccctccacccacatctgctcagggacccggtagagtgggaccgcggaggcagcgcaagcattgtataactgaggatacccccccaacaagtctgtatatcgagggcctggattctaaagaagcgggtggccagagtagccaggaagagcgaatcgagcgtgaagaagaagggaaggaagaacgcacggagaaggaggaggtaggcgaggaggaggagagcacccggggggaaggcgagagagaaaaagaggaggaagtggaggaggaggaggagaaagtagagaaagagacagagaaggaggcagagcaagaaaaagaggaggacagcctgggcgccggaacccaccccgacgcagccattccatcaggcgaaagaacatgtgggagcgaaggcagcagatccgtactggacctagtaaattactttctttcccccgaaaagctgacggccgagaacagatattattgcgagtcttgcgctagcctgcaggacgccgaaaaagtcgtcgagctctcacagggaccctgctacttgattctcactcttttgaggttctcattcgacctcagaaccatgagacgaaggaaaatactggacgacgtctccatccctcttctgttgcgactgccccttgcaggtggaagagggcaggcatatgacctgtgcagcgtagttgtccactctggcgtgtctagcgagtctggacattactactgctatgcccgagaaggggccgctcggccggccgcaagtctggggacagccgatcggcccgagcctgagaaccagtggtacctctttaatgacacccgcgtcagcttttcatccttcgaatccgtgtccaacgttacaagctttttccctaaggacacagcctacgtactgttctacaggcagaggccaagggaaggccctgaggcagagctgggcagtagtcgcgtacgcaccgaaccgactctgcataaggatctgatggaggcgatctccaaagataatatcttatacctccaggagcaggaaaaagaggcgaggtcgagggccgcttacatctcagcactgcccaccagcccgcattggggacgcggtttcgatgaagacaaagacgaagatgagggcagcccaggaggctgtaatccagcagggggtaacggcggcgacttccaccgcctcgtgttttag

SEQ ID NO: 51835 - DNA, 3129 bp, Artificial Sequence
  Description of Artificial Sequence: Synthetic coding sequence
atggacaagatcctggagggcctggtgagcagcagccaccccctgcctcttaaaagggtgatcgtgcggaaggttgtggagtctgctgaacactggctggacgaagctcagtgcgaagctatgttcgacctgaccacgcgcttaattcttgagggacaggatcccttccagcgccaagtggggcaccaggtgctggaggcatacgctcggtaccacaggcctgagttcgagtcattcttcaataagacctttgtgctggggctgctgcatcaaggttatcacagcctagacaggaaagacgtagccatactggactatatccataacggactgaagctgatcatgagttgtcctagcgtgcttgatctcttttcgctgctacaggtcgaggtattgagaatggtctgcgaacggcctgagcctcaactgtgcgcacggctcagtgatctgttgactgatttcgttcagtgcataccgaagggcaagttatctatcacattctgtcagcagctggttagaaccattggacacttccagtgtgtgtccactcaggaaagagagcttagagaatacgtttcccaagtgacaaaagtctctaatctcctgcagaacatctggaaagcagaaccagctacactgctgccttccttgcaggaagtttttgcctctatttcatccaccgacgcctcatttgaaccctcagtggcgctcgccagcctcgtgcagcatattccgctccagatgattacggtacttatacgaagtttgaccaccgatcccaatgtgaaagatgcctctatgacgcaggccctatgtcgcatgatagactggcttagttggccactggcccagcacgtcgacacctgggtgattgctctgctgaagggacttgccgccgtacagaagtttaccattttgatcgacgtgaccctgttaaaaattgaactcgtatttaaccgactttggttccctctggtgcgtcccggtgccttagctgtgctaagccatatgctgttgtcttttcagcattccccagaagcttttcatctgattgtgccccacgtcgtgaatttggttcactcttttaagaatgatggcctgcctagcagtacagctttcctggtgcaattaacggagctgattcattgtatgatgtatcactatagcggattcccagacctgtacgaacccatcttagaggctatcaaagattttcccaagccatctgaggagaagattaagcttatattaaaccagtctgcgtggacttcgcagtccaactcacttgctagttgcctttctcgcctctctggtaagagtgagacagggaagacaggcctcatcaacctgggcaacacttgctatatgaacagcgtcattcaagccctcttcatggctaccgatttccgaagacaagttctctctctgaatcttaatggatgcaactccctgatgaagaagttacagcatctctttgcctttttagcgcatactcagcgtgaggcatacgcgccacgcatattttttgaagcgtctcgtccaccatggtttaccccgagatctcagcaggattgcagcgagtacctgaggttcttgttggatcggctgcacgaggaagagaagattttgaaggtgcaggctagtcacaaaccttcagaaattctggagtgcagcgagacgagcttgcaggaggtcgcttctaaggcagctgtcctgacagagacccctaggacaagcgatggagaaaagacactcatagaaaagatgttcgggggaaaactgagaacccacataaggtgtctcaattgtcgtagtacgagccagaaagtggaggccttcacggatctgtcacttgccttttgtccttcctcttcccttgagaatatgtctgtgcaggatcccgcatcgtcaccaagcatccaggatggcgggctgatgcaggccagcgtcccaggaccctccgaggagccggttgtttacaatccaaccactgcagcctttatctgcgatagtctggtcaatgagaagacaatcggctctccacccaacgaattttactgtagtgaaaacacctccgttcccaatgagagtaacaaaattcttgtgaataaggatgtgccccagaagcccggaggtgaaacaactccatccgtcaccgacctgttgaactattttttggcacctgaaattctgactggagataatcagtactactgtgagaattgtgctagtttgcagaacgccgagaagacaatgcagatcaccgaggaaccagaatatctcatcctgactctgttgagattttcctacgaccagaagtatcatgtgcgcagaaaaatcctggataatgtgagcctgccgttggtgctggagctgcccgtcaagagaatcacctcattctcatctcttagcgaatcatggagtgttgatgtggactttacggatctgtcagagaacctggcaaaaaaactgaagccatccgggaccgatgaggctagttgcactaagctcgtgccatatcttctgagtagcgttgttgtccacagtggcatctctagcgaaagtggtcattactactcctacgcccgtaatattacttctacagactcaagctaccagatgtaccatcagtcagaggctttggccttggcttcatctcaaagtcatctgctaggccgcgatagtccgtccgcagtgtttgagcaggatctggagaacaaggagatgagcaaggagtggttcttattcaatgactcaagggtgacgttcaccagcttccagagtgtccagaagatcactagtcgtttccctaaagatacagcatacgtactgctgtataaaaaacaacattctacgaacggactttctggcaataatcctacttctgggttatggatcaacggtgatccccccctccaaaaggagttaatggacgcaattacaaaagataacaaattgtatctacaagagcaggagctcaacgctagagcacgcgcattacaggcagcgagcgctagctgttcgttccggcccaatgggtttgacgacaatgatccaccaggcagctgtggaccaacaggaggtggcggcggaggcggctttaacacagtggggcggttggttttttag

SEQ ID NO: 51836 - DNA, 3708 bp, Artificial Sequence
  Description of Artificial Sequence: Synthetic coding sequence
atgttcggcgacctgttcgaggaggagtacagcaccgtgagcaacaaccagtatgggaaggggaaaaagctcaagactaaagcactagaaccaccagcgccccgcgaattcactaatctgtctggaatcaggaaccagggagggacttgctacctcaactcgttgctgcaaactctccattttacacctgaatttcgtgaggcacttttttcactgggccctgaggaactgggattgttcgaggacaaagataaaccggacgctaaagtgcgcattattcctctgcagttacagaggctgtttgctcagctgctgctcttagaccaggaggccgcatccacagctgatctgaccgactccttcgggtggactagcaacgaagagatgcggcagcacgatgtgcaggaacttaaccggatcctcttttctgcactggaaaccagcctggtagggacgtcaggccatgacctgatttatcgcctctaccacggcacaatcgtgaaccagattgtgtgcaaggagtgtaagaacgtctctgagcgccaggaagattttcttgatcttaccgtcgcagtgaagaacgtgtctgggttagaagatgccctctggaatatgtacgtggaggaagaagtgtttgattgcgacaatctgtatcactgtggtacctgtgacaggctcgttaaggccgccaagtcagcgaaactgcgcaaactgccccccttcttgaccgtctccttactgagatttaacttcgattttgtgaagtgcgagcggtacaaggaaaccagctgttatactttccccctcagaatcaacctaaaaccgttctgtgagcagtctgagttggacgatcttgagtacatctacgacctcttcagtgtaataatccacaaagggggatgttatggtggccattatcatgtgtacatcaaagatgtggatcatctgggcaattggcagttccaagaggaaaagtctaaacccgatgttaatctgaaagacctacagagtgaggaagagatcgatcaccccctgatgattctcaaggctattctgcttgaagagaacaacttgattcctgttgaccagctcggccagaaattactgaaaaagattgggattagctggaacaagaaatacagaaaacaacacggcccactgcgtaagttcctgcagctgcactcacagatctttctcctcagtagtgacgaaagtaccgtgcgtctgttaaagaacagtagcctgcaagcagaaagtgactttcagaggaatgatcagcagatcttcaaaatgctgccgccggagtcccctggcctgaacaatagcattagctgtccgcactggtttgatatcaatgatagcaaggtgcagcccatacgggagaaagacatcgagcagcagttccagggaaaggaaagcgcatatatgctgttctatagaaaatctcagcttcagaggcctcccgaggcccgggccaatcctcgctacggagtcccatgccacctgctcaatgaaatggacgctgctaatatcgagctacaaacaaagcgagcggagtgcgatagcgccaacaatactttcgaactgcatctgcacttaggtccacaataccacttttttaacggagctttgcacccagtggtgtcccagacagagagtgtgtgggacctgacatttgataaaagaaagaccctaggagatctgaggcagagcattttccagcttcttgaattctgggagggcgatatggtgctatctgttgctaaactcgttcccgcgggcctccacatctatcagtcccttggaggagacgaattaaccctctgcgagaccgaaatcgcagatggcgaggatatcttcgtgtggaatggggtcgaggtgggcggtgtccatattcagaccggtatcgactgtgagccactgctgctcaacgttctccatctagatacaagtagcgacggcgaaaagtgctgtcaagtcatagagagcccacacgtgttccctgctaatgccgaggtgggtacagttctgaccgccctagccatcccggccggtgtcatctttatcaactccgccggctgcccgggaggggagggctggacggctattcctaaggaagacatgcggaagaccttcagagagcaggggttgaggaatggcagttcgatcctgatccaggacagccacgacgataactcccttctcacgaaggaggagaagtgggtgactagcatgaacgaaattgactggctccacgttaagaacctgtgccaattagaatccgaagagaagcaggtgaagatctcagcaaccgtgaataccatggtgttcgacatacgtattaaagcaattaaggagctcaaactgatgaaagaactggcagacaatagttgcctgagacccatcgataggaatggtaagcttctttgcccagtgcccgatagttatacacttaaggaggcggaacttaaaatgggcagctctctgggcttgtgcctcggcaaagcaccttctagctcccaattgtttctgttttttgccatgggaagcgatgtgcaacccggcacggagatggaaattgtggtcgaagaaactatcagcgttcgcgactgtctaaaactgatgctgaaaaagtccggtctgcagggagacgcctggcatcttcgaaaaatggactggtgctacgaggccggcgagccactttgcgaagaggacgcaacgctcaaggagttgctgatctgctcaggcgatacacttctgctcatcgaaggtcaactcccccctctgggcttcttgaaagtgcccatctggtggtaccagctgcagggacccagtggtcactgggagtcccatcaggatcagactaattgtacttcgagctggggacgcgtgtggcgggcaacctccagccagggggctagcggaaatgagcccgcccaagtctctcttctgtatttgggggatatcgaaatatccgaagatgccactttagccgaactcaaatcccaagccatgactcttccacccttcttggaattcggggtgcctagtcccgcccacttgagggcttggactgtggagcggaagcgacctgggagactgctcaggacagaccgtcaacccctacgggagtacaaactgggcaggagaattgagatttgcttggagcccctacagaagggcgagaatttgggcccacaagatgtacttcttcgcacgcaggtgaggatcccgggcgagcggacctacgcacccgcgctggaccttgtctggaacgcggcccagggcggaacggccggttctctgcggcaaagggtggccgacttttatcgcttacctgtggagaaaatcgagatcgctaaatacttccccgagaagttcgaatggttgcccatatctagctggaatcagcagatcacaaagaggaagaaaaaaaagaaacaggattacctccaaggcgcgccctactatctcaaagatggcgataccattggtgttaagaatctcctcattgacgacgacgacgactttagtaccatccgcgacgatactggtaaggagaagcagaaacaaagggccctgggaagacgaaaatcacaggaggccctgcacgagcagtctagctacattttgagctctgcagagacaccagcacggccaagggccccagagacttctctctccatacacgtcggaagtttcagatag

SEQ ID NO: 51837 - DNA, 492 bp, Artificial Sequence
  Description of Artificial Sequence: Synthetic coding sequence
atgggcagcagcctgggcctgtgcctgggcaaggcccccagcagcagccagttgttccttttcttcgctatgggatctgacgtgcagcctggaaccgagatggaaatcgtggtggaggagactatcagtgtccgcgattgcttgaagttgatgctgaagaagagcggcctgcagggagacgcatggcatctgcgtaagatggattggtgttatgaggctggcgagcccctttgtgaggaggacgcaaccttgaaagagcttcttatttgttccggtgacaccctcctgctgattgaaggtcagcttccaccactcggatttctcaaagttcccatctggtggtatcagttacagggtccctcaggccactgggagtctcatcaagatcagacgaattgtacgagtagttggggacgcgtgtggcgcgccaccagcagccagggcgaaaaccggatgggttttcagcagccggtccaccacaaggaaaaatag

SEQ ID NO: 51838 - DNA, 3708 bp, Artificial Sequence
  Description of Artificial Sequence: Synthetic coding sequence
atgttcggcgacctgttcgaggaggagtacagcaccgtgagcaacaaccagtacggaaagggcaagaagctcaaaaccaaggcattggaaccacctgcaccccgagaattcacaaacttaagtgggattaggaatcagggagggacctgttacttgaattctctcctgcaaaccctgcattttacacccgaattccgggaggctttgttctcacttggaccagaggagctgggcttgttcgaagacaaggacaagcccgacgcgaaggtgagaatcatcccactgcagttgcagaggctctttgcacagctccttctcttggatcaagaagctgccagcacggctgatctgacagacagtttcggatggaccagcaatgaggaaatgcgacaacacgatgtgcaggagctcaatcggatccttttctctgcactagaaacgagtctggtggggacatcaggtcacgatctgatctataggctgtatcacggcaccatcgtgaatcaaatcgtgtgtaaggagtgtaagaacgtctctgagcgccaggaagacttcctcgacctgactgtggccgtgaagaacgtgagcggtctggaagatgctctctggaatatgtatgtggaggaggaggtgtttgactgcgataacctctaccactgcggtacctgcgatcggctcgtcaaagcagccaagagtgccaagctgaggaagttgccgcccttcctgactgtgtctctcttgcgtttcaattttgatttcgtcaagtgtgaacgttataaggagacgtcatgttacacatttccactgcgcatcaacttgaagccattctgtgagcagtctgagctcgacgacctggagtatatttatgacctcttctctgtaatcattcataagggcggctgttacggcggccactaccatgtttatatcaaagacgttgatcacttgggaaattggcagttccaagaggaaaaatctaaacctgacgtaaatctaaaggacctgcagtctgaggaggaaatcgaccatcccctaatgattctgaaggcgatactgctcgaggaaaacaatctgattccggtcgatcagcttggacagaaactactgaaaaaaattggaatctcttggaataaaaagtatagaaagcagcatggacctttgaggaaattcctgcaactgcatagccagatcttcctgctcagttccgacgaatctacagttcggcttctgaaaaactcctctcttcaagccgagtccgatttccagagaaatgatcaacagatttttaaaatgctgccccccgaaagtcccgggctgaataacagtatttcatgcccacactggttcgatatcaatgactcgaaagtccaaccaataagggaaaaagacatcgaacagcagtttcagggcaaggagtcagcctacatgctgttttaccgaaagagccagctgcagcgccctccggaggcccgggccaatccgagatacggagtgccctgccacctactgaacgaaatggatgccgcaaacattgaactccagaccaaacgagctgagtgtgacagcgcaaacaataccttcgaattacacctccacctcggaccgcagtatcatttcttcaacggcgctctgcatccagtagtgtcccagacagaaagtgtgtgggacttgacattcgataaacgaaaaacactgggggacttgcgccagagcatatttcagctcttagaattctgggagggagatatggtactgagtgttgctaagctggtaccggctggcttgcatatttaccagtccctgggaggtgatgagttaaccctctgcgagaccgagattgccgatggtgaagatatcttcgtgtggaacggcgtggaagtggggggagtccatatacaaactggcatcgactgcgagcctctcctgcttaatgtactgcatctggatacaagttcagatggagagaaatgctgtcaggtgatcgaaagcccgcacgtgttcccagctaatgccgaggtaggaacggtgctcaccgctctggctattcctgctggcgtgatttttattaacagtgccgggtgccctgggggtgagggatggacggctatcccgaaagaagatatgaggaaaacatttcgcgagcaaggccttcgcaatggcagctcaatactgatacaggatagtcatgacgacaattccctactgactaaggaagaaaaatgggtgacctctatgaatgaaattgactggctccacgtgaaaaacttgtgccagttggaaagcgaggagaagcaggtgaaaatctctgccactgttaatacaatggtcttcgacattcgaataaaagcaattaaagaactcaaactcatgaaggaattagcagacaatagctgcctaagacccatcgataggaacgggaagttgctctgccctgtccctgattcatatacactgaaggaagcagagctgaagatggggagctccctcggtttgtgtttgggtaaggcccctagctcatcgcagctattccttttttttgcaatgggaagcgacgtgcagccaggcacagagatggaaattgtggtggaggagaccatctccgtgcgcgactgcctgaagctcatgttaaagaagtccggcctccagggtgatgcgtggcacctccgcaagatggattggtgctacgaagccggggaacccctctgtgaggaggatgccacacttaaggaactgttgatctgttcaggagacactctcctactgattgagggtcagttaccacccctagggttcttaaaggttcccatttggtggtatcagctgcagggtcccagtgggcactgggagtcacaccaggatcagaccaactgcacttcctcatgggggagggtgtggcgcgctacaagttcccagggtgcttctggtaacgagccagcccaagtaagcctcctgtatctgggagatatcgagatcagtgaggatgctactctggctgaactaaaatcccaggcaatgacccttccccccttcctggaatttggcgtgccaagccctgcgcatttgcgtgcctggactgttgaaagaaagcgcccaggccgattactccgaaccgataggcagccgctgagggagtataaactggggcgccggatcgaaatctgccttgagccgctgcagaaaggcgagaacctgggcccacaagacgtcttgctgcgcacccaagtgagaatcccaggcgagcgcacctatgcccctgccctagatttagtctggaatgccgcacagggggggacggccgggtcgctccgccagagggttgccgacttctatcggttgcccgttgaaaaaattgagattgccaaatatttcccagagaaattcgaatggctgccaatatctagttggaaccaacagatcacaaagcggaaaaagaaaaagaaacaggactacttacagggcgctccgtactatttgaaagacggcgacaccataggagtcaagaacttgctgatcgacgacgacgatgacttttccactatcagggacgacactggaaaggagaagcagaaacaacgggcactcggtcggcgaaagagccaggaggctctgcacgagcagagttcctacatattaagctccgctgagacaccagccaggccaagagctcccgaaacatcactgtcaatccatgtggggtctttcagatag

SEQ ID NO: 51839 - DNA, 987 bp, Artificial Sequence
  Description of Artificial Sequence: Synthetic coding sequence
atgttcggcgacctgttcgaggaggagtacagcaccgtgagcaacaatcaatacgggaaggggaaaaaacttaaaacaaaagccctggagcctccagcaccacgcgagttcaccaatctgagcggaatccgtaatcagggcgggacctgttaccttaactcactccttcaaactctgcacttcacccccgaatttagggaagccctcttcagtctcggcccagaagagctggggttattcgaggacaaagacaagccggacgcgaaggtccgaattatccctctgcagctccaaaggctgttcgctcaactgctgctgcttgatcaagaggccgcatcaacagctgatctgactgactcttttggctggacctcaaacgaggagatgagacagcacgacgtgcaggagttaaacagaattttgtttagcgccctggaaacctcactagttggcacaagtggccatgatttgatttacaggctgtatcacggtaccatcgtgaaccagattgtctgtaaagaatgtaagaacgtatccgaacgccaggaggactttctcgatctgactgtggcggtgaagaatgtttccgggctagaggatgccttgtggaacatgtatgtggaggaggaggtgttcgattgtgataatctgtaccattgcgggacctgtgatagactggtcaaggctgctaaatcggctaaattgcggaaactgccccccttcttgaccgtaagtctgctgaggtttaattttgattttgtgaaatgcgaacgctacaaggagacttcctgttacacgttccctctgcgaatcaacctgaagcctttctgtgagcagagtgagctggatgatctggagtatatgacaagctctcagcttctgtatactaaagtggcagctaccgaagcaattaccatgtatattctgaagatgctgatcatttgggaaacagggagtttcaagaggaagaaagtgaaccagatgtag

SEQ ID NO: 51840 - DNA, 3744 bp, Artificial Sequence
  Description of Artificial Sequence: Synthetic coding sequence
atgagcctgttcctgcgggtggtgttcagcttcaccatgttcggcgatctgttcgaagaagagtactcaactgtgtctaataaccaatacgggaaagggaaaaaactcaaaactaaggccctggagccccccgccccacgggaatttacaaaccttagcggcatccgtaatcagggcggtacatgctacctgaactctctgctgcagaccctgcatttcacaccagaattcagggaagctttattcagcctaggtcccgaggagctgggcctttttgaggacaaagacaaaccagatgccaaggtccgcattattcccctacaacttcagcgcctgttcgcgcagttgctccttctcgaccaggaggctgcttcaacagctgatcttaccgactccttcggttggaccagcaatgaagaaatgcgtcaacatgatgtgcaagaattaaacaggatcctcttcagcgccttagagacaagtctcgtaggaactagtggtcatgaccttatctatcggctctatcatgggactattgtgaaccagattgtatgtaaagagtgtaaaaatgtcagcgaaagacaggaggattttctggacctcacagttgccgtcaaaaatgtgagtggattagaggatgccctttggaatatgtacgtcgaggaagaggtgttcgactgtgacaatctctaccactgtgggacgtgtgatcgccttgtaaaagctgccaagtcggcaaagctgagaaagctgccccctttcttgaccgtgagcttactcagattcaacttcgacttcgtgaagtgtgagaggtacaaggaaacctcatgttacacctttccactgagaatcaacctaaaacccttctgcgaacagtcggaacttgacgatctcgaatacatctatgacctgttcagtgttataattcacaaggggggatgctacggtggacactatcacgtgtatatcaaggatgtggaccatctgggcaactggcagtttcaagaggagaagagtaaaccagacgtaaatctgaaggacttacaatctgaagaggaaatcgatcaccccctcatgattctgaaggccattctgctggaggaaaacaaccttattcctgtggatcaactgggccagaagctgctgaagaagatcggcattagctggaacaagaaatataggaaacagcatggccctctgcgaaaatttttacaactacacagtcagatcttcctcctaagtagcgacgaaagcaccgtgcggctgctaaagaacagcagcttacaggcagagagtgattttcaacggaatgaccagcagattttcaagatgcttcctcccgaaagtccaggcttgaataacagtatatcatgcccacattggttcgatatcaatgactcgaaggtgcagccgattcgtgagaaagatattgagcagcaattccaaggcaaagaatctgcttatatgctgttctaccggaagtctcaactgcagcggccccctgaagctcgggccaacccacggtatggggtgccttgccacctgctgaacgaaatggatgcggctaatattgaactccagaccaagagggcagagtgcgactctgcaaacaacactttcgaactgcaccttcatctgggtccccagtaccactttttcaatggggcactacacccagtcgtatcacagacagagagtgtttgggacttgacttttgacaaaaggaagactttaggcgacctccgccagtctatctttcagctcttagaattttgggaaggggatatggtgctgagtgtcgccaagctggtgcctgctggactgcacatctatcagagtctaggcggtgacgagctaactctctgcgagaccgaaatagccgatggtgaagacatctttgtgtggaacggggttgaagtcgggggtgtacatatccagacagggatcgactgcgagcctttattgttaaatgtcctgcatctagatactagttcggacggtgagaagtgctgccaagtcatcgaatctccccatgtgtttccagcaaacgctgaagtggggacggtcctcaccgcactggcgattcccgctggggttatctttataaattccgctggttgtcccggaggagagggctggacagccatccctaaggaagacatgagaaaaactttccgtgaacaggggctgcggaacgggagctctatcctcatccaagatagccatgacgacaatagcctactgacaaaagaagaaaaatgggtaacctcaatgaacgaaatagactggctacacgtcaagaatttgtgtcagctggagtcagaagaaaagcaggtgaaaatatccgcgaccgtgaacaccatggtcttcgacatccgcattaaggctataaaggagctgaagttaatgaaggagctcgccgataatagctgcctccggccaatcgatcggaatggcaagctgctgtgccccgtcccagattcctacaccctgaaagaggctgaactaaagatgggctcctccctcggattgtgcctggggaaggcacctagttccagccagctgtttctgttcttcgccatggggtccgacgtacagcccggcactgagatggagattgtggtcgaagagacaatctcggtccgcgattgcctcaaactcatgctcaaaaagagtggccttcagggagatgcttggcatctgcgcaaaatggattggtgctacgaggcgggcgagcctctctgcgaggaagatgccacactgaaagagttgctcatttgctcaggcgatactctccttttaatagaggggcagctcccacctctgggtttcctgaaggtgcctatttggtggtaccagttacaggggccgtccggccactgggaaagccatcaagatcagacaaattgtactagcagttggggccgcgtatggcgcgcaacttcatctcagggggcaagcgggaatgagcccgcccaagtgtcgctgctatatctgggggacatcgaaatctcagaggatgcgaccctggcagagctgaaatcccaggccatgactctcccgcctttcttggaattcggggtgcctagtcctgcccatctgcgtgcttggacagttgagaggaaaagacctggaaggctactgcggacagatcggcagccactcagagagtacaagctcgggagaaggattgagatatgtctcgagcccttgcagaagggcgaaaatctcggcccccaggacgttctactccgtacacaggtgcgaattcccggcgagagaacctacgcccccgcattggatctcgtgtggaatgcggcccagggcggcaccgccggaagcctccgccagcgggtggctgatttctaccgacttccagtagaaaaaatcgagatcgctaaatattttccggagaaatttgaatggctgccaatctcgtcgtggaatcagcaaattactaagaggaagaagaagaaaaagcaggattacctacaaggggctccttattatctcaaggatggagacaccatcggcgtgaaaaatctgttaattgacgatgatgatgacttttctactattcgagatgacacaggcaaagaaaagcagaaacaacgcgctctggggagaaggaaatcacaggaggcgctgcacgaacaatcatcttacattctgtctagcgcagagacacctgcccgacccagagcaccagagaccagcctgtccatacacgtgggctcctttagatag

SEQ ID NO: 51841 - DNA, 1074 bp, Artificial Sequence
  Description of Artificial Sequence: Synthetic coding sequence
atggacggcgtgctgttccgggcccaccagtgccagtacgtgcacccttgcgtgcacgtgtatgtcacagtggggctgatggacccactgtgcctgcagagacataaagagcacgccaagggcagggaacctccctgtccagccctcagtacctccggcctggttggccttcacaatatcggccagacttgctgtctcaactctctcatccaggttttcgtgatgaacgtcgactttgctaggatcctcaagcgcataacagttcccaggggagccgatgagcagaggcgtagcgtccccttccagatgctcctgttgctggaaaaaatgcaggactctaggcagaaagctgtgtggcctctggagctggcctattgtctccagaaatacaacgttccactatttgtgcagcacgacgccgcgcagctttatcttaagctgtggaacctgatcaaggatcagatcgccgatgtgcacctggtggagcgcctgcaggctctctatatgattagaatgaaggattccctgatctgcttggactgcgcgatggaaagctccagaaactcctcaatgctgactttgcgtttgtcatttttcgatgtagacagcaaaccccttaagacactggaagatgccctgcactgcttcttccagcccagggagttgtcttctaaatcaaaatgcttttgcgagaattgcggaaagaaaactagaggcaaacaggtactgaagctgacacacctaccgcagacattgaccattcatttaatgaggttctcaattagaaacagtcaaaccaggaagatttgtcactccctgtattttccccagagtctcgatttttcgcaaattcttcctatgaaaagagagagctgtgatgccgaagagcaatcagggggtcagtacgagctctttgcagtcatcgcccacgtgggtatggcagactccggacactattgtgtgtacattaggaacgccgtcgacggaaaatggttttgctttaacgactccaacatctgcttggtgtcttgggaggatattcaatgtacctatgggaacccaaactaccactag

SEQ ID NO: 51842 - DNA, 3951 bp, Artificial Sequence
  Description of Artificial Sequence: Synthetic coding sequence
atgaccatcgtggacaaggccagcgagagcagcgaccccagcgcctatcagaatcaacccggcagctctgaggcagtctctcccggcgacatggacgctggttccgcctcctggggagccgtgtcctcgctcaacgacgtgtctaatcatacactctcccttggacccgtgccgggcgccgtcgtgtattcaagcagctctgtccctgataagagtaaaccctctcctcaaaaggatcaggccctgggagatggaatagccccgccacagaaggttctgttcccttctgagaaaatctgcctgaaatggcaacagacacatagggttggagccgggctccagaacctcggaaacacatgttttgccaatgctgcactacagtgtctgacgtatacaccaccattagcaaattacatgctttcacatgagcactccaagacttgtcacgccgaaggcttctgcatgatgtgcacgatgcaagcccatattacacaagcgctcagcaacccaggagacgtaatcaagccgatgttcgtcattaatgagatgcgccgcatcgcgcggcatttccgattcggaaatcaggaagacgctcatgagtttctgcagtatactgtggacgccatgcagaaggcttgtttgaatgggtcaaacaaactggacaggcatacacaagccactacgctagtctgccagatcttcgggggttatctcagaagccgagttaaatgtcttaattgcaagggagtgtctgacacctttgacccttacctcgacatcacccttgagattaaagcggctcagtcagtgaataaagctttggagcagtttgtaaaaccagagcagctagacggagaaaactcctataagtgttccaagtgcaaaaaaatggtgcctgcgtctaaaaggttcacaatccatcgttcatccaatgttctcacactcagccttaagaggtttgccaatttcactggtggaaaaattgcaaaggacgtgaaataccccgagtacctcgacatcaggccttatatgagccaacccaacggcgagccaatcgtgtatgtactgtacgccgtcttggtgcataccggttttaactgtcacgccgggcattacttttgctatattaaggccagtaacggcctgtggtaccagatgaatgactctatagtgagcacgtccgacatccgctctgtgttgtcccagcaggcgtatgtgctattctacatacgctctcacgatgtgaagaacgggggggaactcacgcatcccacccattcacctggacagtctagtccacgccctgtcattagccaacgggttgttacaaataagcaggcggcgccgggttttatcgggccccaactgccgtctcatatgatcaaaaaccctcctcacttaaatggtaccggccctttaaaggatactccatcttcttcaatgtctagtccaaatggcaacagcagcgtgaatagagccagtcccgtgaatgcaagcgcttcagttcagaactggagtgtcaaccgtagttctgtgataccagaacatccgaagaaacagaagattactataagcatccacaataaacttcctgttcggcagtgtcagtcacaacctaatctccatagtaattcactcgaaaacccaaccaagcccgttccctcctccacgattactaacagtgccgttcaaagtacaagcaacgctagtacaatgtccgtgtcttctaaggttaccaaacccatcccacggtcagagtcctgtagccaacccgtgatgaatggaaagtccaaactaaactcttctgtgctcgtaccctacggagccgagagctcagaggacagcgacgaagagtccaagggcctggggaaggaaaatggaattgggactatagtgagttcacacagccccggacaagatgccgaagacgaagaagccactcctcacgaacttcaggagcctatgacattgaacggagcaaatagcgctgattcagactccgacccaaaggagaacggcctagcccctgacggcgcctcatgccaggggcagccagccctccactccgagaatccttttgctaaagcaaatgggctacctggcaagctgatgcctgctccattgctgagcctccccgaggacaagatcctggaaacatttaggctgagtaataagttaaagggctcaaccgatgaaatgagtgcacctggggccgagcgtggcccacccgaagaccgggacgcagagcctcagcccggctctccagcagccgagtcacttgaggagccggacgcagcagccggactgtcttctaccaaaaaagcaccgcccccccgcgatccaggtactccggctaccaaagaaggtgcttgggaggctatggctgtggccccagaggaacccccaccatcagcaggagaggacatcgtgggtgataccgcgccaccagatctctgcgacccaggaagcttaaccggcgatgcctctcctctctctcaggatgctaaggggatgattgccgaaggtccaagggacagcgcgctggcagaagctccagagggcttgtcccctgcaccgccagctcgcagtgaagagccatgcgaacaaccccttctagtacatcctagtggagaccatgctcgggacgctcaggacccctcccagagccttggggccccagaagctgccgagagaccgcctgcccccgtcctagacatggccccggcaggccaccccgagggtgatgcagagccaagcccaggagagcgtgtggaagatgctgccgctcctaaggcgcccggcccgagtccagctaaagagaagatcggctccttgcgcaaggtggatcgggggcactaccggagccggagagagaggtcctcctctggggagcctgcccgagagtctcgctctaagacagagggacatcggcaccggcggcgcaggacgtgccccagggaacgggatagacaggaccgccacgcgcccgaacaccatccgggccatggagaccggttatctccaggagaacggcgtagcttggggagatgcagccatcatcactcacgccaccggtctggcgtggaattggactgggttaggcaccactacactgaaggggagaggggctggggcagagagaagttttaccctgataggccccgttgggataggtgcaggtattatcatgatcggtacgccctctacgccgcccgtgattggaaacctttccacggcggaagagagcacgaaagagctggactacacgagcggccacataaggatcataacagaggccggagaggctgcgaaccggctcgagagagagagagacacagaccatcttcccccagggccggagctccgcacgccctcgccccccacccggacaggttcagtcatgacaggacagccctggttgccggcgataattgtaatttgtcagacagatttcacgagcacgagaacggaaaatctcgcaaacggaggcacgacagtgtggagaactcagactcacacgtagagaagaaggctagacgatctgaacagaaggaccccttggaagagccaaaagctaagaagcacaaaaagagtaagaaaaaaaagaagtctaaagacaaacatcgcgatagagatagtcgccatcagcaggattccgatttgtctgcggcctgttccgatgccgatttgcacaggcacaagaaaaagaagaagaagaagaaacggcactccagaaaaagtgaggactttgttaaggactctgagctacacctgcctcgagtgacctccctggagacggtggcccagtttcgtcgagcccagggagggtttcccctgtccggcggcccgcccctggaaggggtgggaccttttagagagaagacaaagcatctaaggatggaaagcagggacgacagatgtcgcctgttcgagtatggacagggggactag

SEQ ID NO: 51843 - DNA, 3372 bp, Artificial Sequence
  Description of Artificial Sequence: Synthetic coding sequence
atggacctgggccccggcgacgccgccggcggcggccccctggccccaaggccgcgcagaaggcgaagcttacgacgacttttcagtcgctttctgttagcacttgggtctcgctccaggcccggggatagtccgcctcgccctcagcccggccactgtgacggtgacggcgagggaggcttcgcatgcgcccctggccccgttccagcggctccagggtctcctggcgaggagaggccaccagggccacagccccagctgcagctccccgctggtgatggagcgcggcctccaggtgcccagggcttaaaaaaccacggtaacacctgcttcatgaatgcagtcgtgcagtgcttaagcaacacggatttattggcagagttcctcgctctaggccgttatagagccgcacccggaagagcagaagttaccgaacagctcgcagcactggtccgcgccctttggactcgcgagtacacaccgcaactgagcgccgaattcaaaaatgcagtgtcaaagtacggttctcaattccaaggaaactctcagcacgacgcactcgaattcttgctgtggctactagatcgggttcatgaggacctggaaggatctagtcgagggccagtgtccgagaagcttccccccgaggcaaccaaaaccagtgaaaactgtctgagccctagtgcacagcttccattaggccagtcattcgtgcagtcccacttccaggctcagtaccgcagcagcctcacctgtccccattgcctgaaacaatcaaataccttcgacccgttcctctgtgtgagcctcccaatccctctgagacagactcggtttctcagtgtgacactggttttcccatctaagagtcaacgcttcctgcgcgtaggcctggcagtgccaatcctttccaccgtggctgctctgcggaagatggtggctgaagaaggcggtgtacctgccgatgaggtcattctggttgaactgtacccatcggggttccagcgctccttcttcgacgaggaagacctgaacactattgcagaaggggacaatgtttacgccttccaggttccaccatccccgtcccagggaaccctcagtgcccaccctctgggccttagtgcctctccacggcttgccgcccgagagggccaacgattttcgctgtcgcttcatagtgagagcaaggtgctgatcctgttctgcaacctggtgggtagtggccaacaagccagcaggtttggccccccattcctgattagagaggatcgcgcagtgtcctgggcccagctacagcagtccattctgagtaaggtgcgtcacctgatgaagtctgaggccccagtccagaatctgggaagcctgttctcaattcgggtggtggggttatccgtggcctgttcctacctgagtcctaaggattctcgaccactgtgccactgggccgtggacagggtgctgcatcttcgaaggcccggcgggccccctcatgtgaaactcgccgtggaatgggatagctcagttaaggagcgcctcttcgggagcctgcaggaagaaagagcacaggacgccgacagcgtgtggcagcagcagcaggctcatcagcagcattcatgcacactggatgagtgcttccaattctatacaaaggaggagcagcttgcccaagacgatgcctggaaatgccctcattgccaggttctccaacaaggcatggtaaagctcagtttgtggacgctgcccgacatcttgatcatccacctcaagcggttttgccaagtgggtgagagaaggaacaagctgagcacactagttaagttccccctcagtggactgaacatggcgcctcatgtggcgcaaagaagtacctcccccgaagctggcctggggccatggccttcctggaaacagccagactgtctgcccacctcatatcccttggattttttgtacgacctgtacgctgtatgcaatcatcacggcaatcttcaaggaggacactacacggcctattgcaggaattcccttgatggtcagtggtactcatacgacgatagcaccgttgaacccctgcgggaggatgaagtgaatactagaggggcatacattttgttctaccaaaagaggaactcgatcccgccctggtcagcctcaagcagcatgcgaggcagcacatcctccagcctgtcagatcattggctgctccgcctcggttctcatgcaggatcgacccgtggatccctcttgagctggagttctgcgccatgtccaagccttccgcaggtgccagattcaccaattttcacgaattccctgtgcaaccaagagaagggaggccttgagccccggaggttagtcagaggggttaaaggacgttctatctctatgaaagcccccaccacttcacgggcgaagcagggaccctttaaaacaatgccactacgctggtcctttggctctaaagagaagccacccggagcgagtgtggagttggtggagtacctggagagcaggaggcgccctcggagcactagtcagagtatcgtaagtctgctcaccggcacggccggcgaagacgagaagtcggcctctccccgcagtaatgtagcgctgccagcaaacagcgaggacgggggtcgggcgatcgagaggggccctgccggcgttccctgtccatccgcccaacccaatcactgtcttgctcctggcaatagcgacggaccaaacaccgccagaaagctaaaagagaacgcaggccaggacataaaacttcctcgaaagtttgacctgcccctcacagtgatgccaagtgtcgagcatgagaagcccgcccggccagagggccagaaggccatgaattggaaggaaagcttccaaatggggtctaagagctcccctccgagtccttacatgggattcagtggtaactcaaaggattccagacgcggcacctcggagctggatcgccctctccaaggaaccttaaccttgttgagatctgttttcaggaaaaaggagaatcggcgcaacgaacgcgctgaggtttcgccacaggtgccccctgtgtctcttgtatcagggggtctgagccccgctatggacgggcaggcccccgggagcccccccgctctccggatacccgagggactggcaagaggtctgggatccaggttagagagagacgtgtggtcagccccttcaagcctgcggctgcctaggaaagcctccagggcaccgcgggggtccgcactagggatgtctcagagaactgtgcctggtgaacaggcttcttatggaacattccagagagtgaaatatcacaccctctcccttggtagaaagaaaaccctccctgagtcatcattctag

SEQ ID NO: 51844 - DNA, 3357 bp, Artificial Sequence
  Description of Artificial Sequence: Synthetic coding sequence
atggacctgggccccggcgacgccgccggcggcggccccctggcccctagaccacggcggcgccggtccctccgcagactgttttcacggttcctactggccttgggatctagatcacggcccggggatagtcctccacggcctcagcctggccactgcgacggggatggggagggtggctttgcatgcgcacccgggcccgtccccgccgccccaggctcgcctggggaggagcggccccccggtccacagccgcaactgcagttaccagcgggcgatggtgcccgccctcctggcgcccagggtctgaaaaatcatgggaatacttgttttatgaacgctgtggtgcaatgtctgtccaacacagaccttctcgccgagttcctggctctcgggcgttaccgagccgctcccggacgcgcagaggtgacagagcaactagccgctctcgttagggcgctgtggacgagagagtacacaccacagctgagcgccgagttcaagaacgcagtgtctaagtatggctctcagttccagggtaacagccagcatgatgctctggagtttcttctttggttactggaccgagtacacgaggatttggagggctcttcaagaggccccgtcagcgaaaagctgccaccagaggccaccaaaacaagcgagaactgtttgtcaccatcagcccagctgcctcttggacagtccttcgtgcaaagccactttcaggcacagtaccgttccagccttacttgcccacattgcctcaagcagtcaaatacattcgatccatttctttgtgtcagtctcccgatccccttgaggcagactaggtttctgagcgtcactctggtgttcccctcaaagagccagagatttttgcgcgttggactagcggtcccaattctgagcaccgtggctgctctgcgtaagatggtggctgaagagggaggagttccagccgacgaagtcatactcgtcgagctttatcctagtgggttccagaggagcttctttgatgaagaggacttaaatacgatagccgaaggggataacgtgtacgcttttcaagtgccaccttcccctagccagggtacactgagcgctcatcccctcggcctgagtgccagtccaaggctggcagctcgcgaaggccagcgctttagtttgtccctgcatagcgagagcaaggtgctcattctgttctgtaacttggtaggaagtggccagcaggcttcccgtttcggtcctcccttcctgattcgggaggacagagcagtgtcatgggcccagctgcaacagtctattctgagcaaagtgaggcacctcatgaaatctgaagctcccgtccagaacttgggcagcctgttttccatcagggtggtcggcttgtccgtcgcttgtagctatctctctccaaaggatagccgaccactctgtcactgggccgtcgatcgagtgcttcatctccgacgcccggggggaccaccacatgtgaagttggctgtggagtgggactcatctgtaaaggagcggctgttcggatcactgcaggaggaacgcgctcaggatgctgattctgtttggcaacagcagcaggctcatcagcagcactcatgtactttagacgaatgctttcagttctacaccaaggaagaacaacttgcccaggatgacgcttggaaatgtccccattgccaggttctccagcagggcatggttaagttgagcctctggaccctgcccgacatcctgatcatccatttaaaaaggttttgccaggtgggtgaacggagaaataagctatctaccctcgtgaaattccccttgagtggtctcaatatggcaccccacgtggcccagcggagcacaagccccgaggccgggctcggaccatggccctcctggaagcagcctgactgtttgcctacttcctatcctttagactttttgtatgacctgtacgctgtatgtaaccaccacggaaatttacaggcatattgtagaaactcactggacgggcaatggtactcctatgacgacagtaccgtggaacctctgcgggaggatgaggtaaacaccaggggggcatatattttgttctatcagaagcggaactctatccccccttggtcagcttcaagttctatgagaggcagcactagctccagcctgagtgatcactggttgcttagactcgggagtcatgcaggctccacccggggaagtttgctgagctggagctctgctccttgtccctctctcccccaagttccagacagccctatctttacaaacagcctctgcaatcaggaaaaaggtgggctggaacctcgtaggcttgtacggggcgtgaaagggcgaagtatcagcatgaaggctcccaccaccagcagagctaagcagggaccctttaaaactatgcctcttcgctggtcgtttggcagcaaagaaaagcctcctggagcttccgtggaactggttgaatacctagagtcccgcaggaggccacggtctacctcccaatcaattgtgagtctcttgacagggactgctggggaggatgagaaatccgcttctcctcgatcaaacgttgctcttcctgccaacagcgaggacggcgggcgcgctatcgagcgggggcctgcaggggtgccgtgcccttctgcccagcccaatcactgtttagctcccggaaattctgacggtccaaatacggcccgcaaactgaaggaaaatgccggtcaggacattaagctcccacgcaagttcgatttgcccttgaccgtcatgccatccgttgaacatgagaagcctgccaggcctgagggccaaaaagctatgaactggaaggaatcattccagatgggaagcaaaagctcccccccatctccctacatggggttcagcggtaactcgaaggatagtaggcgcggtacctctgagttggatcgccccctgcagggaacgctcacactgctcaggagtgtgtttagaaaaaaggagaatcggagaaacgaaagggctgaagtcagtccacaggtgccccccgtgagcctggtctcgggcggactcagcccagctatggatggtcaggcgcccggcagccctccagccctcaggatcccagaagggctggcgcggggactaggttctcgcctggaaagagatgtatggagcgcacccagctcccttcgactgccccgaaaagctagccgtgccccccgcggcagcgccctgggaatgtctcagcggactgtgcctggggagcaggcatcctacggtacctttcagcgtgtcaagtatcatactctctcattgggtagaaaaaagacactccctgaaagctctttttag

SEQ ID NO: 51845 - DNA, 2445 bp, Artificial Sequence
  Description of Artificial Sequence: Synthetic coding sequence
atgcgggtgaaggaccccaccaaggccctgcccgagaaggccaagcgtagcaagcgaccaactgtgcctcacgacgaggacagcagcgacgacatcgctgtggggctcacttgccaacacgtttctcatgctattagcgtcaatcatgtgaaacgagctatagccgagaatctctggtccgtgtgcagtgagtgcttaaaggaacgtagattctacgacgggcagctcgtcctaacctcagacatctggttgtgcttaaagtgtggttttcaggggtgcgggaagaactcggagtctcaacattcactgaagcactttaagtcgtcacggactgagcctcattgcatcattattaatctgtcaacctggatcatttggtgctacgaatgtgatgagaaactgtcaactcattgtaataaaaaggtgctagcacagattgtcgattttttacagaaacacgctagcaagactcaaacctccgccttctccaggatcatgaagctgtgcgaggagaaatgcgagacagatgagatccagaagggaggcaagtgtaggaatttatctgtacgcggaattaccaacctgggaaacacctgtttctttaacgccgtaatgcagaatctagcgcagacctacactttaaccgatctcatgaatgaaattaaggaaagttcaacaaagctgaagatctttccaagtagcgactcccagctggatccgctagttgtggaactgtcgcgccctggtccacttactagcgcattgttcctgtttcttcactctatgaaagagactgaaaaaggacccctctctccaaaggtgctgtttaaccaactttgccagaaggcacctcggttcaaagatttccagcagcaggactcccaggagcttctccactaccttctggacgcagtgcgcacagaggagaccaagcgtatacaggcttctatccttaaggctttcaataacccaactacaaagaccgcagatgacgaaaccaggaagaaggttaaggcttatggtaaggagggtgtgaaaatgaactttatcgaccggatattcatcggcgaacttacttctaccgtgatgtgtgaagaatgcgcaaatatttctacggttaaagacccattcatcgatatttcccttcccatcattgaggagcgcgtgtcaaagccgctcttgtgggggagaatgaacaaatacagatccttacgagagaccgaccatgaccgatacagtggaaacgtgacgatcgaaaatatacaccagcctagggccgcaaaaaagcactccagcagcaaggataaatcgcaactaatacacgaccgtaaatgtatcaggaagttgtcctctggcgagactgtaacataccagaagaatgagaatctcgaaatgaacggcgacagcctgatgtttgcaagtctcatgaacagtgaatccagacttaatgaatctcccaccgatgattcagagaaggaggccagtcattctgaatccaatgtagatgccgactccgaaccgagcgagtccgaaagcgccagcaaacagaccggactgtttaggagctcaagcggcagcggggtacagccagatgggccgctgtacccattatcggccgggaaattattatacaccaaggaaactgacagcggcgacaaagagatggcggaggccatcagtgagctgcgcttaagctctacggtgaccggggatcaggactttgatcgcgagaaccagcccctcaatatttctaataacctgtgtttcctcgaggggaaacacctgaggtcatatagcccccagaatgcatttcagaccctgtcacagtcatacataactaccagtaaagagtgcagtattcaatcttgtctctatcagtttacatcaatggagttgctgatggggaataataagcttctttgcgagaactgtaccaagaacaagcagaagtatcaggaggagacatcttttgcggagaagaaggtggagggcgtctacacaaacgcccggaaacagctcttgattagtgccgttccagccgtcttaatactgcacctcaagcgttttcatcaggctggcctcagcctgcggaaagtcaacaggcacgtggatttccccctcatgctagatctcgctccattctgttccgcaacgtgcaaaaacgcatccgtcggagataaggtcctgtatggactgtatggcatagttgaacactcaggcagcatgcgtgaaggccattacaccgcatatgtgaaggtgcggacaccgtcgcgtaagctttccgagcacaatacaaaaaaaaaaaatgtgccagggctgaaggcggccgataatgaaagcgctggccagtgggtccacgtgtctgacacctacttacaggttgtccccgagtctcgagcattgagcgcccaggcctatttgctgttttatgaacgagttctgtag

SEQ ID NO: 51846 - DNA, 870 bp, Artificial Sequence
  Description of Artificial Sequence: Synthetic coding sequence
atgcgggtgaaggaccccaccaaggccctgcccgagaaggccaagaggtcaaaacggccgacagtcccacacgacgaggatagctcagatgatattgccgtgggactgacgtgccagcacgtgagtcacgcaatctctgtgaatcatgtcaaacgcgctatcgccgagaacctctggtccgtctgctcagagtgtttaaaggaacggcgcttctatgacggacagctcgttctgacatcagacatttggctgtgtttaaaatgcggcttccagggatgcggaaaaaactctgaatctcaacattcactcaaacactttaaaagtagcaggaccgaaccccattgtataattataaatcttagtacatggatcatctggtgttacgaatgtgacgaaaagctttcaactcattgtaataaaaaagtgttggcccagattgtcgactttcttcagaaacacgcctctaaaacccaaacctcagctttctccaggattatgaagctgtgtgaagagaaatgcgagacagacgagatccagaaagggggcaagtgcaggaacctgtctgtgaggggcatcaccaacctcggtaatacatgcttcttcaatgctgttatgcagaatctggcccagacatacacgcttactgacctaatgaatgagataaaagaaagctccaccaaactcaagatctttccatcgtccgactcccaactagaccctctcgtagtggaactgtctcggcccggcccattgacctctgcactgtttctattcctgcattctatgaaagaaaccgagaagggtcctttgagccctaaagtgttgtttaatcagttgtgtcagaaatgggttcacctccacctcatttag

SEQ ID NO: 51847 - DNA, 549 bp, Artificial Sequence
  Description of Artificial Sequence: Synthetic coding sequence
atgcgggtgaaggaccccaccaaggccctgcccgagaaggccaagcgatcaaagaggcctactgtcccacatgatgaggactcaagcgacgatatcgctgtcggtttaacgtgtcaacatgtgtctcacgctatctctgtgaatcacgtcaagcgggccattgccgagaacctgtggtccgtctgctctgagtgcctgaaggaaagaaggttttacgatggacagctcgttctgacatcagacatctggctgtgcttgaagtgcggctttcagggttgtgggaaaaattcagaaagtcagcattccctaaaacacttcaagtcatccaggaccgaaccacattgcataatcataaacctgtctacttggattatatggtgctacgaatgcgatgagaagctgtctacacactgtaataagaaggtgctggctcagatagtagattttcttcaaaagcacgccagcaagactcaaactcggccgggccctatactgattcatctgtttagcatcaattgccttggagctcacagcgaatcagtctgctag

SEQ ID NO: 51848 - DNA, 1485 bp, Artificial Sequence
  Description of Artificial Sequence: Synthetic coding sequence
atgcggagcaagaaggtggtgcagaacagccggttcttcctgccccagaccctctcttgggcgcctagattcaaggacttccaacagcaggacagccaagaattgcttcactacctgctggacgcagtgcggactgaggagaccaagatatcaacggtgaaagacccattcattgatattagtctgcctattatcgaggagcgtgtctccaaacctttactctggggcaggatgaacaagtatcgcagcctgagggagacagaccatgaccgatacagcggcaacgtgactattgagaacattcatcagccgcgcgcggctaagaaacattcttctagcaaagacaagtcacagctcatccatgatcggaagtgcattagaaagctcagcagcggcgaaacagtaacataccagaagaatgagaatctggagatgaatggagactctctgatgttcgccagcctgatgaactctgaatccaggctgaatgagagcccgactgatgatagcgaaaaggaggcctcacatagcgagagcaatgtggacgcagattctgagcccagcgaatcagagtcagcaagcaagcagacaggattattcaggtcaagctcaggaagtggggtgcagccagacggaccactgtatcctctcagcgccgggaagctgctgtacaccaaagagaccgattccggtgacaaagagatggccgaagccataagtgaattacggctgtcaagcacagttactggggaccaggattttgatcgggagaatcaacctttaaacatttctaacaacctgtgttttttggagggaaagcacttacggtcttatagcccccagaacgcattccaaaccctcagccaaagttacattacaacaagcaaggagtgttcaattcagtcatgtctgtaccaatttacatccatggagctgctaatgggcaacaataagcttctgtgcgagaattgtactaaaaataagcagaagtaccaggaggagacatcttttgctgagaaaaaagtggaaggagtctatacaaacgcccgaaaacagctcttgatcagcgctgtgcctgcagtgctgatcctccacttgaagcggtttcaccaggcaggactgtctctgcgcaaagtgaatcgtcatgtcgacttccctctgatgctggacctcgcacccttctgctctgcaacctgtaaaaacgcaagtgtgggggataaggtcctttatggactgtatggaattgtggaacattctggaagtatgagggagggtcactatactgcctacgtcaaggtcaggaccccctctagaaaattgtccgaacacaacactaaaaagaagaatgtgcctggccttaaggccgccgacaacgagtcagccggtcagtgggtccatgtgagtgacacttacttgcaggtcgttcctgagtcccgcgccttgtccgcccaggcctatctgttattttacgagcgggtcctttag

SEQ ID NO: 51849 - DNA, 870 bp, Artificial Sequence
  Description of Artificial Sequence: Synthetic coding sequence
atgcgggtgaaggaccccaccaaggccctgcccgagaaggccaagaggagtaagcgccccacagtcccgcatgacgaagattcctcagatgacattgccgttgggttgacctgccaacatgtgtcacacgccattagcgttaatcacgtgaaacgagcaattgctgagaacctttggtccgtgtgctctgagtgccttaaggaacgccgcttttatgacgggcagctagtgttaaccagtgacatttggctatgcctgaagtgtgggttccagggctgtggtaaaaactcagagtcccagcactcgctcaaacactttaaatcaagcaggacggagccacactgtatcatcataaacctgtcaacttggatcatttggtgttacgagtgcgacgagaagcttagtactcattgcaataagaaggtcctcgctcagatcgttgacttcctgcagaaacatgcctctaagactcagacaagcgccttttcacgcattatgaagctctgtgaggagaagtgtgagacagatgagattcaaaaaggagggaaatgccgtaacttgagcgtgcgggggataacaaatctcgggaatacatgctttttcaatgctgtcatgcagaatttggctcaaacttacaccctgaccgatctcatgaacgaaattaaggagtcctcaactaagctaaaaattttcccttcttcagattcacaacttgatcctctcgttgtagagctgtcgcggccagggcctctgacctctgccctttttctttttttgcactctatgaaggagaccgagaagggacctttgtccccgaaagttctgttcaaccagctgtgccagaagtgggttcacctgcacctgatatag

SEQ ID NO: 51850 - DNA, 2445 bp, Artificial Sequence
  Description of Artificial Sequence: Synthetic coding sequence
atgcgggtgaaggaccccaccaaggccctgcccgagaaggccaagcgctctaagagacctaccgttcctcacgacgaggacagctcagacgacatcgcagtggggcttacatgtcagcatgtgagccacgccattagcgtgaaccacgtgaaacgcgccatagccgaaaatctttggtcagtgtgctccgagtgcctgaaagaacgccggttctacgacggccagttggttctcacctctgatatctggctctgccttaagtgcgggttccaggggtgcggcaagaattctgaaagccagcacagcctcaagcacttcaagtcatcgcggacggagccacactgtattatcattaacctgtcaacatggatcatatggtgctacgaatgcgacgagaagctgtccactcattgcaacaagaaggttctggcacagatagtcgacttcctgcagaagcacgcttccaagacccagacctcggcatttagccgaattatgaagctctgcgaggaaaagtgtgaaacggatgagattcaaaagggtggaaaatgccggaacctgtcggtaagaggcattaccaatctggggaatacctgtttctttaacgccgttatgcaaaatcttgcacaaacctataccttaaccgatcttatgaacgaaattaaagaaagcagtactaaactaaagatcttcccaagctcagactcccagctcgaccctctagtggtcgagctgagccggccggggcccctgacaagcgcccttttccttttcctccattccatgaaggaaaccgaaaaagggcccttgagcccaaaggtgttgttcaaccagctgtgccagaaggccccaaggttcaaggatttccagcagcaggacagccaggaactcttgcactacctgctggacgccgttcgcactgaggaaaccaaacgcatccaggcttctattctcaaagcctttaataatcccaccacaaagacagcagacgacgagacgagaaaaaaagtgaaagcctatggaaaagaaggcgtgaaaatgaactttattgaccggatctttatcggcgagttaacttccaccgtgatgtgtgaagaatgcgcgaatataagcactgtcaaggacccgtttatagacatctcccttcctatcatagaagaaagagtgtcaaaacctcttctctgggggagaatgaacaagtatagatctctgcgggagactgaccatgaccgctatagtggtaacgtgaccatagagaatattcatcagccccgcgccgccaagaagcactcatcctccaaagataagtcccaacttattcacgatagaaagtgtatcagaaaactgtcctccggcgaaaccgttacctaccagaagaacgaaaatctggagatgaacggtgacagtcttatgtttgcttcccttatgaattccgaatctcgtttgaatgaatccccaacagacgattctgaaaaggaggcttctcatagcgaatctaatgtagacgccgattctgaacccagcgaatccgaaagcgccagtaaacaaactggactgttcaggtcgtcaagcgggtctggggtgcagcctgatggaccactgtacccactaagtgctgggaaactgctatacactaaagaaaccgacagcggagataaagaaatggctgaggccatatccgaattaaggctgtcttcaaccgtgactggtgaccaggattttgaccgcgaaaatcagcccctgaacatctccaataatctgtgcttcttagagggtaaacatctgcgaagctactccccacaaaacgcgttccagaccctgtcccagtcctatataaccacctccaaggagtgcagcattcagagctgcctctatcagtttacttcaatggagctgctgatgggtaataataaattactgtgtgagaattgtacaaaaaataagcagaaatatcaggaggaaacatcttttgcagagaagaaggtcgagggcgtgtacactaatgcacggaagcagcttctgatcagtgcagtgcccgctgttctgatactgcatctcaaacgcttccatcaggctgggctcagcctacgcaaggtcaacagacacgtcgacttcccactgatgttagacttagctcccttttgctcggccacatgtaaaaatgcgtccgttggggacaaagtgctgtacgggctctatgggattgtggagcacagtggttccatgagggagggccactacactgcctacgtgaaagtccgcacaccaagtcggaagctgtccgagcataatactaagaaaaaaaatgttcccggactgaaagccgccgataatgagtccgcagggcagtgggtgcatgtttccgatacctacctgcaggttgtccctgagtcacgagctttatccgcacaggcctacctcttattttacgaacgggtgttgtag

SEQ ID NO: 51851 - DNA, 159 bp, Artificial Sequence
  Description of Artificial Sequence: Synthetic coding sequence
atgcgggtgaaggaccccaccaaggccctgcccgagaaggccaagagaagtaagcgcccgactgttccacacgatgaagacagctctgacgatatcgcagtcggtctgacatgtcagcacgtgtcgcacgctatctctgtgaaccacgtgaagcggtag

SEQ ID NO: 51852 - DNA, 324 bp, Artificial Sequence
  Description of Artificial Sequence: Synthetic coding sequence
atgctggacctggcccccttctgcagcgccacctgcaagaacgcctctgtgggagataaagtgctctacgggctgtatggaatcgtagagcattctgggtcgatgagggagggccactacacagcatacgtgaaggttagaacccccagccggaagttaagtgagcacaatacaaaaaagaagaacgttccgggcctcaaggccgccgataacgagtcagccggccagtgggtgcacgtctctgacacataccttcaggtggtgcccgaatcccgggccctctccgcccaggcctaccttctcttttacgaaagggtcctctag

SEQ ID NO: 51853 - DNA, 1923 bp, Artificial Sequence
  Description of Artificial Sequence: Synthetic coding sequence
atggaccggtgcaagcacgtgggccggctgcggctggcccaggaccactccatccttaaccctcagaaatggtgctgtcttgaatgtgctacgacagaatccgtttgggcatgcctgaaatgctcccacgtcgcgtgcggacgttacatcgaggatcacgcgctgaagcacttcgaggagactgggcaccctctggccatggaggtgcgggatttatatgtgttctgctatctttgcaaagactatgtcctgaatgataatcctgagggcgacctgaagcttctgcggagtagtctgctggcagtcaggggtcagaagcaggacacccccgtaaggcgtgggcgaaccttaaggagcatggcctcaggggaagatgtcgtgctgccacaaagagccccgcagggccaaccacagatgctgactgctttgtggtacagacgacagagactgttggctcggactctgaggctgtggttcgagaagtcttctcgtgggcaagctaaattggagcaaagaaggcaagaggaggccctggaaaggaagaaggaagaagcccggcgcaggcgcagagaggtgaaaagaagactgctcgaggaactcgcctcaacgccgccccgcaaaagtgccagactcctactccacaccccccgagacgccgggccggccgcatctcggccggctgctctccctacgagccgtcgtgtgccagccgccacacttaagcttcggcggcagccggccatggcgccaggcgtgacaggcctccggaacctgggcaacacctgttatatgaacagtatcctccaggtgctgtcacacctccaaaagtttagagaatgttttctgaatttggacccatccaagactgaacacctcttccccaaggctacaaatggtaaaacgcagcttagcgggaagcctaccaattcatcggccactgagttgagcctccgtaatgacagagcagaggcgtgcgagcgcgagggcttttgctggaacggccgggccagcatcagccgatcactagagcttattcagaataaggaaccatccagcaaacatatttcactgtgtagggagctgcacacattgttccgcgtcatgtggtccggaaaatgggccctcgtatcccccttcgcaatgctacatagcgtgtggtctctgatccctgcttttcgcggctatgatcagcaggacgcacaggagtttctgtgcgagctgctgcacaaggtccagcaagagcttgagtccgaggggaccacaaggcgcatactcataccatttagtcagaggaaactcactaagcaggtgctgaaagtggtgaacaccatttttcatggacagctcctgtcgcaagtaacctgcatttcttgtaattacaaatccaatacaatcgagcctttttgggatctgtccctggagtttcctgaacggtaccactgtatagagaaagggttcgttcccctgaatcagacggaatgccttttgaccgaaatgttggcaaagttcacagagactgaggccctggaaggacgtatatacgcctgtgaccagtgcaattccaaaaggcgaaagtctaaccctaaaccacttgtgttgtccgaggcacgcaaacaactgatgatctacaggcttccgcaagtgctgaggcttcatcttaagagattccgttggtcaggacgcaaccaccgggaaaagataggtgtccacgtggtgttcgatcaggtgttaaccatggagccctactgctgcagggacatgttgagctctctggataaggagaccttcgcctacgatctatccgctgttgtcatgcatcacggaaaaggtttcggtagcgggcattacacagcttactgttataataccgagggcggggcgtgtgccctattgtgcggtgtcggcgacacagagcgtggatag

SEQ ID NO: 51854 - DNA, 1923 bp, Artificial Sequence
  Description of Artificial Sequence: Synthetic coding sequence
atggaccggtgcaagcacgtgggccggctgcggctggcccaggaccattctattctgaatccccagaagtggtgctgtctggagtgtgccaccacagaatctgtgtgggcttgtctcaagtgtagccacgtggcgtgcggacgatacattgaagatcatgctttgaaacatttcgaggagaccggccatccgcttgcgatggaggtgagagatctgtatgtgttctgctacctgtgcaaagactacgtgttgaatgataatcctgaaggagatctgaagctgctgcgctcatcactcctcgccgttaggggccagaaacaagacacccccgtccggcgcggcaggactctgcgaagcatggcttcaggtgaagacgtagttttgccacagcgggcaccgcaggggcaaccccagatgttgacagccctgtggtacaggaggcagcggttgcttgcacgtaccttgagactgtggtttgagaagtccagtcgcggtcaggctaagttggaacaacgaaggcaggaggaagccctggaaagaaaaaaggaggaggctagacggcgccgcagggaagtcaaacggcgactgctggaagagctggcaagtactccgccaaggaaatccgctaggcttcttttgcacaccccacgcgacgccggtcccgccgctagccgtccagcagccctgccgacatcaagacgggtcccagctgccacactgaaactgaggcggcaaccagctatggctcctggcgtgacagggctccgcaatttgggaaatacttgctacatgaatagcattctccaagtgctgtcccatctgcagaaatttagagaatgttttctgaatctcgacccaagcaagacagagcatcttttccccaaagcaacaaacggtaaaactcagctcagcgggaagcccaccaacagttcagccactgaactgtcactgaggaacgatagagccgaggcatgtgaaagagaaggtttctgttggaatgggagagcaagtatctcccggtctctcgagctcattcaaaacaaagagccttcctccaagcacatctcactttgtcgagaactccacactctcttccgcgtgatgtggtctggaaaatgggcactagtgtctccattcgcaatgctgcactcagtctggtccttgatccctgctttccgagggtatgatcagcaggacgcccaggagttcctgtgtgagctcctgcataaggtccagcaagagcttgaatccgagggcactactcgtagaatactaattcctttctcacagaggaagctgacgaaacaggtactgaaggtcgtgaataccatattccacggccagttgttgagccaggtcacatgcataagttgtaactataaatccaatacaatcgagccattttgggacttatcactcgaatttcccgagagataccactgtatagaaaaggggttcgtgcccttaaatcagaccgagtgtttgctcacagagatgttggcaaaattcacggaaactgaagccctcgaggggcggatatacgcgtgcgaccagtgcaatagcaagagaagaaaatccaaccccaagcctcttgtgctcagcgaagcccgaaaacagctgatgatatatcggctgccacaggtgctccgactgcacctgaagcgatttaggtggtccggtagaaatcatcgggaaaagataggcgtgcatgtggtgtttgaccaggttttaaccatggaaccctactgttgccgcgacatgctctcctctcttgataaagagaccttcgcctacgacctgtccgcggtcgtgatgcaccacggtaagggtttcggctcaggccattataccgcctattgctataacactgaaggaggagcctgcgccttactttgcggcgtgggtgatactgagcggggctag

SEQ ID NO: 51855 - DNA, 2067 bp, Artificial Sequence
  Description of Artificial Sequence: Synthetic coding sequence
atggaccggtgcaagcacgtgggccggctgcggctggcccaggaccatagcatcctgaatcctcagaagtggtgctgtctggaatgcgcaaccactgagagtgtctgggcctgcctgaagtgctcccacgtggcgtgcgggagatacatcgaggatcatgctctcaaacattttgaggagaccgggcatccactcgctatggaggtccgcgacctctacgtcttctgctacctgtgcaaagattatgtgctcaacgataatccagaaggggatttgaagctgctccggagctctctcctggccgtgagggggcagaaacaggatacaccagtgagaagaggaagaacattacgcagtatggccagtggcgaagacgtggtgctgcctcagcgcgccccacagggccagccacagatgctcacagccctatggtataggcgccagaggcttttggcccgtaccctgcgcctgtggttcgagaaatcttccaggggccaagctaagctcgaacagcgccgtcaggaggaagccctggagagaaagaaggaagaagctagacggcggcgtcgcgaagtcaagcgccgcctgcttgaagagcttgcctcaactccacctcgcaagtctgcgcgcctgctactgcatacgccacgtgatgccggacccgcagcttccagaccggctgcattgcccacatcgcggcgcgtgccagcagctacattgaagctccgtagacaaccggctatggctcccggtgtgactggcctccgcaatttaggaaatacatgttacatgaattcaatcttgcaagttctcagccacctgcagaaatttagagagtgctttttaaatctcgatccttcaaagactgagcatctctttccgaaggccacgaatggtaagacacagctgagcggcaaacccaccaactcctccgctactgagcttagcctacgcaatgacagagcagaggcttgcgagcgggaggggttttgctggaatggacgtgcatccatttcacggtctctcgagcttatacaaaataaagagccttcctccaaacacatctctttgtgcagagaactgcataccctcttccgggtgatgtggtctgggaagtgggccctggttagtccatttgctatgcttcacagtgtgtggtcgctaattcccgcatttagaggctatgaccagcaggatgctcaagagttcctatgtgagttgctgcacaaggtgcagcaagaactggagtcagagggcactacaagaaggatcctaataccattctctcagagaaaactgaccaagcaggtgctgaaagtggtgaacacgatattccatggccagttgctgtcacaggttacttgtatctcatgtaactataaatccaacactattgagccattttgggacctgtccctggagtttccggaacgataccattgcattgaaaaagggttcgtgcccctcaatcaaacggaatgcctgttaactgagatgctcgctaaatttactgaaactgaggccctggagggcagaatctacgcctgtgatcaatgcaattccaagagaagaaaaagcaaccccaagcccctggtgctgagtgaggctagaaagcaacttatgatttacagattacctcaagttctccgtctacacctgaagagattccgttggtcggggcgcaaccatagggaaaaaatcggtgttcacgtagtattcgaccaagtcctaaccatggaaccctactgttgcagagacatgctctcatcgctcgataaggagaccttcgcttatgatctgtccgccgtggtgatgcaccatggaaaaggcttcgggtctggacactacactgcatactgttataataccgaaggggggttttgggtacattgcaacgactctaagctaaatgtttgtagcgtagaagaggtgtgtaagacacaagcctacatactcttctatacacagcgcacagtgcagggcaacgcgaggatcagtgaaacccatcttcaggctcaggtccaaagttcaaataatgacgaaggtcgaccacagacattttcttag

SEQ ID NO: 51856 - DNA, 2067 bp, Artificial Sequence
  Description of Artificial Sequence: Synthetic coding sequence
atggaccggtgcaagcacgtgggccggctgcggctggcccaggaccattccatactcaatcctcaaaaatggtgttgtcttgaatgtgccaccaccgaatccgtgtgggcgtgtctgaagtgctcacacgtggcctgtgggcgttacattgaagaccatgccctcaaacactttgaggaaacaggtcatcccctggcaatggaggttcgggatctatacgttttttgctatctctgcaaagactatgttctgaacgataatcctgagggagacttaaagctcctccgaagtagccttctggccgtgaggggacagaaacaggacacgcctgttagaagaggaaggacccttcgaagcatggcctctggcgaggacgtcgttttgcctcagcgagctccacagggccagccccagatgttgacagccctctggtaccgccgtcaacgattactggctaggaccctacgcctttggtttgagaaatctagcagaggacaggcaaaacttgagcagcggagacaggaagaagccctggaacgcaagaaggaagaggccaggcggaggaggagggaagttaaacgcagacttctggaagagttggcttcaacacccccccgaaaatctgccagactgttgttgcatacaccccgcgacgccggacctgcagcaagtcgtccagctgctcttcctacctctcgccgggtccctgccgcgacgctcaagctgagaaggcaaccggctatggccccaggcgtcaccggcttaaggaacttgggaaacacttgttacatgaactccattctgcaggtgcttagccacctgcagaaatttcgagaatgcttcctgaacctggatccctccaagacagagcacttatttcctaaagctaccaatggaaaaacacagcttagtggcaagccgacaaatagcagcgctaccgaactttcattacgcaatgatcgggccgaggcctgcgagcgggaggggttctgctggaacggacgggccagcataagtaggtccctagagcttatacagaataaggagcctagctctaaacacatttccctctgccgcgagttgcacactctgttccgggtcatgtggagcggcaagtgggcactagtgagcccgtttgcgatgcttcactcagtctggagcctgattccggccttccgcggttacgatcaacaggacgcccaggagttcttatgtgagttgctccacaaagtacagcaggaactggaatctgaagggacgactagacgcatcctgatccctttttcccaacgaaagctaaccaaacaggtactgaaagtggtgaataccatttttcacgggcagctcctgagtcaggtgacctgtatcagctgtaattacaaaagtaatacaattgagcctttttgggacttgtcactggagtttcccgagaggtatcactgtatcgagaaaggatttgtgccactcaaccagacagagtgtcttctgacagaaatgcttgctaaatttacagagacggaggcattggagggcaggatttatgcctgcgaccagtgtaattctaagcggcggaagtctaatcctaaaccattggtgttgagtgaagcacgcaaacaattaatgatttaccggctgccccaagttctgcgcctgcatctaaaaagatttaggtggtcagggcgaaatcatcgggaaaagataggcgtccatgtagtgttcgatcaagtgttaactatggagccatactgttgtcgggatatgctcagctctctcgataaggaaacatttgcgtatgacctgtccgcggtcgtgatgcaccatgggaagggcttcggctccgggcactatacagcttattgttataatacagaaggcgggttctgggtacattgcaacgattctaaattaaacgtctgcagcgttgaggaagtgtgcaaaacccaggcctatattctgttttacacccagcggacggtgcaagggaacgcacgaatatctgagactcatttacaggctcaggtccagtcatctaacaatgatgagggccgccctcagacgtttagttag

SEQ ID NO: 51857 - DNA, 48 bp, Artificial Sequence
  Description of Artificial Sequence: Synthetic coding sequence
atggaccggtgcaagcacgtgggccggctgcggctggcccaggactag

SEQ ID NO: 51858 - DNA, 114 bp, Artificial Sequence
  Description of Artificial Sequence: Synthetic coding sequence
atggaccggtgcaagcacgtgggccggctgcggctggcccaggaccacagtatactgaaccctcaaaagtggtgttgtctagaatgcgccacaaccgagagtgtctgggcatag

SEQ ID NO: 51859 - DNA, 1005 bp, Artificial Sequence
  Description of Artificial Sequence: Synthetic coding sequence
atgaccagccagcccagcctgcccgccgacgacttcgacatctaccacgtcctcgcggaatgcacagattattatgacacattgccagtcaaggaggccgacggtaatcaacctcactttcagggggtcacgggattatggaacttaggaaatacttgctgcgtaaacgctatcagtcagtgcctgtgcagcattctgccattagttgagtattttctgactggcaagtatattaccgccttgcagaacgactgctcagaggtcgcaaccgcctttgcatatctgatgactgacatgtggctcggtgacagtgactgcgtgagtcccgaaatcttttggtcggcgctgggcaatctgtatcccgccttcacaaaaaagatgcaacaggatgcgcaggagttcctcatatgcgtcctgaacgaactgcatgaagccctcaagaagtaccattactctcggcgccggagctatgaaaagggttcaacacagagatgttgccgtaagtggatcactactgaaacttccattatcactcagctgttcgaagaacagttaaactattccattgtgtgcttaaaatgtgagaaatgtacatacaaaaacgaggtgttcacagtattcagcctgcccatcccgtccaaatatgagtgctccctcagggactgtctccagtgctttttccaacaggatgccctaacttggaacaatgagattcactgctccttctgtgaaacaaaacaggaaacagccgtgcgggcatcaatctctaaggctcccaagattatcatttttcacctgaaacgcttcgacattcagggtacgacaaagcgaaaactgcggactgacatccattatcccctaacgaatctggatctgaccccctatatttgctctatctttcggaagtaccccaaatacaacctgtgcgccgtggttaatcatttcggggacctggatgggggtcattatactgccttctgtaagaatagcgtcacacaggcctag

SEQ ID NO: 51860 - DNA, 2136 bp, Artificial Sequence
  Description of Artificial Sequence: Synthetic coding sequence
atggcccaggtgcgggagaccagcctgcccagcggcagcggcgtgcgctggatctcaggcggcggaggtggcgcctcacctgaggaggctgtggagaaggcgggaaagatggaggaagcggccgccggtgcaacaaaggctagcagtagacgagaggctgaggagatgaaattggagccgctgcaagaaagggagcccgcgccagaggagaacctgacatggtccagctccggcggtgacgaaaaggtccttccctccataccactgcggtgtcatagttcttctagcccagtctgtccaagacggaagccacggcctagaccgcagccacgggctcggtctcgaagtcagcctggcctctccgcgcctccacccccgcctgcgcgccctcctccacctcctccacctcccccgccaccggccccccgtcccagagcttggcgaggatctcgacggaggagccggcctggaagccgacctcagactcgtcgatcatgctctggcgacctcgacggcagcggcgatcccggcgggctcggcgattggctactcgaagtggagttcggtcaggggcccaccggctgtagccatgtcgagagttttaaagtgggcaagaactggcagaaaaacctccgcttaatctaccagcggttcgtctggtcaggaacccccgagactcgtaaacgcaaagctaaaagctgcatttgccatgtctgctccacacacatgaacaggctccattcatgtttaagctgcgtgttcttcgggtgctttaccgaaaaacacatacataagcacgcagaaaccaaacagcaccacttagcggttgacctgtaccacggcgttatttactgcttcatgtgtaaggactacgtctatgacaaagacatcgagcagattgccaaggagaccaaggagaaaattctgcgcctactgaccagtacatcgaccgacgtcagtcatcagcagttcatgacaagtggtttcgaagacaaacagagtacttgtgagacgaaggagcaagagccaaaactggtgaagcccaaaaaaaaaagaaggaaaaagagtgtgtatacagtgggtctgcgcggcttgataaatctggggaatacatgtttcatgaactgtatcgtgcaggcactcacccacatccctttgctgaaagactttttcctgtctgacaagcacaagtgcattatgacttccccaagcttatgcctcgtctgtgagatgagctccctgttccacgcaatgtattccgggagtcgaaccccgcacatcccttataagctgctgcatctgatttggattcacgcagaacatttagctggatatcgacaacaagacgcccacgagttcttgatcgcaattctggacgttctgcatcgtcactctaaagatgacagtggggggcaggaagcgaacaaccctaattgttgtaattgtattatagatcagatcttcaccggcggtctccagtccgacgtcacatgccaggcatgtcactccgtatctaccaccatagacccctgctgggatataagtcttgacctgcctggctcatgcgcgacattcgattcccagaaccccgaacgggccgatagtacggtgtcaagagatgatcatattcctggtatcccatccctgacagactgcttacagtggttcacccgacccgagcatctagggtcttccgccaaaataaagtgcaactcttgtcagagctatcaggagagtaccaagcagctgaccatgaaaaagctgccaatcgttgcgtgcttccacttgaaaaggttcgagcatgtgggtaaacagaggcgtaaaatcaacacattcatctctttcccattagagttggacatgacaccgtttcttgccagtacaaaagaatctcggatgaaagaaggccagccccctactgactgtgtgcctaacgagaacaagtattctctattcgcggtgatcaaccaccatggtactctggagtctggacactacacttccttcattcgacagcagaaagaccagtggtttagctgtgatgatgccattattacaaaggccacaatagaggatcttctctactctgaaggatatctgttattctaccataagcaggggcttgaaaaggactag

SEQ ID NO: 51861 - DNA, 3222 bp, Artificial Sequence
  Description of Artificial Sequence: Synthetic coding sequence
atggcctgggtgaagttcctgcggaagcccggcggcaacctgggcaaagtgtatcagccaggtagcatgctgagcctggcccctaccaaaggtctgttgaatgagccaggccaaaacagctgcttcctgaactcagccgtgcaggtcctatggcagctggacatttttcgcaggagcctgcgtgttctgaccggacacgtttgccaaggcgacgcatgtatcttttgtgccctgaagactattttcgcacagtttcagcattctcgggaaaaagccctaccgtccgacaatatcagacacgctttagccgagagcttcaaggatgaacagaggttccaattgggcctaatggacgacgccgctgagtgtttcgaaaacatgttggagagaatccacttccatatagtgcccagtagagacgccgacatgtgtacctctaagagttgcatcacacaccagaaattcgcaatgaccctttacgaacagtgtgtgtgccgatcatgtggtgcatcctccgatcccctgccgtttacagagtttgtcaggtatatttctacaacggcactatgtaacgaggtggagcggatgctggaaaggcatgagagattcaagcccgaaatgttcgctgagctcctgcaggccgccaatacaaccgatgactaccggaagtgccccagcaattgtgggcagaagattaagattaggcgtgtcctgatgaattgccctgagatcgtgaccatcgggctagtgtgggacagcgagcacagcgatttgactgaagccgttgtgcggaatctggccactcacctgtacctgcctggactgttctatcgcgtcaccgatgagaatgctaagaactctgagctgaatctagtaggaatgatctgctacaccagccaacattattgcgcctttgcttttcataccaaaagttccaaatgggtgtttttcgacgatgctaatgtaaaggagattggaacacgctggaaggatgtagtgtctaagtgtatacgctgccacttccagccactgctcctattctatgccaatcccgatggcacagccgtatccacggaggacgccctcagacaggttatctcttggtctcactataagtctgtggctgagaacatgggttgtgagaagcctgtcatccataaatctgataacctgaaggaaaatggatttggtgaccaggctaaacaacgagagaaccagaagtttcctacagacaacatatcgtcaagcaatagaagccattcccacactggcgtgggaaagggcccagccaaactgagtcatattgaccagagagaaaaaattaaggacatctctcgagagtgtgctttaaaggctatcgagcagaaaaacctcctttcttcccaaaggaaggacttagagaaagggcaacggaaagacctggggcgacatagggacctggtggatgaagacctttctcatttccaatcaggctctcctcccgcgccgaatggttttaagcagcatggtaacccccatctttaccacagtcagggaaaaggtagctataaacatgacagagtggtgccacaaagccgggcaagcgcccagattattagcagctccaaatcccaaatcttggcccctggagagaaaatcacgggaaaggtgaagagcgacaacgggaccggttatgacaccgacagctcccaagattctcgcgacagagggaattcttgcgatagctcctctaaatctagaaatcgtggatggaagccgatgcgggaaaccctgaatgtggactccattttctcagaaagcgagaaacgacaacatagtccaaggcataaaccaaatattagcaacaagcccaagtccagcaaggacccttcattctctaattggccaaaggagaatccgaagcaaaaaggccttatgactatttacgaggatgagatgaaacaggaaattggatctaggagttccttggagtcaaatggtaagggcgctgaaaaaaataagggtctggtcgaaggcaaagtgcacggggacaactggcagatgcaaagaaccgaatctgggtatgaatcctccgatcatataagcaatggaagcactaacctggatagcccggtcattgacgggaacggtactgtcatggatatatctggtgttaaggaaaccgtgtgttttagcgatcagattacaacctccaacttaaacaaggagcgtggagactgcacatccctgcagtcacagcatcacctcgaagggtttcgcaaagaactgcgtaatctagaagctggttacaagtcccatgaattccaccctgagtcccatttgcagatcaaaaatcaccttatcaagagatcacacgtgcacgaggacaatggcaagctgttcccctcatcttcactgcaaattcctaaagaccacaacgctcgggagcatatacaccagtccgacgaacagaaacttgagaaaccgaatgaatgtaaatttagcgagtggctcaacattgagaattcagagcgaaccggtctcccttttcatgttgataacagcgcatcgggcaagcgagttaattccaacgagccttcatccctctggtctagccacctgagaaccgtgggtctgaagccagagactgcacctctgatccaacagcaaaatataatggaccagtgctacttcgagaattccctgtcaacagagtgcattattcgatcagcatctcgatcggacggctgccagatgccaaagctgttctgccagaatttgcctcctcctctcccccccaaaaagtatgcaattacctctgtgccacagagcgaaaaatccgagagcactcccgatgttaaacttactgaggttttcaaagccacatcccacttgccaaaacactctttatctaccgcatcagaaccctcactggaggttagtactcacatgaatgatgagcgtcataaggaaaccttccaggttcgggagtgttttgggaataccccaaactgccccagtagttcttccactaacgattttcaggctaactccggagccattgacgccttttgccaaccagaacttgactccatttccacatgtccaaacgagaccgttagcctgactacatattttagtgtggattcttgcatgaccgatacatataggttgaagtaccatcaacggccaaagctgtcattccccgagagttctgggttctgcaacaactcactttcctag

SEQ ID NO: 51862 - DNA, 3222 bp, Artificial Sequence
  Description of Artificial Sequence: Synthetic coding sequence
atggcctgggtgaagttcctgcggaagcccggcggcaacctgggcaaggtgtatcagccggggtcaatgctgagccttgcacccaccaaggggctactgaatgaacccggtcagaatagctgcttcctgaactctgcagtgcaagtcctgtggcagctcgacatcttccgccggagtctacgggtcctgaccggtcacgtgtgtcagggcgacgcgtgcattttctgcgctctgaagacaatcttcgcccagtttcagcactcccgagaaaaggcattgccctctgacaatattcgacacgctctagctgaatcttttaaggacgaacagagatttcagctgggccttatggatgatgccgctgagtgcttcgagaatatgttggaaagaatccactttcacatcgttcctagcagagacgctgatatgtgcacaagcaaatcttgcataactcatcagaagtttgcaatgactctgtacgagcaatgcgtctgccgttcctgcggggcttcatccgatccacttccatttaccgagtttgttcgttatatttctactacggccctgtgcaacgaagtagagcgcatgttagaacggcacgaaagatttaagcctgaaatgtttgccgaactgcttcaggctgccaacactaccgacgactaccggaagtgtccctccaattgtggccagaagataaagatcagaagggtactaatgaactgccctgaaatcgtgactataggactggtctgggacagcgagcactcagacctgacagaggcagtggtaaggaatttggccacccacctttatctgcctggccttttctatcgggtgacagacgagaacgccaagaactccgagctaaacctggtgggaatgatttgctataccagccagcattactgcgcctttgccttccatacaaagtcatcgaagtgggtgttcttcgacgacgccaacgttaaggaaataggcaccagatggaaggatgtggtgagtaaatgcattagatgccactttcaacctctgctgttgttttacgccaatccagacgggacagcagtatccaccgaagacgccctcagacaggttatctcctggtcccattataaatctgtggctgagaacatgggctgcgagaagccagtgattcacaagtcagataatctaaaggagaatggcttcggcgaccaagccaaacagagagaaaatcagaaatttcctaccgacaacatctctagctccaacagatcccattctcacaccggagtcggtaaggggcctgccaaactgtcccatatcgaccagagggagaagattaaggacatctcacgcgagtgcgctctcaaggccatcgagcagaaaaatctactttcgtcccaacggaaagacttggagaaggggcaacggaaagacctggggagacacagggatctcgtcgacgaggacttgtctcatttccaatccggaagtccccccgctcctaatggattcaaacaacacgggaacccccatttgtatcattctcaagggaagggtagctataagcacgatcgcgtggtccctcagtcacgggcatccgcgcagatcattagctcctccaagtctcagattttggctcccggtgaaaaaatcacagggaaagtgaagtccgataacggtaccggatatgatacggactcctcacaagatagccgggatcgaggaaactcttgcgatagttcgtctaagagccgcaacaggggctggaagcccatgcgagagaccctaaatgtcgactccatcttttctgagtccgagaaacgtcagcattccccccgacacaagccgaacatttcaaataaacccaagagctcgaaggacccttcatttagtaactggccaaaggagaatcccaagcaaaagggattgatgaccatttacgaggatgagatgaagcaagaaatcggctctcgatcatctctggaatctaacgggaaaggcgcggaaaagaataaaggactagtcgaggggaaggtgcatggtgataactggcagatgcagcggaccgaatcggggtatgagtcgtccgatcacatcagcaatggctctacgaacctggattcccccgtgatcgacggtaacgggactgtgatggatatttcaggcgtgaaggaaactgtctgctttagcgatcagataacaacttctaacctcaataaagaaaggggcgattgtaccagtctgcagtctcaacaccatctcgagggcttccgaaaagagctccgtaacctagaagcagggtataaaagccacgagttccatcctgagtctcacctgcagattaagaatcacctgatcaaaaggagccatgtgcacgaagataacggaaagttgtttccaagctccagtctgcagattcccaaagatcataatgctagagaacacatccaccagtcggacgaacaaaagctggagaaacctaacgagtgtaagttttccgagtggctcaacattgagaactccgaaaggaccgggctgccctttcacgtggataactcggcaagtggaaagcgcgttaatagcaatgagcccagtagtttatggtccagtcacctgcgcaccgttgggttaaagccggaaaccgcacctctaattcagcagcaaaatattatggaccaatgctatttcgaaaattcactttcaacagagtgtataatcagatccgcatccaggagtgatggatgccagatgccaaaactgttctgtcagaacttacctccacccctccccccgaagaaatatgctatcactagcgtgcctcaatccgaaaagagtgaatcaactccggacgtcaagcttaccgaggtgtttaaggccaccagccatctccccaagcactcacttagcacagcctctgagccctccctagaggttagtacgcacatgaatgatgaaagacataaagaaacctttcaggtgagggagtgctttggtaataccccaaattgtccatcttcgtcttctaccaatgacttccaggccaacagcggtgctatcgacgccttttgccagccagagctcgattcaatcagcacctgcccgaatgagactgttagtttaacaacgtacttcagcgtagacagctgcatgaccgatacatacagactcaaataccaccaaaggcccaaattaagtttcccagagagttcagggttctgtaacaattccctgagttag

SEQ ID NO: 51863 - DNA, 2235 bp, Artificial Sequence
  Description of Artificial Sequence: Synthetic coding sequence
atgagctggaagcggaactacttcagcggcggccggggcagcgtgcagggtatgtttgcccctcggtcctcgacaagcatagcgccctctaaaggcctgtcgaacgaacctggccagaactcctgctttcttaattcagcccttcaggtgctttggcacttagacatcttcagacggtcatttaggcagcttaccacacacaaatgtatgggggacagctgcattttctgtgctctcaaggggatctttaatcagttccaatgttcatcagagaaggtcctgccaagcgacacactgcgaagcgccctcgcaaagacatttcaggatgagcagaggttccagctgggcattatggacgacgccgccgagtgcttcgagaacctcctaatgcggatccattttcacattgcagatgagaccaaggaagacatttgtaccgctcaacactgcatcagtcaccagaagtttgcaatgactctcttcgaacaatgcgtgtgcacttcctgtggagctacttcagatcccctgcccttcattcagatggttcattacatttctacaacctctctgtgcaaccaagcaatctgtatgttggagaggcgggagaaaccttcaccaagtatgtttggcgaactgttacaaaacgcctctaccatgggagatcttagaaactgtcctagcaactgtggagagcggatcaggatcaggagagtgctcatgaatgccccacaaatcatcaccatcgggctggtgtgggacagcgaccacagtgatttagcagaagacgttatccattctctcggcacatgtctgaaactgggagacctgtttttccgggttacagacgatcgcgccaaacagagcgagctctacctggtgggaatgatctgttactatggaaaacattatagcacattctttttccagaccaagatcagaaagtggatgtacttcgacgatgcccacgttaaggaaatagggcctaagtggaaggacgttgtcactaaatgtataaagggacactaccagccattgctgttactgtacgcagatccacaaggaacccctgtcagtactcaagatttgccaccacaggctgagttccagtcatatagccgcacctgttatgacagcgaagactcaggccgagagccttcaatctcgtctgacaccaggactgacagctctacagaatcttatccatataaacacagccaccacgaatcagtagtgagccacttttcatctgacagccaggggacagtgatctacaacgtggagaacgactcaatgtctcaatcaagccgcgatacaggccacctgactgactccgagtgcaatcagaagcacactagcaaaaaaggtagcctgattgagaggaaaaggtctagcggccgggttcgcaggaaaggggacgagccccaggcttcaggctaccacagtgagggtgagacgctcaaagagaagcaggcgccaagaaatgctagtaagccatcctctagcaccaataggctccgggactttaaggagacagtctccaacatgattcataataggccctctttagcaagtcaaacaaacgttggtagtcattgccgcgggcgcggaggagaccagcccgacaaaaagccaccacgcacattacccttgcattcgagggactgggagattgaatctactagctccgagtcaaagtcaagctcttctagcaagtacaggcccacttggcgcccaaagcgcgaaagcctcaacatcgactcaatcttctcaaaagataagcgtaagcattgtggctacacacagctgtcaccattcagtgaagatagtgcgaaagagttcataccagacgagccatccaaaccaccttcctacgatattaagttcggtggaccatctccccagtataagcgatgggggcctgctagaccagggagccacttgctcgagcagcacccacgcttgatccaaagaatggaatctggttacgaaagttcagagcgaaattcctcctcccctgtgagtctcgacgctgcccttcccgagagcagcaacgtctaccgttattgcctggcgtttgaacagcagcactgtctgctgcagcagtgcgaaccacccacatggggctttcaagcctggttaagacaagtggaggggtggccgctgctcttaagcctgtgtgcattgagcacctcctataataactccacgttgtgctggaaaaatcggggcacgtag

SEQ ID NO: 51864 - DNA, 5055 bp, Artificial Sequence
  Description of Artificial Sequence: Synthetic coding sequence
atgagctggaagcggaactacttcagcggcggccggggcagcgtgcagggaatgttcgctccacgaagtagcactagtatcgctcctagcaagggattgtcaaatgaaccagggcagaacagctgcttcttaaacagcgccctgcaagtgctgtggcacctcgatatctttcggcgctccttcagacagcttactactcataagtgtatgggggactcgtgcattttttgcgccctaaagggaatctttaatcagttccaatgtagttccgaaaaggtcctgccctctgataccctgcgcagtgcactcgcgaagacctttcaggatgaacagcgctttcaactgggcatcatggatgatgcggccgagtgttttgaaaacctgctcatgcggatccactttcatatcgccgacgagactaaggaggatatatgtaccgcccagcattgcatcagccaccaaaaatttgccatgacactgttcgaacagtgtgtttgcacaagttgcggcgcgacatcagacccgctgcccttcattcaaatggtccactacatttccacaactagcctgtgtaatcaggcaatttgtatgctcgagagaagggagaaaccttctccaagtatgttcggcgaactcctccagaatgcttcaacaatgggagacctgcgaaattgtccttctaactgtggggaaagaatccgtattagaagggtcctaatgaacgcgccgcagattattactattggtctcgtgtgggatagcgatcattctgatttggcagaagatgttatccattccctaggcacttgtctgaaactcggagacctcttcttcagggtgaccgatgatcgggccaaacagtccgaattgtatctggtcggcatgatctgttactatggtaagcactatagcactttcttcttccagaccaaaatcaggaagtggatgtattttgacgatgcccacgttaaagagatagggcccaagtggaaggacgtggtgaccaaatgcatcaaaggccattaccaacctctgctgcttctgtatgcagatcctcagggcacccctgtgagcacccaagatcttcccccccaagctgaattccagagctactccagaacgtgttatgactctgaggactcaggtcgggaaccgtctattagcagcgacactaggactgactctagtactgagtcttacccttacaaacactctcatcacgaatcagttgtgtcgcacttcagttccgattcccagggcacagtgatatacaacgtagagaacgatagcatgagccagagcagtagggatacaggccatctaactgatagcgagtgtaatcagaagcacacgagcaaaaaggggtccctcatcgagagaaaaaggtcctcgggtcgagtgcgccgcaagggtgatgaaccccaggctagtggctaccacagcgagggtgaaactctgaaggagaaacaggccccccgaaacgctagcaagccgagcagctccaccaaccggctgagggacttcaaagagaccgttagtaacatgattcacaacaggccgagtctggcctcccagacaaatgttgggtcccactgccgagggcgggggggagatcaaccagataagaaacccccaaggaccttgccccttcactccagggattgggaaattgagtctacatcctctgagtctaagtcttcctcaagttcaaaatacagacccacttggcggcctaagcgggagtcacttaacatagacagtatttttagcaaagacaagcgcaagcactgtggctatacccagctgtctcccttttcagaggactccgctaaggaatttattccagacgagccttccaaacctccttcttatgacataaagttcggaggaccttccccacaatacaagcgttgggggcctgcaaggccaggctcccatctactggagcaacacccccgcttgattcagcgaatggaaagcggttacgaaagtagcgagagaaacagttctagtccggtgagtctggacgccgctcttccagagtcctccaacgtttaccgcgatccctctgccaaaagaagcgccggtctagtgccgtcatggaggcacattcctaaatcgcactcctcctccatccttgaagtcgactctaccgctagcatgggaggttggacgaagtctcaacccttcagtggcgaagagatttcgtccaagtccgagctggatgagctgcaggaagaggtcgccaggagggcgcaggaacaagagttgcgacgtaaacgggaaaaagagctcgaagctgctaagggctttaatccccaccccagtagattcatggacttagacgagctacagaaccaggggaggagcgacgggtttgagcgctccctgcaggaggctgagtccgtcttcgaggagtcgctgcacctcgaacagaaaggtgattgcgctgccgcattggcgctctgtaatgaagccatctccaaactgagactcgcactccatggtgcgagctgcagcacccactctcgcgccctggtggacaaaaagctgcaaatatccatcaggaaggcccgaagcctacaggatagaatgcagcagcagcagtcacctcagcagccctcccaaccctctgcgtgcctgccgacgcaggctggaacactcagtcaacctacatctgaacagccaattcccctccaggtgctgctctcccaagaagcacagctcgagagcggcatggatacagaattcggagctagtagtttttttcactctcccgcaagctgtcacgaatcacactcctcactgtctcccgagtcctctgcgccacagcattcatccccgtctcgcagcgcccttaagctgctgacttctgtcgaggtggacaatatagagcccagtgccttccatcggcagggcctgcctaaagcccctgggtggaccgagaaaaattctcaccattcatgggagcctttagacgccccagaggggaagttacagggcagccgctgcgataattctagctgctcaaaattacccccacaggaaggaaggggcattgcccaggaacaattatttcaggagaagaaagacccagctaacccttcacccgtaatgccaggcatcgcaacatccgagcgaggcgacgagcattccctcggatgtagcccgtcgaactcctccgcccaaccaagccttcctttgtatcgcacctgtcaccccataatgccagtagcctcctcctttgttctgcactgcccagaccccgttcagaaaacgaatcagtgccttcagggacagtcactgaaaacatccctgaccctcaaggtggaccgcgggtctgaggaaacttacagacctgaattcccctctactaagggattggtccgctctctagcagagcaatttcaacgcatgcagggcgtgtccatgcgggacagtaccgggtttaaagacagaagtttgtccggctcgctgagaaaaaattcttctccatccgattccaagccccctttctcccaagggcaggaaaagggtcactggccatgggcaaagcagcagagctctctggagggtggtgaccggcccctgtcctgggaagaatccactgagcacagttctctcgccctgaattccggactgccgaacggagagaccagtagtggagggcagcctcgccttgctgaaccagatatttatcaagaaaaattgtctcaggtacgtgacgtgcggagtaaagatctcgggtcaagcaccgaccttgggacttctctccccctggactcttgggtcaacatcacgcgcttctgtgatagccagttgaagcacggcgctccacgtcccggaatgaaatcatcaccccatgacagccatacctgcgtgacctaccctgaacggaaccacattttgctgcaccctcactggaatcaggatacggaacaggagactagcgaattagagtcactgtaccaggcatccctacaagcatctcaggcaggttgttccgggtggggccagcaggatacggcctggcatcccttgtcccaaacagggtccgccgatggaatggggcgaaggctgcacagtgcccacgacccgggactctcgaaaacctctacggcagaaatggagcacggactccatgaagcaaggactgtccgcactagtcaggcaaccccctgtagagggctcagtagggaatgcggtgaagacgagcaatatagcgccgagaaccttaggagaatttcccgttccctgtccggcactgtggtctccgagcgggaagaggcgcccgttagctcccatagtttcgactcgtcaaacgttcgcaagcccttagagaccgggcacaggtgttcctcctccagttccttgccagtgatacatgaccccagtgtgtttctcctagggccacagttatacttgccccagccccaattcctttctcctgacgtgctcatgcccactatggctggagagccaaaccggttacccggtactagtcggagtgttcagcaattccttgccatgtgcgatcgcggagaaacaagccagggagccaagtacaccggccggactctcaattaccagagcctccctcatcggagtcgtactgataatagttgggccccatggtcagaaaccaatcagcacatcggtaccagattcctcaccactcccgggtgtaatcctcaactcacctacaccgctacgcttccagagcgcagtaagggcttacaggtccctcatacgcaatcttggtccgatctgtttcattccccctcgcatccgccaatagtccaccctgtgtatccaccatctagctctctgcatgtgccgcttaggtcggcgtggaacagcgatcccgtgcccgggagtaggacacctggtccaaggagagtggatatgcctcctgatgacgattggcgccagtcctcctatgccagtcattccggccacaggcgcactgtgggggagggcttcctgtttgtcctgtccgacgccccaaggcgcgagcagatccgtgcaagagtcttacagcatagtcaatggtag

SEQ ID NO: 51865 - DNA, 2178 bp, Artificial Sequence
  Description of Artificial Sequence: Synthetic coding sequence
atggacaccgagttcggcgccagcagcttcttccacagccccgcctcttgccatgagagccactcttcgctctcacccgagtcttcagcaccacaacattcgtctcctagccgatcagcgctaaagcttctcacctctgtagaagtcgacaacatcgagccttcagcctttcataggcagggcctcccaaaagcccctggttggacggaaaagaactcacatcattcctgggagccgctcgacgcgcccgaaggtaaattacagggttctcgatgtgataattcatcttgctccaaattgccgccgcaggaaggcagagggatcgcccaggagcagctgtttcaagagaaaaaagatcccgccaacccatctcccgtgatgcctgggatcgccacctctgagagaggagatgagcattcactaggctgctcaccttccaatagctccgcacagccatctctaccgctttaccgcacatgtcatcccattatgccagtggccagcagctttgtcctgcactgtccggatcccgtgcagaagacaaaccagtgcctgcagggccagagcctgaaaacaagcctgacccttaaagtagaccgcggatctgaagaaacatacaggccagagtttccctctacgaaggggctggtcaggtctctggcagaacagtttcagcggatgcagggtgtgtcaatgcgtgatagtacaggattcaaagacaggtcgctttctggaagtctcagaaaaaattcctctcccagtgattccaaaccaccattttcccaggggcaagaaaaaggccactggccatgggctaagcagcagtcctcactggaaggaggagatagaccattgtcgtgggaggaatcgacggaacactcatcattggcactcaattctggtctgcctaacggcgagacgtcgtccggcgggcaaccaaggctggcggagcctgatatataccaggagaagctctctcaagtccgggatgtcaggtccaaagatttaggcagctcaaccgatctgggcacgtccctgccattggacagttgggtcaatataactcgattctgtgacagccaactgaagcacggtgcccctcgacctggtatgaaatctagtccccacgattctcacacatgcgtcacttaccccgaaaggaatcatatcctgctacaccctcactggaatcaggacacagagcaggaaaccagcgaactcgagtcgctgtaccaggccagcctccaggcttcacaagcaggatgtagcggctggggccagcaagacactgcatggcaccccttgtcccagacgggtagtgcagatgggatgggacgccgcttacacagcgctcatgatccaggactcagcaagactagtacagctgagatggagcatggcttacacgaagccaggactgttcggacttcacaagatagttcaaacgttaggaagccactcgagactgggcacaggtgcagctcttcctccagccttccagtaattcacgacccatccgtgttccttctggggcctcagctgtacctgcctcagccccaattcctgtcacccgatgttctgatgccaaccatggctggcgaacctaatcggttgcctgggacttcccgatcggtgcaacaattccttgccatgtgtgataggggagagacatcacagggcgcgaagtatacaggcaggaccctgaattatcaaagtctgccccatcgcagcaggacagataattcatgggctccttggagtgaaaccaatcagcatatcggcacgagattccttacgacaccaggctgtaacccccagctcacttacactgcaactctgcctgaacgcagtaaggggctgcaggttcctcacacacagagctggtccgatctgttccacagtccttctcatccgccaattgtgcaccccgtctacccccctagctcctcattgcacgtgcctcttaggtctgcctggaattctgatccggtgcctggttcgaggacacctggaccacggcgagtcgacatgccccctgacgatgactggagacagtcttcctatgcatcacactcagggcatcggcggactgtgggcgaaggtttcttgttcgtcctgtcagatgctccgaggagggagcaaatacgtgcgagggtgctgcaacactctcaatggtag

SEQ ID NO: 51866 - DNA, 5055 bp, Artificial Sequence
  Description of Artificial Sequence: Synthetic coding sequence
atgagctggaagcggaactacttcagcggcggccggggcagcgtgcagggcatgttcgctccaaggtcgtcaacttccatcgcccccagcaagggactctctaatgaacctgggcaaaattcttgttttttgaacagcgcactgcaggtgctatggcacctggacatcttcagacggtctttccggcagctgacaacacacaagtgtatgggcgatagctgtattttctgtgccctgaagggcattttcaatcaatttcagtgctcttccgagaaagtgctgcctagcgatacattacgttctgctttagcaaagacctttcaggacgaacagcgtttccagttgggcattatggacgacgctgcagaatgctttgagaatctactgatgaggattcatttccatatagcagatgaaacaaaggaggacatttgtaccgcgcagcactgcataagccatcagaagtttgccatgacactctttgaacagtgtgtgtgtacttcctgcggcgccaccagcgatccactgcccttcattcagatggtccattatatcagcaccacatctctttgcaaccaggccatctgcatgctcgaaagacgcgagaagccaagtcccagtatgtttggagagcttcttcagaatgcaagtacgatgggagacctgaggaattgcccttccaattgtggtgagaggataagaattagaagggtactgatgaatgcgccacaaatcatcacaataggcctggtgtgggattctgaccactcagacctcgcagaggacgttatccacagcctggggacctgtctcaaactgggagatctgttttttcgcgtgactgatgaccgcgccaaacagagcgagctttatctcgtcgggatgatctgctattatggaaagcactatagcacattttttttccagactaagatccgcaaatggatgtattttgatgacgctcacgttaaggaaataggacccaagtggaaggatgtcgtgactaaatgtattaagggacactaccagcctctgctcctgttgtatgctgacccacagggcaccccggtaagcacccaggacttgccaccccaagccgagtttcaatcatatagcagaacttgttacgattctgaggatagcgggcgagaaccgagtatctcaagcgacaccaggacagacagctctactgagtcctatccttacaagcactcccaccatgaaagcgtcgtgagccactttagttcagacagtcagggtactgtgatttataacgtggagaacgattcaatgtcacagtcctcccgggatacaggacacctgacagacagtgagtgcaatcagaagcacacatccaagaagggttccctcattgagaggaaacggtcttcaggcagagtccgcaggaaaggagacgagccgcaggcatctgggtaccattctgaaggcgaaacactcaaagaaaagcaggcaccccgtaatgcatctaagccatcctccagcacaaatcggttacgggacttcaaggaaaccgtgtccaacatgattcacaaccggccaagcctggcgtctcaaacaaacgtgggctcacactgccgtggaaggggaggagaccagccagataaaaagcctccgcgcacgttaccactgcacagtcgcgactgggaaattgaaagtacaagtagtgaaagcaagtccagctctagctccaagtaccgccctacatggaggccaaagagagagtctctgaacatcgatagcatcttttccaaggataaacgcaaacactgcggctatacccagctgagccccttctcagaggactccgctaaggaattcattccagacgaacctagcaagccaccgtcttacgacatcaagtttggcggcccttctcctcagtacaagcgttgggggcctgcacgacccggaagccatctgctcgaacagcaccctcgactaatccagcgcatggaatctggttacgaatctagtgaaaggaatagcagctcaccagtgagccttgatgctgcgttgcccgagagctccaacgtgtatagagaccctagcgctaaacggtccgctggcttagtgccctcatggcgccacattccaaagtcccatagcagttcaattctagaggtggatagcacagcatctatgggggggtggacaaaatctcagcccttttccggtgaagaaattagctccaagtcggaactggacgaactgcaagaggaggtcgccaggcgcgcccaggaacaggagttgcgtcgcaaacgcgagaaggagctggaggctgcaaaagggttcaacccccacccctctcgctttatggacctcgacgagttgcagaaccaggggcgctccgacggttttgagcggtccttgcaggaggcagagtccgtcttcgaggaaagtcttcatctcgaacagaaaggagattgcgctgcagcccttgccctctgcaatgaggctatatcaaagctgcgactcgcattgcatggtgcatcctgcagtacccatagtcgagctcttgtggacaaaaaactacagatctcgattcggaaagcccgctctctccaagatcggatgcagcaacaacagtctccacagcaaccaagccagccatccgcctgtttacctacccaggcgggcactttatctcaacccacctcagaacagccgatccctcttcaggtgctcctcagccaggaagcacagctggagagcggcatggacactgaatttggagcgtcctccttctttcactctcccgcctcctgccacgaatctcatagctcactgtccccggagagtagcgccccccaacactcatccccatcaagatctgccctcaagctcctgactagtgtggaggtagataatatagaaccgtctgccttccaccgacagggccttccgaaggctcccggctggacggaaaagaattcacatcattcttgggaaccccttgatgccccagagggtaagctgcagggaagtagatgcgacaactcttcttgttcaaaacttccaccgcaggagggcagaggaatcgctcaggagcagttgtttcaggagaagaaagaccctgccaatccatccccagtcatgccagggatcgctacgtccgagcggggcgacgagcacagtttaggctgctctccttcaaatagttccgcccaaccgagtttacctctgtaccgaacctgtcatccaatcatgcccgtggcatcatcatttgtactgcattgcccagaccccgtgcagaaaactaaccagtgtctccagggacagtccctgaagacatccctgactctaaaagtcgacaggggatctgaggaaacctaccggccggagttcccttcaactaaggggctggttcgctcattggcagaacaatttcagcgcatgcagggtgtgtcaatgcgtgattctactggatttaaagatcgtagcctgtcagggagcttgagaaaaaacagttcccccagtgactccaagccacccttctcccaaggacaggaaaaaggacattggccgtgggcaaagcaacagtccagcctggaggggggggaccggcctctcagttgggaggagtccactgagcacagttcactggctctgaactcaggcctaccgaacggcgagactagctctggtggccagccacgccttgcggaacctgacatctatcaggagaaactgtcacaagtgcgggacgtgagatctaaggacctcgggtcttccacagacctgggcacttcactgcccttagatagttgggtcaacattacgcgtttctgcgatagtcagcttaaacacggagcgcctcggcctggaatgaagtccagccctcatgacagccacacatgcgtaacttacccggagaggaaccatatactactccacccacactggaaccaggatactgagcaggaaacctcagaactagaatccctataccaggccagcctgcaggcaagtcaagcaggatgctccggctggggccagcaggacactgcttggcatccattgagtcagactgggagcgccgacgggatggggcggcgtctgcattcagcacacgaccctggtcttagtaaaacatccactgccgaaatggaacacggcctgcatgaggcaaggaccgtgagaacgagtcaagctaccccatgtcggggtttatcacgggagtgcggagaagatgagcagtattccgccgaaaatctgcgccgcatctccagatccctgtcaggaactgtggtcagcgaaagggaggaggcaccagtgagcagtcattcgttcgattcttctaatgtgcgaaaacctctggaaactggacaccgatgctcaagttcatccagtctccctgtgattcatgacccttctgtgtttttgctggggccacagctttatcttcctcagccccaatttctgtctcctgacgttttgatgccaaccatggcgggcgaacccaatcgtctacccggcacttcgcggtctgttcaacaattcctcgccatgtgcgataggggtgaaaccagccagggcgctaaatacaccggtagaaccctaaattatcagagcttaccccatcgaagtcggaccgataatagttgggcgccttggagtgagacaaaccagcacatagggacccggtttttaaccacacctgggtgcaatccacaactgacttatactgcgactctgcctgaaagaagcaaaggtctccaagtgcctcacacccagtcatggtcagatctgttccactctccatcccaccctcctatcgtgcaccctgtgtatcccccttctagttcactacacgtgccgctccggtctgcctggaatagtgaccctgtccccgggtcacggaccccaggtccgagaagagtcgacatgcctcctgacgatgattggaggcagtcgagttacgcgtcccacagcggacatagacggaccgtcggagaagggttcctgtttgtgctttccgacgccccccgaagggagcagatcagagctagagtgctgcagcatagccagtggtag

SEQ ID NO: 51867 - DNA, 462 bp, Artificial Sequence
  Description of Artificial Sequence: Synthetic coding sequence
atgagctggaagcggaactacttcagcggcggccggggcagcgtgcagggaatgtttgcccccaggtcatcaacctccatagcccctagcaaggggctcagcaacgagccaggtcagaacagctgctttctgaactcagccctgcaagtgctgtggcacctcgatatctttcgtaggagctttagacagctgacaacccacaaatgtatgggcgacagttgcatcttctgtgccttgaaggggattttcaatcaattccagtgtagctccgagaaggtgctgcctagtgatactttgagatctgcactggcgaaaacttttcaggacgagcaaagatttcagctcggcatcatggatgatgctgcagagtgttttgagaacctgctcatgcggattcattttcacatagcagatgaaacgaaagaagatatatgcactgctcaacactgcatttcacattag

SEQ ID NO: 51868 - DNA, 2460 bp, Artificial Sequence
  Description of Artificial Sequence: Synthetic coding sequence
atggacctggacgagctgcagaaccaggccaagctgcggctggccctacacggtgcctcttgttcgacccattcccgggctctcgttgataagaaacttcagatttccatcagaaaggcacgcagcttacaggaccgaatgcaacagcagcagagccctcaacagccatcacagccttctgcttgcctgcccacccaggccggcaccctttctcagcccacttctgagcagcctatcccattgcaggtactgctgagccaggaagctcagctcgagtcaggcatggatacggagtttggggcatcatcatttttccacagtccagcttcctgccatgaaagtcactcaagtctgtcacccgagtctagtgccccacaacactctagcccctcgagaagtgcactgaaactcctcacatccgtcgaggttgataacattgaacctagtgcatttcaccgtcaagggctgccaaaggcaccgggatggactgagaagaactcccaccatagttgggagccgcttgacgctccggagggaaagctgcaggggtccagatgcgacaatagcagttgtagtaagttgccaccacaggaaggaagagggatagcacaggagcagctgttccaagagaagaaagatccagcgaacccttcccccgtgatgcccggaattgctacaagcgaacgcggggatgagcatagccttggttgttctccgagcaactcatctgcccaaccgtctttgccgctttatcgaacctgtcaccctatcatgccggtggcaagctcgttcgtactccattgtcctgaccccgtacagaagacaaatcaatgtcttcagggccagagtctgaagacttccttgactctgaaagtcgaccgcgggtcagaggagacttataggcccgagtttcctagtaccaagggcctggtacgaagcttggctgaacagtttcaacgcatgcagggggtttctatgagagatagcacaggtttcaaggaccggtccctgtcaggctccctcagaaagaacagttctccttctgacagcaagccccctttttctcaagggcaagagaagggccactggccctgggcaaagcaacaatcttctcttgaggggggtgacagacctctgagctgggaggaatccaccgagcactccagtttagcattgaatagcggtcttcctaacggtgagactagctctgggggacagccgcggctggccgaacctgacatctatcaagagaagctgagccaggtgagagacgtcaggtcaaaagatcttgggagctctaccgatctcgggacttccctaccactggactcttgggtcaacatcacgcggttctgcgactcccagctgaaacacggtgcccctcgacctggcatgaagtcatctccccacgattcacacacatgcgtgacctacccagaaagaaaccacatcctgttgcacccccattggaatcaagacacggagcaagaaacctcggagctggaatctctctatcaggcatcactgcaggcaagccaagctggctgttctggatggggacaacaggatacagcctggcaccctctgagtcagaccgggagtgccgacggaatgggcaggaggctccacagcgcccacgatcccgggctgagcaagactagcactgccgaaatggaacatggcttacatgaggcacgcacggtgagaacctcacaggattcttccaacgtgcgcaagcccctcgagacgggacatcggtgcagtagctctagttcgttgccagtgatacatgacccgagtgtgtttctcctcggtcctcagctgtacttgccccagccacagttcttgtcgccggatgtcctcatgcctacaatggccggtgagccgaatcgcctgccaggaaccagcaggtcagtccagcagtttcttgccatgtgtgatcgcggcgagacatcccaaggggctaagtatactggccggacactgaactatcagtcactgccacatcgctctcgcaccgataatagctgggccccctggagtgagaccaatcagcatatcggcaccagatttctcacaacgcctggctgcaatccacagttgacatacacagccactctccctgagagaagcaaaggtctgcaagttccacatactcagtcctggtccgacctcttccacagcccctctcatcccccgattgtgcacccagtgtacccaccttcttcctcactgcacgttcctctcaggtcggcctggaatagtgatccggtgccaggatcccgcaccccgggcccccgtagggtggatatgcctcctgacgacgactggcgccaatcttcctacgcgtcccattcaggtcataggcgtaccgtcggtgaaggattcctcttcgtgctatctgatgcccctcgccgcgagcagatcagggcacgggtgctccagcattctcagtggtag

SEQ ID NO: 51869 - DNA, 4605 bp, Artificial Sequence
  Description of Artificial Sequence: Synthetic coding sequence
atgagctggaagcggaactacttcagcggcggccggggcagcgtgcaagggatgtttgcccctcgcagtagtacaagtatcgctcctagcaaagggctgtcaaacgagcccggtcaaaactcctgcttcctgaactctgccctccaggtgctttggcaccttgacattttccggagatcctttagacagctgactactcataaatgtatgggggacagttgcatcttttgtgcactcaagggtatcttcaatcaatttcagtgcagctccgagaaggtgctgcctagcgacaccttgcgctctgcactggcgaaaacattccaggatgagcagagattccaactgggcataatggatgacgccgctgaatgtttcctcttttttcgcgtgactgacgacagggcaaaacagtccgagttatatctggtgggaatgatttgctactacgggaaacattacagtactttcttcttccaaactaaaattcggaagtggatgtacttcgacgatgcccatgtgaaggaaattggaccgaagtggaaagacgtggttaccaagtgtatcaaagggcattatcagccactgttgttattatacgcagatccccagggaacaccagtgagtacccaagatctgccacctcaggcggaatttcagtcgtattcgagaacatgctacgactccgaggattccggaagggaacctagtatctcaagcgatacaagaacggattcttcaacggagagctatccctacaagcattcccatcacgaatctgttgtttctcatttcagttcagactcccagggaaccgtcatttacaatgtggagaacgactccatgtcgcaatcatctagagacaccggacatctgacagactccgagtgcaaccagaaacacacaagcaagaaaggatctttgatcgagcggaagcgatcatctggtagagtcaggaggaaaggagacgaaccacaggcctccggatatcattcagagggtgaaacactgaaagaaaaacaggcgccacgcaacgcctccaaaccgtcttctagcacaaatagattacgcgatttcaaggaaactgtgagcaacatgatccataataggcccagtcttgcatcccagacaaacgtcggctcgcactgccggggcagaggtggagaccagcccgacaaaaaacctccccggactctaccccttcacagcagagattgggagattgagagcactagtagtgagagcaaaagcagttcatcctccaaataccgccctacatggaggcctaagagagaaagcctgaatattgacagcattttctctaaggataaacgcaaacattgcggatatacgcagctgtccccattctcagaggattcggccaaggaatttattcccgatgagcccagcaaacctcctagctacgatattaaattcgggggaccatcaccacaatataagagatggggccctgccagacctggttcacacctgctggaacagcaccccagattgattcaacgcatggaaagcgggtacgaatctagtgagcggaactcgagtagcccagtaagtctggatgctgctcttcccgagtccagcaacgtttatcgggacccgtcagccaagaggtcagccggccttgttccctcgtggcggcacattcccaaatctcattcaagtagcatcctcgaggtggactcaacagcctctatggggggttggactaagtctcagcccttttctggggaggagatctctagtaaatcggagctcgacgagctacaggaagaggtggcccgcagggcccaggagcaagaattgaggcgcaaacgagagaaggagctagaggctgccaagggatttaacccccacccatcccgtttcatggacctggatgaattacagaaccaggggcggtctgacggctttgagagaagtctccaagaggctgagagcgtgttcgaagagagcttacatcttgagcagaagggcgactgcgccgccgccctggccttgtgcaatgaagccatcagcaagctgcggcttgcgctgcatggtgcttcctgctccacccactctcgggcacttgtcgacaagaagttacagatttccatccgcaaagcccggtcgttgcaggatcgaatgcaacaacaacagagccctcagcagccgagccagccatcagcctgtctcccaacgcaggcaggcaccctctcccaaccaacctctgaacagccaattcccctacaggttctcctgtcccaggaggcgcagctcgagtcagggatggatactgagttcggcgcgtcctccttttttcacagtccggcctcctgccacgaatcacactcctctctgagccctgagagctcagcccctcaacactcttctccctcacggagcgctctcaagctcctgacttccgtggaagtagacaatatagaacctagcgcctttcataggcagggcctgcctaaggcacctggatggacagaaaagaattctcaccattcttgggagcccttggacgctcctgaaggaaagctgcagggcagtagatgtgataattcttcatgttcaaaactgccaccacaggagggaagaggaatcgcacaagagcagctgttccaggagaagaaggaccccgccaacccgagccccgtgatgcccggaattgcgacttccgagagaggtgatgagcactccttaggatgcagcccctcaaattcctcagctcagccatccctgcctttgtaccgcacctgccaccccatcatgcctgtcgccagcagcttcgtgcttcattgcccagatccagtacaaaaaactaaccagtgtctacagggtcagtcgctcaagacctctctgacgctgaaagtggatcgaggctccgaagaaacctaccgacctgaattcccctcgactaaaggcctcgtgcgatcacttgccgaacaatttcagcgcatgcagggcgtgtcaatgagagattctacgggcttcaaagatcgctctctatctgggtctttgcgtaagaattcttcgccctccgattctaaacccccattcagtcagggccaggaaaagggtcattggccttgggccaaacaacagtcaagcctcgagggaggagataggccactatcatgggaagaaagcaccgaacacagcagtctggcactcaatagtggccttcctaacggcgagacgtccagtggtggacaacccagacttgctgaacctgatatctaccaggaaaagctgagccaggtcagggacgtgaggtcaaaagacctcggcagcagtactgatcttggaactagcctccccctggattcgtgggtgaatattacaagattttgcgatagccagctcaaacatggggccccaaggccaggaatgaaatcaagcccacatgatagtcatacctgcgtcacctatcccgaacgaaaccatattcttctgcatcctcactggaatcaggataccgagcaggagacctccgaactcgaaagtctctaccaggcttcactgcaagcgagccaggcaggatgctctgggtggggccagcaggacacagcctggcatccattgagccaaacaggttcagcagatggaatggggcgaaggctacactcagcacacgatccagggcttagtaaaacgagtactgccgaaatggagcatgggcttcacgaggcaagaaccgtcagaaccagccaagctaccccttgtcggggtctgtctcgggaatgtggcgaagatgagcagtactcagccgaaaatcttcgacggatctctagaagcctgtccgggaccgtcgtgtcagaacgggaagaagcacccgtatcaagccacagctttgattcatccaacgtccggaaacccctggaaaccgggcaccgttgctctagttcgagcagtctgcctgtcatccacgatcctagcgtgttcctgctgggtccacagctgtatcttccccagccacaatttctatcccctgatgtgcttatgcccaccatggctggggagcctaaccggctcccaggaaccagtaggagcgtgcagcagtttttagctatgtgcgaccgcggtgagacatcgcaaggcgccaaatacacgggacggacactgaattatcagtcactgccgcacaggagcaggacagataactcgtgggctccttggagtgagacaaaccaacacattggtacgcgatttctcacgacccctggctgtaaccctcagctcacttataccgccaccttgcccgaaagatcgaaaggcttgcaagtcccacacacacagagttggtctgatttgttccattcaccatcccatcctccaattgtccacccagtctatccaccgtcttcctctctgcatgtgcctctccgcagcgcatggaactccgaccccgtacccggatcacgtaccccaggcccacggcgggtggatatgccacccgacgacgactggcgccagtcatcatacgcctcccacagtgggcatagacggaccgtaggggaaggctttctcttcgtcctgagtgacgcccctcgccgggaacagattcgcgccagagttctgcaacactcacagtggtag

SEQ ID NO: 51870 - DNA, 243 bp, Artificial Sequence
  Description of Artificial Sequence: Synthetic coding sequence
atgagctggaagcggaactacttcagcggcggccggggcagcgtgcaaggaatgttcgctcctcgcagctccacttctatagctccctccaaaggactctctaacgaaccaggccagaacagctgtttccttaactccgcgctgcaggtcttgtggcatctggatatttttcggagatcgtttcggcaactgacaactcacaaatgcatgggcgattcttgcatcttctgcgcactgaaatag

SEQ ID NO: 51871 - DNA, 3279 bp, Artificial Sequence
  Description of Artificial Sequence: Synthetic coding sequence
atgatggacagccccaagatcggcaacggcctgcccgtgatcggcccgggcacagatatcgggatctcaagcttacacatggtgggatatctgggcaagaatttcgactccgccaaggtgcccagcgatgagtattgcccagcctgtagggagaaagggaaactgaaagctcttaagacatataggatcagtttccaggagtccatctttctttgcgaggatctgcagtgcatctaccctttggggtctaagtccctcaataacctcatttctcccgacctggaagagtgtcatactccacataaaccacagaaacgaaagagcctggaatcttcatacaaagacagtcttcttctggccaactcaaagaagacccggaattacattgcaattgatgggggtaaggtgctgaatagcaaacataatggcgaagtttacgacgagaccagtagtaacctgcctgatagcagcggccagcagaatcctatcagaactgcagactcattggagagaaacgaaatactggaagcggacacagtggacatggccaccacaaaagatccagccacagtggatgttagtgggaccggtcgcccatccccccagaacgagggctgcacttcaaagctggaaatgccgctggaaagtaaatgtacatccttcccccaggccctgtgtgtacagtggaagaatgcttacgcactgtgctggctggactgcatcctatccgctcttgtgcactccgaagagctcaagaacactgtgacgggtctctgctccaaagaggagtccatattctggcggctactgacaaagtataaccaggccaacaccctgttatatacgtcacagctttccggagtgaaagatggagattgcaagaagctcacatcagaaatctttgcagagattgagacctgtcttaatgaggtgcgggacgagatctttatcagcttgcagccccaacttcgttgcactttgggcgatatggaatcacccgtttttgcatttccgctgctgctgaaactcgagacccatatagaaaaactgttcctctactctttttcctgggattttgaatgctcacagtgtggtcatcagtaccaaaatcgccacatgaagtccctcgttacattcacaaacgttatcccagagtggcaccctctcaacgctgctcacttcggaccctgcaacaactgtaattccaaatcacagattcgaaagatggttctcgagaaagtttcgcctatctttatgctacacttcgtggagggactgcctcaaaatgacctccaacactacgcctttcactttgaagggtgtctttatcaaataactagtgtcatccaataccgcgccaacaatcattttatcacatggatactggatgcagacggttcatggctagaatgcgatgatctgaagggaccatgcagcgaacggcataagaagttcgaggttcccgcaagtgagattcacatcgtcatctgggagagaaagattagccaggtgacagacaaggaggccgcatgcctgccattaaaaaaaacaaacgatcagcacgccctatcaaacgaaaagcctgtatcactcacatcctgcagtgtgggcgatgctgcttccgctgagactgccagtgtgacgcatccaaaagatatttcagtggctccaaggaccctcagccaggacactgccgtaacccatggagatcacctactcagtggtcctaaagggctggttgataacatcctgcccttaaccctggaagaaactatccagaaaacagcctcggtttcgcaactgaactccgaggcttttctgctggaaaacaagccagttgcggagaatactggaatcctgaagactaatactctgctctcacaggagagtctgatggcttcatccgtctctgcgccctgcaacgagaagctgattcaggatcagtttgttgacatttcgttcccctcccaggtcgtcaataccaatatgcagtcggttcagctaaatacagaagacacagtcaatacaaaatccgtaaataatacagatgcaacgggcctgatacagggcgttaagagcgtagagatcgagaaagatgcccagctgaagcagtttttaactcctaagaccgagcagcttaaacccgagcgcgtaactagccaggtttctaatttgaagaaaaaagagaccaccgcagactcccagactacgacctctaagtcacttcagaatcagtccctcaaggagaatcagaagaaaccgtttgttggaagttgggtgaagggattgatctcacgcggagcctcgtttatgcccttgtgcgtgtccgcccacaatcggaacactattaccgatctacaaccttcagtgaaaggagtcaacaattttgggggttttaagacaaagggcatcaatcagaaagccagccacgtaagtaagaaggcacgtaaatcagctagcaagccacctcccatctctaaacctcctgccggcccaccctcttctaacggtactgctgcacatcctcatgctcatgccgcatctgaagtactggagaagtccgggtcgacttcttgcggtgcccagctaaaccattcgtcctacggaaacggcatttcttccgcaaatcatgaggacctggtggaaggacagatccataaactccgcctgaagctgagaaagaagcttaaggcggaaaagaaaaagttggcagctctgatgagctccccccaatctcgtaccgttcgatcagaaaatctagaacaggtgccacaggacgggtctcctaacgactgtgaatctatcgaggatttgctgaacgagctgccttaccctatcgatatcgcaagtgaatcggcatgcaccactgtccctggtgtaagtctatattctagtcagactcacgaagagatcttggccgagctattgtcccccacacctgtttctaccgagctcagtgagaacggagagggcgacttcaggtacctgggaatgggcgattcccatatacctccacccgtaccttcagaatttaacgacgtgtcccagaacacccatttgaggcaggaccataattattgcagccccactaagaagaacccctgcgaggtgcagcctgactccctgacaaataacgcctgtgtgcgtacgttaaaccttgagtccccgatgaaaaccgatatttttgatgagttcttcagcagcagcgctctcaacgcccttgccaatgatactctggacctgccccatttcgatgaatatctcttcgagaactactag

SEQ ID NO: 51872 - DNA, 357 bp, Artificial Sequence
  Description of Artificial Sequence: Synthetic coding sequence
atgttccactggcaggccaccatcatgggccccaacgacagcccctatcaaggcggcgtctttttccttactatccattttccgaccgactatcctttcaagcctcccaaagtggcctttaccacacggatttaccaccctaacatcaatagcaatggttccatctgtctcgacatcctgaggtcccagtggagccccgccctcacaatttcaaaagtactgctgtccatttgctctttgctgtgcgacccgaacccggatgatcctctcgtgccagaaatcgccagaatctataagactgacagggagaagtacaatcggattgcccgggaatggactcaaaagtatgctatgtag

SEQ ID NO: 51873 - DNA, 444 bp, Artificial Sequence
  Description of Artificial Sequence: Synthetic coding sequence
atggccctgaagcggatccacaaggagctgaacgacctggcccgggacccgccagctcaatgttccgccgggccagtgggagatgacatgtttcactggcaagctactattatggggccaaacgattctccctaccagggcggcgtgttttttctgaccatccattttcccactgattaccccttcaagccacccaaggtcgcctttaccacccgcatttaccatccaaacataaactccaacgggtccatctgcttggacatcctgagatcccagtggagtcccgcattaacgatctcaaaagttctcctaagcatttgcagcctactgtgtgatcccaatcctgacgatccactcgtgcccgagattgccagaatttacaagacagatagagagaaatataaccgaattgcgagggaatggacacagaagtatgccatgtag

SEQ ID NO: 51874 - DNA, 444 bp, Artificial Sequence
  Description of Artificial Sequence: Synthetic coding sequence
atggccctgaagcggatccacaaggagctgaacgacctggcccgggacccacctgcacagtgttccgctggccccgttggagacgatatgtttcactggcaagcaacaattatggggcccaatgactctccataccagggcggagtattcttcctaactatccatttccccacagattatcccttcaagcccccgaaagtggcatttaccacccgaatctaccatcctaatataaacagcaacggttcaatctgtctggatatcctccggtctcaatggtctcccgccctaactattagcaaggtgttgctgtccatttgtagtctgctgtgtgaccctaatcctgacgacccccttgtgcctgaaatcgcccgcatctacaagacggaccgggaaaaatacaaccgaattgctagagagtggacgcagaagtatgcaatgtag

SEQ ID NO: 51875 - DNA, 357 bp, Artificial Sequence
  Description of Artificial Sequence: Synthetic coding sequence
atgttccactggcaggccaccatcatgggccccaacgacagcccctaccagggtggcgtattcttcttgacaatccactttcctactgactacccctttaaaccccccaaggtagccttcaccactcgcatctaccaccctaacatcaattctaatggatctatttgccttgatatcctgagatcgcagtggtcgccagctctgacaatcagtaaggtgttactgtcaatatgttcattgttgtgtgaccccaacccagatgaccccctggtccccgagatcgcccgcatctataagacagaccgcgaaaagtacaatcgtatcgctagagagtggacccaaaagtacgccatgtag

SEQ ID NO: 51876 - DNA, 5361 bp, Artificial Sequence
  Description of Artificial Sequence: Synthetic coding sequence
atgggcctgctgcagctgctggccttcagcttcctggccctgtgccgagcccgcgtgagggctcaagagcccgaattctcttacggttgtgcggagggttcttgttacccagccaccggcgacctgcttatcggcagagcacagaagcttagtgtcacgagtacctgcggactccataagcctgaaccgtactgtatcgtgagtcacctgcaggaagataaaaaatgctttatttgcaattctcaggatccttatcatgaaacccttaaccccgacagccacttgattgagaatgtggtgacaacttttgcgcccaaccggttaaaaatatggtggcagtcggaaaacggggttgaaaatgttactatacagctcgacctggaggccgagttccattttacccaccttataatgacatttaaaacgtttcggcctgctgctatgctgattgagcggagctctgattttgggaagacttggggcgtctaccgatactttgcctacgactgtgaggcctccttcccagggatttccaccggcccgatgaaaaaggtagacgatattatatgtgacagcagatactctgatatcgaacctagcacagagggtgaagtgatatttcgggctttagatcccgctttcaagattgaggacccatacagcccacggattcaaaacctgctgaagataacaaatctgagaattaaattcgtaaagcttcacaccctcggcgacaacctcttggacagccggatggagatccgcgagaaatactattatgcagtttacgacatggtggtgcggggcaactgtttctgctatggtcatgcttcggagtgcgcccctgtcgatggattcaacgaggaagtcgaaggaatggtccacggccactgtatgtgcaggcacaatactaaagggttgaattgtgagctctgcatggacttctatcatgacctcccttggaggcctgcggagggtcgcaatagtaatgcctgtaagaagtgcaattgcaatgagcattccatctcctgccattttgacatggcagtgtaccttgccactgggaatgtgtcaggcggtgtgtgcgatgattgccagcacaacaccatgggacgcaactgtgaacagtgtaaacccttctattatcagcatccagaacgagacatcagggatccaaatttttgtgagcgctgtacttgcgacccagcaggtagtcagaatgagggaatctgtgattcctatactgattttagcacaggcctgatagccgggcagtgcagatgtaagttaaacgtggagggagaacactgtgacgtctgtaaagagggtttctacgacctctcatctgaggacccctttgggtgtaagtcttgtgcctgcaatccattaggaaccatccctggaggcaatccctgtgactcggaaacaggtcattgttattgcaagagactggtgacgggccaacactgcgaccaatgcctaccggagcactggggtctgtccaacgatctggatggctgtcggccttgcgactgcgacttagggggggccctgaacaattcgtgtttcgcagaaagtgggcagtgctcctgtagaccgcacatgattggacgacaatgcaacgaagtcgagcccggatactactttgccacactggatcattatctgtatgaggctgaggaggcaaatctgggacctggagtctcaatcgtggaacgccagtacatccaggaccgcattccttcatggaccggagctggatttgttagagttcccgagggagcttacttggagtttttcatagacaatatcccttacagcatggaatacgatattcttattcggtacgaaccacagcttcctgatcactgggaaaaagccgtgatcactgtgcagagaccgggcagaattccaacgagcagccgctgcggcaatacaattccagatgacgacaaccaggttgtgagcctaagtccgggctcacgttacgtggttctgccccgtcccgtgtgcttcgagaaggggactaattacacagtgcgcttggagcttcctcagtatacctctagcgacagcgacgtcgaaagcccatacacgctcatcgattccctcgtcttaatgccgtactgcaagtctctcgatatctttactgtgggcgggagcggtgacggggtcgttacaaatagtgcctgggaaaccttccagagataccggtgcctcgaaaatagccggagcgtagtgaaaacgcccatgactgatgtatgcaggaacatcatattttctatctcagcactcctccatcaaaccggtctggcctgcgaatgtgacccgcagggcagcctctcttcagtttgcgaccctaacggaggccagtgtcaatgtcgcccaaacgttgtagggagaacctgtaatcgttgcgcaccaggtaccttcggtttcgggccatcaggctgtaagccatgcgaatgccacttacagggaagcgtcaacgccttttgtaatccggtgaccggccagtgccattgctttcagggtgtctacgcccgacagtgtgaccggtgcctgccgggccattggggttttccatcatgtcaaccatgccaatgcaatggccatgccgacgactgtgaccccgtgactggagagtgccttaattgccaggactacactatgggccacaactgtgagcggtgtctagcagggtactacggggatcccattatcggatccggtgatcactgccggccttgtccatgccctgacggtccagactctggaagacagttcgcccggtcgtgttaccaagatccagtgaccctgcagctcgcttgcgtttgcgatccgggctatattggcagccgctgtgacgactgcgcctctggttattttggtaaccccagcgaggtgggcggatcttgccaaccttgccaatgccacaacaatatagacaccacagatccggaggcttgtgataaagagaccggaaggtgtttaaagtgtttgtaccatactgagggcgagcattgccagttctgtcggtttggatattacggtgatgctctacagcaggactgtcggaagtgcgtgtgtaattacctcgggacagtacaagagcactgcaatggctctgactgccagtgcgataaagctactggacagtgcctctgcctgcccaatgtgattggccagaattgcgacagatgcgcaccaaacacctggcagctcgcctctggcaccggctgtgatccttgcaattgcaatgccgcacactccttcggcccgagctgtaacgaattcaccggtcagtgccaatgtatgcctggctttggcggacggacatgcagcgaatgtcaggagctgttttggggcgaccccgacgtagaatgtcgggcctgtgattgcgacccaaggggcatcgaaaccccccagtgtgaccaatcaaccggacagtgtgtgtgcgtggagggggtcgaaggtccacggtgcgataagtgcacacggggctattctggggtgtttcccgattgtactccctgccaccagtgcttcgctctctgggacgtcatcattgctgagctgactaacaggacccacaggtttctggagaaggcgaaggccctgaaaatttctggggtcatcggtccgtatagggagaccgtagactccgttgaacgaaaagtgtccgaaattaaggacatactagctcagtcaccagccgcggaacctttgaaaaatatcggcaatcttttcgaggaagccgagaagctgattaaagatgtcactgagatgatggcccaggtggaagtgaaactgtctgataccacgtcccagtctaacagtacagccaaggagctcgattctctgcaaactgaggctgagagtttggacaacacggtcaaagaactagccgagcagctggaatttatcaagaactctgatattagaggagccttggatagcattaccaaatactttcaaatgtccttggaagctgaagaaagagtgaatgccagcaccacagagcctaactctacagtggagcaatcagccctgatgcgggaccgagttgaggacgttatgatggaaagggagagtcagtttaaggaaaagcaggaggagcaggctcgcctccttgatgagctggcaggaaagctacagagtcttgacctgagcgcagctgctgagatgacttgcggaacaccaccaggcgcgtcatgttcagaaaccgaatgtggaggccccaactgtcggactgacgagggagagagaaagtgtgggggccccgggtgcggcggactggtgacagtggctcacaacgcttggcaaaaggctatggacctggatcaggacgtgctatctgccctcgcagaagttgagcagttgtccaagatggtgagcgaggcaaaattaagagctgatgaagccaaacagtctgccgaggacatcttgcttaagacaaatgccacaaaagaaaaaatggacaagtctaatgaagaactaaggaacctgatcaagcagatccggaacttcctgactcaagactcggcagaccttgacagtatagaagcggtagccaatgaggtgttgaaaatggagatgccatctactccccagcagctgcagaatctgactgaagatatcagggagcgcgtcgagtcactttcacaagttgaagtcatactgcagcattctgccgccgatatcgcgagagccgagatgctgcttgaagaagccaagagggccagcaaaagcgccaccgatgtgaaagtgactgcagacatggtgaaagaggccctggaggaagccgagaaggctcaagtcgccgcagaaaaggcaatcaagcaagcggacgaggacatacagggaacacaaaatctgcttacttccattgaatctgaaaccgccgcctccgaagagaccctgttcaacgcaagccagcgcatatctgagcttgagcgcaatgtagaagagctgaagcgcaaggcagcccaaaatagcggcgaagcagagtacattgaaaaagttgtgtacactgtgaaacagtcagccgaggacgtcaagaaaactctcgacggggagctggatgaaaaatacaagaaggtggaaaacctgatcgccaagaagacagaggagagcgcggatgcccgacgcaaggctgagatgctgcagaatgaagccaaaactctgctggcgcaggcgaattcgaaactccaactcttaaaggatctggagagaaagtatgaggacaatcaacggtatctcgaagacaaggcccaagaactcgctcgactggagggtgaggtgcggagcctcctcaaagatatctcacaaaaggtggccgtttactccacatgtctgtag

SEQ ID NO: 51877 - DNA, 330 bp, Artificial Sequence
  Description of Artificial Sequence: Synthetic coding sequence
atgaccaacgacagcccctaccagggcggcgtgttcttcctgaccatccacttcccgacagactacccctttaaaccacccaaagtggcctttactactaaaatctaccaccccaacatcaactcaaacggcagcatttgtttggatattctccggagtcaatggagtccagcactgaccgtaagtaaagtactactgtccatctgctcgctgttatgcgatcccaacccagatgaccctctggtgcccgaaattgctcatacatataaagccgaccgtgaaaaatataaccgcctggcaagggaatggacacagaagtatgctatgtag

SEQ ID NO: 51878 - DNA, 558 bp, Artificial Sequence
  Description of Artificial Sequence: Synthetic coding sequence
atgctgaccctggccagcaagctgaagcgggacgacggcctgaagggcagcagaaccgctgcaaccgcatcagattccacaagaagggtttccgtgcgcgacaaactcctggtaaaggaagttgcggagctggaagctaatctgccgtgcacatgcaaagtacacttcccggacccaaacaagctgcactgtttccagctaactgtgacaccggatgagggttactaccaaggaggaaaattccagttcgagactgaagttccggacgcatataatatggtgcctcccaaggtgaagtgcctaacaaaaatctggcatcctaacattactgagaccggcgaaatctgtctttctttgctgagagagcactctatagacgggaccggttgggcacccacacggactttgaaagatgtggtttggggcctgaactccctcttcaccgatctgctgaactttgacgacccactgaacatcgaggctgcggagcatcacctaagggataaagaagactttaggaataaagttgacgactacattaagaggtacgcgcgatag

SEQ ID NO: 51879 - DNA, 462 bp, Artificial Sequence
  Description of Artificial Sequence: Synthetic coding sequence
atgctgaccctggccagcaagctgaagcgggacgacggcctgaagggcagccgcaccgcagccaccgcaagcgactcgacgcgtcgcgtaagtgtcagagataaactgctggtgaaagatgaaggttactaccagggtggaaagttccaattcgagacagaagtgcctgatgcttacaatatggtgcctcccaaggtcaagtgcctcacaaagatctggcatcccaacattacggaaaccggagaaatatgcttatccctgctgagggagcactctatcgatggcacaggatgggcaccaacaaggacgcttaaagacgtcgtgtggggcttaaactccctctttaccgatctgctcaatttcgatgatcctcttaacattgaggccgccgagcatcatcttagggacaaagaggatttcaggaataaagttgacgactacattaagcgctacgccagatag

SEQ ID NO: 51880 - DNA, 516 bp, Artificial Sequence
  Description of Artificial Sequence: Synthetic coding sequence
atgctgaccctggccagcaagctgaagcgggacgacggcctgaagggctccaggacagccgctactgcctctgactccactagacgggtctctgtgagagataaattactcgttaaggaagtggcagagctggaagccaacctgccgtgcacttgcaaagtccacttcccagaccccaacaagctgcactgctttcagctgacggtcacaccagacgagggctactatcaagggggtaagttccagttcgaaactgaagtgcccgatgcctacaatatggtgccaccaaaagtcaaatgtctgaccaagatatggcatcccaacatcacagaaactggagagatttgcctctccctgctgagggagcatagcatcgacgggaccggttgggccccaacccgcacattgaaggacgtggtttggggcctcaacagcctgttcactgacctcctcaattttgatgatcccctaaatatcgaagccgccgaacatcacctgagagacaaagaagactag

SEQ ID NO: 51881 - DNA, 513 bp, Artificial Sequence
  Description of Artificial Sequence: Synthetic coding sequence
atgaccgagctgcagagcgccctgctgctgcggcggcagctggccgaactgaacaagaatcccgttgaggggttttcagctggcctgatcgatgacaacgacctttatcgttgggaggtactgatcattggccctccagataccctgtacgagggaggcgtgtttaaggcccacctgacatttcccaaggactaccccctccgtccaccaaagatgaagtttatcactgaaatttggcacccgaacgtagataagaatggggacgtgtgtatctccattctgcacgaacccggcgaagacaaatacggatacgaaaagccagaagaaagatggctgcccatccatactgtggagacgataatgataagtgtgatcagtatgcttgctgatccaaatggtgactcccccgccaatgttgacgccgccaaggagtggagagaggatcgcaatggcgaattcaagcgcaaagtagctaggtgcgtacggaaaagccaggagacagccttcgagtag

SEQ ID NO: 51882 - DNA, 552 bp, Artificial Sequence
  Description of Artificial Sequence: Synthetic coding sequence
atgatcaagctgttcagcctgaagcagcagaagaaggaggaggagtctgccgggggcactaaggggagttccaagaaagcgtccgctgctcagctgagaatacagaaagacattaacgagctgaacctgcctaagacctgtgacatctccttcagcgaccctgacgacttattaaactttaagctggtaatctgtccagatgaaggcttctacaagtcaggcaaattcgtcttttcatttaaggttggccagggctacccacatgacccaccaaaggtcaagtgcgaaacgatggtttatcatccaaacatcgacttagagggcaacgtctgtctgaacattcttcgggaagactggaagcctgtactgaccatcaatagcatcatttacggcctgcaatatctgttcctggaaccaaacccagaggaccccctgaacaaggaagcagccgaggtgctccagaacaatcgtagactgttcgaacagaacgtccagcgcagcatgcgcggagggtacataggctccacttacttcgagaggtgtctgaagtag

SEQ ID NO: 51883 - DNA, 3879 bp, Artificial Sequence
  Description of Artificial Sequence: Synthetic coding sequence
atggccgaccccgccgcccccacccccgccgcccccgcccccgcccaggcccccgctccggcccctgaggcagtccctgccccagccgccgcacctgttcccgcccctgccccagcatccgacagcgctagcggaccctcttccgacagcggtccggaggcgggctctcaaagactgctgttttcacacgatctggtcagcggccggtacaggggcagtgtgcacttcggcctggtgagacttattcatggagaagattctgacagcgagggggaagaggagggacggggatcttctggctgctctgaggccggcggcgcgggccacgaagagggaagggctagcccactgagacggggttacgtgcgagtgcagtggtatccagagggcgtcaaacaacatgttaaggaaacaaaactgaagcttgaagacagatccgtcgttccccgagatgtggttagacacatgcggtccactgactcccagtgtggaacagtgatcgatgtgaacatcgactgcgccgtgaaactgatcgggacgaattgcatcatctatcccgttaactctaaggacctgcagcatatttggccctttatgtacggcgattatatagcctatgactgttggctgggtaaagtgtacgatctgaagaaccagattattctcaagctctcgaatggagctcggtgctccatgaacacagaggacggggccaagctgtatgatgtgtgccctcacgtgagcgatagcggtcttttcttcgatgacagctacgggttctatcccggtcaggtccttattggtcctgccaagattttctcatccgttcagtggcttagcggagtgaaacccgtcttatcaacaaagtctaaattccgcgttgtggtagaagaggttcaggtcgtggaactgaaggtcacgtggatcactaaatcattctgtccaggcggtaccgattcagtgagcccaccaccctcagtgatcacccaggaaaaccttgggcgagtcaaacgcctcggttgtttcgaccacgctcagcgccagctcggggaacgctgtctgtatgtgttccctgcgaaggtcgagcccgccaaaatagcctgggagtgtccagagaagaattgcgcacagggagaaggaagtatggcaaaaaaggtgaaaaggctgcttaagaagcaggttgtccgcattatgagctgcagcccggatacacagtgctctagggaccactctatggaggatcctgacaagaaaggagagtctaagactaaaagtgaagcggaaagtgcctcccccgaagagactcccgacggcagcgcttcccctgttgagatgcaagatgaaggcgctgaagaacctcatgaggcaggagaacaactgcctccattcctgctgaaggaaggcagagacgatcgtctgcactctgcagagcaagacgccgacgatgaggcggctgatgatactgatgatacctcaagtgtaacttcaagtgctagcagtaccactagctctcaatcaggatcaggcacatcacgtaaaaaatcaatccccctctcaatcaagaatcttaaaagaaagcacaaacggaagaaaaacaaaatcacaagagatttcaagcccggcgatcgcgttgccgtggaggtggtaaccaccatgacaagcgctgacgtgatgtggcaggacggctccgtggagtgcaacattcggtctaacgacctattccctgttcaccacttagacaacaacgaattctgccctggggattttgttgtagataaacgcgtgcaatcatgccccgatcccgctgtgtacggcgttgttcagtctggggatcatattggccgcacctgcatggtaaagtggttcaagctacgacctagtggagacgacgtggagctgataggcgaagaggaagatgtgtctgtgtatgacatcgcagaccaccctgattttcggtttaggacgacggacatcgttatccggatcggcaatactgaggacggcgcacctcataaggaagacgagccatccgtgggccaggtcgcccgtgtcgatgtttcttctaaggtcgaagtagtgtgggccgataactctaaaacaattattctgccccagcacctgtacaatatagaaagcgagattgaagaatccgattacgactccgttgagggttcaacatctggagctagctcggatgagtgggaggacgactctgattcctgggagactgacaatggcctggttgaggacgaacatccaaaaatcgaggagccgccaatcccaccactggaacagccagtcgctccggaagacaaaggggtggttataagtgaagaagccgccacagctgccgtccagggtgccgtggcgatggccgccccgatggccggcctgatggaaaaagcgggaaaggacgggcctccaaagagtttccgtgaactcaaagaggccattaagatcctggaatctcttaagaatatgacagtcgagcagctgctgacgggaagcccaacatctccaacagtcgaacctgagaagcctactagagagaagaaatttctagatgacataaagaagctccaagaaaatctgaaaaaaacgttggataatgtggctatagtggaggaagagaagatggaggccgttccagacgtcgagaggaaagaggataaacctgaagggcagagcccagttaaagcagagtggccttccgaaaccccagtgctctgccaacagtgtggaggtaaaccgggcgtgacatttactagcgccaagggggaagttttctctgtgcttgaatttgccccttcaaatcattccttcaaaaaaatcgaatttcaaccaccggaggcgaagaagttcttcagtacggtgaggaaagagatggcgttactggcaaccagtctcccggaaggcatcatggtgaagacgtttgaggatcgaatggatctcttctccgctctgattaagggaccaacgcgtacaccctacgaggacggtctttacctgttcgatatccaactgcctaacatctaccctgctgtgcctccccatttctgctatttgtcccaatgctcgggccgactgaacccaaatctttatgacaatgggaaggtatgcgtgtctctgcttggaacatggataggcaaagggaccgagcggtggacgagtaagagttctttgttacaggtcctaatctcgatacagggcctcatactggtcaacgagccatactacaatgaggctggattcgactctgatcgcgggctgcaggaggggtacgaaaattccagatgttataatgagatggcactaatccgggtggtacaatccatgacccaactcgtcaggcgccccccggaggtatttgagcaggagattcgtcagcattttagtaccggaggctggaggctggtcaaccgcattgagtcttggctggagacccacgcccttctcgaaaaagcccaagccctacctaacggagttcccaaggctagcagcagcccagagcctcccgcagtggcagaactgagcgacagcggacagcaggaacccgaggatggaggccccgcacccggggaagcatcacagggatccgactctgagggcggcgctcagggcttagcaagcgcgagcagagaccacacggaccagactagcgaaaccgccccggacgcctcggtacctcccagcgtgaaaccaaagaaaagacgcaagtcataccggagcttcctgcctgagaagagcggatatcccgatattggcttcccactgttccctttgagtaaaggatttatcaagagcatccgaggagtgttgacccagttccgtgcggccctcctggaggctggcatgcccgaatgtaccgaagacaagtag

SEQ ID NO: 51884 - DNA, 1269 bp, Artificial Sequence
  Description of Artificial Sequence: Synthetic coding sequence
atgcagcagccccagccccagggccagcagcagcccggccccggccagcagctcggcggacagggagctgcacctggcgcgggcgggggccccggggggggaccagggcctgggccatgcctgcggcgcgagctgaagctgcttgaatccattttccacagaggacatgagagatttagaatcgcttcagcttgcctcgatgagctcagttgcgaattcttgctggcgggcgccggtggagccggcgccggtgccgcaccagggccccatctgccaccaaggggttctgttcccggcgaccccgtccggatccactgcaacattaccgaaagctatccagcagtgccccccatttggtctgtggaaagcgatgatcctaacttagctgctgtgctcgaaaggctggtcgatatcaagaagggtaacactctgctgctccagcacctgaagcgaattatcagcgatttgtgcaaattatacaaccttccacagcaccccgatgtggaaatgctggatcagcccctgccagctgagcagtgtacacaggaggacgtgtcctccgaggacgaggatgaggagatgccggaggacaccgaagatctcgaccattacgaaatgaaggaagaggagccagccgaagggaagaagtctgaggatgacggaattggcaaagaaaacctcgccatcttggagaagatcaagaaaaaccaacggcaggactacctgaacggcgcggtttcaggctccgtccaagcaactgaccgcctaatgaaagagctgagagatatttaccggtctcaaagtttcaagggagggaactacgccgttgaactcgtgaacgactccctgtacgactggaacgtgaaattgctcaaggtggatcaggacagtgctctgcacaatgacctgcagatcctgaaggaaaaggagggggctgacttcattcttctcaatttcagcttcaaagacaatttccctttcgaccctccatttgttcgagtggtaagcccagtgctcagtggaggatatgtgctcggaggcggcgccatttgtatggagctgcttactaagcagggttggtcttctgcctactccattgagagtgtcattatgcagatctccgcaactctggtgaaaggcaaggcccgagtccaattcggcgcgaataagtcccaatactccttgacaagagctcagcagagctacaagtccctggtgcagatccatgaaaaaaatggctggtacacgccacctaaggaagacggctag

SEQ ID NO: 51885 - DNA, 486 bp, Artificial Sequence
  Description of Artificial Sequence: Synthetic coding sequence
atgaaggagctgcaggacatcgcccggctgagcgaccggttcatctcggtggaattggtggatgagagcctgtttgattggaacgttaagctgcaccaggttgacaaggactcagtactctggcaggatatgaaagaaactaacactgaattcatacttctcaatctcacctttcccgacaactttcctttctcacctccattcatgcgggtccttagtccccgtctggagaatgggtatgtgctcgatggcggtgccatatgtatggagctgctaacaccccggggatggagcagtgcctacactgtagaggctgttatgcgtcagtttgcagcctccctggtcaaggggcagggccgaatctgccggaaggcgggtaaatcgaagaagtctttctcccgcaaggaagcggaagccacatttaagagtctcgtgaaaacccatgagaagtacggctgggtgacaccccctgtgtcggatggatag

SEQ ID NO: 51886 - DNA, 681 bp, Artificial Sequence
  Description of Artificial Sequence: Synthetic coding sequence
atgcacggccgggcctacctgctgctgcaccgggacttctgcgacctcaaggagaacaactacaaagggatcacagctaagccggtcagtgaggatatgatggagtgggaagtggaaattgagggcctgcagaactcggtgtggcagggcttggtgtttcaactgactattcacttcacctcagagtacaactatgccccccctgtggttaaatttatcacaattcccttccatcctaatgtcgacccacacaccggtcagccgtgtattgatttcctagacaaccctgagaagtggaacactaactacaccctgtcatctatattattggccctgcaagttatgctatccaatcctgttctcgaaaatcccgtgaatctggaggccgcccgcatcttggtcaaggatgagtcattatatcgaactatcctgagactgttcaaccgaccattacagatgaaagatgatagccaggagttgcccaaggatccccgcaaatgtatacgccctattaaaacaactagcttcagcgactactaccaaacctggagccggatcgctaccagtaaggctaccgagtattatcgcactcccctcctgaaagtgcctaattttatcggacaatattacaaatggaaaaaaatggacctgcagcatcagaaggagtggaatctaaaatag

SEQ ID NO: 51887 - DNA, 966 bp, Artificial Sequence
  Description of Artificial Sequence: Synthetic coding sequence
atgcacggccgggcctacctgctgctgcaccgggacttctgcgacctcaaagagaataactataagggtatcaccgcgaagcccgtctcagaggacatgatggagtgggaggtggagattgagggcttgcaaaatagcgtctggcaagggcttgtgttccaactgaccatccacttcacgagtgagtataactatgccccccctgtggtgaaattcataaccattccgttccaccccaatgtagacccccatactggtcagccctgtatcgacttcctggataaccctgagaagtggaatacaaattatacactgtcatcgattcttcttgccctacaggtgatgctaagcaatcctgttcttgagaaccctgtgaatcttgaagctgcccggattctggtgaaagatgagtccctatacagaaccatactacgattgtttaatagaccccttcaaatgaaggatgattcccaagagctgcctaaagaccctcgaaagtgcatacggccaatcaagaccacatcatttagtgactattaccagacttggagccggatagcaacttctaaggctacggagtattatcgtacacctctcctaaaagttcctaattttatcggccagtattataaatggaagaaaatggatttacagcatcagaaggaatggaacctgaagtactccgtgataaagtgctggcttgcaagaaaacggatgcctcacgaagtcacacacagcatggaagaaatcaaactttgtcccacactcattccaacaacagatgaaattttcctggagagtcctactgccattaattcgattactgatatttacgagactgaggaggagggctggaagtccgatacttctctatacgaaaacgatacagatgagccccgtgaagaggaagtcgaagacctcatcagctggaccaacactttgaataccaatacgtctgaggattag

SEQ ID NO: 51888 - DNA, 504 bp, Artificial Sequence
  Description of Artificial Sequence: Synthetic coding sequence
atggccgacgaggccacccggcgggtggtgagcgagatccccgtgttgaaaactaacgctggcccccgggacagagagttatgggtccagaggctgaaagaggagtatcagagccttatccggtacgtcgagaacaacaagaacgctgacaacgattggtttcgattggagtccaacaaagaagggacccgctggttcgggaagtgctggtacatacacgacttacttaagtatgagtttgacattgagtttgatataccgatcacctatcccaccacagctcccgagattgcggtaccagaattggatgggaaaactgctaagatgtacagaggcgggaagatctgtttaaccgaccacttcaagccactgtgggctagaaatgtacccaagtttggcttagctcacctgatggcgctgggcctgggcccttggctcgcggtagaaatccctgatctgatccaaaaaggagtaatacagcacaaagaaaagtgtaatcaatag

SEQ ID NO: 51889 - DNA, 3177 bp, Artificial Sequence
  Description of Artificial Sequence: Synthetic coding sequence
atgagcagcagccccctgagcaagaagcggcgggtgagcggccccgatcccaaaccaggttctaattgtagtccagcacaatctgtgctgtcggaggtgccttctgtgcccacaaacggtatggctaaaaacggctctgaggcagacattgatgagggcctgtattcacgacaactgtacgtccttgggcacgaggcaatgaagcggcttcaaacatcctcagtgttggtttctggattgcggggcctcggtgttgagatcgctaaaaatatcatactgggtggagtgaaggccgtcacccttcacgaccaggggaccgcacaatgggcagatctctcctctcagttctacctgcgcgaagaggacataggcaagaacagagcagaggtgtcccagccccggctggcagagctgaactcgtacgtgcctgttaccgcgtataccggacccctagtagaggacttcctttccgggttccaggttgtcgtgctgacgaatactccacttgaagaccagctccgcgtgggcgagttctgccataaccggggaatcaagcttgtcgttgccgacacaagggggttgttcggtcaattgttctgtgacttcggcgaggaaatgatccttactgacagcaacggcgagcagcctctgtctgccatggtctcaatggttacgaaagataatccaggtgtagtgacctgtctggatgaggcacgccatggattcgaaagcggagacttcgtgtcattcagcgaggtacagggaatggtcgagcttaatggaaaccagcctatggaaatcaaggtgcttggcccttacactttctccatatgcgatacatcaaacttttctgactatattcgaggtgggattgtgtcccaggtcaaggtgccaaaaaagatttcttttaaatcactggttgcgtcccttgctgagcctgacttcgtggtaacagacttcgctaaattctcccgaccagctcagcttcacatcgggttccaagccctacaccagttctgtgcgcagcatggtaggccaccaaggccaaggaatgaagaggacgccgcagaacttgtagccctcgcccaagcagtcaacgccagagccctgcccgcagtacagcagaacaacttggatgaggacctgattcgaaagttggcttacgtcgctgccggggacctcgcacctattaacgcttttattggagggctggcagctcaagaggtgatgaaggcatgttcagggaagttcatgcccataatgcagtggctctacttcgacgccttagagtgtctccctgaggacaaggaagtccttacagaggataagtgcctccagaggcaaaatcgctatgacggccaagtggccgtgttcggtagtgatctgcaggagaaattaggcaagcagaagtattttttggtcggcgccggcgcaatagggtgcgaattactgaaaaacttcgccatgatcgggctggggtgtggtgaaggaggggagatcattgtcaccgacatggataccatagagaaaagcaatctgaatcgtcagtttttgttccggccatgggatgtcacaaaactcaagtctgatacagccgctgccgccgtgagacagatgaacccacatatacgggtgactagtcatcaaaatcgagtggggccagataccgagcgcatctatgacgacgacttcttccagaatctggacggtgtcgccaacgcactggataatgtagacgctagaatgtatatggatcggcgctgcgtgtactacaggaaaccactgttggaatccggcacgctggggactaaagggaacgtgcaggtcgttattccctttctcaccgaaagctattcatcttctcaggatccccctgagaagtcgattcctatctgtacattgaaaaacttccctaatgcaatcgagcataccctccagtgggcaagagacgaattcgaggggctgtttaagcagccggcagaaaacgtgaatcaatacttgactgacccaaagtttgttgagagaacactgcggctagcagggacccagcctttggaggtgctggaggccgtccagaggtccctcgttctgcaaaggccacagacctgggcagactgcgtcacatgggcttgtcaccactggcacactcagtatagtaataatatacggcagctcctccacaattttccacctgaccaattaacctcttccggcgcacctttttggtcaggcccaaaaagatgtccccacccccttactttcgatgtgaacaacccgcttcacttagactacgtaatggctgccgctaatctgttcgcacagacgtatgggcttacgggtagtcaggaccgggctgccgtggccacgttcttacagtctgttcaggtgcctgagtttactccaaagagcggggttaagatccatgtaagtgatcaggagttacaatctgcaaatgcgtccgtggatgactcacgactggaggaattaaaagccaccctgccctcccctgataaactgccaggatttaaaatgtatccaattgactttgagaaagacgacgactccaattttcatatggatttcattgtcgcagcttcgaacctgcgagccgaaaactatgacatcccttccgcagaccggcacaagtccaaacttatagccggaaagatcattcctgccatcgctaccacaacggctgcggtcgtcggattggtctgtttggaattgtacaaggtggtgcagggtcatcggcagttagatagctacaaaaatgggtttctcaatctcgctctgcccttctttggcttttctgaacccctcgccgccccacgacatcaatactacaatcaggagtggacgctgtgggatagattcgaagtccagggcctacagccaaacggcgaagaaatgactctgaaacagttcctcgactactttaaaacagagcacaagctggagattacaatgctgtcacagggggtgagcatgttgtatagtttcttcatgccggctgctaaactcaaagagaggctagatcagcccatgacagagattgtgtcccgggtcagtaaacggaagctgggacgccacgtgcgggcactcgtgctggaattatgttgcaatgacgagagcggcgaagatgtcgaagttccctacgtgagatacacgatcaggtag

SEQ ID NO: 51890 - DNA, 1521 bp, Artificial Sequence
  Description of Artificial Sequence: Synthetic coding sequence
atgggcttccaccacgtgggccaggccggcctggagcccctgacctcaggagacccttcagccctggcctcccaatctgctggtatcaccggtgtctcttactgtgcgtggcctgggttctctatcgaggttggcgaatgggggagattagagggattccctacctcaagagtggctgtgcgcctggtcctcgctttgttcacagacggccccagcaataacgcctgtggcaaccctttttgtcagctctggccacacgttatctgcctcctgtgtctgcaatgggccagggatgagtttgaagggctgttcaagcagccagctgagaatgtgaatcaatacctcacagaccctaagtttgtggagcgaactctgcgtttagccggcacccagcctctcgaagtgcttgaagccgtgcagaggagcctagttctccagcggcctcaaacatgggctgattgtgtgacatgggcctgtcatcactggcacacacaatactcaaacaacatcagacagctcttacataactttccaccggaccagttgacatcttcaggtgcccccttttggtctggccccaagagatgtccccatcctctcacgttcgatgtcaacaaccccctccatctggactacgtgatggccgctgctaacctgttcgcccagacttacggtttgacggggagccaggaccgggccgcagtcgccacgtttcttcagagcgtccaagtacccgaattcacccctaaatccggcgttaagatacatgtgtctgaccaggagctccagtccgccaacgccagtgtggacgatagcaggcttgaggagcttaaggcaaccctgccctcgcccgataaactacctggcttcaagatgtatcccattgacttcgagaaggacgacgattctaacttccatatggacttcatcgtggcagcaagtaatctgagagctgagaattatgatatcccctccgccgaccgacataagagcaagttgatcgccggaaagataattcctgcgatcgctactacaaccgctgccgtggtgggcttggtttgtttggaattgtacaaggtggtgcaaggccaccgccagcttgatagttataaaaatgggtttctgaaccttgctttgccttttttcggattttccgagcctcttgcagccccccgtcaccagtattacaatcaggagtggacactgtgggaccgattcgaggtgcaaggcctgcagcccaacggtgaggagatgaccttgaagcaattcctcgactatttcaagaccgagcacaaacttgaaatcacgatgctctcccagggggtaagcatgctctactctttcttcatgccagcggctaagctcaaggaacgactcgaccaaccaatgactgaaatcgtgtctcgcgtctccaagaggaagttaggaagacatgtgcgggccctggtgctggaactttgctgtaatgatgagtctggagaagatgtggaagtgccctatgtcaggtatactatcaggtag

SEQ ID NO: 51891 - DNA, 3177 bp, Artificial Sequence
  Description of Artificial Sequence: Synthetic coding sequence
atgagcagcagccccctgagcaagaagcggcgggtgagcggccccgacccaaagcctggcagcaactgcagcccagcgcaatcagtgctttcagaggtgccctccgtacccacaaacggaatggccaaaaacgggtcagaagcagacattgatgagggcttgtattctagacaactgtatgttctgggacatgaggccatgaaacggttacagacgagcagtgtgctggtgagcggcttaaggggattgggtgtagaaatcgcgaaaaacataattttaggaggagtgaaggccgtcaccctccacgaccagggaaccgctcagtgggccgacctgagctcgcaattttacctccgggaagaggacattgggaaaaacagagccgaggtctctcaaccgcggttagctgagttgaatagctatgtgcctgtcacagcgtacacaggacccctagttgaggacttcttgagtggcttccaggtcgtggtgctcaccaacaccccgctggaggatcagttaagagtgggagaattctgccataataggggcattaagctggttgtggccgatacccgcgggttgttcggccagctgttctgcgatttcggtgaagaaatgatcctcactgactcaaacggtgagcagcctctgtccgccatggtctccatggtgactaaagataatcctggagtggtaacctgcctggatgaggccagacacgggtttgagtccggtgactttgtcagtttcagcgaggtgcagggcatggtagagttgaatgggaatcagcctatggagattaaagtgttggggccctataccttttcaatttgtgatacctcaaacttttctgattacatcagaggtggtatagtcagccaggtgaaggtgccaaagaaaatttccttcaagtccctcgttgccagcctggccgaaccagacttcgtcgtcaccgatttcgctaaattcagtcgacctgcacagttgcacatcgggtttcaagctctccaccaattctgcgcccagcatgggcggcccccccgaccgagaaatgaggaggatgccgccgagctggtggccctagcccaagcagtaaacgccagagctctgcctgctgtgcaacagaataatctggacgaagacctcattcggaagcttgcctatgtggctgctggagacttagcgcccattaacgcttttatcgggggactagccgcccaggaagtcatgaaagcttgttccggaaaattcatgccgatcatgcaatggttatacttcgatgcactcgaatgtcttcccgaggacaaggaggtgctcaccgaggataaatgtctgcagagacagaaccggtacgacggtcaggtggctgtgttcggctcagacttgcaagaaaagctgggaaaacagaagtactttttggtcggcgctggggctattggttgcgaactgctcaaaaacttcgccatgatcggcctgggttgtggagagggcggcgagatcatagttactgacatggatacaatcgagaaatccaatctgaacagacagttccttttcaggccttgggatgtgactaagctaaaatctgacaccgctgctgcagcagttcgccagatgaatccgcatatccgggtgacctcacaccagaacagggtcgggcctgacacagagcgcatatacgatgacgatttcttccagaacttagatggagtagccaatgccctggacaacgtggatgcacgaatgtatatggatcggcggtgtgtctactatcgcaaacctctcctggagtccggaactttgggtaccaagggaaatgtacaggtcgtgatcccctttctcactgaatcgtatagcagttcacaggatccaccagagaaaagcatccccatctgcacattaaaaaattttcctaacgccatcgaacacacactccagtgggctcgcgacgagtttgagggcctcttcaaacagcctgcagaaaacgttaatcagtacctcacagatcccaaatttgtggaaagaactctgcgccttgctgggactcagcccctcgaggtgttagaagctgtacagagaagtcttgtgctgcaaagaccgcaaacctgggcggattgcgtgacttgggcctgtcatcactggcacacccagtactccaataacataaggcagctccttcataattttccacctgatcaactgacatcaagcggggccccgttttggagcggcccaaaacggtgccctcatcccttgaccttcgacgttaacaatcctcttcacctggactacgtcatggccgctgcaaatttgttcgcccaaacctatggcctcacaggcagtcaggaccgcgctgccgtagccacattcttacagagcgtccaggtgcccgagtttacacctaagagcggcgtgaaaattcacgtcagtgatcaggagctgcaaagcgctaatgcgagtgtggatgattctagactggaggagcttaaagccacgttgccaagtcccgataaactgccgggtttcaaaatgtatcccattgactttgagaaggacgatgactccaacttccacatggactttatcgtcgccgcaagcaacttgagagcagaaaattacgacattcctagtgccgacaggcataaaagtaagctcatagctggaaagattataccagccattgccacgacaaccgctgcggtggtgggtctcgtgtgtctagaactgtataaagtggtacagggacatcggcagttagacagttacaagaacgggttcctgaaccttgccttgccattctttggattctcagaaccactggcagccccgaggcatcagtactataatcaggagtggaccctttgggaccgcttcgaggtgcaaggccttcagcccaacggggaggagatgacccttaagcagttcctcgactattttaagaccgaacacaagctcgaaatcacaatgttgtctcagggcgtgagtatgctgtattcattctttatgccagcagccaaactcaaggaacgcttagatcagcctatgaccgagatcgtctcacgagtttccaaacgcaagctgggacggcacgtgcgtgcactggtgctggagctgtgttgcaatgacgagtcgggtgaggatgtcgaagtaccctacgtgcggtacactattcgctag

SEQ ID NO: 51892 - DNA, 816 bp, Artificial Sequence
  Description of Artificial Sequence: Synthetic coding sequence
atgagcagcagccccctgagcaagaagcggcgggtgagcggccccgacccgaaacctgggagcaattgcagtccagcacagagtgttttatccgaagtaccgagtgtacctaccaacggaatggcaaagaacggcagtgaggctgacattgacgaagggctgtactctcgccaactttatgtgttaggccacgaggctatgaagagactccagacctcctctgtgctcgtgtcaggcttgcgaggactgggagttgaaatcgctaagaatatcattctgggtggcgtcaaagccgttacccttcatgatcagggcactgcacagtgggccgatctgagctcgcagttctatctgagggaagaggatattggcaagaatagagcggaagtgagccagcctcggcttgcagaactgaatagttacgttcctgtgacagcctacaccggccccctagtggaggatttcctcagtggattccaggtggttgtgttgacaaacactccccttgaagatcagttgcgcgtcggagaattctgccacaaccgaggaattaaacttgtcgtcgctgatactcgcggactcttcgggcagctgttctgtgacttcggagaagaaatgatcctgacggactctaatggtgagcagccgttgtcagctatggtgagcatggtcactaaggacaaccccggcgtggtaacctgtcttgatgaagccagacacggcttcgagtccggggattttgtgagcttttctgaggtgcagggtatggtagagctaaatggaaatcagccgatggaaattaaggtcctggggtag

SEQ ID NO: 51893 - DNA, 522 bp, Artificial Sequence
  Description of Artificial Sequence: Synthetic coding sequence
atgctgtgcgtgatctaccacctggacaaccccgtgggcaagatgagttcctcccccctctcgaagaaaagacgcgtctcaggtcccgacccgaaacccgggtccaactgctcccccgcacagtccgtgctgtccgaggttccgtcagttcccaccaatggaatggcgaagaatgggtcagaggcagacatcgacgagggcctgtattctcgccaactttacgttctagggcatgaagcgatgaagagactgcagactagttctgttctggtgagcggtctgaggggcctcggtgtcgaaatagcaaagaatattatcttgggaggggtcaaggccgtgaccctccatgatcaggggacagcacaatgggcagatctgtcttctcagttctaccttagagaagaggacattggaaagaaccgtgccgaggttagtcaaccccggcttgctgagttaaactcttacgttccagtgacagcttacaccggccccctggtagaggattttctttccggcttttag

SEQ ID NO: 51894 - DNA, 855 bp, Artificial Sequence
  Description of Artificial Sequence: Synthetic coding sequence
atgctgtgcgtgatctaccacctggacaaccccgtgggcaagatgtctagttctcccttgagcaaaaagcgtagggtctcaggccctgaccccaagcccgggtctaattgctctcctgcacaaagcgttctttccgaagtgccttctgttccaacgaatggaatggccaagaacggatcagaagctgacattgatgaaggcctttactctagacaactgtacgtcctgggccatgaagccatgaagaggcttcagacatcctccgttctggtgtccggattgcgggggctgggagtggagatcgcaaaaaatattatactcggaggcgttaaggccgtaacactgcatgaccagggcaccgcacagtgggctgatttgagttcacagttctaccttagagaagaagatatagggaagaatagagctgaggtgagccagccgcgcctcgcagagctgaatagctatgtcccagtgacagcttacaccggccctctggtggaagactttctgagcggattccaggtggtggttctgacgaacacacctcttgaggatcagctccgggtgggagagttctgtcacaaccgaggaattaagcttgttgttgcggacactcggggactttttggccaactcttctgcgactttggcgaggaaatgatattgactgactccaacggggaacagccgctgtcagcaatggtgagcatggttacaaaagataacccaggcgtggtcacctgcctggacgaggctcggcatggcttcgagtcaggagactttgtgagtttcagcgaggtccagggaatggtcgaactcaatggcaatcagcccatggaaattaaggttctgtag

SEQ ID NO: 51895 - DNA, 705 bp, Artificial Sequence
  Description of Artificial Sequence: Synthetic coding sequence
atgagcaagccccacttcccccccgccctgcccgcccccgccgccatcccaggtatcaagggcgaggaaaacgggtgcctcctcctgcctacctatagcgtgccaggatcaatgctgtgtgtaatttaccatcttgacaaccctgttggcaaaatgagtagttcgcccctgtctaagaaaaggcgcgtgtctggccctgacccaaaaccgggttcaaactgcagccccgcacagtccgtgctcagtgaagtgccttcggtgccaactaacggaatggctaagaatggcagtgaagccgacatcgatgagggcttatacagccgccaactgtatgtcctcggtcacgaggccatgaaacgcttacagacctccagcgtgctggtgtccgggctgcgtggcctgggcgtcgaaattgctaaaaatattatcctgggcggcgtgaaggctgttaccctgcacgatcagggcactgcccagtgggccgacctgagctctcagttttacttgagggaagaagacattggcaaaaacagagccgaggtttctcagcctaggttggcagaactcaattcctatgtcccagtcaccgcatacacaggacctctggtggaggatttcctgagtggatttcaagtagtcgtcctcactaatactcccctcgaggaccagctcagagtgggtgagttttgccacaaccgcggctag

SEQ ID NO: 51896 - DNA, 588 bp, Artificial Sequence
  Description of Artificial Sequence: Synthetic coding sequence
atgagcaagccccacttcccccccgccctgcccgcccccgccgccatccccggcatcaaaggcgaggagaatgggtgcttgttgctcccaacctatagcgtgccagggagtatgctgtgtgtgatctaccatctcgataacccagttgggaaaatgagtagttctcccctgtccaaaaaacggagagtcagtggtccagatcccaaaccagggagcaactgcagtcctgcccagagtgttctcagtgaggtgccatctgtccctaccaacggtatggcgaaaaatggttcggaggccgatatcgacgaaggactttacagtcgacaattatatgtgttggggcacgaggcgatgaaaagactgcagacatcttcagtccttgtctctgggttgcgagggctgggggttgaaatagcaaaaaacatcattctcggcggagtgaaggccgtgacactgcacgatcagggaaccgctcagtgggccgacctttcctcccagttctacctgcgggaagaggatatcggcaagaaccgcgcagaagtaagtcagccacgattagctgagttgaattcttatgtgccagtatag

SEQ ID NO: 51897 - DNA, 843 bp, Artificial Sequence
  Description of Artificial Sequence: Synthetic coding sequence
atggccaccgaggcccccgtgaacatcgccccccccgagtgcagcactgtggtgtctactgccgtggactcacttatctggcagccaaattccctcaatatgcacatgattaggccgaagtcagctaaaggacgaacccgaccctctctacagaaaagccagggagtggaggtgtgtgcccaccacattccctcaccaccccctgccataccttacgagctgccatcctcacagaagcccggtgcctgcgccccaaaatcccccaaccaaggagcatcagatgagattcccgagttgcagcagcaggtccccaccggggcatcaagcagcttgaacaagtaccccgtgctcccatcaatcaatcgaaagaatctggaagaagaggccgtggagactgtggcaaagaaggccagctccttacagctcagcagcattcgggcgctgtatcaagatgagacaggaaccatgaaaaccagtgaggaggacagcagagcccgcgcctgcgctgtagaacgcaagtttatcgtaagaaccaaaaagcaggggagtagccgggccggaaaccttgaggagccttctgaccaggaaccccgactgctcttggccgtgcggtctccgacagggcagcggtttgtacggcacttccgcccaacggatgacctgcaaactatcgtagctgtggccgaacaaaaaaacaagactagttacaggcattgctccatcgagacaatggaggtgccccggcgaaggttttctgatttgaccaaaagcttgcaggagtgcaggataccccacaaaagcgtgctggggatttctctggaggatggggagggctggccttag

SEQ ID NO: 51898 - DNA, 1155 bp, Artificial Sequence
  Description of Artificial Sequence: Synthetic coding sequence
atggccttcccctgccggcggagcctgaccgccaagaccctggcctgccttctggtgggagtgagttttcttgcgctccagcaatggttcctgcaggctcccaggtcccctcgtgaagaaagatccccacaggaagaaacacctgaggggcccacagatgccccagccgccgacgaaccgcccagcgaattggtcccaggcccaccctgcgtagccaacgcttccgccaacgctaccgccgatttcgagcaactgccagcgcggattcaggacttcttgcgctataggcattgccggcacttccccctactgtgggatgcaccggctaaatgcgccggcggccgcggcgtgtttctgttactggcagttaagtccgcacccgaacattacgagcggcgcgagcttatccggcggacgtggggccaagagcggtcgtacggtggtagaccagtccgtaggctgtttctcttgggtactcctgggccagaggacgaagctagagctgagcgactggccgaactggtcgctctcgaggcccgggagcatggggacgtgttgcaatgggcttttgccgatacatttctgaacttgacactcaaacacttgcatctgctcgattggctcgccgcaagatgtccgcacgcccgatttctgttatctggcgacgatgatgtgttcgttcacaccgccaatgtggttcggttcctacaggcacaacctcccggtaggcatctgttcagtggccaactcatggagggatccgtacctatcagagattcatggtctaagtacttcgtgcctccacaattatttcctggtagcgcctatcctgtgtattgcagcgggggcggctttttattgtctgggccaacagccagggcgctgagagctgccgccagacatacaccactgtttcctatcgacgatgcctatatgggcatgtgtctggagcgggccggcctggccccatctggacacgaaggaatctggccatttggtgttcagctgcctggagcccagcagtctagcttcgacccatgtatgtatcgggagctcctgcttgtgcataggtttgccccctatgaaatgctgcttatgtggaaagccctacactcacccgccctgtcctgcgaccggggtcatagagtttcgtag

SEQ ID NO: 51899 - DNA, 792 bp, Artificial Sequence
  Description of Artificial Sequence: Synthetic coding sequence
atggccttcccctgccggcggagcctgaccgccaagaccctggcctgcctgttggtgggcgtctcatttctcgcccttcaacagcggcgacgccagcgtgtcccccctaccctccctaggcctgcccgggcgcacccggggctccctgctgtgcctcaggagcgttcctatggcggtcggccagtccggcgcctgttcctgctcgggacacccggccctgaggacgaggcgcgggctgagcggcttgccgagctggttgccctggaagcgcgggaacacggcgacgtgctgcaatgggcttttgctgatacctttttgaacttaaccctgaagcatctgcatctgctggactggctggccgcccgctgccctcatgccagattcctcctttctggcgatgacgatgtgttcgtgcacaccgccaatgttgtgaggttccttcaggcccagccccctggcaggcacttgttctcaggtcaactgatggagggcagcgtccccattagggattcatggtcgaagtacttcgtcccgccccaattatttcccggctctgcataccccgtgtactgtagcggaggtggatttcttttatcaggcttagctcctagcgggcatgagggcattcccagtgcctgtagtctccctggcgctcagcagtcctccttcgacccgtgcatgtaccgggagttactactcgtgcaccggtttgctccctatgaaatgctgttgatgtggaaagcactgcattcccccgcactgtcctgtgaccgcgggcaccgcgtatcgtag

SEQ ID NO: 51900 - DNA, 366 bp, Artificial Sequence
  Description of Artificial Sequence: Synthetic coding sequence
atggccttcccctgccggcggagcctgaccgccaagaccctggcctgtttgctggtcggggtgtccttccttgcgctgcagcagtggttccttcaagcaccacggtccccccgcgaggagcgtagccctcaagaggagactcctgagggacctacagatgcccccgcagctgatgagccgccatccgaactcgttcccggaccgccctgcgtggctaacgcctccgctaatgctacagccgactttgagcagctccctgcacgcatacaggactttctgcgctatcggcattgtcggcactttccactgctatgggacgctccggcaaagtgtgccggggggagaggagtattcctcctgctgtag

SEQ ID NO: 51901 - DNA, 1158 bp, Artificial Sequence
  Description of Artificial Sequence: Synthetic coding sequence
atggccttcccctgccggcggagcctgaccgccaagaccctggcctgtctcctagtgggagtctctttcttagccctacagcagtggtttctccaagcccctcgtagtcctcgggaggagcggtcgccacaggaggaaactccagagggccctactgatgctccggctgcagacgagcccccctcggagcttgttccgggccctccctgcgtagccaacgcctcggcgaatgcaacagccgacttcgaacagcttcccgctagaatccaggacttcctcaggtaccgtcactgccggcacttcccgttgctctgggatgcccccgctaagtgcgccggaggcaggggagtgttcctgctgctcgccgtaaaaagtgccccggagcattacgaacggcgggagttgataaggagaacttggggccaggaaaggagctatggcgggcgcccggtgagaagactcttcttgctggggacacccggcccagaggatgaggcacgggccgaacgcctggccgaactcgtggcactcgaggcccgcgagcatggcgacgtcttgcaatgggcttttgctgacacgtttctcaatctaacgctgaaacacttacacctgctggactggctcgccgccagatgcccacatgcacggttcctgttgagcggcgacgacgatgtgttcgtgcatacagctaacgtggtgaggtttctacaggcgcagccccccggaagacatctgttttctggacagctgatggagggctctgtccccatcagagattcctggtccaagtatttcgttcctccacaactcttcccgggatctgcctacccagtgtattgctcaggaggcggctttcttctgagtggacctacagctagagcgctccgcgcggcagcgcgacatacaccactcttccctatcgatgacgcgtacatgggtatgtgcttgggtgcgcgccggcccggggcccagaggcctcgcggtcatcctggcccttcagcctgctcgttaccaggcgcacaacagtcctcttttgacccatgcatgtaccgtgagctgctcctcgttcataggttcgcaccctacgagatgctcctgatgtggaaagcgttacacagccccgcactctcttgcgatcgcggtcatcgtgtgtcttag

SEQ ID NO: 51902 - DNA, 1086 bp, Artificial Sequence
  Description of Artificial Sequence: Synthetic coding sequence
atgagcggcgccggcgtgggcggcgccagcgaggagagccaggccatgcaggcgcacgtatccataatcttgcccgtacataacgcagaaccttggttagacgaatgcctgcgctccgtgctgcagcaagattttgaagggaccatggagctctcagtattcaacgatgcctctaaggacaagtctggcgcgatcattgaaaagtggcgcgtgaagctggaggattctggtgtccacgtgatcattggtggacacgattctccctcaccccggggggtggggtacgccaagaaccaagcagtggcacagagtagtggctcttatctttgttttcttgattctgacgatgtcatgatgccccagagggtgaggctgcagcacgaagccgccgttcagcatccctcgtcaataattgggtgccgtgtacgcagggatccgcccaatagtaccgagagatatacaaggtggatcaaccagctgacgccagaacagcttctcacacaagtctttacatctaacggtcctaccgtgatcatgcccacctggttttgctcccgggcctggttctcccacgtgggtccgtttaatgagggcggccagggagtgcccgaagacctgctgtttttttatgagcatcttagaaagggtgggggcgttatcagagtggaccaaagcctgttgctgtatcggcaccatccacaagcagccactcactgcgtcctcgaaacaacaatctggacccatcgagtgcgcttcctcgaagagcaggccttgccgaggtgggcggcctttaccatttggaacgcaggtaagcagggccgtagactctataggagtctaactgcaggttcacaacggaaagtggtggccttttgtgatgtggacgagaacaagatccgcaagggcttctattgccatgaggatagccaagagcggccaaaaccaaggattccgattctgcacttccgtgccgcaagaccgccctttgtgatctgcgtgaagttagatctcaccgggggggccttcgaggacaacctcagatccctgcatctgcaggagggtcaggatttcctgcacttttcatag

SEQ ID NO: 51903 - DNA, 1812 bp, Artificial Sequence
  Description of Artificial Sequence: Synthetic coding sequence
atggccgtggcccggaagatccggaccctgctgaccgtgaacatcctggtcttcgtaggcattgtcctcttctcagtttactgtcgactgcaggggcgatcccaggagttggtcaggattgtctcgggggataggagagtgcggagcagacatgccaaggtcggcaccctgggagatcgagaggctattctgcaaagactggaccacttggaagaggtggtgtataaccagctcaacggcttagctaagccaataggactggtggaaggtcctggcgggctgggccaggggggtcttgcagctacacttagggatgatgggcaggaggccgaaggtaagtatgaggaatacggctacaacgcccagctctctgacagaatctcattggacagatcaatcccggattaccggccgcgcaagtgtcgacaaatgtcatatgcccaggacttaccccaggtctctgttgtttttatctttgtgaacgaagcgctcagtgtcatcctccgatcagtgcattctgttgtgaaccacactccttcacagctgcttaaagaagtgatcctagtagacgataattccgacaacgtggaactgaagtttaacctggaccagtacgttaacaaacgttatccaggtctggtgaagattgttaggaactctaggagggaggggctcatccgcgctcgcttgcaggggtggaaagcagccactgctcctgttgttgggttttttgacgctcacgtggaattcaataccggatgggccgagcctgcgctcagtcgtattagggaggaccggagaaggattgtgctccctgcaattgacaatattaaatacagtaccttcgaggtccaacagtatgcaaacgcagcacatggctataattggggactttggtgtatgtatattataccaccacaggattggcttgaccgcggcgatgagtctgctccaatccgtacgcccgcaatgattggctgttccttcgttgtggaccgcgaatacttcggagatattggactgcttgatcctggcatggaagtgtatgggggagagaatgtagaactaggcatgagggtgtggcaatgcggaggctcaatggaggttcttccatgtagtcgcgtggcacacatcgagaggactcgtaaaccctacaacaatgacattgattactacgccaagagaaatgccctgcgagccgctgaggtgtggatggacgacttcaaaagccacgtttatatggcttggaatatccctatgagcaacccgggcgtggattttggagacgtaagtgaacgtctcgccttgaggcagcggctcaaatgcagaagctttaagtggtacctagagaatgtgtatcctgaaatgcgcgtttataataatactctcacatatggtgaggttaggaattccaaggccagtgcctattgtttggaccagggcgccgaagatggggatagggcgattctctacccctgccatggaatgagctcccagttggttcgctatagcgctgatgggctgttacagttgggtcctttgggttccactgctttccttcccgactccaagtgtctggtggatgatggaacgggtcgtatgcctacgctgaagaaatgtgaggacgtggccaggccgacccagcgactctgggatttcactcagtccggacctatagtgagcagggctactggtagatgccttgaggtggagatgagcaaggatgccaatttcgggctacgcctggttgtgcaacggtgctccggtcagaagtggatgatacgaaactggatcaagcacgctcggcattag

SEQ ID NO: 51904 - DNA, 714 bp, Artificial Sequence
  Description of Artificial Sequence: Synthetic coding sequence
atggaggtgctgccctgcagccgggtggcccacatcgagcggacccgcaagccctataacaatgacattgattactacgctaaaaggaatgccctcagagcagccgaggtttggatggacgactttaaatcccacgtatacatggcctggaacatcccaatgagcaatcctggagtcgactttggagatgtgtcggaaagactggccctgcgccagagactcaagtgcagatcctttaaatggtacctggagaacgtttaccctgaaatgagagtgtacaataacactctcacatacggagaggttagaaattcgaaggcttccgcgtactgcctcgatcaaggcgccgaggacggggacagggcaattctttatccatgccatggcatgtccagccaactggtgagatactctgccgacgggctgttgcagctgggccctcttggaagcacagctttcctccctgatagcaaatgcttagtggatgatggaaccgggagaatgcctacactaaagaagtgcgaggacgtcgcccggccaacccagcgactgtgggacttcactcaatccggaccgattgtgagtagggccactggccgttgcctggaggtcgaaatgtccaaggacgctaacttcggacttcggcttgtggttcaacgctgctccggccagaaatggatgataaggaactggattaagcacgcaagacattag

SEQ ID NO: 51905 - DNA, 1065 bp, Artificial Sequence
  Description of Artificial Sequence: Synthetic coding sequence
atgatcggctgcagcttcgtggtggaccgggagtacttcggcgacattgggctgttggaccccgggatggaagtgtacgggggagagaacgttgaactcggtatgcgcgagactgagggattccagcaagacaaagttaattacaagcagaataagcgggggagaaaaacgaggcagagggttaagaggtctcgcagtgaggcacatcgagcccagccctctcctggagctacacatggagcgcactctagggctccgggtccaagaactgaacccaccgccgagccttggggtcacgcccgccccacagctgcactccctgcgaccggggtttggcagtgtggcggttcaatggaagtgctcccatgtagtcgggtggcgcatatcgagaggacaagaaagccatataacaatgacatcgactattacgcaaagcgcaatgctcttagggctgccgaggtgtggatggacgacttcaaaagccacgtgtacatggcctggaacatccctatgagcaaccctggggttgattttggggatgtgtccgagaggctggcactcagacagcgactgaagtgccggagctttaaatggtacctggaaaacgtctatccagagatgcgggtgtataataacaccttgacttatggtgaggtgaggaattccaaagcctctgcttactgcctcgatcagggagccgaggatggcgacagagccatcttgtatccgtgccatggcatgagctcgcagctggtgaggtatagcgcagatggcttgcttcagttagggccacttggaagcactgcattcctgcccgacagcaagtgcctggtcgacgatggaacaggcagaatgccgacattaaaaaaatgcgaagacgtagctcggccaacgcagcggctgtgggactttacacagtccgggccgattgtgtcccgggccacaggacggtgtctcgaagtcgagatgagcaaggacgccaacttcgggctcagactcgtagtgcaaagatgtagcgggcaaaagtggatgatccgtaattggatcaaacacgcacgtcactag

SEQ ID NO: 51906 - DNA, 294 bp, Artificial Sequence
  Description of Artificial Sequence: Synthetic coding sequence
atggaggtgctgccctgcagccgggtggcccacatcgagcggaccaggaagccatataacaacgacattgattattatgcaaaacgcaatgcacttcgcgccgctgaggtctggatggatgacttcaagtcccatgtttacatggcctggaatattccaatgagcaaccctggggtcgactttggcgacgtgtctgagcgccttgctttacgccagagattgaaatgccggagtttcaagtggtacctggagaacgtttatccagagatgagggtctataacaacactctgtag

SEQ ID NO: 51907 - DNA, 714 bp, Artificial Sequence
  Description of Artificial Sequence: Synthetic coding sequence
atggaggtgctgccctgcagccgggtggcccacatcgagcggaccagaaaaccgtataacaacgacattgattattatgcaaaacggaacgctcttagggccgcagaagtgtggatggacgacttcaagtcccacgtctatatggcctggaacatcccaatgagcaatccgggggtggacttcggggacgtcagcgagcgtctggctctgaggcagcggctgaaatgtagatcctttaagtggtacttagagaatgtgtaccccgagatgcgcgtttataataacacccttacctatggggaagttaggaattcaaaggccagtgcatattgcctcgatcagggcgctgaggatggggatagagccatcctttacccttgtcacggcatgtctagccagctggtacggtattccgccgatggcctgttgcagctaggccccctcggctctacggcattcttgcctgactctaaatgtctggtagatgacggaaccgggaggatgccgacacttaagaagtgtgaagatgtggcccgacctactcagcgactttgggacttcacacagagtgggccaatcgtatcaagggctacagggaggtgcctggaagtggaaatgtccaaagacgccaactttggcttgaggcttgtggtccagcgttgctcagggcagaagtggatgatcagaaactggattaaacacgctcgacattag

SEQ ID NO: 51908 - DNA, 165 bp, Artificial Sequence
  Description of Artificial Sequence: Synthetic coding sequence
atggaggtgctgccctgcagccgggtggcccacatcgagcggacccggaagccttataacaatgatattgattactacgcaaagcgcaatgcgctgcgggccgctgaggtctggatggacgatttcaaatctcacgtgtatatggcatggaatatcccaatgtag

SEQ ID NO: 51909 - DNA, 714 bp, Artificial Sequence
  Description of Artificial Sequence: Synthetic coding sequence
atggaggtgctgccctgcagccgggtggcccacatcgagcggacccggaagccctacaataacgacatcgattattacgctaagcgcaatgccctccgcgctgcggaagtgtggatggatgactttaaatctcatgtctatatggcatggaacatcccaatgtctaatcctggagtagacttcggagatgtctctgaacgactcgccctcaggcagagactcaaatgtcgctcttttaaatggtatcttgaaaacgtgtacccagaaatgcgggtttataacaatactttgacttatggagaagtaaggaacagcaaggcaagcgcatactgtctggatcaaggcgcggaagatggggacagggccattttgtatccctgccatggcatgtcatcccagctggtgagatattccgccgacggcctcctccaactggggccactgggctctacagcctttctgcctgattccaagtgtctagtggatgacggcaccggtcgtatgcctacccttaagaaatgcgaggacgtggctcggccaactcagaggctttgggactttacccagtcaggccccatagtgtccagggccacggggcgctgccttgaagtagaaatgtccaaagacgcgaacttcggcctgagattggtggtgcaaagatgttcaggacagaagtggatgatccgcaattggattaagcatgcccggcattag

SEQ ID NO: 51910 - DNA, 1812 bp, Artificial Sequence
  Description of Artificial Sequence: Synthetic coding sequence
atggccgtggcccggaagatccggaccctgctgaccgtgaacatcctcgttttcgtggggatcgtactgttcagcgtgtattgtaggcttcaaggccgatcacaggagttagtccgaattgtgtccggtgatagacgggtgcggagccggcacgccaaggtgggtacgcttggcgatcgcgaagccatcctccagcgtctcgatcatttggaagaggttgtgtacaaccaattgaacggattggcaaagcccataggtctggtcgagggacccggagggctgggccagggtggtcttgcagccacgttgcgggacgacgggcaggaagcggagggaaagtatgaggaatatggctacaacgctcagttgtccgatagaataagtctggacaggtcgatccccgactaccgcccacgcaaatgtcggcagatgagttatgcgcaagacctaccacaggtctccgttgtcttcatctttgtcaacgaggcgctctccgttattctaagaagcgtgcactccgtggttaaccacactcctagccagttgttaaaggaagtgatattagtggacgataactctgacaacgtggagctcaaattcaatctagatcagtacgtgaacaaacgctacccaggcctggtcaaaatagtgcgaaattcgaggcgcgaaggtttaatccgcgctcgactacaggggtggaaggcagcaacggcccctgttgtcgggttcttcgacgctcacgttgaatttaatactggatgggccgaacctgccttgtcccgtattcgagaagaccggagaaggatcgtgcttcctgctatcgacaatatcaaatacagcacattcgaggttcaacaatatgctaacgcggctcacggttacaactggggtctgtggtgcatgtacattattcccccccaagactggttggacagaggagacgagtcggcaccaattagaaccccagcaatgatcggttgctccttcgtggtcgacagagaatactttggcgacataggtcttctcgacccaggaatggaggtgtacggaggcgaaaatgttgagctgggaatgagagtatggcagtgcggggggtccatggaggtgctgccatgctctcgagtggcacacattgagcgtacaaggaagccctacaacaacgatatcgattattacgcaaagaggaatgcccttagagccgctgaagtctggatggatgatttcaaaagtcatgtttacatggcgtggaacatccctatgtcaaatcccggggtggactttggagatgtgtcagagagactggctctgcggcaacgcctcaaatgcaggagttttaagtggtatctcgaaaacgtctacccagagatgagggtgtacaacaacacactgacatacggagaggtccggaatagcaaagctagcgcctattgtttggatcagggcgcggaagacggggatcgggcaatactgtacccctgccacggaatgtcatctcagctggtgcggtacagtgcagatggactccttcagctcggcccactgggcagtaccgcctttctgccagattctaagtgtctcgttgacgatggcaccggcaggatgccgaccctcaagaagtgtgaagatgtggcccgaccaacacagaggctgtgggattttactcagtctggccccattgtgtccagggctacgggacgctgtttggaggtagaaatgagcaaggacgccaactttgggctgagactggtagtgcagaggtgctctggtcagaagtggatgattcgcaattggattaaacacgcccggcattag

SEQ ID NO: 51911 - DNA, 1155 bp, Artificial Sequence
  Description of Artificial Sequence: Synthetic coding sequence
atgggccccggccccagccccaactggaccctggaccccgagcccagatgtaggctctggagcgaaccgcgcttacctgccggtcccggggtgctggccgcaggaagccctaggttgccctgtcgctacgttatgacaagcgagttcactctgggcccgacagcggaattctttcgagaacacaatttttttcacctggaccccgccaatgtcgtgatgtttgagcagagactcctgccggcagtaactttcgatggcaaagttattcttgagcgtaaggataaggtagccatggctccagatggtaatggaggcttatactgtgccctggaagaccacaaaatactggaggatatggagagacggggagttgagtttgtgcatgtctattgcgtggacaacatcctggtgaggcttgcagaccctgttttcatcggtttttgtgtgcttcaaggcgctgattgcggcgcgaaggtggtagaaaaagcctatccagaagagccagtcggcgtggtatgccaggtagatggtgtgcctcaggtggtggagtattccgaaatcagcccagagactgctcagctgcgtgcctcagacggctccctgctgtacaatgccggaaacatatgcaatcactttttcactcgggggtttctgaaagcagtcacccgggaattcgagcctctgctgaagccacatgttgcagtaaagaaagtgccctatgtcgatgaggaggggaatctggtaaaaccgctgaagcccaacggtataaagatggaaaaattcgtgttcgacgtatttcgctttgccaagaactttgccgcacttgaggtcctgagggaggaagaattttcccctttgaaaaatgcggaaccagccgaccgcgactctccccgcacagccaggcaggcgctgcttactcagcactatcgctgggcgttgcgagccggtgcccgtttcctggatgcacacggcgcctggctgcctgagctcccttcattaccacccaacggagatcctccagccatttgcgaaataagcccactggtcagctactctggagaggggttggaggtttacctgcagggaagggaattccagagccccctcatcctggacgaggaccaagcgcgtgaaccacagttacaggagagttag

SEQ ID NO: 51912 - DNA, 1524 bp, Artificial Sequence
  Description of Artificial Sequence: Synthetic coding sequence
atggccagcgagcaggacgtgcgggcccggctgcagcgggccggccaggaacacctgctgcgcttctgggctgaactcgcgcccgagccgcgggcggccctactcgcagagctggcgttgctcgaacctgaggcattgcgggaacactgtagaagggccgctgaggcttgcgctcgcccacatggcccccctcctgacctagcggctcgtcttcgccccctgcctcctgaacgggtgggccgggcctctagaagcgacccggaaaccaggcgcagatgggaggaagaaggatttcggcagatttccctaaataaggtggcggtgcttctgttagccggcggtcaaggcacccgactcggagttacctatccgaagggaatgtatagggtcggacttccctccaggaagacactctaccaactgcaggccgaaagaattaggagagtcgagcagctcgccggagaaagacatggaacgcgctgcaccgtgccctggtacgtgatgacctcagaattcacattgggaccaacggctgagtttttccgcgagcataacttttttcatctggaccccgccaatgtggtcatgttcgagcaaaggctccttcctgcagttacatttgatgggaaggttatcctggagcgaaaggacaaggtggcaatggccccagatggtaacggtggtttgtattgcgccctggaggaccacaaaatattagaggatatggagcggcgaggagtcgagttcgtgcacgtttattgcgttgacaatatcttggtacgcttagctgacccagtgttcattggattttgcgtgctgcagggtgccgactgtggtgctaaagtcgtggagaaggcgtaccctgaggaaccagtaggggtcgtctgccaggtggatggggtgccgcaggtcgtggaatactcagagatctccccagagacagcccagctcagggcctcagacggatccctgctctataacgccgggaacatctgtaatcacttctttacgcgggggtttctgaaagccgttacccgggaattcgagccattgcttaagccccacgtcgctgttaaaaaggtcccctacgtcgacgaggaggggaatctggtgaagccgttgaaaccaaatgggattaagatggaaaagttcgtctttgacgtcttcaggtttgctaagaacttcgctgcccttgaggtcctccgggaagaggagttctcacctctcaagaatgcagaacctgctgacagggatagcccccggaccgcacgacaggccttgctgactcagcattataggtgggctctccgagcaggagctaggttcctggatgcacacggagcctggctgcccgaattaccctctctgcctcccaacggcgatccaccagccatttgtgaaattagcccattagtcagctattctggtgaaggtcttgaagtgtacttgcaaggacgtgaattccagtccccactaatcttggacgaggaccaggccagggagcctcagctgcaggaaagctag

SEQ ID NO: 51913 - DNA, 4323 bp, Artificial Sequence
  Description of Artificial Sequence: Synthetic coding sequence
atggccggcatcatcaagaagcagatcctgaagcacctgagccggttcacgaagaacctgagccccgacaagattaacctgagtacgctgaaaggcgagggtcagttgactaatctcgagttggacgaggaagtgctgcaaaacgtgttggaacttcccacgtggctagccattaccagagtgtattgcaatcgggcgtctattagaattcagtggaccaagttgaagacccacccaatatgcttgtgtctggataaggtcgaggtggaaatgaaaacgtgtgaggatccacgacctcctaacggccaaagccctatcgccctcgcttcggggcagtcagagtacgggttcgccgagaaggtggtggagggtatgttcatcatagttaattctatcactatcaagatccattcaaaagctttccacgcatcatttgagctgtggcaactgcaggggtactctgtgaacccaaactggcagcagtctgacctgcgcctaacaagaataaccgatccatgtcgtggtgaagtcttgacctttaaagagattacctggcagacattaaggatcgaggctgatgccacagacaacggagaccaagacccagtgacgactcctttgcgtttgattactaatcagggccgtatacaaattgctttaaaacgacgaaccaaagattgtaacgtgataagctctaaattgatgtttctgctcgacgatctcttatgggtacttacagattctcaactcaaagcaatgatgaagtatgctgaatcactatccgaagcaatggagaagtccgctcaccaacgcaagagcctcgcacctgaaccagtccagatcaccccccccgccccctcagcacagcagtcttgggcgcaggcctttggaggatcacagggtaacagcaatagttctagttctcggttatctcaatattttgagaaatttgacgtaaaagaatccagctaccacttgctaatcagtagactagacctgcacatttgcgatgattcacagagtagagaaccaggtgtctcggcaaacaggctaatgggtggagccatgcaactcacattccggaaaatggcattcgactactacccattccactgggctggggactcgtgcaaacactgggttaggcactgtgaagctatggagaccagagggcagtgggcccagaagctggtgatggagtttcagtcaaagatggaaaagtggcatgaggagacaggtctgaagccaccatggcacctcggagtagactcgctcttccggagaaaggccgattcactgtcaagccctcggaaaaatccactggagcgtagcccaagccaggggaggcagcccgcattccaacctcctgcctggaacaggctaaggagctcatgtatggtggttagggtggatgacctggacattcaccaggttagcaccgcggggcagcctagtaaaaagccatccaccctcctctcgtgtagcagaaagctacataatctaccaacccaggtaagtgccattcatattgagtttaccgagtattactttcccgataaccaagagctgccagttccctgccccaatctgtatatacagcttaacggactcacgtttacaatggaccccgtttccctgctatggggcaacctgttctgtctggatctctaccgatcacttgagcagtttaaggctatctacaagctagaggactcaagtcaaaaggacgaacacttggatataaggttggacgctttctggttgaaggtgtccttccctcttgagaaaagggaacgcgcagagctccaccggccacaggccctcgtgttttctgcaagtgggatgatcgccaccaatacgcgacatgcaccgcactgttcttgcagcgatttgcagtctctcttcaggggcttcgccgctgccgaattttttcattccaattatgatcattttccaaaagtacccggtggattctcactactccacatgctttttctccaccacgcatttcaaatggattcttgcctccctcaacccaatacactgccccctcaacgtcccaaggcatcatgggacctgtggtctgtccactttactcaaatatctcttgatttcgagggtaccgagaacttcaagggccacacattaaattttgtcgccccgtttccactgtcaatttgggcttgtctcccccttcggtggcagcaagctcaggctcggaagcttctactcgcaagtgaaggccgtctcaagccatcagcctcctttggctccccggtgcaatctgaggctctagcacctgacagcatgagccatccgaggtcaaagactgagcacgacctcaagagtcttagcgggctgaccgaagtgatggagatactcaaagagggcagctccgggatggacaataagggccctctgacagaattggaagacgtcgcagatgtccacatgcttgttcattctcccgcccatgtcagggtgagactagatcattaccagtatttggctctcctcaggctgaaagaggtgctgcagcgactgcaggaacagcttactaaggacaccgagtctatgacaggtagccctctccaaaaccagacagcctgcattggggtgctctttccgagtgcggaagtcgccctgctgatgcatcccgccccaggcgctgttgacgcagatagtgcgggcagcgacagcacgtcattagtggactctgagctgtcaccatcagaagacagagagctcaagtctgatgccagttcggatcaggggcctgcctctccagagaaggtgcttgaagaaagctccattgaaaaccaggatgttagccaagagagaccacattcaaatggagaattgcaagactcaggaccgctggcccagcagcttgctggcaaaggccacgaggccgtcgagtccctccaggcgaagaagcttagtcgcacgcaagcctcctcctcccctgccgcactgaaaccacccgcggggcgcgagacggcagtgaacggacagggggagctcatcccgttgaaaaacatcgagggggagctttcaagcgctattcacatgaccaaagacgctacaaaagaagcgctccacgcaaccatggacctgacaaaagaggccgtgagtctgacgaaggacgctttttctctcgggcgtgatcgaatgactagcacaatgcataaaatgctctctttaccccctgccaaggagccaatggcgaagactgatgaaggtgtagccgctcccgtgtctggcggcgccgcccgcctaaggttcttttcgatgaaacggacagtctcgcagcagtctttcgacggcgtctccctggattcttctgggcctgaggatcggatatctgttgatagtgatggcagcgattccttcgttatgctgctggaatccgagtccggcccagagagtgtgccgcccgggtctctcagcaacgtcagtgataacgctggagtgcaaggcagtccactcgtcaataactacggccaaggctcacccgcagctaatagctcagtgtctccctcgggtgaggacctgatttttcatcctgtgtccgtcctcgtgctgaaagtgaatgaagtgagcttcggaatcgaggtccgcggcgaggatttaacggtcgcgttacaggcggaggaattgacactccagcagttgggcaccgtgggcctgtggcagttcttgcatggtcagtgccctggaacctgctttcaggaatcctcgacactgaaaaccggacatattcgacctgccgtagggttaaggttcgaagtggggccaggcgcagccgttcacagtcctctggcaagccagaatggcttcctccacctccttttacacggatgtgatcttgagttattgacctctgttctatctggactgggaccatttctggaggacgaggaaatccctgtggtcgtgccaatgcaaattgaacttctaaattctagcattacactgaaggatgacattccgcctatatacccaacaagtccgggccccattcccattaccctggcaatggagcatgttgtccttaaaagatcagacgatggggtgttccacatcggggccgccgcccaggacaagccctcagccgaagtgctcaaatccgaaaagagacagcctccgaaggaacaggtgtttctggtgcccacgggtgaggttttcgaacagcaggtgaaagagcttcccattctgcaaaaagaactgattgagaccaagcaggccttagctaatgcgaatcaggataaggaaaaacttctgcaagagatacgcaaatataacccgttttttgagctgtag

SEQ ID NO: 51914 - DNA, 4203 bp, Artificial Sequence
  Description of Artificial Sequence: Synthetic coding sequence
atggccggcatcatcaagaagcagatcctgaagcacctgagccggtttaccaagaacctgagcccggataaaattaacctgtcaacattgaagggtgaagggcagctcaccaacctcgaacttgatgaagaagtgttacaaaacgttctcgagctgcccacctggcttgccatcaccagagtctattgcaatagggcatccatccgtatccagtggacaaagctcaagactcatcccatttgtctgtgcctggacaaggtggaggttgaaatgaaaacctgcgaagaccccaggcctcccaacggccagtcaccgatcgcccttgcttccggccagagtgagtatggcttcgctgagaaggtagtggagggcatgtttatcatcgtcaatagcataaccattaaaatccactccaaggcctttcacgccagcttcgaattatggcaactacagggctactctgttaatcccaattggcagcaaagcgacctacgcctgacgcggatcaccgacccctgtcggggagaggtgctgacgtttaaggagatcacttggcagaccctaagaattgaagctgacgcaacggataacggagaccaggatcccgtgaccaccccgttgagactcatcacaaaccagggtcgtatccaaattgccctgaagagacgtaccaaggactgcaatgttatctctagcaagctgatgttcctgctggacgatcttctgtgggtgcttaccgacagtcagctgaaagctatgatgaagtacgccgaaagtctgagcgaggcgatggaaaagtccgcccatcaacgcaaatctctcgcgccggagccagtgcagattaccccccctgcaccaagtgcacaacagtcttgggcccaggccttcggcgggagtcagggcaacagtaactctagttcatcacgactgagccagtatttcgagaaattcgatgtaaaagaaagctcctatcatctcctcatttcaagacttgacttgcacatctgcgacgactctcagagccgcgagccaggcgtgagcgccaatagacttatggggggggcaatgcagctaacctttaggaagatggccttcgactattacccctttcactgggccggcgactcttgtaaacattgggtccgccattgcgaggcgatggagacacgcggccaatgggcccagaaactagttatggagttccagagcaagatggagaaatggcacgaagagacgggactgaaacccccatggcatctgggagtggatagcttattccggagaaaagccgactcccttagcagcccccgtaaaaacccactggagcgcagcccgtctcagggtagacagcccgcctttcagcccccagcatggaaccggttgagaagttcctgtatggttgtcagggtggacgatctggatatacaccaggtgtcgactgcaggccaaccttcgaagaagccatcgacactcttgtcttgttcaaggaaactgcataacctgccaacacaagtatccgcaattcacatcgagttcaccgagtactatttccctgataatcaggagctgcctgtgccttgcccaaatctttacattcagcttaacggtctgaccttcaccatggatcctgtgtcactgctgtgggggaacctgttttgcctggacctgtataggagcctggaacagtttaaggccatctacaaactggaagattctagccagaaagacgagcacctcgacattcgactagatgcgttttggttgaaagtctcattcccactagagaagagagagcgtgcggagctccaccggccccaggcgctggtattttcggcatctggcatgatcgcaaccaacacacgccatgccccacattgttcctgctcagatctgcagagccttttcaggggctttgctgccgctgaattttttcattcaaattatgaccacttcccaaaagtgcccggaggtttctctctactccatatgctgtttctgcaccacgcgttccagatggatagctgcctgccgcagcccaacacactcccccctcagcgccccaaagcgtcatgggacttgtggagcgtgcactttactcagatcagtctcgattttgagggtacagagaacttcaaaggccatacactgaacttcgttgccccgttccccttgtctatatgggcatgtctgccactgcgatggcaacaagcccaggctcgcaagttgttattggcctccgagggcagactgaaaccttctgcaagctttggaagtcctgtgcaaagtgaggccctggcacctgacagtatgtcccacccccggtccaaaactgagcacgacctgaaaagcttgtccggattgacagaagtgatggaaatcctcaaggagggatcttctggtatggacaacaaaggcccactcacagagcttgaagacgtggccgatgtacacatgctcgttcacagccccgcccatgtgcgtgttagactggaccactatcagtacctggccctgcttagactcaaggaagtcctgcagcgcctgcaagagcagctcacaaaagacactgagtctatgaccggctcccccctgcagaaccagacggcttgtatcggagtgttgtttccctcggccgaagtggctctactgatgcacccagctcctggtgctgtggacgctgactcagccggctccgacagtacctccctcgtcgactccgagctgagtcccagcgaggacagagaacttaagtccgacgcgagctctgaccaagggcccgcaagtcctgagaaagtcctggaagaaagttccattgaaaaccaagacgtaagccaggagcggccacactcgaatggggaactgcaggactccggaccgctggcgcaacaacttgccggtaaaggtcatgaggctgtggagtctctccaggcgaagaagctcagtaggacccaagcttcgagtagcccagccgccctcaaacctcccgccgggcgagaaaccgctgtgaacggccagggtgaactgatcccattaaagaacatcgagggcgaattgtcaagtgcgatccacatgacaaaagatgctacaaaggaggctctgcatgcaacgatggatctgaccaaggaagctgtcagccttaccaaggatgcattttcactaggacgtgaccggatgacttcgacaatgcacaagatgttgagtctgccgcccgccaaggagcccatggccaagacggacgagggagtcgcggctcccgtttcgggaggagccgctcgattgcggtttttctctatgaaacggacagtaagtcagcagtccttcgacggagtgtcgctggatagcagtgggcccgaggaccggataagcgtagatagtgatggctcagattcattcgtgatgctcctggagtctgagtccgggccagaatcagtgccaccggggagcctctcgaatgtcagcgataatgcaggtgtccaggggtctccacttgtgaataattacgggcagggctcacccgctgctaactcaagtgtaagccctagcggcgaagatctaatttttcaccccgttagcgtgctagtattaaaggtaaatgaggtgtcttttggtatcgaggtcagaggtgaggacttgaccgtcgccctccaggcggaggagttaaccctacagcaactgggaaccgtgggtttatggcagtttctgcacggccaatgtccaggcacctgcttccaggaatccagcactctcaagacagggcacatcagacctgccgtgggtctccggtttgaggtcgggccaggagctgccgttcatagtcctctcgctagccaaaacggatttttacatcttctgttgcacggctgtgacctagaactgctcacttccgtgctgtcaggtttgggcccatttttggaggacgaagaaattccagtggtcgtgcctatgcagatcgaacttctaaactcctcgatcactctgaaggatgatatcccccctatttatcctacttcgccaggccccattcccatcactctggctatggagcacgtggtgctgaaacgtagcgacgacggcgtgtttcacatcggagcggcggcccaggacaaaccctccgccgaggttttaaaatccgagaagagacagcctccaaaggaacaagtgtttctcgttccaaccggagaggtattcgagcagcagacatag

SEQ ID NO: 51915 - DNA, 4395 bp, Artificial Sequence
  Description of Artificial Sequence: Synthetic coding sequence
atggccggcatcatcaagaagcagatcctgaagcacctgagccggttcactaagaacttaagcccagataaaatcaacctttccactctgaagggcgagggggagctgaaaaaccttgagcttgacgaggaggttttacaaaacatgctggaccttccgacctggttggccatcaataaggtgttctgcaacaaagcctcaattcgtattccgtggacgaagctgaaaacccatcctatttgtctgagcctggacaaagtgattatggagatgagtacatgcgaggaaccgcgctcaccaaacgggccaagtccaattgctactgcctccgggcagagcgagtacgggttcgccgaaaaggttgttgagggaattagtgtatctgtgaatagtatcgtgataagaataggcgccaaggcctttaatgcgtcgtttgaactctctcagctgcgcatctattccgttaatgcccattgggaacacggcgacctgcgctttacccgcattcaggacccccaaaggggcgaggtgctgacctttaaggagatcaattggcagatgatccgcatcgaggccgacgccacacagagctcccaccttgagataatgtgtgcccccgttagacttattacaaatcagagcaagatcagagtcaccttgaagagacggttaaaggactgtaatgttatagctactaagctggtgctgatcctcgatgatctcctatgggtacttacagactcacagctcaaggcaatggtacaatacgcgaagtcccttagcgaagcgatcgaaaaaagtactgaacaacgaaagtcgatggcgcctgagccaacgcagtcatcaaccgtggtggccagcgcacagcaggtcaagactacacagaccagtaatgccccagacgtgaacgacgccatcgtgaaactgtttaatgatttcgacgtaaaagaaacctcacatcatctagtcataagtcacctggacctccatatctgcgatgatatacatgcgaaggagaaagagtcaaatcgaaggattacggggggagctatgcagctgtcattcacccagctgaccatcgattactacccatatcacaaggctggggattcatgtaaccactggatgtatttctcagacgcaactaagaccaagaacggatgggccaacgagctgttacatgagtttgagtgtaacgtggagatgctgaaacaggcagtcaaggaccacaacgtgggcagtccacctaagtcccctacccatgcttcaccccagcacactcaaaccgagaaagattatcctctgaaagggacctgccggacaccatcggttctaagtcaacagtctaaggccaagctgatgtcatcttcagtggtagttaggttagccgactttaatatttatcaggtgagtactgccgagcagtgcagatctagccctaaaagtatgatctgttgtaacaaaaagagcctctacttaccacaggaaatgagcgctgtgtatatcgaattcactgaatactattaccctgatggtaaggactttcctatcccctcccccaacctctattcccagctcaacgccttgcagttcacagtggacgagcggtccatcttatggcttaaccagttcctgttagaccttaagcagagtttgaaccagttcatggcggtttataaactgaatgacaactctaaatctgatgaacatgtagatgtgcgggtggacgggctcatgctgaagtttgtgataccatccgaggtgaagagtgaatgccatcaggatcagccccgagccatctccatccagtctagcgagatgatcgccactaataccaggcattgcccaaactgccgacatagcgacttagaggccctcttccaggatttcaaagactgcgattttttctctaaaacctatacgtctttcccaaaatcgtgtgacaattttaacctcttgcatcccatctttcagagacacgcccatgagcaagacacaaagatgcacgagatctacaagggaaacattactccccagctcaataaaaacactctgaagactagcgctgccacagatgtttgggcagtgtattttagtcagttttggattgattatgaggggatgaagtcaggtaagggacggccaatcagcttcgtggactccttccccctgagcatctggatttgtcagcccactaggtacgccgagagtcagaaggaaccccagacatgcaatcaggtgtcactgaatacatcccagtccgagtcatcagatttggccggaagactgaaacgcaagaagctcctcaaagagtactactcaaccgagtccgagccacttactaacggcggacagaagccctcctcgtcggacacctttttccgtttctcgccgagttcctcggaagcggatattcatcttctcgttcatgtgcacaaacacgtttctatgcagatcaatcattatcagtatctgctgcttctgttcttgcacgagtctttgattctcctgtccgagaatctaagaaaggacgtcgaagccgtgacgggctccccagcaagccaaacaagtatctgcattggcatcttgctgcggtcggctgagctggctcttctgctgcatccagtggaccaggcaaacacgctgaaaagtcctgttagcgagtccgtgagtccagtggtgcctgactacttgccaacagaaaatggcgactttctgagttcaaagcggaagcagatctcccgcgacattaaccggatccgaagcgttactgttaaccacatgtctgacaaccgctcaatgagtgtcgatctgtcgcacattcccctgaaggatccacttctgtttaagtccgcctcggatactaacttacaaaagggaatctcctttatggactatttatctgataaacacttgggcaagataagtgaggatgagtctagcggactggtgtacaagagtggcagtggagagataggttcagagaccagcgataaaaaggacagcttttataccgactccagtagcatattgaactaccgtgaagattctaatatcctcagttttgactcagacggaaaccagaatattttgagctcaactctgacatcaaagggcaacgagacaatcgagagcatcttcaaagctgaggacttactccccgaagccgctagcctctccgagaatctcgacatcagcaaggaggagactccacctgttcgaacactgaaaagtcagtcctccctgtccggcaaaccaaaggaaaggtgtccacctaacttggccccactatgcgtttcttacaagaacatgaaaagaagttctagccagatgagcctggacacgatctctctagactccatgatcctggaggagcagttactggaatcagatgggtccgactcacacatgtttttggaaaagggcaataagaagaacagcacaaccaactatcgcggaaccgccgagtctgtgaatgctggtgcaaacctgcagaactatggcgagacttccccagacgccatcagtaccaattcagaaggagcccaagagaatcacgatgatctgatgtccgtggtcgtgtttaaaatcaccggcgtgaacggagagatcgatatacggggtgaggacacagaaatttgtctgcaagtcaaccaagtgacgcccgaccagctcggcaatatatccctccgacattacctgtgcaataggcccgtgggcagtgatcagaaggctgttattcactcgaagagtagccctgagatttctcttcggtttgagagtggaccgggggccgtgattcacagtctgctggcggaaaaaaacggctttcttcagtgccacatagaaaacttctccacagagtttttgacatcttctctcatgaacatccaacattttctggaggacgaaactgtggctaccgtgatgcccatgaagattcaggtgagcaataccaagatcaatcttaaggacgactcgcctagatcttctactgtcagccttgaaccagcaccggtcacggtgcatatagatcatctggtggtggagcggtcagatgacggcagctttcatattcgagacagtcacatgctgaataccggaaacgacctgaaggagaacgtcaaatcagacagcgttctactcacaagcgggaaatacgatctaaagaagcaacggtctgttacgcaagcgactcagacctcgcccggcgtgccttggccctcacagtccgcaaacttccctgagttcagctttgatttcactcgggagcagttgatggaagaaaatgagtcattaaagcaagagttggctaaggccaaaatggcactggcagaagctcacctggagaaagatgccctgcttcaccacataaaaaaaatgaccgttgaatag

SEQ ID NO: 51916 - DNA, 1569 bp, Artificial Sequence
  Description of Artificial Sequence: Synthetic coding sequence
atggccggcatcatcaagaagcagatcctgaagcacctgagccggttcacaaagaatttgagtcctgacaaaataaatctaagcacccttaagggtgagggggagctgaagaatctcgagctggacgaagaggtcctccaaaacatgctggatttaccgacatggcttgcaatcaataaggtgttttgtaataaagcatctatcaggatcccttggacaaagctgaaaacacatccgatctgtctgtcactggacaaggtgatcatggaaatgagtacatgcgaagaaccgcgatctccaaatggtccttcgcctattgcgacagcgtcgggtcaaagcgagtacgggttcgctgaaaaggtggtcgaaggaatctcagtcagcgttaattcaatcgtgatccggataggggcaaaagccttcaacgcttcatttgagctatcccagctcagaatttactctgtaaacgcccattgggaacacggcgatcttaggttcacacgaatccaggacccacagagaggggaggtactgacattcaaggagatcaactggcagatgatcaggatcgaagccgacgctacgcagtcttcgcacctcgaaattatgtgcgcccctgtgagattgataacaaatcagtctaagatccgcgttacacttaaaaggcgtttaaaagattgcaacgtcattgctaccaagttggtgctgatcctagacgacctgctgtgggtgctgactgattcacagctcaaagctatggttcagtacgctaagtctttgtccgaagctatcgaaaaatcaacagagcagagaaaatccatggcccctgagcctacgcagtcatctacggtggtagcatccgctcagcaggtcaaaacaacccagaccagcaacgcgcctgatgttaatgatgctatagttaagttgtttaacgatttcgacgtcaaagagacttcccaccatctggtgattagtcaccttgacttgcacatctgcgacgacattcacgcaaaagaaaaagagagcaatcgcaggatcacagggggcgccatgcagttgtcgtttacgcagctgaccattgactattatccctaccataaagccggggatagctgtaaccattggatgtacttttctgatgccacgaaaaccaaaaatggctgggctaatgagctcctgcacgaattcgagtgcaacgtggagatgctgaagcaagcagtgaaggaccataacgtgggctcaccacccaagtctccgacgcacgcaagtcctcaacacactcagaccgaaaaggactatcccctcaagggtacctgccggaccccctctgtgctctcccagcagtccaaagcaaagttaatgtcctcttccgtagttgttcgcttggcagacttcaatatctatcaagtgtcaacggcagagcagtgcagatcaagccccaaaagcatgatttgttgcaacaaaaagtctctctatttaccacaggagatgtccgccgtttatattgaattcaccgaatactattacccagacggtaaggatttccccaccgctttcttgtccaggtag

SEQ ID NO: 51917 - DNA, 756 bp, Artificial Sequence
  Description of Artificial Sequence: Synthetic coding sequence
atgagcggcagcaaccccaaggccgccgccgccgccagcgccgccggcccagggggcctcgttgcgggtaaggaggaaaagaaaaaggcaggtggaggggtccttaatcgccttaaggcccggaggcaggccccacaccacgccgcagatgatggggttggggctgctgtcactgagcaagagttgcttgcccttgacacgatccgacccgaacatgtcctgcggttatcgagggtaacggagaactatttgtgcaagccggaggataacatttacagcatagacttcacacgctttaagatacgggacctcgaaacagggaccgttctgttcgagatcgccaagccatgcgtctccgaccaagaggaagatgaggaggaaggcgggggcgacgtggacatttctgctgggaggttcgtccggtaccaattcacccccgcatttctccggcttagaaccgtgggtgccaccgttgagttcacagtcggtgataagcctgtgtccaactttcggatgattgaacgacattacttccgagagcatctgctcaagaatttcgacttcgacttcggcttttgtattccatcatctcgaaacacttgcgaacatatctacgaattcccccagctgtctgaggatgtcatcagactgatgatcgagaatccgtacgaaactcggtctgacagcttctacttcgtcgataataagctgattatgcacaacaaagccgattatgcctacaatgggggccaatag

SEQ ID NO: 51918 - DNA, 756 bp, Artificial Sequence
  Description of Artificial Sequence: Synthetic coding sequence
atgagcggcagcaaccccaaggccgccgccgccgccagcgccgccgggcccgggggcctagttgcagggaaagaggaaaagaagaaagctggcggcggcgtactcaataggctgaaggctcgacgccaagccccccaccacgcagccgacgatggggtcggcgctgctgttactgaacaggaactgctcgctctcgacactatacggccggagcacgtgttgcgcctttcgagggtgactgagaattatctatgcaagcccgaagacaatatctattccatagacttcactcgatttaaaatccgcgacctggagacgggcacagttctatttgagattgccaaaccctgcgtgagcgatcaagaggaagacgaggaggaaggtggcggggacgtggatatctcggcaggcagattcgtaagataccaatttacgcccgcctttttacgccttagaacagttggcgccactgtcgagtttaccgtgggcgataagcctgtgagcaattttcgaatgatcgaacgccattatttcagggagcacctcttaaagaacttcgacttcgattttggcttttgtattccttcttctaggaacacctgcgagcacatatacgagttcccacagctgagcgaggatgtgattcgactgatgattgaaaatccctacgaaacacggtctgatagtttttatttcgtggataacaagctcataatgcacaataaggcagactatgcctacaatgggggacagtag

SEQ ID NO: 51919 - DNA, 3828 bp, Artificial Sequence
  Description of Artificial Sequence: Synthetic coding sequence
atggagaacttcatcctgtacgaggagatcggccggggcagcaagaccgtggtctacaagggtcgccgcaaggggaccatcaatttcgtggccatcctctgcacggacaaatgcaaaaggcccgaaattacaaactgggttagactcactcgcgaaattaagcacaagaatatcgtaactttccacgaatggtacgagaccagcaaccatctgtggttagtcgtggagctctgcactggtggatccctgaaaacagtgattgcacaggatgaaaacctgccggaggatgttgtaagggagtttggcatcgatctcatctcaggcctgcaccacctgcataagctcggcatactattctgtgacatcagcccaaggaagatcctcctggaggggccaggtactctcaagttctcaaacttttgcttagccaaagtggagggtgagaacctcgaagaattttttgccttggttgccgccgaagagggaggtggagacaacggcgagaacgtgcttaaaaagagtatgaagtccagagttaaggggtcgccagtgtatactgcacctgaagtggttcgtggcgccgatttttctatctctagtgatctgtggtcactcggctgcctgctttacgaaatgttctcagggaagcctccgtttttttcggagtccatctccgaactgaccgaaaagattctatgtgaggatccgctccctcccatacctaaggacagttcaaggcccaaagcttcttccgacttcatcaatctgctcgatgggctgctgcagcgcgatccccagaagcgcctcacctggacaaggctgctccaacacagcttttggaaaaaagccttcgccggcgccgaccaggaatctagcgtggaagatttatccctttcgagaaatactatggagtgttctggcccgcaagatagcaaggaattactgcagaacagccagtctagacaggctaagggccacaaaagcgggcaacccctgggacattcgtttcgcctcgaaaacccaacagagtttagaccaaagagtactctggagggccagctgaacgaatccatgtttctgctgagcagcaggcctacccctcggacaagcacggcggtggaagttagccccggtgaggatatgacccactgttcacctcagaaaaccagccccttaaccaaaatcacgagtggccatctctcgcagcaggatctcgaatctcagatgcgggagcttatttacactgattccgacctggtcgtcactccgatcattgataatccaaagattatgaaacaacctcccgtaaaatttgacgcaaaaatcctccacctaccaacttacagcgtcgacaagctccttttcctcaaggatcaggactggaacgattttctgcaacaggtctgttcacagatagattccactgagaagagcatgggtgcatcccgagcaaagctcaacctgctctgctacctttgtgtcgtagctggacatcaggaggtagctacccggctgcttcactcccctctgtttcaattactcatacagcatctgagaattgcacccaattgggatattagagccaaggtggcgcatgtcatcgggttgctggcctcccacacagccgagttgcaggagaatactcccgtggtggaagccattgtgctccttactgaacttatccgggagaacttccggaacagtaagctgaaacagtgcctgctgcccactctaggcgagctgatctacctagtggctacccaggaggaaaagaagaaaaatccaagggaatgttgggctgtgcccctcgctgcgtacacagttcttatgcgctgtctgagggaaggtgaagaaagggttgtaaaccacatggctgcaaagatcatcgagaacgtttgtacgacattcagcgcccaaagccaggggttcatcactggcgagattggacccatcctctggtacttattccggcacagtacagcggactctctgcggatcaccgcagtctccgctctgtgccgaattacacgacacagtcccactgctttccagaatgtgattgaaaaggtcgggctgaacagcgttatcaatagtctggctagcgctatttgcaaggtgcagcaatacatgctgactctgtttgctgccatgttgtcctgcggcattcacttacaacggctgatccaggaaaaggggttcgtctctactatcatccggttactggactcaccatcaacttgcatcagagccaaagcttttctggtcttattgtatatcttaatttataaccgagagatgctgctgttgagctgtcaggcacggctcgtgatgtatattgaaagggattctaggaagaccactccgggaaaagagcagcagtctggcaatgagtatctgtccaagtgcctggacctgctcatatgtcacatagtccaggaactgcctcggatccttggtgatatcctcaatagcctcgctaatgtgtccggccgtaaacatccaagtactgtgcaggtcaaacaattgaagctctgcctgccacttatgcctgtggtgctgcatttagtcaccagtcaagtcttcagaccacaggttgttacagaggaatttctcttcagctacggcaccatcctgagtcatatcaagtctgtcgactctggagagacgaatatagatggtgctatcggtctgactgcaagtgaggaattcatcaaaattactttatctgccttcgaagccatcattcaatacccaattttgctgaaggattaccgatcaaccgtcgttgattacattctccctccccttgtctccttagtgcagagtcagaatgtggagtggcgcctctttagtcttcgactcttgtccgagactactagcctgctggtgaaccaggaattcggcgacgggaaggagaaggcttccgtggactcagactccaatttgctcgcactcatcagggatgtgctccttccgcagtatgaacacatcttactcgaacccgaccccgtgccggcatacgccctcaagctgttggttgccatgactgagcacaatcccacttttactcgactggtggaggagagtaaactgatcccactcatttttgaggtgactctggaacatcaggaaagcattctagggaacaccatgcaatctgtgattgcccttctgagcaacctggttgcctgcaaagacagcaacatggaactcctgtatgagcaggggctggtcagccacatatgtaatctgttgactgagactgccactctttgtctggatgttgataacaaaaacaacaatgagatggccgcccctttgcttttcagcctattggacattctccattcaatgctcacctacacttcagggatagtacggttggccttgcaagctcagaaatcgggatccggcgaggacccacaggcggctgaggacctgctgctccttaatcggcccttgacagatctgatctccctcctaatccctctactccccaatgaagatccagaaattttcgatgtctcctctaaatgtctctccatcctggtacagctgtatgggggcgagaatcccgatagtctgtcccccgagaatgtggaaatcttcgcccatctcctcaccagtaaggaagatcctaaggagcagaaactcctactgaggatcctaagacggatgatcacctctaacgagaaacatcttgaatctctgaagaacgccggttctctccttcgggcactggagcggcttgcccctggctctggctcttttgcagacagcgctgtcgccccactcgcgcttgagatccttcaggcggtcggccattag

SEQ ID NO: 51920 - DNA, 210 bp, Artificial Sequence
  Description of Artificial Sequence: Synthetic coding sequence
atgcagaagtactgcatctaccagcacttccagttccagctgctgatccagcacctttggatagcagccaactgtgatatttgggccaaggtagcgcgcgtaatcgggctgctcgccagtcacaaaaccgacctccaggagaatactcccgtggtggaggcttttccgaactcgccccgtactcccaccttgcccggagttttaacttag

SEQ ID NO: 51921 - DNA, 210 bp, Artificial Sequence
  Description of Artificial Sequence: Synthetic coding sequence
atgcagaagtactgcatctaccagcacttccagttccagctgctgattcaacacctctggatcgctgccaactgcgacatctgggctaaagtggctagggttataggcctgctagccagtcacaaaactgacttacaagaaaatacaccggttgtggaggcttttcccaatagccctagaacgccgacattgcccggcgttctgacatag

SEQ ID NO: 51922 - DNA, 7377 bp, Artificial Sequence
  Description of Artificial Sequence: Synthetic coding sequence
atgatcagcaccctggccaccttcccccccttcctgcacaaggacatcatcgagtatctgtccacttcctttctgcccatggctatcctgggtagttcgagacgtgagggggtccccgcccacgtcaacctctccgcatctagcatgctaatgatcgccatgcagtacactagtaatcctgtgtatcactgccagttgcttgagtgccttatgaagtacaagcaggaggtgtggaaagacctgctgtatgtcatcgcctacggccccagtcaagttaagccaccagccgtgcagatgctttttcattactggcccaacctcaagcccccaggagctatcagcgagtatcgggggctgcagtacaccgcttggaaccctattcactgccagcacatcgaatgccacaatgccatcaataagcctgccgtgaaaatgtgtatcgatcccagtctatctgtggccttgggagacaaacccccccctctgtatctgtgcgaagagtgctcagaacggatcgctggagaccacagtgagtggttgatcgatgtgctcctgccccaggcggagatctctgctatttgtcagaagaagaactgtagttcacacgtgcggcgcgcggtcgtgacctgctttagcgccggctgctgcggtcggcatggaaaccggccagtgaggtactgtaagagatgccactcaaaccatcatagtaacgaggtcggcgcagccgccgagacacacttgtaccagacttccccccctccgattaacacaagggagtgcggagctgaagaactagtttgtgccgtcgaagcggtcatctctctcttaaaagaagccgaattccacgctgagcagcgggagcacgaactcaatcgtcgtcgccagttgggccttagtagttcacaccatagtctggataacgccgatttcgacaacaaggatgatgacaagcacgaccaaaggttattgagccaatttggcatctggtttcttgtgagcctctgcactcccagtgagaacaccccaacagagtccctggcccggctagtggccatggtgttccagtggttccactctaccgcttatatgatggatgacgaagtcggttccttagtggaaaaactgaagccccagtttgttacaaaatggctgaagacggtctgcgatgtacgcttcgatgtaatggtcatgtgtctgttaccaaaacctatggaattcgctcgcgtggggggctactgggataagtcctgttctaccgtaacacagctcaaggagggtctgaatcgaattctgtgtcttatcccatacaacgtgatcaatcagtctgtgtgggagtgtataatgcctgaatggctggaagccatccggaccgaagttcctgacaaccagttaaaggagtttcgtgaggtactctctaagatgtttgacattgagctctgtcctttgcctttctcaatggaggaaatgttcggctttatttcatgtcggttcactgggtatccctcctccgttcaggagcaggccctgttatggcttcatgtcctgtctgagctggacatcatggtacccctgcagttgttaatttccatgttttcagacggcgtgaattctgtgaaagagttagcaaatcagcggaagagccgcgtgtcagaactggccggtaatttggcatctcgcagggttagtgtggcttcggatcctggcagaagagttcagcacaacatgctgtcgcccttccacagcccattccaaagccctttcaggagccctcttcggtccccttttcgatccccttttaaaaattttggtcaccccggcggtaggacaattgatttcgactgtgaggatgatgagatgaatctgaattgctttatcctgatgtttgatcttctgctcaagcagatggagcttcaagacgacggcattacgatgggtctggaacactccctctctaaggacatcatttccatcatcaacaatgttttccaagccccatggggtggatcccacacttgtcagaaagacgagaaggctatcgaatgtaacctttgccagtcctcaatcctgtgctaccagctggcgtgtgaactgttagaacgcttagcccctaaagaagaatcaagactggtagaacctacagactccctggaagattctctgcttagctccaggcctgagttcatcatagggcccgagggcgaggaagaggagaatcctgcttccaagcatggggaaaatcctgggaattgtacagagcccgtcgagcacgccgccgtgaagaatgatacggagcggaagttctgctaccagcagctgccagtgaccttgcgcctcatctatactatctttcaagagatggctaaattcgaagaacccgacattctgttcaacatgctgaactgtctgaagatcctctgtttgcatggcgaatgtctctacattgcacgtaaggaccatccccagtttttggcatacattcaagatcatatgctcatagcgagcctctggcgtgttgttaagtctgaattctcccagcttagctcattagctgtccctttgctgctgcatgccctttccctgcctcacggagccgacatcttttggaccatcattaacggtaattttaactccaaggactggaagatgcggtttgaggctgtggagaaggtcgccgttatatgcaggtttctcgatatacatagtgtgacaaaaaaccacctcctaaagtatagtctagcgcatgcattctgctgtttcctgactgcggtggaggacgtgaaccccgcggttgcaaccagggccggtctcctcctggacacaataaaaagaccggcattacagggattgtgcctttgtctggatttccagtttgacactgtcgtaaaagacagacccactatcttatctaaacttttgctcttgcacttcctgaaacaggatataccagcattgtcgtgggaattcttcgttaatagattcgagactctgagcctggaagcccagcttcacctcgattgcaataaagaattccctttcccaacaacaatcacagctgtccggaccaacgttgcaaatttgtcagacgccgcgctttggaagatcaagcgagcaagattcgctaggaatagacagaaatctgtgcgcagtctgagagactcagtgaagggcccagtggaaagtaagagagccctgagcctgcccgagaccctgacctcaaagatccgacagcaaagcccggaaaacgataacacgataaaagatctgctgcctgaggacgcgggcatagatcatcagactgtccaccagctcattactgtactaatgaagttcatggccaaagacgagagcagcgccgaaagcgatatttcttcagcgaaagcgttcaacacggtgaagcgacacctgtatgtgttactcggatacgatcagcaagagggctgtttcatgattgctccccagaaaatgcgcctaagtacgtgctttaacgcctttatcgctgggattgcacaggttatggattacaatataaacctggggaagcacctgctgccactggtggtgcaggtgcttaaatattgttcatgtccgcaactgcgtcactattttcagcaacccccgcggtgttctctgtggagcctgaaacctcatatacgtcagatgtggctcaaggcattgctcgtcatcctttataagtacccttatcgtgattgcgacatctctaagatcttgcttcatctgatccacatcaccgtgaatacgctgaatgcacagtaccactcctgcaaaccgcacgccacagctggacctctctatagtgataattctaacatcagccggtattctgagaaagaaaaaggagagatcgaattagccgagtaccgggagactggagccctgcaggatagcctcctgcattgtgtgcgggaggagagtatccctaagaagaagcttcgctccttcaaacaaaagtccctggatatcgggaacgccgattccctgctctttactcttgacgagcatcgccgaaagtcttgtatcgacagatgcgacatcgagaaacctccaactcaggctgcatatattgcccagcggccaaatgacccaggccgctccaggcagaacagcgccaccaggcctgataacagcgaaatccctgaaaaccctgctatggaaggcttccccgacgcacgacggccagtaatccctgaggtgaggctgaattgcatggaaacatttgaagtgaaggtcgattcacccgtgaagcctgcacccaaggaagatctggacctgatagacctgtcctccgattccacctccggaccagagaaacatagcatattgtcaacgtcagattctgacagtctagtgtttgagcctctgccgccccttcgcattgttgagagcgatgaggaagaagaaaccatgaatcaaggtgatgacggtccgtctggaaagaacgccgcatcatcaccaagcgtccctagccaccctagtgtgttaagcctctcgacagcacctcttgtccaggtcagcgtggaggactgtagcaaagattttagttcaaaggattctggaaacaaccaatcagctgggaatactgactccgccctcatcacgttagaggatccgatggacgccgaaggcagctccaagcccgaagagctacccgagttctcctgtggatccccactcaccctcaagcagaagagggaccttctgcaaaaatctttcgccttgcccgagatgagcctggatgaccaccctgaccccggcaccgaaggcgagaagcccggtgagctgatgcccagctctggagccaaaacagtgctgttaaaggttcccgaggatgcagaaaaccctaccgagagcgaaaagccagatacgagcgcagagtccgatactgagcagaaccctgagcgtaaggtggaggaagatggagcagaggagtcagagtttaaaatccagatagtgcctcgccaacgcaaacagaggaaaattgctgtgtccgcgattcagcgagagtaccttgatattagttttaatatacttgacaagctcggcgaacagaaagatccagatcctagtaccaaaggcctgagtaccctggagatgcccagagagagtagcagcgccccaacacttgacgcgggcgtgccagagaccagttcccatagttctattagtacccaataccggcagatgaaaaggggcagtctgggtgtcctgaccatgagccaactcatgaaaagacaactggagcaccagagcagcgctccacacaacattagcaactgggataccgaacagatccaacccgggaagcggcagtgtaacgtcccaacatgcttgaaccccgatctggaaggtcagcccctgaggatgcggggagccactaaatcttcgctgttatcggccccctccatagtcagcatgttcgtgcccgccccggaagaattcactgacgaacaacctactgtgatgaccgataagtgccacgactgcggggctatcttagaggagtacgacgaagagacactcggactggcaatagtggtgctgagtaccttcattcacctgtcaccggatcttgccgctccactgctgctggacatcatgcagagcgtggggagactggcttccagcaccacattctcgaaccaggctgagtcaatgatggtccccgggaatgccgccggagtcgccaaacagttcctgcgctgtatcttccatcagttagctcctaacggtatatttcctcagctatttcagtctaccatcaaggatggaacattccttcgcacacttgcctcttccctaatggactttaacgagttatcatcaatcgccgctttgtctcagcttctggaggggctgaacaacaagaaaaacctgccagccggaggggctatgattcgttgtctggagaacattgccacatttatggaggctctcccaatggatagcccctcctccctttggactactatctcaaatcagttccagaccttctttgctaaactcccatgcgtgctgcccctcaagtgctcactggatagctcactgcggataatgatctgcctcctgaagattccatctactaacgccacgcgcagtttgctggagccattttccaaactcctgtctttcgtgatccagaacgccgtgtttaccttagcatacctcgtggaactctgcgggctctgttaccgtgcgttcaccaaggaaagggataaattttaccttagccggtccgtggtcttggaattactgcaagccctgaagctcaagtccccactccctgacacaaatctgctgctgttagtgcagtttatctgcgcagatgcggggactaagctcgccgagtcaactatcctctccaagcagatgattgcaagcgtgccgggctgtggcaccgcagcgatggagtgtgtgaggcaatacattaacgaggtgctggacttcatggcagacatgcatactctaactaaactgaagagccacatgaaaacttgcagtcagccactgcacgaggacactttcggaggacacctgaaagttggactcgcccagatagctgccatggatatctccagagggaaccatagggataataaggccgtgattaggtatctgccatggttatatcatcccccgtctgctatgcaacaggggccaaaggaattcatcgagtgtgtgtctcacatccggctgctaagctggttgttgctgggctcccttacacacaacgccgtttgtccaaacgcgagctccccgtgtttacctatacctcttgacgccggaagtcacgtggctgatcacctgatcgtaattcttattggcttcccagagcaatccaagacaagcgttcttcacatgtgttcactgtttcatgcatttatttttgctcagctttggaccgtctattgcgaacagagcgctgtggccacaaacttgcagaatcaaaacgaatttagctttaccgccattctgacagctctagagttctggagcagggttaccccctcaattctgcaactgatggcccataataaggtgatggtcgagatggtgtgccttcacgtaatctccttaatggaagctctccaggaatgtaattcaaccatttttgtaaaattaattccaatgtggctcccgatgatccagtctaacatcaaacatctttctgctgggctccagctacgccttcaagcgatacagaatcacgttaatcatcattccctccgaaccttgccaggcagcggccaatcttccgccggtttggccgccttgcgcaaatggcttcagtgcacccagttcaaaatggcgcaagttgagattcagtcgtcagaggcagctagccaattctaccccctctag

SEQ ID NO: 51923 - DNA, 7908 bp, Artificial Sequence
  Description of Artificial Sequence: Synthetic coding sequence
atgagcaccaaggccgagcagttcgccagcaagatccggtacctgcaggaataccacaatcgcgttctccacaacatctacccggtcccttccggaacagatattgccaacacactgaagtactttagccaaaccctactgtcgatcctctctagaaccggcaaaaaggaaaaccaggatgcctccaacctgaccgtgcccatgactatgtgcctctttcctgtgcccttcccgctgaccccatcattacggccacaggtttcatccatcaacccaactgtgacccggagcctgctctatagcgtcctgcgtgatgcacctagcgagaggggaccacagagcagagacgcgcaattgtccgactacccttcgctggactaccagggtctctacgtgaccctggttaccctgctggatttggttcccttgttgcagcacggtcagcacgatttagggcagtcaatattttacactaccacgtgcctgctccccttccttaacgatgatatacttagtaccctgccgtacacaatgatttccaccctggccacctttcccccttttctgcacaaagatatcatcgagtacctctctacatcgttcttgcccatggccattctggggtcctcacggcgcgagggggtgccggcacatgttaatttgtcggcgagttcaatgcttatgatagctatgcaatacacaagcaatccagtatatcattgccagctactcgaatgcctcatgaaatacaagcaagaagtctggaaggacttgttatacgtcattgcctacgggcccagccaggtgaagcccccagctgtccagatgctcttccattattggcccaacctgaaacccccaggagcaatcagcgaatacagaggactgcagtatacggcctggaatcctatccactgtcagcatatagaatgccacaacgctatcaataagcccgccgtcaagatgtgcatcgatccgtcactgtctgtagccttgggggacaaaccaccaccactttacttatgcgaggaatgctctgagcgcattgctggagatcacagcgagtggttaattgatgtgctgctgccccaggcagagatatcggccatttgccagaaaaaaaactgttctagccatgtgaggcgggcagttgtgacctgcttttctgcaggttgctgtggcaggcacggaaatagacccgtgagatactgcaaacggtgtcactctaatcatcactctaatgaggtcggcgcagccgctgaaacgcatctctaccaaaccagccctcccccaatcaatacgagggagtgcggggccgaggaactcgtctgcgccgtggaagccgtgatcagtctcctgaaagaggcagagtttcacgccgagcagcgggaacacgaacttaatagaagacggcagctaggccttagttcttcgcaccatagcctggacaacgccgattttgacaacaaggacgatgacaaacatgatcagcgactattgtcgcagtttggaatctggttcttagtcagtctgtgcaccccgagtgagaatacacctaccgaatccttagcccgtctggtcgccatggttttccagtggtttcactccaccgcctacatgatggacgacgaggtgggatctttggtggaaaagctgaagccccagtttgtaactaaatggttaaaaacagtctgtgacgtgcgttttgatgtgatggtgatgtgtctcttaccaaagcccatggagtttgcccgcgtgggtgggtactgggacaagagctgtagcaccgttactcagctgaaggaggggctgaatcgtatcctttgcctcattccttacaatgtgattaaccaatcagtctgggagtgtatcatgccagagtggctggaagctatccgcaccgaggtccctgacaatcagctgaaagagtttagagaagtgctcagcaaaatgttcgatattgagctgtgtcctctgccattcagtatggaggagatgttcggattcatctcttgccggttcaccgggtacccatcctcggttcaggaacaagccctcctgtggctccacgtactgagcgagcttgatattatggtcccactccagctgctgatcagtatgtttagtgacggcgtcaacagcgtcaaagaactggccaaccagcggaagtctagggtatctgagctggccggtaatctggcctcccgtagggtatccgtcgccagtgaccccgggcggagggtacagcacaacatgctgagtccgtttcacagcccctttcagtccccattccgctcccccctgaggtcccccttcagaagtccatttaagaacttcggccaccccggcggtagaacaattgatttcgactgtgaggatgacgagatgaatctaaattgttttatcttaatgttcgatctcttgctgaagcagatggagctgcaggacgatgggatcactatggggctggagcattccctgtctaaagacattataagcatcattaataacgtgttccaagcaccctggggtgggtcccatacatgccagaaggatgagaaagccatagagtgtaacctttgtcagagcagcatcttgtgctaccagctcgcctgtgagctgctcgagcgcctggcccccaaagaagagagccggctggtagagccaaccgactcactggaggattctctcctgagttcccgccccgagttcatcataggccctgagggcgaagaggaagaaaatcctgctagcaaacacggagaaaatcctggcaactgcaccgaaccagttgaacatgccgctgttaaaaatgatacagaaaggaagttctgttaccagcagctgccggtgacactcagactgatatataccatcttccaagagatggcgaaattcgaggagcccgatattctgtttaatatgctgaattgtctaaaaatactctgtctgcacggcgaatgcctatatattgccagaaaggatcacccacaatttcttgcctatatacaggaccatatgttaattgcctccctgtggcgtgtcgtcaaaagcgagttttctcagctttcttctctggccgtaccattgcttctgcatgccctgtctctgcctcacggagcagacatcttttggacaatcatcaacggcaatttcaactcaaaggactggaagatgcgatttgaggccgtggaaaaagtggctgttatctgcagatttctcgacatccacagtgtcactaaaaaccatttactcaagtattctctggcacacgctttctgctgtttccttaccgccgtcgaagatgtgaaccccgccgtggccacgcgcgctggtctcttgttggatacaattaagcgtccagccctgcagggcctctgcctctgtctggatttccagttcgacaccgtcgtgaaagaccggcccacaattctctccaagcttctgctgctacactttcttaagcaagacattccagctctttcctgggaattctttgttaacagatttgaaacattgtcgctggaagcacaactccacctggactgcaacaaagaattcccgtttccaactaccatcacggcggtgcgtaccaatgtggcaaatctcagcgatgccgcactttggaaaatcaagagagcacgctttgctagaaatagacaaaaaagtgttcgctcgctacgggattcagtgaaagggcctgttgagtccaaacgcgcgctgagcctcccagagactctgactagcaagatcaggcaacagagtccggagaacgacaatacaattaaagacttactgccagaggacgccggaatagaccatcagacggttcatcagctgatcacagtgttgatgaagtttatggctaaggacgagtcctccgccgagtcggatattagctcagcaaaggcgttcaacaccgtcaaacgccatttatacgtgctgttaggctacgatcagcaagagggttgcttcatgatcgctccccagaaaatgagattatcaacctgcttcaatgcttttattgcgggaatcgcccaggtgatggactataacatcaacttaggtaaacacctgcttcctcttgtcgtgcaggtacttaagtactgctcatgcccccaactcagacactacttccagcaacctcctaggtgtagtctgtggtccctaaagccacacatccgccagatgtggcttaaagcccttctggtaattctgtataaatacccttacagggattgtgacatttccaagattctgctacacctgatccacatcaccgtgaacacactaaatgcccaatatcactcctgcaaacctcatgcgacagccggccccctgtacagcgataactccaacataagtcggtattccgagaaagagaagggcgagatcgagctcgccgagtacagggagacaggcgccctacaggactcacttttgcattgtgtgagagaggagtctattccaaaaaagaagctgcgctcctttaaacagaagtccctggacattggaaatgctgacagcctcctgtttactttggatgaacacaggagaaagtcttgtatcgaccggtgcgatatcgagaagccccccacgcaagcagcctatattgcacagaggcccaatgatcctggcaggtcacgacagaactcagcaacaagacctgacaactctgagatccccgaaaatccagctatggagggctttccagacgctcgcaggcccgttattcccgaggtgcgcctgaattgcatggagaccttcgaggtgaaggtggactccccggtgaaaccagcccccaaagaagatctggatctgattgacctgagctccgacagcacgtctgggcccgagaaacatagcatcctgtcaacctcagattctgacagccttgtcttcgagccattacctccattgaggatcgttgagtctgatgaggaggaggagactatgaatcaaggcgatgacggaccttcaggcaagaatgcagcgagcagtccctccgtgccttcacacccaagtgttcttagcctatcgacggcccctctcgtgcaagtgagcgtggaggactgttcgaaggacttcagttcaaaggattccggtaacaatcagtcggcgggaaataccgattcagcgctgattactctggaagatcccatggatgccgaaggctcatccaaaccggaagaactccctgaattctcctgtggaagccccctgactctgaaacaaaaacgcgaccttttgcagaaaagcttcgcactgcctgagatgtctctggacgaccatccagatcctggtacagagggcgaaaagcccggcgaactgatgccttcatctggcgccaagacggtactcctaaaggtcccagaagacgccgaaaaccctactgaatctgagaagcccgacacttccgcagagagcgacaccgagcagaacccagagcgcaaggtcgaggaggacggagctgaggagtccgaattcaagatccagattgtccccagacagaggaagcagcggaagatcgccgtcagcgccatccagagagagtatctagacatcagtttcaacatcttagacaagctaggagaacagaaggaccccgatccttcaactaagggcctgagcacgctagagatgcccagggaaagcagctcagccccaacactagacgccggggttccggagacctcaagccactcgagcatttcgacccaatatcggcagatgaagcgtgggagcctcggagtcctaacaatgtctcagctaatgaaacgacagctggaacaccagtcgtcagccccacataatatcagcaactgggacactgagcagattcagcccggcaaaagacagtgtaacgtgcccacgtgccttaacccagacttggaggggcaacctctgcgaatgcgtggcgctaccaagagctctctgctatctgctcctagcattgtgagcatgttcgtgcctgcccctgaggaattcacggatgaacagcccactgtaatgaccgataagtgtcacgattgcggtgcaatattagaagaatacgacgaggagacacttgggctggcaatagttgtcctctccacgtttatccacctgagccccgatctggccgccccactgcttctcgacatcatgcagtctgtcggacgattagctagttcaacaacgttttccaatcaggctgaaagcatgatggtccctggcaatgccgccggggtggccaaacagttcctccgctgtatctttcaccagttggcccccaatggaatcttcccccagctcttccagtctactatcaaagatggaacatttctgcgcacgttggcttcctccctgatggacttcaatgagttaagctctatcgcagcactctcacaacttttagagggcctcaataacaagaaaaaccttccggcgggtggggcgatgatcaggtgcctggagaacatcgcaacgttcatggaagctcttcccatggattccccgtcatctttgtggaccactattagtaaccaatttcaaacgtttttcgccaagctaccttgcgtcctgcccctgaagtgctccctggactcatcacttcggatcatgatttgcctcctgaaaataccaagcacaaacgcgactagatccctcctggaaccatttagcaagttattaagtttcgtgatacagaacgcagtttttactctggcatacttggttgagctttgtggactctgttatcgcgcattcacaaaagaacgggataagttctatctgagccgctcagttgttttggaactcctccaggccctgaaactgaaatcgccccttcctgacactaacctgttgctgttagtgcaattcatctgtgccgacgcagggactaaacttgctgagtccaccatcttgagtaagcagatgatcgcttcagtaccaggctgcggaacggccgctatggagtgtgtccgccagtatattaatgaagttctggacttcatggccgacatgcatacactgacgaagctgaagtctcacatgaaaacctgttcacagcctctccacgaggacacctttggcggccacctgaaggtgggcctggcccaaatcgctgccatggatatctcgcgcgggaaccaccgcgacaacaaggcggtaatcaggtacctgccgtggctataccatccaccttcagccatgcagcagggcccaaaagagtttattgagtgtgtgagccacattcgcctgctgagctggctcctgttaggttcccttacacacaatgcagtctgcccgaacgcctcgtctccttgcttaccaataccccttgatgccggttcacacgttgccgaccacctgattgtcattcttataggctttccagagcagagcaagacatccgtgctgcacatgtgttctttattccatgccttcatcttcgctcagctgtggaccgtgtactgcgaacagtctgctgtagcaactaatctgcaaaaccagaatgaattttcttttacagccatactgacagcgttggagttttggtcccgtgttactccctccatccttcaactaatggcccacaataaagttatggtcgaaatggtgtgccttcatgtaatatcactgatggaggcgttgcaggagtgcaactccacgatcttcgtcaaactgatccctatgtggctgcccatgatacaatccaatattaagcatttatcggctggtctgcaattgagacttcaagccattcagaaccatgtcaatcaccactctctgaggactctacccggcagtggccagagtagcgccgggctcgcggcgcttcggaaatggctgcagtgcacacagttcaaaatggctcaagtcgaaattcagtcctcagaggccgcctcacaattttacccactctag

SEQ ID NO: 51924 - DNA, 7974 bp, Artificial Sequence
  Description of Artificial Sequence: Synthetic coding sequence
atgaacagcaagcggcacaagatcgccagcaagatccggtacctgcaggagtaccacaacagggttctccacaatatctaccctgtaccctcgggcacagatattgcaaatacacttaagtatttttcacagaccttgttgtcgattctgagtcgaaccggcaagaaggagaaccaggatgcctcaaacctaacggtacccatgaccatgtgtctgtttccagtgccttttcccctgacgccaagtctgaggccacaggtgagctctataaatcctactgtgacaaggtcccttctgtattccgtgctgagggacgctccctcagagcgcggtccccagtcccgggacgcccagctttcagattatcccagcttggactaccaggggctgtacgtgactctggttacgcttctcgatctggtgccattgttgcagcacggccagcatgacctcggccagtctattttctacacaactacatgtcttctccccttcctcaacgacgacatcttgagtacactgccttacactatgatcagtactctggctacgtttccaccatttctgcataaggatattatcgaatacttaagcacctcgtttcttccaatggcaattctgggtagtagcaggcgggagggggtgcccgcacatgtgaacctaagcgccagctccatgctgatgatcgctatgcaatatacttcaaatcccgtgtatcattgccagctgctcgaatgtctcatgaaatacaagcaggaagtgtggaaggatctgttatacgtcattgcctacggcccttctcaggtgaaacccccagccgtacagatgctcttccactactggccaaatctcaagccaccaggtgccatcagcgagtatcgtggactgcagtacaccgcttggaatcctatccattgccagcacatagaatgtcacaacgccatcaacaaacctgctgttaagatgtgtatcgatcctagcctttccgtggctctcggcgacaagccaccaccgctgtatctatgcgaagagtgctccgagcgcatagcaggagatcattcagagtggctgatagatgtcttgctgcctcaggccgaaatctcggctatttgtcagaagaaaaattgctcctcccatgttcggcgcgccgtagtgacctgtttcagcgccggctgttgcgggagacacggaaatcggcccgtacgttattgcaagaggtgtcatagcaatcatcatagtaatgaagtgggagctgccgctgagacacacttataccagacctcgcccccccccatcaatacccgggagtgcggcgcggaagagctcgtttgtgcggtcgaggctgtgattagcttgctcaaggaggctgaatttcatgcagagcagagagagcacgagctgaaccgtcgtaggcaactcgggttgtcaagttcacaccactctctggacaacgccgacttcgataacaaggatgatgacaaacacgaccaacggctactgagccagttcggcatttggttccttgtgtccctgtgtactccttctgaaaatacgccaaccgagagtctggcacggctcgtggccatggttttccagtggttccacagcacggcatatatgatggacgacgaggtgggttctctcgtagagaagctgaaaccacagtttgtaacgaagtggctgaaaacagtctgtgacgtccgcttcgacgtcatggtgatgtgcttgctgccaaagcctatggagtttgcaagggttggagggtattgggacaagagctgctccacggtgactcagcttaaggagggccttaatcgcatcctttgcctgatcccttacaacgtaataaaccagagcgtatgggaatgtataatgcctgagtggctcgaggcaattcgcacagaggttcctgacaaccagcttaaggagtttcgggaggtgctgagcaagatgttcgatatcgagctttgcccactgcctttcagtatggaggagatgttcggcttcatttcatgccggtttacagggtatcctagttccgtgcaggaacaagccctcctgtggctgcacgtactgtccgagctggatatcatggttccccttcagctactgattagcatgttcagtgacggcgttaattctgtgaaagagttggcaaatcaacgtaagtctagagttagcgaacttgcgggcaacttagcctcaaggagggttagcgttgccagcgaccccggtagaagagtccagcataacatgctaagccctttccattctccatttcaatctccctttcgctctcctctccgcagtccatttcgctccccatttaagaattttggccaccccggtgggagaacaattgatttcgattgcgaagacgacgaaatgaatctcaattgctttatactgatgtttgacctgctgctgaaacagatggaactgcaggacgatggcatcacaatgggcctcgagcactctctgtccaaggacattataagtataataaacaatgtgttccaggctccatggggcggtagtcatacttgtcagaaagatgaaaaagccatagagtgcaatctgtgtcaaagcagcattttgtgctatcagcttgcctgtgagcttctcgagaggctggcacccaaagaggaaagcagactggtcgaacccactgatagcttggaagattccctgcttagcagccgccctgagtttatcatcggtccagagggtgaggaggaggaaaatcccgccagcaaacatggtgagaatcctggaaattgtactgagccggtggagcatgcagccgtgaagaatgacacagagcgcaagttttgttaccagcagttgcccgtaaccctgcgtttgatctacaccatttttcaggagatggcaaagtttgaagagccagacattctattcaacatgttaaattgccttaaaatcctgtgtttacacggggaatgcctttatattgctcgcaaggaccacccccagttccttgcgtacattcaggatcacatgctgattgcgtctttgtggcgggtggttaagtccgaatttagccagctgtccagtctggccgttccactcctactccacgccttgtcacttccccacggggcagacatattttggacaataattaatggcaacttcaacagcaaagactggaaaatgagattcgaagctgtggagaaggttgcagtgatctgccggtttctggacattcacagcgtcactaagaaccatctcctgaaatactctctggcacatgccttttgctgctttctcacagcagtggaggatgtgaatccagcagtggcaacccgggcaggccttctcctggataccattaagcgtcccgccttacaaggtctttgtttgtgtttagattttcagtttgatacagtagtcaaggaccgcccaactattctgtcgaagctcctcctgctgcacttcctgaagcaggacatcccagccctttcttgggaattctttgttaatcgctttgaaacactaagcctggaagcacagctccatctggattgcaacaaagaattcccattcccaaccacaataactgcagttcgcacgaatgtggccaatctatcagatgccgccctgtggaaaataaaaagagctaggtttgctcgtaacagacaaaagagtgtccgttctctgcgggacagtgtaaaagggccggtggagagcaagagggccttgtccctgccggagaccctcacctccaagattccaatgcgattgactcggcacgagcaatctgcacctgctctgggcggcacccccgaacaaacacccggacagcaatcccctgagaacgataataccattaaagacctgctacccgaggacgccggcatcgatcatcagacggtccaccagcttatcaccgttctgatgaaatttatggcaaaagacgagagttctgcagaatccgacattagctccgccaaggccttcaacaccgtgaaaaggcacctctacgttctgctcgggtatgaccagcaggaggggtgcttcatgatcgcaccacagaaaatgaggctatctacgtgtttcaatgcttttatagctggaatagcgcaggtgatggactataacatcaacttaggcaagcaccttctaccactggtggtgcaggtgctaaaatactgtagctgccctcagcttagacactatttccagcagccccctaggtgttcactgtggtcactaaagccgcacatacggcagatgtggcttaaggccctgctggttattctctacaaatacccttaccgcgattgtgacatttcaaaaatacttctgcacctcatccatattaccgttaacacgttgaacgctcagtaccacagttgtaaaccccatgcgacagcgggtcccctctatagcgacaacagcaacattagccgatactccgagaaggagaaaggagaaatcgagctagcggagtatcgcgaaaccggcgccctccaagacagtctgcttcactgcgtgcgggaggagagcataccaaaaaaaaaactgcggagctttaagcagaagtcgcttgacattgggaatgcagactcactcctgtttaccctcgatgaacaccgaagaaagtcatgtattgatcggtgtgacatcgagaagccacccacgcaagccgcctacatcgcgcaacgacctaacgaccccgggagatcgcgtcagaattctgcgaccagaccagacaattctgaaattcccgagaaccccgcaatggaggggttccccgacgcgcgaagacctgtgatacctgaggtaaggcttaattgcatggaaaccttcgaggttaaagtggatagcccggtcaaacccgcccccaaggaggacttagacttgatcgatctatcgagtgattccacgtctggccctgaaaagcattcaatcttgagcacaagcgattcggatagtctagtgttcgagcctcttccgccgctccgaatcgtcgagtccgacgaggaggaggagaccatgaaccagggggatgacggcccatcaggcaaaaatgctgcaagctctccgagtgtgcccagccatccttcagtgctctcactcagcacagcgcctctcgtacaggtctctgtggaggactgtagcaaagacttctcttccaaagactccggcaataatcagtccgccggaaatacagattctgctttgattactctcgaggaccccatggatgccgaagggagttcaaaacctgaagaactgcctgagttcagttgcggttcacctctcactctaaagcaaaagcgagatctgctgcagaagtcctttgccctcccagaaatgtcactcgacgatcatcccgatccaggcacagagggagagaaacctggagagctgatgccgtcaagcggagccaagaccgtgctgttgaaagtcccggaggatgctgaaaatcccacagagtccgagaagccagatacgagcgccgagagtgacacggaacagaatcctgagcgcaaggttgaggaggatggcgcggaagagtcagagttcaaaatccagattgtgcctcggcagaggaagcaaaggaagatcgcagtctctgcaatccagcgggaatacctcgacatctcctttaatatactggataaactgggagagcagaaggatccagatcctagtaccaagggtctcagcaccctggaaatgccacgggaaagctcctctgctcctacgctggatgcaggcgtgcccgagacaagctctcacagtagcatttctacacagtacaggcagatgaaaagaggaagtttgggcgtgctgactatgagccagctgatgaaaagacagctcgaacaccagagttctgcccctcacaacatatcgaactgggatactgagcagattcagccagggaaacgccagtgtaatgtgccaacctgtctgaatcctgatctagagggccagcctctgcgcatgcgaggagcaactaaatcatcactgctaagcgccccttcaattgtgagcatgtttgtccctgctccagaggaattcactgacgagcagcccaccgtgatgaccgacaaatgccatgattgtggagcaatacttgaggagtacgatgaagaaacattgggtctggcaatagtggtcctctcaacctttatccatttgtcacctgatctcgccgccccactgctgctggatataatgcagagtgtgggacgcctggcctcgtctacgacattctccaatcaggccgaatccatgatggtgccgggcaacgcagcaggagtggctaagcaatttctcagatgtatcttccatcagttagctcctaatggcatattcccacaactcttccagtccaccatcaaagatggcacgtttctcagaacccttgctagttctctcatggacttcaatgagctctcttcgatagccgccctctcgcagcttctcgaaggtctgaacaacaaaaagaacctcccagccggaggcgcaatgattcggtgtttggaaaacattgcaacgttcatggaggcactccccatggacagcccaagttctttatggactaccatttctaaccagttccaaacattcttcgccaaattaccgtgcgtgctgcctctcaagtgttctctggattcctccctgcgcattatgatttgtctgctgaagataccctctacaaatgccactaggagtcttctggaacccttttctaaactcctgagtttcgtgatccagaatgccgtttttacgttggcatacctcgtggagctctgtggcttgtgctaccgggcattcactaaggagcgcgacaagttctacctgtctcgtagcgtggtgctggaactccttcaggctctgaaattgaaaagccctttaccggacactaatctgctattgctggtgcagtttatctgcgccgacgccgggactaagttagccgagagtacgattctatccaaacagatgattgcttctgttccagggtgcggtacggccgccatggaatgtgtgaggcagtatatcaatgaagtcctggatttcatggctgatatgcacacactgacaaagttaaagtcacatatgaaaacatgctcacaacccctgcacgaagacaccttcggaggtcacctgaaagtgggtctggcccaaatagcggctatggatatcagtaggggaaatcaccgcgataacaaagcagttataaggtaccttccatggctttatcacccaccctcagccatgcagcaaggcccgaaggaattcatcgaatgcgtcagccatataaggctgctttcctggctcctgctggggagcctcacccacaacgccgtgtgcccaaacgcctcttccccctgcctaccaattccactggatgccggaagccacgttgcggaccacttaattgttattctgataggtttccccgaacagagcaagaccagcgtccttcatatgtgttccctattccacgcattcatctttgcacaactctggactgtctactgcgagcagtcagcagttgctacaaaccttcagaatcaaaacgagttctcttttaccgcaatcctgaccgccctggagttctggtcgcgtgttaccccatctattctgcagctcatggcacacaataaagttatggttgagatggtgtgtcttcacgtgattagcctgatggaagctctccaagagtgcaatagcaccatcttcgtgaaactgatccccatgtggctgcccatgatccagtctaacattaagcacctgagtgccggactccagctgagacttcaagccatccagaatcacgttaatcaccattccctgagaaccctgccaggaagtggccagagctccgccggattagcggccctaagaaaatggctccaatgcacgcaattcaagatggcccaggtcgagatacaatccagtgaagcagcttcccaattttaccctctctag

SEQ ID NO: 51925 - DNA, 7974 bp, Artificial Sequence
  Description of Artificial Sequence: Synthetic coding sequence
atgagcaccaaggccgagcagttcgccagcaagatccggtacctgcaagaataccacaatagagtgctgcataatatttatccagtaccttcggggacagacatcgccaataccctgaaatatttcagccaaaccctcctcagtatcctctcacgaacaggaaagaaagaaaaccaggacgccagcaacctcacagtgccaatgacaatgtgtttatttccagtgcccttcccactgacccccagtcttaggccccaggtcagctcgatcaatcctactgtaacgcggagtctgctttattcagtgctgagggatgcgcccagcgaacgggggcctcaaagtcgggacgcccagctgtctgattacccatctctggactaccaaggactttacgttaccttagtgaccctgttagatttagtcccgttgttgcagcatggtcagcacgatctgggccagagcatcttttacactaccacttgtctgctgccttttctcaatgatgacatattatctactctgccatacaccatgattagcactctggcgaccttccctccattcctccataaggacattatcgaatacctttctacatcattcttgcctatggctatcctgggttccagccgccgggagggcgtgcctgcacacgtgaacctcagtgctagcagtatgctcatgattgccatgcaatatacatcaaatcccgtgtatcactgtcagcttctggagtgccttatgaaatacaagcaagaagtctggaaagatctgctgtacgtaatagcttatggcccatctcaggtgaagccaccggccgtgcaaatgctcttccattattggcccaacctgaagccacccggggccatcagcgaatatagggggctgcagtataccgcctggaaccccatccactgtcagcacattgagtgtcataacgcaatcaataagccagcagtaaagatgtgcatagacccgtctttgtccgtcgccctcggagacaaaccccctcccctgtacctctgcgaggagtgcagcgaaagaatcgcaggcgaccacagcgagtggcttatcgatgttctgctaccccaggctgagattagcgctatatgccagaagaaaaattgtagcagtcacgtgcggcgcgccgttgttacttgtttcagcgccggatgctgcggacggcatggtaaccggcccgttagatattgcaaaaggtgtcactccaaccatcactccaacgaggtaggggctgccgctgaaacgcatctgtatcagacgtcaccccccccaatcaacacccgcgaatgcggtgccgaggagctcgtctgtgccgtcgaggccgtgataagcttactgaaggaagcagaatttcatgcggaacagagagagcacgagttgaatcgacgtcggcagctcgggctatcctcgtcccaccactccctggataatgctgattttgacaacaaggatgacgataagcacgatcagcgcctgctgtcgcagtttggtatctggttccttgtgtcattatgtaccccgagcgagaacactcccaccgagtctcttgcacgtctcgtagctatggtatttcagtggttccactccacagcctacatgatggatgacgaagtcgggtctttggtggagaaactgaaaccccagtttgttacaaaatggcttaaaacagtgtgcgacgtgagattcgatgtcatggttatgtgccttctccccaaacccatggagtttgctagagtgggtggatactgggacaagagttgttcaaccgtcacccagctgaaagagggactgaatcgcatactgtgtctaattccctacaatgtaatcaaccagagtgtgtgggaatgtattatgcccgaatggttggaagccatacgcaccgaggtgcctgacaaccagcttaaggagttccgggaggttctgagtaaaatgtttgacattgagttatgcccacttcccttctctatggaagagatgttcgggttcattagctgccgcttcaccggatacccctctagtgtccaggaacaggccctactttggttgcatgtgctcagcgagctggacatcatggttccactgcagcttctcatatctatgtttagcgacggggtcaactccgtgaaggagctcgctaaccagagaaagtcacgagtgagtgagctagcgggcaatcttgcatcacggcgggtgtcggtcgccagtgaccctggccgccgtgtgcaacacaacatgctgtcccccttccactcaccttttcaatccccattcaggtcccccttacggagcccatttcgatccccgtttaagaacttcggacatccgggagggcgaactatcgattttgactgcgaagacgacgaaatgaatctcaactgtttcattctgatgttcgacttgctgctcaagcaaatggagctgcaggacgatggcattacaatgggccttgagcactctctctccaaggatataatttccatcataaacaacgtgttccaggccccttggggagggtcacatacatgtcaaaaagacgagaaagctatcgaatgtaatctttgccagtcatctatcctgtgttaccaactagcttgtgagcttctggagaggctagcccccaaagaagagagtcgcctagttgagcctacagattcactggaggattctcttttgagctccagaccagaattcataatcggcccagaaggcgaggaagaagagaatcccgcctcaaagcatggggagaaccccggcaactgcactgagcctgtcgagcacgcggctgtgaaaaacgacaccgaacgtaagttttgttaccaacagctcccagtgacactccgactgatctacacaatcttccaggagatggcaaagtttgaggagccagacattctgtttaacatgctgaattgtctgaagatactgtgtttgcacggtgagtgtctgtatatagcgagaaaagatcatcctcagttcctcgcatatattcaggaccatatgcttatcgcctccctttggagagtggttaagtcggaattctctcagctgagttcacttgctgtgcctcttctcctccacgctttgagccttcctcatggcgcggatatcttttggaccattattaacggcaatttcaatagcaaggactggaagatgcgcttcgaagcagtcgagaaagtggccgtgatttgtaggttcttagatatccattcagtgactaagaaccacttgctgaagtatagcctcgctcatgctttttgctgctttctgactgccgtggaggatgtgaatccggccgttgctacccgcgctgggctacttttggacaccatcaagagacccgccctccagggcctgtgtctatgtttggatttccaattcgatacagtggtaaaggatcgtcccactatcctgagcaaattactcctactccacttccttaagcaggatatccccgctctcagttgggagtttttcgtcaatcgttttgaaacactgtcactggaggcgcagttacacctggattgcaacaaagagtttccgttcccaaccactattacagctgtaagaaccaatgtcgccaatttaagcgacgctgccctgtggaaaattaagcgggcccgttttgcccggaacagacaaaagtcagtcaggtctctccgagacagcgtgaaagggccagtggaatcaaagagagctctgtccttgccggagacgcttacgagcaaaatcccaatgcggttgacaaggcatgaacaatctgcacccgctctaggaggaacccctgaacagaccccgggtcagcagagtccagagaatgacaatacgatcaaggatctactgcccgaggacgctggtatcgatcaccagacagtgcaccaactgatcacagtactaatgaaatttatggctaaagacgagtcctccgcagagagtgatatcagttccgccaaagccttcaacaccgttaaacgccacttatatgtcctgctcggttacgaccagcaggaaggttgcttcatgatcgcccctcagaagatgcggctctccacatgtttcaacgctttcatcgcgggaatcgcccaggtgatggactataacattaatctgggcaaacatctgctccccctggttgtccaagtgctcaagtactgttcgtgtcctcagctgcggcactactttcagcaaccaccccggtgctcgctgtggtcacttaagcctcacattaggcaaatgtggctgaaagcactcctggtaattttgtataaatacccataccgcgattgcgacatctcaaaaatcttactccaccttattcacattacagtgaatacccttaacgcgcagtatcattcgtgcaaacctcacgcaactgcaggccctctgtactctgataactcaaatatctccagatactccgaaaaagaaaagggcgagatcgaactggcagagtaccgtgagaccggagctctgcaagattccctgctgcactgtgtgagagaggaaagcattcctaaaaaaaagctgaggtcattcaaacagaaaagcttggacattggtaatgcagattcactgttgttcacactcgacgagcacaggaggaaatcgtgcatcgatcgatgcgacattgagaagccccccacccaggccgcctatattgcccagagacccaacgacccgggacgctccaggcagaacagtgccactaggcccgacaattctgaaatccctgagaatcccgccatggaagggttccccgacgccaggcgacccgtcattcccgaggttcgtttgaactgcatggagactttcgaggtgaaggtcgactcaccggtcaagcctgcccctaaagaagatctggatttgatcgacctgagctcggactctactagcgggcccgaaaaacacagcattctcagcacctccgacagcgatagcctggtttttgagccactgccacccctacgcattgtggagtccgatgaagaggaggaaacaatgaaccaaggcgacgatggaccctccggcaagaacgccgcctcctctccttcggtaccttcccacccaagcgttttgtcattgagtactgctccgcttgtacaggttagcgtggaagactgctccaaggacttttcgtcaaaggacagcggcaacaaccagtctgccgggaacactgattcagctttgattactcttgaggacccgatggacgccgaaggctctagcaagccggaggaacttccagaatttagttgcggatcacccttaaccttgaagcaaaagcgagatctgctgcaaaaatcatttgcacttccggaaatgtccctcgatgaccatcccgacccggggaccgaaggcgagaaaccaggcgaattaatgccgtcttccggggccaaaacagtgctcttgaaagttccagaggatgctgaaaatccaacagagtcggagaaaccagatacctcagctgagtccgataccgagcagaaccctgaaagaaaggtagaagaagacggagccgaagagtccgagtttaaaattcagatcgtacctcgacagagaaaacagcgcaagattgcggtttccgcaatacaacgcgaatacctggacatttccttcaacattctcgacaaactcggagagcagaaggacccagatccttcaacaaaagggctgtctaccctggagatgccccgggagagctcctccgccccgacccttgacgccggagtacccgaaactagctctcactcttccatctcgacacagtacaggcagatgaagaggggctctttaggagtgctgacgatgtctcagctcatgaagcggcagttggagcaccaatcttcagccccccataatatttccaactgggatacagagcagattcagccagggaaacggcagtgcaatgtgcctacttgcctgaaccccgacctcgagggacagcctctgaggatgcggggggcaactaaaagctctctgctgtcagctcctagcattgtgtccatgtttgtgcccgcccccgaggagttcactgacgagcaacccaccgtgatgaccgacaaatgccacgactgtggcgccatacttgaagaatatgacgaggagactctgggattggccatcgtggttttgtccaccttcattcatctgagcccagacttggccgccccgcttctcctagacattatgcagagcgtggggcggctggccagttcaaccacattctctaatcaagccgagtccatgatggtccctggcaacgctgccggcgtggccaagcagttcttgcggtgtattttccatcagctagcaccgaacggtatatttcctcaactcttccagtcgacaattaaagatggaacttttctcaggacattggcttcttctctgatggatttcaatgagctgtcatctatagccgccctgtcacagctcttggaaggattaaataacaaaaaaaatctacctgccgggggtgcaatgatccgttgcctggaaaacattgccacgttcatggaggcactgccaatggattcccctagttccctctggactacaatctctaaccaattccagactttttttgccaagcttccatgtgtgctgccattgaagtgctccctggattctagcctacgtattatgatctgcttactgaagatcccttccacaaatgccacccgcagcctgctcgagcccttctctaaactgctgtcatttgtcattcaaaacgcagtgttcacactcgcttatctggtggagttgtgcggtttatgctatagggcttttaccaaagagagagacaagttttatctgagccggtcagtggtattggaattgctgcaggcactgaagctcaagagcccattacccgacacgaaccttctgctcttagtgcaattcatctgcgccgacgccggaaccaaactggccgaatccacaatccttagtaagcaaatgatagcctcagttccaggctgcgggacagctgctatggagtgcgttagacagtatatcaatgaggtgctagatttcatggcagacatgcacactctcacaaaactgaaatcccacatgaaaacatgttctcaacctctccacgaggacacgtttggtggtcatctgaaggtggggctcgcacagatcgccgctatggatatatcccgaggcaaccaccgcgataataaggctgtgattcgttacctgccctggctgtaccaccctccatcggctatgcagcagggaccaaaggaattcattgaatgcgtgagtcacatcagactcctctcctggctcctgttaggatctttgactcacaacgcggtctgccccaacgctagttcaccctgtctgcctatacctctggatgccggatcgcacgttgctgatcacttaattgtgattctgattggttttcccgagcagtctaaaacatcggtactgcacatgtgttctttgttccatgctttcatttttgcccagctatggactgtgtactgtgaacagtctgccgtcgctacaaacttacagaatcagaatgaattttcttttacagccatactcacagctctcgaattttggtccagagtgacaccctcaatcctgcagctcatggcacataacaaggtaatggtggaaatggtatgcttacacgtgataagcctgatggaagccctccaagaatgtaactcgactattttcgtgaagctgatccccatgtggctgcccatgatccaaagcaacatcaaacacctgagcgctggcctacagctaaggctgcaggccatccagaaccatgtgaaccatcacagtcttaggacgcttcctggctctgggcagtccagcgctgggttagccgcactgcgcaaatggttacagtgtactcaattcaagatggcacaggtggagatccagtcatccgaagctgccagccagttctatcccctttag

SEQ ID NO: 51926 - DNA, 399 bp, Artificial Sequence
  Description of Artificial Sequence: Synthetic coding sequence
atgcgggagggccaggagatgggccccacccccgtgcccagcaacccactcctccatcgttcattcccttgctggcctcgcgggtggtctcatccagtgcccactagagagctcctgttggagcccgctcagcccgcggatctgctgcccccagcccccacggcagggccctgtagtcttgcgagttggatgctcagtcagcctggcagaggcagccaggtaaagacaggcggaaccccgacagctaccgcgcaagacgcagaggccccactgcccgattgcgatttgtgtctgtcacccgctccggtggggacctggcagccacgcgctaaggcaggatgggccggcgacccgagaaacctgtccggaaatacattcagtccaggttgggaacagtag

SEQ ID NO: 51927 - DNA, 1803 bp, Artificial Sequence
  Description of Artificial Sequence: Synthetic coding sequence
atgttcaccctgagcctgctgagccggggccacggcaagctgggccaggataagcagaagctcgaagtctattttgaaccagaagattacctgaattggagatctcccgaagactacgtgcccgtctccaaaccccaagataaaaataacgcctcccaacactcatggtccctgttcctaccaaaaacctttagcacccgaaaaggcgcactgatcctgtactctgaagggttcgcaataagcgcctggactcctaaggaaaggcgtaaggggccttattgtccaagaggcccctggcgcaaacttgatcttgagctgcacaccctccaggacctgaaagaggcaatcttggcatacgggaggcagcagttaaacctcccaatgggtgatgccggcaagcgtctggaaagggagaagaagaggaagaccaccgtctttctgcctagtcattctgctagctcagaaaaaaagcatctgcattatctctgcgatactgccttaaatcgccaggcccactacgacccacagctgctgcagggggagcaagatcgcgcttggcagccttatttgcatttccggtcccagttggagtctcaggcacagcggcagatccagcccggacattccgctaagcgatatctgcggggacttctaagaacatggccacccgatgcgatgtaccgactgtggtgcgccggatatatcaaagacagtgttctgctgcaagattcacagctcaatgtccccaagaagttgaggccccagcaggaccttagtggtgtacctcccaagtatcacctgttgcctgtgttcccaagtttttggatacaacaaggcaaaagttttgaacagagacagcaaggcctggacgaaggcgaggctggagcggccggccatgttgatcagggccccctcgcaaaaaaccacggatctcagggcactcgactccctcccagacggaagcagccttggcaagaagacgagacacaggcggaagatacaagcatcgagaatcacctgtgtttatacgccagcaaggagagctataacgaaaagactcaacaaacatctagaaaggcgttcggccatggaaggattgatcattcctggctgcctagcgataaaagtcatattaccttttgcggcggcgcatttcccaacaggaaggccgatctgtcggacaaacaacggaatgtcaaacttcataaagcccggtccagccatcttctacaagtactccccgctgagcgttcgctgttcccccccgtggcatctgccaccgggtccaggataattacgccaggtgaggtgaaaaaaaaaaaagctcccaaggcccttaaactgccccctatttcggaggaacccccccgcgtccttgagcccttgaagagccagtttaaagccaatgagccgcccaccgagctctttatcctgcctgttgaaattcactaccataccaagcagccccctaaggagaaggctcaccgccgcggcgcacctcaccctgaatccgagcctgaatcgagtgaagaatctactccggtctggagaccaccccttaaacacgcctcattggaaaccccctgggaactgacagtgcacctcccggtggacgcaagccgggacacactaagcccgcaaggctcctcttcacttcctccagctagccttgggaatctgacgttgaaagggtccaaggcccggcacacgcgggtccactcccaggggaagggcgtgtggaagggcgatgatgatgctcctcctcacgatgtggccccacccctggacctcctgcctccctag

SEQ ID NO: 51928 - DNA, 360 bp, Artificial Sequence
  Description of Artificial Sequence: Synthetic coding sequence
atgagcggcagcccccaggccagctacccccagacccacagcttcactctcaagcaccaggaaatcaggactttctggaacctcaatatgcgtggactgggcggcgaaggcggtacggaagaggaaagttccctcggccaggccggtggtaaactgaagaccgcagcctggccctcatgggtagcagaagttggagcggctggcgccctcgccgatcccgggggccagaaaagtggcagttttctgccttcccaacagctccagtgcatcccagggcccggtctgtatgccggcgaagcctccaaagatccagtcttacgcaaactgccctttcagtgtggccggacacacaatccatag

SEQ ID NO: 51929 - DNA, 405 bp, Artificial Sequence
  Description of Artificial Sequence: Synthetic coding sequence
atgctggtggtgggcgccggccccctgggcgccgccgcctggagccagaggctggactgggggcgctgccagctcaaattactgggccagcacggacaggatgttttgcacactaacctcggagaagagaatgtatgtattgctgggcccctgctgttgccatgtccagattcccagccatgtcttacacccccccacccagcgcaggctcttgtccagttatgggtgccttgcccctgcctttgtcccagagttggtgctagcacggcgtggctggagggcgacaccccagccttacctcagcatttaggcccctcaatcaccacaacaggacggtgggcgacccccaaaaaaatccctgggctgaccgttccaccagagaacatggattctatgtgggggtag

SEQ ID NO: 51930 - DNA, 447 bp, Artificial Sequence
  Description of Artificial Sequence: Synthetic coding sequence
atggactgcgtgccccccatccagtgcagctgcagcatgggcggcagataccaccatcccgctggggaggccttttggaccggagagagatgtgagcaattctgccattgccaggcatccacccacgcggtctgctgctcaccctctagctgcgggcccggacagcgctgcgagaccctgaggggtatcttcgggtgtcacccactctccccgggtatctatcaggccactatgcactcacatgtggcctcatttgaccgcaagtctgttgagttccctggcacttgcgctagcgcttttactaagagctgcgggtcatcttcctccctgcgactcttcaaggttgagatcgggaaagagaaacaggtccaacagtcacattgtgtacactttaaggacgtgggctcttgggatccgggcctctcagccgagagagccccaacttag

SEQ ID NO: 51931 - DNA, 615 bp, Artificial Sequence
  Description of Artificial Sequence: Synthetic coding sequence
atgggcccccagcacggcaccggccccgaccccccccccctgtgccactgtcctcatacggcgggcgggggcgcaggcggtacaggagccccagcatttgggcttcagggaatctgggtgcctttagcagtgggcgacagacgcggcccctgcgggcagggcgctagcatgggcgcccctgggcagcctcggcagggtggcaggggcaaaggacaggaagcctctgcacagacgagatacggagggaactccccgcacggcaggggccagaaccggttagaaggccctggggtccaggtctgttgtaatagagccagaagggcgcgaggatgcccccatccgggccaaaggcatcatgtcgttctgagccagtggagcggcagcggactggtcggaggcatcgaagacactgccgatcttgcaccccccccaggagctgggctgtcgcccttagcccactcaaagggccgcgaccagagggggggcggactgcatcccccttccccacgttgtagccccccaccatatcaccccgtgcaacgatgtccaaggcggtgggaatcctgtgaagggcgaccccaccttgcctgtagtggatgtcctgccagttgctag

SEQ ID NO: 51932 - DNA, 543 bp, Artificial Sequence
  Description of Artificial Sequence: Synthetic coding sequence
atgcagcggggccccctgagccccagccccagcgacggcctgggcgctctcggaacaacttatccaggagtacaccggggccagtctatggcgggcctgagggtgccagcatttaatgccggattgcgggccataaccccaagtcgcgccgagacgcagcatccagagactacctctagcggaatgcatcgcgaacccttgtcttcaacccccatagctcattgggagggggcacagtctcctggtgcccagtcggtcttggctatgctcgttcatcggaccgcagcctacaccttgcaggtcctggagccaaagaaagacccgggccgcgaattgcccgcgacacccagatcctgggcgccggccagacagccttcccctttacacagcattaggcagaccatgcccgccaaacccagcctggtgaagcgggagagaagaaatcaggctctggctagggaagccccgtggtttccccagagaacccagtggaagacctccgaaggacctggcagctcttctggcaggcgaggccggagatag

SEQ ID NO: 51933 - DNA, 456 bp, Artificial Sequence
  Description of Artificial Sequence: Synthetic coding sequence
atgccctacgagacccggagctggatcaccctgctgcggacccagagaagggaggaatgcggattgcactgcacatcattgccctctctggccagggatctaaaattccatacgacggagccaaacacctcaagaccctcatcaaatgacctccggaatcggaagctgtgtctggccgccgacaaattgagccagtgcccctgggatcttcaggatgtgtggaacgaggagaggcaactgtcacagtgcgaactgtccgggggtccccagaagaacgtcggtcggcgagtttttccaatacgccagacagttcttcagccacgacctcccaagaggtcaaatccaggactgctgttctccggtaccgaatgcggatgcattcttccctttctctgctttctgtcccggtatctgttaaccgtgcacatgcgggggctcggtaagctgagcgtttag

SEQ ID NO: 51934 - DNA, 369 bp, Artificial Sequence
  Description of Artificial Sequence: Synthetic coding sequence
atgacctggctggacaagggcgtgtggacccaggaggacgagaacagctgttccttctccgaaagcgattttcccggatgtcgagaccagatcaacccgtccatccctagtatctggacagctgttagtggcatgatgatcagtctcgaggtccgttggtggatcaaaggaaagcagggatacgtgatcagtcttggccatgcactgtctccccgcctagaatgctcaggtacattctctgctcactgcattctcggacttcctggaggctctagttatcctcccgcatcggtcagccaagtggtaggaacaacagccctatacctagtcgaagaagcctgggcagaggcggggaaaatgcgtagttag

SEQ ID NO: 51935 - DNA, 660 bp, Artificial Sequence
  Description of Artificial Sequence: Synthetic coding sequence
atggccgcccggagcgtggacgacatcagcatcaagctgctgcacgaaaagggccccgccacagatcacggggtgaacgtactgccctcaactgttccgggccgggaagaaggaatgacagatagaaaacactggttctcttttggaacccaacctaatgttcccggcctacaagagcccctggactatagagcggcaaaccaagcctggcaggcggtgttagcggaggtgccacgagggggccccggatgcgcagccttgagggatctaggacgatgtgggggcccggatgtgtccacgcgccgacaatggagaccactgccattttcatgcccactttcacatacgacccagcccccgctggggggccattgtcgtgggtctagcgctggtcgttttcatggccgggaccagacctcccctggaacagtgcagcagctgccaagcgctcacgtgctaaagccgggatgcacccagcatggggacctgtcacctggccaggcttctccaccccccgcagccgctctggggccctcacccaaggcatggactcacacactagggcggccacaattgtgggcaggcctggggtctcaccgcttcggcgtacctggccccggaaccaggaataccttggcggcttgttgcgtgcaggagtag

SEQ ID NO: 51936 - DNA, 471 bp, Artificial Sequence
  Description of Artificial Sequence: Synthetic coding sequence
atggccaccccccccgcccccggcgccggcaccgccgcccccagcgcccctcgtccacctcctccaaggcccagctggctacgccttgatcctgctgctcggggagcacgtcttcctttcccaggctctccagggacaactcgaagggcccctagggagtctgcacctcttgcccccgctctccggtccgatcccggccagcctctagcagcctgtaatggtccccccggcgaaccccgtgctgatccgggagtgtcgacgaggtgtgcagccaccatgatccctcagggcaagctgacaggaggtcgttcctgtgggagtagaccccgcatggggagaggtgagcgcgccgagctgtctttccctgccgcagcaccacgcttgaagaggggcctcggcttctggtttttcttctgtggtaattcgtccgtcgaaatactgttagcttgtcataccacgcaccccttctag

SEQ ID NO: 51937 - DNA, 435 bp, Artificial Sequence
  Description of Artificial Sequence: Synthetic coding sequence
atgagcctgaagagcctgttctgcaacagcgaggccaaggacaacaaatgttatcatacgtactctgagtcctcttggtcggaaaccaaaaagattgtgatagccacaaagatccacagctttcaaaccttttcatcttgctatagcgactgtcacggcatccttggcgtactgctccatcagctggagacatcagtcgcgggtggtaccttctgtctgtccattgcccacgcctggtgggctcgcttcgcccacagctcatggaaggctgccctgggatcttgctaccagcccggctttcacacctgccagggccaggctaggctcggctctgtgcggggtgtttgggcgagcgagcacggtgtgcaacctcagcggacaggccgacacactggttgctgcggtcgagttggctctttccgccactgttcttag

SEQ ID NO: 51938 - DNA, 750 bp, Artificial Sequence
  Description of Artificial Sequence: Synthetic coding sequence
atgcgggtgcggtggctgcggttctggctgctgttctggctgctgctcggatttatctcacaccagcccacacctgtgattaatacactggccgatcaccgtcaccgtgagaccgattttggcggctctccgtggatcataattataattgtcttcttaggaaggtacaaattcaccatcctgttttgcaccatatacctgtgcgtccccttcttgaagaccattttctggtcccgcaatggacatgacaggagcagggacgtgcagcaacgagcccggcgaagcaatcgacggcgtcaggaggggattaaaatagggctggaagacatatgcactctttggaaacaggcagagaccaaagtgcaagcaaagattagaaaaatgaaggtaaccaagaaggtgaaccaccactataagatcaatggaaagagaaagactgcgaaggagcagaaaatgtttcagcgggcccaagagctaagatggagggcggaggattatcacaaatgcaagatcactcccagtgcccggaaacctctgtgtaactgggtgtctctcttcgtttttctggcctttggtagcctgccaggacaggacatggacacgttcttttcccttcaactgtgcgcccaggccttgcaacgtgagatggccgaacgcaaagcagcatacaaacatcattctcccatccctgtgggtaaccgagtcgtccagaaacacctgcaccctcacccagtaggccccttgatttag

SEQ ID NO: 51939 - DNA, 402 bp, Artificial Sequence
  Description of Artificial Sequence: Synthetic coding sequence
atggcctgcgccatccagctggccagcagcgaggcccgggaccgggcaaggccacgggatagaacctttctgcagaagaggcagctcggtgctggggtctggcttttgggcgaacgtacaagtaataccatgctgaattggaatggagaacggggccacccttgcttggtgctggtgtttaaaaggaacatcgaggccgacttcaagagcagtttcagctccgagcacttctttttcattccgctggacgactgtaactgcaaggaagaacttgccgtgatatccgacgggcgtaccatcgtctgttatcatcattcggtagacatctcttacgagcacactaagcaaacactgaatcagatcctctgcatgataatgaaaaaacacatgttcaaatgttag

SEQ ID NO: 51940 - DNA, 1851 bp, Artificial Sequence
  Description of Artificial Sequence: Synthetic coding sequence
atgccccccctggagacccagagcagcctggccccccccagcctgcaaacccctcccgcttcccttaccacccctccccttgaaaacttgccctccctcgcaccccctccacttcagaccgcaagcgcccctttgaccacaccgcatctggagactccgccatgcccagccccttgccctcttcaagccccacctagccccctgacgacaccccccccagagacaccatcatccattgcgacgcctcctccccaagcacctccggcactcgcatcacctcccctgcagggcctgcctagccctcctctgagcccgctggcaactccaccaccacaggcgcccccagccctggccctacctccactccaggcgcccccgtccccccctgcctcccctcccctgagccccttggctacaccatcgcctcaggcccccaatgcactggcggtgcacctgctccaagcaccgttctcacctcctcccagccccccagtgcaggctccattttcccctcccgcctcccccccagtaagcccaagcgccactcctccttctcaggcccctcccagcctcgcagcgccacctctccaagtaccccctagtccccccgccagcccccccatgagcccttcagccaccccccccccccaggcccctccccccttggccgcgcccccccttcaggtgcccccctctccacccgctagtccacccatgtcaccctctgccacccccccacctcgggttccacccctgctcgcagcccctcctctgcaggtgcccccgagtcctcctgcctccctgccaatgtccccactcgccaagccgcccccccaggcaccccccgcattagccacaccaccacttcaggccttgccatctccccctgcgagcttccctggacaggccccattttccccaagcgctagtctgcctatgtcacccctcgccacacccccaccacaggcaccccccgtgctcgcagcccccttactccaggtgccaccatcccctccagcctctccaaccttgcaagcaccccgccggccacccactcctggtccagatacctctgtatctggcccaaggctgacactggcactcgcccccggcccacctccacccccgagccgaagcccttccagcaccttatcaggcccggacctggcaggccatagcagcagcgccacctctactcctgaagaattacggggttacgactctggcccagaggggggtgcagcagcttcccctcctcctgatgcagagctggcagcttgccacccggcagcgtggtcacgcgggccagccccaccactcgcatttcgcggggcacctggagcccctcttccatggccaccagctaccggacctggttcagccgacgggctttgcaccatttacgaaaccgagggacccgaatccgctacccctgccccaggggcacttgacccgggcccgtccccaggtacgagcggaggcaaagcagccgccggcgccggcgccggagcttcctctcgcagcccaaagcaggcccggctcggcgagctcccactcggagccctccaggccagcgttgtgcagcacttgctttcgagaaccttactgcttgcggccgccgagggagcagccggaggatcgggcggcgggcccggaggcgcagagggagggggcgtcactggcggggctcgggccgctctcagcgacgccgagctgggtcgctgggccgaactcctgtccccactcgacgagtctcgagccagcattacttctgtgacatcgttctctcccgatgacgtcgcttcacctcagggcgactggaccgtcgtggaggtggagaccttccactag

SEQ ID NO: 51941 - DNA, 549 bp, Artificial Sequence
  Description of Artificial Sequence: Synthetic coding sequence
atgttctgctgcctgggctacgagtggctgagcggcggctgcaagacttggcacagcgcgtgggtcatcaacacattagccgatcaccgccaccgggggactgacttcggtggcagtccctggctgctaattatcacagtctttctgagaagctacaagttcgcaataagcctgtgcaccagttacctctgcgtatcctttttgaaaacgatctttcctagccagaacggacacgatggctccacggatgtgcaacagagagcccggcgatccaaccggagaaggcaggagggtattaagatcgtactggaggacatttttacgttgtggaggcaggttgaaacaaaagttcgcgccaagatatgcaagatgaaggtgactaccaaagtcaaccgacatgacaaaattaacggaaagagaaaaactgcgaaagaacatctgaggaagcttagtatgaaagaacgtgaacacggagaaaaagagcggcaggtaagcgaggctgaggagaacggcaagctcgatatgaaggagatacacacatacatgtag

SEQ ID NO: 51942 - DNA, 1224 bp, Artificial Sequence
  Description of Artificial Sequence: Synthetic coding sequence
atgtacaacgccttctggaaccacctgaaggagcagctgctgagcactccccccgatttcacatgtgcgttagaacttctgaaagacgtgaaggagaatcgactacggaacgagatcgaagaggctctggacactgatctcctgaagcaagaggcggaacacggtgccctcgatgtaccacatcttagtaactacatcctgaacttgatggcgctgctttgcgcccctgtgagggacgaggctatacagaagctggagaccatccgggatccagtccagctcttgcgcggtattttgcgcgtgctgggtttaatgaaaatggacatggtcaattatacaatccaaagctttagaccatatctgcaggaacacagcattcaatatgagcaggccaaatttcaggaactgttggataagcaaccttctctgctcgattacactaccaagtggctgacgaaagctgcaactgatataacaacactctgtccaagctctccagactctccatccagcagctgctccatggcttgttctctgccctctggagcagggaacaacagtgaacctccaagccctacgatggtgctataccagggctacctaaacttgcttctgtgggatttggagaatgttgagttcccagaaactctactcatggatcggattaggcttcaggagttggcgttccagttacatcagctgacagtgctggcaagcgtgttgttggtggccagatccttctcaggagaagtgcttttccgcagtcctgaattcgtggatcgtctaaagtgcacaaccaaagctctcacagaagagttcatctcacgtcctgaggaaacaatgctctctgtctccgagcaagtgtcccaggaggtgcatcagggactgaaggatatgggactcactacactctctagcgagaacaccgcctccctcctggggcagttacaaaacattaccaagaaagaaaactgcattcgtagtattgtggaccagtggattcgcttcttcctaaagtgctgcctactgcatgggatgcaggagagccttctgcatttcccaggcggcctaatcttgatcgaaaaggagctcgccgaactcggttggaagttcctcaacctcatgcaccacaaccagcaagtcttcggcccctattatgccgagatactaaagcacattattcaccctgcccaggctcaagagacagacgtggagcctaattag

SEQ ID NO: 51943 - DNA, 432 bp, Artificial Sequence
  Description of Artificial Sequence: Synthetic coding sequence
atgctgcggaagacctgcggcggccagcaggaggacagccggggcatgggcccgcatcttcctagggtgcctgatggtgttgtgcttggggtggaagaacccgaagggaaagcgcagggcagagtccggggagaactgtgcccaggcgcgcttgccagaatccatatgggacactcgtgcaccaggctttccgctgaggggattgctatgctgctggggacagcgggcccctctcgcctgcccgccgcccccgatgccagtcaagcccctcttaggagtccatgggccctgagcgtcgccgcggcactgtgttcccccgtgagttgccatccttgcggccggcatgtcgtaacattcggccattgccctgcacaagggccctggggactcggcacttttgggcactcattcttcggctgcctgtgcaaatag

SEQ ID NO: 51944 - DNA, 486 bp, Artificial Sequence
  Description of Artificial Sequence: Synthetic coding sequence
atgggccaccggcccaacctgggccagcccccccaccccaacgccgtggctgctgccttacatgcatcgctttgtcccgctaactggggcacttgtccacttggaaaacccggctacccgggatgtctttggttccaacctttactgctgttcccagggtgcctctgttctccagatggtccattccccagggccgtgtttacatcggccggaaaaggccccctacagaccgacttggggagagggagagtcccccctcgtgatcaacaaaccccaaagtccaggccatgtccaagagccccggtagcatctaacaggcagagcgggggctcagctgtgtctgctcctctgtcaggagcccggcgggcctggaagagcgccttcgctgcacccccacgatctcgactacggccccagaaaggcgtgccctggaccgaaaagcgggcaaggggcggaggacgcgccggcccttgcaggcgaacttag

SEQ ID NO: 51945 - DNA, 690 bp, Artificial Sequence
  Description of Artificial Sequence: Synthetic coding sequence
atggccgccgcccccgacgtgggcaacggcggcagcaagaacgtgcgaaaaccccgacctgggaaatgtcaacccaaaagccgacactctctcccccagacacaaaagcctgaggaggtaagaaaatgcggcgggatctgcctcccagtgtgtttgcaagacccaggggcttgcccatcttggctccccctcgaggagggcctgcgtcgccccgctttcgggcaccgaacagaggccggcccccgagggaaaggatttggacggcatcgcggcaattctggtctccgtgcagctgaggtcacccacggcccatgctgggaagcagcggatgtgccatgcctgcgcctgaccaagccccatggactgagagttacagcaggctgctcagaatggcggcgtaatgtggtggccagacaagttccagaggcctccgcagaactctgttctcgcaaccagccatgggccgcagccacacctgggagtctgcatccttccccgcagcccggagtcctcgagggaacaccaaccaacctcaaccgtactctgccttctggtattcgcggatcacagcctctgcctcaaggacagcctccactccccggacgctcaagctgggaaacaaaaacacgcgagccaattcccccacccgtaaggctcgaagcacgcgaggtcggaggcgttagcttatag

SEQ ID NO: 51946 - DNA, 480 bp, Artificial Sequence
  Description of Artificial Sequence: Synthetic coding sequence
atggacgtggtggaggtggccggcagctggtgggcccaggagcgggaggatatcatcatgaagtacgaaaagggccacagagctggcctgccagaggataaggggcccaaacctttcggcagttacaataataacattgaccattttggaatgcagcacgagactgagctacctcccctcaccgcccgggaagttaagcagatcagacgagagatctcccggaagtcgaagtgggtgaagatgctgggcgaatgggacacttacaaaaacagtcgaaagctgatagacagggcctaccagggcattccaatgaacattagaggcccaatgtggagtgtgctgctgaacatcgaggagataaaactcaaaaatcctgggcgataccagatcatgaaagaaaaagggaaacgatcttccgagcacattcagcaaatggacctggacgctgcagggacaacactgcaccccccgggcgtatag

SEQ ID NO: 51947 - DNA, 462 bp, Artificial Sequence
  Description of Artificial Sequence: Synthetic coding sequence
atggccgccgtggagcaccggcacagcagcggcctgccctactggccatatcttacagctgagacattgaagaatcggatgggtcaccagcctcctcctccaactcagcaacacagcattatcgacaatagccttagcctcaaaaccccctccgaatgtgtgttataccccctgccaccaagcgcggatgataacctcaagacgccccccgagtgtctgctgactcctctccccccctctgctctgcccagcgctgacgacaacctcaagactccagctgaatgcctcctgtacccactgccaccatccgcagacgacaatctcaaaacacccccagagtgtctactgactcccctgcctccaagcgcgcctcccagcgctgatgacaatctgaagactcccccagaatgcgtgtgctcactgcccttccacccgcagcgcatgattattagcagaaactag

SEQ ID NO: 51948 - DNA, 1116 bp, Artificial Sequence
  Description of Artificial Sequence: Synthetic coding sequence
atgggcggccccgtgctgggccactggtggcacagcggcggcatgtccttggctgttccaagcctgccaccaccaggtaagtcctcagttttcctatttcttcaagagaaaaaggccaacaacaagaagcagaaggccaagagagtcctagaggtacagcttcagacactcaacatccagaaagaggagctaaataccgacctttatcatatgaaaaggtctctgcgctattttgaagagaaatcaaaggatctggccgttaggctgcagcattcactgcagaggaagggcgagctagaatcagtcctcagcgatgtaatggctacacagaagaagaaagcaaaccagctctcttcacctagcaaggccgggacagaatggaaactcgaacagagcatgagagaagaggctttactgaaggtgcagcttacccaattgaaagagagcttccaacaagtccagttagaacgcgacgaatattcagaacaccttaaaggggagcgcgcaaggtggcaacagaggatgaggaaaatgagccaggaaatttgcacactgaagaaagaaaaacagcaggacatgcgccgcgttgagaaattggaaaggagtctgtcgaaactgaaaaaccagatggcagagccgcttcccccagagcccccagccgtgcccagcgaggtcgagctgcagcacttgcggaaggagctggaacgcgtggccggggaactacaagcacaggtcaaaaataaccaaaggatatctctgttaaatcagcgccaagaggaaaggatccgagagcaggaggagcgactgcgaaagcaggaggagcgcattcaggagcagcacaaaagcctccagcagcttgccaagccccaatctgtgttcgaggaacctaacaacgagaataaatccacacttcaactcgagcagcaggtgaaagagttgcaggagaagctgggggaggtaaaggaatccgagacttcgacgccctcaaagaaaggttgggaggctggctccagcttgtggggcggcgaagtgcccggccaacgccaactgccagcatggggcctggtgacaaccgcgcctcctagggcggtgctgtttctggctagttgtttatag

SEQ ID NO: 51949 - DNA, 384 bp, Artificial Sequence
  Description of Artificial Sequence: Synthetic coding sequence
atgggcaacctgtgcggctgcatccagggcgacagcaagaagccctccaagaaaagagtgaagcgcaagccatattcaacaacaaaggttacatccgggagcaccttcaacgagaatactcgcaggtatgccgtacataccaaccaatgtcgccgaccacacgggtctagagtgaaaaagaagcggtatccacaggaggacgacttccatcacaccgtgttcagcaacttggaacgcttggataagcttcagccgactttggaggcctctgaagagagtttggtccacaaggaccgaggagatggagagcgacccgttaacgtgcgggtcgttcaagttgcccccctccgtagggagagtcgggctattgacactggggaatag

SEQ ID NO: 51950 - DNA, 2265 bp, Artificial Sequence
  Description of Artificial Sequence: Synthetic coding sequence
atgaaggtgatcgtgatccaccggaagatgttccagcgggcccaggaactgcgtaggcgggccgaggactaccataaatgtaaaatacccccatcagcacgtaaagcactctgtaactgggttaggatggcagcagccgaacaccgccactcttccggactgccatattggccatatcttactgccgagactctgaagaatcggatgggccaccagccacctccaccaacacagcagcactccatcactgacaactctctgtccctgaagactccacctgaatgcgtactgactcctctgcccccctcagccgatgacaacttgaagacacccccagagtgtgtcttgaccccattacctccttccgctgacgataatctgaagaccccacccgagtgcttgctcactcctctccccccctctgctgacgacaacttaaaaacacctcccgagtgtctattgacgcctctcccaccctctgctgacgacaatctgaaaacaccaccagagtgcctgttgacccccctccccccttctgctcctccttcagcaccgccctctgcggacgataatctcaagactagagccgagtgcctgcttcatcccttaccaccaagcgcagacgataatctgaagaccccaagtgaaaggcagctgacgcccctgcccccctccgcccctccaagtgccgacgataatattaagacgcccgcagaacgccttcgcggacccctgccgccatccgctgatgataacctgaaaaccccatccgagaggcaattgacacccttgccccctagtgccccacccagcgccgatgacaacatcaagacacctgccttccatccccagcggatgatcatatcccgacacctgcccagtgtcagctccctgccgtttcacccacagttgcacagccagcaaatgattataagccggtatcttctatcagtgtgtggcttcagattccaccaccagccgatgatcatatctcgtcatctcccctccgtgagcagccttccctttcacccccagctccatccccagcagatgatcatttccagacacctcccgagtgtttgtgggggaagatttcacccccaacgtatgatcatcagcaggcacctgccctctgtgtcatcactgcccttccaccctcagttgcaccctcaacagatgattatctccagacatcttccaagcgtgtgcgggggccgcttccaccctcagcggatgattatcagtaggcacctgccctcagtgagcagcctgccttttcacccccagctgcatcctcagcagatgatcatttctcggcatcttccaagtgtgtgcggtggaaggttccatccacaacgtatgattatcagccggcacctgcccagcgtgagcagcctgcctttccacccacagctgcacccacagcagatgatcatttcacgccacttgccctctgtgtgcggagagcgcctccggggaccccttcccccaagcgccgatgataacttgaaaacaccgtccgagcggcaactaaccccgcttcctcccagtgctcccccctcagcagacgacaacataaaaactcccgccgagagactgcgcggaccattacctcctagtgccgacgacaacctcaagactccgagcgagcggcagttaactcctctgcccccaagcgctccacccagtgctgacgacaacattaaaacccccgcagaacgcttgcgaggacctctcccacccagtgccgatgataacttgaaaacaccttccgagcggcaactgacccccctgccgccttctgccccccccagcgctgacgataacatcaagacccctgctgaacgcttgagaggaccactcccacctagtgctgatgacaatcttaaaacgccgcccctggccacccaggaggctgaggctgagaagcctagaaagccgaagagacaaagggcagctgagatggagcccccacccgagccgaaacgtcgccgggtcggagacgtcgagcccagtagaaagccgaagagacgccgagccgcagatgtggaacctagttctcccgagcctaaacggagacgcgtcggggatgtagagccctcacggaagcccaaaaggaggcgcgccgcagacgtggagccttcctctccggagcctaaacggagacgggtgggagacgtcgaaccctcccggaaacccaagcggaggcgggccgcggacgttgagccttcgctgcctgaaccaaagaggaggaggctgtcatag

SEQ ID NO: 51951 - DNA, 810 bp, Artificial Sequence
  Description of Artificial Sequence: Synthetic coding sequence
atggacgagatcgagaagtaccaggaggtggaggaggaccaggaccccagctgcccgcgcttaagcagagagctactcgacgaaaaggaacccgaggtgcttcaggatagcttggacaggtgctactctacgccatctgggtatctggagttgcctgatctgggccaaccatattccagcgcggtatacagtttggaggagcagtacctggggttggccctggacgtggatcgaactaaaaaggaccaggaagaggaggaagaccagggacccccctgtcctaggctctctcgagaactgctggaggtcgtggagcctgaggtactgcaggattctctggaccgatgctattctacaccatcaagttgcttagagcagccagactcctgtcaaccgtacggatcttctttttacgctcttgaggagaagcatgtgggtttctcactggacgtcggggaaatcgagaagaaggggaaaggcaagaaacgccgcggcagacgctctaaaaaggaacggcggaggggtaggaaggagggagaagaggaccagaaccccccctgcccacgcctatcgagagagcttctggacgaaaaggagccagaggtgctgcaggattccctggatcggtgttatagcacgccgtccgggtatctcgagttaccagatctgggtcagccatacagttccgcggtctactcactggaggaacagtacctcggcctcgcactggacgttgactccgaatatctgaccgtgaaagtgatcagcctgcacttggttttccagatcggcgttatatttcttcagtag

SEQ ID NO: 51952 - DNA, 570 bp, Artificial Sequence
  Description of Artificial Sequence: Synthetic coding sequence
atggtgcagggcagcagccggaccgcccggcccctgcccgcccccgcatgtgggcttagccctggtcctgactgtaatgctagctggcaggatagggccgctgatttttgtccagttagggccgtgtgcaaggtcgggccatgtccttgttgtcagctcaagacagaccctagacttggaaagaggacagggctcgatctcttctcagtgtggtcgcggagcgcaatgctggccccagcaggaagcgtgctggctatgcctaccctgcgccctccccgtaacagcgtcggcgatagtggggcttgttgtttgcggaccactggcctagatatcagtaaagtgctgcctgaaagcttcctgtcgtgccccctgctggagttaccatggcacttgtcgtcttgggtgctgaacccgggactgcctacgctgagaacaccccatgcaagttatagctgttttgctgctcaagctcgttctccagagcgggccgccggcggggcttggcctctcactggcaaaccttggccgagaaccggaattctgtccccctctcattcggaaatcttgtag

SEQ ID NO: 51953 - DNA, 684 bp, Artificial Sequence
  Description of Artificial Sequence: Synthetic coding sequence
atgagccaccacacccggaccctgggcgtggtgctgagcccccagcagggggccccagcaggtccagggggaggcttgggcacaccctatcatagtcacccgtgtaagcccagacaagtgcctgtgtccgaatcccaaccgcccccccacaccatgcaggttggacggtgggctggccttggagtcggtcaagctgaggccacatccgtccgcttaggactccacggactggaggccgtgtttccttacctggggcacgaccttcaggggccagccgtctcgcatggcgatggccttgcaggcgtaggtagggaactcgctcttttactgggcggacctgagcagaggggcgccaaacatagggccaaagttgtgcaggggcatttgatcgactgtctgctattatgccaccctgtagaggatcggtcccggggatgctgcttcaacgcaactacacggagagaagcagaggggttgtgtagggcccgcgttctgcgcgaaggagtgaccagcaccctggccgtgctgcaagctgactcctcactaggcgtatcatcaaccaggagaaccgctgcaggcggagctgcacgagccgccgctcacggtcaatcatgccctagggctacacctgcgaccactccaagcccgggctcaccccggcagggtagactgtccatggaatag

SEQ ID NO: 51954 - DNA, 1023 bp, Artificial Sequence
  Description of Artificial Sequence: Synthetic coding sequence
cccgtgcccggccccaccagcagcgccaccaacgtgagcatggtggtgagtgcagggcctttgagctccgagaaggcggagatgaatatcttagagatcaacgagaaactgcatccccagctggctgaaaagaaacagcagtttaggaacctaaaagagagatgtttcgtcacacagctggcgggatttctagccaaccaacagaagaagtataaatatgaggaatgcaaggacctgatcaaaagtatgttaagaaatgagagacagttcaaggaggaaaaacttgctgagcagctcaaacaagccgaagaattgcgtcagtataaagtactggtgcacgcccaggaacgggagctgactcagctccgagaaaagttacgagaggggagggatgcttcccgctcccttaacgagcacctgcaagctctcctgacgccagacgagcctgacaaatcacagggtcaagacttgcaggaacagctcgccgaaggctgtcggctcgcacagcacctggtacagaaactgagtcccgaaaacgataacgatgacgacgaggatgtgcaggtcgaactggcagaaaaagtccagaagagttccgccccccgggagatgcagaaggccgaggaaaaagaggttccagaagacagtcaggaggaatgtgccatcacctactcaaactcacacggcccttatgacagtaatcagccacaccggaaaactaagataaccttcgaggaggataaagtcgattctaccctcatagggagctcatcacacgtagagtgggaggacgctgtgcatatcatccccgagaacgagtctgacgatgaggaagaggaagaaaaggggccagtgtcaccaagaaatctccaggagtctgaagaggaagaggttccacaggagtcctgggacgaggggtatagtacactgagcattccccctgagatgacatcagtgggaagctcagaaaagggcgggcctcgggggaacaggtcgcaggcccaacagggcgcagcagggtag

SEQ ID NO: 51955 - DNA, 11424 bp, Artificial Sequence
  Description of Artificial Sequence: Synthetic coding sequence
tgacccggccccaccagcagcgccaccaacgtgagcatggtggtgtcagcaggccctctgagctccgaaaaagctgagatgaacatcctcgagattaacgaaaaactgcacccgcagctggcagagaagaagcagcagttcagaaatctcaaagagcgctgttttgtcacacagctcgccgggtttctagccaaccagcagaagaaatacaagtacgaggagtgtaaagacctaattaagtccatgctgaggaacgagagacaattcaaggaggagaagcttgccgagcaactaaaacaagcagaggagctgagacagtacaaggttttagtgcacgcgcaagagcgggaacttacacaactgcgggagaaactgagagagggtcgcgatgcctctaggtcgctgaacgaacacctccaggccttactgaccccagatgaacccgacaaatcccaggggcaggacctgcaagagcagttggctgagggctgccgacttgctcagcatttagtccagaaactttcacctgagaacgacaacgatgatgacgaagacgtccaggttgagctggccgagaaggtgcagaaaagtagcgctcctcgcgagatgcagaaagccgaagaaaaggaagtccccgaggactcgcaagaggaatgcgccattacatactccaactctcacggcccatacgactctaatcagccacatcgcaaaactaagattacttttgaggaggacaaggtcgatagcacccttattgggtcaagcagccatgtcgagtgggaggacgccgtccacatcatccccgagaacgagagcgatgacgaagaagaggaagagaaagggccagtgtcaccacgaaacctacaggaaagtgaagaggaggaggtaccccaggagagctgggatgaagggtacagtacgctgagcatccccccagagatgttggcttcataccagagttactcgtctacttttcatagcctggaggaacagcaggtgtgcatggcagtcgacatcggaagacatcggtgggaccaggtcaagaaggaggaccaggaagctactggcccacgactctcccgcgagctcctggatgaaaagggtccagaagtgttacaggattctctggatcgttgctatagcaccccaagtgggtgcttggaacttaccgattcctgccagccatataggagcgctttttacgtattagaacagcagagaattggcctcgctgttgatatggacgaaattgagaagtatcaggaggtggaggaagatcaggatccctcgtgccctcggctatcccgggagctgcttgacgagaaagagcctgaggtgctgcaggacagcctggaccgctgctacagcactcccagcggatacttggaactgcctgacctggggcaaccctattccagcgccgtctattccctcgaagaacagtaccttggtctggctttggatgtggatagaactaagaaggatcaagaagaggaggaagaccagggaccaccatgtcccagattgtcacgagaattactcgaagtcgtggagcccgaagtgctgcaggactccttggatcgatgctattcgacacccagctcctgtcttgagcagcccgacagttgtcagccttacggttcctctttttacgcgctggaagaaaagcacgtggggttcagcctggatgtgggtgagatcgaaaaaaaaggaaaggggaaaaagcggagaggccgcaggagcaaaaaggagcggcgacgcggaaggaaagagggagaagaggaccaaaaccccccttgtccgcgcctgagcagagagctcctcgacgaaaaaggtccagaggtgcttcaggattcccttgatcgctgctactccacgcctagcgggtgtttggagttaaccgattcttgtcagccttatcgttccgccttttacgtccttgagcagcagagagttggactagcagtggacatggatgaaatcgaaaagtatcaggaggtggaagaagaccaggatccatcttgtccccggttgagcagagagttgctggacgagaaggagcctgaggtgcttcaggatagtctggatcgctgctattcaactcctagcggctacctggaattgcctgacttaggccagccctacagcagtgcagtctacagtctggaggaacaatatcttgggctggcactcgatgtggatcgcacgaaaaaagatcaggaggaagaggaagaccagggcccgccctgccctcgcttgtccagggagctactggaggttgtggaaccggaggtgcttcaggactctcttgatagatgctattccacacctagttcatgtctggagcagccagactcctgccaaccatatgggagttccttttatgccctggaggaaaaacatgtcggcttctccctggatgtgggagaaatagaaaagaaggggaaaggcaaaaagaggcgaggaaggagatctaaaaaagagcggcgaagagggcgcaaggagggcgaagaggatcagaacccgccctgccccaggctgtcgagggagttgctggacgaaaaggaacccgaagtgctgcaggatagcctggatagatgttacagcaccccctccggctatctcgaacttcccgacttaggccagccatactccagcgcagtatacagtcttgaggagcaatacttaggccttgcgctggatgtagacgagattgaaaaataccaggaagtggaggaagatcaggacccatcttgccctaggttatcccgagagctgctagacgagaaagaaccagaggttctccaggatagcctggaccgctgctactctacgcctagcggatacttggaactgccggatctcgggcagccatatagtagcgcggtgtatagcctggaggaacagtaccttggtcttgctctggacgttgacaggactaaaaaggaccaggaggaggaggaagatcagggccctccttgcccccggctgtccagagagctgctggaggtagttgaaccagaagtcttacaagattcgctggaccggtgttatagtacaccatccagctgcttggagcagccggactcttgccaaccgtatggcagctccttttacgccttagaggaaaagcacgtcgggttctcactggatgtgggcgagatcgagaagaagggtaagggaaagaaaaggcgcgggaggcgtagcaagaaagagcgtcgtagaggccgtaaagagggggaagaggaccagaaccctccgtgccctagactatctcgggagctcctggacgagaaggagcccgaagttctgcaagactccctggacagatgctatagtactccttctggttaccttgagcttcccgatctggggcagccctacagttccgcagtctactctctagaggagcaatacctgggactggctctggacgtggaccgcaccaagaaagaccaggaggaagaggaagatcaggggcccccatgtcccagactctctagagaacttttggaagtcgtcgagcctgaggttctgcaggattcccttgaccggtgttactccacaccctcttcgtgcctagaacagcctgatagctgccagccgtacggtagcagtttctacgctctggaagagaaacacgttggcttcagcctggacgtcggtgagatcgagaaaaagggcaaggggaagaaacgccgcggaaggaggtctaaaaaagaaagaagaagaggcagaaaagagggggaggaggaccaaaatccaccttgccctaggttgtctcgagagctgctggatgaaaaggaacccgaagttcttcaggatagtctggaccgttgttatagcacaccttcaggatatttggaactgccggatttggggcagccctattcttctgctgtctactccttggaagaacaatatcttggactcgccctggacgtggatagaacgaagaaagatcaggaggaggaggaggaccagggccccccatgccctaggttgtcacgcgaattgctggaggtggtcgaacctgaagtgctccaggattcattggatagatgctactctactccctcttcttgcctggaacagcctgacagctgccagccttacgggtcttctttttacgccctagaggaaaagcatgtaggcttctccctggacgtcggcgagattgagaaaaagggaaaaggcaagaaacgtagaggtcggcgatcaaagaaggaacgccgccggggtagaaaagaaggggaggaggatcagaatccgccctgccccagattatcccgagaattgctcgacgagaaagaacccgaggtgttgcaagattcgctcgacagatgctactccactccttccggatatctggagctgcccgaccttgggcagccctattcgagtgcagtttactccttagaagagcagtacctcggcctggctctcgatgtggaccgaacaaaaaaagatcaagaagaagaagaggaccagggccctccctgcccgagattaagtagggagctgttggaggtggtcgagccagaggtcttgcaggattccttggatagatgctattccacaccatcatcttgcctggaacagcctgactcttgtcaaccttacgggtctagcttctatgctctggaagagaaacacgtcggttttagcttagacgtgggcgagattgaaaagaaagggaaaggcaagaagaggcgagggaggagaagcaaaaaggagcgaagacgagggcgaaaggagggagaggaagaccagaaccctccgtgcccacggctctcacgcgagctacttgatgaaaagggccccgaagtcctacaggattccctcgaccggtgctactccacccctagcgggtgtttagagcttaccgatagctgccagccataccgtagcgctttttacgtgttggagcagcaaagagtgggactagccgtggacatggacgaaattgaaaagtatcaagaggtcgaggaagatcaagacccaagttgtccgaggctgtcccgggagctgctggacgagaaggagcctgaggtgctgcaggacagtctggacaggtgctactctaccccttctggctacttagaacttccagacctcgggcagccttattcttcagccgtgtacagcctggaagagcagtacctgggcctcgcccttgacgtggaccggacaaaaaaggaccaggaggaagaggaggatcaggggcccccctgtccaagactcagtagggaactactcgaggtcgtggaacccgaagttctgcaggattcactcgaccggtgctattctacccccagcagttgcctggaacagccggacagttgtcagccatacggcagttccttctacgcgctcgaagagaagcatgtaggtttttccctcgatgtcggcgaaatagagaagaaggggaagggaaagaaacgccgcgggcgccgctctaaaaaagagagacgccgtggcaggaaggagggcgaggaggaccaaaatcccccttgtccgaggttatcccgagaactgttggatgagaagggtcccgaagttcttcaggattcactggaccggtgttacagcacccctagcgggtgtcttgaattaaccgattcgtgtcagccatataggtctgcattctatgtgctggagcagcagcgagtcggtcttgctgtggatatggatgagattgagaagtaccaggaggtcgaagaggatcaagatccatcctgcccgaggctctcgcgtgagctgctggacgagaaggagcccgaagtgctgcaggatagcctggaccgatgctactctactccctctggctacctggagctgccggacctgggacagccctatagcagtgccgtttacagcctggaagagcagtacctgggactggcactggacgtcgataggaccaagaaggatcaggaagaggaggaggaccagggaccaccgtgcccccgcctgagtcgtgaactgctggaggttgtcgagcctgaggtccttcaagactcgctcgacaggtgttactcgaccccaagttcgtgtttggaacagccagactcctgtcagccttatggatcctctttttatgcccttgaggagaaacatgtaggtttcagcctggacgttggcgagatcgagaagaagggtaaggggaaaaaacggcgtggccgccgctccaagaaggaacgtcggagagggagaaaggaaggcgaggaggaccagaaccccccatgcccgcgcctttctagggaattgctcgatgaaaagggccctgaggtcttacaagattctctagatcgcagctactccacaccaagtggctgtcttgaactgacggattcctgccaaccttacagatctgccttttatgttctcgaacaacaacgggtcgggctggcagttgacatggatgaaatcgagaagtatcaggaggtggaggaagatcaagatcccagctgtcctcggctgagccgtgaacttctcgacgaaaaggagcccgaggttctgcaggattccctggacagatgctacagcacaccatcaggctacctcgaattaccagatctcggacagccttacagttcggccgtgtattccctggaggagcagtaccttggcctagctttggatgtggaccggacaaaaaaagatcaagaagaggaggaggatcagggcccaccttgccctcgcctctctcgtgaactactcgaggtggtcgagcctgaggtactccaggattctctggaccggtgttatagtacgccatcctcttgtttggaacagccagattcatgtcagccttacggatcctctttttatgctctcgaggagaagcacgtgggcttctccctcgacgtgggcgaaatcgagaagaagggcaaaggaaagaaacgcagaggacggaggagcaaaaaggaacgacggcggggtcggaaagaaggagaggaagaccagaaccctccgtgtcccagacttagcagagagctcctagacgaaaaggggcccgaagttcttcaagattcactagatagatgctacagtactcccagcgggtgcctcgagctgacagacagttgccagccttaccgctctgcattttacgtgttggaacagcagcgagttggacttgccgttgacatggatgagatagaaaagtaccaggaagtggaggaagaccaggaccccagttgcccccgcctctcgagggagctcctcgacgagaaggagcccgaggtgttgcaggactctctcgacagatgttacagcaccccatcaggataccttgagctgcctgacctgggtcagccttactccagtgccgtgtactctctggaggagcagtatttgggccttgccctggatgtagataggacaaagaaggatcaagaagaggaagaagatcaaggacccccttgtccccgactcagccgcgagctcctggaggtcgtcgaacctgaagtgctccaagacagcttggaccgctgttacagcacaccaagtagttgtttagagcagcctgactcctgtcaaccatatggctcatcgttctatgcacttgaagagaagcacgtgggcttttccctagacgtgggagaaattgagaagaagggcaagggcaagaagagacgcggacggcgctctaaaaaggagaggaggcgtggccgcaaagagggtgaagaggaccaaaatcctccctgcccgcggctgtcccgcgaactgctggacgaaaaggaacccgaggtgctccaagattccctcgatagatgctactcaacaccaagcggttacctggagttgcccgatctcggacagccttatagcagcgccgtctattctctcgaggagcagtacctcggcctggccctggatgtggatcggacgaagaaggaccaggaggaagaagaagaccagggaccaccttgccctcgtttgtctcgcgaactactcgaggtggttgagcctgaagtactacaggactctctcgaccgatgctattcaacccctagttcgtgtctcgaacagcccgatagctgtcagccgtatggttccagcttctatgcactggaggagaagcatgtcggcttcagcctggacgttggcgagatagagaaaaagggcaaaggaaagaagcgtcgtggacgcagatctaagaaggagcgaaggaggggtcgcaaggagggagaggaagatcaaaatccgccatgccctaggcttagccgggagttactcgacgagaaaggccctgaagttctgcaggactctctagacagatgctactctaccccctctgggtgcttggagttgaccgatagttgccagccatacagatctgctttttacgtccttgagcagcagagggttgggctggccgtggacatggacgagatcgagaaataccaagaagtggaggaagatcaggacccttcctgtcccagactgagccgcgaactgctagacgagaaggagcccgaggtgctgcaagattccttggacaggtgttatagtactccgtctggctacctggagctgcctgacctagggcagccatatagttcagcagtctactccttagaggaacagtaccttggcctggctctggacgttgacagaaccaagaaagatcaagaagaggaggaggaccagggacctccttgcccaagattaagccgtgaactcttggaggttgtagagcccgaggtgctgcaggattcactcgacaggtgctacagcaccccgagttcttgtctcgaacagcccgatagttgccagccctacggctcttcgttctatgccctcgaggaaaagcacgttggattcagcttggatgtgggcgagatcgaaaagaaggggaaaggaaagaaacgaaggggacggcggagcaagaaggagcgccggcggggacgtaaagagggcgaagaagaccagaacccaccctgtcctaggctgtctagggagctcttggacgagaaagaacctgaggtgctccaggactccctggacaggtgttatagcacccctagcggctacctcgaactcccagatctgggacagccatactcatccgcagtgtacagcttagaagaacagtacctcggcttagcccttgatgtggacaggactaaaaaggaccaggaggaagaagaggatcaggggcctccctgtcctagactatcacgtgagctccttgaggtggttgaacccgaggtgctgcaagatagcttagacaggtgctacagtaccccctctagttgtctggaacagccagattcatgccagccatacggttccagtttctatgccctcgaagagaagcacgtgggcttctcattggacgtaggcgagattgagaaaaaaggcaaagggaaaaagaggagaggacggcgctccaaaaaagagaggcggcggggccgtaaggagggcgaagaagaccagaatcctccttgcccacggctttcaagggaactgctggacgaaaaggagcccgaagtccttcaagacagcctcgataggtgttactccactccctcgggttatctcgaattgccagacctcggtcaaccctatagcagcgcagtatactccctggaggaacaatacctgggactggcactggacgttgacaggactaaaaaggaccaggaagaggaagaagatcagggtcctccttgtcctcgccttagccgggaactacttgaggtggtggagcctgaagtgcttcaggacagtctcgatagatgctacagcacaccttcttcttgcttagagcagccagactcctgccagccttacgggtcgtcattttatgccttagaggagaaacatgtgggtttttctttggacgtaggggaaattgagaaaaagggaaaaggtaagaaaagaagaggccgccgcagtaagaaagagaggcgccggggcaggaaggagggggaagaagaccagaatccgccctgccctagactcagcagggagcttcttgatgaaaaggagccagaggttttgcaggatagccttgaccgctgctatagtaccccatcagggtacctcgagctccctgacttggggcaaccctactccagcgccgtgtattcactggaagagcagtacctgggcttagcactcgacgtggaccgtaccaagaaagaccaagaggaagaggaagatcagggaccaccttgtccccggctgagccgcgaactgctggaagtcgtggagcctgaggtattgcaagatagcttggatcggtgctactcaaccccatctagctgtttggaacagcctgatagttgtcaaccttatggcagcagcttttacgccctcgaggagaaacatgtgggttttagtttggacgtcggcgaaattgaaaaaaaaggcaaggggaagaaacgccgtggcagaagatcaaagaaggagagaagaagaggcagaaaggagggtgaggaggaccaaaacccgccttgtcctcggctctcccgcgagctgctcgacgagaagggcccggaggtcttacaggattcccttgataggtcatactcaacaccttctggttgtctcgagttaaccgacagttgccagccttataggtctgcattttacgtgctggaacagcagcgggtgggtttagccgttgacatggacgaaattgagaaatatcaagaggtcgaagaggaccaggatccttcctgcccccgcctgtctcgtgaactgctcgatgagaaggaacctgaggtgctccaggactctctcgaccgctgctacagcacaccatctgggtatctggaactgcctgaccttggccagccatactcgagcgcagtgtactctctggaagagcaatacctagggctagctttggacgtggacagaactaagaaggaccaagaggaagaggaggatcagggacccccatgcccccggctctccagggaacttcttgaagtcgtggaaccagaggtgcttcaggactctctggaccgctgctattcaacaccttcatcgtgtcttgaacagcctgactcgtgccaaccctatgggagttctttttacgcgctggaggaaaagcacgtgggcttttccttggatgtgggggaaattgaaaaaaaaggtaaaggaaagaagagaagaggacgacgctcgaagaaagagcgccggcgcggccgaaaagaaggtgaggaagatcagaatccgccctgtccccgtctgagccgggagctgttggatgagaaaggaccagaggtgctacaagatagtctcgaccgctgttattctaccccctccggctgcttagaattgacggactcttgtcaaccgtatcgttctgccttctatgttcttgagcagcaacgggtggggctggccgttgatatggacggggagtatctctcaatgaaagtgatcagaatccattag

SEQ ID NO: 51956 - DNA, 258 bp, Artificial Sequence
  Description of Artificial Sequence: Synthetic coding sequence
gagatgcagaaggccgaggagaaggaggtgcccgaggacagccaggaagaatgcgctattacctatagtaactctcatggcccgtacgacagcaaccagccccaccgcaaaacaaagatcacattcgaggaggacaaggttgactcgaccttgataggatcaagttctcatgttgagtgggaggatgccgttcacattattccggaaaatgagagtgacgacgaggaagaggaggaaaagggccctgtgagtccttag

SEQ ID NO: 51957 - DNA, 753 bp, Artificial Sequence
  Description of Artificial Sequence: Synthetic coding sequence
gagatcgagaagtaccaggaggtggaggaggaccaggaccccagctgcccacgcctctccagagagctcctggacgagaaagaaccagaggttctccaggactctctggatcgatgttatagtaccccaagtggatatctcgagctcccagacttaggacaaccctatagttccgctgtttactccctcgaggagcaatacctggggctcgctctggacgtggatcgcaccaaaaaggatcaggaagaggaggaggatcagggcccaccctgcccccgcctgtcccgggaacttcttgaggtggtggaacctgaggtgctgcaagattccctggatcgatgctatagtacaccgagctcatgcctcgaacagcccgactcctgccaaccctacggatctagcttctatgcactggaagagaagcatgtgggattttccctcgacgttggggagatcgagaagaagggaaaagggaagaagcggcgtggtcgtaggtcgaaaaaagagcggcgacggggtcggaaggagggagaggaggaccagaaccccccatgtcccagactgtcccgggagttgctagacgagaaaggcccagaggtgctccaggacagtctggaccgctgctactcaactccttccgggtgtctggaactaacagactcttgccagccttacaggtccgccttttatgtgttagagcaacaacgcgtgggactcgctgttgacatggacggcgagtatctgagcatgtag

SEQ ID NO: 51958 - DNA, 300 bp, Artificial Sequence
  Description of Artificial Sequence: Synthetic coding sequence
atgcggcccaagaccctgcggaacagcgccgcccggagccggaaggagcctggtttccttaatcaccacatggagggatcttgcttgcagctgggcgaactcagctcggttggttactggatggaatcacactctgttacgcaggcaggagtccagtggtgcagtttcgggagcctgcagcccccacctccaaggtttaaacctttttcctgtctatcactaccctcatcctgggactacaggaggaagaagggttcttggctgggttccaagttggagttcccaatgctttgcggctag

SEQ ID NO: 51959 - DNA, 300 bp, Artificial Sequence
  Description of Artificial Sequence: Synthetic coding sequence
atgcggcccaagaccctgcggaacagcgccgcccggagccggaaggaacccggcttcctcaatcatcacatggaaggaagctgcctacagctgggggagctctcaagcgtaggctactggatggaatcccattccgttactcaggctggagtgcagtggtgttctttcggcagcttacagccccctcctcctaggttcaaaccattctcttgcctgtctctcccgtcttcctgggactaccggaggaagaaaggatcttggcttggctcgaagctggagtttccgatgttgtgtgggtag

SEQ ID NO: 51960 - DNA, 321 bp, Artificial Sequence
  Description of Artificial Sequence: Synthetic coding sequence
atgcggcccaagaccctgcggaacagcgccgcccggagccggaaggaacctggcttccttaaccaccacatggaagggagctgcttgcaactgggggaattaagcagtgtgggctattggtggccattcgggcaccccggacctgcacaaggccacttgccggtagccgtatgggctagctgggtggtggcggggatttcgatcgcgctctatttgcctcctcaccccgaaggtcgttatgaaggaccgttcaagagacatacaaagacattccgatccgcgcaatgcgcggattgcctgacttgcgctttggaaccatag

SEQ ID NO: 51961 - DNA, 453 bp, Artificial Sequence
  Description of Artificial Sequence: Synthetic coding sequence
atggagaacaaccccagccacaaccccgtgagccccagccccttccctactcgcatctccgcgcccctgaacatgagtcaatctcactttcgggaaaattggttgatgctgaagaaaagcctggaggggaaactgtgccctagttcatgcggctcactgaaatgtcgagcgtctcggagcccctccgtaggcactggcccgtccttaccaatcgagtgctttctgtacatgaaaacctggtcttcccttcaaatgaccgtggcatctgaagaagacaagcggcgggaaaaaactcagaacgccggactgcctctctttttcgcctcaactgtcggcaccgtaacgctgccctcattccaccacctgcagttacacacacacactcatacactggtgcctcagagcctgtttggcacttgcttgactgcccacctcgaaacccgatggagctag

SEQ ID NO: 51962 - DNA, 486 bp, Artificial Sequence
  Description of Artificial Sequence: Synthetic coding sequence
atgggccaccggcccaacctgggccagcccccccaccccaacgccgtcgctgccgctctgcacgcatcactgtgccccgccaatcgggggacatgccctctaggaaagcctggctacccagggtgcctttggttccagcctctgctcttgtttcctggctgtttgtgtagtcccgacggcccatttccccgagccgtgttcacctcagcaggaaagggccccttacagacggacttggggagaggacgtgtccctcctcgcgaccagcagactcctaagtcaaggccatgcccccgtgcccctgtcgcctctaacagacagagtggtggctctgccgtgagcgctcctctgagcggcgcgcgccgcgcttggaagagcgcctttgccgccccgccacgctcccggttaaggccacagaagggagttccctggaccgaaaagcgcgccaggggaggaggccgagcgggaccgtgtagacgcacttag

SEQ ID NO: 51963 - DNA, 321 bp, Artificial Sequence
  Description of Artificial Sequence: Synthetic coding sequence
atgcacagccggccctgggcctggggcgccagcgagatgtgcttctgtttcttcgagatgggctctttctgctgtccctcacgcagtacggtcgccaggagccagctgacagctgcctctaccagctgggcccaagtaattctgcccccacagcctccagaatgtttactcctcgtgttcatgatgacctggggaccgggcatacttcacctgtgttgttccggcgcatcgcctgcacccggggcacatcagcctcaactccgacgggaggcgctcatttgcagagctaagcagttgtgttttcacgtcgacccagcatag

SEQ ID NO: 51964 - DNA, 246 bp, Artificial Sequence
  Description of Artificial Sequence: Synthetic coding sequence
atgtgcagctgggaggtgaccaccccccagggcctgggcaccagcagcgcttctgaggagtccctgacggatgaccatcgacttcttaaggtaatttcccaggggtcttttgcggaagtcaaggcagcaggacccgctcactcccattgggaccaagatggatgcggaggccaccctaatagggctgccggcctgctgcagccccctgggagcgttttacagggcccctatgatgagggcccttag

SEQ ID NO: 51965 - DNA, 720 bp, Artificial Sequence
  Description of Artificial Sequence: Synthetic coding sequence
atgagcgaccccgagggcgagaccctgcggagcaccttccccagctatatggccgaaggggaacgactatatctttgtggcgagttttccaaagccgcgcaatccttcagcaatgctctctacctccaggacggtgacaaaaattgtcttgtggccaggtccaagtgcttcctgaagatgggcgatctcgaacgtagccttaaggatgccgaagccagcctgcagagcgaccccgcattctgcaaagggatcctgcaaaaagccgagactctatacaccatgggtgattttgaattcgctttagtgttctaccatagagggtataagctccgcccggacagggaatttagagtggggatccagaaagcgcaggaagccatcaacaactctgtggggagtccaagctccattaaattggaaaacaagggagacctgtcattcttgtccaaacaggccgaaaatattaaggctcagcagaagccacagcccatgaaacacctcctgcaccctaccaagggggaaccgaagtggaaggcctccctcaagagcgagaagaccgtcaggcagctgctcggcgaattatacgttgataaagagtacctggagaaactgttacttgatgaagtgacattcctgatgcagaatcgggagcctctgaccactctggccgaattcctccccgagctcggaaacagctctaaacccctgacccgcgagtag

SEQ ID NO: 51966 - DNA, 516 bp, Artificial Sequence
  Description of Artificial Sequence: Synthetic coding sequence
atgctgaccagcaagctgcggagcaccctgcagaccctgcagggccttggactaaccagcagttgtctcctggacatcttcagtagcgtctctactcacattcgtaatttgccctgtctcaaccttacgttagcgtcatcctgtctgcaaagaattcagatcatgcagggagccggaaggaagcggaacagaggccgtgctgagaaacagaaagcttgtgccatatcgtttcaggtcgacttttctaaactccacattctcggggcaggaaggggtagaatattagaggaaaaacaaggcattctggtgcgtcaggctaacgcagattgtctgcgtgacttgggactcaagagtgcattcgaactggcattccgtcgctcttccctggtcttcagcccacgcgcaaaaggtctgaagtcttctgcagaagaccggcgctggccccttttttggcaaaacatggtctccatctttggcgcccgttgcaaggcatcctccgcccagacatcttgctag

SEQ ID NO: 51967 - DNA, 1218 bp, Artificial Sequence
  Description of Artificial Sequence: Synthetic coding sequence
atgcacatcaacagcctgcacatgcagctgaacagccaccggatctgcaacagtacccacacagtttatgccaatcaactcgctctgcggatgcagctcaacagtcactgtgtgtgtaactctactagaacagcttacgccaatccccttactgcttatgcaacccaattggcgctcagaatgcaactctcctccctttgcgtgtgtaaccctgccaggtcggcctacgccacccaggtcgctcttaggatgcagttatcctccttatgtgtctgtaattccgcaagaaccgcctacgctacgcaattggctctgagaatgcaggtctcgagcctgtgcgtatgtaattcggcccggtctgcctacgccacccaactggctcttcgcatgcagctgagtagtcactgtgtgtgtaattctgcccgatcggcctatgctactcagcttgcactgcgtatgcagctgtcgtcgctgtgtgtttgcaattccgcccgcactgcatatgccacccgtacggcatatgcaacccagttagcccttaggatgcaactgaactcacattgcgtgtgcaactccactcgcacagcttgcgccacacaactgaccctgcggatgcagctgagcctgctgtgcgtctgcaactctacaaggaccgcctatgcgaatcaacttaccgcatatgcgacccaattagccctgcacatgcaacggaacagtacacatacagcatatgcaactcaactaacgctgtatgctacacagctggctctccacatgcagtttaatagtcactgcgtctgcaagtccacatactgcatctgtaactcgacccactgtgtgtgcaactcaacacgaaccgcatacgccacccaacttgccctgaggatgcagttaaatagccattgcgtgtgtaacagtgccaggaccgcatacgccactcagttgctccaggtcctgatctctgggcattttctctttcttaccaccaccccttcacagtatttctcttctctcaaaagtgcacaagatgaagcactggattcccgtacctgctgcatgcctctgggtctgttagaggtttgtagacttgcctccccccggcttcacccagctctcagctgtctatcttgcgaaaatccagtggccagcgctagcccaggcagcgatttctgtctcctgccgtccagcgcggccccacttggaccctgcttggagtag

SEQ ID NO: 51968 - DNA, 411 bp, Artificial Sequence
  Description of Artificial Sequence: Synthetic coding sequence
atgcggcaggaggtggagggccggggccggggcagccacgagctgattataactgataaacgctgtggcgtttgcggtggctctttgagttgtattgtgtacctctgtatcagtctaaatttctctcgaatcaaaaaactcaagaagtacacgtggcccggccccactcgtgattcccccaacgcttcattacaacccgggcgtgcgaagttcgcattttcccacgcctcccacaccccactccactcccagcttggcgcacttcagactgggaagccccaggccctccttgctagcgctaatccactcagcaggagcatgggaccaccggatcaccaccttaccacgctgatcctgatcagcctcgaaaccccctttccaggcctgctgtccagcggctgctttccgtag

SEQ ID NO: 51969 - DNA, 1008 bp, Artificial Sequence
  Description of Artificial Sequence: Synthetic coding sequence
atgcagctgctgggcctgctgggcctgctgtggatgctgaaggcctccccttgggcaactgggacactgtcgaccgctacctctatctctcaggtgcccttccccagggccgaggccgcaagcgcggtcttgtccaacagcccacactctagagacctagctggatggccactcggagtaccccagctagcctctccagcccctgggcacagggaaaacgcacccatgacacttaccacgtcccctcacgataccctgatcagcgaaaccttactgaactcacctgtgtcctccaatactagtactacacccacttccaaattcgcttttaaggtggaaactaccccacccacggtcctggtctactcggcaactacggaatgtgtgtatccaacttccttcatcatcactatcagtcatcctacatcaatatgcgtgactactacacaggtcgcctttacatcctcctatactagcacgcccgtaacccagaaaccagtgacgactgtgacctccacctattccatgaccacgactgaaaagggcacatcagccatgacgagcagtccatccacaacaactgcacgcgaaactcccatcgtgactgtaacacccagctccgtgagtgctactgataccacatttcacactaccatatcttccaccacccgaaccaccgaacggacgccccttcctacggggtctatccacacgacaactagccctactccagtttttaccactttgaaaactgcagtcacgagtacttctcccatcacttctagcataactagcacgaacaccgtgacttctatgacaacaaccgcaagccagccaacagccactaatactctgtcttcccccacacggaccatcctgtcgagtactcccgtcttgagtacggagaccataacttcaggaattacgaacacgacccctcttagtaccctggtcaccaccctcccgacaaccatttcacggagcacacctacttcagaaacaacgtag

SEQ ID NO: 51970 - DNA, 432 bp, Artificial Sequence
  Description of Artificial Sequence: Synthetic coding sequence
atgcggctgcagaagacccggtgcggcagcgccgccagcccccccaacaaacaacagacggaactcccggcgttctcagtgatgccccggcctgccggccagcatgtgtggccatggaggggcgagagaatgcgactccccggagccgcttcatccctgttcagcaattacttctcactgccttatgtgatttatctcagtatttcagacctgaatgttgaatgtctgatcttcagtgtatttgactcccaacaagtgcacacaagttatcagtctaacgggctgcatcggaatggcatgtttcacgattgtttggaagtatccaagcacccatttctgggactcactttgactctgtggctgtgtgaccttagctccagcgggttctacatgtcaggccatgaaccgctgtggaacctgtctccactgtag

SEQ ID NO: 51971 - DNA, 633 bp, Artificial Sequence
  Description of Artificial Sequence: Synthetic coding sequence
atgagccgggccggcagccaccccaagcccgccatccccggccgggggggagaaaaattagccctactactggcaatgttggggggccgttgctgtccagctggtggtcccgaatcccatacccccaggaagccttggccccctattcgacgagagcggcccggtctgagaagtcctaaacctcgggaagaagccgggccccgggccgattctaaagcagcaagtcctgccctcttcatgggacctggtagcaggggtcggagacggcccccttcttgggcccgaagacgagccagaggaggacgggggtcttgcccagagccccatgtgagggccggccccagattttttatcgccttggcagcccccgccgccaggggcttacgggtcagttcgcaagggcctggcctatggcggggtccagccgcccggaaggagggtgtggctagagtgggtgtcgctgccgggctgcggctccggcccagggggagagggaggaagaccacacctgctttatctggacatcctgcccggttccccctgcagcctggtgactcgcgggagcgctcaagaaaccacagagccttggaattgacgtggcagcctcggggagccaaggccggaggcgcgtag

SEQ ID NO: 51972 - DNA, 633 bp, Artificial Sequence
  Description of Artificial Sequence: Synthetic coding sequence
atgagccgggccggcagccaccccaagcccgccatccccggccggggcggagaaaaattggccctcctgctggccatgctgggagggcgctgctgccccgcaggcggccccgaaagccacactccacgaaagccatggccgcctattaggcgagaaaggcctggtcttcggtctcctaaacctagggaggaggccgggccacgcgctgacagtaaagctgcttctcctgccttgttcatgggaccggggagtaggggcaggcggagacccccatcatgggcccgacgcagggcccgtggaggaaggggatcttgccccgaaccacatgtcagagctggaccacggttcttcatcgcccttgctgctcaggcggccaggggccttagggtcagttctcaggggccaggtctgtggcgaggcccggccgcacggaaggagggggttgcacgcgtaggagtggcagccggcctccgactgcgaccccgcgggcgcggccgaaagactactcccgctcttagcggacacccagcgcgattcccactgcagcctggcgactcgagggaaagatcacgtaatcaccgagctttggaacttacctggcaaccgcgcggggcaaaagccgggggagcgtag

SEQ ID NO: 51973 - DNA, 1881 bp, Artificial Sequence
  Description of Artificial Sequence: Synthetic coding sequence
atgaagatgcagaagggcaacgtgctgctgatgttcggcctgctgttacatctcgaggccgcaactaatagtaacgagacctctacctcggccaatacaggcagcagcgtgattagttccggcgcatcgaccgctacaaattccggatcatcagttacatccagtggagtgtctactgcaactatttcaggaagttcagttacttctaatggggtgagtattgtcacgaacagtgagtttcacaccactagcagtgggatatccacggcgaccaatagcgagttttccacagctagctctggaatcagcatagccaccaactctgagagcagcacgacctcttcgggtgcctctacagccacaaatagcgagtctagtacccctagcagtggtgcatctacggttacaaactcaggttcctccgtcacaagttccggcgcaagcaccgccacaaacagtgagagtagcaccgtttctagccgcgcttctaccgcaaccaactcagagagctcgaccctgtcatctggcgcttccaccgctactaattcggattccagtaccacgtcaagcggagcctcaacagctactaactctgaatcaagcactacaagttccggcgcctccaccgctacaaatagtgagtcgtccactgtgtcgagccgcgccagtacagctaccaactctgagtcatccactacttcgtctggagccagcactgcaaccaattcggagtcaaggactaccagcaacggggcaggaaccgccacaaattctgagagctccacgacctcttccggcgcgtctactgcgacaaacagcgattctagcaccgtatccagcggcgcctcaactgccacaaactctgaatcctccaccactagttctggggccagtacagccacaaatagtgattcgagcactacctccagcggagctgggaccgctaccaactctgaatcgtcgactacaagtagcggggcctccaccgctaccaactcagagagttcgacaacctcctccggcgcttctacggctacaaattccgactcaagcactacatcttccggcgccggtacagccacgaactctgagagtagtactgtcagttcggggattagcactgtgactaacagcgaatccagcaccccatcgtctggcgccaatacggcgaccaactctgaaagcagtactacgagctcaggggccaataccgccacgaacagcgagagttccacagtatcttcgggggccagcacagccactaatagcgaatcttcaactacttcctcaggtgtctctaccgcgactaacagcgaatcctcaactactagctccggagcaagcacagcaaccaacagcgatagcagcacaacctcatcagaagccagcaccgcgaccaatagcgagtcatctactgtttcatctgggatcagcacagtcacaaactctgagtcctcgacaactagctccggggccaatactgcaacaaacagcggcagtagcgtgacctcggccggtagcggtacggcagctcttaccgggatgcatactacctcgcactccgcaagtacagccgtttccgaggccaaacctggcgggagcctcgtaccctgggagattttccttattacacttgtgtcggtagtggccgcggtgggtctgtttgccgggctgttcttctgcgtgcgaaactcactctctctaagaaatacattcaacaccgccgtgtatcaccctcacggcctgaatcacggactgggccccggccccggaggcaatcacggcgctccccaccggccaagatggtctcccaattggttttggcggaggccggtttcctctatcgccatggagatgagtggacggaactctggaccttag

SEQ ID NO: 51974 - DNA, 393 bp, Artificial Sequence
  Description of Artificial Sequence: Synthetic coding sequence
atggagggccgggaggtgtacctgtggtacagcgtggacagccggggagattttctggttttcctatgtccaattttcttttccttctcttttagtgaggtagagtctcttagccctagacttgagtgtagtgggactatctcagctcactgcaacctgtgtctgcttggctcttcctactcgcccgccagtgcctctagggtgaccggcataaccggaatgtgtcaccatgcacagctgatctttgtgtttctggtggagatggaatttcgacatgtggggcaaacttccttcgaactgttagctagttccagtcctccagccagcgcttcacagtccgcaggcataaccggcgttagccactgcgcttggccgttggcccagtatctttag

SEQ ID NO: 51975 - DNA, 459 bp, Artificial Sequence
  Description of Artificial Sequence: Synthetic coding sequence
atgcccgacctgaagatgcaggaggtgaagaagatctgctacgagctggctctggcctactttcatcacggccaggccgagattgaagccctcgccacgttaaaggtgtgggagctttgccacacatatggaaagcccgaggggccacgtgacgcctggcgtgccgtggccagggacttttgggacacagtcggtgaggaggagggtggaggagcaggcagcgggggaggatcagaagagggaaccaggggtgtggaggtcgaggatctgcaggcccatatctgcaaattaatgggaatactgcagcaggtgaagctgcagaactcatctaaagattgggagctgcaggcattgcaggatcgtatggtttgtatggagagaattatccccttggctcaggatcacgaggacgagaacgaggaaggtggcgagttccattgggctccaccggaaggatag

SEQ ID NO: 51976 - DNA, 498 bp, Artificial Sequence
  Description of Artificial Sequence: Synthetic coding sequence
atgagccacccccaggccaccagcaacctgcagcacaccgtgagcaacagtgacaatattggcagcagcgcgggtcggtggacatgggtgcccctgacgtggacagatacatctaagatgtcaatgcgcggcctcctagatttgttcagtttccactcctgtatccttaaaaacggttctgagccggaagaaccccaggactccgccaaaaccgatacacaactctctccagctacattggccctggagcgagaggaacatagttctaggcacgtgccttctgtcctctccaaaacgatgagtcgagcctccgccgaactgacttgtaccgctggccggcaggggcctggcccccccggcagccactcacaggccccgcatatgctcccacagcccgagcccctgctagcctgcgcacccgccatgtggtgtagacgcgagccacaaccaatagggggactccagcctcctcatttacgacttcacctggaatcctag

SEQ ID NO: 51977 - DNA, 375 bp, Artificial Sequence
  Description of Artificial Sequence: Synthetic coding sequence
atgctgcccagcaaggccttcgagttcgccaccgtgaagagcatgcacgggatttttggatgtggcctggctctccctcccgtgttcgctgcagagttgctctatttgactcgagcctgcgcaagcgacgaacagccatttattaccgcgctccgtccacctcctagaccccctcctagcgctctccagtttatctcccgtctcgtgcccatagctacgtgcgggctcgggggcccacccgacatcttaagtttcggctcacccgtgactcccgaactgctccccttttggggagctcacatctgcgatacattggtctgccctgtgcatttcctgcacctcgaatttctctcctgctctcacatatccatctag

SEQ ID NO: 51978 - DNA, 267 bp, Artificial Sequence
  Description of Artificial Sequence: Synthetic coding sequence
atgcggagccagggccagggcggccccggcgcctggcggcggatggaatcctggagtgcggaacccgctgggcctggtcaaggccgtcttgggtctccctgtgaggcggctgaacaggcttcttttgagaagacagtcatcggagtgggtcaggctcgggctgccctgagcgaggaagagcacagggtgtgggaggccgcggccggggtgggcggattggagcaatggggctgctgggaggccggggtcacgtctggatggggctag

SEQ ID NO: 51979 - DNA, 447 bp, Artificial Sequence
  Description of Artificial Sequence: Synthetic coding sequence
atgagcagcttcgtggtggtgatgggcttcctggtggagatgacctcccgcaagaaaaacaatgtgaaggaggaagaaatggagtgtgccgtcacctaccttaggaaggggggcggcatctgtagtttttatttttacttttacctttttttcatattcatctacttattcttcctgcgttggtccttggctcttagcccgcggctggagtggagcggggctatatcagcacactgcaatcttcgattgcccggctcgtgccacagtagcgcctccgcctctagagtagcggggactacaggagccagacaccatgcccttctgattttctatatcttcagtagagatggggtatcaccgtggtccaggagccctcacttagtcgtgtgtccaccctggccgccaaaggtcctgggcctccaggcaccggcaactacgcccgggtag

SEQ ID NO: 51980 - DNA, 375 bp, Artificial Sequence
  Description of Artificial Sequence: Synthetic coding sequence
atgaccctgaacgagcacgccgccttcaagcacctgttcaacaaggcacacctggcgccgcctcttatccatttgacactttctggtcactctacatgcttccgagagcacagagtgggtggcaaagttacagatcagcaggaccctaaggctgaggaattttttctggtgcagaacaagatgaaaagcctaccatgcctgttactcagcacccagacaaggcagccatctgacttctcaattttttctcctccctttcccccggtttattccactaagcccccactcagttcctggccagtcctgaacgagctgctaggcactccaccacggcggggggggggacgcgcagaagggttgttaacttcacagtag

SEQ ID NO: 51981 - DNA, 429 bp, Artificial Sequence
  Description of Artificial Sequence: Synthetic coding sequence
atgcggatccggaccagcttcttcatgagcgccgccctgggcggccgacctcccccagcccgtaccgaatggacacctttgactcgctcaactcacccaaccgcaccccctgcatctttattcggcagacgggggccccctcgtcgacccttatcctgttttcccgcccgcgagcccggacagcgacaactgcggttgctgcgcccgagtggactgtggcggaggcgccgcaggcgaaggagacggcgcaggcgccggaggcgccgggggaggcggcatgccgcacgtgatacgcgctttcggaacgccaacgccctttgtgccggcacagcgctcccactgtctggcaggaggagtgcaggaccagggtcacttgctcatccacccctgggaacagctactcctgaaactctggggccagggatctag

SEQ ID NO: 51982 - DNA, 1977 bp, Artificial Sequence
  Description of Artificial Sequence: Synthetic coding sequence
ctgaagaccccccccgagtgcgtgctgacccccctgccccccagcgctgatgataatctgaagactccacctgaatgcgtcctcacaccgctgcccccttctgcggacgacaacctcaagacccctccggagtgcctcctaacccctctccccccttctgccgacgataacttgaaaacgccccctgagtgcctgcttactcctctgcctccaagtgctgacgacaatctgaaaaccccaccagagtgtcttctcactccaccaccgccctctgcagacgataacctaaagacacgagccgagtgcctgttgcacccgctgccaccatctgccgatgataatctgaagacgccatctgagcggcagctcaccccattacctccctccgcaccgccctccgctgacgacaacataaaaacccccgccgaacgtctgcgaggaccacttcctccctctgccgatgataatctcaagaccccatctgaacgccagctcacccctttgcctccttcagcacctccctcagctgatgataatattaaaactcctgcattccacccccagcgcatgattatcagtcggcacctcccttctgtgtcttctttaccttttcacccacagctgcatagtcaacaaatgattatcagtcgctacctcctctcggtttgtggattccgcttccaccaccagcccatgattatttcaaggcacctgcccagcgtgtcctcccttcccttccacccccagcttcacccccaacaaatgatcatcagccggcacctgccttctgtctgcggtggtcgtttccatcctcaacggatgatcatatccaggcatctgcctagcgtgtccagcttacccttccacccccagcttcaccctcagcagatgatcatctcccgacacctgccttcagtgtgtggaggacgcttccacccccaacgtatgatcatatctcgacatttgccatccgtgagttctctcccattccatccccagctgcatccccagcaaatgatcatcagccgacatttgccttccgtctgtggcggtagattccatccccagcgcatgataatcagccgccatcttccctctgtgtcttctctgcctttccatcctcagctgcacccccagcaaatgatcatttcccgccatctgccatccgtatgtggtgaaagactgcgcgggccactcccgccgtccgcagacgacaacttaaagacgccatctgagagacagttaaccccactgccaccgtctgcgccaccaagtgccgacgacaatattaaaacgccagccgaacgcctgagagggccactcccacctagcgctgatgataatctgaaaacccccagtgagagacaactgactcccctaccccctagcgctccaccatcagctgacgacaatattaagaccccagccgagcgcctccgaggcccacttcccccatccgctgacgacaacctcaagaccccatctgagcgccaactgacgcctctacccccctcagcgcccccaagcgccgacgataacatcaagacccctgccgagagactgagaggtccgctccctcctagtgctgacgacaatttgaaaactccgcctcttgctacacaggaagcagaggctgaaaagcctagaaagccaaaaaggcaacgggccgccgagatggagccaccaccggagcctaagcgcagaagagttggcgacgtggagccctctcgaaaaccaaagcgccgtcgggccgccgacgtcgagccttcttcccctgagcccaaacggcgacgagtgggggatgtggagccctcgcgcaaacccaaacgaagaagggcagcagacgtcgagccgagcagccccgagcctaaacggcgccgcgtgggtgacgtcgaaccttcacgtaagccaaaacgcagaagagcggccgacgtcgagccctccctgccggaacccaagcgaaggcgcctgagctag

SEQ ID NO: 51983 - DNA, 588 bp, Artificial Sequence
  Description of Artificial Sequence: Synthetic coding sequence
atgaacagcgtgttccggcagcccggcagcaacttcagcttccccatctatcaaccctccgcctctgtgacccacggattgagcttcttttgcgaagtgtccccacagatgctcacaccacaggactacagaggcaaacagcagggccatcgcgggtgtcctggttgtatggttgcaatggacacatggccggccgtgttacccgaactgcccgggttctggggcgaaggcagcggtggccaagcctggggcgctcgaggcgaacctctgctacagaaggccaattgcctgctggaggccgtgcgtttatttctaaattataggccactaggggccgagggcggggagttaacttttggcaaaagactactggtgccaacagccgttagttgtgcttacgactgtgtcagtagcagcgccttcctgggaatccagctcctgggcgacccaacacgctcaccaggccattgttacaggcaggatttcaacggtaccctccgcttacgagaggggaaaggactagtacagtcccacactggaaccctgtgggccggccccctccaggaggggacccagggccagacctag

SEQ ID NO: 51984 - DNA, 453 bp, Artificial Sequence
  Description of Artificial Sequence: Synthetic coding sequence
atggccgtgagccggatgagcaagtggcggctgagccgggtgggcgggtcacgctcgctgcccgcggaaatggaggtgcttggtgaggtctggtgcgtgagagcggaggaacaacccatgacaggcctgggcatcgtgtggcattctcccctggacaaagccctagagacatggagcctgcagcaacagccggacttctccctcggccttggccacttggggttgggaacagacgctacctggatgcagagttttcctggaagcggcggagatgcccaggctggcaccggagtcagtggccccctgaggctgtacccaaatctgctttgcgactttgggcccagacagggccctttatgggccctccttctcgagaaacggcagatggctggtacaggaggcagtcccgctctcctggcttggcggtccgcatcctggcgcgcactcggctag

SEQ ID NO: 51985 - DNA, 342 bp, Artificial Sequence
  Description of Artificial Sequence: Synthetic coding sequence
atggccgtgagccggatgagcaagtggcggctgagccgggtgggcggtagccgctcattgcccgcggaaatggaggttttaggagaagtgtggtgcgtgcgggctgaggaacagccaatgactggccttggcatcgtctggcattctccccttgacaaagccctcgagacgtggtcactccaacagcaacccgattttagtctcggattgggtcacctgggtcttgggctgtatatattagcgagttacttgctgtgtccaagacagcctcctagtcaaccagatggtccgtgcggctcaccaaatcccgtctccggcgcaaaaaagactacagtggcatag

SEQ ID NO: 51986 - DNA, 228 bp, Artificial Sequence
  Description of Artificial Sequence: Synthetic coding sequence
atgcacatctacttcaccgccgagctgctgaagcggcggaacgccaagcctacattctctatgagctcaatgcaggcggctcgcagtataccaaaaagcatgaacgttcacagcatgccttctttcctttactccagttgtagttccaccaacatgtggtggttgaagaattgttgtagttttagcctggttaagctcatgcactcatgctctcggctcttgaactag

SEQ ID NO: 51987 - DNA, 561 bp, Artificial Sequence
  Description of Artificial Sequence: Synthetic coding sequence
atgtggaaccagcagggccggcccggcatccggaaccagttcagcctcttctttttcctcactcagtcgctggcccttagcttgcgtcttgagtgcagtggcgctatctcggatcattgtaatctccggctgttgggtagctctgattctagcgcctccgcctcgcgcgtcgctggaataatcgacgtgcggcacatgccgggccagcacggggagaccctgtctctcctgaaaatacagaaactggctggttgtgggggcagccatctgtactcacagctccttgggagactgaaatgggaggacgggctaagtagcgggggacgcggttgcagcgaactgaggggaagacactgtgcccctggttgggtcacggcaaggctttgtctcaagaagaaaaaaaaacgcggcggcggaaaaacaaaactttacagcgtggggttggagttcaacatatggaaagtcgacatatggaacgctctggtccctctggacttgtggttttcactgaagggtgagtccaggaccattgttttggagtcttcagaggtgcggacttag

SEQ ID NO: 51988 - DNA, 459 bp, Artificial Sequence
  Description of Artificial Sequence: Synthetic coding sequence
atgcccagccagccccacctgagcgcctgcagcgtggagagccccggcgctgccgcgcgacttacccaaagacacttgaccggcgtagcccggggcgggggtcagactggcacttttcacatggggctgctcccatcacgccaggagtgcgcccccgtaagcgccctgacactcaccacaacaatggggaggctcttctctgtccactggcagatttggggcccgtgcagcccttgcattgtgtatcctaaaggtgactctgagcaatcggccagcaaatccaagcaggccttcccactgctgctccggaaagggatggaatggcccctgagcgcatggttggagagttccagccctgcgccctgtatgcctctctggcgccgcaattccttctgggaaagccgcccaagtccttgtcgcatccgtggcctgtgcagcatgaggccacacggactctag

SEQ ID NO: 51989 - DNA, 84 bp, Artificial Sequence
  Description of Artificial Sequence: Synthetic coding sequence
atgagccccgccctgaccttcccccggcggtggatcgccgagggcctggtggagaatttgaaccctcccggcgccgatgcttag

SEQ ID NO: 51990 - DNA, 159 bp, Artificial Sequence
  Description of Artificial Sequence: Synthetic coding sequence
atggccgcccggagcctggcccggcgggccctgcgggtggccggcggtgatgcgagaagcggggggcctgtagccagagacacacagctgggagcccaatggaggtggatcgcagaggggttagtcgaaaacctgaatcctccaggcgccgacgcctag

SEQ ID NO: 51991 - DNA, 381 bp, Artificial Sequence
  Description of Artificial Sequence: Synthetic coding sequence
atgcccaacttcgccaagagcctgttcatccaccccatcaacttctttctcctctttagtaccgagttctgctctgtgtcccaggctggagtgcagtggagagatctcggctcacttcagccactgccctctcggttcaatagagtcagctgcctcagcctgccatcttcgtgggattaccggctcatgcctgtcatcccagccctttgggaagcaaaagccggcgggagccccgaggtacggggaagtcgcctggcctggagcaaatggcagaaccccgtatcaactaagaacaccaagaaaccgcagaattgccccgggatggtggcgcacgcatgtagcccaaactacagtggcgggggggggagacgcatcacttag

SEQ ID NO: 51992 - DNA, 501 bp, Artificial Sequence
  Description of Artificial Sequence: Synthetic coding sequence
atgaccgccggcaccgtggtgatcaccggcggcatcctggccaccgtgattctcctctgcatcatcgccgttctctgctactgcagactgcagtactactgctgcaaaaaagacgagagcgaggaagacgaggaggaacccgatttcgccgttcactctcaccttccacccctccactccaaccggaatcttgttctgaccaacggtcctgctttgtatcctacagcctctacttctttctcccagaaatcaccccaggctagggctctgtgtcgtagctgctctcattgcgagccccctacgttcttccttcaagagcctcctgaggaagaagaagatgtactgaacggtggcgagcgagttctgtacaagagtgtatctcaggaggacgtggaactgccaaggggtgccttcggcgggctgcaggccttgaatccaaatcggctttctgctatgcgcgaggccttcgcacggtccagatccatctccaccgatgtttag

SEQ ID NO: 51993 - DNA, 1164 bp, Artificial Sequence
  Description of Artificial Sequence: Synthetic coding sequence
atgtaccggtggaagctgagcagccacgagccctgcagcgccacctgtactaccggggtgatgagcgcttacgctatgtgtgtgcggtacgatggcgtggaagtggatgactcctattgcgatgctttgactcggccagagcctgtgcacgaattctgcgccgggagggagtgtcagcctcgctgggagaccagttcatggagtgaatgctcgaggacgtgcggtgagggttatcaattccgggttgtacgttgctggaagatgctgtcacctggattcgatagcagtgtgtacagcgatttgtgcgaggctgctgaggcggtgagacccgaggagcggaagacgtgtcgaaacccggcttgcggcccccagtgggaaatgagcgaatggagtgaatgcactgccaagtgcggcgaacggtccgtcgtcactcgcgatattcggtgctctgaggatgagaagctgtgcgatccaaacactcgacccgttggcgagaaaaactgcaccgggcccccttgtgaccgccagtggaccgtatctgactggggaccctgctctggaagctgcggccagggccggaccatccgccatgtgtactgtaaaacctcagacgggcgggttgtgcccgagtcacaatgccagatggagaccaaaccattagctatacacccttgtggggacaagaattgccccgcccactggctggcacaagactgggagaggtgcaataccacgtgtggacgcggcgtaaagaagaggctggtgctttgcatggagctagctaacggcaagccgcagacccgaagtggcccagagtgcgggctcgccaagaaaccccctgaggaatcaacatgtttcgagcgaccttgtttcaagtggtatacctcaccctggtctgagtgtactaagacctgtggagttggggttcgcatgcgtgacgtgaagtgttaccagggaactgacatcgtccggggatgcgatcccctcgttaagcctgtcggaagacaagcgtgtgaccttcagccctgcccgacagaaccacccgacgacagctgtcaggatcagccagggacaaattgcgcactggcgataaaggtcaatttgtgcggccattggtattactcaaaggcttgctgcagatcctgtcgccccccacactcctag

SEQ ID NO: 51994 - DNA, 672 bp, Artificial Sequence
  Description of Artificial Sequence: Synthetic coding sequence
atgttccccgtgagcagcggctgcttccaggagcagcaggagaccaacaagtcactcccaaggtcggcaagtaccccagaaacaagaacaaaattcactcaggataacctgtgccacgcacaaagggagaggctggactctgctaacctgtgggttctagtagattgcatcctccgcgacaccagtgaagacttaggtctccaatgtgatgccgttaatctggcatttggtaggcgctgtgaagagctcgaagatgtaaggcacaaactgcagcaccacctccacaagatgttgcgcgaaatcaccgaccaggagcataatgtggtagcactgaaggaggccattaaggataaagaggagccactacacatcgcccaaacccgcctatatttgctgtctcacaggccaaatatgcagctgtgtcgtgaggccgcccagttctctgccgtgggggaggcgagtaggagaggtgccgtacctctacagcctaggggtcacccccacgagcctggtgaaggatgctaccgtcacgatcaacagagtctgcaccgcccccccgaggtacacggcccttcgtacttgctgcatccacaccctgctgcaggatggcttcccgtcagtagcgggacagtgctgcctcctaatcccccaaacaaacagtgcattagctag

SEQ ID NO: 51995 - DNA, 390 bp, Artificial Sequence
  Description of Artificial Sequence: Synthetic coding sequence
atgttccccgtgagcagcggctgcttccaggagcagcaggagaccaacaagtccctgcccaggagtgcctcgacccccgagacacggaccaaatttacccaagacaatctctgccacgcacagagagaacggttggactccgcaaatttatgggtgcttgtcgactgtatcctgagggacacttccgaagatctgggtcttcaatgtgatgcagtaaatctggccttcggaagacgctgcgaagagctcgaagacgcccggcataaactgcaacatcatctgcacaaaatgttacgagagattaccgatcaggagcacaatgtagtggccctcaaggaggccatcaaggacaaggaggagcctctgcatattgcccagacacggctgtag

SEQ ID NO: 51996 - DNA, 528 bp, Artificial Sequence
  Description of Artificial Sequence: Synthetic coding sequence
atgcggctgcccggcgcccccgccctgcccgacgccgacttcctggtccatctgcactttctggtgcagactagctggttcatctgcaacttcctggtacgtattccctgggcctccgcattgcccgatgctcctgctcttctggttatcctggagaagaccttcccagaacacgccacatgcaggggctgttgggtgtccgggtacttatgctggactgccccaggcaattgcatttgttccgctaatgttgggttccttaaaattgaaaatacctaccggcaaatacaccacacccatatgcaccgccacactcacactcatacagacaagtccatcactcatacctgcacagacactcacactcaaagtcaacgccaccggctgacctcccgggcattaagactattcatcctcaacgcaatcacagacactagcaagttcggggctgccgtgttcttttacgtctactgtttattcgccgactctgtctacaaattctttccattcctaccgcctttcagatag

SEQ ID NO: 51997 - DNA, 1941 bp, Artificial Sequence
  Description of Artificial Sequence: Synthetic coding sequence
atggaggtgatcaacctgaccaccctgcccatgatccccgtggacgaacacctggccgtctccctagtggctagaaacactatggtgaagactgtacgcaaagaactggagaataacccccctagctgtttgatcggtagcatgcatcaagtgaaccagaagatcgccgacatcaaccttaggactgagccaagcgccaacagccttgcaattgagaggttcgaacttgagaagaaagctcttcgcgaaaagacaagaagctctccagaagacaaggtaaagaggcaacggaagagccagtactcctgcaaaggcagtgagctcaggcacgccagaagttccgtgataaaacgaaaaacggctgacaaaaacttactggctgaattataccagtatagcaatttcaacagttcgaagccaaataaacttccaaacggtgtggatttctgtgatatggtcggaaatgtggtgagggccgagcgagactgtttgtcagggaaacacttctgttctggaagagagctggagaaatttctatcaagctcgtcacccagagcaatttggttagattctttttggtggatatttcacgaaagatatcagcccaacaaggagctgcaaaataacctcttcgatagaatcgcacagcattacgccctcctcctctttcgcgtccctaagtcccacagcgaggaagccttgctgaagcgtctgccgagcttgttgagcaaggccgtttatacatccttttgttgttgctttcctcagtcctggttcgacacccacgagttcaaaagtgacatctgcaataccatgtccctctggatatccgtggggacttacccctcaccccagtcatacgattcctgggattatagtgagttggatcccgaacgcttcaggagggaagagttaatgctgtatagacgcagattgacaaaggggcgagagttttcgctgtttgctgggaaacgagccttctcgcagaagcccgcccagagccggaagttttaccatccccagagttctagcgcgaacagtccctcagaaaagacatcgagcgctaagcagaactccgaaaaatccctgcgcatgcagaataccgctaaggaacaccattgccagacactcgtgctgaagaaaccaactcaagaagtcaaacgtatcagtgaggcaagagagtgcgaaaacatgtttccaaagaaaagctgtgccgcttgtaagagtcccgagctgactagcaatctcttcaacatatatggaaagagccctttgatcgtttactttctccaaaactacgcttcactgcaacagcacggcaaaaacgtgctcattgtcaggcgggaaaagacaactagcacaccagactgcactcccacttataccgacgtaatatccgagaccctgtgctcaatgaagaaacggaaggacaatctgaatcagctgtaccagcatcattggacggaatggaactatttcgacaagcatctgaaagagctgcaggataacttctcacgcgagatgaaaaacattgacccaaaggctgcggatactaagaaggctaaccacatgtttatcccaccatcagctgtcaatgaggagtcacctgacaagaaaacaaaggggagtctccaacgtgaaatcgaatttaaagggtgttctaataagaaccacgggaaaggccgctccgtgaacatgcgtggaaaagaggagagggaacgagaggagaagcagaaactcaacatctcctttcactccttaccatcgcccgaggagctacataatttggagccaggctcggcataccgcatcagagacatctcagctacccgtacaccactgaggagaccatcgtcttgggaaccaagtcttatataccaggagcaggtgcttctgaaaacacacaccctgtccatggaggaagataagttccgatgctag

SEQ ID NO: 51998 - DNA, 876 bp, Artificial Sequence
  Description of Artificial Sequence: Synthetic coding sequence
atggacgtggtggaggtggccggcagctggtgggcccaggagcgggaagacattatcatgaagtacgaaaaagggcatcgcgccgggctaccagaagataagggaccaaagtcgtttggttcgtataataacaacgttgaccatctgggcatagtgcacgaaacagaactgccccctctcactgcgagggaggtcaagcaaatccgtagagaaatctctcggaagtctaagtgggtcaaaatgcttggggaatgggatacgtataaaaacagccgcaagttgatcgatcgggcctaccagggtattcctatgaacattaggggacctatgtggagcgtactcctcaacatcgaggagattaagctgaaaaacccaggtagataccaaatcatgaaggagaaaggaaagcggtcatctgagcacattcagcagatggacctcgatgttagtggaacacttagacggcatatattcttccgcgaccggtatggaactaagcagcgggagcttttatatattctccttgcctatgaggagtacaatccggaagttggttactgccgggacctgtcccacatcgccgccttgtttctcctgtatctgcccgaagaggatgctttttgggccttagttcaattgctggcaagcgagcgtcactcgttacaaggcttccatagtcccaatggtggcaccgtgcagggactccaggaccagcaagagcacgttgttgctacctcactccctaatacaatgtggcaccagagtgcctcgcgacgaaggcccggggtggccagaggtcacgtgtttggcactggatctctaatgcctggaccagggatgatgaccctttgttcatctatccttgggcccctgtag

SEQ ID NO: 51999 - DNA, 420 bp, Artificial Sequence
  Description of Artificial Sequence: Synthetic coding sequence
atgttcctgctgaagaagagcagcgagaagggctggtaccccgtgaaagaaagtcgagatcgtggtccacgccggtggagccaagggttgtctaggaagaaacggacctttccgaccaagtcatggagaaaaaaaacaccgggccttctgctcccgttgccaagcgggtggcagcatgggagcttacgcgccggacaagtgctccacctggacggagccgggggcgattctgaggcagacgtgctcatgatgctccgacgcttgataaggggacaggtgaaggggaccctcggctggagagtgggtatcgcggttcccacgactccaacactaggcggatgcccacggcgtttggaggtgtggtggtggctgctgctgctcttactgctgctgctgttgctcttattattgcttttgtag

SEQ ID NO: 52000 - DNA, 666 bp, Artificial Sequence
  Description of Artificial Sequence: Synthetic coding sequence
atgagcgccctggtgttcttcccccccagcagccccctgcccatcgcattttttccccccagttcacctctgcccatcgcattctttcctccctcaagcccactcccaatcgtattcttcccatcactgttcagcatctttctgccccccccttacccgcacctgttgctcgcggccgcaagcagttgtagagcctttttaagcccccatcatttgctcttcctcttccctaccgtgctgtctccgcgcccacttctgtcccttagctctccccgagccttccctacaacagtcttcagtccggtcttttttccctcgcaccggtttttaccaatgtcttcccataggcttgctgccgcctctgtgagccggaatctgcttccaacattcttcagtccccccccgattgtgttcttccctcagcctctgattctgaggcacttgttgccgctgccaacattcagccagcagcggcttcctgctgctttcttctcccctcgtacactattcagtcccctacctctccccaccgtattcgcgccagatcgcttgctagctcatcccctgctcgccttgagcaactgtctctccccgcgctccgctccgcgagttaggcctccagtcagcctgcgtctggtgtgtctgtgtgctcagccagctccatag

SEQ ID NO: 52001 - DNA, 1749 bp, Artificial Sequence
  Description of Artificial Sequence: Synthetic coding sequence
tgacccggccccaccagcagcgccaccaacgtgagcatggtggtgtccgccggtccactctctagtgagaaagccgagatgaacatccttgaaataaacgagaaacttcaccctcaacttgcagagaagaagcagcagtttcgaaacctaaaagagcgctgttttgtgacccagcttgcaggcttcttggccaaccaacagaaaaagtacaagtatgaagagtgtaaggatttgattaaatcaatgcttcggaacgaaaggcagtttaaggaagagaagcttgcagagcaactcaaacaggcagaggaactcaggcagtataaggtgctggttcacgcccaggagcgggagttaacccagctgcgggagaaactgcgtgaaggaagggacgcgagtcgcagcctcaacgaacacctgcaggccttgcttacccccgacgagcctgataagagtcagggacaggatctccaggaacagctcgccgagggctgccgtcttgcgcagcacctagtgcaaaaattaagccccgagaacgacaatgatgatgatgaagacgtgcaggtggaactggccgagaaagtacagaagtcctcagctccccgcgagatgcaaaaggcagaagagaaggaagtcccagaggacagccaggaagagtgcgcaattacctatagcaactcccacgggccatacgatagtaaccagccacacaggaagactaagataacttttgaagaagacaaggtggattcaactttgattggaagtagcagccacgtggagtgggaggatgcggttcatatcatcccggagaacgaaagcgacgatgaggaagaagaggaaaaaggcccagtttccccacggaatttgcaggagagcgaggaggaagaggttccacaggaaagttgggacgaaggttattctaccctatctatccctcctgagatgcttgcaagctaccagtcatactcctcaacgttccattccctggaagagcaacaagtgtgtatggccgttgatattggcagacatcgctgggaccaggtgaaaaaggaggaccaggaggctactggaccccgactctctcgggaactcttagatgagaaaggacctgaagtgctacaggattctttggaccgatgttattccacccctagtgggtgcttggagttgacagacagctgtcaaccctataggtcagcattctacgtgttggagcaacaacgggtggggctggccgtcgatatggacgaaatcgagaagtaccaggaggttgaagaggaccaggacccgtcctgccccaggttaagtagggaactgctggatgaaaaagagccggaggtgctccaggacagcctggacagatgttattcaacgccttccggatacctagagctgccggacctgggtcagccttattctagcgcagtgtactcactggaagaacagtacctggggctggccctcgacgtcgacaggaccaagaaggatcaggaggaggaagaagaccagggaccaccctgtccccggttatctagggagctgctggaggtggtggagcctgaagtactacaagacagcttggatcggtgttactctactccaagctcctgcttagagcagcctgattcttgtcaaccttacggttcctccttttacgcgctcgaggagaaacatgttgggttcagcctggatgttggcgaaattgagaaaaaggggaaagggaagaaacgacgcggaagaagatcttag

SEQ ID NO: 52002 - DNA, 474 bp, Artificial Sequence
  Description of Artificial Sequence: Synthetic coding sequence
accctggccgaccaccggcaccggggcaccgacttcggcggcagcccatggctgctgattattacggtcttcctgaggtcttacaagttcgctatatccctgtgcactagctatctctgcgtgagcttcttgaaaacaatctttccaagtcagaatggtcatgacggtagtactgatgttcagcagcgcgccaggcgaagcaaccgccgccgccaggagggcattaagatcgttctggaggatatcttcactctatggagacaggttgagactaaggtgcgagcaaagatctgtaagatgaaggtaacgaccaaggtaaaccggcacgataaaatcaatggcaagcgtaagactgccaaggaacatcttcgtaagttgagcatgaaggagcgagaacatggggaaaaggaacgacaagtgtcagaggctgaggaaaacggtaagttggatatgaaggaaatccacacatattag

SEQ ID NO: 52003 - DNA, 516 bp, Artificial Sequence
  Description of Artificial Sequence: Synthetic coding sequence
atggccgagatgcgggcctggcggcccctggtgcggcccagcctgcagtgtgtcaagctgggtcgagccacagccagatggtggtgggtggtcaaggtgaaacctcatgataaggacgcaaagatgaagtaccaggaatgtaacaaaattgtcaaacagaaagcttttgagcgcgcaatagccggcgacgaacataaacgttcggtggtagacagccttgacattgagtccatgaccatagagggggaatattcaggaccaaagctggaggacgacaaggtgaccattacatttatgaagggactgatgcagtggtataaagatcaaaaaaagctccaccagaaatgcgcttatcaaggccttgcactgagtccgcgcctcaagtgttcaggcaccatcaccgcccactgctctctgaacctgttgggccctcgcgacccaccaacatccgcctcacaggtggcggtaaccgagggcatgcatcatcacacatggctgatcttcctgttcctgtag

SEQ ID NO: 52004 - DNA, 96 bp, Artificial Sequence
  Description of Artificial Sequence: Synthetic coding sequence
atgctggaggccatcctgggccccgtgagcaacagcctgtacgtgagcggaaaaacctgccacggcagtcggagcgtcttctctagcgccaaatag

SEQ ID NO: 52005 - DNA, 225 bp, Artificial Sequence
  Description of Artificial Sequence: Synthetic coding sequence
atgagcaaggcccacccccccgagctgaagaagttcaccgacaagaaatttagcctcaagcttaatggaggccgccatgtgcaggggatcctccgcgggtttgacccattcatgaatttggtgatcgacgagtgtgtcgaaatggcaacatccggccagcagaaaaacatcggaatggttgagatccggggtaactcaatcatcatgctcgaggcactggagtag

SEQ ID NO: 52006 - DNA, 1893 bp, Artificial Sequence
  Description of Artificial Sequence: Synthetic coding sequence
atggaccccagctggcggcggagcagccacagctggccccagcccatgccagattctggacgggcccctgtgaggccacatctggccaaattagaagaggatgtgtggccctgcccgcagttccatcagaccaaggcagcaagtggcccaccatttgtgaatgaagccaactccaaatggctggatgcacactacgatccgatggcaaatattcacacctttagcgcctgtttagccctcgcagatctacacggcgacggtgaatataagctcgtggtgggcgacctgggccctggtggccagcaacccaggctcaaggtattaaaaggcccattggtcatgacagaaagcccactgcccgcactgcccgccgctgccgcgacctttctgatggagcagcatgagccgaggacccctgccttggctctggccagcggtccttgtgtctacgtttataagaatctgagaccctatttcaaattctccctcccacagctgcccccaaacccccttgagcaggatctgtggaaccaggccaaagaggacagaatcgaccctcttaccctgaaagagatgcttgaaagcattagggaaactgcagaggagccgctctccattcagtccctgaggtttctgcagctggagcttagcgaaatggaagcctttgtcaaccagcacaagtccaactccatcaaacgccaaacagtgatcactaccatgaccacactcaaaaaaaacctggccgatgaagatgccgtgtcgtgtctggtcctgggaacagagaataaggagctgctggtcctcgatcctgaggcgttcacaatcctggcgaagatgtcgctcccaagcgttcccgtattcctcgaagtttccggccagtttgatgtagagtttaggctagccgctgcttgcagaaatggaaatatttacatcctgagaagagacagtaaacatcctaaatactgtatcgaactgagtgcccagcctgtcgggctgatcagagtccacaaagtgctggtggttggatcgacccaggatagtctccatggatttacacacaaaggcaaaaaactgtggacagtccagatgcccgccgcgattttgaccatgaacttactcgagcaacatagtaggggactgcaagccgtcatggctggcctagccaatggagaagttagaatttaccgagacaaggctctgttgaacgtgattcacacacctgacgctgtcacaagcctgtgctttggcagatacggtagggaagacaacacacttatcatgaccacgagaggaggaggcttgataataaagatcttaaagagaaccgccgtgttcgtggagggaggctctgaggttggacctcccccagcacaggccatgaagttaaacgtgcctaggaagaccagattatatgtggaccagacactgcgagagagggaggccgggactgcaatgcacagggctttccagacagacctgtacctactgcggttacgcgcggccagggcctacttacaagctctcgagtctagtctgagtcctctaagtacaaccgcgagggagcccctcaagcttcacgctgtagtacaaggcctgggcccaacattcaagctgactttgcatttgcagaacacatctactactcggccagtgctgggtctactggtgtgcttcctctacaacgaagccttgtacagcctcccccgcgcatttttcaaggtgcccctgctggtgccaggtctaaattacccgctagagacatttgtagaaagcctcagcaacaaggggattagtgacattattaaagttttagtgttacgcgaggggcaaagcgcgcccctccttagcgctcatgtgaatatgcccggatcagaaggccttgcggcagcttag

SEQ ID NO: 52007 - DNA, 474 bp, Artificial Sequence
  Description of Artificial Sequence: Synthetic coding sequence
atggtgggccggatgaagctgctgcccaaccggatccggaccctggcattaactgcaataggtgtcgtgctgctgggcgtggatgatcctggtgccccttctgaccaggtggaagtacatctcgaactggacctccccacccagttgacatctgtttggcaggtgatgagtactgttcctcttgctcccctaccaggacagcttagtctgttgggcccaccaggcgcccttgggttccctcagcagggcggcccgacccagctgccgctactgctgcgagaggtcggggtggaacacaaggagcatataggcggaaggcgatgcggaggccctcgccctgcgctgtccagctacccaggccaccttctgctgcagggtccccgcgtccttcagccattgggcgagaggccaggccacctgcaaaatcatgccgctcagggcaaaggcgatttaggacagtcggactccgaatag

SEQ ID NO: 52008 - DNA, 738 bp, Artificial Sequence
  Description of Artificial Sequence: Synthetic coding sequence
aaggagggcgaggaggaccagaaccccccctgcccccggctgagccgcgaactcttggatgaaaaagaaccagaggtactccaggactctctggaccgctgctactcaactccatcaggatacctggagttgcctgacctgggccagccctatagcagtgcagtctacagtcttgaggagcagtaccttggactcgcactggacgtggatagaacaaaaaaagaccaagaggaggaggaggaccagggccccccttgtccccgtttgagcagagagttgctggaagtggtggagccagaggtgctacaagattcactcgaccgctgttattcgaccccctccagctgtctcgagcagcccgatagctgccagccctatggaagtagtttttatgcccttgaggagaagcacgtggggttttctctagacgttggggagattgagaaaaaaggcaaaggtaagaagcgaagggggagaaggtccaaaaaggagagaaggaggggcagaaaggagggggaggaggatcagaaccccccatgtccgaggcttagtcgtgaattactcgatgaaaaaggccctgaggtacttcaggactctttagaccggagctactcaacccccagtggatgcctcgaactgacagattcatgtcagccgtatcgctctgcgttctacgttctggagcagcaaagggttggattggcggtcgacatggatggcgaatatctctcgatgtag

SEQ ID NO: 52009 - DNA, 258 bp, Artificial Sequence
  Description of Artificial Sequence: Synthetic coding sequence
gagatgcagaaggccgaggagaaggaggtgcccgaggacagcctggaagaatgcgcgatcacttgctccaatagccatggcccttacgactccaaccagccgcatcggaagacgaaaatcactttcgaggaagataaggtggactccacattaatcggctcctcatcccatgtggagtgggaggacgcagtccatattatccctgagaatgagtccgatgacgaagaggaagaagagaagggtcccgtcagcccatag

SEQ ID NO: 52010 - DNA, 927 bp, Artificial Sequence
  Description of Artificial Sequence: Synthetic coding sequence
atgcacacccaggtgtgcgcccacacctacatccggatgcaccggcacctgtgcacccatatgcaaatccatcctcaacatccaatatgtgcgacccaccgacacaggtatatggagactgacgcacatacaggcctatgcactcacatacgtatgcaccgccacctgtgcacccatatgcagattcacccacagcaccccatatgtgccacccaccgccataggtacatgaagactgacgcccatactggactctgcacccacgtgtgcatgcaccggcatctttgtactcacatgcagatgcatcctcagtatccaatttgcgccacacaccgccacacatatatggagactgacgcccacaccgggctttgtactcatgtacacatgcaccgacacctgtgtacccacatgcaaatgcacccacagtaccctatctgcgccatccatagacacacctacatggagactgacgctcatacagggctctgcacccacgtgcatatgcatagacacttgtgcacccacatgcagatgcaccctcaatacccaatctgtgcgactcaccggcatacctacatggaaactgacgtacacactggcttgtgtacccatgtccacatgcatagacacctttgcacccacatgcagatgcacccacaataccctatctgtgcaactcatcgtcatacctacatggaaacagacgctcacactggactgtgcacccatgttcacatgcaccggcacctgtgtacacatatgcaaatgcatccccagtatcgcatctgcgctacccagacatatgtgcacggcgaccggtgtacgtaccgctcgatgcatacatgcacccatgcgcaggctccgggacacaccctatatctcctcatttgttctagcccgccctgtcgattgttgggcagatag

SEQ ID NO: 52011 - DNA, 300 bp, Artificial Sequence
  Description of Artificial Sequence: Synthetic coding sequence
atgtgggagcactggctgggcgacagcggcgtgggcctgctgatgcgactgcgtagtgacgtgagtcaggtgtgcttgcagctaaacgcctgtgtcgaggtcgaagatccgctaccaggctggttaacacattgcctgcctggcagggccggatgttggtgggaagcaagcgttcctttccacggatgcttccaatactcttgtggaatcccacccgaacaagtcatgaaggagaataaggccgaagccgcggtactttttacagcgtccttccggtctcacgtgccgagcgacctctag

SEQ ID NO: 52012 - DNA, 315 bp, Artificial Sequence
  Description of Artificial Sequence: Synthetic coding sequence
atggccgccctgatcccccagggcttcagctgcctgagccgggtgttaggttggtggagcaggcagccagtgctggtcacccaaagtgcagctatcgtgcctgtccgaactaagaaacgcttcacatccccgatttaccagcccaagttcaagactgaaaaggaattcatgcaacatgcacgcaaggccggactggtcattcctccggagaaaagtgaccggtccattcacctcgcttgcacagccggcatattcgatgcctacgttcctcccgagggtgacgctagaatcagctcactgagtaaggagaggtag

SEQ ID NO: 52013 - DNA, 366 bp, Artificial Sequence
  Description of Artificial Sequence: Synthetic coding sequence
atgagcctgaccttccggcggcccaagaccctgcggctgcggcggcaacctcgatatccgaggaagtccactccaacaagaaacaaactgggccactacgccatcatcaagttcccgttggcaacggagagcgcagtgaaaaagatagaggagaacaacacactggtctttacagtagacgttaaagcgaataaacaccagattaggcaggccgtcaagaaagtgtatgacagcgatgttgctaaggtgaccaccctgatctgtcccgataaggagaagaaggcatacgtaaggcttgccccagactatgatgcctttgatgttgtgacaaaacttgggtcccctaagttatccccagcgggttag

SEQ ID NO: 52014 - DNA, 1569 bp, Artificial Sequence
  Description of Artificial Sequence: Synthetic coding sequence
atgtggccccagccccggctgcccccccaccccgccatgagcgagaaaacgcagcagggaaaactggctgcagccaagaaaaaactgaaagcgtactggcaaagaaaaagcccagggattccggctggagccaatcgaaaaaaaaaagttaatggctctagtcccgataccgccacctctggtggttatcacagtcctggggatagcgccaccggcatctacggagaggggcgcgcttcttctaccaccctgcaggacctggagagccagtaccaagaattggccgtcgcgctcgactcttctagcgctattatatcacagttaactgagaatattaacagcctagtccggacctcgaaggaggagaaaaaacacgaaattcacctggtgcagaagttaggcaggtcgcttttcaagctgaagaaccagactgccgagccactagcccctgagccccccgccgggccatccaaagtggagcaactgcaggacgagacgaaccaccttagaaaggaacttgaaagcgtgggccgtcaactccaggcagaagtggaaaataaccagatgctatccctgttaaacaggcgccaagaggagcgccttcgcgagcaagaggagaggttgcacgagcaagaggagcggctccacgaacaggaggagaggctgtgtgaacaagaagagagacttcgcgagcaggaggaaaggttaagggagcaggaagaaagactaagagaacaggaggagaggctccacgaacaggaggaacggctccatgaacaggaggagaggctttgcgaacaggaagagagactccgagaacaggaggaaaggctttgtgagcaggaggaaagactccgagagcaggaagagcgtctgtgcgaacaggaagaaaggctgcgcgagcaggaggaaagactgtgcgaacaggaagagaggctatgtgaacaggaagaacggctttgcgagcaggaaaagctaccagggcaggaacggcttctagaggaggtggaaaagttactggaacaagagcgtaggcaggaggagcaggagcgactcctggaacgggaaagactcctggacgaggtggaagaactcctggagcaagagagactgcgccagcaggatgagaggttatggcagcaggaaacactgagagagctggaacggcttcgggagttggagcgcctaagggagctggaaaggatgcttgaactcggatgggaagcactttatgaacagcgagccgagcccagaagcgggtttgaggagcttaacaacgagaataagtcaaccctacagctcgaacagcaggtgaaggaattggaaaagtctggaggagctgaggagccgagaggcagtgagagcgctgctgccgctaggccagtccctggtgctccagtacctcagggtgcttggatgtgtgggcaggcaggatggaccccccaggagcaccccggtctgagcggcgaagcggtgggcaccggagaggccgctggcggagcggaggaagccgcctgtcatagctttcgagcagcagaaaaccgcgaattgaacatcacaattatatag

SEQ ID NO: 52015 - DNA, 783 bp, Artificial Sequence
  Description of Artificial Sequence: Synthetic coding sequence
atgctgcggaacgagctgcagttcaaggaggagaagctggccgagcagctgaagcaggctgaggaacttaggcagtacaaggtgctggttcactcacaggagcgcgagctgacacaactgcgcgagaagttgcgcgaggggagagatgccagcagatctctgaacgaacacctacaggcattgctgacccccgacgaacccgataagtctcagggccaggacttgcaggagcagctggctgagggctgcaggctggcccagcacctggtccagaaactgtcccctgaaaatgatgaagatgaggatgaggacgtgcaagtggaagaggatgaaaaggtgttggagagcagctccccacgagaaatgcaaaaagccgaggaatccaaagtccccgaagactctctggaagagtgtgccattacctgtagtaattctcatggcccgtgcgattcaaatcaaccacacaaaaatataaagatcacgttcgaagaagataaggtaaatagctcactcgtcgtcgatcgcgagtccagccatgacgaatgtcaggacgcgttaaatatcctgccagtgcccggtcctacctccagtgcaaccaacgtgagcatggtcgtgagtgcaggtccattgagctcggagaaggccgagatgaatatcctggagatcaatgagaagctgcggcctcagctcgctgagaaaaaacagcagttccggtcgctcaaggaaaagtgtttcgtcactcaggtagcctgcttcctggcaaaacagcagaacaagtattag

SEQ ID NO: 52016 - DNA, 303 bp, Artificial Sequence
  Description of Artificial Sequence: Synthetic coding sequence
atggccaagaacaagttccggggccagaagagccggaacgtgttcagaatcgctagccaaaaatcgtttaaagccaagaacagggtgaaacctattacggctaacttaaaaaaaatacatattatgaatgatgagaaagtgagtagggtgaataaggctttcggatccgtccaggaggaacttccccacttttccaagggcctctctctggatctgttgcagaaagaactaatccctcagcagcgccaccagtcaaagcccgtgaatgtggacgaggctactaaattaatggctcagctctag

SEQ ID NO: 52017 - DNA, 1659 bp, Artificial Sequence
  Description of Artificial Sequence: Synthetic coding sequence
atgctgaagagccggatcagcatgcggagccggcacccccggcgggccatctccgaggggcacaagtccgagggcaccatgccccctaataaggaagcctcaggcttgtccagcagcccagccggcctgatatgcctgcctcctatctccgaggaattgcagttggtctggacccaagctgcccagaccagtgaactggattcaaatgagcacctcttgaagacattttcctacttcccctacccttctttagcagatattgcacttctgtgtctccggtatggcctgcagatggaaaaagtgaagacttggtttatggctcagagactacgatgtggtatttcctggtcatccgaggaaatcgaggagacacgcgcccgtgtggtgtatcggagagaccagctacacttcaagagcctcctgtccttcactcaccatgccggccggccacctgaggaggtgcctcctccgcccgtccctgccccggaacaggtgggcatcggtattggcccacctactctgagtaagcctacacagacaaaggggctgaaggtcgagcccgaggagccttcccagatgcccccgctcccccaatcccaccaaaagctgaaagaatcccttatgacgcctgggtcaggcgcattcccttaccaaagcgatttttggcagcatctgcaaagttcaggcctcagtaaggaacaggccggtcgcggtccaaaccagagtcacggtatagggacggcctcctggaatcacagcactactgtcccccagccccaggcgcgggataagcctcctccaatcgcactgatagcctcctcatgtaaagaggaatccgccagcagtgtaaccccgtctagctcctcgacttctagctcatttcaggtgcttgccaatggggccaccgccgcatctaagcctctccagcctctcgggtgtgtgcctcagagcgtatccccatcagagcaggccctgccaccacacctcgagcctgcgtggcctcaaggccttaggcataatagtgttccaggccgggtcggaccaactgagtacctaagcccggatatgcagaggcagagaaagaccaagagaaagaccaaagaacagctggcgatcctgaaatctttctttcttcagtgtcaatgggcacgccgcgaagactatcaaaaactcgaacagatcactgggctcccccgccccgaaataatccaatggttcggagacacaaggtatgcccttaagcatggccagctgaagtggtttagggacaatgctgtaccaggcgcacctagctttcaagaccccgccattcctacgcccccaccatcaactaggtccctcaatgagagagctgaaaccccccctctacctattccacccccgccccctgacatccaacctcttgagcgctattgggccgcccatcagcaattgagagagactgatattccccagctctctcaggcttcaagactctctactcagcaggttttggattggttcgatagcaggctgcctcagccagccgaggtagtggtctgtctagatgaagaggaagaggaggaggaggaggagttacccgaggatgatgaggaggaggaggaagaggaagaagaagatgacgatgatgacgatgacgatgtgataattcaggattag

SEQ ID NO: 52018 - DNA, 528 bp, Artificial Sequence
  Description of Artificial Sequence: Synthetic coding sequence
atgaaggtgaccaccaaggtgaaccggcacgacaagatcaacggcaaacgaaagaccgctaaagagcacttaagaaagttgtcaatgaaggaaagagagcatggggagaaggagagacaggtgagtgaagctgaggaaaatggaaagctggatatgaaagagatacatacctacatggaaatgtttcagagagcacaagccctgcgccgcagagctgaggactactatagatgtaaaatcaccccttctgctcggaaacctctttgtaacagagtatccctcctggtatttctggctttcggacactctctccccgggcaggatatggacacatttttcagcctcagactgtgtgcacaggcgctgcagagggagatggctgaaagaaaagccgcgtataagcaccactccccaattcctgtcgggaacagggtggcccagaaacatttgcacccacatcccgttgggcccccatccaatattctgagcgtgcggggctcgatattcgtgatagccaacgggccgtag

SEQ ID NO: 52019 - DNA, 228 bp, Artificial Sequence
  Description of Artificial Sequence: Synthetic coding sequence
atgagcaagctggtgtacctgtacatgctgcgggtgtacatcagcaacataaattctaattctgtggtatacatatttatctccatccctgtgacccattcactggacaactggacctttttggtttccttcgagataggaaagtacgagtcctccaactttgtgctctttcatgactactcaggctatgtgcgccctttgtctattccgtacgagctcgaggggtag

SEQ ID NO: 52020 - DNA, 390 bp, Artificial Sequence
  Description of Artificial Sequence: Synthetic coding sequence
atgctgtgcccctgcatccaggagagcaccttcgagacctgcctgtttatggccgtttctcggatgtctaaatggcgcctgtcacgggtgggcggatcaagaagcttgccagcggaaatggaggtgcttggagaagtttggtgcgttagagccgaggagcagccaatgaccgggctcggcatcgtctggcacagccctctggataaagccctagaaacctggagccttcagcaacagccagatttttccctgggtctgggccaccttggcctgggcttgtacatcttggcatcatatctcctttgtccccgacagccacccagccaaccagacggcccatgtgggagtccaaaccccgtgagcggcgcaaaaaagactacagtcgcttag

SEQ ID NO: 52021 - DNA, 288 bp, Artificial Sequence
  Description of Artificial Sequence: Synthetic coding sequence
ggccggaaggagggcgaggaggaccagaaccccccctgcccccggctgaactccgttttaatggaagttgaagagcccgaggtcctgcaggatagtctagatcggtgttattcgacacccagcatgtacttcgaactgccagattcctttcagcattatcgctccgtcttctactcattcgaggagcagcatattagcttcgctctggatatggacaatcggttttttactctcactgtcacgtcactccatctagtgttccaaatgggtgttattttcccccagtag

SEQ ID NO: 52022 - DNA, 543 bp, Artificial Sequence
  Description of Artificial Sequence: Synthetic coding sequence
atgggcctgggcgccgtggagcaggaggccgccctggccggcgaggcccccgccgcacaagtgccaacagagggtgtgggaggttccgggatggcaggctgtcgttcccgagctctgccacttggcaaggctgctcgggcccccggagagattgaaagatctgctggaggcagtgccctgctgggggacccagtgcatcccccccaacctctggcccgagtgctttccccgtctcttcctggagccggccgggcctgccgactcctgagggttcgggcggcaaagctcacaccaactcagaatagctcttggccagcatccgtggcctgctcaccaggatcttgtagccatctgagcctgcatacctctctgcaggccgagggcgctggatccggtttgggcaaaccgagaaagggattaccgcagtgctccgggggcctaaaaggatcatctagtgccgctaaggtgggcgcccaggcggaggaggctccgagggcttctgagggctcagaagattgccagcatgcagtaacttcccactag

SEQ ID NO: 52023 - DNA, 390 bp, Artificial Sequence
  Description of Artificial Sequence: Synthetic coding sequence
atgctgtgcccctgcatccaggagagcaccttcgagacctgcctgttcatggctgttagcagaatgtccaagtggcgcctgagcagagtcggaggctcacggagcctgcccgctgagatggaggtcctcggagaggtgtggtgcgtgcgggccgaggagcaacctatgacaggcctgggcattgtgtggcactcgccgctcgacaaggcattggagacatggtcgctacaacaacagccagacttttctcttgggcttggccacttaggcctcggactttacattctggcgagctacctgctgtgtccacgccagcccccctcgcaaccagacggcccttgtgggagtccaaaccccgtgtctggtgctaagaagaccactgtggcgtag

SEQ ID NO: 52024 - DNA, 417 bp, Artificial Sequence
  Description of Artificial Sequence: Synthetic coding sequence
atgatcttcccccagatctacctggactacttcaagatgcggcaggattattgccagagtctcaacgtgtggagttatcttccctggatcttcttcagcttcgggctcggtttcatcaacaacctgaatatcatttcttatcgaattacaaaggaagaggtgaacttgatccacctgcggttgcagccaaaaatccaatccaactcatctttttctctctcctgcttcttttttatgttcttactgcttattgctgccagaatcctgcacaggatctcaattgaaatgtacgaaatcctctggagcttgcacgtgcgcatagcccagtacgttactattcagtttcagagggagcccactttcgtccgcttcaccgatcagggggtcgtggaagaagtggaactgcagatacgttag

SEQ ID NO: 52025 - DNA, 504 bp, Artificial Sequence
  Description of Artificial Sequence: Synthetic coding sequence
atggagcaggagcacatcccccactggatccagaccagcgccttcagtggaggtctgggacggagctggtgtaagattcgatgcatggcacgtgcaggacttcccgtgcatatggtgaatggagaccccgataccggccgtcccctgcttaccgcccccggtgcaaaacagccccctagagggtggcgcaggcaagcaggatcctcttgttctagagcacgcggcgtctggcgaggggccctggcgtctcggcagggggctcagcggggcagcaaaggtccgggagtgagtcatcagtcctatggggtggagggcctggggagttctgtatgcccagtgacttggcacctgcgggccctgccccggcagctatgtgatgccagccaccagacggcctgcatcaagtcaggagtgtgttcaagcctcaaatggagacggccagaagcgctggacaggagaagccacatcctagaaggttctgtgctaggtcatcggtgtccctag

SEQ ID NO: 52026 - DNA, 1158 bp, Artificial Sequence
  Description of Artificial Sequence: Synthetic coding sequence
atggcctacctgggcccctaccccaccagccggcagcccccccagatgagattgctgccccataatagtcttcacaggcactcaagtatcgtgaccatggcttctctggacccggccccagcctcccaacccagcttgcaggccctaaatttcctgaaatctaccagcccaggccctgctcacgcatcacttcaacctttgcaggcgcaactgctgcatctgggggggcccagcaggcctagcctgtgtcttcctagtgcttccaccgttccaacttcagcttcccagcaaattctgcacgcccagcaccttccccattgcggcccccctaaaccaagttctcaacctttttcttccttctatactccctcttccagactccccgtggcctcctccggcccttgggggagcttcttaactacggccttccctggcccggttttccctttcaggcgcccgctgcgcgcacagaatctgctcaagtcagctagtcccgatcccctggccccgagcgggagaagcctgagggcacagctgttcttcttggtgggcagtcctggccctatccccgctagtcaacagccactctggactcagtgtcttccaatcagctggaggccgtggagtgcacacagtttcctgaagccatcaagtcccggacctgggcaggcaagccgctggcctctacaagatgaactactaccctctgatgggatcagccgaccacagatggtgagcgggaggtgggctccaccccggcaaggttgggcgagcaggcgacctccccaggcacaagtggttttgaagtccggctcccccggacccgccagccagcaggtcagcaagctgttttggctcaacagttgtccggccccaaataggttatgtcggcccaggacattttcatcccaggctctgagagctcatttactaccacctggcggtctgtatagctcctctacaggctggaggacagcttccgccgggccatcacttgcttctcaaggcccgttgcaggcccagctcctcccaccccgacggcctcccggagctaagtctctaccggccagccagcagcccgcatgcgggccagctcctccaagccggtggcccgtcgatgctcaactgatgccacttgcgccgtgccccgaagcttag

SEQ ID NO: 52027 - DNA, 423 bp, Artificial Sequence
  Description of Artificial Sequence: Synthetic coding sequence
atgggcggccccgagaccaagggcctggagggcgacccccacatgcaccactttctgctattcacagtatgttgggagtcttcacgggccctctgccagatgccacaggaagagaaccctccacaatgcacagtcaaggacgacaccgcgctattgccgaacgataccagaccttcttggtgcctatatatggtcgacgcaggctctgtcgggccaagtgtgctcgggcttgtgcggcgggagtcaactcaggaacagtctgcttcagagcgatcatcagtcgctcctcctgccggcgcgaatagagacagtcacagacctctcgccgactggccaaccctgcctacctccctcctgacaagttcactggtttttcagaagggtgagactactattaaggataaacgcaagggacgatattag

SEQ ID NO: 52028 - DNA, 375 bp, Artificial Sequence
  Description of Artificial Sequence: Synthetic coding sequence
atgacccccaacgagcaccccgccttcaagcacctgttcaacaaggcacatctcgcaccccctctcatccatctgaccctgagtggccattccacttgcttcagagagcatcgggtaggcggaaaagtcacagatcaacaggatccaaaagctgaggaatttttccttgtgcaaaacaagatgaaaagcctgccctgcctgctgctgagcacccagactcgtcagccaagtgacttctccatctttagtcctccctttctaccattttattctacgaagccaccattgtcttcctggcccgtgctaaatgaattactggggaccccaccacggagggggggtgggagggcggaaggtctgcttaccagccagtag

SEQ ID NO: 52029 - DNA, 465 bp, Artificial Sequence
  Description of Artificial Sequence: Synthetic coding sequence
atgggcctgtggcagcagatcagcaactgcatgcccgacctggccctttgtagcgacataaagttctttctgagatgcctggagaggtggctaaatcggaactcttctgccttgcagttgccggccaggagtactcaaaaggagatcatcagcgcattccctactaaggtgccgtcctcatcacactgggactggctggatagtggctgttcaccacagaaggcctcgcgttctagagtgggatgttgcttaaccagagaggcccaaggtgtgagagagctacctcccctagccaaagggtcctgtgagggactgtgcagagaagagcggggcattcctgcccagattctctgcttcccccatggcctatgcaacccccaaacccggcggttcccctgggtcccagcaccacctggcccatgggtatcttcaaagaaacttggcagtcacctgggacgccactag

SEQ ID NO: 52030 - DNA, 168 bp, Artificial Sequence
  Description of Artificial Sequence: Synthetic coding sequence
atggtgcagagcgccagcgtgagcaaggccggcaagggcagcagcagttcacatggagttgccgcagccttgaaccaggatctggatcctgatcctaagtgccatgtgtttaatgttagttcccagcgctgtcagatgggctcagcacagccttgtttgtgttgctag

SEQ ID NO: 52031 - DNA, 621 bp, Artificial Sequence
  Description of Artificial Sequence: Synthetic coding sequence
atgcaccacaacaagcaggccaccgagaacgccaaggaggaggtgaggaggatactcggcctcctcgacgcgtacctcaaaacaagaactttcttggtgggtgaaagggtgacattagccgccgaacctaaagccaaagacccatttgcccacttgccgaagtccacattcgtcttggacgaatttaaaagaaaatattcaaatgaggacactttatccgtggcactgccatacttttgggaacactttgacaaagatggatggagcttatggtactccgagtacagattcccagaagaactgacccagacgttcatgtcttgtaacttgattactggcatgtttcagaggcttgacaagctgcgtaaaaacgccttcgcctcagtgattcttttcggaaccaacaattccagcagcatcagtggagtatgggtgttcaggggacaggagctagcttttccactgagcccggactggcaggtagactatgagagttacacgtggcgtaagctggatcccggcagggaggaaacacagactctggtaagagagtacttttcatgggagggcgcattccagcatgtcggcaaagcctttaatcatggcaagatatttaagtag

SEQ ID NO: 52032 - DNA, 498 bp, Artificial Sequence
  Description of Artificial Sequence: Synthetic coding sequence
atgagctgcagccggagccggagcctggaggccagcagcagccggggcactctgcccgcaagctgggtccgcggaagccggtgcttaggatcaagcttcgcagatgaaggacaagccccactgcacgcggacagaccccgattttttggaaccgtcctgacctcctttccgagcgaaaaactggccgcaaaagctttgttatggggtgctctgaacttttttctggggcccaattggtctgagtccgagtttccatggccaagcttccttcctatccttggtgccggaggcgctgttgacttccttccccgtgatctcttcattatcttcctgtgctcagtgctgccacggccatccgctgtccccgctagccctccatcccccttttctcttctcccccccttccccacccttcctttatccccctttagcctttcacgtatcttaggatgctctaaccaacgcgcggtgtcccttttcttcccacactactgttag

SEQ ID NO: 52033 - DNA, 1158 bp, Artificial Sequence
  Description of Artificial Sequence: Synthetic coding sequence
atggcctacctgggcccctaccccaccagccggcagcccccccagatgcggctgctcccccataacagccttcaccgtcactcctccatcgtcacgatggctagcctggaccccgccccagcgtctcaaccttctctgcaggccctgaattttctgaaatcaacttctcccggccctgctcatgcttcacttcagcctctgcaggcacagttgttgcacttaggtggacctagccgccctagcctttgtctgccgtcggcgagcaccgtgcctacctctgcatctcagcagatccttcatgcccaacaccttcctcactgcgggccgccgaagccctccagccagccattctcatcattctatacaccatcatcacgcttgcccgtagcctcctccggcccatgggggagctttctgaccacagcctttccaggccccgtgttcccctttagaaggccactcagggcccaaaacttgctcaaatccgcatctccagaccctttggccccatcgggtcggtcactgcgcgctcagctcttctttctggtgggatctccgggacctattcccgcgagccaacagcctctctggacacagtgcctgccaattagttggcggccttggtctgctcactcattcctcaaaccgagctcacccgggcccggtcaggcctcaagatggcctctccaggacgaactgctcccatcggatgggatttcacgtccacagatggtctctggaagatgggcccctcctcgccagggctgggcatccaggcggctgccccaggcgcaggtggtgctgaagtcaggaagccctgggcctgcttcccagcaggtgtctaagttgttctggctgaactcctgtccagccccgaatagactatgcaggccgagaaccttcagtagccaggccctcagggctcatctgctccctccgggcggactctatagtagctcgaccggatggcgaactgcttctgcagggcctgcactcgcctcacagggtccactgcaagcccaattacttcctccccgacggcctcccggcgcaaagagtctgccggcctctcagcagcctgcctgtgggcctgcccctccatccagatggccagttgatgcccagctcatgcccctcgccccatgtcccgaggcctag

SEQ ID NO: 52034 - DNA, 510 bp, Artificial Sequence
  Description of Artificial Sequence: Synthetic coding sequence
atggtgccccgggcccccccctgcgcctggctgcggcccggccggcgggctcaggccggagagggccccagagatccaggaaatgctgcctggaggacacggaggaccggtttcccagaggccaccgggcccgcacgccacctgcagcttctgtatgtcgactttgggcgatggacccacggtagacctgttccgttatgccgagcgggatggaggccacagtgccctggtgccgcagctgctcttggactcgccggattgggggaccatatttggccacccgggcgtactgtgccccaggatcctcctgcctgggcgccgccctccagcctggcccatagcctgggagctccggttggcgccggggcagctggatgcccgtgcggtcccgctattcatcggccagcccatgcagccagtccaagcacctgtctgccaacaccacctcagccgccaacaagtcacctcgaagaaactatgggcccagctcccccagctcccggctgctag

SEQ ID NO: 52035 - DNA, 783 bp, Artificial Sequence
  Description of Artificial Sequence: Synthetic coding sequence
atgggcgacaacctgtggctgggcctgcgggcccaggacccctggagggctctgagacccgctcagtccccccgcgcgtgcagaccgcacgctgactgtggcgatcaaggattcaggaggaaggcgcagacccctcagcttaatcccccaactgaccataaggtgccagagcaaagggatgaaggcgccgtgcatttgttgtcccgacctggccgtgcacgtccccagattcgcagagcgccagcaccacataattctcgaactaccaccgctggcggcctcccatccatccgtcccgggcgccctgaacctccccccgcactgtctgaccacttgggggcggggctgagcgtcctcagccaggacggcgcggtgagaatcccaccacaggggttacctgacttgctagaactccgacgggacgctccaaccctagagtcgcgccccgcagccgctgcccttagtctcctatttcaggccgcctctagcgcggccaggcgggcaatgtctcctgcccaagaaacctattcctcttccccgcatcccctgcgccgactagataggtttaggcccctcgaggccacttggggtgggcctcactggaagccactcccaggcattcattctgtgccaaaagcctacagcaccgagaatagccgctcaggaagatgcaaacccggtctggttggagcatgtcgagctagccctactcccgacacacccccaggcgtgggcgccgagcagagctctggccagcctttgaccaccaggtgccgcacatag

SEQ ID NO: 52036 - DNA, 1224 bp, Artificial Sequence
  Description of Artificial Sequence: Synthetic coding sequence
atgtacaacgccttctggaaccacctgaaggagcagctgctgagcaccccccccgattttacatgcgctcttgagctcctgaaagacgtgaaggagaaccgcttgcggaacgagatcgaagaggccctggatactgatttgctgaagcaggaggcagaacacggtgctctggacgtgccccacctttctaactacattttaaacctgatggccctcttgtgcgccccagtgcgggatgaagctatccagaaattggaaaccattcgcgacccagtacaactgctgcgcggcattcttagagtactgggactgatgaagatggacatggtgaattacactatccaatcctttagaccctacttgcaggagcacagcattcagtacgagcaggcaaaatttcaagaacttcttgacaagcagcctagcttattggactacaccacaaaatggttgaccaaagccgcgacagatattacaaccctgtgtccaagctctcctgattccccaagcagcagttgttcaatggcttgcagcctgccctccggcgcaggcaataattctgagcccccaagccccaccatggtcctctatcagggctacttgaatttgctgctgtgggatctagagaacgtagagtttccagaaacgctcctgatggatcggatccggctacaggaattagcttttcagctccatcagctcaccgtgcttgccagcgttttgcttgtagctaggtcattttcaggcgaggtgttatttaggtcccctgaattcgtggatcggctgaagtgtaccaccaaggctttgactgaggagtttatctctcggcccgaggagaccatgctgtctgtctctgagcaggtgagccaggaggtgcaccaagggctcaaggatatgggattaactaccctttcgagtgagaacaccgccagcttgctaggacagctccagaatataaccaagaaagaaaattgtattcgctctatcgtggatcaatggattcggttctttctaaagtgctgcctccttcatggaatgcaggagtccctgctgcattttcctggggggctgattctgattgagaaagaacttgccgagcttggttggaagtttttgaacctcatgcatcacaatcagcaggtgtttggaccatattacgccgagatacttaaacatataattcaccccgcacaggcccaagagacagatgtcgagcccaactag

SEQ ID NO: 52037 - DNA, 390 bp, Artificial Sequence
  Description of Artificial Sequence: Synthetic coding sequence
atgtgctgcaactactacggcaacagctgcggctacggcagcagctatggatgtggttatggaagcggttatggatacggctatggtagctcctacgggtgcgggtacggtaccggctacagttgtggatatgggtgtggctacggtagtggatacggatgcggctacggaagcagctacggttgtgggtacgggacagggtacagctgcggctatggctcaggttactcctgtgggtatggttcaggatctggctgcggctatggcacaggattcggctgcggctacggttgcggctatgggaccggctatggatgcgggtgtggtagcggatctggatactgtgggtacagacctttctgcttccgcagatgctactcctcctgttag

SEQ ID NO: 52038 - DNA, 144 bp, Artificial Sequence
  Description of Artificial Sequence: Synthetic coding sequence
atggccctgccccagggcctgctgaccttccgggacgtggccatcgaattcagtcaggaggagtggaaatgtctcgatccagctcagcgcacattatatagagacgttatgctcgagaactataggaaccttgttagcctgtag

SEQ ID NO: 52039 - DNA, 1170 bp, Artificial Sequence
  Description of Artificial Sequence: Synthetic coding sequence
atgctgctgccccccggcagcctgagccggccccggaccttcagctctcagcctctccagactaagcttatgacccataatggactgttccggcctattccttatgtgacggctgcgtcagcagacgaggcgaccgcttctcagcagcctccacaggctcaattgcaccgctataatggattattccgaccttctagttgtctccccgcctttagccctggccctgagctctcacaggtagatctgacgcggccctcttcgtgttttttcgctgcctctcccggcccagcccctgccagttggtggcccctccaggcccagcctctgccccccgtcagcctatactcacctaacgtatgcctgacagctgatagctctcggcccgccagcacctccctgtggactcctcaggctaaattgcctacgttccagcagctgctgcatacccagctcctgcctccatcaggcctgtttcggccatcttcgtgtttcacaagggcattcccaggccctaccttcgtgagctggcaaccctcattggcccgcttcctgcctgtctcacagcagccccggcaagcacaagtgctaccccacacaggactgagcactagttcactgtgccttaccgtggccagtcctggccctactcctgtgcctggcaggcatctgagagcccagaatctgctgaagctggacagtctcgtacctaccgctgcctcatggtggccaatgaaggcccagaacctgcttaaactgacttgcccaggacccgcccccgccagttgccagcgcctccaagctcaaccacttccgcacggcggttttagcaggcccacaagttcttcatggctgggactgcaggcacagctcctgccacacaattccttgttctggccatcatcatgccccgcgcacggaggacagtgtcgacccaagaccagctcaagccagactctgcaggcgcatttgttgctgcccggcgggattaatcgccctagtttcgatctaagaacagcaagcgcgggccccgctctggctagtcagggactgtttcctgggccagcgttagcctcatggcaactcccccaggctaagttcttgcccgcctgtcagcagccgcaacaggcacagttactcccccactcaggcccgttccgccctaatagctag

SEQ ID NO: 52040 - DNA, 780 bp, Artificial Sequence
  Description of Artificial Sequence: Synthetic coding sequence
accagcctgtggaccccccaggccaagctgcccaccttccagcagctgctgcacacgcagctcctccccccaagtggcctttttcgaccatcatcgtgttttacaagggccttccccggacccacatttgtgtcctggcagcctagcctggctcggttcctcccagtctcccagcaacctcgtcaggcccaggtactcccccacaccggtctttcaacttcctctttatgcctaacggtggcatcccccggtccaacaccagtacctggtagacatctgcgcgcccagaatctcttgaagctggatagcctagtcccaacagctgcctcctggtggcccatgaaggctcagaatttactgaagctcacatgtcccggtccagccccagcgtcatgtcagcgtcttcaggctcagccactgcctcatgggggattcagcaggcctactagctctagttggctgggcttgcaagctcaactcttgccccataatagcttgttctggccttcctcctgtccggcccatgggggacagtgtcgaccaaaaacaagttcaagtcagacattgcaggcccatttactcctgccaggcgggattaacagaccctcgtttgatcttcgtactgcctctgccgggcccgcactggcttcgcaggggctttttccgggccctgcactggcttcatggcagcttcctcaagctaagtttctgccagcatgccagcagccacagcaggcgcagcttcttcctcattcgggcccctttagaccaaacagctag

SEQ ID NO: 52041 - DNA, 1791 bp, Artificial Sequence
  Description of Artificial Sequence: Synthetic coding sequence
atgaagatgcagaagggcaacgtgctgctgatgttcggcctgctgctgcacctggaggctgcaacaaattcaaatgaaacatccacgagtgctaacaccggcagctctgtcatctcctctggtgccagtaccgcgacaaactcaggctcttctgtcacgagttcaggcgtcagcaccgctacaataagtggttcctccgtcacatcgaacggtgtgagcatcgtcaccaattcggagttccacaccacatctagtggaatcagtacggctactaacagtgagttctccaccgccagctcaggtataagcatcgctactaacagtgaatcaagcaccacatctagcggagcaagcactgccaccaattctgaatcctctaccccatcttccggagcatcgacagtaactaattcaggttcttctgtcacttctagcggtgcctccaccgccaccaacagcgaatcaagcactgtgagtagccgcgccagtacagcgaccaactcagagtccagtaccctatcctccggagcaagcaccgcaacaaattcagattcatccacaacaagctccggggcttcgacggcaaccaactctgagtcatctacaacgtcctccggtgccagtactgctacgaattccgagtcatccaccgtgagtagcagggcgagcactgccactaatagtgaatcatccactacaagctctggagcgagtactgcaaccaatagtgaatctcgaacaacctccaacggtgccggcaccgccacaaattccgagtcttccactacttcaagtggcgcttccaccgccacgaactccgacagctccacagtgagctccggagcctcaacagcaactaattccgaatcaagtacgacctcttctggagcctctactgccacaaactctgagagttccactacaagctctggcgcaagtactgcaaccaacagtgatagcagtacaacgtccagcggcgcaggtactgctactaactcggagagctctaccgtttcctccgggattagcaccgttaccaattctgaatcctcgaccccgtcatctggagctaataccgccaccaactccgaatcctcaacaacttccagcggtgcaaacactgccacgaactcagaaagtagtaccgtgtcctcaggcgccagcacagctaccaattccgaaagctccaccacatctagcggtgtcagtactgccactaattctgaaagttccacgacctcatcaggcgcctccactgctaccaattccgactccagcaccacgtcttctgaggccagtacggccacaaactccgaaagttccacagtgtcctccggcatcagcacagtgacaaacagtgagtcatccacaactagcagtggggctaataccgctacgaatagcggcagctccgtgacctcggccggctccggaacagccgcattgaccggcatgcatacaaccagtcactccgccagtaccgcagtctctgaggctaaacctggcggcagcctggtcccttgggagattttcttaatcaccctcgttagtgtcgtggccgcagtcggcctgtttgccggactgtttttttgtgtgaggaactccctctctctgagaaacacatttaacacagcggtctaccatccccacgggctcaatcacgggcttggccctggtcccggcggcaaccacggagccccccaccgcccccgttggtcccctaattggttttggcgaaggcccgtctctagtatcgcaatggaaatgagcggcaggaactccggaccttag

SEQ ID NO: 52042 - DNA, 1434 bp, Artificial Sequence
  Description of Artificial Sequence: Synthetic coding sequence
atgctgttcagctgggtgaagcggcagcggaagagccagtacagctgcaaaggaagcgaattgcggcatgcaaggtcctctgtgattaagcgcaagactgccgacaaaaatctgttggctgagctgtaccagtactctaattttaactctagtaaaccaaataagctaccaaacggggtggatttctgtgacatggtaggaaatgtggtgcgagccgaacgcgactgcctgtctgggaaacatttttgctctggacgcgagcttgaaaaatttctgagcagttcctctcctcgtgcgatttggttggacagcttctggtggattttccatgaacgttaccagcctaacaaagaattacagaacaacttgttcgacaggattgctcaacactacgcactgctgctatttcgtgttccaaaatcccactcagaagaggccctgttgaagaggcttccttcactgctctccaaagccgtctatacgtctttctgctgttgctttccacaaagttggttcgatacgcacgaattcaaaagcgacatttgtaatactatgtctctctggatttcaggtacttacccgtctccacagagctatgattcctgggattattccgaactggaccctgaacgtttccggagggaagaactgatgttgtatcgccgccggctcacgaaagggcgggaatttagcctgtttgcgggcaaacgggccttcagccagaaaccagcccaaagtagaaagttctaccatccccagtcctcatcagccaatagcccctccgaaaaaacatcttccgcgaagcagaactccgaaaagtcattgagaatgcagaatacggccaaagagcaccactgtcagactctggttctcaagaaacccacccaggaggtgaaacggatttccgaggcacgggaatgcgagaatatgtttccaaagaagtcatgcgcagcctgcaagagtcctgagctcacgagtaacctgttcaacatatatggaaaatctcccctgattgtctatttcttgcagaactacgcttctctgcagcagcacggcaagaatgtcctgattgtccggcgagagaagacaacctccgcaaccgattgcacacccacctacaccgacgttatttcagaaaccctctgcagcatgaaaaagaggaaggacaacctcaatcagctgtaccagcaccactggactgagtggaattatttcgataagcatctgaaggagttgcaagataatttctcacgcgagatgaagaacatcgatccaaaagccgccgatactaagaaggctaaccatatgtttattccgcccagtgctgttaacgaggaatcccctgataaaaaaacaaaggaaggcaagggaggagaagggaagcgcagagaaacagaagttgagcacttcttcccacttactagcaaaccatag

SEQ ID NO: 52043 - DNA, 546 bp, Artificial Sequence
  Description of Artificial Sequence: Synthetic coding sequence
atgagcgagctgcccttcaccatcgccagcaagcggatcaagtacctcaggattcagcttaccagggatgtgaaggatctgttcaaaaaaaattataagccactgctgaatgaaatcaaagaagataccaataaatggaaaaatatcccttgttcatggataggcagaataaacatcatgaaaatggcgattctaccgaaggtgatttacaggttcaacgcaatccccattaaactacccatgacgttcttcactaaattggaaaaaaccactctgaagttcatctggaatcagaaaagagcgcttatagccaaaaccattatctccaagaagaataaagccggcggaattaccctccccgattttaagctgtgttacaaggccacagtgacaaagacggcctgctgctggtatctgaatagggatatcgaccaatggaatcggactgaagtgagcgaaattaccattcacatttacaatcacctgatcttcgataaacctgacaaaaataaacaatgggggaaagactccctgtttaacaagtag

SEQ ID NO: 52044 - DNA, 1737 bp, Artificial Sequence
  Description of Artificial Sequence: Synthetic coding sequence
atggccgaggagacccagcacaacaagctggccgccgccaagaagaagcttaaagaatactggcaaaaaaactctcctagggtgccagccggggctaaccggaataggaagacaaatgggagcatccccgaaaaggcaacatctggcggctgccagcctcctagagatagcgccacagggttccacagggaagggcccacttctagtgcaacactgaaggatcttgagtctccgtgccaagagcgcgctgtggttctagacagtcgtagcgttgagatcagtcagcttaaaaataccatcaaatcactcaagcagcagaaaaagcaggtggaacatcagctggaggaagaaaagaaggccaataataaaaaacaaaaggccaagcgggtgctggaagtccagatccaaaccctcaatatacagaaagaggaacttaatacggatctttaccacatgaaaagaagcctccggtattttgaagaaaagtctaaggacttagctgtgagactccagcattcactgcagagaaaaggagaactagaatcagtcctatctaacgtgatggccacgcagaagaaaaaggccaaccaacttaaagaatccttccagcaggtacagctggaaagggatgagtactccgagcatctcaaaggggaaagagcacgatggcagcagcggatgcgcaaaatgtcacaagaaatctgcactctgaagaaagaaaagcagcaggatatgcgacgggtggaaaagctcgagcgatctctatcaaaactgaaaaatcagatggctgagcccctcccgccagaacctccagcggtcccaagcgaagtcgaactgcagcacctgcggaaagaactggagcgggtcgcgggagagctgcaggcccaggttaaaaagaatcagcggattagtctattaaaccagagacaggaggagagaatacaagaacaggaggagcgattaagaaaacaggaagaacgcatccaggaacagcataagagcctgcagcagctcgcaaaaccacagtcagtttttgaggagcccgagcacctcgaagccgcgtcacagcagaatcagcagttgaccgcgcaattatctctcatggccctgcctggcgaagggcatggagagcacctggattccgagggcgaagaagcacctcaacctatgccatccgtccctgaagatcttgaaagccgcgaggcaatgagttcatttatggaccacctgaaggaaaaggctgacttaagcgaacttgtgaaaaaggaattgtgttttattcaccattggcgagatcgtaggcaccagaaaacgcatcatttgctgagcgagcccggaggctgcgctaaagacgcggccctggggggcggtcatcaccaagccggcgcacaggggggtgacgagggggaagcggcgggcgccgccgcagatggtatcgccgcatatagcaactacaataatgggcacaggaaatttcttgccgcagcccataaccccgccgacgagccaggtcccggggccccagcacctcaggagttgggagccgcagacaaacacggcgatctgagggaagtcagcctgacctcctctgcgcaaggggaagcccgcgaagacccactgctagacaagcctaccgctcagccgatcgtgcaagaccacaaggaacacccaggcctgggctccaattgctgcgtacccctgttctgctgggcctggctgccaagacgccgcagatag

SEQ ID NO: 52045 - DNA, 1824 bp, Artificial Sequence
  Description of Artificial Sequence: Synthetic coding sequence
atggccgaggagacccagcacaacaagctggccgccgccaagaagaagttaaaagagtactggcaaaagaattcacctcgcgtcccggcaggcgccaacagaaatagaaaaaccaacggctcaatccccgagaaggcaacctctgggggatgccaaccacctcgcgatagcgctacaggttttcaccgcgaagggcccactagctcggccacactcaaagacctcgagagcccttgtcaggagcgtgcggtggttcttgatagcagatcagtggaaatttctcagctcaagaataccatcaaaagcctgaaacaacagaaaaaacaagtggaacaccagttggaagaggagaagaaggctaacaacaagaaacaaaaagccaaaagagtgcttgaggtacaaattcaaaccctgaacatccagaaggaggaactaaacactgatctgtatcacatgaaacgaagcttgagatattttgaagagaagtccaaagacctggccgtacgcttgcagcacagcctgcaaagaaagggagagctcgaaagcgtgctttcaaatgttatggccacccagaagaagaaggcaaaccagctgagcagcaggagcaaggccagaactgagtggaagcttgagcagtccatgcgcgaggaggctctgctcaaggtccagcttactcagttgaaggaatctttccaacaggtacagctggaacgagacgaatactccgagcacttgaagggcgaacgggccagatggcagcagaggatgaggaagatgtcgcaggagatctgcacgctcaaaaaggagaaacagcaggatatgcgtagagtagagaagttggaacggagcctgagtaagcttaaaaatcagatggccgaacccctgccaccagagccgcctgccgtaccctccgaggtggaattgcagcaccttagaaaagagctcgaaagggtggctggagaactgcaggcccaagtaaagaagaatcaaaggatctcattactaaaccaacgacaggaggaacggatacaggaacaggaagaacggcttcgtaaacaagaggagcgaatccaggagcagcacaaaagcctgcagcaactcgccaaaccccagtcggttttcgaggagcctgagcatcttgaggccgcaagccagcagaaccagcagttgacggcccagttgagtctgatggcccttccaggagaggggcatggtgagcatctcgactccgaaggcgaggaggcgccccagcccatgcctagtgtacctgaagacctggagtcccgcgaggcaatgtccagcttcatggatcatctcaaggaaaaggcagatctgtcagagctggtgaagaaagaattgtgctttatccaccattggcgcgatagacggcaccaaaagacacaccatctcctgtctgaacctggtggctgcgccaaggatgcagcactaggtggcgggcaccaccaggctggcgcacaagggggggatgagggcgaagctgcgggtgcagctgcggacgggatcgccgcctacagtaattacaacaatgggcaccggaagttccttgccgcagctcataaccctgccgatgagcctggacctggcgctccagcgcctcaagagctcggggcagcggataaacacggggacctccgagaggtcagcctgaccagttccgcccagggcgaagctcgcgaagaccctctactcgacaagcccacagcccagccaattgtccaggatcataaggaacacccggggctcggtagcaactgctgcgtgcccctcttctgctgggcctggctgccccgcagaaggcgatag

SEQ ID NO: 52046 - DNA, 258 bp, Artificial Sequence
  Description of Artificial Sequence: Synthetic coding sequence
atgatccagcaggaggagatccggaagctggaggaggagaagaagcagctcgaaggagaaattatagacttctataagatgaaagctgcgtccgaggctctgcagactcaattgagtaccgacacaaagaaagataaacaccctgacccatacgagttcctgctcttacgtaaaatcaagcaccccggcttcaacgaggagctgaccatcacgctgttaatcatccaaaaacatgtcgccggattatcacacttctag

SEQ ID NO: 52047 - DNA, 1713 bp, Artificial Sequence
  Description of Artificial Sequence: Synthetic coding sequence
atgaaccacttccggaagatggaggtgatcaacctgaccaccctgcctatgattcccgttgatgaacatctggccgttagtcttgtggcccgaaacaccatggtgaagaccgtgcgaaaagagctggaaaacaacccaccatcttgtctcattgggagtatgcaccaagttaatcagaaaatcgccgacattaatctccgaacagaacctagcgccaattcattagccattgaaagattcgaactcgagaagaaggcactccgggaaaagacacgctcgtccccagaggataaagtgaagcgccagcgaaagtcccagtatagctgtaagggctctgagctgagacatgccagatcctcagtgatcaagcgaaagactgcagacaagaatctgttggccgagctgtaccaatactctaattttaacagttccaagccaaacaagcttcccaacggtgttgatttttgcgatatggtgggcaacgtggtgcgggctgagcgcgactgtctgtccggtaagcacttctgtagcggtcgggagttagagaaattcttaagttcatcgagcccacgagcaatttggttggacagcttctggtggatcttccacgagcggtaccagccaaacaaggagctgcagaataacctttttgatcggatagcacagcattatgccctgctgctttttagagtacctaaatcacattctgaggaagctctgcttaagcggctgcctagcctcctgagcaaagcagtgtatacatctttttgctgttgtttcccccagtcgtggttcgatactcatgagttcaaaagcgacatttgtaatacaatgagtctctggattagcggaacctaccccagcccccagagttacgactcctgggactacagcgaactcgatcccgaacgtttccggcgcgaagaactgatgctgtatcggaggcggctgaccaagggtagagaattctcccttttcgcagggaaaagagcgttctctcagaaaccagctcaaagtaggaagttttatcacccgcagagctctagcgccaatagtccctctgagaaaacgagctccgccaagcagaattccgagaaaagcctgagaatgcagaataccgccaaagaacatcattgccaaaccctagtgctgaagaaaccaacccaagaggtgaaacgtattagtgaggcaagggaatgtgagaatatgtttcctaaaaagagctgtgcggcctgtaagtcaccggagttgacatccaacctcttcaacatctacggtaagtcccccctgatcgtgtatttcctgcagaactatgcatccctccaacagcatggcaagaatgtgctgatcgttaggagagaaaaaacaacatccacaccagactgcacgccaacctacaccgacgtgatcagcgaaacactttgttctatgaagaaacgaaaagacaatctgaatcagctataccagcaccattggacagagtggaactatttcgataagcatctgaaggagctgcaggataacttttcaagagaaatgaaaaacatcgaccccaaagctgcagatactaagaaagccaatcatatgttcataccgccttccgccgtgaacgaggagtcacctgataagaagaccaaagaaggaaaagggggcgagggcaaacggagggagactgaggtcgagcatttctttccactgacctcaaaaccatag

SEQ ID NO: 52048 - DNA, 366 bp, Artificial Sequence
  Description of Artificial Sequence: Synthetic coding sequence
atgaccggcgtgtgcgaccacgcccagctgatcttcgtgttcttcgtggaaatggaattcaggtatgtcgttcctgggtggtcccagactcccgagctccgacagtcagcccaccttaggctccagaagtgttgggactaccgtcctgaaccattatgcccatctccctggttgatcgatagccatctgctccccgaatcccttcaaggacaccccttcgtgtgtgtctgtgtactcatctccccatataaaaacacttgccacacacggctgggacctacgctgctgaccagcttttaccttaatcatctttacaaagatccgatttcaaaatattctacaatcttacgcagctgtaatatttag

SEQ ID NO: 52049 - DNA, 474 bp, Artificial Sequence
  Description of Artificial Sequence: Synthetic coding sequence
atggccccccaggcccagcccctgcccctgctgggcaagtgcaaggcctcaaacgcacccactccacgcccccctaggcgccctacctggaaacgcaaatccggaaaagtgagtactacagtacctcaaccacaaactgtccctgggtcctggccaagggagagggagcgcaagcgcgagagggatcgcatcaattctcttctgctacagatcatcgggcattctaagcaggctttacctgggccaggcgaaccggctcagcgtctgacacctgcccctgccgatccggggggcaggggagaacagggtggagtcgccgcacagggtgcgggcctggctgcaggacggcgctcagccgtaggtcctagtaaactgtgcaacctggtgtcagcctcaggagcactggctgtgttctcaatcaccggtatgtgccctggtagggatgtgtccgacggcctgaggatggggcagtag

SEQ ID NO: 52050 - DNA, 507 bp, Artificial Sequence
  Description of Artificial Sequence: Synthetic coding sequence
atgaagggcaacaccaacagcgccgtgacccccgcccccaagtgccattggctagaggatctgccccccgtgcgcaggcagcaccgctgggtgctgtctcctttacggccagctgccttacgccggctgcagctgctttccgccgaccgacgacccctccgccgaacgggcgctccaccggcgcaggggccagcccagcatccctggagcagggggccccctcgtcgccctccaaggtctgtcaagctctgtagagcccaacagtggccagagacaagggcggatcccttgccagccggaacccgccagggcgagtctcccctgccgcgggggcgcagacccgacctgggccagggacggccctccgcgcgtcggcttccatctggtccctggacccacaggacgagaacacgggtgcggggcagtcttcgggctgccgcacggtcgcaaaatgctagaagaggaagtcctgctcgccaagccgccaagccaaagctggaggcttag

SEQ ID NO: 52051 - DNA, 807 bp, Artificial Sequence
  Description of Artificial Sequence: Synthetic coding sequence
atgcggcgggcccccgactgggtgcagcggcaggccgcccccggctcaaagtgccgtgtaccatggcagcggcgagaattcccatccagaggtggccgtaagcagcctcagcccggatcgcgccaaaggaaacagaatcccatcagtctgcccggcgaacagaatggacggaaggcgactccacaggctggtgccttaggagccctaggcatcagggggatcccctccttgtgtcaatcagagggaactaggtggagcaggcggggacggaggtgggccgagaggtgtccgcccggagttctgggcgccggccgcagcttaagggctcaaagaagccgcctacatagtaggccaccacctttgtctccattacggaagcctggaggctcaaaccaaccccgttctgccgccgctgcaggaacacacgaggcatgcctgcaggcgtcgggtactacccgcggctggaagtaccacgcactgccccttagactagatccgcggagtggacacgccgggtcggccttgaaagctggctcttgtccccgtttggggggcggggggagggggcgaggcgaggccggtgcaccctctcgattctggttaccccgctctttgcaacagctgctacctaacgaacctcgcaacgcagacgtgcaaaccctgcatcccaccccctcacataccagacgtggtcagaggactggtaagggggcccgcggaccgagattctggaaatcaaaaaactccccagctaaccgccaatcttccgccctagacttctggattacaaccagtatcagcttttag

SEQ ID NO: 52052 - DNA, 327 bp, Artificial Sequence
  Description of Artificial Sequence: Synthetic coding sequence
atgctgctgaccagccagaccgtgttcttcttcttcttcttcttcctgaggcagagtctgaccctgctttctagcctcgagtgtaatgggactatttccgcacattgcatcctccggctgctgggctctagcaagtcccccgccagcgcctccttagtcgctggagttaccggcatgcatcaccacgcccggctgatctttgtattcctggtcgagatgggttttcatcacgtggggcaagctggcctagaactgttaacttcgggcaatccccccgctctggcttctcagagggcagaaataacaggagcctcctaccgggcatag

SEQ ID NO: 52053 - DNA, 324 bp, Artificial Sequence
  Description of Artificial Sequence: Synthetic coding sequence
atgcggcccaagaccctgcggaacagcgccgcccggagccggaaggagcctggttttctgaaccatcatatggaggggagttgccttcagctcggggaactgtcatcagtgggctactggtggccattcggacatcccgggcccgcccagggtcatctgcccgtcgcggtgtgggcctcatgggtggtggccggcattagcatagccctttaccttccgccccatcccgaaggcaggtatgagggaccattcaagaggcatacaaaaacgttcaggtcagctcaatgtgccgactgcctcgtccaatgtccagcttcaccctag

SEQ ID NO: 52054 - DNA, 465 bp, Artificial Sequence
  Description of Artificial Sequence: Synthetic coding sequence
atgcgggacatggagcgggccggcgtgacccgggtgcggcagagcttgaagacatgggtcgagcatggtccattttctggcgaccccggcctgcctcgcagtgtgcgggttgagttgctcacactcgtcgccggccccgctcgcgggcggtccggacacaggcagcccccaccccagcctcagtctcttaggcgcccactatggctctcccacagcgaccctagcttaaaattccgcacactgggccttcgcgaggggagtggcgcagagtgtttgcccccaggaactttcctgcccttctcatggagcttctccgcaccggaacttgcccacctgtcaaatgcgagggccccttggataccactgcccggagccttccagatccagcagaagcagattttcttctttttagagtcacgcacgaaatctggcatgaggtctcggggtggcaaagattcaaaatag

SEQ ID NO: 52055 - DNA, 723 bp, Artificial Sequence
  Description of Artificial Sequence: Synthetic coding sequence
atgaacaagcagcggggcaccttcagcgaggtgagcctggcccaggaccctaaacgccaacaaaggaaaccgaaagggaacaaatcatcgattagtggcaccgaacaagagatcttccaagtagaactgaacctccaaaacccatccctaaatcaccagggtattgacaaaatttacgactgccagggcctactacctcctcctgaaaaactgacagccgaggtgctgggcattatctgcattgtcttgatggcaacagttctgaaaaccattgtactaattccctttctggaacagaataatttctcccctaatactaggacacagaaggccaggcactgtgggcactgcccagaagagtggatcacatattccaatagttgctactatattggaaaggagcggaggacctgggaagagtcactgcaggcctgcgcttcaaaaaattcctcctctctcctgtgcatcgataatgaggaggagatgaaatttttggcctctattctaccaagtagttggatcggggtcttcaggaacagcagtcaccatccttgggttaccattaacggcctggctttcaaacacgaaataaaggattccgatcatgcagaacgcaattgcgcgatgctccacgttcgcggtctgatctccgatcagtgcggtagtagccgcatcatcaggcgtggctttattatgctgactcgactagtcctcaactcgtag

SEQ ID NO: 52056 - DNA, 732 bp, Artificial Sequence
  Description of Artificial Sequence: Synthetic coding sequence
atggagcggcggtggctgagcctgcggagcagcagctgcagcgcccccaggttaaataccgcttggggtatgagatcgtcaccgcaggcaacatcatcgagttcgcggaacgccgcatccttcttacggctcttccgggcgacacgccgagccccctcgttatgccgactgtcactgtgtcgatggccagccacctccgtgactttggctggcaccttcccggctctcttacgccgtgacaatacactgtcatgctttagctccagacgcctctctagagtggcagcccgggcatcaagctgggggaagagtccatccaggtgtagctcaagcaagccccgcagcccgaacacgcagtctggcacctctaggagcagcagtcatctgacaagaatcacttttcgctggtctagaagaaaaacctgtaaagagaaaggttcgttggccggtgagtggtccaaactctcatcttgcaagtgtactagctgcgatagcccgggtggaaaggtgatatcccagatggcttcctctctcagcgactccacctccttaagcagtaagactgtatctggaagacctggctctatgcagcgggcaagctccagtagacccgcggcacttcgctgctcattttgtcgtagtttttccggggttcactcatggctgcgtttgagctgcttccgtcgcctgtcactgacctcagaccggaaaaccgccaagaggctggagtag

SEQ ID NO: 52057 - DNA, 4041 bp, Artificial Sequence
  Description of Artificial Sequence: Synthetic coding sequence
atggacaacaagcgggacaaggccaaggccggcgccgccgcccggactcccgccgctcgggctcccggtctattgacaccacgcccacccgggtcaccgcgaccccccccaccagtgacccctgccgcgcttagagtgctgggtgccgctggcgccgtcggccggaagcctctggcagaacgggcgggcggcataggtggcgccacaattccggaatcagcaccgagggcgggaccaacgagatctgcaggcacctctagcagaaatcctgcctctagacctccagcctccggcagaggggagcgcgccccccctgccaaaaatacctcccccggccctgtgtctagcccaggaagggccagcggcacaactcgtcccggacctttgggacagaagggcctccggatatccgccgaggaaactgtggcgagaggcaaagccaccgaagccccgaagcggtccgcactgagtgccggcgcacgccgtgatacatccggtcctacacccggcaccccttcaccagctatggcccgcagatccagggcggcaggtactgaagtcggactgcctagaccagccccaagcgctcgaccacggccgccaacagagggaccaagaaagtccgtcagttctgcaagcgagcacagtaccacagagccaagccccgctgccagacgtcgccccagtgccgggggaggactgcaacgtccggcatccaggagcctgtcctccagcgctacgcccctgtccagcccagcaaggtccggacccagcgcccgcggaaccccaagggctcccgcccaccctagccaacccaagcccaagggcctccaggcccttaggccaccccaggtgacaccacctcgcaaggatgcagctccggccctgggccctctctcgtcgtctcctttggccacgccctcaccttctggcaccaaagctagaccagtgccaccgcctgacaacgccgccacacctctgcccgcgacactgccacccagtcctcccgttacacctcctcctccggctgcactgcagtcccaggcaccacccactttgccagcaacccctcacagcagcagtttaacttgtcaacttgctacccccctccccctggctccacccagtccttcggctccccccagtctgcagaccctgccctcgcctccagctacaccacccagccaggtccccccaactcaactaatcatgtccttcccagaagctggagtcagttccttagcaactgccgcgtttgtggcaagtgtttcccccagcgtatcaagcccgctccagtccatgcccccaacccaggccaaccccgctctgccctcgctgcctaccctattgtcacccttagccacccccccgctctcagcaatgtctccactgcaaggacctgtctcgccagcgacatctctgggcaactccgcttttcctcttgcggccttgccccagccaggattaagtgccctcactactcccccccctcaagcgtcgcccagccccagcccccctagtcttcaggccacacctcatacactcgcaacactgccacttcaggattcacctcttctggcaaccctgccgttgcaagcttccccctccccactgaccaccgtctctctgcaggaccctcctctcgtttctccttccctgctggccagccctcctctgcaggcccccccccatccacaggcaccccctagcatgaccaccccaccgatgcaagcccccccttccctgcaaactatcccacctatacaggtgccacacagtttaacttcaccctctctccaggcaccaccctccccccttgctctctcgtctctgcaggccacaacctccctcggatccccgacactccaggccacacattccttcctaaccatgtcgcctagacagacccaggcctccctgatctctcctagtcgccctgccagcacaccccctgactccccgcctttacaggccccgctctccctgcccgcctccccacctctgcagacaagtctctcacctgcagtgtcccccctgagctcacccttgacaattcatcccctccaagctctgtcatctcttgcaagccacagtccgcaggcccctctatcttcacttatcatgccgccattagagacccagtcctcgttggcccccccatcactgcagactccccctgcaagcttgacaacacctccactagaaaatctcccatccctggctccccctccattgcaaactgcctccgcaccactgactactccccctctggaaaacctcccttctttagccccaccccctctccagactgcctcggcccccctaactacaccacacctcgagacaccaccctgcccagccccatgtcctcttcaagctccccctagccctctcaccacgcctcctcccgaaactccgagcagcattgccacacctcctcctcaggctccgccagcactggctagtcccccactacagggcctgcctagccctcctctcagtccattggctaccccccctccacaagctcctcccgcactggcgcttccaccactacaggcacctccatctcccccagctagcccacctctatctcctcttgctaccccatcaccgcaggccccgaacgctctggctgtacacctgctgcaagcaccattttccccccccccaagcccacctgttcaggcacctttttcccctcctgctagccccccagtgtccccttcagccacccccccatctcaagcccccccgtcacttgcagctccacctctgcaggtacccccctcacccccggcttcccctcctatgtccccgagtgccactcccccccctcaagcccccccacccctggctgcccctccgctgcaggtacctccttctccacctgcctcccctcccatgtctccctccgctacgccccccccaagagtgccccccctactcgccgctcctccgctgcaggtccccccctcccccccggcctcgctccctatgagccctctcgctaagccaccacctcaggcccctcccgctctggctacgccccctctgcaggctctgcccagtccacctgcttcgttcccaggccaggctccattttctccatcggctagcctcccgatgtctccactggcaactccccctccgcaggctccaccagtgcttgcagctccactgctgcaggtccctccctcacccccggctagccctacactacaggcaccacggcgcccgcccacacctggacccgatacctcagtctccggtcctaggcttacactggctctcgcccccggcccgccgccaccacccagtaggtccccgagttccacactgtcgggaccagacctggctggacatagctcctccgccacctcgactccagaagaactgagaggatacgactctggccctgaggggggtgcggccgccagtccgcccccagacgccgagcttgcagcatgtcatccggccgcatggtcccgtggcccagcccccccgttagcctttcggggagcgcctggcgcccccttaccctggcctcccgccaccggtcccggatcggccgatggtttgtgtacaatctacgaaacggaaggaccagagtctgccacccctgcgcctggtgcactggaccctggcccatcacccggcactagtggcggaaaggccgctgcaggagcaggagctggcgcttctagccgctcccctaaacaggcacggctgggcgagctccctctgggcgctctccaggcttcagtggtacagcacctcttatctcggaccctgcttctagccgcagccgagggggcggctggcggctcagggggcggtccggggggtgctgaaggcggtggggtgacaggcggggcacgcgctgctctgtccgatgctgaactagggcgctgggctgagctccttagccccctggacgaatcacgggcttctattacgtcagtgacatctttttcaccagacgatgtcgcaagcccacagggagattggactgttgtagaggtggaaactttccattag

SEQ ID NO: 52058 - DNA, 2010 bp, Artificial Sequence
  Description of Artificial Sequence: Synthetic coding sequence
atgttcaccctgagcctgctgagccggggccacggcaagctgggccaggacaagcaaaagctcgaagtctacttcgagcctgaagattacctcaactggcgctcccccgaggattacgttcccgtgtccaagccccaggacaaaaataacgcctctcaacattcttggtccctgttcctccctaaaacattcagcactaggaagggtgccctcattctgtactccgaaggcttcgccatttctgcctggactcctaaggaacgacgcaagggcccatactgccccagaggcccttggcgcaagttggatctggaactacataccctgcaggacctcaaggaggcgattttagcgtatggacgccaacagggcgagcaagaccgagcgtggcagccatatcttcacttccgatcacagctggagtctcaggcccagaggcagattcaaccaggacactcagctaagcgttatctccggggccttctccgtacatggccaccagatgctatgtatagattatggtgcgctggctatattaaggatagtgtattactccaggacagccagctcaatgtgcctaaaaaactgagacctcagcaagatctgagcggagttccccccaagtatcatctgcttccagtgttcccaagtttctggatccaacagggaaagtcttttgagcagcggcagcaggggctggacgagggggaggccggcgccgctgggcatgtggaccaggggcctttggccaaaaatcacggatctcagggcactaggcttccccctagacggaagcagccatggcaggaagatgagactcaggcagaggatacctccatcgagaaccatttgtgcctttacgccagcaaggagagctataacgagaagactcagcagactagtaggaaagctttcgggcacggcaggatagatcactcatggctcccctctgacaaatcccacattacattctgtggtggagcgttcccgaataggaaagccgacttatccgataagcaacgcaatgttaaacttcacaaagcgcgatctagtcacctgcttcaggtgctgccagcagaacgctcactatttccgccagttgcgtctgccaccggatctagaattatcacgccaggtgaggtcaagaaaaaaaaggccccgaaggcccttaaactgcccccaatcagcgaggaacctccacgagtgttggaacctctgaaaagccaattcaaagcaaatgagcccccgaccgagctctttattcttccagtggaaattcattatcacacgaaacagcccccaaaggagaaggctcaccggaggggggccccccatcctgagtctgagcccgaatcctcagaagaatccacgcctgtgtggcggcctccactcaaacacgcctctctggagacgccctgggaactgactgtgcacctgccggtcgatgccagcagggatactttgagcccccagggctccagtagtctgccacccgcctccctcggcaacttgaccctgaagggctccaaggccagacacactagagtacatagccagggaaagggagtctggaagggggacgacgatgctcctcctcacgacgtcgctccacccctggatctgctcccaccaatcaaaggcaaaaagagtcccgagagccagaaaggcgtcgattcccccagaacatcagatcataactcacccccttccctccccaatatgcgggtgccaaggagagcattgcctgcagctcaggaagattcttctgatcccactcttggccatttcctcctgggacccgacggggaaaaagtgtgcctgagcttacccggtcatacacagactgaggctctgccctctgggaaagcttatgagtctgtaaatagtaacatcagtcatgaagaagaaggccccagctcacaacatttcttgaaagatatggcggctgctgcatcagatcagggtaaggacgatgacctcgagacattcagtcccaaaaacagcctgtag

SEQ ID NO: 52059 - DNA, 411 bp, Artificial Sequence
  Description of Artificial Sequence: Synthetic coding sequence
atgcggcaggaggtggagggccggggccggggcagccacgagctgatcattactgataaacgttgtggcgtttgtggtgggtccctaagctgtatcgtttacctgtgcatctccctgaatttttcacgaataaaaaagctgaaaaagtacacctggcctggacctacacgtgatagtcctaacgcaagcctccagccaggccgcgccaagtttgcatttagccatgcctcacacacgccccttcatagtcagctcggggccctccagaccggtaagccacaagccctgttagcttccgctaacccactgagtcgatctatggggcccccagatcaccatttgacaaccctgatcttgatcagcttggagacgccatttccaggccttctgtcgtcaggctgtttcccatag

SEQ ID NO: 52060 - DNA, 381 bp, Artificial Sequence
  Description of Artificial Sequence: Synthetic coding sequence
atgcccacccagcccccccccggcagcggcgaggtgcggcagagcccaagcggtaatggcgcactggtgcctaccggacagggctgtcgcggaaggaacctaccaattcagggctacagccccgaagggaggcccaccgcgagcagtcagccagcaggtgcttggcacagcgagagttcccagaaaggcacagcctgcccccttgccctcgggagaggaggcgcccgcggaggaggccaaaggaaaagtaggagcggcgcccgcgctccaggccagcctgctgaggccggactgtctgcctcacccgagaagacgagacctgaggggcgagccgagcggggacgcgctgttgtttggcagtctcagcctaacagatggtag

SEQ ID NO: 52061 - DNA, 699 bp, Artificial Sequence
  Description of Artificial Sequence: Synthetic coding sequence
atgttctgctgcctgggctacgagtggctgagcggcggctgcaagacatggcactctgcctgggtcataaatacgctggccgatcacagacataggggcaccgatttcggcggcagcccttggctcctaattataaccgtgttcttgcgcagttataagtttgccatctcattgtgtactagctatctgtgtgtgagttttcttaagactatctttcccagccagaacggacacgatgggtccacagacgtgcaacagagagcgaggagatccaattgtcgtcgtcaggaaggcatcaagatcgtgctggaggatattttcaccctctggcggcaggtcgagaccaaagtgcgcgcaaagatcagaaagatgaaggtaacaaccaaagttaaccgccatgataaaattaacggcaaaaggaagacagccaaggagcatctgcgaaaactgtcgatgaaagagcgagagcacggtgagaaagagcgacaagtgtctgaggccgaagaaaacggcaaactggacatgaaagagattcacacgtacatggagatgttccagcgtgctcaggcactacgcagacgggcagaggactactaccgatgcaagatcacaccatctgcccgtaagccactttgtaataggtgtacctataatcttgttctacctggatcagagaaaaagtattatagccacgcctag

SEQ ID NO: 52062 - DNA, 636 bp, Artificial Sequence
  Description of Artificial Sequence: Synthetic coding sequence
atggcctacctgggcccctaccccaccagccggcagcccccccagatgaggctgctgccacataattctctgcatcgtcacagttctattgtgaccatggccagcctcgaccctgctcccgcatcccagccctccctgcaggctttaaattttttgaagtcgactagtccaggaccagctcctgcatcttggtggcctttacaggcccagccattgccaccagtgtcactttattcccccaacgtgtgcctgactgccgactcgtcccgcccagcttcaacctctttgtggaccccccaggccaagctgcctacattccaacagctgttgcacacccagctcttgcctccaagtggcctatttcggccatccagctgtttcacgagggcttttcccggccccactttcgtgagctggcaacctagtctggcgcgcttcctacctgttagtcaacagcctcggcaggctcaggtcctgcctcatacaggactgtcgacttcctccctgtgcctcaccgtcgcttcccctgggcctaccccagtgccagggcggcacctgcgtgcccagaacctgctcaaaagcaattctcctggcccgccatctgcttctcgttggcaccagcaagcacagctgtag

SEQ ID NO: 52063 - DNA, 654 bp, Artificial Sequence
  Description of Artificial Sequence: Synthetic coding sequence
atgaccctgctgccccggctggccctgcgggaggaggccgcccggcgagggccccttagagctcccgtccagccagggcttggtgagagaagtccacagcggcaccgcgaaccaaagcaaggacgggtttcccagaggtggcacccagccagggaacccctggcagctaccgggtttcttcacggcctggggcatttgggaagggccgcccaatccccaagggcgagctgttgcatcttgtggccagggacctggggggacccactgaggacactaggacgctcccagcgtgaggtgcagacagtctgcaccggggtgagcggggatcaagcgcagaaagagcaggacgggcacctcttagcctggcggaaaattctcctgccgggaaaaaagacaaccccccgcgggatcggactgggttgtcgaacgctctctcaagctacagctccctttctgttgcagaactggggcaggaaacgggcttttcggcccgggtctgaaaatcctagttcagggactagcaggcccagtcgaggccggctcgaagcaagaagttcgggcctggacgaagcttgggaggctcagagactcacaggacatggacggttcccctctccacgcaaagagaagtctctgcagcggggcttagggtag

SEQ ID NO: 52064 - DNA, 336 bp, Artificial Sequence
  Description of Artificial Sequence: Synthetic coding sequence
atggtgagcctgtgggtggaggacaccttcctgagccccggcttcgggttcgcacacgtggcatgtagtggccttggaatgaaacaaaagagaaaagccgcatcgtctgagcccacatccgaagtggcattaggaggcagtgccgggccagttaggtcccacctgcatcctgaagggttactctggtgtagccgatgcttcttcagcctccgacccaagggcaccgagccacccggtcgttccgcgggactgcagggtgcgactgagaggagcggttggaccagcgtccaagcccaggcgcaggcatgtgaaaacctggtgcccgctgcggtatag

SEQ ID NO: 52065 - DNA, 5103 bp, Artificial Sequence
  Description of Artificial Sequence: Synthetic coding sequence
atgaccagcgcccagtgccccgccctggcctgcgtgatgagccccctacggttttggggtccgtggcctttgttgatgtggcagctgctttggctccttgtgaaggaagcacagccactcgaatgggttaaggatccactgcagctcaccagcaaccccctagggcctccagaaccttggagttcccactccagccattttcctagagagagcccccacgctccaactttgccagccgatccttgggatttcgatcacctcggtcccagcgcttcctccgaaatgcctgccccaccacaggagtcaactgagaacttagtgccattcttggacacttgggattcagccggagagctgccgctagaaccagagcagtttctggcatcccagcaggaccttaaggacaaattgtccccgcaggagcgcctgcccgtgtcccctaaaaagttaaaaaaggacccagctcagagatggtccctggctgaaatcatagggattattagacaactttccacaccccagtcccagaagcaaactctccagaatgaatattcttccacagataccccgtatcccggtagcctcccaccggagctcagggtgaaatccgacgagcctccaggcccgtctgagcaggtcggccccagtcagtttcacttggaacctgaaacccaaaatccggaaacccttgaagatattcagagttcatcactccagcaagaggccccggcccagctgcctcagctgctcgaggaggagccttcatcaatgcagcaagaagcacctgcgctgcctccagaatcttcaatggaatccctcacgctgcccaatcatgaagttagcgtccagccccctggagaagaccaagcttattaccatctgccaaatataacggttaaacctgccgatgtggaggttaccatcacatccgagcccacaaatgaaaccgagagtagccaggcccagcaggaaacccctatccagtttcccgaagaagtggagccatcagctacccagcaagaggccccaatagagcccccggttccgcccatggaacacgaactttctataagcgagcagcagcaacctgtgcagccctctgaaagccctagggaggtggagtctagcccaactcagcaagagactccaggccagcccccagagcatcacgaggtcactgtgtcccctcccggacatcaccagacccaccatctggcctccccatcagtgtccgttaagccgcccgacgtccagctgactatagcagccgagccttctgcggaggttggtacctcgctagttcaccaagaggccacaacgcgactttcagggtcgggtaatgatgtggagcctcccgcaattcagcacggcggacccccattactgcccgagagctccgaagaagccggccccctggcagttcagcaggaaaccagcttccaatcgccagaacctatcaacaacgaaaacccaagtccaacacagcaggaagccgccgccgaacatccacaaacagcagaagagggcgagagctctctgacgcaccaggaagcccctgcgcagacccctgaatttcccaatgtcgtcgtagcacagccccctgagcactcccacttaacgcaggccactgtacagcctctcgacttgggctttactatcacaccagagtcgaaaaccgaggtcgagctctcaccaacgatgaaggagactcctacgcagccaccaaaaaaggtcgtgccacagctacgcgtgtaccagggtgtcaccaatccaacccccggtcaggatcaggctcagcaccctgtgtccccctctgtgactgtgcagttgttggacctggggctcactatcacaccagagcccaccacagaggttgggcacagcacaccgccaaaacgtactatcgtgagtcccaagcaccccgaggtgaccctgccgcaccccgatcaggtacagacacagcacagccatctgacccgcgcaactgtgcagccacttgacttgggcttcactatcaccccaaaatcaatgaccgaggtggagccatccacagcactgatgacaaccgcccctcctccaggacaccccgaagtgacactcccaccatcagacaaggggcaggctcagcacagtcacttgacccaggccaccgttcagcccctggatctagagcttaccataaccacgaagcccacaactgaggtgaaaccttctcccaccaccgaggagacatctacccagcctcctgacctcgggttggccatcatccctgagcctacgacagagactgggcactccacagcattagagaaaactacagcgccgaggccagaccgtgttcagacgctgcaccgatccctcactgaagtgacaggtcctccgacagagctggagcctgcccaggactcacttgtgcagtctgaatcctatactcagaacaaggccctgacggctccggaagaacacaaggctagcacctcaaccaacatctgtgaactctgtacatgtggcgacgaaatgctgagctgtatcgacctaaaccccgagcagagattgcgccaggtccctgtgcccgaaccaaacacccacaatggcacttttacaatcttaaactttcaagggaattacatctcctacatcgacggcaacgtgtggaaagcttattcttggacagagaagctgattcttagagagaacaatctgactgagctccataaagacagttttgaaggcttattgtcactgcaataccttgacttgtcttgcaacaaaatacaatccatcgaaaggcacacattcgagcctttacctttccttaaattcattaatctgagttgtaatgttatcactgaactgtcgtttggtacattccaggcctggcacggcatgcagtttctgcataagctaattctgaatcacaaccccctaactacggtggaagatccttacctcttcaagttgcccgctctcaaatatttagatatgggcactaccctcgtcccgctgacaacattaaaaaacattttgatgatgactgtggaactggagaaactgatactaccatcccacatggcatgctgtctatgccaatttaagaactccatcgaggccgtctgcaagacagttaaactccattgcaatagcgcatgccttactaacacgactcattgtcctgaggaagcttccgtgggcaaccctgagggcgcatttatgaaggtgcttcaagcacggaagaattacacttccacggagctaatcgtcgaacccgaggagccttctgattcttcaggcataaacctttctgggttcggctcagagcagctcgacacaaatgatgaaagcgattttatttctaccctccgctacatactgccctactttagcgctgtgaatctggacgtaaaaagcttgcttctgccattgataaagctgcccaccacaggaaattcgctcgcaaagattcagacagtgggacaaaacaggcagagagtcaagcgtgtgcttatggggccacgatctatccagaaacggcatttcaaagaagtcggtcggcagtccattcgccgtgagcagggcgcacaagctagcgtggagaacgcggccgaggagaagcggctcggatccccagcaccgagggaggttgaacagccacacacccagcagggtcctgagaaactcgctggaaatgcagtgtacactaagccctcattcactcaagagcataaggccgccgtgagtgtgctcaaacccttcagtaagggagccccatccacgtcctcacctgctaaggcacttccccaagtgagagatcgctggaaggatttgactcatgcaatatccacactggagagcgccaaggctcgggtcacgaacactaagacctctaagcccattgtgcatgccaggaaaaaatatcgctttcataagactagatctcatgtgactcaccgcacccctaaagtgaaaaagtcccctaaagtccggaagaaatcttatctttcccgcctgatgctcgccaaccgcctacccttttcggccgcaaagagccttatcaactcaccctctcaaggtgccttcagtagcctcggggacttgagtcctcaagagaatccattcctcgaagtcagtgcacccagcgagcatttcattgaaaaaaacaacacaaaacatactactgcccgtaacgctttcgaggaaaatgatttcatggagaacaccaatatgcctgaggggactatctctgagaacactaactataatcatccccctgaggctgattcagccgggactgcattcaatctggggccaactgtcaagcaaacggagacaaagtgggaatataacaatgtgggcacagacctgagtcctgaaccaaagagcttcaattatcctctactctccagtcccggagaccagtttgaaattcagctgacgcagcagctccagagcctgattcccaataacaatgttcggagactgattgcccacgttatcagaacactaaagatggattgttctgggacgcacgtgcaggtcacatgtgcaaagttaatctctagaactggccacctcatgaaattgctgtctggccagcaagaggtcaaggcctcaaagattgaatgggacactgatcagtggaagattgaaaattacattaatgagtccacagaggctcaatccgaacagaaggagaaatcactcgagctgaaaaaggaggttcctggctatgggtacaccgacaaactgatcttagccctgatcgtcacaggcattctgaccatattaattatccttttctgccttatagttatctgctgtcaccgaagatcactccaggaagacgaggaagggttctccaggggaattttccggttcctgcctcgaaggggctgttccagtcgtagagaatctcaagacggcctttcttcctttggccagcccctgtggttcaaagacatgtacaaacccctttctgccacccgcatcaataatcatgcctggaagcttcacaagaaatccagtaacgaggacaagatcctgaaccgggacccaggagattctgaggcccctaccgaagaggaggaatccgaagctttaccctag

SEQ ID NO: 52066 - DNA, 4908 bp, Artificial Sequence
  Description of Artificial Sequence: Synthetic coding sequence
atgaccagcgcccagtgccccgccctggcctgcgtgatgagccccctgagattttggggcccatggcccctgttgatgtggcagctactatggctgctggtaaaggaggctcagccactggaatgggtgaaggatcctcttcagctgacctctaacccattaggaccgcccgaaccgtggagctctcacagcagccactttcctagagagtccccgcacgctcctacattgcccgctgacccttgggattttgatcatctcgggccatccgcttcaagcgaaatgccagcccctccccaagaatccacagagaatctggtacccttcctagacacctgggatagcgcaggagagcttcctttagagcccgagcagttcttagcctctcagcaggacctaaaggacaagctctccccccaggaaaggctgcccgtctctcccaagaagttaaaaaaggatccggctcagagatggtccctcgcagaaatcatcgggataattagacagctctcaactccacagagccagaaacagaccctgcagaacgagtactcatccacagacacgccctaccccggctccctgccccccgaactgagggtaaagtccgacgagccacccggcccttctgaacaggtcggcccatcacagttccacctggagcccgaaactcaaaacccggaaacccttgaagatatacagtcatcgtccttgcagcaggaggcacctgctcagctgccccaactgctcgaagaggagccctcctccatgcagcaggaggctcccgccctcccccctgaatcttccatggaatctctaactttgcccaaccatgaggtgtcggtccagccccccggggaggatcaagcttattaccaccttccgaacattacagtcaagcccgctgatgtagaggtaacaatcacaagtgaacccacaaatgagactgagtcctctcaagcacagcaagagactcccattcaatttcctgaggaggtggagccttctgccacgcagcaggaggcccccatagaaccccctgtgcccccaatggaacatgaactctcgatatctgaacaacagcagccagtgcagccgagcgaatcaccacgggaagtggagagctcccctactcaacaagagacaccaggtcagccacccgagcaccatgaggtcacggtatcccctcccggccatcatcagacccatcacctggcctcgcctagtgtgtctgtgaagccacctgacgtgcagttaactatcgccgcggagccaagtgcagaggttggtacgagcctcgtccatcaggaagccacaactaggctgtctggttccggaaatgacgtggagccgcctgccattcaacacgggggaccacctcttctccccgaaagttcggaggaagctggtcctctcgccgttcaacaggagaccagtttccagagtcccgagcccattaacaatgagaatccatcaccaactcagcaggaggctgctgccgaacaccctcagactgctgaagaaggtgagtccagcttgacacatcaggaggccccagcgcagactcccgaattccccaacgtggtcgtcgctcaaccgcccgagcatagtcacctgacacaagccacagtgcagccgttggacttaggctttacaataactccagagtctaaaactgaagttgaactaagcccaactatgaaggaaacgccaacccaaccgcccaaaaaggttgttcctcagctacgcgtgtaccaaggggtcacaaacccaactcctggtcaggatcaggcccagcacccagtatcaccaagcgtaactgtgcagctccttgaccttggtttaaccataacccctgagcccactactgaggtgggccattcaacaccacccaaaaggactatcgtatctccgaagcaccctgaagtgaccctaccacatccggaccaggtgcagacacagcattctcatctcacacgtgccaccgtccagccactcgatctcggctttacaatcaccccaaagtctatgaccgaagtggaacctagtaccgccctgatgactacagccccacctcctggtcatccggaggtgaccctgccaccttccgataagggccaagcccagcattcacatctgacacaggccacggtgcagccgctggacttggagttaacaattaccacaaaacccaccacagaagtcaagccttctccaactaccgaagaaactagcacacagccaccagatctgggtctggctatcatcccagaacccaccacagagaccggccactctaccgccctcgagaaaaccactgctccgcggccggacagagttcagacactccatcggtcactcaccgaggtcactggccctccaactgagctggagccagcccaagactctctagtccaatcagagagttatactcagaataaggcactgacagccccagaagaacataaagcaagtacgagcaccaacatttgtgagttgtgcacatgcggcgacgaaatgttgagctgtatcgatctgaacccagagcaaaggttacgacaagttcctgtgcccgagcccaatacgcacaacggtacattcaccatcctgaacttccagggcaactatatatcttatatagacggcaacgtgtggaaagcctactcttggactgagaagctcatcctacgagagaacaacctaactgagctacacaaggatagttttgagggcttactgtcgttgcaatacctggatttgtcctgcaataagattcagtcaatagaacgacatacctttgaacctctgccttttcttaaattcatcaacctctcatgcaacgtgataactgagctgtcctttgggacatttcaggcatggcatggcatgcagttcctccacaagctcattctgaatcataaccctctgacaacggtcgaggatccctacctgttcaaacttccagccctaaaatacttagacatgggtaccacgttggtaccgttaaccacactcaaaaacatccttatgatgaccgtggaacttgaaaagctgatcctccctagtcatatggcctgttgtctgtgtcagttcaagaatagcatcgaggccgtttgtaaaacggtaaagctgcactgcaatagcgcttgcctgactaatacaacccactgccccgaggaggcctccgtggggaaccccgagggagctttcatgaaggttctgcaggccagaaagaattatactagtactgagctcatcgtagagcccgaagagcctagtgacagcagtggaattaatctgtccggctttggaagtgagcagctggataccaacgacgagagtgacttcatctctaccctgcgttacatcttgccatattttagcgccgtgaacctagatgtaaagtccttattgctccccctgataaagctgccaacgacagggaactccctcgccaagattcagaccgtggggcagaatcggcagcgagtgaagagagtattgatgggtccacggtcaatccagaagcgacactttaaggaggtaggtcgtcagtccatcaggagagaacagggggcacaggcctccgttgagaatgcggctgaagagaaaagactgggcagccccgccccaagagaggtggagcaacctcatactcaacaagggccagagaagcttgcagggaatgctgtgtatacgaagccgagcttcacacaggagcacaaagctgccgtctcagtcctcaagcccttttccaagggggcaccgagtacctcctctccggccaaagctcttcctcaggtgcgggatcggtggaaggacctgacacatgccatcagtaccctcgaaagcgccaaggcccgcgtcactaatactaaaacatccaagcccatcgtccatgcaaggaagaagtatcgattccacaaaacacggtctcacgttacccatcgcacacccaaggtcaaaaagtcaccgaaggtgaggaagaagtcctacctgtctcggctgatgctcgcaaatagactccccttttccgcagctaagtctctgatcaatagtcctagtcagggggcattcagctccctgggagaccttagtccacaggaaaaccccttccttgaggtgagcgcaccatccgaacattttatcgaaaaaaataacaccaagcacactaccgcaagaaatgctttcgaagaaaacgacttcatggagaatactaatatgccagaaggcactatcagtgaaaatactaattataaccatcctccggaggctgactcagcagggaccgcgttcaatttgggcccgacagtgaaacaaacagagaccaagtgggagtacaacaatgtcggtacagacctaagtccggagccaaagtcattcaattaccctcttttaagtagtcccggagaccagtttgaaattcagctcactcagcagttgcagagtttgatccctaataacaacgtgcgcaggctcatcgcccacgttatccgaacactcaagatggattgcagtggcacccacgtacaagtgacctgtgcaaagcttattagtcgcaccggacatctgatgaagttactctccggacaacaggaggttaaggctagcaagattgaatgggacactgatcagtggaagattgagaactatatcaatgaaagcaccgaggcccaatctgagcaaaaggagaaatccctggaactcaaaaaggaagtccccgggtacggatacacggataagctcattctggcgctgatcgtgacgggcatactgacaatcctgatcattcttttttgtctgattgtgatatgttgccaccggcgctctctgcaggaggatgaagaagggtttagtagagacagcgaagcccccacagaggaagaagaaagtgaggcattgccatag

SEQ ID NO: 52067 - DNA, 1701 bp, Artificial Sequence
  Description of Artificial Sequence: Synthetic coding sequence
atgaagatgcagaagggcaacgtgctgctgatgttcggcctgctgctgcacctcgaagccgccacaaacagcaacgagaccagcacctcagccaacacaggatcttctgttatttccagtggggcttcaactgcgacaaatagtgggtcctccgtgactagctccggagtgtcaaccgctacaataagtgggtcttctgtgactagtaacggtgtgtccatcgttaccaattctgaatttcacacaacaagttcaggcatcagcaccgctacaaactctgagttctccacggccagttccggcatttctatcgcaacgaactctgagtccagcacgacatcctcaggtgcctctactgcaaccaattccgaatctagcactccgtcgtctggagctagtactgcgacgaactcagagtcaagtactctatcttcgggggcttcaacagcaacgaactctgatagtagtaccactagctccggggcatccaccgcgacaaattctgaatcttccaccacttcctctggcgcatctaccgcaaccaattcggaaagcagcacagtaagcagccgggccagcaccgcaacaaatagcgagtcatcaaccaccagcagcggcgcttcaacggccacaaacagcgagagtcgcacaaccagtaatggagcaggcacggccactaactccgaaagcagtaccacaagcagcggggcctctactgctacaaattcagattccagcactgtgtctagtggcgcaagcactgctacgaattccgagtcctccactacttcctccggagcctccactgcaacaaactccgagtcttccaccacatctagtggtgcgagtacagctactaattctgactcctcgacaactagtagtggtgccggaaccgcgacaaattccgaaagttccactgtgtcatccgggatcagcaccgtaaccaacagtgagtcctcaaccccgtccagtggggccaacacggccacaaactctgaaagctctacaacctcttcaggagccaacaccgcaaccaattcagagagttccaccgtgtcctccggagctagcactgcaaccaattccgagagtagtacaacatcgtcaggcgtgagtacagccacgaactcagagtctagcaccacctcctccggagctagtacagccacaaattctgactcttcaaccacatcatctgaagcttctacagctacaaactcagagtcatctaccgttagttccggtatctctacggtgacaaatagcgagtccagtaccacttcaagtggtgcgaatactgctaccaattctggtagttctgttacctccgccgggtccgggacggcggcactcaccgggatgcatacaacaagccattcggcctccacggctgtcagcgaggctaaacctggtggatccttggttccctgggaaattttcttgatcactctagtatccgtggtagcagccgtcgggctttttgcaggtctgtttttctgtgtgagaaattctctatcattaaggaacacctttaacactgccgtctaccatccccatggactgaatcatggtctgggacccgggcccggtgggaatcatggcgctccacatcggccacgctggtcccccaattggttttggagacgccccgtgagcagcatcgccatggagatgtctggacgcaacagtggtccctag

SEQ ID NO: 52068 - DNA, 375 bp, Artificial Sequence
  Description of Artificial Sequence: Synthetic coding sequence
atgacccccaacgagcaccccgccttcaagcacctgttcaacaaggcccacctagctcctcccctgatacatctaaccctgtccggacactctacgtgtttcagagagcatagggttggtggcaaggtcactgaccaacaggaccctaaggccgaggagtttttccttgtccaaaataagatgaagtctcttccctgcctcctgctgtcaacacagacccgacagccatctgacttcagcatattcagccccccatttctgcccttctatagtacgaagccgcccttatccagttggcccgtcttgaatgagttgttagggaccccgccccggagggggggcggtagggccgaaggccttctgacatcccagtag

SEQ ID NO: 52069 - DNA, 816 bp, Artificial Sequence
  Description of Artificial Sequence: Synthetic coding sequence
atgttcctgagcgaggagaagctgcactaccggagcgcccggaccaaggaactggatgccctgttgggcgacctccactgtgagattagagaccaagaaaccttactgatgtaccagctccagtgtcaggtcctggcacgcgcagcagtccttacaagagtgttagatctcgcatcacgactggatgtgttgttagctcttgcatccgctgcgcgcgactatggctattctcgacctagatacagcccacaggtgttaggcgtgcgtatccaaaacggccggcatcccctgatggaactgtgtgcacgcacgtttgtcccaaactcgaccgaatgtggcggagataaagggcgcgtgaaagtgatcaccggaccaaatagttctggaaaatccatttacctcaagcaggtcggactgataacttttatggccttggtcgggagcttcgttcccgccgaggaggctgaaattggggcggtagacgccattttcacccggatccatagttgcgagtctatctcccttgggttgtccacatttatgatagatcttaatcaggttgccaaggctgtcaataacgctacggcccagtccctggtgcttatcgacgaattcggcaaagggactaacacagtggacggacttgcactcctggccgccgtgctgcggcattggctcgcccgaggtcccacatgtccgcatatctttgtggcaacgaattttctttccctagttcaactacagcttttgcctcaggggccactggtccagtacctggattggcccagagtatccggccaagaaggcggagattag

SEQ ID NO: 52070 - DNA, 372 bp, Artificial Sequence
  Description of Artificial Sequence: Synthetic coding sequence
atgcagagcgagaagccccagggcctgttcctgcagctgaaccccaatgcgtccagtaccgaaactcagctcctcgttcccgccctggaatctcgcgacactctgcctcccacacactgtttcatggctgggaccgaatccccattgggcaatccatggcccttgtcactccctcctccttgctggaccggctgcgtattgccggctccaagagggcagcggaaacctggccccttgggactcagcatattcatctcgctcgggaataagcgacacaggagtgggaatcatgtggtacgggaaagcgagcagcctctgtcacaggggaatccgcaccaagggtggggaccagataccagaaagggtaggtag

SEQ ID NO: 52071 - DNA, 102 bp, Artificial Sequence
  Description of Artificial Sequence: Synthetic coding sequence
atgctgaacttcgacatcagcgccgccccccggaagaccgccctgatgaagctggaaaccataatccatagcaaactgttgcaaggacaaaagactaagtag

SEQ ID NO: 52072 - DNA, 102 bp, Artificial Sequence
  Description of Artificial Sequence: Synthetic coding sequence
atgctgaacttcgacatcagcgccgccccccggaagaccgccctgatgaaattagagacaatcatccatagcaagctcctccagggccagaaaacaaagtag

SEQ ID NO: 52073 - DNA, 2025 bp, Artificial Sequence
  Description of Artificial Sequence: Synthetic coding sequence
atgcagttctacaccctgaagatcatcctgaaccacaaccccctgacgactgtggaagatccttacttattcaaattaccggccctgaaataccttgacatggggactaccctggtcccactgacaaccctgaaaaatatccttatgatgacggttgaactcgagaagctcattcttccatcccatatggcctgctgcttgtgtcagttcaaaaacagcattgaggccgtttgcaagacagtcaaattgcattgtaactccgcctgtcttacgaacactacacattgcccagaggaggccagtgtgggcaatccagaaggagcattcatgaaggtgctgcaggcccgaaaaaattataccagcactgagctaatcgtggagccagaagagccgtcggattcgtcgggcatcaaccttagcggcttcgggagtgaacaattagatacaaacgacgagagtgacttcatctcaacgttgcgatacatcttgccatacttctccgccgttaatctagacgtcaagagtctcctgctgcctctcatcaagctccctaccactggaaattcactggctaaaattcaaaccgtgggtcagaatcgacagcgcgtcaaacgggtgctcatgggccctcggtccatccagaagagacatttcaaggaggttggacggcagagtattaggcgcgagcaaggagcacaggcctcagtcgaaaacgccgctgaagaaaagcgtcttggaagtcccgctccaagggaggtggaacagccacatacacaacaggggcccgagaaacttgccggcaacgctgtgtacactaaaccctcctttacccaggaacataaggcagcagtgagcgtgcttaagcctttctccaagggcgcccccagcacatcttctccggcaaaggccttaccacaagtgagggaccgatggaaggacctgacacacgccatctctactttggagtcagccaaggcccgggttaccaacaccaagacatctaaacccatagtgcacgcacggaagaagtaccgcttccataaaactagaagccacgtcacacatcgaactcctaaggtaaagaaaagccccaaagtcagaaagaagtcctaccttagccggctgatgctcgccaatcgccttccattcagcgctgctaagagccttattaactccccctcacaaggagctttttcctctttaggtgacttgagcccacaggagaatcctttcctggaagtgagcgctccaagtgaacactttatcgagaagaataacactaagcatacgactgctcggaacgctttcgaggagaatgatttcatggaaaacaccaacatgcctgagggaaccatcagcgaaaacaccaactacaaccaccccccagaggccgatagcgctggcaccgccttcaatctcggccctacagtaaagcagaccgagacaaaatgggagtacaataacgtgggcactgacttatctcccgagcctaagtcttttaattatccacttctatcttcaccgggcgaccagttcgaaattcagctcacacaacagctgcagagcttaattccaaacaataacgtgcggaggttgatcgctcacgtgatcagaaccctgaagatggattgttccggagcacacgtccaggtgacatgcgcaaaacttatcagccggacaggtcaccttatgaaactgctcagcgggcagcaggaggtgaaggcctcaaaaatagagtgggataccgaccagtggaaaattgagaactatatcaatgagagcaccgaagcccagtctgagcagaaggagaaatcattggaattgaaaaaggaggtgcctggttacggctacaccgataagttaatactggccctgattgtcacggggatattaaccattttgattatcttattctgccttattgtcatctgctgccataggcgatcgttgcaggaggatgaggaaggcttctcccgagattcagaggctccaactgaggaggaggagagcgaggcactgccatag

SEQ ID NO: 52074 - DNA, 4908 bp, Artificial Sequence
  Description of Artificial Sequence: Synthetic coding sequence
atgaccagcgcccagtgccccgccctggcctgcgtgatgagccccttaaggttttgggggccctggcctctgttaatgtggcaattattgtggctcctggttaaagaagctcagccactggagtgggttaaagatccccttcagctcacatcgaaccctttgggcccgccggagccctggtcttctcactccagccacttccctagggagagtccccatgcccctaccctaccagctgatccatgggacttcgatcatctcggcccaagcgcctcttcagaaatgccagctcccccccaggagagtaccgaaaaccttgtaccattcctggatacttgggattcggcaggcgaacttcctctggaaccagagcaattcttggcctcacagcaggacttgaaagacaagttgtccccacaggaacgccttcctgtctctccaaagaaattgaagaaggatcccgcccaacgatggtcacttgcggaaataattggcattattcgacagttgtcaacccctcagagccagaagcagactctacagaatgagtatagctccaccgatactccctatccaggaagtctgcctcccgagctcagagtaaagtctgatgagccccccggaccctctgaacaggtaggaccaagccaatttcatctagaacccgagacacagaatcccgagaccctggaagacattcagtcctcctcattacagcaggaggcacccgcacagttgccacagctgctggaagaggagcctagttctatgcagcaagaagcccccgccctgccgccagagtctagcatggagtcactgaccctgcccaaccacgaggtaagcgtacagcctcccggagaggatcaagcgtactaccatctgcctaacattacagtcaagcctgcagacgtggaagttactatcacatccgaacccactaacgaaaccgaatcttcgcaagcccagcaagagactcccattcaatttcctgaggaagtcgagccttcagcaacgcagcaggaagcccccattgagcctccagtgccacctatggagcacgagctgagtataagtgagcagcagcagcctgtgcaaccttcggaaagtcctagagaggttgaatcatcacccactcagcaggagacgcctggtcagcctcccgaacaccacgaagtgacagtgtctcctcctggccatcaccagacacatcacctggcctctccatccgtctccgttaaaccgcccgatgtgcagctgaccatcgctgctgagccatccgccgaagtgggaacttcattggtacaccaagaggccactactcggctctctggatctggtaacgatgtcgaaccacccgccatccaacacggcggcccacccttgttgcctgagagttccgaggaggcaggacctttagctgttcagcaagagacttcctttcagtccccggagcccatcaacaacgaaaacccttctcccactcagcaggaagcggcggccgagcatccccaaacagccgaggaaggcgaatcaagccttacacaccaggaggctcccgctcagaccccagagttcccgaacgtcgtcgtggctcagccccctgaacactctcacctcacacaggctactgttcagcctctggacctaggattcaccattacgccggagtctaagactgaagtagagctcagccccacgatgaaggaaacccctacacaacccccaaagaaggtggttcctcagctgcgagtgtaccagggggtcactaatcccacacctgggcaggaccaagcacaacatcctgtgtcaccaagtgtcaccgtgcagctcctggatctgggactgacgattaccccagagcctacaactgaagtgggccacagcactccaccaaaacgaactatcgtctctccaaaacatccggaggtgacccttccgcacccagaccaagtccagactcaacactcccacctgacacgggcaacagtccagcccctggacctggggttcaccatcaccccaaaatccatgaccgaggtggaacccagcacagcacttatgactactgccccaccccctggacaccccgaagtgactctgccaccctcagataagggccaagcgcagcactcccacctgacgcaggcaaccgtccagcccctggacctggagctgaccattaccaccaagcccactacagaagtgaagccctcccctacaaccgaagagaccagcacccaacctcctgatcttggactagccatcattccagaacctaccacagagacggggcactccacagcacttgaaaagaccactgctcctcgacctgatagagtgcagactttgcaccgttctttaacagaggtaactggcccccccaccgaactcgaacccgctcaagactccctcgttcagagtgagtcttatacacagaacaaagccctaactgctcctgaggagcataaagcctctacttccacgaacatttgtgagctgtgtacctgtggagacgagatgctgtcttgcatagatcttaacccagagcaacgactgcgtcaggtaccagttcccgaacccaatacgcacaatgggacattcacgattctgaattttcaaggaaattatatttcatacattgatggaaatgtctggaaagcctattcgtggaccgagaaactcattttgagggaaaataatctcacggaactgcataaagattccttcgaggggctgctttccctgcagtacctcgatttgtcgtgcaataaaatacagtctatcgagagacacacatttgaacctctgccgtttctgaaatttatcaacttgagttgtaacgtgattacagagctttcattcgggacatttcaggcgtggcacggcatgcaattcctccataaactgatcctgaaccacaacccacttaccaccgttgaggacccctacctttttaagttgcctgctctgaagtatctggacatgggcactacgctggttccactgaccactcttaaaaatatcctcatgatgacggttgagctcgagaagcttatcctgcctagccatatggcctgctgcctgtgccagtttaagaattctattgaggcagtgtgtaagaccgtaaagctccactgcaatagtgcatgtttgacgaataccacccattgtcccgaggaagcaagtgtgggtaatcctgagggcgcgttcatgaaagttttgcaggcgcggaaaaattatacctctacagaacttatcgtggagcctgaggaaccctccgattcctcaggcattaatttatccggcttcggatcagaacagctggacaccaacgatgaatcagactttatttccactcttcgctatatcctgccttacttcagcgccgttaatctagacgttaaatccctcctgttaccccttattaaactgccaacgacaggcaattccctagccaaaattcagacagttgggcaaaataggcagagggtgaagcgcgtgcttatggggcccaggtcgatccagaagagacattttaaagaagtcggccgacagagcatcaggcgcgagcagggtgcccaggcaagcgtagaaaacgccgcagaagaaaaacgcctggggtcaccagcgccacgggaggttgagcagccgcacacacagcaggggcccgaaaagttagctgggaacgccgtctatacaaagccatcctttacccaggagcataaggccgcggttagcgtgctcaagcctttttccaagggagccccatcaactagctcacctgccaaggctttaccacaggtgagagatcggtggaaggatctgactcacgccatctctactctcgaatcagccaaagcacgcgtcaccaacaccaaaacaagcaagcccattgtgcatgcccgcaagaagtatcggtttcacaagaccaggagtcacgtgacgcaccgcacacccaaagtgaaaaaatcaccaaaggtccgaaagaagtcttatttgtcccgcctgatgctggctaatcgccttcccttttctgccgcaaagtcccttattaattccccctctcagggtgcatttagctcactgggcgacctgtcacctcaggagaatcctttcctagaagtgtctgccccctcagagcacttcatcgagaaaaataatacaaaacacactacggctcgtaacgcattcgaggaaaacgacttcatggagaataccaatatgcccgaaggcacaatttcggaaaataccaattataatcacccgcctgaggcagattccgccggaacagcttttaaccttggacccacagtcaagcagaccgaaacaaagtgggaatataataatgtagggaccgatctgtcacccgaacccaagtccttcaattatcctctgctttcctctcccggcgatcagtttgagatccaactgacgcagcagttgcaatccctcatccctaataataacgtgcgtagactgattgctcacgtcatcagaacactgaagatggactgcagcggtgcgcacgtacaggtgacctgcgccaagctcatttcacgtacgggacacctaatgaagttactgtctggacaacaggaggtcaaggcatccaaaatagagtgggatacggaccagtggaagatcgaaaattatatcaacgagtcaaccgaggcccaatccgagcagaaggaaaagtctctcgaactgaagaaggaggttccaggatacggatacacagataaactgatactggcgctgattgtaacagggattctgaccatcttaatcatattattctgtctgattgtcatttgctgccaccgccgatccctgcaggaagacgaagaaggcttttcacgcgattcagaagcccccaccgaagaggaagagagcgaggccttgccttag

SEQ ID NO: 52075 - DNA, 2262 bp, Artificial Sequence
  Description of Artificial Sequence: Synthetic coding sequence
atggagttccaccgggtggcccaggccggcgtggagctgctgagctcaggtgatcccccggctagcgcttcacagagcgttggaatcattggcgtcagccactgcacatggcatatcaactttcaaggaaactatattagctacattgatggaaacgtgtggaaagcctactcttggactgaaaaactgattctccgggagaacaatctcaccgagctgcataaggactcttttgaagggctcctgtctctacagtacttaatcctcaatcataacccactgaccacagtcgaggacccatacttattcaagctccccgctctgaaatacctggatatgggaacaacattggtgcccctaaccacgctgaagaatattctcatgatgactgtagaactggaaaagctgatccttccatctcacatggcctgttgtctttgccagttcaagaatagcatagaggctgtctgcaagactgtcaagttgcattgcaactccgcctgcttaacgaacacgacacattgtccagaagaagccagcgtcggcaatcccgagggggcgttcatgaaagtgctacaagcaagaaagaattacacttctaccgagctcatagtcgaacctgaggaaccttccgatagtagtggaatcaacctgagcggttttgggtcagagcaacttgacaccaacgacgaatccgactttatttccaccctcagatatattctcccatactttagtgcagtaaacctcgacgtgaagtccttgcttctgcctctgatcaagcttcctacaactggaaacagccttgctaaaatccagacggtaggccaaaataggcagagagtgaaacgggtcctgatgggcccaagaagcatacaaaagagacatttcaaggaggtgggccgccagtctataaggcgtgagcagggggctcaagccagtgtggagaacgcggccgaggagaaacggctgggtagcccagccccccgagaggtggaacagccccacacccagcagggaccggaaaaactggcaggcaatgccgtttacaccaaaccttcgttcactcaagagcacaaagccgcagtgtctgttcttaagcccttttcaaagggcgcaccgtctacttcttcccctgctaaggcccttccccaagtgcgggacagatggaaggatctgacccatgcaatttccacactggagtcggccaaggccagggtgaccaacacaaaaacgagcaaacccattgtgcatgcgaggaagaaataccgctttcacaagaccagatcccacgtgacccaccgaactccgaaggtcaaaaagagccctaaggtgcggaagaagtcttacctttcacgtctaatgttagcaaaccggctgccgttcagcgcagccaaaagcctgataaacagtccttcacaaggcgccttttcaagccttggggatctttcaccacaagagaaccccttcctggaagtctcagccccatcagaacacttcatcgagaagaataacaccaaacacacaacagcccggaatgcctttgaggagaatgactttatggaaaatacgaatatgcctgaggggacgatcagtgaaaacaccaattataaccacccccccgaggccgattccgccgggacagcctttaacctcgggccgacggtgaaacagacagagacaaaatgggaatataataatgtggggaccgatctgtcgcctgagccaaaatctttcaactatccactgctctcaagtccaggcgatcagtttgagatccaactcactcagcagctgcagtctctcatccctaacaataacgtgaggagactgatagctcacgtcatccgcacgttaaagatggattgctcgggggctcacgttcaggtgacgtgtgctaaactgatatctaggactggtcaccttatgaaactgctctctggccagcaggaggtaaaggcttctaagatagaatgggacaccgatcaatggaagatagagaactatattaacgagagcacggaggcacagagcgaacagaaagagaagtccctcgagctcaaaaaagaggtgccggggtatggttacacagataagctgatcctggccctgatcgtgactggaattctgaccattctgatcattctcttttgccttatagtaatttgctgtcataggaggagtctgcaagaagatgaggagggcttttccagggatagcgaagcaccaacggaggaagaggagagcgaagccttaccatag

SEQ ID NO: 52076 - DNA, 372 bp, Artificial Sequence
  Description of Artificial Sequence: Synthetic coding sequence
atgcagagcgagaagccccagggcctgttcctgcagctgaaccccaacgcatcctctacggagacccagctcctggtgcccgcgttagaatcccgcgataccctgccccctacccactgcttcatggcggggaccgagagcccccttgggaatccctggccccttagtctgccacctccctgttggaccggctgtgtgctcccagcacctcgtggtcagcggaagccaggcccactcgggctgtccattttcatatcactggggaacaaaaggcacagatccgggaaccatgtagtacgggaatccgaacagcccctgagccagggcaatcctcaccaagggtggggccctgacaccagaaagggccgctag

SEQ ID NO: 52077 - DNA, 876 bp, Artificial Sequence
  Description of Artificial Sequence: Synthetic coding sequence
agcgccggcggcggcggcgccggcagccggctgcaggccgagatgctccaaatggacctgatcgacgccacaggcgactccactcctgatgagcccgatgttcactttagcaagaaatttctcaatattttcatgtctggcaggagccggtcctcttcagccgaaagcttcgggctctttagctgtattattaacagggaggaacaggagcaaacccacaggactatcttcagatttgtccctaggcatgaggatgaacctgagctcgaagtagacgatcccctgttggtcgagcttcaggcagaggactactggtacgaagcttataacatgcgtaccggagcacggggctttttcacagcttactacgcaatcgaggttaccaaggaaccagagcacatggccgccttagccaaaaactccgattgggtcgatcagtttagagtcaagttcctcggcagtgtgcaggtcccctatcataagggggacgtggtactatccgctgccatgcagaaaatagctacaactcggcgcctcactgtgcactttaacccgccttccagctgtgtgttggagatctccgttaggggtgtaaagattggagtaaaggccgacgactcccaggaagctaaaggcaacaaatgctctcattttttccagttgaagaatatttcttttcggggataccaccctaaaaataacaagtacttcggctttatcacaaaacacctcgcagaccataggttcgcttgtcacgtgttcgtgtcagaagactccacgaaggcgctagccgagagcgtaggaagagccttccagcagttccacaagcaattcgtggaatatacgtgccctacagaggacatctacctggagtag

SEQ ID NO: 52078 - DNA, 2055 bp, Artificial Sequence
  Description of Artificial Sequence: Synthetic coding sequence
atggcctgcctgggcttcctgctgcccgtgggcttcctgctgctgatttcaaccgttgctggggggaagtacggcgtagcccacgtcgtgtcagaaaactggagcaaagactactgtattctgttttcttctgactacatcaccttgccaagggatctgcaccacgctcctctgctgccgctgtatgacggaaccaaggccccctggtgtcccggagaagactcccctcaccaggcccagctccggtctcctagccagagacctttgcgacaaacgaccgccatggttatgcgcgggaactgtagttttcataccaagggttggctggcccagggccagggggcccacgggctgttaatcgtttctagagtcagcgaccagcaatgctcggataccacactggcgccacaggacccacgccagcctcttgctgacttaaccattccggttgctatgctccattatgctgacatgcttgacatactatctcatacaagaggcgaggccgttgtgagggtcgccatgtatgccccgcccgagcccattatagattacaacatgttggtcattttcatcctggcagtcggcactgtggccgcgggcggctattgggctggcctcacagaggctaatcgcctgcagaggcggcgagctcgcaggggcggaggccccgggggtcaccaccagctgcaggaggcagcagccgctgagggggcccagaaagaagataacgaggacatcccggtggacttcacccccgctatgactggcgtcgtggtgaccctgtcatgttccctgatgcttctcctctacttcttttatgaccattttgtgtacgtgactatcggcattttcgggttgggggctggaattgggttatatagttgcctgagccccctggtctgccgcctgagcttgcggcagtatcagcgaccgccgcattctctgtgggcaagtttgccattgccactcctcttgttggcctccctttgtaccacggtgattatattctgggtggcctatagaaatgaggaccgatgggcgtggctcctacaggacactctgggaatctcctactgcctgtttgtcctgcatagggtcagactgccgaccttgaaaaactgtagctcctttttactcgctctcctggcctttgacgtgttcttcgtgtttgtgaccccttttttcaccaagaccggagagagtattatggctcaggtggcgctcgggcccgctgagtctagctcccacgagaggctaccgatggtgcttaaagtcccacgtcttcgcgtatctgctttaactctttgtagccaaccgttcagcattctgggatttggggatatagtggtacctggattcttagtcgcctactgctgccccttcgacgtccaggtgtgcagccgacaggtttactttgtggcgtgcacagtggcctacgccgtcgggcttctggtcaccttcatggctatggtgctcatgcaaatggggcaacccgcgctgctttacttagtgagcagtactctcctgacatctttagccgtggcggcctgccgccaggagctatctctcttttggacaggccaggggagggccaaaatgtgcgggttaggctgcgccccatccgcagggagcagacagaagcaggaaggcgcggcagacgcacatacagcgagtactctcgaacgcggcacctcaaggggagccggtgatctagacagtaaccctggggaagacacaacagaaattgtgaccatctcggagaatgaagccacgaatcccgaagacaggagcgattctccagagggctggagtgatgcacatctggacccgaatgaactcccttttattcctcctcgcgcatcagaggagttgatgcccctgatgccaatggcaatgctgattccccttatgcctcttatgcccagaccgagcgagctgggacacgtacacgcccaggcccaagcacatgagactggtttgccgtgggctggtttacataaaagaaaagggctgaaggtccgtaagtctatgtcaacccaagcccccctctag

SEQ ID NO: 52079 - DNA, 372 bp, Artificial Sequence
  Description of Artificial Sequence: Synthetic coding sequence
atgcagagcgagaagccccagggcctgttcctgcagctgaaccccaatgcttcatctacagagactcagctgctcgtgcctgccctcgagtcacgtgatactctgccgcccactcactgtttcatggccggcacagagtcccccctagggaatccttggcctctgagtctgccccccccatgctggaccggatgcgtgcttcccgccccccgcggacagcggaagcctggacctctcggactgagtatctttataagtctggggaacaaacgtcacaggtctggaaaccacgtggtccgggaatctgaacagcctctgtcccagggcaatccgcatcagggttggggacctgatactaggaaaggccggtag

SEQ ID NO: 52080 - DNA, 2025 bp, Artificial Sequence
  Description of Artificial Sequence: Synthetic coding sequence
atgcagttctacaccctgaagatcatcctgaaccacaaccccctgaccactgtggaagacccttatctgttcaaactgccagccctgaaatatcttgacatgggaaccaccctggtgcctctcacgactttgaaaaacatacttatgatgactgttgaattggaaaaactcatcctgcctagccatatggcatgttgtctgtgccagtttaagaacagcatagaggccgtctgcaagacagtgaagctgcactgcaacagcgcctgtctcacaaacaccatccattgcccggaggaagcttccgtgggcaaccctgaaggcgcattcatgaaagtactccaggcgaggaaaaattatacaagcaccgagttgatcgttgaaccggaggagccatccgactcttcagggatcaacttaagcgggtttggcagtgaacagctcgatacaaacgatgaatctgactttatctcaacgctacggtacattttgccatacttcagcgccgtgaaccttgacgttaaaagcctgttactgccgctgatcaaactccccaccaccggcaacagcctcgcaaagattcagactgtcggccaaaaccgccagagggtgaaacgcgtcttaatgggaccacgctcaatccagaaaagacattttaaagaggtcgggcgccagtctatccggcgggagcagggcgcccaagcgagtgtggaaaatgcggcggaggagaagagactgggatctccggctccccgcgaggtggaacagccacacacccaacagggcccagagaagcttgcggggaacgccgtgtacaccaagcccagcttcacacaggagcataaggctgccgtctcggtgttaaagcccttcagcaagggagcaccatctacctcttcccccgcaaaggccctcccgcaggtacgtgacaggtggaaggatttaacccacgccattagcatacttgagtcagccaaggcccgggtgacaaacaccaagacctccaaaccaatcgtgcatgccaggaagaaatatcgtttccataagacgcggagccatgtgactcacaggactcccaaagtcaagaaatctccaaaggtgaggaagaaatcctatttgagccgcctgatgctcgcaaacagactccctttctccgcggccaaaagcctcataaattcccccagccagggcgccttctcttccctgggggacctctcgccacaggagaacccatttctggaggtgtctgctccaagcgaacatttcattgaaaaaaataacacaaagcacacgacagctaggaacgcattcgaagaaaatgattttatggagaacaccaacatgcccgagggcaccatctccgagaacacaaattacaatcatccaccggaagcagattcggctggcaccgccttcaatctgggaccaacggtgaaacagacagagacaaagtgggagtataacaatgtgggtaccgacccctccccagagccaaagtccttcaattaccctctactcagctccccgggggaccagttcgagattcaattgacgcagcaactgcaaagcctgattccaaacaataatgttcgcaggctcattgcccacgtaatccgtacgttgaagatggattgctccggggcccacgttcaagtgacatgtgccaaactcatatctcgaaccggacacctgatgaaactgctgtccgggcagcaagaggtgaaggctagcaagatagagtgggacaccgatcagtggaagatcgaaaactacattaacgagagtacggaggctcagagtgagcagaaggaaaaatcccttgagctgaagaaggaagttccagggtatggctatacggacaagctgatcctcgcgcttattgtaacagggatcttaactatccttattatcctcttctgcctgatcgtcatatgttgtcatcgccgaagcctgcaagaggatgaggaaggatttagccgcgactctgaagcccctactgaggaggaagaatccgaagccctgccttag

SEQ ID NO: 52081 - DNA, 393 bp, Artificial Sequence
  Description of Artificial Sequence: Synthetic coding sequence
ggcgcccggagccccggcagcacccaccagggcagcctggccagcggggtgttgcctattaaatgctcacatgttgagttcgggatgtggaagggcgggcgttcacaccctttcctccctcacagttccaggtgtgccggttcagggggccaactggactctatcctgcctcaccagtctcctgcttggggcccctgggggtgtaaggacctatcatctggattccctagcttcttaacttcaagcatcctctggaagtccgcggtcgtgcgggaacctcatatcagtccacaccaggcacccccctacaagacctctgactgcattcgggctatttcctttcctgtttgtactattcaccaggagattatgaggggccactggcataagtag

SEQ ID NO: 52082 - DNA, 876 bp, Artificial Sequence
  Description of Artificial Sequence: Synthetic coding sequence
agcgccggcggcggcggcgccggcagccggctgcaggccgagatgctgcagatggatttgatagatgcgacaggagactccacaccagacgagcctgacgtgcacttctctaaaaagttcctgaatatatttatgagtggccggtcccgtagcagcagcgccgagtcattcggtctgttttcctgcatcattaacagggaagaacaagaacagacccaccggacgatatttaggttcgtgccccgccacgaagatgagcctgagctggaagttgacgatccactgcttgttgaattacaagctgaggactactggtacgaggcttataatatgcggaccggcgccagggggttctttacagcctattacgcgatcgaagtgacaaaagagccagaacatatggctgcactggccaaaaatagcgactgggtcgaccagtttcgggtgaagtttcttggcagcgtgcaggtgccttatcataagggggacgtggtgctttccgcagctatgcagaagattgcgactaccagaaggctaacggtgcactttaatcctccctcatcctgtgtccttgagatcagcgtgcgaggggtaaaaatcggggtgaaagcagatgattcccaggaggctaagggtaataagtgcagtcacttttttcaactgaagaatatttcattccgaggctatcaccccaagaataacaagtacttcggttttattaccaaacatctagcagaccacaggttcgcgtgccacgtgttcgtcagtgaggactctacaaaggcactggctgagagcgtgggccgtgccttccagcagtttcataagcagtttgtggagtatacttgcccaacggaagacatctacctggagtag

SEQ ID NO: 52083 - DNA, 1593 bp, Artificial Sequence
  Description of Artificial Sequence: Synthetic coding sequence
atgagcctgaagtggaccagcgtgttcctgctgatccagctgagctgttatttttctagtggtagctgcgggaaggttttggtgtggccaacggagtatagtcactggatcaatatgaaaaccatactggaagaactggtgcagcgaggccacgaggtaaccgtgctcactagctctgcttctaccctcgtgaacgccagtaaatcctctgccattaaactagaggtgtaccctacctccctcacaaaaaacgaccttgaggacagtctgctgaagatcctagatcggtggatctacggcgtgagcaaaaatactttctggagctacttttcccagctccaggaactctgttgggagtactacgattatagcaacaagttgtgcaaagacgcagtgcttaataaaaaactcatgatgaagctgcaagaatctaagttcgacgtgatactcgccgacgccttgaacccttgtggcgagcttctggctgagctgtttaacattcccttcctctactccttgcggtttagtgtaggttataccttcgagaaaaacggcggcggcttccttttccccccctcttacgtgcccgttgtgatgtcggaattgagtgaccaaatgatattcatggagagaatcaagaatatgattcatatgctgtattttgacttttggtttcaaatttacgacctcaagaaatgggaccagttctactcggaggttttaggcagacccacaactttatttgagaccatgggaaaggctgagatgtggctaatcaggacctactgggactttgagttcccgcgcccctttctgccaaacgttgatttcgtagggggcctgcactgcaagcccgccaagcccctgcccaaggagatggaagaatttgtgcagtcttccggagagaatggcatcgttgtttttagtcttgggagtatgattagtaatatgtctgaggaatccgccaacatgatcgcctcagctttagcacagatcccacagaaggtcctgtggaggtttgacggaaagaagccaaacacattgggatccaacacccgattatacaaatggctgccccagaatgacctgttaggccaccccaagactaaagcctttattacacacgggggcacaaacgggatttacgaggcaatttaccacggtatccctatggtggggatcccgctttttgcggatcagcacgacaacatagcacatatgaaagccaaaggtgctgcattatctgttgacattagaaccatgtcctcaagagatcttctaaatgccctcaaaagcgttattaatgatcctgtatataaagagaacgtcatgaagctaagtcggatccaccatgaccagccaatgaaacccctcgatcgggctgtattttggatcgaattcgtgatgaggcacaaaggagcaaagcacctgcgcgttgccgcccacaatctgacctggattcaatatcactcgctcgacgtgattgcgtttctgctggcatgcgtggccaccgtcatctttatcataaccaaattttgtctcttctgtttccggaaactagccaagaaaggaaagaagaagaagagggactag

SEQ ID NO: 52084 - DNA, 102 bp, Artificial Sequence
  Description of Artificial Sequence: Synthetic coding sequence
atgctgaacttcgacatcagcgccgccccccggaagaccgccctgatgaagctggaaaccattatccacagcaaactcctgcagggccagaaaactaagtag

SEQ ID NO: 52085 - DNA, 375 bp, Artificial Sequence
  Description of Artificial Sequence: Synthetic coding sequence
atgaccctgaacgagcacgccgccttcaagcacctgttcaacaaggcacatctggcccccccacttatccatctgaccctgtcaggacattcaacatgcttccgggagcaccgggtgggcggcaaggttaccgaccagcaggacccaaaagctgaagaattctttctcgtccagaacaagatgaaatccctgccgtgtctcctcttgagcacccagaccggtcagccgtctgatttttccatattttccccaccctttcctccattttactccacaaagccccccctgagttcctggccaatccccaacgagccattaggaacgcctcctagaaggggcagaggccgggcggagggtttactgacttctcagtag

SEQ ID NO: 52086 - DNA, 474 bp, Artificial Sequence
  Description of Artificial Sequence: Synthetic coding sequence
atgcacccctggctgggcagcgccctgggcttccccaagtgccggggtatccatctgtgcgcctgcggcaatggctggacgcccggggaaaccctgagtcagaataaaaccgaaatcaccaaaaacaaggtgacatgctggaggcctcatggctgcgaaccaaacacaggcctcgggtatcagggctcacatactagcaagtataccctcttaccttggaatctcctgaagaccaagccattaccgccctcacatggaaaagaaggcggcaaggaagccaaagtgccatcaggagacaactcagggcgaggcgaggtccctcgagctcaagagggccaggcggcgtgtggtcgggctgcctccggggactctcaggaaggaatgaggcgaggctgtgaggagcgcgcaaccgctcaacgtccagcagttaggtcagccgagactaccgcccacggaacctggatctatccttag

SEQ ID NO: 52087 - DNA, 612 bp, Artificial Sequence
  Description of Artificial Sequence: Synthetic coding sequence
atgggcaacatcttcgagaagctgttcaagagcctgctgggcaagaagaagatgaggatccttatactcagtctggacacagcgggtaagacaaccattttgtacaaattgaaactgggtgaaacggtccccgccgtgcccaccgtcggtttttgcgtagagacggtcgagtacaagaacaacacctttggagtgtgggatgttggaagtcattttaaaatccgccctctatggcagcactttttccaaaataccaaaggtgcacgatcgcccggttccacacaccaggggtctttggctagcggcgttcttccaatcaaatgttctcacgttgagttcggtatgtggaaaggcggaaggtctcatccattcttgccccattcttctaggtgcgcaggcagcggcggacagttagactcgattctgcctcatcagtctcccgcctggggaccctggggttgtaaagacctatcatccggctttcccagctttctgacgtcttcgatcctctggaagtctgcagtcagttaccagctgccatccctgcacaattcatctaggaactatgcagggtcactggcccagatgatgagacacctgctggaagcctag

SEQ ID NO: 52088 - DNA, 1701 bp, Artificial Sequence
  Description of Artificial Sequence: Synthetic coding sequence
atgaagatgcagaagggcaacgtgctgctgatgttcggcctgctgctgcacctcgaagccgccactaacagtaatgagacaagtacttcagccaacaccgggagttctgttatttcttcgggcgcctccactgccacaaacagcggtagctccgtcacctcgtctggggtgagtacggcaacaatctcaggatcctcagtaaccagtaacggagtgtcaatcgtcaccaatagcgagtttcacactacatcttctggaattagtacagcaaccaatagcgaattctcaaccgctagttctggtatctctatcgccaccaattctgaatcctcaaccacctcgtctggcgcaagtacagcaactaactccgagagctccactccaagttccggggcaagcacagctactaatagtgaaagttcaacactgagctccggtgcctctaccgccaccaactcagattccagcacaacatcaagcggcgcaagcaccgctacaaatagtgaatcatctactacatcatctggcgcgtcaaccgccacgaactcggaaagctctaccgtaagcagtcgggccagcaccgccactaacagcgagtccagcaccactagtagtggggcttccaccgccactaactctgaatccaggaccacgagcaacggcgcggggacagcgaccaattcagagtcttcgaccaccagcagcggcgcttcaacggccacaaactctgacagctccacaacctccagcggggccgggactgcgactaatagcgagagctcaaccacaagttctggggcgagcaccgccacaaattcggagagctcgactacaagctcaggggccagtacagcgacaaactcggatagctccacaacatctagtggcgcaggaaccgccactaacagcgaaagcagtacagtcagctctgggatctctacagtgactaatagcgagtcttcaacacccagtagtggggccaacaccgctacgaattccgagtcttctactacatcgtcaggagctaatactgccacaaactcagagtcttcaacagtgtcaagcggagcatcaaccgccacaaactctgaatcttctaccacatcttccggggtgagcactgcaacaaacagcgagtcttcaactacatccagcggcgcgagcaccgccaccaatagcgacagttccactacctcttctgaggcgtccaccgccacaaatagtgaaagttcgacagtgagttctgggatcagtactgtgacaaatagcgaaagctctaccacaagctccggggctaacacggctactaacagcggcagtagtgtcaccagcgcgggttctggcactgccgctctgaccggaatgcacaccacgtctcacagcgcctctaccgctgtgagtgaggccaagccgggaggctccctggttccctgggaaatcttcctgatcaccctcgtaagcgtggtcgccgccgtgggtctgttcgccggcctttttttttgcgtgaggaattccttgtcactgcgcaacacattcaatacggctgtgtaccatccccatgggctcaaccacggcttgggcccaggaccaggggggaaccacggggcgcctcacaggccgcgctggtctcctaattggttttggaggcgtcctgtgagctccattgctatggaaatgagcggcagaaattcaggcccttag

SEQ ID NO: 52089 - DNA, 4908 bp, Artificial Sequence
  Description of Artificial Sequence: Synthetic coding sequence
atgaccagcgcccagtgccccgccctggcctgcgtgatgagccccctacggttctggggcccatggcccctcctgatgtggcagctcttatggctgttggtgaaggaggcacaacccctcgagtgggtgaaagatccacttcagctgacttctaacccgctcggaccacccgaaccctggtccagccatagttctcactttccacgtgagtcaccgcatgcgcccaccctgccagctgacccttgggacttcgaccatttgggcccttccgcctcctccgaaatgcccgccccccctcaggagtctacagagaacctggtaccttttctggacacatgggactccgctggggagttacctttggaacctgagcagtttctcgcgagccagcaggacctgaaggacaagctaagtccccaggaacggcttccagtgtcacccaaaaaattgaagaaggaccccgcacagagatggagtctggccgaaataattggtattattaggcaactctccaccccacaatctcagaagcagaccctgcaaaatgagtatagctcaacagataccccatatcccggctccttgcccccagaactcagagttaaatcagacgagcctcccggaccgtctgaacaggttggtccatctcaattccatctggagcccgaaacccaaaacccagagaccttggaagacatccagagtagtagtcttcagcaggaggcccctgcccaacttccacaactgctcgaagaggagccttccagcatgcagcaggaggctccagccctgccccctgagagcagtatggagagcctgacactaccaaatcacgaggtgtccgtgcagccccccggcgaagaccaggcctattatcacctcccgaatattaccgtgaagcctgcggacgtggaggtcacaataacttcagagcccacaaatgagacagagagctcccaggcacagcaagaaactcctattcagtttccagaagaggtcgaacctagtgcaacccagcaggaggcacccattgagcccccggtacctccaatggaacacgaattgagcatcagcgaacaacagcaacctgttcagccctcagagtcacccagagaggtggagtcaagccccacacaacaggagacaccagggcagccccccgagcatcacgaagtcacagttagtcctcccggacatcatcaaacacaccacctcgccagtccaagcgtgtctgtgaagccccctgacgtgcaattgactatcgccgccgaaccatctgcagaggtcggtacatcactggtgcatcaggaggctacaaccaggctgtccggatcggggaacgacgttgagcccccagcaatccagcacggaggcccccccctcctccccgaatcttctgaggaggctgggcccctcgctgtacaacaggaaacctcatttcagagtcccgagcccattaataatgaaaacccttctccaacacaacaggaagccgccgccgaacacccacagaccgcagaggagggtgagagcagtttgacgcatcaggaagcgccagcccagacgcctgaattcccaaatgtggtggtagcccagcctcctgagcattctcatctgacgcaagccaccgttcagccactagaccttgggttcacgattacacccgaaagcaagacggaggtcgagctgtctcccactatgaaagagaccccgacccagccccctaagaaggtggttcctcagctccgggtttaccagggagtgaccaatcctaccccaggccaggatcaagcccagcacccggtgtcaccatccgtgacggttcagctgttagatctaggactgaccattactcccgaacccacgaccgaagttgggcactctacaccccccaagcggactattgtatcaccgaagcacccagaggtgactcttccacaccctgaccaggttcagacccagcattcacatctcacaagagccacagtgcagcccttagatcttggatttaccatcactcctaagtctatgaccgaggtcgagccatctacggccttgatgacaaccgcacccccgccaggtcatccggaagtaacactgccacccagtgacaagggtcaagcccagcatagccacctgacccaggctacggtgcagcctttggatctggaactgacgatcaccactaaacctacgacagaggtgaagccttcaccaacaacggaggagacctctactcagcctcctgacctgggcctggccatcatccctgagcccaccacagagaccggccactctactgcactcgagaaaacaacagcgccacgcccagatagggtccaaacactgcacagatccctgacagaggtcaccggccctcctaccgaactggagccagctcaggacagtctggtccagagcgagtcttacacccaaaacaaggccttgacggcgccagaggagcataaggcctccaccagtacaaacatctgcgaattgtgtacctgtggcgatgagatgttatcatgtattgacctgaatccggagcaacgtctgaggcaggtccccgttccagagccgaacacccacaatggaacctttaccatattgaactttcaaggaaactacatctcatatatcgacggcaacgtgtggaaggcctactcatggactgagaagctgatcctgcgcgaaaataatctgaccgagctccacaaggattcattcgagggcttgttgtccctccagtatctcgacctgtcctgtaacaagatccaaagcatcgagaggcacactttcgagcccctcccctttctgaaattcattaacctcagctgtaacgttatcactgaactgtcgtttgggacctttcaggcgtggcacggcatgcaattcctccacaaactgatcttgaatcataatcccctcactacggtagaggatccctacctctttaagcttcccgccttgaagtatctggacatgggtaccacattggtacctttaaccacacttaagaatatcctcatgatgaccgtggagctggaaaaactgattctgccttcccatatggcatgttgcctttgtcagtttaagaattcaatcgaagcagtttgtaagactgtcaagctgcactgtaacagcgcgtgtctgaccaacaccattcattgccccgaggaggcctcggtcggcaaccccgaaggagccttcatgaaggtattgcaggctcgcaaaaactacacatctaccgaactgattgtagagccagaagaaccaagcgacagcagcggcattaatctgtcaggattcggctccgagcaactcgacacgaacgacgagtccgatttcatttccactctgagatatatcctgccctatttctccgcagtgaatttagacgttaaaagtctgctcctgccactgatcaaattaccaaccaccgggaatagtttagctaagattcagactgttggacagaaccgacagcgcgtgaagcgggtgctgatggggcctcgctcaattcagaaaagacatttcaaagaggtgggacggcagtcaattcgacgcgaacagggcgcccaagccagcgtggaaaacgctgccgaagagaagcggcttgggtcccctgctccgcgcgaggtggagcagccgcatacacagcaagggcctgagaagctcgctggcaatgccgtgtacaccaaaccctccttcacccaggagcacaaagccgctgtgtctgtactgaagcccttttcaaaaggtgcccctagcaccagtagcccagccaaagcactgccacaggtgagggacaggtggaaggatctgacccatgctatctctattttggagtccgcaaaagccagagtcaccaatacaaagacctctaagcccattgtgcatgcaaggaaaaaataccggtttcataaaactagaagccacgtcacccacaggacacctaaagttaaaaagtccccgaaagtgagaaagaaatcttatttgagtagactgatgcttgccaatcgactcccgttttctgctgcaaagtctctcatcaacagcccatctcagggcgccttctccagtctgggagatcttagcccccaagaaaaccctttcctggaagtctctgcacccagcgaacactttatcgagaagaataacaccaaacacacgaccgcccgaaacgcattcgaggaaaacgatttcatggaaaatactaatatgccggagggtacgataagtgagaacacaaattacaatcatccgcctgaggctgatagtgccggaacagctttcaatctgggccctaccgtgaagcagaccgaaactaagtgggagtataataatgtgggcaccgacccatcaccagagcccaagtcgtttaactaccctctactctcgagcccgggtgaccagtttgagattcaactaacccagcaactgcagtcccttatccctaataataacgtcaggcgcctaatcgctcacgtgatacgaactttaaagatggattgctctggtgctcacgttcaagtcacatgcgcaaaacttattagccgcaccggacacctgatgaaactcttatctggacagcaggaggttaaggcgagcaagatcgaatgggacacggaccagtggaaaatagaaaactacatcaacgagtctaccgaagcacagtcggagcagaaggagaaatccctggagctgaagaaggaggtgcccggctacgggtatactgataaactgatcctggcattgatcgtgactggaattctcaccatcctcataattcttttttgcttaatcgtgatctgctgtcaccgacgaagccttcaagaagatgaggagggcttctcccgtgacagcgaggcccccaccgaggaagaggagtccgaagcattgccctag

SEQ ID NO: 52090 - DNA, 372 bp, Artificial Sequence
  Description of Artificial Sequence: Synthetic coding sequence
atgcagagcgagaagccccagggcctgttcctgcagctgaaccccaacgccagttccaccgaaactcaattgctggtgccagctttggaaagcagagacacactgcccccaacccattgcttcatggcaggaaccgagtccccgctgggaaacccgtggcctttgagcctgccccctccctgttggacaggttgtgtgctccccgcccctcgtggacagagaaaacccggaccactggggctctctattttcatctcattgggcaataagagacacaggtccggcaatcatgtagtgagagaatccgagcagcctctgagtcagggaaatccacatcaagggtggggcccagacacacggaaggggagatag

SEQ ID NO: 52091 - DNA, 2262 bp, Artificial Sequence
  Description of Artificial Sequence: Synthetic coding sequence
atggagttccaccgggtggcccaggccggcgtggagctgctgagcagcggggaccctcctgctagcgcttcacagagcgttggcattatcggggtcagtcactgtacatggcatattaatttccagggcaactatattagctacattgatggcaatgtgtggaaggcctactcctggaccgagaagctgattctgcgagagaacaacttgacagagctgcacaaggacagcttcgagggcctgttgtcactgcagtacctaatcctaaaccacaaccccctgactaccgtcgaggacccctatctgtttaagttgcctgctctcaaatatctggatatgggtacaactctggtaccattaaccacactgaagaacatcctaatgatgaccgtggagcttgagaaactcatcctgccctcacacatggcgtgctgcttgtgccaattcaagaattccatcgaagcggtctgtaaaaccgtcaagttacattgcaactcagcctgtctgactaatactacccattgtccagaagaggcaagtgtcggcaatcctgagggcgcctttatgaaagtcctccaggccagaaagaattatacatctactgagctgattgttgaacctgaggaaccatcagattctagtggcatcaatctgtccggcttcgggtcagaacagttggacactaatgacgagtctgatttcatatccaccctgaggtacatactcccctacttctcagccgttaacttggatgtgaaaagtttgttgctgcctttaattaaattgcccacgactggtaacagcttggccaaaattcaaactgtgggacagaatcgtcagcgggtcaagcgcgtccttatgggcccccggtccatacagaaacgccattttaaagaggtgggaagacaatctatccgtcgcgagcagggagcccaggccagcgttgagaacgccgctgaggagaaaagactggggtctcctgctcctcgagaggtggagcagccacatacgcaacaaggccctgaaaagctggcgggcaatgcggtgtatacaaagccctcattcacccaggagcacaaggcagcggtgtcagtgctgaagcccttctcgaaaggggccccatcaacatcatctccggctaaggcactgccacaagtgagagacaggtggaaagatctcacgcatgcaatcagtacactcgaaagtgcaaaggcaagggttacaaacacaaagaccagcaagccaatcgtgcatgcccgcaagaaataccgctttcataagacgagatctcacgttacccacagaacacccaaagtcaagaagtctcccaaggtgcgaaaaaaatcctatctttcacgactgatgctggctaatagactgcccttctctgcggctaaatcattaataaacagccccagccagggagccttttcgtccctaggcgatctgagtccccaggagaacccgttcttggaagtgtctgccccctccgagcactttatagaaaagaacaacaccaagcatacaacagctagaaacgcctttgaagagaatgacttcatggaaaacacaaatatgcctgaggggaccataagtgagaataccaactataaccatccccctgaggcggactctgcagggacagcttttaatctgggaccaactgttaagcagactgagacaaaatgggagtacaacaatgtaggaaccgacctttcccccgaaccaaagtccttcaattaccccctcctgtcgagtccgggtgaccaattcgaaattcagctcactcagcagctccagtctctgataccaaacaataacgtcagaaggctgatcgctcatgtcatacggaccctcaaaatggattgctcaggaactcacgtccaggtgacctgcgctaagctgatatccagaaccggccatctcatgaagcttctgtccggtcagcaggaggtgaaggcctcaaagatcgaatgggatacggatcagtggaaaatcgagaactatattaacgaatccaccgaggctcagtccgagcagaaagagaagtccttggagctcaaaaaggaagttcctggctacggatatacagacaaactgatcctggcactcatcgtgaccggcattctgactattctgattattctattctgtctcattgtgatctgttgccacagaaggagcctccaggaggacgaagaggggttcagccgcgatagcgaagccccaaccgaggaagaggaaagtgaagctctgccctag

SEQ ID NO: 52092 - DNA, 378 bp, Artificial Sequence
  Description of Artificial Sequence: Synthetic coding sequence
atgggcaacatcttcgagaagctgttcaagagcctgctgggcaagaagaagatgaggatcctgattttaagcctggatacagccggcaaaaccacaattctttacaaattgaaactgggcgaaactgtgccagccgtgccgacagtgggtttttgtgtggagactgttgaatataaaaataatacctttggagtatgggacgttggctctcacttcaagatccgccctttgtggcaacatttcttccagaatactaaggaactctcagcctcccagttcgctcagttcatcaaaaaattatgtggggttactgggactaacgacgaggcatcacctggctccctaacttcttacccttcccacctgctcgaccgctag

SEQ ID NO: 52093 - DNA, 102 bp, Artificial Sequence
  Description of Artificial Sequence: Synthetic coding sequence
atgctgaacttcgacatcagcgccgccccccggaagaccgccctgatgaagttagagacaattatccattctaaactcctgcaggggcagaagacaaagtag

SEQ ID NO: 52094 - DNA, 522 bp, Artificial Sequence
  Description of Artificial Sequence: Synthetic coding sequence
atgcccgccatgcccagccccctgtgcgcccccgcccgggtgagcccatcacccttgactgctgctcccccattctgctccctcagccccatcttatgggtttcacttatcttgctcctcacatctatttctaagtgctgtgaaagcattttcaaatttattcagaacccattcacctctcattattttccttgttcccacccttcacaaggcaagagaaggctgcaccctggtattctccatagctttccgaccgtattccctactgctagcctagtcccccacctctccatcttgttctcagcccagcagcctgaacggtcgttccagaggatgtctccaaccatgagccacttctctaagctgagctccccttgtcactctgaacagaggagcaccccttttccgcatccatcaggacttcccgccctggccaccccacttacatccctgcagtttctgtgcgtccaaccattctggttgttgcctcctagcaggaacacagacaacttcctcccgtag

SEQ ID NO: 52095 - DNA, 876 bp, Artificial Sequence
  Description of Artificial Sequence: Synthetic coding sequence
agcgccggcggcggcggcgccggcagccggctgcaggccgagatgctccagatggaccttatcgacgccacaggcgactctacacccgatgagccagatgtgcatttctcgaaaaagtttctcaatattttcatgagcggcagatcgcggtcatcctcagctgagtccttcggtttgttctcttgcatcattaaccgtgaagagcaggagcaaacgcacaggactatctttaggtttgtgccacgccacgaagatgagcctgaactcgaggtggatgacccactgcttgttgaattgcaggccgaggactattggtatgaagcgtacaacatgcgcacgggggctcggggattcttcaccgcttactatgccattgaagtgaccaaggagccggagcatatggccgccctagcgaagaattctgattgggtggaccagtttagagtcaagtttctgggatctgtacaggtcccttatcataaaggagatgtcgtgctgtccgcagccatgcaaaagatagcgactactcggcgcctgaccgtgcacttcaaccctcctagttcatgtgtcctggagatatctgtcaggggcgtgaagatcggggtcaaggccgatgactcccaggaggctaagggcaacaagtgttctcacttcttccagctcaagaacatcagttttaggggataccatcccaagaataacaagtacttcggctttataactaaacacctggctgaccacaggttcgcatgccatgtttttgtgagtgaagactcaaccaaagccttagctgagagtgttggacgggccttccaacagtttcacaaacaatttgtagaatacacgtgccccaccgaggatatctatctcgagtag

SEQ ID NO: 52096 - DNA, 1272 bp, Artificial Sequence
  Description of Artificial Sequence: Synthetic coding sequence
atgatgtaccggcccgacgtggtgcgggcccggaagcgggtgtgctgggagccatgggtcatcgggctggtcatattcatttccctgattgtgcttgctgtctgtattgggctcacagtccattatgtgcgctacaatcagaaaaagacctacaactattattccactctatcattcaccactgacaagctgtatgcggaattcggaagggaggcctcaaataacttcaccgaaatgtcccagcggctggagtcaatggtcaagaatgcattttacaagtccccactacgcgaagaattcgtcaagtctcaggtaataaaattttctcagcagaagcacggcgttttggcccacatgctactgatctgcagattccacagtacggaagatccagagacagtagataagattgtgcagctggtgctgcatgagaagctgcaagacgctgtgggcccgccaaaggttgatccacagtcagtgaaaattaagaagattaacaagactgagaccgacagttatcttaaccattgttgcgggactcgtagaagtaaaaccttgggacagagcctccgaatagtggggggcaccgaagtcgaggagggagagtggccctggcaggcgtctctgcaatgggatgggtcccaccgttgtggagctactctcataaacgcgacatggttggtctcagcagcccattgcttcactacatataagaatcctgcaagatggacggcatctttcggcgttaccattaaaccttctaagatgaagaggggtctgcgccggattatcgttcatgagaagtacaagcacccatcacacgattacgatatctccctggcggaactgagctcaccggtcccttatactaatgccgttcaccgggtctgcctcccagacgcaagctatgagtttcagccaggtgacgtcatgtttgttactggctttggtgctctgaaaaacgacggctattctcaaaatcatcttcgccaagcacaggtcacccttatcgatgcgacgacatgtaacgagccccaggcctacaacgacgctatcacccccagaatgctgtgtgccggatccttggagggcaagaccgatgcttgccagggtgacagcggtgggccactagtgagctcggacgccagggatatctggtacctggcgggtattgtgtcttggggggatgagtgtgccaagccaaacaagcctggagtgtacaccagagttacagctcttagagactggatcacatctaagactggtatttag

SEQ ID NO: 52097 - DNA, 375 bp, Artificial Sequence
  Description of Artificial Sequence: Synthetic coding sequence
atgacccccaacgagcaccccgccttcaagcacctgttcaacaaggcccacctggctcctcctctgattcacctcaccctcagcggacattcaacctgttttcgggagcaccgggttggaggcaaggtaacagatcaacaggatccaaaagcagaggaattttttctggtacagaacaagatgaaatctctgccttgtctcctactctctacacagacccgccagccgtcagacttttccatttttagtcctcccttcctaccgttttatagcacgaaacctcctctgtcgtcatggcccgtgctcaatgagctgctagggactcctcctaggagggggggtgggcgggcggaaggcttgcttacatctcagtag

SEQ ID NO: 52098 - DNA, 339 bp, Artificial Sequence
  Description of Artificial Sequence: Synthetic coding sequence
tgcgacatccagatgacccagagccccagcagcctgagcgccagcgtgggcgatcgcgtgactataacctgccgggctagtcagagtatcagcagttacctcaattggtaccagcaaaagcctgggaaggctccaaagttgctgatttatgccgcgtccagtctccagagcggggttccttctcggttcagcggatctgggtccggtaccgacttcacactcaccattagcagcctgcaaccagaggatttcgcaacatactactgccagcaaagttattccacaccccctacggtacttcaaggtactcgattgaagattagccgagttgaggcatag

SEQ ID NO: 52099 - DNA, 384 bp, Artificial Sequence
  Description of Artificial Sequence: Synthetic coding sequence
atggagttcggcctgaactgggtgttcctggtggccatcatcaagggcgcacagtgcgaggtccagctggtcgagagcggtgggggcctggtgcaacctgggggctccctacgcctctcctgccccgactcgggattcacgttcagtaaccattacatgtcatgggtgagacaggcccccggaaaagggctggagtggatttcttacattagcggcgattctggatacaccaattatgccgacagcgtgaagggacgattcaccatatcacgtgataatgccaacaactcaccatatctgcaaatgaactcacttagggccgaggataccgccgtgtactattgcgtcaaacacaccgcaagaggaaatctgcagttttactag

SEQ ID NO: 52100 - DNA, 315 bp, Artificial Sequence
  Description of Artificial Sequence: Synthetic coding sequence
atgacccagagccccagcagcctgagcgccagcgtgggcgaccgggtgacaattacttgccgggctagccagtccatttcttcttatctgaattggtaccagcagaaacccggcaaggcaccaaaacttcttatttacgccgcttcatccttacagagcggggtaccttcccggttttcagggagcggcagtggcaccgactttacactgaccataagctctctgcaacccgaggattttgccacctactactgtcagcagtcatattctactcctccgaccgtaggttcagggacctattttaagctcaagtag

SEQ ID NO: 52101 - DNA, 348 bp, Artificial Sequence
  Description of Artificial Sequence: Synthetic coding sequence
atgctgtgggtgcccggcagcagcggcgacgtggtgatgacccagtcaccactatccttaccagtaacgctgggccagcccgcctctataagctgccgaagctcacaatctctggtgtacagcgatggaaatacttacctcaactggtttcagcagaggccagggcaatcaccacgaaggctaatttataaggtctcaaattgggactctggggtgcctgatcgattttctgggagcggcagtggtaccgatttcacgttgaagatctcccgcgtcgaggctgaagatgtaggtgtttattactgcatgcagggcacccactggccccctaccgttgtgcaaccctag

SEQ ID NO: 52102 - DNA, 348 bp, Artificial Sequence
  Description of Artificial Sequence: Synthetic coding sequence
atgcgggtgcccgcccagctgctgggcctgctgctgctgtggctgagaggtgcacgctgcgacatacaaatgacacagagcccttcgagtctgtctgccagcgtgggggaccgtgtgaccattacttgtcgggcttcccaaagcatctccagttacctgaattggtaccagcagaagcctggcaaagctcccaagttgctcatatatgcagcgtcttctctgcagtcgggtgtgccgagtaggtttagcggatccgggtctggaactgacttcacacttaccattagcagcctgcagcctgaagattttgcaacttattactgccagcagtcttacagcaccccctag

SEQ ID NO: 52103 - DNA, 432 bp, Artificial Sequence
  Description of Artificial Sequence: Synthetic coding sequence
atgtgggtgcagacccaccccagcagcgccagctacaagagctggggccctggcactgccgacactcacactatgcgcctgtccagacgccccgaaacattcctgctggccttcgtcctcctgtgtactctcctcgggctgggatgtccactgcactgtgaaatctgtaccgctgccgggagcaggtgccacgggcaaatgaagacttgcagcagtgataaggacacttgtgtgttgcttgtgggcaaggccacatccagcaagcgcatgtggccgggcacttggtggggtggtggcgtttaccttcaagggggacgcgattaccacgcagaaggaggaagcagctggttctcacggagagaaagagggaagaagagcgttgaaagccgcaaagaaggcaagaccatcatgcggtggagggaacaaaagtag

SEQ ID NO: 52104 - DNA, 939 bp, Artificial Sequence
  Description of Artificial Sequence: Synthetic coding sequence
ctggccctgcggccccggcggatggccagcaaccggcagcggagcctaaggggaccctctcacccatcccatatggaggagcctttcctccagatggtgcaggccagtgaatcactcccaccgagtcagacttgggctcagcgtgagttttttctaccttccgagtcttgggagttccctgggtttactagacaggcctatcaccagctcgccctgaagctccctccatgcacagacatgaagagcaaagtgcgacagcgcctaatccacccgtggaagggcggtgcccagcatacatggggattccacacttggcttgacgtgtgccgactgccagccacctttccaacacagccagaccggccttatgattccaatgtctggagatggctcaccgactcgaacgcccatcggtgtccacccacagagcatccaattcctccccctagctggatgggtcagaacagctttttaacctttattcactgttatccgaccttcgtggacatgaagcggaagaaacaggtgatttttagaacagtgaaagagctcaaagaggtcgagaagctgaaactgaggtcagaagccagagcccctccgctggatgcacagggaaacatccaacccccagctagcttcaagaagtatcggcacatctctgcaggagggagattcgagcctcagggtcttcagttgatgccaaatcccttcccaaacaacttcgcaaggtcctggccatgcccaaatcctctgccccattaccaggagaaggtgcttaagctggcactccttcccagcgctcccctgtcacaggacttaatcagagacttccagactttgatcaaggataggacagctcttcccctccatcatctttcaaaggcacaggccagcaaatcccctgcacgcaaaagaaagaggagaccaggacacttttag

SEQ ID NO: 52105 - DNA, 456 bp, Artificial Sequence
  Description of Artificial Sequence: Synthetic coding sequence
atggccgtgagccagatgagcaagtggcggctgagccgggtgggcggttctcggtcccttccggctgagatggaggtcctgggagaggtatggtgtgtgcgtgcagaggaacagcctatgacaggcctcggcatcgtttggcactcacccctgctcgacaaggccctggaaacttggagtctgcagcaacagccagacttcagcctcggcctggggcatctggggctggggactgatgccacctggatgcagagtttcccaggttctggaggcgacgcccaggccggtacaggcgtgtcaggtctgttgcgcctgtaccccaacctcttgtgcgacttcggacccagacaaggaccgctgtgggcattactgctcgagaagagacaaatggccggcacagggggtagtcccgctctgcttgcctggcgatctgccagctggcgggcactgggctag

SEQ ID NO: 52106 - DNA, 345 bp, Artificial Sequence
  Description of Artificial Sequence: Synthetic coding sequence
atggccgtgagccagatgagcaagtggcggctgagccgggtgggcgggtcaagaagtctccccgccgagatggaggtcttgggcgaggtgtggtgcgtgagggctgaagagcagccgatgaccggactgggaattgtgtggcacagcccccttctggataaggcgcttgagacatggtcactccagcaacagcctgattttagtttggggctcggccaccttgggttgggactgtacatcctggcctcctaccttttgtgtcctaggcagcccccatcacagcctgatggcccatgcggcagccccaacccagttagcggggctaagaaaacaacagtggcctag

SEQ ID NO: 52107 - DNA, 504 bp, Artificial Sequence
  Description of Artificial Sequence: Synthetic coding sequence
atgctgtgcccctgcatccaggagagcaccttcgagacctgcctgttcatggccgtgagtcagatgtctaagtggaggctgtctagggtgggagggagtaggagtttgcccgctgagatggaagttttaggcgaggtctggtgtgtcagggccgaagagcagccgatgactggactgggcatcgtctggcacagccctctgctcgataaggccttggaaacctggagtctgcagcaacagcccgacttttctctgggcctcggtcacctgggcctggggacagatgccacttggatgcaatcctttccgggatctggcggggacgcacaggcaggcacaggcgtttcaggcctgctccgcctgtatccgaacctgctttgcgactttggtcctcgacagggcccattgtgggctttgctgctggaaaagagacagatggcgggaaccggagggtcaccagccttgctcgcctggaggagcgcctcttggagagccctggggtag

SEQ ID NO: 52108 - DNA, 393 bp, Artificial Sequence
  Description of Artificial Sequence: Synthetic coding sequence
atgctgtgcccctgcatccaggagagcaccttcgagacctgcctgtttatggccgtctcacagatgagcaaatggcgcctgagtagggtgggtgggtcacgcagtctccctgcagaaatggaagtcctcggtgaggtatggtgcgttcgggccgaagaacaacccatgactgggcttggaattgtttggcactcgcccctgctcgacaaagctctggagacctggtcccttcagcagcaacccgacttttccttgggtttaggccatctaggactcggcctgtacatcctagcttcttacctcctttgcccacgccaaccaccctctcaaccggatggtccatgcggatcccctaaccccgtgtctggagctaagaagactacagtggcgtag

SEQ ID NO: 52109 - DNA, 2124 bp, Artificial Sequence
  Description of Artificial Sequence: Synthetic coding sequence
atggtggaccccgtgcccgaggaggagaaggccggcgccgagcccggcgacagcggaggggatgaggccgtcgcatcggttccccctgacagccagggggcccaagagccggctgcttcctctgccagcgcgtcagccagcgccgccgtcccgaggaaggctgaagtgccatgcgctgccgccgagggaggacgacgcgaacagtctcccctgttgcaccttgacttattcaacttcgattgtcctgaggcggagggcagtagatacgtgttgacgtcaccgcggtctctggaggcatgtgcccgctgcgccgtgaaacctgtggaattgctgcctcgggcactggccgacttggtacgggaggcacctggtaggagcatgagggttgcaacaggcctgtacgaggcctacgaggcagaacggcgtgctaaattgcaacagtgtagggccgagcgggagcgtattatgcgggaagagaagaggcgcctgtttactccactatcacccgccgctgcagcagccgcggccgctgccgcggcctcggctccgagtgcaggttcatcgtcttcgtgttcctcagcatccttaccagcaagcccagcacccagggctgcgaggaaagcatcaccatcaccctcttccgccagaacacagcccccgcccgctggatctcgcaccggaagaaagtcccacagcctggacagtctcagtagacgcagagaaggagcgctgagtagcgagagcggagcgtcatcatcatcatatagtggagaaagtcttcgcgagctgcgctggcctcccagagccagcgcacggaacagttgccccgcaggctccgcttccagtaccaccaacgcccccggtagaccctccgcccttaccttagttccaatcactggcagatccttcagtctaggggacctgtcccacagtcctcagacggcacaacacgtagagcggattgtacgacaggttagggcggaacgcggattgcgcggggtaccagaacgcgataggaagattgccgccttgatgctcgcacgccaccaggaggagctactgctacttgagcagagggcggcggcacacggccaatgggaactgcagagggtgcacgccaagcagcgtagggagcgagaggaacgggaaaagcagagggcactggagcagggccgtcgcgcatgggcggcgcaggtcgaagagcgaagggggcgccgtggacgcgaggaacgtgaggctgcccgacgtcggcagagacagtacgaacggagcgaagagaggaggagggaattagcagagagacaggggcttctaaggagagagagggcagaacgcgcggcaagagaagacaggttgcgcaagctgcagcaagagcagaacctgaaacaaagggaggaaggccttcaggaaggccgagaaagggccgagcagatccggcgggagagggcacaaagggccgctcgtgctaagcagagacaggaaggacaacttcagagggagaagcgggagctgtcacgcgccgaaagagccaggcatgaagccctgctgcaagggaggacccgtcaacaaaggcaagagcgggagggactgaggtcatcactggaagcaagcctaggcagagcccaggagaactacgagcacctcgttgaacaaagaacccgcgagctgcgcgaacgagcccggagggaggagctgcaggggagacgggcaaaagaggcagctgaaagaaaggaacgggagcatcaggcccatttggaggccctggcacgcgccggtgagagaagactgcagcatgccactcaggtcgccgaggaggccgtccagcagaaggctagaagagtgggtcaatctaggctggaaaaagagcgtgcacaaagagccaataaggagaaagtggagcgggacgaggactgcaggagaagagaattattgcaggctatcggtcgtaagctcgagcgtagtgagcagctgacaagggaaaggagatccgcactcgaaagcgctcgctccacggcgcgggcctccttccacgttagggaaaaggtgcgagaagagaccaatacccgcagtttcgatcgtatggtgagggaggcacaactgcacgcctctctggacaggaagtag

SEQ ID NO: 52110 - DNA, 198 bp, Artificial Sequence
  Description of Artificial Sequence: Synthetic coding sequence
atgagcgagcagaacatctgcaaccagaaggacaagagcaccctgccattctgtcaggctcacctttgcgaagagactactaacagactctgcgtcagcaataaagccgtgtacagccttgaatgcaaatgggctgaaagcgaaaaccgcgtgtctgagggacgttggggccgcggctgttttattggagtggggtag

SEQ ID NO: 52111 - DNA, 477 bp, Artificial Sequence
  Description of Artificial Sequence: Synthetic coding sequence
atgcgggccagccggagcccccccagcccccggcggtgccaccaccaccatgaggcaactggagcagccagcggagccgccgccggtggccccggtgccggctgtgtgggcctatgccgcctggcgttgaccccaagcgcccaggatggtcgcaatagcacttttcagacatacaagaaggaggtctgtctaccccgccacagcatgcacccaggaccttgggctatctgctgtgagtgccagaccaggtttggaggcagattgcctgtgagccgagtggaggccgcactgccctactgggtgcctctctctctcaggccacggaaacaacacccgtgctggatgcatgcggcaggaaccaccgctggaggttctgccgtgatgtctgcttgctgcccatcctcctcttcaagcagaccacctacaaggacctcctaccgcctcttacagcgtgtgtgctgtcccagcgccagctag

SEQ ID NO: 52112 - DNA, 1668 bp, Artificial Sequence
  Description of Artificial Sequence: Synthetic coding sequence
atgcggcggcccagcaccgccagcctgacccggacccccccccgggctagtcctacccgcatgccttctcgggcaagtctcaagatgaccccattcagagctagtctcactaaaatggaatctacagccctcctgcgaactttgcctagagcaagcctcatgcgcacgcctactagggcatcattaatgcgaacccctccaagggcaagcccaaccaggaagccccctagggcttcccctcggaccccttcgcgagcctcccccactcgtagattgccgcgggcatcccccatgggtagcccacatcgagcctctcctatgcgtactccaccaagagctagtcctactgggacccccagtacagcgtcccccacagggaccccgtcttcggcttcccccactggcacacctcccagggcgagtccgacaggcaccccacctcgggcgtgggccactcggtcaccctccacagcatctctgacccggactccctctcgcgctagtctgacccgatggcctccgagggcctcccccacacgcacccccccgagggagagccctaggatgtcccaccgggctagcccaacgcggactccgcctagagcctcacctacgaggcggccacccagagcctcccccacaagaaccccacctagagagtctctgcgaacctcccaccgcgcgtcacctactagaatgcccccaagggcatcacctacgcggcggccacctcgggcttcccccactgggtcaccaccccgcgcttcacctatgacccccccacgcgcttcccctcggaccccaccacgagctagtccaactactacccccagcagagcctcccttaccagaaccccctcatgggcctccccaaccacgacaccaagtcgggctagcctgatgaagatggaaagtacagtgtctataaccaggaccccgcctcgggcgtctcctacgggcacacctagcagggcctcccctactggcaccccaagccgggcatcactgaccggatccccttctcgagcttccctcacagggacacctagcagagcatctcttatagggactccctcaagagcctccctgacgggcacgcctcctcgcgcctctctgacggggacaagctctaccgcgtcactgacaagaaccccctctagagcatctctcaccagaacacaatctagtagctcactgacaagaactccctccatggccagtttaactcgcactcctcccagggccagcttaacaagaaccccgcccagagcaagcctaacaagaacactgcctagagcatcactcacaagaacccctccaagagccagcctgactcggactccatctatggtgtctcttaaaaggagcccgtcccgggcatcgctgacccgtacaccttcacgagctagcctgaccatgacacctagtagggcaagcctgactaggacccccagtacagcttcgctcaccgggacccccccaaccgccagtctcacacgcacaccgcctacagcctctctgacccgttcaccacctaccgcttcactcactcgaaccccatccacggcatccctcacacggatgcccagcacggccagcctcacaagaaaaagtaatgtaaaccagcagtgcccagcatcaaccccgtcctccgaagtcatcagctag

SEQ ID NO: 52113 - DNA, 1719 bp, Artificial Sequence
  Description of Artificial Sequence: Synthetic coding sequence
atgcccgtgtactgcaagtaccagttccacaagacccccgtgcacaagactaagggggagccccatggaacacatgtttactttcaggatatcaatgtaatttttctgggggccctgcatccatcagatctgagagaatacctggaagggcctcccatggtggtcgaggtacacgaccgggaccgcaagtctgaggaatgttcccagaaacctgtgctttttggtgaggaccccctcgacagttacctcaattttcaagcactgatttccccccgcgaaacagaaaacaatccattcgagagtcagaacaagatgtggtacccctacggtatagctcaagtctccttcgcagatctactcctgggacataagtacctgaatctggccgtacctattcactcctgtgaggtgcagcccacacactgtgggcaggattcccggcgtcggaaagttgtagggcttggcgtgccaagggacgggcaccagcacgggccgatgcctcgcgggaattatctcgaagcggattcacagctgaagctccgcgttgacattgccgtgcccctgcgggccggcgcaagagccgctgaccccgatctaggaggttctcagttcggacggattatctttgtatttgatttcaagaaagtgagtcttcttcactctctcctgcaagacatcaccatgatcaacgccaaggccctgggtcttgattcttatccggtccgcaccctccagcagattctatctgcattcaaagtaagagtgcgggtgcaggagcagcagcacctcgacgtgctaaccgggtttcacctgctggatggaaaaacccacctgtttatcctggaaggcctggcagaccagggcttgaggcagctatgggagaaccatcagtcatggatcccgaggtctgagcaccgaaaatacaaagtgctgtataatagtcagttgttattccggtcccgtctctacggagatctagaggctatactgtaccacgtgcacctctttcagcccacagaactcctgctccaacaggccgtattcttcctgcgggatactgaacggcggagagtcttccaggctcttgcgcgcatccatgacatatgttacaactccacaactctgtgggacgtgacagtgagggacctcctcccatcctcagccatgattaaggacctgagtcaagaattcggcatgcctttgagccaggaggagctgaccgatgaaaaactgttcgccctgccaccccagcccgcgcccaacctcgaggattatcacagcagaaattccaccctgactctggagatccacgcacaccaggagccccgcaagcgcttcacatacagccaggattacctgagtgctatggtcgaaccgttagacctgaaagaggaagagaagaaagctcaaaagaagagccggcaggcttggttgaccgctcgtgggttccaggtcaccggcctccaatccgatactgaatcctcctttcaggatttgaagctaccacctatcaaagagcttaatgaggaatggaaggagaattcactctttgccaatgtattggaaccagtcctggacagggatcggtggagttgggatcgccaccacgtggactttgatctgtataagaaaccaccaccatttctagagcttcttccttcgccggcgccgaagccagttacagtgaggaagaaaaaagggaactcccctatttcatag

SEQ ID NO: 52114 - DNA, 1719 bp, Artificial Sequence
  Description of Artificial Sequence: Synthetic coding sequence
atgcccgtgtactgcaagtaccagttccacaagacccccgtgcacaagacaaaaggcgagccccacggaactcatgtgtattttcaggatattaacgtgatcttcctgggggccctgcatccttccgatttgagggagtaccttgaaggacctcctatggttgtggaggtccatgatcgcgatagaaaatctgaggagtgttcccagaagcctgttctgttcggagaggaccccctggattcttatctaaattttcaagcgctgatctctccacgggagaccgaaaataatccatttgagagtcagaacaagatgtggtacccctatggaattgctcaggtgagtttcgcagatctgcttctcggccataaatacctgaatctggcggtcccgatacactcctgcgaagtgcagccaacgcactgtggccaagatagccggcggcgcaaggtggttggcctcggtgtcccacgcgacggccaccagcacggacccatgcctcggggaaactatttagaagctgactcccagctcaaactccgcgtggacatcgccgtgcctctgcgtgccggtgctcgagccgccgacccggaccttggggggtcccagtttggccggatcatcttcgtgttcgatttcaaaaaggtatcattattgcatagcctccttcaagatatcacaatgattaatgccaaggccctaggcctggacagttatccggtccgcactctgcagcaaatcctctcagcattcaaagtacgggttcgggttcaggaacagcagcacctggacgttctgactgggttccaccttctggacgggaagacccacttatttatcctcgaaggtctcgccgatcaagggcttcgccagttgtgggagaatcatcaaagctggattccccgatctgagcaccgaaagtataaagtcttatataatagtcagcttctgttcaggagtaggctgtatggcgatttggaggctatactctaccacgtgcacttattccagcccactgagctcctcctccagcaagctgtcttcttcttgcgagacaccgagcgaagacgcgtgtttcaagcgctcgccagaattcatgatatctgttacaacagcactacactgtgggatgtgaccgttagggacttactcccttctagtgctatgataaaggatcttagtcaggagttcggtatgccattgagtcaggaggaactgaccgatgaaaagctgtttgccttgcccccccaacctgcgcctaatttggaagactaccacagtagaaatagcaccttgacacttgaaattcatgctcaccaggagcccaggaagcgctttacatacagccaggattacctttccgctatggtggaacctttagacctgaaagaggaagaaaagaaggcacaaaagaagtcacgtcaagcgtggcttactgccaggggattccaggtcactggactgcaaagcgatacggaatctagtttccaggacctcaaactgcctccgattaaagaactgaacgaggaatggaaggagaacagcctcttcgccaatgtgctggagcctgtcctggaccgggacaggtggtcttgggaccggcaccacgtggactttgatctgtacaagaagccgcctccattccttgagctcttgccgtcccctgcccccaagcccgtgaccgttaggaaaaaaaaaggcaatagccccatttcatag

SEQ ID NO: 52115 - DNA, 390 bp, Artificial Sequence
  Description of Artificial Sequence: Synthetic coding sequence
atgcccgtgtactgcaagtaccagttccacaagacccccgtgcacaaaaccaagggcgaacctcacggtacgcatgtgtactttcaggacatcaatgtgatcttcctcggcgctttgcacccctcggacttgagagaatacttggaagggcctcccatggtggtcgaggttcatgatagagatagaaaatcggaggaatgcagccagaagccagtgctgtttggagaggaccctctggactcctatttaaactttcaggcattgataagtccacgagagacagagaacaaccccttcgaatctcagaacaagatgtggtacccttacggcattgctcaggttagctttgccgacttgctgcttggacacaagtacttaaacctcgcctag

SEQ ID NO: 52116 - DNA, 1068 bp, Artificial Sequence
  Description of Artificial Sequence: Synthetic coding sequence
ctgggcgtgaagggcctgcccctgtaccccgaccccagccgggtgccaggaaccaagacccaaaataacctcgagtcagattacctcgcccgcgacggcccttcgagcaatagctccttccactcttccgaggaggagggaaccgacttagaaggcgacatgttggattgctccggttcgcgtcccctattaatggaatccgaagaagaagacgaatcatgccgcccacccccaggcaaattgggtggggctgtgccattcgcccctccggaagtttcaccagagcaggccaaaaccgtgcaggggggcagaaagaaccagtttcaggcttttacacagcccgccacagatggactgtccgaacccgacgtcttcgcgattgctccgtttcggtcgagtagagtacccaatgatgacatggacatatttagcaaagccccatttgtgtctaagtcttccatggccccatctcaaccagaggagagtgacgtctttctgcgcgcccctttcacaaagaaaaaaagtatggaggagctgacggtgatccagtgcacaagccaggagttaccagcccagacaggactgctgagtcagacgggggatgtaccactgcccgccggccgagagagagcagtgtatacatcagtccaagcccaatattcaaccgctggttttgttcagcagagcaatttgctatctcacagcgttcaagcagccgatcacttggattcgatcagcccaagggggagctgtttagagtcaggggggcactcaaatgaccggaataaaggaccccagttgcaaaaagaagctgtgtctggccccatggcgggaaaaccgttccgaccgcaatccttgagtaaatactcccgtcactactccccagaagacgaaccaagtcctgaggcccagcctattgcggcctacaaaatcgtaagtcaaaccaataagcagtcaattgctggcagcgtgagtatcacctccctgtcttcccggactactgagctacctgctgcagatccattcgccctggctccctttcctagcaagagcgggaagaaaccatag

SEQ ID NO: 52117 - DNA, 462 bp, Artificial Sequence
  Description of Artificial Sequence: Synthetic coding sequence
atgcactacgtgcacgtgcaccgggtgaccacccagccccggaacaaaccgcaaaccaaatgcccctctgggggccagagccagggtcctagaggacagtttctggatactgtattggcggctatgtgtcctatagctatgctgctgactgcggaccccggtatgcctccaacgtgtctgtggcataccccccatgccaagcataaagagcacctatcaatccacctaaacatggtgcctaaatgtgtgcacatgcacgtgacccatactcacacaaactctggatccagatacgtagggaagtacatcctgctaattaagtggtcactcgctatgtactttgtacagggatctactttgagtacggtcactaaaatgtcccatggaaaggctctgccagacagtgacacttacatacagttccccaatcaacaaggcccccacacgccctccatcccctag

SEQ ID NO: 52118 - DNA, 366 bp, Artificial Sequence
  Description of Artificial Sequence: Synthetic coding sequence
atgcagaagcagctgctgcccctggccgccggccagcggtgcgactattcgcagcgggaaagctgttgccagtctccacatagggctgagtccgctggagacaggtctactgacaacggcttgcatagaggcgcagagaggagcttctgctgtgctcttgaccccctgcctcgcagacctcccgctgggcgacgaggaagagacagatcctccagcgcttgtccaggggctagggccagagtttggcccccaggggcttgcgcgagtttcagggattcccataagagatttatcatgcgccggacagcgttattccacttcacaccgacgtcattccacctacggtacacactgcgcaaactgtag

SEQ ID NO: 52119 - DNA, 384 bp, Artificial Sequence
  Description of Artificial Sequence: Synthetic coding sequence
atgctgcccagcagcacccccggccccggccacgccaccgagacctgtccagcaccgcctggaccggaaagaagtcccgcagcaagagccccggcagccgcctcctctcttggcccggtttccactgcaggcagagcccctagggggttagacatgtccgcccaggagcccccccaggggaggagatttcctatagaagcgggtgactcaagggggctggccgcagctcctgagagccaggacagtcccgaggccgtggcaactgagcacaaccctgtgagaccactgcggcggtgcccgggctgtcactgcttaaccttactccacgttccgattgatgtctatctcgccatgggaggttctccacgggcgagagcaacatag

SEQ ID NO: 52120 - DNA, 408 bp, Artificial Sequence
  Description of Artificial Sequence: Synthetic coding sequence
atggtgcccgccccccccttcctgggcgtgctggagaaccccgtgcctcaatgggacctatcgatcctgggatcaatccgaatccgagtatcccacactgaagttcaaggttctggctctagccggagccctgaagcactccggaaggagagcctggaggtcgagtggacattggtgctgctggctatacccccaagaattcagccatcccagcaagatgggggacccccaaagtgctgcgacttgctacgcgccgcactactgggaaggcattgtccactctgcgtgccggctggcgaagtcttctcacagaaacgcgataacgagcaggatcggtctgagttcatcgggcaaacactcaagctgctcgtgaaacggaacgtgtccctggaattaagctgtcggtag

SEQ ID NO: 52121 - DNA, 717 bp, Artificial Sequence
  Description of Artificial Sequence: Synthetic coding sequence
atgcccggccggaccggcctggccggcgagatgcccgtgggctggggaccaggcagagccggcgcatcggaacccaacgagtccacttgcgctcccgaagccctagacggccaccttggtgttgcgagacgtgagggaccaatcctgggaactctcctagggagagggaaaggacattgtcaggccctcagccaactgggccactgtccgagtccagcgtggaacaattacagtggaatgatggacattggagtggcacccagccgagtggggccatcggggcattgtggggttctaagaagtcacagtcggcctggagagttagcagtggtgatgaaccataaagtacccaggcacaggcctgtttcaagcgtgggaaccgagctgttatgggttcggtgtgctcccaaaatggtacaactaccgatctgttgcctgctgttgactccagcaccagggattgggccccgagcgcacggacacttgcataccaacctcgagactagggggctccctcggggtacgcgggagtctcagcaggcagagggggaaggggaagctatccaggaaggacggggcgcctgcaagagagcacagcgaaaagagggagagggtcccagaggtccgtgtgtggtccgcgcaggcggagttggctggggcacacggcaggttgctggtgaacccccactagtcgactgctccacagctgggacgtag

SEQ ID NO: 52122 - DNA, 315 bp, Artificial Sequence
  Description of Artificial Sequence: Synthetic coding sequence
atgggcctgggcgaccggcggggccggcggcgggccagcgccagcgcagccttccgaacggcttcctcgagtagctgcaattgtagtcgatgcagctccgccgacacaagatcttccacctcgattcctctcgtgcctgataagctgtcttctggaaggcgcggatcagcaggctgccgcgctactcaagaacttcagtgtcctaggggaccgagccggctccctggatccaagcgaggggcttctcatgctccattcttgtcacggtacctggggcttgggcaccttgatatgtctcagggccgcggcctatag

SEQ ID NO: 52123 - DNA, 198 bp, Artificial Sequence
  Description of Artificial Sequence: Synthetic coding sequence
atgcccgccaagggcaagaagggcaagggccagggcaagagccacggaaagaagcagaagaaaccagaggtggatatcctaagtccggccgccatgctcaacctctattatatcgctcataatgtagctgactgtcttcaccttcgaggtttccactggcccggtgctccaaaaggcaaaaaagggcgtagcaagtag

SEQ ID NO: 52124 - DNA, 645 bp, Artificial Sequence
  Description of Artificial Sequence: Synthetic coding sequence
gccaccatggtgtggttctgcaacagcgccgactgccagttcagcgtgttcgctcttacaacaatcggctggattttgtcctccacatctacgggcctggtcgagtggcgcatctggtacatgaaggatacatctctctacccgcccggaatcgcctgtgtggggatcttcagagtgtgcatttatcggcgcaggactaatagtacaaccactaagttctgttacagatatagctatcaggacacattcctcccctttgagatctccatggcgcagaggtttctgctgaccgcaagtatctttggcttttttggcagggctttcaacatgtttgcccttcggaatatgtccatgaggatgtttgaggaggatacatacaactcatttgtggtgtccggtatactcaacatagctgctggcgtcttcaacttaatcgctgtgctccagaattacgacgccgtaataaatagtcaagggattactttcttgccgtctctgcagatgccattcaagcccgacgtgcaggaggtgggaacagccattcaggttgcggggattggtgttctaccaatgctgttaacaggcatgttctccctgttctacaagtgccctcccatgttgtaccaaatcttcccaacaacttag

SEQ ID NO: 52125 - DNA, 345 bp, Artificial Sequence
  Description of Artificial Sequence: Synthetic coding sequence
atgtacaccagcctgaagagcaccttcgtggccttcgccgacggccggggaaccacagaatccatgccctcgccccccctggccaactcgaatcatgaaagtcccgttaaccagctgggaaatatgcagaatatgagactggggcctagctttatcctgacagggatcttcctcggtaatggcaggaccgaggcttcaccctttttcacagacgaatttgccctcagcaaaatctttccagaatacaagaggaacctcttcgggaaatttcagacaaacatggccttttcattagagttggatcccccctcacttttgctctccgtcgtgctctttatgttttag

SEQ ID NO: 52126 - DNA, 1086 bp, Artificial Sequence
  Description of Artificial Sequence: Synthetic coding sequence
atggccccccagcgggccggccccggcctgggcaagcccagcagcaaaaaatctagggcgctcaggggggggcccggggttccaagggccagacagaggtcccctagggctgctgccgaattaaacacagaagttccgaagccctcggccaaggacgtggaaatcttggaacaagagtccgaggtgttagaaccttctgtggagcaagatgccgagtcacctgggctgtccactgccgcaggtttcgaaagccctgagcccggccgggacgaccccgggcctagcgaagcccagagagccgaagttcaaggtcagcacccgccccctggcccaaagacttccagctcacgatcaggcagtgaagctccccatctaagattcccaccatgtcccgaggctccccagaggccccctgaagagcgatttatggagacccctattgagagagagatccggcgttcttgtgagagggaagaatctttgcgtcggtctcgggggctgtcaccaggccgggccggcagggagttagtcgagctccgcgtcagacctgtgctgaacctgccaggacctggtcctgcattgcctcgcgccctggagcgggcccgcgctggagcccaaatgcagcgggacatcgagcgtgaggcccatagacaggccgccctcgctcggcctgccgtgcccgagcctagggcacgttcacctcctcagccactgggagaacttaagcggttcttcgaggctgccgcaggcagtggctcctccgctggcgctggcgacggggcaggtcctcagcggctgccagagccaggaggaagaccgagatccgctgtacagggcgggtgcagagtccttggctctgccccaccacccttcactccttccctgctggagcaggaggtgcgtgctgtgcgggagagggagcaagaactgcagcgccagagacgatctgtgtatggcaccgctgagtttaaggagcccaccccctctttgacggccagccgaggggatggcaaactggttgtgatctggcctccccgcaggaaagtgtcagaaaatggcttggaacaggaggagagaaagccatag

SEQ ID NO: 52127 - DNA, 366 bp, Artificial Sequence
  Description of Artificial Sequence: Synthetic coding sequence
atgaccgaccggaaccgggacaagaagagcaccagccccagcaactccgacactgaaatgaagtcagaacaactgcctccctgcgttaatcccgggaacccagtgttctcttgcatgctggacccaaagactctgcagacggcaacttctctttccaagccacagatgattatgtataaaaccaatagtagccattacggggagttcttaccaataccgcagttctttccttgtaattacaccccgaaggagcaggtattctccagtcacattcgggcaaccggattctatcagaacaatactctgaatactgccccagacaggaccagaaccctcgattttccgaacatccaacatacgttatag

SEQ ID NO: 52128 - DNA, 561 bp, Artificial Sequence
  Description of Artificial Sequence: Synthetic coding sequence
atggagcagcccaaggacggcgccggccccgagggcaacaacctgtctctgccttctagcggcaccgagccatggcctcccgctccgctgccggcccccccaccgctcctgctgaactccactgaccctacccacctcggtctgccggagagcgtcgcctccgttacggttccaatccgtttggacaccctttcttgtcttttacactcagccctgctcggcgcttatacttttcaacaagccctgccctcctgtccatgttgcagccaagccggccatagccagccaggtgcggtccgcagaccccccaggggtaggggagggtgggaggttagacaccgccccggatggggccgtgggttacaccgtcgaggactaggtcgggccgaacaacccgagagggggcgcgctggtggaccaggggccggtccgagaacacctcccatgactctccctagccccccaactctgcccgcacaggatggcaagaaggaggcccgtggtccagaacctccactggagacacctcttgcagctgaagattgggaaacggaatactag

SEQ ID NO: 52129 - DNA, 357 bp, Artificial Sequence
  Description of Artificial Sequence: Synthetic coding sequence
atgcagagcctgcggcccgagcagacccggggcctgctggagcccgaacgcactaagacactgctgccgagagaatccagggcttgggaaaagccacctcaccctgcgtgcacaaaggactgggaagccgtagaggttggcgcatcatctcatgattccgatgagaaggacctctcaagccaggagactgggctctcacaggagtggagtagcgtggaagaggacgatgaatcagaaggaagccaagggttcgtggagtggagcaaggccccacagcaaaccactatagtgctggtcgtctgtgtcctgtttctgttcttagttcttaccggaatgcctatgatgtttcacatttag

SEQ ID NO: 52130 - DNA, 315 bp, Artificial Sequence
  Description of Artificial Sequence: Synthetic coding sequence
atgggccggatccccggcggctgcagcagcaaggccttcatcggccgggcacaatggcttacaccagtgataccggctttgtgggaggctaaggggcttaccctcctaagccgacttgagtgcagcgacgtgattatggatcactgctctccccaattgactggccttaggatgaagggcttcctagcccaaacaccacccctggagttcccagtgcaccagtaccaacccggagaccatgtcctcatcaagtcttggaaacgggaatccttaaaccaactccgaagaacatcttctggtacccttgacgagtag

SEQ ID NO: 52131 - DNA, 381 bp, Artificial Sequence
  Description of Artificial Sequence: Synthetic coding sequence
atgaagaagtggaagagccggctgttcccccggccccccaactggctgtcaggaaagtaccttcggttaccatcgtccgccatgtttctcatcgatttttgcctgtgcgttccatggactaccccatttcagtgtaagatactgatggtagaattcatcgtagggttctacgatttctgcctcgctttagaggtccagtatagaacatctaagctcttcctgtgcggtcaaccttccccccgaagaagcctgggcatccagcaacaggctcttaaattggcgtgtctgagccccactctgctggagagtagtagttgcgtcgacccacctggcaataccgccggatcaagaatgcctagctccagcaattgcatcaaatag

SEQ ID NO: 52132 - DNA, 663 bp, Artificial Sequence
  Description of Artificial Sequence: Synthetic coding sequence
gtggagggcgaggcccccggcctgttcctgagcagccaggagcagcgagccagggacaccgaaggccctaggcagggtgacctggaagccggcctcgggtggggctggccgcttcaccctgggagcaatcagggagccccacggcagggtgggtcaatcggttcgggaactaggccctgcccctgtccacctctttctcgggaaggcggtgccttagcgtctccacgggttgccctaagccagctccagtgcgggcttctgggcagcgcagagcagagtttccttcagttggagcaggaaaaccactccctcaaaagacagaatcaagaacttcgggaacagctgggcgccctgttgggaccaggtcagcagtttcttccactttgccctgagcattcctcctgtacggcacttgcttggcctcccgatccagccggtactcagcccctggggaaccgggcccccctgcagttgctcaggcgggagttgtgccaggggcaagaagcatttgtccagcagagccagaatgagctgcagcaaatccgcttgtgcttcgaaaggaaaaagatggtgattacagaggtatgggacaacgttgccgaaatgcacatggccctcaataaccaagccacaggacttttggtggggccccaccgcgcttag

SEQ ID NO: 52133 - DNA, 363 bp, Artificial Sequence
  Description of Artificial Sequence: Synthetic coding sequence
atgtacagcttccccaccaccgtggtggaggagatcctgagcctgtccttgcaattgatcgcctttccaacagtgtcctgcgagatccttttggaaattacttcccagaccaataaaaagcagacctgggaaacatgctatgctcattccgccgaggaaatcggcatcatcgctgggaagaggattcacaaaacgcaggccgtgccctatatttgctttctgctccgtcatcagttcatcagtcagtcctcacatgtcagggtggaagctctttattcccttctgttcctggggactctgttgcaagtgggaaaaggccaggaggtcctcctaaaagacgcgctgagggctagagccccatag

SEQ ID NO: 52134 - DNA, 2568 bp, Artificial Sequence
  Description of Artificial Sequence: Synthetic coding sequence
atgtggagcaccggccccgaggcccgggacggcgacagcagcgtgtcgtcaggtaggctcagttgctctagcgggggtcacgacgtgtgtgtgtcttggaaggagaggccaccgcaggttctggggcctcagcagcgtcctcgcaagtccgacgcaagactggagcagctgagagacaaaattcgcgcccaggcttggcaacaggggtcgtgtgcatctcttggtacctccgccccaagtagtgcctcacgactgcacaaagctagcaccctgatgctgcgacgcaaaggtcaggaggcaaaaaatcctccacctgctccagagtgcagcggtttctctatcctctcggctgcagaacgccgggttgaagctaaggcctctcatggccagggaagggaactgagccgcgttagtcagcatcaggtgcccgtgcttcgtgagaaacctaagcgggtgaaaagttctagctgtaaaagggagaagacgcctaagctgccctcgccgaggagggcagctaaagataagcacaaagacgaagactcagaactggttggtgtgtacgcttggcggaaagggcaggcgctcgtccgcagtctgctcggaccaccgcccgttcttcgccgccaccacagtaaggatcctagtagggacccagctctgaccgtggacttaggcgactcggagaaagttatcgccgccaagtgttccccagtgtgtgcacagctcccggatgctacctccgcctatagcgaccagcaggtaagcggaaacaccccaagcctggccagttttgaccagccggccacaattcaaaccgccatggctattctgcaggatctgagacagcagatccaggccgggttagagctggctcaggcgaggaagggaggacaagagctggggccctcaaaaaggcgtctccaggacgtggccggacgcggctgctgccgagatccgaatgctcaaagctcttttagcaagtctccctgggcgatgactgaaagaaaacacagctccctggaaagggccagatctgttcatacttgggaaccctggtcatccagtacggctcgagaatcttgcccgcagagagcatggggggcacaggggcaagatcgctcgttccagagacctgagtcaccgcatgagagacttgggcacttttcccagcgtccttggtcagccctggcagggcaggcctgttcaccccaaagagcctggggcgcccagcgtcaaggcccatcaagtcaaagacccggatcccccccagagaaacgatcaccatttccgcaacaaccctggtccgccgtcgcaactcagccttgtccgcggagagcatggaccgcttgtgagacttgggaggatcccggacctcgacttcgcaaccctcttgagcggcctagcccacccgcccagaggccttggagctcaagtggtgtgcagagagcaggtccccagggtaagggcagaggcatcggttccccagttagtgccgccaagcacgcgctgcctcggcctacggggtcgtttccacagaatccccttggcaaagagaaagacaccctcaggccctgcccccgctcgcgaggactgctgggaccttcccacagcagcgaatccctacgggaatttatgcgacaaaaggcccaagccaggagacggcaggccctagaagagaaggcctctgcgcttagaactcgcgagctgcggagccggaggcttcaagaggtttacaggcagcagcgggaggcagttcttggtcgggcagtgcccgtcgtgtcccgaacaaccccaggtatcgtgacatttgtgccttcttctgcccaatctggaggcctcgaagcctcaggatcattggagtcacctgtgctggaatggagtaaggtcacatctggaatggttttaggcggacaggaagcccccggatctttttgtttatgtctgaaccgggcctggaatcacgcagaaacgttggacccccccggtatgggaggccctcaggatggaagggacgccccagtgctactgtcagcaagcccttcactgggcagcctagaactacaggacctgactacccgctacttgcccagggggatgtgcatctatctggatcccaaagaagccgagcacctagggacttcttcctctctgcacctcagacacaaacaggctcaactgcaggcattagagactactgccaaagtccttaagcagcgggttgactctctaaccgctaaactgcagggcgcagaggcattggatactgtacgtgatcctgcggtaggtttgctcagaagctgcccacatagtctgcccgcggccccaactctggccaccccaactttagccacacctgcttgccctggcgcccttggtcctaactggggcagaggcgcaccaggggaatgggtatctatgcaacctcagcccctgctccctcccacctatttcctggacggggagactctgagttggggaccatcctgggaacaacagcagtccgtttctccccgagcgcattgtgagtctaaaccccggggtgtttcacaggcacctctcttgctgtag

SEQ ID NO: 52135 - DNA, 2829 bp, Artificial Sequence
  Description of Artificial Sequence: Synthetic coding sequence
atggtggtgagcgccggcccctggagcagcgagaaggccgagatgaatatcctggaaatcaacgagactttgcgaccacagctagccgagaaaaaacaacagtttcgcaacctgaaagagaagtgtttcttgacgcagctggcagggttcctggcgaaccagcagaaaaagtacaagtatgaagagtgcaaagatcttatcaagtttatgctccgcaatgagcggcagttcaaggaggaaaagcttgcggagcagctgaagcaggctgaggaactgcgtcaatataaggttcttgtgcactcacaggaaagagaactcacacagcttagggagaagttgcgggaaggcagggacgcgagcagatccctctatgaacatcttcaggctctgctgactccctacgagccagacaaaagccagggtcaagatctgcaggagcaattggcagagggctgccggctggctcagcacctcgtgcagaagctcagccctgagaacgatgaggacgaagacgaagatgtacaggtggaagaggcagagaaggtcctggagagttcagctccaagagaggtccagaaggcagaggagtcgaaggtgccggaggattcccttgaggagtgcgccatcacatgctcaaacagtcacggaccatgtgactccaaccagccccataagaacatcaagatcacattcgaggaggacgaggtcaattccacattggtagttgatcgcgagtcatctcacgacgagtgccaggacgcacttaatatcctgcccgtgccaggaccgacaagttccgccacaaacgtgtccatggtcgtgagcgcgggtccgctgagtagtgagaaggccgaaatgaacatactcgagattaatgaaaagttaagaccccagctggctgaaaaaaaacagcagtttaggaacctcaaagagaagtgcttcctcacgcagctgtcaggcttccttgccaaccagcagaaaaaatacaagtacgaggagtgcaaggatctcattaaattcatgttgagaaacgaacggcagttcaaagaagagaaactggcagagcagctcaagcaggccgaggagctgcgccaatacaaggtcctggtgcatgctcaggaacgggagcttacccaattgcgggagaagttgcgggagggaagagatgcttctcgaagtctgaacgagcacctccaagcattactcacccccgatgagccagacaaatcccagggtcaagacttgcaggagcagctcgccgaagggtgtcggcttgcacaacatctggtccaaaagctgagcccggaaaatgacaatgacgacgatgaggacgtgcaggtagaagtggccgagaaagtgcagaaatcttccgcaccccgtgaaatgcagaaggccgaagagaaagaggtgccagaggactctctcgaggagtgtgccataacctattcaaatagtcacggctcctatgatagcaatcagccgcaccggaagacgaaaatcacttttgaagaggataaggttgactccaccctgatcggcagcagctctcacgtggagtgggaagatgccgtgcatatcattcctgaaaatgagtccgacgatgaagaggaggaggagaagggacctgtgagcccccggaacctgcaggaatccgaggaggaggaggtgcctcaggaaagctgggatgagggttattcaaccttatcaattccccccgaaatgctggcctcatatcagtcttactcctctacgttccatagcctggaggagcaacaggtgtgcatggccgtagacataggacgccacagatgggaccaagtgaagaaggaggatcaggaagccacagggccacgcttgagtagggaactcctggatgagaaggggcctgaagtgctgcaggatagtttagaccgctgctatagcacgccatctggatgtctggaactcacagatagctgccagccatatagatctgccttttacgtgctcgagcaacagagagtaggtcttgccgtagacatggacgaaatcgaaaaatatcaggaggtcgaagaagatcaggacccttcttgccctagactgtctcgtgaactgctggacgaaaaggaacccgaagtgctacaagatagtctagaccgctgctattcgaccccttccgggtacctggaactccctgatctcggacagccctattccagcgcggtatacagtctcgaggagcagtacttagggctggctctcgacgtggaccggataaagaaggatcaggaagaagaggaggatcaaggaccaccatgcccacgtctcagtagggaactattggaagttgtcgagcctgaagtgctgcaggactcattggataggtgttacagtaccccatccagctgcttggaacaaccggatagttgccagccctacggcagctctttttatgccctggaagagaaacatgtaggatttagtctggatgtgggcgagatcgaaaagaaggggaaaggaaagaaacgaagggggagaaggagtaaaaaggaaagacggcgcggcagaaaagaaggtgaggaggaccagaatcccccttgtcccagactaaacggcgtgctaatggaggttgaggagagagaggtgctgcaggattcccttgaccgatgttattcgactccctccatgtatttcgagttgccggattcttttcagcattacaggtctgtgttctacagctttgaggaacagcatataagtttcgcattgtatgtggacaataggttctttacccttaccgtcaccagtctacaccttgtattccaaatgggcgtgattttcccccaatag

SEQ ID NO: 52136 - DNA, 267 bp, Artificial Sequence
  Description of Artificial Sequence: Synthetic coding sequence
atggccgtgagcaccgaggagctggaggccaccgtgcaggaggtgctgggtaggttgaagtcgcaccagttctttcagagcacctgggatacggtagcctttattgtcttcctgacttttatggggactgtccttctgctcttgttgctggtagtggcccattgctgctgctgttcgagcccgggtcctcggagagagtcacctcggaaggtaagcccctggaaggagagaccaaaaggggtggataatttagcactcgagccgtag

SEQ ID NO: 52137 - DNA, 267 bp, Artificial Sequence
  Description of Artificial Sequence: Synthetic coding sequence
atggccgtgagcaccgaggagctggaggccaccgtgcaggaggtgctgggacgtcttaaatctcatcagttcttccagagtacatgggacacggttgccttcatagtgtttttaacattcatggggacagtcctcttactgctgctcctcgtggtcgcacactgctgttgctgcagctcccctggcccacgccgagaatcaccacggaaagtgtccccatggaaggagaggcctaaaggggtcgacaatctggctctggagccatag

SEQ ID NO: 52138 - DNA, 252 bp, Artificial Sequence
  Description of Artificial Sequence: Synthetic coding sequence
atggccgtgagcaccgaggagctggaggccaccgtgcaggaggtgctagggcggttgaaaagccaccagttctttcaatctacctgggataccgttgccttcatagtgtttcttaccttcatgggcaccgtgctgctgctgttactgttggtggtcgctcattgttgttgctgtagttcaccggggccgcgtcgcgagtcgccccgcaaggaacgacccaaaggagtggacaatcttgcgctggagccttag

SEQ ID NO: 52139 - DNA, 615 bp, Artificial Sequence
  Description of Artificial Sequence: Synthetic coding sequence
atgcagagcgccctggtgggcagctggcacaacaacggcttctacgggcattacagatcccagtttaagtctgagtccgctcgcgaataccacctggccgcaaaaccacagccaccggccgtgtttctgcagaggtgtcaggagccagcgcagcgacacttcttctccaaacatgataaccgtactagttttgataaaggcccatattgcctccttcagggaatcgggcgtagaaaggatctcgagcggctgtggcaacgccatactttcctgcgctgggccccatgcgaaatcgaactgcgccagcagggacctttggaaagctcgtaccaggcagacttcaggcccggaccaggactatccggcctgccacaacacctcattcatttcgtacaggtccaaccaagccacacaaggactacctatcagcagaacttctgctgcccctcacagggggggcactacggatcatataaagttggccctcaggcaccagtaacggatgtgctccctgacctccccggaatccccagaccaaagctactgcagcattatctgcacgccggcgtcagtgagtgtctgaactggtcgagagcacttaacaaagactcttag

SEQ ID NO: 52140 - DNA, 1140 bp, Artificial Sequence
  Description of Artificial Sequence: Synthetic coding sequence
atgcagagcttcctgaccctgctgaaggagcacgaggacacctgcgcccccccagcagaactcgtcactctagccggaaggctgtgtagggacttccaagacgatctcgcacagctgcaacccctggtcacagccatcttggattcccaactgaggcttcatctgcttgacaatgcagacgttgctctggcctgtgcccgggtgctcgaccaacaggaacagcagcaggcggcttgtcggctgctcgagggatgtcaggtgccgggcgggtcccaggagttagtgcagttgtggaacgatatccactacagactggtgatgagacgactgggtgtggctgcccttactcccgtccagaagttcagatgtcgcaaaagaaatccccccccaccaagcctctgccctgaggggcttaaaagccggaatttccctagagaagtgcgcgagaaacttcacaatttcgctgtgggcgtaaacaccaacccatcaaaggctgaacgcgaaaacctggcactcgaaacatcgctgacccccgagcaggtctataactggttcgcaaactaccgccgtaggcagagagcccttccacagcatatgaaaccggcccaacaagccaccgcagaggaccccggagcacgggaaaggggaccagacctcctccagccttcaggcaatcctcgggttgatagtgggttcgtggaccgaccgcagtggtctgaggaacgcgaggagaagggtcccccgcagagtccccagactacgcagggcccttgggagccactggctctggctccggattttccggcggatgaaacagtgagcaaacctctagatgtctcgggccacccacaatctgttcaacttgaggagggcctgggcacctctagcggcagaaccgaactgagggtgggctctttcctggtgacccaaccacccctgcaggccccggagtttatcctgactcagtctccccctgagctggctccggctccttctgccttccctggtcccgtcagcgccatggagctgtctcaggcactgcccagtagtcaggtgcagtgcagcgacagccaggcctcaggcgacgctttttggggagctaggatgctgctcgagtttagtggatccagtctcgggtag

SEQ ID NO: 52141 - DNA, 366 bp, Artificial Sequence
  Description of Artificial Sequence: Synthetic coding sequence
atgagcctgcacggcatcctggccagcgccggcaccatcggcgccgtcgctgcgtggttgatgagctacaaacctgcattattcggctttctttttttactgttactcctttcgaattggttggttaaatatgagcacaagctgacactcccagaaccccaacaggacgaaatattgcagagactgctcttctctgagatgaagatgaaggttttggaaaaccagatgttcattatctggaacaagatgaaccaccatggcagaagtagccggcaccggaatttccccatgaaaaaacatcggatgcgcaggcacgaaagtatttgccctacactgagcgattgtacttcatcctctccctcctag

SEQ ID NO: 52142 - DNA, 756 bp, Artificial Sequence
  Description of Artificial Sequence: Synthetic coding sequence
atggacaccaccctgcggatggtgcggaccgcctgccagcaccgggccccacaaatttcgcacaaaactggctgttctcatatatccatgcattcacccgggggtctgacaacaacaaagatggccggcccattgccaagagttagtgactccctcttcagtgcgatggaactggctaagatgagcgatatgacaaagctgcaccaagccgtggcggccggtgattactcgctcgtaaagaagattctgaagaaggggttatgtgaccctaactacaaagatgtcgattggaatgaccgcaccccactgcattgggctgccataaaaggccaaatggaggtgatacggctgctaattgagtatggcgctcggccctgcctggtgacaagcgttggttggactcctgctcattttgccgctgaggctggccacttgaacattttaaaaaccctgcacgccctgcacgccgccattgacgcaccagactttttcggcgatacccctaagcgcattgcccagatttacgggcagaaagcatgcgtggcatttttggagaaggccgagccagagtgccaggaccacagatgtgccgcacagcaaaaggggttacccctggacgagcgcgatgaagattgggacgctaagaagagagagctagagttaagtctcccctcactcaaccaaaatatgaacaagaaaaacaaaaagagtcggggccccacccgcccaagcaataccaagggacgacgagtgtag

SEQ ID NO: 52143 - DNA, 378 bp, Artificial Sequence
  Description of Artificial Sequence: Synthetic coding sequence
atgcccccccaccccgccatcttcttctactgcctgctgcggcagggtttgaccatgctcccacgtctcgtgctgaatttttgggcgcaggccgttcacctccccaggcctccccgcgtacttggtctgcaagcaggcggcactgcaccagggcaaaaaaagctgtttttgacctctcacttccctcctgcctcccccttaccactgtgtttcagtctgcagcaaaacttcaagaaacattctccaagatcacctcctgggatcctcggatcgctttatccgggtttctgcagtccgattgcaacatcacccttcgctaaggggacaaggggtctccgggttgtagggtcatctggcagactgtccgcctccagctag

SEQ ID NO: 52144 - DNA, 390 bp, Artificial Sequence
  Description of Artificial Sequence: Synthetic coding sequence
atggccgccgccacctgggacaaggagagcaagtgccggctgagccggggacactgtcaccacaggcgtcaccagagcctccctgtcggacttacactcaggtactcagctcccgccagccaccagcccaagtgtttcacatcaaagcatggaacccggccatctcagcggaaaccgtcactccgagtgtccggccactactcccctcactcgctgtttcctggccatggacgtaggggggcatgcgtcgcccggagtcgaagattcgccggccatatgcagctgacctggaagttgaagagaaaaaaacccggtcggaccgcctccagtgaggagcataagaaacaaggccgcggatgcgcgggaaggcgtttgattaaaagcacatag

SEQ ID NO: 52145 - DNA, 711 bp, Artificial Sequence
  Description of Artificial Sequence: Synthetic coding sequence
atgcacacctacgtgtacagctacacccggatctgcatccacatgtatatccacattcacgcctacgcgtatatctgtatattcatttatactcatatgcatacctacgtctattcctatacaaggatctgcattcacatgtatattcacatccacgcctatgcatacatttatgtctattcctacacaaggatctgtatccatatatgtatcttcatttacacacacatgcatacatacatgtatatccacatacacgcatacgcctacatctacgtttacagctatactcggatttgcattcacatatgcgtcttcatctgcacgcacgcatacatttacgtgtatagctacgtgcagtgtatgcacatgtgcatccacatgtacacctgcatgcacatgtgcatcttcatatgtacccatgcttgtatctgcgtcttcacaagcacccacgcttgcatctgtgtgttcacttgtactcacgtgtatattagtgtattcacgtgtactcatgtgtacatttgcgtcttcatctatatttgcatacacgtgtatattcacatttatatatgcattcacatttgtgtatactcctatatacatatgtacacctatattcatacttacacctatacttacacccaactgttttttaatcatttgtccatagatgagcactccttgtttctttatctcggatactgggagtag

SEQ ID NO: 52146 - DNA, 450 bp, Artificial Sequence
  Description of Artificial Sequence: Synthetic coding sequence
atgcggctgctgccccggaccagcatcccccggcggcagcccttctctcgctggcgaaagcagaaccttaaaacccctgtgtctctgaactgctcacgctcttgcaagctgcttgaggggcgaggaatgcctgccattttcataattgccctgcctcctcctaacacaatcgggggccctgccctcatcatttcattacaggtgtacccagccgcacctgagagacagagacctgcgagacgtggacacgatgatggcgggggcttcgtgaagaccaagatgggaatctgtcgagaaaagaaggagaggtctgactgttattgtgtttacatagaacgggaggacatcagagacagtatactgaaaaaaacatgcacgttgaacaactgcttcgctgagatgctgcttatatgcagttttgccccagcaaccttaccccaacccttatag

SEQ ID NO: 52147 - DNA, 444 bp, Artificial Sequence
  Description of Artificial Sequence: Synthetic coding sequence
atgatctacgacggcaacaaccagctgctgaacgccagcaaggtgggcgaggtgctgaggggcggaacacggcagatttactaccaagtagtgaatttctcctcgttgtggcccttgtacaaatacgctgacaagctccacgtcattctgttatacaagacccttcatcagttggtcgtcgagccagtcaaagtcgcagcctggtactatgaaagtgccagactcctcaatacctacggactcctgggcatgaatgtggccggcatatcctggcatttgtacatatttcacttggtttgtactgatacgagtgtgtctagcagcgcacccctgccctgcccactccccctcatccaccagatgctgataatctttgtgtggcgactgttacgggcatgtctgtactgcagctcacttgcactcatcatatggagctattcatag

SEQ ID NO: 52148 - DNA, 1242 bp, Artificial Sequence
  Description of Artificial Sequence: Synthetic coding sequence
atgcggggcggccacagccccgccgccgcccccgcccacaccggcggcaggaggggtgggggggcgcctgccccccaatgtgttcgttctcctgccgctctcagcaggcgacatcagcctggacggttactgttacatgtatgcagtcccgtcccatggacaggcactgccaccgaagggcagagtgtgggcacttgcctccccggccagttcacccgccccctggataggcaccggcatcgcggatctgaatgttggcacctgagttctggctccgtccacccttctcccggcccggcacccgctcaacgggtgcgtgttctggcaccagtctttcggatctgtagtcccctccctcggacagggaccgctactgaggggcaggagtgttggcatctctcttctggatccgtccaccctagtcctggtccagctcccccacaaagggtgcggtccgtcggcacctgcctacctgatctgtttacccggccactcgacagacaccggcataggggttctgaatgctggcacctgtcctcaggtagcgttcacccttcacctggccccgccccaccacaacgagtccgcgtgttggcccctgtgttccggatatgctccccagtcccctggaccggcaccgccaccgagggacagagtgtgggtacttgcctgcccgacctgtttacccgtcccctggatcggcatagacacagagggtctgagtgctggcatttatcatctggctccgtgcatccatcgccgggctctgcccctgctcagcgtgtgagagtattggcgccagtctttagaatttgctctcccgtaccctggactggaacagctacagagggtcagagcgttggcacatgtctgcccgacctgttcactcccaggcttgacaggcacagacaccgtggttctgagtgttggcatctctctagcggttccgtgcacccctccccgggcccagcacctccccagcgcgttagagttttggcaccagttttccgtatttgcagccctttgccctggatcggcacagggaccgaaggccagtctgttgggacctgcctgcccgacctgtttactcgccccctagatcgccacaggcaccgtggttccgagtgttggcacctgagctcagggtctgtgcaccccagcccaggactggctcccgcccagagagtggagtgctggcacctgagttccggttccccgagtttgcctctgtttgtcgaatag

SEQ ID NO: 52149 - DNA, 435 bp, Artificial Sequence
  Description of Artificial Sequence: Synthetic coding sequence
atgatccgggccgccctgctggagccccagccccccaagctgaagcagagtagccacctgagccctcagggagctggcacaaccggcgccgggccccacactccgctcacattcctctacttttttcgtctggaacttctgcaggccgccctccccccccaaccgcccaaagtgctcgtgcgtcaacccgggggcaaggactccctggcggagagtcccttcgatcttagtacggggcgaaatgccccctgtggaggagccttaggcaacctgagacacctgcagtggggtggtgcatggcccctgctgtttcttggaggcacatgggacagcgtgtaccaggctggctccactcttgccctgggacgcgtgtcggtgtccctgtttttcttcctgcctaataagttccacagccacccctcacgtcacctttag

SEQ ID NO: 52150 - DNA, 366 bp, Artificial Sequence
  Description of Artificial Sequence: Synthetic coding sequence
atgaagggctaccgggacaacgccgtggagagcaccttcaccagccgcttttacggatctgaaaagtggcttcagataacgtaccttaaaacccagatgcctagcggctctgcgggaaacatcgaagacctgacgtcctttttcatatttctgcgacagagcctcgccctgctgccacggctggagtgctctggcaccatttctgcacattgcaatttaagtctgcccggctctagcatctcacatgcctctgccttcagagtggccggaatcactggggtccactgtcgaacccagctcatctttgtgtacctggttgagactggattccatcacatgctggcacgtatggtgagcatttcgtag

SEQ ID NO: 52151 - DNA, 399 bp, Artificial Sequence
  Description of Artificial Sequence: Synthetic coding sequence
atgctgagccccctgtggctgcagatcagcaagcggccccggcccgaggtctccgttagcaatgcctgcttctcctccgcactacccaccagcaaccctacctcactcaccctgaaacatcataacattttcgtgctgcgagtggctttggaaataatccagtatagtgtccacggcgggcggaaccgtaagcctctggaggtcacttcattagcctactcctgtcctgagaattggtggcagaagcaaatcggtgtgcaaccgcctgacgtccatgcatccgctctgtccccaaagccatgcgtgagttggtccaggccgctcagcctactgagctccactatccttttctggaagacacacgatgagagggctgactttagcaaactccacagctag

SEQ ID NO: 52152 - DNA, 465 bp, Artificial Sequence
  Description of Artificial Sequence: Synthetic coding sequence
atggagatcatgcccatgaacatcgtgagcatcatcagccccctgatcgacgtgagccctgggcgaaggggtcggctgaagaatgccggaggtggcataagactcgccgaaagagtgaacaggagggccgatagaaatgtcttacgacgtgagaagggtttggccctggggagagtaaccttcccccgcgccggccgaggctctagagtgtcagctcctgcacggagcgagcccggacccgccgccgttccaggaggggtccggagagcagacgacaggaagtttcctccaggagcctcccagccagcatttaggagcagacggttccaagccgcagccggcggcccgtcatatgcgaacgatcctacttcttcagctaaacctgtcaaacttctgcctcgagaaagggctgggcttaaagtcaccaatttcagccagagccgggaacgcgaaggtagcgcttag

SEQ ID NO: 52153 - DNA, 387 bp, Artificial Sequence
  Description of Artificial Sequence: Synthetic coding sequence
atgagctgccaccagagccccctggtgttcgacgtgggccagtgcaggcaacatgaccttgccggtcaaatcctgatttaccatagccttactcccgctggccccctgggacgccctccagatgttccccattcgccccatctggcttctccaacgggttctcgccagagaactgttggggggacatgcgacacggcactctttctatgtagctgcttctctagctctttcttctcccttctcgtaactctgttctttttcaccctgtctcctcataaaaccagaaattttgtgattttgctgatattcctatacagtgtgtgtctccatacggatggttacctgcgggcgagtgagctaagcctaccaccttctattatttcttag

SEQ ID NO: 52154 - DNA, 414 bp, Artificial Sequence
  Description of Artificial Sequence: Synthetic coding sequence
atgctgggcgtggaggacctggtgggcgccggccggtggggccggggacccgaaaatttgcctgattccggtggtaggcttgccgagcaggctctacaagggcctagtcatccatttagctgcctgcctccaccagagcagatccttggcgcgtggcgcgctctgaaagaagagctgctcagcagagctccctctcagttcactctgtgcactgaggtgctgcagtcgagcaatctctctcctacccctgccgtctcaccattcgtgcagtcttctgtcgagatggaaaagttcctggtgccactttctatgtttttgagtggcgagcggacctggaagctgctgctccaggtagacttcctaaaccaggggggtgaatattatagaaactggagaaagcgaaggcgcacatag

SEQ ID NO: 52155 - DNA, 1122 bp, Artificial Sequence
  Description of Artificial Sequence: Synthetic coding sequence
atgttcctggccgacgtgcccaccagcctgcacttccagagcatgctgaaatcgcagtggcagaacaagcctttcgacaaaattaaaccccctaagaagcttagcctaaagcatcgggccccaatgcctgggtcgctcccagatccagccagaaaggataggcataaattagtaagctccttcctgactaccgccatgctcaagcaccacaccgacatgagtagttcctcttacttggccgctacccaccatcctcctcattctcccctcgttcgccagcttagtactagcagcgattcaccagcccccgcaagctcatcttctcaggtcacagcttcgacgagccagcagcccgtgcgccgacggaggggggaatcctcgtttgatatcaacaatattgtcattccaatgtctgtagctgcaaccaccagggtggaaaagttgcagtacaaggagattcttacacccagctggcgcgaggtagatctgcagtctctgaaaggctccccagatgaggaaaacgaggaaatagaagacttaagtgacgcggcctttgccgccctccacgctaagtgcgaggaaatggagagagctcgatggctgtggaccacctccgttccgccccagaggaggggttccagatcatataggtcctcagacgggcgcactacaccacagttgggatcggcgaatcctagcactccacagcctgcctcacccgatgtctcatcaagccattccttaagtgagtactcacacggtcagtcgcctcgctcaccaatatctcccgaactgcactctgctcccctaacccctgtcgcacgtgacacccctagacaccttgcatcagaggatacacgttgtagcaccccggagctgggccttgacgagcagagtgtgcaaccatgggagcggcggacctttcccctggcccactcgccccaggctgagtgtgaggatcagttggatgcccaggaaagggccgctcgctgtacgcggaggacatcaggctctaagacgggaagagagaccgaggccgcacccactagccctccaaccgtccctctgaagtctcgccacctcgtggctgccgccacagctcagcggccaacccaccgttag

SEQ ID NO: 52156 - DNA, 3318 bp, Artificial Sequence
  Description of Artificial Sequence: Synthetic coding sequence
atggccgccatggcccccgccctgaccgacgccgccgccgaggcccatcacatccgcttcaaattggcacccccctcgtcgaccctgagccccggaagcgccgaaaataacggtaatgcgaatatcctgatcgcggctaacggtaccaaaagaaaagccatcgcagcagaagatccttccttggattttaggaataatcctacgaaagaggacctgggcaagctgcagccacttgtcgcatcatatttatgctccgacgtgactagtgttccttccaaggaaagcctcaagttgcagggcgtgttctccaaacagacagtgctcaaaagtcacccccttctgtcccaatcatacgaactgcgcgctgaactcctgggccggcagcctgtgctcgaattcagcctggagaatctgcgcactatgaataccagtggacagactgcactgcctcaggcgcctgttaacggcctggcaaagaagttgacaaagagttccacacatagcgatcacgataacagcacatcactgaacggcggaaagcgggcgctcacgagttcagccctccacggcggagaaatgggagggtctgagtcaggcgatctcaaggggggcatgacgaactgtaccttgccccacagaagcctggatgtggagcacactactctgtactctaataattcgacagccaacaagtcaagtgttaattctatggaacaaccggccctgcagggatcttccagactgagccctgggaccgacagttccagtaatctgggaggggtaaagctggaggggaaaaaatcccccttatcttccattctgttcagtgcacttgattctgacaccagaatcaccgccttgctgagaagacaggccgacatcgagtctcgggcccgacggctgcaaaaaagactccaggtagttcaagcaaaacaggttgaaaggcatattcagcatcagctggggggtttcctcgagaagacactcagtaagctgcccaatctggagagcctccgaccgagatcccaactgatgctgaccagaaaggccgaagctgctttgcggaaagcagctagcgagaccacaaccagcgagggcctgagcaatttcctgaagtccaactctatcagtgaggagttggaacggttcacagcatcaggaatcgcgaacctgcgctgttctgagcaggcgtttgattctgatgtgactgactcatctagtggaggcgagagcgacatcgaggaggaagaactcacccgagccgatcccgaacagagacatgtacctctgcgacgcaggtccgaatggaagtgggccgctgatagggccgcaatagtgagccgttggaactggctgcaagctcacgtttcagatctggagtatcgtatcaggcagcagaccgacatctacaaacagattagagcaaacaagggattgatcgtgctcggtgaagtccctccccccgagcacaccacggacctgttcctgcctctgagcagtgaagtgaagactgaccatggtacagacaagctcatcgaatccgtgagtcagccattagagaatcatggagcgcccatcataggccacatctccgagtctctgtccacaaagagttgtggtgcactccgcccagtgaatggggtgattaacacactgcagcccgttctggccgatcacattcccggtgacagcagtgatgccgaagagcagctgcacaagaagcagcggctcaaccttgtgtcgtctagcagtgacgggacctgcgtagcagcccggacccggcccgtattatcctgcaaaaagcggcggttggtgcggcctaacagcatcgtccccctgagcaagaaagttcaccgtaattccacgattcggccggggtgtgacgtcaatcctagttgtgccctctgcggcagtgggagtatcaacactatgcccccagaaatacactacgaggcaccgctgcttgagcggctgagtcagctggattcctgcgtgcaccccgttctcgcatttcccgatgatgttcccacatctctgcacttccaaagcatgctcaaaagtcagtggcagaacaaaccttttgacaaaataaaacctccaaagaagctgtcgcttaagcacagagccccaatgcctggttctcttcccgaccctgcccgaaaggacaggcacaagctggtcagtagttttcttaccacagcgaagctgtctcaccaccagacccggcctgaccgtacccatcgtcagcaccttgacgacgtaggggctgtccccatggtggagagagtgaccgctccaaaagctgagcgccttcttaacccgcctcctccggtccatgatcctaaccacagcaagatgaggttacgggatcacagcagcgaaaggtctgaagtcctcaaacaccatactgacatgtcaagctcctcatacctcgcggcaactcatcacccccctcacagcccactggtgcggcagctttctacgagttccgatagtccagcaccggcttccagctcttcccaggtcactgcatccacaagtcagcaacccgtgaggcgaaggcgaggggaatcatcctttgatatcaataatatcgtcataccaatgtcagtggctgccaccacaagggtcgagaaactgcagtacaaggagatcttgactcccagctggagagaggttgatctccaaagtctgaagggctctccggacgaagagaacgaggagattgaggatctgtccgacgccgcctttgccgctctgcacgccaagtgtgaggagatggagcgtgctcggtggctctggacaacttcggtgccccctcagagacggggctcgcgatcctaccggagctccgatgggcgcacaactccacagttggggtcagctaacccgtccacgccacaacccgccagccctgacgttagtagcagccactctctcagtgagtattcccatgggcaatcgccccgaagccctatctcccctgagcttcattctgcaccactcactccagttgccagagacacaccaaggcatctggcatcagaagataccagatgttcgactcccgagctgggcctggacgaacagtctgtgcagccctgggagcggcggacttttccacttgctcactccccccaagcggagtgcgaagaccaattggacgctcaagaacgcgctgctcggtgtacaagaagaacgagcggcagtaagactgggcgagagaccgaagcagctcctacctctccgcctacagtcccgttaaagtctcgacacttagtggcagccgcaaccgcccagaggccgacccaccggtag

SEQ ID NO: 52157 - DNA, 486 bp, Artificial Sequence
  Description of Artificial Sequence: Synthetic coding sequence
atgggccaccggcccaacctgggccagcccccccaccccaacgccgttgcagccgctttgcacgcaagcctgtgcccggccaataggggtacatgccctctgggcaagcctggttatcctggttgtctctggttccagcccctgctgctgtttcctggatgcctgtgtagtcctgacggtccttttccacgggctgtattcacatcagctgggaagggacccctgcagaccgacctcggacgtggtcgggtacccccgagagatcaacagactccgaagagtggaccctgtcccagagcccccgtagctagtaaccgtcaatcaggtggcagtgcagtttccgcccctttgagtggcgccaggcgagcctggaagtctgcattcgccgccccaccacggagcagactgagacctcagaaaggagtgccgtggacggaaaaaagagcaaggggcggagggcgggcaggaccgtgtcggagaacatag

SEQ ID NO: 52158 - DNA, 372 bp, Artificial Sequence
  Description of Artificial Sequence: Synthetic coding sequence
atgcggagcgagaagagcaagggctgctggcgggacggcggcgacgcccaccctggcgagaaggctagccaatcgtccggcattacaggagtgtcccatcgcacccggctgaccagtgttcttttaaggaacacacaaagacggcgacatagaagaggggagcaccacgtgatggtggacactgagataggcgttttacaaccgcaggcaaaggagctgctggagcctcccggcgacggacgctgcaaagagttgatattcagccagagcctctggcgagagtgcggccccggggacaccctcatcctggacttctggcctacagagccttgcacccaggaggatttcatatcccaggtttccctacagtag

SEQ ID NO: 52159 - DNA, 630 bp, Artificial Sequence
  Description of Artificial Sequence: Synthetic coding sequence
atgctgagcagccagctgtgctgcgtgcacagcctgccccccaccgcaaacccagcagcgctgtgttcgctagcccaacagatgttcactaatatcaggtctccttgcagcggtccacagggaagccctggactccctcgccgaacccacatccacctgtggccacactcagcccacatgtactttctcgttactagctctctgctcccgtttcccttgatccaacctggctgctccagaacacgcttcaaaactctttgcagcctcagacatacttccgccccgaccgaggagggtcacgggcccgtcaggagaccctgcggtatgcattgtctttctcacctaccccatcccaggggcagaccacagggacaccctacccacatgaggcccgctctacaacaggccctgcttagtcacccttcactgctgttgccctggagaagctctcccgatagtgcagttcaggttggaccaagtatgattctacggcggattccaatggcgggtcacctgtgcttcccccactggcctcagctcttggatagtagggattgctgtacttacacatgtatcaacacaccagtactgaattctcacatggtgcaggagggggtgtgtggccagtag

SEQ ID NO: 52160 - DNA, 642 bp, Artificial Sequence
  Description of Artificial Sequence: Synthetic coding sequence
atgagccccaagtgcgccgagaccgcccagcagctgcggtgcctgaccgaaaacgtgcagcgacccctctgtcccactatgcctgcctggggtcggccctccctaggactactgagagtgtctcctgcttgtcagccgaagggtggaaggtcttgcggatgctcccaacccctgttgaaggttggcctgtgggtggaaatgtgggcggcttccgggcggcactcttacaagtgtattccagcgcttagaaccactttcctcctccctagtccctttctgcggacccccatgcagaagcgcggccgtcaactgacgaaagatcgggagggctattgctcctggcacctcatgggctctatatgctgcatcccactgggctgctgtccaggttggattgggaaagaactggcaggccgcctctccagcgtgctaacaacatggctgggcggaggaaggggggcctggcaagaacagagcgccgggccagggaattggggactcgtgcacgtatgtacacatgtttgcgtctgtgtgcgggcgtgctgggtgggccgagaggaggctgtcaaacctcaccctctcctctccgccgctgtgttgctttgtgtgagtgccgctaggggctgtcatcacacgagctag

SEQ ID NO: 52161 - DNA, 612 bp, Artificial Sequence
  Description of Artificial Sequence: Synthetic coding sequence
atggacagcgcccccgccggcagcttcagcgccagcagcttcttcgacttaagcgtgaccgtcacaagggccaaaaactcgcgcggtccgtcaagcagccccagtgaattacagggcgcccattgtctcacatcttctttggcagctgcctgctccgtggcatatagcgcactgtggtcatcgtcccctttgaggtctccctggagcatctcctctataactatgcctaggctctcctcagaagagtcatccgcatccctgctcgctggagctgatgggagaccgcctaggctattgtttctgccattctgggtgaacctgctcaggctggtcctgttcctacgccctcgcagaccgctgcttggctttctggcagcacctcgaagcgagcctgcatgccctgtcactagccctgagtcttgggcctgcgtcagtgaagctggtggagtgggtgcctctccaggtgtaccagctagcgcagcctgcgtcggcccctcgagctcttccagacgattgatatgcctgcggacactcgtttcttgcgcgcggtcattccaccggaccctgcaaaccccctcactccctggaattagtttgggcatggccgcatag

SEQ ID NO: 52162 - DNA, 666 bp, Artificial Sequence
  Description of Artificial Sequence: Synthetic coding sequence
atggccgccgccggccccctgtgcaccgagcgggtgagcgtgctgagtcagcctaacagcggcgttgaagatcctacccccgctggcggtaggggccaggggcgtaggagagggagagaagaacttgagtcaatcggggccgggccaggagcatctgttcgaatcctcccagcccttcgtccaggcctggggggggtgtggggcgcaggggcagcttctctggttttccaggcaggcccaggctccagttggctgggctggcccgatcttgacctggctttatataggggctgggcctgtcgctcggaggggactgctaatgtggccttccctggcaccgccagtccgggcttttcacgggcccggcagaccagggacctccgtaaaccagccttgaagacgcctagccatactgctagtcagctggccgccgaggccgggaacccctcggggggctgcccttctatgcgctgccagaggcgagtcggcgctctggtccctacctggaagggcggctggcgtgacggctggtccggctctgggggaagagccaaagagcgaattctggctttttcattccctgccggaggtggaataagaggagagagagtgcaagcggcaagcaacacaaggatctgggaggagccaggtagcacccctaattag

SEQ ID NO: 52163 - DNA, 378 bp, Artificial Sequence
  Description of Artificial Sequence: Synthetic coding sequence
atgcagcccgtgatcagcgccctgaacatccagacccagaccgtgcagacgcacccagctcccagaaacacctcagaacactgtaccctacctgcctgtgatgcacaggaagaacacagggacacagtggatggaagcattgcccggaccgagagcgcctccggagaaatttggcggcaaactcacatggacggggagcatcacgtgaataccaaagccgaaatatcggtcatgagcgctaaccagggcgccccacggatcactagcaagccacctgaagcacgccgagaagcacgggacaggagtctgccaagcgccttctcactgcgcggactaaccgacaccctgattctaggtttttgccctcccgaactctag

SEQ ID NO: 52164 - DNA, 369 bp, Artificial Sequence
  Description of Artificial Sequence: Synthetic coding sequence
atgaaggtggccctgctgcggttcttcagcccccccaacatgagcgtgacccataaggaggcccacgagcgaaagtgtccagagaagcctgagctctggaaagccggttctacggtgccactgaccgcacctgaaaagaccgaccctttcccactgtgcccaccactatccctgacatgcccgcagcagcagagttgcattccaagttcgtcgcaggacgtgttaaactccttatgggtgagcagtcactgcctgcagctgaagatttcaaagacaaagacccactgcttgcctacccagaacgttttgcctttccttctcccaacccccgtatctatcgtttgtcggttgccaggcctggatccttag

SEQ ID NO: 52165 - DNA, 459 bp, Artificial Sequence
  Description of Artificial Sequence: Synthetic coding sequence
atggaggccgaggcctggggcagccaggcccgggccggcctgggcgccgctgaaaactgcctcgaagggggtaaccaggctttcctcttagagcgagtgactggcactaaaggaagggggcaggggcagcctttagaaagggcaggagaagaaggcgaggcgggtggggatcccagaagggacccgggagaagtggtcgccaagtcacgcgtacgcgccagacctcacttgtcactctaccctgcactgccaggagtggccctggccttgctgtgttgccccttgcaggaccgatgtctgagactagtacctgcatgcccaactgcgggaccccaacacccacaggttctgccctgggccctgcagaagcagggcgtcgtgagatccggaccctgggccaccgaggaaatggtgtggggaactagaactggagtcggtggcctcaccgctgtgttctag

SEQ ID NO: 52166 - DNA, 879 bp, Artificial Sequence
  Description of Artificial Sequence: Synthetic coding sequence
atgcagcccagccgggaggccctggagctgcggggcctgcccaagtctgtgagtaccgtgagcagcacgaagcctccattgaccactccttcctcaaccaatccatctagacagctggctctagaagactgtgtgcagctgagggccgctctggatctcgggtacgggcctgaatgttgctgtcatcacttgcccgaggttgctcataagtcctcagcctctgctggcgctcctagcgcgaggctgccattgcagccgcactctctggggacgagaaccaagctccctcccagcctgtgcctccctgggcccgggcgcacaaggctgacgacagagccattcccgggggcccccttctgctccgacagctgctctccggcattgtgctgtgttttgttgactcccgggagggggcgcggctcggttgcacctctgggctctagtcaagatggtcgcggcggctgctgccccacagacacggttccagcagcacagggtatggatgcttcttggactgtggctccagcgcaggagtggctgggacaccccttgcagagctgcccccagagcgcctccagaggacacctgccactgccactgcccacgcccactacaccctgtatttcacagcctcccggaaggcggtgccgaccccactgtgggaaggagttgtttcgcgccccaggcgccctccattttctgcctagaagacaccctgcggctgtgagacaccgctggactcgagcttgcccagagggccctcgcatgcatattcctcagggatggctgctaagttcccccagtttattaaccgactggttttctatggactcattcaagcccccttctctggcttcaggacagatttccaagacatag

SEQ ID NO: 52167 - DNA, 900 bp, Artificial Sequence
  Description of Artificial Sequence: Synthetic coding sequence
atgcccgagggcagcgtgagcgccatgcggaccagccccaagagctcttggccctggtgttgctcatggtcctgcgcttggtcatccagtagccccccatggagaagccccccatccgctaccgggaccctgtgtcgatcttgcagcctggccccatctggagatctggaggttcttaagtctcaggaaactgggtgcagagatcctctgcagctgcctgggcttcttggtccttgcgctctgtccccaatggtgggcagtcctagcggacgcgtgaagttggtaggcagaaggtccgtcgtccagtgttccaggtgttgcattgacccgctgattttttttgtgtttgtattcatcctgttctgtttcgtgttcgaaatggagtcctgcagcgtgactcaggccggcgtgcagtggtgtgatgacttgggatccctacagccgcctcctcctggattttcctgcctcagtcttcctggttcttgggattacagacaccctccgcctcaccccgcaaatttttgtattttcagtagagacgaagtttcaacccctacccaggccggggtgaagctactcacagcatccgaccttccaacattagctagccagagtgtagccatcaccggcgtctcccaccacgcacagcctaatcctcttatcttttgtttcagttcttccacggtgcgcaaagcctttgatcgggggcctcgccgatggcagcacggcggcggcctgacagtgtgggtcgtggttaaggctctcgaatcccaattgcagcgggaagatgtggatctgcgggacggtcaatgtcacttgcacagacgcctggaggccccagcctgggggaatcttcttggtaaagagggtagcaaacgagggaccatgaagcagaattag

SEQ ID NO: 52168 - DNA, 843 bp, Artificial Sequence
  Description of Artificial Sequence: Synthetic coding sequence
atgaccagcctgacccacggcatgcacctgaccagcagcaccagctgttcgtgccagtcctccgggacatcgtttacaagttgtagctgtcggagctccggcacatcctctactagtaggtcttggtggagtagcggcacatcgtctacctcgtgtagttggtggtcttctgggacaagttctactttttgctcctgttggagcagcgggacaagcttcacgtcctgtagctgctggtcctcagggacaagctcgactccatgcagttgtagaagttcgggtacgagcagcaccagctgtagttgctggtcatctggcacttcctccactagctggtcttgtaaatcttcagggacaagctccacatgctatatgtgcctgtcctccggcacctccagcacctcatactcttcttggtcttcccaaacgtcttccacaagctctatgtgtctacctagccggaccagcagtatcttctattcttgcctgccgctcgggcaccatttgcccttctgtagcgttcggccactgggtcctcctaccacttcacctttgtctaacctctggatcttgagccatcctttctatttaggaggtgtgtggcccctcaacaatcatctgcacatgaacctgctgggatattttaataacctccacttgtggagccttggcttacaacctctgcctcccccgggtagcccgctcgttcacctcccgcccccgccactgggatggcccttactctcagagttgctgcaggacctgaaccagttgccctacccactgcttcctgttggtcctcgacctcgaccaccccatgtgctgctgggcatattcatctag

SEQ ID NO: 52169 - DNA, 477 bp, Artificial Sequence
  Description of Artificial Sequence: Synthetic coding sequence
atgctggacggcggccggaacggccggctgctggagctgagcagcctcttaccagaaagagggggtgggccttccctgtgtcgcagcccggctagtaccgagaaagaagtcggcgcgtgcgggacgttggcttcactgagacgggggctgtggaaatgttccctatgcccaggaccagctttactgctgggaggctcttgttgcctgatatgttctctgtcactgctgctcctcagcacaccaactttctttagcagaaatttcgaaccatcttttagcccttctcccattgagaaaccaagcgccccgtcctccggccagagttcacagctacagacccaggtgcagcctcccgcggaaagaggagctgcctctatgcccggtcctgcgagcctgcctctctctactggcccatctcagccattgcgatgttccccccgagttctgtgttcacgtgttcttgctctgcggcgatag

SEQ ID NO: 52170 - DNA, 480 bp, Artificial Sequence
  Description of Artificial Sequence: Synthetic coding sequence
atggccaccgtggaccccgccggcctggccctgcaccccgcctgccctcgcgtctggggccccagcgatcagcatagacctcctcaggagggttcccacctcccagctagaaggagaggactggcccgtaaccaatcttgccagcaccccgacctcggcccaccagcaagccgcactgagaaagagatgtccgccgtcgcagccccaggctgcgctgccctccttcagccaccgcaacagacttcagtgcagtctttcaagggcatgtccctaagtgttgaagcagggctttgcggggaacccgcgggaaagctgctaggcgagggaggggggcagagagaagcatccttggtggggaaaaaaggatgggagtggcggaggcaccgcgggcgaaccctgagcgaggaggaccagggggccaggccgttcagccctggatcctgtgccctgcgcggtgacagggagggcgggattggctag

SEQ ID NO: 52171 - DNA, 618 bp, Artificial Sequence
  Description of Artificial Sequence: Synthetic coding sequence
atgcgggagcccctgatccccccctgcaaggccgccagcctgagcgagcaggagcaggttcgcggcgagtgtggcatgatgactgcacagggcatcctcggccctagaggaaagagcaagctaccggtgttgccagatccacgattgatatgtcgctacatgtgcagctgcagagaaatcccaggggtgattagtaccccagtgccccactccgctggccctcaggtgactagattccactcaccctctcccccgcacatcagcgagctgtcccagaccctgcacgcaccgtttcaggggagttggcctcgtccctgccatgctttgtctggcccaagagcgatggttcccaaccagctgcaccctggtactccctgtcctgcacatgtccctcattcctgtaccatgcccgccggcacctgcccactgttcaccggtgcgccggctgcagctgaggccgggctgaatcctggtcccgccttgagggcccctacctcttgtagcagtagcacttggccaaaaccctttatgacggtgtgcctgctccccacgagttctatgctgacttccccaggaacaggcggatgtatcagggcgaggatactcgagcccgcatag

SEQ ID NO: 52172 - DNA, 453 bp, Artificial Sequence
  Description of Artificial Sequence: Synthetic coding sequence
atggccgtgaccttccagatgctggccgtgcagcagagcaccagccacgcaattcagtcttggcacagtctgcgcccttcttgccaaagacgtccggactccagctgtaccagactctcagggatgacaagcgcagcaacccgcacttccgagaccgctatggacgcaactcgtttgtgggggactagatggaaagtgcggacgagacgcatggtggcaagcacaagtcgtttccaagcaaatgtcgcagcgacacggaaaccctctaaagctgctggctgtagtctgaattctgtactaggtaagcccgtgctcggcgagcccgctttttgggacctgccgagcgtccctgtcgcccccgctacaccctcagaggcagccgctccagaatctgagtgctggagagcccaccgtgacctaccatacccatccggggatttggccctgcagtag

SEQ ID NO: 52173 - DNA, 528 bp, Artificial Sequence
  Description of Artificial Sequence: Synthetic coding sequence
atgacccggcccctgcccgagagcatccggctgctgcggcacaccgggctggtccctccaacacctgtgcccctcggatatcctcaccagagttttgtttctcagccacacccattctccaaacaaccgtcaccctgtccccgccagtccccccagggagactttggctgggtgagtcctggagcctcccgatccattacaggcccatcaagtcctgccgcacccagtctgatatcactcggctccctgggtagccatttgcagggtgctaggcctcatccacgccagtcaagcctgggagatttcggactggttacaccaggcacaccatgttgcaggctctgtccaccactgttgctcccgcaaggacggcccccctgggtactatgcgcaggcgtctctaaggaattgggccccaatcctgtcctcccatccccaattgtagaacagagactgggtcacggcgctgacatggtacccccacccgaccaggaggagtggaacgtcgtgatgagccagtcaacatag

SEQ ID NO: 52174 - DNA, 528 bp, Artificial Sequence
  Description of Artificial Sequence: Synthetic coding sequence
atgacccggcccctgcccgagagcatccggctgctgcggcacaccgggcttgtcccccctactccagtgcctcttggctatccccaccagagtttcgtctcccagccccaccccttttcaaaacagccttccccctgtccccgtcagtccccgcaaggcgatttcgggtgggtgagccctggagcttctcgaagtatcaccggaccatcatctccagccgctccatcactgatctccctgggatctctgggctcgcacttacaaggagctagaccccacccccgccaatcctctctaggagacttcggactagttacccctgggactccttgctgccgactttgcccaccactgttgcttccacagggcagacctccctgggtgctctgcgctggcgtgtccaaggaactcggcccgaatccagttctgccctccccaatcgtcgagcagagattgggccatggcgccgacatggtaccaccccctgaccaggaagagtggaatgtggtgatgtctcagagtacatag

SEQ ID NO: 52175 - DNA, 591 bp, Artificial Sequence
  Description of Artificial Sequence: Synthetic coding sequence
atggccgccgccagcgtgccccccgagagcagcatcatccaccccgccagcagcgctatcaagcgcacagacggcgggagactcgaattagagatacgcatcggtatattcgcacagttttggtctgcctgcctcctgtttccacggtgctcacaaccccgtcagcctaggtcatggggaccgagggtaaatgcgtttgccctgtggcctgcaacccgacgccccgcccacactggcagaagggtgacccctgcccgcgcttgttcgcatacatcaggaacgggggcgggtcggaaacgtaagggcggcgaaacatcatttcagagggagtggtcagagaatagaagagaaaaaggacagggaaagattcggagtcctgcgccagagcctgctggcggagaggcaagttcatcccccgctcccgaggaacgaggacccagccactgtagccaggcaaacgtgagccctgcttcctgtaccctgcccggaaaaacccgcatccactccctctgccgggagggtaacgctggacgtacaccctcccaacctcctctgagtggatacaagactccaaacaagagaaatctgtag

SEQ ID NO: 52176 - DNA, 423 bp, Artificial Sequence
  Description of Artificial Sequence: Synthetic coding sequence
atgggcctggaggccaagaacagcccctgctgccaccagcacggcgattttgttccttaccccattctttctgcccgggtttttcagcccgaggtcgaggaagctaccctcgctgctcacgcaataagccatgactgcgtttgttccggaggaggagtcctgctaccacacgactggaggaataattatatgatcttgctgaacccccaagtattggcagatgaacgcggccaccaacgtcctgtcgcctttctggcttacaaggtgaacggtcagtatatcatggagggcttcgcctcatccttcctgtttaccatgggaggattgggctttatcatgctggaccagagtaacgccccaaacattcctaagctgaataggttcttctttttctacagcctcgacagtagcgtgtcatactag

SEQ ID NO: 52177 - DNA, 462 bp, Artificial Sequence
  Description of Artificial Sequence: Synthetic coding sequence
atgcacctgaagaacccccccaaccccccccacctgccccccgtggagtcggcccgcaataaaacaattctacttcagcagttatctgcattgccagatagtcccctgtggggactggggatgacgagggtgttcttggctgacctgaccgaggcttctctggccctctgctcgctgatctccctaaagtgcttgccaggagactctggaaagagtggaaaagtctccctggggttggccggatgcagcggcatacagacatccgtggctccatcttcgcagcaacagaagacggcatcatgtgggaccggtggaagatgctgcgggccgcacccagccagcccgagaaagggagctgggagtcatagcactgcacgagcttggcctagcaagggcgaagcacagcttttcagtcccccagcatctgcaggatgctccggaactcagcctggggttacatag

SEQ ID NO: 52178 - DNA, 549 bp, Artificial Sequence
  Description of Artificial Sequence: Synthetic coding sequence
atggccgtgaccggcgtgcagtgcagcgagcggtgcaagcagaccaggcgggttgattcatcttccggcaaatggttggccaccccgctaatttgggaaaagctgaattggcccagccgatcccaatcacagaacctccacccatttaggatcctgccaaatggtctgacacttcctggagcccaggaaaggcccgggtacctgctggctgctcttcccaatccttgcgccccgcgcccctaccaggtgcactgggtgcatgtggcggtcctgatagctgtcctccttcagcaattgccacagagccgctgtcttaggctcccactgcctgggggcggcggcggtcagcgcgccttgcaggggaggctcaagacacaagcgggtaaacggggtgtaagaaaaaggggagggtggcgtgaacgtgagcggccttccgccgaccctggcgagaggggtctgagagttggggcccaagtacaaaaccccagagctccccgaaaaatcttcgccattcccgcgaccagcaaggtgcagctgcggccgatgtag

SEQ ID NO: 52179 - DNA, 435 bp, Artificial Sequence
  Description of Artificial Sequence: Synthetic coding sequence
atggccgacggcggcggcggcggcagcggcggcgccggccccgcctctacacgggcgtcaagaggattgtttgactctttcaggagagattgcaaggcagacgtggataccaagcctgcatatcaaaacctgtcacagaaggccgacaatttcgtctcgacgcacctggataagcaggagtggaatcctcccgccaatgataaccagttgcacgacgggctccgacagtcagttgtgcagagcggacgttcggaagcgggggtggaccgaattagctcccaggtggtcgaccccaagctcaaccacattttccggccccaaattgaacagatcatccacgagttcttggtagcgcaaaaagaggcagcagtcccagccctccccccagagccagaaggacaggacccaccagcaccaagccaggatacaagttag

SEQ ID NO: 52180 - DNA, 861 bp, Artificial Sequence
  Description of Artificial Sequence: Synthetic coding sequence
cagcggtgctgccggtgctgctgccggtgcccctgctgcggccagggtccccgttccggatgtaaaatccctgctggagatgctagagtgcgggacggcgccggcggctcagtccacctctgcgcattatttgggctgctgccccgcgtctggctggagaggttctatccgtgcctgtggcctttggtgcctggcaggggccagtgccggccaggggactccgctactaataattctactcaaaaagttcagaaggaaactcagggccgttttcacctgctgggagatcccagtcgcaacaactgctcattgtcaatacgcgatgcgcgcagacgcgacaatgggtcttatttcttttgggttgctagagggaggactaaatttagttataagtatagccctctgagcgtgtacgtgacagctctgacccaccggccagatatcttgatcccggaatttttgaaatccggccatccctcaaacctaacctgttctgtcccctgggtctgcgagcagggcaccccaccaatcttcagctggatgagtgctgcgccaacaagcctgggaccccggacccttcactcatccgtgctgacaatcatccctagacctcaagatcacggcactaacctgatctgccaggtgaccttccctggcgccggggttaccaccgagcgcactatacagctgtcagtttcatggaaatcgggcacggtggaggaggtggtggtgttggcagtaggggtcgttgctgtaaagatcctgctgctgtgtctgtgtttgatcattctgtccttccacaaaaagaaggcggtcagggcagttgaggtcgaggaaaatgtctatgctgtaatggggtag

SEQ ID NO: 52181 - DNA, 834 bp, Artificial Sequence
  Description of Artificial Sequence: Synthetic coding sequence
atgcccgagagcgtgaccgtgcaggagggcctgtgcatcttcgtgcattgctcagttttttatcttgagtatggatggaaagatagcacccccgcctacgggcactggttccgggagggtgtgagtgtggatcaggaaacaccagtggcaactaacaattcaacccagaaggtgcagaaggagacccagggaaggttccacctactcggagatccctccaggaataattgctccctgagcattcgggatgctagaaggcgtgacaacggaagttatttcttctgggtggcgcgcggccgtacgaagttctcatacaaatactcgcccctgtcggtgtatgttactgcactgacccataggcctgacattctaatccccgaattcctgaaatcagggcacccaagcaatctgacctgtagcgtgccttgggtctgcgagcagggtaccccgcctatttttagctggatgagcgctgcccccacctcactgggaccccgaacactacattcgagtgtgctgacaataattccacggccacaagaccatggcacgaacttgatttgtcaggtaacctttcctggcgcaggcgtgaccaccgagcgtactatccagctttccgtctcctaccccctgatgaatcccgttatagaggcaagcctggaggacggcacaggcaaatccggtacagttgaggaggttgtcgttcttgctgtgggtgtggtggcggttaagattttgctcctgtgcctgtgtctcattattttatcctttcacaagaagaaagcggtgagagctgtcgaagtagaggagaatgtgtatgcggtgatgggttag

SEQ ID NO: 52182 - DNA, 543 bp, Artificial Sequence
  Description of Artificial Sequence: Synthetic coding sequence
atggccgagagcctgcccctggagatgctgacctacatcctgagctttctgcctctctcagaccagaaagaagcctccttagtcagttgggcctggtaccgggccgcacagaatgcactccgtgagagcctcggtctgagaggcatttgctgtatctctcttacgaacctggacgggagtctggcgtcccatcaggtcttgcaatccgttgcctatcatctgggcccccatctccaatcgctgtctctaggggggggttccccaaccgaagccagctccgtcgccctgatcctgggctgccccgctctgtgcgtcctcgacctgtccggatgcaactccctgttcactagcggcaccctattggcacagccagagatggcccagtcagttcagcaagcactcagtggtctccgagagctgaatctggccggcctgcgcgacctggccgatctgagcttcaatcagttatcttcctgtgctccgtccctggagcggctgtccttggcctactgccacctgacattcgagctaggccctgcatag

SEQ ID NO: 52183 - DNA, 702 bp, Artificial Sequence
  Description of Artificial Sequence: Synthetic coding sequence
atgcggctgctgcccctgctgcggaccgtgctgtgggccgccttcctaggctcccctctgagaggaggctcgagccttcggcacgtggtctattggaacagcagtaatccaagtttgcggagggagggctatacagtgcaagtgaacgtgaatgattacttggatatttactgcccccactacaacagctcaggtgtcgggcctggcgctggtcctggcccagggggcggcgccgaacagtatgtactgtatatggtgtctaggaatggttaccgtacctgcaatgctagtcagggcttcaaaagatgggaatgtaatcgtcctcatgcgccccattctcctatcaagttctcagaaaaatttcagaggtattcagcgttcagcctgggctatgagttccatgcagggcacgaatattactatatctccacacccacccacaatctgcattggaagtgtctgaggatgaaggtgttcgtttgttgcgcttctacaagtcattctggcgagaagcctgtccctactttaccacagttcactatgggaccaaacgtgaagattaatgtgctcgaggattttgagggagaaaaccctcaggtacctaaactcgaaaagagcatttccgggaccagcccaaagagagagcacctgcctctggctgtaggaatcgcttttttcctcatgacattcctggccagttag

SEQ ID NO: 52184 - DNA, 495 bp, Artificial Sequence
  Description of Artificial Sequence: Synthetic coding sequence
atggaggacgagcggatcctggacaacctgggcgccgagggccggcacggtagcgagtgggaatggaggcgatggcactttggtggatgggtggaagaagagcaccggcacaggtggccacggggagtctggtctactgacaaatccccgggaggcgtgcagccccagtgtctcagccaggaggtgtcagcgctcgttagcggtacccagtcctccctcagaaacgggctgggggataaatggtctgcatgttgcactcgggccctagggcagatggagcagaccaagcagtcaaaacgaagagccgggagagaagatcgcttcagtgtcgctctaggacgttgccggggtaatgagcacaagaccctctcgcatgttcctggagcctcagacgccgcccaaaaaccaagagccaagccctgcagtaggggaataggggcgagtgtactgctccaaacaatgcacctgtcttttattacactggggttcagatag

SEQ ID NO: 52185 - DNA, 1323 bp, Artificial Sequence
  Description of Artificial Sequence: Synthetic coding sequence
atgagcatgctggccgagcggcggcggaagcagaagtgggccgtggaccctcagaacaccgcatggtcaaatgacgacagcaagtttggtcaacggatgctggaaaagatgggttggagtaaaggtaaggggcttggcgcccaggaacaaggagcaaccgaccacattaaggtgcaggtaaaaaacaaccacctgggtttaggcgccaccattaacaacgaagacaactggatcgcgcaccaggacgacttcaatcagttactggccgaactgaatacttgccatggccaggagaccactgattcatctgataaaaaagaaaagaagtccttttctctcgaagagaagagtaaaattagtaagaatagggtacactatatgaagttcaccaaaggtaaaagctggaaggctctgacgctctctcagaagaggccgtatgttgatgaggccgaacggcttagactgcagcatatgcaggactaccctaattataaatataggccaaggcggaaaaagcaagcaaaacggctgtgcaagcgtgtcgatccgggcttccttctgtcatctctctccagggatcagaatgcattgcctgagaagagatccggcagccgtggtgccctcggcgaaaaggaagatcggggcgagtacagcccaggcacagcgctgcccagcctcagagggtgttaccatgagggccctgcaggcgggggcggtggggggacaccctcctccgtggatacatatccatatggcttacccacgcctcccgagatgagtcctctcgatgttctggaaccagaacaaactttcttcagctctccatgccaagaagagcacggccatcccagacggatccctcacctcccaggccacccctactcacctgagtatgctccctcaccattgcattgtagtcatcccttggggagcctggccctcgggcaatcaccaggggtttcaatgatgtctcccgtgccaggctgtcccccttctcctgcatactacagtccagccacataccatcctctccactccaatctccaagcgcatcttggccagcttagcccaccccctgaacaccctggctttgacgccctggaccaattatcccaagtggagctcttaggtgatatggatcggaacgagttcgaccagtaccttaacactccaggccaccccgattccgctactggggccatggccctctcgggacacgtcccagtgtcacaggtgactcctacaggtccaaccgagactagcttaatctcagtcctggcagatgcaactgccacgtattacaacagttattctgtgagttag

SEQ ID NO: 52186 - DNA, 888 bp, Artificial Sequence
  Description of Artificial Sequence: Synthetic coding sequence
atgctgcccgacttcaagctgtactacaaggccaccgtgaccaagactgcctggtaccggtaccagaacagagatatagaccagtggaatcggaccgagcccagcgaaattacccctcacatttataattatcttattttcgacaaacccgagaagaataagcagtggggcaaagatagtttgtttaacaagtggtgctgggaaaattggctcgcaatctgtcggaagctgaaactggaccctttcctgaccccctacacaaaaatcaattcaaggtggattaagtacttgaatgtgcgacctaaaaccatcaaaaccgtcgaagagaacctcgggattaccattcaggatatcggcatgggcaaggattttatgtctaagactccaaaggccatggccacaaaagcgaagatagataaatgggacctgatcaagctgaaaagtttctgtacagccaaggagaccaccatccgggtcaaccgacagcccactaaatgggagaagatcttcgcgacgtatagttctgataagggtctcatctcgcgcatttacaatgaattcaaacagatctacaaaaagaaaactaacaatcctataaagaaatgggctaaggatatgaataggcatttctccaaagaggatatctacgccgctaagaagcatatgaagaagtgcagtccgagtctcgccatcagggaaatgcagatcaaaactaccatgaggtaccaccttacacctgtaaggatggcggtgataaaaaaaagtgggaacaacagatgttggagaggatgcggtgaaatcggaacactgctgcactgctggtgggactgcaagctcgtccagcctctgtggaagtcagtgtggcgctttctgcgcgacttagaatag

SEQ ID NO: 52187 - DNA, 372 bp, Artificial Sequence
  Description of Artificial Sequence: Synthetic coding sequence
atgcagagcgagaagccccagggcctgttcctgcagctgaaccccaacgctagttctacagaaacccagctcctggtgccggcgctggaatcgagggacacccttcccccaactcactgtttcatggcaggtaccgagtctccactcggaaacccctggcccctgtccctacccccaccttgttggaccggttgcctgctcccagcaccaaggggacaaaggaaacccggccccctcggactctcaatttttatcagcctgggcaacaagcgtcatcggtccggaaatcatgtggtgcgcgagtcagagcaaccgctttctcagggaaatccccaccaggggtggggacccgatacccgtaaggggagatag

SEQ ID NO: 52188 - DNA, 372 bp, Artificial Sequence
  Description of Artificial Sequence: Synthetic coding sequence
atgcagagcgagaagccccagggcctgttcctgcagctgaaccccaacgcctccagtaccgaaactcaattgctcgtacctgctctggagtctagagatacactgcctcctacacactgtttcatggccgggactgaatcgcccctcggtaacccatggcccctctcacttccccctccctgctggaccgggtgccttctaccagccccccgaggtcagcggaaacctggccccctgggtctgagcattttcatttccctggggaacaagcggcatcgaagtggcaaccacgtggtgagggagtcagaacagccacttagccagggcaatcctcaccagggttgggggcccgacactaggaaggggcgttag

SEQ ID NO: 52189 - DNA, 855 bp, Artificial Sequence
  Description of Artificial Sequence: Synthetic coding sequence
atgctgagcgtggtggagaacggcctggacccccaggccgccatcccagtcataaaaaaaaaactggttggaagcgttaaggctttgcagaagcaatatgtgtcactcgatatggtggtaacctccgaagacggcgatgccaacacaatgtgtagcgcactggaggctgtttttattcacggactccacacgaagcacattcgcgctgaagccggcggaaagagaaagaagagcgcacaccagaaaccactgccccagcccgtattctggccgttgttaaaggcggtgacccccaaacatataatctcagagttagagcatctgacattcgtcaacatggacgttgggaggtgccgggcttggttgcgcctggccctcaacaacggactgatggagtgctacctgaaacttctgctgcaagaacaggcccggttacagctgcagaggaaagaaagtttggatagcattagccatagcagtggtagcgaggatatcgaggtgcaccacagtgggcacaagattaggagaaaccaaaaacctactgcgagtagtctgagtctggacaccgcgagctctagccagcttagctgttccttaaactctgattcatgcctactccaggagaacggaagcaaaagccctgaccattgcgaagagccaatgtcctacgattccgacttggggacagccaacgccgaagactctgaccagagtcttcaggatatcaagatttttagctgggctcagtggttgactccagtgatacccgccctgtgggaggcagaagccggcggctctcagtcccaggagattgagactttcctggctaataccgtaaaaccgcacctgtattag

SEQ ID NO: 52190 - DNA, 516 bp, Artificial Sequence
  Description of Artificial Sequence: Synthetic coding sequence
atggactggaccccccggctgcccagccggcacatcatcagcgagctcgaacatctcaccttcgtgaatatggacgtcggacggtgcagggcctggctgcggctcgccttgaataatgggcttatggagtgttatttgaagttgctgctgcaagaacaggccaggctacagctgcagagaaaggaatccctcgacagcatctctcacagttctgggtccgaggatatagaggtccaccactccggccacaaaatacgcaggaatcagaagccaacagcatcgtccctgagtttagataccgccagctcatctcaattgagctgttcattaaattccgactcttgtctgctgcaggaaaatggtagcaagtctccggatcactgcgaggaacccatgtcttacgactctgaccttgggacagcaaatgcagaggatagcgatcagagtctccaagagaagacgagggccggatcgcagaggatgacctccacaggtctgcccggatccaatccctag

SEQ ID NO: 52191 - DNA, 576 bp, Artificial Sequence
  Description of Artificial Sequence: Synthetic coding sequence
atgcccgccgccatcgcccccaaggacgacctgagcatccggttcctcaagccatggctaggcgaaggcatcctactctcagggggcgacaaatggtctagacaccgccgtatgctcacgccagctttccactttaacattttgaaaccctacattaaaattttcaacagatcagtgaacattatgcatgacaaatggcagcacttagcctccgaaggctcgagccgcttggatatgtttgagcacattagcctaatgacactagattctttgcaaaagtgtatcttctccttcgactcacactgtcaggagcgccccagcgaatatatcgcaacaatcctagagctgtctgccctggttgagaagcgcaatcagcacatcctgcagcatatggattttctctactatctgtcccacgatggctggagattccgccgggcctgtagactcgttcatgattttaccgatgcggtgatccaagagcgccggcacaccctgcccacccagggcatcgtgatttcatccagaacgaaaccatctccaaggttgtggatctccctcatgtgcttttgctag

SEQ ID NO: 52192 - DNA, 4098 bp, Artificial Sequence
  Description of Artificial Sequence: Synthetic coding sequence
atgagcagcggccggcggcggggcagcgccccctggcacagcttctctagattctttgccccgcgctccccgtcaagagataaagaggaggaagaagaagaacgccccggaacgtcaccaccccccgccccgggccgttccgcagcctctgtggagaacgaacccatgagcacctcccagaagaaagaaaatgtgcttagctccgaagcggtgaaaattcgccagtccgaggacaagcggaatcacgccgagaagccagtcactctcccagttcaggaagaccccaaaaaggcctacgatctatcatccagcacttcagacactaaaatcggggaaagtgatcgacagccaaaagagagttttttccagttcttgggaaatctatttaatatatcaggcaagtcctccctgggagaagcaaagcagagcagctttaaagacgaccaggataagaccgagaaagatctgcaaaaccccagtgaccaccacgaggatggaatcaaacgagaacgagagatctttagcgggtcactaagaacacagacccaccccaccgaggagcaagattctaacagcagcgaactgagtgatgcgttttcgcttgatacaacacaggattcagaccaggagaccaccaaccttctcaaacaaattgacgggaagcctgagaagcccagtgtgacatacgcaacatacagaggtcctagacatattggcaaatacctgaagcagcagacaggcctcgccacagtgaacacgctggaccgggaaaacgaatcaagtgactcatccactaataggcatatcgaccccgggtctgaaattgaggccggggtcttaccactcttgttgtcggcatcaaccgactctagcatgaagggtaacctgttagaagggcctcttgaggactctgattgttccaaaacatcctttaataaagagaactcattaacaaataaccccgagctgcagaacattgcctcaagtaataatcttttgaacaagaacgcatgggggtctattgagcggaacaggagctcgccctcctctgtaaccaattccagctatgacggcgagtccgactcacagcaccacttgtcatgtgagcctgtctctcagacgaacaggaacctggtttgcagtgctctccttacggggagcaaccatagaaaggtcccgtgtagtccagatttccaacgggtaacaaccaccgagaataccatcaaagaaaatagtaccgtgatgtcgaatcggacactggtgcagagggaagagctagtggaacctcagggtcccgcaattagcgacttttcctgttcaaagagcgatgggtctgacactactgaacaggaatccacgaatctgccctctccaaacaagtctattcgccacgagcacctgcagctcccagaatccgagtgcagcgataagcaaacgatagatagtagttcaaagcaagccgccacccacaccaatatcatagccctgcaacggcatgcagttaccgacacggagtttgtgaacgaggggaagagactgtcagcacaggactcacaaaagaacgtggcggtccgagagatcagaagggagaccgaatccgcctcagccggggagagcatcgcatcctcacacgtgaaagcccccgaagacaaaatcgagagtctacctaaagataccgaccagtattttgagaccaaagccaagaagcttgacttccgctcacacgacaagattcctcatatccgaatgaacaaaaaagatctggccagcctgaactacatatccgagtctgcagtggtggcaagcctgggcaacgagaatgctcccgagctgaagttcgagcttaatagatcccatatcagtgagactcccctggactcggagtcgccacagcaggctgaagtgagccctgacgctaaaacaagccttagtctggactgcaaaaagctcaactttagcatctccccaccgacattcgttagtggtgtcggaatgttatctaagctcgacatcccagaccttatgaacgaaggctctcctgtgcctattgagacgggaaatgtaaacatcgtcggtatctcttatcagccccggaagtgcaaggaagaaaacgtgaagaaccatgtggaagcagccggacgtaagagcccgccacctagtttttgtcttgagtacacctcggccatcttcgagttcaaggaagttcttagtaacagcgagaagtgccaggtactgcccggttccgaagcgagcggtcctcacctcactggcttagagctcctttcttttgacagcgggaatctgtctaaagactgctctagcattctgagccaagaccctaacagggtggaactggtctcatccaacaccaaagctaatatgtccatcatagaaaaaagcgacagcctctccctggaagctaaaactgcaaatatagtgtccaaggctgagattgacgggcagaacaacgtgctagtggaaagccactccggccgtggaaaaacaatcagtcttagtaaggttagcctgtcaaaagttgagccccgaaatataagccaggacaaaatgtcctcattcccactgaaaatcactcacgtgccagagaaaccaatcctgagtgagctgaccttcctggaggtcgaacagggaaaaaggttccaaagtatcaatcataacgagataggtgagaaatgcagtgatgccggcctgaaagagaattgtcaggcggagctctctcctgcagcctccaagtatgaagacaaacccgagccagaggtcgacgctctgggctccccgcctgctctgctgaagtcaaacatctcctggatcctgccccctatccacgacgaaaaaatatcgaggcagatggctcagaattgcgaggctcacacctgcgttttccaccagagtctggacatttgcggaactaagaaaatatctgggcactctgaaatggcggaattatctcttacaaatataagcccaaagttccaggagacaggtagtatgaaggtgaactcccctttcctggactccgactcctcattggaaaaaaatagctccgcctcagaggattcctcgtttttgaaggtacctagcgtgttgaaactcgaaaagaagagcagttcctatagaaagaaggagaacatccacttcttgaatgggggcatagacagtgtgagcagcagctcaagctatccagaagaagtgagcatgatcgttaactctcataaaccccagaacaatctcgattccatccaggttactaaagacttgacacatgagggcactagtgtgaccaatctgttgtatcccactacatcttacctcgagttcgaaacctcagtctctatcggcactgaggtaaccccgtttcaggaacactttggtatctacacaggcaagatctccatagacttcccaacagccgcccaatttgataacctggtagaagctgaaactggagccgtcgcaggcccagctgcaagcgttaatagctccgggcaacagtgcagcgaggcttcagccgagcacattgaagcgaggagacgcgcgcacgaccaacttctggaccttaagtcctccctgctaaagaaggcagacacgctaatcggcgaaatctttaatagtgtacgcgaagaacttaagttcaagcacactgtgagtacttgtcaagaacatattgccatagaaggtatcatgaatctcggcacattaaaggaggacatctcagaaaaaaatccttctgaggtaacattgaccgagatccagcaaaccgaggggcttgaggaacagggaatggagaacatgagcgaagtgaaagaaaagccctgtgtttcccccaccgtgggcgagaaaaacttgctggtagatcctaactccatgaatgtgtcatgtctgctggaagataaggccagagaattggtgaatgaaataatatatgttgcccaggaaaagctccgcaatgatacgttcgaagataccgaagatacctgggactccgaacttcaggccaatacctccaagatcctcaatagcgactccgttaagccacatgatgtcgtgagggagtttctggtgagtgagcaacccgtctag

SEQ ID NO: 52193 - DNA, 372 bp, Artificial Sequence
  Description of Artificial Sequence: Synthetic coding sequence
atggccacccaccggagcaccctggccggctacagcccctgcagctcaccacaaagggcagcccctactcggaaccagaaggccgagaaagctagaaacaggcaagcgtctcccatcccgacccgtttaccacggaacccaagcctcgcttcaactgggcggcaaggcacccctatgtcaaggaaaaaacaggggtccgattgcctagtataccctggtcatcctcccggcctctggcctgttatcagttgtcacctgggactctctgcactctcgtccgaaatctggaccagcaattgcctctgtctggctgccctgccgtgcgacacgggactggagtcgctgactgttgtttgctggagcggtatctag

SEQ ID NO: 52194 - DNA, 375 bp, Artificial Sequence
  Description of Artificial Sequence: Synthetic coding sequence
atggtgcgggccacccggggctactgggaggccaagggcaagtggcagacatggttgcgctttcgcaagaagagctcgaagtgtagggaggctcgcacttttccttcattcaaattcctcaaagggtctcagagctccttcagcagcctattacagatgcctcttcagagtttcacagcagctcatacctatagacggagaaatagtccaagccagaaagatgatcgcgcactgggggctggcgtgcccctagtactggccgagagtttagacgcatgtgaggtcaagcccgatctgggtaaagcagccctttggactctgttagcagtcccccatacccagctgggatttttacgaaaacagcacaggctgtag

SEQ ID NO: 52195 - DNA, 402 bp, Artificial Sequence
  Description of Artificial Sequence: Synthetic coding sequence
atgggctggcccctgagcctgagccccagcggcttccgggaggtggaatggggtattctgttcgtatggcagtggctcctatcctcctggcacttgtctccattcccggtgcccacttcaccctcaaccccctgcctgcctttcttgtgccacccccttcctgtactccacgggaattgtactgggctgtcagtgtttgcctgcatgtgtgcaccagtatacacatgcatcgagcgctatatttgcggtggtcggggcgagagaggaggggggggggtcaagttacgtgcgtgctcacaggataccgctcactggtctctttcgtccgcccccagtgttctggtgcgcctcagagaggagggtggccgggccctcgttaagcccgactgtccttctttgtag

SEQ ID NO: 52196 - DNA, 534 bp, Artificial Sequence
  Description of Artificial Sequence: Synthetic coding sequence
atgaccaccagcatccggcagttcaccagcagcagcagcatcaagggatcttccgggctgggagggggaagctcaaggaccagctgtcagttgtcggggggcctgggggccggcagctgccgccctggatccgcaggagggctggggagcgcactcggcgggagttcttactccagctgctactctttcgggtccggcggcggatacgggtcatcttcgttcgaaggagtcgacggcctccttgtgggtggggagaaagcaaccatgcaaaacctgaacgatagattggcctcttatctggacaaggtgcgagcgctggaggaagctgataccgagctagaagtcaagattagggactggtatcagcgtcaggccccagggcccgccagagactactcacagtattaccgcattattgaggagctccagaacaagccaccctggacaatgccaacttcctgctataggatgactatgcccatctggttgctcctgacatctgcacccaaatcctggcagaatgaggggagatag

SEQ ID NO: 52197 - DNA, 981 bp, Artificial Sequence
  Description of Artificial Sequence: Synthetic coding sequence
atgccccacctgcccctggccagcttccggccccccttctggggcctgcgtcacagccggggtcttccccgtttccatagtgtatcaactcagagcgagccacacggctctccgatctcgagaagaaatcgcgaagctaagcagaagcggctgagagagaaacaggccacattggaagccgagatcgccggggaatccaagagccccgccgaaagcatcaaagcatggaggcccaaggaattagtgctctacgagatccccactaagcccggagagaaaaaggacgttagcggccccttgcctccagcttattctccccggtacgtcgaagccgcatggtacccctggtgggttcgagaggggttcttcaagcccgaataccaggctcgcctgcctcaggcaacgggagagaccttctccatgtgtatcccaccaccgaacgtgacaggatccctccatattgggcacgctctcacagttgccattcaggatgctttagtgcgctggcataggatgcgcggagaccaggtgctatgggtacccggctccgatcacgccgggatagccacccaggccgtagttgagaaacaactgtggaaagagagaggcgtgcgacgtcacgagctctccagggaggcatttttaagagaagtctggcagtggaaggaggcaaagggaggagaaatttgcgaacaactccgggctttaggggcctcattggattgggacagagagtgctttacaatggatgtggggagctccgtggctgtgaccgaggcattcgtccgcctgtataaggcagggcttttataccggaaccatcagttagtcaattggtcttgtgctctccgtagcgcgatcagtgacatcgaggtagagaaccgtccactgcccggccatacacagctgcggcttcccggttgccccacacctgtctcgttcgggctcctcttttccgttgcttttcctgtggacggttag

SEQ ID NO: 52198 - DNA, 3192 bp, Artificial Sequence
  Description of Artificial Sequence: Synthetic coding sequence
atgccccacctgcccctggccagcttccggccccccttctggggcctgaggcacagcaggggcctaccccgctttcatagcgtgtctacccagtctgaaccgcacggcagccccatctcaaggcgaaatagggaggccaagcagaaacggctcagagagaaacaagcaactctcgaggctgaaattgcaggtgagtccaagtcccccgcggaatctattaaagcctggcggcccaaggagctcgtgctgtacgagatccctacaaagccgggggagaagaaagacgtgtccggtcctctcccccctgcttactccccacgctatgtcgaggctgcctggtacccctggtgggtcagggagggctttttcaagccagagtaccaggcccggttaccccaggccactggagagaccttttccatgtgcattccgcctccgaacgtgactggctcccttcacataggccacgccctgacggtggctattcaggatgcgcttgtcaggtggcatcgcatgcgtggggaccaggtgctgtgggtcccagggtccgaccacgctggcattgctactcaggcggtggtcgagaaacaactgtggaaggaacgcggtgtccgtaggcatgagctgagcagagaggccttcctcagagaggtttggcagtggaaggaggctaagggtggcgaaatctgcgaacagcttcgagcgctgggtgcatctctggactgggatcgtgagtgtttcaccatggacgtgggaagctccgttgctgtgaccgaggcctttgttagactttataaggccgggctattgtatagaaaccaccagctcgtaaactggtcctgtgccttaagatctgctataagcgacattgaggtggagaatcgacccctacctggccatacccagctgcggcttccgggttgtccaactcctgtcagctttgggctgctgttctcggtggccttcccagtggatggggaacccgatgccgaagtggtggttggaacaacgagacccgaaacgctgccaggggacgtggctgtcgcagtccatccagatgattcgagatacactcatctgcatgggaggcagctgagacaccccttgatgggccaaccgctacctctgataactgactatgctgtgcagccccacgttggcaccggggcagtaaaggttactcccgcacactctcctgctgacgcagagatgggagcgcgccacggtctgagccccctaaacgtgatcgccgaggatgggactatgacatcactctgtggtgattggctccagggactccatcgtttcgtcgcgcgggagaaaatcatgtctgttttatctgagcgcggactctttagagggctgcaaaaccatcccatggtgctgcccatctgttccaggtctggggatgtaattgaatacctattaaaaaaccagtggttcgtgaggtgtcaggagatgggagctagggccgcaaaagcagtagagtcgggcgccctggaattgagtccttcattccaccagaagaattggcagcactggttttcccatatcggcgactggtgcgtctcgcgccagctctggtggggccatcagataccggcatacctggtggttgaagaccacgcccaaggtgaagaggattgctgggtggtgggaagaagcgaggcggaggcacgggaggttgctgctgagttgaccggtcggcccggcgccgaactgacgttggaacgagatccagacgtgctggatacatggttttcaagcgctctgttccctttttccgcactgggctggccccaggagactcccgacctggcccgcttctaccccttatcactgttggagactggttctgatttattgctcttctgggtggggcgtatggtgatgcttggcactcagctcaccggtcagctccctttttccaaagtattacttcatcctatggttcgcgatcggcaagggcgcaagatgtcgaaatcacttgggaacgtcctggatccaagagacatcatttctggagttgaaatgcaggtgctacaggaaaagttgagatctgggaacctagatccggccgaattggctattgtggctgcagcccagaagaaggactttccccacggcatcccagaatgtggcaccgatgccctgagattcactttgtgctcccatggggtgcaagctggggatttacacttgtccgttagcgaagtacagtcatgccggcacttctgcaacaagatttggaacgctttgcgttttattctcaacgctctgggggagaagttcgttccccagccagcagaagagctctcgcccagctcccctatggacgcctggatcctatcccgcctggcgctcgccgcccaggagtgcgaaaggggattcctcacaagggaactcagcttggtcactcacgccttacaccatttctggctgcacaacctctgcgacgtttacctggaagcagtgaaaccagtgctgtggcattcacctaggccactcgggccgcctcaggtcctcttcagttgtgccgatttgggcctgagacttctcgctcctctgatgccatttttggctgaggagctgtggcaacgccttccgccaagacccggatgtccacccgctccctcaatttccgtggctccttacccttcagcctgttccttggagcactggcggcagcccgagttagagcgccgtttctcaagggttcaggaggtggttcaggtcttacgggcattacaggccacctaccagctaacaaaagccaggccacgagttttactgcagagctcagaaccaggggaccaaggtctgttcgaagccttcctggaacccttggggaccttagggtactgtggggccgtgggcctgttacccccaggggctgctgcaccttccggttgggctcaggcacccctatccgatacagctcaagtgtatatggaactccagggactggtagacccacagattcagctgcctttgctcgcggcaagacggtacaagctgcaaaaacaactcgattctcttactgctagaaccccatccgagggcgaggctgggacacagagacagcagaaattgagcagtttacagctcgagctaagcaaactcgataaggctgcctcccatctgcgccagcttatggatgaaccccccgccccagggtctccagaattatag

SEQ ID NO: 52199 - DNA, 348 bp, Artificial Sequence
  Description of Artificial Sequence: Synthetic coding sequence
atgccccacctgcccctggccagcttccggccccccttctggggcttgaggcactcacggggactccctcgcttccattctgtcagcacacagagcgaaccacatggaagccccatcagccgccgcaacagagaagctaagcaaaagagactgagggagaagcaggccacactggaagctgaaatagccggagagagtaagagcccagctgagagtatcaaagcttggcgccccaaagagctcgtgttgtacgagatccctaccaagcctggtgagaaaaaggatgtgagcggtccattgccccctgcatatagcccccgctacgtggaggcggcctggtacccctag

SEQ ID NO: 52200 - DNA, 2772 bp, Artificial Sequence
  Description of Artificial Sequence: Synthetic coding sequence
atgtgcatccccccccccaacgtgaccggcagcctgcacatcggccacgcactcaccgttgccatccaggacgcactggtgcggtggcataggatgagaggcgaccaggtactgtgggtgcctggatcagaccatgcaggcatagctacacaggccgtggtggagaagcagctgtggaaggaacggggcgtcaggcgacatgagcttagcagggaggcgtttctccgtgaggtttggcagtggaaagaagcgaaaggcggtgagatttgcgagcaacttcgcgctctgggagcgtctcttgactgggacagggaatgttttaccatggacgtgggctcctctgtggcagtcaccgaggccttcgtgagactgtacaaagccggcctcctatatagaaaccatcagctagtgaattggtcttgtgcattgaggtcagcgatcagcgatatcgaagtggagaatagaccattaccaggccacactcagctgaggcttcccggctgcccgactcccgtatcatttggcctgcttttctcagtcgcctttcctgtggatggagagcctgacgcagaggtcgtggtcggcactacacggccagagactctgcccggggatgtcgccgtcgccgttcatcctgacgatagcagatacacccatctccatggccgtcagttgaggcacccactgatgggccaaccattgccacttatcaccgactatgccgtgcagccacatgttggaacaggggcagtcaaagtgactcccgcacactctcccgctgacgccgaaatgggagcccgacatgggctgagccccctgaacgtcattgccgaggatggcactatgacaagcttgtgtggcgactggctgcagggattgcacaggttcgtcgcaagagaaaaaattatgtcagttttaagtgaacgggggttattccgcgggctgcagaatcatcccatggtgctccctatttgttcacggtccggcgacgtgatcgaatacctgctgaaaaatcaatggttcgtccggtgtcaggaaatgggggcacgtgccgcaaaggctgtggaatcaggagcactggagctttctcctagctttcatcagaagaattggcagcactggttctcccatatcggcgactggtgcgtctcgcggcaactgtggtggggacaccagattccagcatatctggtcgtagaggaccatgcgcaaggtgaagaggattgttgggtggttggccgatccgaagctgaggcacgggaagtggccgccgagttgaccgggaggcccggggcagagcttacactcgaacgggatcccgacgtcctggacacctggttctcatccgctctcttcccgttcagcgccctcggatggccacaggaaacccccgacctggccagattttatcctctttcgctgctcgagaccggtagtgatctattgcttttctgggtcggccgcatggtgatgctgggaacccagttaactgggcaactgccgttctcaaaagttttgctgcaccccatggtccgcgaccgccagggtaggaaaatgagcaaatccctaggcaatgtgctggacccaagagatattatatcgggtgtcgagatgcagctcctacaagagaaactgcggtctggtaatctcgatcccgccgaacttgccatagtggccgctgcccaaaaaaaggactttccgcacggcattcctgagtgcgggactgatgctctgagattcacactgtgcagccatggcgtacaggccggcgatctccacctaagtgtgagcgaagttcagtcctgcaggcatttctgcaataaaatctggaatgctctgaggtttatattgaatgccttgggggaaaaatttgtaccgcaacccgctgaggagctctctcctagctcccctatggacgcctggattctgtcgcgcctagctttggctgcccaggagtgcgagagaggcttcctgactcgtgagctgtcccttgtcacacatgcactgcatcatttttggcttcataatctgtgcgatgtgtatttagaagctgtgaaacccgtgctgtggcattcgccccgtccgctagggccaccacaagttctgttttcttgcgctgacctgggtcttaggctgctcgcaccacttatgcccttcttagcggaagagctgtggcaacgcctgcccccccgaccgggttgccccccggcgccttcaatcagcgtggctccgtatccatcagcctgtagcttggagcattggcgccagcccgaactggaacgccgattttccagggtccaagaagtggtacaggtgctgagagccctgcgcgctacctaccagttgacaaaggcaaggccccgggttttgctgcagagttcggaacctggggatcagggcctttttgaagcgtttctcgagcctctcggtacattgggctattgcggggctgttggactgctaccacctgggactgctgccccctcaggatgggctcaggccccattgtcagatactgcgcaggtctacatggaattacagggcctcgtcgacccccagattcagctccccctgctagccgccaggagatataaattgcagaagcagttggacagtctgaccgcaagaactccatcagaaggggaggcagggacccagaggcagcaaaagctaagtagcctacaactggagctgtcaaaacttgacaaggccgcttcccacctcaggcagctgatggatgagcctccggctccgggaagccctgagctttag

SEQ ID NO: 52201 - DNA, 3282 bp, Artificial Sequence
  Description of Artificial Sequence: Synthetic coding sequence
atgggcggcaaggcctggccccggcgggccgtgggcaccgccggcgggccctgcgccgaacagatcagcgccccttttcagaccctgctaatgccacatctgcctctcgcttcatttaggccccccttctggggcctgcgccacagccggggtctgccgcgcttccactctgtgagcacacaaagcgaaccccacgggtccccaatttcccggagaaacagggaagctaagcaaaagagactgcgagaaaaacaggctacccttgaggctgagatcgcaggtgaatcaaagagccccgccgagagtataaaagcatggcgacctaaagagctggttctgtacgaaatcccgacaaaacctggcgaaaagaaggacgtgagcggaccattgccacccgcatattctcctcgatacgtggaggcggcttggtacccgtggtgggtgcgtgagggtttctttaagccggagtaccaggcacgccttcctcaggctactggcgaaacattttctatgtgtatcccaccgccgaacgtcactggcagcctgcatattggtcacgctttgacggttgccattcaggacgcattagtgcgttggcaccgaatgcgtggcgatcaggtactttgggtaccaggttccgaccatgcaggcatcgccactcaggcagtggtagagaaacagctgtggaaggagcggggagttcgccgacatgagctgtcacgcgaggctttcctgagagaagtatggcagtggaaagaagcgaaaggcggggaaatatgtgaacagctgcgcgccctgggagcttcgctcgactgggacagggaatgtttcaccatggacgttgggtcaagcgttgctgtcactgaagcattcgtccgactgtacaaggcaggtttgctataccgcaaccaccagctcgtcaattggagctgtgctcttcgttccgcgatctccgacattgaggtagagaataggcccctgccgggtcacacccagctcaggctgcctggatgtcccacaccagtatcttttggtctgttgttttccgtggcattcccggtggatggtgaaccagacgccgaggtggtcgtgggtaccaccagaccagaaactctgccaggtgacgtagccgtggccgtgcaccccgatgatagtcggtatacccacctccatggacgccagctgcgccatccgcttatgggccaacccctgccccttatcactgattacgccgtgcagccccatgttggcaccggcgcggtgaaagtgactccagctcactcgccagctgatgctgaaatgggtgctaggcacggcctctccccactgaacgtgatcgcagaggacgggaccatgactagcctgtgtggcgattggctgcaaggtttgcaccgattcgttgcaagggaaaaaatcatgtccgtgttgtctgagagaggtctcttcaggggactccaaaatcaccccatggtgctgcctatctgctcccggagcggtgatgtgatcgaatacctactgaagaatcagtggttcgtgcgctgtcaggaaatgggggcaagggcagccaaagccgtggaatccggagcactggagctgtctccttcgttccaccaaaagaattggcagcactggttctctcatatcggcgattggtgtgtgtctagacagctctggtgggggcatcaaatacctgcctacctggtggtggaggaccatgcacaaggtgaagaagattgctgggttgtagggagatccgaggcagaggcccgcgaggtagccgctgagctaactgggaggcctggcgcagaactgaccctagagagggaccccgacgtgctggatacttggttctcctcggccttattccccttttctgccctggggtggcctcaggaaacccccgacctggcccgcttctatcccctttcacttctcgaaacgggctctgatcttttgcttttttgggttggaaggatggtgatgctcggtacacaactcaccggccagctgcctttttctaaggtgctgctgcatccaatggtgcgggacagacaaggaagaaaaatgtctaaatctctgggcaatgtcttagatcctcgcgatattatatctggcgtcgagatgcaggtcctccaggagaagctgcgcagcgggaatcttgaccccgctgagcttgccatcgtggctgcagcccaaaagaaggacttcccccacggcatacccgagtgtggcacagatgccttgaggttcaccctatgtagtcacggcgtacaggccggcgatcttcatttatctgtcagcgaggtccaatcatgtagacatttctgcaataaaatctggaatgcgctgcggtttatcttgaatgcacttggggaaaagttcgtgccacaacccgcggaggagctctcacctagttcccctatggacgcttggatcttgagccgactcgctctggccgcacaagagtgcgagaggggcttcctgactagggaactgagcctagtgacgcacgccctgcaccatttttggctgcacaacttatgtgatgtgtatctcgaggcagtaaaacccgtgctatggcactccccgaggccacttgggccccctcaggttctgttcagctgtgcagatctagggcttagactgctggcgcctcttatgcccttcttagccgaagaactgtggcaaagacttcccccccgtcccggctgccccccagcaccctccatctctgtggccccatacccttccgcctgcagccttgagcactggcgccagccagagctcgagcgtagattttccagagtgcaggaggtggtccaggtcctgagagctctgcaagccacctaccaacttacaaaggccaggccaagggtcttgctgcaatcttcggagccaggcgaccagggcctgtttgaagcttttctagaaccgctcggcacgctggggtattgtggcgctgtgggcttacttccccccggggctgccgctccttctggttgggcacaggccccactatccgatacagcgcaggtctatatggaattgcaaggtctggttgaccctcagatccaactcccactgctcgccgcacggcgttacaaattgcagaagcagttagactcactcacggccaggacccccagtgagggggaagctggcacacaaaggcagcaaaaactgtcgtcccttcaacttgagctgagcaaactcgataaagctgcaagtcatctgagacagctgatggatgaaccccccgccccgggcagccctgagctgtag

SEQ ID NO: 52202 - DNA, 2772 bp, Artificial Sequence
  Description of Artificial Sequence: Synthetic coding sequence
atgtgcatccccccccccaacgtgaccggcagcctgcacatcggccacgctctgacagtggcaattcaggatgctctggtcagatggcacaggatgaggggagatcaggttctttgggtgcccggaagcgaccatgcaggaattgctacacaggccgttgtggagaagcagctgtggaaggagcggggggtacgcagacatgagctgtctcgcgaagcattcctgcgggaagtatggcagtggaaggaagccaagggaggtgaaatctgcgaacaactgagagcgctcggcgcatcacttgactgggatagagagtgtttcacaatggatgttggatcgtcagtggcagtgactgaggctttcgtccggctttacaaggctggcttgctgtatagaaatcaccagttggtgaattggtcctgcgccctgcgctctgctattagcgatatcgaagtggaaaaccgccccctgccaggacacacgcagctgagattacctggctgccccacacctgtgtctttcggtctgcttttctcagtcgcattccctgtcgacggggagcctgacgcagaggtggtcgtcgggaccaccagacccgagacattgcctggggacgtggctgtggctgtccatcctgacgactctcggtatacccatctccatggtcgccaattgaggcaccctcttatggggcagcccctgcctttaatcaccgactacgccgtccaaccccacgttggaactggcgccgtaaaagtgacaccagcacattcaccagcagacgcagaaatgggggcacggcatgggctctcccccctgaatgtcatcgccgaagacggtaccatgactagcctgtgcggggactggctgcaaggtttacatcggtttgtcgcaagagagaagattatgagcgtgctgagcgagagaggcttatttcgcggactccaaaaccaccccatggtgctgcccatctgcagccgctccggagatgtgatcgagtatttgttgaagaaccagtggtttgtgagatgccaagagatgggggcccgggctgctaaagctgtcgagagcggggcccttgagctgtcccccagctttcaccagaagaattggcagcactggttctctcatatcggcgattggtgtgtctctaggcagctgtggtggggtcaccagattcctgcttacctggtggttgaagaccatgctcagggggaagaagactgttgggtagtcggccgctccgaggcagaggccagggaggttgctgcagaattaaccggccgacccggtgcagaactgaccctcgagagagaccctgatgttctagacacgtggttttcttccgctctttttccattttctgcattgggatggccccaggagactcctgacttggctaggttctaccccttaagtttgctggagaccggttctgacctcctactgttctgggtgggcagaatggtaatgctcgggacgcagctcacgggtcagctgcccttttcgaaggtcctgcttcatcctatggtcagagatcggcaaggccgaaaaatgagcaaaagcctggggaacgtgctggacccccgggacatcattagcggggtggaaatgcaggtgctgcaagaaaagttgcgcagcgggaacctggatcccgcggagctcgcgatcgtcgccgccgctcagaagaaggactttccgcacggaatcccagaatgtggcacagacgccttaagatttactctctgtagccacggagtccaggctggggacctgcacctttccgtatccgaggtccagtcttgccgtcacttctgtaataagatttggaacgcactgaggttcattttaaacgccttgggggaaaaatttgttccccaaccggccgaggaactgtcgccatcttcccctatggatgcttggatcttatctcgtctggcattagccgcccaagaatgcgaacgagggttcctgaccagagagctgagcttggtgactcacgccctgcatcacttttggctgcacaacttgtgcgacgtgtacctggaagctgtaaaacccgttctttggcactctcctcgccctctgggaccacctcaggtgttattctcctgcgccgaccttggacttcggctgttggcgccactcatgccgtttctggccgaagagctgtggcaacgtctgccccctaggcccggatgccccccagcaccctccatcagcgtggcaccttatccatccgcatgctcactggaacactggaggcaacccgagctggagcggaggttttcacgggtgcaagaagtcgtgcaggtgctccgagcactccaggccacataccaactgacaaaggcccgccccagagtactgctacagtctagcgagcccggagatcaggggttgtttgaggccttccttgaaccactgggaacactgggctattgcggggccgtggggcttctgcctcccggcgccgctgcccctagtggctgggcccaggcccccctttcagatacagcccaggtctatatggagctacaaggcctggtggacccacaaatacaattacccctactagctgccagacgttacaagctccagaagcagctggattccctaacggctcgaaccccttccgaaggggaggcagggacacagagacaacagaaattatctagcctgcagctagagttgtccaagctggataaggccgcaagtcacctcagacagctgatggatgaaccgccagcccccggctctcccgaactgtag

SEQ ID NO: 52203 - DNA, 774 bp, Artificial Sequence
  Description of Artificial Sequence: Synthetic coding sequence
atgccccacctgcccctggccagcttccggccccccttctggggcctgagacactcccgcggtcttccccgatttcattccgtgtctacacaatctgaaccccacggctcacccatcagcagaaggaaccgcgaggccaaacagaagcgcctgcgagagaaacaggcgacattggaagccgagattgcaggcgagagcaagagcccggctgagagcatcaaagcatggcgtccaaaggaactggtgctatacgagattccaaccaaaccgggggagaaaaaggacgtctccgggcctctcccacccgcctattccccacgttatgtggaggctgcctggtacccctggtgggtgcgagagggcttttttaagcccgaatatcaggctaggcttcctcaggcaacgggcgaaacgttttccatgtgtattcctccgcccaatgtgaccggctccctccatattggccatgccctgaccgtcgccatccaagacgccctggttcggtggcatcggatgagaggagaccaggttctgtgggtgcctgggtcagaccacgccggcatcgctactcaggctgtggtggaaaagcagctatggaaagaaaggggcgttaggcgccacgaactcagtcgtgaagccttcctgagagaggtttggcagtggaaggaagccaaaggcggagaaatctgcgagcagctccgtgctttgggcgcttcccttgattgggacagggtgttctaccatggatgctggctgctgtcaggttgcgactag

SEQ ID NO: 52204 - DNA, 639 bp, Artificial Sequence
  Description of Artificial Sequence: Synthetic coding sequence
atgcccaccacctgccactgcgtggccatcaccccccccgacagcggtggaagtccttcttccccggccggcggctcaccaagccccgcccctgctgccggggccgcagagcttagccctgcgacccccactggttctgccaaccccaccactagctcctgcgccggcggcacccccgctgctagcttgctgaggtgggttaggtcatgcttcctgagattggacgataccacaaaggacttcccacatgcgttgcaatggaaaggccgtagccctgagtgcacaaggctttgttttgtccgacttgcccgatccgccaaagctcggcctcacagttctcagaggaaggggaggtggcctgagtgcaccagcgcctgccgacttaggtctcaagacgctacaaatgtgctttctcactgtaggcatttgaacggccggtctcccgtgtgcacgagacgttgcatggcccgttctgccggatgccgaaaatccctcccccacttctcccagtggtacggatttactccttcatgggctagatggtggagaagaaagctcgagggatccgagaacatgcggccccagcggggtcaccgtaagggattttcccctgaatgcgtgaggtcctggctgtggtag

SEQ ID NO: 52205 - DNA, 1233 bp, Artificial Sequence
  Description of Artificial Sequence: Synthetic coding sequence
atgggcgccgtgagctgccggcagggccagcacacccagcagggcgagcacacccgggttgccgtgcctcataagcagggaggaaatatccgcgggccttgggcccgcggctggaagtcactgtggacaggacttggcacaatacgctccgatttggaagaactgtgggagctgaggggacaccattacctgcaccaggaaagcctgaagccagcccctgtgcttgtcgaaaagccactgcccgagtggcccgtgccacagttcataaatctgttcttgcctgagtttcccatccgcccaattaggggccagcagcagctaaaaatcctcggtctagtagctaaaggaagcttcggtacagtgctgaaggtccttgattgcacacagaaggcagtctttgctgtgaaggtagtgccaaaagtcaaagttctgcaacgtgacaccgtgagacaatgcaaggaggaagtgtccatacagagacaaatcaaccacccatttgtccacagcttgggggacagttggcagggtaagaggcacctgtttatcatgtgctcctattgctcaacagatttatacagcctctggagtgccgtagggtgctttccagaagcatctatcaggctgtttgccgctgagttggtgctggtgctatgttatttgcacgatctggggatcatgcaccgcgacgtgaagatggagaatatccttctggatgagcggggccacctgaagctgaccgacttcggccttagtagacacgtaccccagggggcccaggcctacacaatctgtggaacattgcagtatatggcacctgaagtcctgtccggtggaccctacaaccacgcagctgattggtggagcctgggcgtgctcttgttcagtcttgcaactggcaaattcccagtggctgctgagagagaccacgtcgccatgctcgcctctgtgacacacagcgacagcgagataccagcctccctgaaccaaggcctctctctgctgctccatgaactgctttgccaaaatcccttacatagactgagatatttgcaccattttcaggtgcaccccttcttccggggcgtggcgtttgacccagaattgctccaaaagcagcctgtgaattttgttaccgagacgcaggccacccagccatcttcggccgaaaccatgccattcgatgactttgactgcgacttagagagcttcctcctgtacccaatcccggcctag

SEQ ID NO: 52206 - DNA, 447 bp, Artificial Sequence
  Description of Artificial Sequence: Synthetic coding sequence
atgggcgccgtgagctgccggcagggccagcacacccagcagggcgaacacacgagagtcgcagttccccacaaacagggaggcaatatcaggggtccttgggccagggggtggaagagcctgtggaccggactcgggactattaggtccgacctggaagaactgtgggaattgcggggccatcactatctccatcaggagtctctgaagcctgcccccgtgctggttgaaaagcccttaccagagtggccggttccacagttcattaacctgtttcttccagagtttcccattcggccgatcagagggcagcaacagctgaagatcttagggctagttgccaaaggcagctttggaacagtgctaaaggtgctggattgcacccaaaaggcggtgttcgcagtgaaggtggtgcccaaggttaaagtgctgcagggaataccttag

SEQ ID NO: 52207 - DNA, 516 bp, Artificial Sequence
  Description of Artificial Sequence: Synthetic coding sequence
atgggcgccgtgagctgccggcagggccagcacacccagcagggcgaacacacaagggtcgcagttcctcacaaacagggtggcaacattcgtggaccttgggctcgaggttggaaatccttgtggactgggctcgggaccatccgaagcgacttggaggaactctgggaactcaggggtcaccactatctccaccaggaatccctgaaacctgcacccgtcttggtcgaaaaacccctgcctgaatggccagtacctcagttcatcaatctgtttctgcctgaatttcccattcggccaatccgaggccagcaacagttgaagatactgggcctggtggccaagggctcatttggaaccgttcttaaggtactggactgtacccagaaggctgtgtttgcagtgaaggtcgtgcctaaagtcaaagttctgcagcgtgacactgtcagacaatgcaaggaagaggtgtccatccaggttataagcatgacgtgggcttcatgcatcgaaatgtag

SEQ ID NO: 52208 - DNA, 516 bp, Artificial Sequence
  Description of Artificial Sequence: Synthetic coding sequence
atgggcgccgtgagctgccggcagggccagcacacccagcagggcgagcacacacgggttgccgtcccccacaagcagggcggtaacattcgcggcccctgggcaagaggatggaagtctctgtggacaggtttagggacgattcggtccgacttagaagaattgtgggagctgcgagggcatcactatctgcatcaggagtctctgaagcccgctcccgtgctggtggagaaaccactaccagagtggccagtcccacaattcatcaacctcttcttacccgaattcccgattcgtcctatccggggccagcagcaactgaagatcctcggtcttgtggctaaggggagttttgggaccgtcctgaaggtactggattgcacccagaaagccgttttcgccgtcaaagtggtgcctaaagtgaaggtgctacagcgggacacagtgcggcagtgtaaagaggaagtatctatccaggtgattagtatgacttgggcaagctgtattgaaatgtag

SEQ ID NO: 52209 - DNA, 441 bp, Artificial Sequence
  Description of Artificial Sequence: Synthetic coding sequence
atggccgccagccggctggagctgaacctggtgcggctgctgagcagatgtgaggcaatggccgctgagaagagagaccccgacgagtggcggctggagaaatacgtcggcgcactggaagacatgttacaggccctgaaggtccatgcctctaagcccgcttcagaagttatcaacgagtattcttggaaggtggacttcctaaagggaatgttgcaggctgagaagctaacgtcttcgtccgagaaggcactggctaaccagttcctcgcccccggcagagtgcctaccacagctcgtgaaagagttcccgccacaaagaccgtccacctgcagtcgagagcgcgctatacaagtgaaatgagatctgaactgctcgggacagctgaggccgaacctgagatggacgtcagaaaacgcacgccttgtcatactcactag

SEQ ID NO: 52210 - DNA, 780 bp, Artificial Sequence
  Description of Artificial Sequence: Synthetic coding sequence
atggccgccagccggctggagctgaacctggtgcggctgctgagccgctgtgaagcaatggctgccgagaaacgtgaccccgatgagtggcgcctggaaaagtacgttggcgccttggaggatatgctgcaggccctgaaggtccatgcgagtaaacccgcctccgaggtcattaatgagtatagttggaaggttgatttcctcaaggggatgctccaagcagaaaaattgacatcctccagcgagaaggctctggctaaccagtttctcgctccggggcgggtgccaacgaccgccagagagcgggtacccgcgaccaagactgtacacctgcagagtcgagccaggtacaccagcgagatgcgatctgagttacttggcactgccgaagcagaaccagagatggacgtcagaaaacgcacaggcgttgctggctctcaaccagtctctgagaagcagctggcagccgagcttgacctggtcctgcaaagacaccaaaacctacaggagaagttggctgaggaaatgctaggactggccagatcactcaaaacgaatacgctggccgcccagagcgtcattaagaaggataaccagactttatcccacagcttgaaaatggcagaccagaaccttgagaaattgaaaacggagtccgagcgcctggagcaacacacccagaagtctgtaaactggctgctgtgggccatgcttatcatagtatgttttatatttatttcaatgatcttgtttatccgtataatgccaaagctgaaatag

SEQ ID NO: 52211 - DNA, 2661 bp, Artificial Sequence
  Description of Artificial Sequence: Synthetic coding sequence
atgcggcccgactgcaacagccagaagcccagccaggccctgagcatacgggatacaagctcaaaagatccttggccggacattgaaccccagctacctgccaccccagccgccgtctggggtgtgtttacatttagttggaggggggctggcgcactagggccacggaggggcccaagaagactgaacaacaagcgcggcgcagccaagcgccaggaagacaagaccatgtccaaggggccgggccctggaggaagtgctgcatccagcgcgcccccggcagcaaccgcccaagtgctgcaagcccagccagagaagcctcaacactatacttatttgaaggagtttagaaccgaacagtgccccttgtttgtgcagcataagtgtactcaacataggccttacacttgctttcactggcacttcgtgaatcaacgcagaaggaggtcaatcaggcggagggatggcaccttcaactattcgccagacgtctattgcactaaatatgatgaggccacagggctgtgccccgagggggacgaatgtccctttctgcaccgcacgactggggatactgaacggcgataccatctgcggtattacaagaccggaatctgcattcacgaaacagactctaaaggtaattgcacaaaaaacggcctgcattgtgcatttgcacacggcccccatgatcttcgcagccccgtctatgatatccgcgagctgcaggctatggaggcccttcagaatggccagacaactgtggaaggcagcatcgagggccaaagtgcgggtgccgcatcacatgcaatgatcgaaaagatcctgagcgaagagccccgctggcaggaaacagcctacgtactgggcaattataagaccgagccctgcaaaaaaccgccccgactttgtcgtcagggatacgcctgcccgtactaccacaactccaaggataggcgccgttcccccaggaagcacaagtacagatcttcaccttgtcctaatgtcaagcatggagacgaatggggagaccccgggaagtgcgaaaacggcgacgcctgccagtattgtcacactcggaccgaacagcaatttcaccccgagatttacaaatcaaccaagtgcaacgacatgcagcagtcggggtcctgtcctcgcggacccttctgtgccttcgcccacgtggagcagccacccctctcggatgacttgcagccatctagtgccgtcagtagtccaacccaaccaggtcccgtgctctatatgccaagcgccgctggagatagcgtgcccgtttccccatctagccctcacgctccagacttgagtgctttgttatgtagaaatagttctttagggtcgcccagcaacctgtgcggatcccctcctggttccatccgaaagccgcccaacctggagggaatagtgttcccaggagagtccgggctcgctcctggctcctacaagaaggccccaggattcgagcgcgaagatcaggtaggtgctgaatatcttaaaaactttaagtgtcaggcaaagttgaagccccattcactcgaaccccgcagtcaagagcaaccactcctgcaacctaaacaggacatgctaggcattctccctgcagggtctccccttaccagttcaatttcttcctcaatcacgtcttcactggctgcgacacctcccagccccgtgggaacaagcagtgtgcccgggatgaacgctaatgcgctccctttctacccaactagcgatacagtggaatccgtgattgaatctgcgctcgatgacttggacttaaatgagttcggggtggccgctctggaaaaaacgttcgacaattccactgtgccgcaccctggatccatcactatcgggggctctctgctgcaaagctcagcacctgtgaatatcccaggctcattgggctcttcagctagttttcacagcgcttcacctagtccccccgtctctctcagttcccattttctgcaacagcctcagggccacctgagccagtccgagaatacgtttttaggcaccagcgcgtctcatggatctcttggtctgaatggtatgaacagctctatatgggaacactttgcatcgggcagcttcagccccggaacaagtccagctttcctcagtggaccgggcgctgcagaactagctaggctgcgccaggaacttgacgaggccaacagcactattaaacagtgggaagaaagctggaaacaggcaaagcaggcctgtgatgcttggaagaaagaagcagaggaggccggcgagagagcaagtgccgctggagcagaatgcgagctcgcacgtgagcaacgtgacgcactcgaagttcaagtcaagaagttgcaggaagagctcgagaggctgcacgcagggccggagcctcaggcgctccccgccttcagtgatctggaggcactgagtcttagcactctgtatagcctgcagaagcagctcagagcccatctggagcaagtcgataaggccgttttccatatgcaatcggtgaagtgcttgaagtgccaggaacagaagagagccgttcttccttgtcaacatgcagccctctgcgagctttgcgccgaaggctctgagtgtcccatttgccagccaggccgcgctcacaccctccagagctag

SEQ ID NO: 52212 - DNA, 510 bp, Artificial Sequence
  Description of Artificial Sequence: Synthetic coding sequence
atggtgagcagcaagggcctgtggaaggagcggcccagcgcccacacttcagagtgtttctccactaccgcctgccccgtggctttcatcctgctggtgtggaacagtcagacacctgccggtctgcagagcctctgtacaggccggcaccccagcctcagcgcccgagcgcaaagagcagggcccagagcatcacgcgaggaagggaccttctggaccgaaagggtgggccaagaacgctggctgatccgtagcgggagcagtcagaatgaaagtcaggaggaccagggtgcaggtctgataagtcaggccggcctgaaagccgataatcgtagagagagctctacttgggcaaacgaggtggaggatcgcagaccacagtgcacccccgcgcttaatctcacaccgtctcatccccaccctccgcacagcctcactacgttcctccgaagcgtgatcgggatccagattccgccgggcctggtcgccgccggcggtaccgtagcctag

SEQ ID NO: 52213 - DNA, 510 bp, Artificial Sequence
  Description of Artificial Sequence: Synthetic coding sequence
atgggcagcagcaagggcctgtggaaggagaagcccagcgcccacacatccgagtgtttcagcaccaccgcctgcccagtggcttgtatccttctggtctggaattcacagacccccgcaggcctacagagtctgtgcaccggacgccaccccagcttgagtgcacgggctcagtgggccggcccccgtgcatctagggaggaagggacgttctggaccgagccagtcgggcaggagcgtagactaattcgcagtggaagctcgcagaatgaatctcaggaggaccagggtgcagacctaattagccatgaaggactgaaggccgataatcagagggagagcagcacatgggcgaatgaggttgaggatcgacgcccccagtgtaccagcgccctgaatctaacacctagccatctgcatcctccacatcccctaacaacttttttccgaaatgtcatcgggattaaaatccctcccggtttggttgcaatgggcggcacagttgcctag

SEQ ID NO: 52214 - DNA, 972 bp, Artificial Sequence
  Description of Artificial Sequence: Synthetic coding sequence
atgaagaacgtggacagcgacgacctggtgaccggcaccctgcccaagctaaagagtagcaaggagtggctagaacccaaaccactctgtttcatggaagttctcgccaaggaggataccgaagctgctattcagtctatactctataaagaaaattctgtcataaaggaactggacaagtacctccagcatcatgcttttttaaatgctcgcaggaaagagatgctttacaagagatgggtagactgtgtggccgacccactgcaaaagaagataattgagaaagtatgttcacacaagaagattaagaagcggcgccagggggagctggatggtttcctcaaacatgtgaacaagaaaggtaacgcattcattgagcattacgacccaaaagagtatgatccattttatatgtccaagaaggatcccaacttcttgaaagtgaccatccccccattccacgatccactgaagaaggcacagtatgacaaagacaacgagaaacgtacactccttcagtgcgaaaccggcaaaatttactctattaaggaattcaaagaggtggagaaagttcagttgcactcacgcttcccccagatttctaactcacggcatttcatcacaccaaatgaatggctcaagttgcccacacgatatatagaatccgagttttgccggagaagaagactgaaagtcaaagtgaacttcaatgattgctcttttgacctcaagccccttgctcgcgcaccatacttgctagagtctcaggaggaggagaagacggttatttacaaaaacaagggcagttctttccttgagcgtgagcctctgtgctatcaggaaggtaataacccctcagctaaggaagccataagtgaggggtacttctccagcttgagcttacaagagcgagaggaagaccaggatggaagtccttctccacgcctggggttgcttaaacttgaactgtag

SEQ ID NO: 52215 - DNA, 2592 bp, Artificial Sequence
  Description of Artificial Sequence: Synthetic coding sequence
atgctggagagctacgtgacccccatcctgatgagctacgtgaacaggtacattaagaatctaaagccttccgatctccagctgtcactctggggcggcgacgtcgtgctgtctaaacttgaattaaagcttgacgtactcgaacaagaattgaagttgccattcacatttcttagcggccatatccacgagctgagaatacatgttccctggaccaagttaggctctgagcccgtggtgatcaccataaatactatggaatgtattctgaaactgaaggatggtatacaagacgaccatgagtcctgtgggagcaactctactaaccgaagcactgctgagtcaactaaatcaagcattaaacctaggcgtatgcaacaggcggcccccacagatcccgatctgccccctggttacgtccaatcactgattcgcagagtagtgaataatgtgaacatcgtcatcaataacctgatcctaaaatatgtggaggatgacatcgtgctctctgtgaacatcacctccgccgagtgttacacagtgggtgaactctgggatcgggcattcatggatatctccgctactgacctggtgctaagaaaagtcatcaatttcagcgattgcaccgtgtgtctcgacaagcgaaatgcatcaggcaaaattgaattctatcaggaccctctgctctataaatgtagctttcgaacacgacttcatttcacgtatgaaaatctgaacagcaaaatgccctcagtgattaagattcacactctggttgaatcgttgaagctcagcattacagaccaacagttgccaatgttcataaggatcatgcagttgggcattgccctctattacggagaaatcggcaattttaaggaaggcgagatcgaagacctgacgtgtcacaataaagacatgcttggtaatattaccggctctgaggatgaaactcgtattgacatgcagtaccctgcacagcataaaggccaagagctctacagccagcaggacgaggagcagccccaggggtgggtatcctgggcatggtcattcgtgccagcgatagtgtcctacgatgatggtgaggaagactttgtcggaaatgatcctgctagcacgatgcaccagcagaaagcccagaccctcaaagatccgattgtgagtattgggttctattgtaccaaggccacggtgacattcaaattgaccgaaatgcaggtcgagtcatcctactactctccgcagaaggttaagagtaaggaagttctctgttgggaacaggaaggaacaacagtggaggccctgatgatgggggaacctttcttcgattgtcaaatcggatttgtaggctgtcgggccatgtgtctgaagggcattatgggcgtgaaagactttgaggagaatatgaatcgctccgagacagaggcttgcttttttatttgcggcgacaacctttctactaaagggtttacctacctgacaaactccctgtttgattatcgcagtccagagaataacggaacccgggccgaattcatccttgattctacccaccacaaggagacctatactgagatagccggaatgcaacgctttggagccttttacatggactatctgtacaccatggagaatacctccggcaaggggtctaccaatcagcaagactttagttcagggaagagcgaggacttgggcaccgtacaggagaagtctacgaaatccctggtcatcggtcctctcgatttcagactggatagcagtgcagtgcacagaatcctgaaaatgatcgtttgtgcattagaacacgagtacgagccctattcgaggctgaagtctgatattaaagacgagaacgagacaattcttaacccagaagaagtcgctttgctggaagaatacattccaacacggcacactagcgtgactctcttgaaatgcacatgtactatctctatggcggagtttaatctactagatcacctgttacccgtgatcatgggggaaaagaactcctcaaacttcatgaataccacaaattttcaatcactgaggccactgcccagtatcaggattctagtggacaagatcaacctcgaacacagcgtgccaatgtacgctgagcagctagttcacgtcgtgtcgagtctgacccagccgagcgataatctgctgcattattgctatgtgcactgctatttgaagattttcggatttcaggccgggctgacttcccttgattgcagcggaagttactgcctgccagtgcctgttatccccagcttttcgacagccctgtatgggaagctgctcaaacttcccacttgctggacaaaacgcagccagattgccatcaccgaagggatattcgaactgcctaatctgaccatccaggccactagagcccaaactctactcctccaagccatctaccagtcctggagtcacttagggaatgtcagcagttcagcggtgattgaggctctaataaacgagatcttcctgtcgattgaaattgggtcctgttacgtggcccaagtggatctagagctcctggccagcaatgatcccccaactagcacaagctag

SEQ ID NO: 52216 - DNA, 11994 bp, Artificial Sequence
  Description of Artificial Sequence: Synthetic coding sequence
atgctggagagctacgtgacccccatcctgatgagctacgtgaacagatacatcaaaaacctgaagccctctgacttgcagctaagcctgtggggcggtgacgtggttttgtctaagctagagttaaaactggatgtcctggaacaggaactcaaattgcccttcacgtttctatccggccacattcatgagttaagaatccatgtcccgtggaccaaactgggttctgaacccgtcgtaatcacgataaacacaatggaatgcattcttaagctgaaagacggaatacaagacgatcatgaaagctgcggatctaattcaactaaccgctccaccgctgaatccaccaagtcttcaataaagcccagacgcatgcagcaggctgcccccaccgatccagacctcccacctggctacgttcagtccctgatccggagagtggtcaacaacgtaaacattgtgatcaacaacctgatattaaaatacgttgaggacgacatcgtgctgtcggtgaatattacctctgcggaatgctacaccgtcggcgagttatgggaccgcgccttcatggacatctccgctacagacctggtcttgaggaaagtcattaactttagcgattgcaccgtgtgcctggataaaagaaacgccagcggcaaaattgagttttaccaggaccccctgctgtacaaatgctccttccggacacggttgcatttcacatatgagaacctgaatagcaaaatgcccagcgtgatcaagatccatactctcgtggaatcacttaaattaagcatcaccgaccagcagctccccatgttcattagaatcatgcagctggggatagccttgtactatggcgaaatcgggaactttaaggagggcgagatcgaggatctcacctgtcacaacaaggatatgctcgggaacattactgggtcagaggatgaaacccgcattgacatgcagtaccctgctcaacacaaaggacaggaactatactctcagcaggatgaagagcagcctcaggggtgggtgtcctgggcttggtccttcgttccggctatagtgagttatgacgacggcgaggaagacttcgtgggtaatgacccagcttcaacaatgcatcagcagaaagcccaaacccttaaagatcccatcgtgagtattggcttctactgcaccaaggcgactgttacctttaagttaactgaaatgcaggtcgagtcaagttactactctcctcagaaggtgaagtccaaggaggtgctgtgctgggaacaagaagggacaacagtcgaggctcttatgatgggcgaaccattttttgattgccagatcggattcgtgggctgccgtgctatgtgtctgaaagggatcatgggcgtcaaagacttcgaagaaaatatgaaccgttcagaaacagaagcctgcttttttatatgtggcgacaacctttccaccaaaggcttcacatacctcacaaacagcctttttgattaccggtccccggagaacaacggtaccagagcagagttcattcttgatagcactcaccataaagagacatacaccgagatcgccggcatgcagaggttcggagctttctacatggactacctgtatacgatggaaaacacgtcagggaagggcagcaccaaccagcaggactttagttcgggaaagtcagaagacctgggcactgttcaagagaagtccaccaaatccttagtcatcgggccccttgatttccgcctggactcttctgccgtgcaccggatcctgaagatgattgtctgtgccctggagcatgaatacgaaccatactcgcgcttaaagtcagatataaaggacgaaaatgagactattcttaacccagaggaggtggcgctgttagaggagtacataccaactaggcatacatcagtaactctactaaagtgtacctgtaccatctctatggccgagtttaatctcttggatcaccttctgccagtgattatgggggagaagaactccagtaatttcatgaataccaccaattttcagagcctgaggccactgccctcaatccgaattctcgtggacaaaatcaacctggagcactcagtccctatgtatgccgaacagttggtgcatgtagtttcaagcctgactcagccgtcggataatctactgcactactgttacgtccattgctacttaaagatcttcgggtttcaggccggcctcacttccttggattgttccggctcttattgcctgcccgttcctgtgatcccatctttttcgacagcattgtatggcaagctgctaaagttgccaacttgttggacaaaaaggtctcagatcgccatcacagagggcatttttgagctacctaatttgactatacaggcgaccagagcccagaccctcctcctacaagcaatctatcagagttggagtcatctcggcaatgtcagcagctctgcagttatagaggctctgatcaacgagatctttctttccattggggtgaagtcgaaaaaccccctacctacgttggagggcagcatacagaacgtggaactcaaatattgctctacctcgctagtgaaatgtgctagcggcaccatgggcagcattaaaatttgtgctaaagcacctgtagattctggaaaggagaagttaatcccactcttacagggcccttctgatacaaaagatcttcattccactaaatggcttaatgagagccgaaaacctgagagtttgctggccccagatcttatggcatttacgattcaagtgccacagtatatagattattgccacaacagtggggctgtcttattatgctcaatccaaggactcgcagtgaatattgaccctatattgtacacatggctcatctaccagccacagaaaagaacgagccgccacatgcagcagcagcctgtagtcgcagtgcccctggtgatgcccgtctgtaggcggaaagaggatgaagtgagtatcggaagcgctcccctcgcaaagcagcagagctatcaggcttccgaatacgctagctcacccgttaagactaaaacggtgactgagtcgagaccgttgagtgtgccagtgaaagcgatgctcaatatctcagaatcttgccgctcccctgaggagcgtatgaaggagtttattggcatcgtgtggaacgcagtgaagcatctaacgctgcagctcgaggtgcagtcctgttgcgttttcatccctaatgattccctgccttctccaagtaccatcgtctcaggcgacattcccgggaccgttcgcagttggtaccatggccagactagcatgcccggtactctcgtgctgtgcctgccccaaataaagattatttcagctgggcacaaatatatggaaccactccaggagattccctttgtgatccctcgcccaatcttggaagagggagacgcatttccttggacaatcagccttcacaacttttcaatctataccttgcttgggaaacaggtgaccttatgtctggttgaacctatgggttgcacgtccaccctagccgtgacatcacagaagctcctggcaacaggtcccgatactcgtcattcctttgttgtatgcctacacgttgacctcgagagtctcgagattaagtgcagtaaccctcaggtgcagcttttctacgagctcactgacatcatgaacaaagtgtggaacaaaatccagaaaaggggcaatctgaatctctctcctacatcccccgagacaatggcaggccctgtgcctacatcccctgttagatcatcgatcgggaccgcccccccagacacaagtacttgtagtccatccgccgatatcgggaccacgactgaaggtgactcaattcaggccggcgaagaatctccattctcagactctgtgacgttggagcaaaccacttctaatattggtgggaccagcggacgcgtgtctctctggatgcagtgggtgctgcctaagatcacaatcaagctgttcgcccccgatccggagaataaaggcactgaggtatgtatggttagcgaactcgaggaccttagcgcttctattgatgtccaggacgtttacactaaggtaaagtgcaagatcgagtccttcaacattgaccactaccggtcaaggcccggcgaggggtggcaatctggtcatttcgaaggggtatttttacagtgtaaggagaagagtgtgacaacgacaaagctactagacggaacccaccagcaacatggcttcctttcactgacctacactaaagcagtcaccaagaatgtgagacacaaactgaccagcagaaacgagcgccgttcctttcataaattgtctgagggcctcatggatggctcccctcacttccttcatgaaatcctcctaagcgcccaagccttcgatatcgtcctgtacttccccctactgaacgcgattgcatcaattttccaggctaaacttcccaagacgcaaaaggagaaacggaagagccctggtcagcctatgcgtacccacactctgacaagcagaaacctgcctctaatttacgtcaacacttctgtgattcgcatctttatcccaaaaaccgaggagatgcaacccacagttgaggccaaccaggcggccaaagaggatacagtcgtgctgaaaatcgggtcagtagccatggccccccaggctgataaccctttaggacggagtgtcctacgcaaggatatttaccagcgcgccctgaatctgggcattctcagagatcccggctcggaaatcgaggaccgacaataccagatcgatctccagtccatcaacattggaactgcacagtggcatcagcttaagccagagaaggaatccgtgagtgggggggtggtgactgagactgagcggaatagtcagaatccagctcttgagtggaacatggcttcttccatccggcgccaccaagagagacgcgccattcttacccccgtgttaactgatttcagcgttcgcatcaccggcgctccggctgtgatcttcaccaaggtggtgagccctgagaacctgcacaccgaggagattttggtttgcggccacagcctggaagtgaatattaccactaatctcgactttttcctgtccgtcgcccaggtgcaactgttacaccagctgattgtggccaatatgaccggcctggaaccttctaataaagcagcggagatttcaaaacaggagcagaagaaggtggacatctttgatggaggcatggccgaaacttcatcaaggtatagtggagctcaagactctggaattggctcagactccgtaaagatacgcattgtccagatcgagcagcactcaggcgcatctcagcatagaattgctcggccctcccgccagtccagcatagttaagaacctcaatttcatcccctttgatatctttattaccgccagtaggatctcacttatgacatactcgtgcatggcgctgtccaagtctaaatctcaggaacagaagaacaatgaaaaaacggacaaatcaagcctgaatctccccgaggtggatagcgatgtggccaagccaaatcaggcttgcatatccacagtgactgccgaggatctcctccggtcctctatcagctttccgagtggaaagaagatcggcgtcctgtcccttgaaagcttgcacgcctcaactcgttcctctgccaggcaggcactcggaatcacaattgtacgacagcccggaaggagagggaccggcgacctccagctcgagcccttcttatattttattgtcagccagccatccctgttactaagctgccaccaccgcaagcagcgggtggaggttagcatcttcgatgccgtccttaagggagtggcttctgactacaagtgtatcgacccaggtaagaccctgccggaagccctggactattgtacagtatggctgcaaacagtgcccggggagatagacagcaagtctggcatcccccctagctttattaccttacagatcaaggattttttaaatggccccgccgacgtgaacctagacatctcgaaacccctcaaagctaacctcagctttaccaagcttgaccagataaacctgtttcttaagaagataaagaatgcacactccctggctcactccgaggaaacgagtgcaatgtccaatacgatggttaacaaagatgacctgccagtttctaagtattatagaggaaaactgagcaaaccaaagatccatggggatggcgtgcagaagatcagcgctcaggagaacatgtggagggccgtcagctgctttcagaagatctccgttcagactacacaaattgtcatatctatggagactgtgccccatacgagcaagccatgtctcctcgcaagtctgagtaacctgaacgggtctctctcagtcaaggccactcagaaagttcccggcattattctgggaagctcatttcttctctctatcaatgacttcttgctaaaaacgagtcttaaagaacgttctcggattttgatcggtccgtgctgtgcaacagctaatctggaggccaaatggtgcaagcattcggggaaccccgggcccgagcagagcatcccgaaaatttcaattgatcttcgggggggattacttcaagtcttttgggggcaggaacacttaaattgcttagtactgctccatgagctgctgaacggctatctcaacgaagagggtaatttcgaggtccaggtgagcgagcctgtgccacagatgtcttctcccgtggaaaaaaaccagaccttcaaaagcgagcagagttccgatgacttaagaacaggcctgtttcagtatgtccaggatgcggaaagcctcaaattgcctggtgtctacgaagtgcttttctataatgagacagaggactgccccggcatgatgctttggcgctacccggaacctagagtgcttacccttgtccgcatcacacccgtgcccttcaacacaacagaagaccccgacattagtactgccgacctgggagatgtgcttcaggtgccatgttctcttgagtattgggatgaactgcagaaagtctttgtcgctttccgggagttcaatttgagcgagagcaaggtttgcgaactccagctgcctgatatcaatcttgtaaacgatcagaagaaattagtaagtagtgacctgtggcggattgtgctaaactcatctcagaacggggccgacgaccaaagcagcgcctccgaatccggtagccaatccacatgcgatcctctggtcacacccactgctctcgccgcctgtacccgggttgattcttgtttcacaccatggtttgtgccatccctgtgcgtgagttttcagtttgcacacctggaattccacttatgtcatcatctcgaccagttaggaacagctgctcctcaatatctccagccttttgttagtgaccggaacatgccaagcgagctggagtatatgattgtgagtttccgagagccccacatgtacttgcgccaatggaacaacggctccgtctgtcaggaaattcagtttctcgcgcaggccgactgtaaacttctggagtgccggaacgtgacgatgcagtctgtggtgaaacccttcagcatcttcgggcagatggcagttagctccgacgtggtcgaaaagctcctggactgcactgtgatcgtagactccgtatttgtgaacctggggcagcacgtcgtccacagcttgaatacggctatacaggcgtggcagcagaacaaatgccccgaggtggaagagctggtgttttcccactttgttatctgtaacgacacccaggagacactgagatttggacaggtggatactgacgagaatattctgcttgcgtccttgcacagccaccagtactcttggcgcagccacaagtctcctcagcttctgcatatatgtatcgaaggctggggaaactggcggtggagcgaacctttcagcgtggaccatgcagggacttttatcagaacaatccagtatcgcggcagaacagcctctctgatcatcaaggtgcagcagttgaacggggtacagaaacagataatcatctgcggtcggcagatcatttgttcctacctcagccagtccatcgaattaaaggtggtgcagcattacataggacaggacggtcaggccgtagtgagggaacactttgattgccttaccgccaaacagaaacttccctcctatattctggagaacaacgagcttaccgaactgtgcgtaaaggcaaaaggcgatgaggattggagccgggatgtgtgcctcgaatcaaaggcccctgaatactctattgtgatacaggtgccgagttccaacagcagcatcatctatgtttggtgcacggtactgacgcttgaacctaactctcaggtgcagcagaggatgatcgtgttcagccctctgtttattatgcgttctcacctgccggaccctatcattatccacttggagaagaggagcctgggcctcagtgaaacccaaatcatacctggcaagggccaggagaagccccttcagaatatcgagccagacttggtgcaccacctaaccttccaggctcgagaagagtatgacccaagcgactgtgccgttcctatcagcaccagcttaatcaaacagattgcaactaaggtgcaccctggcgggacagtaaatcagatcctggacgaattctacggtcccgagaaatctctccaacctatatggccatacaataagaaggactccgatagaaatgagcagctttcccaatgggactcaccaatgcgagtcaagcttagtatctggaagccttacgtgcgcaccctgctgatcgagctgctcccctgggctctgctgataaacgagtcaaagtgggacctgtggctgtttgagggcgagaaaatcgtgctgcaggtgccagccggaaagatcatcatcccccctaactttcaggaagcgttccaaattggaatttattgggccaacacaaacaccgtgcataagtcagtcgctattaaactggtgcataatctgacaagtcctaagtggaaagatggagggaacggagaagttgtaaccctggatgaggaggctttcgtcgacacagagattaggctgggtgcctttcccggccatcagaagttatgtcagttctgtatttcttctatggtccagcaaggtattcagattattcagatcgaagacaaaaccaccatcatcaataatacaccttaccagatattttacaaacctcagctgtcggtatgtaatccacatagtggaaaggagtactttcgcgtaccggatagtgctacattctctatctgcccaggcggggaacagccggctatgaagtcatccagcctgccctgttgggatttaatgcccgacatttcacagagtgtgctggatgccagcttactgcaaaaacagatcatgttgggcttctcccccgcgcctggcgccgattcatcccagtgctggagcctgcccgccatcgttaggccggaattcccaaggcagagcgtggccgtacccctcggcaactttagagagaacgggttctgtaccagagccatcgtactgacttaccaggaacacctgggcgtgacctatctcacactctccgaggacccaagcccaagggttatcatacacaacagatgccccgttaaaatgttaatcaaagagaacatcaaagacatccccaagtttgaagtgtattgcaaaaagattccaagtgagtgctcaatccaccacgagctctaccaccagatttcctcttatcccgattgcaagacaaaggatctcctgcctagccttctactgcgcgtggagccgcttgacgaggttactaccgagtggtctgatgccatcgacatcaactcccaaggcacccaagtggtgtttctgactggattcggatacgtgtatgtggacgtggtccaccagtgcggaactgtattcattaccgtggcccctgaaggcaaggctggccctatcctgacgaatacaaaccgagcacctgaaaaaatagtcaccttcaaaatgttcatcacacagctgtcgctggcggttttcgatgatctcacgcatcacaaagccagcgcagaactgctcagattaacactcgacaatatttttttgtgtgtggcccctggtgccgggcctctgccaggggaggagcctgtggccgcactatttgaattgtactgcgtcgaaatctgctgtggagacctgcagcttgacaatcaactgtacaacaaaagcaactttcatttcgcggtgctggtgtgccagggtgaaaaggccgagccgattcagtgctctaagatgcagagccttctcatctcgaataaggaactcgaggaatacaaggagaagtgttttattaagctctgcatcaccctcaatgagggcaagtccatcctttgtgatattaatgaatttagtttcgagctcaagcctgccaggttatacgtggaggatactttcgtatattatatcaagacactgtttgacacttatcttccaaacagtcggcttgccgggcatagcactcacttgagcggcggaaagcaagttcttcccatgcaggtgacgcagcacgccagagccctggtgaatcccgttaagctgcgaaaactcgttattcagcccgtgaatctcctggtaagcatccatgcatctcttaagctgtacatcgcctcagatcatacacccctctccttcagtgtcttcgagagggggcccatctttaccactgcgcgccagctagtgcatgccctagctatgcactacgccgctggagctctctttcgtgctggatgggtcgtgggttccctggatattttgggatcacctgcgagcctagttagatctataggtaatggagtagcggacttcttccggctgccttacgaaggtctcactaggggacccggagccttcgtttcaggcgtgtcacgaggtaccacgtcattcgtgaagcatatctccaaagggacactgacgagcataacaaacctagcgacttcactggccagaaacatggataggctctctcttgatgaagagcactataatagacaagaagagtggaggcgacaactacccgaaagccttggcgagggactcaggcagggactcagcagactgggcatctcgctgctcggagcaattgccggcatcgtagatcagccaatgcaaaactttcagaagaccagtgaagctcaggctagtgccgggcacaaggcgaagggcgttatcagcggcgtgggaaaaggaattatgggagtttttaccaaacccattggaggggccgccgagctcgtttcccagacgggctacgggatcttacatggagctggcttatcccagctgcccaaacaacgacatcaaccatctgatctgcacgctgaccaggctcctaactcccatgtgaaatacgtctggaaaatgctgcagtctctgggccgtcctgaagtgcacatggccctcgatgtcgtccttgtgcgtggctcaggacaggagcacgaaggatgcttgctccttacatcggaagttttgttcgtggtatctgtgtcggaagacacccagcagcaggctttccccgttactgaaatcgactgcgcacaggattccaagcaaaacaatttactaaccgtgcaactcaagcaacctagagtggcctgcgacgttgaggtggatggtgtaagggagagactgtcagagcaacagtacaataggcttgttgattacataactaagacatcttgccatcttgctccgtcttgctccagcatgcagatcccttgccctgtggtggccgctgagcccccacccagtacggtaaagacctaccattacctggttgacccccacttcgctcaggtatttttgtctaagtttacaatggtgaaaaacaaggccttacgcaaaggcttcccgtag

SEQ ID NO: 52217 - DNA, 12069 bp, Artificial Sequence
  Description of Artificial Sequence: Synthetic coding sequence
atgctggagagctacgtgacccccatcctgatgagctacgtgaacaggtatattaagaatttaaaaccaagcgacctccagctgagtctgtgggggggtgacgtggtgctgtccaagctcgaattaaagctggacgttctagagcaggagctgaagcttccctttaccttcctgagtgggcatatacatgagctgagaatccacgtaccctggacaaagcttggtagcgagccagttgtgatcacgataaacacgatggagtgcattctaaaactgaaggatgggatacaggacgatcatgagagttgcgggtccaactccacgaacagaagcactgcagagtctacaaagagtagcatcaaacctcggcgcatgcagcaggcggctccaaccgatccagacctgccccccggctacgtgcaatctttgataaggcgggttgttaataacgtgaatatagtgataaacaatctaatcctaaaatatgtggaggacgatattgtcctatccgtaaacattacatccgctgagtgctacaccgttggggaactctgggacagggcgttcatggacattagtgccactgacttggtgctgagaaaagtgattaattttagcgactgtaccgtttgcctcgacaagaggaacgcatccggaaaaatcgagttttatcaggatcctctcctatacaaatgcagcttcaggactagactgcatttcacatacgagaacttaaattcaaaaatgccttcggttatcaaaatccataccctggtggagtccctgaaactttctattactgatcagcaactgcccatgttcattcgcatcatgcaactgggcatcgcactctactacggggaaatcggaaattttaaggagggtgagatcgaagacttaacttgccacaataaagatatgctaggcaatatcaccgggagtgaagatgagacaagaatcgatatgcaatatcccgcccagcacaaaggacaggagctgtactcacagcaagatgaagaacaaccccagggatgggtctcatgggcctggtcttttgtgccagcaatcgtgtcgtatgacgatggcgaggaggatttcgtgggtaatgacccagcctcaaccatgcaccagcagaaggctcaaacactgaaagacccaatagtcagcatcggattttactgtaccaaggctacagtgacattcaaacttacagagatgcaagtggagtcctcatactactccccacagaaggtaaagtctaaggaggtcctatgttgggagcaagaaggaaccactgtagaggccctgatgatgggcgagccattcttcgattgtcaaatcgggtttgtggggtgcagggcaatgtgtctgaaaggtataatgggggtcaaagactttgaggagaatatgaatcggagcgagaccgaagcctgttttttcatctgcggggacaatctgtccactaaaggcttcacctatctaaccaattctctgttcgactaccgctcccctgagaacaacggaactagagcggagttcattttagacagcactcaccataaagagacctatactgaaattgcgggcatgcagaggttcggggccttttacatggactacctgtacactatggaaaacacaagcgggaaaggttcgacgaatcagcaagacttcagctctgggaagagcgaggatctcggcactgtccaggagaaatctaccaagtcgcttgtgattggaccactagactttagactggattcttctgcagtacacaggatcctaaaaatgattgtgtgcgcgctggagcacgaatacgaaccatattctaggttaaagagtgatatcaaagacgagaacgaaaccatcctgaatcccgaggaagtagccctgttagaagagtatattcctacccgtcacacatctgtgacccttctgaaatgtacatgtactatatccatggcggagttcaatcttctcgaccacctactgcctgtcataatgggcgaaaagaacagcagcaactttatgaataccactaatttccagtcccttaggcccctcccgtccatcagaattttggtcgacaagatcaaccttgaacactccgtgcccatgtatgcagaacagctggtgcacgtggtgtcaagtcttacgcagccatcggacaatctactccattactgttatgttcattgctatctgaagatattcggattccaagcaggactgaccagcctggactgctctgggtcatattgcctgccagtaccagtgataccaagtttctccaccgccctgtatggaaagctgctcaaactgcctacgtgttggacgaaaaggtcacagatagccataacagaggggatttttgagctgccaaatcttacgattcaggccaccagggcccagacgcttctcctgcaggcaatttaccagtcgtggtctcacctgggcaacgtgtccagctcagccgttatcgaagccctgatcaatgagatttttctgtccattggtgtgaagagcaaaaatcccctccccaccctggaaggctccattcagaatgtagagctgaaatattgcagcacgtccctggtgaaatgcgctagtggaacaatgggatcaatcaaaatctgtgcaaaggccccagtcgactcaggaaaggagaaactcattccactgctgcaaggccccagtgacaccaaagaccttcattccaccaaatggttgaacgagtctaggaagccagaaagcctgctggcccccgacctgatggctttcaccatccaagtgcctcaatatattgattactgtcataactcgggtgcagtccttctctgttcaatacaaggacttgctgttaatattgatcccattttatatacctggttgatctaccaaccccagaaacgcacctcgcgacacatgcagcagcagccagttgttgctgtgcccctggttatgccagtctgtagaagaaaagaagatgaggtgagcattgggtccgcacccctcgccaaacaacagtcctaccaggccagcgagtacgcctcatctccggtcaagacgaagacagttaccgagtcacggcccctatcagtccctgtcaaggctatgttgaacatctctgagtcatgcagatctcccgaagagcgaatgaaggaatttattggcattgtctggaatgccgtgaagcaccttactctgcagctggaagtgcagtcttgctgtgtgttcattcccaatgactcacttccgtcccctagcactatcgtgtccggtgacattcctggcacagtcaggagctggtatcacggccagacatctatgcccggcactctcgtactgtgcctccctcagatcaaaatcatcagtgctgggcataagtacatggaacctcttcaagagatcccatttgtcatacctcggcccatactagaggaaggcgacgcttttccgtggacaatctccctgcacaacttcagtatttacactttgcttggtaaacaggttacactttgcctggtcgagcctatgggctgcactagcactttagccgttacctcccagaaactgttagcgaccggtcccgacacacgtcatagttttgtcgtgtgcttgcatgttgaccttgagtcactggagatcaagtgctcgaatcctcaggtacaactgttctacgaactgacagacatcatgaataaagtatggaataaaatccaaaagcggggcaatctgaacttatcccctacaagccctgagacgatggccggaccagtaccgacgagtccagtaagatcttcaattggaactgcccctccagatacttccacttgttcaccaagcgccgacatcgggactacaacggagggggacagcattcaggccggcgaggaatcaccattttctgattccgttacactggaacagactacctcaaatattgggggaacctctgggcgggtcagcctctggatgcagtgggtcttgcctaagatcacaataaagctgtttgcccccgatcccgaaaacaaaggcactgaggtgtgcatggtctccgagcttgaagacttgagtgcttctattgacgttcaagacgtctacacaaaagttaagtgtaagattgaatcatttaacattgatcactataggtcctccctcggggaggaatgttggagcctgggccagtgtggtggagtatttctttcttgtacggacaaactgaatcgtcgaaccctgcttgtgcggcccattagcaagcaggatccattcagcaattgctccggctttttcccttccacaacaacaaagttgctcgatggcactcatcagcagcatgggtttttatccctgacctacaccaaagccgtcactaagaacgtcaggcacaagctgactagtaggaacgagcgacgaagcttccataagctgtcggaaggacttatggacggttctcctcatttcctgcatgagattcttctatccgcgcaagcgtttgacattgttctatacttccctctgctaaacgctattgcatccattttccaggctaaactgcctaagacacaaaaagaaaaaaggaaatctcccggccaacccatgcgtactcacactttgacatctcgcaatctgcccctgatttatgttaacacaagcgttatcagaattttcattcccaaaacggaggaaatgcaacccaccgtcgaggccaaccaagctgccaaggaagacactgttgtgctgaagattggcagtgtggctatggctccccaagcggataatcccctgggtaggtctgtgttgcggaaggacatttatcagagagccctcaatctaggtatccttcgggaccccgggtcagaaatcgaggatagacagtaccagatcgatttacagagtattaatattgggactgcacagtggcatcagttgaaaccggagaaagaatccgtatccggcggggtggtgacagagacagaacgtaactctcagaatcccgccctggagtggaatatggcctccagcatccggaggcaccaggaacgccgtgccattttgacgcctgtgctgacagatttctctgtccggatcacaggagcgccagcagttattttcacgaaagtcgtctccccagaaaatttacacaccgaagagatcctggtgtgtggtcattcattagaggtgaacattacaactaatctggatttctttctgtcagtcgcccaagtccagctactgcaccaactcattgttgcaaacatgactgggttggaaccaagtaataaggcagcagagatctccaagcaggagcagaagaaggtcgatatttttgacggaggtatggccgaaacgagctccagatattccggcgcacaagatagtggcatcggcagcgattctgtgaaaatccgtattgttcaaattgagcaacattcaggggccagccagcatcgcatagcacgaccgtccaggcagtcaagcatcgtaaagaacctgaattttatcccttttgatatctttataacggcttcacggatctcattaatgacttacagctgcatggccttatccaagagcaagtcccaggaacagaagaacaacgaaaaaacagacaagagctccctgaacctgccggaggtggatagtgacgttgcgaaacccaaccaggcctgcatttcaaccgtcaccgctgaagatctgctacgctcttccatctccttccccagtggcaaaaaaataggcgtcctttctcttgaatcattacacgctagtactcgatctagtgctcgccaggccctgggcatcacaatcgtgcgccagccgggacggagaggcacaggtgaccttcagctcgagccattcctttattttattgtgtctcagccttcactcttactgagctgccaccaccgaaaacagcgagtggaagtgagtatcttcgatgctgtcctgaaaggagtcgcctcggattataaatgtatagacccaggtaagacgcttccggaggcgcttgattattgcacagtctggctacagaccgtgccaggcgaaattgactcaaaatcagggattccgcctagcttcattaccctgcagattaaagatttcctgaatggccctgcagatgtaaacttggatatctccaaacctctcaaggccaacctttcctttacgaagttagaccagatcaatttgtttctgaagaaaataaagaatgcccacagccttgcccattctgaggaaacgtctgccatgtcaaataccatggtcaataaggacgatttgccggtgtccaagtactacagggggaagctgagtaaacccaaaatccacggtgacggtgtgcagaaaataagtgcccaagaaaatatgtggcgcgcagtgagctgcttccagaaaatcagtgtgcagactacgcaaatcgttattagtatggagactgttccacacacatcaaagccatgccttctggccagtctcagtaacttaaatggcagcttgagtgtcaaggcaacacaaaaggtgccagggatcatcctgggttcatcattcctgctcagcattaacgatttccttttgaaaacatctttaaaggagcgctcacggatcctgatcggaccttgttgtgccactgccaacctggaagcaaagtggtgcaaacacagtggcaaccctggccccgagcaatctatcccaaagatttcgatagatctacgcggcggacttctccaagttttttggggacaagaacacctcaattgtctcgttctgcttcacgagcttttgaatggttacctaaacgaggaaggaaatttcgaagtgcaggtttcagagcccgtccctcagatgtccagccctgtggaaaaaaatcaaacgtttaaatccgagcagtcatccgatgaccttcggaccggactgtttcagtacgtgcaggatgcagagtccctgaagctgccaggcgtgtatgaggtgctgttctataatgagactgaggactgcccgggcatgatgctctggaggtaccccgagcctagagttcttacgctagttcgcattacccctgttccttttaatactacagaggacccagacatttctacagccgaccttggcgacgtattgcaggttccttgcagtctggaatactgggacgagctacagaaggtctttgtagcttttcgagagttcaacctgtccgagtctaaagtttgcgaactgcagttgcccgacataaatttggtgaatgatcagaaaaaactggtctcctctgacctctggaggatcgtgctcaattcttcacagaacggtgctgatgaccagtcatctgcatccgaatctggctcccagtcaacttgcgaccctttggttacaccgacggcactggcggcctgtacaagagtagatagctgttttaccccctggtttgtacccagcttatgcgtgagtttccaatttgcccatttggagttccacctctgccaccacctggaccagctgggcacggcagcgccccaataccttcagccattcgtgtccgatcgcaatatgccatctgaattggagtatatgatcgtcagctttagggaacctcatatgtacctgagacagtggaataatggttcagtgtgccaggagattcagttcctcgctcaggctgattgtaaattactggagtgcagaaacgtcactatgcagtccgtggttaaacctttctcaatattcggccaaatggcagtgtcttccgatgtagtggaaaaactcttggattgcacagttatcgtagactctgtgttcgtcaatttgggccagcacgtggtacatagccttaataccgccattcaggcctggcaacagaacaagtgccccgaggttgaggagctcgttttttcccactttgtcatctgcaacgatacgcaagagacattaagatttggccaggtggacaccgatgagaacattctgctggcctctttgcacagccatcagtactcctggagaagtcacaagtcgccacagttacttcatatttgcatcgaggggtggggaaattggcgttggagtgaacccttttccgtggaccacgcgggcacattcatcagaacaatccagtatagaggtaggacggccagccttataattaaggtgcaacaactcaatggagttcagaagcaaatcatcatctgtggaaggcagattatctgtagttatctttctcagagcattgagctcaaagttgtccagcattatataggccaggacggccaagccgtggtccgcgagcacttcgactgccttacagccaagcagaagctgcctagctacattttggagaataacgagctcactgagctgtgcgtgaaagctaagggagacgaagattggtcccgagatgtctgccttgagagtaaagcacccgaatactcgatcgtgatccaggtgccatcctctaatagttccatcatctacgtgtggtgtacagtcctaacactagaacccaacagtcaggtgcagcagcgcatgattgtattctctcctctgttcataatgcggtcgcacctaccggatccaatcataatccacctggagaagcgaagtctgggcctgtccgagacccaaatcatccccggcaaagggcaggaaaaacctcttcaaaacattgaaccagacttggttcaccacttgacgtttcaggctagggaggaatatgatcccagcgactgtgccgtcccaatctcaacttccctcattaaacaaatagcaaccaaagttcaccccgggggcactgtcaaccagatcctcgacgaattttacggtccggagaagagcctgcagcctatctggccctacaacaagaaggattctgatagaaatgagcagttgagccagtgggattccccaatgcgggtcaagctgagcatctggaaaccttacgtacgcacgcttctgatcgaactgcttccatgggctttactcatcaatgagagtaaatgggatctgtggctctttgagggcgaaaaaattgtactgcaagtgccagctggaaagatcataatcccccccaacttccaggaagcctttcagatcggtatttattgggctaacacgaatactgtgcacaaatccgttgccatcaagctagttcataacctcacctctcccaagtggaaggacggtggaaacggcgaagtggtcacactggatgaggaggcatttgtcgataccgagattagactgggagcctttccaggccatcagaagctgtgtcaattttgcatcagctcgatggtccaacagggtatccagatcatccagatcgaggataagacaaccattatcaacaatacgccttaccagatcttctacaagcctcagctgtcagtgtgtaacccacattccggaaaagagtatttccgcgtgcctgattccgctacgttttccatttgtccaggcggggagcaaccagccatgaagagttcgagcctcccttgttgggacctgatgcccgatatctctcagtccgtactcgacgcatctctcctgcagaagcagattatgcttggcttctctcctgccccgggcgccgattctagtcagtgctggagcctgcccgctatagtacgccccgagtttcctagacagtctgtggcggtacccctgggtaattttagggagaatggtttttgcactagagccattgtactcacttaccaggaacacttaggcgttacctacctgaccttgtcggaggacccttctccaagagttattattcacaatagatgccctgtcaaaatgttgattaaagaaaacataaaggacatacctaaatttgaggtttattgcaaaaagataccaagcgagtgcagcatccaccatgaactgtatcatcagatatcatcttacccagattgtaagacaaaagatctcctcccctctctattgctgcgggtagagcctctggacgaggtcacaaccgagtggagtgacgccatcgatatcaatagccagggcacccaggtggtctttctgactggatttggatacgtctatgttgacgtcgtgcaccagtgtggtactgtattcatcacggtggctcctgagggtaaagcgggcccgatactgacgaacaccaaccgagcccctgagaaaattgtgacctttaaaatgttcataactcagctatctctggccgtgtttgacgacctgacgcatcacaaggcaagcgcggaactgcttcggctgaccctcgacaatattttcctctgcgtggcccccggggcaggccccctgcccggggaagaacctgttgctgcactttttgagctatactgtgttgagatctgctgtggagatctgcagttggacaatcaactgtataataagagcaattttcattttgccgtgctggtgtgccagggcgaaaaggccgaacctattcagtgttctaagatgcagtccttgctgatttctaataaagaactggaagaatacaaagagaagtgtttcattaagctgtgcatcaccttaaatgaggggaaaagcattctctgtgacatcaatgaattcagttttgaactgaagcctgctaggctttacgtggaagacactttcgtctattacatcaagaccctgtttgacacttaccttccaaacagtaggttggccgggcattccacacatctttcaggaggaaaacaggtgctgccaatgcaggtgacccagcacgccagagcgctggtgaaccctgtgaaactacgaaagctcgtgatccagcctgtaaatttactcgtctctattcatgcttcacttaaactgtacatagccagtgaccatactccactttccttcagtgtttttgaaagagggcctatttttactactgcccgccagctggtgcacgctctggccatgcactacgcagccggagctttattcagagccggatgggtcgtcggcagcctcgacatactgggatcccccgctagtctagtacgatccattggaaacggagtggctgatttttttaggctcccttatgagggtttgacccgtggaccaggcgccttcgttagcggggtttctcggggcaccacgagctttgtaaaacacatttctaaaggcacgctgacttctatcacaaacctggcgacctcgcttgccagaaacatggatcggttatctttagacgaagagcattacaaccgccaggaggagtggaggaggcagctccctgagtccctgggagaagggctacgtcaggggctgagccggttgggaatatctctgctaggcgccatagcaggaatcgtggatcagcccatgcagaattttcagaagacctcggaggctcaggcttctgcgggacacaaagcgaaaggtgtcatctctggggtgggcaaggggattatgggggtgttcaccaagcccatcggcggggctgccgagcttgtgtcacaaaccggctacgggatcctccacggagcaggcctttcacagcttcctaagcagcggcatcaacctagcgacttacacgccgatcaggcccccaatagccatgtgaaatacgtctggaagatgctacaaagcttgggccgccccgaggtccatatggctctcgacgtggtgttggtgcggggaagcggacaggagcacgagggttgccttctccttacgagcgaggtgctgtttgtagtgtctgtgagcgaggatacccaacagcaggccttccccgttactgaaatagattgtgcccaagatagcaagcagaacaacctgctgactgttcagctcaagcagccacgagtagcttgcgacgtggaggtggacggagtgcgcgaacgtctgtcagaacaacagtacaacagactcgtcgactatataaccaagacatcttgccacctggctcccagttgtagtagtatgcagatcccctgtccggtggtggcagcagagccacctccaagtactgtcaaaacataccactacctcgttgatccacattttgcacaggtgttcctgtctaaatttaccatggtcaagaacaaggccctccgcaaagggttcccttag

SEQ ID NO: 52218 - DNA, 4284 bp, Artificial Sequence
  Description of Artificial Sequence: Synthetic coding sequence
atgctggagagctacgtgacccccatcctgatgagctacgtgaacagatatattaaaaatctcaaaccatcagatctgcagctgtcactctggggtggagatgttgttctctccaagctggagctcaagctcgacgtactcgagcaggaactgaaacttccctttacttttctttccgggcatatccacgaactgcgcattcacgtgccgtggacaaagcttgggagtgaacctgtggtcataacaatcaatacaatggaatgcatactcaagcttaaggacgggatccaggacgatcatgagtcctgcggcagcaacagcactaacaggagcaccgcagagagcacaaaatcctctatcaaaccccggcgtatgcagcaagcagcccctactgaccctgacttacccccgggttacgtgcaatcacttatcagaagggtcgtgaacaatgtgaatatcgtgatcaacaatctcattttgaagtatgtggaggatgatattgtactctctgtgaacatcacaagcgccgaatgttacacggttggcgaactatgggaccgggccttcatggatatctcagctaccgacctcgtgctccggaaggtaatcaacttttcggactgtaccgtttgcctggacaaaaggaacgcttctggcaagattgagttctatcaggaccctctgctgtacaagtgtagctttcggacacgccttcattttacttacgaaaacctgaattcaaaaatgccgtccgtcattaagatccacacccttgtggaatctcttaaactgtcaatcacagatcagcaacttccgatgttcatcaggatcatgcaactgggaatcgcactttattatggcgagattgggaattttaaggaaggagagatcgaggatttaacgtgccacaacaaggatatgctgggcaacatcaccggatccgaggacgagacaagaattgatatgcagtaccctgcacaacacaagggccaggaactctattcccaacaggatgaagaacaacctcagggatgggttagttgggcatggagttttgtgccggcaatagtgtcatacgacgacggggaagaggactttgtcggtaatgatcccgcctcaaccatgcaccagcagaaagcgcaaactctgaaagatcctatcgtgtctattggtttctactgcaccaaggctaccgtgactttcaaactcacagagatgcaagttgaatccagttactactccccccagaaagtgaagagtaaggaagtgttgtgttgggagcaggagggaaccacagtcgaggcacttatgatgggagagcctttcttcgattgccaaataggtttcgtcggatgtcgtgcaatgtgtcttaagggaatcatgggcgtgaaggatttcgaggaaaatatgaacaggtccgagactgaggcctgcttttttatctgtggggacaacttgtctaccaagggcttcacataccttactaatagcctcttcgattaccgctctcccgagaacaatgggacgagagcggaattcattcttgacagcactcatcacaaagaaacgtatactgaaattgctggcatgcaacgcttcggcgccttctacatggactacctctatacgatggagaacacatctggtaaaggatcaacgaatcaacaggacttttctagcgggaagtcagaggacttggggactgtgcaagaaaaatctacaaagtcactagtgatcggcccactcgacttcagactagattcttcggccgtacaccgcatcctgaaaatgatcgtttgcgctttagagcacgaatacgagccctactctagactgaaaagcgatattaaggacgagaatgagactatcctgaatcccgaggaagtcgctctgctggaggagtacattccaacaagacatacttctgttacgttacttaaatgcacttgtaccatctcgatggctgagttcaatctcctggaccatctgctgccagtaatcatgggagagaagaattcatctaacttcatgaataccacgaactttcagtcattgcggcccctgccgagcataaggattctggtcgacaaaatcaacctggaacactccgtccccatgtatgctgaacagctggtacatgtagtgtcaagcctcacgcagccttctgacaacctcctccattactgctacgtccactgctatttaaaaatttttgggtttcaggctgggctgaccagccttgactgcagtggatcctactgcttacccgtgccagtaatccccagcttttctacagccctgtatggaaagttgctgaaactgcccacctgctggactaagcgaagccagattgccattaccgagggaattttcgagctgcctaatctcaccatacaggccactcgcgcccagacgctccttctgcaggccatctatcagtcatggagccacctgggtaatgtgtctagttccgccgtgattgaggctcttatcaacgaaatttttcttagtataggggtaaagtccaagaatccgctccccacactggagggctcaatccaaaacgtggagttgaaatactgcagcacttcccttgtgaaatgcgcttctggaaccatgggcagtatcaagatctgcgccaaagcgccagtcgatagcggaaaggagaagctgataccgctgctgcagggcccaagcgatacaaaagatttgcacagtactaagtggctgaatgagagccgcaaaccggaatctttgctggcccccgacctgatggcttttactattcaggtgccccagtacatagactactgccacaacagcggtgcagtgcttctttgcagcatccaaggcctggctgtgaacattgaccctattctctacacctggctgatctatcagccacaaaaacgcacttctcggcacatgcagcagcagccagttgtcgccgtccccctggtcatgcctgtgtgccgcagaaaggaggacgaggttagcattggctcagcccctttggctaagcagcagtcctatcaagcatctgagtatgcgtcaagccctgtaaagactaaaacagtgacagaaagtcgccccctcagcgtgcctgtgaaggctatgctgaacatctctgagagctgcaggtcaccagaggagaggatgaaagagtttattgggatcgtctggaatgccgttaaacaccttaccctgcagctggaagtgcagtcttgttgtgtctttattcccaatgactccctgccttcaccaagcacaattgtcagcggcgatatacctgggaccgtccgatcctggtaccacggtcagacgtcaatgccaggtactctagtgctctgcttacctcagatcaagattatatccgcgggccacaagtatatggagccgctacaggagattcccttcgtgattccaaggcccatcttagaagagggagacgcctttccctggaccatatctctccataacttttctatatatacattgctaggcaagcaggttaccttgtgtctggttgaaccgatggggtgcactagcacactggcagtcacttcacagaagctgttagctacaggtccagatactaggcattcctttgttgtgtgcttacacgtagatctcgaaagcctggagatcaagtgctccaatcctcaagtacagttattttacgaactaaccgacatcatgaataaggtttggaacaagatacagaagcgcggaaatctgaacctaagcccaaccagtccggagacgatggccggacctgtgcccacatcacctgtacgcagttccattggcacagcaccaccggacacatctacttgctccccatccgctgatattggcactacaaccgaaggcgacagtatccaggcgggagaagagtcccccttttccgacagcgtgactctcgagcaaacgactagcaatattgggggaacatccggccgggttagtctgtggatgcaatgggtccttccaaagattactattaagctttttgcccccgaccccgaaaacaaaggcacagaggtctgcatggtaagtgagcttgaggaccttagcgcttccattgatgtgcaggacgtgtacaccaaggtgaagtgcaagattgaatcatttaacatcgaccattatcgctcaaggcctggggagggatggcaaagcggtcatttcgaaggggtttttctccaatgcaaggagaaatccgtgccgtggggtagggtgctcgtttttggtgccatgtggcgttgcttgccgttcttatactag

SEQ ID NO: 52219 - DNA, 1248 bp, Artificial Sequence
  Description of Artificial Sequence: Synthetic coding sequence
atgctggagagctacgtgacccccatcctgatgagctacgtgaaccgctatataaagaatctcaagccctctgacctccagctgtccttatggggcggggacgtcgtgctctccaagctggagctcaagctggacgttctcgagcaggagttgaagctcccatttacatttttgtccgggcatatccacgagctgcgaattcacgtgccttggacaaagctaggctcagaacccgtcgtcataacaatcaacaccatggaatgcatcctcaagttaaaggacggaattcaagatgaccatgaatcttgtggttcgaactctacgaacagatcaactgcagaaagtaccaaatccagtattaaaccaaggaggatgcaacaggctgcgcccaccgatcccgacctgcctccagggtacgtgcagagtctaatcaggcgtgtggttaataatgtcaacattgttatcaataatctgatattaaagtatgtggaggatgatatcgtgctctctgtgaacattacctctgccgagtgctacacagtcggcgagctctgggaccgagctttcatggatatttctgccacggacctggtgcttcgcaaggtgattaacttttcggactgtacagtgtgtcttgataagcgtaatgcttctggcaagattgaattttatcaggaccccctgctgtataagtgctcatttaggacacgtcttcactttacatatgaaaacctgaattccaaaatgcctagcgtgattaagatccatacacttgttgaatctttaaaattatcaataacagaccagcagttgcccatgttcattcggattatgcagctcgggattgctctttattacggagagatcgggaactttaaggagggggaaatagaggaccttacttgtcacaataaggatatgttagggaatattactggctcagaggatgagaccagaattgatatgcagtacccggcccaacacaagggccaggaactctattctcaacaagatgaggaacagccccagggctgggtatcctgggcgtggtcctttgtccctgccatcgtgtcatacgatgacggagaggaggacttcgttggcaacgatcccgcaagcaccatgcatcaacaaaaagcccagactctgaaagaccctatcgtgtcaataggattttactgcactaaggctaccgttacctttaaagtcggccttttcagctgttgtctgtacttgtaccagctgtag

SEQ ID NO: 52220 - DNA, 11133 bp, Artificial Sequence
  Description of Artificial Sequence: Synthetic coding sequence
atggtgctggagagcgtggtggccgacctgctgaaccggttcctgggggactatgtggagaatctcaataaatctcaactgaaattggggatatggggtggaaacgtggccctggacaacttgcagattaaagagaacgccttgtctgaactcgacgtgcctttcaaagttaaggcagggcagatagataagctgaccctcaagataccgtggaagaatctgtatggagaagccgtggtggccaccctggagggattgtatctccttgtcgtccccggagcttccatcaagtacgatgccgtcaaagaggagaaaagtttacaagacgtcaaacagaaggagcttagtaggattgaggaagctctccaaaaggcagctgagaaagacaagcccaaggaagccaagaaagatacattcgtcgagaaactagctacacaggtgattaagaacgtgcaggtcaagattacagacattcatatcaaatatgaggacgatgttaccgatccgaagcgcccactcagcttcggcgtaactctgggggagctgtctctcctgacggcgaacgagcactggaccccctgcattctgaatgaggcggacaaaataatttataaattgataagattagattcactctccgcatactggaacgtaaactgttcaatgtcctatcaaaggtcccgcgagcagatcctcgatcagctaaaaaacgaaattttgacaagcggaaacattccccccaattatcagtatatttttcagcccatctccgcttccgccaaactctacatgaacccttatgcagagagcgagctgaagacaccaaagctcgactgtaacattgaaattcagaatatcgccatcgagttgactaagccacagtatttgagtatgattgatttacttgaaagcgtagactacatggtgagaaatgctccctacagaaaatacaagccctacctgcccctgcacaccaacgggaggaggtggtggaaatatgccatcgactcagtgctggaagtccatatcaggcgatatacccagatgtggtcttggagcaatatcaaaaaacacaggcagctgctcaaaagttacaaaatcgcatataaaaacaagctcacccagagtaaggtgtccgaagagatccagaaagagattcaggacctcgaaaaaaccctggatgtctttaacatcattctggccagacagcaggctcaggtggaagttataagaagcgggcagaagctccgcaagaagtctgctgatacaggcgaaaagagaggagggtggttctctggactgtggggaaagaaggaatcaaaaaagaaagatgaggagtccttgattccagagacaatcgacgatcttatgacaccagaagaaaaagacaagttgtttacggctatagggtattccgagagtactcacaatttgacgctgccaaagcagtatgtcgcccatattatgactcttaagcttgtttcgacttctgtgaccattagagaaaacaagaatattccggagatactgaagattcagatcattggactcggcactcaggtgagccagcgtccaggcgcccaggctctgaaggtggaggcaaaactggagcactggtacataacggggctgagacaacaggatattgtgccgtccttggtagcctcaataggcgacaccacatcaagtctactcaagatcaagtttgagaccaatcctgaagattcccccgccgaccagactcttatagtgcagtctcaaccagttgaggttatctacgatgccaagacggttaacgccgtcgtcgagttctttcagtctaataagggcctggaccttgagcagatcacttccgcgaccctgatgaagctcgaagagattaaggagagaactgctaccgggctcacacacattattgaaacaagaaaggtactggacttacgcatcaatctgaaaccttcttaccttgtggttcctcagacaggtttccatcatgaaaagtctgacctgctcatcctcgatttcggcacgttccaactgaactccaaggatcaggggttacagaaaacaaccaacagttctctagaggaaatcatggacaaggcatacgataaattcgatgtcgagataaagaacgtgcagctcttatttgcccgggcagaagaaacctggaaaaagtgtaggttccagcacccttcgacgatgcacattctccagccgatggacatacacgtcgagcttgcaaaggcaatggtggagaaggatatccgcatggctaggttcaaggtctccggggggctgccgcttatgcacgtgcgaattagtgaccagaaaatgaaggatgtgctgtacctaatgaatagcatcccactgccacaaaagagctccgcacagtcccccgaaagacaggtgagctccatccctattatttcgggtggcacgaaaggtctgctggggacttctttgctgttggataccgtcgagtctgagtccgatgacgaatacttcgacgccgaggacggggaacctcagacttgcaaatcaatgaagggctccgagctgaagaaggcggccgaagtacctaacgaagagcttataaatctgctgttgaagtttgagatcaaagaggttatactggaattcaccaaacagcagaaagaggaggacacaattctagtgttcaatgtgacccagctcgggaccgaagcaactatgcgaacatttgatttgacggtagtctcttatctcaagaagataagtctcgactaccatgaaatcgaggggagtaaacggaaacctctacaccttatctcgtcttccgataagccagggcttgatttactaaaggtcgagtacatcaaggctgacaaaaacggaccatcttttcagaccgcatttggaaaaaccgagcaaaccgtgaaggtagctttctcgtcccttaacttattactgcagactcaggccctggttgcttccatcaactatcttactactataatcccaagcgatgatcaaagcatcagcgtagctaaggaggtgcaaataagtacggagaaacagcagaagaatagcaccctgcctaaagcaattgtttctagtcgagactcggacattatcgatttccgcctgtttgcaaagctgaacgctttttgtgtaattgtctgcaatgaaaaaaataacatagctgagataaagattcaaggattagattcttcactgtcactgcagagccgcaaacaaagtctgtttgcgcggttggaaaacatcattgttacagacgttgacccgaaaaccgtgcataagaaagccgtgtctatcatggggaatgaggtgtttaggttcaacttggacctgtacccggatgccacagaaggggatctttataccgatatgtccaaggtggacggagtgctctcgcttaacgtggggtgcatccagattgtgtatctgcataagttcttaatgagtctcctgaactttttgaataacttccagacagctaaagagtcactgagcgccgcgacagcgcaagccgccgagcgagccgctacctctgttaaggatctcgcccagcggagcttccgggtcagtataaatatcgaccttaaggccccagtcattgtgataccccagtccagcatatcgacgaatgcagttgtcgtggatctcggcttgataagagtccataatcagttctcactagtctcagacgaggattacctgaatccacctgtcattgatagaatggacgtccaacttactaagctgaccctctatagaactgtgattcagcccggtatttatcaccccgacatccagctcctccatcccattaacttagaatttctggttaaccggaatctggcagctagttggtaccacaaagttccagtggtggaaatcaagggtcatctggatagcatgaatgtgtccttgaaccaggaggatctcaacctgctcttcagaatcttgacggagaatctctgcgaaggaaccgaggacctcgataaagtgaaaccccgcgttcaggagactggggagatcaaggagcctttagagatcagcatttcccaggacgtccacgatagtaaaaatactctgaccactggagtagaagagatcaggagtgtggatattatcaacatgttactgaactttgaaataaaagaggtggtggtcaccctgatgaagaagagtgagaaaaaggggagaccattgcatgagctgaacgtgttacagttgggcatggaagctaaagtgaaaacctacgacatgactgccaaggcttacctcaaaaaaattagcatgcagtgtttcgattttaccgattcgaaaggtgagccactccacattattaattctagtaacgttacggacgagccactactgaaaatgctcttgaccaaggcggatagcgacgggccagaatttaagactatccacgatagcacaaagcagcgcctcaaggtctcatttgcaagcctcgacctggtgttgcaccttgaagccctgctttcctttatggactttctgagctccgcagctccattctcggagccaagtagttccgagaaagaaagcgagctgaaacctctcgtaggtgaaagtagaagtatcgccgtgaaggctgtttcctccaatatctcacagaaggacgtgtttgacctcaaaattacagcagaacttaatgcgtttaatgtgttcgtttgcgaccaaaaatgtaacatagcagacatcaagattcacggcatggacgcgagtatctctgtgaaaccaaagcagaccgacgtctttgccaggctgaaggacatcattgtgatgaatgtcgatttacaatctatacacaagaaagctgtgagtattctcggggacgaagtgtttcgattccagctcaccctctatccagatgcaacagagggcgaggcctacgcggatatgtctaaagtggatggaaaactcagctttaaggtagggtgtatacagattgtctacgtacataaatttttcatgagcctattgaattttctcaacaacttccaaaccgcgaaggaggctttgtccacagccaccgtgcaggccgcagagagggccgcctcaagcatgaaggacctcgcacaaaagagcttcaggttgctgatggatatcaatcttaaagcccccgttattatcatcccccaatcttccgtatcccccaacgcggtgattgccgacctggggctcataagagtggaaaataagttcagcctggtgccaatggagcactatagtctcccaccagtgatcgataaaatgaacattgaactcacacaactgaaattatcccgcactatcttgcaagcaagtctgccacagaatgacatcgagatactcaagccagtgaatatgctactgtcgatccaaaggaatctggccgcagcctggtacgtccagatccccggcatggaaattaaaggtaagctcaaaccaatgcaggtggctttgagcgaggacgacttaactgtcttgatgaagatcctgcttgaaaatctgggggaggctagttcccagccttcacctactcagagcgtccaggagactgttcgagtgagaaaagttgatgttagctcagtccccgaccatctgaaggaacaggaagactggacagattccaagctcagcatgaatcaaatagtttccctgcagttcgattttcacttcgagtccctctctatcatactgtacaataacgacatcaatcaggagtctggtgtggcctttcataatgactcctttcagttgggggagctcagactccatctgatggcttctagcggcaaaatgttcaaagacggttctatgaacgtttcagtgaaactgaagacatgcacccttgacgatcttcgggaggggattgaaagggctactagccgcatgatagaccgaaaaaatgatcaagacaataatagctctatgatcgacatttcctataaacaggataagaatgggagtcagattgacgccgtacttgataaactgtacgtctgcgcaagtgtcgaatttctcatgaccgtggcggacttcttcattaaggctgtgcctcaatctcctgaaaacgtcgctaaggaaacccagattctgccaagacagacagccacgggtaaggtcaagattgagaaggacgactcagtcagaccaaacatgactctgaaggcaatgattacggatcctgaagttgtgttcgtggccagcctgaccaaggctgacgctcccgcactgaccgcctctttccagtgtaacctgagcctgtctaccagcaaactagagcaaatgatggaggcgtcagtgagagatcttaaggtgctggcttgcccattcctgagagaaaagcggggcaaaaatataactacagttctacaaccctgttctcttttcatggaaaaatgtacatgggctagtggcaagcagaatattaacataatggtgaaagagttcataattaagatcagcccaatcattcttaatacggtgctgacaatcatggccgctctcagccctaagacaaaggaggatggcagcaaggacacgagtaaggaaatggaaaacctgtgggggatcaagagcataaacgactataatacttggttcctgggcgtggacaccgccaccgaaatcaccgagagctttaagggtatcgagcatagcttgatcgaagaaaactgtggcgtggttgtggagtccatacaggtaaccctcgaatgcggccttggccatcggaccgtaccattgttgctggctgagagtaagttctccggcaacataaaaaactggacaagcctgatggcagctgtggcagatgtgacattgcaggtgcactattataatgagatacacgcagtgtgggagccactcattgaacgagtggaagggaaaaggcagtggaacctgagactggatgttaaaaaaaaccctgtgcaggataagtcgcttttgcccggcgacgatttcatccctgagcctcagatggccattcatatttcatcaggaaatacaatgaacatcacaatttcaaagtcatgtcttaatgtgtttaataacctagccaaaggattctccgagggcaccgcctctaccttcgattatagcttaaaggatcgcgctccctttaccgtgaagaatgcagtgggggtgcccatcaaggttaagcccaactgtaacctgagggtcatgggctttccggagaaatccgacattttcgatgttgacgcgggacagaacctcgaactggaatacgctagtatggtgccctcttcccaggggaacctgtccatccttagtcgacaagagtctagttttttcaccctgaccatcgtcccccatggctacaccgaagtggccaacatacccgtcgctagaccggggaggcgtctctacaacgtacgaaatcctaatgcctctcactcagactccgtgctcgtgcagattgatgctacggaaggcaataaagtgataactctcaggtcaccattgcagattaagaaccacttttccattgctttcatcatttacaaatttgtgaagaacgtgaagctgttagaacgtatcggcattgcccgaccagaggaagagttccatgtgcctctggactcttataggtgtcagttgtttatccagccggccgggattctggagcatcagtacaaagaatcaacaacctacatctcttggaaggaggagctgcaccgctctagagaagtacggtgtatgctccagtgcccctcagtcgaggtgtcctttctgcctctgattgtgaacaccgtagcattgcctgacgagctcagctatatctgtacgcatggtgaagattgggacgtggcatacataatccacttgtatccatccctcaccctccgcaacctgctgccatactcactgcgctaccttctggaaggcactgctgaaacgcacgagctcgctgagggcagtaccgccgatgttctccattcaaggattagtggcgagatcatggaactggtactggtgaagtaccagggtaaaaattggaatggccatttccgtatccgtgacaccctgccggaatttttccccgtttgttttagcagtgattccacagaagtgacaactgtggatctgtctgtgcatgttcgtaggatcgggtccagaatggtcctgagcgtattttccccttattggctgataaacaaaactactagagtgctgcagtacaggtctgaggatatccatgtcaagcatccagccgatttccgcgatatcatcctgttctcctttaagaaaaaaaacattttcaccaagaacaaagtgcaactgaagatctcaacatccgcttggtcgagctcattctcactggacacagtgggctcatacggatgcgtgaagtgtcccgctaacaatatggaataccttgtaggagtgagcatcaagatgtcgagctttaacctcagcagaatcgtgacgctgactcctttttgtacaatagcgaacaagtcgagtttagaattagaagttggcgagatcgctagcgatggctctatgccaactaacaaatggaattatatcgcctccagcgaatgccttcctttttggccagaatcgcttagcggaaagctctgtgtgagagtagtcgggtgcgaaggatccagcaaaccattcttttataacagacaagataacggtacactgttatccttggaagacctgaatggcggaatactcgtggacgtgaataccgctgaacacagtactgtcatcactttttcagactatcacgaaggcagcgcgcctgcactaatcatgaatcatactccttgggatattttaacctacaagcagtccggctccccggaggaaatggtccttctcccacgtcaggcccggctattcgcatgggcggaccctactggaacccggaagcttacatggacctacgcagctaatgtgggcgaacacgaccttctcaaagacggctgtggccagttcccgtacgatgctaatatacagatccactgggtctcttttctggacggtagacagcgtgttctcctgtttacagatgatgttgcactcgtgtccaaagctcttcaggctgaggaaatggagcaggcggactacgaaatcactctaagtctccatagtttggggctctcgctggtgaataatgagagtaagcaagaagtgtcctatatcgggattacctcttccggcgtcgtgtgggaggttaaaccaaagcaaaagtggaaaccattctcccaaaaacagattatcttactggagcaaagctaccagaagcaccagatatcaagggatcacggatggataaagctggacaataacttcgaagtgaattttgataaggacccaatggaaatgcgcttgcccatccgtagtcccattaagcgagatttcctcagcggcattcagatcgaatttaaacagtcatcccatcagcgatccctgagggcaaggttgtactggttgcaggtggacaatcagctgcccggcgctatgtttcctgttgtttttcaccctgttgcgcctccaaaatcaattgcgctcgactctgagccaaaaccgtttatcgacgtatctgtgatcacacgctttaatgagtacagcaaggtccttcaatttaaatattttatggtgctaattcaggagatggcactgaaaatcgatcagggctttttaggggcaatcatcgcactgttcacgccaacaacggaccccgaagctgaaagacgaagaactaaactgatccagcaagatattgatgctctaaacgcagaattgatggagacatcgatgaccgatatgagcattttaagtttttttgagcactttcacatttccccagtgaaattgcacctgtccctatctctgggttccgggggtgaagagagcgataaagaaaaacaagagatgttcgcagtgcactctgttaacctactgcttaaaagcataggcgccacactcacagatgtcgacgatcttatctttaagttggcatactacgagatccgataccaattctataagcgcgatcagctgatttggtcagtggttagacattacagcgaacagttcctcaaacagatgtatgtgctggtcctgggtttggatgtgttagggaaccccttcggacttatccggggcctgtccgagggagtggaggcactattctatgagccattccaaggagccgtacaaggacccgaggagttcgctgagggtttggttattggggttcgttccctttttggtcacacggttgggggggccgccggcgttgtaagtcggatcaccggctctgtcggtaagggactggccgcgataacaatggacaaggaataccagcagaagcgccgcgaagaactgtccagacagccccgcgactttggtgatagccttgccagggggggtaaagggtttctgaggggcgtggtggggggagtcacaggcatcattactaagcccgtcgaaggcgccaagaaggaaggggccgcgggcttcttcaagggaatcgggaaagggctcgtgggcgccgtggctagaccaactgggggtatcgtggacatggcctcaagcaccttccagggtattcaacgcgcagctgagtcgaccgaagaagtttcatccttgcggccaccaaggctgatccacgaagatgggattataaggccctatgacaggcaggagtctgaaggtagcgatctgctagagaaccacataaaaaagctggagggcgagacctaccggtaccactgcgccatccccgggtccaaaaaaactatcttgatggttactaaccggagagtcctgtgcatcaaagaagtggaaatccttggcctgatgtgcgtggattggcagtgtccgttcgaagatttcgtgttccccccctccgtgagtgagaatgtgttaaagatttctgtaaaggaacagggactttttcataagaaggactccgctaaccaaggatgtgttcgtaaggtgtacctgaaagatactgccacggcagagagagcgtgcaacgccatcgaggatgctcagtcaactcggcagcaacagaagctgatgaaacagtcctcagtgcggctcctgcgcccccagctgcctagctag

SEQ ID NO: 52221 - DNA, 11262 bp, Artificial Sequence
  Description of Artificial Sequence: Synthetic coding sequence
atggtgctggagagcgtggtggccgacctgctgaaccggttcctgggtgactacgtggaaaacctcaacaaatcgcagctgaagctggggatctgggggggaaacgtggcactcgacaatctccagataaaggaaaatgcactgagcgaattagacgtgccctttaaggtgaaagctggacagattgacaagctcaccctgaagatcccgtggaagaacttgtatggtgaagcggtcgttgccactctggagggcctttacctccttgtggtccctggcgcctctatcaagtacgatgccgtgaaagaagaaaaatcccttcaggacgtaaagcagaaagagctgtctcgcatcgaagaggccctccagaaagccgctgagaaagggactcattccggggagttcatctacggtctcgagaacttcgtgtacaaggacataaaacccggaagaaagaggaagaagcacaagaaacacttcaagaaaccattcaaggggctcgaccgttcgaaggataagccaaaagaagccaagaaggacaccttcgtggaaaagttggctacccaggttatcaagaacgttcaagtaaagattacagatatacacatcaaatatgaagatgacgtgaccgatcctaagcgtccattgtcgttcggagtcacacttggagagctgtcactactgaccgccaacgagcactggacaccttgcatcctcaatgaggctgataagataatctacaaactgatccgcctggactccctctccgcatactggaacgtgaattgttccatgagctatcaacggtcacgggagcagatactcgaccaactgaagaatgagatcttgacatcaggcaacatacccccgaattatcagtatatattccagccgatatctgcttcggcgaaactgtacatgaacccatacgcagagtcagaactcaagaccccaaagctggactgcaacattgagatacagaacatcgctatagaattgaccaaaccgcagtatcttagcatgatcgacctgcttgagagcgtcgattatatggtccgtaatgcaccctacaggaagtacaagccttatctgcctctgcatactaacggccggcgttggtggaaatacgcgatcgattccgttcttgaggtgcatattcgcagatatacacaaatgtggagttggagtaacattaaaaagcatcggcagctgttaaagtcttacaagattgcctataagaataaattgacccaaagcaaagttagcgaggaaattcagaaagaaatccaggatctggaaaagacattggatgtgttcaatatcatcctggctcgtcagcaggcccaggtagaagtcatcaggtccggacagaagcttcggaagaaatcagccgacaccggcgagaaaagaggcggatggtttagcggcctttggggcaagaaggagtctaagaaaaaggatgaagaatccctcatcccagagactatcgacgacttaatgacaccagaggagaaagataaattattcaccgctattggctactctgaatccacacacaatcttacactgccgaagcagtatgtggctcatataatgactttgaagctggtgagcaccagtgtgaccattagggagaacaagaatattcccgaaatcctcaagatccagatcataggcttgggaacacaggtgtcccaacggcctggagcccaggcactcaaggtggaagccaagctggaacattggtacatcaccgggctgcggcagcaagacatcgtcccatcccttgtggcctctattggggataccacttcttccctattgaagataaagtttgagaccaaccctgaagactcaccagccgatcagacgctgatcgtgcagtctcagccagttgaagtcatctacgacgcaaagaccgtcaacgccgttgtggagttctttcaatctaataaagggctggacttagaacagataaccagtgccactctaatgaaactcgaggagatcaaagagaggacggcaactgggttaacgcatatcattgaaactcgaaaggtgctggacctgcgcataaatctcaaacccagttacttggtggtgccacagaccggatttcaccatgagaaaagcgacctcttaattcttgatttcggaacctttcagctgaactcgaaagatcagggcctgcaaaagaccacaaactcgtcacttgaagagattatggataaggcttacgacaagtttgacgtggagatcaaaaatgtacagctcctgttcgcgcgcgcggaagagacgtggaagaagtgtaggtttcaacacccctccacaatgcacattctgcagcctatggacattcatgttgaattagcaaaggcgatggttgaaaaggatattaggatggctaggtttaaagtgtccggtggactcccgcttatgcacgtgcggatttccgaccagaaaatgaaggacgtgctgtacctcatgaactccatacccctaccacaaaagtcctcagcccaatctccagagcgtcaggtgagcagcattccaatcatcagtgggggaacaaaaggcctgttggggaccagtctgctcctggatacagtggagtcggagagcgacgacgagtacttcgacgccgaggacggagagccgcaaacttgtaagtctatgaagggtagcgaattaaagaaggcggctgaggtccctaacgaggaacttataaacctcctcctgaaattcgagatcaaagaggtcatccttgagtttactaaacagcagaaggaagaggataccattttggtgtttaacgtgacgcaactcggcacggaagctacaatgcgtacctttgacctcactgtagtctcgtatctgaaaaaaatcagcctcgactaccatgaaatcgaagggtctaagcgcaagcctctccatctgatatccagcagtgacaaacccggattagatttgttgaaggtggagtatatcaaggcagataagaacggcccctctttccagacagcattcggtaagactgagcagaccgttaaagtcgctttctcgagcctcaaccttctcttgcagacccaagcactagtggcaagtatcaattatcttacaacgattataccttccgacgatcagtcaatttctgtggcaaaagaggtgcagattagcaccgagaaacaacagaaaaacagcactttacctaaagcaattgtgtccagccgggactctgatatcatcgattttcggctgttcgctaagctgaacgctttttgtgtgatcgtttgtaatgaaaagaataacatagccgaaattaagattcaggggctggacagctctctatcactgcagagcaggaaacagtcgctgttcgccaggctggagaacattattgtaactgacgtagatccaaaaaccgtgcataaaaaagctgtcagcatcatgggaaatgaggtgttccgcttcaacctggacctgtaccccgatgcaaccgaaggagacctctatacagatatgtctaaagtcgatggtgtgttatcactaaacgtggggtgtatccagattgtgtatttacataagttcctaatgagcctcctaaattttctgaataattttcagacggcaaaagaatccttgtccgccgccaccgctcaggcggctgaacgagcagcgacaagcgtgaaagatcttgcccaaagaagcttccgggtgagcataaacatcgatctgaaggccccagtgattgttatcccccagtcttccatctccacaaacgcagttgttgtggacttgggattgatcagggtgcacaaccagttctccctcgtcagcgacgaggactatttgaatcctccagtgatcgatagaatggatgtccaacttaccaaactgaccctctaccggacagttattcagcccggcatctaccaccctgatattcagctgctccatcccatcaatttggaatttctagtcaacaggaatctggctgcttcatggtaccacaaagttcctgtggtagagatcaaaggccacctcgattctatgaatgtcagtcttaaccaggaggacttaaatctcctatttcgaatcctcacagagaacctgtgtgagggcacagaggatctggacaaggtcaaaccccgagtacaggagaccggagagataaaagagccactcgagattagcatttcccaggacgtccacgacagcaaaaataccctcaccaccggcgtggaagagattaggagtgttgatattatcaatatgctgcttaatttcgaaataaaggaggttgtggtaactctcatgaagaaatcagaaaaaaaggggcggcctctgcatgagctcaatgtactccaattggggatggaggctaaggtgaagacttatgacatgactgctaaggcctatttgaaaaagatctccatgcagtgcttcgattttacagattctaagggcgaacccctgcacattatcaattcctctaacgttaccgatgaaccgctacttaaaatgctgcttaccaaagcagactctgacggcccagaatttaaaaccatccatgactcaaccaagcagaggctgaaggtgtcctttgccagcttggatctcgtgctgcatttagaggcgctcctctccttcatggacttcttgagttccgcagccccgttctctgagccatcaagttccgaaaaggaatccgaattgaagcctctcgttggcgagtctagatcaatcgcagttaaggcggttagctctaacatttcccagaaggacgtgttcgatctcaagataacggctgagttgaatgccttcaacgtgtttgtgtgtgatcagaaatgtaacattgccgatatcaagatacacggcatggatgcttcaatttccgtgaagcctaaacagaccgacgtgtttgcaagactcaaggacatcatcgtgatgaacgtggacctgcagtcaatccacaagaaggccgtgtctatccttggggatgaagtgtttagattccaattaacactctacccagacgctacagaaggtgaggcctatgcagacatgagtaaagtggatggaaaactgtctttcaaagtcggctgtattcagatcgtgtatgtacacaaattcttcatgtccctgctcaacttccttaacaattttcagaccgccaaggaagccctgtcgaccgcaactgtacaagccgccgagcgcgccgcatcttccatgaaagatctggcccagaaatcttttaggctgctgatggacatcaacttgaaggcccctgtgataattattcctcagtctagcgtctctccaaacgctgtcatagccgacctgggcctgataagggtggaaaataaatttagcttggtgcccatggagcactattctctgccacccgtgatagacaaaatgaacatcgagttgactcaattgaagctcagtagaaccattctacaggcttcactgccccagaatgacatcgagatattgaaacccgttaacatgctcctgagtattcagcggaaccttgcagctgcgtggtatgtgcagatcccagggatggaaataaaaggcaaactgaagccgatgcaggtggctctgtccgaggacgatttgacagtgttgatgaaaatcctattggagaatctgggagaagcctcaagccagccatcaccaacacagtcagtgcaggagaccgtgagagtaaggaaagtggacgtttcctctgttcctgaccacctgaaggaacaggaggattggacggacagcaagctttcaatgaaccagattgtgtccctgcagttcgactttcatttcgagagcctgtcgattatcctctacaacaacgatattaaccaggaaagcggcgtcgcctttcacaacgattcctttcagttaggagagttgagactgcacctgatggcctcgtctggaaaaatgttcaaagacggatcgatgaatgtatctgtcaaactcaagacctgtaccctcgatgacttacgtgaaggcattgagcgcgccacctctcgcatgatagacaggaaaaatgatcaggacaataactccagcatgatcgacatatcctacaaacaggataagaacggctctcagatagacgctgtgcttgataagttgtacgtgtgtgctagtgtagaatttctgatgacagttgccgacttcttcatcaaggccgtgccacaatccccggaaaacgttgccaaggagactcagatcttgcccagacagacggccaccggcaaagtcaagatcgaaaaggacgacagcgtccgcccaaacatgaccctgaaagccatgataaccgacccagaagtggtattcgtggcgagcctgactaaggccgacgcaccagcccttactgccagctttcagtgcaacttgtctctgagcacatctaaactcgagcagatgatggaagcttctgttagggacttaaaggtgctcgcttgcccatttctaagagaaaagaggggaaagaatatcaccacagttctccagccctgctcactgttcatggagaaatgcacatgggccagcggaaagcagaatataaacatcatggtgaaagagttcatcattaaaatttcaccgattatcctgaacaccgtgctcactatcatggctgctctgagccctaagacaaaggaagatggtagcaaagatacctctaaagagatggagaatctgtggggaatcaaatccataaatgattacaatacttggttcctcggggtggatacggcaacagaaatcaccgagagttttaaaggcatcgagcactctctgattgaagagaattgcggggtcgtagtggagtcaattcaagtcactctcgaatgcggattgggtcaccgtaccgtccctctcctcctggccgagtcgaagtttagtggtaatattaaaaactggactagtcttatggcagctgttgccgacgtgacgttgcaagtgcactactacaacgagatccatgcagtttgggagcctctgatcgaaagagttgagggaaaaaggcagtggaatcttcgactggatgttaagaaaaatcctgtccaggataagagtttgttgccaggcgacgatttcatcccagaacctcagatggccatccacataagttccggcaatacaatgaacattacaatttcaaagtcatgcctcaatgtgttcaataacctagccaagggattttcggaaggcaccgcctccacattcgactactctctcaaagaccgcgctccctttactgttaaaaatgcggtaggagtgcccattaaggtcaaaccaaactgtaatttgcgtgtaatgggcttccctgaaaagagtgacatctttgatgtcgacgcaggtcagaatctggagctcgaatacgcatcaatggtgccttcatcccagggcaacctgagcatcctcagcagacaggagtccagttttttcacccttacaattgtgcctcacggctatacagaggttgcgaatatcccggttgccaggcccggccgccgtctgtacaatgtaagaaaccctaatgcctcacactccgactccgttctggttcagatcgatgctacagagggaaataaagtgataacactgcgctctcccctgcagatcaaaaaccatttcagtattgcatttatcatctacaagttcgtgaagaacgtaaagttgttggagcggattggtattgcacggccggaggaagagttccatgtgccactggattcttatagatgtcaactgttcatccagcccgccgggatcttggaacatcagtacaaagagtctacaacatacatcagctggaaagaagagttacacaggtcccgggaggtgcgatgtatgttgcagtgcccatctgtagaagtcagcttccttcctttgatcgtgaatactgtcgcactgcccgatgaactgagctatatctgcactcacggagaggattgggacgttgcctacatcattcatctgtatccgtccctgacactccgaaacttactcccctattccttaagatacctcctggaaggaaccgccgagactcatgagttggcagaagggtcgacggcagatgttctgcactcacggatctctggagagattatggaacttgtgctagttaagtaccagggcaaaaactggaacggccattttaggatcagagataccctgcccgagtttttccctgtctgcttttcttctgattcaacagaagtgactactgtggaccttagcgtgcatgtacgcaggattgggtcacgcatggtgctgagcgttttctctccttattggctaatcaacaaaactactagagtcctccagtatcggtctgaggatattcatgtgaagcacccagccgattttcgggatatcatcctattttcattcaaaaaaaaaaatatcttcacaaaaaataaggtgcagttgaagatcagcacttcggcctggtcctcttctttctccctagacacggtcggctcctatggctgcgtaaaatgtccagccaacaacatggaataccttgtcggtgtgtctatcaagatgagctccttcaatttgagcaggattgtcacgttgacacctttttgcactatagctaataagtcatcccttgagctggaagttggtgaaatcgcctccgacggcagtatgccgacaaataagtggaactatatcgcgtccagcgagtgtctgcctttttggcctgagtccctgagtggtaagctgtgcgtgcgggttgtcggttgtgaaggctcaagtaaaccgttcttctataaccgacaagacaacgggacgctcttatcactggaagacttgaacggtgggatactggtggacgtaaacacagccgaacattccacggttatcactttttccgactaccacgagggctctgctccagctctgatcatgaaccacactccatgggacatattaacttacaaacaaagcggttctccagaggaaatggtgctgctccctcggcaagcgaggctgtttgcgtgggccgacccaactggtacccggaagctgacttggacatatgctgccaacgtgggtgagcatgatctgttgaaggatggctgcggccagttcccatatgatgcgaatattcagatacattgggtgtctttcctggatggaaggcaacgcgtgctcctgtttacagacgacgtcgccttggtctcgaaggcattacaggccgaagaaatggagcaggcggactatgaaatcacgctgtctctgcattctctgggtctgtccttggtcaacaatgaatccaaacaagaggtgtcctatataggtatcacgagcagcggagtggtctgggaggtgaaaccaaagcagaagtggaagcccttctcccagaagcaaatcattctgttggagcaaagctaccagaagcatcagatctcacgggaccacggctggatcaaactggacaacaatttcgaggttaattttgataaagatccaatggagatgaggcttccaatacggtcaccgatcaagagggattttctcagcgggatccaaatcgaattcaaacagagcagccaccagagaagtctcagggctcggctctactggctgcaggttgacaaccagctgccaggtgcaatgtttccagttgtctttcacccagtagctcctccaaagtcaatcgcgcttgatagcgagcccaaacctttcatagacgttagcgttatcaccaggtttaacgagtactctaaggtgctgcaatttaagtactttatggtcctgattcaagagatggccttgaagatcgaccaagggttcttgggagcaataatcgcgctgttcacccctacaacagacccagaagccgagaggcgtagaaccaagttgattcagcaggacatcgacgccctgaatgcagaacttatggagacatcaatgacagatatgagtatcctcagcttttttgagcactttcacatttctcccgtgaagctacatctatctctcagcttaggatccggcggggaggagtcagataaggaaaagcaagagatgtttgccgttcattctgttaatctgctgcttaagtctattggagcaactctcaccgatgtggacgatctgatctttaaactcgcctactacgagatcaggtatcaattctacaaaagggaccaactcatatggtctgtggtgcgccattatagcgagcagttcctaaagcagatgtacgtcctggttctgggactcgacgttcttggaaatcccttcggactcattagagggctctctgaaggagttgaggccctcttttatgagccattccagggagcggtgcagggtccagaggagttcgccgaaggccttgtgatcggggtccgaagcctgttcggacatacggtcggaggtgctgctggtgtggtgtctaggatcaccggctcagtgggcaaaggcctggccgcgattactatggacaaggagtaccaacagaaacgtcgcgaggagctttcccgacagccgagggattttggcgattcgctggctaggggcggaaaggggttcctgcgcggcgttgtgggtggcgtgactggcattataaccaagcctgtcgagggcgctaaaaaagagggagcagcaggcttttttaagggaattgggaagggtttggtaggtgcggttgccagaccaaccggtgggattgtcgatatggcttcatcaactttccaaggcatccaacgagcagcggaatccacagaagaagtgagttcgctaaggcccccaagactaattcatgaagacgggattattcgcccttacgataggcaggaatccgaggggagcgacctcctggaaaaccatatcaaaaaactggaaggagagacttaccggtatcactgtgccattccgggctccaagaagaccatcctgatggtaacaaaccgaagagtgctgtgtattaaagaagtcgagatccttggcctgatgtgtgtggattggcagtgcccttttgaggacttcgtgttccctccatcagtgtccgaaaacgtcctcaagatttctgtcaaagaacagggcttatttcacaagaaggactccgccaaccagggctgcgttcgcaaggtgtaccttaaggataccgccactgccgaaagagcctgtaacgcaatcgaagacgctcaatctacgcggcagcagcaaaaattgatgaaacaaagttcagtacggttactgaggccgcagctgcccagctag

SEQ ID NO: 52222 - DNA, 10887 bp, Artificial Sequence
  Description of Artificial Sequence: Synthetic coding sequence
atggtgctggagagcgtggtggccgacctgctgaaccggttcctgggtgactacgtggagaatcttaataagagtcagcttaagctgggcatctggggagggaacgtcgcgcttgataacctgcagatcaaagagaacgcgctctccgagctggacgtccccttcaaggtgaaggcaggacagatcgataagctgactttgaaaattccatggaagaatctgtatggggaggcagtcgtggctacgctggaggggctttatttgctggtagttccaggcgcctcaatcaaatatgacgccgtcaaagaagaaaaaagcttgcaagatgttaagcagaaggaactttcccgaatagaagaggcactccagaaggctgctgaaaagggtacacactccggagagtttatctacgggttagagaacttcgtgtataaggacataaagcccggacgaaaaagaaaaaaacacaaaaagcatttcaagaagccctttaaggggcttgataggagcaaagataagccgaaggaggcgaagaaagacacatttgtcgaaaagctggccacacaggtaatcaagaatgtgcaggtaaaaataacagacatccatatcaaatacgaagacgacgtgaccgacccgaagcgtccgctgtccttcggcgtaacgctcggcgagcttagtctgctaacggctaatgagcactggaccccttgcatccttaacgaggcggacaagataatctacaaactgattcggctggactcactcagcgcctactggaacgtaaattgctccatgagttatcagcgttcacgtgaacagatactggaccagctaaagaatgagattctgaccagcgggaacattcccccgaactatcagtatatcttccagccaataagcgcgtctgcaaaactgtatatgaacccttacgccgaatcagagctgaaaacacctaaactggattgcaatattgaaatacagaacatcgccatcgaacttaccaaaccccagtatctgtcaatgatcgaccttttggaaagtgtagactacatggtgagaaatgccccgtatagaaagtacaagccctatcttccactccacacaaatgggagaagatggtggaaatacgccattgactccgttctggaggtgcacattcgcaggtatactcagatgtggagctggtcaaatattaagaagcaccgacagctgctcaagtcttacaagatcgcttataagaacaaactcacccagagtaaagtgagcgaggagatccagaaggagatacaggacttggaaaaaaccctggacgtcttcaacatcattctggcacgccaacaggcgcaggtggaagtaattcggtcaggccagaaactccgcaagaagagcgcagacacaggggagaaacggggcggatggttctctggtctatgggggaagaaagaaagcaagaagaaagacgaagagagcttgattcccgagacgatcgacgaccttatgaccccggaggaaaaggacaagctgttcacagctattggctacagtgaaagcacccacaacctgactctgccaaagcagtatgtggcccatatcatgaccttgaaactggtgtcaacaagcgtcaccatccgcgaaaacaagaacattcccgagatactcaagatacaaatcattgggttgggcactcaggtaagccagcgcccgggagcccaggccctgaaggtggaggcaaagctggagcattggtacattacggggttgcggcagcaagatattgttcccagcttagtcgcttctatcggggacactacaagctcactgctgaagattaagttcgagaccaacccagaggactcgcccgctgatcagacactaatcgtgcaatctcagcctgtggaggtgatatatgatgctaagaccgttaacgccgttgtggagttttttcagtctaataagggtctggacctggagcaaatcaccagcgcaaccctgatgaagcttgaagagatcaaggaaaggacagcaactggcttaacccacattatcgaaaccaggaaagtgctggatctgcggataaacctgaaaccatcctatctggtcgtgcctcagacaggctttcaccatgaaaaaagtgatttgctgattctggattttgggaccttccagcttaactctaaagaccagggccttcagaagacgacgaattccagcctggaagaaatcatggataaggcctatgataagtttgatgttgagatcaaaaacgtccagctcttgttcgcgcgggcagaagaaacttggaagaagtgccggttccagcaccccagcactatgcacatcttgcagcccatggacatccatgtcgagctggcaaaggctatggtggagaaagacattcgtatggcacggtttaaagtgtccggagggttacccttaatgcacgtccgtatatcggatcagaagatgaaagacgtcctctacctgatgaatagcatccccctgccccaaaagtcctcggcccagagtcctgaacgccaagtcagctctatccctatcatttcaggaggcacaaaaggcctcctgggcaccagtctgctgctggacaccgtcgagagcgagtcggatgacgaatacttcgatgctgaggacggcgagccacagacctgcaagtctatgaagggcagtgaactcaagaaagcagccgaagtgcccaacgaggaactgatcaatctgctactaaaatttgaaatcaaggaggtcatcctggagtttaccaagcagcaaaaggaggaggataccatcctcgtatttaacgttactcagttggggacggaggccaccatgagaacattcgatctcacagtggtcagctacctcaagaagataagtcttgactaccatgagatagagggttctaagcgcaaaccactgcacctgattagcagctcagacaagcccggcttggacctgcttaaggtcgaatacataaaggcggacaagaacgggccttcgttccaaacagccttcggcaaaactgagcaaactgtcaaagtggctttctcctcacttaacctgctgttgcaaactcaagccttggtcgcatccatcaactacctaaccaccattataccaagcgacgatcagtccattagcgtagcaaaggaagtacaaatcagcaccgagaagcagcagaagaattctacgttacccaaggcaattgtttcttcaagggattccgatatcatcgacttccgtctgttcgcaaaactgaatgctttctgcgtgattgtctgtaatgagaaaaataacattgccgaaatcaagatccagggcctggactcaagtttgtccctgcagagcagaaaacagagcttattcgctaggctcgaaaacatcatcgtgactgacgtcgatccaaaaacggtccacaaaaaggcagtcagtatcatgggcaatgaggtcttcagatttaacctggacctgtatcccgacgccactgagggtgacctctacacagatatgtcaaaagttgacggtgtgctgagtctgaatgtggggtgcattcaaatagtctacctccataagtttctgatgtctttgctgaactttctgaacaacttccaaaccgcgaaagaatccctgtcggcagccaccgcccaagccgcagaacgagccgctacctccgttaaggacctggctcaaaggtctttccgtgtgtccattaatattgatttgaaggcgccagtgatcgtcattcctcagtcttcgatcagcaccaatgctgtggtggttgatctcggcctcattcgagtgcacaatcaatttagcctcgtgtcagacgaagattacctgaacccccctgtcattgatagaatggacgtgcagttgaccaaactgaccctttaccgtactgtgattcagcctggcatttaccaccccgatatccaactattgcaccccattaatctggaattcctggtgaacagaaatctggcggctagctggtaccacaaggtacctgttgtggagatcaagggacacctggactccatgaacgtttctctgaaccaggaggatctaaacctcctatttcgtatccttacagagaatctgtgcgaaggaacggaggacctggataaagtcaaaccccgggttcaggagaccggtgagatcaaggagcccctagagatctccataagccaagatgtgcacgacagcaagaataccctgaccactggtgtggaggagatccgttctgttgacattatcaacatgctcctcaacttcgagatcaaagaagtggtcgtaactctgatgaaaaaatctgaaaagaaaggcagacctctccatgagctcaacgtcctgcagcttggcatggaggcaaaggtcaagacatatgacatgaccgccaaggcctatctcaagaagatcagtatgcagtgtttcgattttacagactctaagggcgaaccactgcacatcattaatagcagtaacgtgacagatgagccactcttaaaaatgttactgactaaagccgacagcgacggtccagaattcaaaaccattcacgactctaccaaacagagattgaaagtgtcttttgccagtctggatcttgtccttcacctggaggccttgctgagcttcatggattttctcagcagtgccgcccccttcagtgaaccctcatcgagcgagaaagagagtgaattgaaaccactcgtgggggagagccggtcaatcgcagtgaaggccgtcagtagtaatatctcccagaaggacgtgtttgatctcaagatcactgctgagctgaacgctttcaacgtgttcgtctgtgatcagaaatgcaatattgcagacatcaagatccatggtatggacgcttccattagcgtgaagcccaagcagacagatgtgttcgcccgcctcaaggacattatagttatgaatgtggacctacaaagtatccacaagaaggcagtgtctattttgggcgatgaggtctttaggtttcagctcaccttatacccggatgctaccgaaggagaggcctacgccgacatgagcaaggtagatgggaagctgtcattcaaggtgggatgcatccagatcgtttatgtgcacaaatttttcatgtccctgctgaactttttaaacaattttcagaccgccaaggaggctttgagcacggccacagtgcaggccgccgagcgtgctgcctcatctatgaaagacttagctcagaaatctttccgtctactcatggacattaatctgaaagcgcctgtgatcattattccacaatccagtgtcagccctaatgctgttatcgctgatctaggactgatccgagtggagaacaagttttctcttgttcctatggaacactactccctgccccccgtcatcgacaaaatgaacatcgagctgacacagctgaaactgtccagaacaattctgcaggcctccttgccacaaaatgacatcgagatattaaaacccgtgaacatgttgctaagcattcagcgaaaccttgccgctgcgtggtatgttcaaatccctgggatggagattaaaggaaaacttaagccaatgcaggtggcgttatcagaggatgatttgactgtattgatgaaaatccttctggagaatctgggcgaggcctccagtcaaccgtccccgacacagagcgtgcaggaaacagtacgagttcggaaggtggatgtcagtagcgtgccagatcacttgaaggagcaggaggattggacagatagtaaactgagcatgaatcagatagtgtcactacagttcgactttcacttcgagagcctgtcaattatactatataataatgatataaatcaggaaagcggagtggcctttcacaacgacagttttcagttgggcgagctgcgcttacatctgatggcttcatctgggaagatgtttaaagatggctcgatgaatgtgagcgtcaagttaaagacttgcactctggatgacctcagggagggcatagaaagggctacttccaggatgatcgatagaaagaacgaccaggacaataacagcagcatgatcgatatctcatacaagcaggacaagaatggaagccagatcgacgctgtattggacaaactctatgtctgcgcttcagtggagtttctaatgacagtggctgatttttttataaaagcagtgccgcagagccctgagaatgtcgccaaggagacacagattctgccaagacagacggctaccgggaaagtaaagatagagaaagacgattctgtgcgcccaaacatgacactgaaagcaatgattacggatcctgaggtggtcttcgtagcgtccttaaccaaagcggatgcacctgcactgacagcgtctttccaatgcaatctaagcctctcaacttccaagctcgaacagatgatggaagccagcgtcagggatctgaaggttttagcctgtccatttttgagggagaagcggggcaagaacatcaccacagtgctgcagccttgttcactttttatggagaaatgcacatgggcctccggcaaacagaacataaacatcatggtcaaagagtttattatcaaaatctctcccatcattctgaacacggtcttaaccatcatggccgccctgagccctaaaactaaagaagacggctctaaggatacttcgaaagaaatggagaatctgtgggggatcaagtcaattaatgattacaatacatggtttctgggcgtggacaccgccactgagataaccgaaagcttcaaaggcattgagcactccctcatagaagagaattgtggcgtggtggtggaaagcatccaggtcaccctcgaatgtgggcttgggcaccgcacagtccccctgcttttagctgagagcaaattctctggcaacattaagaactggacctcactgatggcggcagtcgccgacgtcacactgcaagtgcactattacaacgagattcatgccgtgtgggagcctttaattgaacgagttgaaggtaagagacaatggaatctgcgcctggatgttaaaaagaaccctgtccaggataagtctctgttacctggcgatgatttcatccccgaaccacagatggcaatacatatctctagtggtaacacaatgaacatcaccatatccaagtcctgtctgaatgtgtttaacaatctggccaaaggctttagcgagggcactgcgtcaacctttgattacagtttgaaggatcgggctccttttacggtaaaaaacgcagtgggggtgcctattaaggttaagccaaattgtaatctcagggtgatgggcttccctgagaaaagtgacatttttgacgttgatgccggccagaacctggaattggagtacgctagtatggtaccctctagtcagggtaacctgagtatcctgtccagacaagagtcctcattcttcaccctgactattgtgccccatggctataccgaggtggctaatataccagttgctcgcccaggtcggaggttgtacaatgtgcggaatccaaatgcttctcatagcgactccgtgctagtgcaaatcgacgccaccgaaggtaacaaggtaattactttgcgttcgccactccagattaaaaaccactttagcattgcattcatcatctataagttcgtgaagaacgtgaagctactggaaagaatcggcattgcgcgacccgaggaggaatttcacgtgccgttggattcttataggtgccagctgtttatacaacccgccggtatcttggagcaccaatataaggagtccactacttatataagctggaaagaggagcttcaccgctcccgggaagtgagatgtatgctgcagtgcccttctgtggaggtgtccttcttgccacttattgtgaacactgtcgcactccccgacgagctctcctatatctgcacccacggagaagattgggatgtggcttacattattcacctctaccctagcttaacacttcggaatctgctgccttactcacttcgctatctgctggaaggtacagctgagacacacgaactggccgaaggaagtaccgccgacgtgttgcattcccgcatcagtggcgaaattatggagctcgtactcgtgaagtatcaggggaagaactggaatggccatttccgcataagggacacccttcccgaatttttcccagtgtgcttctctagcgacagtactgaggtgacaacagtcgacctgtccgtgcacgtgcgaagaattggttcacggatggtgctgagtgtgttttccccatactggttgattaacaaaacaaccagggtcttgcagtaccgcagtgaagatatccacgtcaagcacccggctgatttccgtgacataatcttattctcattcaagaaaaaaaatatctttacaaagaacaaggttcagttaaaaatcagtactagcgcatggtcgtcttccttttcacttgacacagtaggatcatatggctgcgtgaagtgccccgccaacaacatggagtatctggttggggtgtcaattaagatgtcgtcttttaacttgagccggattgttaccctgacgccattctgcaccatcgccaataaaagctccttggaactcgaagttggagaaatcgcctccgacgggtccatgccaactaacaagtggaattatatagcaagttcagaatgtctgcctttctggccggagtccctcagtggtaaattatgcgtgcgcgtggtgggctgcgagggtagtagcaagccatttttttataaccgtcaagacaacggcactctgctcagtctggaggacttaaacgggggcattctggtcgacgttaacactgcagaacatagcactgtcattacattctctgattatcacgaaggctccgcccccgcactgattatgaatcacacaccgtgggatattctcacttataaacagtctggcagtcccgaagagatggtactcttaccgcgacaagctagactgtttgcttgggccgaccccactggaaccagaaagctgacctggacttatgcagccaatgttggcgagcatgatttactcaaggatggctgtggccagttcccatatgacgccaatatccagatccactgggtcagcttcctggacggccgacaacgggtgctcctgttcacagacgacgtagccttagtgagtaaagctctccaggccgaagagatggagcaggccgattacgagatcacactgtcccttcatagcttggggctttcattagtgaacaatgagtcaaagcaagaggtttcgtatataggcatcacatcttccggcgttgtatgggaagtaaaaccaaagcagaagtggaaaccctttagccagaaacagatcattctactagaacagtcttaccagaagcatcagatcagcagggaccatggttggatcaaactggacaataacttcgaggtcaactttgacaaagatcccatggaaatgcggttgccaattcgctcccctattaagcgggattttctcagtggaatccagatcgagtttaaacagtcctcccatcagaggtccctacgggcccgcttatattggctgcaggttgataatcagctgccgggagccatgttcccagtggtttttcatcccgttgcaccacccaaaagtattgcactggactcagagcctaaaccattcatcgacgtctctgtgatcactagattcaacgagtactccaaggtattgcaatttaagtattttatggttctgatccaagaaatggctcttaaaatcgaccagggctttctaggcgccatcattgcccttttcacgcctacaactgaccctgaggcggagagacgccggaccaaactgatccagcaagacatcgatgctttaaacgccgagcttatggaaacttcaatgactgatatgtccatcctgtccttcttcgaacacttccatataagcccagtgaagctgcacctctcactgagcttgggctccggaggcgaggaatcagacaaagagaagcaggaaatgtttgccgtccatagcgtaaatttgctgctgaaaagcatcggcgctaccttaacggatgtagacgatctgatttttaagttggcctattatgagatccggtaccagttctacaagcgagatcaactgatttggagcgttgtgagacactactcagagcaatttcttaagcagatgtatgtcctggtgctgggtttggacgtcctgggcaacccgttcggactcataagaggattatccgagggcgtggaggcgctgttttacgaaccattccagggggctgtgcagggtccagaggagttcgcggaaggcctggtgataggtgtcaggtccctctttggacacacggtcggcggagcggctggcgtggtgtccaggataaccggatcagtgggcaaggggctagctgcaatcacaatggacaaagaataccagcaaaagcggagagaggaactaagccggcagccacgcgacttcggggacagcctcgctcgggggggtaagggcttcttgcgaggtgttgtaggtggcgttactgggatcatcacgaagcccgttgaaggggctaaaaaggagggcgcagccggttttttcaagggcattggcaagggcctggtaggcgctgtggccagaccaactggaggtattgtcgacatggcatcttccacatttcagggcattcagcgcgctgctgaaagcacagaggaagtatcgagccttcgccctccaaggctcattcacgaagacggaattatccgcccctacgacaggcaagaatccgaaggctctgatctgctcgaacaagagctcgagatacaggagtag

SEQ ID NO: 52223 - DNA, 10758 bp, Artificial Sequence
  Description of Artificial Sequence: Synthetic coding sequence
atggtgctggagagcgtggtggccgacctgctgaaccggttcctgggggactacgtagaaaacctgaacaagtcacagctgaaactcggaatttggggaggaaacgtcgcactagataacctgcagatcaaagagaacgccctgagcgagctcgatgtgcctttcaaagtgaaagccggacagatcgacaaactgaccctgaagatcccatggaaaaacctgtacggagaggccgtggttgcgacacttgaagggttatatctgctggtggtacccggcgctagcatcaagtatgatgctgttaaagaagaaaagtctctgcaggacgttaagcagaaagagttgagccgcattgaagaggccctgcagaaagcagcggaaaaggacaaacctaaggaagccaaaaaggatacattcgtggagaagctggcgacccaggtcattaagaatgtgcaggtcaagataacagacattcatatcaagtacgaagacgacgttacagatccaaaaagaccgctctcttttggcgttacgctaggcgagctttccttgctaacggcaaacgaacactggaccccatgtatccttaatgaggcagacaaaatcatatacaagcttattagactcgactccctgagcgcttattggaatgttaattgtagcatgtcctaccaacggtcccgggagcagatcctcgaccagctcaaaaatgagatccttacttcaggcaatattccgcctaactatcaatacatctttcaacctatttccgccagcgccaaactgtatatgaatccttatgcagaatccgagctgaagacaccaaagttggattgcaatatcgaaatccagaacatcgccattgaactgacaaaaccccagtatttatcgatgatcgatctgcttgagagtgtggactatatggtccggaatgcaccctaccgcaaatacaagccatacttgcccttacatacgaatgggcggcgttggtggaagtacgctatcgacagtgtccttgaggtgcatattagaaggtacacacagatgtggagctggtccaatatcaaaaagcatcgccagctcctgaaatcctataagatcgcttacaaaaacaaattgacgcagagcaaggtgagcgaggaaatacaaaaggagatccaggacctggaaaaaacactcgatgtgttcaatatcattcttgcccggcagcaggctcaggtcgaagtcattcggtccgggcagaaactacgtaagaagagcgcagatacaggggaaaaacgtggtggatggtttagcggtctgtgggggaaaaaggaaagtaaaaaaaaggacgaggaaagcctcataccggagaccatcgacgatttgatgacaccagaagagaaagacaaactgtttacagccattggctactccgagtccacgcacaacctaactctgcccaagcaatacgtggcccatatcatgacactcaagctcgtgtcaacttccgttaccattcgtgagaataagaatatacctgagatcctgaagatccagattatcgggctgggcacccaggtatctcagaggcccggcgctcaggccctcaaggttgaagccaaactcgaacactggtatattaccggactgcgtcaacaagacatagtcccctcactggtcgcatccatcggtgatacgacatcttcgttactcaagatcaagttcgaaaccaaccccgaggactcccccgccgatcaaacccttatagtccagtcccagccagtagaggttatctacgatgcgaaaaccgtgaatgctgttgtggagttctttcagagcaacaaggggctggatctcgagcagattacctcagccaccttaatgaaattagaggaaatcaaggaacggactgcgactggcttgacgcacattatcgagactcgaaaggtgctggatttgaggatcaaccttaagcccagctacctggtggtgcctcagactggcttccatcacgagaaatctgacctcctcatactcgactttggtacttttcagttgaacagtaaggatcaaggcctacaaaagactacaaattcttcgctggaggaaattatggacaaagcgtatgacaagttcgatgttgagatcaaaaatgtccagctgctgtttgcccgagcagaggagacgtggaaaaaatgccgctttcagcatccaagcactatgcacatcctacagccaatggacattcacgtagagttggctaaagctatggttgaaaaagacattagaatggccagatttaaagtgtccggggggttaccattgatgcacgtgagaatatccgatcaaaagatgaaggacgtcttgtacttgatgaattctatcccactaccccaaaagtctagtgcacaatcccctgaaagacaggtgtcgtccatcccaatcatctccggtggcactaaagggctgttggggacttctctcttgctggatacagtagagagtgaaagcgacgatgagtatttcgatgctgaggatggagagccgcagacttgtaagtcaatgaaaggctccgaactcaagaaagcagccgaggtccccaacgaggagttgattaatctgctgctcaaatttgagatcaaggaggtcattcttgagttcaccaaacagcagaaagaggaggacactatcttggtatttaacgtaacccagctcggcaccgaggcaaccatgcgtacatttgatttaacagtggtgtcgtatcttaaaaagatatctttggattatcacgaaatcgaaggctccaaaaggaaacccctgcacctgatcagctcatctgacaagcccgggctggatttgttaaaggtggaatacattaaagcagacaagaacggaccctcgtttcagaccgcgttcggcaaaaccgaacaaactgtcaaggtggcattctcatccctgaatttgctgctgcagactcaagctttggttgcctctatcaactatctgacaactattataccttctgacgatcagtctatcagtgtagccaaagaagtccaaatcagcacagagaaacaacaaaagaattcgaccttgccaaaggccatcgtgagctctcgagactctgatatcattgattttcgactctttgccaaattgaacgccttctgcgttatagtgtgcaatgagaaaaataacatagccgagattaagatacaggggctggactcttctctttctctgcagtctcgcaagcagtccctctttgcccggcttgagaatattatagtgaccgacgtggatcctaagacagtgcacaagaaggccgtgtccattatggggaacgaggtgttcaggtttaatctagatctgtatcctgatgctactgaaggtgacctctacacagacatgagcaaagtcgatggggtgctgagcctcaacgtcggctgcattcagattgtttaccttcataagttcttgatgagcttgctcaacttcctgaataacttccagaccgcgaaggaatcactctctgcagcgacagcccaggctgctgagcgcgccgcaaccagtgtcaaggacctcgctcaacggagcttccgggtgtcaataaacatcgacctaaaggctcccgtcatcgtcatccctcagtcttctatttctaccaatgcggtagtggtggatctggggctaattcgggtacacaaccaatttagcctggtgtcggacgaggattacttaaaccccccagtgatcgaccgaatggatgtgcaactgaccaagctgaccctgtacagaaccgtaattcaacccggtatttaccatccagatatccaactcttgcatcctatcaatctagagtttctggtgaatcggaacctggcagctagctggtaccacaaggtaccagtggtggaaatcaagggccacctagacagcatgaatgtgagtttgaaccaagaagatctgaacttacttttccggatcctcacggaaaatctgtgcgagggaaccgaggacctcgacaaagttaagcctcgagtgcaggaaaccggtgagattaaagaacccctcgaaatctctattagccaggacgtacacgactctaagaataccttgaccacgggagtagaggaaattcgctccgtcgacattattaatatgctccttaacttcgagattaaagaggtggtcgtgacgctgatgaagaagtctgaaaagaagggtcgcccactccacgagcttaatgtgcttcagctagggatggaagcgaaggtgaagacctatgatatgactgccaaggcatacctcaaaaaaattagtatgcagtgcttcgatttcacagattctaaaggcgagccactgcatataattaattccagcaacgtgactgatgaacccctgctgaaaatgttgcttacaaaggctgactctgacgggccagagtttaaaaccatacatgatagtactaaacaaaggttgaaagtgtcattcgcttcgcttgatttggttcttcaccttgaagccctgttgtcttttatggattttctgtcgagtgccgctccattctcagaaccatcgtctagcgagaaggagtccgaactcaaacctctggtgggagaatccaggtctatcgcagttaaagccgtgtccagcaacattagccagaaggatgtgtttgacctgaagatcactgcagagctgaatgcttttaatgtgtttgtgtgtgatcagaaatgcaatattgccgacatcaaaatccacggaatggacgctagcattagtgtgaaaccaaaacagaccgatgtgtttgccagactcaaggatataatcgtaatgaatgtggatctgcagtccatacacaaaaaagctgtcagcatccttggagatgaagtgtttcgctttcagctgactctctatcccgatgctacagagggcgaggcctacgctgacatgagcaaggtcgacggcaagctgagtttcaaagtcggatgtattcagatcgtctacgtgcacaaattctttatgagtctgctgaatttcctgaacaattttcaaaccgccaaggaggcactgagcactgctactgtccaggccgctgagagagcagctagcagtatgaaagacctcgcccagaagagttttagattgctcatggatattaacttgaaggcgccagtcatcatcatcccccagagctccgtctcgcccaatgcggtgatagcagatctagggttaatcagggttgaaaacaaatttagccttgtgcccatggagcactattctctgccaccggtgatcgacaagatgaatattgaattaacccaacttaagctgtctagaactatcttgcaggcttccctgccacagaacgatattgagatcctcaagcccgtgaatatgctgcttagcatccaaaggaatctggctgctgcctggtatgtccagatcccgggtatggaaatcaagggaaaactcaagcccatgcaggtggctctgagcgaggatgacctgacagtgttaatgaagatcctcctggaaaatctgggagaggcaagttctcagccatcccctacccagtctgttcaggagaccgttagagtaaggaaggtcgacgtgagtagtgttcccgaccacctgaaagaacaggaggactggaccgactctaagctgagcatgaaccaaatcgtcagtctccagtttgatttccacttcgaatcattaagcatcattctgtacaacaatgacatcaatcaggaaagtggagtggctttccataacgactcatttcagctgggagagctgcgccttcacctgatggcatcaagcggcaaaatgttcaaagacggaagtatgaacgtctcagttaagctaaaaacatgcacactggatgatcttcgtgaaggcatcgagcgagcaacaagcagaatgatcgacagaaagaatgatcaagataataatagctccatgattgacatcagctacaaacaggacaagaatggttcccaaattgacgccgtgctggacaaactttatgtatgtgcctctgtggagttccttatgaccgtggcggatttcttcatcaaggcagtgccacagtcacctgaaaacgtggccaaggagactcagattctacctaggcaaaccgcgaccggcaaggtaaagatcgaaaaggacgatagcgtccggcctaatatgactctcaaagcaatgatcaccgaccccgaggttgtgttcgttgcttcattgaccaaggcagacgcgccagcattgaccgcatcttttcaatgtaacctctctctctcgactagtaaactcgaacaaatgatggaggctagcgtgagagacctgaaagtactcgcctgccctttcttgcgcgagaagagaggaaaaaatatcaccactgtcctccaaccttgctccctgtttatggagaagtgtacatgggcctcaggcaagcagaacatcaacatcatggttaaggaatttatcatcaagataagccctataatactgaacaccgtgctaaccatcatggcagccctgtcacctaagaccaaggaggatggaagtaaagatacatcaaaggagatggagaatctatggggaattaaatccatcaatgattacaacacatggttcctgggagttgacacagcaaccgagatcacagagagttttaagggaatcgagcattctctgatcgaagagaattgtggtgtggtggtggagtctatccaagttaccctcgaatgtggtcttggccaccgaactgtgcccctgttgctggccgagtccaaattctctggaaatatcaagaactggaccagccttatggcagcagtggctgacgtcactttgcaggtgcattattacaacgaaatccacgcagtatgggagcccctgatcgagcgcgtggaaggaaagaggcagtggaatttaaggctggatgtaaaaaaaaacccagtccaggacaagtctttgcttcccggcgatgactttatccctgagcctcaaatggctatacatatttcgtccgggaacacgatgaatattaccattagtaagagctgtctgaacgttttcaataatctcgctaagggtttctctgaggggaccgcctcaacattcgactactcgttgaaggacagagctccctttaccgtgaagaatgcagttggagtccctataaaggtcaagcccaactgtaacctgcgtgtcatgggttttccagaaaagtcggatatcttcgacgtggatgcaggccaaaacctggaactggaatacgcaagtatggtcccaagcagtcagggaaacttaagtatcctgtcccgtcaggaatccagctttttcaccctcaccattgttccccatggatatacagaagtggccaacattccagtggcccgacccggccgaagactgtacaatgtgagaaatcctaatgctagtcatagcgactccgtgttagtccagatcgatgccaccgaaggcaacaaggtgattactttgagatcacctttgcagattaagaaccacttttcaatcgcctttatcatctacaaattcgtaaagaacgtgaagctgctagagaggatcggaatcgcacgccccgaggaagagttccatgtgccgctggacagttatcggtgccaattgtttattcaaccggcgggaatattagaacaccagtataaggagagtacaacctatataagttggaaagaggaactgcatcggtccagggaggttcggtgtatgctgcagtgtccgagcgttgaggtctcttttctgccactgatagtcaacacagtggcgctgcccgacgaactgtcttacatttgtacacacggcgaagattgggatgtggcctatatcattcacctgtaccccagcctgactctccgtaatctgctgccttacagccttcggtatctcctggagggaacagcagagacccacgagttggcagaaggttctacggcggatgtgctccattcccgcattagcggggaaatcatggagctggtgttggtgaagtaccagggcaagaactggaatggccactttcgaatccgagataccctgccggagttctttcccgtgtgctttagtagtgattctactgaagtgaccaccgtggacctgtctgtccacgttcgcagaatcggctctcgcatggtcctgtctgtttttagcccttactggctcatcaataagactacacgagtactccaataccgctcagaggacatccatgtaaagcacccggctgattttagagacataattctgtttagctttaaaaaaaaaaatatttttaccaaaaataaagttcagttgaagatctctacaagtgcatggtcttctagcttttcgttagatacggtggggtcttatggttgtgtgaaatgtcccgccaacaatatggagtacctggtcggggtgtctatcaaaatgagcagctttaatctctcgagaattgtgaccctcactccgttctgtactatcgcgaacaaatccagcttggaactggaggtgggcgaaattgccagcgacggctctatgcccacaaacaaatggaactacatcgcttcatcagagtgcctgcccttttggccagaatcactgtccggaaagttgtgcgttagggtcgtgggctgcgaaggctcttcaaaaccctttttttataataggcaggacaacgggacattgttgagcctggaggatttaaatgggggcattctcgtggacgtcaacaccgccgagcactctactgtgatcacattcagcgattaccacgaaggctccgccccagccttgattatgaaccatacgccttgggatatactaacttataaacagagcgggagtcccgaggaaatggtgttactcccgcggcaggctcgtttgttcgcgtgggccgatcccaccggtacccggaaactgacctggacatatgccgctaatgtgggcgagcacgacctcctcaaggatgggtgcgggcaattcccctacgatgctaatatccagatccactgggtgtccttcctcgatggccgtcagcgggtcctgctgttcactgatgacgtcgctctcgtctcaaaggctctgcaggccgaagaaatggaacaggctgattacgagattactcttagcctgcattcactgggattgtctctggtgaacaacgaatcaaagcaggaagttagttatatcggcattaccagcagtggggttgtatgggaagtcaaaccaaagcagaagtggaagccgttctcccagaaacagattatcttgctggaacagtcttatcagaagcaccagattagtcgggatcacggatggataaagctggacaacaatttcgaagtgaactttgataaagaccctatggagatgcggttgccgatccgtagcccaatcaaacgcgacttcttgtccggcattcagatcgagtttaagcagagcagccaccagcgatccctgcgcgcccggctgtactggctgcaggtggacaaccagctgccaggggcaatgttcccagttgtgtttcacccagtagcccctcctaaatctattgccctggattctgagcctaagcccttcattgatgtaagcgttattacaaggtttaatgagtacagtaaagttctgcagttcaagtatttcatggtgctgatccaagaaatggctctgaagatcgaccagggctttctcggagccattatcgcccttttcacccctactactgaccctgaagccgagcggaggcggacaaaattgatacaacaagatatcgatgctctgaatgccgagctgatggaaacctcaatgacggatatgagcattcttagcttttttgaacattttcatatctcgccagttaagctgcacctctccctcagcctcggaagcggcggcgaagaatctgacaaagaaaaacaggagatgtttgccgtgcatagcgtgaaccttctcctgaagtccattggtgctactctcactgatgttgacgacctgatatttaagctggcctactatgaaattcgttatcaattttacaaaagagatcaacttatttggtccgttgtacggcattactccgagcaattcttaaagcaaatgtacgttctggtgctgggccttgacgtgctgggaaatccgtttggcctcatccgagggttgtccgagggagtcgaggccctgttctatgaaccatttcagggggccgttcaaggccctgaggagttcgcagaaggactagtgattggtgtccgcagcttattcggccacactgtagggggggcagctggggtagtgtcccggatcacagggagcgtgggcaagggtctcgcagctataacaatggataaggaataccagcagaaacgccgtgaggaactgtctagacaaccccgtgactttggcgactcactggcacgcggcggaaaggggtttctaaggggggtggtgggaggcgtgacaggaatcattaccaagcctgtggagggtgccaaaaaggaaggagctgccgggttcttcaagggaattgggaaaggactcgttggagccgtggccagaccaacaggtgggatcgtggatatggcatcaagtacctttcaaggcatccagagggccgccgaaagtacagaggaggtttcctctctgcgccctccccggctcatccacgaggacggaataataagaccctacgatcgacaagaatccgaaggctcagatttactggaacaggaattggaaattcaagaatag

SEQ ID NO: 52224 - DNA, 13092 bp, Artificial Sequence
  Description of Artificial Sequence: Synthetic coding sequence
atgctggagggcctggtggcctgggtgctgaacacctacctgggcaagtatgtcaacaatctgaacactgaccagctaagcgtggcactgctcaaaggcgccgtcgagcttgaaaacttgcctttaaagaaggatgccttgaaggagcttgagctgccattcgaagttaaggccggcttcataggaaaggttaccttgcagatcccattctaccgccctcacgtcgacccctgggtgatctctatcagctccttacacctgatcggtgctcctgagaagattcaggattttaacgatgaaaaggagaaattgctcgagcgtgagcggaagaaagcactgttgcaggctctagaagagaagtggaagaacgaccgacagcagaaaggggaatcttattggtattctgttacggcctcggtcgtcacccgaattgtagaaaacattgagcttaaaattcaagatgttcatctaaggttcgaagacggagtgacaaacccctcacatccctttgcctttggtatttgcattaagaatgtctctatgcagaacgcagtaaatgagccagtacaaaaattaatgcgtaagaagcagctggacgtcgccgagttctcaatctattgggacgtcgactgcaccttgctgggcgacttgcctcaaatggagctgcaagaagcaatggctcgatccatggaatcaagatcacaccactatgttctggaacctgtcttcgccagcgctctcttaaagcgaaattgttctaagaagcctcttcgctcacgtcactctccaaggatcgattgtgacatccagctggagaccattcctctgaagctcagccagctgcagtacaggcagataatggagtttttgaaggagctagaacgcaaggagagacaggtgaaatttcgccgatggaaacctaaagtcgccatcagcaagaattgtagagagtggtggtacttcgctttaaatgctaacctgtatgagattagggagcaacgtaaacgctgcacgtgggacttcatgctgcatcgcgctcgcgacgctgtctcttataccgacaagtactttaacaagctgaaaggggggctgctgtccaccgatgacaaggaagaaatgtgcaggatcgaggaggaacagagtttcgaggaactgaagatcctccgagaattggtgcacgatagatttcacaagcaggaggagctggcggagtcgctgagagagcctcagtttgactctcctggagcctgtcccggcgctcccgaacccggtggggggagcggaatgctgcagtatcttcagtcctggtttcccgggtggggcgggtggtacggacagcaaacacccgagggcaacgtggtggaagggctgagtgccgagcagcaagaacaatggattccagaagagattctcgggaccgaagagtttttcgatcccacagccgacgctagttgtatgaatacttatacaaagagagatcacgtgttcgccaaacttaacttgcagctgcagcgcggaaccgtaaccctcttgcacaaagagcagggtaccccccagatgaatgagagcgcgttcatgcaacttgagttctctgatgttaagctactggctgaaagcctccctcgacgcaacagtagcctgttgtctgtcaggttgggcggcctgttcctcagggacctcgccactgagggtactatgttccctttgctggtcttcccaaatcctcagaaggaggtcgggagggtgagccagtcttttgggctacaaacgaccagtgccgaccgaagtgatcattaccctgcggctgatccagatggccctgtttttgaaatgctatacgaacgtaacccagcccatagtcacttcgagaggcgactgaacgtcagcaccaggccgctcaacatcatatacaatccacaagcaataaaaaaggtggccgactttttttataaagggaaggtccacactagtggcttcggttaccagagtgaactagagctgagagtagcagaggctgctcggcggcagtataataagctgaaaatgcaaacaaaagccgaaattcgccagactttggatcgactgttagtgggagatttcatcgaggagagtaaaaggtggaccgttcgacttgatatttcggccccacaggtgatctttcctgacgattttaaattcaagaaccccgtactggtggtggtcgacctcgggaggatgctgttgaccaatacccaggataattctcgcagaaaatcccgggacggctcggcatcggaggaaacacaattttctgacgatgagtacaagacccccctggccacacctcctaatacacctcctccagaaagctcatctagtaacggtgagaaaacgcctcccttctctggcgttgaatttagcgaggagcagctccaagcccatctgatgtctacaaagatgtacgaaaggtactccctctcttttatggaccttcaaattatggtagggagagtgaaagacaactggaaacatgtccaggacattgatgttgggcctacccatgtagtagaaaaattcaacgtccatctccagttggaaaggagactgatatacactagcgaccccaaatacccgggtgccgtactttccggcaatctgcctgatttgaaaattcacataaatgaggataagatctcggctttgaagaattgcttcgcacttctcacaactcctgagatgaagacttctgacacccagataaaagagaagatctttcctcaggaagaacaaagggggtcactgcaggactctgtgatgaatttgactcagagtattgtcctcctcgaacagcacactagagaagtgctggtggagtctcagctacttctcgctgagtttaaagttaactgtatgcagctgggcgtggagagtaatggcagatacatttcagttctgaaagttttcggcaccaacgcgcactttgttaagcgtccctacgacgctgaggtgagcctgacagtgcatgggctgctgctagtggataccatgcagacctatggagcagattttgacctcctcatggcctcgcacaaaaacttaagttttgacatccctactggctcccttcgggacagcagagctcagagtcccgtgagcgggcctaatgtagcacacttgaccgacggcgccacactgaacgatagatctgccacctccgtgagcctggacaagatcctgacaaaagaacaggaatctctaataaagctggaataccagtttgtgtcttccgaatgcccaagtatgaacctggacagtaccctccaagttatttcactgcaggttaataatttagatattatactgaaccctgaaaccatcgtcgagctcatcggctttcttcagaaaagtttcccgaaggaaaaagatgatctctccccacaaccactgatgacagattttgagcgaagctttagggagcaggggacatatcagagtacctacgagcagaacacagaggttgcagtggagattcaccgcctgaacctgctgctgctgagaacagtggggatggccaatagggaaaaatacgggcgtaagatcgcgaccgcctcgattggcgggacaaaggtgaacgtcagcatggggtctacttttgacatgaatggttccctggggtgccttcagcttatggacctcacccaagacaatgtgaagaatcagtacgttgtgagcatcggcaactcagtgggatacgagaatattatcagtgatatcggatattttgaaagcgtgttcgtgcgcatggaggatgccgctctcacagaggccctgagcttcacatttgttgagcgatctaagcaggagtgttttctgaaccttaagatggccagcttgcattacaaccattctgccaaattcttgaaggagctgacgctatctatggatgaactcgaggaaaattttaggggaatgctgaaaagcgcagccactaaggtaacaaccgttctggcaacgaagacagctgaatatagcgagatggtaagtctcttcgaaacacccaggaaaacacgtgagccttttatcctggaagagaacgaaatctacgggtttgacctggcctctagccacctggacacggtgaagctgatcctcaacatcaacattgagagcccggtcgtgagcatcccccgcaaacctgggtcacccgaacttttggtcggacacctggggcagatcttcatccagaatttcgtggctggggacgacgaatcgagaagtgatcgcctgcaggttgaaatcaaggatatcaagctttactccctgaattgcacacagctagctggtagagaagcggttggcagtgaaggttctcggatgttttgtcctccaagtggtagcggatcggctaattcacaggaagaggctcactttacccgtcatgatttcttcgagagtcttcacagggggcaggctttccacatactgaacaacacgacaatacagttcaagttggaaaagattccgatcgaacgggagtccgagctgactttttctctgtcccctgatgacctaggaacatccagtataatgaagattgaggggaagtttgtgaacccagtgcaggtagtgttagcaaaacatgtatatgaacaggtacttcagactcttgacaacctggtctactctgaggatctcaataaataccccgcttcagccaccagttccccgtgtcccgatagccccttgcccccactgagcacatgcggggagtcctccgttgaacgcaaggagaatgggctcttcagtcacagctcattatcaaacacttcacagaagtccctgtccgtgaaggaggtaaaaagctttacccagattcaggctaccttctgtatcagcgagctccaggtgcagctgtcgggggatctgaccctgggggcccagggcctggtctcactgaagttccaggatttcgaagtggaattctcaaaggatcatcctcagactctgtctatccagatagccttgcattccttgctaatggaagatttactcgaaaagaacccggactcaaagtacaagaatctcatggtttcccggggcgccccaaagcccagcagcctagcccagaaagaatacctgtcacaatcttgtccttccgtgagtaacgtcgagtacccagatatgccccgttcactcccaagccatatggaggaagcccccaatgtgtttcagctgtatcagagacctaccagtgcctctcgcaaaaaacagaaggaggtgcaagataaggactacccactgactccccctcctagccctacagtggacgaacctaaaatcctggtgggtaaatctaaatttgacgatagtctggtgcacatcaatattttcctggtggataagaagcatccagagttttcaagcagttacaatcgcgtgaacagatctatcgacgtcgactttaattgcctggacgtgcttattaccctccagacctgggtggtgattttggattttttcggtatcgggagtaccgccgataaccacgccatgcgactcccgcccgaaggcatcctgcataatgtcaagcttgagcctcacgcctccatggagagcgggctgcaagatccagttaacactaagctcgatctaaaggttcatagtttgagtctggttctgaataagacgacctctgaactcgccaaagccaatgtttcaaaactggtcgcgcaccttgagatgatagagggcgaccttgccctacagggcagcattgggtctctatccctgagtgacctgacctgtcatggggagttctatcgagaaaggttcacaacttcaggcgaggaggcgctcattttccagacctttaaatacggaagaccggatccgttattgcgccgcgagcacgacatcagagtgtcactgcggatggcttcagtgcaatacgtgcacactcagcggttccaggcagaggttgtcgcgttcatccagcattttactcagttgcaagatgtgctggggcgccagcgcgccgccattgagggtcaaactgtgcgcgaccaggcccagcggtgctccagagtactgttggacattgaggccggagcccctgttttactcatccctgagagcagtagatccaataacttgatcgtggccaacctggggaaactgaaggttaagaataagttcctgttcgccggcttcccaggcactttctccctccaggataaagaatctgtgcccagtgcctctccaaccgggataccgaaacacagccttcgtaagacaacttcgaccgaggagcctaggggcacacacagccaagggcagttcaccatgcctctggccggcatgtccctgggctctctgaaatccgagtttgtccccagcacttctactaagcagcaaggccctcagccaaccctgagcgttggacaggaaagctctagccctgaggaccatgtgtgtctcctggattgcgtcgttgtggacctgcaagacatggacatcttcgccgcggagaggcacccacgcgaatatagcaaggcccccgaggactcaagtggggacctgatattcccatcgtactttgtgaggcagaccggcgggtctctgctaactgagccttgtcgactgaagctgcaggttgagcgcaatctcgataaggagatttctcacacagtaccagatatatctattcacggcaatctctccagcgtacattgttccctggacctgtacaaatacaaattaatacgcggtctgcttgagaacaatctgggagagcctatcgaggaattcatgcgtccatatgatctacaagatcctcgaatacataccgtcttgagtggcgaggtgtacacctgtatgtgttttctcattgatatggtgaatgtatctctggagctgaaggaccccaaacgaaaggaaggcgctggtagtcttgcccgctttgattttaaaaagtgtaagctgctctacgaatcattcagtaaccagacgaaatccataaacctcgtctctcactccatgatggcttttgacacacggtatgccgggcagaaaacttctcccggtatgaccaacgtcttttcctgcatttttcagcccgcaaaaaactcaagtacgactcagggaagcatccagatcgaactgcatttccgcagcactaaagactctagttgcttcactgttgtgcttaacaatctgcgcgtgttcctgatttttgactggctgcttctggtgcatgactttctgcacacgccctctgacatcaagaaacagaatcacgtcactccatctcgccaccgtaactcgtcctccgaaagtgctatcgtgcctaagactgtgaaatccggcgtggtgacaaaaaggtcttcactccctgtctctaatgagcgtcatctggaagtcaaggtgaatgtgaccgggactgagttcgtcgtcatagaggacgtgtcctgtttcgacaccaatgccataatcttgaaaggaacaactgtgctcacatacaaaccccgattcgtggacaggcctttctctggctcgttgtttgggattgaggtgtttagctgtcggctgggcaatgaacacgataccgctctgtctatagtggatcccgtccagatccagatggagctggtagggaattcgtcttatcaaaactcatcaggacttatggatgcgttcaactcagaggatttccccccggttctcgagattcaactgcaggctctggatatcagactgtcatacaatgatgtgcagctcttcctcgccattgcgaaatctattcccgagcaagccaacgctgcggttcccgattccgtcgcgctggaaagcgatagcgtgggtacctatttgcctggtgcctcccgggtcggagaggaaatcagagagggcactcgacatactttggatccagttctggagctgcagctagccagacttcaggagctggggttttccatggacgattgcaggaaagccttactggcgtgccaggggcagcttaaaaaggcagcctcatggctttttaagaatgccgagcccctaaagagcctttccctagcttcaacctccagggatagtcccggggctgtcgcggcgcccttgatttctggggtggagataaaggccgagagtgtgtgtatctgcttcatcgacgactgtatggattgcgatgtgcctctagcagaactgacattttctaggctcaacttcctacaacgggtgcgcacaagtcccgaagggtatgctcattttaccctgagcggtgattattataacagggccctgagcggctgggaacccttcattgaaccatggccctgtagcgttagctggcagcagcaggctgcttcaaggttgcacccccctcgactgaagctcgaagctaaagcaaaaccgcgactggacatcaatataacctctgttctgattgaccaatatgtttcgactaaggaatcatggatggctgactactgtaaggatgataaggatatagaaagtgcaaaaagcgaagattggatgggctcgtctgtggatccgccttgtttcggccaaacggaggtgaagacacccaaaaggcgtcagccgttcgtgccctttgccttacggaatcacacaggatgcaccctatggtttgctacactcactactactccaactagagctgcacttagccattcaggtagtcccggagtggtaccagaaggtaacggcacgtttcttgacgatacacacaacgtctcagaatggcgggaggtcctgactggggaagagatacccttcgaatttgaggcccgagggaagctaaggcaccgccacacgcacgatcttcggatccaccaattgcaggtgcgggtgaacgggtgggaacaggtaagccccgtgtctgtggacaaggtgggaacatttttccgatatgctgcccccgataagaactctagttcgtctacaattgggtccccctcgtctcgcaccaacattatccatcctcaggtgtatttttcaagtttaccacctgtacgcgttgtgttcgccgttaccatggaggggagcgctagaaaagtgatcactgtgcgatcagctctcatagttcgcaatcgcctagaaaccccaatggaactccgcttagacagccctagcgcaccagacaaaccggtggtgttgccagccattatgcccggcgactcgtttgccgtacctctgcacctgaccagttggcgcctgcaggccaggcctaagggcctcggagtcttcttttgtaaggcacccattcactggacgaacgttgtcaaaactgccgagattagctcaagtaagagagaatgccacagcatggacacagagaaatcccgctttttcaggttttgtgtcgcaattaagaaagagaactaccctgactacatgccgtctaatatcttctccgacagcgccaagcagatattcagacaacctggtcataccatctacctgcttcctacagtcgtaatctgcaatctgctgccatgcgagttggacttttacgtgaaggggatgccaatcaatggcaccctgaagcccggcaaagaggctgctcttcatacggccgataccagtcagaacatcgaactgggtgtcagcctggagaattttcccctttgcaaggagctgcttatacccccaggaacacagaactacatggtgagaatgagattgtacgacgtcaataggcgtcagttgaacctgacgatcagaatagtgtgtcgcgccgagggctccttgaagatcttcatctccgccccgtattggctcatcaataagactgggctccctctgattttccggcaagataacgcgaaaactgatgccgctggccaattcgaagagcacgaacttgctcggtcactcagcccgctacttttctgctacgcagacaaagaacaacctaacctctgcactatgaggatcggtcgaggtatccaccccgaaggaatgcctggatggtgccaggggttctcactggacggcggatctggagtcagagccctaaaggtgatccagcaagggaacaggcctggactaatatataatatcggcatcgacgtcaagaaggggcgaggtaggtatattgatacctgcatggtcattttcgccccccgctacctgctggacaacaaatctagccataagctggctttcgctcagcgcgagtttgcacggggtcagggaactgctaaccccgagggatacattagtacattgcctgggtcctccgtggtgtttcattggccacgtaacgattatgatcagctgctgtgcgttcgtctaatggatgtcccgaattgtatctggagtggcggtttcgaagtgaataagaacaattcatttcacattaatatgagagatacactgggcaaatgtttcttcctgcgagttgagatcaccctacgcggcgccacttacaggatttcgttcagcgacactgaccagcttccgccccctttccggattgacaactttagcaaggtgcctgtcgtctttactcaacacggtgtagccgaacctagactgcggacagaggtgaagccaatgacgtccctcgactatgcttgggatgagcccactctgcccccattcataaccctcaccgtgaagggagcaggctcctccgaaattaactgtaatatgaatgattttcaggataataggcaactgtactacgagaatttcatttatattgctgccacttacacattcagtggtttgcaggagggaaccggacggcctgtcgctagcaacaaagctataacatgtgctgagctggtgctggacgtctccccaaaaactcagagggtgatcctcaaaaagaaggaacctggtaagaggagccagctctggcgcatgactgggaccgggatgcttgctcatgagggttccagcgtgccacataacccaaacaagccctccgcagctcgcagcaccgaggggagtgccattctggatattgcgggcttggcagccgttaccgataatagatatgagccattgatgctacgcaagcctgacaggcgacgttcaacaacgcagacatggagtttccgcgaagggaagttgacgtgcggcttacatggcttagtcgtccaggcaaaaggagggctctccgggttattcgatggagcagaggtcgttcttggccctgacacatcaatggagcttctcggcccggttccgcccgagcagcagtttataaatcagaaaatgagaccaggctccggtatgctgagtatacgggtgatcccagatggccctaccagagcgctccagattacagacttctgtcatcggaaaagttcccggagttacgaggttgatgagctccccgtgacagaacaggaacttcaaaagcttaaaaaccccgacactgagcaagagctagaggtgttagtccggctggaggggggcatagggttgagtctgatcaacaaggtgccggaagaattagtgttcgcctcgttgacaggaataaacgtgcattacacacaattagccacgagccatatgctggagctcagcatacaggatgtgcaggtcgacaatcaactgatagggaccacccagcccttcatgctctacgtaacacccctgtccaacgaaaatgaagtaatcgagaccggccctgcggtccaggtgaatgcggtcaagttccctagcaaatccgctctgactaacatctataagcacctgatgataacagcccagagatttactgtgcaaattgaggaaaagcttcttctcaaactcttgtcttttttcgggtacgaccaggccgaatccgaagtggaaaaatacgatgaaaatctgcatgagaaaaccgctgagcaaggcggcacccctatacgctattattttgaaaatttaaaaatcagtatccctcaaattaagctgagtgtctttacctctaataaactgcctctagacctcaaagcccttaagtctactctcggtttccctctaattagattcgaagatgctgtgatcaatctggatccattcactcgggtgcatccctacgaaaccaaagaattcattatcaacgatatccttaagcattttcaggaagaactactgagtcaggctgcaaggatcctgggctctgtcgatttcctcggcaaccctatggggctgttaaatgatgtctcagagggcgtaaccggtctcattaagtatggaaacgtagggggccttatcagaaatgtaactcacggcgtctccaatagtgccgctaagtttgctggcactctctcagacgggttgggtaaaacaatggataatcgccaccagagcgagagggaatatattcggtaccacgcagctaccagcggagagcacctggtggctggtatccatggccttgcacacgggatcatcggtggtttgacttctgtgattacatcaaccgtcgagggcgtgaaaaccgagggtggcgtgtccggcttcatttcagggttgggtaagggtctggtggggaccgtgacgaaaccagtcgccggggctcttgattttgctagcgagacagcacaggcagtgcgtgacacagccacactatctggaccacggacccaggcgcagcgcgtgaggaagcccagatgttgcaccggcccgcagggcctgcttccccggtacagcgagtcgcaggctgagggtcaggagcagctgttcaagctgacagacaatatccaggacgaatttttcatcgcggtcgagaatattgactcctattgcgtgcttatctccagcaaagctgtttactttttgaagagcggtgactacgtggatcgtgaggctatcttcctcgaagtgaaatatgacgacctgtaccactgtctggtttcgaaggatcatggcaaggtgtacgtccaggtaactaagaaggctgtgtccacttcctcgggcgtatctatccctggcccgtcgcatcagaagcctatggtgcacgttaagtcagaggtcctggctgtaaaactgtctcaggaaatcaattatgcaaagagtctgtactacgagcagcagctgatgttgcgactcagcgagaaccgcgagcagctcgaactggatagctag

SEQ ID NO: 52225 - DNA, 13167 bp, Artificial Sequence
  Description of Artificial Sequence: Synthetic coding sequence
atgctggagggcctggtggcctgggtgctgaacacctacctgggcaagtatgttaacaacctcaacactgatcaattgtccgtggcgctactcaaaggggcagtggagctagagaacttaccgttgaaaaaagatgcgctgaaagaactcgaacttcccttcgaggtgaaagctggattcattggaaaggtcactctgcagattccgttttatcggccacacgtggacccgtgggtcattagcatttcctctctgcacttaattggggcccccgaaaagatccaagattttaacgacgaaaaagagaagctccttgagagggagagaaaaaaagctttgctccaggctttggaagagaaatggaagaacgacaggcagcaaaagggcgagtcttactggtactcggttactgctagcgtagtcacgaggatcgtagaaaacatcgagctcaagattcaagatgtacatctccgtttcgaagacggtgtcaccaatccaagccaccctttcgcattcgggatctgcattaagaatgtctcaatgcagaacgcagtgaacgagcctgtccagaagttgatgcgaaagaagcagctggatgttgccgagttctccatctactgggacgtggactgcacactgctcggagatcttccccaaatggagcttcaggaagccatggctagaagcatggaaagcagaagccaccattatgtgctggaaccggtcttcgcgtctgctctccttaaaagaaattgtagcaagaagcccctgcgatcaaggcattcaccgcggatcgactgtgacatccagttagaaacgatacccctgaagctgtcacagctgcaatatcgccagataatggaatttctgaaggaactcgaacgtaaggaacgccaggtgaaattccgaaggtggaaacctaaggttgcaatttccaagaattgcagggagtggtggtactttgccctgaacgccaacctgtacgaaattagagaacagcggaaaagatgcacctgggacttcatgctacaccgggcacgggacgccgtcagctacactgataagtacttcaataagctaaaaggcggcctgctcagtaccgatgacaaggaagagatgtgtaggattgaagaggaacagagctttgaggaactgaagatcctccgggaactggtacatgaccgctttcacaagcaagaagaactggctgaatccttgagggagcctcagtttgactcccccggagcgtgccctggcgcaccagaacccggaggaggaagtggcatgttgcagtacttgcagtcatggtttccaggttggggaggttggtacggacagcagactccagagggcaacgtggtcgagggcctgtcagcggagcaacaagaacagtggatcccagaagaaatcttgggaaccgaggagtttttcgatcccacagctgatgcaagctgcatgaacacatataccaagcgggatcatgtctttgctaaactgaacctacagctccagagaggcacagtaacccttctgcataaagaacagggcactcctcagatgaacgaaagtgctttcatgcagctggaatttagcgatgttaaattgctcgcagaatctctaccccgccgcaactcttcactgctcagtgtaagactgggcggcctgtttctccgcgatttggccactgagggcaccatgttcccgctgcttgtatttcccaacccacagaaggaggtgggtcgcgtgtctcagtctttcgggctgcagaccacttcggctgaccggtcggatcattaccccgctgcagaccccgacggtccagtcttcgagatgttgtatgagcgtaatccagctcactctcactttgaacggcggttaaacgtttcaacaaggccgctgaacatcatctataatccacaagccatcaagaaggtcgctgattttttctacaaaggaaaagtccacaccagtggatttggctaccaatccgagctggagttgcgggtagccgaggccgctcgccggcaatacaataagctcaaaatgcaaactaaggccgaaattagacaaacattggaccgactcctagtgggcgatttcatcgaggagtcaaaacggtggacagttcggcttgatatctcagctccccaggtgatcttccctgacgattttaagttcaaaaaccccgtgctcgtcgtggttgatctgggtcgaatgctcttgactaacacacaggataattcaaggcgtaaatcccgagacggctcagcctcggaggagacccagttctcagacgacgagtataagacgccgctggcgacccctcctaatactccgccccccgaaagctcatcatccaacggagaaaagacaccacctttcagtggcgtggaatttagcgaagagcagctgcaggcgcacttgatgtctacaaaaatgtatgaaaggtactctttaagcttcatggacctgcagattatggtcggtcgcgttaaggataactggaaacacgtccaggacattgatgtgggaccgacacacgtggtggaaaaattcaacgtacatctgcagctggaacggcgactcatatatacctccgatcccaagtaccctggggcagtacttagcggaaatctccccgatctgaaaatccacatcaacgaagacaaaatttctgctctgaagaattgtttcgcactgctcactactccggagatgaagacaagcgacactcaaatcaaagaaaaaatcttcccacaggaggagcagcggggatctctccaagattcagtcatgaatttgacccaatcaatcgtcttgctggagcaacacacacgcgaagtgttagtagaatcccagctgttgctagccgagtttaaagtgaactgtatgcagttaggcgtcgagtccaacggcaggtacatctccgtcctgaaggtcttcgggacaaatgcgcatttcgtgaagcgaccttacgacgctgaagtgagtctcacggttcatgggctcctgctggtagatacaatgcagacatacggagccgacttcgatctgctgatggccagccataagaacttatccttcgacatcccaacaggcagcctgagggattcccgggcccaatctcctgtgtccgggcctaacgttgcccacttaacagacggcgccaccttgaacgataggagcgcaaccagcgtgagtcttgacaaaattttaactaaggagcaggaatctctaattaaactagaataccagtttgtctccagtgaatgtccttctatgaacctggacagcacgttgcaagtgatcagccttcaggttaacaatctggacatcatcctgaaccctgagactatcgtcgagctgattggcttcctgcagaaaagttttccaaaggagaaagatgatctgagtcctcagcctttaatgacagactttgagaggtcctttagggagcagggtacctaccagtcaacctatgagcagaacaccgaggtggccgtggagatccaccgccttaatttactcctgttacgaaccgtaggaatggcaaatcgtgagaagtatgggcgcaagatagccactgctagcatcggcggcacaaaggtcaatgttagtatggggtccactttcgatatgaatggatctttgggatgccttcaactgatggacctgacgcaggacaacgtcaagaaccagtatgtggtctcgatcgggaacagtgtggggtatgaaaacattattagcgatataggatatttcgagtccgttttcgtgcggatggaggatgcggcgctcaccgaggccctgagctttacttttgtggagcggagcaagcaagagtgctttttaaatcttaagatggccagtttacactataatcattcggccaagttcctgaaggagttaacactgtcgatggacgaactggaggaaaacttcagaggcatgctcaagagtgccgctaccaaggtgactactgttttagccaccaaaacagctgagtacagtgagatggtgtccctcttcgagaccccccgaaagacccgggaacccttcatcctggaagagaacgagatctacggattcgatctcgcaagctcccacctggataccgtaaagctgatcctgaatatcaacatcgagtctcctgtagtatcgatcccccggaaacccggttctccggagttattagtggggcatcttggccaaatctttatccagaacttcgttgcaggagatgacgagagcagatcagatagactccaggtggaaatcaaggacattaaactgtatagtttgaactgtactcagctggccggacgcgaggctgtgggttcagaaggcagtaggatgttttgccccccatccgggagtggctcagctaactcacaagaagaggcccatttcaccaggcatgactttttcgagtccctgcaccgcggccaggcattccatatattgaacaatactaccatccagtttaagctcgagaagattcccatagagagagagagcgagcttaccttctctttgagcccagatgatttggggacttctagcattatgaaaattgaaggaaagttcgtcaatccagtccaggtggtgttggccaagcatgtttacgaacaggtcttgcagaccctggataaccttgtgtattcagaggacctgaacaaatatcctgctagtgccacttcctctccctgtccagacagcccgctgcctcctttgtcaacgtgtggagagtcctccgttgagcgtaaggagaatggcctgttttcgcacagttccctgtccaatacgagccagaagtctcttagcgtgaaagaagttaagtcgttcactcagatccaggccaccttttgcatttctgaactccaagtccagctgtccggggacctgaccctgggagcccaggggctggtctctctaaagttccaggactttgaagtggaatttagcaaggaccacccccaaaccttgtctattcagattgccctgcatagtcttctgatggaggacctgttagaaaagaaccccgattctaagtacaagaacttgatggtcagtcggggtgctcccaaaccttcgagccttgcacagaaggagtacctttcccagtcctgtccatcggtgagtaacgtggaatatccagacatgccacgcagtctaccctctcacatggaggaagcacccaatgtgtttcaactttaccagagacctacaagcgcttcccgcaagaagcagaaagaggttcaggacaaggattacccactcacaccacccccaagcccaacagtagatgaacccaagattctggtcggaaagtccaaatttgacgattctttggtccatatcaacatcttcctcgtcgacaaaaaacatccagagttttcttcatcctataacagggtgaaccggagtattgatgtggattttaattgtttggatgtccttattacgctccagacctgggtagtcatactggactttttcggtattgggagtaccgctgacaaccacgccatgcggttgccccctgaggggattctgcataacgtgaaattggaaccacacgcaagcatggagagcggcctgcaagatcccgtgaacaccaaactggacctgaaagttcattccctcagtttggtgttgaataaaaccacctctgaattggctaaagccaatgtgtctaagctcgtcgctcatctcgagatgattgagggcgacctagcgctgcaggggtctatcggctccctgagcctgtcagacctcacgtgtcacggtgagttttatcgggagcgtttcactaccagcggagaagaagctctgatttttcagacctttaaatacggtcgtccagaccccttgctgaggagagagcacgatatccgggtgtctctgcgcatggcctctgtgcaatatgtgcatacccagagatttcaggccgaggtggtcgcctttatccagcacttcactcagctgcaggatgttttgggtagacagagagcagcaatagaggggcagacagtgcgcgaccaagctcagcgctgcagccgagttctgctggatatcgaggcaggagcgccagtgctgctgattcctgagtcctctcgctctaacaatctcatagtcgccaaccttggcaaacttaaagtgaaaaataagttcctgtttgctggcttccccgggaccttcagcctgcaagacaaggagagcgttccgagcgcgagtccgaccggaattccaaaacactctctcaggaagaccaccagcacagaagagccaaggggtactcacagccagggccagttcaccatgcctcttgctggaatgagcttaggctcacttaaatcggaattcgtcccatctaccagtacaaagcaacagggtccccagcctacattatcggtcgggcaggaaagcagttcacctgaggaccatgtgtgtttattagactgcgttgttgtggatctgcaggatatggatatctttgccgccgaaagacaccctagggaatattccaaagcccccgaagattccagcggggatctgattttcccctcttattttgttagacagaccggagggtccctacttaccgaaccttgcagattaaagttacaggttgagcggaacctcgataaagaaatttctcataccgtgcctgatatttccatccatggaaatctaagctctgtgcattgtagcctcgatctctataaatataagctcatcagaggactgcttgagaacaacttaggggaacccatcgaggaattcatgcgtccatatgacctgcaggaccctcgcatacatacggtgctctcgggagaagtatatacgtgcatgtgttttctgattgacatggtaaacgtgtctctggagctgaaagacccgaagaggaaggaaggtgctgggtctctggcccgatttgatttcaagaagtgcaaacttctttatgagtcatttagtaaccaaaccaaaagcattaacctggtgagtcactctatgatggcttttgacacgcgctacgctggccagaagacctcacctgggatgaccaacgtgttctcctgcatttttcagccagccaaaaactcaagcaccacccaagggagcatccagatcgaattgcactttagaagtacaaaggatagctcttgcttcacagtggtgctcaacaacctccgggtcttcctgatattcgattggttgctgctcgtgcatgactttctccacacgccgtcagatatcaagaaacagaaccatgttaccccctcacgccatagaaatagctctagtgagtctgctatcgtgcctaagaccgtgaagtccggcgtcgtaactaagcggtcttccttaccagtgagtaacgagcgccatcttgaggtgaaagtaaacgtgaccggaaccgagttcgtagtgattgaagatgtttcgtgctttgataccaacgcaattatactgaagggaacgactgtgttaacgtataagcctaggttcgtcgataggccctttagcggctctctgttcggcatcgaagtgttcagctgccgcctaggcaacgagcacgatactgcactttccatcgtggaccccgtgcagatccaaatggaacttgttggaaactcttcttaccaaaacagttccgggctgatggacgcctttaactccgaggattttcctcctgtgttggagattcagctccaggcgcttgacatacgcctgtcctacaatgatgtgcagctctttctggctattgcaaaatcaattcctgaacaggccaatgcagcggtcccggacagcgtggccctcgaatctgacagtgtcgggacctacctacctggcgcgtcccgcgtaggggaggaaatcagagagggcacccgacatacgttggacccagtgctggagcttcaacttgcaagactgcaggagctcggcttttctatggacgactgccgcaaagctctgctggcctgccaggggcagctgaaaaaggcagccagctggcttttcaaaaacgctgagccgcttaaaagtctctcactcgctagcacctctagagatagccctggagcagtggccgcgcccctgatctccggtgtagaaatcaaggccgagtcagtttgcatatgctttatcgacgactgtatggattgtgacgtccctttggcagagttgaccttcagcaggctgaatttccttcagagagtccgcacatcacctgagggttatgcccatttcaccctgagtggtgactactataatagggctctcagcggctgggaaccctttattgagccatggccctgctcagtgtcatggcagcagcaggccgcgagcagacttcatcccccacgcctgaagcttgaggccaaggccaaaccacgcctggatattaatattacctcagtcctcatcgatcagtatgtgtcaacaaaagagtcttggatggcggactactgcaaggacgataaggatatcgagtctgctaaatctgaggactggatgggaagcagtgttgacccaccgtgcttcgggcagagcctgccgctggtgtatcttcgaactcggtctacggccagtctgaccaatttggaacatcagatctacgcgagggccgaagttaaaacccccaaacggaggcagccctttgtgcccttcgctctgaggaatcataccggttgcactctttggttcgcaaccctgactactaccccaactagggccgcgctgtcccactccggatctccaggcgttgtgcccgaaggtaacggcacattcctggacgacacacacaacgtgtcagagtggcgcgaggtgctgaccggtgaggaaatcccatttgagttcgaagctagaggtaaactgcggcatcggcacacccatgatctcagaatccaccagttgcaggttagggtaaatggctgggagcaggtgtcgcctgtcagtgttgataaggtcggtacattcttcaggtacgccgcacccgataaaaatagcagctcctctaccattgggtctccttcatcaaggactaatataattcacccccaggtgtatttttccagcttgcctccagttagagttgttttcgctgtgacgatggaaggatccgctcgaaaggtgataactgtgcggtcagctctgattgtcagaaatcgccttgagacacccatggagctgcgcttggattcacctagcgctccggataagccagtggtcctgccagccattatgccaggtgacagctttgctgttccattacacctcacttcctggagactccaagcaagaccaaaaggtttaggcgtgttcttctgtaaagccccaatacattggactaatgtggtcaagaccgcagaaatctcttctagtaagcgcgagtgccatagcatggacactgagaagtcgagatttttccgcttttgcgtagcaatcaaaaaagaaaactaccctgactatatgccttcgaacattttttcagactccgccaagcagatttttcgccagccagggcatactatctatctactccctaccgtggtaatttgtaacctgttaccttgtgagctggacttctatgtgaaagggatgccgatcaatggaactctcaagcctggcaaggaagcagccctccataccgccgatacatcacaaaatattgagttgggagtgagtttggagaacttccctctgtgtaaagagttactaataccaccaggtacgcagaactacatggtgaggatgcgattgtatgacgtcaacaggcggcaactgaacctgaccattaggatagtgtgtagagcggaagggagtctgaagatttttattagtgccccatactggctgatcaacaaaactgggttacctctgatttttaggcaggacaatgccaaaaccgacgccgctggccagtttgaagagcacgagctggctcggtccctgagcccacttctgttctgctatgccgataaggagcaacccaacctctgtaccatgaggatcgggcgcggcatacacccagagggaatgccaggctggtgtcagggattttccctcgacggcggctccggcgtgcgcgctctcaaggtgattcaacagggcaacaggcctggcctaatttacaatatcggtatagatgtgaagaaaggccgaggcagatatatcgacacctgcatggtgattttcgctccaaggtatctgctggataacaaatcttcccataagctggcattcgcccagcgagagtttgctcgggggcaggggaccgcgaaccccgaggggtacatttccactcttccaggatcctccgtagtgtttcactggcccaggaacgattatgatcaactgttgtgcgtccgcttaatggacgtaccaaattgcatctggagcggcggctttgaagttaataaaaataattccttccacattaacatgagagatacgctgggcaagtgtttcttcttgcgggtcgaaatcacactgagaggggccacgtaccgcatctccttctctgatacggaccagttacccccccccttccgaatcgacaacttttcgaaagtgcccgttgtttttacacagcatggagtagccgaaccgaggttacggaccgaggtgaaacccatgaccagcttggattatgcgtgggatgaacctacgctcccgcccttcattaccctgacagttaaaggggcaggctccagtgagatcaactgcaatatgaacgacttccaagacaatcgacagctgtactatgaaaacttcatctatattgctgctacctacacatttagcgggttgcaggaaggcaccggccgcccagtcgcatctaacaaggcaattacatgcgctgagctagtgctggacgtgagccctaagacccaaagggtgatccttaaaaaaaaagaacccgggaaacggagccagctgtggcggatgactggcacaggtatgctggcgcatgaagggtcctcggttcctcacaatccaaataagccttctgccgctcgcagcaccgagggctctgccatattggatatcgcagggttagccgccgtgactgataatcgatacgaacccctcatgctgagaaaacccgatcgcaggaggagtacgacacagacttggtcgtttcgggaggggaaacttacctgtggcttgcatggcttggtggtacaggctaagggaggactgagcgggctgtttgatggggccgaggtggtgctcggtcctgatacatcaatggaactgttgggaccagtgccacctgagcagcagtttatcaatcagaagatgagaccaggtagcggaatgctcagtatcagggtcatacctgacggcccaacaagagccctccagataactgacttctgccaccgaaagagttccagaagctatgaagtggacgaactaccagtcaccgaacaagagttacaaaagttgaaaaaccccgacacagaacaggaactcgaggttttggtgaggctggagggtgggattggactttccctgattaataaagtgcctgaggaactcgtcttcgccagcctgacaggcataaacgtccactatacccaactggctacaagccatatgctggaacttagcattcaggatgtgcaggttgataatcagctaattggcacaacccagccgttcatgctgtatgttacacccttgtccaatgaaaacgaagtgatcgagactgggccagcagttcaggtgaacgcggttaagtttccttcaaagtcagcactcaccaatatatacaaacacctgatgatcacagctcagcggtttacggtccaaatcgaggaaaagctgcttctgaagctcctcagcttcttcggctacgatcaggccgagagcgaagttgagaagtatgatgagaatttgcacgaaaagacagcagaacagggtggaacacccattcgctactattttgagaatctcaagataagtatccctcaaattaagctaagcgtgtttacttctaacaaactgccccttgacctgaaagcactgaaatcaaccctgggattccctttaattcgatttgaggacgctgttataaatcttgacccttttacacgagtgcatccctatgagaccaaggagttcatcatcaatgacattctgaaacattttcaagaggaactactaagtcaagcagcgagaatattaggaagtgtggatttcctcggaaacccgatgggactactcaatgatgtcagcgaaggcgtgaccgggctgatcaagtatggtaatgtgggtggcctgatccgtaacgtcactcatggcgtctctaactcggcggctaagttcgccggaacactctctgacggcttgggaaaaaccatggacaaccgccaccagtctgagagggaatatattcgataccacgccgcaacgagcggggagcacctggtcgccggcatccacggcctggcccacggaattatcggaggacttacgagcgtgataactagtacggtagaaggagtgaaaaccgaggggggtgtctcgggctttatttctggcttaggaaagggacttgtaggaaccgtcaccaaacccgtggctggcgccctcgattttgcaagcgagactgcgcaggccgtaagggataccgctaccttgagtgggccccgcacccaggcacaacgcgtgcggaagcccagatgctgtactgggcctcagggactcttacctaggtatagtgagagccaggccgaggggcaggagcagctcttcaaactgacagacaacatccaggacgaattctttatcgcggtggagaacatcgacagctactgcgtcctgatatcctctaaagcagtgtacttcttaaaatctggggactacgtggatcgggaagctatcttcctggaagtgaagtacgacgatctctatcactgcctggtgagcaaggaccatggaaaagtgtacgttcaggtgacaaaaaaggcagtttccacgagtagcggggtctccatccccggtccttcccaccagaaacccatggtccacgtaaagagcgaagtgctggccgtcaagctcagccaggaaattaactatgcaaaatccttgtactacgaacaacagctgatgttgagactctctgagaatcgcgaacagttagagctggacagttag

SEQ ID NO: 52226 - DNA, 579 bp, Artificial Sequence
  Description of Artificial Sequence: Synthetic coding sequence
atgctgctggaggagaccggcctgaccccccaggagacctgcctgagtcctcggcgcccgcatagatggcagagaactcaagcccagagggtccggaagccaaggtgctgtaccggcccccaggggctgctgcctcggtattcagaatcccaggccgagggacaggaacaattgttcaaactcaccgataacatccaggatgagttctttatcgccgtcgagaatatcgatagctactgcgtcctgatttcctccaaggcagtgtacttcctgaaatccggcgattacgtggatagagaagctatcttcctcgaagtcaagtacgatgatctttatcattgcctcgtgtccaaagatcacgggaaggtgtacgtccaggtaactaaaaaggccgtttccacatcatccggggtgagcatcccaggaccaagccaccagaaacctatggtgcatgtcaagtcagaggtgttggcagtgaagctttcccaggagattaactacgcgaagtctttgtactatgagcagcaattgatgctccgactcagcgagaacagagagcaactggaactcgacagttag

SEQ ID NO: 52227 - DNA, 1161 bp, Artificial Sequence
  Description of Artificial Sequence: Synthetic coding sequence
atgcggggcgagaagctgagcaaggccctgaagagcaccctgggctttcctctcatccgctttgaggatgccgtgatcaatttggatccctttacccgtgtgcacccatacgagaccaaggagttcatcattaatgacattttaaagcactttcaggaggaactgttatcgcaagccgcgaggattctcgggagcgttgacttcctggggaaccctatgggcctccttaatgacgtgagcgagggggtgaccggtttaatcaagtatggcaacgtcgggggacttatccgaaatgtgacacatggagtttcaaactcggccgcaaagttcgctggtacactgtctgacgggctcggaaaaaccatggacaatcggcaccaatccgagcgcgagtacattcgatatcacgccgcaaccagcggagagcacctggtggccggaatccatggactggcccacggaatcatcggtggactgacatccgtcattacgagcaccgttgagggggttaagactgagggcggtgtttctggtttcatcagtgggcttggaaaggggttggtgggcacagttactaagcccgttgccggcgccttagattttgcttctgaaaccgctcaggccgtccgtgatacagccaccctgtccggaccacgcactcaggctcagcgcgtccgcaagcctaggtgttgcacaggaccgcaaggcttgttgccgagatactccgagtcacaagctgaaggccaggagcagctgttcaaactgacagacaacattcaagacgagtttttcattgctgtggagaatatcgactcgtactgcgtactgatctcctctaaggcagtgtatttcctcaagagcggggactatgtggatagggaagcgatcttcctggaggttaagtatgatgacctatatcattgtttagtgagcaaggaccacggtaaagtctatgttcaggttactaagaaggccgtgtcaacctcatccggtgtatctatcccaggcccaagccatcagaagcccatggtgcatgtcaaaagtgaagtgctcgctgttaagctgagccaggaaatcaactatgccaagtcactttattacgagcaacagctgatgctccgcttgtccgagaaccgggaacaattggagctggatagttag

SEQ ID NO: 52228 - DNA, 378 bp, Artificial Sequence
  Description of Artificial Sequence: Synthetic coding sequence
gagttcatcgaggagctgctgagcccccccttcggcggcctggtggcattcgtgaaagaggccgaggcactcatcgagaggggacaggctgagcgcctcagaggagaggaagcccgtgtcacccagctgattagaggtttcgggagcagctggaaaagttctgtggagtcactgtcacaggacgtgatgcggtctttcacaaatttccggaacgggacgtcaatcatccagggcgcactcacccagctcattcagctgtatcacaggttccatagagttctgtcccagccccagctgcgcgcactcccagcaagagcagagctgattaacattcatcaccttatggtggagctaaaaaaacacaaacccaacttctag

SEQ ID NO: 52229 - DNA, 378 bp, Artificial Sequence
  Description of Artificial Sequence: Synthetic coding sequence
gagttcatcgaggagctgctgagcccccccttcggcggcctggtggccttcgtgaaggaagcggaggccctcattgaacgcggccaggccgaacgcctgcggggagaagaagctcgtgtgacccagctcatacgcgggtttggaagttcttggaagtcaagcgttgagtctttatcccaagatgtgatgcgttcctttacaaatttccgtaatggtacaagcattatccaaggtgcactcacccagcttatccagctctaccatcggtttcatcgtgtgctgtcccaaccgcagctccgagctctccccgccagggctgagttaattaatatacaccatctcatggtcgagcttaagaaacacaaacccaatttctag

SEQ ID NO: 52230 - DNA, 1797 bp, Artificial Sequence
  Description of Artificial Sequence: Synthetic coding sequence
atggagcagatgctgggcgccttccagagcgacctgagcagcatctctagtgagatccggacactgcaggaacagtctggggcgatgaatataaggctgcgcaaccgacaagcagtgcgaggtaagctgggagaactcgttgatgggctagtggtcccctctgcccttgttaccgccatcctggaggcaccggtgactgaaccccggtttctggaacagctgcaggaattggacgcaaaggcggccgcagtgagagagcaggaagcccggggtaccgccgcctgcgctgacgtgcggggcgtgctggaccgtctcagggttaaggctgtcacaaagatcagggagttcatcctccagaagatctactcttttcgaaaaccaatgacaaattaccagatccctcagaccgcgttactgaagtaccgattcttttaccaattccttttaggaaatgagcgtgcgaccgcaaaagaaatccgggacgaatacgtcgagactttgtccaaaatttacctaagttactatagatcctacctggggaggctgatgaaagtgcaatatgaggaggtagctgaaaaggacgaccttatgggtgttgaggatacagccaaaaaagggttctttagtaaaccctcgctgagatcgaggaacaccatcttcactctgggcaccagaggctccgtgatctccccaaccgaactggaagcccccattttggttccgcacactgcgcaacgaggggagcagcgttaccctttcgaggctttattccgtagccagcactacgcacttcttgacaattcctgccgcgaatatctctttatttgtgagttcttcgtcgttagcggaccagccgctcacgatctatttcatgccgtgatgggacggacattgtctatgacgctaaagcatctggattcctacctggccgactgctacgacgctattgcagtcttcttatgtattcatatcgtactaaggttccggaacattgcggcaaagcgagacgtgccagccctcgatcgctactgggaacaggtgttggcactattgtggcctagatttgagttgatcctggagatgaatgtgcagagtgtccggagtacagatccccagcgattgggtgggctggacacgagaccacattatatcacacggcggtatgcagaattctcctccgccctggtgagcatcaaccaaacaattcctaacgagcgcacgatgcagctgcttggccagctgcaggtggaagtcgaaaatttcgttctgcgcgtcgctgcagaatttagcagccgcaaggagcaactggttttcttaataaacaactacgatatgatgctgggggttttgatggaacgcgcagccgatgatagtaaagaggtcgaatcttttcagcagttacttaacgcgcgaacacaagagttcatcgaagaactgctctcaccaccctttgggggcctggtggcttttgtgaaagaggctgaggccctgatcgagaggggccaggctgaaagactgaggggtgaagaggccagggttacccaactcattcgcggttttggctccagttggaaatccagcgtggaatcattatctcaggatgtgatgcggtctttcacgaatttcaggaacggaaccagcattattcagggagccctgactcagctgatccagttgtaccatagattccatagagtcctgagccagcctcagttgagagcactgcccgctcgggccgagttaattaatattcatcatctcatggtagagctgaaaaaacataagcccaatttctag

SEQ ID NO: 52231 - DNA, 1797 bp, Artificial Sequence
  Description of Artificial Sequence: Synthetic coding sequence
atggagcagatgctgggcgccttccagagcgacctgagcagcatctcctctgaaatcagaactctgcaggaacagagcggggctatgaacattcggctgaggaatcgtcaggctgtgcgggggaagctgggcgagctggtggacggccttgtggtgccatctgctctcgttacggctatcctggaagcccccgtaaccgaaccccgcttcctcgaacagcttcaggaactggatgccaaggccgcagcagtgcgggagcaggaggcaagaggcacagcagcctgcgctgacgttcgcggtgtccttgacagactacgggtgaaggcagttactaagattcgagaatttatacttcagaagatctactcatttcggaagcccatgactaattatcagatccctcaaacggcactactgaagtacaggtttttttatcagttcctcctcggcaacgagagagctaccgcaaaagagattcgggatgagtacgtggagacactgagcaaaatttacctgagttattacaggagttatctcgggcgtttgatgaaagtgcagtatgaggaggtcgccgagaaggatgatctaatgggcgtcgaagataccgctaagaaagggttcttctcaaagccatctctgcgctccaggaataccatttttaccctcggcacacgaggctcagttattagccctactgagctcgaagcacccattctggtcccacatacggcccagaggggcgaacagcgctatccctttgaggccttgtttagatctcagcattacgcactgctggacaactcttgccgggaatacctattcatttgtgagttcttcgtcgtgagcggccctgctgcccatgacttattccacgcagttatggggagaacactgtcaatgaccctgaaacacctcgactcgtatttagccgattgctatgacgctattgccgtttttctctgcatccatatagtgttacgcttccgcaatattgccgccaagagagatgtgccggcccttgaccgttactgggaacaagttttggccttactgtggccccggttcgaactgatccttgagatgaatgtacagtccgttcggagcaccgacccgcagagactggggggtctggacacacgtcctcattacattacaaggcggtatgctgaattctcttccgccctggtcagcataaatcaaactatacccaatgagcggaccatgcagctgctgggccaattgcaggttgaagtggaaaattttgtactgcgggtggctgcggaattctccagccgtaaagagcagttagtgtttctgatcaataattacgacatgatgttgggcgtcctgatggagcgagcggccgatgacagcaaagaagtcgagtcattccagcagcttttgaacgctagaactcaggaattcattgaagaattattaagtccaccattcggcggtctggtggcattcgtaaaagaagcagaggccctaatcgagagaggacaagcagaacgtctgcggggagaggaagctcgggtgacacagttgatcagaggatttggctcctcatggaagtcaagcgtggagtcactttcacaggacgtaatgcgtagttttaccaattttaggaatggcacaagcatcattcaaggggctctaacccagttaatccaactgtaccacaggtttcaccgagtgctctctcagccccagctgcgagcactaccagcaagggctgagctcataaacattcaccatctgatggtcgagctcaagaaacacaagcccaacttctag

SEQ ID NO: 52232 - DNA, 2106 bp, Artificial Sequence
  Description of Artificial Sequence: Synthetic coding sequence
atggaggaggaggagggccccctggccggcggccccggcctgcaggaacctctgcagcttggcgagcttgacatcacaagtgatgaattcatcttggatgaagtcgatgtgcacatccaggcaaacctggaggacgagctagtcaaagaagcgttaaaaactggcgtcgatcttaggcactatagtaaacaagttgaacttgagctgcagcagatcgagcagaagtcaatccgggattatattcaggagagcgagaacatcgcctccttgcacaaccagattaccgcatgcgacgctgtcttagaaaggatggagcagatgcttggcgcttttcagagtgatcttagctctatctcaagtgagatccgaacactgcaggaacagtcgggcgcaatgaatattaggctaagaaaccgtcaggccgtgagagggaaactcggagagctggtagatggccttgtggtccccagtgcgctggtcaccgctattcttgaagcacccgtgaccgaacccaggtttttagagcagttgcaggaactcgacgccaaggcagcagcggtgcgcgaacaggaagcccgtgggacagcagcctgtgctgatgtacgcggagttcttgacaggctgagagtgaaagctgtgacgaagataagagaattcattctgcagaaaatttacagttttcgcaaacccatgacaaattatcagatcccacagaccgctcttctcaaatatcgatttttttatcagtttctcttaggcaatgagcgagcgactgctaaagagattcgggacgaatatgtcgaaacgctctctaagatttatttgtcttactacagatcataccttggccggctcatgaaagtgcagtacgaagaggttgccgagaaggacgatcttatgggcgttgaagacaccgcaaaaaaaggcttcttctccaagccaagccttcgctctaggaacaccatatttacacttggcacccggggcagcgtcatctcacccactgaactggaggcccctatcctggtgcctcataccgcacagcgcggcgagcaaagatatccattcgaagctctgtttagatctcagcattacgccctcctggataactcctgtagggagtacctgtttatttgtgaattctttgtcgtctctggccccgcagcacatgatctctttcatgccgttatgggacggactcttagtatgactctgaagcatctcgattcctacctggcggactgttatgatgccatagctgtattcttgtgtatccacatcgtcctgcgttttaggaatatcgctgcaaagcgggatgtgcccgctctggatcggtactgggaacaggtcctggcattactttggccccggttcgagctaatccttgaaatgaacgtccagtccgtcaggtccaccgatccacagaggctgggtgggcttgatacccgtcctcactacatcacccggcgttacgctgagtttagcagtgcccttgtgtctataaatcagacgatacctaacgaacgcaccatgcaactgctggggcaactacaggtcgaagtggagaactttgtgctgcgggtggccgctgagtttagcagtcgaaaggaacagctggtgttccttatcaacaactatgacatgatgctgggcgttcttatggaacgcgcggccgatgatagcaaagaagtcgagtcatttcagcagttgctcaacgctagaacccaggagttcattgaggagctcctttctcctccttttggaggactcgtggccttcgtgaaggaggcagaagccttaatagagcggggacaggctgagcgcctcaggggggaggaggccagagttactcagctgatccgggggtttggtagttcctggaagtcgtctgtggagtcgctgagtcaggacgtcatgcggagtttcactaactttagaaacggcacgtcaattatacagggtgcactaacacagcttatacaactgtaccacagattccatagagtgctatcccagccacagcttagagcgttacccgcaagagccgaactcattaatattcatcacttgatggtcgaacttaagaaacacaaaccgaacttttag

SEQ ID NO: 52233 - DNA, 2106 bp, Artificial Sequence
  Description of Artificial Sequence: Synthetic coding sequence
atggaggaggaggagggccccctggccggcggccccggcctgcaggagccacttcaattgggagagctggatataacctccgacgaattcatcctggacgaagttgacgtgcacatccaagcgaatctggaagatgaactagtgaaagaggccctcaagacaggtgtcgacctgaggcactatagcaagcaggttgagctcgagctgcagcagattgagcaaaagagcatccgggactacattcaagagagcgagaatatcgccagcctccataatcagattaccgcctgcgatgctgtgttagaaagaatggaacagatgctgggggccttccagtctgaccttagctcaatcagctctgaaattcgaactctccaggagcaaagtggcgccatgaatatcaggctgcgaaatcgccaggctgtgcgggggaagttaggggagttggtcgatggactagtcgtgcctagtgctcttgtgacggccattttggaggcgccagtcaccgaacctcgattcctggaacagctccaggaactagatgcaaaagcagctgctgtccgggaacaggaggctcgcggcacagcagcctgtgctgatgtacgtggcgtgctggaccgactgagagtcaaggccgtgaccaaaattcgagaattcattctgcagaagatctacagtttccgtaaacccatgaccaactatcagataccccagacagctctcttgaagtataggtttttttaccagtttctgctggggaatgaacgagccacagcaaaggagatccgcgatgagtatgtggagaccttgtctaagatctatctgtcttactacagatcatacctaggaagactcatgaaggtgcagtatgaggaggtcgctgaaaaagatgacctgatgggagtcgaagacaccgctaagaaagggttcttcagcaaaccctccctcaggtcacgcaacacaatttttaccctgggcaccaggggctcagtgatctctccaacagagctggaggcgccgattctcgtcccgcacaccgcccaaagaggggaacagaggtacccatttgaggctctctttagatctcaacactacgcactcctcgataattcatgcagggagtatctttttatatgtgagttcttcgtagtctctggcccggctgctcacgacctgttccacgccgtgatgggccgcactcttagcatgacccttaaacacttggacagctaccttgcagattgttacgacgcgattgcagtctttctgtgtatacacatcgtgctaagatttagaaacattgctgccaagagggatgtccctgccttggatagatactgggagcaagtactggctttgctgtggcctaggttcgaactgatactcgaaatgaatgtgcaatcagtccgctctactgatccacaaaggctgggtggcctggacaccaggccacactacatcacacgcaggtatgccgagttctccagtgccctggtgagtatcaatcagactatcccaaacgagagaactatgcagcttctgggccagctccaggtggaagtggagaacttcgtgctgcgggtggctgcagagtttagctcacggaaagaacagctggtcttcttaataaataattatgacatgatgctgggggttctgatggagagggctgcagatgacagcaaggaggtggaatctttccagcagctgttgaatgcgcgtacccaggagtttatagaggaacttctgtcccccccatttgggggcctggtggcttttgtcaaagaagccgaagcgctgatagaacgaggacaggccgaacgtcttcgcggggaggaagcccgggtgacccaactcattcgtggcttcggatcaagctggaagagctccgtggaaagcttgagtcaagacgtgatgcgttctttcaccaattttcgaaacggcacatctataattcagggggccttgactcaattgatccagctgtaccacagatttcaccgggtgttatcacagccacaactcagagccctgcctgcccgtgcggaactcatcaacatacaccatttgatggttgaactgaagaaacacaaacccaatttctag

SEQ ID NO: 52234 - DNA, 1797 bp, Artificial Sequence
  Description of Artificial Sequence: Synthetic coding sequence
atggagcagatgctgggcgccttccagagcgacctgagcagcatcagtagtgaaatccggaccctacaggaacaatctggggctatgaacattagactgcggaatcggcaggccgttagaggcaaattaggcgagctcgtcgacgggcttgtggtgcccagtgcgttggtgacggccatcctcgaagccccggtgacagaacctaggtttctcgaacaactacaggaactggatgccaaagctgccgccgtccgcgagcaggaggcgcgcggtaccgccgcgtgcgccgatgtgcgtggcgtgctagaccgcctgagggtcaaggctgtgactaaaatccgagagttcattcttcaaaaaatatactctttccgaaagccaatgacaaactaccaaataccacagacagccttgcttaaataccgattcttttatcagttcttgctcggcaatgaaagggcaaccgcaaaagaaatcagagatgagtacgtagagacccttagtaaaatatatctatcgtactacaggtcctacctgggtagactgatgaaagtgcaatatgaagaggttgcagagaaggatgatcttatgggcgtggaagacacggcaaagaaaggctttttctccaagccttctctgaggagccgtaacaccatcttcactctgggcacgcgtggctcagtgatctccccaacagaacttgaagcgccgatactggtcccccatactgcacaaagaggggaacagcggtacccattcgaggccctgtttaggagccagcactacgccctcttagacaatagctgcagagagtacctgtttatctgcgagttcttcgtggtatctggacctgctgctcacgatctgttccacgcagtaatgggtaggaccctgtcaatgaccttgaagcacctggattcatacctcgcggactgctacgatgcaattgcagtgtttctgtgcatccatatcgtgttgaggtttcgtaatatagccgccaagagagacgtcccagccctcgataggtattgggagcaggtgctggctctgttatggccccgcttcgaattaattttggaaatgaatgtgcagagcgttagaagtaccgatccccagaggcttgggggactcgacacaagacctcactacatcacacgtaggtacgcagaattcagctccgccctggtgagtattaaccagaccatcccgaacgagagaactatgcagttgctcggccaacttcaggtggaagtagagaactttgtgctcagagtggcagctgagttctcttccaggaaagagcaactggtgttccttattaataattacgacatgatgctcggagttctgatggaacgggcagcagatgactctaaagaggttgaatccttccagcaacttctgaacgcccggacacaggagtttatcgaagagctcctttcaccaccgtttggggggctcgttgcattcgttaaagaggccgaagctttgattgaacggggccaggccgagagactgaggggagaggaggccagagtcactcagcttattcggggcttcggcagcagctggaaatccagtgtagagtctcttagccaggatgttatgaggagcttcactaacttcaggaacggcacaagcataatacagggagccctcacccagctcattcagctctatcacaggtttcacagagtgttgagccaacctcagctcagggcactgcccgcccgagccgagctgattaacatccaccacctgatggtagaactgaagaagcacaaacctaatttttag

SEQ ID NO: 52235 - DNA, 2106 bp, Artificial Sequence
  Description of Artificial Sequence: Synthetic coding sequence
atggaggaggaggagggccccctggccggcggccccggcctgcaggagccactccagctgggagaactggacattacatctgatgagttcattctggacgaggtagacgtgcatattcaggccaatctagaagatgagctggtcaaggaagcgcttaagacaggagttgatctgcgacactacagcaagcaggtggagctggaattgcaacagatcgagcagaagagcatcagggactatatccaggagagtgagaatatcgcgtctctccataaccaaattactgcttgtgatgcggtcctcgagcggatggagcaaatgctgggggccttccagagcgacctgtccagtataagctcagagatccgtacgcttcaggagcagtccggcgctatgaacattcgccttagaaaccgccaggctgtaaggggcaagctcggggagttggtggatggtcttgtggttccctccgctctggtgaccgctatcctggaggctcccgtgacagagccccggtttctagagcagcttcaagaactcgacgctaaggctgcagccgtacgggagcaagaggccagaggcaccgccgcctgtgctgacgttcggggagtcctggaccgtctgcgagtcaaagccgtgactaagatcagagagttcatccttcaaaagatctattcatttcgaaaaccaatgaccaactaccagataccccagaccgctttactcaaatatagattcttctatcagttcttgctggggaatgaaagggctacagccaaggagatcagggacgaatacgtggaaactcttagcaaaatttacctctcatattatcggtcttacctaggccgattaatgaaggttcaatatgaggaggtagccgaaaaagacgatctgatgggcgtggaggatactgccaagaagggctttttttccaaaccttctctgcggagtagaaatactattttcacgctaggtactcggggatcagttatctcacccacggagttggaggctcccatcctggtgccccacaccgcccagcgtggagagcagcggtatccgtttgaggcactgtttaggagccagcactacgcactgctcgacaattcttgcagggagtacttattcatttgtgaattcttcgtggtctcgggcccggccgctcacgacctcttccacgccgtcatgggccggacactcagcatgacgctaaaacacctcgacagctacctagctgattgctacgatgccatcgctgtattcctctgcattcatatcgtgttgcggttccgaaacattgctgctaagcgcgacgtgcctgccctcgatagatactgggagcaagtattagcgctcttgtggccccggtttgagttgatcttggaaatgaatgtgcaaagcgttcggtctactgacccccagcggctgggaggcctcgatacaagaccgcattatataacccgccgctatgctgaattcagcagtgccctcgttagtatcaatcagaccatccctaacgagcggacaatgcagctactcggccagcttcaggtggaagtagagaatttcgtgctgcgcgtggctgccgagttttcttcaaggaaggaacagctcgtgtttctcatcaataactacgacatgatgctcggagtgctgatggagagggccgctgacgacagcaaagaagttgagtcatttcagcagttgctgaacgcgcgcacacaggaatttatagaagaacttctctcacccccattcggggggctggtggcctttgtgaaggaagcagaggctcttatagagcggggtcaggccgagcggcttcggggtgaggaagcccgtgtgacgcagctgatccgaggctttgggagcagttggaagtccagcgtcgagtccctgtcacaggatgtcatgagatcattcactaactttagaaacggcaccagcatcatccagggcgctctgacacaactgatccagctgtatcaccgatttcatagagtcttgtcccagccacagcttagggccctgccagctagagccgaattaataaacatccaccaccttatggtggagctaaaaaagcataagcctaatttctag

SEQ ID NO: 52236 - DNA, 2013 bp, Artificial Sequence
  Description of Artificial Sequence: Synthetic coding sequence
atgatggaggaggaggagctggagttcgtggaggagctggaggccgtgttgcagttgactcctgaagttcagttggccatcgagcaggtgttcccgagccaggaccctctggaccgcgccgacttcaacgcagtggagtatattaacacccttttccctactgaacaaagcttagctaatattgatgaagtggtgaataagattcgcctcaaaatcaggcgcctggatgataatatacggaccgtcgttcgcggccaaacaaacgttggacaggacggcaggcaggtcaaggagattacccgtgacatcaagcagctggatcatgccaaacgtcacctcaccacctcgataaccacattgaatcatctgcacatgttggccggcggtgtggacagcctggaggcaatgaccaggagacgccaatacggggaggttgctaatctgttgcagggcgtgatgaacgttctggagcactttcataagtacatgggaatcccccagatcagacagctgagcgagagagttaaggcagctcaaaccgagctggggcaacaaatcttggccgatttcgaagaggctttccccagtcagggcaccaaaaggcccggtggccccagcaacgtgctgagggatgcctgtcttgttgctaatatcttagatccgcgcatcaagcaggagattattaagaagtttattaagcagcacttatccgagtacctggtgctctttcaggaaaaccaagacgtggcttggctggataagatagatcggagatacgcttggatcaagcggcagttggtcgactacgaagaaaagtatggccgcatgttcccccgcgaatggtgtatggccgagaggattgccgtggaattttgccacgttacgagagctgaactggctaagattatgcggacccgcgctaaggagatcgaagtgaaattgctgctgttcgcaattcagcggactactaattttgaaggattcctcgccaagagattttctggctgtacgttaaccgacggtacactgaaaaagctggagtctccacctccctcgacaaatcccttcctagaggatgagccaaccccagagatggaagagctggcaaccgaaaaaggagacctcgatcagcccaaaaaacctaaggcgccggataaccctttccacgggatcgtttccaaatgttttgagcctcacttgtacgtttacatcgaatcccaggataaaaaccttggggagctcatagaccggtttgtcgctgactttaaggcccagggacctcctaagcctaataccgacgaaggcggcgccgtcctgccttcatgtgccgacctgttcgtgtactataaaaaatgcatggtgcaatgttctcaattatcaacaggggagccaatgattgcccttactactatctttcagaaatatctgcgcgaatacgcctggaaaattttgtctggcaatttgcctaagacaacaacgagtagcgggggcctgactatttcttctctcttgaaggaaaaagagggcagcgaggttgccaagtttacccttgaggagctgtgcttgatctgcaatatcctgagtacagccgaatattgcttggccacgacccagcaactggaagaaaaactcaaggaaaaagtggacgtcagcttaatcgagcgaatcaatttgacgggcgaaatggacacattctctacagtcatctcctcaagcattcagctcctggtccaagaccttgatgccgcttgtgaccccgccttgacagcgatgtctaagatgcagtggcagaatgtcgagcacgtgggcgaccagtctccatacgtgacctctgtgattttgcatattaagcagaacgtaccgataatccgggataacttggcttctacaagaaagtacttcacacagttctgcgtgaagtttgctaactcgttcatacccaagtttatcacccacctctttaaatgcaaaccgatctccatggtgggagcagaacaggttcggtggacttag

SEQ ID NO: 52237 - DNA, 1644 bp, Artificial Sequence
  Description of Artificial Sequence: Synthetic coding sequence
atgatggaggaggaggagctggagttcgtggaggagctggaggccgtgctccagctgacacccgaggtccagctcgccatcgagcaggtctttccaagccaggacccactggatcgcgcagatttcaatgctgtcgagtatatcaacaccctgtttcccaccgagcagtcgctggctaatattgacgaagtagttaataaaatccgtctcaagattcggagattggacgataacatccgcactgtggtgagaggccagacaaacgtgggacaggacggacgccaagctctggaagaagctcagaaagccatccagcagttattcgggaagattaaggacataaaagacaaggccgaaaaatctgagcagatggtgaaagagataacaagagatattaaacagctggaccacgcaaaaaggcacctgactaccagtataacaaccttaaaccacctgcacatgctcgccgggggagtggattccctggaggcaatgaccaggcgtagacaatacggcgaggtggctaacctacttcaaggggtgatgaatgtgctcgaacattttcacaagtacatgggcatccctcagatccgtcagttgtccgagcgagtgaaagcggcacaaactgagcttggccagcagattctcgccgactttgaggaagctttcccatcccaaggaaccaaggttgcatggctcgacaagattgataggcgatatgcctggatcaagcgacagctggtcgactacgaggagaaatacggccgaatgtttcccagggagtggtgcatggcggaacgaattgcagtcgaattttgtcacgtgacacgggctgaactcgcaaaaatcatgcggacgagagccaaggaaattgaggtcaaactgctgcttttcgcaattcaacgcaccaccaattttgagggcttcctggccaagcggttttcaggctgcacgttgaccgatggcacactgaaaaagctcgagtctcccccaccctccaccaacccatttttggaggatgagccaactccagaaatggaggaattggctactgagaaaggcgatctggatcagcctaaaaagcctaaggctcccgataatccctttcacggcattgtgagcaaatgcttcgagccacacttgtacgtctacatcgaatcacaggacaaaaacctgggcgaactgattgaccgatttgtagccgatttcaaggcccagggcccgcccaaaccaaacaccgacgaaggcggggcagtgttgccttcgtgtgcggatctgtttgtgtattacaaaaaatgtatggtccagtgctctcagctgagcacgggtgaaccaatgatcgctctcaccaccattttccaaaagtacctgagggagtatgcttggaagattctgtccggcaacctgcccaaaacaaccacctcttccggcggcttgaccatctcatcccttctaaaagagaaggagggcagcgaggtcgcgaagtttaccttggaagaactgtgcctgatctgtaatatactgagcacagctgagtactgtctcgccacaacacagcaacttgaagagaagctgaaggagaaggtggatcgccacctgcagcaatactcagctgctgggtccggcagtggatgttgcttatag

SEQ ID NO: 52238 - DNA, 1269 bp, Artificial Sequence
  Description of Artificial Sequence: Synthetic coding sequence
atgatggaggaggaggagctggagttcgtggaggagctggaggccgtcctgcaactaacaccagaggttcagctggctattgagcaggtgtttccttcccaggatcctcttgatagggccgattttaacgctgtggaatatataaatacactgtttcctaccgaacagtccttagcgaatatcgatgaagtggtaaataagattcgtctcaagattcgtagactggacgacaatatccggaccgttgtccggggacagacaaacgtggggcaagatgggagacagaaaaagctggagagtccaccgccgtctacgaacccctttctagaagacgagcctactccagaaatggaggagctcgctaccgaaaagggagatttagaccaacccaagaagcccaaagcccctgacaatccctttcacggtattgtctcaaagtgctttgagcctcatctgtatgtgtacatcgaatcccaggacaagaatctcggcgaactgattgacagattcgtcgctgacttcaaagctcagggcccaccaaaaccaaacacagacgaaggcggtgctgtgctgccatcatgcgcagacctttttgtgtactacaaaaagtgcatggtccaatgtagccagcttagcacaggtgagcctatgatcgcgttaaccactatcttccagaagtaccttagagaatacgcttggaagatcctatccggtaacttgcctaaaaccaccacatcctccggaggccttacgattagttcactgctgaaagaaaaggagggcagtgaagtggccaagtttaccctggaggagctgtgtcttatctgcaatattctctcaaccgctgagtactgtctggctaccacacagcagctggaagagaaactgaaggagaaggtggatgtgtcactgattgaacgaattaatcttaccggggaaatggacactttcagcacagttatctctagttccatccagttgcttgtgcaagatctggacgccgcctgtgaccctgccttgaccgccatgtcaaagatgcagtggcaaaatgtcgagcacgtgggcgatcaatcaccttatgtgacctcagtgatcttgcacataaaacagaatgtgcctattatcagagataaccttgcgtcaacccggaagtactttactcagttttgtgtgaagtttgctaatagctttatcccaaagtttatcacacacctgtttaaatgcaaacctatttctatggtgggggctgaacaggtgcgctggacttag

SEQ ID NO: 52239 - DNA, 2499 bp, Artificial Sequence
  Description of Artificial Sequence: Synthetic coding sequence
atgatggaggaggaggagctggagttcgtggaggagctggaggccgtcctgcagctgacccccgaggtccagctggctatcgagcaggtgtttccctcgcaggaccctcttgaccgcgccgattttaacgcagtggagtatattaatacactgttccctaccgagcaatctctggccaatatagacgaagtggtcaacaagattcggcttaagattcgaaggctggacgacaatatcaggacagtcgtcaggggacagaccaatgtggggcaggacgggcgtcaagcattagaggaggctcagaaagccatccaacagctctttgggaagattaaagatatcaaggataaagcggaaaagtcagagcagatggtcaaggagatcaccagagacattaaacagctcgatcacgccaaacgccatctgacgactagcattactacactcaatcatctgcatatgctcgccggaggggttgatagccttgaggccatgactaggaggaggcagtatggtgaggtagcaaacctgttacaaggtgtgatgaacgtgctggaacattttcacaagtacatggggattccccagattcggcaattgagcgagagagttaaggccgcccagactgaattggggcagcagatcctggccgacttcgaagaggcgttcccttcacaagggacgaaacgtcctggaggcccctctaatgtgttgcgagatgcgtgtctggttgctaatatcttggatccccggatcaagcaggaaatcatcaaaaagttcattaaacaacacctctccgaatatctcgtgctgttccaggaaaatcaggacgtggcatggctggataagatcgatcgaaggtacgcctggatcaagcgacagctagtagattacgaggagaaatatggccgtatgttcccccgggaatggtgcatggctgaaagaatagccgtagagttttgccacgtgacgcgtgctgagttggcaaaaatcatgagaacgcgggccaaggagatcgaggtgaagctcctcctctttgcaatccagcgtactaccaactttgaagggtttcttgcgaagcggttcagtgggtgtacacttactgatgggacacttaaaaaacttgaatctccgcctccctctactaatcccttcctggaagatgagccaacacccgaaatggaggagcttgccaccgagaagggggatcttgatcagcccaagaaacctaaggcgcccgataacccattccatggaattgtgagcaaatgtttcgagccacacctttatgtgtacatcgaaagtcaggataaaaacctcggcgaacttatcgaccgctttgttgcggattttaaggcccaagggcccccaaagccaaacacagatgaagggggggctgtcttaccttcttgtgctgatctgtttgtctattacaagaaatgcatggtacagtgtagccagcttagtacgggggagcctatgatcgcgctcaccactatatttcagaaatacctgagggagtacgcctggaaaattctcagcggcaacctgcctaagacaactacttcttctggagggctgaccatttcctctctgctgaaagagaaggagggttcagaggtggccaaatttacactagaagagctttgcctaatatgcaatattctaagtacagcagagtactgccttgccacgacacaacagctggaagagaagctcaaagaaaaggttgatgtgagtctgatcgagaggattaacctcacgggagaaatggacacctttagcacggtaatctcctcctcaatccaactactggtacaggacttagatgccgcttgcgatccggcactgaccgctatgtcaaaaatgcagtggcagaacgtcgagcatgtcggcgatcagagtccctatgtaacatcagtgatactgcatattaagcaaaatgtacccataattcgcgataatctggcttcaactaggaaatatttcacgcaattttgtgttaaattcgccaattcgtttatcccaaaattcatcacccacctgttcaagtgcaagccaattagtatggtgggcgcagaacagctgctgctcgatacacattccctcaaaatggtcctcctcgacctacctagcatttcaagccaggtggtcagaaaggctcctgccagctatacaaaaatagtggttaagggtatgacacgagccgagatgattcttaaggtcgtgatggctccccacgagcccctggtcgtcttcgtggacaactatatcaaactcctcacagattgcaacaccgaaaccttccagaagatactagatatgaagggtcttaagcggagtgagcagtcatcaatgctggagctgttacgccaacggctccccgcccccccgagcggggcagagagttctggctccctgtcactcaccgcccctacgccggagcaggaatcttcccgaattcgcaagttagagaagctaatcaagaagagactgtag

SEQ ID NO: 52240 - DNA, 1506 bp, Artificial Sequence
  Description of Artificial Sequence: Synthetic coding sequence
atgttcagcctgatcgtgaaggccgcccagaccgagctgggccagcagattctcgccgacttcgaggaagccttcccttctcagggcaccaagagacccggtggaccgagtaatgtgttacgagatgcctgtctggtggccaatattcttgatccaagaatcaagcaagagatcatcaaaaagtttattaagcagcatctctctgagtatctcgtgctatttcaggaaaaccaagatgtcgcctggctggataaaatcgaccggcgttacgcatggatcaaacgacagctcgttgattacgaggagaaatatggtcgaatgttccctcgcgagtggtgtatggctgaacgcatcgctgtggagttttgccatgtgacccgcgccgagttggctaagattatgagaacgcgggcaaaggaaattgaggtcaagcttcttttgttcgcaatccaaagaacaacgaactttgaggggtttctcgctaagcggttcagcggttgcacactcacagacggcactttaaagaagctggaaagtccacccccctctaccaaccctttcctggaagacgagccaactccggagatggaagaactggccaccgagaagggtgacttggatcagcccaagaagcccaaggccccagacaatccttttcacggcatagtgagtaagtgtttcgagccacacttgtatgtgtatattgagtcccaggacaagaacctgggtgagttaattgacaggtttgtggcggatttcaaggcacagggtcctcctaaaccaaacactgatgaagggggcgctgtcctgccaagctgcgctgacttgttcgtgtactataagaagtgcatggtgcagtgttctcaactgagcactggcgaacccatgattgccctgacaaccattttccagaagtacctgcgggagtatgcatggaagattctgagcgggaacttgccaaagactaccacttcttccgggggcttgaccatatcaagcctcctgaaagagaaagagggctctgaggttgctaagtttacactagaggagctgtgtttgatctgcaatatcctgagtactgcggaatactgtctcgccacgacacagcaactggaggaaaagctgaaggagaaagtggatgtcagcctaattgaacggattaaccttactggcgaaatggacacatttagtactgtgatctcttctagtatccagctgttggtgcaggatctcgacgccgcctgtgacccagccctgacggccatgagtaagatgcagtggcagaatgtggagcatgtgggcgaccagtccccatacgtgactagcgtcatactgcacatcaagcagaacgtgcccatcatccgcgataatctggcttctaccagaaaatatttcacccaattctgtgtgaaatttgccaacagctttatccctaagttcatcacccatctgttcaagtgtaagccaatcagcatggttggggcagagcaggtacgctggacttag

SEQ ID NO: 52241 - DNA, 387 bp, Artificial Sequence
  Description of Artificial Sequence: Synthetic coding sequence
atggtgctgctggacctgcccagcatcagcagccaggtggtgcggaaagcccctgcaagctatactaaaatcgtggtaaaggggatgactagagccgagatgatccttaaggtcgtaatggccccccacgagcccctcgtcgtcttcgtggacaattacataaagcttctaacagactgtaataccgagactttccaaaagatcctggacatgaagggcctaaaacggtctgaacaatccagtatgctggaactgttgagacagcgtctgcctgctcccccgagcggggcagaatcttcaggaagtctttctctgacagctcctacaccagagcaagagagcagccgaatcaggaagctcgaaaagctcataaaaaaaagattatag

SEQ ID NO: 52242 - DNA, 2934 bp, Artificial Sequence
  Description of Artificial Sequence: Synthetic coding sequence
atggccagcagccacagcagcagccccgtgccccagggcagcagctcagacgtcttcttcaagatcgaagttgaccctagcaagcatattcgcccagtgccgtctctccccgatgtgtgtcctaaagaaccaacaggtgactcacattccctctacgtggccccgtctctagtaaccgaccaacataggtggaccgtttatcattcaaaggttaatctccccgccgcactcaacgatcctcgactggccaagagagaatcagattttttcacgaagacctggggactggacttcgtcgacacagaagtcattccctcgttctacttgcctcaaatttcaaaagaacatttcaccgtttatcagcaggagatatcccagcgggaaaaaattcacgaaagatgtaaaaatatctgtcctcccaaggatacattcgaacgcacgctgttacacacccacgataagagtcgcactgatctggaacaggtccccaaaatttttatgaagccagatttcgccttggatgattcccttacgttcaactctgttctgccctggtcccattttaacaccgcggggggaaaagggaatagagacgccgcctcgtccaaactgctgcaggagaagctgtcacattacctggacatcgtggaggtgaatattgcacatcagatctctcttaggagcgaagcattttttcatgccatgacttcacaacatgagctccaggattacctgcgcaagactagccaggccgtcaagatgctccgggataaaatagcacaaatcgacaaagtcatgtgcgagggaagtttacatattctacgccttgcattgacgcggaataactgcgtgaaagtgtacaacaagctgaagctcatggctactgtgcaccagacacaacctacagtccaggtgcttctttctacctctgagttcgtgggtgccctggacctgatcgcaaccactcaggaggttctgcagcaagagctgcaggggatccattcatttagacatcttggctctcagctttgtgaactagagaagctgatcgataaaatgatgatcgccgaattcagcacgtactcacactcggatctgaaccggccattggaggacgactgtcaggtcttggaggaagaacgcctgatcagtttagtcttcggactgctgaaacaaagaaaactcaatttcctggaaatttacggggaaaagatggtgattaccgcgaagaacattattaaacagtgcgtgatcaacaaggtatcccaaacggaggagattgatactgacgtcgtcgtcaagctggccgaccagatgaggatgttgaattttccccagtggtttgatttgctgaaggacatattctcaaaattcactatttttctccagcgggtgaaagcgacacttaacattatacactctgtcgtcctctccgtgcttgataagaaccagcgtacgcgggaactcgaggagataagccagcaaaaaaatgccgccaaggacaacagcctggacactgaggtggcctacctgatacacgaggggatgtttatctctgacgcatttggggaaggagagttgacaccaattgcagtggatacgacctcccagcgtaacgcatcaccaaactcagagccctgctctagtgattccgtctcagagccagaatgcacaaccgattcatcctcctcaaaggagcacacctcctccagcgcaatccccggcggcgtcgatatcatggtgagcgaagacatgaaacttactgacagtgagcttggaaagctggcaaataacattcaagaactgttgtacagtgcttcagacatctgtcatgatcgtgcagtgaaattcctcatgtctcgggctaaggatgggttcctggagaaactcaattccatggagtttatcaccctttccaggctgatggaaacatttatcctcgacaccgagcaaatctgtggaagaaaatctacatctctgcttggcgctctgcagtcccaggcaattaaattcgtgaatcggttccacgaagaacggaagaccaagctgtcactcctgctagataacgaacgctggaagcaggccgatgtgccggcagaattccaagatctggtggatagtctctcagatggaaaaattgccctccccgaaaaaaagtccggagcaaccgaagaaaggaagccagccgaagtattgatcgtggagggccagcagtatgctgttgtgggcaccgtcctgctgctgattaggatcattttagagtattgtcagtgcgtagacaacatccccagtgttactaccgacatgctcaccagattgtccgatttgctgaaatatttcaacagccgctcttgtcagctcgtgcttggcgccggagcgctacaggtggtggggctgaaaactataacaactaaaaacttagcactctcttctcggtgtttacagctcattgtgcactacattcccgtcattcgcgctcacttcgaggctcggttgcccccaaagcagtattcgatgctgaggcacttcgaccacatcacaaaagactatcacgaccacattgcagagatctctgccaaactggtcgcaatcatggacagtttgttcgataaactgctaagcaaatatgaagtcaaggcccccgttccctctgcttgctttcggaacatatgcaagcaaatgactaaaatgcacgaggccatcttcgatctgctgccagaagagcaaacacaaatgctcttcctgaggattaatgcatcctacaagttgcatttgaaaaagcaactgtctcacctaaacgtcatcaacgatggcgggccccagaacggcctggtaacagctgatgtcgctttttacaccggcaacctgcaggctctgaagggcctaaaggacctggacttgaacatggccgaaatctgggagcaaaagagatag

SEQ ID NO: 52243 - DNA, 2901 bp, Artificial Sequence
  Description of Artificial Sequence: Synthetic coding sequence
atggccagcagccacagcagcagccccgtgccccagggcagcagctccgatgtatttttcaaaatcgaggttgatccctccaagcatatacggcctgtgcccagcctccccgatgtttgtcctaaggagcccactggtgattcacactcactttacgtagctccgtctcttgtaactgatcagcatcgctggaccgtctaccattctaaggtcaaccttcctgccgcgttgaacgatccgcggttagccaagagggagagcgattttttcacaaagacctggggactagacttcgttgacacggaggtaatccccagtttctacttaccacagatatcgaaggagcacttcactgtgtaccagcaggaaataagccagcgcgagaaaatacacgaaagatgcaaaaacatttgcccacccaaggacacctttgagaggactctcttgcatacacatgataaatccaggacggacttagagcaagtgcccaagatcttcatgaagccagactttgcactggatgactccttgactttcaattccgttctcccatggtctcactttaacaccgcaggtggcaaggggaatagggatgctgcatcaagtaaattgctgcaagaaaagctgagccattacctggacatcgtggaggtgaacatcgcgcaccagatcagcttacgaagcgaggctttttttcatgccatgacttcgcagcatgagcttcaggactatctcagaaagaccagccaggcggtcaaaatgcttcgggataagatagcccagatcgacaaggtaatgtgcgagggctcgcttcatattttgagactcgctctgacccgaaacaactgcgtgaaagtctataataagctgaaactgatggccaccgtgcaccaaacccaaccgacagtgcaggtgctcctcagtactagcgagttcgtgggagccctggacctgattgccaccacccaagaggtcttgcagcaggaacttcagggtattcattcattccggcatctcggctcccagctgtgtgagctcgaaaaactgatcgacaagatgatgatagctgagttcagtacttattcgcattctgatctgaaccggcctttggaggacgattgccaggtgcttgaagaggagagattgatttccttagttttcggattactgaagcagcgaaagctcaattttctcgaaatctatggggaaaaaatggtgattacagccaaaaacattattaaacagtgtgttatcaacaaggtaagtcagacagaagaaattgatacagatgtggttgtaaaactggcggaccagatgcgaatgctcaatttcccccagtggttcgatctgcttaaggatatattctctaagtttacaatcttcctgcagcgcgttaaggcaacactgaatatcatccactctgtggttctgagcgtccttgacaagaaccaaaggacgagggaactggaagagatcagccagcagaaaaatgccgctaaggataactccttagacactgaggtggcctatctcatccacgagggaatgtttatttcggacgcgtttggagagggtgagctcacccccattgccgtggatacaacatcacagagaaacgcctctcccaactcagagccctgctcttctgatagcgtgagtgagcccgagtgcacaacagatagcagtagttccaaagaacatacatcttcttcagcaatacccggaggcgtggacatcatggttagcgaggacatgaagctcactgacagtgagttgggcaagttggccaacaacattcaagaactactctacagtgcttctgatatatgtcacgatcgagcagtaaaattccttatgagccgggccaaggatggctttctcgaaaagctgaactccatggagttcattactctgtctcgccttatggaaactttcatcttggatactgaacaaatttgcggccggaaaagcaccagcttgctcggcgctctccagtcccaggctatcaagttcgtgaatcgattccacgaggaacgaaaaaccaaactaagccttcttctggataacgaacgttggaagcaggcggacgtgccggctgagttccaggatttggtggactcgctgagcgatggtaagattgccttgccagagaaaaaatcaggcgcaacggaggaacgaaaaccagccgaagtgctaatagttgagggccagcagtacgctgtggtgggcactgtgctgctgctgattcggataatactggaatactgtcagtgtgtggataatatcccatctgtgaccaccgacatgttgacccggctgagtgatcttcttaagtattttaactctcgatcttgtcagctggtgctcggggccggcgctctccaggtggtggggttaaaaactatcacaaccaagaacttagctctgagtagtaggtgcctgcagttaatcgtgcattatatacctgtgataagggctcatttcgaagccagactgccaccaaaacaatactctatgttacgccatttcgaccacattacaaaagattatcacgatcatattgccgaaatttcggctaagctggtcgcaattatggattccttgtttgacaagcttctgagcaaatacgaagtcaaagcccccgtaccaagcgcctgttttcgaaacatttgcaagcagatgacaaaaatgcacgaggccattttcgatctcttgccagaggagcagacacagatgttgtttctgagaatcaatgcgtcttataagctccatctgaagaaacagctgtcacacctcaatgttatcaacgatggaggacctcagaacggcctcgtgaccgcggacgtagcattctatacaggaaacctgcaggccctcaaagggttgaagatctggatgtag

SEQ ID NO: 52244 - DNA, 2898 bp, Artificial Sequence
  Description of Artificial Sequence: Synthetic coding sequence
atggccagcagccacagcagcagccccgtgccccagggcagcagcagcgacgtcttctttaagatcgaagttgacccaagtaaacacataaggccggtgcctagtctccccgatgtttgcccgaaggagccaaccgtgactgaccagcaccgctggacggtgtatcacagtaaagtcaacctcccagccgccctcaacgaccctcgcctcgcaaagagggaaagtgacttcttcacaaaaacatggggactcgatttcgtggacacagaagtgattccgtcattttacctcccacagatttcaaaggaacactttaccgtctaccagcaggagatctcccagcgggaaaaaatccatgagcgctgtaaaaacatttgcccacctaaggacactttcgaacggaccttactgcacacacacgacaagtcaaggaccgacctggaacaggtccccaagatattcatgaagcccgactttgcactagatgatagtctgacgtttaactccgtgctcccctggagtcatttcaataccgcagggggaaaaggaaacagagacgctgcttctagtaaactgctacaggagaagttgtcccattatctcgatatcgttgaagtgaacatcgctcaccagattagcctgagatccgaagccttctttcacgcaatgacgtcacaacatgaactgcaagattacctgaggaaaacttcacaggccgtgaagatgttgagggataagattgcccagatagataaggtgatgtgcgaggggagtttgcacattctcaggctcgcccttacccgcaataactgcgtcaaagtttacaataaactaaaactgatggccacggtccaccagacacagcctaccgtgcaggtattgctgtcgacgtcagagttcgtgggagcattggatctgatcgctactacacaggaagtacttcagcaggaacttcaaggcattcacagcttccgacacttggggagccagctgtgtgagctcgagaagctgatcgacaagatgatgatagctgagttctcgacgtacagtcacagcgacctgaaccgccccctcgaagacgattgtcaagtgcttgaggaggagaggctgatcagcctggtattcggactgcttaagcagaggaagctgaatttcctggaaatctatggagagaaaatggtcattaccgccaagaatatcataaaacagtgtgtgatcaacaaggttagtcaaaccgaagaaattgatactgacgtcgtggttaaactggccgaccaaatgcgcatgctgaattttccacagtggttcgacctgctgaaagatatcttttcgaaatttactattttcctgcagcgggtcaaagccactttaaacatcatccattctgtggtcctcagcgttctagataagaaccagcgaactcgtgaactggaagagatctcccaacaaaaaaatgctgcaaaggataactcattagacacggaagtggcatatctgattcacgagggaatgtttattagcgatgcattcggagaaggggaactgacgccgatagcagtcgacactacttcccagaggaacgcgtccccaaatagcgagccctgctcttctgattccgtttcggagcctgaatgcaccaccgatagctctagttccaaggagcatacttcctcctctgccattcccggcggagtcgatataatggtctccgaggacatgaaactgaccgactccgagcttggaaagcttgctaataatatacaggagctcctgtacagcgcatccgatatttgtcatgaccgcgcagttaaatttctaatgtcacgcgctaaagatgggttcttagaaaaactaaacagcatggagttcattacactcagccgtctaatggaaaccttcatcctggatacagagcagatatgtggccggaagtcaacatctcttctcggggccctccagtcgcaagctatcaagtttgtgaaccgcttccacgaggaacgaaagactaagctgagcctccttttggacaacgagaggtggaagcaggctgatgttcctgccgagttccaggatctggtagactccctgtcagatggcaagatcgccttacccgaaaagaaaagtggggctaccgaggagagaaagcctgctgaggtccttattgttgaaggacaacagtacgcagtagtggggacggttctcttactgatacggattatcttagagtactgtcaatgcgtcgacaatatccctagtgtcactacagatatgttgactcggctgtctgacctactcaaatatttcaattcccgctcctgtcagctcgtccttggtgccggagctcttcaggtcgtgggtctgaagacaataacaacgaagaacctggctctttcaagccgctgtctgcagttgattgtgcattacattccagtgatcagggcacacttcgaggctcgcctgccgccgaaacagtactctatgctacgccatttcgaccacataacaaaagactatcatgaccacattgccgagatttccgcaaaactggtcgccatcatggacagcttgtttgataagctgctcagcaaatatgaggtgaaagctccagtcccatccgcatgcttccgcaacatctgtaaacagatgaccaaaatgcatgaagctatcttcgaccttttgccagaggagcaaacccagatgctgtttctgcgtattaacgcctcctataagttacaccttaaaaagcaactgtcacacctgaatgtgatcaatgatggcggcccccagaatgggctggtcaccgccgatgtggctttttataccggcaatctgcaggccctaaaaggcctcaaggacctggacttgaacatggctgagatttgggagcagaagagatag

SEQ ID NO: 52245 - DNA, 2898 bp, Artificial Sequence
  Description of Artificial Sequence: Synthetic coding sequence
atggccagcagccacagcagcagccccgtgccccagggcagcagcagcgatgtcttttttaagatcgaggtggatccttcgaagcacatcaggcccgttccaagtctcccagacgtgtgcccgaaagaacccaccgttactgaccagcacagatggaccgtgtatcattcgaaggtaaacctgcctgcagcactgaatgacccaagactcgctaagagggagtcggacttctttacgaagacatgggggcttgacttcgtggatactgaggtgattccatcattttaccttccacagatttcgaaagaacacttcaccgtatatcaacaggagatttctcagcgggagaaaatccatgagcgctgcaagaatatttgcccgccaaaggacacgttcgagcggacgctgctgcacacgcatgataaatctagaactgacctggagcaggtgccaaagatctttatgaagcccgacttcgctttagacgattcactgaccttcaacagcgtcctgccgtggtcgcacttcaatactgcaggcggcaaaggaaacagagatgccgcttcctctaaactgctgcaggaaaagcttagtcattatcttgatatcgtagaggtgaatatcgcacatcaaatttcccttcggagcgaggcctttttccacgcaatgacctcccagcacgaactgcaggactacctgaggaagacaagtcaagcggtgaagatgttgcgagacaagatcgcccagattgacaaggtaatgtgcgagggttccctgcatattctgcggctggccctcactaggaataactgcgtaaaggtgtataacaaattgaagctgatggccactgtgcatcagactcagccaacagttcaggtgttgctgagcacctcagagttcgtgggggctctcgaccttatcgctacaacccaagaggtgttacagcaagaactgcaggggatccatagcttcagacacctgggatcccagctttgtgagctagaaaagctgatagataaaatgatgattgccgaattttcgacgtactctcacagtgatctgaaccggccgcttgaggacgactgccaggtgttggaggaggagcggctgatctcactggtattcggcctcttgaaacagaggaagctgaacttcctcgagatttacggggagaagatggtgataacagcgaagaatattatcaagcagtgcgtaattaacaaagtgagtcagacagaggagatcgacaccgacgtggtggtgaagctggccgatcaaatgagaatgttaaatttcccgcagtggtttgatttgctcaaggatatcttctcaaagttcacaatttttctccaacgcgttaaagctaccctgaatatcattcacagcgtcgtcctgagtgttctggataaaaatcaaagaactcgggaactggaagagattagccagcagaagaatgccgccaaagacaactcactcgacaccgaggtcgcgtacctgatacacgaagggatgttcataagtgatgcatttggagagggcgaactcactccaatcgctgttgacactacctcacaacggaatgccagccctaattcagagccgtgtagcagcgattctgtcagcgagccggaatgcactacggattctagttccagcaaagaacacacatccagctctgccattccggggggggtggacatcatggtctccgaggatatgaagctgaccgactctgagttggggaaactggcaaacaatatacaggagctcctgtactccgctagtgacatctgtcatgatagggctgtgaagttcctgatgagtagggccaaggacggatttttggagaagctgaactctatggagttcatcacattgagccgcttaatggagaccttcatcctagacaccgagcaaatttgtggtcgcaagtctacctccttactgggcgcgctccagagccaagctattaaattcgtgaatcgtttccatgaggagaggaaaacaaagctctccctcctgctggacaacgaacgctggaagcaggcggacgtgcccgccgagtttcaggacctcgtggattccttgtcagatggaaaaattgcattacccgagaaaaaaagcggggcgacagaagagagaaagccggcagaagtgctgattgtagaaggacagcagtatgcggtggtgggaactgtcttgctgctgatccgcattatcctggagtattgccagtgtgttgataatattccttccgtcactaccgatatgttaactcgactttctgatttgctgaagtatttcaactcccgcagctgtcaacttgttctgggcgcaggcgcattacaggtcgttgggcttaaaacgatcactactaaaaacctcgctctgtcttctcggtgcttgcagctgatcgtgcactatattccggtgattcgggcacacttcgaggcacgcctgccgccgaaacagtattcaatgctgcgtcacttcgaccacattaccaaagattatcatgatcacattgctgagatctcagcgaagctggtagccatcatggattccctttttgataaacttctgtccaagtatgaggtgaaggcgccagtgccaagcgcctgcttccgaaacatttgtaagcaaatgacaaagatgcacgaagccatatttgaccttctacctgaggagcagacacaaatgctctttcttcggatcaatgcttcgtacaagttgcacctcaagaagcagctcagtcaccttaacgtaataaacgatgggggcccccagaatgggctagtcacagcggacgtggcattttacacgggaaatctgcaagccctcaaggggctgaaggatctggatcttaatatggccgagatatgggaacagaagcgctag

SEQ ID NO: 52246 - DNA, 4287 bp, Artificial Sequence
  Description of Artificial Sequence: Synthetic coding sequence
atggagaacgagcccgaccacgagaacgtggagcagagcctgtgcgctaaaacgtcagaggaagaactgaataaatccttcaatctcgaagcctccctgagcaaattctcctatatagacatggacaaggagctcgaatttaaaaatgatctcatcgacgataaggaatttgacatcccccaggtcgacactccgcccaccctagagagtattctgaacgagactgacgacgaggatgagtctttcatcctggaggacccgacgttactaaacattgacactatagattcgcactcttatgacacctccagcgtggcctcatccgattcaggagacagaactaatctgaaaagaaaaaagaaattgcctgatagcttctctcttcatgggtccgtcatgagacattcactcttgaaggggatctcagcccagattgtttccgccgcagataaggtggacgctggtctaccgaccgcaatcgccgttagttcactcatagccgtaggaacctctcatggccttgccctgatcttcggtaaataccagaatcaggccctgagattgtgtctggggtcgaccagcgtgggcgggcagtacggcgctatctcggccctgtctatcaacaacgactgcagtcgacttctgtgcggtttcgctaagggacagataacaatgtgggatctagcgtcgggcaaactgcttcggtccattacggacgcacacccccctggcaccgcaattttacatataaagttcaccgatgatcccactctcgctatctgcaacgatagcggagggagcgtgtttgagcttaccttcaagcgtgtaatgggcgtgaggacctgcgagtctcgatgtctgttcagcgggtcgaagggggaggtttgctgcattgaaccgctgcactcaaagcccgagttgaaagaccatcctatcactcagtttagtcttctcgccatggccagtcttacaaaaatcctggtgataggactgaagccctcactgaaggtgtggatgacatttccatatggaagaatggatcccagttctgtgccgctcctggcctggcactttgtcgcagtacagaattacgtaaatcccatgctcgccttttgccgcggcgatgtggtacactttctgcttgtgaaaagggatgagagcggcgctatacacgtaaccaagcagaaacaccttcacttgtactatgacctgatcaacttcacatggataaattccagaacagtcgttctccttgactccgtggagaaactccatgtgatagacaggcagacccaggaggaacttgaaaccgttgagatcagcgaagtgcagctcgtctataactcttcccacttcaaaagcttggctaccggaggtaatgtctctcaggccctcgctctagtgggcgagaaggcgtgttaccaatcaatcagcagttatggcggccaaattttctatctggggacaaaaagcgtttacgtgatgatgctgagaagctggcgcgaaagagttgaccatctgctgaagcaggactgcttaacggaggccctggccctcgcctggtccttccacgagggcaaagctaaggccgtggtgggactgagtggcgacgcatcaaaaaggaaagccatcgtcgctgatcgcatggtcgaaattctctttcattacgcggaccgagccctgaagaagtgccccgatcagggaaaaatacaagtgatggaacagcacttccaagatatggtaccagtcattgtggattactgtttgttgttacagagaaaagatctcctcttcagccaaatgtacgacaaactctctgaaaatagcgttgccaagggtgtgtttctggagtgcctggagccttatattctgagcgataaattggttggcataacaccccaggtgatgaaagacttgatcgtgcatttccaggataaaaagctaatggagaatgttgaagcacttattgtccatatggacatcacctccctggacattcagcaggtcgtcctcatgtgttgggagaatcgcctctacgatgccatgatatatgtgtataacaggggaatgaacgagttcatatcaccgatggaaaaattgttccgggtgattgccccccccctgaatgcaggtaagaccctgacggatgagcaagtagtgatgggtaataagctccttgtttatattagctgttgcctggccggccgcgcttatcctctcggcgatattccggaagacctggtccccttggtgaaaaaccaggtgtttgaattcctgattcgcctgcactccgccgaggctagccctgaagaggagatttatccatacatccgcacactcctgcacttcgatacaagagagtttctgaacgtgctagccctgactttcgaagatttcaaaaacgacaagcaggcagtagaataccagcaaaggatcgtggacatcctcctgaaagtgatggtcgagaacagtgatttcaccccgtctcaagtcgggtgcctgttcactttccttgcacgacagttggcaaagcctgacaataccctgtttgtaaatcgcaccctgttcgaccaggtcctcgagtttctctgtagcccagacgacgactctcgacatagcgagagacagcaagttttactggagctgctccaggctggcgggattgtgcagtttgaagaatcccggctgattcggatggcagagaaggcagaattctatcagatttgtgaattcatgtacgagcgtgagcaccagtatgataagatcattgactgttacctgagggatcctctacgggaagaggaggtttttaattatatccataacatccttagcatcccagggcatagtgctgaggagaaacagtccgtctggcagaaggctatggaccacatcgaggaactcgtgagcctgaagccttgtaaagctgcggaactcgttgctactcacttttccggacacattgaaactgtcattaagaagttacaaaaccaggtcttactgtttaagtttttgcgctccctgctcgatccccgagaagggatacacgtgaaccaggagctgctgcagatctccccctgcattactgagcagttcattgagctcctctgccagtttaacccaacacaggtcattgagaccttgcaggtgctagagtgctaccgccttgaggaaacaattcagataacccaaaagtatcaacttcatgaagttaccgcttacctgctggaaaagaaaggagacatccatggcgcctttctgatcatgcttgagcgcttacagagtaagctccaggaggtgacccaccaaggggaaaatacaaaggaagatcctagcctcaaagacgtggaggacacaatggtggagaccatagccttatgccaacggaacagtcacaatcttaatcagcagcagcgcgaggcattatggtttccactgttggaggctatgatggcccctcagaagttaagtagttcagccataccccacctacattctgaagccctaaagtctttgacaatgcaggtcctgaacagcatggcggctttcatcgctctgccttcaattttgcaacgaattctgcaagatccagtttatggcaagggcaagctcggagagatacaaggactgatcctggggatgctggacactttcaattatgaacagaccctcctcgaaactacaacctcactgcttaaccaggatctccactggtcactgtgcaacttgagggcctctgtaactcgtggtcttaatccaaagcaggattattgtagtatctgcctgcagcagtacaagcgacgccaagagatggccgacgagattatagtgttctcatgcgggcatttgtaccattcattttgtctacagaacaaagaatgcacggtagaatttgaaggccagacaaggtggacgtgttacaaatgttcaagctcaaataaggtgggcaaactctccgaaaattcatcagaaattaaaaagggcaggatcacacccagtcaggtcaagatgtccccctcctatcaccaatcaaaaggcgatcccactgccaagaagggcaccagtgaaccagttttggatcctcagcagatccaggctttcgaccagttatgccgcctataccgtggcagcagcaggctggcacttctaaccgagctgagtcagaatagaagctctgagtcctatcggcccttttctggatcccagtccgctccagccttcaactccattttccaaaatgagaatttccagttgcagctcataccgccacctgttaccgaggactag

SEQ ID NO: 52247 - DNA, 609 bp, Artificial Sequence
  Description of Artificial Sequence: Synthetic coding sequence
atggagaacgagcccgaccacgagaacgtggagcagagcctgtgcgccaagacaagcgaagaagagttgaataagagctttaatctcgaagctagcctgagtaaattcagctacatcgacatggataaagaactggagttcaaaaatgatctcatcgatgataaagagtttgacataccacaggttgacacgccccctaccctcgagagtattcttaacgaaaccgacgacgaagacgagtcattcatcctggaggaccccaccctgttaaacatcgacacaatcgacagccactcttatgacacatcctccgtggcgtcgagcgattccggtgaccgcacaaacctcaagcgaaagaagaagctgccagactcctttagtctccacggatccgtgatgcgccatagcctattgaaggggatctccgcccagatcgtttccgccgccgacaaggtcgatgccggcttgcccactgcaatcgctgtatccagtctgatcgcagtaggcactagccacggcttagctctgatctttgatcagaatcaggccctgcggctgtgtctgggcagtaccagcgttggtggccagtatggtgctatctctgcttag

SEQ ID NO: 52248 - DNA, 4281 bp, Artificial Sequence
  Description of Artificial Sequence: Synthetic coding sequence
atggagaacgagcccgaccacgagaacgtggagcagagcctgtgcgcaaaaacatccgaagaggaactcaataagagctttaacctagaagcctctctgagtaaattcagttacatagacatggataaggaattggagtttaaaaacgatctaattgacgataaggaattcgacatcccacaggtggacacaccaccaacgctggagtctatcttaaatgaaacggatgacgaagacgagtcttttatcctggaggatccaactcttcttaacatagataccatcgatagccattcatacgataccagcagcgtcgccagttcagatagtggggacagaactaatctgaaaaggaaaaagaaattgcccgattcattttcattgcacggcagcgtgatgcgacacagtctcctgaagggaatatctgcccagatcgtgtcagcagctgacaaggtggatgcaggcctgcctactgccatcgccgtgagctccctcatagcagttgggaccagtcatggactcgctctgatcttcgatcagaaccaggcgctgagactatgtctcggttccacctcagtggggggacagtatggggccatcagcgccctcagcattaataatgattgctcacggttactttgtgggtttgccaaggggcaaatcaccatgtgggatctggcatctggtaaattgctgaggagcataaccgatgcacaccctcccggcaccgcgatactgcatatcaagttcaccgacgaccctactctcgccatctgtaatgattcaggcgggtctgtgttcgagctgaccttcaagcgcgtaatgggcgtgcgcacgtgtgagagtagatgtctgttttcaggatcaaaaggggaagtgtgctgcatcgagcctctgcattctaagcctgaactcaaggatcatcccatcactcagttttcattgctggcaatggcaagcctgactaagatccttgtgattggcttaaagccatccctcaaggtgtggatgacattcccttacggtaggatggatccaagcagcgttcctttactggcctggcattttgtcgctgttcagaattatgttaatcctatgctcgcgttttgccgtggggacgtggtgcacttcctgctggttaagagagatgaatcaggcgctatccatgtgaccaagcagaaacacctccacctttactacgatctgattaactttacgtggataaactcgaggactgtagtgctcctcgattccgttgaaaagttgcacgtgatcgatagacagacgcaggaagagctagagacagtagagattagcgaggtgcaactggtttataatagctctcattttaagagcttggctacaggagggaatgtgagtcaggctctcgctcttgtcggcgagaaggcctgctaccaaagcatttcttcttacggtggtcagatcttttatttaggcaccaaatccgtgtacgtcatgatgcttcgtagttggcgcgaaagagtggatcacctgctgaagcaggactgtctcactgaagccttagcactggcctggtcttttcatgaggggaaagccaaggcagtggtgggcctatccggcgacgccagtaagaggaaagctattgtcgccgaccgcatggtcgaaatcttgtttcattacgcggaccgggccttgaaaaaatgccccgaccaggggaagatccaggtgatggaacagcattttcaagacatggtccctgtgatcgtcgattattgcctcttgctgcagcgcaaggatctgctgttttctcaaatgtacgacaaactgagcgagaatagtgtcgcaaaaggcgtgttcctggaatgtctcgaaccttacatcttatccgataaactggtgggcatcacaccacaggttatgaaagacctgatcgtacacttccaagataagaagcttatggaaaacgtcgaggccctgatcgtacacatggatataaccagcctagacatccaacaggtggtgttgatgtgctgggaaaatcgtctgtacgacgccatgatctatgtgtataatagggggatgaatgagttcatttccccaatggagaaactgtttagagtgattgctcctcctctgaacgcgggtaaaacactgaccgatgaacaagttgtcatgggtaataagctgctggtgtacatttcatgttgcctcgccggaagagcttatccgctcggcgatatccctgaagatctcgtgcccctggtgaagaaccaggtcttcgagttcttgattcgcttgcattctgctgaggcgagtcctgaggaggagatttatccctacattcggacccttttacactttgatactagggagttccttaatgtgctggcccttacttttgaagatttcaaaaatgataagcaggccgtggaataccagcagcggatagtggatatcctgttaaaagtgatggtcgagaattccgactttaccccatcgcaggtggggtgcctgttcacctttctggcgcgccagctggctaagccagataatactcttttcgtcaacagaacactcttcgaccaggttttggaattcctctgttcaccagatgacgattctcgacactctgagagacagcaggtacttctcgagctgctgcaggccgggggcatcgtccagtttgaagagtccagattaattcggatggccgaaaaggcagagttttaccagatctgtgagtttatgtatgagagagaacatcaatacgacaagataatcgattgctaccttagggaccccctaagagaggaggaggtgttcaattacattcacaatatactgagcattcctggccactccgccgaggaaaagcagtcagtttggcagaaagccatggaccacattgaagaactggtgtccctgaaaccgtgcaaggctgccgagctggtggcaactcacttcagcggccacatagagactgttataaaaaagctccaaaaccaggtcctgctcttcaaatttcttagaagtctcctagaccccagagagggcattcacgtcaaccaggagttgctacaaataagcccatgcatcactgagcaattcattgaattgttgtgccaatttaatcctactcaagtgatcgagactcttcaggtgctggaatgttaccgactcgaggaaacgatccagattacccagaagtaccaattgcatgaggtcacagcttatttacttgagaagaaaggggacattcatggagcattccttattatgcttgaaagactgcagtctaagttgcaggaggttacacatcagggagagaatactaaagaagaccccagcttgaaggacgtggaagatacgatggtggagacaattgccctctgtcaacgtaacagtcacaacctcaatcagcagcaacgggaggcattgtggtttcccctgctcgaggccatgatggccccccagaagctcagttcaagcgctatacctcatctgcattcagaagctctcaagtccctgaccatgcaggttctgaactctatggccgcattcattgccctcccctcgatccttcagcgaatattgcaggaccctgtgtacgggaagggcaaacttggggaaattcaagggctcatacttggcatgctcgacactttcaactacgaacagactctgcttgaaacgacgacatccttactgaatcaagaccttcattggagcctttgcaacctaagggcaagtgtaactcggggtttgaatcccaaacaggactactgctcaatctgtctgcaacagtacaagagaagacaggaaatggctgatgaaattatcgtcttctcatgtggccacttataccatagtttctgtctccagaataaggagtgcacagtggaatttgagggccagacgcgatggacatgctataagtgctcctctagtaataaggtgggcaaattgtccgagaactcaagcgaaattaaaaagggaagaatcacaccatcccaagtaaaaatgagccctagttaccaccaaagtaagggcgatccgacagcaaagaagggcaccagtgaaccagtgctggacccgcagcagatccaggcatttgatcagctctgtaggctgtaccgaggaagtagtaggctcgccctgttgacagagttgtctcagaatagatcatctgagtcgtacagacccttctctggctcacagtcagcaccggcttttaatagcattttccaaaatgagaatttccaactgcagctgatcccgcctcctgtaacagaagattag

SEQ ID NO: 52249 - DNA, 4287 bp, Artificial Sequence
  Description of Artificial Sequence: Synthetic coding sequence
atggagaacgagcccgaccacgagaacgtggagcagagcctgtgcgcaaaaacgagcgaggaggagcttaataaaagttttaacctggaggcgtccctgtccaagttttcttatattgatatggataaggaactggagttcaaaaacgacctgatcgatgacaaagaatttgacatccctcaggtagatacaccgcccactctagagtcgatcctgaacgaaaccgatgacgaggacgagagtttcatcctcgaggatcccacccttcttaatatcgataccatcgacagtcactcctacgatacttcttccgtggctagctccgacagtggcgaccgtaccaacctgaaacgcaagaaaaaacttccagacagctttagtctgcacggctcagtgatgagacacagcctcctcaaggggatctccgcccagattgtgtccgcagctgacaaggtggacgccggactccctactgcaatcgctgtttctagcctgatcgctgtgggaaccagtcatggtctggccttaatttttgggaaggatcagaatcaggcgctgaggctgtgcctcggttccacaagtgtgggaggacaatacggcgccattagtgccctttccataaataacgactgcagtcgattgctctgtggatttgccaaaggacagattaccatgtgggacctggcttctggcaaacttctccgctccataactgacgctcaccctccagggacggccatcctgcatattaaattcacggatgacccgacgctcgccatctgtaatgatagcggtggaagcgtgtttgaacttaccttcaaaagggtgatgggcgtgagaacatgtgagtccagatgtctgttctcggggtctaaaggagaagtgtgttgtattgaacccttacattcaaaacctgagctcaaagaccaccctataacccaatttagcctcctggccatggcaagcctgacaaaaatcttagtgatcggcctgaagcctagcctgaaggtttggatgacatttccttacggacgcatggacccaagttccgtgccccttttagcatggcacttcgtggctgtccagaattacgtgaatcctatgctggccttctgccgcggagacgtggtccatttccttttggtcaagagagatgagtctggggcaatccacgtcaccaaacagaagcaccttcatttatactacgacctgatcaactttacgtggataaactcacgcacagtggttttgttagacagtgtggaaaagctccacgtgatcgatagacaaacacaggaggaactggagacagtggagatctccgaagtgcagttagtgtataattcttctcacttcaagtcattggccaccgggggaaatgtatcccaagccctggcccttgtgggggagaaggcctgctaccaaagcatttcctcctacggggggcaaattttctacctggggactaaatctgtatatgttatgatgttaagatcgtggagggagagagtggaccacctgttgaagcaggattgccttacagaggccttagctttggcctggtcattccatgaaggaaaggcgaaagctgtggtcggcttgtccggggacgctagcaagcgtaaagctatcgtggctgaccgtatggttgaaatcctgtttcactatgccgaccgagctctgaagaaatgccccgatcagggtaaaattcaagttatggaacagcacttccaggacatggtgcccgtgatagtggactattgtcttctgcttcagaggaaggacttgctgttctctcagatgtatgataaacttagcgagaactccgtagcaaaaggggtttttctggagtgcctggagccctacattttgagtgacaaactggtaggcattaccccgcaagtgatgaaggatctgatcgtgcacttccaagacaaaaagttgatggagaatgtcgaggccctaattgtgcatatggacatcacaagcctcgacattcagcaggttgtcttaatgtgctgggaaaacaggctctatgatgctatgatatacgtttacaatagaggcatgaatgagttcatcagccctatggagaagctctttagggtgatcgcccctcctctaaatgctggtaaaactctgactgacgagcaagtggtcatgggaaataagctactggtttacatttcatgctgcctggccgggagagcctacccactcggggacatacccgaggatctagtacccttggtgaagaatcaggttttcgagtttctgataagactccattcagctgaggcgagccccgaagaagagatatatccttacatccgtacacttctacactttgacacaagggagtttctgaacgtcctcgctcttacctttgaagacttcaaaaacgacaagcaagccgtggagtatcagcagcgaatcgtggacattctgttgaaggtgatggtggagaatagtgatttcactcccagccaggttggatgcttgttcactttcctggcacgacagctggctaagccagacaatactctttttgttaaccgcaccctgttcgatcaggttctagagtttctgtgctcccccgatgacgacagccggcacagcgagaggcagcaggttctcctggagttgttgcaggctgggggtattgtacagtttgaagagtccagactgatccgaatggccgagaaagctgaattttaccaaatctgcgaattcatgtatgaaagggagcaccagtacgacaagatcattgattgttacctccgagatcctctgcgcgaggaagaggttttcaattatatccacaacatcttgtctatcccaggtcattcagctgaggagaagcagtcagtgtggcagaaagctatggaccacatcgaggagttggtgtcgctaaagccctgtaaagcggcggagctcgtagccacccattttagcggacatattgaaactgtgattaaaaagcttcagaaccaggtgctgttgttcaagttcctccggagcctgctcgatcctagggagggcatccatgtgaatcaggaattgcttcagatcagcccttgtatcactgaacagttcatcgaactgctctgtcagtttaacccgacacaggtgatcgaaacactccaggtgctggagtgttacagactggaggagacaattcagattacccaaaaataccagctccatgaggtcactgcctatctgttggagaagaaaggtgatatccacggtgcctttctgataatgctggagcggctgcagtcaaagctgcaggaagtgactcatcagggagaaaataccaaggaagacccatccttgaaagatgtcgaagatacaatggtggagaccatcgctctgtgccagcggaactcccacaacttgaatcagcaacagagggaggctctgtggtttcccctgttggaggcaatgatggccccgcagaaactgtcctccagtgccatcccacatctgcattctgaagcactgaagtccctgactatgcaggttttgaatagtatggccgcctttattgcactgccgtcaattctgcagagaatcttgcaagaccctgtatacggtaaggggaagttgggagaaatccagggtctgattctgggcatgctcgatacctttaattatgagcagacgttgctggagacgactacgtcattactgaaccaggatctgcactggagcctttgtaatctccgagcatctgtgactaggggcctcaaccctaagcaagactactgtagtatctgtcttcagcaatataaaagacgccaggaaatggcagacgaaataattgtgttctcctgcggacacctttaccactctttttgtttgcagaataaagagtgtactgttgaattcgagggacagacaaggtggacttgttataagtgtagttcctcgaataaagtcggaaaattgtctgagaactcttccgaaatcaaaaagggccggatcactccaagccaggtgaagatgtctcccagctaccaccagtcgaagggggatcctaccgccaagaagggcacgtccgagcccgtgctcgatcctcagcagattcaagctttcgatcaactgtgtcggctgtatcgaggaagttctcgactggcgttgctgacggagttaagtcaaaatcggagctcagaaagctatcgtccattcagcggaagccagtcggcgccagcttttaactctatattccagaacgagaatttccagttgcagctgatccctccaccggtcactgaggattag

SEQ ID NO: 52250 - DNA, 423 bp, Artificial Sequence
  Description of Artificial Sequence: Synthetic coding sequence
atggagaacgagcccgaccacgagaacgtggagcagagcctgtgcgcaaaaacttcagaagaggaactaaacaagagctttaatctggaagcatcactgagtaaattttcttacattgacatggataaagaattagagttcaagaacgacctcatagacgacaaggaatttgacattccgcaggtcgacacaccccccacactcgaaagcatactcaatgagaccgacgacgaagatgagagcttcatccttgaggatccaactcttctgaatatcgatacaatagactcacacagttacgatacctcctccgtggcttcatcggacagtggagatcgtacaaaccttaagagaaaaaagaagttgcctgactccttttctttgcacggatccgtgatgcgccattccctcctgaaaggctag

SEQ ID NO: 52251 - DNA, 366 bp, Artificial Sequence
  Description of Artificial Sequence: Synthetic coding sequence
atggagaacgagcccgaccacgagaacgtggagcagagcctgtgcgccaagacctccgaagaggagttgaacaagagtttcaacttagaagcaagcctgtccaaattttcttacatcgacatggacaaggaactggagttcaagaacgacctcatcgacgataaagaattcgacatacctcaagtcgatacccctccaacgctggagtcaatcctgaacgaaactgatgatgaggacgaaagtttcatactagaggatcctacattgttaaacatcgatacaattgacagccattcctacgatacatccagcgtagcctccagcgactcaggtgacagaacgaatctcaagagaaaaaagaagtag

SEQ ID NO: 52252 - DNA, 4011 bp, Artificial Sequence
  Description of Artificial Sequence: Synthetic coding sequence
atggagaacgagcccgaccacgagaacgtggagcagagcctgtgcgcgaagacaagcgaggaagaactgaataaaagcttcaatctggaggcatcgctttcaaagttttcgtacatcgacatggacaaggagctggagtttaaaaatgacttgatcgacgacaaggaatttgacatacctcaggtagacactcccccaacgctggagtctattctgaatgagaccgacgacgaggacgaatcgttcatcttggaggaccccaccctgctcaacattgatactattgatagtcacagctacgatacttcatccgtggccagctccgactctggcgaccggactaaccttaaaaggaaaaagaagttgccagatagcttttctctgcatggatcagtcatgcgccattcgctgttgaaaggcatttcggcccaaatcgtaagcgctgcagataaggtggacgcaggcctgccaacggcaattgcagtctcctccttgatcgctgtcgggacatctcatggactggccttgatcttcgaccaaaatcaggctctgaggctgtgcctgggatcaacgtcggttggcggacaatacggagcaatctccgcactctccatcaacaacgattgctcccgcctgctctgtggctttgccaagggacaaataactatgtgggatctcgccagcggcaaacttttacgctcaattaccgatgcccacccacctggcacggcgattcttcatattaaattcaccgacgaccctaccctggccatctgcaatgatagtggtggatctgtctttgaacttacatttaagcgggtcatgggggtgcgcacctgcgaaagtaggtgcctgttcagcggaagcaaaggcgaagtttgctgtatcgaacctctgcattccaaacccgagctcaaggaccaccccatcacacagtttagtctgctggccatggcctccctcacgaagatccttgtgatcgggctgaagccatccctgaaagtctggatgacctttccttacggacgtatggatccatcctccgtgcccctgctcgcctggcatttcgtcgccgtgcagaattacgtgaacccaatgttggctttctgcagaggagacgtggtgcacttcctgctggttaaacgcgatgagagcggtgcgatccatgtgactaagcagaagcacctgcacctgtattacgacttgatcaattttacatggatcaactctagaaccgtggtgctattggacagtgtggaaaaactccatgtgattgataggcagacccaagaagaacttgaaactgtagagatttctgaagtccagcttgtgtacaactcctcccacttcaaaagtctcgccactggcggtaatgtgtctcaggcccttgctctggttggcgaaaaggcatgttatcaatccatcagttcttatggtggacaaatcttctatcttggaactaagagcgtgtatgtgatgatgctgagaagttggagggagcgagtggaccaccttctcaaacaggattgcttgacggaggctttagccctggcttggagcttccacgaaggaaaggcaaaagcagtggtcggcctatcaggggatgctagcaagcggaaggcaatcgtggccgacagaatggttgagatccttttccactacgccgaccgcgccttgaaaaaatgtccggaccaggggaagatacaggtcatggaacaacactttcaagttgtcctgatgtgttgggagaatcgactctatgatgctatgatttatgtgtacaataggggcatgaacgagttcatcagccccatggagaagttattccgcgttatcgctccaccgctgaatgctggcaaaaccttaaccgacgagcaggtcgttatgggaaacaagctccttgtgtacatttcgtgttgccttgctggaagggcttatcccctcggtgatatccctgaggatctggtgccattagtgaaaaaccaagtctttgagtttctcataaggttgcactcagcggaggcgtctcccgaggaggaaatttatccatacattcggacgctcctacatttcgataccagggaatttcttaacgtgctggcgctaacttttgaggactttaagaacgacaaacaggccgtggaataccagcagcggatcgtagatatcctcctcaaagtgatggttgagaattctgacttcaccccaagccaggtcggttgcctattcacctttttagcgcgccagctggcaaagccggataatactctcttcgtgaacagaaccctttttgatcaggtcttagaattcctctgttcacctgacgatgattctaggcattccgagcgacagcaagtcctgctagagctgctccaggctggcggcattgtacagttcgaggaatctcgcctcattcgtatggcggaaaaggcggaattctaccagatttgcgagtttatgtacgagcgggagcatcagtacgacaagattatcgattgctacctccgcgacccgttacgggaggaggaggtgttcaattatattcacaatatcctttctatccctgggcattctgcggaggaaaaacagagcgtgtggcaaaaagcaatggatcacatcgaagagcttgtgagcctcaagccgtgtaaggccgccgaactcgttgcaactcacttctcaggccacatcgagacagtgattaagaagttacagaaccaggtgctgctgttcaagtttttgagaagcttgctggatcccagggaaggaattcatgttaaccaggagctgctccagatcagcccttgcataaccgagcagttcattgagttgctgtgtcaattcaaccccactcaggtgattgaaactctgcaggtcctggagtgctatcgcctggaggagaccattcaaatcacccagaaatatcaacttcatgaggtgactgcatatctgctggagaagaaaggagatatccatggtgcctttctcatcatgttggagcggctgcagtccaaactacaggaagtgacccaccagggggagaatactaaggaagacccgtcattaaaggacgtagaggacacaatggttgaaaccatcgctctctgccaaaggaatagccacaacctaaatcaacaacagcgggaagcactgtggttccctctgctggaagcaatgatggccccacagaaactctcttcgagcgccattccccatctgcactcagaggctctcaagtctctgacaatgcaggtcctgaactctatggcagctttcattgctctaccttccatactgcaaagaatcctgcaggatccagtgtatggcaaggggaagctgggggagatccagggcctcatcttgggcatgctcgacaccttcaattatgagcagaccctactggagacaaccactagcctcctgaatcaggacctccactggtcactgtgtaatctgcgggcttctgtgactagggggctcaacccaaagcaggactattgctccatttgtcttcaacagtataagcgtcgccaagaaatggccgacgagattatcgtcttctcatgcggccacctgtaccatagtttttgccttcagaacaaagagtgtactgttgagtttgagggccagacgaggtggacctgttacaagtgtagttcctctaataaagtgggtaagctcagtgagaactctagcgagatcaagaaaggccggattacgccgtcccaagtgaagatgtctcccagctatcaccagtcgaaaggcgacccgaccgccaagaagggaaccagcgagcctgttctggacccccagcagattcaggcattcgatcagttgtgccggctctaccggggtagttctcggctggctttattgaccgaactgagtcaaaatagaagtagtgagagctataggcccttttccgggagtcagtccgctcccgctttcaatagcatcttccagaacgaaaactttcagctccagctgattccacctcctgtgactgaggattag

SEQ ID NO: 52253 - DNA, 225 bp, Artificial Sequence
  Description of Artificial Sequence: Synthetic coding sequence
atggagaacgagcccgaccacgagaacgtggagcagagcctgtgcgcgaaaacctccgaggaagagctgaataaaagcttcaatctggaagcctccctctccaagttctcttacattgatatggataaggaactggagtttaaaaacgacctgatcgacgacaaggagttcgatattccgcaagttgacactcctcccaccctggagtccatactgaatgaatag

SEQ ID NO: 52254 - DNA, 741 bp, Artificial Sequence
  Description of Artificial Sequence: Synthetic coding sequence
atgagccccaagccccgggccagcggcccccccgccaaggccaaggaagccggcaaaaggaaaagttcctcacagccttcaccctccgaccccaagaagaaaactaccaaagtggctaagaaggggaaggccgtgcggaggggtcggcgcgggaagaagggggccgctacaaagatggcagctgtgactgcaccagaggcagaaagcggacccgccgcacctgggccatccgaccagccgtcacaggaactaccccagcacgagctcccacccgaagagcccgtcagcgaaggcacacagcatgatcctctgagccaggagagcgagctcgaggagccactgtcccaggaatcagaggtggaagagcctctgagccaggagagccaggttgaggagcctctctcgcaggaatctgaggtggaagagcccctgtctcaggagtctcaggtcgaggagcctttgtcacaggagtcagaggtcgaggagccattaagtcaggagtccgaagttgaagagccactgtcacaagaaagccaggtcgaggagccccttagtcaagaatcagaggtggaagagcctctgagccaggaatcccaagtagaggaacctttgagtcaggagagtgaaatggaggaaccactgtctcaggaatcacaagtcgaggagcctttgtctcaggaatccgaaatggaagaacctttatcccaggaaagcgagatggaagagctgccgagtgtgtag

SEQ ID NO: 52255 - DNA, 378 bp, Artificial Sequence
  Description of Artificial Sequence: Synthetic coding sequence
atgagccccaagccccgggccagcggcccccccgccaaggccaaggaaaccggcaaaaggaaaagctcctcccagccatcgcctagtggcccaaagaaaaaaactaccaaagtggccgagaaaggggaggccgtcagaggcgggaggagagggaagaagggggccgccacaaagatggctgcggtgactgcccctgaggcggagtccggaccggctgcacctggaccaagcgatcagccttcgcaggagttacctcaacacgaactgccgcccgaagaaccagtgtccgaaggcacccagcacgatccacttagccaagagtctgagctggaggagccgctgtcgaagggcaggccctctactccgctttccccctag

SEQ ID NO: 52256 - DNA, 2109 bp, Artificial Sequence
  Description of Artificial Sequence: Synthetic coding sequence
atgaccagccggaaccagctggtgcagaaggtgctgcaggagctgcaggaagctgtagagtgcgaggggctcgagggcctgatcggcgcttccctggaagccaaacaggtgctgagttcttttacacttcctacttgtagggaaggaggccccggactccaagtcctggaggttgatagcgtggctctctctctgtatccagaggacgcgcccaggaatatgctgcctcttgtctgtaaaggggagggaagcctgctgtttgaagccgcgtctatgctcctgtggggcgatgctggtctcagcctggagctgcgcgcaaggacggttgttgagatgttactgcacagacattactatttgcagggtatgattgactccaaggtcatgcttcaggccgtgcgctacagcctgtgtagcgaagagtctcccgagatgacctccctaccgcccgcaaccctcgaagctatattcgacgccgatgtaaaggcctcctgcttcccttcatccttttctaacgtgtggcacctgtatgccctggccagcgtgctgcagcgcaatatctactccatataccccatgaggaacctcaagattagaccgtactttaaccgcgttatcaggcccaggcggtgtgaccacgtgccgtccacactgcacatcatgtgggccgggcaaccgctgacctctcatttcttccgccaccagtacttcgcacctgtggtgggtctggaagaagttgaggccgaaggggcaccaggcgtggcgccagccctcccagcactggccccactatcttcccctgctaagactctggagctgcttaaccgggaaccagggctctcatactcacacttatgtgaacgatattctgttaccaagtccaccttctaccggtggaggcggcagtcccaagaacataggcagaaggtggccgcccgcttctccgccaaacacttccttcaggacagcttccaccgtgggggtgtggtgcccctgcagcaattcctccagagattccctgaaatatcccgtagcacctactatgcctggaaacatgaactgctgggttctgggacatgtcctgcactccctccccgcgaggtgctgggtatggaggagctggagaaactccctgaggagcaagtggctgaggaggaacttgaatgctcagctctcgccgttagctctccgggaatggtgcttatgcaacgggccaagctgtacctagagcattgcatatccctaaacactctggtgccttacagatgtttcaaacgtcggtttcccggaattagtcgcagcacctactataactggaggcgtaaagctcttaggcgtaatcccagctttaaacccgcaccagcactctccgcagcaggaaccccacaactcgcatccgtcggggaaggcgctgttatcccttggaagagtgaggccgaagagggcgccggaaacgctaccggagaggacccccctgcccctggggaactgctgccccttagaatgccactgagtaggtggcagaggaggctccgaagggcagcaagacgtcaggtccttagcggacatctcccgttttgtcgattcagacttaggtatcctagtctgagcccgtcggcattttgggtgtggaaaagcctggctcgaggatggccacgaggcctgtctaaactacaagtgcccgttcccactcttgggaaagggggccaggaggcggaagagaaacaggaaaaagaagctggcagagacgtgacagctgtgatggctcctccagtgggcgcatcatctgaagacgtggaaggggggccctctcgggaaggcgccctacaagaaggggccactgcacaaggccagccacactcgggcccgctgttatcacaaccagtggtagccgcagccggcggaagagacggacggatgctagtcatggacatgatcgccactaccaagttcaaggctcaggcaaagctgtttctccagaagcgttttcagtccaagtctttcccatcttataaggagttctcagctctgttcccactcacggccaggtcaacttattacatgtggaaaagagccctgtatgatggtctgacacttgttgatggttag

SEQ ID NO: 52257 - DNA, 252 bp, Artificial Sequence
  Description of Artificial Sequence: Synthetic coding sequence
atgaccagccggaaccagctggtgcagaaggtgctgcaggagctgcaagaagccgtggagtgcgaaggactcgagggcctgatcggggctagtctcgaggccaagcaggtactaagttcatttaccctgcccacctgccgggagggcggcccaggcctccaagtgctcgaggtagacagtgtggccctgagtctctacccagaggacgcacctcggaacatgttaccactagtgtgcaagggagaggggtag

SEQ ID NO: 52258 - DNA, 1260 bp, Artificial Sequence
  Description of Artificial Sequence: Synthetic coding sequence
atggccaaggagggcgtggagaaggccgaggagaccgagcagatgatcgagaaagaggcaggcaaagagcccgccgaaggcgggggcggtgacggctcgcaccgactgggcgacgcccaggagatgcgagccgtggttctcgccggcttcgggggtttaaataagctccgtctgtttaggaaggccatgcctgagccacaggatggcgaactaaagatacgcgtgaaagcctgtggcctgaatttcatcgacctgatggttagacaaggcaatatagataatccgccgaaaaccccactggtgcctggctttgagtgctctgggattgttgaggcactaggcgattccgttaaaggatatgagataggcgacagagtaatggcctttgtcaactataacgcttgggcagaagttgtgtgtactccggtcgaatttgtatataagattccggacgacatgtccttttccgaggctgcagcgttccccatgaacttcgtgacagcctacgtgatgctcttcgaggtcgctaatcttcgagagggaatgagtgtgttggttcactccgccggcgggggggtcggccaggcggtggctcagctctgcagcacagtcccaaacgttacagtatttggcaccgcttccactttcaagcatgaagcaattaaagattctgtgacccatctattcgataggaatgccgactatgtgcaggaggtgaagcgaatttctgccgagggagtagatatcgttctggactgtctttgcggagataacactgggaagggactctccctccttaagcctcttgggacatacatcttgtacggcagcagcaacatggtgacaggagagaccaagtcatttttcagcttcgcaaagtcctggtggcaggtggagaaggtgaaccctatcaaactgtatgaagagaacaaagtgatcgctggtttctcacttttaaatttgctgttcaaacaggggcgggcggggctgatccgaggagttgtcgaaaaattgatcgggttgtataatcagaagaaaataaaacctgtagttgactccctatgggcactcgaagaagttaaggaggccatgcagaggatccacgaccgcggaaacattgggaagctaatcctcgatgtagagaaaacaccaacacccctgatggccaatgattctaccgagacatccgaggcgggggaggaagaggaggaccatgagggcgacagtgaaaacaaagagcgcatgcccttcatccagtag

SEQ ID NO: 52259 - DNA, 648 bp, Artificial Sequence
  Description of Artificial Sequence: Synthetic coding sequence
atggtgctgctgaccatgatcgcccgggtggccgacggcctgcccctggccgcgagcatgcaggaagacgagcagagcggacgggatcttcaacagtaccagtcccaggcgaaacagctctttagaaagctcaacgaacaatccccgactcgttgcaccctcgaagctggcgcaatgacctttcattacatcattgagcagggagtgtgctatctggtgctgtgtgaggctgctttcccaaaaaagctggccttcgcctatctcgaagacctgcattcggaatttgacgagcagcatgggaaaaaagtgccaactgtgagcaggccatattcattcatagaattcgacacattcatacagaaaaccaagaaactgtatattgactcgagggccagaagaaatttgggtagcatcaatactgagctgcaggatgtacagcgcatcatggtggcaaatatagaggaggttctgcaaagaggggaagctttgagcgctctggactcaaaggccaataatctgtcgtctctttctaaaaaatacaggcaagatgccaagtacctgaatatgcgctccacgtacgccaaactcgccgcagttgcggtctttttcattatgctgatcgtgtacgtgcgcttctggtggttgtag

SEQ ID NO: 52260 - DNA, 873 bp, Artificial Sequence
  Description of Artificial Sequence: Synthetic coding sequence
atggagacccccctggacgtgctgagccgggccgccagcctggtgcacgctgatgatgagaaacgggaggcagccctgagaggggagcccaggattcagacactgcccgtcgcctcagccttgagctcacatcgcacaggacccccccccatttctccttcaaaacgtaagttctcaatggagcctggtgacgaggatctcgattgcgataatgaccacgtgtccaagatgtcaagaatttttaacccccacttaaataagacggctaatggcgattgtcggagggatcctagagaacggagtcgctctcctatcgaaagggcagttgcccctacaatgtcactccatgggtcccacctgtatacaagcctgccaagtttaggactggagcagcccttggccctcacaaaaaattccctggacgcttctagacccgctggtcttagtccgaccctcactccaggagagcgccagcagaacagacccagtgttatcacctgcgcttccgcaggagcgagaaactgtaatttgtcacactgtcctatagctcattcgggctgcgcagctcccggccccgctagttataggagaccaccctctgcagccacaacctgtgatcctgtcgtggaggagcatttcagacgctctcttggaaaaaattataaggagcctgaaccagcccctaatagcgtgtccatcaccggaagtgtagatgaccatttcgctaaagccctaggcgatacttggctgcagattaaggccgcaaaagatggcgcttccagtagtcccgaatcagcaagccgcagggggcaaccagcaagtccttctgcacatatggtctcacactcacacagtccgtccgtcgtgtcctag

SEQ ID NO: 52261 - DNA, 888 bp, Artificial Sequence
  Description of Artificial Sequence: Synthetic coding sequence
atgaccgagaacacccacttcgacaagatccccgagagctgcgccctgaagtcttggcgacaccctggccttcaccacggtgaggcagccttgaggggcgagccacggatccaaacattgcccgtggcctcagcactgtcttcacacaggaccgggccaccccccatctcaccctcaaagcggaagtttagcatggaaccaggggacgaagatttggactgtgataatgaccacgtgtcaaagatgagtagaatcttcaatccccacctgaacaagacagccaatggcgactgtaggagggacccacgcgagaggagccgtagccctatcgaacgcgctgtggcacccaccatgtctttgcacggctcccatctgtatacaagccttccctcgttaggactcgagcagcctctggcactgactaagaactcactagacgctagccgaccggcaggcctttctcccacactgactcctggagagcggcagcagaacagacctagcgttattacatgcgcctccgctggcgctagaaactgtaatttgagtcactgccctattgcccatagcggctgtgccgcgcccggtcctgcatcctaccgccgccccccatccgctgctaccacctgcgatcccgtcgtggaagaacacttccgacggagtctagggaaaaactacaaggagccggaacctgcacctaacagtgtctccatcacaggcagtgtggatgatcacttcgccaaggcccttggcgatacgtggctgcagattaaggctgccaaggatggggcgtctagcagtccagaatccgcgagtcggaggggccagcctgcctcaccctcagctcacatggtgtcacactcacattcaccatccgtcgtctcctag

SEQ ID NO: 52262 - DNA, 510 bp, Artificial Sequence
  Description of Artificial Sequence: Synthetic coding sequence
atggagacccccctggacgtgctgagccgggccgccagcctggtgcatgcagacgatgagaagcgagaagccgcactgcggggcgaacctagaattcaaactctgcctgtggcatcagctcttagttcacatcggaccggcccaccacccatttccccaagcaaacgcaaattctccatggagcccggagacgaagaccttgactgcgataatgatcatgtgtcaaagatgagccgcatcttcaacccgcacctcaacaagacagcaaatggtgattgtcgcagagaccccagagaacgttctagaagccccattgagagggccgtcgcccccactatgagcctccacggctcacacctttatacatccctgccgagcctaggtcttgagcaacctctggccctgacgaaaaactccctggatgcctctagaccggccggactatctcccacactaaccccgggggagaggcagcaggtgggcctctgccttgggggctggaggggatag

SEQ ID NO: 52263 - DNA, 603 bp, Artificial Sequence
  Description of Artificial Sequence: Synthetic coding sequence
atggagacccccctggacgtgctgagccgggccgccagcctggtgcatgccgacgacgaaaaacgggaagcagctttgcgcggggaaccaagaatccaaacgttacctgtggcaagtgcgctgtccagtcacaggacaggcccccccccaatttctccgtccaaacgcaaattctcaatggagccaggtgacgaagatctggactgtgataacgatcacgtaagtaaaatgagccgaatttttaacccacacctcaataaaaccgcgaacggcgactgccgccgggacccccgagagagatcacggagcccaatcgagagagctgtagccccaacaatgtcactccacggctctcacctgtacacaagcctgcccagtttagggctggaacagcctcttgcactgaccaagaactctctggacgccagtcgcccagccggcttgagtccgactctgacacctggcgagaggcaacaaaaccggccatctgttattacatgcgcgtcagcaggtgccagaaattgcaatctgtcccattgtcctattgcccacagtggctgtgctgccccagggcccgccagctaccgccgccccccatcttag

SEQ ID NO: 52264 - DNA, 384 bp, Artificial Sequence
  Description of Artificial Sequence: Synthetic coding sequence
atggagacccccctggacgtgctgagccgggccgccagcctggtgcacgcggacgacgaaaaaagggaagccgctctacgcggggaacccaggattcaaacactgcctgtggccagcgccctatcttcccatcgaaccggtccaccaccaatcagcccttccaagaggaagttcagcatggaacctggcgatgaggacctggattgcgacaacgatcacgttagcaagatgagtcgcatctttaacccacacttgaataaaacagctaatggtgactgccggcgggaccctcgcgagcgctctcggtctccaatcgaaagagcagtggctcccactatgtccctccacggcagtcatctatacacttcactccccagcctatag

SEQ ID NO: 52265 - DNA, 891 bp, Artificial Sequence
  Description of Artificial Sequence: Synthetic coding sequence
atgctgttcatgaagatggacctgctgaactaccagtacctggacaaaatgaacaacaatatcggcatcttatgctatgagggtgaggccgctttgcgaggcgagcccagaatccaaactttacctgtggcttccgccctgtcaagtcaccgtactggtccacccccgattagtccatcgaagcggaagtttagcatggagcccggcgatgaggatctggactgtgataacgaccacgtttccaagatgagcagaatattcaatccacacctgaataaaaccgccaatggggactgtcggcgtgaccctcgagagagaagccgatctccaatagaacgcgctgttgctcccacaatgagtctccacggaagccacctctacacctctctgccctccctcggcctggagcagccgttggccttaacaaagaatagcctcgacgcttcccgcccagctggtctctcacccacactaaccccaggtgagcggcagcagaacaggccatcagtgattacttgcgcgtccgcaggggctagaaactgcaacctttcacactgtccaatcgctcattctggctgcgcggctccaggacccgcctcttatcgtagacccccatcagctgctactacctgtgacccggtggttgaagagcacttcagacgctctctggggaagaactataaagaacctgagcccgcaccaaactcagtgtccatcactggctcggttgatgaccactttgcgaaagctctgggggatacctggctgcagattaaggccgcgaaggacggggccagctcttcccccgagtccgccagtaggcgcgggcaacctgcctcgcccagcgctcacatggtgtcacattcccattcacctagcgtggtgagctag

SEQ ID NO: 52266 - DNA, 675 bp, Artificial Sequence
  Description of Artificial Sequence: Synthetic coding sequence
atggagacccccctggacgtgctgagccgggccgccagcctggtgcacgcagacgacgaaaaacgtgaggctgcactacgcggtgagccacggattcagacactgccggtagctagtgcactttcttcacaccgcaccggtcccccacccatctccccttccaaacggaagttctcgatggagccaggggacgaggacctggattgcgacaacgatcatgtctccaagatgtctcggatctttaatccccacctgaacaaaaccgccaatggtgattgccgtcgcgatccacgggagaggagtcgttccccaatcgagcgagcggtggcccctaccatgtccctgcatggctctcacctgtacacctcactgccatcgcttggattggagcaacccctcgctttaacaaaaaactccctggacgcgagccgaccagctggcttatcaccaacactgactccaggggagaggcaacagaatcgtcccagcgttatcacctgcgccagcgctggcgcacgtaattgtaacctcagccactgccctattgcccatagtggatgcgccgcccccggacccgcttcgtaccggcgtcccccatctgccgccactacatgcgatccagtggtcgaggaacatttcaggagatcactcggcaagaactacaaagaaccttag

SEQ ID NO: 52267 - DNA, 621 bp, Artificial Sequence
  Description of Artificial Sequence: Synthetic coding sequence
atgaacaagaccgccaacggcgactgccggcgggacccccgggagcgctctaggtcccccattgaaagagcagtggcacccaccatgtccctacacggaagccatctgtatacgtcgttacctagtttgggcctcgaacagcctcttgcactgacaaaaaacagcctggacgccagtcgtccagccggattgagcccaaccctgacccccggcgagcgccaacagaaccgccctagtgtaatcacttgtgcaagcgcaggtgcaagaaactgtaatctcagccattgcccaatcgctcactcagggtgcgccgcacctgggcccgcctcttatagacgccctcccagcgcagcgactacctgtgatcccgtggttgaggagcatttcagaaggagtctgggtaagaattacaaagagccagagcctgcccccaacagcgtcagtatcacaggatccgtggatgatcatttcgcaaaagcgctgggtgacacctggttgcagattaaggctgcgaaggacggcgcctcgtcgtcacccgaaagtgcctccagacgcgggcagcctgcctcaccttccgcccatatggtctctcatagccattctcccagcgtggtcagttag

SEQ ID NO: 52268 - DNA, 633 bp, Artificial Sequence
  Description of Artificial Sequence: Synthetic coding sequence
atgatcaaggtgcggaacaagaccgccaacggcgactgccggcgggatcctcgcgaaaggtcgagatccccgatcgagagggcagtggctcccacgatgtccctccatgggtcacacctttacacctctcttccctctctgggactggagcagcctctcgctcttacgaagaactccctggacgcttcaagacccgccgggttgagtcccaccttgacccccggtgaaaggcagcagaaccgcccttccgttattacatgtgcgagtgccggcgcccggaactgtaacctgagtcattgcccaatcgcacacagcggctgcgccgctccgggcccggcctcataccgtcggcccccttctgctgctaccacgtgcgatcctgtagtggaagaacactttcgacggtccctgggaaaaaactacaaagagcccgagcccgccccaaatagtgttagcatcacaggatctgtggacgatcactttgcaaaagccttgggcgacacctggcttcagatcaaagctgcgaaagacggtgcatcttcctcaccagaatccgccagtcgacgcggccagccagctagtcccagcgcgcacatggtctcacatagccattcaccctctgtggtaagctag

SEQ ID NO: 52269 - DNA, 906 bp, Artificial Sequence
  Description of Artificial Sequence: Synthetic coding sequence
atggccagccggtacgtggccgtgggcatgatcctgagccagaccgtggtcggtgtgttagggtctttctccgtgttattgcactacctcagcttctactgcaccggatgtaggctcagatcaactgacctcattgtcaagcacttgatcgtggcgaattttcttgctttacggtgtaagggggtgcctcagactatggccgcctttggggtgagatactttttgaacgccttgggctgtaaactcgttttctacctacatagggtggggcggggcgttagtatagggaccacatgtctgctcagtgtgttccaggtgattactgtgagcagtcggaagagcaggtgggcaaaattgaaagagaaagctccaaagcacgtgggcttctccgttcttctctgctggattgtgtgcatgctggtcaatatcatctttccaatgtacgtcactggaaagtggaattatacgaacatcacagtcaatgaagacctgggctactgctccggaggggggaataataagatcgcacaaacactccgagcaatgttgctgagtttcccggatgtattgtgcctgggacttatgttgtgggtcagttcgagcatggtctgtattctgcacagacacaaacagcgagtccagcatatcgacaggagcaacctcagtccacgcgcatcacccgagaatagggccactcagagtatactgatcctggtgtcaaccttcgtatccagctacacgctcagttgcctatttcaggtgtgtatggctcttttggacaacccgaactccttattggttaacacgtctgcactcatgagtgtatgttttcccaccctgtcccccttcgttctgatgagctgtgacccttccgtgtatcgattctgcttcgcctggaaacgttag

SEQ ID NO: 52270 - DNA, 2178 bp, Artificial Sequence
  Description of Artificial Sequence: Synthetic coding sequence
atgccccccttcctgctgctggaggccgtgtgcgtgttcctgttctcgcgagtgccgccttctctgcccctgcaggaagtccacgttagtaaggaaaccatcgggaaaatcagcgcggccagtaagatgatgtggtgctccgccgccgttgatattatgtttctgctggacggctccaactccgtaggtaagggctcttttgagaggagtaaacactttgctatcacggtttgcgatggtttagacataagccccgagcgcgtgcgagtgggcgccttccagttctctagcactccccatctcgaatttccgcttgatagcttttctacccaacaagaggttaaagctcgtataaaacgcatggtgttcaagggtggcagaaccgaaaccgagttagccctgaaataccttctccatcgtggactgcccggcggtagaaatgcttcagttcctcagattcttataatcgtgacggacggaaaatcccagggagatgttgcgctcccaagcaaacagctgaaggaacgcggcgtgactgtgtttgcggtgggcgtgcggttccctcgctgggaagagctacatgccttagcttccgagcccagagggcagcacgtgctcctcgcagaacaagtcgaagacgccaccaatggtctgttcagcacactgagttcctctgcaatatgttccagtgctacacctgactgtagggtggaagctcatccgtgcgagcacagaacactggaaatggtgcgggaattcgccggtaatgctccttgttggcggggctcccggaggacactcgcggtgctcgctgcgcattgtccgttttatagttggaaaagggtctttctcacacatccggctacttgctataggacaacatgcccaggaccatgtgattcacagccatgccaaaacggtggaacatgcgtccctgaggggctcgatggctatcagtgcctgtgtccactcgcctttggcggggaggccaactgtgctctgaagctctccttagaatgcagggtggacctgttattcttgctggactcctctgcggggacaaccctggatggctttttaagggccaaggtgtttgtgaagaggttcgttcgcgctgtgctttccgaggacagcagggctcgtgtaggtgtggccacttacagtagagagctgcttgttgccgtgcctgtgggagagtatcaggacgtgcccgatctggtgtggtccctggacgggattccatttaggggaggccccactctcaccgggtctgcccttaggcaggccgctgagcgggggtttggatccgccacccgaactggtcaggataggccgcgacgagtcgtcgtactgctaacagagtcacattctgaggatgaagttgcaggaccagccaggcatgcccgtgctcgcgagcttctattactcggcgtggggagcgaagccgtccgtgccgagctggaggagatcactggatccccgaaacatgtaatggtatattctgatccgcaggatctctttaatcagatccctgagctgcagggaaagctgtgcagccgtcaacggcctggctgcaggacacaggccctcgacctggtgtttatgctagacacctcagcgtcggtggggccggagaacttcgctcagatgcagagtttcgtaagatcttgcgctctccaattcgaggttaacccagacgtgacacaagtcggtctggttgtttatgggtcccaagtgcagacagcttttggcttggatacaaaacccactcgagcagccatgctgagggcaatcagtcaggccccatacttgggcggagttgggagtgcaggtaccgcgcttctgcatatttacgacaaggtcatgaccgtgcaaaggggcgcgcgacccggcgtgcctaaagccgtggtggtcctcaccggtggccgcggcgccgaagacgctgctgtacctgcccaaaaattacggaacaatgggataagcgtactcgttgtgggagtgggacccgtcttgtctgaaggtctgcgtcggctggccgggcccagggacagccttattcatgttgcggcttacgcagacctgaggtatcaccaagatgtgcttatcgaatggttgtgtggcggggagtggggcaatccacatccgcagggatgcccccacggaagaccatcggcctag

SEQ ID NO: 52271 - DNA, 1251 bp, Artificial Sequence
  Description of Artificial Sequence: Synthetic coding sequence
atggccaccaagggcatgcggctgaagagcaccaaggaggtgttccccttggctcatgtttgtaacgacacgaataagatgacgctaattaaccctcagggagccaaacttaacatctacaagagaaaggtagagcaagcgattcagagttacgaaaagaggttgaataagattgtctggcgagcgttgtcacaggaggaaaaggagaagctggacgcaaataagcccatccagtacctggagaacaaaaccgtacttaaccaagccctggagcgcttgaactggcccatctcactgaaggaactttctatgttagaaagtgaaatcctagccggcaaaatgtacatccagcaagccatggaactgcaggaggcagcaaagaaaaattacgctaataaagcccctggcgagcagcagaagctgcagggcaatcccacaaaaaaaacgaagtcaaagagacctgatcccctgaagggacagaaagtgatcgcccgatgtgacgagaatgggttctatttccctggggtcgtgaaaaagtgtgtgtccaggactcaagccctcgtcgggttctcctatggcgacacaaaggttgtctctaccagttttattacccccgttggcggtgccatgccgtgccctctgctgcaagtgggtgactatgtgttcgctaaaatcgtgatacctaaaggctttgacttctatgttcctgcaatcgtgatagccctccctaacaagcacgtggcaaccgagaagttttacactgtcctgaaatgcaacaataggcgagagttctgtccccgctctgccctgataaaaatttcccagaataaatatgccttgagctgttctcacataaaaagtccaccaatcccggaagatcccgaggtcgaagatgtggaagccagaaattcagcatttcttttttggccactgaaggaggccgacacccaggactcccgggaaccaaggcgcgagaagccaagaaggaagaagcgcccggctaagcaaccactgcagcaagcagccccatccgacagtgacggaagttcccacggaatttcttcacatggaagctgccaaggaacacacccggaaccccgcaccgcacacctgcacttcccagccgcagggcgactaggcctgagttctcacgctattattgctactccccccccacgggccgctctcccgtgcaccttgcaggcaacacacagctccaagggactgaggagcgtgccagaaacattgtag

SEQ ID NO: 52272 - DNA, 1875 bp, Artificial Sequence
  Description of Artificial Sequence: Synthetic coding sequence
atggagaagagcggccccagcagcaccatcagcgagcagcagctgcagcgacaggagggatggatcaacaccaaaaccgatctcgctgagcagagtctgatttcgtcagaaaaatggctacagctccacggattaaagtccaacaagcttaccctgaaacagatacttagtcaaattggctttccccattgtgaagactatgtggccagcttgggtcgaccagtggcaagcagatacgccgatggtttatttccacaactgtacagagctgaggatgggcgtgtttacaacctgacggctaaatccgaactgatttaccaattcgtggagcatctaacacaagctgtcgaatcgtataagcagagaatggactggctcacttccaagtctcggcaaatcttcggcgtcatcttggagcaatgtgtaaccatagtcctagacttcggaggcatcctggaaggagagctcgatctctgtagggaggctctgaccatggtgctacaagagcaagtcgcacatatcacagaatttaacataataagagtgtctcaggaacctgtcaaatggcaggagaacgccacccccgtgaccgagcagagcattgcaacggcgattagttgggttgaaaagttgacagtagagctgactgtttcggaagccgggagattggatgccctcttggaggctggaagggataagaccatcgagtcaatatactatttcgtagtgggtgacgtgccagaggaatctaaggagctcctgctacaacgagctctggagattccctgccccgtctacaccgtctcatttaacgcccggggggagggtacgatcgcctttctcaaagacctcagtgccaaaacccacagtcggttccacgcttttgctgaaagaaccgagtgcgtcgagttccctgccttctccactaaagatggggataacgtgatgacatggaattcccgcaagctcaaaggcaagctgccaccaggtgccggagtgcgggaggacgtcttccttgtttggcaagagatggaagaagcttgttccacccttgctcagatccagcggctggtggctgaacctccaaagcccgacgtggccacagtcgattgcgaaagtgagacgacctccgtggaaattgccagcaaccccgaagatacctgggattccaaaacttggttacagaagtacggacttaaagcacagaagctgagcttatacgatgtgctcgcggattgctccttcagacatgccgatggcgtggtggacattaaagcaaagccagaaaacgaaagcgtgcagactagcgccgagaccaacaagaagacagtccacgctaagtactgcagccgcttcgttcatgctccctggaaggacggtagcctcgtgcatgttaacattactaaggagaagtgcaaatggtattccgagagaatccacacagccctcgccagaattcgtcgtcgcatcaaatggctccaggacggcagtcagagtctgttcgggcgcttacataatgattgcatatacatcctgatcgataccagccatagcatgaaatcgaaattagacctggtgaaggacaagattattcaattcatccaggaacaactgaaatacaaatccaagtttaacttcgtgaagttcgatggacaagctgtggcctggcgggaacagctggcagaggtgaatgaagataacctcgagcaggcgcagagttggattagggacattaaaattgggtccagcaccaatactctctccgcgttgaagactgcgtttgccgacaaggagacgcaggccatttacttgctgacagatggcagaccagaccagggaactagtagtcacctgctgttgaccgctgctgtgtag

SEQ ID NO: 52273 - DNA, 1428 bp, Artificial Sequence
  Description of Artificial Sequence: Synthetic coding sequence
atgtggcggctgtggggcgacctgtggctgctgggcatgctgatggtttgttttcattcgtctacggagcaaaaaatggctgaatacacaatggtttctcaggaacccgtgaaatggcaggagaatgcaacacccgttaccgagcagtctatagccaccgccattagctgggtggagaagctgacagtggagttaaccgtctccgaggcaggccgcctcgacgccctcctggaagcgggccgggacaaaactattgaaagcatctactacttcgtagtgggagatgtgcctgaagagtcaaaggagctgctgctgcaacgcgcactggaaatcccttgccccgtttacactgtgtccttcaacgctagaggggagggaacaattgcatttttgaaggacctgtcagcaaaaacacactcccggttccatgccttcgctgaaagaacagaatgtgtggagtttcccgctttttccactaaggatggtgacaacgtcatgacatggaattccaggaagctcaaaggtaaattgccccctggtgcaggggtacgagaagacgtgttcctcgtctggcaggagatggaagaagcctgcagcaccctcgctcagatacagcgtcttgtggccgaaccgccaaaacccgatgtagctacagtggattgtgagagtgaaactacttcagtcgagatcgccagcaaccccgaggatacctgggattcaaagacatggttacagaagtacggactgaaggcgcaaaagctctctctctacgatgtgctggcggattgcagctttcgacacgctgacggagtggtggacatcaaggccaagccagaaaatgaatctgtccagacttccgccgagaccaataagaaaacggttcatgcgaagtactgctctcggttcgtgcatgctccatggaaggacggatccctcgtgcatgtgaatatcaccaaggaaaagtgtaaatggtattccgagagaatccacacggcgctggctcgtatcagacggcggataaaatggctgcaggacgggagccagtcattattcggtcgcctccataatgactgtatctacatcctgatcgacacaagccattcaatgaagtctaaactggatctcgtaaaggataaaatcatacagtttatacaagaacagctcaagtacaaatccaaatttaactttgttaagttcgatggccaggccgtggcctggcgagagcagctagctgaagttaacgaggacaacttggagcaggctcaaagctggatacgggacatcaaaattggatcctctacgaacacgctttctgccctgaaaacggcgtttgctgataaagagacccaagctatttacttgctgaccgatggacgtcctgatcaacagccttttaaagaaggggtttcggtcttgagccaccgctag

SEQ ID NO: 52274 - DNA, 3885 bp, Artificial Sequence
  Description of Artificial Sequence: Synthetic coding sequence
atggagaagagcggccccagcagcaccatcagcgagcagcagctgcagcggcaggaaggatggatcaatacaaagactgacctggcagagcagagcctgattagctcagaaaaatggctacagctccacgggctgaaatctaacaagctgaccctgaagcagattctgagccagatcggctttccacattgcgaggattacgttgcatcccttggccgtcccgttgcctcacgatacgccgatggcctttttcctcaactttatcgcgcggaagacgggagggtctataatcttactgctaagagtgaactgatttaccagtttgtcgagcatctgacgcaggctgtggagtcctacaagcaaagaatggattggcttaccagtaaaagccgccagattttcggcgtcattctcgagcagtgtgtgacgattgtgctggatttcgggggcatcttagaaggcgaattggacttgtgtcgggaagccctcacaatggtgttacaggagcaagtggcacatataacggagttcaacatcatacgcgtgtcgcaggagcctgtgaaatggcaagagaatgcaacaccggtgacagagcagtctatcgccaccgctatttcttgggtggagaaactgactgtggaactgactgtgtctgaagctggccgcctggacgctctgctagaggcagggagggacaaaaccatcgaaagcatctattactttgtggtgggcgatgtccccgaggaatctaaggaacttctcctgcagagagctctggaaatcccctgtcctgtatataccgtgagtttcaacgcccggggtgaaggtacaatagcattcctgaaggatcttagtgccaaaacacattcacgcttccatgcttttgccgagcgaactgagtgcgttgaattccccgccttttccacaaaggacggcgacaacgtcatgacctggaattctagaaaacttaaaggtaaactcccccccggtgccggcgtgcgtgaagatgttttcctggtgtggcaagagatggaagaagcttgctccacactggcgcagattcaacgactggtggcagaaccccctaagcctgatgtggcaacggttgactgcgagagcgaaacaacttcagtagaaatcgccagtaatccggaagatacgtgggacagcaagacctggctccaaaagtatggcttgaaggcacaaaaattatctctctatgacgtattggctgattgttcatttcggcacgcagacggggtggtggacattaaagcaaaaccagagaacgaatccgtgcagaccagtgcagagacaaataaaaagaccgtgcatgcgaaatattgcagcaggtttgtccacgcaccttggaaagatgggtcccttgtacacgtaaacattaccaaggagaaatgcaagtggtattccgagcgaatccacaccgcgctcgccaggattcggcggaggattaagtggcttcaggacggctcccaatcgctctttggacgactccataatgactgtatctacatcctcatagatacgtcccactccatgaagtcaaaattagacctagttaaagacaaaataatccagtttattcaagagcaactcaaatataaatccaagttcaactttgtcaaattcgacggccaggcagtcgcctggcgtgagcagctggcggaggtcaacgaggacaacctggagcaggcccagtcctggatacgggacattaaaatcgggagcagcacaaatacactttccgccctgaagacagcctttgcggataaggaaacacaggcaatctatctcctgaccgatggccggccggaccagcctcccgaaactgttatcgatcaggttaagagattccaggagattcccatctacaccatctcatttaattacaatgacgaaatcgccaatagattcttgaaagaagtggccgctttgaccggtggcgaattccatttttacaatttcggttgtaaagacccgacacctcccgaggcagtccagaatgaagatctcactctccttgtgaaggagatggagcagggacattctgaccttgagaagatgcaggacctgtacagcgagagtctaattatggactggtggtataatgctgaaaaagatggggactccaaacatcagaaggaaatctgctcaatgatttctacccccgaaaagtgcgccaagccacaaagcgatgtggactctactcaaacttcaagtctcaacatgctgaaaggcccttggggactgagcgaccagaaggtgcagaaaaagaaagtgcttcacgcggagagcactaaaaccagcctgctgaggagtcaaatgtccagcctaaggagcagtgcctgctccgaaaggaaggacggccttagtaacgcatctagccggcggactgcgttgtcagacaaggagatgtctatccttctggccgaggaatggctggacgacaagtcttcagaaaaggttacccgcgaggggtcgcaggtgtacgaccacgacagcagtgacgttagctcagagaattggttgaaaacctacggactggttgctaaaaagcttacgctgatggacgcactttcagtagccgctgtgccacattcttcaacctacgtcccagtgctcgacaaacatgtggtgtcaaaagtgttcgacgaggttttcccgctggcccacgtgtgtaatgatactaataagatgacattaatcaacccacagggtgctaagctgaacatatacaagcggaaggtggaacaggcaatccagagctacgaaaaacgcctgaacaagatagtgtggcgcgctctttcgcaagaggagaaggaaaagttggatgccaacaagcctattcaatatctggaaaataaaactgtccttaatcaggcgctggagagactgaattggcctatcagcctgaaagaactgtcaatgctggaaagcgaaattttggcaggcaagatgtacatacagcaggccatggagttacaggaggcagctaaaaaaaactatgctaacaaggcccctggggaacagcagaagttacagggaaatccaactaagaaaacgaagtcaaagcggcccgaccctctgaaaggccagaaggtgatagcgcggtgcgatgagaatgggttctacttccccggcgtggtcaagaagtgtgtgagtcgtactcaagccctggttgggttctcttatggcgatacaaaagttgtatctaccagctttatcactcctgtgggtggcgccatgccctgcccactgctccaggtgggggactacgtttttgccaaaatcgtgattcctaaggggtttgacttctatgtgcccgctatcgtgattgccttgcctaacaaacatgtggcaacagaaaaattctacaccgtcttgaagtgcaacaatcgtagggagttttgcccaaggagcgccctgattaagatcagtcagaataagtatgctctgagctgttcccatataaaaagcccgccaatccccgaggatcccgaggtggaagatgtagaagcacgcaattccgcatttcttttttggccgttaaaggaggccgacactcaggacagccgcgaaccacgtagggagaagcccagacggaaaaagagaccagccaaacaacccctacagcaggccgcgcctagcgactcagacggtagcagtcacggcatcagttcccacggatcctgccagggcacccaccccgagcccagaacggcgcatctacactttcccgcggccggacgtctgggcctttctagccacgccatcatagctaccccgccgcctagggcagccctgccatgcactttgcaggctacccacagcagcaaaggtctgcgaagcgttcccgaaactctttag

SEQ ID NO: 52275 - DNA, 3729 bp, Artificial Sequence
  Description of Artificial Sequence: Synthetic coding sequence
atgcccggcctgtactgccccagcagctggacccccctgcccctgacagactcctgggtcagggcctgtgccaacggaccttgtctctccgtgcgcgccagactcacatatcgcaaccctcagccacagccagtggacggcgtgtttgtgtatccactcgccgaagccgaagtcgtgtccggtttcgaggcagaggcggcaggccgcagggtgagttttcagctccaatctaggaggaggagtcaggccgcatgctgccgcgcacttggccctggcctgggcacccctacaccccgccgctgtgcccagggacaccttgttctcgatctggcccaggctcgtagcacactggtgttgccaactggcatcattgccgcagctgggaccatgaccgttaccttgcattcgtctcgtgaactgccgagccggccagatggcgtactccatgtcgcccttcctaccgttctgaccccgctggccccaccagggcctcctggcccacctcgcccccccggattgtgcgatgattcccccacatcgtgttttggcgtaggctccctgcaggaagagggactggcttgggaggagttggccgccccaagagacgtctttagcggccctgcccggtgccctgccccatatactttttctttcgaaatgctggtgactggcccctgtctcctcgctggtctggagtctccctcccacgcgttgcgcgctgacgcccctcctcatgcatcttcagccgcaacaatatgcgtgactctggcagaaggtcatcactgcgacagagctttggagatcctcctgcacccaagtgagccacaccagccacatcttatgctagagggaggcagcctgagcagcgccgagtacgaggcaagggtgcgcgcccgtagagatttccaacgacttcagcgaagggatagtgacggcgatagacaagtctggtttttgcagagacgcttccacaaagacatcctgctgaacccagtcctagccctgagcttctgcccagatctctcctccaaaccaggccatctcggtactgcaacaagagagctccttttcctgctggatagttcatctgttgcccataaggatgctatcgtcttagccgtgaagagtctcccaccccagacactgattaaccttgcggtgttcggcacactggtgcaaccgctgttccccgaatctcggccatgcagcgatgacgccgtacagctgatctgtgaaagtatcgaaacactgcaggtaccctcaggtccaccggatgtcctggccgccttagattgggccgtggggcagccacaacacagggcatatcccaggcagctattcttgcttacagccgcctctccaatggctgctaccacccacagaaccctggagctcatgcggtggcaccgtggaactgcacggtgcttttcattcggactggggccaacttgccatcagttgttacagggtcttagcgccttgtcccgcggacaggcctactttctgcgacctggccagcgattacagcctatgcttgtgcaagcactaagaaaggctctcgaaccagctctcagcgatatatcagtggactggtttgtccccgatactgtggaggcactactgacccctagggagattccagcattgtatcctggagatcaactcctcggctattgcagcctgttccgggtggatggcttcaggtctaggccaccaggtggacaggagcccggatggcagagtagcggagggtcagtctttccttctcccgaggaagcgccgtcagccgcctcaccgggtaccgagcctactgggaccagcgaaccactcggcacgggtaccgttagcgccgagctgagctccccatgggccgcgcgagactccgagcagagtaccgacgctctgacagatcccgtgacagatcctggcccgaatcctagtgatactgcaatatggagaagaatcttccagagcagttacatccgggagcagtatgtcctgacccattgtagtgcgtccccagagcccgggccaggtagtacaggcagctccgagagccctggtagtcagggtcctggctcgcccgaggggtccgcgcctttagaaccaccatctcagcagggttgccgaagcctggcctggggggagcccgcgggtagccgctcttgcccccttcccgcccctaccccggcgccctttaaggtgggcgctctctccaccgaagtcctggggagacagcacagagccgccctggcaggacgctccctgtcctctccgcccggtcgagcgaatcaggtacccggccgcccaaggaaacccagcttaggcgcaatcctggatggcccctccccggagcctgggcaacagctgggccagggcctggatgatagtggaaacttgctgtctccagcccccatggattgggacatgcttatggaaccacctttcctgtttaccgctgttcccccaagtggagagctggcgccccctgcagtgcctccgcaggcccctaggtgtcatgtggtgattagagggctttgtggcgagcaacctatgtgctgggaggtgggtgtgggcctggagacgctgtggggaccgggagacggcagccaacccccaagcccccctgtgagggaagccgcatgggaccaggctctccataggctgaccgctgcgtccgtcgttcgtgacaacgaacagttagccctgagggggggagcagagactacagccgataggggccacgctcggaggtgctggctgagagccctgcagacctcaaaggtcagttccgctccatcctgtttcacttgtcccgtggccgtcgacgctaccaccagagaagtcttgcctggtgccctgcaagtgtgttcaagcgaacctgccgagccccctgggacaccccccgcctcccattctcacctcgacgcggcccccctacccactgttgtgtatagcaaaggcctgcagaggggatctcccgctggcgcctgggactcggaccagaacgggaactcaaagagggccctgggagaccctgccacccctacagagggacccaggcggcccccgccgcggcctccatgtagactgtccatgggccgacgtcataagttgtgtagtcccgaccctggccaggccaataacagcgaaggttccgaccatgattatcttccccttgtccggctgcaggaggcccccgggagtttccggctcgatgcccctttttgcgccgccgtacgaatcagtcaggaacggttatgtcgagcctccccttttgccgtgcaccgcgcttccttatcccccacatccgcttcgctgccctgggctctcttaggaccgggagttggccagggtgactccgctacggcatcctgttccccctccccatctagtgggtcggaaggtccgggtcaggtggacagcggtcgcggctcagatactgaggccagtgaaggcgccgagggcctgggcggcaccgacctgcgagggcggacctgggcaacggccgtcgcccttgcctggcttgagcacaggtgcgcagcggccttcgatgagtgggaactcaccgccgccaaggcagattgctggttgcgcgcacagcacctgccagatggcctcgacctggccgccttaaaggccgcggctagaggcctgttcctgctactacggcattgggatcagaatctccagctgcaccttctgtgctactcacctgcaaacgtttag

SEQ ID NO: 52276 - DNA, 2676 bp, Artificial Sequence
  Description of Artificial Sequence: Synthetic coding sequence
atgctgcccaccgaggtgccccagagccaccccggccccagcgccttgctgctcctccagctgctattgccccccacatcagctttttttcctaacatctggtcacttctggccgctccaggatccattactcaccaggacttgaccgaagaggccgcactgaacgtgacactgcaattatttttggagcagccccccccaggccggcccccactgcgcttagaggacttcctgggacgaacactcctggccgacgatctgttcgccgcgtactttggtccaggcagctcgaggcgctttagagcagcccttggcgaagttagtagagcaaacgccgcacaagacttcctgcccacctctagaaacgaccccgacctgcacttcgacgcagagcggctgggtcaagggagagctaggctcgtgggcgcccttcgtgaaaccgtggtggccgcccgagccctagatcacaccctagcaagacagcgactgggagccgcgctgcacgctctgcaagacttctactctcactcaaactgggtagaactcggagagcagcaaccccacccacatttactctggccccggcaggagttgcagaatcttgcccaagtggccgacccaacctgcagtgattgtgaggaattgtcttgtccccgaaattggctcgggtttactttacttacttccggctacttcggaactcatccccccaaaccacccggtaagtgcagtcacggcggacacttcgatcgaagcagctctcagcccccgaggggaggcatcaacaaggactcaacctctcccggattctccccccatcatatgctacatctgcaagcagccaagctggcgctcttggccagcatccaagccttcagcttactgaggtccagactgggcgaccgagatttctctaggttattagatatcactcccgcgagctctttgagcttcgtcctcgataccaccggaagtatgggagaggagatcaacgcggctaagattcaggcgcggcacctcgttgagcagcggagagggtcaccgatggaacccgtgcactatgtcctcgtaccctttcacgatccaggtttcgggcccgtctttacgacaagcgatcccgattccttttggcaacagctgaacgagatccacgccctgggggggggagacgaaccagagatgtgtctcagtgccctgcaactcgctctcctgcatacccctccactgtctgacatcttcgtgttcactgatgcgtcccctaaggacgcatttctgaccaaccaggtggaatctctgacacaagagcggcggtgtagggttacctttctggtgaccgaggacaccagccgagtccaaggccgggcccgtagggagatactgtctcccctacgttttgaaccgtataaagccgttgccttagcaagcggtggggaagtaatttttacaaaagaccagcatattcgagatgtggctgcgatcgtgggcgagagcatggccgccctcgtgactttgcctctggatcctcctgtagttgtgccaggtcagcctctggtatttagcgtggacggccttcttcagaagatcactgtccgaatccacggcgacatcagtagtttttggataaaaaatccagcaggtgtgtctcagggccaggaagaagggggcggtcctctgggacatacaagacgctttggccaattctggatggtaacgatggatgaccctcctcaaaccgggacctgggaaatccaggtgactgccgaggacacgccaggcgtcagagtgcaggcgcaaactagtttggactttctcttccacttcggcattcccatggaggacgggcctcatcctggcttgtatcccttgactcaacctgtggccggtctacaaacacaactcctggtggaggtcaccggactgggatcacgagcgaatcccggagacccacagccacattttagccatgtaatcttgcgcggagtgccggagggggccgagcttggacaagtccctctggaaccagtgggcccaccagaacggggactgctggccgcgagcctgtctcctaccctgctcagtacaccccgacctttttcgttggagctgatcggtcaggatgccgcgggccggcggttacaccgcgcagcacctcagccctccactgtggttcccgtcctgttagaactatcaggcccatcaggctttttggcccctggcagtaaggtccctctctcactgaggatcgcgagcttttcaggtcctcaggatctggatctcaggacctttgttaacccttctttcagcctgacatcaaacctgagtcgtgcccatctggaactgaatgaatccgcctggggccggctgtggctggaggtacctgactccgccgcccctgatagcgttgtaatggtgaccgtcaccgccggggggcgcgaagccaacccagtgcctccgacgcacgccttcctgagactgctggtgtcagcccccgcccctcaggacagacacacaacacccactggttctagcgaccctattttaacaaccgccaccccagctttttcccccttcactctggtggcccagggtagggccggcgcaggcctagcagcgggctctccctggtgggggaccgttggaggggtccttctgctgttggggttggcatcctggtag

SEQ ID NO: 52277 - DNA, 2067 bp, Artificial Sequence
  Description of Artificial Sequence: Synthetic coding sequence
atgctgcccaccgaggtgccccagagccaccccggccccagcgcccttctgctattgcagctgttgctgcccccgactagcgcatttttccctaacatctggagtctgttggccgcacctgggagtattactcatcaggacttgacagaagaagccgcactgaatgtgactctgcaactctttttagagcagccacctcccggaagacccccactgcgtctggaggactttcttggcagaacactgctcgccgatgacttattcgctgcctatttcgggccaggatcttcacgtagattccgtgcagccttgggcgaagtgtcacgggccaatgcagctcaggattttctgcctaccagccggaatgatcccgacctgcactttgacgctgaaagactcggccaaggcagagctcggctggttggcgctctgcgggaaacggtggtcgccgcacgtgcgctcgatcatacgcttgctcgccagcgtctgggagctgctctccacgcactacaggacttttactctcattccaactgggtcgagctgggcgagcagcagccccacccccacttgctttggccaaggcaggaactgcagaatttagcgcaggtggcagatcctacatgctctgattgcgaggagctcagttgccctcgcaactggctgggcttcacgctgctgacttccggatacttcggaactcacccccccaaacctccgggaaaatgtagccatggaggccacttcgacagaagtagttcacagcccccaaggggcgggatcaataaagactccacttctcccggtttcagtcctcaccatatgctccacctccaggccgcaaaattggctctgctcgcgtcaatccaggccttcagcctgctcagatcccgattaggggatcgggatttcagccggctgctggacattacacctgcaagcagcttaagtttcgtgcttgacactaccggcagtatgggggaagagatcaatgctgccaagattcaggcccgccacctggtggagcaaaggcgggggtcaccaatggagcccgtgcactacgtgttagtgcctttccacgacccaggctttggaccggtgtttacaacctcagatcccgactctttttggcagcaactgaacgagatccacgccctgggaggcggcgacgaacccgagatgtgtctctcagcactccagctcgctctcctgcataccccacctctgagtgatattttcgtgttcactgacgccagccccaaggacgcctttcttactaaccaggtggaatcgcttacgcaagagcgccggtgccgcgtcacgtttctggtgactgaagatacttctagggtccagggtcgggcacggcgggaaatcctcagtcccctgcgcttcgaaccttacaaagccgttgcccttgccagcggcggagaagttatcttcactaaagaccaacacatcagagacgtagccgccatcgtgggagagtcgatggccgccttggttacgctaccattggatcctccggtggtggttcccggacagcccctagtattctcggttgacggtctgctgcagaagatcacagttcggattcatggggatatcagttcgttttggattaagaaccccgctggcgtttctcaaggccaagaagaaggcgggggccccctcggccacacgcggcggtttggacaattttggatggttaccatggacgacccccctcagactggaacctgggaaatccaggtgacggcagaagacaccccaggcgtgcgcgtacaagcccagaccagcctggattttctctttcattttggcatacccatggaggacgggcctcacccgggactctaccctctgacgcagcctgtcgctggcctccagacacaactgctcgttgagagccagagttggggttcatccgcagcttttctgccccgtcatccatctcgcggccccagaggctgtcggactagaccaggagccctgggtgcccgaggcacgtctggggcccgcagcccgcggtcactggccgtggcccacgcagcagtgaacccttag

SEQ ID NO: 52278 - DNA, 2559 bp, Artificial Sequence
  Description of Artificial Sequence: Synthetic coding sequence
atgctgcccaccgaggtgccccagagccaccccggccccagcgccctcctcctcctgcagttgcttcttccgcctacgagcgctttctttcctaatatctggtcattgctggcggcccccggtagcatcactcatcaggatctgaccgaggaggccgcacttaatgtaaccttgcagttgttcctcgagcagccaccaccggggagacctcccctgcgactcgaggatttccttggtcggactctactcgcggacgatctgttcgcggcatactttggaccaggatcttcacggcggttcagggccgcactcggggaggtaagccgcgccaacgctgcccaggactttctgcccacctcccgcaacgaccctgatctgcacttcgatgccgagagactggggcagggccgggcgaggttggtcggggctcttcgcgagactgtggtcgccgctagagctctcgaccatactctagcccgacagcgattgggtgctgctctgcacgccttacaggatttctactctcactctaattgggtggagcttggagagcagcagccccatccacatcttctttggcctaggcaggagcttcagaacctcgcccaggtagcggatcccacctgcagcgattgtgaggagctgtcttgcccacgaaactggttaggatttaccctgcttacctcgggatacttcgggacgcaccctccaaagcccccgggtaaatgtagccatggcggccatttcgacagatcttcctcccagccccctcgaggcggtatcaataaagacagcacgagcccgggattctccccccaccatatgctgcatcttcaggctgccaagctggccctgctggcgtctattcaggccttttctctcctcagaagtcggctcggggacagggacttttcacgcctcttggacatcacacccgcgagttctctctcattcgttctggacaccacaggatctatgggggaggagatcaacgccgctaagatccaagcacgacatttggtcgagcagcgcagaggaagtccaatggagccagttcactatgtgctggtccccttccacgaccccgggttcggcccggtcttcacgacatccgacccagatagcttttggcagcagttaaatgagatccacgccctgggaggcggagatgagcccgagatgtgcctctcggcactgcaactggccttgttgcatactcctccactctccgatattttcgtgtttacagatgcctcccccaaagacgctttcctgaccaaccaagttgaatcactcacccaggagaggaggtgcagggtgacgttcctggttacagaagatacatcccgcgttcagggaagagctcgcagggagatcctgtcacctctgaggttcgagccttataaggcagtcgcgctcgcttccggaggcgaggtcatctttacaaaggatcagcacattcgggacgtagctgccattgtaggcgaatctatggcagctctggttacgctccccctcgacccacccgtggtggttccaggccagccactggtgtttagcgtggacggattactacaaaagataaccgtgcggattcacggagacatcagttctttttggattaagaacccggcaggcgtgagccaaggccaagaggaggggggaggcccactggggcacactcggcggttcggacagttctggatggtcaccatggatgaccctccacagaccggaacttgggagatccaggtcacggcagaggacacaccaggcgtcagggtccaagcgcagacctccctggatttcctgtttcacttcggcatccctatggaggacggaccacaccccggcctctaccctctgacccagcctgtcgccggcctgcagacacagttgctcgtggaggtcaccggtctgggctcccgcgcaaaccccggggatccccagccccatttttcgcatgttatactgcgcggtgtgccagaaggagccgagcttgggcaggtccctttggaaccagtgggcccacccgagaggggcctgttggccgcctcactgtctcccaccctgctgtcgaccccccgccctttttcgctggaacttataggacaagatgccgcggggcggagacttcaccgcgcggcgccccagccatccaccgtggttcccgttctcctggagttgtcaggcccctcaggtttcctcgctcccgggagtaaagtgcctctttcgctgcggatcgcctcttttagcggtccccaggatctggatttgcgaaccttcgtcaacccatcctttagcctaacgtcaaacctgtcacgggcccacctggagctcaatgaaagcgcatggggccggctctggttggaggttcctgacagcgctgcacctgactcggtcgtgatggtaactgttacagccggtggccgtgaggctaacccggttccccctacacacgctttcctgcgactgctggttagtgcccctgccccccaggtacgcaaccattacttcccttctcagggtcctgcacatcatccatataggctgatatag

SEQ ID NO: 52279 - DNA, 2835 bp, Artificial Sequence
  Description of Artificial Sequence: Synthetic coding sequence
atgagcctgaccatccgggcccccagcgtggactaccggaacaccttagggctgtgtggtactttcgacgagaacccggagaatgatttccacgacaagaatggtatgcagattgaccagaattttaacaattacgttgcgtttattaacgaatggaggattctgccaggaaagtcgatgtccgataccctcccagtgtctatgacctccccagggaaaccaagctattgtagctgctctttggacacagccgcgtaccccagcagtgaggacctcgatagcgtgagtagaagcgagatcgccctgggttgtaaagacctaaatcacgtcagtctctctagtctgataccagagctcgatgtcacctcagagtatataaatagcgatactctggtccgcgaaatcaataagcacacctcccccgaagaatataatctgaacctgttcctgcaggaaaaaaagcatatcaacttaactaagcttggtctgaatgtgcagaagcatcctggcaatgagaaggaagacagtctgcagtacctcgccaacaaaaaatacacccagggacgtggctctcattctcaggagatgaggtacaatcgtcagaatcgttggaagagacagaatttccacgagttccctcccctgttcgccttccctagtctgtctcagacggatcttgaggagttgacctattttttccccgaagatcatgccgaggacgttcagcaggaattcttcccaagttggccaacccccagcggcctgaccgagtattctacacttacgttatgccaggaaacgctagccaattcctccatcgggaggctgtgcctggccttcctggggaaacgtctggatagcgtgatcgaaatgtgtgtgaaggacgttcttctgaaggacgacctcagttgggccgaggccggtgtggctcttctcgagaatgaatgtgagaaacgcatcgtcgaggaggggaagtataataccgaagaatatggcacaagcattgaggatattctttctgtcctgaagtgccctaatctatgttccgggaatggccaatgtatggagtgggggtgcgcctgttccccctcttttagctcttacgactgctctgacagctacgacaaggcacccgagattactgaactgggtaacgccgggttttgcgatgtacagaagtacaactgcatgatggttagggtgttcggcaaaggtttcaaggaactcccatctatcaagtgcgaagtgacaaagcttcagtacaacagctccgaatggatgccaggagagcctatctatacccagacagtgttccataattcccgggccgttgactgtcaactgcccacagatgtccagcaatttgacacaatggacttagtgggaggcaaacctacaggcaagtggcagctcaaagtgtctaacgatgggtataaattttctaaccccaaaataaccgtaatctatgacggggcttgccaagtgtgcgggctgtacaaaaacgactcatgcaccataaaggaaaacgtgtgtattatcgacggtctgtgctacgtggagggcgataaaaatcccacatctccttgtctcatctgcagaccgaagatttctcggtttacttggtctttcttggagaataatcagcctcccgttattcaggcccttcaggataagctgcaaacattctacggagagaatttcgagtaccaattcgtggcctttgaccctgagggttccgacatccactttacactagacagcggccctgagggcgccagcgtgagcagcgccggacttttcatgtggaaaactgatctcctgacaacacagcaaatcactgttcgcctgaacgacgactgtgacgcagagacccgcgtgacaattgaggtcacagttaagtcatgtgactgccttaacggcggatcctgtgttagcgatcgcaacttttcacccggctcgggagtgtacttgtgcgtgtgcctccccggctttcatgggagcctgtgcgaagtggacatttcagggtgtcagtcgaatccctgcggcttaggaagctacatcagcggtttccattcttattcgtgcgactgccctcccgaactgaaggtggaaacgcagttcgtgaaccaatttacgacacagacagtagtgctcacaaggtccgacaagagcgtgaataaagaggaagatgacaaaaatgcgcagggtaggaagaggcatgttaagcccactagcggtaacgcttttaccatatgcaaatatccctgcggaaaatcacgcgaatgcgtagcccccaacatctgtaaatgcaagcccgggtacattggctcaaactgccagacagccctctgcgatcccgattgcaaaaatcatggtaaatgtattaagccaaacatctgtcagtgtctgccagggcatggaggggccacgtgcgacgaggaacactgtaatcctccctgtcagcacgggggcacctgcctggctggcaatctctgcacctgcccgtatgggtttgttggaccaaggtgtgagaccatggtgtgcaatagacactgcgaaaacgggggtcagtgtctgactcccgacatttgccagtgcaaaccaggctggtacgggcccacttgctccactgcgctctgcgaccccgtttgtttaaacggtggatcctgtaacaagccaaatacctgcctttgccccaatggattcttcggtgaacactgccagaatgccttctgtcacccaccatgcaaaaacgggggacactgcatgcggaacaatgtgtgtgtatgcagggaggggtacacaggcagaaggtttcagaaacgacacctgtag

SEQ ID NO: 52280 - DNA, 513 bp, Artificial Sequence
  Description of Artificial Sequence: Synthetic coding sequence
atgcccggcggcgcctgcgtgctggtgatcgccctgatgttcctggcatggggcgaggctcaagaatgttcacctggcggccaccagttcctgcgcagtccttatagatcggttcggttcgatagctggcatctgcagcagtccgccgtccaggatcttatttgtgaccacagccttagtccgggctggtatcgcttcctgatcctggataggccagccgagatgccgactaaatgtgttgagatgaaccactgtggcacacaagctccaatttggctttcgcttagggattcagagacgttaccttcccccggggagattaagcagttaactgcatgcgccacatggcaatttctcttctctacaaccaaagattgttgcctgttccagattcccgtcagtgtgagaaattgcggcaatttttctgtctatctcctacagcccactcagggttgtatgggctactgtgctgaaggtttttttgctaaaattgtcaagtcccctcacacctag

SEQ ID NO: 52281 - DNA, 4524 bp, Artificial Sequence
  Description of Artificial Sequence: Synthetic coding sequence
atgaccaccgtggtggtgcacgtggacagcaaggccgagctgaccacgctgttagagcaatgggaaaaggagcacggctctggccaggatatggtgcccattttaacgagaatgtcccagctgatagagaaggagaccgaggaataccgcaagggagacccagacccgttcgatgatcgccatcctggtagggccgatcccgaatgcatgctggggcacttgctaaggattctatttaagaatgacgatttcatgaatgccctcgtcaacgcatacgtgatgacctcacgcgagccgcccctgaatactgccgcctgtagacttttgctggacataatgccaggcctggagaccgccgtagtctttcaggagaaagagggaatcgttgaaaacttgttcaagtgggctcgggaagccgaccagccactgcgcacctactcgactgggctgctgggtggtgcaatggagaatcaggatattgctgccaattacagggacgaaaatagccagctggtggccattgttctccggaggttgagagagcttcaactacaggaggttgctcttagacaggagaacaaacgacctagtcctagaaaactgagtagcgagcccctcctgccacttgatgaggaggccgttgacatggattacggagatatggccgttgatgtggtggacggggaccaagaagaggcctcaggtgacatggaaatttccttccacttggacagtggccacaagaccagctccagagtgaacagtactaccaagccagaagatggaggcctgaaaaagaacaagtccgctaaacagggagatagagagaattttcggaaagctaaacaaaagttgggcttcagtagtagcgatcctgatcggatgtttgtcgagctgagtaattcttcctggtcagagatgtctccatgggtgattggcaccaattacactttgtatcctatgaccccggccattgagcagcgtctcattctgcaatatcttacaccactgggagaatatcaggaactgctccctatcttcatgcagcttggctcccgcgagctgatgatgttttacatcgacctcaagcaaaccaatgacgtgctccttacatttgaagcactgaaacacctcgcatccttgctgcttcataacaagttcgctactgaattcgttgctcatgggggagtccaaaaactgctcgaaatcccccggcccagcatggcagcaacgggggtctctatgtgtctctattacctgtcttacaaccaggacgccatggagcgagtgtgtatgcacccgcacaatgtcttgtcagacgttgtgaactacactctgtggctgatggagtgttctcacgccagtggatgttgccacgccactatgttctttagcatctgctttagcttccgtgcagtgttggagctgttcgatcgatacgacggacttcgccgcctagtcaacctgatttcgacccttgaaatacttaacttagaggatcagggcgcgctactgtctgatgatgaaatctttgcttccaggcaaaccggcaaacacacatgcatggcacttaggaagtattttgaggcccacttggccatcaaactggaacaagtgaaacagtccctacagcgcacggagggtgggattttggtgcacccacaacccccttataaagcctgctcttatacacatgagcagatcgttgagatgatggagttcctgattgagtatggccctgcccagctttactgggagcctgcggaagtattcttgaagctaagttgtgtgcagcttctcctgcaattaatcagtatcgcttgcaattggaaaacttactacgctcgcaatgatacggtcagatttgccctggatgtcctagccattctgaccgtggtgccaaaaattcagctccagctggccgagtccgtggacgtcctcgatgaggcaggctcaacagtctccacagtagggatctcaattatcctgggcgtggccgagggagaatttttcattcacgatgctgagatccaaaagtccgcactgcagattatcatcaactgcgtctgcggtccggacaataggattagctcaatcggcaagtttattagtggcacaccaaggcggaagctacctcagaatcctaaatccagcgagcataccctggctaaaatgtggaatgtggtgcagagcaacaacgggatcaaggttctgctgtcattactgtccataaagatgcctatcactgatgcagaccagattcgggctttagcctgcaaggcccttgttggcctgagccgttctagtactgtgcgacaaatcatatcaaagctacctctgttttcatcttgtcagattcaacagctgatgaaggagccagtcttacaggacaaacggtcagatcatgtcaaattctgcaaatatgcagccgagttgattgagcgtgtcagcggaaaaccgctactcattggaacagacgtgtccctggccagacttcagaaggcggatgtggtcgcgcagtcaaggatctcctttccagaaaaagaactgctcctgcttatacgaaaccacctgatttcaaagggcctgggcgagacagctactgttcttacaaaagaagcagatctgcctatgacagctgccagtcactcttccgcgttcacgcctgtaactgcagctgcgagtcctgtttccctgccacgaaccccccgcatcgccaacgggatcgcaacccgcttgggatcccacgctgccgttggtgccagcgccccgtcagctcctacagctcatccccagccacggcctccacaggggccactggccttacccggcccttcatacgctggaaacagtccacttatagggcgtatctcctttatccgcgagcggccctcaccatgtaacggacgcaagatacgggtgctgcgacagaagtcagatcatggggcatattcccagagccctgccataaaaaagcagctcgaccggcaccttccctcccctcccactttggattccattattacagaatatcttcgggagcaacacgccagatgtaagaacccagtggctacatgtcccccgtttagcctctttacaccccatcagtgccccgagcccaaacaacgtagacaggccccaatcaactttaccagcaggctgaatagacgagctagcttccccaaatacggcggagttgacggcggctgtttcgaccgacatcttattttttctcggttccgacccatcagtgtctttagggaggccaatgaggatgagtccggctttacctgctgtgccttctcagcacgggagcgtttcctgatgctaggaacctgcacgggccaactcaagctgtacaacgtattttctggccaggaggaggctagttataattgtcacaattccgcaataacccacctggagccctccagggacggatccctactgctcacatccgcaacatggtcccagccactgagcgcactgtggggaatgaagtcagttttcgacatgaaacacagttttaccgaagatcattatgttgagttcagtaagcatagtcaggacagggtaatagggacaaagggcgacatcgcccatatttacgacatccaaacaggaaataaactgctgacactattcaatcctgaccttgccaataactacaagaggaactgcgctacatttaatcccaccgatgatctagtgctaaatgacggcgtactctgggacgtcaggagtgctcaagctattcataaatttgacaaattcaacatgaatatctctggcgttttccatccaaatggtttggaggtcattattaacaccgaaatttgggaccttagaacatttcatctgctacacactgtgcctgccctggatcagtgtcgggtggtttttaaccacacaggcaccgtgatgtacggcgccatgttgcaggcagacgatgaagatgacctcatggaagagaggatgaagagcccctttgggagctccttcagaacatttaacgcaactgattataaaccgattgccaccatagatgtgaagaggaatatattcgacctgtgtacagacactaaagactgttatctggcagtgatcgaaaatcaggggtccatggacgcgctgaatatggacaccgtgtgccggctctatgaggtggggcgccaaagacttgccgaagacgaggacgaagaggaagaccaggaggaagaggaacaggaagaggaggacgatgatgaagatgacgatgatacagatgacctcgatgagctcgacacagatcaactgctggaggcagagttagaggaagacgataataacgaaaatgccggcgaggatggtgacaacgactttagcccctcagacgaggagttagccaatttactggaagagggggaagatggcgaagatgaagattccgatgccgacgaggaagtggagcttatcctgggagacactgattcatccgataactctgacctagaagatgatattatcctgtctctcaatgaatag

SEQ ID NO: 52282 - DNA, 4524 bp, Artificial Sequence
  Description of Artificial Sequence: Synthetic coding sequence
atgaccaccgtggtggtgcacgtggacagcaaggccgagctgaccaccctcttggaacagtgggagaaagagcatggtagtggtcaggacatggtgccaatactaactcgcatgtctcagctgattgagaaggagactgaagaatacaggaagggagatcccgatccttttgatgatcgccaccccggaagggcagaccctgagtgtatgctgggccatttgctacgtatcctgttcaaaaacgatgatttcatgaacgccctggttaatgcctatgttatgacctccagggaaccacccttgaatacagcagcctgcaggttgctgttagacattatgccgggcttggaaactgcagtggtattccaggagaaagagggcatcgtggaaaacctctttaaatgggctagagaggccgatcagcctctcagaacgtacagcaccggacttcttggcggcgccatggaaaaccaagatatagctgccaactaccgggacgagaatagccagctagttgcaatagtcctgagacgtttgcgagaactccagttacaggaggtggccctgaggcaggagaacaagcgtcctagcccccgcaagctcagttcagagcctctactgccacttgatgaagaagcagtcgatatggattatggcgatatggcagtggatgtggtggacggagaccaagaggaagcaagcggcgatatggaaatctctttccacctcgattccggccataagacatcctcccgcgtgaacagtacaacaaaaccagaagacggagggctcaagaaaaacaaatcagctaagcagggcgaccgcgagaatttcaggaaggctaagcaaaaattgggatttagttcctctgaccctgaccgaatgttcgtggaactaagcaactctagctggagtgagatgtctccttgggtgattgggacaaactacaccctgtaccccatgacccctgcgatcgagcagagattgattctgcaatatctgacaccgctgggagagtaccaagagttgctcccaatattcatgcagctgggatcccgggagctcatgatgttttatattgacctcaaacagacaaatgatgttcttctgaccttcgaagcgttgaaacacttggcaagcctgcttctgcacaacaagttcgctactgagttcgtagcccacgggggcgtccagaagctcctcgagatccctcggccatcaatggccgcaaccggcgtgtccatgtgcctttactacctgagttacaatcaggatgcaatggagagagtttgcatgcatcctcacaacgtgctttccgacgtggttaattacaccctctggctcatggagtgcagccacgccagtgggtgctgccacgcgactatgttcttttcaatatgcttctcgtttagagcagtgctggaactgttcgataggtacgatggactgcgcaggcttgtgaatctcatcagcaccctggaaattttaaacttggaagatcagggggccctcctctcagatgacgaaatctttgcatcgcggcaaactggcaaacatacatgcatggccctgaggaagtattttgaagcccatctggcaatcaaactggaacaggttaagcagtcattgcagcggaccgaaggaggcatcctcgtgcaccctcagcccccctacaaggcttgttcctacacacatgaacaaattgtggaaatgatggagtttctgatagaatacgggccagcccagctgtactgggagcccgccgaggtattcctcaaactcagctgtgtgcagttgcttctgcagctgatctccatcgcctgtaattggaagacttattacgcccgaaacgacactgtgaggtttgctctggatgtgctcgccatcctcacggtcgtccctaagatccagcttcagttggctgagtcagttgacgtgctcgatgaggcagggagtactgtcagcaccgtggggatctccatcatcctgggggttgcggagggagagttctttatccatgacgctgagatccagaagtcagccctgcaaatcattatcaactgcgtgtgtggacccgataataggatctcttccatcggcaaatttatctccgggacgccaagacgtaaacttccgcagaacccaaaatcgagtgaacacacactggcaaaaatgtggaacgtggtacagtctaataatgggatcaaggttctccttagcctactcagcattaagatgcctatcaccgacgccgatcagattcgggctctggcctgcaaggctctggtgggcctgtctcggtcatccaccgtacgccagatcattagtaaactgcctctgtttagtagttgccagatccagcagctgatgaaggagcctgttctgcaagataagcggtcggaccacgtcaagttctgcaaatacgctgccgagttgatcgagagagtgtcagggaaaccgctccttattggaacggacgtatccctggcacgcctgcagaaggctgatgtagtggctcagtctaggatctctttccctgaaaaggagctgctcctgctcatcaggaatcaccttatctcgaagggactgggtgagacggcaactgttctgactaaggaagccgatcttcctatgaccgcagcgtcccactctagtgcttttacgccagtgaccgccgccgccagtcccgtaagcctccccagaactcctcggatcgctaacgggattgcaaccagactgggctcccatgccgccgtgggagctagtgctccttccgctccaacagcacatccacagcctaggcccccccagggtcccctcgccctacccgggcccagctatgctggaaatagccctctcatcggtcggattagttttatccgtgagaggccctcaccgtgcaacggtcggaagattcgagtgctccgacaaaaatcagatcacggggcctacagccaaagcccggccataaagaaacagctcgacaggcatctccccagcccccccacccttgacagtataataacagagtacctgagggagcagcacgccaggtgtaaaaatccggttgccacctgtcccccgttctctctgtttacaccacatcagtgccccgaacccaagcagaggagacaggcaccaattaactttacatcccgcctgaataggcgagcatctttccccaagtacggaggtgtcgatggagggtgctttgatagacacttaatcttttctcgatttagacctatttccgtgtttagagaggcaaacgaagatgagagtggattcacttgctgtgcattctccgctcgggaaaggtttctgatgcttggtacttgtaccggccagctgaagttgtacaacgtattctccggccaggaagaggccagttacaactgtcataacagcgcaattacacatctggagcccagccgcgatggcagcctgctcttaaccagtgctacgtggagccaacccctttccgccctatggggaatgaagagtgtattcgacatgaagcacagtttcacggaagaccattatgtggagttcagcaaacactctcaagatagagtcattggtacaaaaggcgacatagcgcatatttatgatatccaaactggaaacaaattgttgaccttgttcaaccctgatctcgccaataattataagagaaactgtgcgacttttaacccgaccgacgacctggtcctgaacgacggggtgctctgggacgtgcggtctgctcaagcgatacataagtttgacaagttcaacatgaatatttctggcgtgtttcaccctaatggtctagaggtaattataaacaccgagatctgggacctgagaaccttccatttgctgcataccgtgccagcccttgaccagtgccgagtggtgtttaaccataccggtaccgtgatgtacggagccatgctacaggcagatgatgaggatgatcttatggaggaacggatgaaaagcccttttgggtctagcttcaggacattcaatgcaactgattacaagcctattgcaaccatcgacgttaaacgcaatattttcgacctgtgcacagacactaaagactgctatctcgcggtcattgaaaatcagggaagcatggacgcactcaatatggacacagtttgccgcctctatgaggtgggcaggcagcggttggccgaggacgaagacgaggaggaagatcaggaagaggaagaacaagaagaagaggacgatgatgaggacgacgatgatacagacgaccttgatgaactggatacggatcaactcctggaagccgaacttgaggaagacgataataacgagaacgctggtgaggacggcgacaatgattttagcccctctgacgaagaactagccaatctcctggaggagggagaagatggggaggacgaggattccgacgccgacgaagaagtcgaactgatcctgggtgacactgattcaagcgacaattctgacctcgaggacgatattatcctgtcgctgaacgaatag

SEQ ID NO: 52283 - DNA, 984 bp, Artificial Sequence
  Description of Artificial Sequence: Synthetic coding sequence
atggccgagctgcccggccccttcctgtgcggcgccctgctgggcttcttgtgcctctcagggctggccgtggaggtgaaggtgcccacagaacctctgagtacgcccttgggtaagactgccgaactgacctgcacatactctaccagcgtgggcgacagctttgcacttgagtggtccttcgttcagcctgggaagccaatttccgagtcacaccccatcttgtattttaccaacggacacttataccctaccggctctaaaagcaaacgagtctctctgttgcagaatcctcccacggtcggcgtagccaccctcaagttgaccgacgttcatccaagtgatacggggacgtatctgtgccaagtgaacaatcctcccgatttctacactaatggcttgggcctgatcaatctgaccgtcctggtgcctccttccaatcctctgtgttcccaaagtggccagacaagcgttgggggctccaccgccctccgctgctcctcttctgaaggggccccaaagccagtgtataactgggtgcgtttgggtacctttcctacgcccagccccgggtcaatggttcaggacgaggtgtccggccagctcatactgacaaacctctctctgacctcctctggtacttacaggtgtgtagcaacaaatcaaatgggatctgcttcttgtgagttgaccctgtcagttacagaacccagtcaaggcagggtggcgggcgccttgatcggagttctcctcggagtgttgctgctttccgttgcagccttctgcctcgtgcgctttcagaaggagcgtggcaaaaaaccaaaggagacgtacggggggtcagatctccgagaggatgctatcgccccaggaattagtgagcacacttgtatgagagctgatagttccaaaggcttcttagaacgcccatcctccgcctcaactgtgaccaccaccaaaagtaaactgccgatggtcgtatag

SEQ ID NO: 52284 - DNA, 855 bp, Artificial Sequence
  Description of Artificial Sequence: Synthetic coding sequence
atggccgagctgcccggccccttcctgtgcggcgccctgctgggcttcctttgcctctcagggctcgctgtggaggtcaaagtaccaaccgaacccctgtcaaccccactcggcaaaaccgcagaattgacctgtacctacagtaccagcgtgggcgacagttttgctctcgagtggagcttcgtacagcctgggaaaccaatcagcgagagtcatccaattctgtacttcactaacggccatctatacccaacagggtccaagagtaaaagagttagtctactgcaaaacccccccacagtcggggtggccacccttaaactgaccgacgtgcatcctagcgacacaggtacgtacttgtgtcaggtcaataaccctcctgatttctacacgaatgggcttgggctcatcaatctcacagtgctggtgcccccatccaaccctctttgttctcagtcagggcagacatctgtcggagggtccacggcgctgcgttgttcttcgagcgagggcgcacctaaacccgtgtacaattgggttcggctcgggacttttcccacaccatcccccgggagcatggtgcaggacgaagtaagcggacaactcattctgactaatctctctctgacaagctccggaacctaccgctgtgttgctactaatcaaatgggttccgcttcctgcgagctgaccctgtctgtgaccgaaccatcccagggacgcgtagctggagccctgataggagtcctgctaggggtgctcctcctcagcgtcgccgctttctgccttgttcggtttcaaaaggaaagaggaaaaaagcccaaagaaacctacggaggtagcgacctgcggtag

SEQ ID NO: 52285 - DNA, 363 bp, Artificial Sequence
  Description of Artificial Sequence: Synthetic coding sequence
atggactggaactggcggatcctgttcctggtggtgatcgccgccggagcccaatcgcaggtccagcttgttcagagtggtgctgaggtgaaaaagccaggtgcgtcagttaaggtctcctgtaaggccagtggttataccattacttcttattgtatgcactgggttcatcaagttcacgcgcagggcctggagtggatgggtctcgtctgccctagcgacggctccacttcttatgcccagaaatttcaggcacgcgtaaccattacccgcgacactagtatgtcaacagcctatatggagctcagcagtctccggtcagaggacaccgctatgtactactgtgtccgcgacacaatgtag

SEQ ID NO: 52286 - DNA, 564 bp, Artificial Sequence
  Description of Artificial Sequence: Synthetic coding sequence
atgggcgcccccctggccgtggccctgggcgccctgcactacctggctctatttctgcaattggggggcgccacaaggccagctgggcatgccccctgggacaatcacgtgtcaggacatgccctgtttaccgaaacaccacacgacatgaccgcgagaacaggcgaagatgtagaaatggcatgctccttccgaggatccggttcaccaagctacagcctggaaatacaatggtggtatgttcgctcccaccgagactggaccgacaagcaggcttgggcaagcaatcaagtagtgaaagtggttgggtccaacataagccacaaactgcgactttcacgggtgaagccaacagacgaggggacatatgaatgccgggtgattgacttcagtgacggcaaggcgaggcatcataaagtgaaggcgtatcttagggtgcagcctggggaaaatagcgtgctgcacctacctgaggcccctccagctgcccccgcaccacctccccctaaaccaggcaaagaactccgcaagaggtccgtcgaccaagaggcctgctcactgtag

SEQ ID NO: 52287 - DNA, 615 bp, Artificial Sequence
  Description of Artificial Sequence: Synthetic coding sequence
atgggcgcccccctggccgtggccctgggcgccctgcactacctggctctgttcttgcagctgggcggggcaactcggccagctggccacgctccatgggacaatcatgtgagcggacatgctctttttactgaaaccccccacgatatgaccgcacgcaccggggaagacgtcgagatggcctgttcctttagaggctctggttccccttcttactctttagagatccagtggtggtatgtacggagccacagggactggaccgacaagcaagcatgggcatccaatcagctcaaggcaagtcagcaggaggatgccggaaaggaggccactaagatctctgtggtgaaggtcgtgggctccaacatctcccataagcttagattatcgcgcgtcaaacctaccgacgagggcacatatgagtgtagggtcattgatttctcagatggcaaggctcgccatcacaaagtgaaagcatatttgagagtccaacccggggagaattcagttttacacctacccgaagctccgccagctgcgccggccccacctcctccaaagccggggaaggagttgaggaagcggagcgttgaccaggaggcgtgtagtctatag

SEQ ID NO: 52288 - DNA, 450 bp, Artificial Sequence
  Description of Artificial Sequence: Synthetic coding sequence
atgggcgcccccctggccgtggccctgggcgccctgcactacctggctctgtttctgcagttgggaggcgccaccagacccgccggacacgctccatgggacaatcacgtgagtggccatgcgctgtttacagagaccccacatgacatgacagctcggacaggagaagatgttgaaatggcatgttcttttaggggaagtggttccccctcttactctctggaaatacagtggtggtacgttcgaagccaccgagactggaccgataagcaagcatgggcatctaaccaggtcgtgaaggtggtaggttccaacatttcccataaactgcggctctcaagggtcaaacccaccgacgagggcacgtacgagtgcagggtgatcgatttctcagatggcaaggctagacaccacaaggtcaaggcttatctgagggtgcagcctggctag

SEQ ID NO: 52289 - DNA, 858 bp, Artificial Sequence
  Description of Artificial Sequence: Synthetic coding sequence
atggagcagcggaaccggctgggcgccctgggctacctgccccccttactcctgcacgcactgttactgttcgtggccgatgccgccttcaccgaggtacctaaagacgtaactgtgagagaaggcgacgatatcgaaatgccctgtgccttccgagcctccggcgccacttcttattcactcgagatccagtggtggtacttgaaagagcctccccgggagctgctgcacgagctcgcgctgtctgtgccgggggcgcggtctaaggtcacaaacaaagacgctactaagatttcaactgtacgggtgcagggtaatgacataagtcataggctgcgactgagcgccgttcgtctacaagatgaaggcgtgtacgagtgtcgcgttagcgattattccgatgacgatacacaggagcataaggctcaggctatgctgagggttctgtctcgctttgccccgcctaacatgcaggcagcagaagcagtctctcacatccagagtagcggaccaaggcggcatggaccagccagcgctgccaacgccaacaatgcaggcgcggcctctaggaccacaagtgagcccggccgcggagacaaaagccccccgccaggatcccctcccgcagctatcgaccctgcagtgccggaagcagctgcagcaagcgccgcacacacccccactaccaccgttgccgccgcagctgccgcttcgagcgccagcccccctagcggccaggcagtgctcctgagacagaggcacggtagtggcactgggcggagctatactaccgaccccctgctgagtctgctgttactggctcttcacaagtttttgaggctgctcctggggcattag

SEQ ID NO: 52290 - DNA, 2034 bp, Artificial Sequence
  Description of Artificial Sequence: Synthetic coding sequence
atggccaaggtgaacatcacccgggacctgatccggcggcagatcaaagaacgaggagctctgagttttgaacggcggtaccatgtcaccgaccccttcattcgtagactcgggcttgaggccgagttacagggtcactctggttgcgtaaactgcctggagtggaacgagaagggggaccttctcgcgtcaggatctgacgaccagcacacaatcgtatgggacccgcttcaccacaagaagctcctaagcatgcatacggggcatacggcgaacatcttttcagtcaaatttctcccccacgccggagatcgcatcctcatcactggagccgcagatagtaaagtgcacgtacacgatctcacagttaaggagacaattcatatgtttggtgatcataccaatcgggtcaaaaggatcgcgaccgcccctatgtggcccaacaccttctggtccgcagcggaagacggactgattagacagtatgacctgcgcgagaactcgaaacattcagaagtgctgatcgatctgactgagtattgcggacaactggtggaggcaaaatgtctgacagtgaacccacaagacaataactgcctggccgtcggtgcatccggtccattcgttcggctgtacgacatcaggatgattcacaatcacagaaagagcatgaaacagagcccatcagcaggtgtacatacattctgtgacagacaaaagcctctccccgacggtgcggcccagtattacgttgccggccatctaccggtgaaactgccagactataataataggctccgcgtgctggttgccacttacgtaacattctcccctaatggaacagaactgcttgttaacatggggggtgagcaggtgtacctctttgatttgacgtacaagcaacgtccgtatacttttttgctcccaagaaaatgtcacagcagcggtgaggtgcaaaatggcaagatgtctaccaatggggtgtcaaacggcgtgagtaacggcctacatcttcactccaacggattcagactgcctgaaagccgaggacatgtctctccccaggtcgagctccctccatatctggagagagtcaaacagcaggctaacgaagccttcgcttgccagcagtggactcaggccatacaactctatagcaaggctgtgcagagggcccctcacaacgcgatgctgtatggtaatcgtgccgcagcctatatgaagcggaagtgggatggggaccactacgacgccctgagggattgtttgaaagccatttccttgaatccctgtcacctcaaggcccactttcgactggctaggtgcctcttcgagctgaagtacgttgccgaggcgctggaatgtttggacgatttcaagggcaagttccccgagcaggcccattcctcagcgtgcgatgctctggggagagacattacggcagcgctcttttctaaaaacgatggggaggaaaagaaaggacccggaggcggggctccagttcggctccgctccaccagcaggaaggactccatctcagaggatgaaatggtcctgcgagagcgctcttacgattatcagttcagatactgtggtcattgtaatactacaaccgatataaaggaggccaacttctttggctctaatgctcagtatatcgtttctggaagtgacgatggctcgtttttcatatgggagaaagaaactaccaatctggtgcgggttctccagggggatgagtcgatcgtgaactgtctgcagccccacccgtcttattgctttctcgctactagcggtatcgaccctgttgtacgcctgtggaacccgaggcctgagtctgaagacctcacagggagagtcgtcgaagacatggaaggcgcttctcaggccaaccagcgcagaatgaacgccgaccctctggaggtaatgcttttaaacatgggttaccgaatcacagggctgtcctctggcggagcgggagcctcagacgatgaggacagcagcgaggggcaagtgcaatgtagaccctcatag

SEQ ID NO: 52291 - DNA, 2031 bp, Artificial Sequence
  Description of Artificial Sequence: Synthetic coding sequence
atggccaaggtgaacatcacccgggacctgatccggcggcagatcaaagaaagaggcgcactcagttttgagagaaggtatcacgtcaccgatccttttatacggaggctcggtctcgaggccgagctacaaggccacagtggatgcgtgaattgtctagagtggaacgaaaaaggagacctgttggccagtgggagtgatgaccaacataccatcgtctgggaccctttacaccataagaaattgctaagcatgcacacaggtcacactgccaatattttttctgtgaagtttcttcctcatgccggcgatagaatactgatcaccggtgcggctgattccaaggtacacgtgcatgacctgactgtaaaggagactatccacatgtttggtgaccacaccaatcgagtgaagcgcatcgcaacagccccgatgtggcccaatactttttggtcggccgccgaagatggtttgatccgtcaatacgatttacgggagaacagcaagcattccgaagttttaattgatcttacagaatattgcggacaacttgtggaggcaaaatgcctgactgtgaatcctcaggataacaattgtctagctgtgggggcgtccggtccgttcgttcgattgtacgacatccggatgatccacaatcaccgaaagagcatgaagcagagcccaagtgccggggtccatactttttgcgataggcagaagcctctcccagatggcgcggcacagtactatgtggcgggacaccttccagtgaagctgcccgattataataaccggttacgggtcttagtagctacctatgtgacattcagccctaacggaactgagcttttggtcaatatgggcggagagcaggtctacctgtttgatctcacctacaagcaacggccgtatactttcctgctccccagaaaatgccatagcagtggagtccaaaacggaaagatgtccaccaatggtgttagcaacggcgtgtctaatggcttgcacctccatagcaacggatttaggttgcctgaaagtagaggtcacgtatcaccacaggtggagctgccaccttacctggagcgggttaaacagcaggccaacgaggcgttcgcttgtcagcagtggactcaggccatccaactgtactccaaagcggtacaaagagcaccccataacgccatgctgtacggcaaccgggcagcagcgtatatgaagcggaagtgggacggcgaccactacgatgcgctgcgtgactgccttaaggcgatctctctcaatccttgtcacctgaaggcacactttcggctggcacgatgtttgttcgagctgaaatatgtcgccgaggcactcgagtgtctggacgacttcaagggcaagtttcccgaacaagcccatagtagtgcttgtgacgccctcggccgagacattaccgccgctctgttctccaagaatgatggcgaggaaaagaaaggccctggtggaggggccccagtgcggttgaggtcgaccagtcggaaggacagcataagtgaggatgagatggtgctgcgcgagagaagctacgactatcagttcaggtactgcggccactgtaacaccacgacagacatcaaggaagcaaatttctttggaagcaatgctcagtatattgtttccggcagtgatgacggttcattcttcatctgggagaaggaaacaacaaacttggttcgggtgctccagggtgacgagtctatagtgaactgcctccagccccatcctagttattgttttctggctacgagcggcattgaccctgttgtcagactgtggaacccccgacctgaatccgaggacctgacaggccgtgtggtggaggatatggagggagcatcacaagcaaatcagagacgcatgaatgccgaccctttagaggtgatgttgcttaatatgggttatcggatcactggcctgtcctcagggggggccggagcttctgacgatgaggatagttccgagggacaggtgcaatgcagaccatcttag

SEQ ID NO: 52292 - DNA, 1203 bp, Artificial Sequence
  Description of Artificial Sequence: Synthetic coding sequence
atggccgccgagatccagcccaagcccctgacccggaagcccatccttctccagagaatggagggatctcaggaagttgtgaacatggcggtaatcgtcccaaaagaggaaggcgtcatctctgttagcgaggataggaccgtgcgtgtgtggttgaaacgggattccggacaatattggccatctgtataccatgctatgccaagcccttgcagttgtatgtcattcaaccccgagacaagaaggctcagtataggtttggacaatggaaccattagtgagtttatactgtccgaagactacaataaaatgacgccggtaaagaactatcaggcccatcaaagccgggtgacaatgattctgttcgttctcgagctcgagtgggtactgtcaaccggccaagacaagcaatttgcgtggcactgtagtgaatctggccagcgtctgggtgggtacagaacatctgccgtggcctctggcctccagttcgacgtggagactcgtcacgtcttcatcggcgatcactcaggtcaggtcactattctgaaactggaacaggaaaattgtaccctggtcacaacttttagaggacatacaggaggcgtcaccgcgctgtgttgggatcccgtccagagagtgcttttcagcgggagcagtgaccactcagttatcatgtgggacattggcggtcggaagggcacagctatcgaattgcaggggcacaatgaccgagtccaggccctatcctatgcacaacataccaggcaattgatatcctgcgggggagacgggggtattgtggtgtggaatatggacgtcgagaggcaggagacacctgagtggctcgattccgactcttgtcagaaatgtgaccagccattcttttggaactttaagcaaatgtgggacagcaagaagataggccttaggcagcaccactgcaggaaatgcggtaaggccgtgtgtggcaaatgcagctcgaagagatcatccataccgcttatggggtttgaattcgaggtcagagtatgcgatagttgccacgaggccataactgatgaggagagggcccccacagccacgttccatgatagtaaacacaatattgtgcatgtccactttgatgcgacccgagggtggcttctgacctctggaacagacaaggtgatcaaactctgggacatgaccccagttgtgagctag

SEQ ID NO: 52293 - DNA, 1266 bp, Artificial Sequence
  Description of Artificial Sequence: Synthetic coding sequence
atggccagcttccccccccgggtgaacgagaaggagatcgtgcggctgcgcacaatcggggagctgttggctcctgctgctcccttcgataagaagtgcggacgggaaaattggacagtggcttttgctccagatggttcctatttcgcttggtcacagggacaccggactgtgaaactggtgccatggagccagtgtcttcaaaattttctgctgcacggcacaaagaatgtcactaacagctctagcctgcgacttcctcggcagaattccgacgggggccagaagaacaaaccccgagaacatattatcgactgtggcgacattgtgtggtctctggctttcggttctagcgttcctgagaagcaatcgcggtgcgtcaatattgagtggcacaggttcagattcgggcaggaccaattacttctggccacagggctcaataacggaagaataaaaatttgggatgtgtataccggcaagctgctcctgaatctggtggaccacaccgaagtcgttagagatctgacatttgcccctgatggcagcctgattctcgtttccgctagtcgagacaaaaccctacgtgtctgggatttgaaagacgacggaaatatgatgaaggtgttacgcgggcaccagaattgggtttattcctgcgcttttagcccggattccagcatgctgtgcagcgtaggggcttctaaggccgtgttcctctggaacatggacaaatatactatgatcagaaagctcgaaggacatcatcacgacgttgtggcctgtgactttagtcccgacggggctttgctggctactgcatcctatgacacaagggtgtatatctgggaccctcataatggggacattctaatggagtttggccacctgtttcctcctccgaccccgatttttgcaggcggagccaatgatcgatgggtaagaagtgtctccttttcgcatgacggcctccacgtcgcatcactggccgacgacaaaatggtcaggttctggcggatcgacgaagactatcccgtccaagtcgcgccgctgagtaatgggctatgttgcgctttcagcacagacgggagcgtgctagcagcaggtacccacgacgggagtgtctatttctgggccacaccccgacaggtaccctctctacaacatctgtgtagaatgtctattcggagggtcatgcccacgcaggaagtgcaggagcttcctattccgtctaaactcttagagtttctgagctatcggatttag

SEQ ID NO: 52294 - DNA, 828 bp, Artificial Sequence
  Description of Artificial Sequence: Synthetic coding sequence
atggccagcttccccccccgggtgaacgagaaggagatcggcaagttgctgttgaaccttgtcgatcacacagaagtagtccgagatctgactttcgccccagatggctccctaattctggtatccgctagccgcgataagacactgcgggtctgggatctgaaagatgatggcaatatgatgaaggtgctacggggccaccaaaactgggtctactcctgtgcattcagcccggatagttctatgttgtgttccgtcggagcctctaaggctgtgttcctgtggaatatggataagtacacaatgatcagaaagttggagggccatcaccacgatgtggtggcgtgtgatttttcacccgacggcgccctgctggcaaccgcgtcatacgacacacgtgtctacatctgggacccacacaatggcgacattctgatggagtttggccacctgttcccgccccctacccccattttcgcaggaggcgcgaacgatagatgggtgcgcagtgtgagcttcagccatgatggtttacacgtcgcatcactggcggatgataaaatggtgagattctggcgcattgatgaggattacccggtacaggttgcgccattgagcaatgggctgtgctgtgctttctctaccgacggttcagtattggctgcaggcactcacgacggctcagtctatttttgggccacccctcgtcaagtcccctccctccagcacctttgcagaatgagtattcgtcgagtgatgccgactcaggaggtccaggagctgcctatccccagcaagctactcgaattccttagctaccgtatatag

SEQ ID NO: 52295 - DNA, 642 bp, Artificial Sequence
  Description of Artificial Sequence: Synthetic coding sequence
atggccagcttccccccccgggtgaacgagaaggagatcgacggctcatattttgcttggagtcaaggacaccggaccgtgaaactggttccatggtctcagtgcctgcagaacttcctgcttcatggaacaaagaacgtcaccaattcctctagcttgagacttccacgtcagaattctgacggcggtcagaaaaataagccccgggagcacatcatagattgcggtgatattgtgtggtcccttgcattcggctcatccgtccctgagaagcagagccggtgtgtgaatattgaatggcaccggttcagattcgggcaagatcagttactcctggctacaggcctgaacaacggcagaataaaaatctgggacgtatatacaggaaaactgctgttaaacttggtcgaccacaccgaggtagttcgtgatctgaccttcgcacctgatgggtccctcattctggtgtctgcctccagggataagactctcagagtttgggacctgaaggacgacgggaacatgatgaaggtactccgcgggcatcagaactgggtgtactcttgcgctttttctcccgactcctcaatgctttgttccgtgggagcatctaaggccgtggtcgccgctatacttgtatag

SEQ ID NO: 52296 - DNA, 1215 bp, Artificial Sequence
  Description of Artificial Sequence: Synthetic coding sequence
atggaggccggcgaggagcccctgctgctggccgagctgaagcccgggcggccccaccaatttgattggaaatctagctgcgaaacgtggtctgtggctttctcccctgacggtagttggtttgcttggagtcagggacattgtatcgttaagttgatcccgtggcccttagaggaacaattcataccaaagggtttcgaggccaagtctcggtcctcaaaaaacgagactaaaggccgtggctctcctaaggaaaaaacccttgactgcgggcagatcgtatgggggttggccttttctccctggcccagtcctccttcgcggaagctctgggctagacaccacccccaggtacccgatgtttcttgcttagtgctcgctaccggtctgaatgacggccaaataaagatctgggaagtgcagactggactactattgctgaatctgagcgggcaccaggatgtggtgcgagatctcagcttcacaccctccggctctcttatcctggtttcagcttcacgggacaaaacactgagaatctgggatctgaataagcacggtaagcaaatccaggtgctcagtggccatcttcaatgggtctattgttgcagtatttcgcccgactgttctatgctatgtagcgccgccggtgagaagtccgtgttcctctggagtatgaggtcctacaccttaatccgtaaactggaaggccatcaatctagtgtggtctcctgcgacttcagtcccgacagcgcactcctggtgacggctagctatgacaccaacgtgattatgtgggacccttataccggggaaaggctgcgaagcctgcaccacacacaagtggaccctgccatggacgactctgatgtgcacatttctagcttacgcagcgtgtgcttttctcctgaagggctctatttggctactgtcgcagacgatagactgctccggatctgggctctggagctgaaaacacctattgcctttgcccctatgactaacggtctgtgctgtaccttttttcctcatgggggtgtgatcgcaaccggtacacgtgacggccacgtccaattctggacagcccctagggttctgagcagtctcaaacatctgtgcagaaaggccttgagaagctttctgacaacttaccaagttctggcattgcccatccccaaaaaaatgaaggagtttctgacatacaggacattctag

SEQ ID NO: 52297 - DNA, 540 bp, Artificial Sequence
  Description of Artificial Sequence: Synthetic coding sequence
atgcggagctacaccctgatccggaagctggagggccaccagagctctgttgtgagctgtgatttttcccctgactctgccttgctggtgacggcatcctacgatactaacgtaattatgtgggatccatacaccggcgaacgcctaagaagcttacatcatacacaagtggaccctgctatggacgactccgacgtccacatttcttcattgcgcagcgtctgtttttcgcctgagggtctgtacctagccacagtagcagatgaccgactgctcaggatttgggctttggagctgaagacgccgatcgccttcgccccgatgacgaatggtctgtgctgtactttctttccccatggcggggtcattgccactgggacacgggatggacatgttcaattttggactgcgccccgtgtcttgtccagcttgaaacatctgtgccgcaaggccttgcgcagctttctgacaacctaccaggtgctcgcgctaccaattcccaaaaaaatgaaggagtttttgacgtatcgtacattttag

SEQ ID NO: 52298 - DNA, 585 bp, Artificial Sequence
  Description of Artificial Sequence: Synthetic coding sequence
atgctgtgcagcgccgccggcgagaagagcgtgttcctgtggagcatgcgctcctacaccctcatccgaaaacttgaggggcatcagagttccgtagtgagctgcgacttcagcccagactcagcactgttggtcaccgcctcatacgatacgaatgtcatcatgtgggatccgtacacaggcgagcgtctacgctccctgcatcacacccaagtggacccagcaatggatgatagcgatgtacacattagctccctcaggtccgtttgtttctccccagaggggctttatcttgccacggtggcagatgacaggctgctgagaatatgggcgcttgaactgaaaactcctatcgccttcgccccgatgactaatggcctgtgttgtacttttttcccccacggcggcgtcattgccaccggcacacgcgacggacatgtgcagttctggactgccccgagggtactgtcttctttaaagcacctgtgcaggaaagcattgcggtctttcctcactacgtaccaggtgctggccctgcccatacccaaaaagatgaaagaattcctgacatacaggaccttctag

SEQ ID NO: 52299 - DNA, 1458 bp, Artificial Sequence
  Description of Artificial Sequence: Synthetic coding sequence
atggccgccgtgtggcagcaggtgctggccgtggacgcccggtacaatgcctatagaactccaacctttccccagtttagaacccagtacattcgccggcgcagccagctgctccgcgaaaatgccaaggccggacatccacctgctctacggcgacagtacctcagactgagaggccagctgcttggccaaagatatggacccctctccgagcctgggtcagcccgggcatattccaattctatcgtaagatcttcgagaacaacccttgatcggatggaagacttcgaggacgatccgcgggcactcggcgcgagaggccacagacggtcagtatctcgtggctcttaccaactgcaggctcaaatgaatcgggccgtatacgaggacaggccacctggtagcgttgtgcccactagcgccgcagaggcttctcgggccatggctggagacaccagtctcagcgagaactacgccttcgccggtatgtaccacgtctttgatcagcatgttgatgaggccgtccctcgagtccggtttgcgaatgacgacaggcatcgtctagcctgctgcagtcttgacggctctatatcactgtgccaattggtccccgctcccccaaccgtcctccgcgtacttcggggacacaccagaggagtaagcgattttgcctggagcctgtctaatgatattctcgtctcaaccagtctcgacgccactatgcggatctgggcctcagaagatggcagatgtatccgggagatccccgatcctgactcagcagagttactgtgctgcacattccagcccgtcaataataacttgaccgtggtgggaaatgcgaagcacaatgtgcacgttatgaacatctctaccggcaagaaagttaagggcgggtcaagtaaactgacaggccgcgtgttggccttaagctttgatgcaccaggccggctcttatgggcaggggatgaccacggaagtgtgttttctttcctgtttgatatggccaccggcaagctgactaaagcaaagcgcttggttgtgcatgaaggaagccccgtaacatccattagcgcaagatcctgggtcagccgggaggcccgagacccaagcctcctgatcaacgcctgcctcaacaaattgctgctatatcgggtagtggataacgaggggacgctgcaactcaagcgatccttcccaattgagcagagctcacatcctgtacgcagtattttttgtcccctaatgagtttccgacagggcgcttgcgtcgtgaccggatcagaagacatgtgcgtgcacttctttgacgtcgaaagggcggctaaagcagcagtgaataagctgcaaggtcacagcgcgccagtgctggacgtgagtttcaattgtgatgaaagcctcctggcctcgagcgacgcaagtggaatggtaattgtttggcggcgagaacagaaatag

SEQ ID NO: 52300 - DNA, 1299 bp, Artificial Sequence
  Description of Artificial Sequence: Synthetic coding sequence
atggccgcccccatggaggtggccgtgtgcaccgacagcgccgcccccatgtggtcatgtattgtctgggagctgcattctggagcaaacttgctaacttacagaggaggccaagcaggaccacgcggtctggccctgctcaacggggaataccttcttgcagcccagctcggtaaaaactatatttctgcatgggaactgcagaggaaagatcaattgcagcagaagattatgtgccctggtcccgtcacctgcttaactgcatctccaaacggactatacgtgcttgccggagtcgcggaatccatacacctgtgggaagtgtccacagggaatctgttagtgattctctcacgacattaccaggacgtgtcttgcctgcagttcacaggtgatagttcacactttatttccggcgggaaggattgtttggtcttggtatggagcctctgcagcgtcctgcaggcagatccgtcccgcatcccagcgcctcgtcatgtgtggagccaccacgcactgccaattaccgacctgcactgtggattcggcggcccactcgccagggtcgctacctccagtctagatcagaccgttaagctatgggaagtttcttccggagagttgcttctcagcgtactgtttgacgtatccatcatggctgtgacgatggatctcgcagaacaccacatgttttgcggaggaagtgaaggttcgatcttccaggtggatctgttcacctggcctggacagcgggagcgatcgttccatcctgaacaagacgctggaaaggtgttcaagggccatcggaatcaagttacttgtctgtcagtgagtaccgacggcagcgtactcttgtctgggtcacatgatgaaactgtgagactatgggacgtgcagtccaaacagtgcattaggacggttgcgctgaagggacctgtcaccaatgctgccattttactcgccccagtgtccatgttatcaagcgacttcaggccctctttgccattgcctcatttcaataaacacctgttaggcgctgaacacggtgacgagcctagacatggaggtctgactctccgactgggcctgcaccagcagggaagcgagccgagctacttggacaggacggagcagctacaggctgtgctgtgttctaccatggagaagtctgtgctaggcgggcaggaccaacttcgtgttcgggtcaccgagcttgaagacgaagtcagaaacctccgcaagataaacagagatttgttcgatttttcgacccgctttattacacgccccgctaagtag

SEQ ID NO: 52301 - DNA, 1746 bp, Artificial Sequence
  Description of Artificial Sequence: Synthetic coding sequence
atggccaccgagggcggcggcaaggagatgaacgagatcaagacccagttcaccactagagagggtctctataagctgctgccacactccgaatatagtcgtcctaatagggtgcctttcaattctcaggggtcaaatcccgtgcgggtctcttttgtgaacctcaatgaccagtctggaaacggagataggctttgctttaatgtggggagggagctctatttctatatatacaaaggagttaggaaagcagccgatttgagcaaaccaatcgataagcgaatttacaaaggtacccagcctacatgccacgacttcaaccatcttacggcgacagccgagtctgtttccctcctggtcggcttttccgccgggcaggttcagctgattgaccccataaagaaggagaccagcaaactgttcaatgaagagcgtctcattgataagtcccgcgtgacctgcgttaagtgggtgcccggcagcgagtccctgttccttgtggctcactcatccggaaacatgtatctttacaatgttgaacacacttgtgggaccacagctccacactaccagttgctgaagcagggcgagtctttcgctgtccacacatgcaagagcaagtccacccggaatccactgctgaagtggaccgtgggcgagggggctctgaacgagtttgccttttccccagacggaaagtttctggcatgtgtctctcaggacgggtttctgagagtgttcaattttgactccgtggagttgcacggcaccatgaagtcttatttcggaggcctgctgtgcgtgtgttggagtccggacggcaagtatatcgtgaccgggggcgaagacgacctcgttaccgtgtggtcctttgttgactgcagggtgattgcccgaggacatggccacaagtcttgggttagcgttgtggctttcgacccctataccaccagcgtggaagaaggggaccccatggagttctcgggttcagacgaggacttccaggatttgctgcacttcgggcgagacagagccaactctacccaaagtagactgtctaagcgtaattctactgactcccgacctgttagtgtgacctaccggttcgggagcgtggggcaggacacacaactgtgcctctgggatcttacggaggatatcctgttcccccaccagccactgagccgggctcgaacccacaccaacgtgatgaacgcgacaagcccaccagccgggtctaacggaaattccgtgacgactccgggaaactcagtcccaccacccctgccccgatccaactcgctgccacacagcgctgtctccaacgccggatcaaaaagttccgtgatggacggggcgatcgcatcaggcgtaagcaaatttgctacactgagcctgcatgatcgcaaggaacgacatcacgagaaagaccataaacgaaaccactctatgggtcatatctctagcaagtcttctgacaagctgaaccttgtgacgaagacgaaaacagacccagcgaaaactttgggaactcctctgtgtccaagaatggaggatgtgcccctgctcgaaccactcatctgtaagaagatagcgcacgagcggttgactgtgctcatcttcctcgaggactgtatagttactgcttgtcaggagggtttcatttgtacctgggggcgcccaggaaaggtgggatctcttagttccccgtcccaggcatcgtcccctggtggtactgtggtctag

SEQ ID NO: 52302 - DNA, 1710 bp, Artificial Sequence
  Description of Artificial Sequence: Synthetic coding sequence
atggccaccgagggcggcggcaaggagatgaacgagatcaagacccagtttacgacgcgggaagggctctataagcttctccctcattctgagtattccagaccaaacagggtcccttttaatagccaggggtcaaaccctgtgcgtgtgtcctttgttaacttgaatgaccaatccggaaacggagaccggttgtgtttcaatgttggaagggagctgtacttctatatctataagggcgtgaggaaggccgctgacctgagcaagcctattgataagaggatctacaaaggtacgcagccaacatgtcacgacttcaaccatttgacagctaccgccgaaagtgtatccctgttggtgggttttagcgccgggcaggtgcagttgattgatccaattaaaaaagaaaccagcaagctttttaacgaagagcgattgattgacaaatctcgcgtgacatgcgttaaatgggtccccgggagcgagtcacttttcctagtcgctcactcgagcggaaacatgtacctgtacaacgtcgagcacacctgcggcactacggcccctcactatcaacttttgaagcagggtgagtcatttgccgttcacacttgcaagtccaagtcaacgcgcaatccacttctgaagtggaccgtgggcgagggagcccttaatgaattcgccttcagtcccgatggtaagtttctggcatgtgtctcacaggatgggtttctccgggtgttcaatttcgactcagtggaactccatggtacaatgaaatcctactttggaggactgttgtgtgtgtgctggtcaccggatggaaagtatatcgtcaccggcggcgaggatgatctggtaaccgtgtggagttttgttgactgtcgggtgattgcgaggggccatgggcacaagtcttgggtcagcgtagtagcttttgatccatataccacttcagttgaggagggcgacccaatggaatttagtggcagtgatgaagacttccaggatctgctccacttcggtcgggaccgggctaattctacccagtctagactctctaagaggaactctacagacagccggccagtctcagtgacttacaggttcggatccgtgggccaggatacccagctctgcctatgggacttaactgaagatatcttgtttccacaccagcccctgtccagggcccggactcacaccaatgtcatgaatgcaacatccccaccggccggttctaatggaaacagcgtgactacccccggaaacagcgtgccgccacccctcccaagatcaaattcactgccccattctgctgtgagcaatgcaggttctaaaagctccgttatggacggagccatcgcctctggcgtgtccaagttcgccactctgagcctccacgaccgcaaagagcgacaccacgagaaggatcataaaaggaaccactctatgggtcacatatctagcaagagctcagataaacttaatctggtgacgaagacgaagacggacccggcaaagacattaggaacacctctctgtcccagaatggaggacgttcccctcctggagcctttaatctgtaaaaaaattgcacacgagcgcctgaccgtacttatcttcctggaggactgcatcgtcactgcgtgccaagagggctttatttgcacctggggacgtcctggcaaagtcgtgagctttaacccttag

SEQ ID NO: 52303 - DNA, 1536 bp, Artificial Sequence
  Description of Artificial Sequence: Synthetic coding sequence
atgaacgagatcaagacccagttcaccacccgggagggcctgtacaaactcttgccccattctgaatatagtaggcccaacagagttcccttcaattcccaggggtcgaatcctgtacgagtgtctttcgtgaatctgaacgatcagtctggcaatggagataggctctgttttaatgtgggccgggaactgtacttttacatctacaagggcgtgaggaagcggctgattgacaagtcccgggtgacttgtgtcaagtgggtgcctggtagcgagtccctgttcctagtggcacactcctctgggaacatgtatctttataacgtggaacatacttgcggaactacagcaccgcattatcaactactgaaacaaggagagtcctttgccgtgcacacttgcaagagcaaaagcactcgcaaccctttgttaaaatggactgttggggagggagctctgaatgagtttgcgttttccccggacgggaagtttctggcctgtgtaagccaagacggattcttgcgagtgttcaacttcgacagtgtagagctgcacgggactatgaaatcttactttgggggtctgctctgcgtttgctggagtcccgatggaaaatacattgtcactggtggcgaggatgacctcgtgactgtatggagtttcgtggactgccgggttatcgcccgtggacacggccataaatcttgggtgtccgtggttgccttcgatccttacaccacttccgtagaagaaggcgatccaatggaattcagtggcagcgacgaggatttccaggatttgctgcattttggccgggacagggctaattctacacaatcacggctgtccaaacggaactccacagatagcaggcccgtgtccgtaacgtataggttcgggtctgtgggtcaggatacccagctttgcctttgggacctgacggaagacatcctattcccgcaccaacctttatcccgggcgcgcacgcacaccaacgttatgaatgccacgtccccaccggcaggatccaacgggaactctgtgaccacacctgggaacagcgtacctcctccattacccaggtccaattccctcccacattctgcagtcagcaacgcaggctccaaatcttccgtgatggacggcgcaattgcatcgggtgtttcaaagttcgcgactctgtctttacatgacaggaaagagcgtcatcacgaaaaagaccacaagcggaatcactcgatgggccacatcagtagcaagtccagtgataagcttaatttggtgaccaaaacaaaaactgaccccgctaagaccctcggaacaccactttgccctagaatggaagatgtacccctgctggagccactgatttgtaaaaaaattgcgcacgagcgactgaccgtcctaattttcctagaggactgtattgtcaccgcttgccaggagggcttcatctgcacgtggggcaggccaggcaaagttggatctcttagttctccctctcaagcatcttctcctggcggcaccgtagtgtag

SEQ ID NO: 52304 - DNA, 1338 bp, Artificial Sequence
  Description of Artificial Sequence: Synthetic coding sequence
atgtgggccggcagctgcaccagcatcagcacccggggcagcgcccgtcaatcccatgaacggttaattgacaagtctagggtaacctgcgtcaaatgggttcccgggtctgagtctctgttcctggtagctcactcttccggaaatatgtatctgtacaatgtggaacacacctgcggtacaacagcaccgcattatcagctgttgaagcagggagagtcatttgcagtccacacgtgtaaaagcaaatcaacccgtaacccactgctgaagtggacggtgggtgagggagcgctgaacgaattcgcttttagcccagatggtaaattcctcgcctgtgtctcacaggatggattccttcgggtgtttaacttcgatagcgttgagctgcacggtaccatgaagtcttacttcggaggcttgctgtgcgtgtgctggagcccagacggcaagtacatagtgactggcggggaagacgacttggtgaccgtgtggagcttcgtcgactgcagggtcattgcgaggggccatgggcacaaatcatgggtgagcgtcgtggcatttgacccatacacaactagtgtggaggagggggatccaatggaattttccggaagcgatgaggatttccaggacttattgcactttggtcgcgatcgagcgaactcaactcagtcccgtctttctaaacggaacagcactgatagcagaccggtgtccgtgacctatcgctttggcagtgtcggacaggatacacaattgtgtctgtgggatctcacagaagatattctgtttccccaccagccattatcacgcgcccgcacgcacaccaacgttatgaacgctacctccccacccgcagggtccaatggcaatagtgtcaccactcccggcaactccgtgccgccaccactccctaggagcaattcactcccacactcagcagtgtctaatgcaggctcgaagagcagcgtgatggacggggcaatcgcaagtggggtgtccaaatttgccacattgtcccttcatgataggaaggaacggcatcacgaaaaggaccataagcgcaaccattctatggggcatatttcctcaaaaagctctgacaaactaaatctcgtgaccaagaccaagacagaccctgccaaaacccttggcactcctctttgcccccgcatggaagatgttccgctgctagagcccctcatctgcaagaagatcgcacacgaacgcttaaccgtcctgatcttcctggaggattgtattgtcaccgcatgtcaggaggggttcatctgcacctggggtcgtcccggcaaggtggtgagcttcaacccatag

SEQ ID NO: 52305 - DNA, 1803 bp, Artificial Sequence
  Description of Artificial Sequence: Synthetic coding sequence
atggccaccgagggcggcggcaaggagatgaacgagatcaagacccagtttacgacgagggaggggctctacaaattgttgcctcacagtgaatactctcggccaaacagagtgccgttcaattcccaagggtcaaatcctgtgcgcgtctcattcgtcaacctgaacgatcagagtgggaacggggacaggctttgtttcaacgtgggacgtgagctctacttttacatttacaaaggggtgcggaaggcagcggacctcagcaaaccaatcgacaaacgcatttataagggcacccagccgacctgccatgattttaatcacctgacggctactgctgaatccgttagtttgctggttgggttttctgccggacaagtccagttgatcgatccgatcaagaaggaaacttctaagctctttaatgaagagaactcttgtcagcacctatggaaggtggactggaacgaggaacgtcagaacgaggggtccaaaacttccgaagaggcattagtgaccgttcagagactgatcgacaagagtcgggtgacctgcgtcaagtgggtcccaggaagcgaatccctctttcttgtcgctcacagcagcggcaatatgtatctgtacaacgtggaacatacttgcgggaccacagcccctcattatcagctgctgaaacaaggcgaatcttttgccgtccacacgtgcaaaagcaagtctaccaggaacccactgctgaagtggacagtgggagagggagcattgaacgagtttgcgttttcccccgatgggaaattcctggcctgcgtctcccaggacggattcctacgcgtgttcaactttgactcagtagagctccacggcacaatgaaaagttactttggtggactcctgtgcgtctgctggtctcccgatggcaaatatattgtcaccggcggggaagacgacctggttacagtttggagcttcgtggattgtcgcgtgattgcccgtggccacgggcataagtcttgggtgtccgtggtcgcttttgacccctatacgacgagcgtggaggagggcgatccgatggagttcagtgggtcagacgaggactttcaagacctgttacatttcggtcgcgaccgcgctaactccacacagtcgagactgagtaaacgcaactccacggatagcaggcccgtgagcgtcacctatcgcttcggatcagtgggacaggatacacaactgtgtctatgggatctcactgaggacatcctgtttccccatcagcccctgagccgggccaggacacataccaacgtgatgaacgccacatccccaccggctggttctaatggaaacagcgtgaccactcctggaaatagcgtgcccccaccccttccgaggagtaattcattaccacactctgctgtcagtaacgccggttctaagagctccgttatggatggagccatagcctctggagtttctaaatttgccactctctccttacatgaccgaaaagagcgccaccatgaaaaggaccataagaggaatcactccatgggacatatctccagtaaaagttctgacaagctcaacttagtgaccaagactaaaacagaccctgccaagactctgggcaccccgctctgtccacgaatggaagacgtgccactgttggagccactgatatgtaaaaaaattgcccacgaaagactgaccgtgctcatcttccttgaagattgcattgtcactgcttgccaggagggctttatttgtacttggggcaggcctggtaaggtggtatcatttaatccttag

SEQ ID NO: 52306 - DNA, 939 bp, Artificial Sequence
  Description of Artificial Sequence: Synthetic coding sequence
atgaagagctacttcggcggcctgctgtgcgtgtgctggagccccgatgggaaatatatcgtcacgggaggggaggatgacctggtcactgtgtggtcttttgtggactgtcgagtaatcgcccggggccacggccacaagtcatgggtgtctgtagtggcctttgatccctatactacctctgtcgaagaaggtgaccccatggaattctcagggagcgacgaggacttccaggatctgctgcactttggcagagacagggctaactccacccagagtcgcttatcgaagcggaattccaccgattcacgcccagtgtcggtcacttatcggtttggcagcgtagggcaggatacacagctttgtctgtgggacctgacagaagatatcctcttcccgcatcaacccctctctcgcgctagaacccacaccaatgtgatgaatgctacgtcccctcctgcaggctctaatggtaattccgttaccactcccggcaactctgtgccgccacctctgccacgcagtaactctttgccacattctgctgtttcaaatgctggatctaagagcagcgtgatggacggggcaattgctagcggagttagcaagttcgcgactctcagtctgcacgacagaaaagagcggcatcacgaaaaggaccacaagcgtaaccattccatggggcacatctcaagcaaaagttccgataaattgaacttagttactaagactaagacagacccagccaagaccctcgggacaccattgtgtccaagaatggaggatgtgccactgctggagcctttgatctgcaagaaaattgcccatgaaaggctcactgtgctgatctttctggaggattgtattgtaacggcctgtcaggaaggattcatctgtacgtggggcaggcctggaaaggtggtgagttttaacccatag

SEQ ID NO: 52307 - DNA, 1191 bp, Artificial Sequence
  Description of Artificial Sequence: Synthetic coding sequence
atgtacctgtacaacgtggagcacacctgcggcaccaccgccccccactatcagctgttaaaacagggggagtcttttgcagtccacacatgtaaaagtaagtcaactaggaacccccttctgaaatggaccgtcggtgagggggccttaaacgagttcgcttttagcccagatggcaagttcctggcttgtgtgagccaggatggatttctccgagtgtttaactttgacagtgtggaacttcacggaactatgaagtcctattttggtggcttactgtgcgtgtgttggagccctgatggaaagtatatcgtgactggcggagaagacgacttagtgacggtctggagcttcgtagactgtcgtgtgattgcgaggggacatgggcacaaatcatgggtatcagtggtggcgttcgatccatacactacatccgtggaggagggggaccccatggagttcagcgggtccgatgaagattttcaggatctgttgcactttggacgcgacagagccaattccacgcaaagtaggctgtcaaagagaaattcaaccgatagccgtcccgtgagcgtcacttatcgcttcgggtccgtgggtcaggatacacaactctgtctctgggacctcactgaagatatactcttccctcaccaaccactgtcacgcgcgagaacacacaccaatgtcatgaacgcgacctctccgcctgccggcagcaacgggaactctgtcaccacacctggcaactccgttccaccccccctgcctcgatctaactcgctccctcacagtgccgtctccaatgcaggttctaaatcgagcgtgatggatggggctattgccagcggcgtctctaaattcgccactctgtctcttcacgacaggaaggagcggcatcacgagaaggatcataagcgtaatcattcgatgggtcatatcagcagtaagagttccgataaactgaacctggtgacgaaaaccaagacggacccagctaagacattagggacaccattgtgcccacggatggaggacgttcccttgctggaaccactgatctgcaaaaagatcgctcatgaacggttaaccgtcctaatctttctcgaggattgcatcgtgacggcatgccaagaagggtttatttgcacgtgggggcgcccaggtaaagtggtgagctttaatccctag

SEQ ID NO: 52308 - DNA, 1527 bp, Artificial Sequence
  Description of Artificial Sequence: Synthetic coding sequence
atggccaccgagggcggcggcaaggagatgaacgagatcaagacccagttcactactcgcgaggggctctataaactgttaccacactctgagtactcccgtccaaatcgagtgccctttaactcccagggtagcaaccccgtgagagtctcattcgtcaaccttaacgatcagagcggaaatggggatcggttatgcttcaatgttggtagagaactgtacttctatatctataagggtgtgaggaaaagactgattgataaatctagggtgacatgtgtcaaatgggtcccaggcagtgagagtctttttttagtagcccactcctccggtaacatgtatctctataacgtggagcacacttgtggaaccacagctccccattatcagttgttaaagcagggggaatcatttgccgtgcatacatgcaagagcaaatctaccagaaatccgctgctcaaatggaccgttggggagggcgcattgaacgaatttgccttctctcccgacggcaaatttttggcctgcgtatcacaggacggctttctgagggtcttcaacttcgattccgtcgagctccatggaactatgaagtcttactttggtggtctcctgtgcgtttgttggtctcccgacggtaagtacatcgtcactggaggtgaggacgacctcgtgaccgtctggagctttgtagactgccgtgtgattgcaagaggacacggtcataagtcttgggtaagcgtggtggcttttgacccttacaccacttctgtcgaagagggggatcctatggaattctccggcagtgacgaggacttccaagatctgttgcatttcggtagggatcgagcaaactctacccagtcacggctgtcaaagcgaaattctaccgattcacgacctgttagtgtaacatacagattcggttccgtcgggcaggacacccagctttgtctttgggaccttacagaagatatcttattcccccatcagcccctgtcacgggcacggacccacactaacgtaatgaacgcgaccagcccccccgctggatctaacgggaactccgtaactactcctgggaactcggtgcctccccccctcccaagatcaaacagtttacctcactctgcggtctccaacgctggctcaaaaagcagtgtaatggatggagctattgcgtcgggagtgtctaaatttgctacattgtctctccacgatcgcaaggaacggcaccacgaaaaagaccataagagaaaccactctatgggccacatctccagcaagtcctccgataagttgaaccttgtgaccaaaacaaaaactgatcctgccaaaacgctcggaactcctctctgcccccgaatggaggacgtcccgctacttgagcccctgatctgcaagaagattgcgcatgaaaggctcacagtgttaatcttcctggaggactgtatcgtaaccgcatgtcaggagggttttatctgcacctgggggcgtccgggtaaggtcgtatcctttaacccatag

SEQ ID NO: 52309 - DNA, 588 bp, Artificial Sequence
  Description of Artificial Sequence: Synthetic coding sequence
atggccaccgagggcggcggcaaggagatgaacgagatcaagacccagtttaccacgcgggaaggcctctacaaattgctgccccactcggagtatagtaggcccaatcgggttccgttcaactcccagggctccaatcccgtgagggtgtcgttcgtcaatcttaatgatcagtctggtaacggggaccgtttgtgttttaacgttggacgtgagctgtatttttacatctacaagggtgtgaggaaagccgcggatttgtccaagcctatcgacaagcggatatataaggggactcaacctacctgccacgacttcaaccatctgacagcaacagctgaatccgtttccctcctggtgggcttctcagcagggcaggtgcagctgatagaccccattaagaaggagacctccaaattgttcaatgaggagaacagctgtcagcacctctggaaagtcgattggaacgaagaaagacaaaacgaaggtagcaaaacttcggaagaagccctggtgacagtgcagccagccgagcacttttgtcgccaggaggacagaatgcaaggcgtgctgcaagatcagaattag

SEQ ID NO: 52310 - DNA, 1563 bp, Artificial Sequence
  Description of Artificial Sequence: Synthetic coding sequence
atggccaccgagggcggcggcaaggagatgaacgagatcaagacccagttcactactcgcgaaggactgtacaagctgctgcctcactccgaatattcaagaccaaatagggtgccatttaacagtcaagggtccaacccggttagagtgagctttgtgaacctcaatgatcaaagcgggaacggtgaccgcttgtgcttcaacgttgggagagaactctatttctatatctataagggggtccgcaaaagactgatcgacaagtccagagtgacgtgtgtgaagtgggtgccgggttctgagtccctcttcctggtcgcacactccagtggcaacatgtacctctataatgtggagcacacctgcggaaccactgcccctcactatcagctgctgaaacagggtgagtcttttgccgttcacacatgcaagagcaagtccacacgaaatccactgctcaagtggactgtaggagagggagcactgaacgagttcgcgttttcccctgatggcaaattcctggcatgtgtctcgcaggatggattcctcagggtgtttaacttcgactctgtcgaacttcacggcacaatgaagagctactttgggggactgctgtgtgtgtgttggtcaccagatggcaaatacattgtgactggaggggaagatgacctggtcactgtgtggtccttcgtggattgtcgcgtaattgcgcgcggccacgggcacaagagctgggtgtctgtcgttgcctttgatccctatactacatctgtggaagagggcgaccccatggagttctctggtagcgacgaggacttccaagatttgctgcattttggtagagaccgagccaacagtacccagtctcgcctttctaagcggaatagtacggactcacgcccagtgtcagtgacctatagatttggctcagtcggccaggacacccagctatgcttgtgggacctcacagaggacattctgtttcctcaccaaccacttagccgggccaggacacataccaatgtaatgaacgcaacaagccccccagcaggtagtaacggcaactccgtgacaacacctgggaattccgtccccccaccccttccacgctccaatagtcttccccatagcgcagtgagcaatgcagggtcgaaaagctccgttatggacggtgccattgcttctggagttagtaaatttgccactctcagtctacatgacagaaaagaaagacatcatgaaaaggaccataagagaaatcactctatgggacacatctctagcaaatcgagtgacaaactgaatctcgtgacaaaaacgaaaacagatccagccaagaccctgggcacccctctgtgccctaggatggaagatgttcctctgctggagcccttaatttgcaagaaaatagctcatgagaggctgacagtgttaatctttttagaagattgtatcgtgacggcttgccaagagggcttcatttgcacctggggccgaccgggaaaggtcggatcactgtcatcacctagccaggcaagctcccctggagggactgtcgtatag

SEQ ID NO: 52311 - DNA, 2763 bp, Artificial Sequence
  Description of Artificial Sequence: Synthetic coding sequence
atgggcaagaagcggaccaccagcggcgagggccgggagcggcagagactcccagcgcgccggttccggactacctcaccagcagctctccgggccgacagcgttgatggcggaagcctgctagccccattgctcgggctcacagacagggctttctctgactgccccgacttggcggacggagcaatggaaaagatgtcgcgcgtaacaaccgccctgggaggtagcgttttgacaggaaggacgatgcactgtcaccttgatgctcccgcaaatgcgatctctgtgtgtagggatgccgctcaagtagtggtggccgggaggagcatcttcaagatttatgctattgaggaagaacaattcgtggagaaacttaacttgagagtgggcagaaaaccctctcttaacctctcctgcgctgatgtggtctggcaccagatggatgagaatctgctggctaccgcagctactaatggcgtagtcgtcacttggaacctgggccggccttcgcgaaataagcaagatcagctgttcacagagcacaagcgaaccgtgaacaaagtgtgtttccacccaacagaggcacatgtgctcctgagcggatcacaggacgggttcatgaagtgttttgacctccgccgaaaagacagtgtctccacgtttagtggagaggccaccgaggccggcccacgggaatgggcgatggccggatgtgttcctatcttacccgtgctgtcctgtagaatcctgcggttacatcattcgtttgcccacggcccgatgcaggacgccgagtcaacagcgaatgatgcgcgagagagctggggatgtcctctgtatccactcgggctgtgcagtggcccacaggctgggcagtcagaaagtgtacgggacgtgcaattctccataagggattatttcacattcgcctctaccttcgaaaacgggaacgtgcagctatgggatatccgcaggccggatagatgtgagcggatgttcacagcccacaacggaccagtgttttgttgtgactggcatccagaagacaggggatggctggccaccggagggagggataaaatggtgaaagtctgggatatgaccactcaccgcgccaaagaaatgcattgtgtgcagaccattgcatctgtcgcaagggtaaagtggaggccagagtgccggcaccacctggcaacatgctctatgatggtcgaccataatatttatgtatgggacgttagacggcctttcgtgccagccgccatgttcgaagaacatcgggatgtgacaaccgggatagcctggcgccacccacacgatcctagcttcttactttctggtagcaaagatagctccctgtgccagcatctttttagggacgcctctcagccggtggaacgggccaatcccgaaggactatgctacggacttttcggcgatctggcattcgctgccaaagaaagtctcgtggcggcagagtcaggaaggaagccttacaccggcgatcgccgtcatcctatcttctttaagaggaagctggaccccgccgagccttttgctggtcttgcctcttccgcgctgtccgtgtttgaaaccgaacctggaggtgggggaatgcgttggttcgtcgacaccgcagaacgatacgcgcttgccggaaggccactagctgaactttgcgaccacaacgcaaaagtggccagggaactgggcagaaatcaggttgcacagacatggacaatgctcagaataatatattgtagccctgggctagtgccaacagctaacttgaaccacagcgtggggaaaggcggcagttgcgggcttcccttaatgaattctttcaatcttaaagacatggcccccggccttggatcagagacacggttggaccggtcaaaaggtgacgcaaggtcagacacagtcctgctggactcatctgcaactctaatcaccaacgaagacaacgaggaaacggaagggagtgatgtgcctgctgattatctgctcggcgacgtcgaaggcgaggaagatgaattgtatctgctggacccagagcatgcacacccagaagatccggagtgcgtgctgcctcaggaggccttccccctccgacacgagatcgtggacacgccccccggccctgaacacttacaggacaaagctgactccccacacgtcagcggaagcgaggccgatgtggcgtcattagcccccgtggactcctccttttccctcctgtccgtgtctcatgctttgtatgattctcggctaccccccgacttctttggcgtgctggtgcgcgacatgcttcacttttacgcggagcagggagacgtgcagatggccgtaagtgtgcttatcgtcctcggcgagagagtgcgaaaagacatagatgagcaaactcaagagcattggtatacgtcctacattgaccttcttcaaaggttccgactatggaacgtctcaaacgaagtggtgaagctctcaacttctcgggctgtgagctgtctgaaccaagcctccaccacccttcacgtgaactgctcccactgcaagcgccccatgtcttcgcgcgggtgggtatgcgaccgctgtcacagatgcgcatcaatgtgtgccgtttgccatcacgtggtcaaggggcttttcgtgtggtgccaaggttgtagccacggcggtcacctgcagcacatcatgaagtggttggagggatctagccactgccccgcaggctgcggccatctgtgcgagtatagctag

SEQ ID NO: 52312 - DNA, 2373 bp, Artificial Sequence
  Description of Artificial Sequence: Synthetic coding sequence
atggagaagatgagccgggtgaccaccgccctgggcggcagcgtgttgacggggcggactatgcattgccacctggatgctcctgccaatgccatttccgtctgccgcgacgccgctcaagtggttgtggccggaaggtctatttttaagatctacgcaatcgaagaagagcaatttgtggagaagctgaacttgcgtgtcggcaggaagccttccctgaacctttcatgcgccgatgtcgtgtggcaccagatggatgaaaatctgctggctactgctgctacaaacggcgtcgtggtcacctggaacttgggtcggccctccaggaacaagcaggaccaactcttcaccgaacacaagaggacggtgaacaaggtttgtttccacccaactgaggcccacgtacttctgtctgggtcccaggacgggtttatgaagtgctttgatctgaggagaaaggattcggtgagcacgttttctggacaaagtgaaagcgtccgggacgtgcaatttagcattagggactatttcacatttgctagtaccttcgagaacggaaatgtgcagctgtgggatattaggcgacccgatcgctgcgagagaatgtttacggcacacaacgggccagtcttttgctgtgactggcatcccgaagatcgtggatggctcgccacaggcggtcgggataagatggtgaaagtgtgggacatgactactcatcgagcaaaggagatgcattgtgtccagaccatcgcgtcagtcgcgcgtgtgaagtggcgcccggaatgccgccatcatttagcgacttgtagtatgatggtagaccacaacatctatgtatgggacgttcgccgaccgttcgttcccgccgccatgtttgaggagcatcgtgatgtgacaaccggcatcgcttggcgacacccccacgacccctcctttctgctctccgggtctaaagactcttcgctgtgccaacatttgttccgagacgcatcacagccagtggaacgggctaaccctgagggactttgttacggattattcggcgatctcgcctttgcagcgaaggagtcactggtggctgccgaatctggtcggaaaccgtacacaggcgataggagacatccgatcttcttcaagcggaagctagacccagccgagccatttgccgggctagctagttcagcactttctgtgtttgagacagagcctggtggggggggcatgcgttggtttgtggacacagctgagcgctacgctctcgcaggtcgtccactggcagaactctgtgatcataacgcgaaagtagctagagaattagggcgtaaccaggtagctcaaacttggacaatgctaaggatcatttactgtagtcccggcctcgtgcccaccgccaatctaaatcatagcgttggcaaaggcgggagctgcggcctgccactgatgaacagtttcaatctcaaagatatggcgcctggactggggagcgaaacacggctcgacaggtccaagggcgacgcacggtctgacacagtactgctcgattcaagcgcgactttgatcactaatgaggacaacgaggagacggagggctcagacgtccccgctgactacctcttgggagatgtggagggggaggaagacgagctgtacttgctggacccagaacacgcccatcccgaggacccagagtgtgttctgccccaggaagctttcccattgcggcacgagatagtcgacacccccccaggacccgagcatctgcaggataaagcagacagcccccacgtctcagggtctgaggcagacgtggcaagtttggcaccagtggatagtagcttttctctcctgtccgtcagccatgctctgtatgattcaagactcccccctgacttcttcggcgtcctcgtgagggacatgctgcatttttacgctgagcagggagacgtgcaaatggcggtctcagtcctgatcgtccttggggaaagagtgcggaaggacatcgacgagcaaactcaagaacattggtacacaagctacatagacctcttacagagatttcgattgtggaacgtctccaacgaagttgttaaactgtcgaccagtagagctgtgtcttgcctgaatcaggctagtaccacgttgcacgtcaactgctcacattgcaagcggcctatgtcttcacgcgggtgggtttgtgatagatgccacagatgtgcgtctatgtgtgccgtttgccaccacgttgtcaaggggttattcgtttggtgtcagggctgcagtcatggcggacacctgcagcatatcatgaagtggctggaagggtcgtcccactgccccgcagggtgcggccatctgtgcgaatactcttag

SEQ ID NO: 52313 - DNA, 1635 bp, Artificial Sequence
  Description of Artificial Sequence: Synthetic coding sequence
atgaccgcccggaccctgagcctgatggccagcctggtggcctacgacgattcagattcagaggcagagacggagcacgcagggagctttaacgccactggccagcagaaggatacttcaggtgtcgcacgcccacccggccaggacttcgcttccgggacacttgatgtacccaaagcgggggcacagcctactaagcatggttcctgtgaagatcccgggggctacaggttgcccttggcacagcttggaaggtccgactgggggagctgcccttctcagagactgcagtggcccggtaaggagccacaagtgacattccccattaaagagccatcatgcagcagcctatggacttcccacgtccctgccagccacatgccattggcagcagccagatttaaacaggtcaagttatcgcgcaatttcccaaagtcaagcttccacgcccagagtgagtcagagacagttgggaaaaacgggtcctcatttcaaaaaaaaaagtgtgaggattgcgtggtcccttacaccccccgcagattacgccagaggcaggccctgtccaccgagacgggaaaagggaaagacgtggagccccagggacccccggcaggcagagctccagcacccctgtacgtcggtcctggggtctcagagtttatacagccttatctgaactcccattacaaggaaacgacagtgccaagaaaggtccttttccatctacggggacaccggggaccggttaataccattcagtggtgtccggtgttgtccaagagccatatgctactgtctactagtatggataaaacttttaaagtctggaacgctgtggactcaggccactgtctgcaaacatattctctgcacactgaggccgtacgcgccgcaagatgggctccttgtggcagaagaatcctctctggcggctttgatttcgccctgcatcttacagacctggagacaggcacgcaattattctccggtagatcagactttagaatcacgacgctgaaatttcatcctaaggatcacaatatcttcctatgtggcggcttctcgtcagagatgaaggcgtgggacatcagaactgggaaagttatgcgatcctataaggctaccatccagcagactttagacatccttttccttagggaagggagcgagtttttgagctcgaccgatgcgtctacacgggactctgcggaccggacaatcattgcctgggacttcaggacctcagccaagattagcaatcagatttttcatgagcgcttcacgtgccccagcttggccctacacccccgcgagccagttttcctggctcagacaaatggcaactatttggccctgttcagcaccgtatggccttacagaatgagccgacgcaggcggtatgagggacacaaagtcgaaggatattccgtcgggtgtgaatgttctccggggggcgatctccttgtgaccggaagtgccgacggtagggttctgatgtacagcttcaggaccgcctcccgggcctgtaccttgcagggtcacacacaggcgtgtgttggcaccacttatcatcccgtcctgccgtcagttcttgcgacctgttcttgggggggagacatgaagatttggcactag

SEQ ID NO: 52314 - DNA, 1635 bp, Artificial Sequence
  Description of Artificial Sequence: Synthetic coding sequence
atgaccgcccggaccctgagcctgatggccagcctggtggcctacgacgattcagacagcgaagccgaaacggaacatgctggtagtttcaacgcaacgggacagcagaaagatacttcgggcgtggcacgcccaccagggcaggattttgctagcggcaccctggacgtccccaaggctggggcccagccaactaaacacgggtcatgtgaggaccctggaggatatcggctgcccctggcccagcttggacggagcgattgggggtcttgccccagccagcggttgcagtggcctggtaaagagccgcaagtgacattccccatcaaggagccatcctgctccagcctctggacatcacatgtccccgccagccatatgccactggctgcagcccgctttaagcaggtgaaattatctcgcaattttccaaagagttccttccacgcacagagtgagtcagagaccgtcgggaaaaacgggtctagttttcagaagaagaagtgtgaggattgcgtagtcccctacacccccagaagactgcgccagcgccaggctctatctaccgagaccggaaaaggaaaggatgttgaaccccaggggccacctgctggcagggcccctgccccactgtacgtcgggcctggcgtttctgagtttatccaaccctatctgaattctcattacaaagagacgaccgtgcccaggaaggtgctcttccaccttcgcgggcacagaggccccgtgaatacgatccagtggtgcccggtcttgtccaaatcacatatgctgctgagcacctcaatggataagactttcaaagtgtggaacgcagtggacagtggacactgtctgcagacatattcactgcacacagaggccgtgagggctgcaaggtgggccccctgtggccggaggatcctctctggcggatttgattttgccctccacctgactgacttggagaccggcacccagttattctccggccggagcgactttagaatcacgactctgaagtttcatccaaaggatcataacatctttctgtgcgggggcttctccagcgagatgaaggcctgggatatccgcaccgggaaagtgatgcggtcatacaaagccaccatccagcaaactctcgatatactgtttctgcgggaggggtccgagtttcttagcagcaccgatgcttctacgcgggatagcgccgatcgcactattatcgcgtgggactttcgaacctctgcaaagataagtaaccagattttccacgaacggttcacatgcccttctctggccctgcatcctcgcgaaccggtgttcctagcacaaacaaatgggaactatctcgcccttttttcgacggtgtggccatacaggatgtctcgcagacgccggtacgagggtcataaggttgaaggatacagcgtcgggtgtgagtgtagcccgggtggtgacctgttagtcacaggttctgcagacggccgggtcctgatgtattctttccgtactgcctcccgggcttgtacattgcagggacacactcaggcatgcgttggcaccacctatcaccctgtgttacctagtgtacttgccacctgctcttggggcggcgacatgaagatttggcattag

SEQ ID NO: 52315 - DNA, 864 bp, Artificial Sequence
  Description of Artificial Sequence: Synthetic coding sequence
atgcccgccctgtgcctggtgctgtgctggttccagggcctgctgggggaagtttggaacgcggtcgactctggacactgccttcagacatatagtctgcacaccgaggccgtaagagcggctcgctgggcgccttgtggccgcaggatcctctctgggggtttcgattttgccttgcacctgaccgacctggagaccggaacccagttgttctcaggcagaagtgacttccgaatcaccaccctgaagttccacccaaaagaccacaatatatttctgtgtggcggattcagctccgagatgaaagcatgggatattcggaccggcaaggtgatgcgatcctacaaagcgacaatccagcagacccttgatatattgtttctccgggaagggtccgaatttttgtccagcacagacgccagtaccagagacagcgccgatcggaccattatcgcatgggactttcggacctcagctaaaatttcaaaccagatttttcacgaacgtttcacatgccctagcctggcattacaccctcgcgaacccgtctttctggcacaaacaaatgggaactatctggccctgtttagcaccgtgtggccctatcgaatgtctcggcgccggcggtacgaaggtcataaggtggaagggtatagtgtggggtgcgagtgcagcccaggaggagacctcctggtgacgggaagtgctgacggaagagtcctgatgtatagcttccgaaccgcctcacgtgcctgcacactgcaggggcatacccaggcctgcgttggaactacataccacccagtgttacccagcgtcctggctacatgctcatggggtggggacatgaaaatctggcactag

SEQ ID NO: 52316 - DNA, 1635 bp, Artificial Sequence
  Description of Artificial Sequence: Synthetic coding sequence
atgaccgcccggaccctgagcctgatggccagcctggtggcctacgacgatagtgattcagaggcagagacagagcacgctggttctttcaacgccaccggccagcagaaggacaccagtggcgtggcaaggccgccaggacaggattttgcctctgggacactggatgtgcctaaggcgggagcgcagcccacgaagcacggttcttgtgaagatcctgggggctatcgattgcctctggcacagctcggcagatctgattggggtagctgcccctcgcaacggttgcagtggcccggtaaggagccccaggttaccttccccattaaggagccttcctgcagctccctgtggacatctcatgtgccagccagccacatgccccttgccgcggcccgtttcaaacaggtaaaattgtcaaggaatttccctaagagctcttttcacgcccagtccgaatcagaaacagttgggaaaaacggatcatcttttcagaagaagaagtgcgaggactgtgttgtcccgtatacgccccggcgactccgtcagcgccaagctctcagtacagagacaggtaaggggaaggatgtggagccacagggacctcccgccggtagggcgccagcccccctgtacgtgggcccaggtgtatcagaatttatccaaccatatctgaacagccactataaggaaactaccgtcccaagaaaagtgctcttccacttgagagggcaccgaggaccagtgaacacaatccagtggtgtcctgtgttgtcgaaatcgcacatgcttctgtccacctctatggataagaccttcaaggtgtggaacgccgttgacagcggccattgtctgcagacatacagcctgcacaccgaagccgtgcgagccgctcgctgggcgccctgcggaaggcgcatcctttccggagggttcgatttcgccttgcatctgaccgacctggagaccggaactcaactgttttctgggagatccgatttccgcataaccaccctcaaattccatccaaaggatcacaacatcttcctctgcggggggttctccagtgagatgaaagcttgggatattaggactgggaaagtgatgaggtcttacaaggccaccatccagcaaaccttggacattctcttcctccgggagggttcggagtttctttcttctactgacgctagcacgcgagatagcgccgatagaaccataatcgcctgggacttccgaacgtccgctaaaatttccaaccagatattccatgagcggttcacctgtccctccctggccctgcatcctcgcgagccggtcttcctggcacagacaaatgggaactacctagcactgttctcaactgtgtggccttacagaatgtccagaagacgaagatacgagggccataaggtggaaggatactctgtgggctgcgaatgttccccaggcggcgacctgcttgtgaccgggtccgctgatggccgtgtcttgatgtactcctttaggacagcctcgcgggcctgtaccctgcagggacacacacaggcttgcgtgggaaccacttaccatccagtgctccctagcgtgttagccacttgtagctgggggggagacatgaagatctggcactag

SEQ ID NO: 52317 - DNA, 2574 bp, Artificial Sequence
  Description of Artificial Sequence: Synthetic coding sequence
atggagaacccccaggacatcttcagcagcaacggcggctgcctgtctgacatcgttattgaaaagtacctggtcgaatccaaagaatccgtgtctcatgttcagttggcctgtagtatgcaggactgtgcgttcccgctcgatggtacagaactgtgcatttggaatactaaagaccccagccatcagcttctaatactgagaggacaccatcaaccaatcacggccatggccttcggcaataaagtgaaccccctgctgatctgttcagcctcgctcgattacgttatcatgtggaatctagatgagtgtcgcgaaaaggtcctgcagggcctggtccccagaggtaccgtcatgggatcacttcttggcaaggttctttgtttgcagttgtctctggacgatcacgtagtggcagtctgcgcaggaaataagatctttatgctcgacattgagcagaggttcagtgtgacatatatcgaaagaccagacgtaaataaccgacacaaagtcccacctccgaccttcctgcacacattctctcagacccaagctgtgagggccgaattgcagggacatcttggcccagtgacagctgtcgaattttgcccttggagagctggcacattgatttccgccagtgaagacagggggtttaaagtctgggatcattgtactggctccctgatctactcctcatcagtgctatctgcctatccactgctgtccctttttatcgacgccgagtcccgccagctggtaacggggtgtgccgacggccagctttggatttttagtctcatggacggccaccattatagaagagtcgcaagagttgatcttcggaagaaaactgaaacctttagtacgaggagagtgaagtcaggcctctgtagtcagcctgaggagagccagctgccatctacctccgccctaggcaagggggaacaggttgaagtgaccttccctgtgcttaggctagccccctgtgacctcagcctaatccccaatagcgcatgcggctgtttaagctccgaaaacacgcgatgcgtgtggattggatcctctgttgggctttttgtgtttaatctcgcaaatctcgaagtggaagcagcactctactacaaggatttccagagcctaagtattctgttggcaggaagctgtgccctccgcaaccgtacagcagatcagaaagtcctgtgcttgctagcctcactatttggtggcaagattgctgtcttggagataaaccctgccgcgttggtcagagcccagcaatgtcccagcatggggcagtctctttctgtgcccgcctcctcttgtgtgctgccaacctcgcctctgtatcttgggattgcaaaggaaaaaagtacaaaagctgccagcgagcaacgtcgggccgctcggaatgtgatgaaggaccagaggctcgtttttcactccaaggtaaggtcgtccgggtacgcctcagctcctcacgtcacaatgttctcacctaagacaaacatcaagagcgagggaaaggggtccagcagaagccgcagctcatgtgccagagaagcctaccctgtggaatgcgcagtccccacaaagccagggcctcaggtcgcggccgcaccaacatgcactagggtttgctgcattcagtacagtggggacggacaatggttggcctgcggactggcgaatcacctactgttagtatttgacgccagtttgacgggcacccccgccgtcttctctgggcacgacggagcagtgaatgctgtctgctggtcccaggatcggcggtggctcctgtctgctgcccgggatggaaccctccgaatgtggtcagccaggggagccgaactggcattgctgctcggcaaggacatgttctccaaacctatccaaagcgcccagttctattacattgacgccttcatcctgctctcctctggccccgaattccaattgctgagatatcacattgacacctgcaaggatgagattaagaggtacaagcagaagagtaagtccaaattaatttgtcgcctgagcaccacgggagctgttgatatgacttccctttcagctgtgaatgatttctacagtcatatcgtgctagccgccggacggaacaggacagttgaagtatttgacctgaatgccgggtgcagtgccgcagttatagctgaagctcattctcgtcccgtccatcaaatctgccagaacaagggatcttcctttacaacacaacaaccccaggcctataatttgttcctgactaccgcaatcggggacgggatgcggctctgggacctacgtactctgcgttgcgaaaggcactttgagggacaccccaccaggggctacccgtgcggcatcgctttctctccctgcgggagatttgccgcctgcggggctgaggacagacacgcttacgtgtatgagatgggatcatcaactttctcacacagactcgcaggacacacagataccgtgaccggtgtggcatttaacccgagcgccccacaactcgcaaccgcgacactggatggcaagctgcaactgttcttagcagaatag

SEQ ID NO: 52318 - DNA, 546 bp, Artificial Sequence
  Description of Artificial Sequence: Synthetic coding sequence
atggagaacccccaggacatcttcagcagcaacggcggctgcctgagtgatatcgtgatcgagaagtacctggtggagagcaaggagtctgtatctcacgtccagctggcctgcagtatgcaggactgtgcatttccactggatggcacagagttgtgtatctggaatactaaagatccaagccaccagctcctaattctgcgaggccaccatcagccgatcacagccatggctttcggtaacaaggtgaacccattactgatctgctccgccagccttgactatgtgataatgtggaacctggatgagtgcagggaaaaggtgcttcaaggcctagtgcctcgtgggaccgtgatgggctcactgctcggcaaagtgctttgccttcaactatcccttgacgatcatgtggtggccgtatgcgccggaaataaaatctttatgttagacatcgaacatatcctgttcagtgtatactcactgatgcaaaaggccggaagctggtcacccggggtgttgactgcctcatttggttcaagtgtctag

SEQ ID NO: 52319 - DNA, 2193 bp, Artificial Sequence
  Description of Artificial Sequence: Synthetic coding sequence
atggagaacccccaggacatcttcagcagcaacggcggctgcctgtccgacattgtgatcgagaaatacctcgtggagtcaaaggagagcgtaagtcatgtgcagctggcttgcagtatgcaggactgcgccttccccctcgatggtaccgagctgtgcatttggaacactaaggacccttcccatcagcttctcattctcagaggacaccatcagccaattaccgccatggccttcggcaataaagtgaacccactactgatttgtagtgcctccctggactacgtcatcatgtggaatctggatgagtgtagggagaaagtgttgcaggcctatcccctcctcagtttgtttattgatgcagagtctagacagctggtaactggctgtgctgacggccagctttggattttctcgctgatggacggacaccactaccgtcgcgtagcgcgtgtggatctccgtaagaagactgaaacgttttccactagaagagtgaagagcggcctatgttctcagccagaagaatcccaactgccttcgacttctgctttagggaaaggtgaacaagtcgaagtaaccttcccagttctcagacttgccccctgtgatttatctctgattcccaattcagcctgtggctgcctgtctagcgagaacaccagatgtgtatggattggctcctctgttggtttatttgtgttcaatctggcaaacctagaggtcgaggctgctctctactacaaggacttccagagtctgtccatcctcttggccggaagctgtgccctgcggaatcgcacagcagatcagaaggtcctatgtctgctagcttctctcttcggaggaaagatcgccgtgctggaaataaatccagccgctttggtgagagcccagcagtgccccagcatgggtcagtctctgagcgttcccgccagtagctgcgtgctccccacctccccactgtacctgggcattgctaaggaaaagtccacaaaagccgcttccgaacagagacgcgcagctcggaatgttatgaaagatcagaggctggttttccactcaaaagtgcgcagttccggctacgcaagtgctccacacgtaacgatgttcagtcccaaaacaaacattaagtctgagggcaaggggagctccagaagccgctccagctgcgcgcgcgaagcctatccagtagaatgcgctgtgcccactaaacccggaccccaggtcgcggccgcaccaacatgcacaagagtatgttgcatacaatattcaggagatgggcagtggctggcatgcggattagccaaccatctcctgctagttttcgatgcaagcctcacgggcacaccagctgtattctctggtcacgacggagccgtgaatgccgtgtgttggagccaggatcgcaggtggctgttgagcgctgccagggacgggactctgagaatgtggtccgctcgcggagccgaactggcactacttcttggcaaggacatgttctcaaagccaattcagtcagcccagttttactacattgacgcatttattctgctctcatccggaccagaattccagctgcttaggtaccacatagacacttgtaaagacgagataaagagatacaagcaaaaatcaaaatcaaaactcatttgtcgcctgtccaccacaggcgccgtcgatatgacgtcattgagcgccgtgaacgacttttattcacacattgtgcttgcagccggacgtaataggacagtggaggtatttgacctgaacgcaggatgtagtgctgcggtgattgccgaggcacacagccgcccagtccatcagatctgccagaataagggcagtagtttcacaacacagcaaccccaggcctataacctattcctaactacagcaattggggacggtatgcgtttgtgggatctccgtaccctgagatgtgaaagacatttcgaaggacatcccacacgggggtacccgtgcggcatcgcattctccccctgtggacgtttcgccgcctgcggtgcagaggacagacatgcctatgtgtacgagatgggcagctcaacattttctcatcggctggctgggcacactgacactgtgacaggcgttgcatttaacccttctgctccccagctggccacagccaccctggatggaaaactccagttgtttcttgctgagtag

SEQ ID NO: 52320 - DNA, 2688 bp, Artificial Sequence
  Description of Artificial Sequence: Synthetic coding sequence
atggagaacccccaggacatcttcagcagcaacggcggctgcctgtctgatatcgtgatcgaaaagtatcttgtggagtccaaagagtccgtgtctcacgttcaactcgcgtgttccatgcaggactgtgcgtttcctctggacgggaccgagctgtgcatctggaacacaaaggacccctcccaccaactgctcattctgcgcgggcatcaccagcccattaccgccatggccttcggaaacaaggtgaaccctctactcatatgtagcgccagcttagactatgttatcatgtggaacctggatgagtgccgggaaaaggtccttcaagggttggttcctagaggcaccgtcatggggtctttgctcggcaaggtactatgtctgcagctctcattagacgaccatgtggttgcggtgtgcgcgggcaataagattttcatgttggacatagagcagcgcttctccgtgacctacatagagcgcccagacgtgaacaacagacacaaggtaccgccccccactttcctccatacattctcccagacacaggctgtgcgggctgaactgcaaggccacctggggccagtgactgcagtcgaattctgcccatggagagcgggaactctcatttccgctagcgaggacagaggcttcaaggtctgggatcattgcactggctcactcatatattcttcatctgttctcagcgcttaccctctgttaagcctttttatcgacgctgagtcacgacagctcgtgaccggatgcgcggacggacaactgtggattttctcactcatggacggacaccactaccggcgagttgcacgggtggacctgaggaagaaaacagaaaccttctccactcggagagtgaaatccggcctgtgttctcagcctgaagaatcgcagctgccttctacatcagccctaggcaagggcgagcaagtagaagttacctttccagtactcagactggccccatgcgaccttagcctgataccgaactctgcatgtgggtgtctgtcgtccgaaaatacaagatgtgtgtggatcgggagttcggtcggtctctttgtgttcaacctggccaatcttgaagttgaggccgctctctactacaaggacttccagagtctctccatcttgctcgcgggctcttgtgccctcaggaacagaacggcagatcagaaggtcttgtgcctgctggcaagcctgttcggcgggaagatagccgttttggaaattaatccagccgcattggtgagggctcagcagtgccccagcatgggacagtccttgtctgtgccagcaagctcttgcgtgctgcctacctctcctctgtacctcggtatagcaaaggaaaagtccaccaaagctgcctcggagcaaaggagggctgcaagaaatgtgatgaaggaccaacgactggttttccacagtaaagttcgtagtagcggatacgcttccgctccccatgtgacaatgttttctcctaaaacgaatatcaagtccgaaggaaaagggagcagccgctcacgctcttcttgtgccagggaggcctaccctgtggaatgcgctgtgcccactaaacctgggccacaagttgcagcggcccctacctgtacaagggtttgctgcatacagtacagtggcgatggccagtggctcgcgtgcgggctggccaaccatctgctgctggtgtttgatgcatcactgaccggcaccccagctgttttctctgggcacgatggcgcagttaatgctgtgtgctggtcccaggatcgaaggtggctactgtctgctgcccgagacggcaccctgcgcatgtggtcagcgagaggtgccgagctggccctgctgttggggaaggacatgttctcaaagccaatacagtcagctcagttctattacattgatgcattcatcttgttgagttctggccccgaatttcaactccttcggtaccatatcgatacctgcaaggacgaaatcaaaaggtataagcagaaaagcaagagcaaactaatctgcagattgagcacaacaggtgccgtagatatgacctctctctccgcagtgaatgatttctatagccacatcgttctcgcagccggccgaaatcggactgtcgaagttttcgatctgaacgccggatgcagcgcggccgtgattgcggaggcacatagccggcctgtgcatcagatttgccaaaacaagggctcaagtttcacgactcagcagccacaggcttacaacttgtttcttactactgccataggcgacggtatgcggctatgggacctgcggaccctgcggtgtgaacgacattttgaaggacatccaactagaggttatccgtgcggtatcgcattcagtccatgtgggcgctttgctgcttgtggggctgaggataggcatgcctacgtttatgagatgggctccagcactttctctcataggctagccggccacacagatacagtgacaggtgttgcattcaatcctagcgccccccaaatggagagtcggtcagtggcgcatgctggagtgcagtggcatgacttgggctcactccagccccccccatcaagattcaagcaatttttctgtttaagcctcccttcatcctgggactactcacttccccaactgccatggatggtcaatagctcttcattttag

SEQ ID NO: 52321 - DNA, 267 bp, Artificial Sequence
  Description of Artificial Sequence: Synthetic coding sequence
atggagaacccccaggacatcttcagcagcaacggcggctgcctgtctgatattgtaatcgaaaagtacctcgtggaatcaaaggaatcagtttcccacgtccaactggcgtgctcaatgcaggattgcgcgttccccctggatggaaccgaactgtgtatctggaacaccaaagatccctctcaccagctcttgattctgcggggtcatcaccagcccattacagccatggcgttcggcaacaaggtgaacccactgctgatatag

SEQ ID NO: 52322 - DNA, 1101 bp, Artificial Sequence
  Description of Artificial Sequence: Synthetic coding sequence
atgctgctgctgcggtgccagctgaagcaggcccccccccagaaggtgtcctttcgcttttgtgtagtcatgggcaagcagcaaagcaaattgaaacactctacttacaaatatggacccgatgaaatcatcgaagagcgaattcagacaaaagcattccaggaatatagtcccgcccacatggatacagtctcggtagtggcagcgctcaatagtgatttatgtgtgtctgggggaaaggacaagactgttgtggcttacaactggaaaactggaaatgttgttaagagattcaaaggacatgagcacgagatcaccaaggtggcctgtatccccaagtccagccagtttttctccgccagccgggatcggatggttatgatgtgggatctacatgggtccagccagccaagacaacagctctgcggccacgcgatggtggtcacaggtctggcagtgtctcctgattctagtcagctatgtacgggatcacgtgacaatactttactcctctgggacgtggtcacaggacagagcgttgagcgtgcttccgtctcccggaatgtcgtcactcacctgtgctgggtcccacgggaaccatatattctccagacctctgaagacaagacgctgcggctgtgggattctcgggggctccaggttgctcatatgttccctgctaagcagcacatccagacatactgcgaagtatcagtcgatggccacaaatgcataagttgttctaacggctttggcggggagggttgcgaggccacactgtgggacttaagacagacaaggaatagaatttgcgagtacaaaggacattttcaaaccgtggcttcttgcgttttcttaccacgggctttggcactgatgccactgatagccacaagtagtcacgattgtaaggtgaaaatctggaatcaggatacaggtgcatgtctttttactctgagcttagacgggagcggccctctgaccagtctggcggttggagacgcgatttctttgctgtgtgccagttttaacaggggaatacacctgctgcgaatggatcactcacagggactggaactgcaagaagtggctgctttctag

SEQ ID NO: 52323 - DNA, 1104 bp, Artificial Sequence
  Description of Artificial Sequence: Synthetic coding sequence
atgctgctgctgcggtgccagctgaagcaggcccccccccagaaggtcagctttcgtttttgcgtggtaatgggaaagcagcagtctaagctgaagcacagcacatacaagtacggccggcccgacgagataatcgaagaaagaatccagaccaaggctttccaggagtattctccggctcatatggacacggtaagcgtggtggctgccctcaacagcgacctgtgtgtctccggcggtaaggataagactgtggtggcctataactggaaaaccggaaatgtagtgaagagatttaagggacacgagcacgagataaccaaggtggcctgcattccgaaatcttcacagtttttctcggcctcccgggacagaatggtgatgatgtgggacctccacgggagcagccagcccagacagcagctttgcggacacgcaatggtggtgacaggacttgctgtctccccagatagctctcagctttgcacagggtctcgcgataatactctcctgctctgggatgttgtaactggacagtctgtggaacgcgctagtgtatccagaaacgttgtcacccacctctgttgggttccacgcgaaccctatattcttcagacctcggaggacaagacgcttaggctctgggacagtagggggctacaagtggcccacatgttccctgcgaaacagcacattcaaacatactgcgaggtgtccgtggatggtcacaagtgcatttcttgtagcaacggattcggtggtgagggatgcgaagccacactttgggatctgagacaaacccgcaatagaatttgtgaatataaaggacacttccagacagtcgctagttgcgtctttctgccacgagctctcgctctgatgccccttattgccacctcatctcatgattgtaaggtcaagatttggaaccaggataccggagcctgcctattcaccctgtcacttgatgggagtgggcccctgacctctctggcagtgggtgatgccatttctttgctttgcgcctctttcaacaggggaatacacctgctaaggatggaccattctcagggcctggagttgcaggaggttgcagccttttag

SEQ ID NO: 52324 - DNA, 729 bp, Artificial Sequence
  Description of Artificial Sequence: Synthetic coding sequence
atggtgatgatgtgggacctgcacggcagcagccagccccggcagcagttatgtggacacgccatggtagttacaggacttgcagtttcccccgactcaagccagctgtgtactggaagtcgcgacaacacactgctcttgtgggacgtggtgaccggacagagcgttgaaagggcttcagtgtctagaaatgtcgtgacacacctgtgttgggtgcctagagagccctacatcctacagaccagcgaggacaaaactctgaggctgtgggatagccgcggtctccaggtggcccacatgttccctgctaagcagcacattcagacatactgtgaagtctcagttgatggccataagtgcatctcttgtagcaacggctttggtggagaggggtgtgaggcgaccctatgggatctgcggcagaccagaaatcgaatttgcgaatacaaagggcacttccagactgtggcgtcgtgtgtgttcctccccagagctctggcattgatgcctttgatcgccacctcatcccacgactgtaaggtaaaaatttggaaccaggacaccggagcatgcttgtttacattatccctggatgggagcggcccacttacatctctggccgtgggagacgcaatcagcttgctctgcgcgagttttaaccgaggcattcatttgctgagaatggatcacagccaaggccttgagttgcaggaagtagcggccttttag

SEQ ID NO: 52325 - DNA, 4011 bp, Artificial Sequence
  Description of Artificial Sequence: Synthetic coding sequence
atggccaccgagatcggcagccccccccggttcttccacatgcccaggtttcagcaccaggccccaagacagctgttttataagcggccggattttgcccagcagcaggccatgcagcagctcacatttgatggtaaacgcatgaggaaagctgtgaatcgcaagaccatcgattacaatccatcagtcattaagtaccttgaaaacaggatatggcagcgcgatcagcgagacatgcgtgcaatccagcctgatgctggctactataacgacctggtgccacccataggcatgctgaacaacccaatgaacgcagtgaccactaagttcgtcagaacctccaccaataaggtaaaatgtcctgtgtttgtggtgagatggacccccgaaggacggagactggtgacgggagcgtcttccggcgagttcaccctgtggaacggactgacatttaattttgagaccattctgcaggcccacgactctcctgtgcgcgccatgacttggtctcacaatgacatgtggatgctaactgcagatcatggcggctacgttaagtactggcagagcaacatgaataacgtgaaaatgttccaggcccataaagaggctatacgtgaagcgtccttctcacccacagacaacaagtttgccacgtgcagtgatgacggtaccgttagaatctgggacttccttcgatgtcatgaggagcgcatattgcggggtcatggcgccgatgtcaagtgcgtggactggcacccaactaaaggcctggtggtatctgggagcaaggactcccaacagcctataaagttctgggatcctaaaaccggacagtccctcgctacactgcatgcacacaaaaatactgtgatggaggtcaaactgaacttgaatggaaattggctgttgaccgcatctcgcgaccatttgtgcaaactgttcgacattcggaacctcaaggaagaactccaggttttccgcgggcacaagaaggaggccaccgccgttgcctggcatccagtccacgaaggacttttcgccagcggcggcagcgatggctctctcctgttctggcacgtgggtgtggaaaaggaagtgggaggtatggagatggcccatgaggggatgatctggagtctggcctggcatcctctggggcacatactctgctctggctctaacgatcatacttccaaattttggaccaggaatcgccctggagataaaatgcgggacagatacaacctaaatcttctgcccggaatgtccgaggatggcgttgagtacgacgacctggaacccaatagccttgcagtgattccaggcatgggcatcccagaacagctcaaactggccatggagcaggagcagatgggtaaggatgaatctaacgagatcgaaatgaccattcctggccttgattggggaatggaggaggtgatgcagaaggatcagaaaaaagtgccacagaagaaggtcccttatgccaaaccgatcccagcccaattccaacaggcctggatgcagaataaggtgcctattcccgcccccaacgaagtcctcaacgatcggaaggaggacatcaagctggaggaaaagaagaaaacccaggctgaaattgagcaggaaatggcgactctgcagtatactaatccacagctgttggagcagctgaaaatagagcgcctagctcagaaacaagtcgaacagattcagcctcccccatcttctgggacccccctgttgggtcctcagccctttcctgggcagggtccaatgagccagatcccacaaggttttcagcagcctcacccaagtcaacagatgccaatgaacatggctcagatgggacccccgggcccccagggtcagtttcgcccccccggcccacaaggacaaatgggccctcagggcccccccctgcaccaagggggaggggggccacagggtttcatgggcccccaagggccacagggacctccccagggccttcctagaccccaggacatgcacgggccacaggggatgcaaagacatcctgggccgcacggaccccttggcccacagggacctccgggcccccagggcagtagcggcccacagggccatatgggcccccaggggcctcctgggccccaaggacatatcggcccccagggcccacccggcccgcaaggacatctgggcccacaggggccacccggaactcaggggatgcagggaccccccggcccccgtggaatgcaagggcccccgcaccctcacggcatccagggtggacccggcagccagggtatccaaggaccagtgtctcagggacccctgatgggattgaacccccgaggaatgcagggcccgcctggaccccgggaaaaccaaggaccagccccacaagggatgatcatggggcaccccccccaggagatgagggggccacacccacccgggggactcctgggccacggcccccaggaaatgcgaggcccccaggaaatccggggcatgcaaggccccccccctcagggcagtatgctgggtccaccccaagagctcagaggcccccccggcagccagagtcagcagggacccccccagggctccctcggaccacccccacagggaggaatgcagggtccaccagggccgcagggacagcagaatccagcgagaggcccccacccctcacaggggccaattcccttccagcaacagaaaactcctctgttaggagacggcccccgagccccctttaatcaggagggtcaaagtactggaccccccccactgatccctggcctgggccagcagggtgcacaggggagaatccctccacttaacccaggacagggaccagggcctaacaagggagattcccggggcccccccaaccaccacatgggtccaatgtctgagcggcgtcacgaacagtccggcggcccggagcatgggccagaacgggggccgttcagggggggacaggattgtagggggccacccgataggagagggccccacccggactttcctgacgatttttcacggccagacgattttcaccccgataaaaggttcggacaccggctgagggagtttgaaggacgcggcgggccactgccccaggaagagaagtggaggagaggtgggcctggacctcccttcccgccagatcatcgcgagttctcggagggggacgggcgcggcgcagcccgcggccctcctggcgcatgggagggcaggcgacccggagatgagcgttttcctcgtgatcccgaggatccacgctttcggggcaggcgcgaggaaagttttagacgcggcgccccaccgcgtcatgaaggacgtgcccccccacgggggcgcgacggttttccaggccctgaagactttggtccagaggagaactttgatgcgagtgaagaggcagcacgcggaagagatctgagaggcagaggccggggtacaccccgcgggggccgcaaggggctgcttccaacgcccgatgaattccctaggtttgaagggggccggaagcctgattcctgggacgggaaccgcgaacccggtcctggccatgaacacttcagggacacacccagaccggatcaccccccacacgatgggcattcaccagccagccgtgagcgcagttcaagcttgcagggtatggacatggcctctctaccaccgcggaagcgtccatggcacgacggacccggaacatccgaacatagggagatggaagcacccggaggccctagcgaagaccgaggaggaaagggccggggtggccctgggcccgcccagcgtgtgccaaaatccggccgatcttcatcccttgacggggagcatcatgacggctaccatcgcgatgaaccttttgggggtcctcccggcagtggcactcctagtcgggggggccgcagcgggtcaaattggggcagaggtagtaatatgaattccggtccacctcggagaggagcctctcggggcggtggccgcggcagatag

SEQ ID NO: 52326 - DNA, 774 bp, Artificial Sequence
  Description of Artificial Sequence: Synthetic coding sequence
atggccaccgagatcggcagccccccccggttcttccacatgcccagattccagcatcaggcccctcgacaattgttttacaaacgtcctgattttgctcaacagcaggccatgcagcagctgactttcgacggaaagaggatgaggaaagcagtcaatcggaagaccatcgattacaacccaagtgtcattaagtaccttgaaaaccgaatttggcagcgtgatcaaagggatatgcgtgcaatccaacccgatgcaggatactataatgatctggttccgcccattggaatgctgaataacccgatgaatgcagtgactactaagtttgtgagaactagcacaaacaaggttaaatgccctgtgttcgtggttaggtggactccagagggtcgccgtctcgtgacaggtgcgtcaagcggggagtttacactatggaacggattaacttttaattttgagaccatcctgcaggcccacgacagccctgtcagggcgatgacatggtcccataatgacatgtggatgctaaccgcagaccatgggggatacgtgaagtactggcagagtaacatgaacaacgtgaagatgttccaggctcataaagaagctattcgggaagctagcttctccccaaccgataacaaattcgccacttgtagcgacgatggtaccgtcagaatctgggacttcctgcgctgtcatgaggagcggatcctccgagatacatgttttcaccattgccggtgttacttcttaagcgtcaagagatag

SEQ ID NO: 52327 - DNA, 357 bp, Artificial Sequence
  Description of Artificial Sequence: Synthetic coding sequence
atggccaccgagatcggcagccccccccggttcttccacatgccccgatttcagcaccaagccccacggcagttgttctataagcgacctgatttcgcccagcagcaggctatgcaacagttgacattcgatggtaagcgaatgagaaaagctgtaaaccggaagactatagattacaatccttctgttattaaatacttggaaaatcggatatggcagcgggaccagcgtgacatgagggcgattcagccagacgccggttattataacgacctggtgcccccaataggcatgttgaataaccctatgaatgccgtgacaactaaatttgtcagaacgagcaccaacaaggtttag

SEQ ID NO: 52328 - DNA, 981 bp, Artificial Sequence
  Description of Artificial Sequence: Synthetic coding sequence
atggccaccgagatcggcagccccccccggttcttccacatgccccggttccaacaccaggcccccaggcagctattctacaagcggcccgactttgcacagcaacaggccatgcaacagctgaccttcgatgggaagagaatgcggaaagccgttaatcggaaaaccatcgattacaatccaagtgtcatcaaatatctagaaaacaggatctggcagcgcgatcaaagggatatgcgcgctatacagcctgatgccgggtattacaatgatctggtccctcccattggaatgctcaataaccccatgaatgctgttacgacgaaattcgtgagaacctcgactaataaagttaaatgtccagtgtttgtagtccggtggactcctgaaggaagaagattggttactggagcctccagcggggaattcaccttgtggaacggtttaacattcaatttcgaaacgatcctgcaggcgcacgattcgccggttagagctatgacttggagccacaacgatatgtggatgctgacagccgaccatggaggatacgtaaaatattggcagtctaacatgaataatgtgaagatgtttcaagcccataaagaggcaattcgggaggctagatttatccataacatccccttctctgtagtgccaatcgtgatggtgaagcttttctccaaatgtatactgggagctgaaatgcacgggttatgtcagttccttggcaactttctgcaccccattaataccatctttttcttcgtgttcacacactctcccttctgctggcacttgtccgaagtcgtgctgtcacgttaccagcccctgcagtatgtcagagatgttctatccgctgctttctgcaccggtttcctatttagcttcatgatcaataatgtgtacactctctttctgtttattatctactgtgtgaggcaggagtattttatcccaaacaaagaatttagcctatag

SEQ ID NO: 52329 - DNA, 1485 bp, Artificial Sequence
  Description of Artificial Sequence: Synthetic coding sequence
atgcccaccgagagcgccagctgcagcaccgcccggcagaccaagcagaagcgcaaatcccactcactgtcaatccggagaacaaactccagtgagcaggagcgcaccggattgcccagggacatgctggaaggccaggactcgaaactgcccagctccgtgcgctccacgctgttagaactttttggccagattgaaagggagtttgaaaacctgtatatcgagaatctcgaactgcgcagagagatcgacacgctcaacgaacgtctggcagcagagggccaggctattgatggggcagaactgtccaagggtcagctgaagacaaaggcatcccactccactagccaactcagccagaagctcaaaactacgtataaggcgtcaacctccaagattgtgtcttctttcaagaccacgactagccgtgcagcttgtcaactcgtgaaagagtacatagggcatagagacgggatttgggacgtgtctgtggcaaagacgcagcctgtggtactggggactgcatcagccgaccataccgcactgctgtggtccatagagactggaaaatgtttagtgaaatatgctggtcatgtggggtcagtgaattccattaagtttcacccgagcgaacagctcgcattaacagcctctggagaccagacagcacacatttggagatacgctgtgcagttacctaccccccagcctgttgcagatacaagcatttccggagaagatgaagtggaatgctcggataaggatgagcccgacctcgatggggacgtgagctcagattgtccaaccatccgagtgccactgacttcgctcaagagccatcaaggtgtcgtgatcgctagtgattggcttgttggcggcaagcaggctgttaccgcaagttgggacaggaccgctaatctgtatgatgtggagacaagtgaacttgttcattctctgactgggcacgatcaggagcttacacattgctgcacacatcccacacagagactagttgtgacatccagtagggatacaacatttcggctgtgggacttcagagacccaagcatccactccgttaatgttttccagggtcatactgacacagttacatcagccgtgtttaccgtcggcgataacgtggtgtcaggatccgacgatcggaccgtgaaggtgtgggatctgaaaaacatgcgttcacccattgctacaattcgaaccgacagtgccataaatagaataaacgtgtgcgtgggccagaagatcatcgcactccctcacgacaataggcaggttaggttgttcgacatgtctggcgtcaggttggcacggttaccgagatcctcacgacaggggcatcgcagaatggtctgttgctccgcctggtcggaagatcatcccgtgtgcaatcttttcacctgcgggttcgatcgccaggccatcggctggaatatcaatatcccagcactgttgcaggagaagtag

SEQ ID NO: 52330 - DNA, 1485 bp, Artificial Sequence
  Description of Artificial Sequence: Synthetic coding sequence
atgcccaccgagagcgccagctgcagcaccgcccggcagaccaagcagaaaagaaagagtcactctctcagtatcaggagaacaaacagcagcgagcaggaaagaactggtttgccccgggatatgttagagggacaggattccaaattaccgtccagcgtccgctctacattactggaactcttcggccagatcgagcgcgaattcgagaatctgtacattgaaaatctcgaactccggagggagatcgacacactaaacgaaaggttggcggccgaaggacaagccatagacggggccgaactgtccaagggccaactgaaaaccaaggccagccactccactagccagcttagtcagaagctcaagactacttataaggcttctacaagtaaaatcgtgagctcttttaagacaaccacctcacgagccgcatgtcagttggtgaaggagtatatcggccatcgggacgggatctgggatgttagcgtcgcgaaaactcagccagtggtccttggtacagcttcagctgaccacaccgcactgctttggtcaattgagactgggaaatgcctggtgaagtacgctggccacgtgggctcagtaaactccattaagtttcaccctagcgagcagctggccctgaccgccagtggcgaccagaccgcccacatttggcggtatgccgtacagctccccacaccccagccggtggcggatacatcaatctctggcgaagatgaggtagaatgcagcgataaagacgaacctgacctggacggcgacgtgtctagcgactgccctaccattagagtgcccctgacttcactgaaatcccatcagggggttgtcatcgccagtgactggctggtcgggggcaagcaggcagtgactgcgtcttgggatcgtacagctaatctctacgatgtcgagacaagcgaactggtgcacagcttgacaggtcatgaccaggaattgactcattgttgcacacatccaacccaaaggctcgtcgtcacaagtagcagggacacgacctttagactctgggattttcgcgacccaagtatacattcagtgaatgtctttcaggggcacactgatacagtgacgtcggccgtgttcaccgtgggtgataatgtggtctctggctccgacgacagaactgttaaggtttgggacctgaaaaatatgcgttctcccatcgctacaatccgaactgattccgcaatcaacaggataaatgtgtgtgtgggacaaaagatcatcgcgctgcctcacgacaaccgacaagtgaggctgtttgatatgagcggcgtccggttggcaaggctcccgagaagtagcagacagggccatcgacgaatggtgtgctgctctgcatggagcgaagaccacccagtctgtaatctcttcacctgcggctttgataggcaagcgatcggttggaatattaacatcccggccctactccaggagaaatag

SEQ ID NO: 52331 - DNA, 750 bp, Artificial Sequence
  Description of Artificial Sequence: Synthetic coding sequence
atgcccaccgagagcgccagctgcagcaccgcccggcagaccaagcagaagcgcaagtcacactctttaagtattcggaggacaaactccagcgaacaggaacggactggcttaccccgggacatgctagaggggcaggattcaaaattaccatcatccgtccgtagtaccctgttagagctctttggccagattgagcgcgagttcgaaaacctctatattgaaaatcttgagttacggcgtgaaattgatacacttaatgaacggctcgctgcagagggccaggctattgatggagccgagctcagtaagggccaacttaagactaaggcctctcattctaccagccagctgagccagaagttgaagaccacatataaagccagcacatccaagatcgtttcatcctttaaaacaacaacctccagagccgcttgtcaactggtcaaagagtatattgggcatcgcgacgggatttgggatgtgtccgtcgcaaaaacccaacctgtggtgttaggaacagccagcgcagaccacactgctcttctgtggagcattgaaacaggaaagtgcctagtcaaatatgccgggcatgtcggctctgtcaacagcattaagttccacccttctgagcagctcgccctgacagcaagtggcgaccaaacagctcacatttggcggtacgctgtccaactgccaacaccgcagcctgttgccgacacctccgtgtccacttttccatacctatag

SEQ ID NO: 52332 - DNA, 630 bp, Artificial Sequence
  Description of Artificial Sequence: Synthetic coding sequence
atgagcagcgacagcgagtgggaccggagcgcctgcagcgacagcaaacttccttccagtgtccgtagtactttactggagttatttggtcaaattgaacgcgaatttgagaatctctacatcgagaacttggaactgagacgggaaattgataccttaaacgagcgtctagcagccgagggtcaagcaatcgacggtgcagaattgagtaagggacagcttaagacaaaggccagccactcgactagtcagttgagccagaagctcaaaaccacatataaggcctcaacatccaaaattgtcagctcattcaagactacaacatccagagcggcctgtcaactagttaaggaatacattggccaccgtgacggaatatgggacgtcagtgtagccaaaacccagccagtcgtgctaggaaccgcaagtgctgaccatacggcactattgtggagcattgaaacggggaaatgcctagtgaagtatgctgggcacgtcggatccgtgaactcgattaaattccatcctagtgagcaattggcactgaccgcctccggagaccagacagcccatatctggcggtatgcagtacaactgcccactccccaacccgttgcagataccagctag

SEQ ID NO: 52333 - DNA, 945 bp, Artificial Sequence
  Description of Artificial Sequence: Synthetic coding sequence
atgaacagcggcgtgcccgccaccctggccgtgcggcgggtgaagttcttcggccaacatggtggagaagtcaattcttcagcctttagcccagacggtcagatgttactcaccggctccgaggatggatgcgtgtacgggtgggagacccggagtggccagctcctgtggagactgggcggccatacagggcccgtgaaattctgtcggttctccccagacgggcatcttttcgccagcgcgagttgcgactgcacggtgcgtctctgggacgtggctagagcaaagtgcctcagagtgctgaagggccaccagagaagtgtggagaccgtgtctttctccccagactcccgccagctggccagtggcggttgggataaaagggtaatgttgtgggacgttcagtccggccagatgctccgcctcttggtgggccaccgagactccatacagagtagtgatttcagccccacggtcaactgtttggctaccggctcatgggatagcaccgtgcacatttgggaccttcgtatggtaactccagccgtgtcacatcaggccttggaggggcactccgctaatatttcttgcttgtgctactcggcctctggcctgttagcttcaggaagttgggataagacaattcatatctggaagcctacaacctcctcactcctgatccagctgaagggccatgtgacctgggtgaagtcgattgccttctcaccagacgagctatggttagcgtccgctggctactctaggatggtcaaggtttgggattgcaatacagggaaatgcttagagacccttaagggcgtcttggacgtggctcacacttgtgccttcacaccagacggcaagattctggtctctggtgcggcggaccagaccaggcgccagattagccgaacgagtaagagtcctagggaccctcaaacatag

SEQ ID NO: 52334 - DNA, 1380 bp, Artificial Sequence
  Description of Artificial Sequence: Synthetic coding sequence
atgctgcggtggctgatcggcggcggccgggagccccagggcctggcagagaagagtcctttacagaccattggagaggaacagacacagaacccctacactgagctgctggtcctgaaggcacatcacgatattgttaggttcctcgtgcagcttgacgactatcggtttgccagcgcaggcgacgacggcatcgttgtggtctggaacgcgcagaccggggagaaactgttggaattgaatggtcatacacaaaagattaccgccataatcacgtttccatccctagagtcatgcgaagagaagaaccagctcatcctaactgcatcagcggatagaactgtcatcgtctgggatggcgataccactagacaggtgcagcgaatatcttgtttccagtcaacggtaaagtgtttaactgtgctgcagcggcttgacgtgtggctgtcaggaggaaatgatctctgcgtttggaatagaaagcttgatctcttgtgcaaaacctcccatttatcagacaccgggatctctgcattagtcgagattcccaaaaactgtgtggtggccgccgtggggaaggagctgattatttttaggctcgtcgcccctactgaggggtctctggagtgggacatcctggaagtgaagagactgctggatcatcaggacaacatcctctcactgatcaacgtgaatgacctgagcttcgtcaccggcagtcatgtgggcgagctgatcatttgggatgcccttgattggactatgcaagcgtatgaacgcaacttctgggatcctagtccccaactcgatactcagcaggaaattaagctgtgccagaaatctaatgacattagcattcaccactttacttgcgatgaagagaacgtattcgcagctgtcgggcggggactttatgtgtatagtctgcagatgaaacgtgtcatagcctgtcagaaaacagcgcatgactcaaacgtcctccatgttgccagattgccaaaccgccagctcatatcttgctctgaagacggatccgtgcggatttgggaactcagagagaaacagcagttggcggcagaaccagtgcccactgggttctttaatatgtggggattcggcagggtctcgaagcaggccagccaaccagtgaagaagcaacaggaaaatgcaacatcctgctcccttgagctgataggggatttgatagggcattccagcagtgtagagatgtttctatacttcgaagaccatggcctggtgacttgctcagccgaccatttgatcatcctctggaaaaatggcgaacgagagtccggactccgatccctacggctgtttcagaagctggaagaaaatggcgacctgtacttagctgtgtag

SEQ ID NO: 52335 - DNA, 618 bp, Artificial Sequence
  Description of Artificial Sequence: Synthetic coding sequence
atgcaggcctacgagcggaacttctgggaccccagcccccagctggatacccagcaggaaatcaaattgtgccaaaagagcaatgatatctctatccaccattttacgtgcgatgaagagaacgtgtttgcagccgtggggcgcggtctgtatgtgtactctctgcaaatgaagagagtaattgcctgccaaaagaccgcccatgactcaaacgtgctacacgtcgcacggcttcccaacaggcagctgattagctgtagtgaggacggctccgtgcgcatctgggaactgagagagaagcagcaacttgccgccgagcctgtgcctaccggtttctttaatatgtggggctttgggagagtttccaagcaggcttcccagcctgtcaagaagcagcaggagaatgccacaagctgcagtctggagctaatcggcgacctgataggccacagctcatcggtggagatgtttctgtattttgaggatcacggattggtgacctgtagtgccgaccatcttatcattctttggaagaatggagaacgagaaagcgggctgcgctctctgcgtctctttcagaagctggaggagaacggtgatctgtacctggctgtgtag

SEQ ID NO: 52336 - DNA, 1086 bp, Artificial Sequence
  Description of Artificial Sequence: Synthetic coding sequence
atgacccagcagcccctgcggggcgtgaccagcctgcggttcaaccaagaccagagctgcttttgctgtgccatggagaccggcgtgcgaatatataacgtcgaacccttgatggagaaaggacatttggatcatgaacaggtggggtcgatgggattagtcgagatgctgcaccgttccaatctattggccttggttggcgggggatcttcgcccaaatttagtgagatctccgccgttctgatctgggatgatgcacgggaaggaaaggactctaaagagaaattggtcctggagttcacatttactaaacctgtcctctccgtgcggatgcgccacgataagatcgtgattgtgctaaagaaccgcatctatgtttatagcttccctgacaaccctaggaagctcttcgaattcgacacccgcgataatccaaaaggactctgcgatctttgccctagcctggaaaaacagctgttggtctttccagggcacaaatgtggaagtcttcaacttgtggatcttgccagtacgaaacccggtacctcgagcgcaccgttcacaattaacgcccatcagagcgacatagcgtgtgtaagcctaaaccagccaggcactgtggtggctagcgcctctcagaaagggaccttaatcaggttattcgacacacagtccaaagagaaacttgttgaactccgacgcggcacggatccagcaaccttatattgcatcaatttttcccacgacagctcttttctttgtgcctcttcagacaagggcacggtccatatttttgctttaaaagacacccgtttgaaccgtcggagcgctctcgcgagggttggcaaggtaggccctatgattggccagtatgtggattcacaatggagtctcgcctcattcactgttccagccgagtctgcctgtatatgtgctttcggaagaaacacgtctaagaatgtcaatagtgtgatagcaatttgtgtcgacgggaccttccacaagtacgtcttcacgcctgatggaaattgcaacagagaggcctttgacgtgtacctcgacatttgtgacgatgacgatttttag

SEQ ID NO: 52337 - DNA, 1833 bp, Artificial Sequence
  Description of Artificial Sequence: Synthetic coding sequence
atggagaccgcccccaagcccggcaaggacgtgccccccaagaaggataaactccaaacgaagagaaagaaacctcgccgttactgggaggaagaaacagtgccgactactgccggggccagtcccgggccccccaggaataaaaagaatagggaattaaggccccaaaggcctaaaaacgcgtatatactgaagaaatcaaggatttccaagaaaccgcaggttcccaagaagccccgcgagtggaaaaaccctgaatcacagcgcggcctctccgggacacaggacccatttccaggacctgcgcccgtacccgttgaggtagtccagaaattttgtcggatcgataagtcacgtaagctcccccacagtaaagccaagacccggtctagactggaggttgctgaggccgaagaggaagagacaagcattaaggccgcccgctccgaactgctgctcgcagaagagcccgggtttctcgagggggaggacggggaggatactgcaaaaatttgtcaggctgatatcgtcgaggccgttgacatcgcaagcgccgcgaagcattttgatttgaatttgaggcaattcggcccctatcgcttgaattactcaagaaccggccggcacttagcctttggaggacgccgagggcatgtggcagcgctggattgggtgacgaagaagttgatgtgtgagattaatgtcatggaggctgttcgggacataaggttcctgcactctgaagccctgctagcagtggcgcagaaccgctggttgcatatctatgataaccagggcatcgagctgcattgtattagacgttgtgaccgggtgaccagactggaatttcttccgtttcactttttattagccacagcgtctgagacgggctttctcacatatctggatgtctcagtggggaagatcgtggctgccctgaatgcccgtgccggccgattggatgtgatgtcacagaacccttataatgccgtgattcaccttggacacagtaatgggacagtcagcctttggagccctgcgatgaaggaacctttagccaaaattctgtgtcatcgggggggagtccgagcagtcgccgtagactctaccggcacatacatggctacaagcgggctcgatcaccaactgaaaatttttgatctgcgcggtacttaccagcccctgtccactcgaaccttgccacatggcgcaggccatctcgcattctcccagaggggcttgctagtcgccggaatgggggacgtcgtcaacatttgggctggtcagggaaaagccagcccacctagcctggagcagccctacttgactcaccgcttatcgggtccagtgcacggcctgcaattttgcccgtttgaggacgttcttggggtcggacacactggaggaattactagtatgctcgtgccaggggccggagagcctaattttgatggattggaaagtaatccgtacaggtcccgaaagcaacgacaggagtgggaggtgaaagccctgctggagaaggtgcccgccgagcttatctgtctcgaccctcgggccctcgccgaggtcgatgtgattagtctggagcaaggcaaaaaggagcagatcgaaagactgggatacgatcctcaggccaaggccccttttcaacccaagcctaagcaaaaagggaggagttccacagccagcctggtgaaacggaaacgcaaggtgatggatgaagagcaccgggataaggtacggcagtcactgcaacagcagcatcacaaagaagcaaaagccaagccaacaggggcacggcccagtgccctcgaccgctttgtgcgatag

SEQ ID NO: 52338 - DNA, 1833 bp, Artificial Sequence
  Description of Artificial Sequence: Synthetic coding sequence
atggagaccgcccccaagcccggcaaggacgtgccccccaagaaggacaagctccaaaccaaacggaaaaaacctcgccgatactgggaagaggagacagtgcctacaaccgcgggagctagcccgggaccaccaaggaacaagaagaatcgcgagctcaggccacaaagaccaaaaaacgcgtatatcttgaagaagagcagaatttcaaagaagcctcaggtgcccaaaaaaccgagagaatggaagaacccagagagccaaaggggtctttccggggcccaggacccgttccccggtcccgccccagtgcccgtggaggtcgtgcaaaagttttgtcggatcgacaagtcccggaaactgccccacagcaaagccaagaccagaagccgcctggaggtggctgaggcagaggaggaagagaccagcatcaaggctgctcggagcgagctcctgctcgccgaagagcccggttttttggagggcgaggatggggaggatactgcaaagatatgccaagcagacattgtcgaagccgtggacatagcctccgcggcaaagcacttcgacctgaacctacggcagttcgggccttacagactgaattattctcgaacagggcgccatctggctttcggcggcaggcggggtcacgtagccgctctggactgggtgaccaaaaaactaatgtgcgaaatcaatgtgatggaggccgtgcgcgatatacggttcctgcactccgaggcactgttggctgtggctcagaacagatggttgcacatctatgataaccaaggcattgagctacattgcatcaggagatgtgacagggtcacacgcttggaatttctcccttttcattttctgttggctaccgccagcgagactggatttcttacatatctggatgtgtccgtcggcaagatcgttgctgccctgaacgcccgcgctggtagactggacgtgatgagccagaatccttacaacgcagtgattcacctaggacacagcaatggtactgcaagcctgtggtcccccgcaatgaaggagcccctcgcgaaaatcctgtgccatcggggcggtgtgagagccgttgccgttgacagtactgggacttacatggcgacttccgggctggaccatcagctgaaaatcttcgacctaagaggaacataccaaccactatctacccggacactgccccacggggcgggccatctggcatttagccaaagggggttgcttgttgccggaatgggcgatgttgtgaacatatgggcaggtcaggggaaggcatcacccccctccctggagcagccctacctcacccacaggctatccggccccgtgcatggtttgcaattctgcccctttgaggatgtgctgggcgtgggccacaccgggggaatcaccagcatgttggttccgggcgccggagagcctaactttgatgggctggagtccaacccatatcgaagccggaagcagaggcaagagtgggaagtaaaggccctgctcgaaaaggtgccagccgaattgatttgcctcgacccaagagctttagccgaggttgatgtcattagcctggaacaaggaaagaaggagcagatcgagcgcctggggtacgacccccaggccaaagcaccattccaacccaagcccaagcagaagggtcggagtagcacggcctccctcgtcaagcgcaagagaaaggtcatggacgaggagcaccgggacaaggttagacagtcattgcagcagcagcatcacaaggaagcaaaagcgaagcccactggcgcccggccctctgccttggataggttcgttcggtag

SEQ ID NO: 52339 - DNA, 969 bp, Artificial Sequence
  Description of Artificial Sequence: Synthetic coding sequence
aagagccggatcagcaagaagccccaggtgcccaagaagccccgggagtggaaaaaccctgaaagccaacggggactgtccggcgcccaggacccctttcccgggccagcccccgtcccagtggaggtggtgcagaaattctgccggattgacaaaagccggaaactgccccacagcaaagcgaagacccgaagtcgccttgaggtcgcggaggccgaggaggaagagaccagcatcaaggccgcacgctcagagctgctcctagctgaagagccaggttttctagaaggggaagacggcgaggacaccgcaaaaatctgccaggccgacattgtcgaggcagtcgacattgcttctgccgctaagttcggaccctaccgtctaaactactctagaactggacgccatctcgcgtttggtggaaggcgcggtcatgtggccgccttggattgggtgacaaagaagctcatgtgcgagatcaacgtaatggaagctgtccgcgacatcaggttccttcactcagaggcgctcctggctgtcgcacagaatcgctggctgcatatttatgacaaccagggaattgagttacattgcatccggcgttgcgaccgtgtcacacgcctcgagtttctaccctttcacttcctgcttgccactgcatcagagaccggcttccttacctaccttgatgtcagcgtgggaaaaatcgtggccgcactgaacgcgagagcagggcgtctcgatgtaatgagtcaaaatccgtataacgccgtgattcatctgggtcactctaatggcactgcttccctgtggtcccccgccatgaaagagcccttggccaaaatactctgccataggggtggggtacgtgctgtggcagtggactcaaccggaacctatatggcaactagtggtcttgatcaccagctcaaaatttttgatttgagagggacctaccagcccttgtag

SEQ ID NO: 52340 - DNA, 1833 bp, Artificial Sequence
  Description of Artificial Sequence: Synthetic coding sequence
atggagaccgcccccaagcccggcaaggacgtgccccccaagaaggacaaacttcaaaccaagagaaaaaagccacgccgctactgggaggaagagacggttccaacgaccgcgggggcctcacccgggcctcctaggaataaaaagaacagggagctcagaccccagcggccaaaaaatgcatacattctgaaaaaaagccgcatctccaaaaagcctcaggtccccaaaaaaccccgcgagtggaagaatcccgaatctcagcgcggcttatccggggcacaggatccgtttcctggacccgctcctgtgccggtggaggtggttcaaaaattttgtcggatcgacaaaagccgaaaactaccacactcaaaggctaagacccggagtcggctggaagttgccgaggctgaagaagaggagacaagtatcaaggcggcgagatcagagctgctcctggccgaagaaccgggtttcctcgagggcgaagatggcgaggacaccgccaaaatttgccaggcagatatcgttgaagctgtagatattgctagtgctgcgaagcactttgatctcaacctgaggcagttcggaccctaccgcttgaattattcgagaacagggcggcatctggcatttggtgggcggcgcggccatgtcgcagccttagactgggttacaaagaagctcatgtgcgaaatcaatgtgatggaggcagtccgggatatcagattcttgcacagcgaggcactcctggccgtggctcaaaaccgctggctccacatctatgataaccagggcattgaactgcactgcatacggaggtgtgaccgggtcacgcgccttgagtttctgccttttcatttccttttggccactgcctcagaaaccggtttcctgacatacctcgacgtatccgtgggaaaaattgtggcagctttgaacgcgcgcgcaggaaggctcgacgtgatgtcgcaaaacccctacaacgccgtgatccacctcggccattccaacggtacagtgtcactctggagccccgccatgaaggagcctctggcaaaaatactatgccaccgtggcggcgtgcgggctgttgccgtggatagcacagggacatatatggcaaccagtggactggaccaccagttgaagatttttgatctgaggggtacgtatcagcctttgtccactcgaacactgccgcatggagccggacaccttgctttctcacagaggggactgttggtcgccgggatgggcgatgtggtcaacatctgggccgggcagggtaaggcatccccaccgtcacttgaacagccatatttgacacatcgcctttccgggccagtgcacggactgcagttctgtcccttcgaggacgtactaggagttggacacactggtgggattacgtccatgctggtgccgggggcaggggaacccaacttcgatgggcttgagtccaacccgtacagaagtaggaagcagagacaggagtgggaagtgaaagcactcctggaaaaagtgccggctgagttgatttgtctggacccacgcgccttggccgaggttgatgtgatttccctagaacagggaaaaaaggagcagatcgagagacttggctatgatccacaagcaaaggccccattccagcctaagccaaagcagaagggacgatctagtacggcatcgttggtgaagaggaaacgcaaggtgatggacgaggagcatcgagataaagtgcgacagtctctgcagcagcagcaccataaagaggcaaaggccaagcctactggagcacgaccatctgctttggataggtttgtgagatag

SEQ ID NO: 52341 - DNA, 1833 bp, Artificial Sequence
  Description of Artificial Sequence: Synthetic coding sequence
atggagaccgcccccaagcccggcaaggacgtgccccccaagaaggataaactccagactaagcgcaagaagccgcgccggtactgggaagaggagactgtgccaacgaccgcgggcgcaagtcccgggccccctagaaacaagaaaaaccgggaattgagaccccaacggccaaaaaatgcatacatcctgaagaagtcacgtattagcaagaagccacaggtgccaaaaaagccgcgggaatggaagaatcccgagtcccaacgaggactatcgggcgctcaggatcctttccctggtcccgccccagtaccggtggaggtggtgcagaagttctgccgcatcgacaagagcaggaagctgccacattccaaggcaaagaccaggagccgtttggaggtggcggaggccgaggaggaagagacttcgataaaagccgcccggagcgagcttcttctggccgaggagcctggatttctcgagggggaggatggtgaggatactgctaaaatttgccaagcagatatcgtggaagctgtcgatatcgctagtgccgcaaaacattttgacctcaacctcagacagttcgggccatatcggctcaattactcccgaacgggacggcacctagccttcggggggcgccgggggcatgtcgcagccctcgattgggtgacgaaaaaactcatgtgtgaaatcaacgtcatggaggccgtgagggatattagattcctgcatagtgaggcgctgctggcggtggctcagaatcggtggctgcacatttatgacaatcaggggatagaactgcactgtatccgacgatgtgatcgcgtgaccaggcttgagtttttacctttccacttcttgcttgctaccgctagcgagactggcttcttgacctatttggacgtgagtgtcggtaagattgtggctgccctgaacgcgagagcggggcgacttgacgtaatgtcacaaaatccttacaatgctgtaatacatctgggccactccaatgggacggtttcattgtggagtccagccatgaaagaaccactggccaaaattctgtgtcaccgtggcggggttcgcgctgtggccgtcgatagtacaggcacttacatggccacttccggcctcgaccatcagctcaaaatctttgacctcaggggaacgtaccaaccgctctctaccaggacgttgccgcatggagccggccatctagctttttctcagagaggtctgctggtcgctggtatgggagatgtggttaacatctgggcaggccagggcaaagccagccccccatcactcgagcagccctatctgacacaccggctaagcggacctgtccacggtctccagttttgtcctttcgaagatgtgctcggcgtcggccatacaggaggaataactagcatgctcgtcccgggcgcaggagaacccaacttcgatggtttggagagtaacccttataggagtagaaagcagcggcaggagtgggaggtgaaggctctcctggagaaggtgccggctgaactgatctgtctggaccctagggccctagccgaggtggacgtcattagtctcgaacagggaaaaaaagaacagatcgagcgtttaggctatgacccgcaagctaaggccccctttcagccgaaacctaagcagaagggtcggagcagcaccgcatccctggtcaagagaaagagaaaggtgatggacgaggagcacagagacaaagtgaggcagtctttgcaacagcagcatcacaaagaggccaaggccaaacctacaggcgcgcgcccgagcgccttagatcgtttcgtgagatag

SEQ ID NO: 52342 - DNA, 969 bp, Artificial Sequence
  Description of Artificial Sequence: Synthetic coding sequence
aagagccggatcagcaagaagccccaggtgcccaagaagccccgggagtggaagaacccggagtcacagcgcggcctcagcggagcgcaggacccctttcccggaccagcacccgtaccggttgaggtcgtccagaagttctgtaggatagataaatccagaaagctcccgcactcgaaggccaagactcgatccagattggaggtggcagaggcagaggaagaggagaccagtataaaagctgcccgtagcgagctgctcctggccgaagagccaggttttctggaaggagaggatggcgaggataccgctaaaatatgtcaagccgacatcgtggaggccgtagatatcgcttccgctgcaaagtttgggccctatcgactcaactactctagaacaggccggcacctcgctttcgggggtcggaggggccatgttgctgctttggactgggtcaccaaaaaactcatgtgcgagatcaatgtgatggaggctgtgcgcgatatccggttcctacactccgaagccctgctggcagtagcccaaaatcggtggcttcacatctacgataatcagggaatcgagctccactgcatccggcgctgtgatcgcgtcacacggttagagtttttgccctttcatttcttactcgctactgccagcgagactggattccttacttacctcgatgtgagcgttggaaagattgtagccgcgctgaatgctagagccggcagactcgacgtgatgagccaaaacccatataacgcagttattcatctgggacactcaaatggaacggtatccctttggtccccagccatgaaagagcctcttgctaagatcctttgtcaccgaggcggggtcagagctgttgccgtagattccacggggacctacatggctaccagtggactggaccaccagttgaagatcttcgacctaagggggacataccagcccctgtag

SEQ ID NO: 52343 - DNA, 969 bp, Artificial Sequence
  Description of Artificial Sequence: Synthetic coding sequence
aagagccggatcagcaagaagccccaggtgcccaagaagccccgggaatggaaaaaccctgagagtcaacgcggactgagcggaacccaggatccgtttcctggcccagcacctgtaccagttgaagtggtgcagaaattttgtcgaattgacaagtcgcggaagctgccacacagcaaggccaagacacgctctaggctagaggttgcggaggccgaagaagaggagacctcaattaaagccgcgaggtctgaactcctgctggccgaggagcccggcttcctcgagggcgaggatggggaggataccgccaaaatttgccaggctgatatcgtcgaggccgtcgatatcgcctcggctgcaaaattcggtccttacaggctgaactactcacggaccggccgacatctggccttcggtggcagaaggggacacgtggctgccctcgactgggtgaccaaaaagctaatgtgcgagataaacgttatggaagcagttagggacatacgtttccttcatagcgaagcgttactggcagtggcccagaatcgatggttgcacatttacgataaccagggaatcgagttgcactgcatccgccgctgtgatcgggtgactcgcctggagtttctccctttccacttcctcttagccactgcgagtgaaaccggatttcttacttacttagacgtgagtgtcggaaagatcgtcgccgcactgaacgctagagcaggcaggctcgacgtgatgtctcagaacccttacaacgccgttattcacctgggccattctaacggcaccgtgagtttgtggagccctgcaatgaaggaacctctggccaagatcctgtgccatcgcggaggtgttcgggcggtggcagtggattccaccggcacctacatggcgacctcgggtcttgaccaccagctcaagatatttgacctgcggggaacctatcagcccttgtag

SEQ ID NO: 52344 - DNA, 969 bp, Artificial Sequence
  Description of Artificial Sequence: Synthetic coding sequence
aagagccggatcagcaagaagccccaggtgcccaagaagccccgggaatggaagaaccccgagtcccagagaggacttagtggcgcacaggaccccttccctggccctgcccctgtaccagttgaggtggtccaaaaattctgtagaattgacaaatcacgaaagctcccacacagtaaagccaagacacggtcacggctggaggtcgccgaggctgaagaagaagaaacatccataaaggccgcaagatccgaacttctgctggccgaggagcccggctttcttgagggagaagacggggaggatacggctaagatttgccaggccgacatagtggaagcagtggatatagcgagcgccgccaaattcggcccatatcgtctcaactattctaggactggcagacatctcgctttcggaggacgcaggggtcacgtggcggcccttgactgggtgacgaagaaactaatgtgcgagatcaacgtcatggaagcagtccgcgacattaggtttctacattccgaggctctgcttgcagtggcccagaacaggtggctgcacatttatgacaaccaggggatcgaacttcattgtatcagacgttgcgacagggttacacggctcgagtttctacctttccattttctgctcgcaactgcctccgagactgggtttcttacctacttggatgtttcagtaggaaagattgtagccgccctgaacgcccgcgcaggcagactggatgttatgtcgcagaacccttataatgcagtaatccatcttggccactctaacggcaccgtatccctctggtcccccgccatgaaagagccactggctaagatcctgtgtcatagaggcggagtccgggctgtggcagtagactcaactggcacttatatggctacttccggactcgaccatcagttgaaaatctttgaccttcggggcacgtatcagcccctctag

SEQ ID NO: 52345 - DNA, 969 bp, Artificial Sequence
  Description of Artificial Sequence: Synthetic coding sequence
aagagccggatcagcaagaagccccaggtgcccaagaagccccgggaatggaaaaatcctgagtcccagcgcggtctctccggcgcccaggacccttttcccgggccggctccagtgccagttgaagtcgtgcagaaattctgtcggatcgacaagagccggaagctgccccacagtaaggccaaaacacgctcaaggctggaagtggctgaggccgaagaagaggaaacatcaatcaaagctgcccggtcggaactgcttctggcagaggagcccgggtttctggaaggcgaggatggagaagatacggcaaagatctgccaggcggatattgtcgaggcggtggatatagcttctgctgctaagttcggtccgtacagattgaactattcaaggaccgggcgtcatctcgcctttggagggcgaaggggccacgtggcagctctggactgggtcactaagaagctgatgtgcgagattaacgtcatggaagcggtccgagacatccggtttttgcatagcgaggccttactcgctgtggctcagaatcgttggttacacatctacgacaaccaggggatcgagctgcattgtattcggagatgtgaccgcgtgacaaggctcgagttcctgccttttcatttcttgttggctaccgcttccgagacaggattcttaacatatcttgacgtgagcgtggggaaaatcgtcgcggctttaaatgcgagagctggaagactggacgttatgtcacagaacccatacaacgccgtaatccacctcggccactctaatggaacagtgtccctctggtcacctgcgatgaaagagccactggccaaaatcctgtgccaccgaggtggagtacgagcagttgccgtggactcaactggaacatacatggccaccagtggcctcgaccaccagctgaagattttcgacttgcgcggaacctatcaacccctgtag

SEQ ID NO: 52346 - DNA, 1833 bp, Artificial Sequence
  Description of Artificial Sequence: Synthetic coding sequence
atggagaccgcccccaagcccggcaaggacgtgccccccaagaaggataagctgcagaccaaacgcaagaagccgagaaggtactgggaggaggaaactgttcccaccaccgccggcgcctcaccagggcccccccgcaacaaaaagaatagggaactgaggccccagagacccaaaaatgcatatatactgaagaagagccgcatctcgaaaaagcctcaggtgccgaaaaagccgcgtgagtggaagaatccagaaagtcagagaggcctctccggcgcccaggatccctttcccggtccagctccagtccccgttgaggtggtgcaaaagttctgccggatcgataaaagcaggaaactacctcactccaaagccaaaacacgcagcagactcgaagtggctgaagcagaagaggaagaaaccagcattaaagccgccagatctgaactattgctggccgaagagcccggattcctagagggtgaggacggagaagatacagcaaagatttgccaagcagatattgtggaagcagtggacatcgcgtcagcagcaaagcatttcgatttgaacttgcggcaattcggaccatatcgcttgaactattcccgaactggccgccacctggcttttggaggacgaagaggacacgtggccgccctggactgggtaacaaagaagctgatgtgcgaaattaacgtgatggaggccgtgcgagatatccggttcctgcactcggaggcgttgctcgcagtcgcccagaatcgttggcttcatatttatgacaatcagggtattgagttacactgcatccgacgatgcgatagggttacaaggctcgagttcctccctttccactttctgctggccacagcctccgagactggatttcttacatatcttgatgtttctgtgggtaaaatcgtggcagctctcaacgcaagagccggacggctggacgtcatgtcccaaaacccttacaatgccgtgattcacctcggccattccaatggaactgtctctctgtggagtccagccatgaaggagcccctggcgaagatcctctgccaccggggcggagttcgagccgtggcagtggacagcaccgggacatatatggccacgtctggcctggatcaccagctcaagatatttgacctacgcggcacgtatcagccactttccacgcgcacactaccacatggcgctggacacctggcattttcccagagggggctactggtagccggcatgggagatgtagtgaatatctgggcaggacagggaaaggccagcccaccttctctcgaacaaccatacctcacccaccgtctctcgggtccagtgcacggactgcaattttgcccctttgaggacgtgctgggggttgggcatactggcggaatcacttctatgcttgttcccggcgccggagaaccaaactttgacggcttggagtccaatccctatcgttctcgaaagcagcgtcaagagtgggaagtcaaagctctgttggagaaggtgccggcagagctgatctgcttggaccccagggccctggcagaagtggacgtaatatcactggagcagggcaaaaaggagcagatagagcggctgggatacgatccccaggccaaggcaccatttcagcccaaacccaaacagaaagggcgatcatctaccgcctcactggtcaagcggaagcgcaaggtgatggatgaggaacaccgggataaggtgagacagtctctgcagcaacagcaccacaaagaagcaaaagccaaaccaaccggagcgcggccttctgctttggatcgatttgttagatag

SEQ ID NO: 52347 - DNA, 2676 bp, Artificial Sequence
  Description of Artificial Sequence: Synthetic coding sequence
atgaccgccgaggagaccgtgaacgtgaaggaggtggagatcatcaaacttattttggactttttaaatagcaaaaaactgcatatttctatgctcgctcttgaaaaggaaagcggggtcataaacggcctattctccgacgacatgctatttttgcgatttcgttatatcattctgaagcaaaagttcctagaggcgctgtgcgtgaataatgcgatgtccgcagaagacgaaccccagcatctggagttcaccatgcaggaagcagtccagtgcctgcatgctctcgaggaatattgcccctccaaagacgactactccaaactgtgtttgctcctgacacttccgcggctaacaaatcacgcagagtttaaggattggaatccaagcaccgcaagggtgcactgcttcgaggaggcctgcgttatggtagcagagtttattcctgccgatcgcaaactctccgaggctggcttcaaggcttctaataacagactattccagctagtaatgaaaggccttttgtacgaatgttgcgtggagttctgccaaagtaaagcaaccggagaggaaatcactgaatccgaggttctactggggatagacctgctgtgtgggaatggatgtgacgatctggatctgtctctcctcagttggctgcaaaacctgccatctagtgtgttctcatgcgccttcgagcagaagatgctgaatattcatgtggataaactcctcaagcccaccaaagctgcttatgcagatctgttgactcccctcattagtaagttgagtccgtatccttcatcaccgatgcgccgcccccagagcgccgatgcttatatgacccgtagcttaaaccccgctcttgacggacttacttgcggcctgaccagccatgataagcggatctctgacctggggaacaaaaccagtcctatgtcacatagtttcgccaattttcactaccccggggtgcaaaatctgtctagaagcctaatgttggagaacactgaatgtcacagtatctacgaggagtctcctgagcgggatactccagtggacgctcagcgacctatcgggagtgaaatccttggacagtccagtgtcagtgaaaaggagcccgcaaatggcgcccagaaccccggacccgctaaacaagagaaaaacgagttgagggattccactgaacaattccaagagtactaccggcagcgattgaggtatcagcagcacctggagcagaaagagcaacaaagacaaatctatcagcagatgttgcttgaagggggggtgaaccaggaagatggaccggatcagcaacagaacctgaccgagcagtttctgaaccgttccatccagaaattaggagaacttaacattggtatggatggtctcggtaacgaagtaagcgcactcaaccagcagtgtaacgggtctaaaggcaacggaagtaatggctcttccgtgacctcctttaccactccgccacaggattcaagccagaggttgacccatgacgccagcaatatccacacatccaccccacgaaatcccggcagcacgaaccacatccctttcctggaggagtccccttgtggatcacagatttctagtgagcattctgtcattaaacctccgctgggggactctcccgggagccttagcaggagcaaaggagaggaagatgacaagagcaagaaacagttcgtatgcatcaatatcctggaggacacacaggctgtgagagcagtagccttccaccccgctggggggctgtacgcagtcggcagcaactccaagaccctaagggtctgcgcgtacccagacgtcatcgatccttctgctcacgaaacaccaaagcagcctgtggtgaggttcaagcgcaacaagcaccacaagggtagcatatactgtgtggcctggtctccctgcgggcagctcctagctacgggatcgaacgacaaatatgtaaaagttctccctttcaatgccgagacatgcaacgcaaccggcccagacctcgagttttcaatgcacgacggcaccatcagagatttggccttcatggaagggccggaaagtggaggggctatcctcatcagtgctggcgcaggcgattgcaatatttatactaccgattgtcagcggggtcagggcctgcacgccctgagtggacatacaggccacatcctcgctttgtatacatggtcagggtggatgatcgcatcggggtcacaggacaagaccgtaagattctgggatctcagggtacctagttgcgtgagggtagtgggtacgacattccatggaactggcagtgccgtggcttcggtcgccgtggatccctcaggtcggctactggcaaccggacaggaggatagctcctgtatgttatacgatatccgcggtggcaggatggttcagagctatcatcctcactcctcagacgtgcgtagcgtgaggttctctcctggcgcccattatttgctgactgggtcgtatgacatgaagattaaagtcaccgacctgcagggagatttaacgaagcagctaccaattatggtagttggagagcacaaggataaagttattcagtgtcggtggcacactcaggatctctcttttctcagttcctccgccgatcgcaccgtaacgttgtggacctacaacggatag

SEQ ID NO: 52348 - DNA, 2676 bp, Artificial Sequence
  Description of Artificial Sequence: Synthetic coding sequence
atgaccgccgaggagaccgtgaacgtgaaggaggtggagatcatcaagttgatcctggattttttaaacagtaaaaagctccatatttcaatgctagctctggagaaggagagtggcgtcattaacgggctatttagcgatgatatgctattccttagatttcgctacataattttgaagcaaaagttcctggaggctctgtgtgtgaacaatgccatgtccgccgaggatgaaccccagcatcttgagtttaccatgcaagaagctgtgcaatgtcttcacgccttggaggaatactgtcctagcaaggatgactacagcaagttatgtctgctgctgaccctcccgagactgacgaaccacgccgagttcaaggattggaatccttccacggcccgagtgcattgtttcgaagaggcctgcgtcatggtggcagaattcatacccgccgacagaaaactaagtgaggctggcttcaaggcttccaacaaccgcctcttccaattggtgatgaaggggttgttgtacgaatgttgcgttgagttttgtcagtcgaaggctaccggcgaggaaatcacagaatctgaggttctgctgggcattgatttattgtgcggcaatggctgtgatgatcttgacttatctctgttgagctggcttcagaacctcccttcctctgtcttcagctgtgctttcgaacagaagatgttgaatattcacgtggataagctgcttaaaccaacaaaggccgcctacgcggacctcctgacgccactgatctcaaagctgtctccctatccttcatctccaatgcggagaccgcagtctgcggatgcttatatgactcgtagcctgaatcctgcccttgacggactgacctgcggtctaacttcacacgacaaacgcatctccgacctggggaataaaacgagccccatgtcccattcctttgccaattttcactatccaggcgttcaaaacctgtcacgtagcctcatgttggagaacactgagtgccactctatctatgaagaaagccccgagagggacacgcctgttgacgcacagagaccaattgggtccgagattctcggacagagctcagttagcgaaaaggagcctgccaacggggcacagaatccaggccctgcgaagcaagagaaaaacgaactcagggattccaccgaacagtttcaggagtactatcgtcaaagactgcgctaccagcagcatctggagcagaaagagcagcaaaggcagatttaccagcagatgttactagagggaggcgtgaaccaggaagatggccccgaccagcagcaaaatctgacagagcagttccttaacaggagtatccagaagctgggagagttgaacattggaatggatgggctgggcaacgaggtaagtgctcttaaccagcagtgcaacggaagcaagggcaatggcagcaacggatccagcgttacctctttcaccaccccacctcaagatagtagccaaaggttaacacacgacgcttctaacatccacacaagtactcctcgaaaccccggatctacaaatcatattccttttctcgaagaaagtccatgcggtagccagatttcatccgaacactctgttataaagccccctctaggagactcccctggatccctgagccggagtaaaggggaggaggacgacaaatcaaaaaagcagttcgtgtgcatcaacatcctcgaggatacccaggctgtcagggctgtggcgtttcacccggccggagggttgtacgcggtcggatccaacagtaaaactctgagggtttgtgcttaccctgacgttatcgatccatcagcacacgagactccgaaacagcctgttgtcagattcaagcggaacaagcatcacaaaggaagcatctactgcgtcgcttggagcccctgcggacagttacttgcaactggttccaacgataagtacgtgaaggttctcccattcaatgccgagacgtgtaatgcgactggccccgacctcgaatttagtatgcacgatgggaccattcgggacctggccttcatggagggccccgagtccggtggcgctattctcatctctgccggagctggagattgcaatatctataccaccgattgccagaggggccaaggcttacacgctctcagcggacacactggtcacattctggctttgtatacttggagcggttggatgattgctagcggatcccaggacaagaccgttcggttctgggacttaagggtgccctcctgtgtgcgcgtagtaggaaccacttttcatggtaccggatccgccgtcgcgagcgtagcagtggatccctctggaaggctgctggcaaccgggcaggaggatagctcctgcatgctgtatgacattaggggaggtcgaatggtgcagtcttaccatccacattcttcagatgtccgcagcgtgcgctttagccccggcgcgcattatcttctgaccggcagttacgacatgaaaattaaggtcacggacctgcagggcgatctgactaaacagttacctatcatggtcgtgggcgagcacaaagataaagtaattcagtgcagatggcacactcaggacctgagtttcttaagctcgagtgccgataggacagtaaccctctggacgtataatggctag

SEQ ID NO: 52349 - DNA, 2760 bp, Artificial Sequence
  Description of Artificial Sequence: Synthetic coding sequence
atgaccgccgaggagaccgtgaacgtgaaggaggtggagatcatcaaactcatcctggatttccttaatagcaagaagctccacatttctatgctcgcactggagaaggaaagtggggtgatcaatgggctcttttcagatgatatgctattcctccgtcaattaatcctggatggacagtgggatgaggtcttgcaattcatccagcccctcgaatgtatggagaagttcgataagaagcggttccgttacataatactcaagcagaaatttctggaggccctttgcgtgaataacgccatgagcgccgaggacgaacctcaacacctggagtttactatgcaagaggccgtgcagtgtctgcatgcgctggaggagtactgcccttcgaaggatgactattccaagctttgcctgctcctgaccttgccgaggctgaccaaccatgcggagttcaaggactggaacccttcgaccgcccgggtgcactgcttcgaggaagcttgtgttatggtggcagagtttattcccgccgatcggaagctgtctgaagcggggtttaaagcatccaacaaccgtctgttccaacttgtcatgaaggggctcttgtacgagtgctgcgtggagttctgccagagtaaggctactggtgaagagattactgaatctgaagtgttgctcgggattgatttgctctgcggcaatgggtgcgatgacctggatttgagcttattaagttggctccagaacttacctagctctgtgtttagctgtgcattcgagcagaaaatgttgaacattcatgtcgataaattgctgaagcctacgaaagctgcctacgctgatttgctgacccctctaataagcaagctgagcccctatcccagctcgccaatgagaagaccccagtctgccgacgcctacatgacgaggtcccttaacccggctctggatgggctcacatgtggcctcaccagtcatgataaaaggataagtgacctgggcaataaaaccagccctatgtcccacagctttgctaactttcattacccaggggtgcagaatctgagtagaagtcttatgcttgagaataccgagtgccatagtatctacgaagaaagtcctgaacgagatacaccggtcgacgcccaaaggccaattggcagcgagattctgggccagtcatccgtgagtgagaaggaacccgccaatggagcccagaatcccgggcctgcaaagcaagaaaaaaacgaacttcgcgactccactgaacaattccaggagtattacaggcagaggttacgatatcagcagcacctggagcagaaggagcagcagagacagatttatcagcagatgctgctcgaaggcggagtgaaccaggaggacggacccgatcagcaacaaaacctcactgagcagttcctgaacaggtctatacaaaaactgggcgagctcaacattgggatggacgggctgggcaacgaagtctcggcactgaatcagcaatgcaacgggagtaaggggaatggtagcaacggcagttcagtgaccagctttacaacgccacctcaggattcttcacagcgactcacccacgacgcgtcaaatatccacacaagtaccccacgtaaccccggctcgaccaaccacataccatttctggaggagtctccctgtgggtcgcagatctcttccgagcacagtgtgatcaagccgcctctgggggattcaccaggcagcttgagccggtctaaaggcgaggaggatgacaaatcgaaaaagcaatttgtatgcatcaacattctggaggatacgcaggccgtaagggcagtggcattccaccccgccggagggctgtatgccgtgggctctaattccaaaactttgagagtgtgcgcttatccagacgttatagacccatctgcccatgaaacccctaagcagcccgtggtgaggtttaagcggaataaacatcataagggatccatttattgtgtggcctggtctccttgtggacagctactggcgaccgggtccaatgataaatatgtgaaggtgttaccctttaatgccgaaacatgcaacgctaccggaccagatctcgaattttcaatgcacgacgggacaatcagagatcttgcctttatggagggacccgagagcggcggagcgattctcatatctgctggagccggggactgtaatatctatacaaccgactgccaacgcggccagggattacacgcactgtcgggtcatacggggcatatacttgcactgtatacatggtctggctggatgattgcctctggctcacaggacaaaacggtcaggttctgggacctacgggtaccctcctgtgtccgggtggtcgggacaacctttcatggcactgggagcgcggtcgcatcagtagctgtggacccatcaggtcgcctgctcgcaacgggtcaggaggattctagttgtatgctttatgacattaggggcggcagaatggttcagtcctatcaccctcacagctcggacgtacgatcagtgcgctttagtcccggcgctcattatctcctgaccggaagctacgacatgaagatcaaggtgacagacctgcagggggatctgacgaaacagcttcccattatggtcgtgggtgagcataaggacaaagtgatccagtgcaggtggcacacacaggacctgtccttcctgagctccagtgccgacagaacagtgactctgtggacttacaacggatag

SEQ ID NO: 52350 - DNA, 2763 bp, Artificial Sequence
  Description of Artificial Sequence: Synthetic coding sequence
atgaccgccgaggagaccgtgaacgtgaaggaggtggagatcatcaaactgatcctggattttttaaattccaagaaacttcacatttctatgttggccctcgaaaaagaaagcggtgtgataaacggcctcttcagtgacgacatgctgtttcttaggcagctgatactggatgggcagtgggacgaggtacttcaattcattcagccgctggagtgtatggaaaagtttgataaaaagcggttccggtatattattttgaagcaaaagttcctcgaggccctttgtgtgaataatgccatgagtgccgaggatgagccccagcatctggaattcaccatgcaggaagctgtccagtgtcttcatgcactggaagagtactgcccgagcaaggacgactactccaagctctgtctgttactgacactgccaagattgacaaatcatgctgagttcaaggactggaatcccagtactgctcgcgtccactgctttgaggaggcgtgtgtcatggtcgccgagttcatcccagccgatcgaaaactatccgaagccggctttaaggcaagcaataatcggcttttccagctcgtcatgaagggactgctatatgaatgttgcgtggagttttgtcaaagtaaggccaccggcgaagagatcaccgaaagcgaggtgctgttggggatcgatctcttatgcgggaacggctgcgacgatctagatctgtccctcctctcttggctgcagaacttgccgtcaagcgtgtttagctgcgcctttgagcaaaagatgcttaacattcatgtagacaagttgttgaagcccacaaaagcagcttacgccgatctccttacgcccctgatctctaaactcagcccctacccttcctcacccatgcggcgacctcagtccgccgatgcctacatgacgagatcacttaaccccgccctcgacgggctgacgtgcggactgaccagccatgataaaagaatcagcgatcttggaaacaagacttcaccaatgagtcacagctttgccaattttcactaccccggcgtgcagaatttgtctcggtcccttatgctggagaacaccgagtgccattcaatctacgaagagtcccccgagaggtcagatactccagtcgacgcgcaaagaccaatcggctccgagattctgggacaatcctccgtttcagagaaagagcccgccaatggcgcccagaatccgggccccgccaagcaggagaagaacgagttgcgggactccacagaacagttccaggagtactaccggcagcgccttcggtatcaacagcatctggagcaaaaagaacaacaaaggcagatctaccaacagatgctgttggagggaggtgttaaccaggaggatggcccagaccagcagcagaacctgactgagcagttcctaaatcgctctatccaaaagttgggagagcttaacatcggcatggacggactcgggaatgaggtatcggccctgaatcagcagtgtaacggcagcaaaggtaatggtagcaatgggagctccgtgacgagctttacaacccctccccaggatagttcgcagaggctgacacatgacgcttccaacatacacacatccacccctcgcaacccaggctccaccaatcatattcccttcctggaggaatcaccttgcggatcccagattagctccgaacattccgtgatcaaaccccccctgggggatagccccggcagtctttctcgctccaagggtgaggaagacgacaaaagtaaaaaacagttcgtctgtatcaatatcctggaggacacacaagctgtacgggctgtggcatttcatccagcgggggggctttatgctgtgggaagcaactcgaagaccctccgtgtatgtgcttaccccgacgtaattgacccaagcgcacacgagacccccaagcagcccgttgtccgattcaaacgtaacaaacaccacaagggtagtatctactgcgtggcctggtctccttgtggccaactcttagcgaccggctctaacgataagtatgtcaaggttctccctttcaatgctgagacatgtaatgccaccggtccagatctggaattttccatgcacgacggcacaattcgtgatctcgccttcatggagggacccgagtccggaggcgccatactcatctctgcaggtgcaggcgactgcaatatctataccactgactgccaacggggtcagggcctccacgctctgtctgggcacaccggccacattcttgcactatacacctggtccgggtggatgatcgccagcggttctcaggacaagaccgtcaggttctgggatctgcgggtccccagttgcgtgagagtggttgggaccacctttcacgggactggatcagccgtcgctagcgttgcagtggatccctccgggcgattgttggctactggacaagaggactcctcatgcatgctttacgatatcagaggaggcaggatggtgcagagctatcaccctcattcaagtgatgtgcgaagcgtgagattttctcctggcgcccactatctcttgaccggctcctacgatatgaagattaaagtaaccgatctacagggcgacttgacaaagcagctgccaattatggtggtgggtgaacataaggacaaggtcatacagtgccggtggcatacacaggacctgagcttcttatctagtagtgccgatcgtaccgtcacattgtggacttacaatggctag

SEQ ID NO: 52351 - DNA, 2784 bp, Artificial Sequence
  Description of Artificial Sequence: Synthetic coding sequence
atgaccgccgaggagaccgtgaacgtgaaggaggtggagatcatcaaactaatccttgatttcctcaactctaagaagttgcatataagcatgctggcccttgagaaagaatccggcgtgatcaacggactgttctccgacgacatgctgttcttaagacaattgattctggacggacagtgggatgaagtgctccagttcatccagcccctcgagtgtatggagaaatttgataaaaagagattcaggtacattattttgaagcagaagttcctggaagcgctctgtgtgaacaatgccatgtccgcagaggatgagccccagcacgtcagattcctctttctcaagctggagtttaccatgcaggaggcggtccagtgcctgcacgctctggaggaatactgtccttccaaagatgattactccaagttgtgtctcctgcttaccctgcctaggctgacaaaccatgccgaattcaaagactggaacccctctacagctcgggtgcattgttttgaggaggcttgcgtgatggtggccgaatttatcccagcagacaggaagttgtccgaagcgggctttaaggccagcaataaccgccttttccagctggtgatgaaaggacttctatatgagtgctgtgtggagttttgtcagtccaaagccacaggcgaagaaattaccgagagcgaggtgctgcttgggattgacctgctttgcggcaacggatgcgacgatctagacctgtctcttttgagctggcttcagaaccttccgagtagcgttttctcgtgcgcctttgaacaaaagatgctaaacatccacgtggataaactgcttaaaccaactaaagctgcatacgcagacctcttgacaccccttatctctaaactgtccccatatccctcatcccctatgagacgcccccaaagtgcagatgcctacatgacgcggagcctaaatcccgcactggatggacttacctgtggcctcacctcgcacgataaacggatctctgacctggggaataaaacatcacccatgtcacacagcttcgctaatttccattatcccggggtgcagaatttatctcgcagtctcatgctggagaatacagaatgccactccatctatgaagaatcaccggagaggtccgacactccagtcgatgcccagcgacccattggatccgaaattctaggccagtcctcggtcagtgagaaggaacctgccaatggcgcacaaaaccccggaccggcaaagcaagagaaaaatgagctgcgggattccaccgaacaattccaggagtactataggcagcgattgaggtaccagcagcacctagaacaaaaggaacagcaacgacagatttatcagcagatgctactcgaaggaggtgtaaaccaagaagatggacctgatcagcagcaaaacttaacagaacagtttctgaaccgctctatacagaagctgggcgaactgaatattgggatggatggacttggtaacgaagtctccgcactgaaccaacagtgcaatggatccaagggtaacgggtccaacgggtcatcggtcacatctttcaccacaccaccgcaggactcttcgcagcgactgacccatgacgcctccaacatccatacgtccacacctcgaaacccgggtagcaccaaccacatccctttcctggaggaaagcccatgcggcagccagatctcatctgagcattctgtgattaaacctcctctgggcgattcccccggatctctgagtcggagtaaaggcgaagaagatgacaaatcgaagaaacagtttgtatgcattaacattcttgaggatacccaggcggtgagggccgtggcctttcatcccgctggaggtctgtatgccgtcgggtccaatagcaaaactctgcgggtttgcgcttacccagatgtgatcgacccgagtgcgcatgagacccccaagcaacccgttgtaagattcaaacgaaataagcatcacaagggcagtatttactgcgttgcatggagcccttgcgggcaactgctggcaaccggttccaatgacaagtatgtaaaggtactgcctttcaatgccgagacatgcaatgccaccggtccagacctcgaattctccatgcatgacggaaccattagagacctcgcatttatggaaggtccagagagcggcggagcaattctcatatcagcaggcgctggagactgcaatatctatactacggactgtcagcgcgggcagggcctccacgcactgtccggccacaccggtcacattttggctctctatacctggagtgggtggatgatcgcatcagggtctcaggacaaaaccgtcagattctgggacctgagagtcccatcttgcgttagggtcgtcggcacaactttccacggcaccgggagtgccgttgctagcgtggccgtggacccttctggacgactactagctacagggcaggaagatagcagctgtatgctgtatgacattagagggggccgtatggtccagtcttatcatccacatagctctgatgtgcggagcgtgcgcttcagccccggtgcccactacttgctcacggggtcttacgatatgaaaatcaaagtcacagaccttcagggggatctgacaaagcagttgccaattatggtcgtgggcgagcataaggacaaagtcatacagtgccgctggcacactcaggaccttagctttttgagctcgtccgccgacagaaccgtaactctatggacatacaacggttag

SEQ ID NO: 52352 - DNA, 321 bp, Artificial Sequence
  Description of Artificial Sequence: Synthetic coding sequence
atgaccgccgaggagaccgtgaacgtgaaggaggtggagatcatcaagttgatccttgactttttaaactctaagaagctgcatatatcgatgctggccctggaaaaagagtcaggagtgattaacggattgttttctgacgatatgttatttcttcggcagctaatcttggacggccagtgggatgaagtcctccagttcatccagccactggaatgcatggaaaagttcgataaaaaacggtttcgctatataatcctgaagcaaaagtttctcgaggctctgtgcgtcaacaatgcaatgtccgcagaggatgagtag

SEQ ID NO: 52353 - DNA, 522 bp, Artificial Sequence
  Description of Artificial Sequence: Synthetic coding sequence
atgaccgccgaggagaccgtgaacgtgaaggaggtggagatcatcaaattaattctcgattttctgaacagcaaaaaactccacatttcgatgctggctttagaaaaagaaagtggcgtcatcaacggcctcttttcagatgatatgctgttcctgcgacagctcattctggatggccagtgggacgaagtgttacagttcattcaaccattggaatgtatggaaaagtttgacaaaaagcgcttccgttatatcattctgaagcagaagtttcttgaagcactctgcgtgaacaacgcaatgtcagcagaagacgaacctcagcatttagagtttacaatgcaggaagcagtacagtgcctgcatgccctggaggagtactgtccaagcaaagatgattattccaagctgtgtctgttgctaaccttgccacggctcacaaatcacgcagagtttaaggattggaatccttctactgccagagtgcactgctttgaagaagcttgcgtcatggttgcatag

SEQ ID NO: 52354 - DNA, 2094 bp, Artificial Sequence
  Description of Artificial Sequence: Synthetic coding sequence
atggcctggcgggagaagagcaagaagcggctgaacatgaccagctttaacatcgcacaaggaatccacgcattcgactaccattccagacttaaccttatcgcaaccgcagggatcaacaacaaggtgtgtttgtggaacccatatgtagtgtccaaaccggttggggtgctgtggggccactctgccagcgtgattgcggtccagttttttgtagagcgtaagcaacttttttcattcagcaaagacaaagtcctgaggctgtgggatatccagcatcagctgtctatacagcgtatagcgtgtagctttccaaagagccaggacttccggtgcctgtttcattttgatgaagctcacggaagactcttcatcagctttaataaccagcttgcattactcgcgatgaagagcgaagcctcgaagcgagtgaagagccacgaaaaagctgtgacttgcgtgctgtataacagcattctgaaacaggtgatttctagtgacaccggatccactgtctccttctggatgatagacactggccagaagatcaagcagtttacagggtgccatggcaatgcagaaatttcaactatggcgctggatgccaatgaaacccggctgctgactggcagcaccgacgggactgtaaagatctgggacttcaacggatactgccaccacacgctgaatgtggggcaggacggggccgtggatatctcacagattctcattctcaagaaaaagattctggtgacgggttgggagcgcgcaatcacagtctttagaccccagaattttaaccagtttttcattcagccagaggagtggaagggagggatccagcaccacgacgatatcctgtgcgccgccttcttgcctcctcagacactcgtaactggctcatacgacggagagattgtgttgtggaataactctaccgaaaatgcgcatcacgtcctgcatcctgattaccagaggctgctgaagtccaagctggacaccaagcctcagaagctactttcggccggaagaagccagccttcccacccgatggctgaccattctaccactggagttcgaaatttcgagatcgacacagaaggaaagaatgctgtaatgcgcctctgctttctcaaagcgcggaagaataccgctgttaccggcggggcaaacctggtgagctgcgggggatccggatacgttcgattttgggatatatataagaagcaactgttagccgaatttcttgcacattccggcgtgggtagcattattatgtctacagacaagatgaaccgctacctgacaaccggggacctcgacggctggttgaagatctggaacatcgaggagtactgtcttaactcttccaagaataaaattacaaaagcccctacacttattagatcgttccagcctcacgaggatagaatcagctcccttgaaatgtgcgaacctggtgggcagttgcttattatttcctcttccgcggactgtagcatttgcgttacaggtgtctgtaacgcccctgtgtggatttttgggcaagctaaacactggcatatcgagaactgcctttttctgcctaagagagacaccaacctcgtagagtcagagattcagaaagagatatccctgttcagcaaagaggaatcatgcctggatcccacagagcattcattgctgaacaagaagaataaagatgacagcacttacaatgtcagaccttctgaagatatcaacctggacatcaaatataaggaaaggtccacttgcatgaaagaaacccaaaaaccatactatggagaggtcatcaagaaatctttctctactttcaggtcactcaatattggcgccttggaggaactcccagaggtgaataaacccgcgtttctcctggaccccgagaagtactttcggaaggagccagaggaggaacgacctcaaatattggaggcaccatctttatttaagacgctaaaggcggtattcgatgagaaaaacctctttccaaaagagattctgcaccacgagcggaaggctaagcagctctgccaggagaagagctgcgaggtgaagaaaaataaaaagtag

SEQ ID NO: 52355 - DNA, 1989 bp, Artificial Sequence
  Description of Artificial Sequence: Synthetic coding sequence
atgaccatcaactgggccgagctgctgagcggctgccacaagtgctgccacattctggagcataaactgcatcagggtgattgggtcagacaggtgacatacaatgcatcattagatgccatcatctcatcgaccacgtcgaacaccaacagcgttgtcatggcctggcgcgagaagagcaagaagcgtctaaacatgacgagtttcaacatcgcccaaggtatccacgccttcgactaccattctcggcttaacctcatcgccaccgccgggattaacaataaggtttgcctctggaatccctatgttgtcagcaaaccagtgggcgtgctctgggggcacagcgcttcagtcatcgccgtccagtttttcgttgagcggaagcaattgttttcattttctaaggataaggtgttacgtctatgggatatccagcaccaactcagcatacagcggatcgcttgcagcttccctaagtcccaggattttaggtgtcttttccacttcgacgaagcccatggacggctgtttattagcttcaataatcaactggcgttacttgccatgaaatccgaagcctcgaaacgggttaagtctcacgaaaaagccgtgacctgcgtgttgtataactcgatcctgaaacaggtgattagcagcgacacgggttctacagttagcttctggatgatcgacaccggccagaagatcaagcagttcactggatgccacgggaacgccgagatttcaaccatggcccttgatgccaacgaaacgcgcctgctgacgggcagcaccgatggcacagtgaagatttgggactttaacggttactgccaccacacacttaatgtcggtcaggacggcgctgttgatattagccaaatcctgatactgaagaagaagatcctggtgaccggctgggagcggtacgactatgcttcttggaaaaccataggtcgggctataactgttttccggccccagaacttcaaccagttctttattcagccagaagaatggaagggtgggatccagcaccatgacgacatcttgtgtgctgccttcctgccaccccagacactcgtcacaggttcctacgatggagaaatagtgctatggaacaattctactgagaatgcccaccacgtgctgcatccagattaccagcggctgctgaagtcgaaactcgacaccaaaccccagaaactgttgagcgctggcaggagccagcccagccaccctatggctgatcacagtacgaccggagtgagaaacttcgaaatagacacagagggcaaaaatgctgttatgcggctctgtttcctcaaggcgcgcaaaaacaccgctgtaactggcggcgccaaccttgtgtcttgcgggggcagtggatacgttagattctgggatatttacaagaagcagctcttagccgagttcctggctcattcaggggtggggagtattatcatgtcaactgataaaatgaaccggtatctcaccactggggacctcgatggctggttgaagatatggaacattgaagaggagtcgtgcctcgatcctaccgaacactctttgctgaataagaagaacaaggatgattccacatataacgtgcggccctcggaggatatcaacctggatattaaatataaggagcggtccacctgcatgaaagagacacagaagccatactatggagaagtgatcaaaaaatcctttagtacgttcaggtccttgaacatcggcgcccttgaggaattgcctgaggtgaataaacctgcttttttactcgaccccgagaagtattttcgaaaagagcctgaagaggaacgcccgcaaattctagaagccccgtctttatttaagacactaaaagccgttttcgacgagaagaacctattccctaaggagatactccaccacgaaaggaaggccaagcagttgtgtcaggaaaagagctgcgaggtgaaaaagaacaaaaagtag

SEQ ID NO: 52356 - DNA, 2949 bp, Artificial Sequence
  Description of Artificial Sequence: Synthetic coding sequence
atgaaggagcccgacgaccaggacaccgacggcgagaagagcgtgacctccaaatctgacggcaaaaaatctcttaggtcctccaagtccgagagccgcagtccagtgcaggaggacaacactttcctggaggacgatacggatgaaacatttactaagggcgagggctcttacctggaggaggattccgatgaggaaagactagagggaagtctgtccagttttcaatatggagacctccagtcaacaactgtgcctcagcagactcctgccccggctgtggaagaggcagaagaggaggtgaaaaagaagatttctgagtcttttttctatgattacatggaactggcgagcatgccttttgtgacactggactctaacattcctctggatcttctgacccttgtgcattctttcggatatgattgtcgaaaaagggccaatctacagctgctggacgatagcatcgctatctacattgcaggaaatcagctgatcttcctgaacttaaagacaaaagaacagatctacttgcgtagctcctcaggtgagggaattggcgtgattggagtgcatcctcacaaaacctactttactgtggcagagaaagggtcatttcctgatatcattatctacgagtacccctccctgaggccgtatcgagtcctcagagatgggactgagaaggggtatgcctatgttgattttaactacagtggcaacctcttggcctccgtgggatctaaccctgactatacactgactatttggaactggaaagaggaacagcccatcctcaggacgaaggcgttcagccaggaggtctttaaggtcaccttcaaccccgataaggaggagcagctaacgacgagcggatccgggcatattaagttttgggagatggccttcacttttacagggttgaaactccaagggtcgcttggacgtttcggaaagacaatcaccaccgatattgaaggatatatggagctgccagacggtaaagttttatctggctccgagtggggcaatatgctcctgtgggagggcggtttgatcaaagttgagttatgcaggggtacgagcaagtcctgccacaacgggccaatcaaccagatcatgctctacgagggcgaggtcatcacggtggggagtgacggctacgtgagaatttgggactttgagaccattgataccgccgacgtgatcgacgagaccggattgctggagatcgagcctatcaacgagttgcaggtggacaagaacgtcaacctgttctccatgatcaagatgaacgagaccgggaataacttctggctggctcaggatgctaacggtgctatctggaagctggacctgtctttcagcaacattacccaggatcccgaatgtttatttagctttcactctggcgccattgaggctgtcgccgtgagcccactgacttatctcatggccactaccgcgctggattgttctgtgaggatctacgactttgcctctaagacccctttggcacaaatgaaattcaagcagggggggacagcgttggtgtgggtgccaaggatggtgaactttacaggggcccagatcatcgtcgggttcgaagatggcgtggtgagaatcttagagctgtacgacccaaaaggactgaccatcttcgcagggaggaagaagattctggacgctgacatacaactgaaacaggtgtttaaaccacacaccgcatgtgtgacagctctcgcctacgaacgcgatggagaaattcttgcgacaggctccaaggatcagaccgtgttctttttcgaggtggagagagattacaaaccaattggatatataaacacgccaggacccgtgtgtcagctgatgtggtcccccatgagtcatcctgagtcaaccctgcttataatttgcgaaaatgggtatattttggaagcaccccttccgacaatcaagcaggaagaagacgaccatgatgtggtgtcgtacgaaataaaggacatgtgcatcaagtgcttccatttctcttctgtaaaatctaaaatcctgaggctgattgaaatcgagaagagggagcggcagcgtgagctgaaggagaagatcagagaagagcgaagaaataagctggccgccgagatgggggaggatggtgagaaagaattccaggaagaggaagaggaaaaggaggaggaggaagaagaagaagaaccgctaccggagatctttatcccttccaccccttcaccgatcctgtgcggtttctactctgaacctgggaagttctgggtctctttggggggatacgattctggtttcctgtaccactgcgagtttccgccttgtgatgaaagctctgactttaaagaacagaaagacgagccgatcgatgttcggtacctggcggacacagaagacaacccaattcagacgataacttttaacattaataaagtgatgatgttctgtgggatgaaaaatggggcaatccgcgtttatgtccttaaccagaacgacccaagtctgaccagtttagtggactattggcacttcaatatgcacgacaacaactacggctgtatcaagtccatagcaaatagcttcgatgaccgtttccttgtaactgccggggcagatgggaatatatttgtgttcaatatcttttccgagtttatgctcaggaaagatatgaaggcgaaggtcccctcaccaaggttcggaatagagacggagcccatcccagaagatattgaggacccaaaggcttattctattgagaacgcgcgtaggaagcgcgagcacgacaagcttatgaaagaggtgggcgagattaaagcgagaaaaagagaacaaatcaaagccttgaggagtgagttctgcaatttgctcgagatgaatgagaaactcccaaagcatatgcagttcaaacggacagtaagtctgatctag

SEQ ID NO: 52357 - DNA, 1206 bp, Artificial Sequence
  Description of Artificial Sequence: Synthetic coding sequence
atgaagctgagcgacctgcaccacgtgaccctgttccaggagatcctgctcttaaaaaattttgaaaagcaagaaaatatcctgcaggaacgggtgaacagcctggacaaggaggaacaatatatgcagtggaagattaatgagacattgaaagagatggaagagaaaaagaacgagataacgaagctgcaggagcaggagaaggccttatatgcaggcttccaggccgccatcggcgaaaacaacaagttcgcgaactttctcatgaaagtgctgaaaaagaagatcaaaagggtgaaaaagaaagaggtcgagggagacgctgatgaagacgaggaaagtgaggagtctagcgaagaggagtcctccctggaatccgacgaggatgagagcgaaagtgaagatgaagtcttcgatgatagcatttgccctacaaattgcgacgttgcactgttcgaattagctcttcacctgagggagaaacgtctggacattgaagaagctctggtagaggagaagaagatcgtggacaatctgaagaaagagtacgatacccttagtaagaaggtgaagatcgtggccactaacctgaacgcagcagaagaagccctagaagcctaccaaagggagaagcagcagaggcttaatgagctcctcgttgtcattccgctcaagctgcaccagatcgagtatgtagtgttcggcgaaataccatcagatctctctggcactctggtcttttctaatcacgccctccggcgcctgcaggaacggattcatgaactgcaggaagaaaattcaaagcagcaaaaactgaataaggagtggagagaacgtaggaagcagctgatccgtgaaaagcgggagatgaccaaaacaatccacaaaatggaagagacagtgagacagcttatgatatccaagtttggaagggtggttaaccttgaagcccttcagacgctatctgtcaacacaactctggaggagctcaagatacggaaactgaggaaagagttggcaaatgcaaaggagatgaaaatgtgggaggagaagatcgcgcaaatgaggtgggagttgatgatgaagacaaaagagcacacgcgcaagctctatcagatgaacgacttatgtatcgagaaaaaaaaactagacagccggttgaataccttgcagaatcagcagaacccagggaacggattgagctag

SEQ ID NO: 52358 - DNA, 5565 bp, Artificial Sequence
  Description of Artificial Sequence: Synthetic coding sequence
atgaaggagcccgacgaccaggacaccgacggcgagaagagcgtgactagcaagtctgacggaaagaaaagtctgcgaagctcaaagtccgaaagccgcagccccgtacaagaagacaatactttcttagaagacgatacagacgagacattcacaaaaggggaaggatcttatctggaggaggatagcgatgaggagagactagagggcagcttgagttcttttcagtacggtgatctacagtctactactgtgccacagcaaacccctgctcctgccgtggaggaggctgaggaggaggtgaaaaagaaaatttcagagtcttttttctatgactatatggaactcgctagtatgcctttcgttacgttggatagtaacattccgcttgatctcctaaccctggtgcacagcttcggttacgattgcaggaaaagggccaacctgcagctcctggatgacagcattgccatttatatagccggaaatcagctcatctttcttaacctgaagaccaaggaacagatctatttgcgcagctcgagcggtgaaggaataggcgtaataggcgtacaccctcacaaaacatattttaccgttgccgagaagggtagcttcccagacattattatttacgagtatccttccctccgcccctatcgggtgttaagagacggtactgaaaaagggtacgcatatgtcgatttcaattacagcggcaatctgctcgcttctgtcggatctaaccctgactacactctcaccatttggaactggaaagaggaacaaccaatacttcgcacgaaggcattctcccaggaagtatttaaggtcacttttaacccggacaaagaagaacagttaacaacgtcggggtccggccacatcaagttttgggagatggcattcacatttaccggccttaagctccaggggtctttgggtcggttcggtaagaccatcactacagatattgagggctatatggaacttcccgatggtaaggtgttaagcggatctgagtggggcaacatgctgctgtgggagggcggactgatcaaagtggagttgtgccgcggaacgagcaagtcttgtcacaatgggccgataaatcagatcatgctctatgagggagaggtaatcactgtcggatcagacggttacgtcaggatctgggatttcgagacaatagatacagcggacgttatcgacgaaaccggcctgctggagattgagccaatcaacgagctgcaggtggacaagaatgtcaacctcttctctatgatcaagatgaacgagacgggaaataatttttggcttgcacaagatgccaacggtgcaatatggaagctcgacctaagtttttctaatatcacacaagacccggaatgcctcttcagctttcatagcggcgccatcgaggcggtcgcggtctcccctcttacctacctgatggccacgaccgcactggactgctctgtgcgaatttatgactttgcgagcaagacccccctggcgcagatgaaattcaaacaggggggcacagctttagtatgggtgccccggatggtgaattttacgggtgcccagatcattgtcgggtttgaggatggggtcgtacgaattctcgaactctacgatcccaaggggctgaccattttcgccggcagaaagaaaattcttgacgccgacatccaattgaagcaggtgtttaagcctcataccgcctgtgtgactgctctcgcttacgagagggacggggaaatcttggctacgggatctaaggaccagaccgtgtttttttttgaggtggagagggactacaaaccaataggctacatcaacacacctggacccgtgtgtcagctgatgtggagccctatgtctcatcccgaatctacgctcttaatcatatgcgagaacggatatattcttgaagcgccgcttccaaccattaaacaggaggaggatgatcacgacgttgtttcttatgaaattaaggacatgtgtatcaaatgctttcacttttctagcgtcaaaagcaaaatcttgcgcctcatcgaaattgaaaaacgcgagaggcaacgggagctcaaagaaaagatccgagaagagcgtcgtaataaactggccgccgaaatgggcgaggacggagagaaagagtttcaggaagaagaggaggaaaaggaggaggaagaggaggaagaagaaccccttcccgagatcttcattcccagcaccccaagcccgattctctgcggcttctacagcgagcctgggaaattttgggtctccctgggtggctatgatagcggctttctctatcattgtgagtttcctccgtgtgatgagagctccgattttaaggagcagaaggacgaaccgatagatgtgaggtacctcgccgacactgaggacaaccctatccaaacaattacctttaacattaataaggtaatgatgttctgcgggatgaagaacggggcaattcgagtatacgtgctgaatcagaatgacccgtccctgacgagtctcgtagactattggcatttcaacatgcatgataacaactatggctgtatcaagagcattgctaactctttcgacgaccgtttcctggtgaccgccggggccgacgggaacattttcgtgtttaacatcttctcagaattcatgttgaggaaagatatgaaggccaaggtgccgagcccccggtttggtatcgaaacagaaccgattcctgaagacatcgaagaccctaaagcatatagcattgaaaatgccagacgcaaaagagaacacgacaagttaatgaaggaagtgggagaaattaaggctcgtaaaagggagcagattaaagccctgcggtccgagttctgtaaccttctcgagatgaatgaaaaactgccaaagcacatgcagttcaagagaacagattttgacgttgactcacagatacgggctgaaatgcacaggaaaaccgcatttaaaatccagcaggtggagaaggaactcgcatgggaaaaagagaaacatgagctcgggttgatgaagttaaagaacagattcagagacccgctggaaagtgacactatcgtggtgcatgccatcctctctgatcacaagatctcatcataccgactggtgcagccctcgaaatacagcaagttcaaaagggcgtcccaatcagaaagaaagcctagcaaactagataggtttgagaaagagggcccaggccggaaggattctcagagggatgcgggtgggagtgtaacaatccaggaagaatctatcattgaaaagggtaagaaatttcgccctaagaccttgagcgagatcattgtggagaatcagatcgagaaaactcgaaaactgattctgaaggctgagcgggctcagctgaagattcagcagagaaagaaggagtgggaagaactctacaagagcaaaccaggcgacgactatgaagacccaaaggacttgcaggcaataaaggaggcccaggtgtacatgggagatttcaatctgaaaacagccccagactacaagatcccagagcacatgaggattaatgccgccaagaaggaagaagagttgggacatctggactccctggtgcacgggaataagagacacatgaataagtgcatcctgagcctgagggatttgaaggtggcagttgtggaggaaatccagtgtctggtccaggaacttaagaacatccagagcactttgcatatatccaaacatatccctattcccaagatcccacaaattcatcctgaggaagtgccagagaaaagatttcagtacgacgaagaaacattactcaattttaaacagcagcagatgaagagtaaagacgaaaagagtccgggggtcgagcagaccggaagtggaggccctgtgggggggttcctcaaactcagttctagaaaggatggtgacctaaccacacgcgactccatctcgcgctcatccaaggcaagcaccttttctctggacatccctaagtgtcttgagtttgagaaggccgagccaacggacgtagaactggagatcatgaagcgtgatgaaattaaacacgtgtatatgcagcagtatttggtgaaccggattaaagagttggtcgtgaccttcgatgctgaattgagactgctaagacaccagaagctgaagctcgacacccaaatgaagctcagcgaccttcaccatgtgacgctgtttcaggagatcttgttgctcaaaaactttgagaagcaggaaaacatcttgcaggaacgagttaatagcctggataaagaagaacaatatatgcaatggaagattaatgagacgttgaaagagatggaggaaaagaaaaacgagataactaaactccaagaacaggaaaaggcgctttacgccggatttcaagccgctataggagagaataacaagtttgccaattttctcatgaaggtgctaaagaagaagatcaaacgcgtcaagaaaaaggaggtggagggagacgcagacgaggacgaagagtcagaggagagctctgaggaagagtctagcctcgagtctgacgaagatgaaagcgagtctgaagacgaagtttttgacgattctatctgccccactaactgcgatgtggccctgttcgagctcgcccttcacctccgcgaaaagagattggatattgaggaggctctcgtggaagagaaaaagatcgtggacaatctgaaaaaggagtatgatacactgtccaaaaaagtgaagatcgtggcaaccaacttaaatgcagctgaggaggccctggaggcatatcagcgtgaaaaacagcagaggctgaacgagctgctggtcgtcatcccactcaaattacaccagatcgaatacgttgtgtttggggaaattcctagcgacttgagcggtaccctggttttttccaatcatgcactgcggagattgcaagaaaggattcacgagctgcaggaagagaactcaaaacagcaaaagctgaacaaagaatggagagaacggcgtaagcaactcatcagggaaaagcgtgaaatgaccaagacaatccacaagatggaagaaactgtaaggcaacttatgatctcaaaattcggacgcgtggttaacctggaagctttgcagactctcagcgttaacacaaccctggaagagctgaagatccgtaagcttaggaaagaacttgccaacgcaaaggagatgaagatgtgggaagagaagatagcacagatgaggtgggaactcatgatgaaaaccaaagaacacacaaggaagttgtaccagatgaacgatctttgcatagaaaaaaaaaagctcgattctagactgaacaccttacagaaccagcaggggaacgcgtttcagggtcccagagaagcggacgtggtagccagagaggaggttactgagcttattcagctgcaagcggaacgcatttccgccctcaaggaagaaattgccctgctaagaaggaagggcagcctcatcctccccccaattcagagtccaagagaaaaggagattcagcctgcagacctgtag

SEQ ID NO: 52359 - DNA, 255 bp, Artificial Sequence
  Description of Artificial Sequence: Synthetic coding sequence
atgaaggagcccgacgaccaggacaccgacggcgagaagagcgtgacgtctaagtcagacggtaaaaaatctctccgctccagcaagtctgaaagccgatctcctgtccaggaggacaatacattcctggaggatgacacagatgaaactttcaccaagggcgaaggctcttatttggaggaggacagtgacgaggagcgcttggagggcagcctttccagcttccagtatggcgacctgcaaagtaccacgtag

SEQ ID NO: 52360 - DNA, 1077 bp, Artificial Sequence
  Description of Artificial Sequence: Synthetic coding sequence
atggccgtgaagtggaccggcggccacagcagccccgtgctgtgcttgaatgcctcaaaggagggcttgctggcctcaggggcagagggcggggaccttaccgcgtggggggaggatggcacaccgctgggccacacacgtttccagggagccgacgacgtgacctctgtgctgtttagtccctcctgtcctaccaagctgtacgcctcccacggagaaaccatttcagtacttgacgtccgctccctcaaagactccctagatcattttcacgttaacgaggaggagattaactgtttgtccctgaaccagaccgagaatctgctggcctctgctgatgacagcggagcaataaaaatcttggacttggaaaataaaaaggtaataaggagcctcaaacgtcactccaacatttgctctagcgtggccttcaggccacagagaccgcagagcttagtgtcatgtggactggacatgcaagtcatgttgtggtccttgcagaaagcccggccgctctggataaccaatctccaggaagacgagactgaagaaatggaagggccccagtcccctggccagcttcttaatcccgcccttgcacactcaatctcagtagcatcatgcggcaacatattcagttgtggagccgaagacggcaaagtaagaatctttcgggtgatgggagtgaaatgtgaacaggagctgggctttaagggccacacctcaggggtgtcccaagtctgctttctgccggagagctatcttctgcttaccgggggcaacgatggcaagataacattgtgggacgcaaattctgaggtggagaagaagcagaagagtcccacgaagaggacacatagaaagaagcccaaacggggcacttgcactaagcaggggggcaacaccaacgcttccgtaacagatgaggaagagcatggcaatatacttccaaaactgaacatagagcatggtgaaaaggtcaactggctgctgggcactaaaatcaaaggacaccaaaatatcctggtggccgatcaaacaagctgcatttcagtctacccattaaatgagttctag

SEQ ID NO: 52361 - DNA, 465 bp, Artificial Sequence
  Description of Artificial Sequence: Synthetic coding sequence
atggccgtgaagtggaccggcggccacagcagccccgtgctgtgcctgaatgcttcgaaggaagggctcctggcttcaggagccgagggaggtgacctgactgcatggggagaggatggtacgccgcttgggcacacccggttccaaggagccgatgacgttaccagcgtgctcttctccccatcctgtcccaccaagttgtacgccagccacggcgaaaccatctctgtgcttgacgtgcgatcactgaaggattccctagaccacttccacgtgaatgaagaggagattaattgcctcagtctgaatcagacagaaaatcttctggccagcgctgatgattcgggtgccattaagatcctggacctggaaaataagaaagtgatacgctccttgaaaaggcacagcaatatctgctcatccgtggcattccgccctcagcgcccccagtcactggtgagctag

SEQ ID NO: 52362 - DNA, 483 bp, Artificial Sequence
  Description of Artificial Sequence: Synthetic coding sequence
atggccgtgaagtggaccggcggccacagcagccccgtgctgtgcctgaacgccagcaaagaaggtctgttagccagtggggctgaaggaggggacctcacagcttggggggaagacggcacacccctgggtcacactagattccagggagcagatgacgtgacaagtgtgctatttagccctagttgcccaaccaagctgtacgcatctcacggcgagactataagcgtgctggacgtgcggtccctaaaggattcgctggaccacttccacgtgaacgaggaggagatcaactgcctctctctgaaccagactgaaaatctccttgcttccgcagacgacagcggggctataaagattctggacctggagaacaagaaggtgatacgctctctcaagagacactcgaatatttgttcctccgtggcattccgaccgcagagaccccaaagccttgtttcctgtggactggacatgcagtag

SEQ ID NO: 52363 - DNA, 1005 bp, Artificial Sequence
  Description of Artificial Sequence: Synthetic coding sequence
atgttccggtgggagcggagcatccccctgcggggcagcgccgccgcactgtgtaacaatctgtctgtactgcagctccccgcgagaaatctgacctacttcggagtggtgcatggcccttcagctcagttgctgagtgcggctccagagggcgtgccactggcccagcgccaacttcatgcaaaagagggcgcaggggtgtcaccccctctgatcacccaggtgcattggtgtgtgctgcccttcagggttctgctcgttctgacatcacatcgcggcatccagatgtatgagtctaatggttacacaatggtgtactggcacgcactggatagtggggacgcatcccccgtccaggcagttttcgcccgcgggatcgctgcatccgggcacttcatttgcgtgggaacctggagcgggcgagtcctagtgtttgacattcctgctaaggggcctaacatcgtgctgtcagaggaactggccgggcatcagatgcccatcactgatattgcaactgaaccagcacaggggcaagattgcgtcgccgatatggtaaccgccgatgactctgggttgttgtgcgtgtggcgatctgggcctgaattcactctcttaaccaggatccctggctttggcgtgccctgtccatccgtgcaattgtggcagggcataatcgcagcagggtatggcaacgggcaggtgcatttatacgaagctaccactggaaatctccatgtgcagattaacgcccatgcccgcgccatttgtgctcttgatttggcttctgaggtagggaagctcctcagtgctggagaggacacatttgttcacatttggaagctttctagaaatcctgaatccggctatattgaggttgagcactgtcacggtgagtgcgtggctgatacccagctgtgcggagctcggttttgcgattcatctggaaatagctttgctgttacgggttatgatctcgccgagattcgccggttttcttctgtgtag

SEQ ID NO: 52364 - DNA, 2925 bp, Artificial Sequence
  Description of Artificial Sequence: Synthetic coding sequence
atggccgcccggtggagcagcgagaacgtggtggtggagttccgggactctcaggcaacagctatgtccgtggattgtttgggccaacacgctgtgctgagtggacggcggtttctatatattgttaatttggatgccccattcgaaggccatcggaagatctcacgacagtcgaaatgggatattggagccgtgcagtggaatccccatgacagctttgctcattatttcgccgcatcttcaaaccagagagtcgacctgtataaatggaaggacgggtcaggcgaggtggggaccaccctgcagggccacacccgcgtgatctcagatctggattgggccgtatttgagcctgacctgttagtcactagcagtgtggacacgtatatatacatatgggacatcaaggacactagaaaacccacggtggcattaagcgccgtcgccggggccagtcaagtcaaatggaacaaaaaaaatgctaactgtctggctaccagccacgacggggacgtccgaatctgggacaagcgcaagcccagtactgcggtggagtacctggctgcccatttgagcaagatccacgggctggattggcatcctgattctgagcacattcttgccaccagctcacaagataacagcgtcaagttctgggactaccggcagccccgcaaatatcttaacatacttccctgccaggtcccagtgtggaaggcaaggtatactccattctctaacggtctggtgaccgttatggtgccccagctgcgcagagaaaacagtcttttgttgtggaatgtattcgatctgaatacaccggtgcacacgttcgttggccatgatgacgttgtgctggagtttcagtggaggaagcaaaaggaagggtccaaggattaccagctggtgacgtggtcaagggatcagaccctgcgcatgtggcgcgtggacagtcagatgcagagactatgtgccaatgatattctcgatggagtcgatgagttcatagagagcattagcttgttgcctgagcccgagaagaccttacacacggaggacaccgatcaccagcataccgcctcccatggagaggaagaggccttgaaggaagatccccccagaaacttgctcgaggagcggaaaagcgaccagctagggcttccccagactctgcagcaggagttcagtttgataaatgttcaaatccgcaatgtcaacgtggaaatggatgccgccgatagaagttgtaccgtgtctgtgcactgctctaaccacagagtgaaaatgttggtgaaattccctgctcagtacccaaataacgccgcacctagctttcaatttattaaccccaccaccatcacatcgacaatgaaagctaaactgctgaaaattctcaaagatactgctcttcagaaggtgaaacgtggccaatcttgtctagagccctgtctgagacagttagtatcgtgtttggagagctttgtcaaccaagaagactccgccagctcaaatccttttgctttgccaaattccgttacgcccccgctgcctacgttcgcacgggttacaaccgcctatggctcctaccaggatgcaaacatccccttccctagaacatccggggctaggttctgtggggcgggctacctggtgtatttcacacgtccgatgactatgcatcgggccgtcagtcccactgagcccactccgcgttccctttctgcgctctccgcctaccacactggccttattgctcccatgaaaatacgcacagaggccccaggcaatctcagactgtacagtggcagcccaacccgcagcgaaaaggaacaggtctcgatttcctccttctattacaaagagcgaaagtccaggagatggaagagcaagcgcgagggctcagatagcgggaaccgacagatcaaggctgcgggtaaagtaataatccaggatatcgcctgcctgctacccgtccataagtccctgggggagctctatattcttaacgtcaacgacatccaggaaacctgccaaaagaacgccgcctctgcactgttggtcggacgcaaagatctcgtacaggtgtggtctctggctactgtggctaccgatctttgtctgggccccaaatccgacccggacctggaaactccgtgggctcgacatcccttcgggcgacaactgcttgagtcacttttggcccactactgtcggctgcgggacgtccagacactggcgatgctatgcagcgtgtttgaagctcagagtcgaccacagggcctccccaaccctttcggcccctttccgaataggagctcaaatttggttgtctcccattcacgctatccatctttcactagtagcgggagctgcagctcaatgagcgacccgggcctgaatacagggggctggaacattgcgggcagagaagccgagcacctgtcatctccatggggtgaatcgtcccccgaagagctgcgtttcggttcattgacgtactccgaccctagagagagggagcgggaccaacacgataaaaataagaggttgcttgatcctgccaacacacagcagtttgatgattttaagaagtgctatggtgagatattataccgctgggggctccgtgaaaaacgggcggaagtgcttaagttcgtgagctgtcccccagacccgcacaagggcattgagttcggagtatattgctcccactgccgcagtgaggtgcgggggacacagtgcgcaatttgcaagggatttacttttcagtgtgctatctgccatgtggctgtacgcgggagtagcaacttctgtttgacctgtggccatggaggacacacctctcacatgatggagtggtttaggacccaggaagtgtgccctaccgggtgcggctgccattgtctcctcgagagtacattttag

SEQ ID NO: 52365 - DNA, 1377 bp, Artificial Sequence
  Description of Artificial Sequence: Synthetic coding sequence
atgagcgtggactgcctgggccagcacgccgtgctgagcggccggaggttcctctatatcgtgaacctggacgccccatttgaggggcaccgcaaaatatctagacagagtaaatgggacattggcgcagtgcaatggaatcctcatgacagcttcgcgcattactttgctgcctcttcaaaccagagggtggacttgtataagtggaaagacgggagcggagaggtcgggaccacgctccagggacacacacgggtaatcagcgatctggattgggcagtgttcgagccggacttgctcgttacaagtagcgttgacacctacatttacatatgggacattaaagatacaagaaaaccaactgttgctctgagtgcggtcgccggcgcgtcgcaggtcaaatggaataagaagaacgctaattgtttggctacatcccacgacggagatgtacgaatttgggataaaaggaagccttccaccgcagtcgagtaccttgccgcccatctctctaagattcacggactcgactggcatcctgactccgaacatatattagcaacgtcctcacaggataacagcgtcaaattttgggactatcgccaaccccgcaaataccttaatatcctgccctgccaggtgcctgtgtggaaagcacggtacaccccattttctaacggccttgtaaccgtgatggtgccacaactgcgccgcgagaattctctgctgttgtggaatgttttcgatctgaacacacccgtccacaccttcgtgggccacgacgacgtcgtgctcgagtttcaatggagaaagcagaaggagggcagtaaagactaccagctggtaacctggtctagagatcagacgcttcggatgtggcgggtagatagtcagatgcagagattatgcgctaatgacatactggatggagtggacgaatttatagagagcatatctttgctgcccgagcccgaaaaaaccctgcacaccgaagatacagatcaccagcatactgctagccatggtgaggaagaggcactgaaagaggacccccctcggaatctccttgaggagcgcaaaagtgaccagttgggactgccacagacacttcagcaggaattctccttaattaatgtgcagatcaggaacgtgaacgtcgagatggacgctgctgaccgctcctgcacggtgtcagtgcattgctccaaccatagggtgaagatgctcgtgaaatttcctgcccagtaccccaataacgctgcgccttcttttcagttcatcaatccaacaactattacgagtacaatgaaggctaaactcctgaaggtgggagtctgggtgccgaaattctccctgctgttttgtattattgtctag

SEQ ID NO: 52366 - DNA, 993 bp, Artificial Sequence
  Description of Artificial Sequence: Synthetic coding sequence
atggccaccaaggagagccgggacgccaaggcccagctggccctgtcttcctctgctaatcagagcaaggaggtacccgaaaatcctaactacgcgctgaagtgtacgctggttggacacacagaggcggtatcaagcgtgaaattctcgcctaatggggaatggctggcatcctctagtgctgaccgcctcataattatttggggcgcatacgacggcaaatatgagaaaaccctatatgggcacaatctggaaatttctgatgttgcctggtccagtgactccagcagactggtgagtgcgtctgatgacaagacgctcaagctgtgggacgtgcgctcagggaaatgcctgaaaacgctgaaaggtcattccaactacgtgttctgctgtaactttaatcccccgagcaacctcatcattagcggtagctttgacgagaccgtgaagatttgggaggtgaagacagggaaatgtctgaaaaccttgtctgcacatagtgaccctgtctctgctgtgcatttcaactgctccggtagcctgattgtgtcaggaagttacgatggcctgtgccgaatctgggatgcggcatcaggacagtgtcttaaaactctcgtagatgatgataatccacctgtgtccttcgtgaagttcagccccaacgggaaatacatcctcaccgccacactggataacacactcaagctctgggattactctaggggccggtgtctcaagacgtataccggacataaaaacgaaaaatattgcatcttcgccaattttagcgttactggcgggaaatggattgtttcaggttccgaagataatctcgtctatatctggaatcttcagacaaaggaaattgtgcagaaactgcagggacacactgacgtggttatcagcgccgcctgtcatcccaccgagaatttaattgcatctgccgccctggagaacgacaaaactatcaaattgtggatgtctaatcactag

SEQ ID NO: 52367 - DNA, 3201 bp, Artificial Sequence
  Description of Artificial Sequence: Synthetic coding sequence
atggagcccggcaagcggcggaccaaggacgacacctggaaggccgatgacttacgcaagcatttgtgggccatccagtccgggggaagtaaggaagaacggaagcaccgcgaaaaaaaactgcgaaaggagtcggagatggatctgcctgaacataaggaaccaaggtgtagggacccagatcaggacgcaagaagccgggatagggtggccgaagtacatactgctaaggagtctccgcggggggagcgtgaccgagacaggcaaagggaaagacgacgggatgccaaggatagagaaaaggagaaactgaaagagaaacaccgggaggctgaaaagtctcacagtcgaggaaaagatcgtgaaaaagaaaaggacaggagagcccggaaggaagagcttcgccagacagtggcccaccacaatctgcttggccaagaaacacgtgaccgccagctgctcgagagggctgaacggaaaggacgttccgtgagtaaggtgcgcagcgaggagaaggatgaggattcagaacgcggggatgaggaccgggagcgcaggtacagggagcggaaactccagtatggagatagtaaagacaatcctttgaaatactggctctataaggaagagggagaacgaaggcaccgaaagcccagggaacctgatcgggacaacaaacatcgcgaaaaatcatccaccagagagaagagagaaaaatactccaaggagaagtccaatagtttttcggacaagggggaggagcgacataaggagaaacgccataaggaaggctttcacttcgacgacgaacggcaccaatccaacgttgacagaaaggaaaagagtgctaaagacgagccaagaaagcgtgagtctcaaaatggtgagcacagaaataggggcgcctcaagcaaaagagacgggacctcatcacagcatgctgaaaatctggtgcggaaccatgggaaagacaaggacagtagaaggaagcacggacacgaggagggttccagcgtttggtggaagcttgaccaacgcccaggcggagaggagactgtcgaaattgaaaaggaggagacggacctcgagaatgcaagagccgatgcctacactgctagctgcgaggatgattttgaggactacgaagacgatttcgaggtgtgcgacggtgacgatgatgagtctagcaacgagcctgaatctcgagagaagctcgaagaactgccactcgcccagaaaaaagaaatccaagagatccaacgggcaatcaacgccgaaaatgagcgcatcggggaacttagcctcaagttgttccaaaagagggggagaacagagtttgagaaggaaccgcgcaccgatactaattcctccccctctagagcatctgtgtgtggtatctttgtagactttgcctcagcctctcatcgccaaaaaagcagaacccaggccttgaagcagaaaatgagatccactaaactgcttcgtctgatagacctcgatttctctttcacattttctctgctagaccttcccccagtcaacgagtatgacatgtacatccggaacttcggcaagaagaacaccaagcaggcctacgtgcagtgtaatgaagacaatgtagaaagagatatccagactgaagagatcgagacccgggaggtttggactcaacatccaggtgaatcaaccgtcgtgagcggcggctctgaacagagggacacctctgatgcagtcgttatgcctaagatcgacaccccccgtctgtgttcctttctgcgggcggcctgccaagtgatggcggtgctccttgaagaagatagactcgctgcagaacccagctggaatctgcgagctcaggatagagccctatacttctcggactcttcgtctcagctgaatacatccctgccctttctccaaaataggaaggtgtcatctctccataccagccgtgtccagcgccagatggtggtgtcagttcatgacctccctgaaaagagtttcgtccccctgcttgattcaaaatacgtcctatgcgtgtgggatatttggcagcctagcgggccccaaaaagtgctaatctgtgaaagccaagtgacctgttgctgcctgtctcctctgaaagcatttttattgttcgcaggcacagctcacggtagtgtggtcgtgtgggacctgcgcgaggattcccggctgcattattctgtgacactctccgacgggttttggactttcaggacagccacattctccacagacggcatcctgactagcgtgaaccaccggagtcccctccaggcagttgaaccgatttctaccagcgtacacaagaagcaatcctttgtcctgagcccattctctacccaggaggaaatgtcggggctcagctttcatatcgcttctctggatgagtccggcgtcctaaatgtgtgggtcgtggtggaactgccaaaggctgacatagccggtagtatcagtgacctgggactgatgcccggcggacgagtgaagctagttcacagtgcacttatacaattgggcgactctctttcacataaaggcaatgaattctggggcaccactcagaccctgaatgtaaaattcctaccttcagaccccaaccacttcattataggaaccgatatggggctgattagccatgggacgcgccaagatctgagggtggctccaaaattgtttaaaccccagcagcatggcattaggccggtaaaagtcaacgtgattgatttttcgccgttcggggagcccatcttccttgccgggtgttcagacggcagtattcggcttcatcagctttcaagcgcattcccattgttgcagtgggactcaagcaccgatagccacgctgtgaccggtctgcaatggtcccccaccaggccagccgtctttcttgtgcaggacgacactagtaatatttacatttgggatttacttcagtcagacctgggccccgttgccaaacagcaggttagcccaaacaggctcgtcgccatggccgccgtgggcgaaccggagaaagcaggaggtagcttccttgccctcgtcttggctcgtgcttctggaagcatcgatattcagcacctgaagagaagatgggccgccccagaggtagacgagtgtaatagattgcggctgctcctgcaagaagccctttggccagaagggaagttgcacaaatag

SEQ ID NO: 52368 - DNA, 918 bp, Artificial Sequence
  Description of Artificial Sequence: Synthetic coding sequence
atgaccaaccagtacggcatcctgttcaagcaggagcaggcccacgacgacgcaatctggtccgtcgcatggggcaccaacaaaaaggaaaattccgagactgtggtcactggctcccttgatgatctggtaaaagtttggaaatggcgcgacgagagactcgatctgcaatggtctctggagggtcatcagctaggggtcgtgagcgtggacatttcccacacacttcccatcgctgcatcttccagcctagacgcacacatcaggttgtgggacttggaaaatgggaaacaaatcaaaagcatagacgctggacctgtcgatgcctggactctggcgttcagtccagacagccagtacctggccacaggcacgcacgtcggtaaagtgaacatttttggcgttgagagcggtaagaaggagtactccctagatactaggggcaagtttatcctctctattgcttacagccctgacggcaagtacctcgcttccggtgctattgacggaatcatcaacatctttgatattgcgacgggcaaactcctccacacactcgaaggccacgccatgccaatcagatctttgactttcagccccgacagccagctgttggtgaccgcttcggacgacgggtatattaaaatctacgacgtccaacatgctaatctggctggcactctgagcggccacgccagctgggtgctcaatgtggctttctgtccagacgacactcactttgtcagctccagctccgataaatctgtcaaagtttgggacgtgggcaccagaacgtgcgtacatacattttttgatcaccaagaccaggtttggggcgtgaagtacaatggaaatggatctaaaattgtgtccgttggtgacgatcaggaaatccacatttatgactgtcccatttag

SEQ ID NO: 52369 - DNA, 918 bp, Artificial Sequence
  Description of Artificial Sequence: Synthetic coding sequence
atgaccaaccagtacggcatcctgttcaagcaggagcaggcccacgatgacgccatctggtccgtggcctggggaacaaacaaaaaggaaaattctgaaacggtggttaccggaagcttggacgatctcgtaaaagtgtggaaatggcgggatgaacgactggatctccagtggtccttggagggccaccaattgggggtggtgtcagtagacatcagccacacactgcccatcgcggcctcatctagcctcgatgcacacatccgcctttgggacttggaaaacggaaaacaaattaaatcaatcgatgccggccccgttgacgcctggaccctggcattctcccctgatagtcagtatttagccaccggaacacatgtggggaaggtcaacattttcggagtcgagtctgggaaaaaggagtactcccttgatacccggggaaagttcatcctcagcatcgcttactcccctgacgggaaatatctggcctctggagctatagatggtattatcaacatctttgatatcgcaacagggaaactgttgcacactctggaaggccatgccatgcctatacgctcactgaccttcagcccagattcccagctactagtcactgccagcgatgacggttacatcaagatctatgatgtgcaacacgccaacttggcaggcaccctgagcggacatgcttcgtgggtgctgaatgttgccttctgcccggacgatacgcattttgtaagcagttcctcagataaatctgtcaaagtgtgggacgtaggcaccaggacctgtgtgcacacattcttcgatcatcaggatcaggtgtggggggttaagtataatggcaacggaagtaagatcgtgtctgtcggtgacgatcaggagattcatatatatgattgtccaatctag

SEQ ID NO: 52370 - DNA, 885 bp, Artificial Sequence
  Description of Artificial Sequence: Synthetic coding sequence
atgaccaaccagtacggcatcctgttcaagcaggagcaggcccacgacgacgcaatttggtctgttgcctggggaacgaacaagaaggagaattctgagactgttgttacgggaagtctcgatgacctggtgaaggtgtggaagtggagggacgaacgattagacctgcaatggtctctggagggacaccagctcggcgtagtgagcgtcgatatctcccacacacttcctattgccgcatcaagctctctcgatgcccacatacgattgtgggatctggaaaatggaaagcagattaaatcaatcgacgcaggccccgtcgacgcctggacattggccttctcccccgattctcagtacttggccacaggcacccacgtgggtaaggtgaacatctttggggtggagagcggcaaaaaggagtacagcctggatacacgcggcaaattcattctctccatcgcctattctccagatggaaaatatctagctagtggtgccatagacggtattatcaatattttcgacatagctactggcaaactactccatactctggagggccatgctatgcccatacggtcactcacttttagccctgactcacagctgctggtaacagcaagcgatgacggttacatcaagatttatgatgtacaacatgctaatctggccgggaccctgagcggccatgccagttgggtccttaatgtggcgttttgtcccgatgatacacattttgttagcagcagctctgacaagtctgtgaaggtgtgggacgtgggcacgaggacttgcgtgcatactttcttcgaccatcaggaccaggtttggggcgtaaagtataatggcaacggctctaagattgtctctgtgggcgattag

SEQ ID NO: 52371 - DNA, 2676 bp, Artificial Sequence
  Description of Artificial Sequence: Synthetic coding sequence
atggcccccaagcagaagaagaagaccagccggggcaagaagcggttaaagccagtcctcgcagcctctgaggatatggagcccgtgaacatggagagtatgggccaccccgaaatttatcctttggtgctgacaacaaaaacccaggagatatttaactgtcggattgacgaggatgttaccgatgagcagccatacaagctcatcaataaggaagatatttttgaagatcttagaaatcgagccgctgtgagcgatttccatccagtgaagaagatcgtccaggaatatcctggcaacgagttgctcctcgtatatgacaaggactttaagtatggtctaaacttttatctcatagcaacagaggaagggaaggagaattaccttaaccccccagaagtccccgaggaacaagaagaatataaagagcacatacctgaagacgtttatatctacaaacccccagttagtaagccatgggttagcctcggcagtgagaaggagatcgaagaagagtctgtcaccgaaagcacaaagcagataacatacatgatttcccggaagcgttcagagttcggagccccgataaagttttccgaccagaatgctagctccgtcaaggacgcgtatatagagtgcaccgcttacccagataaaaatttcaccctcaagcagctggagaaggatgtcggtatgcaggtgattccacagatcaaggatattagcacccagactaagtggacctacccaaaaaatgcaactactcaatactacccgagggaattctctgaagaggagaaggagacactgaagcaaagtaaaccacttgtggacttcctgaataatgcctctattagtgtggagatcgcccttcagcagaacgaaatcatgaatacattcatcgacgattggaagtatttggcagaagaggagggcaccttcggcgataagacagatacacatttaaaggagtaccagagctttacagacctccacagcccaacggaaaaaatgatcacatgtgtctcatggcaccccacaatctacggtctcatcgccgtatcagtggcggttcgcctgtcctttgaagacagggtgcacttttcgggcaaattgcttcttcagccatctttgattcttttctggagtttttcggatcctattcatccacagctcatgctggagtcccccgacgacatcttttgcttcaagttttgtccttctgacccaaatataatcgccggcggatgtatcaatgggcagatcgtaatgtgggacatcaccgctcacgccgaccgtatagaaaatattaaggctggaggcagccgcagcaaacgtgcaaccttgaagcccatgtttttgttggagcctgaatcaaataaagaggctatgtacattaggcactgtgccgtctcttccattgagaacggacacaagaaggtgatcaccgacatccattggctgtccgacaccttcgagattaatagaatggggagtgtgtttgaaaaccgcagcggcatttgctgtcaactggtgacctgctccgccgattgtaccatctgcttctgggacatcaggcctcagaagcccctaactcctcagacgaccgagaaaaaaaaggaagaaagtattgaaattcctttcgacgtgccttccactttcctccacctggacctgagctggaagcctctcactaaggtgcgcctgtctaaaggagaaacctctctcgatcattgccccacgaagattagcctgaatgaggatcacctgctatgcaaaacccaggataaaatgttggctcaatccaagaccgagaaggctgaagagatgaatccgtatcacaacctcgagagcggaatggccaatcttcttaagccgatcgatgacttctgcacaaaattcttcgttggtaccgaagaaggagaggtaatctacactgactggaaaatggaaaaggatccggagaccgggaggctgatgtcaaagaagccagtgagccatcatacgatccatgatgggactgtacatactatacagcgtagtccgttttacaacgatatcattttgaccgtcggcgggtggaatgtcgccatttggaaggagggcgttatgacaggaccactcctgcagagttgttgcgcgcctaaacggtatactagcgggcactggtccctgaccaggcctggcgtgttctatattggtcgagaagatggttatatcgacatttgggacctcctcgagaaaacgcacgagcctgctcagtcacagaatatctgtattaccatgatcacttacatcaaaccttggattttttccagtaaacagcagtttatcgccactgccgactactatggaaccttacatattctggaaatcccctggactcttagccgaccatctactaacgaaatggctagtgtgaaccactatttcgagagggaggttaaacatctagagtacgtcgagcaacggaagaaaattagggagcaagaaaaaaaggaaatggaactagaaatggctaagaagaaggtcaaaacctatcagaaatcaaaggagcagatgcaagcggagttaaagatggactacgagagctacttagagctggaaaaaactgttcttatcaatctgggtctcataaaggtgactgagaagggatcatacatggaagttatgtag

SEQ ID NO: 52372 - DNA, 2559 bp, Artificial Sequence
  Description of Artificial Sequence: Synthetic coding sequence
atggcccccaagcagaagaagaagaccagccggggcaagaagcggctgaagcctgtccttgcagcgtctgaagacatggagccagttaatatggagtcaatggggcaccctgagatctatccccttgtcctgacaaccaaaacacaggagatattcaattgtcggatcgatgaggatgtgaccgatgagcagccctacaagctgataaacaaggaagacatatttgaagatttgcgcaatcgagcagcggtttctgactttcaccccgttaagaaaatagttcaggaataccctgggaatgagctcctgctagtttacgataaggatttcaaatacgggcttaatttctatttgattgctaccgaggaagggaaagaaaactacctcaacccaccagaggtgcccgaggagcaggaggaatacaaagagcatatacccgaggatgtctatatttataagccccccgtgtctaagccctgggtgtctctgggaagcgaaaaagaaattgaagaggagtccgtcaccgagagcactaagcaaatcacctacatgatatcgcgcaaacggtctgaattcggggccccgatcaaatttagtgaccaaaatgccagctcagtgaaggacgcttatatcgagtgtacagcctacccagataagaattttacgctgaagcagctggagaaagatgtcgggatgcaggtgatccctcaaatcaaggacatttctacccaaacaaagtgtgtagaaatagcgttacaacagaacgagattatgaatacctttatcgatgattggaagtacctggcagaagaggaaggcacattcggcgataaaaccgacacacacttgaaggaataccagtccttcactgatttgcacagcccaacagagaaaatgataacgtgcgtgtcctggcatcccacaatttatggtctcatcgctgtcagtgtggccgtgcggctgtcttttgaggatagggtgcatttctccggcaaactactgctccagcctagcttgatcttgttctggtcattcagcgatcccattcacccgcagcttatgctagaatccccagacgacatcttttgcttcaaattttgcccctctgatcctaatattatcgctggaggttgtattaatggccaaatcgttatgtgggacattacagcccacgcagatcgcatcgaaaacatcaaggctggtggcagccggtcaaaaagggccactctgaagcccatgtttctgttggaacccgaatcaaataaagaagctatgtatataaggcactgtgccgtctcatctattgaaaacggacacaagaaagtaatcaccgatattcactggttgtccgacacctttgaaatcaacagaatggggtcagtgttcgaaaaccgaagtggaatatgctgtcagctagttacttgctcggctgactgcaccatttgcttctgggacattagacctcagaaacccctcactcctcagactacagagaagaagaaagaggagtcaatcgagataccgttcgacgtgccatctacgttcctccatctggatctctcgtggaagcctctgacaaaagtccggctgtctaagggagagacaagcttggatcattgtccgaccaagatttccctaaatgaggaccacctgctttgtaaaactcaggataaaatgcttgcccaatcaaaaactgagaaggccgaggagatgaatccataccacaacctcgaaagtggtatggccaatttgttgaagcctatagacgacttttgcacgaagttttttgtggggaccgaagagggagaggtcatctatacagactggaagatggaaaaagacccggaaactggtaggctgatgtccaagaagcctgtgagtcatcacactatccacgacgggacagttcatacaatccagaggagccctttctataacgatataattttaaccgtaggcggatggaatgtggccatctggaaggagggcgtcatgaccgggccgttgctgcaaagctgctgtgcgcctaagaggtacacctcgggccattggagcctcacaagacctggagtattctacatcgggcgggaagacggatacattgacatctgggatctcttggaaaagactcatgaaccagctcagtcccaaaacatctgcatcacaatgattacctacatcaaaccatggatcttcagtagcaaacagcaattcatcgccacggccgattattacgggaccttacatatcttggagatcccgtggaccctgtcccgaccatcaacaaacgagatggccagcgtgaaccattactttgagcgcgaagtgaaacacctggagtacgtcgagcaaagaaaaaagattcgggaacaggagaagaaggagatggaactcgagatggctaagaagaaggttaaaacctaccagaagagtaaggagcagatgcaggccgagttaaagatggactatgagagctatctcgaactggagaagaccgtgctgatcaacctgggccttatcaaggtgacagagaagggaagttacatggaggtgatgtag

SEQ ID NO: 52373 - DNA, 2559 bp, Artificial Sequence
  Description of Artificial Sequence: Synthetic coding sequence
atggcccccaagcagaagaagaagaccagccggggcaagaagcggctcaagccagtgctagcggccagcgaggacatggaacctgtgaacatggaaagtatgggccaccccgaaatttatcccctggtgctaactacaaagactcaggagatcttcaattgtcgtattgatgaggatgtcaccgatgaacagccatacaagctgatcaacaaggaggatatttttgaggatctcagaaatcgtgccgcagtgtccgatttccacccagtcaagaagatcgtacaggaatatcccggcaatgaattattgctggtttatgacaaggactttaagtacggcttgaacttttacctgattgcgactgaagagggaaaagaaaactaccttaacccaccggaggttcccgaagagcaagaagaatataaggagcacatccctgaagacgtctatatttataagcccccggtgagtaagccatgggtgtcactcggttctgagaaggagatagaagaggagtccgtgacagagtcgaccaagcagattacctacatgatctccagaaagagatccgagttcggcgctccaatcaaattttctgatcaaaatgcttcttccgtgaaggacgcatacattgaatgtacagcataccctgataagaacttcaccctcaagcagctggagaaagatgtcgggatgcaggtgataccgcagataaaagacatttccacccaaactaaatgtgtggaaatcgccctgcagcaaaatgagatcatgaacacatttatagacgattggaaataccttgcggaagaggaaggaacattcggtgacaagacggatacccatctaaaggaatatcagtcattcaccgacctccatagccccaccgagaagatgatcacatgtgtgagctggcaccctacaatctacggtttgatcgccgtgtctgtggcagtgcgactctcctttgaagaccgagttcacttctctgggaagctacttctgcaacccagccttatcctgttctggagctttagtgaccccattcacccacagctaatgctggagagtccggatgacattttttgcttcaaattctgtccgtccgacccgaacattatagccggaggttgtatcaacggacaaattgttatgtgggacatcaccgctcacgctgacaggattgaaaacatcaaagctggcgggagcaggagcaagagagccaccctaaagccaatgttcctgttagagcctgaaagtaataaggaagccatgtacatacggcattgcgccgtcagctcgatcgagaatggacacaagaaagtgattacagatatccactggttgtcggacacattcgagattaatcgcatgggctcggtcttcgagaatagatccggtatttgttgtcaactggtcacctgttccgcggattgcaccatctgcttttgggacattcgaccccagaaacctctgaccccacagaccactgaaaagaagaaagaggaaagtattgaaatcccattcgacgtacccagtacatttttgcatctggatctgagttggaaacctctgaccaaagtacgcctttctaaaggagaaacttctctggaccattgtccaacgaagatctctctcaatgaggaccatttattatgcaagacacaggacaagatgctggcgcagagtaaaacggagaaggcagaagaaatgaatccctatcacaacctcgagagcggcatggcaaacctgttgaagcccattgacgatttctgtacaaaattctttgtagggaccgaggagggcgaggtaatttataccgattggaagatggaaaaagatccagaaaccggccggttgatgagcaaaaagccagtttcgcatcatacaattcacgatggtaccgtgcacaccattcagcgttcacctttttataatgatatcatcctgacagtgggcggctggaacgtcgccatctggaaggaaggggttatgacaggaccactccttcagagttgctgcgcccccaaacggtacaccagcgggcattggagcctgaccagaccaggagtcttttacatcggaagagaggatgggtatattgacatctgggatctgctcgagaaaactcacgaacctgcgcagagccagaatatctgtattaccatgattacctatattaagccatggatcttctccagtaagcagcagttcatcgccacggctgattattatggcacacttcacatcttggagattccttggacacttagtaggccttccaccaacgagatggcttcagtgaaccactatttcgaaagggaagtcaagcatctggagtatgtggagcagcggaagaagatccgggaacaggaaaagaaggaaatggagctggaaatggcaaaaaagaaggtcaagacatatcaaaaaagcaaagaacagatgcaggcggaattgaagatggactatgagtcctacctggaactggagaaaaccgtgctcatcaatctcggactcatcaaagttactgagaagggttcatatatggaggtgatgtag

SEQ ID NO: 52374 - DNA, 3246 bp, Artificial Sequence
  Description of Artificial Sequence: Synthetic coding sequence
atggacatccggaaggagaagcggctgaacatggccctgcagatgagtaatttcaaaaaggccttaaaccggttcgagaagctcgtagagcagaccgcagcccaaaaaagggacgaacgggctgggttatttatacataaagaggatgccattggatatgacaagttttacgcctctgtgcagaaactcttcggtcctgacgtgaagaaccaggacgtcaaacgattttataggaagctgtgtaacaacacagacgcttcggctgactggtgtgaaatttttgggtatttctccagtgaagaagatccaatagcctctcagctcgatgaggagaatttggtgttcttcgtgagtcggaaaagacgtatactaattagcggcagtcggcgaagggatgtgattaaatccattgtaaagattcctcacttggacctgctcatcacagctacacagaaaggacttatcaccgtcttcaataaccaggacacaagctggatcaccggctgtgactatctgcttcagttgaagagaattgtcgccacaacagaaaggaccatcatcgtctgggattacaaagcccagggatccagtcaggaaaattactttgttatcaaaccgatggaccactgtctgttgtgtgtgtgcgtcgtgccactaccggatcacctttgtcgagacgacattttattgggagatgatggggggttcgtgaaccggttcacagtcaatagtgatgattttgggataaaacaggccaagagtaagcggaagttgcagaaccaagtgcttgatagcaagaacttcaaaagcgtgaagagaaagctccacaacgattgggtaatgaaaatcagatacatctctgccctgaactgtttcggcagctgctctctggatagcaaccattccctagtcctggagagcttaaagcggctcgaagacaacctgcctgtgcgcgagttttccatgccacggggcgcaaacaccttttgctattgtgtgaaggctaatgtgatcgtcaccggaggagatgacaaagtgatcaggctttggcaccccaatatctctacaaaaccagtgggaaaactagtgggacacatgttttccatagccgagattgtgactaacgagaaggatcagcacgtggtctccttgtcatccgccaaagtattccgcgtctgggacattcagacgctttccttgctgcaagtgttccatgatagccaaggtggtcccggggatatgcagatatatagtatgatttacgacgcaaaccatgggatgttgataacaggttccagcgtgatggacatgtaccctctaacacggatgattcaggacaccaagcaagttccccacactcatgagagagagattaatgtcatgctgtataacaagtactttcatcaggtgcttacaatatgtagcgagagcataatcagggtgtgggaactggagaccggcctgcaggtctatcagatactggagccccatggctttaacacagaggtgacttcagctgctgtggatgagtcaggatttctgttcgccaccggagcatacaatgggaccgtacgcatttgggactttggtagtggccaggagatgaaagtcctgcccgagggcaaggactggaaggaagacgaacattgtctgcgacgcctcattttcctgaaggcacaggagaagcatcagcagctggtgctggctctcgagcgaaacggtactatcaagatgattcagggcaaagaggatgatatatatctgatggtgatttgggagctgccagacgtcgtgcctttcctgcaggacggtaaacacgcagtgcatctgcgcatgagcacaagggaccgaaacatggccattccattcccagatgttgagctcatcgtcgagcggaacttctctcagccgactgataacccaacaatggacctgctccgtgtgaactgtatcgatctgctgcaagtggagggttacaacctaatcgctgcaggaacactcaatggggttattattctatggaacttcgtgacatccacggtgaagaaagtttacagaccagaagattgctttactgtcaatcctgacctccatccaaagcatttcaagattaatgacatcctgttcctgtttagaacacctgaatgcgcaagaagatcttcccaggatagcatatgctcgtcctcccagtgcgagtctagtaagggacctcaatcaagtaaaggctccaaacaatcgattcacgactccgaggtgaagggcgagcaaaccgacgtcatggttggaaagcaacagcctatggacaaaaaacaccccgggatagctaacctgccagaggctcaacctcctatcctggtgactgctcacgaagacgggcacttgcgcttatggaccctggagggaaggttgctcaaagatatgcttccatttactaaacactccgcaatctccctgacgtcactctacaccgattcctgtacccgtattctgctcgccggcaatgtcgagggacacgttattctttgtaacattagctcatttttggatcctccacatgatgagaagaagttcaagcagttactctcctggagagctcattctctagaaatcatccaagtcatttacgtcgaagaaaagcaggtcgtattaactgccagcattgatggcagtgtgcggctgtggcacgccctgaacggccattactgcggttatttcggtcaacggagactgtttgagctgtcacagacccgggactttatcctgccatgcgacgtcacagagtatccgatagagataaaagaggagtcaaaattcacagaaaaacaaaagtacgaatacccacttatatttgacagggagaagtggaggaagatgtcctccgtttctttattgttcaagcgtacgcccccaaaggccttcgaagtggagcaagattttaaatttttcaagagcctgagttctcccaagatccgcaggtatcctctcgaagggttcgtaactgaaaatagagaagccgggatagtcttcggttctctcccgatatattctatcagttctccaacgtccctgcgcttcctcccgctgatcggggtggaagcccagaaggactcctcagatggcattactgggaaaaaaaagggcggccatgttcaacgggagaaagctccgagacgaaggtccctgaaaaagaatctggtgcctcagataaacctggcctctagcttcttccctgccatccccaaatag

SEQ ID NO: 52375 - DNA, 2745 bp, Artificial Sequence
  Description of Artificial Sequence: Synthetic coding sequence
atggacatccggaaggagaagcggctgaacatggccctgcagatgagcaatttcaagaaagccctgaacaggttcgaaaaactcgtcgagcagaccgcagctcagaagcgcgacgagcgggcaggactgtttatccataaggaggacgccatcggctatgacaagttttacgcgtctgtccagaagctgtttgggccggatgttaagaatcaggatgtcaagaggttttatcgaaagctgtgtaacaataccgacgcctctgcagattggtgcgaaatattcggctacttcagttcagaagaagatccgattgcgtcacagttggatgaagagaatcttgtcttcttcgtttcccgcaaacgccggatcttgatttcgggctcaagaagaagggatgtgataaaatcaatcgttaaaatcccgcacctggacttactgatcaccgcgacccagaagggcctgataacggtgtttaataatcaagacactagttggatcacaggatgtgactacctgctgcagctcaaacgtatcgtggctacgactgaaagaacaatcatcgtctgggactacaaggcccagggctccagtcaggaaaattactttgttattaaacctatggaccattgtttattatgtgtctgtgtggtccccctgcctgaccacttgtgtagagacgatattttgcttggagatgatggaggcttcgtgaaccggttcactgtgaacagtgatgacttcggtatcaagcaggctaaaagcaaacgaaagctccagaaccaggtgctcgattctaaaaactttaagtctgtgaagaggaaacttcataacgattgggtgatgaagattaggtatatctcggccctgaactgcttcgggagttgcagcctggactctaatcactccctagtgttggagagcttgaagaggctggaagacaacctgccggtgcgggaattttccatgcctaggggcgctaacaccttctgctattgtgttaaagccaatgtcatcgtcaccgggggcgacgacaaagtgattaggttgtggcaccctaatatttccacaaaacccgtgggcaaactcgtggggcatatgttttctatcgcagagatagtaacaaacgagaaagaccagcacgtggtctctctctctagcgctaaagtatttagggtctgggacatccagaccctgagtctcctacaggtgtttcatgactcccagggcgggccaggggatatgcagatctacagcatgatatatgacgccaaccatggcatgctgatcaccggatcatctgtgatggacatgtatccactgaccagaatgattcaggacacgaaacaggtacctcacacacatgagcgggagattaacgtaatgctttacaataaatatttccatcaagtgctgacaatttgtagcgagtccataatacgcgtctgggagttggaaacaggcctgcaagtgtaccagattttggagcctcacgggtttaacactgaagtcacctctgccgccgtggatgaaagcggattcctgttcgccacaggcgcttacaacggtacggtccgcatctgggacttcggttccgggcaggaaatgaaggtgctccccgaaggcaaggattggaaggaggacgagcactgcttgagaagactgatcttcctgaaagcccaggagaagcaccagcagctggtcttggccttagaacgtaatggaaccatcaaaatgattcaggggaaggaagatgatatctacctgatggtgatatgggaattgcctgatgtggtccccttcctccaagacggaaaacacgccgtgcatcttaggatgtcaactagagatcgcaacatggctattccatttccagacgtcgagctgatcgtggagcggaatttttctcagccaacggacaatccaaccatggacctgctccgagtgaattgtatcgacctgctccaagtggaggggtacaacctgatcgctgccggaacactgaatgaaggccatgtcatcctctgtaacatatcctcattcttggatccacctcacgatgagaagaagttcaagcaactgctgagttggagggcccattctctagaaattatacaggtgatctatgtggaagagaagcaagtggtcctcacggcatccattgatggcagcgttaggctgtggcacgctctgaacggccattattgcgggtattttggacaacggcggctttttgaactgtcacagactcgggatttcatcctgccttgcgatgttacagagtaccccatcgagataaaggaggaatcaaaattcacggaaaaacagaaatacgaatacccgctcatctttgaccgggaaaaatggaggaagatgtcaagtgtgtcgctgctgtttaagcggacccccccgaaagcatttgaggtcgagcaagactttaagttctttaagagcctgagctccccaaagatacggaggtatccactagaggggttcgtcacggaaaatcgcgaagccggcatcgtttttgggtcgcttcccatttattccatttcctcacccacctcactgcggttcctaccgctgatcggggtcgaagctcagaaggatagttcagacggcattacgggaaaaaaaaagggaggccacgttcagcgggagaaggcacctcgacgaaggtcactgaaaaagaatctcgtcccacagattaatctggcctcttccttcttccccgccatccctaagtag

SEQ ID NO: 52376 - DNA, 3450 bp, Artificial Sequence
  Description of Artificial Sequence: Synthetic coding sequence
atgagcgacgccgccgaggccccccgggaggccaccggcgagaacggcgagacagaaatgaaggaggaggaagagcctaatccgaattacaaagaagtggaggatccccagcaggaaagcaaggatgacacaatcgcatggcgggaatctcaggaggaggagagaaaaaccggcgaggaggagggagaggaagaggggaaggaggacaagaagatcgtgatggaggagacagaggagaaagcaggggaggtgcaggagaaagaagcatcagggatccaggaggaaacaacagtggagccccaggaagttacggcatcaatgattaggttggagactcagattaccgacagccaatccattaccagcggaatcttcccgaagacccagcgagggagtaagagcaaactttccctgcagctcgaagatgccgagaccgatgagctgctgcgtgatctctccactcaaatcgaattcctggatctggatcagatttcacccgaggagcagcagatatcgagcccagaacgacagccaagcggagagttagaggagaagaccgaccggatgccccaggatgagctaggccaggagcgccgggatctggagccagaaaatcgggaggaaggtcaagagagaagagtgtcagatatccagtctaaagcagggatcagcagagaatccctggtgagtagcacgacagaagacattctgttccagaaggataagagcactcctgtctaccccctcacaatgacctggagttttggttggaatagttcgttgccagtgtactacatccgagaagaacggcagcgcgtcctgctgtacgtttgtgcgcacacagccatcatctacaacgtctttcgcaacaaccagtaccatctccagggccatgccaatattatctcctgcctgtgcgtgtcagaagaccggcgatggatcgccacagctgacaagggtcctgattgccttgtgataatttgggacagctttactggaattcccgtccacactatttttgactcttgccccgaaggaaacggcataatggcaatggccatgacacatgatgcgaagtaccttgctacgatcagcgatgcggaggtccagaaggtgtgcatatggaaatggacccttgctgtggaaacccctgcatgcactctggagttgcccacggagtacggggtacagaactacgtgacttttaatccaacaaataataaagagttagtgtcaaattcgaagacacgggccatatactacgcctggtacgaagagcgggatactctggcacactccgctcccctcctgacagagaaaacattcaacaagcttgtcggaaaattcagccagagcatcttccaccttaacctgactcaaattttgtctgccaccatggaaggcaagctagtcgtctgggacattcatcgtccaccctcgagcgcgagcacatttttgggctttccgtatataaagccatgtaaactggtacacctgcagaaggaaggtatcaccgttttaacaacaatcgattcatacatcgtaactggcgatatcaagggcaacattaaattctacgatcacaccctctctatagtaaattggtactcgcatctcaagctaggggctattagaactctgtcttttagtaagacccctgcaacccctcctacagagaagtccaactacccgcctgattgtacactgaagggggatctctttgtactacgtaattttatcattgggacatctgacgccgctgtgtaccacctgacgactgatggaaccaaactggaaaaactgttcgtagaacctaaggatgccatttgtgcaataagctgtcatccctaccagcctttgatcgcaatcggatctatctgcggcatgataaaagtgtggaactatgagaataagcagtacctgttctcccgcgtattcgagaaaggtctcggagtgcagtccctcacctacaatcccgaaggtgccctgctgggcgctggatttaccgagggtacagtatacattctggacgccatgtccttggaaaatgagtctcccgagccatttaaatattctagaacaagcgtcacacacatttcattctctcatgatagccagtatatggcgacagccgatagaagcttcactgtggccgtgtatatgctggtggtgagaaatggacagagagtttgggaatacctagctaggctacgctcccatcgaaaatcaatcaggtcactgctttttggcgtatacttggactcaaacgagccaagattattgtcactggggactgacagactgttgatcgagtatgacctgctgaggtcatataaagaccacctggaggtgctcgatatccatcacactgatcaaggatgctacccgacctgcatggtgtggtacccacccctgacgcgcgagctgttcctgcttatttgcaatagcggatataaggtcaagcttttcaacgctactacaaaaatgtgcaggaagactctgttggggccagcatacgggtccccgattgaacagacccaagtgttacccgtaagaagtatggcggaactacaaaaacgttacctcgttttcatcaaccgcgacaaagtggggctccagatcttacccgttgacgggaatccacataagacatcggcaatagtgtgtcatcccaatggagtggctggaatggctgtttcatatgacggatgctacgcatttaccgccgggggtcatgatcgctcagtggttcagtggaaaatcacactgagtgtactcgaggcagcagtgagcctgggcggagaagatctgacgccgttttacggtttattgtcaggaggacgtgaggggaaattttacagggaacttgaagattatttttactactcccagctgcgatctcagggtatcgataccatggagacaaggaaagtgtcagagcacatttgtctctccgaactcccttttgtgatgcgagcaattgggttttatcccagcgaggagaagatcgatgacatatttaacgagataaagtttggggaatatgtcgatacggggaagctcattgacaagataaatctcccagacttcctgaaagtctacctcaatcacaagcccccctttgggaatacgatgagcggaatccacaaatccttcgaagttctaggctacactaactccaagggaaagaaagccattcggagagaagattttttgaggctgctggtgacaaaaggggagcatatgacagaggaggaaatgctggattgctttgctagcctgtttgggctgaacccagagggttggaaatccgaacctgcgacatgttccgtgaaaggcagtgagatctgcttagaagaagagctgccagatgagataactgcagagatcttcgcgactgagatcctgggtctcacaatctcagaagactctggccaagatggtcagtag

SEQ ID NO: 52377 - DNA, 2826 bp, Artificial Sequence
  Description of Artificial Sequence: Synthetic coding sequence
atgagcgacgccgccgaggccccccgggaggccaccggcgagaacggtgagacagagatgaaagaggaggaggaaccaaacccaaattacaaagaggtggaagacccacaacaggaaagcaaagacgataccatcgcctggcgggaatcacaggaggaagaacgtaagaccggtgaggaggaaggggaggaggagggaaaagaagacaagaagatcgttatggaggaaacagaagaaaaggccggtgaggtgcaggaaaaggaggcaagtggtatccaggaagagaccactgtggaacctcaggaggtcaccgctagcatgatccggttagagacacagatcaccgatagccagagcataaccagcggcatctttcccaaaacccagagaggaagcaagtccaagctgagcctccagctagaggatgctgagaccgatgaacttctgagggacctgagcacacagatagaattccttgatctggatcaaataagccctgaggagcagcagattagcagccccgagagacagccctctggcgagctggaggaaaagaccgataggatgccccaggacgaactcgggcaggaacgtagggatctcgagcccgagaatagagaagaaggacaagaacggcgggtatcggatattcagtcaaaggccggaataagtagagagtcactggtttcttctacaaccgaggatatactgtttcaaaaggataaatctacacctgtctatcccctgacaatgacgtggagctttggttggaactcctctcttcccgtctactacattcgcgaagagcggcagagagtactcctctatgtctgtgcacacacggcaattatctacaacgtcttcagaaataaccagtaccacttacaggggcatgccaatattatcagctgcctgtgcgtctccgaagacaggcggtggattgcaacagccgacaagggaccagattgtctggtgattatttgggactccttcacaggcatcccagtgcacactatctttgatagctgccctgaagggaatgggatcatggccatggctatgacacatgatgccaaatatctcgctactatttctgatgccgaggtacagaaggtgtgtatatggaagtggacattagcggtggagacacctgcttgtaccctcgagctgcccacggagtatggagtccaaaactatgtgaccttcaatccaacaaataacaaagagctggtttccaatagcaaaacgagagccatttactacgcatggtacgaggaaagagacaccctcgctcatagtgcaccccttctcactgagaaaactttcaataaactcgtaggtaaattctctcagagcatttttcacctgaaccttacacagatcttgtccgccactatggaaggaaagctggtggtgtgggatattcacagacccccctctagtgcttctacattcctcgggttcccttacatcaaaccatgtaaactggtgcacctccagaaagaggggatcaccgtgttgactacaatcgatagttacatcgtgaccggcgatatcaagggaaacataaaattttatgatcacactttgtcgattgtgaactggtactctcaccttaaactgggggctatacgaactctgtcattcagcaagacccccgcaacaccaccaaccgaaaagagcaactatcctcccgactgtacactgaaaggtgacctcttcgttctgcgcaatttcataatcggaaccagcgatgcggccgtctaccacctgactacggacggcactaagctggagaagctgtttgtggagcctaaggatgccatatgtgctatttcttgccatccataccagcctttgatagctatcggctcaatatgcggtatgattaaggtgtggaactacgagaacaaacagtacctgttcagtagggtgttcgagaaaggactgggtgtacagagtttaacgtacaaccccgagggagcactcctcggcgccggctttactgaaggtactgtgtacatcctcgacgctatgtcactggaaaacgagtctcccgagccctttaaatactcccgcacatccgtcacccatatttcatttagccatgatagtcagtatatggctactgctgatagatccttcactgtggccgtctacatgctggttgttagaaatggacagagggtgtgggagtatttggctcgcctaaggagtcatcgtaaatcaatcaggtctctccttttcggggtgtatctcgattcaaacgaaccccgcttattgagcctggggaccgacaggctgctgatcgagtacgacctgcttagatcctataaggaccacctcgaagttctggatattcatcacaccgaccagggttgttaccctacatgtatggtctggtacccgcctctgactcgcgagctcttcctgcttatttgcaactcaggttataaagtgaagctgtttaatgcaacaacaaagatgtgcagaaaaactctgctcgggcccgcttatggatcccctatagagcaaacgcaggtgctacccgtacgctccatggccgaactacagaagcggtacctcgtctttatcaatcgggacaaggtgggcttacagattttaccggtggatggaaatccgcataaaacaagcgctatagtttgccaccctaacggagtggcgggtatggctgttagctacgacggctgctacgcatttaccgctggcgggcatgaccgctctgtagtgcagtggaagataactctctcccatcctggttcacaggcccctattctgtctccaagtgatacctcccggtcctag

SEQ ID NO: 52378 - DNA, 1248 bp, Artificial Sequence
  Description of Artificial Sequence: Synthetic coding sequence
atgaagctgaagagcctgctgctgcggtactacccccccggcatcatgctcgagtacgaaaaacacggcgaactaaagacaaagtccattgatcttttagaccttggaccctctacagacgtgtcagcactagtcgaagagattcagaaggctgaacctctactgacagctagtaggacggaacaagtgaagctacttattcagaggttgcaggagaagttgggccagaactccaaccacacattttatctgtttaaggttctaaaagcgcatattttgcctttaacaaacgtcgccttgaacaagtcaggcagctgtttcatcacggggtcttacgacaggacatgcaaattgtgggatactgcatccggcgaagaactgaatacattggaaggacatagaaatgtggtttatgcaattgcctttaacaacccctatggcgacaaaatcgccactggcagtttcgataagacatgcaaactttggagcgtcgagacaggtaaatgctatcatactttcagagggcatacggctgaaattgtgtgtttaagcttcaacccccagagtaccctagtggcgacaggctcaatggacaccactgccaagctgtgggatattcaaaatggggaggaagtttatacactgaggggtcactccgctgagatcatctctctgtcttttaatacatccggggatcgaataattacaggaagctttgatcataccgtcgtggtctgggacgcggacaccgggcgtaaagtaaatatactcatcggacactgtgccgagatctcctccgcatcctttaactgggactgtagcttgatcttaaccggctctatggacaaaacatgtaagctatgggatgccacaaatggcaagtgcgtggctactctcacaggtcatgacgacgaaatcttagattcctgctttgattatactgggaaactgatcgccaccgcaagcgcagacgggaccgccagaattttctctgcagccactagaaaatgtattgcaaaactggagggacatgagggcgagatcagtaagataagttttaatcctcaggggaatcatttgttgacgggctcgagcgataagactgccagaatatgggacgctcagaccggccagtgtttgcaggtgttagagggtcatacagatgagatcttttcctgcgctttcaattataagggcaatatagtgatcactggctcaaaggataacacgtgccggatctggaggtag

SEQ ID NO: 52379 - DNA, 1203 bp, Artificial Sequence
  Description of Artificial Sequence: Synthetic coding sequence
atgctggagtacgagaagcacggcgagctgaagaccaagagcatcgatctgttggatctgggaccctccacagacgtgtctgcgcttgtcgaagaaattcaaaaggctgaaccactcctgactgcttcgaggaccgagcaagtgaaactgctgatacaaaggctccaagaaaagctcgggcaaaattctaatcacaccttctacttattcaaagtgctaaaggctcacattcttcctcttactaacgttgccctgaataaaagtggttcctgcttcatcaccggctcttatgaccggacttgtaaactgtgggacaccgcctctggagaagaacttaacactttggaaggtcatagaaatgtggtgtatgcgattgcctttaataacccttatggagataaaattgccacaggttcattcgacaaaacatgcaagctgtggtctgtcgagacaggcaagtgctatcacacttttcgcggacatacagctgagattgtctgccttagcttcaacccccaatctactctggtcgccacaggctctatggatactaccgccaagctttgggatatccagaacggagaagaggtgtacacattgcgcgggcacagtgccgaaatcatctctctgagcttcaatacttctggagatcgaatcataaccggaagctttgatcacaccgtagtagtgtgggacgcagacacaggaagaaaggtgaacatccttataggacactgcgccgagatctcatcggctagctttaattgggactgcagtcttatcctaacagggtcgatggacaagacctgtaagctgtgggatgctactaacgggaaatgtgttgccaccctgaccgggcatgatgatgaaatccttgactcctgctttgactatactggcaagctcatcgccactgccagcgccgatggcaccgccagaatattctcagctgccaccagaaaatgcattgccaagctagagggacatgagggagagatttccaagataagtttcaatcctcaggggaatcatctgctgacgggatcctcagataaaactgcacggatatgggacgcacagaccggccagtgtttacaggtactagaagggcatacagacgaaatcttctcatgcgcttttaattataagggaaatatcgtaatcactgggtcaaaagataacacgtgtcgcatatggcgctag

SEQ ID NO: 52380 - DNA, 1965 bp, Artificial Sequence
  Description of Artificial Sequence: Synthetic coding sequence
atggagcggagcggccccagcgaggtgaccggcagcgacgccagcgggcctgaccctcagctggccgttacgatgggcttcacagggttcggaaagaaggcccgtacatttgacctggaagcgatgttcgaacaaacacgacgcaccgccgtggagagaagcagaaaaaccttggaagcccgagagaaagaggaggagatgaacagagaaaaggaactgcggcgccaaaacgaggacattgagccaacctcgtcgcggagtaacgtcgttagagactgcagtaagtccagcagtcgtgacactagctcctcggaatcggagcagtccagcgattccagcgatgatgagttaatcgggccaccgttgcctccaaagatggtggggaaacctgtaaacttcatggaagaagacatccttggacccctcccgcccccactaaacgaagaagaggaagaagcggaagaagaggaagaggaagaggaggaggaggagaacccagtccataagatccccgatagccacgaaataacgttaaaacatggaacgaaaacagtgtctgcccttggattggatccgagtggagcaagactggtaaccggcgggtacgattatgatgtgaaattctgggattttgccgggatggacgcgtcgttcaaagcatttcgatccctacagccatgcgagtgccaccagattaaatctttgcagtacagcaataccggcgacatgatactggtggtgtctggaagttctcaggcaaaggtaattgatcgtgatggctttgaggttatggagtgcatcaagggcgaccagtacatcgtggatatggcaaacaccaagggacacactgccatgctgcataccgggagttggcatccaaagatcaagggagaattcatgacctgcagtaatgatgcaacagtgcgcacatgggaggtggagaaccccaaaaaacagaagtctgtctttaaaccacggacaatgcaggggaaaaaggtgatcccaaccacgtgcacatattcgcgcgatggtaacctcatcgcagcagcttgccagaatggctccattcaaatatgggatcgaaatttaactgttcatcccaaatttcactacaagcaggcgcatgattcaggcactgatacatcctgtgttactttctcctatgacggaaatgtcctcgcatctcgcggtggggacgactctttaaagttatgggacatcaggcagtttaataagccgttattttcagcttccgggctgccaaccatgttcccaatgaccgactgctgcttctcaccagacgacaagctcattgtcaccggaacttcaattcaaagagggtgtggttcaggtaaactggtcttttttgaacgccgcacttttcagagagtatatgaaattgacataaccgatgcgtccgtggtccggtgcctctggcacccaaagcttaatcagataatggtgggaacgggtaacggtttggcgaaggtttactacgatcctaacaagagtcagagaggggctaagctgtgcgtcgtcaaaacacagcgaaaagccaaacaggccgagaccttaacacaggattacattatcactccacacgccttgcccatgttccgcgaaccgcgtcagcgcagtacccgtaaacagcttgaaaaggacagacttgatcctttgaaaagccataagcctgagcctcctgttgccggaccaggtcggggggggagggtcggtacacacggaggaaccctgagcagttacatagttaagaacatcgccctggacaagaccgacgactccaacccgcgcgaagccatcctcaggcatgcaaaagctgctgaggactccccttactgggtatccccggcatatagtaagactcagcccaagactatgttcgcccaggtagagtcagatgatgaagaggctaagaatgaacctgagtggaagaaacgtaaaatttag

SEQ ID NO: 52381 - DNA, 1137 bp, Artificial Sequence
  Description of Artificial Sequence: Synthetic coding sequence
atggaccccggcgacgactggctggtggagagcctgcggctgtaccaggacttttacgcttttgatctgtcgggagcaactcgagtgcttgagtggattgacgataagggggtgtttgtggccggatacgagagtctcaagaaaaacgagatactgcatctcaaactccctctacgtttaagtgtgaaggagaacaaggggctttttcctgagcgcgatttcaaagtgcggcacggaggcttttctgaccggtctatcttcgacctgaagcacgtcccccacacacgactcttggtcaccagcgggctcccaggttgttatctgcaggtgtggcaggtcgctgaagattctgatgtcatcaaggccgtgagcaccatcgctgtacatgagaaggaggagagtctgtggccacgagtggcagtgttcagcaccctggctcccggagtgcttcatggagcacgcttgcgatcacttcaggtcgtcgatctagagtcgcggaaaaccacgtatacgtccgacgtgtccgacagcgaagagttgtccagcctccaggtgctggatgcagacacatttgcgttctgttgcgcgagcggtcggctcggactggtggacactcgccagaagtgggctccactggagaataggagtccagggcctggctccggtggcgagaggtggtgtgcagaagtgggctcctggggccagggccccggaccttctatcgcaagcctcgggagcgatggacgcctttgcttattggatcccagagacctctgtcacccagtctcatctgtccagtgtcctgtgagtgtgccatctccagaccccgaactcttgcgcgtgacatgggcccccggcctaaagaattgcctggccataagcggctttgacgggacagtgcaggtctacgacgctaccagctgggatggcactagatcgcaggatggcacccggagccaagttgaacccctgttcacacatcggggccatatcttcctggatggaaacggaatggatcccgctcccctggtcacgactcacacatggcacccctgtcgccctcgaacactgctttcagccaccaatgacgcttcgttgcacgtgtgggactgggttgatctgtgcgcaccccggtag

SEQ ID NO: 52382 - DNA, 1881 bp, Artificial Sequence
  Description of Artificial Sequence: Synthetic coding sequence
atgagccggagcggcgccgccgccgagaaggccgacagccggcagcgtcctcagatgaaagtgaatgaatataaagagaaccagaatattgcctatgtctctctgaggccagcccaaaccacagtgctgataaaaacagcaaaagtttatttggcccccttctcgctgagtaactatcagctagaccagctgatgtgcccaaagtcattaagtgaaaagaacagcaacaatgaggtagcctgtaaaaagaccaagatcaagaagacctgcaggaggatcatccctcccaaaatgaaaaacaccagtagtaaagctgaaagcaccctgcagaactccagttcagccgtgcatacagaatcgaacaaactccaacccaagcgcactgctgacgctatgaacttgtccgtggatgtcgagtcgagtcaggatggagatagcgacgaagacaccacccctagcctggacttcagcgggctgtcgccctacgagcgaaagagattgaaaaacatttctgagaacgcagacttctttgccagcctgcagctctcagagtcagcagcccgcctgagggaaatgattgaaaaacggcagccaccaaagagcaaaagaaaaaaacctaaacgagaaaatggaattgggtgtcggcgctcaatgaggttgcttaaagtagatcccagcggggtctccttgcctgccgcccctactccgccaacactggttgcagacgagaccccactgttgccaccaggccccttagagatgacttctgagaatcaagaggacaataatgaacgcttcaagggatttctgcacacatgggccggaatgtctaaaccaagcagcaaaaatactgagaaggggctctcatcaatcaaaagttacaaggccaacctcaacggaatggtgatctcagaggatacggtttacaaggtgactactggccccattttctccatggcactgcacccaagcgagactagaaccctggtggccgtgggggctaagttcggacaggtgggactttgtgacctgacgcagcagccaaaagaagatggtgtgtatgtgttccacccccacagccagccagtaagttgtctgtacttctcccccgctaatcccgcacacatcctttctctgagttacgacggaacactgcgctgtggggattttagccgtgctatctttgaggaagtgtaccggaatgagagatcctcattttcctccttcgacttcctggctgaggatgcctctacgctaatagtgggccactgggacggaaatatgtctctggtggaccgcagaacaccaggcacatcttatgagaaactgacatcttcctcaatgggcaagatccgcactgtgcacgtgcaccctgtccacaggcaatacttcattactgctggcctgcgcgacacgcatatctacgacgctagaaggctgaatagtaggcgttcacaaccgttaattagcttaacggagcacaccaagtccatcgcatctgcctattttagtcccctgacaggcaatcgcgttgtcacgacctgtgccgactgtaatcttcgtatcttcgatagtagttgcatttcgtctaaaattccactcctgaccaccatcagacacaacacatttacaggaagatggttgacgcgctttcaagccatgtgggatcccaaacaggaagactgtgtgattgttgggtcaatggcccaccctcgaagagtggaaattttccacgagactgggaagcgagtgcattcctttggcggggagtatttagtaagtgtctgtagtatcaatgctatgcatcctacaaggtacattctggccggaggaaacagcagcggtaagatccatgttttcatgaacgaaaagtcgtgctag

SEQ ID NO: 52383 - DNA, 1689 bp, Artificial Sequence
  Description of Artificial Sequence: Synthetic coding sequence
atgtgccccaagagcctgagcgagaagaacagcaacaacgaggtggcatgcaagaagactaagattaagaagacatgcaggcgaattatcccgcccaaaatgaagaacacgagcagcaaagcagaatcaaccctccagaatagttccagcgccgttcacaccgagagcaacaaactccagccaaagcggaccgctgacgctatgaacctctctgtagacgtggaaagctcacaggacggagatagtgacgaggatacaacgccctctctggatttttcgggcttgagtccttacgagcggaagcggctcaagaatatctcagagaacgctgactttttcgcctctttacagctctctgaaagcgccgctagactccgagagatgattgaaaaacgacagcccccaaagtccaagaggaagaagccaaaaagggaaaacgggataggttgccggcgcagtatgaggctactcaaagtggatccctctggcgttagtctgcccgctgctcctaccccacctactctagtagctgacgagacccctctacttcctcctgggccactggagatgacctctgagaaccaggaagataataatgaaagattcaagggatttctacacacctgggccggcatgtctaagccatcatctaaaaacacagagaagggattgtcttcaattaagtcttacaaagcaaatctcaatggtatggttatctctgaggacaccgtctataaggtgacaaccggaccaatttttagcatggctttacatccctcagagacacgtacgttagtggcagtcggggccaagttcgggcaggtcggcctttgtgacctcactcagcagccaaaggaggacggggtatatgtcttccacccacattcgcagcctgtgtcctgtctctatttcagtccagctaatccagctcacatcctttctctttcctacgatggtacactccggtgtggggatttctcccgggctatcttcgaagaagtatatcggaatgagcgctccagcttttcgtcctttgattttttggctgaagatgcctctaccctgattgtgggacattgggacggtaatatgtcactggtagacaggcgcacgcccgggacctcatacgagaagctcacctctagctctatgggaaaaatccgtacagtgcacgtacacccagtgcacaggcagtattttataactgccggtctgcgggatacacacatttacgacgcacggcggctgaactctcggcgatcccaacccctgatttccttgaccgaacacacgaagtctatagccagcgcctactttagtccacttacaggaaaccgcgtcgtgacaacctgcgctgactgcaacttaagaatctttgactcttcctgcattagctcgaagatccctctgctgaccaccatccggcacaatacgttcaccgggagatggctgactaggttccaggcgatgtgggaccctaagcaagaggattgcgtgatcgtgggtagcatggcccacccccgccgcgtagagatttttcatgagacaggaaaaagggtgcattcttttgggggcgaatatctggtatccgtctgtagtataaacgctatgcatccaacaagatacattctggccggtgggaactcaagcggcaagattcacgtatttatgaacgagaagagctgttag

SEQ ID NO: 52384 - DNA, 1638 bp, Artificial Sequence
  Description of Artificial Sequence: Synthetic coding sequence
atgacccccggcaagcacagcggcgccagcgcccgggccgccaacggtggagcttggggctacagggattttcgcggagggcagaagaagggatggtgtacaacaccacagctggtagctacgatgccagtatcccctgcagggtcacataaacaacagaacttcggtcttaacaacgccactcagccaaaaaaatctatttccttctttgctactatgaaggcaacctccgttaagggttacaccggagcgaaccaatcccgcatggctgtctcgaaaacagtgctcatcccccccgaattaaagactgtcgagaagcccaaccctaacattaagacgactcaggttttcgacattaacgggacagacgtaactccaagaccactttatcacccggaccccctaactggaactgccaagcctagcaaattgctcacctctcaggaaggtagtctgggatccgagtttatcagttcatatagcctgtatcaaaatactatcaatcccagcactctaggccagtttacccgatccgttctggggagctctacagttagcaaatcatcagtcagcgcgtctgagtcaattgcggaagacctggaagagcccagctataagcgagagcggttaacatcgttcacggaccttcaggtgatacgcgcagcccctgagaagatcgtgaccaaagaagatctggaaaagaacatcgaaattatcctgacagagaccgagaccctccgtttcttcgacctccccacagtcatggtgtctgtcgagtctgaggaagctgaaaaagtcactcagcgtaacaaaaattacgaagttttgtgtcggaacagactcggtaacgatttgtacgtagaacgcatgatgcagacctttaacggagcccccaagaataaggacgtgcaatgcgacaagatcataatggaggataaaggtatcatgagcactgcttgggacttatatgactcatacaatgcaatggagctagtctccctgtctgtgaagcagagcgtggtggagtcttcctccaaggccaatgtcctccctaaggaccaggatcagcgcctgccgggtagcactacagaaaagaattctgagacttcatcactgatggacatcgagaacgttatcttagccaagatccacgaagacgaagaagaccactccgatgctatcctaaagagtgataaatttcatcaggacctgttttttatggagagagtgctaatggagaacatctttcagccgaaattagccgcatatcggcagttgcccgtattaaaggaacccgaaccagaggaacccgaggatgtattggaaagtgcaaaacacgaagaagtcgaggaggaaagcaaaaaagaggaggaggaagagattcacgctgaagagagtaccataccagcgaacttggaaagactgtggagcttttcctgcgaccttaccaagggtctgaacgtctcttcacttgcctggaacaaaacaaatcccgacctgctcgctgtgggctatggccattttggttttaaagaacagaagaggggattagcttgttgttggagcatcaagaatcctatggtcacgcaaaccagaattcggtctatcttcatatggctactcactaaattctcttag

SEQ ID NO: 52385 - DNA, 2547 bp, Artificial Sequence
  Description of Artificial Sequence: Synthetic coding sequence
atgacccccggcaagcacagcggcgccagcgcccgggccgccaacgggggggcttggggataccgcgattttcgaggaggccagaagaagggctggtgtaccacaccacagctcgtagccacaatgccggtctcaccggcaggatctcataaacaacagaatttcggcctcaataatgccacacagccaaagaaatcaattagttttttcgccactatgaaggccacctcggtaaaaggctacactggtgctaatcagtccaggatggctgtctcaaagacggtgctaatcccccctgagctgaagactgtggagaaacccaaccccaacataaagaccactcaggtgtttgacattaacggaacagatgtcactcctcggccgctataccaccctgacccattaaccgggactgcaaagccaagtaaactgctcaccagccaggaggggagcttagggagcgagtttattagctcctattctctctaccagaataccatcaatcccagcactcttggacagtttacccggagtgtcttaggctctagcacagtgagtaagtcctccgtgtccgcaagcgaatccatcgctgaggacttagaggaaccatcctacaagcgcgagcggcttactagcttcacggatttgcaggtaataagggccgctcctgaaaaaatagtcactaaagaggaccttgaaaagaatattgagatcatcctgacagagaccgagaccctaagattcttcgacctccccactgtgatggtgagcgtagaatcagaggaagccgaaaaggtcactcagcgcaataaaaactatgaggttctgtgtaggaaccgcctgggaaatgacctctacgtcgagcgcatgatgcagaccttcaacggggcccctaagaataaggacgtgcagtgtgacaagatcatcatggaggacaaggggatcatgtccaccgcctgggacctctatgacagctacaatgctatggagcttgtttcattgagtgtgaagcagtccgtggtggaatcatcatccaaagctaatgtccttccaaaggatcaggatcagcgcttacccggcagtacaacggaaaaaaattccgaaacttccagtctgatggatattgagaacgtgattctcgccaagatccatgaggacgaggaggatcattctgatgctatcttgaaaagcgacaaattccaccaagacctttttttcatggagagggtgctcatggaaaatatcttccagcccaaactggccgcttataggcagttgcccgtgctgaaagaacctgagcctgaagagccggaagatgtgctggaatctgctaaacacgaggaagttgaagaagagtcgaagaaagaggaggaggaagaaatacacgctgaagagtctacgatccccgctaatttagagcgtctgtggtccttctcgtgtgacctgaccaagggcctgaatgttagctccctagcctggaacaaaaccaatcccgacctgctcgccgtgggctacggacattttgggttcaaagaacagaaacgcggcctggcctgctgctggagcatcaagaacccgatgtggcctgaaagaatttaccaatctccctacggagtgacggctgtggacttttccataggagctcccaatctgctggccgtagggtaccacaacggtacaatcgcgatatacaatgtccggtccaatagtaacgtaccggtcctggactcctctgagagcccccagaaacacctcggcccagtgtggcagctgcagtggatagaacaggacagagggactaccggcgatggtaagcgcgagatccttgtcagcatcagcgctgacggtagaattagcaagtgggttattcgcaaagggctcgattgctatgatttgatgaggttaaaaagaactacggccgcttccaacaaaaaggggggggaaaaagagaaaaaggatgaggctctgatttccagacaggcccccggaatgtgctttgctttccaccccaaggataccaacatctacctggccgggacggaagaaggacatattcacaagtgttcttgcagctataatgaacaataccttgacacttataggggccacaagggcccagtctataaggtcacatggaaccccttctgccacgacgtgttcctatcttgctccgctgattggggggtcattatttggcaacaggaaaacgtgaaaccttcactaagcttctatcccgcaacctccgtggtgtacgatgtggcatggtctccgaagtcatcctacatatttgccgctgccaatgaaaacagggtcgaaatttgggatttacacattagcacactggaccctctcatcgtgaacacagctaatcctgggattaaattcacgaccatcctgttcgccaaacaaaccgattgcttgttggtgggcgacagtgatggccaagtcagtgtatacgaactacgcaacatgcctaccgtactggagaccgggcgtggggacattatggacacgttgctggggtccaaatcaaaccagtccgcctag

SEQ ID NO: 52386 - DNA, 1686 bp, Artificial Sequence
  Description of Artificial Sequence: Synthetic coding sequence
atggtgagcgtggagagcgaggaggccgagaaggtgacccagcggaataagaactacgaagttctgtgcagaaatagactgggcaacgatctctatgttgaaaggatgatgcagaccttcaatggagcccccaaaaataaggacgtgcagtgtgacaagattattatggaggacaaaggaatcatgagtacagcctgggatctgtatgactcttacaacgccatggagctcgtgagcctgtcggttaagcaaagcgtcgtggaaagttcttcgaaagcaaacgtccttccaaaagaccaggaccagaggttaccaggctccaccacagaaaagaatagcgagacatcttcactgatggacattgaaaatgtgatcttagcaaagatccatgaggatgaggaggatcacagcgatgctattctgaagagcgataagtttcaccaggacctcttctttatggaacgggttttgatggagaatatctttcaaccaaagctggccgcatataggcagttaccggtgctaaaggagccagagcctgaagagccagaggatgtgctggagtccgccaagcatgaagaggtggaggaagagtccaagaaggaggaggaagaggaaattcatgcagaggaatctaccataccagccaatctggaacgcttatggagcttctcgtgtgacctgacaaagggactcaatgttagttcactggcgtggaacaagactaaccctgacctgctcgcagtggggtatggtcactttggttttaaggagcaaaagcggggcttagcttgttgctggagcattaaaaaccctatgtggccggagagaatctatcagagcccctatggtgttaccgcagtcgactttagtatcggcgcccctaacctcctggcggtgggttaccacaatggcaccatcgcaatatataacgttcggagtaatagcaatgtgcccgtgcttgattcctccgaaagcccacagaaacacctgggcccagtctggcagctccaatggattgaacaagataggggaactaccggcgacggcaagcgtgagattctcgtttctatatctgccgatggacgtatctccaagtgggtgattcgcaaagggctcgactgttacgatttgatgagacttaagagaacaacggcagcttctaataagaagggcggcgaaaaagaaaagaaagatgaagctcttatttcacgacaggctcccggaatgtgctttgcctttcacccgaaagggcctgtgtacaaggtgacctggaatcccttctgccatgacgtattcctgtcctgttccgccgactggggagttatcatctggcagcaagagaacgtgaaacccagtctgtcattttacccagctactagcgtcgtgtatgacgtggcttggtcgcccaaaagtagttacatctttgcggccgctaatgagaaccgagttgagatctgggatctccacattagcacactggacccgctaatcgttaacaccgccaaccccggaattaagtttaccaccatcttgttcgccaaacaaacagattgtctactcgtcggggacagcgatggccaggtttccgtttatgagcttagaaacatgccaacagtgctggagaccgggaggggagacatcatggatacactgctgggttctaagtctaatcagagcgcatag

SEQ ID NO: 52387 - DNA, 2673 bp, Artificial Sequence
  Description of Artificial Sequence: Synthetic coding sequence
atggacggcgagccccccgccagcagcggcctgggcctgcccgactatacaagcggggtcagcttccatgaccaggcagacttacctgagacggaggactttcaggctggcctgtatgtgaccgaatcacctcagccccaagaggctgaagctgtttccttgggaaggctttcagataaatcgtccacatccgagacgtctttaggggaggaacgagctcccgatgagggcggagcgccagtggacaagtctagtctccggtctggggactcgtctcaagatctgaagcagtccgagggcagcgaggaggaggaggaggaagaggatagctgtgtggtgctcgaggaagaggagggtgaacaggaagaagtcacaggcgcctcggaacttaccctttctgatacggtgcttagcatggaaacagtggtggctggaggatctggaggagatggtgaggaagaggaggaagccctccctgaacagagcgaaggaaaggagcagaaaatcctccttgacacagcctgcaagatggtgcgatggctgtcagccaaacttggacctacggtagcctctcggcatgtcgctcggaacctgctacgcctcttgaccagctgctatgtgggtccgacgaggcagcagttcaccgtatcttccggtgagtctcctccactgagtgccgggaacatttaccagaagcgccctgtgttgggcgacatcgtgtctgggcctgtgctgtcatgtctgctacacatcgcccgcttatatggcgaaccagtcctgacctatcagtatttgccttacatcagctacctggtcgctccaggcagtgcatccggaccatctcgtcttaattcaagaaaagaggcgggacttctcgccgccgtgactttaacacagaaaataatcgtatacctgtctgacacaacattgatggacatcctgcccagaatcagtcatgaggttctgctgccagtactatctttcttgacgagtctggtgactgggttcccatccggcgcccaagcaaggaccatcctgtgcgtcaagacaattagccttattgccctgatctgccttcgtatcggtcaggagatggtccagcagcatttgtctgaacccgttgccacctttttccaggtctttagccagctccatgaattgcgacagcaggatctaaagctcgatcctgctggccggggcgagggacagctaccgcaggtggtcttttcagacgggcagcaaaggccagtggaccccgctctcctggatgagctgcagaaagtcttcaccctagagatggcttatacaatctatgtcccattctcctgccttctgggcgacataatccgaaaaatcatccccaaccacgagctcgtcggcgaactcgcagccctgtacctggaatccatttccccttcttcacggaacccagcctcggttgaaccaaccatgcccggtacggggccggagtgggatccacatgggggcggatgtcctcaggatgatggccattctggaacattcgggagcgtgttggtcgggaacagaatacaaatccccaatgactcccggcctgagaatcctggaccattaggtccaataagtggggtcggaggcggcgggctgggaagtggttcggatgataacgccctcaagcaggagttgcctcgaagtgttcatgggttatccggaaattggttagcctactggcagtacgagatcggtgtgagtcaacaggatgcccattttcacttccatcagatacgcttgcagagcttccctgggcacagtggggccgtcaagtgcgtggctccactgtcatccgaagactttttccttagcgggtcgaaagaccggacagtgcgtctgtggcctctctataactacggggacggaacttccgagaccgcccccaggctggtatacacccaacatagaaaaagtgtttttttcgtgggccagctggaagcaccgcaacatgtagttagctgcgacggagcagtgcatgtgtgggatccattcactggaaaaacccttaggaccgtggaacccttagacagtcgcgtgcctctgactgccgtggcagtgatgccggccccccatactagcatcacgatggcctcttccgattccactcttcggttcgtggattgccgcaagcccggcctccagcatgaattccggttgggtggaggccttaaccccggcctggttagagcactcgccatcagtccatccggaaggtcagtcgttgcaggattttcctccggattcatggtcctgctggacacacggaccggcctggtcttgcggggttggcctgctcatgaaggcgacattctgcaaattaaggcagtggaggggtcggtgttggtcagcagtagtagcgaccatagcctcaccgtgtggaaagagttggagcagaagccaacgcaccattacaaaagcgcatccgaccccatccatacttttgacctgtacgggtcagaggtagtgaccggcaccgtgtccaacaaaattggggtctgtagtctcctggagcctccgtcccaagccactactaaactgtcttctgagaatttcaggggcacactcacatcccttgcgttactgccgaccaagaggcatctgctcttgggatccgataacggagtgattcggctgctggcatag

SEQ ID NO: 52388 - DNA, 2079 bp, Artificial Sequence
  Description of Artificial Sequence: Synthetic coding sequence
atggacggcgagccccccgccagcagcggcctgggcctgcccgactacacgagtggagtgtcgtttcatgaccaagccgacctcccggaaactgaagactttcaagccgggctgtatgtaaccgagtcaccacagccccaggaagcggaagcggtgagcctgggacgcctgagtgacaaatcctcaacctaccagtacctgccatacatctcttacctggtggctccaggcagcgcatctggcccatcaagactgaattcccggaaagaggccgggctgctcgcagccgtcacacttacccagaagatcattgtttacttatctgacactaccctgatggatattctgccgcgtatctctcacgaggtgctgctgcctgttctatcgttccttacgtcacttgttaccggatttcccagcggcgctcaggccaggacgatcctgtgcgtgaagactatctctctgattgctttaatatgcttgcggattggacaggagatggttcaacaacacctgagtgaaccagttgccacattcttccaggtattcagccagttgcatgaactccgccagcaggacttaaagctggaccccgccggcaggggcgaaggtcagcttccccaggtcgtgttttcagacggccagcaacggcccgtagatccagctctcctcgacgagctgcagaaagtcttcactctcgagatggcctacaccatttacgtgcctttcagttgtctcctgggcgatattatacgcaagattattccaaatcacgagctggtgggcgagctagccgcactgtacctagagagcatttcaccttcgtctaggaacccggcttcagtcgagccaacaatgcccggcaccggcccggagtgggatcctcacgggggtggctgtccacaagacgacggtcacagcggcacattcggaagtgtcctggtcggtaataggatacagattcccaatgacagccgcccagagaaccctggcccattggggcccatcagcggagtcgggggtggcggcctgggcagtggctccgacgacaatgccctgaagcaagagctgcctcggtcggttcacggactgagtggcaactggttggcctactggcagtacgagattggggtttcccagcaagatgcccattttcatttccatcagattcggttgcagagtttccccggtcacagtggggccgtgaaatgcgtggctcctttaagctccgaggactttttcctttctggctccaaggaccggacagtccgtctgtggcccctctacaactacggggacgggacgagcgagactgctcctcgtctggtgtacacacaacacagaaaatctgtgttctttgtagggcagctggaggctccccagcatgtggtgtcttgtgatggagctgttcatgtctgggacccatttactgggaaaacgctgagaactgtggagcctttggatagtcgggttcctctgaccgccgtggccgtgatgccagcgcctcatacatctatcacaatggccagttcagatagcactctgcgctttgtggactgtcgcaagcctggtttgcagcacgagtttagactcggaggtggcctcaacccaggcttggttagggcactggccatttctccatccggccggtctgtggtcgccggcttctcctcaggattcatggttctgctcgataccagaaccgggctagtcctgcgagggtggcctgcccacgaaggtgacatcttgcagatcaaggcagtggaggggtctgtgctggtttcctcatccagcgatcactcactgacagtgtggaaggagctggaacaaaaacccacccatcactataaaagtgcctcagatcccatacacacctttgacttgtacggcagtgaagtcgttactggcacagtctccaacaagattggcgtgtgtagtttgctcgagccaccgtcccaggcgactaccaagctaagctctgagaatttccgcggtacacttacatcactggccttactccctacaaagagacacctgttgctgggtagcgacaacggagttatcaggcttttggcttag

SEQ ID NO: 52389 - DNA, 2217 bp, Artificial Sequence
  Description of Artificial Sequence: Synthetic coding sequence
atgctggtgcgggtggtgctgagcctgacccccagcttccccgagccctccgccctatacaccgcctgtaagatggttagatggctgtccgctaaactcggcccaacagtggcatcaagacacgtggccagaaacctactgaggctgttgaccagctgttacgtgggacctaccaggcaacagtttacagtcagctcaggtgagtcacctccattgagcgccgggaatatttaccagaaaagacccgtgctgggagacattgtctccgggccggttctttcctgtttgctgcatatcgctcgtctttatggtgaaccagtgcttacctaccaatacctgccatacatcagctacctggtggcccctggcagcgcttcgggccctagcaggctgaattcccggaaggaagccggcctcttggcggcagttacactgacgcagaagatcatcgtctatctatctgacactaccttgatggatattctgccccggatttcccatgaggtactcttacccgtcctttctttcctgacgtccctcgtgaccggattccctagtggagcacaggctcgcacaatactgtgcgttaagacgattagcctcatcgccctcatatgtcttagaatcggacaggaaatggtgcaacagcacctgagcgagcccgtagcgacgttcttccaggtcttttctcaactgcatgaactaaggcagcaggatctgaagttagaccctgctggcagaggcgaggggcagctgcctcaggtcgtcttttcagacggacagcagcggccagttgatcctgccctcctggatgaacttcagaaggtgtttactctggagatggcctacactatctacgtacccttctcgtgtttgctcggtgacattatccgaaagatcatcccaaaccacgagttggtcggcgaactggccgctctttatttagaatcgatttcaccctcaagccgtaacccagcctcggtcgaacccaccatgcccggcacaggaccagaatgggacccccacggcggtggatgtccccaggacgacggacactcggggacttttggctccgtcctggtgggaaatcgcattcagatccccaatgattctcggcctgaaaatcctggtccactcggaccaataagcggcgtcggagggggtgggctgggctctggtagtgatgataacgctctcaaacaagagctgccgcgatctgttcatggcctatcgggcaactggctggcctactggcaatatgagattggcgtgtcacagcaggatgcgcattttcactttcaccagatccgactccagtcatttcccgggcattccggagctgtgaagtgcgtggcacccctgagtagcgaggacttctttttgagcggcagcaaagaccgcacagtccgactctggccactctacaattacggggacgggacaagcgagactgctccaagactggtgtacactcagcatagaaaatctgtcttcttcgttgggcagttggaagccccacagcatgtggtgagttgtgatggtgccgtgcacgtctgggacccattcactggaaagaccctgagaacagtagagccattggattccagggtgccgctgacagccgtggccgtcatgcctgctcctcacaccagtattaccatggcaagctccgactcaactttaaggtttgtggattgtcggaagcctgggctccagcacgagtttaggctggggggagggttaaatcccggcttagttcgagctctggccattagtccctctgggcgctccgtggtggctggcttcagttctggattcatggtgcttctagatacgcggacaggactggttctccgagggtggcctgctcacgaaggcgacattctgcagattaaagcggtggaggggtccgtgcttgtctcttcatcttcagatcattcgctgacggtctggaaagagctcgagcagaaaccaacacaccactataagtctgcatcagaccctattcataccttcgatttgtatggatctgaagtagttacgggcaccgtatccaataagatcggcgtctgttcattgctggaacccccctcacaggccacgacaaaactgagtagcgaaaactttcggggtaccctgaccagcctggctctcctgcctactaagaggcacctattgcttggatccgataatggggtgattaggctgctagcctag

SEQ ID NO: 52390 - DNA, 1719 bp, Artificial Sequence
  Description of Artificial Sequence: Synthetic coding sequence
atgggcagcctgagcagccccaccagcacctgccccaccagcgccacctggtttcccagcggcgcgcaagctcgtactattttgtgtgtcaagacaatttccctgatcgccctcatttgccttcggatagggcaagaaatggttcagcagcacctgtcagagccagttgccactttttttcaagtcttttcccagctccatgaactccggcagcaggacctcaaactcgatcccgccggtagaggggaaggccagctcccacaggtagtcttttcggatggccagcaacggcctgttgacccggcacttttggacgaacttcaaaaggtctttactttagagatggcctacaccatttatgttcctttcagctgcctcctgggtgacatcatccggaagattattcccaatcatgaattggtgggcgaactggctgccttgtatctagagtctatatcacccagcagccgaaaccctgccagtgtagagccaacaatgcctggaacaggacctgaatgggatccacacgggggaggctgcccccaggacgacgggcactccggcactttcgggtcggtactggtggggaatcggattcagattcctaacgactcacggccagagaatccggggcctctgggacccatcagcggggtgggaggggggggactcggctcgggcagtgatgacaacgcattgaagcaggagctgccgaggtcagtgcacggcctgtccggaaactggttggcatactggcagtacgaaattggagtcagccagcaggacgcccacttccactttcatcagatacgccttcagtcctttccagggcactccggcgccgtaaaatgtgtggctcctctctctagtgaggactttttcctgagcggaagcaaggatcggacagtgaggctgtggcccctgtacaattacggcgacggtacctctgaaactgcccctcggctagtctatacccagcaccgcaaatccgtattcttcgtgggacagcttgaagcaccacaacacgttgtctcatgcgatggcgctgtgcatgtttgggaccctttcacggggaagacattacggaccgttgaacccctggactcccgagtgccactcactgctgtggcagttatgccagccccccacacgagtatcacaatggctagctcagatagtaccctccgattcgttgattgcaggaagcccggcttgcagcatgaattcagactgggcggcggcctaaatccgggcctcgttcgcgccctggccatctctccttctggtcgctcagttgttgctgggttcagcagcggcttcatggtgttgttggatacacggaccggtttggtgctgagaggttggccggcccacgaaggcgacatcttgcagatcaaggcagtcgaaggctcagtcctcgtgagctcttccagtgatcatagtctgactgtgtggaaagagctggaacagaagccgacacaccactataaatccgctagcgacccaatacacactttcgatctttacggctccgaagtggtcactggaactgtgtctaacaagatcggggtgtgctcccttctcgagccaccaagccaagccaccacgaaactatcatccgaaaacttccgcggaacgttaactagcctagcgttgttgcccacgaaacgtcatttgcttctaggctctgacaacggagtgataaggctcctggcatag

SEQ ID NO: 52391 - DNA, 5826 bp, Artificial Sequence
  Description of Artificial Sequence: Synthetic coding sequence
atggcccagggcagcggcggccgggagggcgccctgcggacccccgccggcggttggcacagtcccccgtctcccgatatgcaggagctactgcgcagcgtggaacgagacctgtccattgaccccagacagctggccccagccccaggaggcacccacgtagtcgctctggtgcccgctcggtggcttgcaagcctccgcgaccgaaggctccctctgggcccttgcccaagggcagaagggctcggggaagccgaggtgcgaactttgctacaaaggagcgtccagaggctcccagcaggatggaccagggtcgaggtgcatggtttgaggaagcgcaggttgtcctatccactcggaggaggtctcccctttgaggacggctcgtgcggcccggagacccttaccaggttcatgcaggaggtggctgctcagaactaccggaacctttggagacacgcctaccatacttacgggcaaccttactctcattcccctgccccctcggctgttccagccctggactctgtgcgccaggcgctgcagcgggtgtacggctgctcctttctgccggtaggcgaaaccacccaatgcccaagctacgcccgcgaagggccttgtccccccagagggtctcccgcctgtccatctctcctgagagccgaggctttgctagagtctcccgagatgttgtacgtggtccatccatacgttcagtttagtcttcacgacgttgtgacattcagcccagctaaactgacgaattcccaggctaaggtcttatttattctattccgggtattgcgggcaatggatgcttgccatagacagggcctggcttgcggcgcgctgagtctgtatcacatagcagtcgacgagaagctgtgtagcgaactccgtctggacctgtcagcatacgagagaccagaggaagacgaaaatgaagaggcacccgtggcacgggatgaggccggaattgtttctcaggaagagcagggaggacagccgggccagcctacaggccaggaagagctacggtcactcgtgctggattgggtgcacgggcggatttccaacttccattacctgatgcaactaaacaggttggcagggcggcgacaaggtgatcccaattaccatcctgtactcccatgggtggtcgacttcactacaccacatggcagattccgggatttgcgcaagtccaagttcaggctaaacaaaggggacaagcaactcgatttcacatacgagatgaccagacaggcgtttgtggctggtggcgcagggggtggcgaacctccacacgttcctcatcacatatccgacgtactgagcgatatcacctactatgtctacaaggcccggaggaccccaaggagtgtgctctgcggccacgtcagggcccagtgggagccacatgagtatcccgccagcatggaacggatgcagaactggacccctgatgagtgtatccccgaattctacacagatccctcgatattccgctctattcacccagacatgccggatctggatgttccagcatggtgtagcagttcccaggaattcgtggctgcgcatagggccctgctagaatccagagaggtatctcgagatctccatcattggattgatcttaccttcggatacaaacttcagggaaaagaggctgttaaagaaaagaacgtctgtctgcacctcgtggacgcacacacccacctggcctcttacggggtagtgcagctatttgatcagccgcaccctcagagattggcaggggccccagctctggcccccgagcccccgctgatcccaaagctccttgtgcaaaccattcaggagactacagggcgcgaggacttcacagagaatccggggcagctccccaacggggtggggaggcccgtattggaagctactccgtgtgaagcttcttggacaagggaccgccccgtggcgggtgaggatgatttggaacaagctactgaggcactcgatagcattagtcttgctggcaaagccggggaccagctgggctcgagctcccaggcctcacccggtctgttgagcttcagtgtcgcatctgcttcacgacccggccgaaggaacaaagctgctggggccgatcctggggagggcgaggaaggtcgaattttactgcccgagggtttcaaccccatgcaggctctcgaagagttggagaagactggtaacttcctggcgaagggtcttggcggcttgcttgaggtgcccgaacaaccacgggtccagccagccgtacctctacagtgtttgcttcaccgcgacatgcaggcactgggcgtgctgctggctgaaatggtgtttgccactagggtcagaacgctgcagcctgatgcgcccttgtgggtgcggtttcaggccgttaggggcctttgcacaagacatcctaaggaggtgccggtttcgcttcaaccagtcctcgatacattgttgcagatgagcggtcccgaggtcccaatgggcgccgaacgcggcaagctggatcagctattcgaatacaggcctgtctcgcaggggctcccacccccctgtccatcacagcttcttagccctttctcatccgtggtcccgtttcccccatatttccccgctctgcacagatttatccttctctaccaggccaggagggtggaggatgaggcacagggtcgggaactggtgttcgccctctggcaacagctcggagctgtgttaaaagacatcactcctgaagggttggagattctgttgcccttcgtcctgtccctgatgtccgaggaacacaccgcagtatacaccgcttggtacctttttgagcccgtggcaaaggccctgggccccaagaatgctaataaatatttactgaagcccttgattggcgcttacgaatctccttgtcagctgcacggccgtttttatctctatactgactgcttcgtcgcacagctgatggtccggttaggcctccaggctttcttgactcatctccttccccacgtcctgcaggttctagccggggcagaagctagccaggaggaaagcaaagacttggccggagcagcggaagaggaagagtccgggttacccggtgccggccccgggtcttgcgcgttcggggaggagattccaatggatggggagccacctgccagctccggtcttggcctcccagattacacatcgggcgtgtccttccatgaccaggccgacttgcctgaaactgaagacttccaggctgggctctatgtcaccgagagtcctcagccacaggaggccgaggccgtctccctcggccgactgagtgataagagttctactagcgaaaccagcctgggcgaagaaagagctcccgatgagggaggcgccccagtcgataaatccagccttagaagcggagattccagtcaggacctgaagcagtctgagggttccgaggaggaggaggaagaggaggatagttgtgtggtcctggaggaagaggaaggagagcaagaggaagtcacaggtgctagcgagctcaccctttccgacaccgtgctgtcgatggaaaccgtggttgccggtggctccggaggagatggggaagaggaggaggaggctctaccggaacagtccgaagggaaggagcaaaagatccttctggataccgcctgcaaaatggttagatggctatctgcaaaactgggccccaccgtggcttctagacacgttgcgcgcaatctactgcggttgctgacttcgtgttacgtgggccctacacggcagcagtttacagtgagtagtggggagtccccgccgctttctgccgggaatatctaccaaaagagaccagtgttaggagatatcgtcagtggcccggttttgagttgccttctgcatattgcccggctgtacggcgagccagttctgacataccaatacctgccttacatatcctatttggtagcccctggatcggcctccgggccctccaggctgaacagccgcaaagaggccgggttattagctgcagttactctaactcagaaaatcatcgtatacctttccgatacaacattaatggatatcctgcctcgcatcagtcacgaggtgttgctgccagtcctgtcttttttaacttctctggtgacaggatttccctctggtgctcaagcccgcaccatcctgtgtgtaaagactatatccttgattgctctaatttgtctccgaattggccaggagatggttcagcagcaccttagcgagcctgttgctaccttcttccaggtgttttcccagctgcatgagctgcggcagcaggacctgaaattggaccccgctggtcgcggcgaaggtcagctcccgcaggtagtattttcggatggacaacagcggcccgtcgaccctgcgcttctagatgagctgcagaaggtatttactctagaaatggcatatacaatctacgtccccttttcttgccttctcggcgatattattcggaagatcatcccaaaccacgaactcgtcggtgagctagcggccctgtatctggagtccatctcgcccagcagtaggaaccctgccagtgttgagccaactatgccgggcacaggacccgaatgggacccccatggggggggctgccctcaggacgacggccacagcgggactttcgggtcagtgttggtgggcaacagaatccagattccaaatgactccagacccgagaaccctggtccgctgggcccaatcagtggagttggtgggggcggtcttgggagtggttctgatgacaatgccctgaaacaggagctgccaagatcagttcatggtttatcaggaaactggctggcatactggcaatacgaaatcggggtttcccagcaggacgcccatttccactttcatcaaattcgcttacagtcatttccgggccactccggtgctgtcaaatgtgtggccccactgtcgtctgaagatttctttctgtcaggttctaaggacagaacggtgaggctgtggcctttgtacaattacggagatgggacctctgaaaccgcccctcggctagtgtacactcagcacaggaagtctgttttttttgttggccaattggaggcaccgcagcacgtggtgagctgcgatggcgcggtacatgtttgggacccgttcaccggaaagacattacgaacagttgagcccctcgattctagggtgcctctgaccgcagtagcagttatgcctgctccccacacttccattaccatggcctcttctgactctactctgaggttcgtggactgtagaaaacctggtctccaacacgagtttagactgggcggagggctaaaccccggcctggttcgtgcgctggctatttcaccaagtgggaggagcgtggtggcgggcttcagttccggctttatggtgctgctagacacacgcacaggtcttgtgctccggggctggcctgcacacgagggagacatcctgcagattaaggcagtggaaggcagcgtgctggtgtcaagtagcagcgaccatagcttaacagtttggaaggaacttgaacagaagccaacccatcattataaaagcgcgagtgatcccatacacacatttgacctgtatggaagcgaggttgtcaccggaacagtgtcaaacaaaatcggcgtgtgcagcctcctggaacctccatcccaggctactactaaattgagcagcgagaacttcagaggaactcttacctcccttgcgttgctacctaccaagagacatctgctgctgggcagcgacaatggggtaataagattgttggcctag

SEQ ID NO: 52392 - DNA, 2145 bp, Artificial Sequence
  Description of Artificial Sequence: Synthetic coding sequence
atggtgcggtggctgagcgccaagctgggccccaccgtggccagcagacatgtggcccggaatcttctgcggttgctcacatcttgttatgtagggcccacacgccagcagtttaccgtctccagcggagaatcacctccattgagtgctggcaacatttatcagaagagacctgtgctgggcgacattgttagcggccctgttctctcatgtcttttgcacattgcaaggctttatggagagccggtactgacctaccagtatcttccctatatatcttatcttgtggcaccaggttcggccagcggcccttctcggctgaactctagaaaagaggccggcctgttggccgccgtaacgctgacccagaagataatagtgtacctaagcgacacaactctgatggacatcctccctcgcattagccatgaagtgcttctcccagtgcttagctttctgactagtctagtcacggggtttccttctggcgcgcaggcccggacgattttgtgtgttaaaaccatctcccttatcgccctgatctgtctccggattggtcaggagatggtccaacagcatctttctgagcccgtcgccactttcttccaagtctttagccaactacatgaactgaggcagcaggacttgaaactggaccctgccggacgcggggaggggcagcttcctcaggtggtgttttcagatggccagcagcgcccagtggatcctgcactactggacgagctccagaaagtttttaccctggagatggcgtataccatctatgtgccattctcgtgtctccttggtgacatcatccgtaagataatcccaaaccatgagctggtgggagagctcgcagcgctctatctggagagtatctccccctctagccgcaatcccgcctcagtggagcctaccatgccaggaaccggccccgagtgggacccacacgggggcggctgcccgcaggacgatggccactctggcacgtttggtagcgtactcgtggggaaccgcatccagatccccaatgacagtcggcccgagaacccagggccactggggccaatctccggagtaggagggggaggactcggctctgggtcagatgacaacgccctgaaacaagaacttccgagaagcgttcacggcctttccgggaactggctggcctactggcagtatgagattggggtgagccaacaggatgcccacttccattttcaccagattcgcttgcaatctttccccggtcacagtggggctgtgaaatgcgtggctccactttcctccgaagattttttcctgtctggaagcaaggacagaacagtgaggctgtggccactgtataactatggggacggcacctccgagaccgcaccaagattggtgtatacccagcatcgcaagtccgtgttttttgtaggccaactcgaggctccacagcacgtggtctcgtgtgatggtgccgtccacgtttgggatcctttcacaggtaagacactaagaacagtggagcccctggattctagagtacctctgactgcggtggcagtaatgcccgcaccacatactagcatcacaatggcatccagtgacagcaccctcagattcgtggattgtaggaaacctggcctgcagcacgagtttcgccttgggggagggcttaatcccggactggtgagggccctcgcaatctcaccgagcggcaggagcgtcgtggccgggttttcttccggctttatggtgctgctggatacacggaccgggctcgttctcaggggctggcccgctcacgagggcgatatccttcagataaaagctgtggagggaagtgtgcttgtcagctcctccagcgaccacagcctgaccgtgtggaaggagctcgaacagaaacccacgcatcattataagtctgcctcagaccctatccatacctttgacctttacggtagtgaggtagtgacgggcaccgtcagtaacaagattggtgtttgctccctcttagagccgccttcccaggcaactacaaagctgtcgagcgaaaatttcaggggaacactgactagtctggcattactgcccactaaacggcatctgctgttgggctccgacaatggagtgatccgcttgctagcctag

SEQ ID NO: 52393 - DNA, 834 bp, Artificial Sequence
  Description of Artificial Sequence: Synthetic coding sequence
atgagccgggagttccggggccaccggaactgcgtgctgaccctggcttattctgcaccctgggacctcccaagtacaccgtgcgccgaagaggccgccgctgggggacttctggttacgggctctaccgacggcacagccaaggtttggcaggttgctagtggatgttgccaccagacacttcggggccacactggggcagtgctttgcctggtgctggacacacctggacacactgcattcacagggtcaaccgacgccactattagagcttgggatatactgagtggggagcagctgcgagtattccgagaacaccgaggctccgtcatatgtctggaatgttcacgagccgccggtaccttagcacccggtccctccacgcgctcacttgaaagctgcggtgggtgctccggcgccactcatagttctagtacggcgtcacggtgcaccgcccgatgctccacccctcctcgtactacggccccttgcgccagtggaacttgtgcggggagcgaggtgcctcggggcccgctccgcccatgtgccgcgtctagggggtcttctgctactcgctgggctgccccccctaggccttgctcaagacccgatccagcaggtccactacagacaccagcgcagactccaagtggcagccagtccgcccccccttgttaccctcgctggtggcggccaatggcaggggaagggcgcggagcgcgaaaaccaggaagggaggaaagccccagccaggcaagtgggtttagcctcgtcgcccgcaggcgctgggagagagagtgctccccatgggggcccccgccttttcctttctag

SEQ ID NO: 52394 - DNA, 1131 bp, Artificial Sequence
  Description of Artificial Sequence: Synthetic coding sequence
atgggcggcggcggcagcgccctgcgggtgtgcgccgaccaccggggtggtatcaactggctgagtctgtctcccgatggacagcgtctgttgactggctcagaggatggcacagctagactgtggtccacagctgatgggcaatgctgtgccctgctgcagggccatgaatcctacgttaccttttgccagttggaggacgaagccgcctttacatgtagtgcagattgcacgatcagacggtgggatgtcctgactggtcagtgccttcaggtgtacaggggccacacaagcatcgtgaatagaatcctggtagctaataatcagctgttttcctctagctacgatcggaccgcacgagtatggtcggtggataagggtcagatgagtagggagttccggggacatcgaaactgcgtccttactctggcatactcagcaccctgggacttaccgagtaccccttgtgccgaggaagctgccgccggtggcctgttggtcaccggcagtaccgatggcacagccaaggtttggcaggtagcttccggctgctgccaccagaccctgcgcggccataccggagcagtattgtgcctggtgcttgatacccccgggcacaccgcttttaccggttccactgatgcgacaattcgcgcctgggacatcctgagcggagaacagctcagggtcttccgggagcacagaggctcggtaatatgtctagagttagttaatcgtctagtgtattctggatccgccgacaggacagttaagtgttggttggctgatacaggcgagtgcgtccgtacatttacggcccaccggcggaatgtcagcgctttgaaatatcatgctggaaccctcttcacaggctcgggagacgcctgcgcacgtgcatttgatgcccagtccggagagctccgtagagtcttccggggccacacattcatcatcaactgcatccaggttcatggacaggttctgtacaccgcgtcacacgacggagctcttcggctgtgggatgtcagaggcctgagaggggccccacgacctcctccaccaatgaggagcctcagcaggctgttcagcaacaaggtggggtgtgcagccgctcccctgcaaccagcatag

SEQ ID NO: 52395 - DNA, 8622 bp, Artificial Sequence
  Description of Artificial Sequence: Synthetic coding sequence
atgagcagcccccggctgatccccctgtggaaggacctgaagctgcttttgaacgacaccatcaacaagtccaaacagcctagtgaggaccctaaaaattgtctgatcgtcttgtcggatcggtcccaggcagtcgcctggatgaagtcgaaaactgaggacatggtagaaaaaaggaccttctcgatgacggaaagactccccccaattcagtctatggtgcacgcgggttcgtttcatatactggtagtctactgcggcgatttgattctgcgactgtttggagaccacttccgggctttcaagccccttgggaaagttccctgtcgcttcaatataagttgcttatgttacgacccagagatgaaaatgctgctgagcggcatcctgggcgctgtcgttacatgggtgatagagttgggaggtactggcctccagattgcccacatggtgtcaatgccaggcgatgaacttgttcaagatatcgtattaaacggcccatctggcagtttgctagccctttgcgagactgtggtccgtgtgcttatgcaccagggtaagggccagctgggggaggtgaagcggtttacatcgacatcgtcaggttcctctattacatgctgcttcacatgcttcgatcaaggatttttgtacgcaggcaatcaggccggtgagatccaggtgtggagtttgcaacagggacaccctctgcattcattccaagcccaccagagcggagtgatttgtatccgaagtcggccagaagcacataccctcctgaccgctggaagtgactccctcattaaagaatggaacctgaccagcggttccctgctgagacggctcgaattaggcgaagaattataccgtctacagtttatagacagcatcacattcttttgccagacagcacactccttcagccttcatcggctcccctgtttttattcactgtttaatgtgtgtgggtccgcccctcagcagctgcggcgggtctgttgtggcaacaattggttccgaatcctttgtacgacggaggatgggctgctgcggttcgtgtcccctgtgaccggagacctcctggtaattacctggcccttttcgatcctggatcaggcagtggattgggcttacgacccaggtaaggaagaactgttcgttgcaacgggcagctcagaagtccttgtcttcgatacaactcggtgtccgtgtcccgcaaagtacctcttgggcacatctcccaatagtcaggatttcgtgcaatgtctcgcctacggtcacttcaatctcgggcgcgggttagaggggctcattttcagcggtcaccagtctggggtgattcgggtgctgtctcagcattcttgcgcccggctggagaaatttatgcacttcggagctgtgctggctctgagtactctttccgggggcatctttggcggccagggaaactccttgctctgctcctacggcatggacgattatgtgcatctgagcgaggctgtccttgatggggtcaaggtgcagctcagaccacttgcttccattttgtcaagctgtcatctgacacacctgattctgttgcccaagtccgtgggcgctataactgaaacaaactgcctgcgcctgtggaagtttcacgattttctgagttcgggtagccagaacgggctgaaatttatcgagaccttgccgctgcacctgtgcgctataacgtcctttgacgtctgtttgtcactgtctctgttcgttacaggcagcgctgacggaagtgtcaggatttgggattttcatgggagattaatcggcattttagattccagtctgcatttcggccccgtgtgttttgccaatgaccgcggcgacctacttgtgacctttaaccagtctctttacttggtctcctgtctgaagctcctgccccccgcacttctcacaagactgagctttatgagcattagcgatgaggttctggaagtgccaaagccctttataccctcgtttttttttagcttcgagactatgttcgtgccaaagtacatctaccccggtcaagcccagcagaagctggtgggcttagagaagttggtgaataatcgagcaatagcttttgatcacagtgtgcctcatgtaatcgaggaggatgaggagggcagtcccgtgctgctgcgtagctctatgcattattcattgcaagatatggaagattggatgcaggtgtcaaaacggtatcagtgccattacgtgctgccacctcaattgcagctgacgagttgggatgggttgaatccctatcagatcctgcgatactactttggtcatggtagagaatggctgttcgctccagattgctacatccctaattcagtcatcagggcaaggctctggccagagggcacacctatctatctgcagtgcaacctgcacgctccgcagagggaactcgagtgggacaggtctcaagagtttttcttctggcactcgcgtgttcgagctatttcgaatacagaatacccaaagaacaaggaagaggacgagcatttcctcgagatgagactatcaaaagatgtcacatattcagtacttaccgacggagcaaaccgctcttggttgggccgtaagatgtccgaaatcaccattaacagcatgattgaaacgatgctcaatatcatggttcacgcgagcctattaaaatatcagtgctgtgttggtgctctagggcaaatcttcgcctcgtatcaggtgtctcctgcgttgcggagtgaaacggcccgccgactgctaaacgacacaaccaactcgaacccactcatcagagaactggcttgggagggactaaagaggctcggaatgattacacatctgttcgctatgcctctggcccagggcctcatggataaagacgagagagtgagaatcaagactctctcgctcatggcggagattggcatccacagcaggacctccctgctccagctgacccagaaacaggaaacctttagggaaatgcagcagcaaatgattggggaggaaccattagaccacttactgggaatgcgcgccacagacttgcagattttaagtactcaagtcgaacagaggttaaacgagaacttgaccctttcacacagggacgaaaagccagctttctcactggacgttagtatgccatctgagctgaagagctcactgaagccaccgacagtgtcagaggaatctgaggtggcaatcaagccaagtaagggacaaaggaggggacaggccggtgtgaaaaaacacagtcagaagtggttgagaggcctgaagaagactaaagagcgggattctaagcaaatgtcaacagaaccaggcctgttggaagacgaaagcgggaccgaggccgctccaatcgagatggaagaggcgtctgtttactctcagtggagttcctccacaagcgtgatcaagctcagcaaagacgtggacagtcaagaaaaggacatctcaaaggatcacattgccctgacattaaagcgtttacagaaaatccgtgacaagcgcgataaaaaggccactgcacaaaaactgaagaaaaagcataagaaaaaggggaaggaggcgaaggtgatcaacgaggagactacaccacctgtgatggagcagccggtaacgaaaaaagtgaaaattcagggcaggggcgcctcaggcatctccgggcgtagaagcaccgccggtgacgggtcttcatggcgtgatgacctgtgtaggcttatggcactgaggattagcggcagtcagacgaaaatgtcagaaaatctcaacgctgaattggttacattcgcacaggaaatgcttgtggatcggcatcctagttgggagctattccaggagatctgtccactcctgaagaaggagtccaaagtcctgctggaggatctagattgggatgtggttccaccagagaagaaaccaatctttatccaggagggggccatcagagaggatatgatccaaggtgtcactcaggaggtcattaggcataaggaagtgatgcctcgggaagaggaacaggctcagaagaaagccagagatatgctgggccttgaggaaacccaggtcatactcaagaagggaaagaaagtcattttcctggaacccggcaacgtgaccatgggaaaagaaatctccaagaaggaggagaagaagaccttccaaaagtctcctaagcaaggcagaaaagccgtgcagaaagaaaggaaagtcggaaaaattaagcgcgagatgaccaaggaagaacgtgacatgtctgaggaggtggaggagatggctacactggaggaaaaggtggttaaacaggaggggaagctggtcatgatcgaaagaaccccatcttggcaagactggaaaaaagcatgggacgaatggaaacaggtccatggcgagacgcgtaagtcatggaaagcctggaaagaagagtgggaaaaaagacttctgcaagaggaagagaagctgcaccaggctggcgaaaaactttcacctgaggaagaaatgctccaggaggacaagaagttaaagtgggaggaatggaagcaggtgtgggaaaatatgctgtctagcaagtccaaagagcaacagtacaaagatgaagaggaggttacactggaagaagaggtctctagggagggggaggagaaagagcagcaggtgactgaggaacaacggcatatccaggaagagcacaagtgggccaggatccaccgaaagagggctcgggccgaaaaaaagagggcccaagaagagcgaaaactagctcaggaagaagagaagctggcccaggaagaacgccagcttgcccaagaggagcgcaagctggcccaggcctacgtgaagataacacaggacgatagggaaatggcacaagccgaaggaaagttcgcccaaaaggaagaaactctcgctcaacgcggagagaagttgtctcaggaggccgaaaagttagcccagaagcgcaaaaaactggccaagaagtgggaaaaggtggctcgggaggaagagaaactggcaaagaaagggggcaaactcgcagaggtgaagaatatactggcccagaaagtcgaagagctgccgcagagagagcagaatctggattggcaggagaaggaactcgcccaggagctagaggagttggagtgggacatggaggagttgtcgtggaaagaggaggagctcaaccaagaagaggggaagctcgtggaggaaaaaaaaaagctggccgaagaggaagaagccctggcctggcagagagaaaagttaagcgaggaagaaacgaagctggcacaggaagaggaactgctcatccaagagaaggagaagctggcacaacataaagaaaaaatgcctgaagaggaggagcgcctggggaggaaaagggagcaactcatcgaaaaaaaaatgaaacttgctcagaaaagagaacgatggattaacagcatggaggagcttactaagaacaagatgatcctgtatcagaagaagaatttggcacaggaaaagaagaatctagcccaggagaaggagaaactagcacagcggaaggaaaacctcctgtacaacaaagaacggctcacacactcaaagaaacaactggtccaggtcaaaaataaacttggaatgtttaacaaaattctggctcaggtcgaagagaagcttacgcaagaaaaagaaactgtgattaaaaaaaaggagaagctagcagagacagagaaaaaactggtccaagtcgaagacagcttggctaaaaaacaggagaaactggctcaggagaagatgaagctggctctggaaaaggcgatggtgcagggcaaaaaaaggctgcgcggagagcttgacattgccaaagaggaaaaagctctcaacctcgagatgaagcgtctagctgaggagaagatgagactcgtggaaggaaaggagacattgagcaaaggcgaaactccagagacatctagacagagaaaaatgacgcaggtagaacaagaactcttcgaaaggaaacttagcctggaggagaaaatcctgttacatgaagatcgaatcttggccatggaagaatctgagatagctaagggtaaactagagttcacgagagggcagcgaatttttgtgcaaggtcaacggaaactggctaaggccagccggaagctcatcaaaaaacgggagtccctgagcaaggaaccagccaaacttaataagattctgaaggcactccagaagttgaccagggatgaacgaaagcttacacaggaggagattaaaatgaccaagatgaaacgggccttattcgtgaaagagcggcgactttctatcgaacaatctaaactggatatcaaagagtgggatttctccgaaaagcgctctgaacttaccaaggacgaaaagaaacttgccagaaagcagcgcaaactggcaaataagatgcgccgcatgattaataaggaggaaaaaatgacggaggaagagtcaaagttagccaggaaacactctgaggttattctagacgacgaagaagagggcggtatagaagaggaggaggtaattccgttcttgaagaggaggtggcgcaagagaaaggaggcaaaacgcggcgataaacccaaggagaaattctcatcccaagtggatgaggttgagagtgaagaacatttcagtgaggaaatggaaagcttgctggacgaattggagaaacaggagtcgctttccagtgaagaggaggaagagcgtgaggaagaagaggaacgcgaggaagaggaagttagagaagaggaggaggaacgaaaggaagaggaggagggggaggagaagcaggtggaaaaagaggaagaagagaagaagaaaaaaaagaaggaaaaaaaaaaagaagaggtgcaggagaaagaggaagtctttgaagaaaaggaggagatcatgtccgaggaagagactgaatcgctgtctgacgaggaggaagaagaagagtcctgttcccttgaagaggaggtagaccgggagaaggaaatcctgaagaaggagaagcagtttaagcttcaggagcaacggcggaagtctctcagggggcgcgagcgcgtacttagcattttgagaggtgtgccacatggcaaggggagggctatcaggcttggcgtgctcaaaagccctctgaaaaagctgatgtccaccgcccttgaaatgaaagaaaagacacccgtgcccgttcctgagaagcagattagctgggaggacaagaaggctacggtcgtggagatacccaggaaattcctcggaactatggacaaagaacgcgaagtgatggggaaatacgagcccatcccaccacatgtgctcggcactgttctcgaatcccaggcacaggacctgaaaaccccatttatgtctcatattttaaggagaactgtggaggccgaggaactgcagcacaagcccctcggcgcctggtggaagtggttcctacagcatcctccactgatggggcagactgaggtgcagctacctttgtctcagatacccgccaaagagcagcacgccgacgtgagccttagcgacgtcgaatggataagacacgtcttagaaagaatggaagctggtgagcaactgtcaagagacggattccataggctgtgccagctgctgaaggatctggccagcaagggaaacctggaatggctgcacctcgctaagcacgaagctatagtgtacaggcatagacaggcactggagtctcaggatactagaatctccagtagacaaagtatgtctccaaaatatcttaaagtgattcctcccataaaagcaaaggaaaaagagtcctggcccaaaccactcgctgtcccaacacaaaagtcgcccctcgctactaagcgcatccctgatcccagagctaaaaactggcacctcttaggtgagccctacaggagtgaaagagctcagcagatatctattgctcataaggaaatggagatgcagtatttctaccccgcaaccagggatatattcccttccgcacacgcaagtgtggagaagcaaacactggccttaatgtttcagaaagatttttgggatttcaaagataaaagacggttcccaaagctgcccaagctggagaagaaaacccagcctatcagtaaaaagaaggaggagctgccactctgggagacttttgtggccctctatcacgtccttcggatgctccagcagcggtatcctaaagacagtactgcatggatggagcagttctaccagctgatggacctttaccagctaaaaagccctagaattcagaagctgctccaagagctgcttatgagagaagaaccacagcctcaggaaattatttacgaggaagccttaaaggccaccgagctggtgcctggagaacgcttgttttgctgcctgttctgcggttcatcccacacgccaagatccccgcaagaattccagggcgccgtgcccctcccatggcagaattgcgtccggaccattctgcctgtgggaattgctcggtacggaatcttggaactggcttggaagagcctaccagaagccgacctgcacctcaccaaggccctcacgcacaccgttgctccaacactgtag

SEQ ID NO: 52396 - DNA, 8739 bp, Artificial Sequence
  Description of Artificial Sequence: Synthetic coding sequence
atgagcagcccccggctgatccccctgtggaaggacctgaagctgttacttaatgacactatcaataaatcaaaacagccttccgaggatcccaagaattgcctgatcgtgttgagtgatcgcagccaggtgcttttcaaagaatctaggtaccctcagaacatgccatgcgtctgctactacttctctgacgctcactttttcgcctcactgtcctgggttacctctaacaccaaagagatacaggcagttgcttggatgaagtccaaaacagaggatatggtggagaagcggacgttcagcatgaccgaacggctgcctcccatacaaagcatggtacatgctggatcatttcacatactggtagtgtattgcggcgacctgatcttgaggcttttcggcgaccacttcagagcttttaaacccctggggaaggtgccctgcagattcaacatcagttgcctttgctacgatcctgagatgaagatgctgctttctgggattcttggagctgtagttacatgggttattgaactcggcggcaccggtctgcaaatcgcacacatggtgtctatgcccggcgacgaactggttcaggatattgttttgaatggccctagcggttcattgctcgccctgtgcgagactgtggtcagagtgctgatgcatcaggggaaaggacaactgggagaggttaagcgcttcaccagtactagttcaggatcatcaattacatgctgcttcacttgtttcgatcaaggatttttatacgctggtaaccaggcaggcgaaattcaggtgtggtctctccagcaggggcaccctctgcattcatttcaggcgcatcagtccggcgtaatctgtattcgatctcggcctgaggcccacacgctgctgaccgccgggtccgattccctcataaaagaatggaacctgacctccggaagcttacttagaagattggagctcggggaggagctttacagattacaattcatagattccataacatttttctgtcagacggctcattctttctccctgcatagattaccctgtttttatagtctgtttaatgtgtgtgggtccgcgccccagcagcttaggagagtttgctgtggaaacaattggttccgaatcctctgtactacagaggatggcctgttgcggtttgtgtccccagtgacgggcgatctcctggtgatcacatggccattttccatcctggaccaagccgtggattgggcctacgatcctgggaaggaagagctgttcgtcgcgaccgggtcctcagaggtgctggtcttcgacaccacccggtgcccttgccctgccaaataccttctcggtacctcccccaactctcaagattttgtgcaatgtctggcctacgggcattttaaccttggcagaggcctggaaggactcatcttttccgggcaccagtcaggagtgataagagtcttgtcccagcactcttgtgcaaggttagagaagtttatgcactttggggccgtgctcgctctttcaaccctgtcaggggggatctttggggggcaggggaactccttgctttgctcttacggaatggatgactatgtgcacctgagcgaggcagtgcttgatggcgttaaagttcagttaagaccactggcgtctatcttgtcaagctgtcatctaacgcacttgattttgctgccaaagagcgtgggcgccattaccgaaaccaactgcctgcgcctctggaaatttcatgacttcctatccagtgggagtcagaatggcctcaaattcattgagacattgccacttcatctttgtgcaattaccagctttgatgtgtgcctgagcctcagcttgttcgtcaccgggagcgccgatggaagcgttaggatctgggacttccacggtaggctgatcggcattctggactccagtcttcatttcggccccgtgtgcttcgccaatgatcgcggcgatcttctggttaccttcaaccagtcattatacctggtgtcctgtttaaagcttttaccccccgcccttctcaccagacttagtttcatgtctatcagcgacgaagtgctggaagtccctaaaccttttatccctagcttctttttcagctttgaaacaatgttcgtgcccaagtacatatatcccggccaggcacagcagaagctcgtggggctggaaaagcttgtcaacaacagagcaatcgcctttgatcactccgtccctcacgtcatagaagaagatgaggaaggaagcccggtgctcctccggtcctctatgcactattcccttcaagacatggaagactggatgcaggtttccaagcgctaccagtgtcattatgttctccctccacagttacaactgaccagctgggacggcctgaacccctaccagatcctgagatactatttcggccatgggagggagtggttatttgcccccgattgctacataccgaactccgtcatcagggctcggctctggcctgaaggaactcctatctatctgcaatgtaacctccatgctcctcaacgggagctggagtgggatcgctcccaggaatttttcttttggcactcaagagtccgggccatttctaacactgagtatcctaaaaataaggaggaagatgaacacttcctggaaatgcgacttagcaaagacgtgacttattctgtcctcaccgatggggcgaataggtcgtggcttggccggaagatgtcggagattacaatcaattcgatgattgaaaccatgctgaacattatggtgcacgccagcctgctgaaatatcagtgctgcgtcggagccctggggcagatttttgctagctaccaggtgtcccccgcccttcggtctgagactgcccggcgccttctgaatgatactacaaacagcaaccccctgattcgggagcttgcatgggaagggctcaaaagattgggtatgattacccacctgttcgcgatgcccctggcacaagggctgatggataaagacgaacgtgtgcggatcaagacactgtctctgatggccgagatcgggatccattctcgaacctccctgctccaattgactcaaaaacaagagacattcagagaaatgcagcagcagatgataggcgaggagccactcgatcatctcctggggatgcgagccacagacctgcagattctctccacccaagttgaacagcggcttaacgagaaccttacactttcacaccgggatgagaagccggcatttagcctggacgtctcgatgccgtccgagcttaaatcaagccttaaaccacccaccgtttctgaggaaagtgaggtcgccataaagccctctaaaggccaacggcgcggtcaggctggagtgaagaagcattctcagaagtggctgaggggcctgaagaaaaccaaggagcgcgatagcaagcagatgtccacagaacccggactcctggaggacgagtctggcacagaggcagctcccatcgaaatggaagaggcgtctgtgtactcccagtggtccagttccacatctgtaataaagctgtcgaaggatgtggactctcaggagaaggacatttccaaagatcatatcgcactcacccttaagcgcctacagaagattcgtgacaagagagacaaaaaagctactgctcagaaactgaagaagaaacacaaaaaaaaagggaaggaagccaaggtgatcaatgaggaaacaactccacccgtgatggagcagccagtgacaaagaaagtcaagatccagggcagaggggcatctggtatctcaggcagacggagtactgccggtgacggttcaagctggagagatgacctctgtaggctcatggctctcaggatctctggaagccagacaaagatgagcgaaaatctcaacgccgaactggtaacatttgctcaagagatgttggtggaccgccacccgagttgggagctgtttcaagagatatgtcctctgctcaagaaggaaagcaaggttctgttagaagatctggattgggatgtggtgccccccgaaaagaagcccatctttattcaagagggagccattcgcgaagacatgattcagggggtgacccaagaagtcatccgccataaagaggtgatgccaagagaggaagaacaagcgcagaaaaaggctagagacatgcttgggctagaggaaacccaggtgattcttaagaaaggcaagaaagtaatatttcttgagccgggcaacgtcactatgggcaaagaaatctctaagaaggaagaaaaaaaaaccttccagaagtctccaaagcaagggagaaaagcggtgcaaaaagaacgcaaagtcggcaagataaaaagagagatgaccaaagaggagcgtgacatgtccgaggaggtagaggagatggcgaccctggaagaaaaagtagtgaagcaagagggaaagttggtcatgatcgaaaggacgccttcctggcaagattggaaaaaggcatgggacgagtggaaacaagttcatggggagactcggaaatcatggaaggcatggaaagaagaatgggagaagaggcttctgcaagaggaggagaaactgcatcaggcaggggagaaattaagtcctgaggaggagatgctccaagaagacaaaaagttgaaatgggaggaatggaagcaggtatgggaaaatatgctgagttcgaagtctaaagagcagcaatataaagatgaagaggaggtgaccttggaggaggaagtgtctcgcgagggggaagaaaaggagcagcaggtgactgaggaacaacgccacatccaggaagaacataagtgggcccgtatccatcgtaagagagcccgggccgagaaaaaacgagcgcaagaagaacggaagctggcacaagaagaggaaaagttggcacaagaggagcgccagttggcccaggaagaaagaaagctagcgcaagcatacgtcaaaattacacaagacgaccgcgaaatggcccaggccgaaggcaagtttgctcagaaagaggaaacactagctcagaggggcgagaaattaagccaggaggcagaaaaactggcccaaaaacgaaaaaaacttgctaaaaaatgggagaaggtcgcacgggaggaagagaagctagcgaagaagggcggcaaactagcagaagtgaaaaacattctcgcacagaaggtggaggaactaccgcaaagggagcaaaatcttgactggcaggagaaagaattagcccaagagcttgaagagctcgaatgggatatggaggaattaagctggaaagaggaggagttgaatcaggaggaaggcaaactcgtggaggaaaaaaagaaacttgccgaggaggaagaggccctcgcttggcagcgcgaaaagctctctgaggaggagacaaagctcgcccaggaagaggaactgcttatacaggaaaaggagaaattggcccaacacaaggaaaagatgcccgaagaagaagagagactgggcagaaagcgggaacagctgatcgagaaaaaaatgaaactcgcgcagaagagagaaaggtggatcaactcaatggaagagctgacaaaaaataagatgattctgtatcagaagaagaatctggcccaggagaaaaaaaatctagctcaagaaaaggagaagcttgcgcagaggaaggagaatctgctgtataataaggagcgactcacacactccaagaagcaattagtgcaggtaaagaataagttggggatgttcaataaaatactggcccaggtggaagagaaactgactcaggaaaaagaaacagtcatcaagaaaaaggagaaattagccgagacagagaaaaaattagtgcaggtggaagattctttagcgaagaaacaggagaagctggctcaagaaaagatgaaactggccctggaaaaggctatggtacagggaaagaagcggcttcgtggggagttggacattgccaaggaagaaaaggcactgaatttggagatgaagcggttggctgaagagaagatgaggctggtggaagggaaggagaccctctcgaaaggggaaactcccgagaccagcagacagcggaagatgacgcaggtggagcaggagctgttcgaacggaagctgagtctggaggagaagatactcctccacgaggacagaattctggcaatggaggaaagcgaaatagctaaaggcaagctggagtttactcggggtcagcggatttttgtccaggggcagcgaaaattggctaaggcttcgagaaagctcatcaaaaagcgggagagtttatctaaggaacctgctaagctgaacaagattctcaaagcccttcagaagttgactagagatgagcgtaaactgacgcaggaagaaatcaaaatgactaaaatgaaacgggcactgtttgtgaaagagagaagactgtcaatcgagcagtccaagctggatatcaaggagtgggacttttccgaaaaacgatcagaattgaccaaagacgaaaagaagctcgccaggaagcaacgtaaactggctaacaagatgaggcggatgatcaataaggaggagaagatgacagaagaggaaagcaaactcgcccgtaagcactccgaagtcatcttagacgacgaggaggaaggcggtattgaagaggaagaggttataccttttttgaaaaggagatggagaaagaggaaggaggcgaaaaggggagacaagccaaaagagaaattcagcagccaggtggacgaggttgaatccgaagagcacttcagcgaggagatggagtccttgctcgatgaattggaaaagcaggagtccttatcctccgaggaggaagaggagcgtgaggaggaggaagagcgtgaggaagaggaagtgcgagaggaggaagaggaacggaaagaggaagaagaaggcgaagagaagcaggtggaaaaagaagaggaggaaaaaaagaaaaaaaaaaaagagaaaaagaaggaggaggtccaggaaaaggaggaagtcttcgaagagaaagaagagattatgagcgaggaagagactgagagcctgagcgatgaggaggaggaagaggaatcctgcagtctcgaagaggaagtagaccgcgagaaagagattctgaagaaggagaagcaatttaaactgcaggaacagagacggaagagcctccgcggcagggagcgcgtactgagcattctccggggcgtcccacatgggaaaggacgcgctatacgactgggagtgctcaaatcgcctctgaaaaaactcatgagcacagcccttgagatgaaggaaaaaaccccggtgccagtcccagagaaacagatttcctgggaagataaaaaagccacagttgtggaaatacctcggaagttcctggggaccatggacaaagagagggaagtgatgggcaagtacgagccgattcctcctcacgtgctcgggacagttcttgaatcacaagcccaagatctcaagaccccttttatgtcccacatactgcgtaggacagtcgaagcagaagaactacagcataagcctctgggggcttggtggaagtggtttctgcagcacccccctttaatggggcaaaccgaagtgcaactccccctgtcccaaatacctgccaaggagcaacacgccgatgttagcctctccgatgtggagtggatacgtcacgttcttgagcgcatggaggccggtgagcagctctctagggacggctttcataggctgtgccagctgctaaaagacttggcttcaaaagggaatcttgaatggcttcatctggccaaacatgaggcaatcgtatataggcacagacaggccttggagtctcaagacacacgaatttctagccgccagtctatgagccctaaataccttaaagtgatccctccgatcaaagctaaggagaaggaatcatggccaaaacctctcgccgtgccaacacagaaatctccactagccactaaacgtatccctgatcctcgagcaaagaattggcacctgctgggcgaaccttaccgatccgagcgagctcaacaaatctccatcgcccataaagagatggagatgcaatacttttaccctgcaaccagagacattttcccaagtgcacacgccagcgtcgaaaaacagacactcgcattaatgtttcagaaggacttttgggactttaaagataagcgcagatttcccaagcttccgaagttggagaagaagacacaacccattagcaagaagaaggaggagttgcctctgtgggaaacctttgtggcactataccacgtgctccgcatgctgcagcagaggtatcctaaggactccacggcctggatggagcagttttaccaattaatggatctgtatcagctcaagagcccccgaatccaaaagctcctccaggagttgttaatgagggaggagcctcagccacaagaaatcatttatgaggaggctctgaaggctaccgagctcgtgcccggagagcgcttgttctgttgtttattttgtggctctagtcacacaccgagatcaccccaagaatttcaaggcgccgtccccctgccttggcagaattgcgtccgaaccatcctcccagtgggcatcgcccggtacggaattctcgagctcgcatggaaatcactccccgaggctgacctgcacctgacgaaagcccttactcataccgtggcaccaaccctctag

SEQ ID NO: 52397 - DNA, 1419 bp, Artificial Sequence
  Description of Artificial Sequence: Synthetic coding sequence
atggccagccccccccggtgcagccccaccgcccacgaccgggagtgtaagctgccccccccctctgcccccgcgagcgaatattgccccggaaaacttagttgggggaccatggcacgagctctcggtagattcaagctcagcatacctcatacgcacctgctggccaccttagatccgctggccctggaccgggaacccccaccgcatctgctccccgagaaacaccaggtgccagaaaaattgatctggggcgaccaggaccccctctctaagattccgtttaaaatcctgtcaggccatgaacatgccgtttccacttgccatttttgcgtcgatgatactaagctcctctctggaagttacgattgcaccgtgaagctgtgggatcccgttgatggatccgtggtgagggactttgagcacagacctaaagctccggtagttgaatgttctataaccggggattcaagccgcgttattgccgcttcttatgataaaacagtccgagcgtgggatttagagaccggcaagttactgtggaaagtgaggtacgacacctttattgtgagctgtaagttcagtccggacggcaagtatgtcgtgtccggatttgacgtggaccacggaatttgcatcatggatgctgaaaatatcactaccgtgagcgtcatcaaggatcatcatacacgcagtatcaccagctgctgcttcgaccctgacagccaacgagtggcttccgtgtccctcgacaggtgcatcaaaatctgggatgtcacgagtcaggccactctcctgacaattaccaaagcccattctaatgctatctctaactgttgcttcacttttagcgggcacttcctttgtacctcctcttgggataagaatctgaagatatggaatgtgcatacaggtgaattcagaaactgcggcgcttgtgtgacactgatgcagggccacgaaggttctgtcagttcctgtcacttcgccagagacagtagctttctgatctcaggcggattcgaccgcactgtggcaatatgggacgtagctgaggggtacagaaagctgagcctgaaagggcataacgactgggtcatggatgtggcgatctccaataacaagaagtggattctgtcagccagcaaagatagaactatgagactctggaacatcgaggagatcgacgagattccactggtgatcaagtataaaaaggctgtgggactgaagctgaagcagtgcgagcgctgtgataggccgttttccatttttaaatccgacaccagctctgagatgttcacacagtgcgtgttctgtagaattgacacacgcgggttgcctgctgacacaagttcttccagtagcagttccgaacgagagaactcacctccaccgagagggtctaaagatgactag

SEQ ID NO: 52398 - DNA, 1281 bp, Artificial Sequence
  Description of Artificial Sequence: Synthetic coding sequence
atggccagccccccccggtgcagccccaccgcccacgaccgggagtgcaaacttccaccgcccagtgcacctgcctctgaatactgtcccggcaaactaagctggggcaccatggcgcgtgccttagggaggtttaaactctcaatacctcatacacacttgctcgctacgctggaccccctcgccctggatcgcgagcctcccccccatttactccctgagaaacatcaggtgcccgaaaagctcatatggggtgaccaggatcctctaagtaagatcccttttaagatcctgagcggacatgagcacgctgtaagcacttgccacttctgcgtagacgataccaagctgctctccggctcttatgactgtaccgtgaagctttgggatcccgtagatgggagtgttgtgcgagactttgaacatcggccgaaagcccccgttgtggaatgcagcatcaccggagactcatcccgggtgattgccgcaagctatgacaaaacggtaagagcgtgggacctcgagacgggaaagctcctctggaaggtgcgctacgataccttcatagtgtcctgtaaattttcaccagacggcaaatacgtcgtgtccggcttcgatgtcgatcacggtatctgtattatggacgccgaaaacatcaccaccgtgtccgtgattaaagatcaccatactcgtagcatcaccagctgctgcttcgatccagacagccaacgcgtggcatctgtctctctagacaggtgcatcaagatatgggacgttacttcgcaagcgactctgctcaccatcaccaaagcccattccaacgctatttcaaactgctgcttcacgttcagcgggcatttcttgtgtacatcctcctgggacaagaacctcaaaatctggaacgttcacactggcgagttccgaaattgcggcgcgtgtgtaactctcatgcaaggccatgagggctcggtcagtagttgccacttcgcgagagatagttccttcctgataagtggagggttcgaccgcaccgtagctatctgggacgtggcagaggggtatcgtaaactgtccttaaaggggcacaatgactgggtgatggacgtggcgatcagtaacaataaaaaatggatcttatctgcttccaaggacagaactatgcggttgtggaacatcgaagaaatcgatgagattccactggttataaagtataagaaggccgtaggcctgaaacttaagcaggagaagaaggaggcttatctgaagctgaaacagggctag

SEQ ID NO: 52399 - DNA, 1164 bp, Artificial Sequence
  Description of Artificial Sequence: Synthetic coding sequence
atggagaagatcgaggagcagttcgccaacctgcacatcgtgaagtgttctctcgggacgaaggaacctacatacttgctggggattgacaccagcaaaactgtgcaggctggtaaggagaacctcgttgccgtattgtgttcgaacggaagtattcgtatttatgacaaagagagactcaatgtgctcagagagtttagtggttaccccggattactcaatggggtgagatttgccaactcatgtgactctgtctacagtgcgtgcaccgacggaaccgtcaaatgctgggacgcccgagtcgcccgcgagaaaccagtacaactgttcaagggctacccctcaaatatatttatctcttttgatattaattgtaatgatcacataatttgtgctgggacggagaaagtggacgatgatgcactattagtcttttgggacgcaagaatgaacagccagaacctaagcaccacaaaagattctctaggagcctactccgagacgcacagcgacgatgtgacgcaagttagatttcaccccagtaatccaaacatggtggtgagtggttccagtgacggcctggtcaacgttttcgacataaacattgataacgaggaggacgcccttgtcacaacctgcaatagcatctccagcgtgagttgcataggctggagcggtaaggggtacaaacaaatctactgcatgactcacgatgaaggattctattggtgggacctgaaccatctggacaccgatgagccagtgacacggctgaatattcaggatgtgagagaagtggtgaatatgaaagaggacgcactggactatctcattggaggtctttaccacgagaagaccgacactctccatgttatcgggggcacgaacaaagggaggatacacttgatgaattgctcgatgtccggcctgacccacgttacttcactgcaaggaggccatgcggctactgtgagaagcttttgttggaacgtgcaggatgattcactgctcacagggggtgaagacgcccagctgctgctctggaagcccggggccattgaaaagacattcacaaagaaagagagtatgaagattgcttcatccgtgcaccaaagagtgagggtccattccaacgattcctacaaaagacgtaaaaagcagtag

SEQ ID NO: 52400 - DNA, 1164 bp, Artificial Sequence
  Description of Artificial Sequence: Synthetic coding sequence
atggagaagatcgaggagcagttcgccaacctgcacatcgtgaagtgttctctgggcaccaaggagccaacttacctgctgggcatagacactagtaagacggtgcaggccggcaaggagaacctggtggccgtgctgtgttccaatggctcaattaggatctacgataaagagaggctcaatgtgctgagagagttctcaggttacccaggtctgcttaacggcgtccgctttgctaacagctgcgactccgtttactcagcatgtaccgatggcaccgtaaaatgttgggatgcccgggtcgcccgggagaaacctgtgcaactctttaaaggctatcctagcaatattttcatctcttttgacatcaattgtaacgaccacatcatctgcgccggcacggaaaaggtggatgatgatgctctccttgtgttctgggacgctagaatgaattcccagaatctgagtacaacaaaagactcactcggagcctactctgagacccacagtgacgatgtcacacaagtccgttttcacccttcgaatcctaatatggtggtaagcggctcttccgatgggcttgtgaacgtatttgatatcaatatcgacaacgaagaagacgccctcgtcaccacctgtaattctatcagctctgtgtcatgtatcggctggtcaggaaagggatataagcaaatctactgcatgactcacgatgaggggttctattggtgggatcttaatcacctggacacagatgaacccgtgaccagactgaacattcaggatgttcgagaggttgtaaacatgaaggaagatgcgctggactaccttattggcggcctgtaccatgaaaaaacggacacactgcacgtgatcggcgggaccaataaaggaaggatacacctaatgaactgcagcatgtccggcttaacccacgtcaccagcttgcagggcgggcacgccgcaacagttcggagcttttgctggaacgtgcaggacgattccctcttgacgggcggagaggacgcccaactcttgctgtggaagcctggagccatcgagaagacatttacgaagaaggaatctatgaaaatcgctagctcagtgcatcagagggtgagggtccattccaacgattcttataaaagaagaaagaaacagtag

SEQ ID NO: 52401 - DNA, 900 bp, Artificial Sequence
  Description of Artificial Sequence: Synthetic coding sequence
atgctgtggttcggccagcccggccccggcggctggaaccggaagtgcttgcgacctttcaccctgccgagagggcagcatccacagccgagctatgggttcccacaagttaacgaggtggtgttctcccctggtgagtcacactgcgccacatgtagcgaagatggcagtgttagagtctgggcactcgcgtctatggagctggtaattcagtttcaggttctgaatcaatcatgtttgtgcctcgcttggagtcccccatgctgtgggaggccagaacagcaacgattggcggctgggtacggagatggttccctgcgtatcttttccgttagcagaactgctatggagcttaagatgcatccacaccctgtggcattgaccactgttgcttttagcaccgacggccaaaccgtactgtccggcgacaaggatgggctcgtcgctgtgtcccacccctgcacaggcaccactttccgcgtgcttagtgaccatcagggggcccctattagtacaatctgcgttacctgcaaggagacgcagggccatctgccgccttcactggcggctttttgcccctgggacggtgccttactcatgtacgtgggccccggcgtatataaggaggtgataatctacaatttgtgccagaagcaggtggttgagaaaatccccctgccatttttcgcaatgtctctgtcactgtctcctggcacacacctcctggcggtcgggttcgctgagtgcatgctgcgtctcgtggattgcgctatgggaacggcgcaagactttgcagggcatgacaacgccgtgcacttgtgtaggtttactccttccgcccgcctgcttttcaccgcggcccggaacgaaatcctggtctgggaagtgccggggctctag

SEQ ID NO: 52402 - DNA, 5247 bp, Artificial Sequence
  Description of Artificial Sequence: Synthetic coding sequence
atggcccgggcctggcagcaccccttcctgaacgtgttccggcactttcgggtagacgagtggaagaggtcagcaaaacagggcgatgtggccgttgtgactgataaaaccctcaagggggccgtatatcgtatcagaggctccgttagtgcagctaactacatccagttaccaaaatcttctacacagagtctcggacttaccgggaggtatctgtacgttttgtttcgaccacttccttccaagcacttcgtgatacacctagacgtgtcctctaaagacaatcaggtgatccgtgtgtcgttcagcaatctattcaaggagttcaaaagcaccgccacttggttgcagttcccactggtgctcgaagcgcgcacaccacagcgagatttggtcggcttggccccaagcggagccaggtggacctgtcttcagctggatctccaagatgtgctgcttgtctatctcaacaggtgttacgggcacctgaaaagcattagactgtgcgcttccctgttggtgcggaatctatacacctccgacctatgttttgaacctgccatatcaggagcccagtgggccaagctgcctgtgacaccaatgcctagggaaatggcttttcccgttcctaaaggcgagagttggcacgaccggtacatacatgtcagattccctagtgagagtctgaaggtcccttccaaacctatcgagaagtcctgtagtccacctgaggctgtgttacttggacccgggcctcaaccgctgccgtgccctgtggcatcttccaagccagtcaggttttctgtttccccagtggtgcaaacgccgtctcctactgcaagcggccgcgctgctctcgcccctcgcccttttcccgaggtatctctgtctcaggaacgatccgatgcaagcaacgcagatggaccaggcttccattctctggagccctgggcccagctggaggcaagcgacatccatacagccgccgctggtacgcatgtcctcacccacgagtcagccgaggtcccagtcgcacgtacaggatcttgcgaggggttccttcccgaccctgtactgcggttaaaaggagtgatcggttttggaggccatggaactaggcaggcactctggaccccagatggcgctgcagtggtgtacccatgccacgcggtgatagtcgttcttctggtcgatacaggggaacagcggtttttcctgggtcatacagataaggtttctgcgctcgcgctggatggaagtagtagtctcttggccagtgctcaggcgagagctccttctgttatgcgtctgtgggactttcagacggggcggtgcttgtgtttgttcagaagccccatgcatgttgtctgcagtctgtcttttagcgactccggcgcattgctgtgtggagtgggcaaagaccaccacggtaggacgatggtggtggcctggggtactgggcaagtggggctgggcggcgaggttgtggtgctggcgaaggcccataccgattttgatgtgcaggcgttccgcgttacgttcttcgatgagacaaggatggcatcttgcggccagggcagcgtccgcctgtggcggcttaggggcggagtactccgttcatgcccagtggatctgggcgaacaccatgcgttacagtttactgaccttgcattcaaacaggcacgtgatgggtgccccgaaccgtcagctgcaatgctgttcgtgtgcagtcgttctggccacattctagaaatcgactgccagcgcatggtggtccgccatgcgcgacgcctgctcccaacaagaactcctggcggcccacatccgcagaaacagactttctcatccgggccgggtatagccatttcctccttgtcagtgtcaccggcaatgtgtgctgttggctccgaagacggctttctccgtctctggccactggacttctcatctgtgctcttggaagctgaacatgaaggccctgtgtcaagcgtgtgtgtgagccccgacggtctgcgggtgcttagcgccacctcgagcgggcacctgggatttctggacacccttagtagagtttaccatatgctggcccgatctcacactgcgcctgtactcgctctggctatggaacagagacgtggccagctggcaacggtgagccaagacaggacagtgcggatatgggatttggcgaccctgcagcagttgtatgatttcacgtccagtgaagatgccccttgtgcagtcacattccatcctacccggcctacatttttctgcggattctctagcggggctgtccgaagtttttctctggaggcagccgaggtcttggtggagcacacctgccatcgtggcgcagttacgggcttaacagcgacgcccgacggaagattgcttttctcctcgtgttcccaaggatccctcgctcagtactcttgtgcggacccccaatggcacgtactgcgggtggccgctgatatggtgtgccccgacgcgcccgcttctcccagtgccttggccgtaagtcgggatggcaggctgttagcttttgtggggccctcccggtgtacagtgacagtcatgggctctgcaagcctggacgaactgctgcgggtagacattgggacactggatcttgcctcttccaggctggacagcgctatggccgtctgttttggcccagccgcattaggccatctcttagtgtccacatcttcaaaccgtgtcgtggtgctggatgccgtcagcggtaggataatcagggaactaccaggagtgcatcccgagccatgtccaagtttaacactgagtgaggacgctcgcttcttgctgatcgcggctggaaggacgataaaggtgtgggactacgctacacaggctagtcccggaccccaggtgtatataggacatagtgaacctgtgcaagctgtggcttttagtccagatcaacaacaggtgctgagtgccggagacgcagtcttcctgtgggatgtcctggccccaactgagtccgatcagagctttcctggtgcgccaccagcctgtaagactggacctggagccgggcccctagaagacgccgccagtagggcaagcgagctgcccaggcaacaggttcctaaaccgtgccaggcgtctccacctagacttggggtctgcgcaaggccacctgagggaggcgatggggccagggatacaaggaactccggagccccccggaccacatatctggcttcttgcaaggcattcacaccagctagggtgtcttgctcaccacattccgcgaaagggacctgccctccgccagctagcggcggttggctgcgcctgaaggccgtggtgggatactcaggtaacggcagagccaacatggtatggcgtcccgacactggatttttcgcatacacatgcggccgcttggttgtggtcgaagacctgcatagtggagcccagcaacattggagcggccactctgcagaaataagtaccctcgctttgtcacactctgcgcaagtcttagcttctgcctccgggcgtagcagtacgaccgcccactgtcagattagagtgtgggatgtgagtggaggtctgtgtcagcatttgatatttccccatagcactaccgtgctggccctcgccttcagtcctgatgaccgtctcctggttactttgggtgatcacgacggccggacacttgccctctggggaacagcaacctacgacttggtcagcagcacgagacttcctgagcctgtccatggcgtcgccttcaacccatgggatgccggcgaactcacgtgcgtaggtcagggtacagttactttttggctgctgcagcaaaggggagccgacatcagtcttcaggtgcgacgagagccagttccggaagccgtgggcgccggggaacttaccagcttgtgctacggcgccccaccactgctctattgtgggacttccagcggccaggtctgcgtttgggatactcgtgccggtagatgtttcctgtcatgggaagccgatgatggcggcattggcctgttgctcttctcaggatccagactcgtgtccggttcatctaccggacgactaagattgtgggcggtgggggccgtgagcgagttgaggtgcaaggggagtggagcctcctccgtgtttatggagcacgaactggtgctcgacggtgccgtagtgagtgccagtttcgacgatagcgtggacatgggagtcgtgggcaccactgcaggaaccctgtggtttgtgtcttgggcggaaggaacgtcgactcgactgataagcggacaccggtctaaggtaaacgaggtagtcttttctccaggagagtcgcattgcgccacgtgttctgaggatggatccgttagagtttgggccctcgccagcatggaactggttattcaattccaggtccttaaccagtcatgcctgtgccttgcttggagtccaccgtgctgcgggcggcccgagcaacagaggctggccgcgggatatggtgatggctctcttcgaatcttttctgtttctcgtactgccatggaactcaagatgcatccccatcctgtcgccctcacgaccgtggcattctccactgacggacagactgtgctctccggcgataaagacggacttgtcgccgtctctcacccatgcaccgggaccactttcagagtgctgagcgaccatcagggagcacccatctccacgatctgcgtgacttgcaaggaatgtgaagatttaggtgtggaaggcactgatttatggctggccgcatccggtgaccaaagggtgagcgtgtgggcctccgattggcttcgcaaccactgcgagctagtcgattggttatcctttccaatgcctgccacgacagagactcaaggacacctgccaccttctctggccgccttttgtccctgggatggtgcccttctgatgtacgtgggaccgggcgtatacaaggaggtcatcatctacaatttatgtcaaaagcaggtagtggagaaaatcccgcttcctttttttgctatgagtttaagtctgtcccccggcacccatctgctggcagtaggcttcgctgagtgcatgttgcgcctggtggattgtgccatggggacagcccaggatttcgccggacatgataatgctgtacatctgtgcagattcacaccgtccgctcgactgctattcacagcagctcggaacgaaatcctggtctgggaggtgcccggcctatag

SEQ ID NO: 52403 - DNA, 1911 bp, Artificial Sequence
  Description of Artificial Sequence: Synthetic coding sequence
atggccgaggccgtggagcggaccgacgagctggtgcgggagtacctcctcttcagggggttcactcatacattgcgacaactggacgcagaaatcaaagctgataaagaaaaaggctttcgcgtggacaagattgttgaccagctgcagcagctcatgcaagtgtacgatctggcagcactccgcgactattggtcttatctagaaaggagactgttttcaaggctcgaggatatttataggcccaccattcataagctgaaaacttctctctttcgtttctatctggtttatacgatccagacaaatagaaacgacaaggcacaggagttcttcgccaaacaggcaactgagttgcagaaccaagctgaatggaaagattggtttgttctgccctttctccctagtccagacacaaaccccacatttgctacttacttctctcgccagtgggcagacaccttcatcgtcagtttgcataattttctcagcgtcctcttccagtgcatgccagtgccagtgattctcaactttgatgcggaatgtcagagaactaaccaggtccaggaggaaaacgaggtgttacgacaaaaattgtttgccctccaggcagagatccaccgcctgaagaaagaagagcaacagccagaggaggaggaggcactggtgcagcacaaactgccaccatacgtatcaaatatggaccgtttgggggatagtgaattagctatggtgtgcagccagaggaacgcatctctctcacagtctccccgcgttggatttctaagtagcctgcttccacagtctaagaagtccccctcccggctcagccccgcccagggacctccgcaaccacagagttctgcaaagaaggagtcctttgggggccagggcacaaagggtaaggatcctacctccggggccaaggatggaaaatctctgctcagtggtcttgcaacaggggagagtggctggtctcagcacaggcagcgccgcctgcaggaccatggcaaagagaggaaggagttgttctcaaccacaacatctcagtgcgccgagaagaaacccgaggcttccggtccggaagctgagccttgtcccgagctgcatactgaacccgtggagcctctcacgcgtgctagtagtgccggaccagagggtggaggggttaggccagagcagccttttatagtgctggggcaagaggagtacggagagcaccactcctcaatcatgcactgtagagtagattgttccgggaggcgggttgctagtctggacgtagatggagttatcaaagtctggagcttcaatccaattatgcaaactaaggcatccagtattagtaagagcccactgctgtccctggagtgggccaccaagcgggatagactgttgctcctgggcagcggggttggaacagttcggctctacgatacggaagccaaaaaaaatctctgtgagattaatattaacgataatatgccacggatcctgagcttggcatgcagtcccaatggtgcttccttcgtttgttctgcagccgccccctcactgaccagtcaggtggatttctccgcccctgacatcggtagcaaggggatgaaccaagtgccaggtcggctgctcctgtgggacacaaaaaccatgaaacagcaactgcagttctctctcgacccggagccgatagccatcaattgcaccgcttttaatcacaatggtaatttgctagttactggagcagctgacggtgtgattcgcttatttgtgcatcctgtcgagcacccccaggagtggcctcagggaattagagttcagcctcctcttcgctgtcacgggcctctgtgcgcagtttggatacaaaggttgcaggcaggctcgtcacctcaagggcctaccctacgcttctag

SEQ ID NO: 52404 - DNA, 2244 bp, Artificial Sequence
  Description of Artificial Sequence: Synthetic coding sequence
atggccgaggccgtggagcggaccgacgagctggtgcgggagtacttgctgttccgcggtttcacacatacgcttcggcagctcgacgcggaaattaaggccgataaagaaaagggctttcgcgtggacaaaattgtcgaccagcttcagcaactcatgcaagtgtacgacctcgccgctctgcgggattactggtcttatctggaacggcggctgttctcacggttggaggacatttaccgacctacaattcacaaattgaagacaagcttattcagattttacctggtgtatacaatacaaacaaataggaatgacaaggcgcaggagttcttcgctaaacaggctaccgagctgcagaatcaggccgaatggaaggactggtttgtgctgccgttcctcccctctcctgacaccaatcccactttcgcaacttatttttctcgtcagtgggctgacacgttcattgtttccctccacaactttctttccgttctgtttcagtgtatgcccgtccccgtgatattaaacttcgacgcggagtgtcagcggaccaaccaagtgcaggaagaaaatgaagttcttcgccagaagctcttcgcactgcaggcggaaattcatcggctaaaaaaagaggaacaacaacccgaggaggaggaagccctcgtccaacacaagcttcctccctatgtctcaaatatggatagattaggggacagtgagcttgctatggtgtgctctcagcggaatgctagtctgtcacaatctccacgagtgggcttcctgagttccttgctcccacaaagtaaaaagagcccatctcgactcagccctgctcagggcccccctcagcctcagagtagcgcaaagaaggagtcctttgggggtcaagggacgaaagggaaggatcccactagcggagccaaagatggcaagagtctcttaagcggcctagctactggcgaatccggctggagccagcatcggcagcggcgcctacaggatcatggcaaagagcgtaaagagttgttttcaactactacaagccaatgtgccgaaaagaagccggaagcctcggggccagaggcagaaccctgccctgagctgcatacagagcctgtagagcccttaacacgggcctcttccgctggccccgagggaggcggagttcgcccagagcaaccttttattgttctgggtcaggaagagtacggcgagcatcattcctcgataatgcactgtagggtggactgctccgggaggagagttgcgagtttggacgtggatggggtaatcaaagtgtggagtttcaaccccatcatgcagacgaaggcctccagcataagcaaaagcccgctattaagtctggaatgggcaacaaagcgagataggcttctactgctgggttcgggcgtgggtacagtccgtctgtatgacaccgaggcgaaaaaaaatctctgcgagattaacataaacgacaacatgcctcggattctttcactggcctgttccccaaacggagccagttttgtttgttctgcagcagccccctccctgacctctcaggttgactttagcgctcccgacattggcagcaaaggaatgaaccaggtgccaggacggcttctcttatgggatacgaagaccatgaagcagcagttacagttctcattagacccagagcccatcgcgattaattgcacggccttcaaccataacggtaacctgcttgtgaccggtgctgcagacggggtgattaggcttttcgatatgcagcagcatgaatgcgccatgagttggagagcccactatggcgaggtgtacagcgtggagtttagttatgacgagaacacagtttattccattggagaggatggaaagtttatccaatggaatatacacaagtccgggctgaaagttagtgaatactctcttccgtcagacgccactggaccctttgtcctttccggatattctggttacaaacaagtccaagtgccgagggggcgcttgtttgccttcgattcagaggggaactatatgttgacctgttcggccacaggaggggtcatatataagttgggtggggatgagaaagttctggagtcctgtcttagtcttggaggtcaccgggctccggttgtgacagtagactggtcaacagccatggactgtggaacctgtctgaccgctagtatggacggaaaaataaaattgacaaccctgcttgctcataaggcgtag

SEQ ID NO: 52405 - DNA, 2613 bp, Artificial Sequence
  Description of Artificial Sequence: Synthetic coding sequence
atggccaccaacatcccctgcgaggtggtggccttcagcgaccggaaattaaaacccttaatctacgtgtatagtttcccaggcctgactcgacgcacgaagcttaagggaaatatcctcctggattatacactgctgagctttagctactgtggtacctacctggcctcgtactcttcgctgcctgagtttgaactggctttgtggaattgggagtcttcaattatactgtgtaagaaaagccaaccgggcatggacgtgaatcagatgtcctttaacccaatgaattggcggcagttatgcctctcttcccctagcaccgtgtccgtatggaccattgaaaggagcaaccaggaacactgcttccgggcacgaagtgtcaagctgcccctggaagatgggtcgttttttaatgaaaccgacgtagtcttcccgcaatcacttcctaaggatctgatatatgggccagtgctgccattgtccgctattgcgggcctggtaggcaaagaggccgagacttttcgccccaaggacgatctctaccccctgctacatcccacaatgcactgttggaccccaacttctgacctgtacatcggctgtgaggaagggcatctccttatgatcaatggcgacactctgcaggtcactgtgttgaacaaaatagaagaagagagtcctttggaggatagacgaaattttatatcaccagtcaccttagtgtatcagaaggaaggcgttctggcaagcggtattgatggattcgtctacagttttattattaaggatcgcagctacatgattgaggacttccttgaaatcgagcgacccgtcgagcatatgacgttcagccctaattacaccgtgctgctgatccagacagataaaggctccgtctacatctatacattcggaaaggagcctactctgaataaagtccttgatgcgtgcgatggaaaatttcaagccattgacttcattacacccggcacccagtacttcatgaccctcacatactcaggagaaatctgtgtctggtggttggaggattgcgcctgtgtatcaaagatttacctgaacacactggcaaccgtactggcctgctgcccaagttccctgtctgccgccgtcgggacagaggatggaagcgtgtactttatcagtgtctatgataaggagagtcctcaagtggtgcacaaggcctttttatccgagtcttccgtacagcacgtcgtgtacgaccaacagggcatcttcttactcgttggtaccgctgaaggaaaagtgttcatcattaacgcaaattcttcctccagtttccagatcatcggatttaccgaagtggctaaggacattcttcagattagtaccgtgtcgcttcttgagaccgatatcgtggaggtgatggtactgtcctcgctgccagaagctggaaggtctcgtcttgagatgtttacgcttcccactctcctccctcaagtctcaaccaccttcgccgacgaacgaggaaggctcaaagatgagattattcacaagtacctgtacgaactggaacatgcgctgagcagcgccgtgctgggcttccagagtaatcagatatatggattctgttctcaggtgccgtatatctgctcatatctgctgccggaagaggagcacacgggaatctacatcttgaaaccctacaagaaggtgcagtctagacagtatggccctggactgctatatctcagtagccatggcctttggctaatcacaatagcaaagtgtggcatattgtgtattcgtgacgtctacacactggagacatttgcctggtgtcggtctcattctcatcaaggacatggtatacagtctatgcgaatcagcatggatggccagaatattttggtgaatgggagagatgatggaacccttgtgtatctgaagtggaaacggttcggaggacacctagcttccgagatcctggactactaccaaaagctactgatctccctgagttccgcaatggataaagagaatcactatctgtctaccacccctaaagtaagtgtggatttgggatccgactcagagcacaccaaacagaaggcctcaactgacctttcacaggacgaacttgtgcttacagacgtgaaaaaggagatcccctggatacagcagaagtcacaagaagctatcaagaaggaggtgaatctgttcagtaaaaagcggaaagaaatcaagcaagggatcaaaagcctctccaagacaatcctgaatatgatggaagaaaacgacaaacttgagaatatcgccaagctcgaccagcaggaatttggccttgacctggaggagctggagcggctgcatgatgagtcccaggaagaggtggctaaaatgatcaaggacgtcgagatgcacaatctggccaagagttacctcgccgagctgattaaggaggaatgttggaattccatggccgtcaagggtagggcccttaaatgttttcacatcccttgcgtcgtggaaaactttcccatgaaagcacgaaccgtggaagaactcaaggaactggagcgagtgctgcagcagaagaagatcgaggcagaatgcctgaaggtactgttctag

SEQ ID NO: 52406 - DNA, 4998 bp, Artificial Sequence
  Description of Artificial Sequence: Synthetic coding sequence
atggcccagggccgggagcgggacgagggcccccacagcgccggcggggcttctttgagcgtacggtgggtccaggggttcccgaagcagaatgtgcacttcgtgaacgataacactatttgctacccctgcggcaactacgtcatttttattaacatcgagaccaaaaaaaagactgtcctgcaatgctccaacggaattgtaggcgttatggcaactaacataccctgcgaagttgtggccttctctgaccgcaagctcaaaccgcttatttacgtgtactccttcccaggattgacacgccggactaagctgaaggggaatatactgcttgattatactctgctcagttttagctattgcggcacttacctggcatcctactcttctctaccagaattcgagcttgcgctgtggaattgggaatcctccatcatactgtgtaagaaatctcaaccgggcatggacgttaaccagatgtcgtttaaccccatgaattggcgccagctgtgtctgagctcaccatctaccgtaagtgtgtggaccatcgagaggagtaatcaagagcattgctttcgagcaagaagtgtcaagctcccactggaggacgggagcttttttaacgagaccgacgtggtgtttccccaatcactgccaaaggaccttatctatggccccgtcttacctctttccgctatcgccggcctcgtgggcaaagaagccgagactttccggccaaaagacgacctttaccccctgctgcaccctacaatgcattgttggactcctacctctgatctatacatcggatgcgaggagggacacttactcatgattaacggtgacactctgcaggttacggtcctcaacaaaatagaggaagaatcgccactggaccggaggaattttataagccctgtcacactggtgtatcagaaggagggcgtcctcgctagcggcatcgacgggttcgtgtactcctttattatcaaagaccgcagctacatgatcgaagacttcctggagatcgaaagacccgtggagcacatgacattcagcccaaattataccgtgctgctcattcaaactgacaagggttccgtttatatttacacctttgggaaggaacctactctgaataaggtactcgatgcctgtgatggcaagttccaggcgattgactttattacccctggtacgcagtacttcatgacactgacctactccggggagatctgtgtgtggtggctcgaggactgtgcctgtgtatcgaagatatacctgaacactctggccaccgtgctggcctgttgccctagctctctctctgcagccgttggcaccgaagatggatctgtttacttcatctccgtgtacgacaaggaaagtcctcaggtcgtacacaaggcttttctgagcgagagttcggtgcaacacgtggtgtatgaccagcagggaatcttcttgctggtgggaacggccgaaggtaaagtattcattatcaacgctaacagtagctcgtcttttcagatcattggctttactgaagttgccaaggacatcctccagatatcaacggtctcgttgctcgaaacagacatcgtcgaggttatggtactgtccagcctgcctgaagcaggccgatcgaggctggagatgttcacccttcctaccctcctgccacaggtatctaccaccttcgccgatgagagaggccgattgaaagacgaaatcatccataaatacttatacgagcttgaacacgcgctgtcatcggccgtgttagggttccagtctaaccaaatctacggattctgctcccaagtgccatacatatgcagctacttgctgcccgaagaggagcacacaggtatttacattcttaagccatataagaaagtccagtcgaggcagtacggccctgggttgctatatctgtcgtcacatggactgtggctgatcaccattgcaaaatgtgggatcttatgcatccgtgatgtctacacactcgagaccttcgcgtggtgcaggagccatagccaccagggccatggcattcagtccatgcgcatttccatggacgggcagaatattcttgttaacggtcgtgacgatggaactttggtgtatcttaaatggaagaggtttggtgggcacctcgcaagcgaaattctggattactaccagaagttactaatttctctttcctccgcaatggataaagagaaccactatctgagcactacccccaaagttagtgttgacttaggcagtgattctgaacacactaagcagaaagcaagcaccgatctcagccaagatgaactggtactgacagacgtgaagaaggaaatcccctggatccaacaaaaatcccaggaggccatcaagaaggaagtaaacctgttctcaaagaagaggaaagagataaaacaaggaatcaaatcattgtccaaaacaattcttaacatgatggaggagaatgacaaattggagaacatagccaagttggaccagcaggagttcggcctggacctggaagaattagaacgactgcatgacgagagtcaagaggaggtagcgaaaatgatcaaagatgtggagatgcataacctagcgaaatcttacctcgctgaattgattaaggaggagtgctggaattcgatggccgtcaagggccgtgctctcaaatgctttcacattccctgcgtggtggaaaattttccaatgaaagctcggacagtggaggagttgaaagaactggagcgagtgctccagcagaaaaaaatcgaggccgagtgccttaagctgcgcaaagagatagtcgaggctcagtccggagttaagctgataaaacaacgacacgaagaggacgatgaggaggaagaggaggaagacaagactgtgaaatattccaaccttcccaattatttgctggggtcactcagcacagatttcggggttgatacatcattactctccagtcagctggagttgcactccagggaagaaaagatcaaccagatcatattgcttaaagacatcatttacaaggtcaagacagtattcaataacgagtttgacgcagcctacaaacaaaaggagttcgaaattgcccgcgttaaagaacgcaacgtgcggatcagggaaatcattctggacctggagctcgaggaagcagtgtggcagccagagttcgaggattgcgaaaagcccgagcggaccctcgtcgtgcaggacgaggagatcacagctcataaacacataaagccatggcacaaagctaaagaactgatcgttaaccatgagaaggagcactggcttctcatccaagatgcgtcaacgagactgagagcactcatggatatgatgggaggggtgctggaggtgaaaaaggaggatatcttgcgcatggtgattccacagccagccttcatggcgaaaccggacgccgtgtggaccgaggaagagagaaagcagttcaaagactatgaaaagaaagtgaaagaattgaatgaagagcgagataagtacaggaagtcactcgaggcagaactgaaaaagctccaaaactctatccaggagagcactcaagcctttgacgagcatctgaagcggttgttcgagaggcgggtgaaagcagagatggtgactaaccaggaggagctgaaaatctccaacctcgctttttcactgctgctggacgaagagcttagctccagagagaaatttctgaataactatctcacacgcaaacagcacgagaaatctcagacttccgaagcggtcaggaagtcacgggaggatctcgatgtgtgcaaagagcattacgataacctcctggcagaggataaagtcatggataggtcgtttaagaaagaattctctgagatcccaggacaccaggtcgatatcctttacaagctttttaagcgtaggccacggatctctaagcagaaaacacactcggagaccacgtcagtggtgccgttcggggaattgcctggtagcggaaagctgaacaaagatgcctttgcacagttgatgaaggctatggacgagctggacaacatttccaacatgccagagggcctagatccgcttgtgtggaatcacttctgcatgacccgcagggcaaaagtggagaatgagcagaaagtaaagcagaaggcggccgacttgctagagatggctacattccttcaaaagcgagttgaagaggaggaaaaggttcagcaagagattgagcgggttttccacgagctgatccttctgcaggaggagaaggtccgattccaactgaacctcacgattcagatactcctcaagcagggacaggtggagctcgaaaattttcagttggtcctcgagtattctgatgccattctcattaataagaacattatagaagatctcaattccgtcatccgcactcagggtcagaagaaggtggctagcatgatggagtctaaagacgttcacaaacggatcttgcagatcgagtgggagcataaaaaaatggaaatggagcgtgaggaccttaaccaaaaggcctgggatatccagatgctgttctttagcagggataggcagaagtatctgaatgaacctaactacgaggcactgattagtatccagatagggataatggagcaaactatcgcggttctggacaagatgcacaaaaaaaacgtggagaactgcaaaaagttgctgaagaaactaggaaagtttagtaaccagaaggatatcgcaaattacgccctgtcgtgtaatttacgcgaggagcttgtcgctgtgtctgagagaaaagacatatgcaatgccatgggatccaaactaacatgcgagaaaattgtaaaggagagatacgagaacatgatgcagcagcagaagcttactaatatttcaaagcagcaagcagaacaaatctccattctccaaactgaagttgagcgccttagaatgaagacctttccggccctcgtgcagatgtag

SEQ ID NO: 52407 - DNA, 912 bp, Artificial Sequence
  Description of Artificial Sequence: Synthetic coding sequence
atggccaccaacatcccctgcgaggtggtggccttcagcgaccggaagctgaaaccactgatctatgtgtattcatttccaggactcaccagaaggactaagctgaagggtaacatcttgctggactatacattactttcctttagttactgcggcacttacctggcaagctattctagcctgcctgaatttgagctggccttgtggaactgggaatctagcataatcctgtgtaagaagagccagcccggaatggacgtgaatcagatgagttttaatccaatgaactggcggcaactttgcttgtcaagtccatccactgtctcagtatggaccatcgagcggagcaatcaggaacattgcttccgcgcacgctctgtgaaattgcccctggaagatgggagcttttttaacgaaactgatgtggtgtttccccaaagtcttccgaaggatctgatttacggcccagttttaccgctctcagctattgcaggtttagtgggcaaggaggccgagacttttaggcctaaagacgacctttatccacttctgcaccccaccatgcactgttggaccccaacctcagatctctatataggctgcgaggaagggcacctcttaatgatcaatggagatacactgcaggtgactgttctgaataagatcgaagaagagtctcccctggaggatagaagaaacttcatctcaccggtcacgctggtctaccagaaggagggcgttctggcctcggggattgacggcttcgtctatagctttattattaaggacaggagttatatgattgaggatttcttggaaatcgaacgacccgttgaacacatgacattttccccaaattacactgtcctgctcattcagaccgataaggtgtgttggatggttatttcctag

SEQ ID NO: 52408 - DNA, 1239 bp, Artificial Sequence
  Description of Artificial Sequence: Synthetic coding sequence
atggccaccaacatcccctgcgaggtggtggccttcagcgaccggaaactcaagcccctgatctacgtctattcattcccaggattgacccgcaggactaaactcaagggtaatatcctactcgactacacccttctaagtttttcttactgtggtacctatcttgcaagctacagctctctgcccgaatttgagcttgccctgtggaactgggagtcttccattatactgtgtaagaaaagccaacctggaatggatgtgaaccagatgtcttttaatcctatgaattggcggcagttgtgcttgagttcgcctagcacggtctcggtgtggaccatcgagcgctcaaatcaggaacactgtttcagggctcggagcgttaagttaccgctcgaagacggatctttctttaacgagacagacgtcgtcttccctcagagtcttccgaaggatttaatctatggtcctgtgcttcccctaagtgccattgcgggcctagtgggtaaggaggctgagacattcagacctaaggatgacctttatcctctcctgcaccccactatgcattgctggacacctaccagcgatctttatattggatgcgaggaggggcacctactgatgatcaacggagacactcttcaggtgaccgtgctgaacaaaattgaagaggaatctccattagaagaccggcgaaactttatcagccccgtaacactcgtgtatcagaaggagggcgtgctggcgtccgggattgatgggtttgtctatagctttattattaaagacagatcctacatgattgaagactttctagagatcgagcggccagttgagcacatgaccttcagccccaactacacagtgcttctaatacaaacggataagggcagcgtgtacatctacaccttcggtaaggagccgaccttgaacaaggtgttagatgcatgtgacggtaaattccaggcaatagattttatcacccctggcacgcagtattttatgaccctcacctactccggcgagatttgcgtgtggtggcttgaggattgcgcttgcgtcagtaaaatctacctgaataccctggcgaccgtgcttgcttgctgtccctcatcattgtccgctgccgtcggcaccgaagacggaagcgtatacttcattagcgtgtacgataaggaatctccccaggttgtgcacaaggctttcctatccgagtcgtccgttcaacatgtggtgtag

SEQ ID NO: 52409 - DNA, 4914 bp, Artificial Sequence
  Description of Artificial Sequence: Synthetic coding sequence
atggcccagggccgggagcgggacgagggcccccacagcgccggcggcgcatctttgagcgtgagatgggtgcaggggttcccaaaacagaacgtgcatttcgttaacgataatacaatttgttatccgtgcggaaactacgtgatcttcattaatatcgagaccaagaaaaagactgtgctgcagtgtagcaatggcatcgtgggagtgatggctaccaacatcccatgtgaagttgttgccttttcagacagaaaattgaagccattaatctacgtgtattcctttcccgggctcacaaggagaacaaagctgaaggggaatatcttgctagactacaccctgctatccttcagctattgtggcacttatctcgcctcatacagctctctccctgagttcgaactagctctgtggaattgggagagcagcataatactttgcaaaaaatcgcaaccgggtatggatgtgaatcagatgagctttaatcccatgaactggaggcagctctgcctctcttcaccatcgacagtgtctgtctggacaatcgaacgctccaatcaagagcattgctttcgggccaggtccgtgaagctccccctggaggacggatcattttttaacgaaaccgacgtggtgttcccacaatccctcccgaaggacctgatatacggccccgtgctccctctgtctgctatcgcaggacttgttggaaaagaggccgagacatttaggccgaaagacgacctgtatcccctgttgcaccccacgatgcactgctggactccgacctctgacctatacattggatgtgaagagggacacctactgatgattaacggcgatacactgcaggtgactgtgctcaacaaaatcgaagaagagagcccacttgaagaccgcaggaatttcatcagtcctgtgacgctagtctaccagaaggagggggtgttagcaagtgggatcgacggctttgtgtacagcttcataattaaagataggagctatatgatcgaggacttcttagagatcgaacgccctgtggagcacatgactttcagtccaaactacaccgtgctgctgattcagactgacaaagggtcagtttatatctacacattcggtaaagagcccaccttgaacaaggtgcttgacgcctgcgatggaaagttccaggcaatcgatttcatcactccaggcactcagtatttcatgactctcacgtactccggtgagatctgcgtgtggtggctggaagactgcgcgtgcgtgtcaaagatttacctcaatactctcgccacggtcctggcctgctgcccttctagccttagtgccgccgtgggaacagaggacgggtccgtgtacttcataagcgtgtacgataaggagagcccccaggtcgtgcataaagctttccttagcgaaagtagcgtgcaacatgtggtgtacgaccagcaggggatttttctcctggttggcaccgccgaaggcaaagtgtttatcatcaatgcaaactcctcttcctcctttcaaatcatcggttttactgaggtagccaaagatatcctgcaaatctcgaccgtctctttactggaaactgacatcgtggaggtcatggtgttaagttcccttccggaggctggaagatcacgactcgagatgttcacactccctactctgctgccccaggtgagtactaccttcgcagatgagcgggggcgcctgaaggatgaaatcatccataagtatctgtatgagttggagcacgccctctccagcgccgtgttgggattccagtctaatcaaatttacgggttttgctcgcaggtaccgtacatctgtagttatttgctgcctgaggaggagcacaccgggatctacattctgaaaccatataagaaggttcagtcacgacagtacggccccggcttactgtatctctccagtcatggactttggttgatcacgatagctaaatgtggaattctgtgtatcagagacgtgtataccctggaaaccttcgcctggtgtcggagccacagtcaccaggggcatggtatacagagcatgcgtatcagtatggacggccagaacatcttagttaacggccgggatgacggaaccctggtctatttaaagtggaaaagattcggcgggcatctggcttcggagatcctggattactaccagaagctgctgatatcccttagcagcgccatggataaagagaaccactacctatctactacccccaaggtgtccgtggacctcgggtctgatagcgaacataccaagcagaaagccagcaccgacctgagccaagatgaactcgtactgactgatgtcaagaaggaaatcccctggatccagcaaaagagtcaggaggccatcaaaaaggaggttaacttgttctcaaagaaacgcaaggagattaaacagggcatcaagagcttgtcaaaaacaatcctcaatatgatggaggagaacgacaagctcgagaatattgccaagctggaccagcaggaatttgggcttgatctggaagaattggaaagactgcacgatgagtctcaggaagaagtggccaaaatgatcaaagatgttgaaatgcataacctggcaaagagctacctggccgaactgattaaggaagagtgttggaatagcatggcagttaagggacgagccctgaaatgttttcacattccatgtgtggtggaaaattttcctatgaaagcccggaccgtagaagagttgaaggagctggaacgggtccttcaacagaagaaaatagaggctgagtgcctgaaactgcgcaaagagatcgttgaagctcagtctggagtcaaacttatcaagcagcgtcacgaggaggacgacgaggaggaagaggaagaagacaaaaccgtgaagtattctaacctccctaattatcttctcgggtccttatctaccgattttggggttgacacctctctgctttcttcccagctcgaactgcatagccgggaggaaaaaatcaaccagatcatacttctgaaagatatcatctataaggtcaaaactgtgttcaacaacgaattcgacgcggcttacaagcagaaagagttcgagatcgcccgcgtaaaagaaagaaacgtgagaattcgcgagattatattggatcttgaactggaggaggccgtctggcaacccgaatttgaggactgcgaaaagcctgagcggactctggtggtgcaagacgaggagatcactgctcacaagcatatcaagccctggcacaaagccaaggagcttatagtcaaccatgagaaggaacattggctgcttatacaggatgcctcgaccagactacgcgccctgatggatatgatgggtggcgtgttagaagtgaaaaaggaagacattctgcgcatggtcataccacaaccagcctttatggccaaaccagatgctgtttggaccgaggaggaacggaagcagtttaaggactatgaaaagaaggtgaaggagttgaacgaggaacgtgacaaataccggaaaagcttggaagccgaactgaagaagctccagaactccatacaggaatctacccaggcttttgatgagcatctcaaacgacttttcgagaggagagttaaagccgagatggttactaatcaggaagaacttaaaattagtaacttggccttcagcctgctattggacgaagagctctccagcagagagaagttcctgaacaactacctgacaaggaagcagcacgagaaggtgatggacagatctttcaagaaagagttttcggaaatcccaggtcaccaggtggatattctgtacaagttattcaaacggagacccaggatttcaaaacagaaaacccattcagaaaccactagtgtggttcctttcggggaactgccgggctccggtaaattgaacaaagatgcctttgcccagcttatgaaagccatggacgagctggacaatatctctaatatgcccgaaggattggaccctttggtatggaatcacttctgcatgactagacgggccaaagtggagaacgaacagaaagtcaagcaaaaggccgcagaccttttggaaatggcaactttcttgcaaaaacgagtggaggaggaggagaaggtgcagcaagaaatcgaaagggtgttccacgagctgatactgctgcaggaggagaaagtcaggtttcaactaaatttgacaatccagatccttctaaagcaggggcaggtagagttagaaaatttccagctagttctggaatactccgacgcaatcttgattaataaaaatataattgaagatctgaattccgtgatacggactcaagggcaaaagaaagtggcaagcatgatggagagcaaagatgtacataaaagaatcttacagatcgagtgggagcacaagaaaatggaaatggagagggaggatctcaaccagaaggcctgggatatccagatgctgttcttcagccgagacaggcaaaaatacctgaacgagcccaactatgaggccttaatttctatccaaataggaataatggagcaaacaatcgcagtgcttgataaaatgcataaaaaaaacgttgagaattgtaaaaaactgctcaaaaagttaggtaagttcagcaatcagaaagacatcgcaaattatgccttgtcatgcaacctgagagaggagctggtggcagtgtcggaacggaaggacatctgcaacgccatgggaagcaagttaacctgtgaaaagattgtgaaagagcggtacgagaacatgatgcagcagcaaaaattaacaaatataagcaagcagcaggccgagcagatttccattttgcagactgaggttgagaggctccggatgaagacattccccgctcttgtgcagatgtag

SEQ ID NO: 52410 - DNA, 2994 bp, Artificial Sequence
  Description of Artificial Sequence: Synthetic coding sequence
tgacccggcctgctgtacctgagcagccacggcctgtggctgatcacaatcgctaaatgcggtatcctatgcataagagatgtgtatacattagagacatttgcatggtgccgcagccattcccatcaaggccacggcattcaatcgatgcgcatatctatggacgggcagaacatcctcgtcaacggccgggacgacggaactctcgtttaccttaaatggaaaagatttggcggccacttggcctccgaaattctcgactactatcagaagctcctgatctcactcagctccgccatggataaggagaaccattatctttctactacccccaaggttagcgtagacctgggatctgacagtgagcacacaaaacagaaagctagtaccgacctgagccaggatgaactggtgctgacagatgtgaaaaaggaaattccttggatccaacaaaagtctcaggaggcaattaagaaagaagttaatctcttctcaaagaagaggaaagaaataaagcaggggattaagtccttaagcaaaacaatcctgaatatgatggaagagaatgataaactcgaaaacattgcaaaattggaccagcaggagttcgggttggatctcgaggagttggaacgccttcacgatgagtcacaggaagaggtggctaaaatgatcaaagacgtggagatgcacaatctggcaaagtcttacctggccgagctgatcaaagaagaatgttggaacagcatggctgtcaaggggagagctttaaaatgctttcacatcccctgtgtggtggaaaatttccctatgaaagctaggacagtggaagagttgaaggagctcgaaagggtgcttcagcagaagaagatagaagccgagtgtctgaagttgcggaaggagattgtcgaggcccaaagcggagtgaaactcattaagcagcgacacgaagaagacgacgaagaggaagaggaagaggataaaacagtgaagtatagtaacttgccgaattatttactgggcagtttatcaaccgacttcggggtagatacctcgctgctgagttctcagctcgagctacactctcgggaggaaaagataaatcagataattctgttgaaggatatcatctataaggtgaagactgtatttaacaatgagttcgatgccgcgtacaagcagaaagagttcgaaattgcaagggtgaaagaaaggaacgtccgcatccgggagatcattttagaccttgagctggaagaggcagtgtggcagccagaatttgaggactgcgagaagcccgagcggaccttggtggtgcaggacgaagagatcaccgcccacaagcatattaagccgtggcacaaagcaaaagagttaatcgtgaaccacgagaaggaacattggctattgattcaggacgctagtactcggcttagagccctgatggatatgatggggggagtgctggaagtgaagaaggaagacatactgagaatggtcataccccagcccgcatttatggccaagccagacgccgtttggacagaggaggaaagaaaacagttcaaggactacgagaaaaaagttaaagaattgaacgaggaaagggataagtatagaaaatccctggaagctgagttgaagaaactccagaacagcatacaggagtctacacaggcgtttgacgagcacttgaaaagactgttcgagagacgcgtgaaggccgagatggtcacaaatcaggaagaattgaaaatatctaatctcgccttttcgcttctgctggacgaagaattaagcagtagagagaagtttctgaataactacttgaccaggaaacaacatgagaaagtcatggaccgttcttttaagaaggagttttccgaaattcctggtcatcaggtggacatactctataagctgttcaaaagacgtccaagaatatcaaagcaaaaaactcattccgagacgactagcgtggtgccgttcggagaattgcctggcagcggaaagctgaataaggacgccttcgcacagctgatgaaggcaatggacgagctcgacaacatctccaatatgcctgaagggctggacccccttgtgtggaatcatttttgcatgactcgcagggccaaagtcgagaatgaacagaaggtcaaacagaaggctgcggatctgctggaaatggccacgttcctgcagaagagagtggaggaggaagaaaaagtgcaacaagagatcgagcgagtgtttcacgagcttatactattgcaagaagaaaaggttcgatttcagctcaacctgaccatccagatcttgctgaagcagggacaagtggaactggagaatttccaactggtattagaatacagcgatgcaatcctgatcaacaagaacatcattgaagatctgaactctgtgattcgaacccaaggacagaaaaaggtagcttccatgatggaatctaaagacgttcataaaaggatcctgcagattgaatgggagcataagaagatggagatggagcgcgaggatctcaatcaaaaagcctgggacatacagatgctttttttttcaagagaccgccagaagtatctcaatgaaccgaactacgaggccctgatcagcatccagatcggaataatggagcaaacaatcgctgtgctggacaaaatgcacaagaagaatgttgaaaactgcaaaaagttactcaaaaagctgggaaaattctccaatcagaaggatatcgctaactacgccctcagttgtaacctgcgagaagaacttgttgcagtcagcgagcgcaaagacatctgtaatgccatgggctcaaagcttacttgtgagaagattgtgaaagagcgttacgaaaacatgatgcagcagcaaaaacttacaaatatatctaaacaacaggccgagcagatctccatcctgcagaccgaagtcgagcggctgcgtatgaaaacttttcctgcgcttgttcagatgtag

SEQ ID NO: 52411 - DNA, 1545 bp, Artificial Sequence
  Description of Artificial Sequence: Synthetic coding sequence
tgatggaccgaggaggagcggaagcagttcaaggactacgagaagaaggtcaaggaactcaacgaggagcgggacaaataccggaaatcattggaggccgagctcaagaagctccagaattctatccaggaatcaacccaagcctttgacgagcacttgaagcggctctttgaacgccgcgtgaaagcagagatggtaaccaatcaagaggagctgaagattagcaacctggctttctcactgttgctggacgaagagctgagtagtcgcgaaaagtttttgaataactatctgactagaaaacaacacgaaaagagccagacatcagaggcagtacgcaagagcagagaggatttagacgtgtgtaaggagcattacgataacctgctggccgaagacaaggtgatggacagaagctttaagaaagagtttagtgagatcccaggccaccaggtggatatcctgtacaagttgtttaagcgcaggcccagaataagcaagcagaaaacacactcggaaaccaccagcgtggtcccttttggtgaattaccaggctccggcaaactgaacaaagacgctttcgctcagcttatgaaggctatggatgaactggacaacatctcaaacatgcccgagggactggaccccttggtgtggaatcatttttgtatgacccggagggcgaaagtggagaacgagcagaaggttaagcagaaagccgccgacttgctcgagatggctacgttccttcagaaacgcgtggaggaagaagagaaagtccaacaggagatcgaaagggtgtttcatgagctgatactgctgcaagaggaaaaggtccgcttccagctgaatctgactatacagattttgcttaaacaggggcaggtggagctggagaatttccaactagtgctggaatattccgatgccatcctgatcaataagaatatcatagaagacttaaactcagtgataagaacccagggacagaagaaggttgcctccatgatggagtctaaggacgtccacaaaaggattctacaaattgagtgggaacacaaaaaaatggaaatggagcgggaagacctgaaccagaaagcctgggacatccagatgttgtttttcagtagagatagacagaagtacctaaatgagccgaattatgaggctctgatctcgattcagattgggatcatggaacaaaccatcgcagtgctggacaagatgcacaagaaaaacgtcgagaactgcaagaaactgctaaagaagttgggtaaattctcaaaccagaaagacatcgctaattacgcactgtcctgtaacttacgcgaggagctcgttgcagtctccgaaaggaaagacatctgcaacgccatgggctctaagctgacctgcgaaaaaattgtcaaagaacgatatgagaacatgatgcagcagcagaagctgaccaacatctccaagcaacaggccgagcagatttctatacttcagacagaagtggagcgcctcaggatgaaaacttttcccgcgctggtgcagatgtag

SEQ ID NO: 52412 - DNA, 1965 bp, Artificial Sequence
  Description of Artificial Sequence: Synthetic coding sequence
atggcccccctggtgcccggcccccccctggaggccagccccaccacccttgacgctgccgtgagatggggactacagcgccctgtgcgcgggcacatggccccgggccaagctggaggacgcggggacgcttctgccttaggagcccagtactcatgggcaagagacggacgctccgcggtgggatccaagctgtcttgggtggggcctgcggccccggagagtaaagcagctcaaggcagggaaatggggcgcgacgtagggaaggccgtggattgcctcgatctctccggccctgatggggctagttgtctgcagttaagcctgcggaaaagcgagctgtttcccgctgcccgccggcctggaagacctgccgaccctggcttatctccccgctgtctgcgacgcccccctctccgccccggaccggcatccactccattacggggccctggcgctgcaagaccaccaccactacccccccactctcgcggccgaagcgcagttagttttctggcttttttgccaccccagcgttccccctccgcaccaagggaagccgcaggttcccgggggggccttcgagccagcggtggcagatgtggtggcccagccggagcggccgctgggagcggaggagggggagatgccccaggtcctgctggcagagcaatgcagaggtcccgcgcaggggctgatgaagccgcccttctgctcgccgggctagccctaagggagctggaacccggttgcggatcgccaggcaggggacgcaggggccccaggccaggcccaggagacgaagccgcaccggcactggggcgaaggggtaaggggagcggcggccctgaggccggcgcggacggcctgagtcggggtgagcgcggaccaagacgggcggctgtcccagagctgtctgcccagcctgcgggaagcccccgcgctagcctggcgggatcagacggcgggggaggaggaggaagcgcccggagttcaggtatatccctgggatacgatcaacgacatggctccccaaggtcgggacgcagcgatccccggccagggccgggccctccaagcgtaggtagcgctcgttcctccgtctctagtttaggctcacgcggaagcgccggggcctatgctgacttcttgcctcctggggcctgcccagctccagcccgctcccctgagcctgctggacctgcacccttcccactccctgcacttccgctgcccccaggacgtgagggcggacctagtgccgctgaaaggagactcgaagctctcacgagggagctggagcgggcccttgaggcacggacagcccgggattattttggaatttgtatcaagtgtgggctgggcatctatggagcccagcaagcttgccaggccatggggagtttgtatcacaccgattgctttacctgtgattcctgcgggcggagattgcggggaaaggccttctacaatgttggtgagaaagtttattgccaggaggatttcttgtattctggattccagcaaaccgctgataaatgttccgtgtgcggccatctcatcatggagatgattctccaagccttgggtaagagctaccatccaggttgtttccgttgcagcgtttgcaatgagtgtctggatggcgtccctttcaccgtggacgtggagaacaacatctattgcgtacgagactatcacactgtgtttgcccccaaatgcgccagctgtgctcgtcctattctgcctgctcaggggtgtgagaccaccattagggttgtgagcatggaccgagattatcatgttgcctgctatcactgtgaggactgtggcctgcaattgagcggcgaggagggcagaagatgttacccgttggctggacacctcctgtgccggcgctgccacctcagacgcctacaacctggccctttaccttctcccacagttcacgtgactgaattatag

SEQ ID NO: 52413 - DNA, 5403 bp, Artificial Sequence
  Description of Artificial Sequence: Synthetic coding sequence
atggccaccgacagcggcgaccccgccagcaccgaggacagcgagaagccagacggaattagttttgagaaccgggtccctcaagtggctgcaacacttactgtcgaagctcgtctgaaagagaaaaattcaacgttctcagccagtggcgagactgtggagcggaagcggtttttccggaaatctgttgaaatgacagaagatgacaaagtggccgaatccagccctaaggatgaaagaatcaaagctgccatgaatatcccccgcgtggacaagctgcccagcaacgtcctgaggggaggacaggaagtgaaatacgagcaatgcagcaaatccacctccgaaatttcaaaagattgttttaaggagaagaacgagaaggagatggaggaggaagctgaaatgaaggccgtcgccacatctccgagcggccggttcctgaagttcgacatcgagttaggccggggagctttcaagaccgtgtataaaggactggatactgagacctgggttgaagtcgcctggtgcgagcttcaagaccgtaaactcaccaaagctgagcaacagcgatttaaggaggaagctgaaatgttaaaggggctccagcaccccaacatcgtgaggttttatgatagctgggagtcaatactcaaaggaaagaaatgcattgtgctcgtgaccgaactaatgacgtccggaaccctcaagacctatttaaaaagattcaaggtaatgaaacctaaagtactgcgcagctggtgtcgccaaatccttaaggggctgcaatttctccatactcgcacacctcctattattcatcgggacctcaagtgcgataacatctttatcaccggacctacgggatccgtcaagattggagacctgggcctggctacattgatgcgcaccagcttcgccaaaagcgtgataggaacacctgagtttatggcgcccgaaatgtacgaggaacattatgatgaatccgtggacgtgtacgcctttggaatgtgcatgctcgagatggccacatcagaatatccatacagcgagtgtcagaacgcagcccaaatatatcggaaggtaacctcgggcattaagcccgccagcttcaataaagttacggacccagaggtgaaggagattatcgaggggtgcatccgacagaataaatccgaaaggctgtccatcagggacctgctcaatcatgccttcttcgccgaagatactggcctacgtgtcgaactggctgaggaggacgactgtagtaattcgtctctcgccctgagactttgggtggaagatccaaagaagcttaagggcaaacataaagacaacgaagctatagagttcagcttcaatctggagacagacacccctgaagaggtggcatacgagatggttaaatcagggttcttccatgagtccgattcaaaggccgtggctaagagtattagagacagagtaacccctataaagaaaactagagaaaaaaaaccagccggctgcctggaggagagacgggatagccaatgtaaatcgatgggcaacgtgtttccacagccacagaacacaaccctgccactcgcccccgcccagcaaaccggcgctgaatgcgaggaaactgaggtagatcagcacgtgcgccagcagctcctacaacggaaacctcagcaacactgtagttcggtaacaggagataatctgtccgaggcaggggcagcttcagtcattcattcagatactagctctcaaccctctgtggcttactcctccaaccaaacaatgggttcgcagatggtaagcaacattcctcaggcagaggtaaatgtccctggacagatctattcatcacaacagcttgtgggccactaccagcaggtttcaggactgcagaagcactccaaactgacccagcctcaaattctgccactggtgcaagggcagtcgaccgtgttacctgtccatgtgctggggcctactgtggtctcccagcctcaggtctctccactgacggttcagaaagtgccccaaattaagccggtgagtcagcctgtgggcgctgaacaacaggccgcattgctgaaaccagatctcgtccgaagcctgaaccaggatgtggctaccacaaaggagaacgttagcagtcccgacaacccctcaggcaatgggaagcaggatagaatcaagcagcgcagagctagttgcccgcggcccgagaagggtacaaaattccagctgactgttctccaggtgagcacgtcaggagataacatggtcgaatgccagctagagactcataacaataagatggtcacatttaagtttgatgtcgacggagacgcaccagaggacatcgccgactacatggtggaagataacttcgtgttggaatctgagaaggaaaaattcgtggaggagctccgagctattgtggggcaggcacaggaaatcttgcacgtccactttgctacggagcgcgcaacaggcgtggattccatcaccgttgactccaattcttcacagacaggttcctccgagcaagtgcagatcaattccacatcgacccagacctcgaacgaaagtgcgcctcagagctctccagtcggccgctggcggttttgcatcaaccagaccatcaggaatcgggaaacacagagtccaccgagcttgcagcacagcatgtctgctgtgcctggacggcatccgttgccaagtccaaaaaatacgtcaaataaagagatatccagggacacactgctcacaattgaaaataacccgtgtcaccgggctctgtttacgagtaaaagtgagcacaaggatgttgttgatggtaagatttcagagtgtgcatccgtggagacaaagcaacctgccatcttgtaccaggtggaggataaccgccagatcatggccccagtcaccaactcgtcttcctattcaacaacttcagtgagggcagtgcccgccgaatgtgaaggccttacgaagcaggccagcatcttcattccagtgtatccttgccatcagacagcatcccaggccgatgctctgatgtctcatccgggcgaaagtacgcagacaagcggaaatagtctgaccacacttgcgtttgatcagaagccccagactctctctgttcagcaacctgctatggatgcagagttcattagccaggaaggggagaccaccgtgaatactgaggccagctctcccaagactgttattcctacccagaccccaggactggaacccactacacttcagcctaccacggtcctggaatctgatggtgagcgtccgcctaaactggagtttgccgacaatcgaattaaaaccctggatgaaaagctgcggaacctgctgtaccaggagcattccatatcttcaatctatcctgagagccagaaggacacccaatctatcgactcccctttttcctcaagcgctgaagatactcttagctgccctgttacagaggtgatcgcaatttcccattgtggtattaaagactctccagtccagtcacccaacttccagcagacaggatcaaagctcctttcaaacgttgccgcttctcagcccgcgaacattagcgtgtttaaacgggacttgaacgtgatcacctctgtcccctcggaattgtgcctccacgaaatgagtagcgacgcttctctgcccggcgacccggaggcatacccagcagcagttagtagcggtggcgccatacatctccaaaccggcgggggatattttggactgagtttcacctgtcctagcctgaaaaatcccatttccaagaaatcctggactcgaaagctgaagagctgggcttatcggctgcggcagtctacttcatttttcaagcggtctaaggtcagacaggtagagactgaggagatgagatctgcaatcgctccggatcctatccctctgacccgtgagtccactgccgacaccagggcgctgaaccgctgtaaggccatgtccggatcttttcagagggggcggttccaggttattacgatcccccagcaacaatctgccaaaatgaccagcttcggcattgaacacatcagcgtgttcagcgaaacaaaccacagttcagaggaagctttcataaaaaccgccaaatcacagctggtcgagattgaaccagccacccagaatccaaagaccagcttctcctacgagaagctgcaggcattgcaagaaacctgtaaagaaaataaaggggtacctaaacaaggcgacaactttctgtccttttctgctgcttgcgagacggatgtaagttccgtgacacctgagaaagagttcgaggagacgtctgctacaggatcttctatgcagtccggaagcgagctgctcttgaaggaacgggagattttgactgccggcaaacaaccttcttctgacagcgagttcagcgctagcttggccggctcgggcaagtctgtcgccaagacaggccccgagtccaaccagtgcctgccccaccacgaagagcaggcctacgctcagacccagagcagcctgttctacagtccatctagcccgatgtctagtgacgacgagtcagaaatagaagacgaggacctgaaagtcgaactacagagactacgtgagaaacacattcaggaagtcgtgaatctccagacccagcaaaacaaagagctgcaagagctttatgaaaggctccgctccatcaaagacagcaaaacacaaagcaccgaaatcccgcttcccccagcttcaccccggagacctagaagcttcaagtctaaactgaggtcaagaccccagagtctcacccacgtcgataatggtattgtggccacaggtaagagctgtctgatcaacgaactcgagaaccccttgtgtgtggaaagcaacgccgcttcatgccaacaaagccccgcgtcgaagaaaggaatgttcactgatgacttgcacaagcttgtggatgattggacaaaagaagccgtgggtaacagcctcattaagccgagtttaaatcaattaaaacaatctcagcacaaactggagactgaaaactggaacaaggtgagcgagaatactccaagcacgatgggctacacatctacctggattagttccctgagccagatccgcggagccgtcccaacatctctgcctcaggggctaagtttacccagctttccagggcccctttcttcctatgggatgccacacgtgtgccagtacaacgccgtagcgggggccggatatcccgtacagtgggttggcatttcaggaaccactcaacaatcagtcgtgattccagctcagagcggaggcccctttcagcctggtatgaatatgcaggcctttccaactagttcggtgcagaatccagccacgattccgcctggcccaaaatag

SEQ ID NO: 52414 - DNA, 1065 bp, Artificial Sequence
  Description of Artificial Sequence: Synthetic coding sequence
atgcagggcctgctgttcagcaccctgctgctggccggcctggcccaattttgctgtagggttcagggaaccggcccattggatactacacccgaaggacggcccggtgaagtgtctgacgctcctcagcgcaagcaattttgccattggccctgcaagtgtcctcagcaaaagccacgctgccctccaggcgtcagcttggtgcgggacggctgcggatgttgcaagatatgcgcaaaacaaccgggagagatctgcaacgaggctgacctgtgcgatccacacaaaggcctgtattgcgactacagtgttgatcgcccaaggtatgagactggcgtctgcgcttatttggtggcagtcggctgtgagttcaatcaggtccactatcataatgggcaggttttccagcctaacccgctgttctcctgtctgtgcgtttcaggcgcaatcggctgcaccccactgtttataccaaaactcgcgggttcacactgctctggagccaaaggcggcaagaagtcagatcagtctaattgctctctggagcccctcctgcagcaactaagtacctcctacaagaccatgcccgcctacagaaatcttccacttatctggaaaaagaaatgcctggtgcaggctaccaagtggacaccatgttcacgaacctgcggcatgggaatttcaaatagagtgactaatgaaaattctaactgtgagatgcggaaggagaaacgcctgtgctatatccagccctgcgacagcaatattctaaagacaattaagataccaaaaggaaagacatgccagcccacctttcagctcagtaaagccgagaagttcgtctttagtggatgttcaagcactcaatcgtataagcccacattctgtggaatctgtctggataagcggtgctgtattccaaataagtccaaaatgattaccatccagtttgactgcccaaatgaggggtccttcaagtggaaaatgctctggattacatcctgcgtttgccaaagaaactgtcgggagcctggggatatatttagcgaactcaagatcctgtag

SEQ ID NO: 52415 - DNA, 2139 bp, Artificial Sequence
  Description of Artificial Sequence: Synthetic coding sequence
atgctgaaggactacctgagcgtggcccaggacgccctgcggacccagaaggagctctaccacgtgaaggagcaacgtctggcactcgctctggatgagtatgtgcgcctgaacgacgcctataaagagaagagcagctcccacacttcactcttttcgggatcctccagctctacaaagtacgatccagatatccttaaagctgaaatatctactactcgcctgagagtcaagaagcttaagagggaactgtcccagatgaaacaagagctgctctataaggaacaagggtttgagactttacaacagatcgacaagaagatgtccggcggccagtccggctacgagctttccgaagctaaggctatcctgaccgaactaaagtcaatccgaaaggccatcagctctggagagaaggagaagcaggacctaatgcaatcattggcaaaactgcaggaacgatttcacctcgatcagaatatcggccgctctgagcccgacttgcgctgcagtcctgtaaatagccacctatgtctctcccggcaaacactcgatgctggttcacagacctctatttctggagacattggagtgcggtcccggtctaatctcgcagagaaggtgcggctctctctccagtacgaggaggctaagcgaagcatggccaacttgaagatagaactgtctaagttggacagtgaggcctggccgggcgcattggatatcgaaaaggaaaaactcatgcttattaacgagaaggaggaacttttgaaggaattacagttcgtcactccacagaagcgaacccaagatgaactggaacgcctggaagcagagagacagcgacttgaagaggaactcctatcagttaggggaacgccatcacgggccttagccgagcgcttgcggttggaggagaggagaaaagaactcctgcagaaactggaagaaacaactaagctgacaacttatctgcatagtcagctgaaaagcctctcagccagtacactgagcatgagttcgggttcttccctcgggagcttggcaagcagccggggatctctgaacactagttcacgcggcagtttgaattccttgtcttccacagagttgtattattcctcccagagcgatcagatagatgtggactatcaatacaagctggactttttactccaggagaagtctggttacatcccttctggtcctattaccaccatacatgagaatgaagttgtgaaatcaccctcgcagccaggccagtctgggctgtgcggcgtggcagcagccgcaacgggccatactccaccgttagccgaggcccccaagtctgtggcctccttaagctctagaagcagcctcagctccctctctccccccggctccccgctcgtcttagaaggcacatttcctatgagttcatcccacgacgcttcactacatcaatttaccgccgacttcgaggactgtgaactgagctctcattttgctgatatttctcttatcgagaatcagattttattagacagtgactccggcggggcatctcagtctctctcggaagacaaagacttaaacgaatgcgctagggagccgttgtatgaggggacggccgatgtggagaagagccttcctaagaggcgagtcattcacctgctgggcgagaagaccacttgtgttagtgccgccgtcagtgacgaatcagtggctggcgacagtggggtgtatgaagcattcgtgaaacagccttccgaaatggaagacgtgacatatagcgaagaggacgttgcaattgtggagaccgcacaggtgcagatcggccttcgatataacgccaaaagttcctccttcatggttattattgcacagctcaggaatttacatgcctttcttatccctcacacgtccaaagtgtactttagagtcgcagtgctgccgtccagcacggacgtgagctgtctgtttcggacaaaagtgcatccaccgacagagagtatccttttcaacgatgtgttccgcgtggctataagccagaccgccttgcagcaaaaaactctgcggaagaatttcacctttgtcaccgcaatcacacacggagtctgcctcccgttgccagtgccaatgccatccttcgcttag

SEQ ID NO: 52416 - DNA, 3579 bp, Artificial Sequence
  Description of Artificial Sequence: Synthetic coding sequence
atgccccggcgggccggcagcggccagctgcccctgccccggggctgggaggaggctcgagactatgatgggaaggttttttacattgaccacaacacacgaagaaccagctggatagacccacgcgaccggctgacgaaaccactgagcttcgccgattgcgttggtgacgagttaccgtggggatgggaggccggttttgaccctcaaatcggagtttattacatagaccacattaataagaccactcagatagaggacccaaggaagcagtggcggggcgagcaagagaaaatgcttaaggattatttgtccgtggcacaggacgccctgcggacacagaaagaactgtaccacgtgaaggaacagcggctggcactggcactagatgaatacgttagactgaatgacgcctataaagaaaagtctagctcacacacgtcccttttctcggggagttcttcatctaccaagtacgatccagatattctgaaggctgaaattagtactacacgtttgcgggtaaagaaacttaaacgggagctcagtcagatgaagcaggaacttctgtacaaggagcaaggattcgagaccctgcaacagatcgataagaagatgtcggggggccagagcggctacgagttgtccgaagccaaagccatcctaacagagttaaaatccatccgcaaggctatatcttcgggcgagaaagaaaagcaggatctgatgcaatctctggccaagctgcaggagcgattccatctggatcagaatattggaagaagcgagccggatttaagatgcagcccggtgaattcgcacctgtgtctgagtaggcagaccctggacgctggttctcaaacatccatttcaggcgacatcggagtgcggtctaggtctaatcttgctgaaaaagttcggttgagcttgcaatatgaggaggccaaacggagtatggctaaccttaaaatcgagctcagcaaactggactcagaggcatggccaggagccctagacatcgagaaagagaagctgatgttgattaatgaaaaagaagagctgctgaaggaactgcagtttgttactcctcagaagcgtacacaggacgagctagaacgcctcgaagcagagcgtcagcgcttggaggaagaactcttgtccgtgaggggaaccccgtcacgcgccttagcggaaaggttgcgactggaagaaaggcgcaaagagctgctgcaaaagctggaggagaccactaaactaacaacgtacctgcattcacagttaaagtccctgtccgctagcactttaagtatgtcctccggaagttcactgggctccctggcatcatctagagggtcactaaatacatcctccaggggatctctgaacagcttgtctagtaccgagctgtactactcttcccagtctgaccagatcgatgtcgattaccagtacaaactggatttcctcttgcaagagaaaagtggatatatcccttctggcccaatcactactatacacgaaaacgaagtggtcaagtctccctcccaaccaggccagtctggcctttgtggcgtggccgctgccgctaccgggcacacaccgccacttgccgaggccccaaaaagcgtggcgtctctatcaagccgctccagcctgagcagcctctccccacctggctcccctctggtgctggaagggacttttcccatgagctcgtcacatgatgcttcgcttcaccagtttacagccgattttgaagactgcgagctgagctctcattttgccgacatctcattgattgagaaccagatcctccttgattctgactccgggggagcttcgcagagtctgagcgaagataaagacctcaacgaatgtgctagggagcctttatatgaggggacagcagacgtggaaaaatccctacctaaacgaagggtgatccatcttctgggagagaagacaacctgcgtgagcgctgcggtttccgatgaatcagtggctggggatagcggagtctatgaggcctttgtgaagcagccgagcgaaatggaggatgtgacctacagtgaagaagacgtcgcgattgttgagactgcccaggtgcagattgggttgaggtataacgcaaaatccagcagtttcatggtgatcattgctcagcttaggaacttgcatgcttttcttatcccccacacaagtaaagtgtacttccgggtggccgtattgcccagttctacggacgtttcctgcttatttaggaccaaagttcacccaccaactgaatctattctttttaacgatgttttccgcgttgccatctctcagaccgccctccagcagaagaccctgcgggtcgatctgtgctccgtctccaaacacaggcgggaggaatgtttagctggcacccaaatctcacttgccgatctccccttcagctcagaggtcttcaccctttggtacaacttgctgccctctaagcaaatgccctgtaaaaaaaacgaggagaatgaagactctgtgtttcagccgaaccagccccttgtggacagcatcgatctggacgctgtgtccgctctgctggcccggacctcggccgagctcctggctgtggaacaggagctcgcacaagaggaagaggaggagtctggccaggaggaacccaggggtccagacggggattggcttaccatgctacgagaggcttctgacgaaatcgttgcggagaaggaggcagaagtgaaactgcccgaagacagttcctgtacggaggatctgtctagctgtacgtcagtgcctgagatgaatgaagacggcaatcgaaaggagagcaattgcgctaaggatcttagatcccaaccccctacaaggattccgacactggtggataaagagacaaatacagacgaagccgctaacgacaacatggctgttcgtcccaaggagcggtcatccctgagctcacgacagcatccattcgttagatcttctgttattgtgaggtcacagacattttcaccgggagaacgcaatcaatatatttgtcgcctcaaccggtccgactccgacagcagtaccctggccaaaaagagcctgtttgtcagaaactcaacggagcgccgaagcctgagggtcaaacgcactgtgtgccagtcagttctgagacgcacaactcaggaatgccctgtgcggaccagtctagatctcgagctggatttgcaggcatctctgacaagacagtccagattgaacgacgaactgcaggctctcagggatttacgtcagaagctggaagagctgaaggcccaaggagagactgacctgcctcccggcgtgctcgaagacgagaggttccagcgcctgctaaagcaggctgaaaagcaggctgagcagtcaaaggaggaacagaaacaggggttgaatgccgagaaactcatgcggcaagtgtctaaggatgtgtgccggctcagggaacagtcacagaaagtgcctagacaggtgcagtcatttcgtgagaagatcgcctattttactcgagctaagatctcaatccccagtctgcctgctgacgacgtatag

SEQ ID NO: 52417 - DNA, 3651 bp, Artificial Sequence
  Description of Artificial Sequence: Synthetic coding sequence
atgccccggcgggccggcagcggccagctgcccctgccccggggctgggaggaagcgagggattacgacggcaaagtattctacatcgatcacaatacacgtcgcaccagctggattgacccacgcgatcgcctaactaagcctctgtctttcgccgactgtgtgggggatgagctgccttggggctgggaagcggggtttgatcctcagatcggcgtctactacatcgaccacataaataaaacgacccagatcgaggatcccagaaagcagtggcgcggggagcaggagaagatgctgaaagactacctcagcgtggcgcaggacgcgctcagaactcagaaagagctgtaccacgtcaaagagcagagattagctctggctttagatgagtatgtcagactgaatgatgcctacaaggaaaaatcttcaagtcacactagcctgtttagcggtagcagcagctccacgaagtacgacccagacatcttgaaagctgagatcagtactacaagacttcgagttaaaaagcttaagcgggagctttcacaaatgaagcaggagcttttgtataaggaacagggcttcgaaaccttgcagcaaatcgataaaaagatgagcggcggtcagagcggttatgaactgtccgaggctaaagctatcctgactgaactgaagagcatcagaaaggcgatcagctccggcgaaaaggagaagcaagatcttatgcagtccttggctaagctccaggagcggtttcatctggaccagaatataggccggtcagagcccgatctgagatgctccccagtgaattcccatctctgcttgagccgccagaccctggacgccggttcacagacgtctatcagcggcgacatcggggtgcggtctagaagcaacctggctgaaaaagtacggcttagcctccagtacgaggaggccaagcgttctatggctaacctaaaaatagaactaagcaagcttgattccgaggcatggcctggcgccttggacatcgaaaaggaaaagctcatgcttatcaacgaaaaggaggagctgttaaaggaactgcagtttgtgacgccacagaagagaacccaagacgagctcgagagacttgaggctgagagacagaggctcgaggaagagctccttagtgtgagggggacgccaagcagggctctggcggaacgacttagactcgaggaacgacggaaggagctgcttcagaagctggaggaaacaactaagctgactacctacttacactcgcagctcaagagccttagcgctagcactctcagtatgtcctccgggtcctcgctgggtagcttagcctccagccgcgggtctctgaatacctcatctagaggatcgctcaactctcttagctctacagagttgtattactcctcacaaagcgaccaaatcgacgttgactatcaatacaaactggactttctgctgcaggagaagtccggttacattccctctggccctatcacaaccattcatgaaaatgaggtagtgaagagcccgagccaaccaggccagagtggtctctgtggagtcgctgccgctgcgacgggacacactcctcccctggccgaggccccaaagtccgttgcctccttgagtagcagatcatcacttagttctctttcgcctcctggttcgcccctcgtactggaaggtacattcccaatgagctccagccacgacgcatccctgcaccagtttaccgcagatttcgaagattgtgagctgagctcccactttgctgacataagtttaatcgagaaccagatactacttgactcagattccggcggtgccagccaatccttgtctgaggataaagatctgaatgagtgcgcacgtgagcctctttatgaggggacagccgatgtggagaagtcactccctaaaagacgtgtgatccacctcttgggggagaaaactacatgcgtcagcgcagccgtgtccgatgagagcgtggctggcgacagcggtgtgtatgaggcattcgtgaagcaaccgagtgagatggaggacgtgacctactccgaggaagatgtggctatagttgaaactgctcaggtgcagatcggcctacgctataacgcaaaatcgtcaagttttatggtaattattgcccagctccgcaacttacacgcctttttgatcccacacacgagcaaggtctatttccgagtagccgtcttgccctctagcacggacgttagttgtctttttagaaccaaagtgcaccctccaaccgagtctatccttttcaatgacgtgttccgcgtggccatcagccagaccgcattacagcagaagacacttagggtggatttatgcagcgtgagcaagcaccgccgtgaagaatgtcttgccgggacacagattagcctggccgatttaccattcagttccgaggtatttacattatggtataacctgcttccttccaagcagatgccttgcaagaaaaatgaagagaacgaagacagcgtatttcagcccaaccaacctctagtggacagtattgatctggatgctgtatccgcgctgctcgccaggacaagtgcagaactgctcgcagtggaacaagaactagcccaggaggaggaagaggagtccgggcaggaggaacctcggggcccggatggggattggttgaacacttacttcctctgctgctgggagctcaaagacgacgtttttacccggctgacagtgaagccgctgctgacaatgctgagggaagcctcagacgaaattgtagccgaaaaggaagccgaagtgaaactgccagaagattcttcatgcaccgaggacctgagctcttgcactagtgttcctgaaatgaacgaagacggaaataggaaggagagtaactgcgcaaaggatttaagatcccagcctcctacccggatcccaacactcgtggacaaagagacaaatacagatgaggcagcaaacgataacatggccgtgaggcccaaagagcggagctctctctcgagccgccagcatccattcgtccgaagctccgtgattgttagaagtcagacttttagccccggggagcgcaatcagtacatttgtagactgaatagaagcgattccgattccagcacactggcaaagaagtctctgtttgtcaggaattccaccgaacggcgttctctgcgagtcaaaagaactgtttgccagtcggtgctaaggcgaaccacgcaagaatgccctgtgagaacaagtctggacttggaactggacttgcaagcctcactaacccgacagagccgacttaatgatgaactgcaggcgcttagagacttgagacagaagctggaagaacttaaagcgcaaggcgagactgatctgccgccaggcgtgcttgaagacgagcggttccagcggctgctgaaacaggcagagaagcaagcagaacaatctaaggaggaacagaagcaggggttaaatgccgagaaactcatgcgccaagttagtaaagacgtgtgtcgcctgcgcgagcaatctcaaaaggtgccccggcaggtccagtcatttcgggagaaaatcgcctacttcacacgcgcgaaaatatctattccttctttgccagcagatgacgtgtag

SEQ ID NO: 52418 - DNA, 963 bp, Artificial Sequence
  Description of Artificial Sequence: Synthetic coding sequence
atgccccggctgcgggtgcacggcgcctgcctgcccaccaagagcgtgttgtttctgttctatcatagacttaccatgctgcgtgaagccagcgatgagattgttgcagagaaggaggcggaagtcaagctgcccgaggattcctcttgcactgaagacctgagtagctgcactagtgtaccagagatgaacgaagacggaaaccgcaaagagtctaattgtgcaaaggatctgaggagccagcctcctactcggattccaaccttagtggacaaggagaccaatactgacgaagccgcgaatgataacatggctgttcggccaaaggaaagatctagcttgagtagtcggcaacacccttttgttagaagttctgtcatcgtgaggtctcaaacgttctctcctggagagcgcaaccaatacatctgccggctgaacaggagtgattcagattcctccactctcgccaagaagagtctgttcgttcggaattccaccgaacgtagatccctgagagttaagagaactgtctgtcaatccgtattgcggagaactactcaagagtgtcctgtgaggacgagtctcgatttagaattagacctgcaagcttcactaactcgacagagtcgccttaacgacgagctccaagccctgcgagatctccgacaaaaattggaggaactgaaggctcagggggaaaccgacttgccccccggcgtgcttgaggatgaaagatttcagcgccttctcaagcaggctgagaaacaagcggagcagagcaaggaggaacagaagcaaggattaaatgctgagaagttaatgcggcaagtttctaaagatgtttgtcgactgcgcgaacagtcgcagaaagttcctagacaggtgcagtcttttcgagagaaaatagcctacttcacacgcgctaaaatttccataccttcactgcctgctgatgacgtgtag

SEQ ID NO: 52419 - DNA, 3432 bp, Artificial Sequence
  Description of Artificial Sequence: Synthetic coding sequence
atgccccggcgggccggcagcggccagctgcccctgccccggggctgggaagaagcccgcgactatgacggtaaggttttttatatcgatcataacacccgaaggaccagttggattgaccctcgggatagactgacaaagccgctctccttcgccgactgtgtgggtgacgaactgccttggggctgggaagccggattcgatccacagattggcgtgtactatatagatcacatcaacaaaaccacacagatcgaggatccaaggaagcaatggaggggtgagcaggaaaagatgttgaaggactacctatccgtggcccaggacgctctgagaacccagaaagaactgtaccatgtgaaagaacagagactcgccctagctctggatgagtacgtcaggctgaatgacgcgtacaaggagaagtcgtcttcccacacaagcttgttctcgggtagttcaagttccacaaaatacgatccagatatactcaaagcagagatttctaccacccgtctacgggtaaagaagttaaaacgggagctaagccagatgaagcaagagctgctttacaaggagcagggcttcgagacacttcagcagatcgacaagaaaatgtccggaggacagagcggctacgaactgagcgaagctaaagccattttgaccgaactcaaatcaattagaaaagcaatcagcagtggggaaaaggagaagcaagatctgatgcagtccctggccaaattgcaggaaaggttccacctggaccagaatattggaaggagcgaacctgacttacgttgctctccggttaactctcacctgtgccttagtagacagacgctcgatgccgggtcccagacttccatttccggagacatcggggtcaggtctcggagtaacttggctgagaaggtaagactgtccctgcagtacgaagaagcaaaaagatctatggcaaatctgaagatcgagctgagcaagctcgactccgaggcttggcctggcgccctagacatcgagaaggagaagctgatgcttatcaatgagaaggaggagttattaaaagagctgcagtttgtgacaccacagaagagaacacaggacgaattggagaggcttgaggcagaacgccagagactcgaagaggagctgctgagtgtgcgagggaccccttccagagctctggccgaaagactgaggctagaagagcgtcgcaaggagctgctgcagaaacttgaagagactaccaaactgaccacgtacctgcactcacagctgaaaagtttatcagcatctaccctgtccatgtcaagtggctctagccttggctcacttgcttcctcccgggggtccctgaacacgtcctctagagggtctctgaactcgctaagcagcacagagctgtattactcttctcagtcggaccagatcgacgtcgactaccagtacaaacttgacttcttactgcaagagaaatcaggatacataccaagtggacctatcacaacaatccacgagaatgaggtcgtgaaatcaccatcacagccaggtcagtccgggctgtgcggcgtggctgcggctgctaccggccatactccacccctggctgaagctccaaagtcagttgcatctctcagctccaggagcagtttgtcatccctgtctccaccggggtccccactagttctcgagggcacctttccgatgagcagcagccacgatgcatccctccaccagtttacagcagatttcgaggattacgtcgagaagtcactaccaaaacggagagtgatccacctgctcggtgaaaagacgacctgtgtaagcgccgccgtgtcagatgaatctgtggcaggcgacagtggtgtgtacgaagccttcgttaaacagcccagcgagatggaagatgttacctacagtgaagaggacgtcgccatcgttgaaactgcacaggtgcagatcggcctccggtacaatgcgaagagttcaagctttatggttatcatagcacaactgcggaatttgcacgccttcttgataccacatacctccaaagtttacttccgagtggccgtgctccccagcagcacagacgttagctgcttgttccggacaaaagtgcacccacctaccgagagcattttgttcaacgatgtatttcgagtggccatatcacagacagccctgcagcagaaaaccctgcgggtggatctctgctcagtgagcaagcaccgaagagaggaatgcttggccgggacccagatttccctggctgacttgcctttcagcagcgaagtcttcacactgtggtataacctcctgccatctaaacagatgccctgcaaaaaaaacgaggaaaatgaggacagtgtatttcaacctaatcagccgctcgttgattcaattgatctagatgctgtgagtgccctcctggccaggaccagtgcggagctcctcgcagtggagcaggaactggcccaagaggaagaggaagaaagtggccaggaggagccaagggggcccgatggggattggctgaccatgctcagggaggccagcgacgaaattgtggctgaaaaggaggccgaggtcaagctgcccgaagattcctcttgcacggaggatttatcttcctgtacaagcgtgcccgagatgaacgaggacggtaatcgaaaggagagcaactgtgccaaggatctgagaagccagccacccacccggattcccaccctcgtcgacaaggaaaccaatacagacgaagccgccaatgacaacatggctgttagacccaaagagcgatcatctctgtcctccagacagcacccgttcgtccgttcttctgtcatagtccggagtcagactttttcacccggtgaacggaaccagtacatttgcaggctgaatagatctgattcagattccagtactctggccaagaaatctttgttcgtgcgcaactccaccgagcggcggagcttgcgggtgaagcggacggtctgtcagtcagtacttcgccgcacgacccaggagtgcccggtccgtacttcacttgacctcgagctcgatctgcaggccagtctcactcgccaatccagactcaacgacgagctccaggcattgcgggatctccggcagaaactagaggaacttaaggcgcaaggggagaccgatctgccacccggcgtgttagaggatgagcggttccagcggctcttaaaacaagcagagaagcaggcagagcagtctaaggaggagcagaagcagggactgaacgccgagaaacttatgaggcaagtgtctaaagatgtctgccggttacgagaacaatcccagaaggtccctagacaggttcaaagcttccgcgagaagatagcctattttactagggccaaaatcagcatccctagcctcccagccgatgacgtgtag

SEQ ID NO: 52420 - DNA, 315 bp, Artificial Sequence
  Description of Artificial Sequence: Synthetic coding sequence
atgaagagctgccagaagatggagggcaagcccgagaacgagagcgagccgaagcatgaagaggagcccaagccggaagagaaacccgaggaagaagaaaagctggaggaggaagctaaggctaagggaacttttagggagcgcctgatccaatcgctccaggaattcaaagaggacatccacaacagacatctcagcaatgaggacatgtttcgcgaagtcgacgagatcgacgagattagaagagtccggaataagttaatcgttatgcgctggaaggtgaatcgcaatcatccctacccttacctgatgtag

SEQ ID NO: 52421 - DNA, 315 bp, Artificial Sequence
  Description of Artificial Sequence: Synthetic coding sequence
atgaagagctgccagaagatggagggcaagcccgagaacgagagcgagcccaagcacgaggaggaacccaagccagaggagaaacccgaggaggaagagaagctcgaagaggaagctaaggcaaagggtacgttccgggagcgcctcattcagtcattacaggagttcaaagaggatattcacaacaggcatttatccaatgaggacatgttcagggaggttgacgaaatagacgaaattcggcgggtgcggaataaactgattgtgatgaggtggaaagtcaaccgaaaccatccttatccttatctgatgtag

SEQ ID NO: 52422 - DNA, 3279 bp, Artificial Sequence
  Description of Artificial Sequence: Synthetic coding sequence
atggaccacatcaacaagctgacccagatcgaggacccccgggagcagtggagacgagagcaggaacgcatgctgaaggagtaccttatcgtcgcacaagaggccttaaacgccaagaaagaaatttatcaaattaagcaacagaggttcgagctagcccaggaggagtaccagcagttgcataagatgtgtgaagatgattcccggtcctatgcgtcctctttctctggatatagtacgaataccaaatatgaccctcaccagataaaggctgaaatcgcttccagaagagacaggttgtctaggctcaagagggagctgactcaaatgaaacaggaactccaatataaggagaagggggttgaaactcttcaggagattgatcgcaaaatgagctctacacacacatcctacaaactcgacgaggcccaggctatcatgtccgagctccggaccattaaaaaagcaatctgcactggggaaaaagagaggcgcgatctgatgcactcactggctaaattaacggattccttcaagaacagttgcagtgtgaccgactccctggtggacttcccacaccatgtgggcgtgcccggggatgctggagtgccccagcagttctgtgatgctggctctcagaccgatattatcggggaattcgtcttcgacgataagacgcgactggtggatagagtgagactaaattggcagtatgaggaagcacgcaaaagagtagcaaacatccagcagcagcttgcccggctggacaacgagagctggccttctactgcagaggctgaccgagataggcttcaactgattaaagagaaggaggccctcctacaggagctccagctgataatcgcacagaggcgcagcgcaggcgatgtcgcgcgattggaggaggagagagaaaggcttgaggaggaattacggcgagccagggccactagcgcacagggcgcaaccgagcgtatcctccttcaagagaagaggaactgcttgttaatgcagttggaagaggctaccagactgactagttatctgcaatcgcaactgaagtctctgtgcgcctctactttaaccgtctcctccggctcctcaagaggctcgctcgctagctcccgaggatccctggcttctagtcgaggctctctttcttccgtttcatttaccgatatctatggcctgccgcagtacgagaaaccagatgcagagggcagtcagctcctccgtttcgacctgatccctttcgactccctgggccgtgacgctcctttcagcgagccaccaggtccctcagggtttcataagcagcgccgcagtttagacacgccccagagcttggcatccctctcttctcgcagcagcctgagttctctgagcccgccctcctccccactggacaccccattcctaccagcgagccgggactccccactggcacagcttgccgactcctgcgaaggcccggggttgggggcgcttgatcggctgcgagcccatgcgagcgcaatgggtgatgaggatttgccaggtatggctgccttacagccccacggcgtccccggtgatggagaaggaccccatgaacggggcccaccacccgcgtcggcaccagttggtggcaccgtgacactcagagaagatagtgccaagcgactggagcggagggcccgccgcatctcggcctgtttaagcgattactcattggcatctgactctggtgtcttcgaaccattgacaaagaggaacgaggacgccgaggagcctgcttatggagatactgcttcaaatggcgatcctcagatccatgttgggctgctccgcgactctgggtccgaatgcctgttggtacacgtgctacagttgaagaaccccgcaggtctggcagtcaaagaggattgtaaggttcacattcgagtgtatctcccccctttggactccgggacccccaacacatattgctctaaagccctggagttccaggtgccgctggtcttcaatgaggtgttcaggattcctgtgcattcatcagcgctgaccctgaagtcgctgcagctttacgtgtgctcggtgaccccgcagctgcaggaggaactgctggggatcgcacagatcaatttggccgattatgacagcttgtccgaaatgcagttgagatggcattccgtgcaggtgtttacaagttcagaaccatcacgaactagggaggcaggctgcgccggcgaatctagcgcccgcgacccagcccacactatctcaattagcggtaagacagacgcagttaccgtgctcttggctcgcactacagcacaactgcaagccgtcgagagagagttagccgaagagagagctaaactggagtacaccgaagaagaggttctggaaatggaacgtaaggaggagcaggccgaggccatttccgagcggagttggcaggctgactctgtcgatagcggctgttccaattgtacacagacctcaccgccatatcccgagccatgttgtatgggcatagatagcattctcggccatccgttcgccgcccaggccggtccatattcccctgaaaaatttcaaccttcgcccctgaaagtggacaaggagaccaatactgaggatttgtttctcgaagaggctgcatcactggtcaaggaacgcccctcaaggcgagccaggggttctcctttcgtacgttcgggtacaattgtaaggagtcagaccttcagcccaggagcccggtcccagtacgtgtgccgtttatacagatccgactctgatagctcgaccttgcctcgaaagtcaccctttgtaagaaacaccctagagcgtcgaaccttgcggtacaagcagagctgtcgatcatctctcgctgaattgatggccaggacgagccttgacctggagctggacctgcaggcctccagaaccagacaacggcagctgaatgaggagctctgtgcgctgcgcgagttacggcagcgcctggaggacgctcagctgagagggcagacagatcttccaccatgggtactcagggacgagcgactcagaggcctgctgagagaggctgagcggcagacccgccaaacgaaattagactataggcatgaacaggctgccgaaaagatgctgaagaaggcctctaaggagatctaccagctgagaggtcagtcccacaaggagccaatccaagtgcagacattccgtgaaaaaatcgcattcttcacacgcccccggataaatatcccacccctccccgcagatgacgtctag

SEQ ID NO: 52423 - DNA, 1749 bp, Artificial Sequence
  Description of Artificial Sequence: Synthetic coding sequence
ctgagccacatcagcgagctgacccagatcgaggacccccgggagcaatggaggcgggagcaagagcgaatgcttaaagagtatttgatagtcgcccaggaggcgctgaacgccaaaaaggagatatatcaaatcaaacaacagcgtttcgaactggcccaggaagagtaccaacagctgcacaaaatgtgcgaagatgactcacgtagttacgcaagttccttctcagggtacagtacaaatactaagtatgacccccatcagattaaggccgagattgccagtcggagagatcgcctctctcggttaaaacgcgaattgactcaaatgaagcaggagttacagtacaaggaaaagggtgtggaaaccctgcaggagatcgaccgcaaaatgagcagtacgcacacctcttacaaattggatgaggcccaagcaatcatgtcagaattgagaacaatcaagaaggctatctgcactggggagaaggaaaggcgggatctgatgcactcgctggcaaaactcaccgacagttttaaaaattcctgttccgtgaccgatagcctggtggacttcccgcaccacgtcggcgttcccggggatgcaggggtgccacaacaattctgtgatgctggctcacaaacagacatcattggggaattcgtattcgatgataaaacccggttggtagatagagtcagactcaactggcagtacgaggaggccagaaaaagggtggccaacatccagcaacagctcgcgcgattagacaacgaaagttggccaagcactgcggaagcagacagagacagactgcaactcatcaaggagaaagaggccctgctgcaggaactccaattaattatcgcccagaggagatctgctggagacgtggcccgcctggaggaggagcgggaacgcctggaggaggagctgagacgcgccagggccacctccgcacagggggcgacagaaaggatactgcttcaagagaaaaggaattgcctgctcatgcagctcgaggaggcaacacgcctgacgagttacctgcagtctcagctgaagagtctctgcgcatcgacactaacagttagcagcgggtcaagccgaggctcccttgcttccagccgcgggtccctcgcatcctctagaggaagtctcagttcagtgagctttacagacatttacgggttgcctcagtacgaaaaacccgacgctgaggggtcccaactgcttcgcttcgacctgataccttttgacagtctaggtcgcgacgcaccttttagtgaaccgcctggacccagcggttttcataagcaacgcaggtcactggacacaccccagagtctagcctccctttcatctcgaagcagcctgtcttcattgtccccacctagttcacctcttgataccccctttttgccagcctctagggactctcccctggctcagctcgctgatagctgcgagggtccaggactgggggcgttagatagactgcgagcccacgcctcagccatgggcgacgaggatttacctggtatggctgcactgcaaccacacggcgtgccaggggacggggaaggaccccatgaaagaggacctccccccgcatccgccccagttgggggctccaaatgtggatgctccgactccagcaggaggcagtgccaagaagtaggggaagagggcactcctcaccttaggatgtcggtcggactgtttgccagccagaggcaatggggggtgtag

SEQ ID NO: 52424 - DNA, 3279 bp, Artificial Sequence
  Description of Artificial Sequence: Synthetic coding sequence
atggaccacatcaacaagctgacccagatcgaggacccccgggagcagtggcgtcgcgaacaggagcgcatgttaaaggagtacctcattgtcgcccaggaggcactaaacgccaagaaagaaatttaccagattaaacaacagcggtttgagctggcccaggaggagtaccaacagctacataagatgtgtgaggacgactcccggtcttatgctagtagcttttctggctactccacgaacaccaaatacgacccccaccagatcaaagctgagatcgcatcccgccgagatcggctgtctcgcttaaagcgtgagttgacacagatgaaacaggagttgcagtataaggaaaaaggggtagaaactctgcaggaaattgatcgcaaaatgagcagtactcatacttcctacaagttggacgaagcccaggcgataatgagcgagttacgtactatcaagaaagcaatttgtacaggcgaaaaggagcgcagggacctcatgcatagccttgctaagttaaccgacagtttcaagaatagctgcagtgttactgatagcttggtcgattttcctcaccacgtgggggtacccggagatgcaggtgttcctcagcaattttgtgatgctggctcacagacagatataataggggagttcgtcttcgatgacaaaactcgccttgtcgatagagtccgccttaactggcaatacgaagaagctcgaaaaagagtagcaaacatccagcagcagcttgcacgactcgataacgaatcctggccctccacagccgaggcggatagagaccgtcttcagctgattaaggaaaaagaagcattgttacaggaactgcaactgataatagcccagaggcggtcggcgggggatgtggcccgacttgaagaagaaagagagcgcttagaagaggaacttcgaagggccagggccactagtgcacagggcgctacagagaggattcttctacaagagaagcggaattgcctgctcatgcagctcgaggaagctacaagactgaccagctacctgcagtctcagctgaagagtctatgcgcaagcaccctgaccgtctcctctggcagcagcagaggcagcctggccagtagtaggggaagcctcgcatcctcccgaggttccctcagctcagtctccttcacggacatttatggactgcctcagtacgagaaacccgatgccgaaggcagccagttgcttcgatttgacctgattccttttgattcactgggacgagacgctccattctcagagccgcccgggccatccggatttcacaagcagcggcgcagcctcgacacgcctcagtctctcgcttctctatccagcagaagtagtttatcgagcctatccccgcccagctctcccctggacacaccttttcttcctgcttcacgagactcgcccctggcgcagctggctgactcatgtgagggcccaggactgggtgccttggatcggctaagggcccatgcctccgctatgggcgatgaagacctccccgggatggcggccctgcaaccacacggagtgcccggggacggcgaaggccctcatgagcggggaccgccaccagccagcgcaccagttggtggcaccgtgaccctcagagaagacagtgctaagaggctggaacggcgggctcggcgaatcagtgcctgcctttccgactattctctagccagcgattccggcgtgttcgaacctctcacaaaaagaaatgaagacgcggaagaacccgcatatggtgatactgcctctaatggcgacccgcaaattcacgtcgggctgctacgtgactctggaagcgagtgcttgttggttcatgtactacagctgaagaatcccgccggcctcgctgttaaggaggactgtaaggtgcacattagagtctatttgcccccactggattccggaaccccgaatacatactgtagcaaggccctggagttccaggttcccctcgtatttaatgaggtatttcgcatcccagtgcactcatccgcccttacactcaaatctttgcagctgtacgtatgctctgtgacgccccaattacaggaagaacttctcggtatcgcccagatcaatttggccgattacgactccttgtccgagatgcagctacgatggcactctgtccaggtttttacttcatcggaaccctcaaggacgcgtgaagcagggtgtgccggggaaagcagcgccagggatccagcccacacgattagcatttcagggaagacagacgccgtgacagtactgttggcccgtacgacagcccaactgcaggctgtggaacgtgaactcgcggaggagagggcaaaactagagtacaccgaagaagaggttctggaaatggaacgtaaagaggagcaggccgaggccatctcagagcgaagttggcaagccgattcagtggattccggctgttccaactgcacccagaccagtccaccatatccggaaccctgctgcatgggcatcgattcgatactgggacatccgtttgctgcccaagccggcccttactctcccgagaagttccagccatctcccctgaaagttgacaaagagaccaacaccgaggatttgttcctggaagaggcggcgtccctggttaaggagcgcccatcccggagagcccgcggaagcccgtttgttcgatcgggtactatcgtccggagccagacattttcaccaggagcgcgctctcagtacgtgtgtaggttatataggtccgacagcgactcctccacactgcctcggaagagcccatttgtccgaaataccctggaacggcgcacattaaggtacaaacagtcatgccggtctagcctggccgagttgatggcgcgtacttctctggacctggaacttgacttgcaggcgagccgcacccggcagagacaactgaacgaagagctgtgcgccctaagagagttacggcagcggcttgaagacgctcagttgagagggcaaactgaccttcccccctgggtccttcgagatgagagactgagagggttacttcgggaggctgagcgccagacccgccagacaaagctcgattacagacatgagcaggccgccgaaaaaatgctaaaaaaggccagcaaggagatttaccagctgcgcggccagagccacaaggaacctattcaagtgcagacctttcgggagaagattgccttcttcacccgtccccgcattaacattccacccctacctgccgatgatgtctag

SEQ ID NO: 52425 - DNA, 639 bp, Artificial Sequence
  Description of Artificial Sequence: Synthetic coding sequence
atgcagctggaggaggccacccggctgaccagctacctgcagagccagctgaaaagcctgtgcgcgagtaccttgactgtctcctcgggctcttcaagaggtagcctggcttccagtaggggtagtctagcaagcagccgggggtcactgtctagcgtgagctttacggatatatatggactgccacagtacgaaaaaccggacgcagagggtagtcagctgctacgatttgatctgatccccttcgacagccttgggcgagacgccccattcagtgagccccccggtccctctggattccataaacagagacgtagcctggatacgcctcagtccctggctagcctaagctctcggtcctcgctaagcagcctgtcaccgccgtccagcccactggacaccccattcctgccggcttcgcgggatagccctttggctcagctggcggactcttgtgaagggccaggacttggtgctttggaccgcctgcgggcccatgcctccgctatgggcgacgaggatctgcctggtatggcagctctccagccacatggggtacctggcgacggagagggcccccacgaacgtggccccccaccggcatccgccccagtgggagggaaaatactgacgtcctag

SEQ ID NO: 52426 - DNA, 1764 bp, Artificial Sequence
  Description of Artificial Sequence: Synthetic coding sequence
atgggcgacgaggacctgcccggcatggccgccctgcagccccacggggtgcctggcgacggggaaggcccacatgagaggggaccccctcccgcttctgctccagtcggaggtacggtgactttgcgggaggacagcgccaagcgtctggagcgaagggctagaagaatatccgcctgtctgtcggactatagcctggcgagcgattctggtgtgtttgagcctctgaccaagcggaatgaagatgctgaggagcctgcctacggggacaccgcctccaatggagatccgcagatccatgtgggtcttctcagggactctggcagcgaatgcctgttggtacacgttctgcagctgaaaaaccctgctggactggccgtgaaggaggactgcaaggtgcatatacgggtatacctccctcccctggactccggaacgccaaacacttactgtagcaaagctctcgaatttcaggtgccattggtctttaacgaggttttccgcatccctgtacattcatctgctttaacactcaagtctctgcagctgtatgtgtgttcagttacaccccaattgcaggaagagctgctcggaattgctcagatcaatctcgccgactacgatagcctgagtgagatgcagctcagatggcacagcgttcaggttttcacgtcatctgaaccgagtaggacacgggaggctggatgcgccggcgagtcctccgccagggaccctgcccacactatttccatttccgggaagactgatgcagtaactgtactcctggcgcgaaccaccgcccaacttcaggccgtagaaagggagttggccgaagaaagggcaaagttggagtacactgaggaggaggtgctggagatggagagaaaggaagagcaggcagaggcaatttctgagaggtcgtggcaggccgatagcgttgactccggctgtagtaactgcacccaaactagtccaccatacccggaaccctgttgtatgggaatagactctattctcgggcacccatttgccgcccaggcaggaccctattcgcccgaaaagtttcagccatctcctctgaaagtggacaaagagacgaataccgaagatctgtttctggaggaggctgcatcactggtgaaggagcgaccaagtcggcgcgctaggggttcaccatttgttcggtccggtaccatcgtgcggtctcagaccttctcacctggagcaagatcccagtacgtttgccggctttacaggtctgactcggatagctctacactccccagaaagtcgccctttgtgaggaacactttggagcgtaggactctcagatataagcaatcttgcagatccagtctagctgaactgatggcaagaacatcgctggatctggaactggatctgcaggcctcccgaacaagacagcgacaactgaacgaggaactctgcgccctacgggaattgaggcagcgactcgaagatgcacagttgcgcggccagaccgatctgcctccctgggtgctgagagacgagcggcttaggggactcctaagggaggccgaaagacaaacccgacagacaaaactcgattatagacatgagcaggcagctgaaaaaatgctgaagaaggctagcaaggagatataccagctgagggggcagagccataaggaacccatccaggtgcagacattcagggagaagatagcattctttacaagaccgagaataaatatcccccccctccccgccgacgatgtatag

SEQ ID NO: 52427 - DNA, 210 bp, Artificial Sequence
  Description of Artificial Sequence: Synthetic coding sequence
atggagagccccaagaagaagaaccagcagctgaaggtgggcatcctccacctgggctcaaggcagaagaaaattaggatacagcttagaagccaggtgctgggccgagagatgagagatatggaaggagatttgcaggaactgcatcaatcaaatacgggtgataagagcggattcgggttccgccgccagggcgaggacaacacctag

SEQ ID NO: 52428 - DNA, 441 bp, Artificial Sequence
  Description of Artificial Sequence: Synthetic coding sequence
atgctgctgtggtgccccccccagtgcgcctgcagcctgggcgtgtttcccagcgccccatcccctgtctgggggactcgcaggagttgtgaacccgccaccagagtgccggaagtgtggattctgtcacccctgctaagacacggggggcacacccaaacacagaaccataccgcttcgcccaggtcaccggttatggaatcacctaagaaaaaaaatcagcagctgaaggtcgggattctgcaccttggtagtcgacagaagaaaatcagaatccaactgcggtcccagtgtgcgacgtggaaggttatctgtaaaagctgcatctctcagacgccaggtataaacctcgatcttgggagtggagtgaaagtgaaaataatcccaaaagaagagcactgtaaaatgcccgaggccggtgaggaacaacctcaggtgtag

SEQ ID NO: 52429 - DNA, 441 bp, Artificial Sequence
  Description of Artificial Sequence: Synthetic coding sequence
atgctgctgtggtgccccccccagtgcgcctgcagcctgggcgtgtttccttctgccccatctcccgtttgggggactcggcgctcctgcgaacctgccacgcgcgttcctgaggtctggatcctaagccctctcctccgccacggtggtcacacccagactcagaaccataccgcctcgccacgcagtccagtgatggaatcgcccaagaaaaagaatcaacaattaaaggtgggcattcttcatttaggctctcgccagaaaaagattcgcatccaactgcgtagccagtgcgccacatggaaggtgatatgtaagagctgtatttcacagacaccgggcatcaacctggaccttggctccggggtgaaagtcaaaattatcccaaaagaggagcattgtaaaatgcccgaagcaggtgaagaacagccgcaggtctag

SEQ ID NO: 52430 - DNA, 210 bp, Artificial Sequence
  Description of Artificial Sequence: Synthetic coding sequence
atggagagccccaagaagaagaaccagcagctgaaggtgggcatcctgcatctggggtcaaggcagaagaagatccggattcagctgagaagtcaggtgcttggccgagaaatgagagacatggagggtgacctccaggaactccatcagagtaacactggagataaatccggatttggttttcgacgccagggcgaagataatacatag

SEQ ID NO: 52431 - DNA, 336 bp, Artificial Sequence
  Description of Artificial Sequence: Synthetic coding sequence
atgatctggcggggccggagcacctaccggccccggccccggcggagcgtacctccccccgagctgatcggcccaatgttggagcctggggatgaggaaccccagcaagaagagccaccaaccgagtcgagggatccggctccaggccaggaaagggaagaggatcaaggagcggcagagacgcaagtgcccgatcttgaggccgatctccaggagctgagtcagtccaagactggaggggaatgcgggaatgggcctgacgatcaaggaaaaattctgcccaagtctgaacagttcaagatgcctgagggaggcgaccgccagccacaggtctag

SEQ ID NO: 52432 - DNA, 336 bp, Artificial Sequence
  Description of Artificial Sequence: Synthetic coding sequence
atgatctggcggggccggagcacctaccggccccggccccggcggtcagtgcccccccctgaactcattggaccgatgctggagcccggcgacgaagagccacaacaggaagagcctcctactgagagtcgtgaccctgcgcccgggcaggagagggaggaggaccagggtgcagcggagactcaggtgcctgatctggaagccgatctacaggaattatcccagagcaagacagggggtgagtgtgggaacggccccgacgaccaaggaaagatcttgcctaaaagtgaacagttcaagatgcctgagggaggcgatcgtcagccccaagtctag

SEQ ID NO: 52433 - DNA, 327 bp, Artificial Sequence
  Description of Artificial Sequence: Synthetic coding sequence
atgagctggcggggccggcggtaccggccccggcggtgcctgcggctggctcagctggtggggcccatgctagaacccagtgtgcccgaaccccagcaggaggaaccccccacagaatctcaggaccacacccccggtcagaaacgagaggacgatcagggagcagctgaaattcaggtgcccaacctggaggctgatctccaggagctttctcagagtaagaccggtgacgaatgcggggatagtcccgacgtgcagggcaaaattctacccaagtcggagcagtttaaaatgcctgagggtggggaagggaaaccccagctgtag

SEQ ID NO: 52434 - DNA, 246 bp, Artificial Sequence
  Description of Artificial Sequence: Synthetic coding sequence
atggagagccccaagaagaagaaccagcagctgaaggtgggcatcttgcacctcggtagtagacagaaaaaaattagaatccagcttagatctcagtgcgcaacttggaaggtaatttgtaagtcttgcatcagtcaaacccccggtattaatcttgacctggggagcggggtcaaagttaagataattcccaaggaagaacattgcaagatgcccgaggccggtgaagagcaaccacaggtgtag

SEQ ID NO: 52435 - DNA, 441 bp, Artificial Sequence
  Description of Artificial Sequence: Synthetic coding sequence
atgctgctgtggtgccccccccagtgcgcctgcagcctgggcgtgttcccatccgcacccagcccggtatggggcaccaggcgatcctgcgaacccgccacccgagtgcccgaggtgtggatattatctccactgctcaggcatggcgggcacacccagacccagaatcataccgcctccccccggagccctgtgatggagagccccaagaaaaaaaatcagcagctcaaggtggggatcttacatctcggctcaagacagaaaaaaattaggattcaattgagatctcagtgtgctacttggaaggtgatatgtaaatcctgcatctcgcagaccccaggaataaatttggatcttggttctggcgttaaagtgaagattatccctaaggaagagcactgtaagatgcctgaagcgggggaggagcaaccccaggtctag

SEQ ID NO: 52436 - DNA, 210 bp, Artificial Sequence
  Description of Artificial Sequence: Synthetic coding sequence
atggagagccccaagaagaagaaccagcagctgaaggtgggcatcctgcatctcggaagtcggcagaagaaaatcaggatccagctgcgatcccaggtgctgggtcgggagatgcgcgacatggaaggcgacctgcaggaattgcaccagtcaaacacaggggataaatcgggtttcggtttccgtcgccagggagaggataacacttag

SEQ ID NO: 52437 - DNA, 336 bp, Artificial Sequence
  Description of Artificial Sequence: Synthetic coding sequence
atgagctggcggggccggagcacctaccggccccggccccggcggtccttacagccccctgaacttatcggggcaatgctcgagcccaccgatgaggagcctaaggaagagaagcctcccactaaatcacgtaatccaacccctgatcagaagcgagaagacgaccagggagccgcagagattcaggtgccagacctggaggcagaccttcaggaactgtgccaaacaaagaccggcgacggctgcgagggagggactgatgttaaaggcaaaattctccccaaagccgaacacttcaagatgcccgaagccggagaggggaagtcacaggtgtag

SEQ ID NO: 52438 - DNA, 336 bp, Artificial Sequence
  Description of Artificial Sequence: Synthetic coding sequence
atgagctggcggggccggagcacctaccggccccggccccggcggtcactccagccccctgaattgattggtgcgatgctcgaacccacagacgaagaacccaaggaggagaaacccccaactaagagtcggaatcccaccccagatcagaaacgcgaggacgatcagggagcagccgaaatccaggttcccgatcttgaggccgatctccaggaactttgtcagaccaagacaggagacggctgcgaaggcggaacagacgtcaaaggaaagatactccctaaggcagagcacttcaaaatgcccgaagcaggggaggggaaaagccaggtgtag

SEQ ID NO: 52439 - DNA, 327 bp, Artificial Sequence
  Description of Artificial Sequence: Synthetic coding sequence
atgagctggcggggccggcggtaccggccccggcggtgcctgcggctagcccaattggtcgggcccatgttggagccgagtgtacccgagccgcaacaggaggagccaccgactgagagtcaagatcatacaccaggacagaagcgagaggatgaccagggggctgccgaaatccaggtcccgaatcttgaggccgatctgcaagagctgagccagtctaagactggcgacgagtgtggagactcgcctgatgttcaaggaaaaatcctgcctaaatccgaacagttcaagatgccagagggcggtgaaggaaagccacagctgtag

SEQ ID NO: 52440 - DNA, 327 bp, Artificial Sequence
  Description of Artificial Sequence: Synthetic coding sequence
atgagctggcggggccggcggtaccggccccggcggtgcctgcggctcgcccaactcgtgggacccatgctggaaccctcggttcccgaaccccagcaggaagagccacccacggagtcccaggatcataccccgggtcaaaagagggaagatgatcaaggcgccgcagaaattcaggtgcccaacctcgaggccgatctccaggaactttctcagagcaaaacaggagatgagtgtggcgacagcccagatgtgcaaggtaagatactcccaaagtcagaacagttcaaaatgcccgaggggggcgaaggaaagccccaattgtag

SEQ ID NO: 52441 - DNA, 228 bp, Artificial Sequence
  Description of Artificial Sequence: Synthetic coding sequence
atgagctggcggggccggcggtaccggccccggcggtgcctgcggctcgctcagctggtcggccccatgctggagccatctgtccccgaaccgcagcaggaggagccacctaccgaaagtcaggaccacacaccagggcagaaaagagaggacgaccagggggcagcagaaattcagggtacatctatcctggcgcaggacaaaactcagttcagcgaaaccggttag

SEQ ID NO: 52442 - DNA, 327 bp, Artificial Sequence
  Description of Artificial Sequence: Synthetic coding sequence
atgagctggcggggccggcggtaccggccccggcggtgcctgcggctggctcagttggttggcccaatgttggagcccagtgtcccagagccccagcaggaagaaccaccgacggaaagccaggaccataccccaggacagaagcgcgaagacgatcagggagctgcggaaattcaggtgccgaatctcgaggccgaccttcaagagctgtctcaatctaaaaccggtgacgaatgcggggactcacctgatgttcagggtaagatccttcccaagtctgaacaattcaaaatgcctgaagggggcgaggggaaaccccagctctag

SEQ ID NO: 52443 - DNA, 270 bp, Artificial Sequence
  Description of Artificial Sequence: Synthetic coding sequence
atgaagtacaccaagcagaacttcatgatgagcgtgctgggcatcatcatctacgtcaccgatttaatcgttgacatatgggtcagcgtgcgcttttttcacgagggtcagtacgtgttctctgctcttgcactcagtttcatgcttttcggaacgcttgtagcgcagtgcttttcttactcctggtttaaggcggatcttaagaaggcggggcaggaatcccagcactgcttcctgctcctgcactgcctccagggaggagttttttag

SEQ ID NO: 52444 - DNA, 492 bp, Artificial Sequence
  Description of Artificial Sequence: Synthetic coding sequence
atgcggcggctgctgatccccctggccctgtggctgggcgccgtgggggtgggggtggcggagctgacggaagcacagagaagaggactacaggtggctttggaggaattccataagcacccccctgtacagtgggccttccaggaaacgtctgtcgaatcagccgtagatacgccctttcctgccgggatcttcgttcgtcttgaatttaagctacaacagacgtcgtgtagaaaacgcgattggaagaagccggagtgtaaagttaggcccaatggacgcaaaagaaagtgcctcgcgtgcattaagcttggcagcgaggacaaagtgctgggtcgactggtacactgcccaatcgaaacacaggtgttacgggaggccgaagagcaccaggaaacacaatgcctcagggtccagagagccggggaggacccacacagtttctacttcccagggcaatttgctttctccaaggccttgccacgcagctag

SEQ ID NO: 52445 - DNA, 621 bp, Artificial Sequence
  Description of Artificial Sequence: Synthetic coding sequence
atgagctgggtgcaggccgccagcctgatccagggccccggcgacaagggcgacgtgttcgacgaagaggccgatgaaagtctcctggcacagcgagagtggcagtccaatatgcagagaagagtcaaagaggggtaccgcgacggtatcgatgctggaaaggcggtcaccctgcagcaggggtttaaccagggatataaaaaaggggccgaggttatcctgaattacggaagactgagggggacccttcgcaacagcactgactggtccctgttgggattgagagctcctctccggtctccagaggtgggcactcagctgttacccaggccgctccccgtgcccggacacatggcctcaggggccacaccgaagcagcctaccgaactggaagccactttgctgtcactggtgccccaaagtggccgggcgaccccaaggttccccgctcggttgagggcacctggccccgggaccccgagccacagacgtagatttcggcgcaaaccccacagggaccccgctgctgcatgcccagcatggcctcctgaagccccttctaacagcgagactcacttttcgacttacaatcgcatcatcatccgcggaggacatatatag

SEQ ID NO: 52446 - DNA, 972 bp, Artificial Sequence
  Description of Artificial Sequence: Synthetic coding sequence
atgagccggccccggatgcggctggtggtgaccgccgacgacttcggttactgtcccagacgagatgagggtatcgtggaggccttcctggccggcgcggtaactagtgttagtctactcgtcaacggtgccgctacagagtcagcagcggagctggctcggcggcatagtataccaaccggtctgcatgccaacctgagtgagggcaggcctgtgggaccagcacggcgaggagccagttccctcctgggtccagaaggcttcttccttgggaagatggggtttcgcgaagccgtcgccgcaggcgacgtggacctgccgcaggtcagggaagagcttgaggcacaactctcatgcttcagggaactgcttggaagggctcctacccacgccgacggccaccaacacgtgcacgtgctgccaggagtttgccaggtattcgcagaggccctccaggcatacggcgttcgatttacccgccttcctcttgagagaggtgttgggggttgcacgtggctggaggcccctgcacgggcgtttgcatgcgccgtcgaaagggatgctcgcgcagcggtggggccattttcacgtcatggtctgcgatggaccgacgcctttgtcggcctctcgacgtgcgggcggcacatgtcagcccatagagtctctggcgccctggcccgcgtcctggagggaaccctggcaggccataccttaaccgccgaactcatggctcatccagggtatccatcggtgcctcccactggtggttgtggggagggccccgatgcttttagctgctcctgggaaaggctgcacgaactgcgggtgctaactgccccaacattacgggcccagcttgcgcaggacggtgtacagctctgtgctttagatgaccttgattccaaaaggcctggcgaggaggttccctgcgagccaacccttgaacctttcttggaacctagcctcctgtag

SEQ ID NO: 52447 - DNA, 450 bp, Artificial Sequence
  Description of Artificial Sequence: Synthetic coding sequence
atgagccggccccggatgcggctggtggtgaccgccgacgacttcggatattgcccgcgtagggatgagggcattgtcgaagcatttctcgccggcgccgttacctcagtttctctcctagtgaacggagcagctactgagagtgctgccgagctggcccgccgccattccattccaacagggcttcatgcgaacctcagcgaaggtcgcccagtgggacctgctcgaaggggtgcatctagcctgcttggccccgagggtttctttctcggaaagatgggatttagagaggctgtggccgcaggcgatgtggacctgccgcaggtgagagaagagcttgaggctcagctgtcctgtttccgggagctgttagggagggccccgacccatgccgatggacatcagcatgtgcatgtgttgcctggaggtcagaccccaagctgggcatag

SEQ ID NO: 52448 - DNA, 900 bp, Artificial Sequence
  Description of Artificial Sequence: Synthetic coding sequence
atgagcagcgccgccggccccgaccccagcgaggcccccgaggagcgccactttttacgagcgctggagctgcagcccccacttgccgatatgggcagggctgagctctcaagcaacgccacaacatctctggttcagcgcagaaagcaggcctgggggaggcagagttggcttgagcagatctggaacgccggaccggtatgccagtccaccgcagaggccgcagcgctggagcgggagcttctagaagattatcggtttggacgccaacagttggtcgagttgtgcggacatgctagtgctgttgccgtgaccaaggccttcccacttcccgccctgtctcgcaaacagcggaccgtcttggttgtgtgtgggccggaacagaatggcgccgtcggactggtgtgtgccagacatctgcgcgtgttcgagtacgagcccaccattttctatcctacccgttccctcgatttgctgcatcgggatctcactacgcaatgcgagaaaatggatatccctttcctctcctatcttcccacagaggtacagctcattaatgaggcttacggacttgtggtcgatgccgtgttggggccaggggtggagcccggagaggttggaggaccatgtacccgggccctggcaaccctcaagctgctgagcattcctttggtcagcctagatatacccagtggctgggacgcggaaactggctctgactctgaggacgggcttcgcccggacgtgttagtgagcctggctgcccccaagcgctgcgccggccgtttctcgggcagacatcattttgtggcgggcaggtttgtgcctgatgacgtacgcagaaagttcgcattgagactgcctgggtatacaggcaccgactgtgttgccgccctgtag

SEQ ID NO: 52449 - DNA, 750 bp, Artificial Sequence
  Description of Artificial Sequence: Synthetic coding sequence
atgagcagcgccgccggccccgaccccagcgaggcccccgaggagcggcactttttatcaacagctgaagcagcagccctggagcgagagctgctagaggattacaggtttggacggcagcagctggtcgagctgtgcggacacgcatctgccgttgccgtcaccaaggccttcccactgccagctttgagccgaaaacagagaacagtcctggttgtctgcggacccgaacaaaatggtgctgtaggcctggtgtgtgctcgccacctacgagtttttgagtacgagcccacgattttctatcccaccaggtcactggaccttcttcatcgcgacttaacaacacagtgtgaaaagatggatataccttttctgtcatatttgcccaccgaggtgcagctgatcaacgaagcgtacggcttggtggtggatgccgtgctggggccaggggttgaacccggggaggtcggcggcccttgcactagagcccttgctactttaaaactgctgtcaattcctcttgtgagcctggatatcccctctgggtgggacgcggaaaccggctctgattctgaagacggtttaaggccagacgttttagtgtctctggccgcccccaagcgctgcgctggaaggttttctggtcggcatcacttcgtggctggacgtttcgtacctgacgacgtgcgaagaaagttcgcattacgtctccccggctacacaggtaccgactgcgtagctgctctctag

SEQ ID NO: 52450 - DNA, 750 bp, Artificial Sequence
  Description of Artificial Sequence: Synthetic coding sequence
atgagcagcgccgccggccccgaccccagcgaggcccccgaggagcggcatttcctgagtacagcagaagcggctgctctggaaagagaactcctggaagattaccggttcggaagacaacagctggtggagctgtgcggtcatgcgagcgccgtggccgtcactaaggctttcccgttacccgccctgagtagaaaacagcgtacggtgctagtggtatgtggtcccgaacagaatggtgccgtgggcctggtatgtgctcgccatttgcgagtgtttgaatatgagcctacgatattttatccaacccgaagcttggatcttcttcatcgtgacctgactacccaatgcgagaaaatggacattcctttcctgagttacctacccacggaggtccaactcataaatgaggcctatggcctggtagtggatgccgttttgggtccaggagtggagccgggggaagtgggaggcccttgcactcgggcactggcgaccctgaagctcttgtcaatccccctcgtatccttagacatccctagcggatgggatgccgagaccggcagtgacagcgaggatgggctgaggcccgatgtgctcgtatccctggcagctccaaaaagatgcgctggaaggtttagcggcaggcaccactttgtggcgggccgctttgttcccgacgatgtgcgtcgcaaatttgccctgcggctacccgggtacaccgggactgactgtgtcgcggccctgtag

SEQ ID NO: 52451 - DNA, 900 bp, Artificial Sequence
  Description of Artificial Sequence: Synthetic coding sequence
atgagcagcgccgccggccccgaccccagcgaggcccccgaggagaggcactttctcagagccttggagcttcagcctcccctcgccgacatgggacgtgcagagctgtccagcaacgctaccacatccttagtgcaaaggagaaaacaggcatggggaagacagtcctggctggaacagatctggaatgccggccccgtctgtcagtctaccgctgaggcggctgcactcgagcgtgagctgctagaggattatcgttttggccggcagcagctggttgaattgtgtgggcatgccagcgccgtggctgtgactaaagcttttccactgccagcacttagcagaaaacagcgtactgtccttgttgtatgtggaccagaacagaacggcgccgtggggctggtctgtgccaggcatctccgtgtgtttgagtatgagccaaccatattttatcccacacgctctctggatctgctccaccgggacctcacgacccagtgcgagaagatggacatccctttcctctcatatctgccaaccgaggtgcagctgattaatgaggcgtacgggctcgttgtagatgccgtcctgggccccggcgtggagcctggggaagtaggcggaccttgtaccagagctctggcaaccctgaaactgctgagcataccactggtgagcctggatatcccctctggttgggacgcagaaacgggatctgacagcgaggacgggctgcggccagacgttcttgtgtctctagccgctcccaaacgatgcgctgggagattttctggcagacatcactttgtggccggacgttttgtccctgatgatgtgcggcggaaatttgctctgcgtctccccggctatacaggtaccgattgtgtggcagccctctag

SEQ ID NO: 52452 - DNA, 822 bp, Artificial Sequence
  Description of Artificial Sequence: Synthetic coding sequence
atggccgccagcaaggtgaagcaggacatgcccccccccggcggctatggacctatcgattacaagcgaaacttgcctagacgagggttatcaggctactcaatgcttgccatcggcattggcaccctgatctatggacattggagtatcatgaagtggaacagagaaaggcgccgtctgcagatcgaagatttcgaggcccggatcgccctgcttcccctgctgcaagctgaaaccgacagaaggactcttcagatgttgcgcgagaacctggaggaagaggccatcataatgaaggatgtgcccgattggaaggcctttcccctgccggccttgagccgcaaacagagaaccgttcttgtggtgtgcggcccagaacagaatggcgccgtggggctggtgtgcgcacgccacctccgagtgttcgaatatgagcctacaatattctacccaacacggagtctggatctcttacaccgcgacctgacaacccaatgtgaaaagatggatattccatttctatcatatcttcctaccgaagtccagctcataaacgaggcgtatggactcgtcgtggacgctgttctaggacctggtgtggagccaggagaagtcggggggccttgtaccagagcactcgctactcttaagctcctaagcatccctctggtgtccttggatattccaagcggaatgcctgggagaggcgggcacatcggagcttggggtgcctgggtggaggcaccggtgccccagcttcttgtagcgcccgcttgcctaaatctcaacttgccgagcctggacggtcccactctgggctag

SEQ ID NO: 52453 - DNA, 507 bp, Artificial Sequence
  Description of Artificial Sequence: Synthetic coding sequence
atggagttcgtgcccggcggcagcatcagcagcatcatcaaccggtttggacctctccctgagatggtgttttgtaaatatactaagcagatactgcagggcgtagcgtacctgcacgagaactgtgtggtccatagagacatcaaaggcaataacgtgatgctgatgcccaccggcataatcaagcttattgacttcggttgcgctaggcgactcgcctgggccggcctaaatggcactcacagtgacatgctaaagagcatgcacgggacaccgtactggatggctccggaagtaattaatgagtccggttacggaagaaaatctgacatctggtcaatcggctgcacagtgtttgagatggctaccggcaagccacctctcgcaagtatggacaggatggcggccatgttttacatcggggctcacagggggctgatgcccccactccccgatcacttctccgaaaatgcagcagattttgtgaggatgtgcctaacccgctag

SEQ ID NO: 52454 - DNA, 3648 bp, Artificial Sequence
  Description of Artificial Sequence: Synthetic coding sequence
atgagcagcatgcccaagcccgagcggcacgccgagagcctgctggacatctgtcatgacactaattcttcccccactgacttgatgactgtgacaaagaatcaaaacatcatccttcaatccatctcccgaagcgaagaattcgaccaggacggcgactgcagtcacagcacactcgtgaatgaagaggaggaccccagcgggggtcggcaggactggcaacctaggacagaggaattcagcacaagccacatgaaatactctggacggtctatcaaatttttgttgccgccactgtccttactccccacccgttcaggcgtgctgacgatcccacagaatcataaatttcccaaagaaaaggaaagaaacataccatcattgacaagtttcgtcccgaagctgtccgtgagcgtgagacagtctgacgaactgtcgccgtctaacgagccgcccggcgccctcgtcaagtccctgatggacccaactctgaggagttcggacggctttatctggtcacggaatatgtgctccttcccgaaaacaaaccaccacaggcagtgtctagagaaggaagaaaattggaagagcaaggagatagaagaatgtaataaaattgagataactcacttcgaaaaaggccagtccctggtttccttcgaaaacctgaaggagggaaatatccctgccgttcgcgaagaggacatcgactgtcatggatcaaagacaagaaaacccgaagaggagaattctcagtacctatccagcaggaagaatgagtcatccgttgccaagaattacgagcaggatccagaaatcgtgtgtaccatccctagcaaattccaggagacgcagcacagcgaaatcacacctagtcaggacgaggagatgaggaataataaggcagcttcaaagagggtatctctgcacaaaaacgaagctatggagcctaacaacatcctcgaggagtgcactgtcctgaagagcctgtcttctgtcgtgttcgatgaccccatcgacaagttacccgagggttgttcatccatggagaccaatataaagataagcattgccgagcgtgcaaagccagagatgtctaggatggtcccattgattcacatcacctttcctgtagacggcagccccaaggagcccgttatcgctaagccctccctgcagactcgcaagggtacgatccacaacaatcattccgtgaacatcccagtgcaccaggagaacgacaaacacaagatgaattcccaccgctccaaactagacagcaagactaagacttctaagaaaacgcctcagaattttgtgatttcaacagagggtccaattaagccaactatgcacaagacctccattaaaacacagatcttccctgccctgggcctggtggacccacgcccttggcagctccctaggtttcagaagaaaatgccccagattgctaagaagcagtcaacgcaccggacacagaaaccaaagaagcaaagcttcccttgtatttgcaaaaatcctggcactcagaaatcctgcgtgcctctctccgtccagcctacagaaccaaggctcaattatcttgacttaaagtacagcgacatgtttaaggagatcaactcaaccgcaaatggacctggtatttatgaaatgtttggtacaccggtatactgccacgtgcgtgagaccgagcgtgacgaaaatacatattacagagaaatctgctcagccccgtctggcaggcgtattaccaacaagtgtcgtagtagccattctgaaaggaaatcgaacattcgcactagactgagtcagaagaagacccacatgaagtgccccaagacaagttttgggatcaaacaggaacataaggtgttgatctccaaagaaaagtccagtaaagcggtgcattccaacctccatgacattgagaacggagatgggatctctgaacccgattggcagatcaagtcatctgggaatgagttcttgtccagcaaggatgagattcaccccatgaatctggctcaaaccccagaacagtcgatgaaacagaacgaattcccccctgtgtcggacctaagcatagtcgaggaagtctccatggaggagtctactggtgaccgcgatatttcgaacaatcagatccttacaacaagcctacgtgacctgcaagagctagaggaactgcatcaccagattcccttcattccttctgaagacagttgggccgtccccagcgagaagaactcgaacaaatacgttcaacaggagaaacaaaataccgcttcgctttccaaagtgaacgccagccggatcctaacaaacgacttggagtttgactccgtatctgatcattctaaaactctgacaaacttctctttccaagccaagcaagagtcagcctccagccagacttaccagtattgggtgcattacctggatcatgactccctggcaaataagtctatcacttatcagatgttcgggaagacactgtccggtactaatagcatcagtcaggagatcatggactcggtgaacaatgaggaactgaccgacgagctacttggctgtcttgctgccgaacttctggcgctggacgagaaagataacaacagttgtcagaaaatggctaatgagaccgaccctgagaatctgaatctcgttctgagatggaggggatcaacccccaaagagatggggcgcgaaactacaaaagtcaaaattcaacgccactctagcgggctccgcatctacgaccgagaggagaagtttctgatctctaatgaaaagaaaattttcagcgagaacagcctgaagtctgaagagccaatcctctggacaaagggtgagatcttgggtaagggtgcttacgggactgtgtattgcggcctgacttctcagggccagcttattgcagtgaagcaagtagcactcgacacaagtaacaagttggctgccgagaaggagtataggaaactccaggaggaagttgacctccttaaggcgctaaaacacgtgaatatcgtggcatacttgggcacttgtttgcaggagaacaccgtgagcattttcatggagtttgtacctggcggttctatctcctccattatcaatagattcggcccgttacccgagatggtcttttgtaagtatactaagcagattctacagggtgtggcataccttcacgagaattgtgtggtccaccgggatattaaggggaataatgtaatgttgatgcccacgggcatcatcaaacttatcgactttggatgtgcccgtaggctggcatgggctggactgaatggcacgcactcagacatgcttaagtctatgcacggaacaccatattggatggccccagaggtgattaatgagtccggatacggacgcaagagcgatatttggtccatcggatgtacagtgtttgagatggcaaccggcaaacctcctttagctagtatggatagaatggccgccatgttttatattggagctcaccgcggtctcatgccccccctgcccgaccactttagtgaaaacgccgccgattttgtccggatgtgtctaacacgggatcaacacgaacgaccatcggcgctccagttattgaaacactctttcctcgagaggagccactag

SEQ ID NO: 52455 - DNA, 1533 bp, Artificial Sequence
  Description of Artificial Sequence: Synthetic coding sequence
atgagcagcatgcccaagcccgagcggcacgccgagagcctgctggatatttgtcatgatactaactcttctcctacagatctaatgaccgtcacaaagaatcagaacattattctccagtctatcagccggtccgaagaattcgatcaagatggtgactgctctcactcaacactggtcaatgaagaggaagatccttcaggcgggagacaggactggcagcccagaacagagggcgtggaaattacagttactttcccacgggatgtttccccacctcaggagatgtcacaagaagacctgaaggagaaaaacctcataaatagcagtcttcaggaatgggcgcaggctcacgctgtgtcccatccaaacgagatcgaaactgtggaactacggaaaaaaaagctgacaatgcgacctctcgtgctgcaaaaagaagaaagtagtcgtgagctttgtaacgtaaatctgggattcctgttaccacgatcctgtctcgagctgaatatctccaaatccgttactcgagaggacgctccacattttctgaaagaacagcagaggaaatcagaggagttttcaacatctcacatgaagtactccgggcgatccatcaagagacactcatcagggctacggatatacgatagagaagagaagttcctcatatctaatgagaagaagatctttagcgagaactccctgaagtccgaagaaccaatcctctggactaagggagaaatcctgggaaagggggcctatggcacagtgtactgtggcctgacctcacagggtcagctcatcgctgttaagcaggtggcactggacaccagtaataaattggctgccgaaaaagagtacaggaaactgcaggaagaagtggatttactgaaggcactgaagcacgtcaacatcgtggcatacctgggcacctgcctgcaggagaatacggtgtctatttttatggagtttgtgcctggagggagcatcagcagcataataaacaggtttggcccactgccagagatggttttttgcaaatacaccaaacagatccttcagggggtggcctatctgcacgaaaactgcgtggtacatagagatataaaaggcaataacgtgatgctcatgcccaccgggatcatcaaactcatcgatttcggatgcgcccgccgcttagcctgggccggattgaacggcacacatagtgatatgctcaaaagcatgcatggcacgccctactggatggcaccggaggtaattaacgaatctggttacgggcgaaagtccgacatctggtctattggctgcacagtcttcgagatggctactggaaagccacccctcgcctccatggaccgcatggccgccatgttttatatcggtgctcataggggcctgatgccaccgctgcctgatcatttctcagaaaacgccgctgatttcgttaggatgtgcttaactagggaccagcatgagagacctagcgccctacagctgctgaaacacagctttttggagcggtcacattag

SEQ ID NO: 52456 - DNA, 3987 bp, Artificial Sequence
  Description of Artificial Sequence: Synthetic coding sequence
atgagcagcatgcccaagcccgagcggcacgccgagagcctgctggacatctgccacgacactaactcatctccaactgatctcatgaccgtgactaagaatcagaacatcattcttcagtctatcagccgcagtgaggagttcgaccaggatggcgattgttcccacagcacactggtgaacgaagaggaagaccctagcggggggagacaagactggcagccacgaaccgagggggtcgagataacagtgacttttccgcgggatgtgagcccgcctcaggagatgtcgcaggaggatctcaaggagaagaacctgatcaacagctctttgcaggagtgggcccaagcacacgccgtgtcgcatcctaatgaaatcgaaaccgtggagttacgcaagaagaagctgacaatgagacctctcgtgctccaaaaggaggaaagcagcagggaactctgcaacgtcaatcttgggttcctcttgccccgctcttgtcttgaattaaatatcagtaagtcagtgaccagggaggatgcccctcatttcttaaaagagcagcagaggaagtccgaggaatttagtacctctcatatgaaatatagcggccgcagcataaagttcctccttcctccattgagtctattgccaacacgttcaggtgtgctgacaattccgcagaatcacaagttccccaaggaaaaggaacggaacatcccatcactcacgagtttcgtcccgaagctctccgtgagcgtcaggcagtcagatgagcttagtccaagtaatgagccccctggagcgctagtgaaaagcctgatggaccctacccttcggtctagtgatggatttatctggtccaggaatatgtgttcctttcctaagaccaatcatcatcggcagtgtttggaaaaggaagagaattggaaaagcaaggagattgaagaatgcaataagattgaaatcacgcactttgagaaggggcagtctcttgtgagctttgaaaacttgaaggaagggaacattcccgctgttagagaggaagatatagattgccatggttcaaaaacaaggaaacctgaagaggagaacagtcagtacctgagctcacggaagaatgagtcatctgtcgcaaaaaattacgagcaagatcccgaaatcgtgtgcacaatcccctctaagtttcaagaaactcagcactcggagattacaccatcccaggacgaggagatgcgtaataataaggcagctagcaaacgcgtctccctgcacaagaatgaggcgatggagccaaacaacatcctggaggaatgcaccgtgctcaaatcccttagctcagtggtctttgacgatcccatcgacaaattgccagagggttgcagctccatggagacaaacataaagatcagcatagccgagcgtgctaagccagaaatgtcgaggatggtccctctgatccacataacgttccccgtcgatggaagccctaaagaacctgtcattgctaaaccgagcctgcagactaggaaaggaactattcataataatcacagcgtgaatatccccgtgcaccaagagaatgataagcacaagatgaactcacatagatcaaagctcgactcaaagaccaaaacttccaagaaaacccctcaaaacttcgtgatctcgactgagggacctataaagccgactatgcacaagacaagtatcaaaactcagattttccctgcactgggcctggtggacccccgcccatggcaactcccaaggtttcagaaaaagatgccccagatcgctaagaagcagagcacccacagaacccagaagcccaaaaagcagtcattcccttgcatttgcaaaaacccaggcacgcaaaagagctgtgttccgttgtctgtacagcccactgaacctcgcttgaactacctggacctgaaatactctgatatgttcaaggaaattaattctacagcaaatggtccaggcatctatgagatgttcggcacccctgtgtattgccacgtccgcgaaacagaacgggacgaaaatacatactaccgagagatttgtagcgccccttcagggaggagaattacgaataagtgtcgcagttctcactccgagcgcaagtctaacatccgcactcgtctgagtcagaagaaaactcacatgaaatgtcccaagacgagcttcggtatcaagcaagaacacaaggtgcttatctccaaggaaaaatcaagcaaagctgtgcacagtaatctgcacgacatcgaaaatggggacgggatatcggagcctgattggcagattaaaagctccggaaatgagttcctctccagcaaagacgaaatacatcctatgaatttagcccagaccccagaacagagcatgaagcagaacgagtttccccccgtttcagatctgtccattgttgaggaagtctccatggaggagagcaccggtgatcgggatatttcaaataaccaaatattgacgacgtcactgagggatttacaggaactggaagagctgcatcaccagattcctttcattccgtccgaagacagctgggccgtaccaagcgagaagaacagcaataagtacgtacagcaggaaaaacaaaacacggcatccttgtccaaggtaaatgcctctcgcattctgactaacgaccttgagtttgactcagtgtcagatcactccaaaactctcaccaattttagcttccaggccaaacaagaatccgcctccagtcaaacttatcagtattgggtgcattatctggaccatgattctctcgccaacaagagcattacctatcagatgttcgggaaaaccctgtcaggaaccaatagcatctcgcaggagatcatggactctgtaaacaacgaagagttgaccgatgagctcctaggctgcctggcggctgagttgctggcactggacgagaaggataataactcctgccagaaaatggcgaatgagaccgaccctgagaatctgaacctcgttttgagatggagggggtctacccccaaggaaatgggtcgtgaaaccactaaggtgaaaatacaaaggcattctagcggtttgcggatctacgatcgcgaagagaagtttctcatctccaacgagaagaagatcttttctgaaaactcgctcaaaagtgaggaaccgatcctgtggactaagggcgaaatcctcgggaaaggcgcatacggcacagtgtattgcgggctgacctcacaagggcaactaatcgccgtgaaacaggtcgcccttgatacgagcaacaagctggccgccgagaaagaatatcgcaagctgcaggaagaggtagacctgctgaaagctctcaaacacgtgaatatagtggcctatctggggacgtgtctgcaggagaatacagtatctatattcatggagtttgttcccggcggctcaatttcctctataattaaccgcttcgggccactgcctgagatggtgttctgcaagtatacaaagcagatcctgcagggcgtggcttaccttcacgagaactgtgtggtccaccgagacattaaggggaataacgtcatgctgatgccgacaggaattattaaactgattgattttggatgtgcccggcggctcgcgtgggcagggttaaacggcactcactccgatatgctgaagagcatgcatggcactccctattggatggcacctgaagttatcaacgaaagcgggtacggcaggaagtctgacatctggtctattggttgcaccgtcttcgagatggccacaggtaaaccacccttagcttctatggaccgaatggctgccatgttctatataggagcccatcggggcttaatgccgcctctccctgaccatttctccgagaacgccgctgatttcgtgaggatgtgtcttacgcgggatcagcacgagaggcccagcgcactgcagctgctcaagcacagctttctcgagcgatcccactag

SEQ ID NO: 52457 - DNA, 1383 bp, Artificial Sequence
  Description of Artificial Sequence: Synthetic coding sequence
atgagcagcatgcccaagcccgagcggcacgccgagagcctgctggacatatgccacgatactaacagtagccccacagatctgatgaccgtgacaaaaaaccagaacattatcctgcagtcaatttcacgaagtgaggaattcgaccaggatggtgactgtagccacagtacactggttaacgaagaggaggatccatctggaggacgtcaagattggcagcctagaaccgagggcgtggagatcacggttaccttccctcgggatgtgagccctccccaagagatgtctcaggaggacctaaaagagaaaaacctgataaattcctcattgcaagaatgggcccaagcacatgccgtgtcccatcctaacgaaatcgagaccgtggagctccgcaaaaaaaagttgaccatgaggcctttggtgttgcagaaggaggagagctcgcgcgagttgtgtaacgtgaatcttggattcctgctgcctcgtagctgcctggaactgaacatctctaagtccgtgacgcgcgaagacgccccacatttcctcaaggagcaacagagaaaaagtgaagaatttagcaccagtcacatgaagtactctggccgttctatcaaggtgtattgtggcctaacaagccaggggcagctaattgctgtgaagcaagttgccctggatacatcaaataaactggcagccgaaaaggagtaccgcaaactgcaggaagaagtagacctgttgaaagcactgaagcatgtcaatattgtcgcttatctgggcacgtgcctacaggaaaacacagtcagcatcttcatggaatttgtgcctgggggctctatttcttcaattattaaccgatttgggccactgcccgagatggtcttttgcaagtacacgaaacagatactgcagggagtggcttacttgcacgagaactgcgtcgttcatcgcgatattaagggcaataatgtgatgcttatgcccacaggaattatcaagctaatcgatttcggctgtgcccgccgcttggcctgggcaggcctgaacggtacccacagcgatatgctgaaaagcatgcacggtacgccgtactggatggcgcccgaggtgatcaacgaatctggctacggccgtaaaagtgatatctggtctatcggctgcactgttttcgaaatggccactgggaaacctccacttgcaagcatggatcgcatggctgccatgttctatattggcgcgcaccgcggcttgatgcctccgcttccggaccactttagtgagaacgccgccgacttcgtgagaatgtgtctcactcgcgatcagcacgaaagaccatcagccctgcagctgttaaaacatagctttctggagaggagtcactag

SEQ ID NO: 52458 - DNA, 1389 bp, Artificial Sequence
  Description of Artificial Sequence: Synthetic coding sequence
atgagcagcatgcccaagcccgagcggcacgccgagagcctgctggatatctgccacgacactaatagctccccaacggatctgatgacagtcactaaaaaccaaaacatcatcttgcagagcatcagtcgtagtgaggaattcgatcaggacggtgattgctcacactctacactggttaacgaagaggaggatccatccggcggccgccaggattggcagcctagaaccgagggagtggagattacagttacctttccacgcgacgtgagcccacctcaagagatgtcccaagaagatctcaaagagaaaaatctcatcaacagttcactacaggagtgggcccaggcccatgcggtgtcccacccgaacgaaatcgaaactgttgagctcaggaagaaaaaactaactatgcgccccctagtgctgcagaaggaggagagtagcagggaattatgcaatgtgaacctagggtttttgctgcctaggagctgtctggaactgaacatttctaaatctgtcacccgcgaagacgctcctcattttctaaaggagcagcaacgaaagtctgaggagttttcaacgtcacacatgaaatactctggccggagcattaagcgtcatagcagcggtctgaggatctacgatagggaggaaaaatttctcatttcaaacgagaaaaagattttcagcgaaaactcattgaaaagcgaagaaccaatcttatggacgaaggtggatctactgaaagccctgaagcatgtcaatattgtcgcttatctcggtacgtgtttacaggagaacaccgtctctatttttatggagttcgtgcccggcggatccatatccagcattatcaatcggtttggccctctgcccgagatggtcttttgtaagtacacaaagcaaatactgcaaggcgtagcctacttacatgaaaactgtgttgtgcatcgggacataaagggtaacaatgttatgttgatgccgacgggtattatcaaactcattgactttgggtgcgcacggcggttggcatgggccggtctgaacggtacacactctgacatgctcaagtcaatgcacgggacgccatactggatggcccctgaggttattaatgaaagtggctacggcaggaagtcagacatctggtccatagggtgcacagtattcgaaatggcaactgggaaaccaccactcgccagtatggaccgcatggcagccatgttctacattggcgctcatcgaggcttgatgccccccctgcccgatcacttctccgaaaatgctgccgacttcgtgagaatgtgtctgactagggaccagcatgaaaggccctctgcccttcagttgctaaaacacagtttccttgaacgatctcattag

SEQ ID NO: 52459 - DNA, 2094 bp, Artificial Sequence
  Description of Artificial Sequence: Synthetic coding sequence
aagcagagcttcccctgcatctgcaagaaccccggcacccagaagtcttgcgtgcctctgtcagtacagccaactgagcccagactgaactatctcgacctgaaatattccgacatgttcaaggagataaatagcaccgcaaatggccccggcatctacgagatgttcggtacacccgtgtattgtcatgttagagaaactgagcgcgatgaaaacacatactatcgcgaaatttgcagcgccccctctggaagaaggatcactaataagtgccggtcttctcacagcgagcgaaagtctaatatccgcacccgattgagtcagaaaaagacgcacatgaaatgtccaaaaacatcgttcggaatcaaacaagagcataaggtgctcatttcaaaggaaaagtcttctaaagccgtccacagtaatttgcatgacatcgaaaatggggacggcatttccgaaccagactggcagattaagagttcaggcaacgaatttctgagcagtaaagacgagattcacccaatgaacctcgcacagacaccagagcagtctatgaagcagaacgaatttccccctgttagcgacctctccatcgtggaggaggtgtccatggaggaaagcaccggcgatcgagacatcagcaacaatcagatcctgaccacaagcctgcgtgacctgcaggaactcgaggaactgcaccatcagattccattcatcccctctgaagattcctgggctgtgccaagtgagaaaaactcaaataaatacgtgcagcaagagaagcagaacaccgcctctttgtctaaagttaacgcaagccgaatactcactaacgatcttgagttcgactctgtttctgatcacagcaagactctaactaactttagtttccaggccaagcaggagtcagcctcttcacagacctaccagtattgggtgcactatctggaccatgactctcttgctaataaaagcatcacttatcagatgtttggcaagaccctttcaggcactaacagcatttcccaggagattatggatagcgtgaacaatgaagaactcactgacgaactgttgggttgtctcgccgcagagctactcgctctggatgagaaggataataactcctgccagaaaatggctaatgagacagaccccgagaacctgaacctggtgctccggtggagaggaagtacgcctaaggaaatgggtcgtgaaacaacaaaggtgaagattcagcgccactctagcggactgaggatctatgatcgagaggaaaaattcctcatctctaacgagaagaagatcttctccgaaaactccctgaagagcgaagagccgatcctatggaccaaaggcgagatactggggaagggcgcatatggaacagtgtactgcggactgacaagtcagggccaactcatcgctgtgaagcaagtcgctttggatacatctaacaaacttgctgcggaaaaggagtatcgcaaactccaggaagaggttgatctgctcaaggcactgaaacatgtcaacatcgtcgcctatctgggaacttgcctccaagagaatactgtttccatattcatggaattcgtgccggggggttctatctcaagtatcataaataggttcggaccactgcccgagatggtcttctgcaagtataccaaacagattctacagggcgtggcttatctccatgagaattgcgttgtgcaccgagacatcaaagggaataatgtaatgctgatgccgaccgggatcataaaactgatcgattttggatgcgccagacgcctggcttgggctgggttgaatggcacacacagtgatatgttgaaatctatgcatggaactccatactggatggccccagaggtgattaacgagagcggttacggaaggaaaagcgatatttggtcaattgggtgtactgtatttgagatggctacaggaaaaccccctctcgcaagcatggaccgcatggcagcaatgttttacatcggggcccatagaggactgatgcctcctctgcctgatcatttcagtgaaaacgccgccgacttcgtccgtatgtgtttgacaagatag

SEQ ID NO: 52460 - DNA, 4293 bp, Artificial Sequence
  Description of Artificial Sequence: Synthetic coding sequence
atgagccggcccagcagcgtgagcccccggcagcccgcccccggcggggggggtgggggaggcccaagcccctgcggtcccggaggaggtggtcgggccaaggggttgaaagatattagaattgacgaagaagtcaagatcgccgtcaatattgctcttgaaaggttccgctatggggatcagcgggagatggaatttccatcaagcctaacatcaaccgaacgggcttttatccatagacttagtcagtccctgggcctggtatcaaagagcaaaggcaagggcgctaataggtaccttactgtgaagaaaaaggatggatccgaaaccgcccatgcaatgatgacatgtaatctcacacacaacaccaaacacgcagtgaggtctctgattcaacgctttccagtcactaacaaggaaaggactgagctgctccctaaaaccgagcgcggtaacgttttcgcagtggaggccgagaaccgggagatgagcaaaacaagtggccgcttgaacaacggcattccacagattccagtcaagcgcggcgaatctgagtttgactcatttcgtcagagcttacccgtttttgagaagcaggaggagattgtgaagatcatcaaggagaataaagtggtcctgatagtgggggaaaccgggagcggaaagacaactcaaattccacagtttctgctggatgattgtttcaagaatgggatcccctgtcgtattttctgcacccagccaaggagactcgccgccatcgcagtcgctgaacgagtagctgctgagcgccgggagaggatcggtcagacaattgggtatcagatcagactggagagccgggtctccccaaagaccttactgactttctgtaccaatggtgtccttctcaggaccttgatggctggtgactctaccttgtccacagtaacacacgtcattgtggacgaagtgcacgaacgggatcgatttagcgactttttgcttacaaaacttcgcgatctgcttcagaagcacccaacactgaagcttattctctcctccgctgccctcgatgtgaatctctttattaggtacttcgggtcatgtcctgtaatatacatccaggggagaccttttgaggttaaggaaatgttccttgaagatattctgcgaacaaccggatatactaataaggaaatgcttaaatacaagaaagaaaagcagcaagaggaaaagcagcagaccactctcactgagtggtacagtgcacaggaaaattcctttaagcctgagagtcagagacagagaacagtgctcaacgtaacggatgaatacgaccttttagatgacggaggcgacgccgtcttttcccagctcacggagaaggacgtgaactgtctggagccttggttgatcaaggagatggacgcctgtctaagtgacatatggctgcataaagacattgacgctttcgctcaagtgtttcatctgatcctgacggaaaacgtgtctgtggactaccggcatagcgaaaccagtgctacggccctaatggtcgcagccgggcggggattcgcttcgcaagttgaacagctaatttccatgggggctaatgtacacagcaaggccagcaatgggtggatggcactggattgggcaaagcactttggtcagaccgaaatcgtggacttactcgaatcttatagcgctaccctagagtttgggaacctagacgagtcctcactggttcagacaaatgggagcgacctctctgcagaggacagagaactgctcaaagcctaccatcactccttcgacgacgaaaaggtggatctagatctaatcatgcaccttctgtataatatttgccattcctgtgatgccggagctgtgttgatttttctccctggctacgatgaaattgtcggtctacgggaccgcatactgtttgacgacaaacgatttgccgattctacacatcgctaccaggtttttatgttgcattctaatatgcagacgtccgatcagaagaaggtgctcaaaaatcccccagctggcgttcgaaagatcattctctctaccaatatcgccgaaacctccattactgtgaatgacgtggtgtttgttatcgatagtggaaaagtgaaggagaagtccttcgacgcactgaattttgtcactatgctgaaaatggtctggatcagtaaggcctccgcaattcagcgtaaggggcgggcagggcgctgtcgcccaggaatttgttttcggctcttctccagattacgcttccagaatatgttggagttccaaacacctgaactattgcgcatgcccctgcaagaattgtgtctgcatacaaagctgctggctcctgtcaattgccctattgccgacttcttaatgaaagcccctgaaccgccccctgcactgatcgtcaggaacgccgttcagatgctgaagacaattgatgccatggacacctgggaagatctgacagaactcgggtaccacctcgcagatctgccagtggaaccacacttaggaaagatggtcctgtgtgcggtagttttgaagtgtttggacccgatcctgactatcgcttgtaccctagcatatcgagatcccttcgtgttgccaacgcaggcctcacaaaagagagctgctatgttgtgccgcaagaggttcactgcgggagctttctccgatcacatggccctgttacgggcatttcaagcctggcaaaaagcccggagcgatggatgggagagagccttctgtgagaaaaactttctgagtcaggcaacaatggaaataataattggcatgaggacacaactactcggccagctgcgagcatccggattcgtccgcgcccgcgggggtggagacatccgggacgtcaatacaaatagtgagaattgggccgtcgtcaaagctgccttggtcgccggcatgtaccctaacctggttcatgtggaccgagaaaatctagtccttactggccctaaggaaaagaaggtaaggttccatccagcatctgtgctgagccagccccagtataaaaaaatcccccccgcgaatggccaggccgctgccatcaaagctcttccaaccgactggctgatatacgacgaaatgacccgggcacataggattgctaatatcaggtgttgtagcgcggtcacccccgtcacaatcctggttttctgtggacccgctaggctcgcaagcaatgcgctccaagagcccagcagttttagggttgatggaatacccaatgacagttcggacagcgagatggaggacaagacaactgctaaccttgctgcgctcaaactggacgagtggctccactttactctggaacctgaggcagctagcctgctcctccagcttcgtcaaaagtggcattcattgttcctgcgccgaatgagagccccctctaagccctggtcccaggtggatgaggccacaatccgagcaataatcgctgtattatctactgaagagcagagcgcaggactgcaacagccctccggcattgggcagcgcccaagaccaatgtctagcgaagagctgccgctagcaagttcttggaggagcaacaacagcagaaagagcagcgccgacacagaattctcagatgagtgcactaccgccgagagagtcttgatgaagtctcctagtcccgccctgcatcccccgcagaaatacaaagatagaggcatactacaccctaaaaggggaacagaggataggagcgaccagagctccctaaaatctacagacagtagtagctacccatctccctgcgcaagccccagccccccgtcatccggtaagggatcgaaaagcccgagcccccggccaaacatgcctgtgagatacttcattatgaagtcctccaatcttcgcaacctggagatatcccaacagaaaggtatctggtccaccacaccgagcaatgaaaggaagctgaaccgcgccttctgggagtccagtatagtgtatcttgtctttagtgtgcagggttccgggcactttcagggcttctcacgtatgtctagtgagatcggccgcgaaaaaagccaggattggggctccgcaggattaggcggcgtgtttaaagtcgagtggatccgtaaagagtctctgccttttcagtttgctcaccacctcctaaatccgtggaacgacaacaagaaagtgcagatctctcgtgacgggcaggaactggagcccttggtcggagagcaactacttcagttatgggagcgcctgccactgggagagaagaacactaccgattag

SEQ ID NO: 52461 - DNA, 4023 bp, Artificial Sequence
  Description of Artificial Sequence: Synthetic coding sequence
atgctgcggaagggcgccaaccggtacctgaccgtgaagaagaaggacggctccgagaccgcccacgccatgatgacatgcaacctcacccataacacaaaacatgcggtacggtctctcattcagcgtttccccgttaccaacaaggagcgtactgaactgctcccaaagaccgagagagggaatgtgttcgcagtggaggccgagaacagagagatgagcaaaacgagcggcagactcaacaacggaattccacagatccctgtgaaacggggggagagcgagttcgatagctttcggcaatccctacctgtatttgagaaacaagaggaaatcgtgaagatcatcaaggagaacaaagtagtgctgatcgtaggagagacagggagtggaaaaacaacacagatcccccaattcttgcttgatgactgcttcaagaacggtatcccatgccgcattttctgcacccagccgagaaggctagcagccattgctgtggccgaaagagtggctgccgagcgccgggaacgaattggccagactataggataccaaatccgtttggaatcccgggtttccccgaagacgctgctcactttttgcacaaatggtgtgttattacggacattgatggcgggtgacagcacactgtccacagttacacatgtaattgtcgatgaggtacacgaaagggaccggttcagcgactttctgctcaccaagttgagggacctactccaaaagcatcctacacttaaactgatcctgagctcagcagctctggacgtcaacttgttcatcaggtactttggaagctgccccgtcatatatatccagggcagacctttcgaagttaaagagatgtttttggaggacattctacgtacgaccggctataccaacaaggagatgctaaaatacaaaaaggaaaaacaacaggaagagaagcagcagaccactctgacagagtggtacagtgcccaggaaaacagcttcaaaccggagtcacaacgccagcgaaccgtcctcaacgtgaccgacgaatacgaccttttggacgacgggggggacgccgtatttagccagctaacggaaaaggatgtgaactgtcttgaaccttggctgatcaaagagatggatgcttgtctgtcagacatctggctgcacaaagatattgacgccttcgcccaagtgttccaccttattcttacagaaaacgtgagtgtagattatcgtcactcagagaccagcgctactgcactcatggtcgcagccggcaggggatttgcaagtcaagtagagcagctgatctccatgggtgccaacgtgcacagcaaagcctccaacggatggatggctctcgactgggctaagcattttggtcagaccgagattgtggatctcctggagagctactccgccacactcgagttcgggaacttagacgaaagctccctggtccagacaaatgggtctgacctgagcgccgaggatagagagctcttaaaggcctaccaccactctttcgatgatgaaaaggttgatttggacctgatcatgcaccttctctataatatttgccattcctgcgacgccggagcggtgctgatttttctgcccggctacgatgagattgtcggtctaagggaccgaattttatttgatgataagagatttgcggattccacgcatagataccaggtattcatgctccattccaacatgcagacgagtgaccagaaaaaggtgctgaagaatccaccggccggggtcagaaagatcatcctatccaccaatattgccgaaacaagcatcacagtaaacgacgtcgtttttgtgatagatagcgggaaggtgaaggagaagtctttcgatgctctcaattttgtgacaatgcttaaaatggtgtggatttctaaagcatcagccatccagaggaagggccgagctggccgttgtcgccctgggatttgctttcgcctcttttccaggctacggtttcaaaacatgttggaattccagacacctgagttgctccgcatgcctctgcaggagctctgtttgcacaccaaactcctcgcaccggtgaactgcccaatagcagatttcctcatgaaggcccccgagccacctcccgccttgattgtaaggaacgcagtgcagatgcttaagactattgacgccatggacacctgggaggacctgacagagctaggataccatttggctgatcttcccgttgaaccccatctcggcaagatggtgctatgtgccgtcgttctgaagtgcttggatcccatcctcaccatcgcttgtaccctggcttatcgggatccttttgtactccccacgcaagcatcacagaagcgcgcagccatgttatgtcgtaagcggtttactgctggtgccttttccgatcatatggcgttgttacgtgcctttcaagcttggcagaaagcgcggtcagacgggtgggagcgcgcattctgcgaaaagaacttcctgagtcaggccactatggaaatcattatcgggatgcggactcaactgttgggacaacttcgagcttctgggttcgtccgggcacgcggcggaggggacattcgcgacgtgaatacgaatagtgagaattgggcagtggttaaggctgcactggtggcagggatgtaccctaatctggtccatgttgaccgggagaatcttgttctcaccggcccaaaggagaaaaaagttcgatttcatccagctagtgtcctctcacagccccagtataagaaaatcccgcccgcgaacggacaggccgcagcgatcaaggccctgcccacagactggctcatctacgatgaaatgaccagagcacaccgtattgccaacatccggtgctgtagtgcggtcacacccgtgacaatcttagtgttctgcggaccagcccggctggcaagcaacgccctacaagagcctagttcatttagagtggatggcatccccaacgactcgtctgatagtgagatggaagataagacaacggctaatctcgcggccctcaagctggacgagtggcttcacttcaccttggaacccgaggccgccagtttgttgttgcaactaaggcaaaaatggcactcgttatttctgcgccgcatgcgggcacccagtaagccttggtcacaggttgatgaagcaacaatacgagctatcatagctgtcctgagcaccgaggaacagtctgcagggcttcagcagcccagtggtatcgggcaacgtccacgcccaatgtcgtccgaggagctgccactcgcctccagctggcgttctaataacagtaggaagagttccgcggatacagaatttagcgatgaatgtacaactgcagagagagttcttatgaaaagtccatctcctgccctgcaccctccacagaaatacaaggatcgcggcatactgcaccctaagcgcgggacagaagaccgatcagaccaatcatctctgaaatctacagattctagcagttatccttcgccctgtgcctcgccgagccccccgagtagcggcaagggttctaaatccccatccccgaggcccaacatgccagtaagatacttcattatgaagtcaagcaatctgagaaatctggagatctcccagcagaagggaatctggtctactacgccttccaacgaaaggaagctgaatcgggctttctgggaaagctctatcgtctatctggttttctcggtacagggatcaggccacttccagggattttcacgtatgtcgtcggaaattgggcgcgagaagagccaggactggggatctgctgggctgggcggggtgttcaaggtggagtggataaggaaagaatccctccccttccaattcgcccatcacctgcttaacccctggaacgacaataaaaaagtgcagatttctcgggacggccaggaactcgagcctctcgtgggtgagcagttactgcagctctgggaaaggttgccccttggagagaaaaatacaaccgattag

SEQ ID NO: 52462 - DNA, 597 bp, Artificial Sequence
  Description of Artificial Sequence: Synthetic coding sequence
atgctgttcctgggcagcctgggcgcctggggcaccaccagcatcagcacaggatccatcttttccctgaagacactccggagtcagcacggaggacaggtgggtcttaaagttagccggcccagagccccccgcatgggagccgccacacctacccccagggcaccctgggtggctcgctggctgatgggcagtcaggcattcactgccactccctcggccaggccccctcctcccccaatcaaacacaacatggacattgggacatgggacaataaaggccctgttcctaaggcccctgtccctcagcaggccccatctccacaagcggcccctcagccacagcaggtggcccagccactcccagcccagcccccagccttagcccagccgcagtaccagagtccccagcagccacctcagacccgctgggtcgcaccccgaaatcgcaacgcagcttttgggcagtccggcggggctggtagtgactcaaactccccagggaacgttcaaccgaattcagctcccagtgtggagagtcacccagtcctagagaagcttaaagcagcacattcatacaaccccaaagagttctag

SEQ ID NO: 52463 - DNA, 1530 bp, Artificial Sequence
  Description of Artificial Sequence: Synthetic coding sequence
atgagcgacccctacctgagcagctactacccccccagcatcggctttccatacagtctaaacgaagccccttggtcaacagctggtgatccaccaattccttatctgactacttatggccagctttcaaacggtgatcatcactttatgcatgacgcagtgttcggacagcctggcgggctgggaaataacatctaccagcaccgtttcaattttttcccggagaaccccgcattctccgcatggggcacttccgggagtcagggccagcagacgcaatcgagcgcttatggaagttcatacacctacccgccctctagcctgggtggcacagttgtggacggacaaccagggttccatagcgatactctctcaaaagcgccaggcatgaatagcctggaacagggcatggtgggtctgaagataggagatgtcagctcatccgcagtcaagaccgtgggatcggtggtgtcgtccgtggccctcacaggtgtactctctggcaacggtggtacaaacgttaatatgccggtgagcaaacccacctcttgggcagcaattgcgagcaaacctgctaagccgcagccaaagatgaagactaaaagcgggccagttatggggggtggcttgccaccaccgccgattaaacataatatggatataggaacatgggacaacaaaggcccagtgcccaaggcaccagtgcctcagcaagcgcccagcccgcaggccgctcctcagccacaacaagtggcgcagcctttacctgcccagcctccagccctggcccagccccagtaccagtcacctcagcagcccccccagaccaggtgggtggctcctcgaaataggaacgccgcctttgggcagagtggcggggccggctctgacagtaatagccccggcaacgtccagcccaacagcgctccgtcagtcgagtcccatcccgtgcttgagaaactaaaagcagctcactcttacaatccgaaagagtttgaatggaacttgaaatccggcagggtgttcattattaagtcttacagtgaagacgacatacacaggagtatcaagtactcaatctggtgctccaccgaacacggtaataagcggctcgactcagccttcagatgtatgagcagtaaagggcccgtgtacctgcttttcagtgtcaatgggtccggtcacttctgtggagtggctgaaatgaaaagcccagtagactatggaaccagtgcgggggtatggtcccaggacaaatggaagggaaagttcgatgtgcagtggatctttgtgaaggatgtgcctaacaaccagttaaggcacatacgcctggaaaataacgataataagccagtgacaaactctagggacacccaagaggtccccctggagaaggcgaagcaagtgttgaagattatctccagctacaagcacaccacgtccatctttgacgactttgcccactacgagaaaaggcaagaggaggaggaggtagtacggaaggaaaggcagtctcgaaacaaacagtag

SEQ ID NO: 52464 - DNA, 1680 bp, Artificial Sequence
  Description of Artificial Sequence: Synthetic coding sequence
atgagcgccaccagcgtggacacccagcggaccaagggccaggacaataaggtccaaaacgggagcctccaccaaaaggataccgtgcacgataatgacttcgaaccctacctcacaggacagagcaatcaatcaaattcgtacccgtcgatgagtgacccttatctgtcaagttattatcccccctccatcgggtttccatactccctcaatgaggccccgtggtcaaccgctggcgacccacccatcccgtatcttaccacctacggacagttaagtaatggagaccaccactttatgcacgacgctgtctttggccagcccggaggcctaggtaacaatatctaccaacatcgcttcaatttctttcccgaaaacccggccttctccgcatgggggacatcaggttctcaaggccaacaaacccagagttcagcctatggcagcagttacacgtaccccccctccagtctggggggcaccgtcgtggacgggcagcccggctttcattcagatacattgtcgaaggctcccggaatgaactctctggaacagggaatggtggggctcaagattggtgatgtatcaagctctgcggtgaagacggtcgggtctgtggtcagctctgtggctctgaccggtgtcttgtcaggcaatgggggaacaaatgtgaacatgccagtctccaaacccacatcctgggctgcaattgcatcaaagcccgccaaaccccaacccaagatgaaaactaagtctggccccgtcatgggaggcgggctccctccccctccaataaaacataatatggatatagggacttgggacaacaagggacccgtgcccaaagcccccgtaccacagcaggccccctctccccaagccgctcctcagccccaacaggttgcacaacctctgcccgcccaaccacctgccttggctcaaccacaataccagtcacctcaacagcctccccaaactcgatgggtggcaccaagaaaccgcaacgccgcttttggccagagcggcggtgcgggctctgacagcaactctcccggcaatgtgcagcccaactctgcgccctcagttgaaagtcacccagtgctggaaaaactcaaggccgcccattcttacaatccaaaggagttcgagtggaatctgaaatctggcagagtatttatcatcaagtcctactcagaggacgatatccacaggagcatcaagtattccatctggtgttctactgagcacggcaacaagcggctggacagcgcctttagatgcatgtcatccaaaggccccgtgtacctgcttttcagcgtgaacggctctggccatttctgcggtgtggcagagatgaagtcccccgtggattatggcacatcggccggagtttggtcccaggacaaatggaaaggaaaattcgacgtacagtggatctttgtaaaggacgtgcctaacaaccaactgcgtcacattcgtttagagaataatgataataaacctgttaccaattctagagacacccaggaagtgccccttgaaaaggctaaacaagtactgaagattatctcctcctataagcatactactagcatttttgatgatttcgctcactacgaaaagcggcaggaggaagaagaagtggtccggaaagaacgacaatcaagaaacaagcagtag

SEQ ID NO: 52465 - DNA, 879 bp, Artificial Sequence
  Description of Artificial Sequence: Synthetic coding sequence
atgctgcggaagctgtggcagtggttctacgaggagaccgagagctctgacgacgtggaggttctgaccctgaagaaattcaagggcgacctggcctatcggcggcaggagtatcagaaagcattgcaggaatactcctctatttccgagaaactgagttccacgaatttcgctatgaaacgggatgtgcaggaaggtcaggcgaggtgcttggctcatctggggaggcacatggaggcactggaaatagcggccaacctggaaaataaggcaaccaatacggatcatctcactacagtcttatatctgcagttggctatatgttccagcctgcaaaaccttgaaaagactatcttttgcctgcagaagttaatcagcctgcacccctttaatccatggaactgggggaagctggctgaggcctatcttaaccttgggcccgccttatcagcagcactggctagttctcagaaacaacattcattcaccagcagcgataaaaccatcaaatcattctttccgcattctggtaaagactgcctcctgtgtttcccagaaaccttgcctgagtcttctctcttctcagttgaggccaattctagtaacagccagaagaatgaaaaggcattaaccaatattcaaaactgcatggctgagaagagagagacagtgctcatcgaaacgcagcttaaggcttgcgcgtcgtttatccgtactcggctgctgctgcagttcacgcagccccagcagacatccttcgccctcgagagaaacttacgaacccagcaggaaattgaggataaaatgaaagggttttcttttaaggaggacactctgctgttgatcgctgaagtgtcggtcagtctggggttcatgtag

SEQ ID NO: 52466 - DNA, 684 bp, Artificial Sequence
  Description of Artificial Sequence: Synthetic coding sequence
atggccgagctggacatcggccagcactgccaggtggagcactgccggcagcgcgattttttgccatttgtctgcgacgactgctcagggatcttctgtctcgagcacagaagtcgcgagtcccatggctgtccagaagtgactgtcattaatgaacggctcaagactgatcagcacacttcgtacccatgctcctttaaagattgtgctgaaagggaactggtggcggtgatttgcccatactgcgaaaaaaacttttgccttcgccaccggcaccagagtgatcacgaatgtgaaaagcttgagatacccaaaccgaggatggccgcaacccagaagctggtcaaggacatcatcgattccaagaccggagaaaccgcctctaaacgttggaagggagctaagaactccgaaaccgctgctaaggtcgccctgatgaaattaaaaatgcacgctgatggggacaagagtctaccacagacagagaggatctactttcaggtttttctccctaagggtagcaaagaaaaatcaaagcctatgtttttctgtcacaggtggagtatcggtaaggctatagactttgcagcctcactggctcgtctcaaaaatgataataacaagtttaccgccaaagttactagccattataataacatcagcattttgattaaggtgttgtag

SEQ ID NO: 52467 - DNA, 786 bp, Artificial Sequence
  Description of Artificial Sequence: Synthetic coding sequence
atggccgagctggacatcggccagcactgccaggtggagcactgccgccagcgagacttccttccttttgtgtgtgatgattgctctggaattttctgccttgaacaccgctcaagggagagccacggatgcccagaggttacagtcatcaacgaacggttaaagaccgaccagcatacttcctacccatgttcatttaaggattgcgccgagcgcgaacttgtggcagtgatttgcccctattgcgaaaagaacttctgtcttaggcatagacaccagagcgatcatgagtgtgagaagctggagatcccaaaacctcgcatggctgcaacccaaaagttggtcaaagatattatcgattctaagacaggcgagactgcctctaaaagatggaagggggcaaagaacagtgaaacggccgccaaagtggccttaatgaagttaaagatgcacgccgacggagacaagagtctcccccaagtgttcttgcccaaagggtcaaaggagaagtctaagccgatgtttttctgccacaggtggtcaatcggcaaagcgattgatttcgccgcttccttagctaggctgaaaaatgataacaacaaatttactgccaagaagcttcggctgtgccacattacatccggcgaagctctgccccttgaccataccttggagacatggattgccaaagaagactgtccactatataacggggggaatattattttagaatatttgaatgacgaagaacaattctgcaagaatgttgaatcgtatcttgaatag

SEQ ID NO: 52468 - DNA, 3696 bp, Artificial Sequence
  Description of Artificial Sequence: Synthetic coding sequence
atgtgcaagtgctgcaacctgttcagccccaaccagagcgagctgctgtcgcatgtaagcgaaaagcatatggaagagggtgtaaacgtcgacgaaatcatcatccccctgaggccattatcaaccccggaaccacctaactccagcaaaacgggggatgagttcttagtaatgaagagaaagcggggacggccaaaaggcagtactaaaaaatctagcacagaggaagaactcgccgagaacatcgtttctcctacagaggactcacccttagcgcccgaggagggaaatagcttgcctcccagtagtttagaatgcagcaagtgctgccgaaaattcagtaacaccagacagctgagaaaacacatttgtatcatcgtactcaatttgggggaagaagaaggcgaagctgggaacgagagcgacctggagttggagaaaaagtgtaaagaggatgatagagaaaaggcatctaagcgccctcgttctcaaaagaccgagaaagtacagaaaatctctggaaaagaagcacgccagctgtcaggtgcaaaaaaaccgatcattagcgtggtgctgactgcccacgaagctatccccggggcaacaaaaatagtgccagtcgaggccggtcctccagagactggcgccaccaactccgagacaacaagcgccgatctagtcccccggcgaggctatcaggagtatgccatccaacaaaccccctacgagcagcccatgaaatcttcacggctgggaccgactcaactgaagatctttacatgcgagtattgcaataaagtgtttaaatttaaacactctctgcaggctcatcttcggattcacaccaacgagaagccctataaatgcccccagtgctcatatgctagcgcgataaaggccaacctgaatgtacaccttagaaagcacacaggcgagaagtttgcatgtgactactgttcattcacatgtctgtccaaaggacaccttaaagtgcatatcgaacgggtgcataagaagattaagcagcactgcaggttctgcaaaaagaaatattcagatgtgaagaaccttatcaaacatatacgcgatgcccatgatccacaagacaagaaggtcaaggaagctctagatgagctgtgcttgatgacacgggaagggaagaggcagctgctatatgactgccacatttgcgagagaaagttcaaaaatgagttggatagagacaggcatatgttggtgcatggggacaagtggcctttcgcatgtgagctgtgcgggcacggcgccaccaagtatcaagctcttgagctccatgttagaaaacacccctttgtatacgtctgtgcagtatgtcgcaagaaattcgtgtctagcataaggttgaggacccatataaaggaggtccacggggccgcacaggaggctcttgtgtttacaagcagcatcaatcagagtttctgcttgttagaaccaggaggggacatacaacaggaagcgttgggcgatcagctgcagttagtcgaagaggaattcgctctgcaaggcgtcaatgctttgaaggaggaagcttgccctggggatacccagctcgaggagggcagaaaggaaccagaggccccaggcgagatgcctgcaccagccgtccatctcgcctctccacaggcagagtccactgcgttaccaccctgcgagctggaaaccactgtggtctccagcagcgatcttcattcacaggaggtggtgagcgacgatttcttgctgaagaacgacactagttcagctgaggcccatgctgctccagaaaagccacccgacatgcaacatcggtccagcgtgcaaacacagggcgaggtgataactctgctgctcagtaaggcgcaatcagccggctctgatcaagagtcacacggcgcacaaagcccattaggggaaggccagaatatggctgtgcttagcgccggcgaccctgatccttcaagatgcctgcggagtaaccccgcggaagcctccgatctgctccccccggtcgcaggcgggggagatacgataactcatcagcccgactcttgcaaggccgcgcccgagcatcgctcaggaatcaccgcctttatgaaggtgcttaatagccttcagaagaagcagatgaatacttcactgtgtgagcgcatccgcaaagtgtatggcgacttagagtgtgaatactgcggcaaactattctggtatcaagtgcactttgacatgcatgttagaacccatacacgcgagcacctatactactgctctcaatgtcattactcaagtatcacaaagaattgtctgaagaggcatgtaatccagaaacactctaacatcctcttgaaatgtcctactgacggatgcgactattcaacccccgacaaatacaagctgcaagcgcacctaaaagtacacactgcgctggacaagagaagttattcgtgccccgtttgtgagaagagcttctctgaagacagactgatcaagtctcatattaagacaaaccaccctgaagtttccatgtctaccatctcagaagtgctaggaaggagagtccagcttaaaggcttgatcggaaaacgcgccatgaagtgcccctattgcgacttttacttcatgaagaacggttcagacctgcaacggcacatttgggcccacgagggtgtcaaaccttttaagtgctctctctgcgaatacgccactaggtccaaatcaaatctcaaagcccacatgaaccgtcactccacagagaagactcatctctgcgatatgtgtggcaagaaattcaagagtaagggtacactgaaatctcacaagttactccacaccgctgacggcaagcagtttaagtgtacagtatgcgactacactgccgcacagaaaccacaactattacgccatatggagcaacatgtttcattcaagcccttcagatgcgcccactgtcactattcctgcaacattagcggttctctgaaaaggcactacaaccgtaagcaccctaacgaggagtacgccaacgtgggaacaggggaattagctgcagaagtacttatacagcagggggggttgaaatgtcctgtttgttcctttgtttacggaaccaagtgggagttcaatagacacctgaagaacaaacatggcctcaaggtggtggagattgatggcgatcctaagtgggaaactgccactgaagcacctgaagaaccctccacacaatacctgcatatcacggaagccgaagaggatgtacagggcacccaagccgccgtcgcagccctccaggacctgcgctacacttctgaatcaggcgaccgcctcgaccccacggcggtcaacatactccaacagataatagaactaggagccgaaacacacgatgccaccgccttagcatcagtggttgccatggctccaggtacagtgacagtggtaaagcaagtcaccgaagaagaaccgtcctcaaatcatactgtgatgatccaggagaccgtgcaacaggcctcagtggaactagctgagcagcatcatttagtcgtgtctagcgacgatgtggaaggaatcgaaaccgtcacagtctacacacagggaggtgaggctagcgagttcattgtgtacgtacaggaagccatgcagccggtagaggagcaagccgtggagcagcccgcccaagagctctag

SEQ ID NO: 52469 - DNA, 1905 bp, Artificial Sequence
  Description of Artificial Sequence: Synthetic coding sequence
atggagcccagccccctgagccccagcggcgccgccctgcccctgcccctaagcctggccccccccccactgcctctacctgccgctgcggtcgtgcacgtgtctttccctgaggttacctctgccctgctggaatcactcaaccagcagcggttgcagggacaattatgtgatgtgtctatcagagtccagggtcgggaatttagagcgcaccgggctgtgctggccgccagttccccttacttccacgatcaggtactcttgaaagggatgacatctatcagtcttccttctgtgatggatcctggtgcatttgagaccgtgctcgctagcgcgtacaccggacgactctctatggcagcagccgatatcgtgaattttctcaccgtcgggagcgtcttacagatgtggcacatcgtcgataagtgtaccgaacttctcagggagggcagggctagcgccacaaccactatcacaaccgccgcggccaccagcgtgacagtccccggtgctggtgtcccatctgggagtggagggacagtagcaccggctaccatggggtcagcccgcagccacgccagttcacgagcctctgagaaccaaagcccttctagttcaaactacttcagtccccgcgagtccactgatttttcaagcagctcccaggaggcctttgcagcttcggctgtgggtagcggtgagcgtcgtgggggtggccctgtgttccccgccccagtggtggggtccggtggtgccacaagcggcaaactcctgcttgaggcagacgagctgtgtgacgatggaggagatggaagaggagccgttgttccgggcgcaggactgaggcggcccacctacactccaccatccattatgccgcagaaacattgggtctatgttaaacgcggaggcaattgccctgcccccgcccccttggtgccccaggaccccgacctggaggaggaggaggaggaggaagatctggtcctgacttgtgaagatgacgaagacgaagagctgggtgggtccagtagagtgccagtcggaggaggacccgaggccactctgagtatcagcgacgtccgaactttaagcgaaccccccgacaagggagaggaacaggttaatttctgcgagtcttccaacgacttcggcccatatgagggagggggccccgtggccggtcttgacgactccgggggccccacccctagctcctatgctccttcacaccccccacggcccctgcttcccctagacatgcagggcaaccagatactcgtgttcccaagcagttcttcatcctccagctctcaggcccccggccagccccccgggaaccaggctgaacacggagctgtcaccgtcggtgggacgtcagtgggaagtttgggtgtcccagggagtgtggggggagtgccaggaggcacaggatctggggatggtaacaaaatattcctgtgccactgcggtaaagccttttcacacaagagcatgcgggaccggcacgtgaatatgcacctgaacctgcgcccgtttgactgccctgtatgtaataagaaatttaaaatgaagcaccatctcactgagcatatgaagacacacacgggactgaaaccctacgaatgtggggtgtgcgcaaagaaattcatgtggagggacagtttcatgagacacaggggccattgtgaaagaagacaccgcctgggcggcgtgggagccgtgccaggccctgggacacccacaggaccttcccttccaagcaaaagggagtcgccgggggtagggggcggctccggtgacgaagcctccgccgctaccccgccctcgagccggagagtctggtcccccccccgggtccacaaggtggaaatggggttcggaggcggtggcggcgcgaactag

SEQ ID NO: 52470 - DNA, 1905 bp, Artificial Sequence
  Description of Artificial Sequence: Synthetic coding sequence
atggagcccagccccctgagccccagcggcgccgccctgcccctgcctttgagcctggcccctccacccttgccccttccagccgccgctgtcgtgcatgtgtcgttccctgaggtcacatccgcactcctggagtcgctgaatcagcagagacttcaaggccagctgtgcgacgtcagcatccgggtgcaaggccgagagtttcgggcccatcgggcagtccttgccgcttcgtcaccttattttcacgatcaggtgcttctcaagggtatgacatcaatctcactccctagcgtaatggatcctggcgcgttcgaaacagtgctcgcatcagcctatacaggaaggttgtccatggccgcagccgatatcgtgaactttctaacggtcggctcggtcctgcagatgtggcatattgttgataagtgcacagagctacttagggagggtcgtgccagcgctacgaccactattacaacagccgcagccaccagtgtgaccgtccctggagcaggcgtgccctcaggaagcggaggcacagtagcgcccgcaacaatgggatctgcccggagccatgcatcctccagagcttcagagaaccaatcacctagttcttctaattatttttccccaagggagtcaaccgatttcagttctagcagccaggaggcatttgccgctagtgcagtaggaagtggggaacgcaggggagggggacccgtgtttcctgctcccgtggtcggatccggtggagctacatctggcaaactgcttcttgaagccgacgagctgtgcgatgatggtggagacgggaggggggccgtagtaccaggagccggcctgaggcgccctacctatacccccccgagcattatgccacagaaacattgggtgtacgtgaagagagggggtaactgtccggcccctgcccccctggtgccacaggatcctgatctggaagaagaggaggaagaagaagacttggtgctgacttgtgaggacgatgaggatgaggaacttgggggaagttctcgtgtcccagtcggaggtggtcccgaggcaactctgtctatctcagatgtgcgcacgctctctgagccacccgataaaggcgaagagcaggtcaatttttgcgagtcctcaaacgattttggtccgtacgaagggggcgggcccgtggcggggcttgatgattctggaggacccacaccctcatcctacgccccaagtcaccccccgaggccattacttccactggatatgcaggggaatcagatactggtttttccctccagctcttccagtagcagctcccaggctccaggccagccaccaggaaaccaggccgagcatggcgcagtcacagttgggggaaccagtgtgggcagtctcggggtgccaggcagtgttgggggggtcccagggggaacaggcagcggcgacgggaataagatcttcttgtgccactgcggaaaggccttctcccacaaatcaatgcgggaccggcacgtcaacatgcatttgaacctgcgccccttcgactgtcccgtgtgcaacaaaaagttcaagatgaaacaccatcttacggagcatatgaaaactcacactggattaaaaccatatgagtgtggagtgtgcgcaaagaagtttatgtggcgggatagcttcatgcggcacaggggacattgcgaaagacgacaccggcttggtggcgtgggagccgtgccgggtcccggaaccccaaccggtccttctctgccgagtaagagagaatcacctggggtcggtgggggcagcggggatgaggcctctgcagccaccccaccatcatcaaggcgggtgtggtccccgccaagagtacataaggtagagatgggattcggcgggggcgggggtgcgaattag

SEQ ID NO: 52471 - DNA, 1905 bp, Artificial Sequence
  Description of Artificial Sequence: Synthetic coding sequence
atggagcccagccccctgagccccagcggcgccgccctgcccctgccactctccctcgcaccaccccccctccccctcccagcagctgcagtggtccacgtctcgttcccagaggtgacaagcgcccttcttgagtcccttaatcagcagcggctgcaaggccagctgtgcgatgtctccatccgggtgcaggggcgtgagttccgcgctcacagggctgtattagcggctagctccccttacttccacgatcaggtgctcctcaagggtatgaccagcataagtctgccctccgtcatggacccaggagcctttgaaacagtgcttgcctcagcgtacactggtcgcctgtccatggctgccgcggatatcgtgaattttctgacggttggcagtgtgcttcagatgtggcatatcgtcgataaatgtaccgagctgttgagggaaggccgcgccagcgccactaccacgatcactacggcggctgccacgagtgtcacggtgccgggagcgggggtgccaagtggttcaggaggaactgtggcccccgcaaccatgggctccgcccgctcccatgcttctagccgagctagcgaaaatcagagcccgtcttcttcaaactatttcagcccccgggaatcaacagacttcagttccagtagtcaagaagcattcgcagcctctgccgtgggcagcggcgagagacggggaggcgggcctgtgtttcccgccccagtggttggaagcggaggtgctacatcagggaaactgctccttgaagcagacgaactgtgcgatgatggaggcgatggtagaggcgccgtggtgcccggtgccggtttacggagacctacctacacaccgccctctattatgccacagaagcactgggtgtatgtgaagaggggagggaactgccccgctcccgcccctcttgtgccacaggatccggacctggaagaggaagaggaggaggaggatcttgtcctaacctgtgaggacgacgaggacgaggaacttggaggttcctcccgcgtgccagtcggcggaggaccagaggcaactctatctatctccgacgtcaggacccttagcgaacctcccgacaagggcgaagagcaggtaaatttttgcgaatcgtcaaacgatttcggaccatatgaaggcggtggacctgtcgccgggctggatgacagtgggggccccacaccatcatcttatgcgcctagccacccaccccgccctctgttacccctggatatgcaagggaatcagattctggtctttccgtcatcttccagttcttcctccagtcaagcgcctggtcagccgcccggaaatcaggccgagcatggggcagtgacagtgggcggtacttctgtcggctctctcggggtgcccggatccgtcgggggcgtgccaggcgggaccgggtctggcgatggtaataagatatttctgtgccactgcggaaaggcgttcagtcacaaatctatgagagatagacacgtgaatatgcaccttaaccttcggccatttgattgcccggtgtgtaacaagaaattcaaaatgaagcatcatctgaccgagcacatgaaaacacacacggggctcaagccatacgagtgcggtgtgtgtgccaagaagtttatgtggagagacagtttcatgcggcaccgcggacactgcgaacgtagacatcgcctcggcggcgtgggggctgttccaggccccggaacccctaccgggccatccctgccttctaagagagagtctcccggcgtgggtggaggctcaggtgatgaagcatcagccgcgacacctccctcctcccgaagagtctggagtcccccaagagttcacaaggttgaaatgggcttcggcggagggggcggcgctaactag

SEQ ID NO: 52472 - DNA, 450 bp, Artificial Sequence
  Description of Artificial Sequence: Synthetic coding sequence
atggagcccagccccctgagccccagcggcgccgccctgcccctgcccctatctcttgctcctccccctctgccgctccctgccgctgcggttgttcacgtttctttccctgaagtgacctccgctctactggagtcactgaaccagcagcgcctgcagggccagctctgcgatgtttcaatcagggttcaaggaagagagttcagagctcacagagccgtgctagccgctagttccccttacttccacgatcaagtgctattgaaaggaatgacctcaatttctctgccctctgtcatggacccaggggcattcgaaactgtgctcgcatccgcttataccgggaggctgtcaatggcagcagcggacatcgtcaacttcttgacagtggggtccgtcctgcagatgtggcatattgtggataaatgtaccgaactcctgagggagtag

SEQ ID NO: 52473 - DNA, 450 bp, Artificial Sequence
  Description of Artificial Sequence: Synthetic coding sequence
atggagcccagccccctgagccccagcggcgccgccctgcccctgcccctatccctggcaccgcctcctttgcccctgccagctgccgctgtggtgcacgtgtctttccctgaggtgacaagcgcattgcttgaaagcctcaaccagcagaggctgcaaggccagctgtgtgatgtcagcattagggtgcagggccgcgagtttcgggcccacagggccgtgctggcagcttcctccccatattttcacgatcaggttttactaaaaggaatgacttccatcagcctccctagtgtgatggacccaggggctttcgagaccgtattggcaagtgcatataccggtaggctcagcatggccgcagctgatatcgtcaatttcctcactgttggtagcgtcctgcaaatgtggcacattgtggacaaatgcaccgaactgctgcgtgagtag

SEQ ID NO: 52474 - DNA, 450 bp, Artificial Sequence
  Description of Artificial Sequence: Synthetic coding sequence
atggagcccagccccctgagccccagcggcgccgccctgcccctgccgctcagcttagcccccccacctctgccactgccggccgctgctgtggtgcacgtgagcttcccagaagtgacctctgccttgctggagtccttgaaccagcagaggctgcagggccaactgtgcgacgtttctatcagggtgcagggtcgagagtttcgagcccaccgcgccgttttggcggcttccagcccctactttcacgatcaggtgctgctaaaaggcatgacgagcatttccctacccagtgtaatggaccccggtgccttcgagaccgttctcgcctctgcttataccgggaggctgtcaatggccgctgccgacattgtgaacttcctgaccgtcggttccgtgctccagatgtggcacattgtggacaaatgcaccgagctcttacgggagtag

SEQ ID NO: 52475 - DNA, 1905 bp, Artificial Sequence
  Description of Artificial Sequence: Synthetic coding sequence
atggagcccagccccctgagccccagcggcgccgccctgcccctgccactgtccctggctcccccaccacttcccctgcctgccgccgctgtagtccacgtctcattccctgaagtaacttccgctcttttagaaagtctgaatcaacagcgactgcaaggccagctgtgcgacgtttcgatcagggtgcagggccgggagttccgcgctcacagagccgtccttgctgccagctccccatattttcacgatcaggtcctgctgaagggtatgaccagtatctctctcccttcagtgatggaccccggcgcctttgaaaccgtgcttgcctccgcatatacgggtagactctcaatggcagcagccgacatcgtaaatttcctcacagttgggagtgtgttacagatgtggcatattgtggacaaatgtacagaattgttgagagaaggaagggcttccgccacaaccaccattaccactgccgccgccacatcggtcactgtacctggcgcgggggtgcctagcggaagcgggggaactgtggctcccgcaaccatgggaagtgctagatctcatgcgagtagtagagccagcgaaaatcagagtccaagttcatctaactacttctccccccgggaatcaaccgacttctccagttcttctcaggaagccttcgctgctagcgctgttggttccggtgaacgacgaggcgggggtcctgtctttcctgctcccgtcgtgggatcgggaggagcgacttctgggaagctcttgctcgaggcagatgagttgtgcgacgatgggggggatgggagaggtgcagtggtgcccggcgccgggctacgccgccctacttatacacccccttcgattatgccacagaaacactgggtttacgtgaagaggggcggtaattgtcctgctccagcgcctcttgtgccccaggaccccgatcttgaggaagaagaggaagaagaggatctggtcctgacatgcgaagatgacgaggatgaagagctcggaggttcttcacgggtcccggttggagggggaccggaagcgactctaagtatctccgacgtgcgcactctgagtgaaccacctgataagggagaggagcaggtaaatttctgtgagagcagtaatgactttggcccatacgaaggtggtggtcctgtcgcaggtctggatgactctggcgggccaactccttcatcatacgcaccatcacacccgccacgcccattacttccactggacatgcagggcaaccaaatactcgttttcccatcgtcctcttcatctagtagctcccaagcgcctggccagcctccgggaaaccaagctgaacacggtgccgtgaccgtgggcggcactagcgtcggcagtctgggggtcccagggtcagtgggcggagtgcctggcggcactggtagcggggatggtaacaaaattttcctctgccactgcggcaaagcattctcccacaagtctatgcgggaccgtcacgtaaacatgcacctgaacctgcgcccatttgactgtccggtctgtaataagaagtttaaaatgaagcaccacctaactgaacacatgaagacacataccgggctaaaaccttacgagtgcggcgtatgcgcgaagaagtttatgtggagggatagctttatgaggcaccgggggcattgtgagagaaggcacaggctgggcggggtcggggcagtgccaggacccggcacaccaacgggcccatccctgccctccaaacgggagagtccgggggtggggggcggtagtggcgatgaggcatccgccgccactccaccatcttctcggcgcgtgtggagccctccccgcgtgcataaggtcgagatggggttcggcggtggggggggggcaaactag

SEQ ID NO: 52476 - DNA, 1905 bp, Artificial Sequence
  Description of Artificial Sequence: Synthetic coding sequence
atggagcccagccccctgagccccagcggcgccgccctgcccctgccactaagtcttgcccccccccccttgcccctgccagccgctgcggtcgtacatgtcagcttccctgaagtcacttccgcactgctcgaatctctgaatcagcaaagactccagggccaactttgcgatgtgagcatccgcgtccaaggccgggaatttcgggctcatagggctgtcctagctgctagcagcccatactttcacgatcaggttttacttaaggggatgaccagcatttccctcccttccgtgatggacccaggggccttcgaaaccgttctggcctcagcttatacagggcggctgtcgatggctgcggccgatattgtgaacttcctgacagtcggtagcgtgctgcagatgtggcacatcgtggataagtgtactgaattactgcgagaggggcgtgcatccgcaacaacaactatcaccaccgccgcagcaactagcgtaacggtgcccggcgctggtgtccctagcggatccgggggaacggtggcccccgctaccatgggaagtgcaagatcacacgcctccagtcgggcttcagagaaccagagtccaagctcctccaattatttttcccccagggagagtacggacttcagttcctcctcccaggaagctttcgctgctagcgccgtcggaagtggtgaaagaaggggcggggggcctgtgttccccgcccccgtcgtgggctccggcggcgctacgtctggaaagctccttcttgaagcggacgaactgtgcgatgatggaggggatggtcgcggggctgtggtgcccggggccggactcaggcgtccaacttacactcctccctccattatgcctcaaaaacattgggtctatgtcaagcgagggggcaattgccccgcccctgcccctcttgtcccacaagacccagacctggaggaagaggaagaggaagaggatttggtactgacctgcgaggacgatgaggacgaagagctcggaggatcatcaagagtccctgtgggtggtggaccggaagccacactgtcaatttcagatgtccggacgctgtcagaacccccagacaaaggtgaagagcaggtgaacttttgtgaaagtagtaacgacttcgggccctatgaggggggaggacccgtggcaggacttgatgattcgggagggcccactccaagttcctatgcacccagccatccaccaagaccactgctgcccctggatatgcagggcaatcaaatcttggtgttcccctcaagctctagcagctcctcatcccaagcgcccggtcaacctcccggcaatcaggccgaacacggcgcagtgacagtcggagggacgtctgtggggtccctgggagtcccgggctccgtgggaggcgtacccggcggcacaggaagcggcgacggtaacaagatctttttgtgccattgcggtaaggcattctcacacaagagcatgcgagaccgacacgttaatatgcatctgaatcttcgaccgtttgactgtccagtgtgtaataagaagtttaagatgaaacatcaccttaccgagcacatgaagactcacaccgggctgaagccctatgaatgcggcgtgtgcgctaaaaagtttatgtggcgcgattcctttatgcgacatcgcggccactgtgaacgtagacacaggctgggcggtgtgggtgctgtcccaggccctgggacccctaccggaccttcattgccctcaaaacgggaatcacccggggttggaggtggatcaggcgacgaggcctctgccgcaaccccaccttccagccgccgggtgtggtcaccccctcgtgtacataaggtagagatggggtttgggggaggcggaggggccaattag

SEQ ID NO: 52477 - DNA, 1905 bp, Artificial Sequence
  Description of Artificial Sequence: Synthetic coding sequence
atggagcccagccccctgagccccagcggcgccgccctgcccctgcctctgtctcttgcaccaccacctttgccactgccagccgctgcggtggtgcacgtttcattccccgaggtgacaagcgcactactggagagcctgaaccagcagcgtctccaggggcaactgtgcgatgtgtccatccgggtgcagggaagggaatttagagcccaccgagccgtgctggccgctagcagcccctactttcacgaccaagtactcctgaaaggaatgacctcaatatctcttccctccgtaatggatccaggcgcattcgagaccgtcctggctagcgcttacacagggcggttgtcaatggcggccgcagacattgtcaatttccttacagtgggatcggtgcttcagatgtggcatatcgtggacaagtgtacggagctccttagggaagggagggcctcagctacaacaactatcacaacagccgcggctacaagcgtgacagtgcccggcgctggagtgccatctgggtccggaggaaccgttgcacccgctaccatggggtccgctaggagtcatgctagcagcagagccagtgagaaccaaagcccgagctcaagcaattacttctcccctcgagaaagtactgatttcagtagcagttcccaagaagctttcgccgcctctgctgtcgggtccggagagagaagaggcgggggtccagtcttccccgcccccgtggttggtagcgggggcgcaacgagcggaaaattactgcttgaggccgacgagctgtgtgatgacggcggagacgggcgcggggcagtggtccctggtgccggtcttagacgccccacgtatacgcccccaagcatcatgcctcagaaacactgggtctacgtgaagcgcgggggcaactgccccgcgccggcccccctggtccctcaagaccccgatcttgaagaggaggaggaggaggaggacctggtcctcacctgcgaggatgacgaggatgaagagctcgggggtagttcacgcgtacctgttggcgggggcccagaggcaactctttccatttctgatgttcgaacactatcagagcctcctgacaagggtgaggaacaggtgaacttctgtgagtccagtaacgattttggaccatatgaaggcggaggaccagtggccggactcgatgattctggcggaccaacgccgtccagctacgctccgtcccatcccccaaggcctcttctgcctttggatatgcagggcaaccagatcttagtgttcccatccagctcctctagctctagtagtcaggcccccggtcagcctcctggtaaccaggctgaacatggagcggttacggtgggcgggacatctgttgggagcttgggagtgccaggtagcgtgggcggggtcccaggcgggactggatcgggcgatgggaacaagatattcctgtgccactgtggaaaggcgttctcccacaagtcaatgagggaccgacatgtgaacatgcaccttaatctgcgtccattcgattgtcccgtatgtaacaaaaagttcaagatgaagcaccacctgactgagcacatgaagacccacaccggactgaaaccttacgaatgcggagtgtgcgccaaaaaatttatgtggcgagattcgttcatgcgtcacagaggtcattgtgaacgcaggcaccggcttggtggcgtgggggcggtgccgggtcctggaacaccaacaggaccctccctgccatcaaaacgagaaagcccaggcgtcggaggtggctccggcgacgaagctagcgcggccacccctcccagctctaggcgcgtgtggagtcctccgagagtgcataaagtggaaatggggtttggaggaggaggcggggcaaactag

SEQ ID NO: 52478 - DNA, 2019 bp, Artificial Sequence
  Description of Artificial Sequence: Synthetic coding sequence
atggagagccggaagctgatcagcgccaccgacatccagtacagcggtagtctccttaactcgttaaatgagcaacgtggccatggcctgttttgtgatgtaaccgtgatcgtcgaagacaggaaattcagagcccataaaaacatcctgagtgcgagtagcacctacttccaccagctgttcagtgtggcgggacaggtggtggagctcagcttcatcagggccgaaattttcgctgaaattttgaattacatttacagctctaagattgtgagggtgagatctgatctcctggatgaactgatcaaatccgggcagctccttggcgttaaattcatcgccgaactgggcgtgccgctatcccaggtgaagagcattagcggaactgcccaggacggaaatactgaaccactgccaccggactcgggcgataagaacctggtgattcagaagagcaaggacgaggctcaggacaacggtgcaactattatgcctattattacagaaagcttctccctgtccgctgaagactacgaaatgaagaagattatcgtgacagattcagatgatgacgacgatgacgtgattttctgctccgagatcttgcccacaaaagagacccttcccagcaacaacacagtcgcccaggtgcaatcaaacccaggacctgtcgccatctccgatgtggcccctagcgcttccaacaactccccgcctttgaccaacattacgcccacccagaaactgcccacacccgttaatcaggccaccttaagtcaaacccagggtagcgagaaattgttagtgtcatccgcaccaactcatctgactccaaacatcatcctcctcaatcagacccctcttagtacaccacccaacgtgtcatcaagcctccctaaccatatgccctcctcaataaacctgctcgtccaaaaccaacagacaccaaattcagctatcctgacagggaataaggccaatgaggaggaggaagaggagataatcgacgacgacgatgatactatctcgagcagcccagactcggcggtgtcaaataccagcctagtcccacaggcagacacaagtcaaaacacttcctttgatggcagcctcatccagaagatgcagattcccactctgctgcaggaacccctgtctaacagtttgaaaattagcgacatcataacccggaataccaacgatccgggcgtgggatcgaagcatctgatggagggtcaaaagatcatcacattggacacggcaactgagatcgagggactgtctactggttgcaaagtgtacgccaatatcggagaagatacatacgatatcgtcattccggtgaaagatgatcccgatgaaggtgaagctaggttggaaaatgaaattcctaagacctccggatcagaaatggctaataagaggatgaaagtgaaacacgacgaccattacgagctgatagtggacggaagagtctactatatttgcatcgtctgtaaacgctcttatgtgtgtctgaccagtcttcgtagacatttcaacatccactcctgggagaagaagtatccctgtaggtactgtgagaaggtatttccgttagctgagtatagaaccaaacacgaaatccaccacacaggtgagcggagatatcaatgcctggcttgtggtaagtcttttataaactatcagtttatgagctcccacattaaatctgtgcattcacaggatccttctggagacagtaagctgtaccgcttacatccctgtcgctccctgcagatcaggcagtacgcatatctcagcgatcggtcgtctacaatccctgcgatgaaagacgacgggattgggtacaaagtggatacaggcaaagagccaccagtgggtactaccacgtccacccagaacaaacccatgacctgggaagacatctttatacaacaggagaacgacagtatatttaaacagaacgtgaccgacggatcaacagagttcgaatttatcataccagagagttactag

SEQ ID NO: 52479 - DNA, 609 bp, Artificial Sequence
  Description of Artificial Sequence: Synthetic coding sequence
atgctgaccgccaccctgagcatcaacaccgagaacatcatcgacgtgctggctgccgcgtcctatatgcagatgtttagcgttgcaagtacatgtagcgagttcatgaagagttctattctttggaacacgcccaactcacaaccagaaaagggactggatgctggccaggagaacaatagtaattgcaatttcacttcccgggatggcagcatcagtcctgtgtcatctgagtgctctgtggtggaacggaccattccggtctgcagggagtcacggaggaagaggaaaagctatatcgtcatgtcaccggagtccccggttaaatgcgggacccagactagcagcccccaggtgctgaactcctctgccagctactcggagaatcggaatcaacctgtggactcctcccttgccttcccctggacatttcccttcggaattgacaggaggatacagccggaaaaagtaaagcaggcagaaaatacccggaccctggagctccccgggccatccgagaccgggaggcgtatggcagactacgtcacatgcgagtccacaaagacaaccctacctctcggtacagaagaagatgttcggtctaaatag

SEQ ID NO: 52480 - DNA, 1713 bp, Artificial Sequence
  Description of Artificial Sequence: Synthetic coding sequence
atgggcgtgaagaccttcacccacagcagcagcagccacagccaggaaatgcttgggaaactgaacatgctgcggaatgatggtcacttttgtgatataacaattagggtgcaggataagatctttagagcccataaggtggttttggcagcatgctcagacttcttcagaaccaagcttgttgggcaggcagaggacgagaataagaatgtgctggacttacaccacgtgacggtgaccgggtttatccctctgttagaatatgcgtatacggcaacattaagcattaatactgagaatattattgacgtcctcgcagctgcatcttatatgcaaatgttttccgttgcctcaacatgttcagaatttatgaagtcttctattctgtggaatactcctaatagtcagcctgagaaaggacttgacgctggccaggagaacaacagtaattgcaactttacatcgcgggacggttccatctctcccgtgtcctccgagtgcagcgttgtcgagaggacaattcctgtttgccgggagtcccgaagaaagaggaagtcatatatcgtcatgagccccgaatcccctgtcaagtgcggaacacaaacctctagtccacaagtcctgaatagcagtgctagctactctgagaacagaaatcaacccgtagattcctccctggcttttccatggacattcccattcgggattgatcggagaatccagcccgaaaaggtcaaacaggctgagaacacacgcactttagaactcccgggaccttctgagaccgggcggcgcatggctgattatgtgacttgcgagagtacgaagaccaccctgcccttagggactgaagaggacgtcagagttaaagtggaaagattgagcgacgaggaggtacacgaggaggtctcccaacctgtttcagcatcacagagctctctgagcgaccagcagaccgtgcccggctctgaacaagtgcaggaggatttactgatctcccctcagagcagtagtatcgggagtgtggatgagggggtctcagagggacttcccactcttcagtctaccagctcaacaaatgctcccccagacgatgacgacaggttggagaacgtgcagtacccctatcagctgtacatcgcgccaagtacctccagtaccgagcggccttcaccaaacggtccggataggccattccaatgccccacttgcggtgtgcgttttacccggatacaaaatctgaagcagcatatgcttatccacagtggtatcaagccttttcagtgtgataggtgcggcaagaaatttactcgggcttactcactcaagatgcaccgtctcaaacacgagggcaagcggtgcttcagatgccagatatgttccgccactttcacatcttttggcgagtataagcatcacatgagagttagccggcatatcattcgaaagcctagaatttacgaatgcaagacctgtggggccatgttcaccaattctgggaacttaatagtgcacctgaggtcactgaatcatgaagccagtgagctagcaaattactttcaatctagtgacttcctcgtacccgactatctcaaccaagagcaggaggaaactttagtacagtatgatctgggagaacacggattcgaatccaatagctcagtccaaatgccagtgatcagccagtatcactccaagggaaaggagccgtag

SEQ ID NO: 52481 - DNA, 1713 bp, Artificial Sequence
  Description of Artificial Sequence: Synthetic coding sequence
atgggcgtgaagaccttcacccacagcagcagcagccacagccaggagatgcttggcaagctgaatatgctgaggaatgacggacacttttgcgacatcaccattcgggtgcaggacaagattttccgggctcacaaggtagtgctagcagcatgcagcgattttttcagaactaaactggtggggcaggcggaagatgaaaacaagaacgtcctcgatctccaccacgtgactgttaccggcttcatacctctgctggaatatgcctataccgccacgctgtccatcaacacagagaatattatcgatgtgttggctgctgccagctatatgcaaatgttctccgttgcatctacatgctccgagtttatgaagagtagtatactctggaacacacccaatagccagccagagaagggacttgacgcaggtcaggagaacaacagcaactgtaactttacatcacgcgacgggtccattagccccgtgtcctcagagtgctctgtagttgaacggaccatacccgtgtgcagggaatcgcgccgaaagcgaaaaagttacatcgttatgagcccagaatcccccgtaaaatgcggaacgcagacgtcttcccctcaggtgttaaattcttccgcttcatactccgagaacagaaaccaacccgtggattcttctctcgcattcccctggacattccccttcggcatagaccgccgcatccagccagagaaggtcaaacaggcggagaacacaagaactctcgagttgccaggcccctcggaaactgggagacgcatggcagattacgtgacctgcgagtccacaaagaccactcttcctctgggcactgaggaagatgtgagggttaaagtcgagcggctgagcgacgaggaagttcacgaggaggtaagccagccggtgtctgccagtcagagcagtctgtctgatcagcaaaccgtccctggcagcgagcaggtacaggaggatcttttaatctcccctcagtcgagcagtatcggctctgtggatgagggggtatccgaggggctgccaactttacagtccacctcgtcgacaaatgccccgcctgacgacgacgacaggcttgagaacgtgcaatatccgtaccagctgtatatcgcaccctcaactagcagtacggagcgacctagccctaacgggccagaccgacccttccaatgtcctacctgtggagtccgctttacccgcatccaaaatctgaagcagcacatgctgattcactccggaataaagccctttcagtgtgatagatgcggaaagaaattcaccagagcttatagcctcaaaatgcatagattgaaacacgaaggcaaacgttgtttccgctgtcagatctgctcagccacattcacaagcttcggtgaatataagcatcacatgcgcgtttcgaggcatatcatcaggaaacctaggatctatgagtgcaagacttgtggggctatgttcaccaactctggaaacttgattgtgcacttacggtctcttaatcacgaggccagcgagctggcaaactacttccagtcctccgattttcttgtgccagattacctgaatcaggagcaggaggaaacactggtgcagtacgacctgggggagcacgggttcgaatcaaacagtagcgtgcagatgcctgtgatctctcagtatcacagtaaaggcaaagaaccctag

SEQ ID NO: 52482 - DNA, 1404 bp, Artificial Sequence
  Description of Artificial Sequence: Synthetic coding sequence
atgggcgtgaagaccttcacccacagcagcagcagccacagccaggagatgctgggcaaattgaatatgctgagaaatgatgggcacttctgcgatataacaatccgagtgcaggacaaaatctttagggcacataaagtagttctggctgcctgcagtgatttctttcgtacgaagctcgtgggacaggccgaagacgaaaacaagaatgtgctggacctgcaccacgtgaccgtcactgggttcattccactgctggaatatgcttacacagctaccctaagtatcaacactgaaaacatcattgacgtcctcgctgctgctagctacatgcagatgttttcggtggcatccacatgttccgagttcatgaaatcatcaatactttggaatactcctaattcacagccagagaagggcctcgacgccgggcaggaaaacaacagcaactgcaatttcacatctcgcgacggctcgatctccccagtgtccagcgagtgcagcgtggttgaacgcaccattccagtatgcagagagtcccgtcgcaagcgtaagtcctatattgttatgtctcccgaaagcccagtcaagtgtgggacgcagacctcttcgccccaggtcctgaatagctccgcctcatactctgagaacagaaaccagccggttgatagcagtctggcatttccgtggacctttccctttggcattgataggagaatacagcctgagaaagtcaaacaggcggagaatacacgaactctggagctgccaggccccagtgaaacgggtcgtcggatggcagactatgtcacatgcgagagcaccaagacgacactgcccctcgggacggaggaggacgttagggtgaaagtcgaacgcctatctgatgaagaagtgcacgaggaagttagccagcctgtgagcgcttctcaatcgtctcttagtgatcagcagacagtccctgggagcgagcaggtgcaggaagacctgctaattagtcctcagtcttctagcatcgggtcagtagatgagggcgtgtcagagggacttcccaccctgcagagcaccagcagcacaaatgcccctccagacgacgatgacagactcgagaatgtgcagtatccataccagctgtatatcgccccctccacttcttcaaccgagcggccctctcctaatggacccgaccggcccttccagtgccccacctgcggtgtgaggttcactcggatccaaaatttgaagcagcacatgctgatacatagtggcatcaaacctttccaatgcgatcgctgcggtaagaagttcactagggcttactcacttaaaatgcacagactcaagcatgaaggacatccgaggaagagcgcatctcgctcatcctccgccacaaactgctgttag

SEQ ID NO: 52483 - DNA, 1362 bp, Artificial Sequence
  Description of Artificial Sequence: Synthetic coding sequence
atgggcgtgaagaccttcacccacagcagcagcagccacagccaggaaatgctaggtaagctcaacatgctgcggaatgatggtcacttttgtgacattactatccgggtgcaagataagatcttcagagcccacaaggtggtgctggccgcctgctctgattttttccgcacaaagcttgtgggacaggccgaggacgagaataagaatgtgctggatctgcaccacgtgactgtcacagggtttattcccctgcttgagtacgcctacacagcaacactgagtatcaacaccgaaaacatcatcgacgttctcgccgccgcgtcatacatgcagatgttctcagtcgctagtacctgcagcgagtttatgaaatctagtatcctgtggaatacacccaatagccagcccgagaagggactggacgccgggcaagaaaacaattcgaattgcaattttacatctcgtgatggctctatctctccagtttccagcgagtgttcagtggtcgagcgtaccatacctgtttgtagagaatctagacgtaaaagaaaaagctatattgtaatgagtccggagagcccggtaaaatgcgggacccagacctccagtcctcaggtactgaatagtagtgcttcatactctgagaatagaaaccaaccagtggatagcagtttggcttttccctggacatttccattcggaatcgacaggaggattcagccagagaaagttaagcaggccgagaacacgcgcacactcgagctgccaggaccttcggagactgggcgccggatggccgactacgtcacttgtgagtctacaaaaacaacactcccacttggtaccgaagaggacgtcagagtgaaagtggaacgcttgtccgacgaagaggtccatgaggaggtgtctcagcctgtaagtgctagccaatcaagcctgtcagatcagcagactgtacccggctccgaacaagtgcaggaggatctgttgatatctcctcagtcatcctccatcgggagtgtcgacgagggggtttccgaggggttacccacattacaatccaccagctctactaacgcaccgccagatgacgatgaccggctggagaacgttcagtatccctaccaactgtatatcgccccttcaactagcagtactgagagaccctcccccaacgggccagatagaccgttccagtgtcccacctgtggggtccgattcacaagaattcagaatcttaaacagcacatgctcatccactctggcattaagcccttccagtgtgatagatgtggcaagaaattcacaagggcctactcactgaagatgcaccgcctgaaacacgaggttattagctag

SEQ ID NO: 52484 - DNA, 1425 bp, Artificial Sequence
  Description of Artificial Sequence: Synthetic coding sequence
atgggcgtgaagaccttcacccacagcagcagcagccacagccaggagatgcttggaaagctgaatatgctgagaaatgacggccacttttgcgacatcaccattagggtgcaagataagatctttcgagcacacaaggtcgtactggcagcatgtagtgatttctttcgcacgaagttggtcggacaggctgaagatgaaaataaaaacgtcctggatctacaccatgtcacagtgaccggtttcatcccgctgcttgagtacgcatatacggccacgttgtccatcaataccgagaacatcattgatgtgcttgccgctgcctcatatatgcagatgttttcagtcgctagcacgtgtagcgagttcatgaagtcaagcattttgtggaatactccaaacagccagcccgagaaggggctggatgctggccaggaaaacaatagtaattgtaatttcacatctcgcgatggcagcatatctcctgtgagctctgaatgttccgtcgtggaaagaaccatcccagtgtgccgcgagtcaaggaggaagcgaaagtcctatattgttatgtcacccgaatcacccgttaagtgcgggacacagacttctagcccacaggtgctcaactcctctgcctcctacagcgaaaaccggaaccagcctgtcgacagttcattagcgtttccatggactttcccctttggaatcgaccgacgtattcagcccgagaaggttaaacaggctgaaaatacccggacccttgagctccccgggccctccgagacagggagacgcatggctgactatgtgacttgcgaaagcacaaagacaaccctacccctgggaaccgaggaagacgttagggttaaagttgaacgtctgtccgacgaagaagtccacgaggaagtaagccaacccgtgtctgcatcccagtcgtctctcagcgatcaacagacagttccgggcagcgaacaggtccaagaagacctgctaatttctccccagtcatcttcaatcggctccgtggatgaaggagtgagtgaggggctgcccactctgcagtccacaagtagtacaaacgcccctcctgatgatgacgatcgcctggaaaatgtgcagtatccctaccagttatatatcgccccttcaacctcatccactgaacgcccatcgcccaacggtcctgatcgacccttccaatgccccacctgcggcgtgcgctttacacggatccaaaaccttaagcagcacatgttgattcacagcggaataaagccatttcagtgcgatcggtgcggcaagaagttcacacgtgcctactccctgaaaatgcataggctgaagcacgaagtccctctgcagcgccagggcaccatgattgacaattcacaggcagtggatgagatgactaggaacggcgagtag

SEQ ID NO: 52485 - DNA, 231 bp, Artificial Sequence
  Description of Artificial Sequence: Synthetic coding sequence
atgaagggcggcagccgggtgagcaaccccgccgtgatggcccaggaggaagaggatgtaagggactacaatttgactgaggaacagaaagcaatcaaggccaagtacccgccagtgaaccgcaagtatgaatatcaccagactcacctactgcaatccccacataggatctactcacatctacattcgagtgccatctggaatccatacctgcacctcatggggacctag

SEQ ID NO: 52486 - DNA, 411 bp, Artificial Sequence
  Description of Artificial Sequence: Synthetic coding sequence
atggcccaggaggaggaggacgtgcgggactacaacctgaccgaggaacagaaggccatcaaagccaaatatcccccagtgaacaggaagtacgagtatctggatcacacagccgacgtgcagcttcatgcatggggggataccttggaagaagctttcgaacagtgtgcaatggccatgtttgggtacatgacggacacaggtacggtagagcctctacaaacagtcgaagtggagacacagggcgacgatctccagtcgctcctctttcattttctcgacgaatggctgtataaattcagcgccgatgaatttttcatacctagggtcggccgcagaatctttatcgtacaggcaccaagcggcaatagatcgcagtcaaacaatatcttctccaacgccgggctgtag

SEQ ID NO: 52487 - DNA, 444 bp, Artificial Sequence
  Description of Artificial Sequence: Synthetic coding sequence
tgaggcggcagccgggtgagcaaccccgccgtgatggcccaggaggaagaggacgttagagactacaatctgacggaggagcaaaaggccattaaagctaaatatcccccagtgaatcgaaaatacgaatatctggaccacacggccgatgtccagttacacgcctggggggacacccttgaagaggcttttgaacagtgcgccatggccatgttcggctatatgacggatacgggcaccgtcgaacctttacagacagtcgaagtggaaacacagggggatgatttacagtctttgctgtttcattttttggacgagtggttatataagttctccgccgatgagttcttcatacccagagttggccggagaatttttatagtacaggccccttctggaaacagaagccagtcgaacaatatcttttcaaacgcgggattgtag

SEQ ID NO: 52488 - DNA, 540 bp, Artificial Sequence
  Description of Artificial Sequence: Synthetic coding sequence
atgaagggcggcagccgggtgagcaaccccgccgtgatggcccaggaggaagaagacgtaagggactataacctgacggaagaacagaaagcgatcaaagctaagtacccacctgtgaacaggaagtatgaatacctagaccacaccgcagacgtgcagctgcacgcgtggggagataccctagaagaggctttcgagcagtgcgccatggcaatgttcgggtatatgactgacaccggtactgtggaaccacttcaaaccgtggaggtggaaacccagggagacgacttgcagagcctactgttccactttctggatgagtggctgtacaagttttccgctgatgaattctttataccaagggaagtgaaggtgcttagcattgaccagaggaattttaagcttaggtctattggctggggtgaggagttcagcctcagcaaacaccctcaaggaactgaagtgaaagcaatcacctatagtgccatgcaagtgtataatgaagagaatccagaagtctttgtgatcattgatatttag

SEQ ID NO: 52489 - DNA, 1488 bp, Artificial Sequence
  Description of Artificial Sequence: Synthetic coding sequence
atggccgccaactggaccctgagctggggccagggcggcccctgcaattcccccgggagcgataccccacgctccgtagcttcccccgagacacagctgggaaaccacgaccgtaatccggagacatggcacatgaatttcagaatgttctcatgccctgaggaaagcgatccgattcaggccctgagaaagctgaccgaactctgccacttgtggttgagacccgacctgcatactaaagaacagatcctcgatatgctggtgatggagcagtttatgatctccatgccacaggagctccaggtgcttgtgaaggtgaatggggtacagagctgtaaggatctcgaagacctgttgcgcaacaatcggcgccctaagaaatggtcgatcgtgaatctgctcggcaaagagtatttgatgctcaacagtgacgtcgaaatggctgaagccccagccagtgtacgagacgatccccgcgacgtttcatctcagtgggctagctccgttaaccagatgcaccctggaacagggcaggcccgacgagaacaacagattctccccagagtggccgccctgagtagaaggcagggggaggacttcctcctccacaaaagcatcgacgtgacgggagacccaaattcccctcggcccaaacaaactctggagaaggatttgaaggagaatcgcgaggagaaccccggactgagctcccccgagcctcagctgccaaaaagcccaaacctcgtgagggctaaggagggaaaagaaccccagaaacgagcgagcgttgaaaacgtggatgccgataccccctcagcctgcgtagtagaacgggaggcacttacgcatagcgggaaccggggggacgccctgaatctgagttcccctaaaagatctaagcccgacgctagctccatcagccaagaggagccacaaggggaggcgacacccgtgggtaacagggagagtcctggacaagcagagatcaacccagtccattctcccggccccgccgggccagtatcacacccggacgggcaagaagccaaggctctgcccccctttgcttgcgatgtatgtaacaaatccttcaagtattttagccagctgagcattcatcggcgttcccatactggtgaccgcccctttcaatgtgacctgtgtcggaagagatttcttcagccgtccgacctccgcgtgcatcagcgcgtgcacaccggagaaagaccttacatgtgcgatgtgtgtcagaaacgattcgcccacgagtccacgctgcagggacataaacgaatccatactggcgagcgtccttttaaatgtaaatattgcagtaaggtgtttagccataagggtaacctgaatgtacatcagagaactcacagtggcgaaaagccttacaagtgtcccacatgccagaaggcttttagacagctaggaactttcaaaagacacttgaaaacccacagggaaaccacctcacagtag

SEQ ID NO: 52490 - DNA, 1491 bp, Artificial Sequence
  Description of Artificial Sequence: Synthetic coding sequence
atggccgccaactgcaccagcagctggagcctgggcgagagctgcaattccccaggctccgagccgccgcagtcgatgccaagccccgccacccagttgggaaaccatgattcggatccagaaacttgccacgtgaattttaggatgttctcgtgccccaaagagtccgacccaatccaagcactgcgaaaacttactgagctgtgtcacttatggctccgcccggacttgcacactaaggaacagatcctggacatgctggttatggagcagttcatgataagcatgccccaggagctgcaagtgctagtgatgatgaacggagtacagagctgcaaagacctagaagatttactcagaaataacaggcgccccaaaaaatggtctgttgtgtcattcctcggaaaagagtacctgatgcaggaatctgacgtcgagatggcggaggctccagccagtgtgcgcgatgatccacgacatgtctctagccaacgcaccagctccgtcaaccagatgtgcccagaagaaggccaggccagccaagaactgcagactctgccacgtgttccagctttgttccggcgccaagaagaggatttcctgctgccagagactactgtgatgaagggtgatccaaaggcgctccgccccaaaccgacactcgaaaaggatctcgaagaagatcgggaagagaacccgggattgacctcgcctgagcctcagctgcctaactcaccaactggagtagtcggcgccaaagaaggcaaagaaccccaaaaaagggcctccgtggaaaatgtagacgcagacacaccaagcgcttgtgtggtagaaagggaggccagcactcactcaggaagtcgcggagatgcgctgaatcttagagggctgaagagaagcaaacctgacgccacttctatctcacaggaagagcctcagggcgaagctacacccgtgggaaaccgggagtctccagggcaggctgaaatcaatcccgtgcattctcctgggccagcgggacctgtctcccaccccagcggacaagaggtgaaagagttactgccttttgcctgcgaagtctgtggtaagcgctttaaatacagaggaaagctcgcagttcatacacgctctcacacgggggagaggttgttccagtgcaatctgtgcgggaagaggttcatgcagcgtattgggctccagttccatcaacggacccacaccggtgagagaccttacacttgtgacatatgccaaaaacaattcacgcagaaaagttacctgaagtgtcataagcgcagtcacactggagagaaacccttcgaatgtaaggattgcaaaaaagtcttcacttataaagccaacctgaaggaacatcagcgaatccattctggggaaaaaccgcacaagtgctccaaatgcccaagggcattcggccgtccagcaacactgcgccgacaccagaagacccaccgggaagcaacatctcaatag

SEQ ID NO: 52491 - DNA, 1491 bp, Artificial Sequence
  Description of Artificial Sequence: Synthetic coding sequence
atggccgccaactgcaccagcagctggagcctgggcgagagctgcaactcacccggatcagagccaccccagtctatgccaagtccggccacacagcttggaaaccacgattctgacccagagacttgccatgtgaacttccgaatgttcagttgtccaaaagagagcgacccaatccaggctctgaggaaattgacagagctttgccacctctggttgcgaccagacttgcatacaaaagaacagattctggatatgttggtcatggagcagtttatgatctccatgcctcaggagctgcaggttttagtgatgatgaacggtgtccagagctgtaaagacctggaagatctgctcagaaacaatcgccgaccaaagaaatggtccgttgttagctttctgggcaaggagtatttgatgcaggaatctgatgtggagatggcagaggcgcctgcctcggtgcgagatgaccccagacatgtgtcatcacagcgaacatcctccgtgaaccagatgtgtcccgaggaaggtcaggccagccaagagctccaaacccttccccgcgttcctgcactgtttaggaggcaggaggaggactttctactccctgaaacaaccgttatgaagggggatcccaaggccctgaggcctaagcccaccctcgaaaaggacttagaggaggaccgggaagaaaacccaggcctgacatctcccgaacctcagttgcctaattcccctaccggtgtggtcggcgccaaggaggggaaggagcctcagaagcgagccagtgtggagaacgtagacgccgataccccctctgcctgcgtggtggagagagaggcttcgacacacagtgggtcccgcggcgatgcccttaatttgcgcggattaaaaaggagcaagccagatgcgacatccattagccaggaggagccacagggggaagctactcctgtcgggaatcgggaaagtcccggccaggccgagataaatccggtgcactcacctggccccgccggcccagtgtctcatccatccggacaggaagtgaaggaactgctccctttcgcttgtgaagtgtgcgggaaacgctttaagtaccgcggcaagctcgctgttcatacccgctcccataccggtgagcggctctttcaatgcaacctgtgcgggaaacggtttatgcagagaattggcctgcaatttcaccagcggacccacactggcgagcgtccttatacttgcgacatctgtcagaaacagtttacccagaaatcgtatctgaagtgtcacaaaaggagtcacacaggggagaaacccttcgaatgcaaggattgcaagaaagtattcacttacaaagcgaatctgaaagagcaccagagaatccactccggggagaaaccacacaaatgcagtaaatgtccccgggctttcgggagacccgccactctccgccggcaccagaagacacatcgcgaagcgacgtcccaatag

SEQ ID NO: 52492 - DNA, 2316 bp, Artificial Sequence
  Description of Artificial Sequence: Synthetic coding sequence
atggagaaggtgcagctggagttcgagaaccaggagatggagaagaaactgcaagaattccggagcacgcgcaataaagagaaggaagaccgcgagtcttctgagtactattggaagtctgggaaggtcggcaagctcgtgaaccagagctacatgatgtctcagaacaagggcaacgtcgtgaaattctccgccggaaaggtgaagttgaaactgctgaaggagcagatccaggagcctgtaaagcccactgtcaactataagatggcaaattcgtccgagtgcgaaaagcctaaaattaatggcaaggtttgcgggcagtgcgaaaacaaggcagcactgttggtgtgtctggagtgcggggaggattactgcagtggttgtttcgcaaaggtccatcagaaaggcgccctcaagctccaccgcactacactgctacaagctaagtcgcagatcctgttcaatgtgctggatgtagcccatcagtttatcaaagatgtcaaccctgacgagccaaaggaagagaataactccacaaaagagaccagtaagatccagcacaaacctaagtccgtgttgctccagcgtagctcgtccgaggtggagattaccaccatgaaacgggcacagaggacaaagcctaggaaatccctgctgtgtgaaggatcattcgacgaggaggcctctgcccaatcatttcaagaagtcctgagccagtggcggactggaaaccatgatgataataagaagcaaaacctgcacgctgcagttaaggactccctggaggagtgcgaagtccagacaaaccttaaaatctggagggagccccttaacattgaattgaaggaagacattctttcttacatggaaaagttgtggctgaaaaagcatagacggaccccacaagagcaactgtttaaaatgcttccggacaccttcccccacccccatgagacaactggggatgctcagtgtagccaaaatgagaacgatgaggactctgacggggaagagacaaaggtccagcataccgccctgcttcttccagtggaaaccctgaacatcgaaagaccagaaccttccctgaaaattgtggaactggatgatacatacgaggaggagttcgaggaggctgaaaatatcgtgccctataaggtgaagcttgcagacgctgacagtcagcgaagttgcgcctttcatgactgtcaaaagaactcgttcccttacgaaaatggcatccatcagcaccatgtctttgacaaaggcaagagggattttctcaatttgtgcctgcgtaactctagtacatactacaaagataacagcaaggccgaaacttccaacaccgatttcgataatattgtggaccccgatgtgtacagctccgatattgagaaaatcgaagagtccacttcctttgaacgcaatctgaaggaaaagaacatcggtctagagtcaaaccagaagagcgatgactcctgcgtgtcactggagtccaaagatactcttcttgggagagacctagaaaaggcccccattgaggaaaagctatcgcaggatatcaaagagagcctggagctttctaacctgtataaaagaccaagttttgaggagtccaaaactaccaagtcaagtctcctccttcaagagatcgcgtgcaggagcaaaccaattacaaaacaataccagggccttgagcgattttttatcttcgataccaatgagagactgaatctgctacctagccaccgcctggaatgcaataactcctcaaccaggatcacactcgctggccagaagagccagcgcccgtcaacagccaactttcctctgtctaactcagtcaaggagtcctcttcctgcttatcaagctctcaccccaggtccagaagcgcggccgcacaatcctccagtcgcgcagcttccgaaatctccgagatcgagtacatcgatattaccgaccaaaatgagttgtcactggatgacaccaccgatcagcatactttggataatctggagaaggaactgcaggtgcttcgctcccttgccgatacatctgaaaagttgtattcattgacttccgaggagtttcccgattttagtagtcaatccctgaacatctcccagatctctacagactttctgaaaacatcgcatgtgcgcggcccgtgtggggttgaggagttaagctgttccggccgggacacaaagattcagtcactgctgagcctctctgagagcagcaccgatgaggaagaggaggacttcctcaacaaacaacatgttattacgttgccgtggagtaagtcgacatag

SEQ ID NO: 52493 - DNA, 2082 bp, Artificial Sequence
  Description of Artificial Sequence: Synthetic coding sequence
atgatcgcccccctgctgtgcatcctgagctacaacttcaacacctttgctatattaaatgtttacagcaagcttactatgttctgtacgacaaattccctgccaatggatctcttgctcaagcagggttctctcaagcaggaagttgaatccttctgctatcagatcgtgagtgagagtaacgatcagaaagtgggaatcctgcaaagcgaagacaaacagctacaacccagtgtatctaaaaaatcagaaggagagctgagtagggtgaaattcattagcaactctaataagataacatttagcaaaaagcccaagcgccgcaagtacgacgaaagttacctgtctttcgggtttacgtattttggaaatagagacgcccctcatgcccaatgcgtgctgtgcaagaagatcctgagcaacagctccttggccccctccaaacttcgtcgacatctcgagactaaacacgcggcctataaggataaggacatctcctttttcaagcagcacttggacagccctgagaacaataagccgccaactccaaagatagtcaatacggacaacgagtcagcgactgaggccagctataacgtgtcttatcacatagcactctccggcgaagctcataccataggggagctgcttatcaaaccctgcgctaaggacgtggtgatgcgtatgttcgacgagcagtacagtaagaaaatcgacgctgtacagcttagcaatagcaccgttgctcggaggatcaaagatctcgcggccgatatagaggaagaactggtttgcagattaaagatttgcgatgggttcagtctgcagctcgacgaatccgcagacgtgtcaggtctcgcagtgttgctggtgtttgtaaggtatcggttcaacaaatctattgaagaagaccttctgctgtgcgaatctcttcagtcaaacgccacaggagaagaaatctttaattgtatcaattctttcatgcaaaagcacgaaatcgaatgggaaaaatgtgtcgacgtgtgtagcgacgccagccgggccgtggatggaaagatcgccgaggcagtcaccctcatcaaatatgtggctccggaatcaacctcttctcactgcctgctgtatagacatgctctagctgtgaagattatgcctacctcattgaagaacgtgctcgatcaggccgtccagattattaactacattaaggcacgcccgcaccaaagtcgtttgctgaagatactttgtgaggagatgggcgctcagcatacagcactactcctcaacaccgaggttcggtggttatcccggggaaaagtcctggtccgattgtttgagctccgcagagagcttctggtttttatggactccgccttccggctgtccgactgcctcactaattcttcatggttactacggctcgcgtacttggctgacattttcacaaagctgaacgaagtgaatctgtctatgcaagggaaaaacgtaaccgtcttcaccgtctttgacaaaatgtcatcgttattgcggaagctcgagttttgggcaagcagtgtcgaggaggaaaattttgattgtttcccaacgttgtccgactttctcaccgaaattaattccactgtagacaaggacatctgctccgccatcgttcagcatcttcgtggcctccgcgctaccctactcaagtactttcctgtgacaaacgacaataacgcgtgggttaggaatccctttactgtcaccgtgaagcccgcctcactggtggctcgggattatgagtccttaatcgacctgacctccgacagccaagttaaacagaattttagtgaactcagcctgaacgatttttggagtagtctcatccaagagtatcccagtatcgctcgccgcgctgtcagagtcttattgccttttgcaacgatgcacttgtgtgagacgggtttctcctattacgctgcaacaaagaccaagtaccggaagcggttggacgcagccccgcatatgcgaattcgactgagcaacatcacacctaatatcaaaaggatatgcgataagaaaactcaaaaacactgcagtcactag

SEQ ID NO: 52494 - DNA, 2082 bp, Artificial Sequence
  Description of Artificial Sequence: Synthetic coding sequence
atgatcgcccccctgctgtgcatcctgagctacaacttcaacacctttgcgatcctgaatgtgtactcaaaacttaccatgttttgcaccactaactcactgccgatggatctactcctgaagcagggttcactcaaacaggaggtcgagtcgttctgttatcagatcgtgagcgagtccaacgaccaaaaagtaggtatactgcagtcggaggacaaacaactccaaccttctgtgtccaaaaaatcggagggggaattgagtcgggtaaagttcatctctaactctaacaagattacattttctaagaagcctaaaaggcggaaatacgacgagagctacctgtcattcgggtttacctactttggcaatagggacgcgcctcacgctcagtgtgtactgtgtaagaaaattctaagtaacagctcactggcaccatcaaagctgaggcggcaccttgagaccaaacacgccgcctacaaagataaagacatcagcttctttaagcagcatctagattcccccgaaaataacaagccaccaactcccaaaatagtgaacaccgacaacgagtccgctactgaggcgagctataacgtgagctatcacatcgccctctccggagaggctcatacgatcggggagttactgattaaaccatgcgcaaaggacgtggtcatgaggatgtttgacgagcaatacagcaaaaagatagacgcagtgcagctgtctaatagcactgtcgccaggcggatcaaggacctcgccgcagatatcgaagaagagctagtttgtcgcctgaaaatttgtgacggttttagtctgcagttagatgaatcagccgacgtctccgggttggcagtgctgctggtttttgttcggtatcgatttaacaaatccattgaagaagatctattactgtgcgagagcctccagtctaatgcaactggcgaggagatattcaattgcatcaatagtttcatgcagaaacacgaaattgagtgggaaaaatgcgtggatgtgtgctctgacgcttctagggccgtggatgggaaaatcgccgaggcagtcaccctcatcaaatacgttgcccctgagtctactagctcccattgtctcctatatcggcacgccctggcagtcaagattatgcccactagccttaaaaatgtgctggaccaggctgtgcaaattatcaattacattaaggcccgcccccatcagagcaggctgctgaagattctttgtgaggagatgggggcgcaacataccgcccttctgctcaatacagaggttcgctggctgagccgcgggaaagtgctcgtgcgcctcttcgaactgagaagagaactgctcgtgtttatggactccgcgtttcgcctcagcgactgcctaacaaatagctcctggctgcttaggttggcctatctggcagatattttcaccaaactgaacgaggtgaacctaagcatgcagggcaagaacgttactgtgtttacagtgttcgacaaaatgagcagcctccttagaaagctggaattctgggcctcttctgtggaggaagagaattttgactgctttcccacgctgagcgactttctaaccgaaataaatagcactgtcgacaaggatatctgttcagcgatcgtacaacatctgcgaggcctgcgggccacactacttaaatattttcccgtgacaaacgataataatgcgtgggtgcgcaaccctttcacggtgaccgtcaaaccagccagcctcgtagcgcgagattacgagagcttgattgacctgactagcgatagccaggttaaacaaaatttctctgagctaagtttgaatgatttctggagctcattgatccaggagtaccccagcatcgcgaggagggctgtacgtgtgcttctcccattcgcaactatgcacctttgcgagaccggcttcagttactacgcagctaccaaaacaaaatacagaaagaggctggacgcggccccgcacatgagaattcggctgtcaaatatcactccaaatataaagcgtatctgtgacaaaaagacacagaaacattgctcccattag

SEQ ID NO: 52495 - DNA, 1305 bp, Artificial Sequence
  Description of Artificial Sequence: Synthetic coding sequence
atgcccgaccgggacagctacgccaacggcaccggcagcagcggcgggggacccgggggcggtgggtccgaggaagcctctggcgccggtgtcgggtccggaggtgcttcttccgatgcaatttgccgagacttcttacgaaatgtatgtaagcgcgggaaaagatgtcgctatcgccatcctgacatgagtgaggtgtccaacctgggcgttagtaagaatgagttcattttttgccatgacttccagaacaaggaatgttctcgccctaattgtagattcatccatggatctaaggaggatgaggatgggtacaagaaaacgggcgagctccccccccggcttcgccagaaagtcgcggccggactgggactctcccccgcggatctgcccaacggaaaagaggaggtacctatttgccgtgacttcctgaagggggactgccaacggggagcaaagtgtaaatttagacaccttcagcgggatttcgaattcgatgcaagagggggaggggggacagggggaggaagcaccgggtccgttttgccgggccgtcgacacgacctgtatgacatttacgacctgcccgataggggttttgaggaccatgaaccagggccaaagcgaaggcgtggggggtgttgtccacccgacggcccccactttgaaagctacgagtattccctcgccccccctcggggggtggagtgccggttgttagaagaagaaaatgccatgctccgaaagagagtcgaagaactgaagaagcaggtttccaaccttttagcaacaaatgaggtgctgctcgagcagaatgcccagtttcgtaatcaggccaaagtgataaccctgtcttcgacagccccggccacggagcagaccttggcacccaccgtgggcacagtggcgaccttcaatcacggtatagcccagactcacaccactctcagcagtcaggctctccagccccggcctgtgtctcagcaggagctcgttgccccagccggggccccagctgcccccccgactaacgcggcgcccccagccgcgccccctccgcctccaccgcatcttacccccgaaataacaccattatctgccgccctcgcccaaactatcgcccagggtatggccccaccccccgtatcaatggcccctgtggctgtgagcgtagctcctgtagcccctgttgcggtctccatggcccaacccttggctggcataacaatgtcacacacaacgacccccatggttacctaccctattgcttctcagtccatgaggattacagctatgcctcactag

SEQ ID NO: 52496 - DNA, 270 bp, Artificial Sequence
  Description of Artificial Sequence: Synthetic coding sequence
atgcccgaccgggacagctacgccaacggcaccggcagcagcggcggaggacccggaggcggcggttccgaggaagcatctggggcaggggtgggctcgggcggagcttcttccgacgctatctgcagagatttccttcgaaacgtctgtaaacgcggcaaacgttgcagatacagacatccagatatgtcagaggtttcaaatctgggtgtgagcaaaaatgagttcatcttctgccatgactttcagaacaaagagtgctcgcgatag

SEQ ID NO: 52497 - DNA, 138 bp, Artificial Sequence
  Description of Artificial Sequence: Synthetic coding sequence
atgcccgaccgggacagctacgccaacggcaccggcagcagcggcggtggccctggggggggtgggtcagaggaagcttccggcgctggcgtggggtccggcggggcatcttcagatgccatctgtcgggacttctag

SEQ ID NO: 52498 - DNA, 240 bp, Artificial Sequence
  Description of Artificial Sequence: Synthetic coding sequence
atgcccgaccgggacagctacgccaacggcaccggcagcagcggcggcgggcctggcggcggtggctccgaagaggcatccggcgccggagtgggaagcggaggagcatcttctgacgccatatgcagggactttctgagaaatgtgtgtaagagagggaagcgctgccgctacaggcacccagatatgtctgaagtcagcaacctgggggtctccaagaacgaattcatcttttgctag

SEQ ID NO: 52499 - DNA, 5136 bp, Artificial Sequence
  Description of Artificial Sequence: Synthetic coding sequence
atgatcagcaccgcccccctgtacagcggcgtgcacaactggaccagctccgatcgcattagaatgtgcggcataaatgaagagagaagggcgccactgagtgatgaggagagtactaccggtgactgtcagcacttcggctctcaggagttctgcgtaagttcctctttttccaaagtcgagctgacagctgtgggttccggttctaacgcacgcggggctgaccccgatgggagcgctactgagaagctgggacacaaaagcgaagacaaaccagacgacccgcagccgaagatggattatgccgggaacgtcgccgaagctgaggggtttttggttccgctgtcctctcctggtgatggcctgaaactgcccgcttccgattctgccgaagcgtccaacagccgtgcagactgcagttggacacctcttaatactcaaatgtctaagcaagtcgactgctccccagcaggcgtcaaggcgctggactccaggcagggggttggagagaaaaacacatttatcttggccacgctgggaactggtgtgcccgttgaaggaacattgcctttagtgactaccaacttcagtcccctacccgcgcccatctgcccgcccgcaccaggctccgcctccgtgccacactccgtgccagatgcatttcaggtcccccttagtgtgcccgccccggtgccacacagcggcctggtccccgttcaggtggctacctctgtacccgctccatccccaccgttggcacctgtgccagccctggcccctgctcctccctcagtgcctacgctaatttctgatagcaatcctttaagtgtgtcagcctccgtccttgtgcctgtgcccgcttcagcccccccaagcggaccagtccccttgtcagcacctgctcctgcacctctgagcgtccccgtgtccgctcctcctctggccctgattcaggccccagtgcctccctcagcccctactctggtgctagccccagttcctaccccagtgctggcacctatgcctgccagcacgcccccagcagcgccagccccccccagcgtgcccatgccaacgccgacacctagcagtgggccaccgtccacacctacattgattcctgcattcgcccctaccccggttccagctccaactcctgctcctatcttcacccctgctcctacacccatgccagccgcaacccccgcagccattcctacaagcgcccccatccccgcctccttctctctgtccagagtctgcttccccgcagcccaagcccccgctatgcaaaaggtgccccttagcttccagcccggaaccgtgctcaccccctctcagcccttggtctacatacctcctccttcctgcggtcaacctctctctgtcgccaccctccccactactctcggagtaagttcgaccctgaccctgcctgtgctcccctcctacctgcaagacagatgccttccaggagtactggcctcgcccgagctcagaagttatccatacgcattctccgtggcccggcctctgactagtgattcgaaactggtctctcttgaggtcaatagactcccgtgtaccagcccctctggctccacaactacccagcccgcccctgatggcgtcccgggccctttggcggatacctctctggtcacagccagtgccaaggtgctcccaaccccccagccgctgctgcccgcgccctccggctcaagcgccccgccacacccagccaagatgcctagcggaacagaacaacaaaccgaggggaccagcgtgaccttcagtcccctgaagtccccgccacaactggaaagggaaatggcatcaccccccgagtgttccgaaatgcccctggacctcagttcgaagagcaataggcagaagttgcccttgcctaatcaacggaagacccctcctatgccagttcttaccccggtacacacatcttccaaagcactgttatctaccgtgttgtctaggagtcagcggaccacacaggccgcgggcgggaacgtgacatcatgcctcggcagtacaagttccccctttgtgatctttcccgagattgtccgcaacggtgatccgtctacctgggtcaagaattctacggcgctgatctctaccatcccagggacctacgtcggtgtcgctaacccagtgcctgcctctctgttgctcaataaggaccccaatctcggcctcaatcgggatccgagacacctgccaaagcaggaacctatctctattattgatcagggagagcccaaaggaaccggcgcaacttgcgggaaaaaaggctcccaggcaggcgcagaagggcaaccatcaactgtgaagaggtatacgccagcacggatcgcccctggcctgcctggctgtcagacaaaggaactgtcactgtggaagccaaccggcccggcaaatatctacccacgttgcagtgtgaacggcaagcctacatccacacaagttctgcccgtgggttggtcaccctaccaccaggcatcactgcttagcattggaatttcgagcgcaggccagctgacgccatctcagggcgctccaatccgacctaccagcgttgtgtccgagtttagcggtgtaccttctctcagcagttccgaagctgtccacggtctcccggagggtcagccaaggcctggcggcagctttgtgcctgaacaggacccagtgacgaagaataagacatgccgaatcgccgcgaagccctatgaggagcaggtgaatccagtgctgcttactctctcaccccagaccgggacactcgcactctcagtacaaccttccgggggtgatattcggatgaaccaggggccggaggaatcagaatcacacctgtgttccgattctacccccaaaatggagggaccgcagggggcctgcgggttaaaactggccggggacactaagcccaagaatcaggtgctcgctacatatatgagccatgagctggtgctagccacacctcagaacctgcctaaaatgcccgaactaccacttttaccacatgatagtcatccgaaggagctcattttagacgttgtcccttcctcccgacggggcagctccacagagcggccacagctgggaagtcaagttgaccttgggcgcgtaaaaatggagaaagtcgatggggatgtggtgtttaatttagctacctgcttccgggcggacggcctgccagtggcaccccagaggggacaggctgaagtgagggccaaggccgggcaggcccgagtgaagcaggagagcgtgggggtgttcgcgtgtaaaaataagtggcagcctgatgacgtgacggaatcacttccaccaaagaagatgaagtgcggcaaagaaaaggactctgaggagcaacagctgcagccacaagcaaaggctgtggtcaggtcaagccaccgccccaaatgtagaaagcttccaagcgacccacaggagtccaccaagaaatctcctcggggcgcatccgattctggaaaggagcacaatggggttcgaggtaaacacaagcacaggaaaccgacaaaaccagagtctcagtctccagggaaaagagccgacagccacgaggaaggtagtctggagaagaaggcgaagtcaagctttcgcgatttcatacccgtagtcctcagcactaggactcgctctcaatccggcagcatttgcagttccttcgctggcatggccgactccgatatggggtcacaggaagtttttcctactgaggaagaggaagaagtgactcctacgcctgctaaaaggcggaaagtgaggaagactcagcgcgatacacaatatcggtctcatcacgcgcaggataagagtctgttgagtcagggccgccgccacctttggagagcccgggagatgccgtggcgaacagaggcggctcgtcagatgtgggacaccaacgaagaggaagaggaagaggaggaggagggactgctgaagaggaaaaagcgcaggcgacagaagtctcgaaagtaccagacgggcgaatacctcaccgaacaggaggatgagcagaggcgcaagggccgggccgaccttaaagcgcgaaagcagaaaacgagcagctcacagagcctggaacatcggcttcgcaaccgcaacctcctgcttcctaacaaggtccaaggcatttcagatagtcccaacggattcctgcccaataacctggaagagcctgcatgcctggaaaattcggaaaagccatcaggtaagcgcaaatgcaagactaagcacatggctacggtgtctgaggaggcaaaggatgtggtcctttattgcctgcaaaaggattcagaggatgtcaaccatagagacaatgctgggtatactgccttgcatgaggcttgttcgcgggggtggactgatatcttgaatatcctgctggaacacggagccaatgtgaactgttcagcccaggatggaacgcgcccagtgcatgatgccgttgtgaatgataaccttgagaccatttggctccttttgagctacggcgccgatccaaccttggcaacctatagcgggcaaacggccatgaagctcgccagctcagacaccatgaaaaggttcctgagcgaccacttatctgacctccagggcagggccgaaggagacccaggtgttagttgggacttctatagctcaagtgttttggaagagaaggacgggttcgcttgtgacctgctccacaaccctccggggtcctccgaccaggagggcgatgacccaatggaggaagatgacttcatgtttgagctcagcgacaaaccgctgttgccctgctacaacttacaggtgtccgtgagcagagggccatgtaactggttcctcttcagtgatgtgcttaagagactgaagcttagtagtcggatattccaggccaggttcccacatttcgaaatcacaaccatgcccaaggccgagttctatcggcaagtagcctcttcccagctcctgaccccagctgagagacctggggggctagatgatcgatctcccccaggctcatccgagactgttgaactggtgagatacgagcccgacctcttgcgactcctgggcagcgaggtggagtttcagtcatgtaacagctag

SEQ ID NO: 52500 - DNA, 2511 bp, Artificial Sequence
  Description of Artificial Sequence: Synthetic coding sequence
atgaccgccaccgccgaggtggagacccccaagatggagaagagcgcctccaaggaggagaaacaacagcctaaacaagattcgactgagcagggtaatgccgactccgaagagtggatgtcgtctgagagtgacccagaacaaatatctcttaagagttccgacaacagtaagtcttgccagccaagagatggccaattgaagaagaaggagatgcatagtaagccacatcggcaactctgtaggagtccatgtctggacagaccctcattctctcagagctccatcctgcaggacgggaagctggatttagagaaggaataccaggctaaaatggaattcgctctcaaactgggctatgccgaggaacaaatccagtcagttcttaacaaactcggtccggagagccttatcaatgatgtcctggcggagttggttcggctgggtaacaagggggacagcgagggtcagatcaacttgagcctgctggtgccgagaggacctagttccagagagattgcttcacctgaattaagccttgaagacgaaatcgataacagtgataacctgaggcctgtggtgattgacgggagcaatgtggcgatgtcccatggaaacaaggaggagttctcgtgtcgcgggattcagctcgcagtcgattggttcttggacaaaggacacaaggatatcactgtgtttgttcctgcctggcggaaagaacagtcccgccctgacgcacctataactgaccaagacatactcaggaagctggaaaaagagaagattctggtgttcactccatctcgccgggtacagggtcgaagggtggtctgctacgatgatcgcttcattgtgaaacttgcattcgacagcgatggcatcatcgttagcaacgataattaccgggatctgcaggtggagaagcctgaatggaagaagttcattgaagaacgactacttatgtacagcttcgtcaatgacaagttcatgccacccgatgaccctctgggaaggcatggcccttctttagaaaatttcctgcgcaaaaggccaattgtgcctgagcataagaagcagccctgtccctatggcaaaaagtgtacttacggacataaatgtaaatactaccatcccgaacgggccaatcaaccccagcggagtgtggcagatgaactgagaatatccgctaagctgtctaccgtaaagactatgtctgagggcacactggccaagtgcggcactggcatgagttctgctaaaggagaaatcacaagcgaagtgaagcgggtggcccccaagcggcagagcgacccatctattcgatcggtggcgatggaaccggaggagtggttatctattgccaggaaaccagaggccagctcggtcccctcactggttacagccctctcagtgcccaccatccccccgcctaagagccacgccgtaggagctctaaacactaggagcgcttcctctcccgtgccagggtcctctcattttccgcaccagaaggcctctttggagcatatggcctccatgcagtatcctccaatactggtaaccaattcacatgggaccccgatttcctacgccgaacaatatcccaagttcgagagcatgggggaccacggttattatagtatgcttggggatttctctaaactgaacattaactctatgcataatcgcgaatattacatggccgaagtggaccggggggtctacgcacggaatcctaatctctgcagtgatagcagagtgtctcacacccgtaatgataattactccagttataacaacgtttacctcgcagtggcagacacccacccagaagggaaccttaagcttcatcggtctgcaagccaaaataggctgcagcccttcccccacggttatcacgaggcgctgaccagagtgcagagttatggccctgaggactccaagcaaggccctcacaaacagtctgtgccacatctggctctccacgcccagcaccctagcacaggcactcgcagctcatgtccagccgattatcctatgccccccaatatacacccgggtgcaacgccgcagccagggcgagccctggttatgactagaatggacagcattagcgacagccgattgtacgagtcaaaccctgtgaggcaaagacggccacccctatgcagagaacagcacgcctcctgggatcctctcccttgcacaactgacagctatggatatcattcttatccgctttccaattccctgatgcagccatgctatgagcccgtgatggttcgctcagtcccggaaaagatggagcagctctggcgaaacccctgggtgggtatgtgcaacgactcacgcgagcacatgattccagaacaccagtaccaaacttacaagaacctgtgtaacatctttccgtcaaatatagtgttagccgtgatggaaaagaaccctcatacagccgacgctcagcagctcgcagcccttatagtagcaaaattgagggccgcacggtag

SEQ ID NO: 52501 - DNA, 2478 bp, Artificial Sequence
  Description of Artificial Sequence: Synthetic coding sequence
atggagaagagcgccagcaaggaggagaagcagcagcccaagcaggattctaccgaacaagggaatgccgacagtgaagagtggatgagtagcgagtccgatcctgaacagatcagtcttaagtcaagcgacaattcaaaaagttgccagccacgagacggacagctgaagaagaaagagatgcatagcaaaccacaccgccagctctgtcgaagcccttgcctggaccgacccagtttttcccagagcagcatccttcaggatgggaaactcgatctggagaaagagtatcaggccaagatggagtttgctctgaaacttggttacgccgaggagcagattcaatccgtgctaaataagcttgggcccgaaagcttgataaacgatgtacttgcagaactagtgagactcgggaataaaggcgactccgagggccagatcaatctgagcctgctcgtccccagggggccaagcagtagagagatagcctctccagagctctctcttgaggatgaaatcgataatagtgacaacttacgccctgtggtaatcgatgggtctaatgttgccatgtcccacggcaacaaagaagagttcagttgtcgggggatccagttggcagtggactggtttcttgacaagggccacaaagacataacagtatttgtgcctgcttggcgtaaagagcaatcgcgccctgacgcgcctattactgaccaggacattctgaggaaactggaaaaggagaagattttggtcttcactcctagtcggagagttcagggccggagagttgtgtgttacgatgatagatttattgtaaagctagccttcgattctgacgggattatagtatctaatgacaattaccgcgacctccaggtcgagaaaccagaatggaagaagtttattgaggagagactgctgatgtattcttttgtcaatgacaagttcatgccacctgatgacccactgggcagacacggcccgtctcttgagaactttctgcgaaaacgcccaatagttcctgagcataagaagcaaccctgcccatacggcaaaaagtgtacttatggacacaagtgtaaatactatcatccagagcgagccaatcagccccaacgaagtgtggcagatgaactcaggatctctgcaaagctctctacggtaaagactatgtccgagggcacactggctaagtgcggtaccgggatgagcagcgcgaagggcgagatcactagtgaggtgaagagagtggcaccaaaaagacagtcagaccccagtatccgcagcgtggccatggaacctgaggagtggctgtctattgccaggaaacctgaagcttcgtccgtgccatctctcgtcacagccctgtccgtgccgaccatccctcccccgaaatcccatgcggtgggcgcccttaatacccggtcagcttcctctcccgtacccggctctagtcatttcccccatcagaaagctagtctggaacatatggcatccatgcagtatccacccatccttgtaacgaacagccatggaacccctatcagctacgccgagcaatacccgaagttcgagtctatgggcgatcatgggtattatagcatgttaggcgattttagcaagctcaacattaacagcatgcataacagagagtattacatggctgaagttgaccggggcgtgtacgccaggaatcccaacctctgtagtgatagcagggtttcacacactaggaacgacaattactccagttacaataacgtttacctggccgtcgctgatacacatcctgagggcaacctgaagttacatcgctccgcctcccagaaccgcctccagccctttcctcacggttaccatgaggctctgacgcgtgtacagagttatggacccgaggacagcaaacagggcccacacaagcagagcgtgcctcatttagcactgcacgcccagcacccttccacagggacacgtagctcctgtcccgccgactatccaatgccccccaacatccatccaggcgcaacaccccagcccgggcgagcacttgtgatgaccaggatggacagcatctctgactcacggctatatgaaagcaatccagtgaggcagcggcggcctcctctgtgtcgggagcagcacgcttcctgggatcctcttccatgcactaccgattcatatggctatcacagctatccgttatctaactccctgatgcagccctgctatgagcctgttatggtccgcagtgttccagagaagatggagcagctgtggcggaacccatgggtcggcatgtgcaacgatagtagagagcatatgatcccggaacaccagtatcagacatataagaatttgtgtaacattttcccaagcaacattgttttggctgtgatggaaaaaaacccacacaccgcagatgcacagcagctcgctgcactgatcgtggccaaactcagggctgcccgttag

SEQ ID NO: 52502 - DNA, 2652 bp, Artificial Sequence
  Description of Artificial Sequence: Synthetic coding sequence
atgcccggcggcggcagccaggagtacggcgtgctgtgcatccaggagtatcgcaagaacagtaaggtcgaatcaagtacccgaaataactttatgggcttaaaagaccatctgggacacgacctcggacatctctacgtggaaagtacagaccctcagctcagccccgctgtcccatggagcactgtcgagaaccccagcatggatactgtaaatgtgggcaaagatgaaaaagaggcatccgaggaaaatgcgtccagcggcgactctgaggaaaacaccaactctgatcacgagagcgagcagctgggaagtatctctgtggaacctggacttatcaccaagactcatcgacaactgtgtcggtctccgtgcctcgagccacacattttgaaaaggaatgagattctgcaggatttcaagcccgaggaatcccagacgacctctaaggaggcaaagaagccaccagatgtggtgagagaatatcagacgaaactcgagttcgccctcaaacttggctacagtgaagaacaggtccaactggtgctcaacaaattgggaaccgacgctcttattaatgacattttaggagagctggtgaaactgggaaataaaagtgaggctgatcaaacggtgtctaccatcaacacaattactagggagacctcatccttggagagtcagcgctctgaatcccccatgcaagagattgtcactgacgacggagaaaacctgagaccaatcgtgatcgacggatcaaacgtagccatgtcccacggaaacaaagaagtgttcagttgccggggaataaaactggcagtggattggtttttggaacgcggacacaaagacattacggtattcgttcctgcctggcggaaggagcagagccggcctgatgctttgatcacagaccaggaaatccttcgcaaactggagaaggagaaaatattagtttttacgccttcccgtcgcgttcaagggagacgcgtggtttgttacgatgacagattcatcgtgaagttagctttcgagagcgatggaataatcgtttccaacgacaactacagagatctggccaacgaaaaacccgagtggaaaaaatttatcgacgagcgacttttgatgtattccttcgttaatgataagttcatgccccccgacgatcctctggggaggcacggccctagcctggataatttcctgcgtaaaaaacccatcgttccggagcacaagaagcaaccttgcccatacgggaagaaatgcacttacggacacaagtgtaagtactatcaccctgagcgggggtcacagccacagcgctcagtcgcggatgagctgcgcgccatgtcaagaaatacagcagctaagaccgccaatgagggaggcctggtgaaaagcaactccgtgccctgtagtacaaaggctgacagcacgtcagatgtgaaacggggagcccctaagaggcagagtgacccttccatccgaacccaggtctatcaggacttggaggagaagcttccaaccaaaaacaagctcgaaacgcgctctgtgccatccctcgtgtcgatccccgctaccagtacggcgaaaccacaatccactacctcactttctaatggacttccttcaggagtccacttccctccacaggaccagaggccacagggccagtacccgagtatgatgatggctactaaaaaccatggaaccccaatgccctatgagcagtacccgaaatgcgacagccccgtggacatcggctattatagcatgctgaatgcctatagcaacctgagtttgtctggtccaaggtcgccggagcggaggtttagcctggataccgactacagaataagtagcgtggccagcgattgcagtagcgaaggatcaatgtcatgtgggtcctctgacagttacgttggatacaacgacagatcttatgtgtcatctcctgatccgcaactggaggagaatttgaagtgtcagcatatgcacccacattcaaggttgaatccccagccttttctgcagaatttccacgaccccctcactagaggacagtcctacagtcatgaggaaccaaaattccaccacaaaccaccgctcccccatttggcattacatctgccgcacagcgcagtgggagcccgtagctcatgtccgggcgactatccgagccctccatcctccgcacattctaaggctccccatcttgggaggtccctggtcgccacccgcatcgacagcatcagcgacagtcgcctctatgatagttccccttccaggcagcgaaaaccttattcccgtcaggaaggcctaggttcatgggagcggccagggtacggtattgacgcctatggctaccgacagacttatagtctgccggacaacagtacccagccttgctacgagcaattcaccttccagtccctgcccgagcagcaagaaccagcatggagaatcccttactgtggcatgcctcaggatccccctagataccaggataacagagaaaagatatacatcaatctgtgcaatattttcccaccagaccttgtgaggattgtgatgaaacggaatccacatatgaccgatgcccagcagctggctgcggccatcctggtcgagaagagccagctaggctattag

SEQ ID NO: 52503 - DNA, 5007 bp, Artificial Sequence
  Description of Artificial Sequence: Synthetic coding sequence
atgagcaagatccggcggaaggtgaccgtggagaacaccaagaccattagcgatagtacttcacgccggccgtcagtatttgaaagactcggccctagtacaggctccacagccgagactcagtgtaggaactggctgaagaccgggaattgtctttacggtaacacttgccggttcgtgcatgggccatcccctaggggtaagggctatagctccaattacagacgcagccctgaacggccgacgggtgatcttcgagaacgcatgaagaataaaaggcaggatgtagacaccgaacctcaaaaacgtaataccgaagaaagtagtagtcccgtgcgcaaagaaagttctcgcgggcggcacagggagaaggaagatatcaaaattaccaaggagcgcaccccagagtccgaggaggagaacgtggaatgggagacgaatcgtgacgattcagacaacggagatattaattacgattacgtgcatgagctatctcttgagatgaagagacagaagatccagcgggagctgatgaaattggagcaggagaatatggagaagcgcgaggaaatcatcattaagaaggaggtgtctcccgaggttgtgcgatcaaagttgtcaccgtcaccctcgctgcgcaagagcagtaaaagtcccaagcgaaagtccagcccgaagtctagcagcgcatctaaaaaggacagaaagacttccgcagtgtcctctcctttgctcgaccagcaacgtaattctaaaactaatcaatcgaaaaagaaagggccacgcactccatctccaccaccgcctataccagaagatattgctctaggaaaaaaatacaaggaaaagtataaggtaaaggataggatcgaagaaaaaacacgcgatggcaaggatcggggacgagattttgaacgccaacgcgaaaagagagataaacccagatcaacaagcccagcgggccaacaccacagtcccatctcctcaagacaccacagcagttcttcacagtctggcagctctattcagcgacattctcccagtccacggcgcaagcggaccccaagccccagctatcaacgtacgctgacccccccactcagaaggtccgcaagtccatacccaagtcactctctgtcttcacctcagcgaaaacagtctcccccaagacaccggtctcctatgcgggagaagggcaggcacgaccatgagcggacctcgcagagccacgaccgacgacatgaaaggcgggaggacacccggggcaagcgggatagggaaaaagacagcagggaggaaagagaatatgaacaggatcagtcttccagtagagaccaccgggatgatagggagccccgggatgggagagatagaagggacgcccgtgatacgcgggacaggagggagctcagggacagcagggacatgcgtgattcacgtgagatgcgcgactacagtagggacacaaaggaatcgcgtgacccgcgtgacagccggagtacacgggatgcccatgattaccgagatagagaaggaagggacacccacaggaaagaagatacttatccagaagagagccgtagctacgggcggaatcacctgagggaggagagctctagaacagagatcagaaacgagtcaagaaacgagtccaggagcgaaattagaaacgaccgcatggggcgcagtcgaggtcgggtacctgaactccccgaaaaaggaagccgcggatcaagaggcagccaaatagacagccactcatctaactctaattatcacgactcctgggaaactcgaagtagctacccggaacgagatcggtatcccgagagggacaatagagatcaggctcgagattcctctttcgagaggcggcacggcgagcgggacagaagagacaatcgggagcgcgaccagcgccccagttccccaatcaggcaccaggggcgcaacgacgaactggaacgagacgagcgacgcgaagagcggcgagtggaccgggtggacgaccgaagggatgagagagcaagggaacgcgacagggagagggaacgggaccgggagcgggaacgcgaacgagagcgagaacgcgacagagagagggagaaagagagagaactggaaagagagcgggcccgcgagagagaacgcgaaagagagaaggagagggatagagaacgcgacagagacagggatcatgatcgcgaaagggaaagagagcgcgagagagacagagaaaaggagcgggagcgagagagagaggaacgggagcgggaacgggagagggagcgagagagggaacgggagagagaacgagagcgcgagcgagctcgcgaaagagataaagaaagggagcggcagcgcgactgggaagataaggataaagggcgagacgacaggcgcgagaagcgcgaggaaattcgcgaggaccgcaacccacgggacgggcacgacgagaggaaatcaaagaaaagatatcgaaacgagggtagcccttcacctcggcagtccccgaagcggcggcgcgaacactctcctgattctgacgcttataactcgggagatgacaagaatgaaaaacacagactgctgagccaggttgtccgtccccaggagtctcggagcctgtcaccaagccatcttactgaggatcgccaggggcgatggaaagaagaggacagaaaacctgaaagaaaagaaagctcccggcgatacgaggagcaagaactgaaagagaaggtgtccagcgtcgataagcaacgggagcagacagagattctggagagttctcgcatgcgagcacaggacatcatcggacatcaccagtcagaagatagggaaacctccgaccgcgcgcacgacgaaaacaaaaaaaaggccaagatacagaagaagccaatcaagaagaagaaggaggacgatgtgggtattgagcgggggaatatcgagaccaccagcgaagatgggcaggtgtttagtcccaagaagggccagaagaaaaagtcgatagagaagaaacgaaaaaaatccaagggcgacagtgacatatctgacgaagaggccgcccagcagagcaaaaagaagcgtggacccaggactcccccaatcaccactaaagaggaattagtggagatgtgtaacgggaaaaacgggatccttgaggattcacagaagaaggaagacaccgccttcagcgattggagtgacgaggacgtgcccgatcggacagaggtaacagaggcagaacacacagccactgcaacgaccccaggttctacccccagtcccctatcgtctctgttgcctccaccccctcctgtggcgactgcaacagccaccactgtcccagctaccttggccgccacgaccgccgccgcagctacaagcttcagtacaagcgccatcactatatccacaagcgcaacaccgacaaatacaactaataacaccttcgcaaacgaggacagccaccggaaatgccatagaaccagggtggaaaaggtggagacgccccatgtgaccatcgaagatgcccaacaccggaaacctatggatcagaagcgatcttcgagtcttgggagcaatcgtagcaaccgtagtcatacttctggtagactgcggtctcctagtaatgatagcgcgcatcgaagtggagatgaccagtccggccgaaaaagggtcttacattctggcagcagggaccgggagaagactaaatctttagagatcaccggcgaaagaaagtcccgcatcgatcagctcaaacgtggtgaaccttcccggagcacctctagcgaccgccaggacagcagaagtcactcatctcgccgctccagtcccgaaagcgatcgccaagtgcacagcagatcaggatcgtttgactccagagatcggctgcaggagcgcgaccgctatgaacacgaccgtgagagggaaagggaaaggcgagatacgagacagagagagtgggacagagatgccgacaaagactggccgagaaaccgggaccgcgaccgcctgcgggaaagagaacgcgagagagaacgggacaaaaggcgagacctggatagagaacgcgaaagactgatctccgacagcgtggaaagagatcgggaccgagaccgcgataggacctttgagtcctctcagattgagtcagtgaagaggtgcgaggccaagctggagggagaacacgaacgcgatctggagtcaacgagtcgcgacagcctcgcccttgacaaggaacggatggataaagaccttgggtcagttcagggttttgaggagaccaataaatcagaaaggaccgagagcttggaaggagacgatgagtcaaagttggacgacgcccacagcctggggagcggggccggcgaggggtacgagcctatttctgacgatgaacttgacgagattcttgcaggcgatgccgagaaacgggaggatcagcaggatgaagagaaaatgcccgaccctctcgacgtaatcgatgtcgattggtctggcctaatgccaaaacatccaaaagaaccacgggagccaggggccgctctcctgaagtttactcccggcgccgtcatgctgagagtgggaatctctaagaaactcgccggcagcgagctgtttgcgaaagttaaggagacatgccagagactgctcgagaaaccgaaagacgctgataatcttttcgagcacgagctcggggctttgaatatggccgctctgttgcgcaaggaggagcgggcctcccttctctccaacctcggcccctgttgtaaggcactgtgcttcagaagagacagtgccatcagaaaacagctcgtaaagaacgaaaaggggactattaagcaagcctatacatccgcacccatggtggataacgaactgctacgtctgagcctgcgtttgttcaagcgcaagacaacctgtcacgcccccgggcacgagaagacggaagataacaagctctctcagagttcgatacaacaggaactgtgtgtgtcctag

SEQ ID NO: 52504 - DNA, 4695 bp, Artificial Sequence
  Description of Artificial Sequence: Synthetic coding sequence
atgagcaagatccggcggaaggtgaccgtggagaacaccaagaccatttcagattctacttcaagaaggccaagcgtgttcgaaagattagggccgtccacaggaagcacagccgaaactcagtgcagaaattggttgaagaccggaaactgcctgtatgggaacacctgtcgattcgtgcacgggccttcaccccgaggtaaaggatattcttccaattatcgacgtagtccagagagacccaccggggacctccgtgagcgaatgaagaacaaacggcaggatgtcgacaccgagccccagaagagaaataccgaggaatcgtccagccccgtgaggaaggagtcttctcggggccggcatcgcgagaaggaagatattaagataaccaaagagcgcaccccagagagcgaggaagagaacgttgagtgggagacaaaccgcgatgattcagacaacggcgatataaattatgattatgtacatgaactttcactggagatgaagcgacagaagatacaaagggagctcatgaagctggaacaagagaatatggaaaaacgggaggagataataataaagaaggaggtcagcccggaggtggtgcggtctaaactgtccccctccccaagcctccgaaaatccagtaagtctccaaagcggaaatcaagccctaaatcctcctcagcgtctaaaaaagaccgcaagaccagcgccgtttctagtccactactcgaccagcagcggaactccaaaaccaaccagagcaagaaaaaaggcccccggacaccctccccacctccgcccatccccgaagacattgcattgggaaagaagtacaaggagaagtataaagtcaaggaccgcattgaggaaaagacaagagatggtaaagatcgtggccgcgattttgagcgtcagagggagaaacgcgataagcctcgaagtacctcacctgctggccagcatcatagtcccatctcgtccagacaccattcttcctctagccaatcgggctcttccatacaaagacacagcccctcccctcgcagaaaacggacccccagcccgtcctaccagcgcaccctgacacctcccctcaggcggtcagcttccccatatccatctcattctcttagctcccctcagcggaagcagtctcctcctcgacaccgcagcccaatgcgggaaaagggccgtcacgaccatgagcgtacaagccagagccatgaccgcagacacgaacgaagagaggacactcggggcaaacgggacagggagaaagactctagggaggagcgcgaatatgaacaagatcagagttcatccagggatcacagggacgatcgggaacccagggacggtcgtgatcggagagacgcacgcgacacaagagaccgccgagagctacgggacagccgggacatgagagactcccgggagatgcgagattattctagagatacgaaggagagcagggatccccgtgattctcgcagcacacgcgatgcccacgattatcgcgatagagaaggtcgcgatacacaccgaaaggaagacacctatccggaggaaagcaggtcatacggccggaaccacctgagggaggagtccagtagaactgagatcagaaatgagtcccgcaatgaatcccgtagcgagattagaaacgacagaatggggaggagccggggacgggtaccggagctgcctgagaagggctcgagggggtccagagggtcccagatcgattcccactcttccaatagtaattaccacgacagctgggagacccgctccagttatcccgagcgcgacagatatcccgaaagagacaacagagatcaggcccgtgactcctctttcgaacggagacacggagaaagagatcgtcgggataatcgcgagcgggatcaacgtccttcatcaccaatccgacaccagggccgaaacgacgaactggagcgggacgagcgacgtgaagaaaggagggtagatagggtggacgatcgtagagacgaacgcgcacgggaacgggatcgcgaaagggaacgggatcgggaaagggagcgtgagagggaaagggagcgagaccgcgaacgggaaaaagagagagaactagaacgagagcgtgcccgcgaacgggaaagagagcgcgaaaaggagagagatcgagaaagggatcgggatcgggaccacgatcgcgaacgggagagggaaagggagcgcgatcgggaaaaggagcgggagcgggagagagaggagagggagagggagcgggaaagagaacgcgaaagggaacgcgagcgggagcgagagcgtgagagggcccgcgagagagacaaggaaagagagagacagcgtgactgggaagacaaagacaaaggaagagacgacagaagggagaagcgagaggagatccgcgaagaccgaaaccctcgtgacggacatgacgaacggaagagtaaaaaacggtatcgcaatgaaggctctccgtcccctcgtcagtcacccaagcgccgcagggagcactctcccgacagcgatgcgtataactcaggggatgataagaatgaaaaacataggctgctcagccaggtggttagaccacaggaatcaaggtctctgtctcccagccatctcactgaggacagacagggcaggtggaaggaagaggacaggaaacctgagcggaaagagagttccaggagatatgaagaacaagaactcaaagagaaagttagtagcgttgataaacagagagagcaaacagagatcttggagagttctaggatgagggctcaagacataatcgggcaccaccagtcggaagatcgggaaacttcagacagagctcatgatgagaataagaaaaaagcaaagatacagaagaaacctatcaagaaaaagaaggaagacgatgtagggatcgaaaggggaaacattgagaccacctccgaagatggacaggtgttctcgcctaaaaagggccagaagaaaaagagtatcgagaagaagaggaaaaagtccaagggcgactccgatatctcagatgaggaagctgcccaacagagcaagaagaagaggggcccacgcacccctccgatcactacaaaggaagagttggtggagatgtgtaatggcaagaacgggattcttgaggatagccagaaaaaagaggataccgctttttctgattggagcgacgaagacgtcccagatagaaccgaggtgaccgaagctgagcacaccgccactgccaccactcccgggtcaactccatccccactctcatccctgctgccccccccccctccagtggccactgccactgcgacaactgttcctgccaccctcgcagcaacgacagccgccgcagcaacctctttttccactagcgctattaccatctcaacatccgctacccccaccaacaccacaaacaatacattcgctaatgaggatagtcacagaaaatgccaccggacaagagtagaaaaagtcgaaactccgcatgtaacaatcgaagacgcgcagcataggaaaccgatggatcagaagcgctcatcaagtctgggctccaatcggagtaaccgctctcacacttccggccgactccgcagcccctctaacgatagcgcacataggtccggggatgatcagtccgggaggaaacgtgtcctccattctggtagccgcgatagagagaagacaaagtccctggaaattacaggtgaacgtaaatcacggatcgatcaattgaagcgcggtgaaccttctcggtccacatcaagcgataggcaggacagccggagccattcctcccgacgaagctccccagagtctgacagacaagtgcatagcagaagtggctcctttgattctcgtgatcgacttcaagagcgggatagatacgagcacgatagagagagggaaagggaaaggcgcgatactcgtcagagggaatgggacagagatgcagacaaggattggcctaggaacagagacagggatcgactgcgggaacgcgaacgggagcgcgaaagggacaaacgccgagatcttgacagagagcgtgagcgactcatctccgatagcgtcgaacgggatagagaccgcgacagggatcgcacctttgaaagctcacagatcgagagtgtgaaacgctgcgaggccaaactggagggcgagcatgaaagagacctagagtccacttctcgcgattctttggccttggacaaggagaggatggataaggacctgggtagtgtccagggctttgaggagacgaataaatccgagcggactgagagtttagaagccggtgacgacgagagcaagttagatgacgcccactcactcggatccggggctggagaaggctatgagccaatcagcgatgatgaacttgatgagattcttgccggcgacgcagagaaacgtgaggaccagcaggacgaggaaaaaatgcctgacccccttgatgttattgatgtggattggagcggcctgatgccgaaacaccccaaagaacctagagaaccaggcgctgctctgctaaaatttacaccaggggctgtgatgttgcgagttggaatttctaagaaattggcaggctccgaactgtttgctaaagtgaaagaaacgtgtcagcgattactggagaaaccgaaggggtccttcattttgctgtag

SEQ ID NO: 52505 - DNA, 1875 bp, Artificial Sequence
  Description of Artificial Sequence: Synthetic coding sequence
atgtgcaacggcaagaacggcatcctggaggacagccagaagaaggaagacactgcatttagtgattggtccgacgaggatgtacccgaccggaccgaggtgacagaggctgagcataccgccacagcaacaacaccgggctccaccccttcccctctcagctccctcttgcctcccccacccccagtggcgacagcaaccgcaaccactgtacctgcgaccctcgccgccacaaccgctgctgccgccacttcatttagtacctctgctatcactattagcacttccgcaacaccaacaaacaccactaataatacttttgctaacgaggactcccacagaaaatgccatcgaaccagagttgaaaaggttgagaccccacatgtaaccatagaggacgctcagcaccgcaaacccatggatcaaaaaaggtcttcgtccctgggctcaaacaggtcgaatagaagccacacctccggacgattaagaagtccgagcaacgactcagcccaccgctcgggtgatgatcagtctggccggaagagggtcctgcattctggttcacgggacagagagaaaacaaagtcactcgaaatcactggagagcgtaaatctcgtatcgaccaacttaagcggggcgaaccttcacgcagcaccagctccgacagacaggacagcaggtcacacagctctagacggagctccccagaatccgatcggcaggtccattcgcgtagtggttcctttgacagtcgagaccgcctccaggaaagagaccgatacgagcacgaccgcgagagggagagggagagacgggatacccggcaaagagagtgggatagagacgctgacaaagattggccccggaatcgagatagggaccggctgcgcgagagagagcgcgaaagggaaagagacaagaggcgtgacctggatagagaaagggagcgactcatctccgattcagtggaacgggacagggacagagaccgcgaccgtactttcgaatccagccagatcgagtcagtcaagcgctgcgaggcaaagcttgagggggaacacgagagggacctcgaatccacatctcgcgattctctggccttagataaagaaagaatggataaagacttggggtctgtgcaaggcttcgaggaaacgaataaaagtgagcggactgaaagcctggagggggacgatgagtccaaattggatgatgcccatagtctcggcagcggtgccggcgagggttacgaacctatttccgacgacgaactcgacgagatcctggcgggcgatgccgaaaaacgagaagaccagcaggatgaggaaaagatgcccgaccccctggacgtgatcgatgtggactggtcgggcctaatgcccaagcatcctaaggaaccccgcgagcccggcgcagccctgctcaagttcaccccaggggctgtgatgctgcgcgtgggtatctccaaaaagttagccgggagtgagctcttcgctaaagtcaaggaaacctgccagcgcctgctcgaaaagccaaaggatgctgacaatctgtttgagcatgaactcggggccctcaatatggctgcactcttaagaaaagaagaacgcgccagcctccttagcaacttgggcccctgttgtaaagctctgtgttttcgccgggactctgccattcgaaagcagttggttaagaatgaaaagggcaccattaaacaggcctatacaagtgccccaatggtggataacgaacttctgcgattatctctgcggctttttaagaggaaaactacttgccacgcaccaggccacgaaaagaccgaagacaataagctatcacagtctagcatccagcaggagctctgcgtctcttag

SEQ ID NO: 52506 - DNA, 348 bp, Artificial Sequence
  Description of Artificial Sequence: Synthetic coding sequence
atgagcaagatccggcggaaggtgaccgtggagaacaccaagaccatcagtgacagcacgtcacggcggcccagcgtatttgaacgcctgggcccaagtactggctctactgccgagacacagtgtagaaactggttgaaaacgggaaactgcctgtacgggaacacctgccggttcgttcatggtcctagtccgcgggggaagggctactcaagcaattataggcgatccccagagagacctactggtgacctgcgggaacgcatgaagaataagagacaagacgtggatactgagccccagaaaaggaataccgaagaatccagcagccccgtccgggtcggatag

SEQ ID NO: 52507 - DNA, 1455 bp, Artificial Sequence
  Description of Artificial Sequence: Synthetic coding sequence
atggagaagcgggaggagatcatcatcaagaaggaggtgagccccgaagtggttcgttctaagctcagtccttctccctccctgagaaagtcctccaagtcaccaaagcggaagtcgtcccccaagagcagctctgcatccaaaaaggacaggaagaccagcgctgtcagttctcccctccttgatcagcagaggaactctaaaaccaatcagtcaaaaaagaaagggcccagaacacctagccctccccctccgattccggaggacattgccctggggaagaagtataaggagaagtataaggtgaaagacaggatcgaggagaagacgcgagatggcaaggacaggggccgcgactttgaacgacaaagagagaagcgggacaagcctcgcagcacttcccctgcaggccagcaccattccccaatcagcagcagacatcatagttccagctcacagtccggaagttcgattcagcgccattccccttcaccaaggcgcaaacggacccccagtccctcttatcagagaactttgacacctcctctcagacggtctgcatccccttacccaagtcactccctgtccagtccgcagcgaaagcagtcccctcccaggcaccggtctccaatgcgggagaagggtcgacatgaccacgaacgcacatcccagagccacgaccgccgacacgagcgccgtgaggatactaggggcaagagagatagagaaaaagactctcgtgaggagagagagtacgagcaggatcagtccagctctcgtgaccaccgggacgatcgggaacctcgagatgggagagatcggcgcgatgcccgcgacactagggatcggagggaactgagagattccagagacatgagggattccagagagatgcgcgactactcgagggataccaaagagtctcgggatccacgtgattctcgttccactcgagacgcccacgattaccgcgaccgtgagggccgcgacacacaccggaaggaagacacctacccggaggagtctaggagctatgggagaaatcacctgagagaggaaagttcccggacagaaatccgcaacgagagccggaatgagagcagaagtgagatcaggaatgatagaatgggtcgctctaggggcagggttcccgaacttccggaaaaggggagtaggggaagtagaggttctcagattgatagccattcgtccaatagcaattatcacgactcatgggagacccgttcctcttatcccgaacgagatcggtaccctgagcgtgataaccgtgaccaggcccgcgattcaagcttcgaaaggcggcatggtgagcgggaccgccgcgacaaccgagagagagatcaaagaccttccagtccgatccgacatcagggccggaatgatgagctcgaaagggacgaacgacgagaggaacgccgtaaagagaagaagtag

SEQ ID NO: 52508 - DNA, 3912 bp, Artificial Sequence
  Description of Artificial Sequence: Synthetic coding sequence
atggaggccgcccccggcacccccccccccccccccagcgagagcccaccaccacccagcccccctcccccctcaaccccatccccacccccatgctcccctgacgcccgccccgcgacaccccacttacttcaccacaggctcccacttccagatgatcgagaggatggagagctggaggagggcgagctggaggatgatggtgctgaagaaacccaggacacctccggcggccccgagagatctcgaaaagaaaagggcgagaaacaccacagcgactctgatgaagagaaatctcacagaagactgaagcgcaaacgcaagaaggagcgagagaaggaaaagcggaggtcaaaaaaacgcagaaagagtaagcacaagagacacgccagcagctcagatgacttctccgacttcagtgatgactctgatttctccccttcagaaaaagggcatcgaaagtaccgcgaatactcaccgccttacgcgccatcacatcagcaatatcccccgtcacacgccacgcctctgcccaaaaaagcttactccaaaatggatagcaagtcatacggcatgtatgaggattatgaaaatgagcagtatggtgaatatgagggggacgaagaggaagacatgggaaaagaggattacgacgatttcaccaaggagctgaaccagtatcggagggcgaaagagggaagcagtcgggggcgcgggagcaggggccggggaagaggttaccggggaagaggaagtcgcggcggttcccgggggcgcggcatgggacggggctccaggggtcgggggcggggttccatgggaggggatcatcctgaggacgaggaggatttttatgaggaagagatggactacggagaatctgaggaaccgatgggtgatgacgattacgacgagtactccaaggagctcaaccagtaccggagaagcaaggacagccgcgggagaggcttaagtagaggcaggggtagaggatctagagggagaggcaagggcatggggagagggaggggtaggggcggtagccggggtggcatgaacaagggaggcatgaacgacgatgaggatttctacgacgaagacatgggagatgggggaggcgggagttatcgcagcagagaccacgacaagcctcaccaacagagtgacaagaagggcaaagtgatctgtaaatatttcgtcgagggtcgctgcacatggggtgaccactgcaatttttcgcatgatatagaacttccaaagaaacgcgagttgtgcaaattttatattactggcttttgtgcccgggctgagaattgcccatatatgcacggcgacttcccttgcaagctgtatcacacaaccggcaattgcattaacggagatgactgcatgttctcccacgaccccctcacggaagaaacccgcgaattactggacaaaatgctggccgatgatgcggaagccggtgccgaggacgaaaaggaggttgaagaactcaaaaagcaggggatcaatcctctacccaagcctcctcccggggtgggactcttgccaaccccccctcggccacccgggccacaggcacccacctctccaaatggaagacccatgcaaggcggcccccctccgccccctcctcctccccctccgcccccgggtccaccacaaatgcccatgcctgtgcacgagccccttagcccacagcagctgcagcagcaggatatgtacaataaaaaaattcccagtctcttcgaaatcgtcgtcagacctaccggacaactggctgagaaactgggagttcggtttcctggtcctggggggcctccagggcctatggggcccgggcccaatatgggaccacccggaccaatgggaggacctatgcacccagacatgcacccagatatgcatcctgatatgcacccagacatgcacgcagacatgcatgccgatatgcccatgggacctggtatgaaccccggtccaccaatgggaccaggcgggcctcctatgatgccctacggtcccggcgactcaccccactccggtatgatgccaccgatcccacctgctcagaatttttatgagaacttctatcagcagcaggaaggcatggagatggagccagggctgctgggcgatgccgaagattacggtcattacgaagagctccctggggagcctggggaacatctgttccccgagcaccccctggagccggattccttttcagaagggggtcctcccgggaggccaaaaccgggagccggtgtgcccgacttcctgccaagcgcccagcgggcattgtatttaagaatccagcagaagcaacaagaggaagaggagcgcgctcgtaggttggcagaatctagtaaacaggatcgtgagaacgaggaaggagacacaggcaattggtactcctccgacgaggatgaaggaggatctagcgtcacatccattctgaaaacgctgagacagcaaacctcatcacggcctccggccagcgtgggcgagctgagttcatctggtctcggtgaccccaggcttcagaagggacacccaaccggttccagactggccgacccaaggctgtcaagggacccacgtcttacccggcacgttgaggcttctggaggatcaggccctggggacagtgggccaagtgatccaaggttggcaagagcattacctacatccaagccggaaggtagcttgcatagcagtcccgtgggcccctcaagtagcaagggctcaggcccgccacccactgaagaagaagagggggagagggcactccgcgaaaaagcagttaatatcccactcgaccccctgcccggtcatcctctgcgcgaccctcgctcacaacttcaacaattcagccacatcaaaaaggatgtaacactttccaagcccagtttcgcacgcactgtactgtggaacccagaagatctgataccgcttccgattcccaagcaggatgctgtgccacctgtgccagcagctctgcaaagcatgccaacattggacccacggttgcaccgtgctgcaaccgccggccctccaaatgccagacagcggcccggcgcttctactgacagctccacacagggagccaatctgcccgacttcgaactgctcagccggatcttgaagacggtaaacgccacgggctccagcgccgcacccggatcaagcgacaaacctagcgacccacgggtgcggaaggcacccacagaccctagattgcagaaaccaacagactcaacagcaagctctcgtgctgccaagccaggtcccgcagaagcccccagtccaaccgccagtccgtccggggacgcctctccacccgcgactgctccttatgatccccgggtcctcgcagctggaggccttgggcaaggaggagggggaggacagtcatcagtgttgtctggaatttctttgtacgacccaaggacaccgaatgccgggggcaaagcaaccgaacccgccgcggacaccggggcacagcctaagggagcagagggcaacggcaagtccagtgccagtaaagctaaagagccaccttttgtgagaaaaagcgcactcgagcagccagaaactggaaaggccggcgccgacggaggaacgccaacagatagatataatagttacaatcgaccacggcccaaagctgccgccgcacccgctgcaactaccgctaccccacctcctgaaggagcacccccccaaccgggagtccataacttgcctgtgccaactttatttgggacagttaagcaaacccctaagactggcagtggaagccccttcgcagggaacagcccagctcgtgagggcgaacaggacgccgcaagcctaaaagacgtgttcaaaggatttgatcccacagcaagtccgttctgccaatag

SEQ ID NO: 52509 - DNA, 3570 bp, Artificial Sequence
  Description of Artificial Sequence: Synthetic coding sequence
atgaccgacagcgagcacgccggccacgaccgggaggacggcgagctcgaggacggtgaaattgatgacgccggtttcgaggaaatccaggaaaaggaagccaaggaaaacgagaaacagaaaagtgagaaggcctatagaaaatcaagaaagaaacacaaaaaggagcgggagaaaaaaaagtctaagagacgaaagagggaaaagcacaagcacaactccccctctagcgacgactcctccgattactctctcgattctgatgttgaacacacagagagctctcataaaaagcgcaccggcttctacagagattatgacatcccctttacccagagagggcacatcagcggtagctacatcactagcaaaaaagggcagcacaataaaaagttcaaatccaaggagtacgacgagtactccacatattcagacgacaatttcggtaattactctgatgataatttcgggaactacggccaggagaccgaagaagatttcgctaaccagttgaagcagtatagacaggccaaagagacaagcaatatcgcgctcggatcatcatttagtaaggaatccgggaagaaacagagaatgaagggcgttcagcagggaatagaacagcgcgtcaagtcatttaatgttggacggggcaggggcctccctaaaaaaataaaacgaaaggagcgtggaggtaggaccaacaaaggcccaaatgtgtttagcgtgtctgacgattttcaagagtacaataagcctggtaagaagtggaaggtgatgacacaggaatttattaatcaacatacagttgagcacaaagggaagcaaatatgcaagtacttcctcgaaggtagatgcattaagggggatcaatgcaagtttgatcacgatgccgaattggagaagcgtaaggaaatctgcaagttctacttgcaggggtactgtacaaaaggtgagaactgcatttatatgcacaatgagtttccttgcaagttctatcactctggggcaaaatgttaccagggggataactgtaagttttctcacgatgatctaacaaaagagaccaagaagctgctcgacaaagtgttgaataccgatgaggagttaattaatgaggatgaaagggaactggaagagcttcggaaacgcgggatcaccccactgcccaagcctccacccggggtggggttgctcccaactcctccggaacacttcccgttctcggaccctgaggacgattttcaaactgatttttctgatgattttcggaagattccaagtcttttcgagattgttgttaagcctacggtggacttggcccataagataggacgcaaacctccggcgttctacaccagcgcgtctccgcccgggccacagtttcagggttccagtcctcatccccaacatatttattcaagcgggtcctcacccgggccagggcctaatatgtctcagggacactcttcccctgtgatgcacccaggctcacccgggcatcacccatgtgcagggccacccggtctgcctgtgccacagtcgccccctctccctccaggtccacctgagatcgttggcccacaaaaccaagcgggtgtgttagtgcagccagacacttctttgaccccacccagtatgggcggagcctatcattcccctgggttcccaggacacgtcatgaaagtgcctcgggaaaatcactgttctcccggaagcagctaccagcaatcccctggagaaatgcagctcaacacaaattacgaatccctccagaaccctgcggaattctatgacaattattacgcccagcactctattcataatttccagccccctaataactcaggggatggcatgtggcacggcgagttcgcacagcagcagccacccgtggtgcaggactctcctaatcatgggtctggatctgacggctctagcacccgcacaggccacggccccctccccgtaccaggcttgttaccagccgtccagagggctctgtttgtgagactgacccagcgctaccaagaagatgaggagcagacgagtacacagcctcaccgcgctccctccaaggaggaggacgacacggtcaattggtattcctcatcggaggaggaggagggttcgtctgtgaagagtatactgaagaccctgcagaagcagactgaaactctccgcaaccaacaacagccttcaaccgaactgagcacaccaaccgatcccagattagctaaggaaaagagtaagggtaaccaggttgtcgacccaaggttacggactatcccaagacaagatattcgtaaaccctcagagtcagcacctttggacttgcgcctggcctgggaccctcgaaagcttcgtggaaacgggtccggccacattggctcgtcagtaggtggggctaagttcgacctacaccacgcaaatgccgggacaaatgtgaagcataagcgcggggacgacgatgatgaggacacagaacgagagttgagggagaaggcgtttctaattcccttggacgcaagccctggaataatgttacaagacccgagaagccaactgcgtcagtttagtcatattaagatggacattacacttactaagcccaatttcgccaagcatatcgtttgggccccggaggacctgctgcccgttcctttgccaaaaccggatccagttagcagcatcaacctccccttgcctccgctgatcgccgatcagcgccttaaccggctgtggaataccaagagcgatctgcaccagaataccgtgagtatagatcccaaacttgcagctaaggctaagattaacactaccaatagagaagggtatttggaacagttcggcgattctcacggctcaggtgccaaactgggggatcctcgtcttcagaaaaatttcgacccacggttgcataggctgcctaacacggaatcccaccaagtggtgatgaaagatagccacgcctctaaaggcgccccccatcttccaaggtcaaacccgggtagctcccaacctagcggtgcaggcacttcaaacagcggcagtggcgcattaccaccgtacgcccctaagctctcctctagtgcaggattgccgttagggacatcaactagcgttctgtcggggatcagcctttacgacccccgagaccacggtagcagttcaacttccgaattggctacggcttccagcggcgagaatagcaagaaccagaaaaaatccggcggcctaaagtcatctgacaagactgagccttcaccgggcgaggccattttacctcaaaaacccagcccaaatgttggtgtgacactcgaggggcccgctgacccacaggctgatgtgccccgctcatctggcaaagttcaagtaccagcggtgcattctctgcccgtgcaggcccttacaggactgatccgtccccagtactcagaccctagacaggctcggcagccaggtcagggatctcccactcccgataatgatcctggccgcgagactgacgacaaaagtctcaaggaagtctttaagaccttcgatcccaccgcctcacctttctgctag

SEQ ID NO: 52510 - DNA, 3570 bp, Artificial Sequence
  Description of Artificial Sequence: Synthetic coding sequence
atgaccgacagcgagcacgccggccacgaccgggaggacggcgagctggaggatggggagatcgatgatgccgggttcgaggagatccaggagaaggaagccaaggaaaatgaaaaacagaagagtgagaaagcctatagaaagtccaggaagaagcacaagaaggaacgcgaaaagaagaagagcaagcgcagaaagcgggaaaagcacaagcacaacagcccatcatccgacgacagctctgattactccctggatagtgacgtggagcacaccgaatcatctcacaagaagaggaccggattctatcgggactatgacatccccttcactcagaggggccatatcagcggcagctatatcacttccaagaagggccagcacaacaagaagttcaagagtaaggagtacgatgaatacagcacctactccgatgacaatttcggcaattatagtgacgacaacttcggcaattacgggcaggagacggaggaggattttgccaatcagctgaaacagtatagacaggcaaaagaaacttcgaacattgctctcggttcttcctttagcaaggagtctgggaagaaacagagaatgaagggggtccagcaaggaatcgagcagagagttaagagtttcaacgtcgggagagggcgagggctccctaagaaaataaagcgcaaagagcgcggcggccggaccaacaaggggcccaatgtattcagcgtttctgacgacttccaagagtataacaaaccgggcaagaagtggaaagtgatgacccaggagttcataaaccagcacacagtggaacataaaggcaagcagatttgcaagtacttcttggaaggccggtgcataaagggcgatcagtgcaagttcgaccacgatgctgagctagaaaaacggaaggagatctgcaagttctatctgcaggggtactgtacaaaaggagagaattgcatctacatgcataacgaatttccgtgtaagttctaccactctggtgcaaagtgctaccaaggcgacaactgcaagttctcacatgatgacctgacaaaggaaactaaaaagctgcttgacaaagtcttgaacaccgacgaagagctaataaatgaagatgagcgggagctcgaggagttgcggaaacggggcattacaccattgcctaagcccccccctggggtcggtttgcttcccacaccgcccgagcactttcccttcagtgacccagaggatgacttccagacagacttttctgacgatttcagaaaaatcccgagtctgttcgagattgtggtaaagccgacagtcgatttagcacacaagatcggacgaaagccccccgccttttacacctccgccagcccgccaggtccccagttccaagggtcatctcctcatccacagcatatctatagctccggcagctcccccgggcccggtccgaatatgtcccagggccacagcagcccggtgatgcaccccggctcccctgggcatcacccctgcgctggaccacctggccttccagtgccacagtctcccccgcttcccccgggcccgcctgaaattgtcggcccccaaaaccaggcgggtgttcttgtccagccggatactagcctaaccccaccctcaatgggcggtgcttaccactcaccaggatttccaggccacgttatgaaagtcccccgagaaaatcattgctcacctgggagttcctaccagcagtcccctggcgagatgcagctgaacacgaactatgaatccctccagaacccagccgagttttacgacaattattacgcccagcactctatccataatttccaaccaccgaacaatagcggtgatgggatgtggcacggggaattcgcacagcaacaaccaccggtggtccaggattctccgaaccacggttctgggtctgatggttcttccacccgaacaggtcacggtcccttgccggtcccaggtcttttacctgccgtgcagcgggccctgttcgtgcgactgacacaaagataccaggaggatgaggagcagacaagcacacagccccacagggctccttccaaagaggaagacgataccgttaattggtattcttccagcgaagaggaggaaggcagctccgtgaaaagtatcctcaaaacactgcagaaacagactgaaaccctgagaaatcaacagcagccttcaactgaactgtccaccccaactgatcctagactggccaaggaaaagtctaaaggcaaccaggtagtggacccaagactgcgtacaatccctcgccaagacatcagaaagcccagtgaaagcgctccacttgatttgagactggcctgggaccctaggaaactcagaggaaacggctccggccatattggctcatctgtgggcggggccaaattcgatcttcaccatgctaatgccgggaccaacgtcaaacataagcgcggcgacgatgatgatgaggatacagagcgagagttgcgcgagaaagcctttctgattcccttggatgcttcccctgggattatgttgcaggaccccagaagccaactgcggcagttttcccacatcaagatggacatcacactgaccaagcctaactttgccaagcatattgtgtgggcacctgaggacctgttgcccgtccctctgcccaagccagatcccgtcagctccattaacttgccactcccccctctgattgccgaccaacgactgaaccgactgtggaacacaaaatccgatctgcaccagaacacagtgagcattgatccgaagctcgcagccaaggcaaagattaataccaccaaccgggaggggtacctcgaacaattcggcgatagtcacggatccggcgcaaagctgggggacccccgactgcaaaagaacttcgaccctaggctgcacaggttgcccaataccgagtcccatcaagtggttatgaaggattcccacgcttcaaagggggcccctcacctccccagaagtaatcccggctcctcacaaccgtcgggagccggaacttctaactctgggagcggagccctccccccgtacgctcccaaactctccagttccgccggcttacccctcgggaccagtacgtccgttctgtcgggtattagtctgtacgatccccgggatcatggaagctcctccacaagcgagttggcaaccgccagtagcggggagaacagtaagaaccagaaaaagagcggtggcctgaaatcctcagacaagacagaaccaagccccggcgaggccatcctgcctcagaagccaagccccaatgttggagtgactctggaaggccccgccgatcctcaggccgatgtgcctcgatcaagcggtaaagtgcaggtaccagccgtccatagccttcctgtccaggcactgaccgggttaatcaggccgcagtatagcgatcctcgccaggctagacagcctggacagggcagcccaacgcctgataacgacccaggcagagagacagacgacaaaagccttaaagaagtcttcaagactttcgatcccacggctagccccttctgctag

SEQ ID NO: 52511 - DNA, 2679 bp, Artificial Sequence
  Description of Artificial Sequence: Synthetic coding sequence
atgcaggacctgaagaagtacaagaagaagaagcagaagcggatgaagtccaggaaggttcggaagccgactgaaaaccaggaaaagaatatcaggaagcgggagaggaaaaaatcaaagcgacggaagcgtgagaagcacaaacacaattcccccagtagcgatgatagctccgattattctttggatagcgatgtagagcatacagaaagctcacacaagaagcgaaccggcttttatagagactacgatataccttttacccagaggggccatatttccgggagctatataacctctaaaaaaggccagcacaacaagaagtttaaaagtaaagagtatgatgagtactccacgtatagcgacgataatttcggaaactactctgatgacaacttcggtaattatggacaggagaccgaagaggattttgcaaatcaactgaaacaatataggcaggctaaagagacttcaaacatcgcactgggatcctcattctccaaggagtcaggaaaaaaacagcgcatgaagggtgtgcaacagggcatcgaacagcgggtgaaatcgttcaatgttgggcgtggccggggcctgcctaagaaaataaaaaggaaggaaaggggtggacggaccaataaaggccccaacgtgttcagcgtgtctgatgacttccaagagtataataaacccggtaagaaatggaaagttatgacccaagaatttattaatcagcatactgtggaacacaaggggaagcaaatttgtaaatattttttggaaggcagatgtattaagggcgatcaatgtaagttcgaccatgatgcggaacttgagaaaagaaaagaaatatgtaagttttacttacagggatattgtaccaagggagagaactgcatctacatgcacaatgagtttccttgtaaattctatcatagtggcgccaagtgctatcagggagataactgtaagttctcacatgatgatcttacaaaggagactaaaaaactcctcgacaaagtgttaaacacagatgaggagctcatcaacgaggacgaacgggaactggaggaactaagaaaacggggaataacccctctgcccaagcctcctccaggcgtcggactgctgcccacacctcccgagcatttcccattcagcgaccccgaagacgactttcaaacagatttctccgacgatttccgcaagattccgtcgctattcgaaatcgtggtgaaacccacggtggatctggcgcataaaataggccgcaaacctccggcgttttacacctccgccagtcctcctgggccacagttccagggatcctctcctcacccgcaacacatctattcttccggcagctcccccggtccaggacccaatatgagccagggccacagcagccctgtcatgcatcccggctcgcccggtcatcacccctgtgctggaccccctgggctgccagttccccagagcccaccactgccccctggccctcccgaaatcgtgggcccccaaaaccaggccggcgtcttggtgcagccggacaccagccttaccccgcccagcatgggaggggcttatcattcgcccgggttccccggccacgtgatgaaagtgcctagagagaatcactgttctcctggctcatcttaccagcaatctcctggggagatgcagctcaacactaactacgagagtttgcaaaaccctgcagaattctatgacaattactacgcccagcatagtattcataattttcagccgcctaacaattcgggagacgggatgtggcacggcgaattcgctcagcagcaacccccagtggtgcaggacagccccaatcacggaagcggtagtgacggatcaagcaccaggacaggtcacggcccccttccagtgccaggccttctcccagccgtccaacgggctctgtttgtgaggttgactcagcgctatcaggaggacgaggaacagacatcaactcagccgcaccgggccccatctaaggaggaggatgacactgtgaactggtacagctcatccgaagaggaggaaggctcgagtgtaaaatcaattttaaaaactttacagaagcagaccgaaacactaagaaatcagcaacagccttccactgagctgtccacacctacagatcccagactagctaaggaaaagtcgaaggggaatcaagtggtagatcccaggctgcgcacgatccctcggcaggacatccgaaagccatctgaatcagccccactggaccttagacttgcttgggatccccggaagctgagagggaatggcagcggccatatcgggtcaagcgtaggtggagcaaagttcgaccttcatcacgccaacgccggcacaaacgtgaagcacaagaggggtgatgatgacgacgaagatacagagagagaattgcgtgagaaggcattccttatcccactggacgcctcaccaggaatcatgctgcaggaccctcggagccagctgaggcagttctcgcacataaaaatggacatcacactgacgaagccgaatttcgccaaacatattgtgtgggcccccgaggatcttctgcccgttccactgcccaagccagaccccgtatcatccattaacctacccctgcctcctctcattgctgatcagcgcttgaatcgactgtggtag

SEQ ID NO: 52512 - DNA, 903 bp, Artificial Sequence
  Description of Artificial Sequence: Synthetic coding sequence
atggccgagcccaccgtgtgcagcttcctgaccaaggtgctgtgcgctcacggcgggcgcatgtttctgaaggacctccgcggacacgtggaactgagtgaggctcgcttaagggacgtgctccaacgggctggccctgaacggtttctcctgcaggaggtggagacacaagaaggattaggtgacgcagaagcagaagctgcagcaggcgctgttggagggggcgggacttccgcctggcgagtggttgctgtcagcagcgtgcgactctgcgccaggtaccagcgcggagaatgtcaggcgtgcgatcagctgcacttttgtcgccggcacatgctgggaaaatgtcccaacagggactgctggtcaacatgcaccctgagtcacgatatccatactcccgtaaatatgcaggtgctgaaatcccacgggctgttcggtttgaatgagaaccagctgcggatccttttgctccagaacgatccctgtttattaccggaggtttgcctgctctacaataagggggaggccctttatggatattgcaaccttaaagataagtgcaataagtttcacgtttgtaaatcttttgtgaaaggagagtgcaagctgcagacctgcaagcgttctcaccaattgattcatgccgccagcctgaagctgctacaggaccagggactgaacatcccttctgtggtcaacttccagataatttctacatataagcatatgaagctccataaaatgctcgaaaataccgacaatagcagtcctagcactgaacattctcagggcctggagaagcagggagtccacgcggccggagccgctgaggctgggcctctggcttctgttcctgctcagtctgccaaaaagccttgccccgtctcctgcgagaaatag

SEQ ID NO: 52513 - DNA, 309 bp, Artificial Sequence
  Description of Artificial Sequence: Synthetic coding sequence
atggccgagcccaccgtgtgcagcttcctgaccaaggtgctgtgcgctcacggcggaagaatgttcctgaaagatctgcggggccacgttgaactctccgaggcgcggctgcgggacgttcttcaacgggccggtcccgaacgctttctcttacaggaggtagagactcaggaagggctcggtgacgcggaagcagaggccgcggcaggtgccgtcggtgggggaggaacgagcgcatggagggttgtcgccgtcagcgggaccatcggggcttgccaccatacccaactgatctttttgggcttctag

SEQ ID NO: 52514 - DNA, 1575 bp, Artificial Sequence
  Description of Artificial Sequence: Synthetic coding sequence
atgatgaccaccctgcagaacaaggaggagtgcggcaagggccccaagcgcatatttgcacccccagctcagaagtcctatagcttgctgccatgttcccccaactcacctaaagaagagacacctggcatctcaagccctgaaaccgaagcaaggataagtctgccgaaggcctctctgaagaagaaggaggaaaaggcaacaatgaaaaacgtcccatcacgggaacaagagaaaaagcgcaaagctcagatcaacaaacaggccgaaaagaaggagaaggaaaagtccagcttgacgaacgccgagtttgaagagatcgtacagatagtgttgcagaagtctctgcaagaatgtttgggcatgggctccggattggacttcgccgaaacatcgtgtgcacagcccgtggttagcacgcagtccgataaggaacctgggataacagcttctgctacagacaccgataatgccaatggggaagaagtgcctcacacccaggagataagtgtgtcatgggaaggagaagcagcgcccgagatacgtactagcaagttgggtcaacctgatcctgcccccagcaaaaaaaagagcaaccgtctgacactctccaagagaaaaaaggaagcccaagatgaaaaggtcgagaaaacccagggggggcacgaacacaggcaggaggaccgtctaaaaaagaccgtacaggaccattcacagatccgggaccagcagaaaggggagatcagtgggtttgggcagtgtttggtctgggtgcagtgttcctttccaaactgtggtaagtggcgccggttgtgtggaaatattgacccgagtgtgttgcctgacaattggtcttgcgaccagaacacagatgtccagtacaaccggtgtgatataccagaggagacctggaccggccttgaaagcgatgtcgcctatgcttcatatattcccggtagcattatttgggctaaacagtacggttacccctggtggcctggtatgattgagtcagaccccgatctgggggaatatttcctcttcacgtcccatctcgattcacttccaagcaaatatcacgtcacgttcttcggcgagaccgtgtccagggcctggattcctgtgaatatgttgaagaatttccaggaattgagcttggaactctccgtgatgaagaaacggcgcaacgattgttctcagaaactgggtgtagcactgatgatggcacaagaggcagagcagatttctatccaggaacgggtgaatctgtttggattctggtccagattcaacggctcaaacagcaatggggagcggaaggacctacagctctctgggttaaactctcctggttcctgtctggagaaaaaagagaaggaggaagagctcgagaaagaagagggagaaaagacagcacttagaaagaacctcaaactgccgagggcccgaccatggcagccggcctttcagcgtgaaaaaaaattggagcagtgtcagcggacctgggcctatcaaagagtacgggggccagccccccacctgaggaagaaatctcccgatacaggcaacccctag

SEQ ID NO: 52515 - DNA, 330 bp, Artificial Sequence
  Description of Artificial Sequence: Synthetic coding sequence
cccatggtgggcctgctggtgcacaccgccgccaccttcaactacagctttcggaaaattaggggtctgctgtgtccgcaacacaagcagagaggggtccaagctaatcagacacctgtgctctttttgcatatcagctgtgtatactactcactgtacctcttctttttgttctgttgtttatttcttatccccctggagcagaagatgacaaccagcccactcccatacccgtgcgataacatccacgttactgtgtggcctctcggggaggttttgatggagaccagaatgtgggaaagtaagatcgggttggagatgagactgtag

SEQ ID NO: 52516 - DNA, 399 bp, Artificial Sequence
  Description of Artificial Sequence: Synthetic coding sequence
atgcggaacatgatcccccaggacaacgagaaccccccccagcagggcgaagccaaccaaaatgacttcgcacttgtcgctcaggctggcgtgcagtggctggacttaggaccccagctgcccctgctgccaggtttcaaacagttcttctgcctgtctttgcttagtagctgcggctatagttggagccttgctctgtcccctcgtttagagtgcagcggcgcaatatctgcctacggcaaattgcggctgcccggttcgtgccacagtcctgcttcggcaagcagggttgcccggacaacaggagccaggcaccacacccggctgattttcgtcttcttagtagaaacccgatttcatcgagtttcacaggacggactggatctgctcacatcctag

SEQ ID NO: 52517 - DNA, 891 bp, Artificial Sequence
  Description of Artificial Sequence: Synthetic coding sequence
atgatcgccgagcggctggcccggctgcggcaggagaacaagcccaagctggtgccttcgcaagcagaaatagaagcaagactcgctgccttaaaggacgagcgccaaggctcgattccaagcacccaggaaatggaggctagactggcggctctgcaaggccgggttcttccaagccagaccccccagccggcgcatcacacacccgataccagaacccaagcccaacagacccaggatctgcttactcagctcgctgcagaggttgcaatagacgagagctggaaaggcggcggtccagccgcttccctacaaaatgatctgaaccaggggggccctgggtcaaccaattcaaagcggcaggctaattggagccttgaggaggagaagtctcgcctcctggccgaggcggccctcgaactgcgtgaggagaatacaagacaagaaagaatcctggctctggcaaagagactggcgatgctgcgagggcaagaccctgagagagtgactctacaagactacagacttccggattccgacgacgacgaagatgaagaaaccgcgattcaaagggtgctgcagcagctgacagaggaagccagcctggacgaggccagcgggtttaacatcccagcagaacaagcctctcggccctggactcagccccgaggggccgaaccagaagctcaggacgtggaccctcggcccgaggccgaagaagaggaacttccctggtgttgcatatgtaatgaggacgcaacactccggtgcgcaggatgtgatggtgatttattctgcgctagatgttttcgcgagggtcacgatgccttcgagctcaaagagcaccaaacttccgcttattccccaccgagagccggccaggaacactag

SEQ ID NO: 52518 - DNA, 1584 bp, Artificial Sequence
  Description of Artificial Sequence: Synthetic coding sequence
atgtaccagcccgaggacgacaacaacagcgacgtgaccagcgacgacgatatgacccgcaatcggagggaaagtagcccaccacattcggtgcattctttctcaggcgatagggactgggacagaaggggcagatccagagatatggagcctagggacaggtggagccatacccgcaaccctagaagccgaatgccacctagggacctcagcttgccagtggtcgctaagacctcctttgagatggacagggaggatgaccgggacagcagggcctacgaaagccgaagccaggacgctgaaagttaccagaacgtggtcgacctggccgaagacagaaagccccacaataccatccaggacaacatggagaattataggaaactactgtcattgggctttttagcgcaggatagcgtccctgctgaaaagcggaataccgaaatgctggataatctcccttctgccggttcacagtttccagattttaaacatctgggcaccttcctcgtctttgaagagctggttacattcgaggacgttttagtggattttagccctgaggaactatcttccctgagcgccgctcagcggaatttgtaccgcgaggtcatgctggagaattatcgcaatctggtaagtcttggacaccagttttcgaagcctgatatcattagcaggcttgaagaagaggagtcatatgctatggaaacagatagcaggcacaccgtcatttgtcagggggaatcccatgatgacccccttgagccccaccagggcaaccaggaaaagctcctaacccctattactatgaacgatccgaagacccttaccccagaacgctcctatggttcggacgaatttgaaagatccagtaatctctccaagcaaagcaaggaccctctgggcaaggaccctcaggaggggacagcccctggcatctgcacttccccccaaagcgcatcccaggagaacaagcacaaccgttgcgagttttgtaaacggaccttctcaactcaggttgctttgcgccgccatgagaggatacatactggaaaaaaaccttatgaatgcaagcaatgcgctgaagctttttacctgatgccacacctcaaccgacatcagaagactcactcaggcaggaagacctcgggatgcaacgaagggcgtaagccgtctgtccaatgtgccaacctgtgcgagcgagtccgcatacacagccaggaagactatttcgaatgtttccagtgcggaaaggccttcctgcagaacgtgcatcttctgcagcatctcaaagcacatgaggcagctagggtgttgcctccaggactgtcgcactctaagacctacctgataagataccagcggaagcacgactacgtgggagagcgcgcatgccaatgctgcgactgcggacgcgtgttcagccgcaattcttatctcatccagcactatcggacgcacactcaagaaaggccctaccaatgccagttgtgcggcaaatgtttcgggcggccctcctacctcacacaacactaccagctccatagccaggaaaagaccgttgagtgcgaccactgttag

SEQ ID NO: 52519 - DNA, 1809 bp, Artificial Sequence
  Description of Artificial Sequence: Synthetic coding sequence
atggcccggctgaccaagcggcggcaggccgacaccaaggccatccaacacctgtgggccgctatcgaaatcatccggaaccagaagcagatcgccaacattgatcgtataaccaagtatatgtcccgggtacacggcatgcaccctaaagagacgactcggcaactgtccctggcggtgaaggacggcttaattgttgaaaccctcacggtggggtgtaaagggtcaaaggctgggatcgagcaagaaggatattggctgccaggtgatgaaattgattgggaaacagaaaaccacgactggtattgctttgagtgtcacctaccaggcgaagttctaatttgcgacctctgcttccgagtctatcatagcaagtgtctgtccgacgaattccggttaagagactcatcatcaccttggcagtgcccagtctgcaggagtattaagaagaaaaacactaataagcaggagatgggaacctacctacgctttatagtctccaggatgaaggagagggcaatcgatcttaacaagaagggaaaggataataagcatcccatgtatagacgcctggtgcacagcgctgtagacgtgccaacaatccaggagaaggtgaatgaaggaaagtataggtcttacgaggagtttaaggcagatgcacagctgttactgcacaatacagttatcttttacggagcggatagcgaacaggcggacatcgctcgaatgctttacaaggacacttgccacgaactagacgagctgcagctctgcaaaaattgcttctatcttagcaacgcaaggccagataattggttctgttatccatgcattccaaaccacgaactcgtgtgggccaagatgaaagggtttggtttctggcccgctaaagttatgcagaaggaagataatcaggtggatgttcgcttctttgggcaccaccatcagcgggcttggattccaagcgagaacattcaggacattaccgtcaacattcaccggctacacgtcaagcgttccatgggctggaagaaagcctgcgacgaacttgaacttcaccagaggtttttgcgcgaaggtcggttctggaaatctaagaacgaagatcggggagaagaggaagcagagtcctctatctccagcaccagtaacgagcagctcaaggtaacacaggagcctcgggccaaaaaaggtcgtagaaatcagagcgtggagcccaaaaaggaggagcccgagcccgagaccgaagccgtatcctccagtcaggagatcccaactatgccacaaccaattgaaaaggtgagtgtgtctacacagacgaaaaagctgagcgcctcatcacctcggatgttgcaccggagcacccagactacaaatgacggcgtttgtcagtctatgtgtcacgacaaatacacgaagatttttaacgatttcaaggaccgcatgaaatccgatcacaagagagaaacggaaagggtggtccgcgaggctctcgaaaagctcaggtcagaaatggaggaggagaagcggcaagcggttaacaaggcagtggccaacatgcagggggagatggataggaaatgcaagcaagtgaaagaaaagtgtaaggaagagtttgtggaagagataaaaaaactcgccacccaacacaagcagctcatttctcaaacgaagaaaaagcagtggtgttacaactgtgaagaggaggctatgtaccactgttgttggaatacttcgtattgttcaatcaaatgccagcaagagcactggcatgccgaacataagagaacatgtcgacgtaaacggtag

SEQ ID NO: 52520 - DNA, 1920 bp, Artificial Sequence
  Description of Artificial Sequence: Synthetic coding sequence
atgacccccgccagcgccagcggcgaggacagcggcagcttctactcctggcagaaggcaaaaagagaacagggactagtgaccttcgaagacgtggccgtcgattttacccaggaggaatggcagtacttaaatccccctcaaaggaccctttacagagacgttatgctggaaacctactccaatttagtttttgtggggcaacaagttaccaaacccaatctcatccttaagttggaggttgaggagtgtccagcagaaggaaaaatacccttctggaacttccccgaagtctgtcaagtggatgagcagattgagcgtcagcatcaggacgatcaggataagtgtttattgatgcaggttggtttctcagataaaaagactatcatcacaaagagcgcaagggactgccacgagtttggaaatattctccacctgagcacaaacctggtggcttccatccaacgaccggacaagcatgagagcttcggaaacaatatggtggacaacctggaccttttcagccgctcgagcgccgaaaacaaatatgacaatggctgtgctaagctgttttttcacactgagtatgagaaaactaacccaggaatgaagccttacgggtataaggaatgtggcaagggccttaggcgcaaaaagggtctgtctctgcaccagcgcatcaagaatggagaaaagccgtttgagtgcaccgcctgccggaaaacgttcagtaaaaagtcccatctgatcgtccactggagaacccatacaggtgagaagccttttgggtgcacagagtgcggtaaggccttttctcaaaagtcacagcttattattcatctccgcactcatactggggagaggccttttgagtgtcccgagtgcggcaaagcgttcagagagaaatccacagtaattatacattacagaacacataccggcgagaagccttatgagtgtaatgagtgcggcaaagcctttacgcagaagtctaatctgatcgttcaccagaaaacacataccggtgagaaaacctatgaatgcaccaagtgtggagagtcattcatccagaagttagatctgataatccatcactctacacacacgggaaaaaaaccccacgaatgtaacgaatgtaagaagaccttttcagataaatccaccctgatcatacaccagcgcactcatacaggcgagaaaccccacaaatgcaccgagtgtggaaagtcatttaatgaaaaatcgaccttaattgttcaccagcgtactcatacaggggagaagccttacgaatgcgatgtctgcggaaagactttcactcagaagtccaatcttggagtccatcagaggacccattccggagagaagccctttgagtgtaatgaatgtgagaaagcctttagccagaagtcatatctcatgttgcaccagagggggcacaccggtgaaaagccttatgagtgcaacgagtgtgagaaagccttcagccaaaaatcatacttaatcatccaccaaaggactcataccgaggaaaagccttataaatgcaacgagtgcgggaaggcgttcagagaaaagtctaagctgattattcaccagcgaattcataccggggagaagccatatgagtgccccgtctgctggaaggcattttctcaaaagagtcagcttatcatccaccaacgcacacacacgggagaaaagccctatgcttgcactgaatgcgggaaggcattcagagagaaatccactttcactgtccaccagaggacacataccggagagaagccatacaaatgtacagagtgcgggaaggccttcacccagaaatccaacttgatagtgcaccaacggacccatgcaggaaagaaagcacacggacgtggccacaccagaaagagcaagtttatggcccactag

SEQ ID NO: 52521 - DNA, 993 bp, Artificial Sequence
  Description of Artificial Sequence: Synthetic coding sequence
tgaagcgagatggccgcccgggacgagctgggcctgggcggcgactcactcgaagccatgcccgtaccagcagcgcgggggaggccacgtattaccaatgggcctgaggagctcgctgcaccttccccagctgccctcgctgactacgaagggaaggatgtggctacaagagtgggcgaggcctggcaagagcggcccggggccccacgcgggggccagggtgacccagccgtcccagcccagcaacccgccgatccttctaccccggagcgccagagttcgccaagtggctccgagcagctggtaaggcgagagtcttgtggttcatccgtgcttacagactttgagggtaaggatgtggcaacaaaagtgggcgaggcttggcaagatcggccaggggctcctaggggcggccagggtgacccagccgttccaacccagcaacccgcggatccatccaccccagagcagcaaaatagtccgtcggggtctgaacaatttgttcggagggagagctgtacctcccgtgtgaggagtccttcctcttgcatggtgaccgtgactgtgacagctacaagtgagcaaccccacatttatataccagcaccagcatcggaacttgactcctcatccacgaccaagggtatcctgtttgtgaaagagtacgtgaatgcctccgaagtatcctccggtaagcccgtcagcgctaggtacagcaatgtcagtagtattgaggacagttttgccatggaaaagaaacccccctgtggatccacaccatactctgagcgaactacaggagggatctgcacttattgtaatcgggagatcagagactgccctaaaattaccctggaacacctcggcatctgctgccacgagtattgctttaagtgcggcatctgttccaagcccatgggggatctgttggaccaaattttcattcatcgggacaccattcactgtggaaagtgctatgaaaagctcttttag

SEQ ID NO: 52522 - DNA, 1167 bp, Artificial Sequence
  Description of Artificial Sequence: Synthetic coding sequence
atggccgccgtgagccccaccacccggtgccaggagagcgtgacctttgaggatgtcgcggtcgtctttacagacgaggaatggtcacggctcgtgcctatccaacgagacctatacaaagaggtgatgctcgagaattataactctatcgtgtccctggattgggaaactaagcccgagatccacgacgcctcggacaagaagtcagagggctcgctccgagaatgtttaggaagacagtctccattgtgtcctaagttcgaggtccacacccctaacgggagaatgggcacagagaaacagagccctagcggcgagaccagaaagaagtctctttccagggataagggactccgacgacggaggagcgctctgagtagagagatacttaccaaggaacgccaccaagaatgtagtgactgtggcaaaactttctttgatcacagcagtcttaccaggcaccagagaacccacacgggagaaaagccctacgattgcagagaatgcgggaaggccttctcacatcggagctctctgagccgccacctgatgtcccacaccggggaaagcccttacgaatgttctgtttgtagtaaagccttctttgaccgaagcagtctgacagtgcaccagcggatccataccggggaaaagccattccagtgtaacgagtgcggaaaagccttctttgatcggagctccttaaccaggcatcaaaggatccacaccggggagagcccttacgagtgtcaccagtgcgggaaggccttctcgcagaaaagcatccttactagacaccagctcatccacacagggcgcaaaccttacgaatgtaatgagtgtgggaaagcattttacggggtgtcatccctgaatagacaccagaaagcccatgcaggcgatcccaggtatcagtgcaacgaatgcggcaaggcatttttcgatagaagcagccttacccagcaccagaagatacacacaggggataaaccctatgaatgttccgaatgcgggaaggcattttcacagcgatgtaggttaaccagacatcagcgggttcacactggcgaaaaaccatttgagtgcactgtgtgcggcaaggttttcagctcaaagtcttcagtgatccagcaccagagacgctacgccaagcagggcatcgactag

SEQ ID NO: 52523 - DNA, 2049 bp, Artificial Sequence
  Description of Artificial Sequence: Synthetic coding sequence
atgatccccaagcaggacatcagcgaggagctggagagccagcgggccaagtctgaagaccacgtgagaaatatattcaaggaaaccgaggaaatgtcaaaaaccgagggtaagcttgagaactgctggcggaaatatgccgttgagggagtgaagaacagcttctctcagaagtctaattttcgcgagatcaccatgcgctatgtaaagacactttcacgggagaacgggcagaaattcaacgctgttggagaaaactgtatcacagactcaaaccctgccaaacatcttcggggatctcgggaggagtcgttgcaccctagtgtctccagcgtggagaatttgcaacagcacgaagatctaatcaacctccagtccttccagctaggggaaagagcctaccagacagacgttctcgtcaaagtgccacggcagtcaagcgtgctgagcgagaaccagcgtatgaacaatccagagagatggtttgagagcactgggtgcggcaagacttacaaccaaaaccgagctttcaaccagcaccaacgttttcactcgggcgaaaaaacctatgaacataacgaatgcggcaaggcattctcttggccgtcaatcctgtcaaagcaccagcggatacataccggcaagaaactgtacacctgtgaagattgcggaaaatccttctccgtccactcctattttattcagcattgcaagatccatactcgggaaaagccgtacgagtgtattaagtgcggcaaggcattcagcacccattcttcatacgtgcaacacttgaagatacacaccggagaaaaacatcacgagtgtaaccagtgcggcaaggcattctcccactcatccaatctcatccaccatcagcgtattcactccggcgagaagccttataaatgcaaagagtgcggtaaggcgttcaacaggcagtctaaccttatccagcaccagaggatacattccggagaaaagccctatgactgtaaggagtgcgggaaagcattcagcacccagttgttcctgattcagcatcagcgaattcataccggagaaaagccgtacgagtgcaatgaatgcgctaaaagcttcagccttaaccggaccttgaccgtccaccagcgaatccatacaggcgaaaagccctaccggtgcaacgaatgcggtaaaagcttcagccagtgctctcaagtgattcagcataagcgcatacacaccggagaaaaaccatacatttgtaatgagtgtgggaaatccttcggcgctcggctttctctgatccagcatcagcggattcatacgggcgagaagccgtatggatgtagggaaaaaccgtacgaatgctccgagtgtggcaaggccttcagccaaagtttcaacctgattcaccatcagaggacgcacaacggagaaaaaagctacgagtgcaacgagtgcgataaggccttcagccttctcagctccctcgtgcagcatcagaggattcataatggtgataaaccatatgaatgccataagtgcggcaaagcattttctcaagggagccacctcattcagcaccaaaggtcccacatcggggaaaaaccttacgagtgtaatgagtgtgggaagacctttggtcaaatctccactcttattaaacacgagagaacacacaatggtgagaaaccttacgagtgttctgactgcggcaaggctttttctcagtcagcccacctgattcaccaccaacgcattcacacaggggagaatccttacgaatgtagtgagtgcggtaaggccttcaatgtttgttcaagcctgatccagcaccacaggattcatacaggcgagaagccatacgagtgctcggactgtggtaaggcattcagtcagcactctcagttcattcagcatcaacggatacatactggggagaaaccttatatgtgtaacgagtgtgagaaatcattcagcgcctgtttatcacttatccagcacaagcggattcacactggggaaaagccttatgtgtgtgccaaatgtgggaaatctttttag

SEQ ID NO: 52524 - DNA, 1419 bp, Artificial Sequence
  Description of Artificial Sequence: Synthetic coding sequence
atgatgggcacctacggcaacctgctgagcctgggctgcgacagccggatagaaaaagaagaaatgattccgaagcaggatataagcgaggagcttgaatcacagagggctaagagcgaagaccacgtaaggaacatctttaaagagactgaggagatgagcaagacagagggtaagctcgaaaattgctggcggaagtatgccgtcgagggggtcaaaaactcattcagccagaaatccaatttccgagagatcactatgcgttatgtgaagacactgtctagggaaaatggtcagaagttcaatgctgtgggagagaattgcattacggactcaaatccggccaagcacctccgcggatctagggaggaaagcctgcatcccagcgtgtcctcagtggaaaacctgcaacagcatgaggacctcataaacctgcagagcttccagctgggggaaagagcctatcagacagatgttttggtgaaggtccccagacagagcagtgtgctctctgagaatcagagaatgaataatcctgagcgctggtttgaatctactggctgcggcaaaacatacaaccagaaccgcgcattcaaccagcaccagaggtttcatagtggggagaagacgtatgagcacaacgagtgcggcaaagctttctcctggccgtccattctaagcaagcatcagcgcatacacactggaaaaaagctttacacgtgtgaggactgtgggaagagcttttctgttcactcttactttattcagcactgtaaaattcacacgagagagaaaccatacgaatgtatcaaatgcggcaaagcgttttcaacccatagttcgtatgtccaacacctgaagattcatacgggagagaaacaccatgagtgcaatcagtgcggcaaggcttttagtcacagctccaacctgatccaccatcaacggatacacagtggcgagaagccgtataagtgcaaagaatgcggtaaaacctttggccagatcagtactctaattaagcatgaacgcactcacaatggagagaagccttacgagtgctcggattgcgggaaggcgttttcccagagcgcacatctcatccaccatcaaagaatacacactggcgaaaatccatatgaatgttccgaatgtggtaaggcctttaacgtgtgtagcagtctgatccagcatcacagaattcacaccggggaaaagccgtatgagtgtagtgactgtggaaaagctttttcccagcactctcaatttatccagcaccagcgtattcacactggggagaagccctatatgtgcaacgagtgtgagaagtccttctctgcctgcctgtcccttatacaacacaagaggattcatacaggtgaaaaaccttacgtgtgcgctaagtgcggtaagtctttctag

SEQ ID NO: 52525 - DNA, 1200 bp, Artificial Sequence
  Description of Artificial Sequence: Synthetic coding sequence
atgagccaggtgaccttcagcgacgtggccatcgacttcagccacgaagagtgggcttgtctcgactcagcacagcgggacctttataaggatgtgatggttcagaattatgaaaaccttgtctcggtgggcctcagcgtgactaagccctatgtgatcatgctgttggaggacggtaaggagccttggatgatggaaaaaaaattgagcaaagactgggagtcacggtgggaaaacaaggaactcagcaccaaaaaagacatctacgatgaagactccccacagccggtgaccatggaaaaggtggtaaaacagtcatatgagttcagcaatagcaacaagaatcttgagtatactgaatgcgacactttcaggtccactttccatagcaagtctactctctcagagccacagaacaatagtgctgagggaaacagccacaagtacgatattcttaagaagaatttatctaaaaagagcgtcatcaaaagtgaacggatcaatggtgggaaaaaactgctgaatagcaataaatccggggcggccttcaaccagagcaagtccctaactctcccgcaaacttgtaacagagaaaagatttatacctgctcagagtgtggaaaggcatttggaaaacagagtatcctatctaggcactggagaattcatacgggtgagaagccatacgagtgccgtgagtgtggcaagaccttctctcacggctcaagcctgactcgccaccaaatttctcactctggagagaagccctacaaatgcatcgagtgcgggaaagccttcagccatggctcatccctaacaaaccatcagagcacccacactggagagaagccatacgagtgcatgaattgcggcaaatccttctctcgcgtgtctctgctgatccagcacttgcggattcacacacaagagaagcgttatgagtgcagaatttgtggaaaggctttcatccattcgtcatctctcatccatcatcagaaatcccacaccggggagaagccttatgaatgcagggaatgtgggaaggccttctgttgctcatctcatttaacccagcaccaacgcattcactccatgaaaaagaagtacgagtgcaataagtgcctcaaagtgttcagctcattttcttttcttgtccagcatcagtctattcacactgaggagaaaccgttcgaggtgtag

SEQ ID NO: 52526 - DNA, 1332 bp, Artificial Sequence
  Description of Artificial Sequence: Synthetic coding sequence
atgagccagcggcagtaccccgagtgctacctggcccccaacggctgccttgtgagcaactgcggggtgaataaaatgtcaaatgaagagcttgtgggccagaaccatggcatggagggggaggcctgcactgggggagatgtgactttttcagacgttgctatcgatttctcacacgaagagtgggcttgcttggactctgcccaacgggatttgtataaggacgtaatggtccagaactatgaaaacctggtttccgtcgggttgagtgtcacaaagccgtacgtgattatgcttctggaagacggaaaggagccatggatgatggaaaagaagctcagtaaggattgggagtccaggtgggaaaacaaggagttgtcaacaaaaaaagatatttacgatgaggattctcctcaaccggtcacaatggagaaagtagtgaaacaaagctacgagttctccaatagcaacaagaatttggaatatacagagtgcgacaccttccggagcacatttcactctaaaagtacacttagcgaacctcagaacaactccgccgagggcaattcccacaaatacgacatccttaaaaaaaatctctctaaaaaatcagtgatcaaatccgagagaataaacggagggaaaaaactcttaaactctaataaatctggcgcagcgtttaaccagtccaagagtctgaccctgccgcagacatgtaatagggagaaaatctacacctgctccgagtgcgggaaggctttcgggaagcagtctatactgagcaggcactggagaattcacaccggtgagaagccttacgagtgccgagaatgcggcaagactttctcccacggatcttctctgacccggcatcagatttcccatagcggcgaaaaaccttacaaatgcatcgagtgtggaaaggcattctcccatggctcatctctcactaaccatcagtccacccataccggcgagaaaccctatgagtgtatgaactgtggaaaaagtttctcccgggtgtcattgctaattcagcacctgcgtatccatacacaggaaaagcggtacgagtgccgcatttgtggtaaagccttcatccattcctcttccctcattcatcaccagaaatcccatacaggcgaaaaaccatacgaatgtagggagtgcggaaaggcgttctgctgctcatcccatttgactcagcatcaaagaattcactccatgaagaaaaagtatgagtgcaacaagtgccttaaagtgttttcctccttctcatttctggtgcagcaccaatccatccacacagaggagaagccattcgaggtgtag

SEQ ID NO: 52527 - DNA, 1200 bp, Artificial Sequence
  Description of Artificial Sequence: Synthetic coding sequence
atgagccaggtgaccttcagcgacgtggccatcgacttcagccacgaggagtgggcgtgcttggactcagcccagcgagatctgtataaagatgtcatggtacagaattacgagaacctcgtttcagtcggcctgtccgtaacaaagccctatgtgatcatgctcctcgaagacggtaaggagccttggatgatggaaaagaaattgtctaaggattgggagtccagatgggaaaacaaggagctatccacaaagaaagacatctatgatgaggactcaccacaacctgttaccatggagaaggtcgtcaaacagagctatgaatttagcaactccaataaaaacctggaatatacggagtgcgatacatttcgtagcacctttcactccaagagcactctgtccgagccgcagaataacagcgcggaaggcaattcacataaatacgacatcctgaaaaagaatctatccaagaagagcgtcattaagagcgaacgtatcaatggaggcaagaaactcctgaattctaacaaaagtggggcagcctttaaccagagcaagtctctgaccttgccgcaaacatgtaatcgagagaaaatctacacctgcagcgaatgcggaaaggccttcggtaaacagtccatcctgtctaggcattggcgaattcacacaggcgagaaaccctacgaatgtcgcgaatgcggaaagacattttcccacggaagctctcttactcgccaccagataagtcattcgggggagaaaccatacaaatgcatagaatgtggaaaggctttcagccacggctccagcctcaccaaccaccagtccacacacaccggcgaaaaaccctacgagtgtatgaactgcgggaagtcattttcacgcgtgtcactgctgatccagcatttgcggatacacacgcaggaaaaaagatacgaatgcagaatttgcggcaaggcttttattcactcctcatccttaatccatcatcagaaaagccacactggggaaaagccgtacgagtgccgcgaatgcgggaaggccttttgttgttcgtctcacctgactcaacaccaacgcattcattcaatgaaaaagaaatatgagtgcaacaagtgccttaaagttttcagctcttttagcttccttgtgcaacatcagagcattcatactgaggaaaagcctttcgaggtgtag

SEQ ID NO: 52528 - DNA, 429 bp, Artificial Sequence
  Description of Artificial Sequence: Synthetic coding sequence
atgagccaggtgaccttcagcgacgtggccatcgacttcagccacgaggaatgggcctgcctggattcagcccagagggacttgtataaggatgtcatggtgcaaaattatgaaaacttagtgagtgtgggcctgtcagttaccaaaccttacgtgatcatgttgctcgaggatggaaaggaaccctggatgatggaaaagaagttaagcaaagattgggagagtaggtgggaaaataaggaactgtccacaaaaaaggatatctatgatgaggacagtcctcagccggttacgatggaaaaagttgtgaagcagtcatacgagttttctaactcaaataagaaccttgagtacaccgagtgcgatacattccggagtactttccactccaagtcaacactttccgaaccacaaaacaattccgcgtag

SEQ ID NO: 52529 - DNA, 1200 bp, Artificial Sequence
  Description of Artificial Sequence: Synthetic coding sequence
atgagccaggtgaccttcagcgacgtggccatcgacttcagccacgaggagtgggcttgccttgactccgcacagcgtgacttgtataaagacgttatggtacagaactatgaaaatctcgtctcagtggggctgagtgtcacgaagccttacgttatcatgctcctggaagacggcaaggagccatggatgatggaaaagaagttatccaaagactgggagagccgctgggagaacaaggaactgagcactaagaaagacatttacgatgaagactccccgcagcctgtcacgatggagaaggtggtcaaacaatcctacgagtttagcaattccaataaaaacctggaatatactgagtgcgatacctttaggtctacgttccactctaagagtacccttagcgagccacaaaacaacagtgcggaaggcaactctcacaaatatgatatcctcaagaagaacctctctaagaagagtgtgatcaagagtgagcgtatcaatggggggaagaagttgctaaattctaataagagtggagccgcgttcaaccaatcaaagtccctgacgctgccccagacgtgtaaccgggagaaaatctatacctgctcagagtgtggcaaggcattcggcaaacagtccatactgtcaagacattggcggattcacacgggggagaagccttatgagtgccgggaatgtgggaagacttttagtcacgggtctagtctcactaggcatcaaatctcgcatagtggcgagaagccttacaaatgcatcgaatgcgggaaagctttcagccatggtagctccctgaccaatcatcaaagcacccacactggtgaaaagccatacgagtgtatgaactgtggaaagtccttctcgagagtcagcctgctcattcaacatctgagaattcacactcaagaaaaacgttacgaatgcagaatttgcggaaaagcgttcatccattcctcctccctcattcaccatcagaaatctcatacaggtgaaaagccatatgagtgtcgagagtgcggtaaggccttctgttgcagctctcatctgacccagcatcagagaatccactccatgaaaaagaagtatgaatgtaacaagtgccttaaggtctttagctccttctcctttctggttcaacaccagtcaatccatacagaagaaaagcctttcgaagtatag

SEQ ID NO: 52530 - DNA, 399 bp, Artificial Sequence
  Description of Artificial Sequence: Synthetic coding sequence
atgagccaggtgaccttcagcgacgtggccatcgacttcagccacgaagagtgggcctgtctagattcagcccagagggatttatataaggacgtaatggtgcagaattacgagaatcttgtgtcagtggccggcctgtctgtgaccaagccttacgtgattatgctgctcgaagacggtaaagagccatggatgatggaaaagaaattgagcaaggcttatccgttcccgctctcacacagtgtccctgcctctgtcaatttcggcttttcggccttgttcgagcattgttcagaggtgaccgaaatcttcgagctcagcgagctatgtgtattctgggtactgcacttcctgtcaaatagtccaaatagcacggtcgaagccttttttaaaaaatag

SEQ ID NO: 52531 - DNA, 399 bp, Artificial Sequence
  Description of Artificial Sequence: Synthetic coding sequence
atgagccaggtgaccttcagcgacgtggccatcgacttcagccacgaggaatgggcctgcctggattccgctcaaagagatctctataaggacgtgatggtgcagaactacgagaaccttgttagtgtagccggcctgtccgttacaaagccctacgtgataatgctgctcgaggatgggaaagaaccatggatgatggagaagaagctgtctaaggcatacccttttcctttgtcccatagtgtgccggccagtgttaacttcggtttctccgctctgttcgagcattgttctgaagtcaccgaaatcttcgagctcagcgagctctgcgtattctgggtcctccacttcctgtcaaattctccgaactccaccgtggaggccttctttaagaaatag

SEQ ID NO: 52532 - DNA, 2001 bp, Artificial Sequence
  Description of Artificial Sequence: Synthetic coding sequence
atgcaggaggtggtgctgctggacgagagcagcggcccccccagccagctcttgtggacgcgccaggatacgcagctgcctcaagagtctgctctcctgcctgcaccctatccagcatttactaaagatgggtctcaggggaatttaccccaagctgacatcactttgatgtcacaggcacaggagtccgtcacctttgaagatgtcgctgtgaacttcactaaccgggagtggcagtgtttgacctatgcccagcgacatttatataaggatgtgatgctggagaattacggtaatatggtctctctcggatttccttttcctaagccgccattgattagccatctcgaaagagaggtggatccctgtgtacaggatccacaggatagggaaagtttgtcttgtagctaccctgtgtccgctgacaagatgtggcccgagaatgaaaaagcgagctcgcagcaggaaatctttgagaacggcgaagcatactggatgaaattcaattctttgctaaaggtggactcacgggatcccaaggtccgggaggtgtgtgtccaagacgtgaagctggagaaccaatgggagactagtatccgcgagaagctacgcgaggaaaaagagggcagtgaggaggtaacatgtaaaaagggcaagaaccaaaaagtactgtcgaagaacctgaacccaaactcaaaacattcccaatgcaacaaggtgcttatcgctcaaaaactgcatgagtgtgcacgatgtggcaaaaatttttcctggcactcagatctgatcctccacgaacagatccattctggggagaaaccacacgtgtgcaacgaatgcggcaaagcttttaaaacaaggaatcagctatccatgcatcggattatccataccggcgaaaagcccttcaattgtacacaatgtggcaaagcatttaactcccgaagtgccctgtgtcgacacaaaaagacccattctggggaaaagccacatgaatgtcgcgactgtggaaaggcattcaaaaccagaaacaggctgtgtatgcaccagttaatccatactggggagaaaccatacaagtgtaactgttgtggaaaggcctttcagtttaagcacagtcttacaattcatggccgaatacacacaggagagaagccatatgagtgtgaagaatgcggcaaggcttttagtggatcaagtgacttaacgaaacatattcggatccacacgggcgaaaggccctatgagtgtagcaagtgtggtcgcgctttcagtcgttcctctgatctctccaagcacaaacggatccacacccgcgagaaacactatggctgcccgcagtgcgggaaagattttagcatcaaggcagaattgaccaagcaccgcaggatccacactgaggaaaaacgatatcggtgtgaagagtgcgggaaagccttcagacataactgcaagcggagggctcatgagcgagaacacaccggtgaaaagccgtaccagtgcagggactgtgggaaaactttccaagaccaacattgtcttactatccatcagaggatccatactggcgagaagccttacaagtgccttgaatgcggtaaggccttctccggtaaatctaatctcacaaaccatcggcgtattcatacgggtgaaaaacctcacaaatgtgaggtgtgcggaatggccttccaccatagctcagttcttcggcaacataaacgcattcatacaggggagaaaccgtatacctgcagcgagtgtggcactagtttcaggcagggctctgctctgattgggcacaaacgcgtccatactggggagaagccgtatgaatgtgaagagtgcggaaaagcatttcgagtgtcttccaaccttaccggacacaagaaaagaaagcaccaagtttggagcacccacgagctggacgggtcacggaagagcctttcaccagtgacagtaagtcagacgtccgttgtaagcatcctaacaagcgcatag

SEQ ID NO: 52533 - DNA, 1725 bp, Artificial Sequence
  Description of Artificial Sequence: Synthetic coding sequence
atgctggagaactacggcaacatggtgagcctgggcttccccttccccaagccccctctaatcagtcaccttgaaagagaggtggatccctgcgtgcaagatccacaggatcgtgagtcactgtcatgctcctaccctgtatccgccgataaaatgtggccagagaatgaaaaagcctcaagccaacaagaaatctttgaaaatggcgaggcgtactggatgaaatttaacagtctgctgaaagtcgactctcgggatcctaaagtcagagaagtttgcgtccaggacgtgaaactagagaatcagtgggagacaagcatcagagagaagcttagggaagaaaaggaagggagtgaggaggtaacgtgcaagaagggaaaaaaccagaaagtgctgtctaagaatctcaaccctaatagcaagcacagtcagtgtaataaagtgctgatcgctcagaagcttcacgaatgcgcgaggtgtgggaaaaactttagctggcactcagacctaattttacacgaacagattcatagcggggagaagccacacgtgtgtaatgaatgcggcaaagcttttaagacgagaaatcagctgagtatgcatcgtattattcataccggggaaaaaccatttaactgtactcaatgtggcaaagcattcaattcccggagcgcactatgtcggcataagaagacacactccggggaaaagccccacgaatgcagagactgcggcaaagcatttaagactcgcaatagactctgcatgcatcagctaatacacaccggcgaaaagccttataaatgtaattgttgcggaaaggcctttcaattcaaacactctttgaccattcatggcagaattcacaccggagaaaagccttatgaatgcgaggagtgcggcaaagctttcagcggcagctctgatcttacaaagcatatcaggatccataccggagagagaccctacgagtgcagcaagtgcggcagggctttcagccggtccagtgacttgtccaaacataagaggatccacactcgggagaaacactatggttgtccccagtgcgggaaagattttagtattaaggccgaactgacgaagcaccggcgaattcacactgaggaaaagcgctacagatgcgaagagtgcggcaaagctttccgccacaattgcaagaggagggcacacgagcgtgagcatactggcgagaagccctatcagtgtagggattgcgggaaaacgttccaggatcagcactgcttgaccattcaccagcggatacacaccggcgagaaaccttacaagtgtctggaatgcggcaaggccttttctggtaaaagcaaccttacaaaccacaggaggattcacactggagaaaagccccacaaatgtgaagtgtgtggcatggccttccaccattcctctgtgctccgccaacacaagcgtatacacaccggcgagaagccttatacctgctcggaatgcggtacctccttccgtcaaggaagcgcacttattggccataagagggtccacactggggagaagccatatgaatgcgaggaatgtggtaaagcgtttcgggtgagcagtaacctgaccggtcataagaagagaaaacaccaggtatggtcgacacacgaattagatggcagccggaagagtctctcacccgttactgtcagccaaaccagcgtagtgtccatattaacatcggcttag

SEQ ID NO: 52534 - DNA, 702 bp, Artificial Sequence
  Description of Artificial Sequence: Synthetic coding sequence
atgctgcgggaggaggccaccaagaagagcaaggagaaggagcccggaatggcactaccacagggaagacttactttccgtgatgtggccatcgaattctcactggaggagtggaagtgtctcaatcccgctcagagggccttgtaccgggcggtgatgcttgagaactacagaaatctggaatttgtcgacattagcagcaagtgcatgatgaaagagttttcttccacagcccaggggaacaccgaagtcatacatacaggcacactgcagaggcacgagtcacaccatattcgggatttctgttttcaggaaattgagaaagacattcacaattttgagttccaatggcaggaggaagaaaggaatggccatgaagcccccatgaccgaaatcaaagagctcacaggaagtacggacagacacgatcagagacatgccggcaacaagcctatcaaagaccaattgggcagcagcttccacagccacttgcccgaactacacatctttcagcccgagtggaaaatcggaaaccaggtggaaaaatctattattaatgcatctctgattctgaccagtcaaagaatctcctgctcccctaaaactagaatttctaataattacggtaataattccctgcacagctctctccctattcagaagctcggcagcactcatgaacggaaaatattccccatgtag

SEQ ID NO: 52535 - DNA, 1209 bp, Artificial Sequence
  Description of Artificial Sequence: Synthetic coding sequence
atgtacaccagcgaggagaagtgcaaccagcggacccagaagcggaagatttacaacgtgtgccctcgcaagggcaagaagatattcatccatatgcacgagatcattcagatcgacggtcacatctaccagtgcctggagtgtaaacagaatttttgtgaaaacctggccctgattatgtgcgagcgcacgcacaccggcgagaaaccttataagtgcgatatgtgcgagaagacatttgttcagtcctcagatctgacctcccaccagaggatccataattacgaaaagccctataaatgttctaaatgtgaaaaaagtttctggcatcatctggccctaagcggtcaccaacgaacacacgctggcaagaagttctacacatgtgacatatgtggcaaaaatttcggacagagctcagatctgctggtccatcagcggtctcacaccggtgaaaagccgtatctgtgctccgagtgtgataagtgcttctcgcggtctacaaacttaatcagacaccgacgcactcacacaggggagaagccatttaagtgtcttgagtgcgagaaggctttcagcgggaaatctgatctcatctcacaccagcgaacccatacgggggaaaggccgtataaatgtaataaatgcgaaaaatcgtatcggcatcgctcagccttcatcgtacacaagagggtgcatacaggagagaaaccatataaatgtggggcctgcgagaaatgcttcggccagaaatctgatctcattgttcaccagagagtgcacaccggtgagaaaccctacaagtgcctagagtgcatgcgctccttcacaagaagtgcaaaccttatcaggcatcaagcaacgcacactcatacgtttaagtgtctggagtacgaaaagtctttcaactgttcctctgatctaatagttcaccaacggattcacatggaggaaaagccccatcagtggtcagcatgcgagtcaggcttcctgctcgggatggattttgtcgcccagcagaaaatgcggacccagactgaggaactccattacaagtataccgtatgtgataagtctttccatcaatcctcagccctgttacagcatcaaacggtgcacatcggtgaaaagccatttgtatgtaatgttagtgaaaagggtttagaattgagcccgcctcatgcaagcgaggcctcccagatgtcatag

SEQ ID NO: 52536 - DNA, 744 bp, Artificial Sequence
  Description of Artificial Sequence: Synthetic coding sequence
atggtgacccagctgcggtacgagagcttctgcctgcaccagttccaggagcaggatggggaaagcattccagagaatcaggagctcgcctcaaagcaggagattctcaaagagatggaacatctcggggactcaaaactgcagcgcgacgttagcttggatagtaaatacagggagacgtgcaaaagagattcaaaggctgagaagcagcaggcgcattcaactggcgaacggagacatcgctgcaacgagtgtggcaagagcttcactaagtcctcagtcctgattgagcaccagaggatccacacaggtgaaaagccctacgagtgcgaagaatgtggcaaagctttctccaggagatcctccctgaatgaacaccggcgctcgcacactggagagaagccttatcagtgcaaagaatgcgggaaggctttttctgcctcaaacgggctgacccgccaccggagaatccataccggggagaaaccgtacgaatgtaaggtgtgcgggaaggcatttctcttgagctcctgtctcgtccagcaccagcgcattcacacaggcgagaagaggtaccaatgcagagaatgtggtaaggcttttattcagaatgcaggcctcttccaacatctgcgggtgcacactggcgaaaagccataccagtgctcccagtgctcgaaactgtttagcaagaggactctactgaagaaacaccagaaaatacatacgggagaacgcccgtag

SEQ ID NO: 52537 - DNA, 1653 bp, Artificial Sequence
  Description of Artificial Sequence: Synthetic coding sequence
caggtgcccctgaccttcagcgacgtggccatcgacttcagccaggaggagtgggaatacctgaacagcgaccagagagatctgtacagagacgtgatgttggaaaattatacaaatttagtttctctggatttcaacttcactaccgaatccaataagctgagctcggagaagcgaaactatgaggttaacgcatatcatcaggagacttggaagaggaacaagacattcaatctcatgcgctttatcttccgcaccgaccctcagtacaccattgagttcggcagacagcagaggccgaaagtaggctgcttctctcagatgatatttaagaagcacaaatccctgcccctgcacaaaaggaacaacacacgggagaagtcttatgaatgtaaggaatacaagaaggggttcagaaagtacctccatctaacagaacatctgagggaccataccggggtcattccctatgagtgcaatgagtgcggaaaggcctttgtggtgttccaacactttatccggcaccgtaagatccacaccgatcttaaaccctatgaatgtaacggctgtgagaaagcctttagattttattctcagttgattcaacaccagatcattcatacgggaatgaagccctacgagtgcaagcagtgtgggaaggctttcagacggcattctcacctgacagagcaccagaagatccatgtcggtctgaaaccattcgaatgcaaggaatgcggggagaccttcagactgtaccgccatatgtgcttacatcaaaaaatccaccacggggtgaaaccttacaaatgcaaggaatgtgggaaggcctttggacatcggagtagcctttaccagcataagaagatccactccggagaaaagccttacaaatgtgaacagtgcgagaaggccttcgtgcgaagctatctgctggtcgagcaccagcgcagccatacaggggagaagccacacgaatgcatggaatgtggaaaagcattcggaaaaggctcttctctgttgaagcacaaacgcatccactcttctgagaagctctatgactgcaaggactgcggaaaggctttttgccggggatcccagttgacacagcaccagcgtattcacaccggggaaaagccgcacgaatgcaaggagtgcggcaagactttcaagctgcattcatacctgatccagcatcaaatcattcacaccgacttgaagccatatgagtgtaagcagtgcgggaaggccttcagccgtgtcggcgacctcaaaacccaccagtccatacacgcgggcgagaaaccatacgagtgcaaggagtgcggcaaaacatttcgtttgaactcacaactaatctaccaccagaccatccatacaggactgaaaccctatgtatgtaaggaatgcaaaaaggcttttcgatcgattagcggtctgtctcagcataaacgcatacacacaggagaaaagccctacgaatgtaaagaatgtgacaaagctttcaatcgttccgaccgactcacccagcacgaaacgattcacacaggcgtcaagcctcagaaatgcaaggaatgtggtaaagctttcagtcattgctatcagctgtcccaacaccagcggttccaccatggcgagcgtttactgatgtag

SEQ ID NO: 52538 - DNA, 1668 bp, Artificial Sequence
  Description of Artificial Sequence: Synthetic coding sequence
atggccttcacccagctgaccttccgggacgtggccatcgagttctcccaggacgagtggaagtgtttgaactcaacccagagaaccctatacagagatgtgatgctggagaattacaggaatctagtgagtttagatctttctcgtaattgcgttatcaaagagcttgcgccgcaacaggaaggcaatcctggcgaagtattccacacagtgacattagaacaacacgaaaagcatgacatcgaggagttctgctttcgagaaattaagaagaaaattcacgattttgattgtcaatggcgggacgatgaaagaaattgcaacaaggtgacgaccgctcccaaagaaaacctaacttgcagaagagaccagagagatcggcggggaattgggaataagtcaatcaaacatcaacttggactttcctttctgccccatccacacgagcttcagcagtttcaggctgagggaaagatttatgagtgtaaccatgtcgaaaagagtgtgaatcacgggtctagcgtcagtccgccccaaatcatctctagtaccattaaaactcacgtttcaaataagtatggaacagacttcatctgctcctctctgctgacacaggagcagaaatcgtgcatccgggagaaaccctacagatacatcgagtgtgacaaggcactgaaccatgggagtcacatgacagtgagacaggtgtctcactccggcgagaagggctataagtgtgacctctgtggaaaagtgtttagtcagaagtctaatctggctcgccattggagagtccatacaggcgagaagccctataagtgtaatgaatgcgatcgctcctttagccgcaactcctgcctggctttacatcgacgggtgcacaccggcgagaagccttataagtgttacgagtgcgacaaggtattctctcgcaactcctgtttggccctgcaccaaaagacacacatcggagagaaaccctacacttgtaaagaatgcggcaaggccttcagcgtacggtcgactctcaccaatcatcaggtaatccactctggtaagaagccctacaagtgcaatgagtgcgggaaggttttcagccagacaagttctctggccactcaccagcgcatccacaccggagagaagccatataagtgcaacgaatgtggcaaagtgttttcccagacctcaagcttggcacgtcactggcgcatccacactggggaaaaaccatacaagtgtaatgaatgtggcaaagtgttttcctataattcccacttggcatctcataggcgggtgcacactggggagaagccttacaaatgcaacgagtgtggcaaagccttctccgtgcacagcaatcttactacgcatcaggttatccacaccggtgagaagccatataaatgcaatcagtgcggcaagggttttagcgtccatagttcactgactacgcatcaggtgattcacacaggagaaaagccatataaatgtaacgaatgtggaaagagttttagcgtgaggccaaatcttaccaggcatcagataatccatactggcaagaaaccatacaagtgtagtgactgcggaaaatcttttagcgttaggccgaatctatttcgccaccagattatccacactaaagaaaagccgtacaagaggaactag

SEQ ID NO: 52539 - DNA, 1704 bp, Artificial Sequence
  Description of Artificial Sequence: Synthetic coding sequence
atgcccgagctgtacaccgaggacttcatccagggctgcgacgtgggggaactgcaagagcctgggttgcctggcctagagtgtaacggggctatttccgcacactgcaacctcagacttcctgactcaaacgactctcctgcaagcgcttcccgggtggcaggcatcaccgacttgtctcgaaactgtgttattaaagaacttgcgccgcaacaggaaggtaacccgggagaagtgttccataccgtgacactggaacagcacgagaaacacgatatagaggagttttgtttcagggagatcaaaaagaagattcacgacttcgactgccagtggcgagatgatgaaagaaactgtaataaggtgaccaccgcccctaaggagaatctgacttgtagacgtgaccagcgggacagaaggggcatcggcaacaagagtatcaagcaccagctcggtttatccttcttaccccatcctcatgagctgcagcaatttcaggccgagggcaagatctacgaatgtaatcacgtcgaaaagtctgtcaatcatgggtcatctgtgtcccctccgcagatcatatcatccaccatcaagactcacgtgagtaataaatatggcactgactttatttgcagttcattgttgacccaggagcagaaaagctgtatccgagaaaagccataccggtacatcgagtgtgacaaggctctcaaccacgggtcacatatgaccgtgaggcaagtatcacactcgggcgagaaaggctataaatgtgatctatgtggaaaggttttcagtcagaaatccaatctcgccaggcattggcgggtgcatactggcgagaagccatataaatgcaacgaatgtgacagatctttttctagaaacagttgcctcgctctgcatcgcagagtccataccggcgagaaaccatataagtgttatgagtgtgacaaggtcttttctagaaactcctgcctagctttacaccagaagactcacattggcgagaagccctatacctgcaaggagtgcgggaaagccttctcggtccgatccactctcaccaatcatcaggttattcactccgggaaaaaaccctataagtgcaatgaatgcggtaaggtgttctcccagacttcctctttggcaacgcaccagagaatccacacaggtgagaaaccttataaatgtaatgagtgtggcaaggtcttttcacagacgagttcgctcgcccggcactggcgaatacacaccggagagaaaccatacaaatgcaacgagtgtggcaaagtatttagttataacagtcatctggcaagtcacaggagggtacatactggggaaaaaccatataaatgcaacgagtgtggaaaagctttttccgtgcatagcaatcttacaacgcaccaggtgatacacaccggggaaaagccttataagtgcaaccagtgtggcaaagggttcagtgtccactcgtccctgaccacacatcaggtgatccatacaggagagaaaccatataaatgtaacgaatgcgggaagtcatttagcgtcaggcccaatctcacacggcaccagattatccataccgggaagaaaccctataagtgctcggattgcggcaagagtttctccgttagacctaacttgtttcgccatcagattattcatactaaggaaaaaccttataagcgtaattag

SEQ ID NO: 52540 - DNA, 1629 bp, Artificial Sequence
  Description of Artificial Sequence: Synthetic coding sequence
atgtgggagcaccggaaggagccctggaccatcgagagccaggtgagagtcgctaggaagcctaaaggctgggagtggataaagggagtgaagacagacctgagcagaaattgtgttatcaaagagctggcccctcagcaagagggaaatccaggggaagtgtttcacacagtgaccttagagcagcacgaaaaacatgatattgaggagttctgctttagggaaataaagaagaagatacatgacttcgattgccagtggcgagacgacgaacgcaactgcaataaagtgaccacggcgcccaaggaaaaccttacctgtagaagagaccaacgagaccggcgaggcatcggaaacaaatcaattaagcaccaactgggtctgtcctttctcccccatccccatgaattacagcagttccaggccgaaggcaagatttacgaatgtaaccatgtggaaaaaagcgtgaaccacggttcatccgtgtctccaccgcagatcatctcatccacaatcaagacacacgttagcaacaaatatggaacagactttatatgttcctccttattgacgcaagagcagaagagctgcatcagagaaaagccatataggtacattgagtgcgataaagcacttaaccacgggagccacatgactgtgcggcaggtttcccatagtggggagaaaggctataaatgtgatctttgcggcaaagtattctcccagaaatcaaatctcgcgcgtcactggcgagttcacaccggtgaaaagccctataagtgtaacgagtgtgaccgctcttttagccggaatagctgcctggccctccacagacgggtgcatacgggagagaagccgtacaagtgttatgagtgtgacaaggtcttcagtagaaatagctgtttggccctgcaccagaaaacgcacatcggagagaagccctacacatgcaaggaatgcggaaaagcattcagcgttcgcagcaccctgacaaatcaccaggtgatccattctggaaagaaaccatataagtgcaatgagtgtgggaaggtgttttcccagacctccagcctggccactcatcagcgaatacacaccggcgagaagccctataaatgtaacgagtgcgggaaggttttctcccaaacctcttcactcgcgcgtcattggaggatacatacaggcgaaaaaccctacaagtgcaatgagtgtggcaaagtctttagctacaactcacaccttgctagtcacaggcgcgtgcataccggcgagaagccatacaaatgtaacgaatgcggtaaggcatttagtgtacattccaatctaacaacacaccaggtgatacacacaggggagaagccatataagtgcaaccagtgcggaaaagggttctccgtacactcatcccttaccacccaccaggtcattcacacgggggaaaaaccttataaatgtaacgagtgcggtaaatcgttttccgtgcggccgaaccttactaggcatcagatcatccatacagggaagaagccgtataagtgtagcgactgcggtaagtctttctcagtacgccccaacttgtttcgtcaccagattatccatactaaagagaagccctataaacgtaactag

SEQ ID NO: 52541 - DNA, 1812 bp, Artificial Sequence
  Description of Artificial Sequence: Synthetic coding sequence
atgcccgagctgtacaccgaggacttcatccagggctgcgacgtgggagaactgcaagaacctggtctgcctggcgtcttaagttatgtgggtgcacaagagcgagcattagatcaccggaaacctagcacaagctcaaagaaaacaaaaagagtgggcatggaccaacgctgtgaaaacagactggaatgtaacggagcgatctcggcccactgcaatttgcgacttccagacagcaatgactccccagccagcgcatctcgcgttgccggaatcaccgacctgtcccgaaactgcgttataaaggagctcgcaccgcagcaggagggcaatccaggagaggtgttccatacagtcactctggagcagcacgaaaagcacgacattgaggaattttgcttccgagaaatcaagaaaaagatccacgatttcgactgtcagtggcgggacgacgaaagaaactgcaacaaggtgaccaccgccccgaaagaaaacctgacttgtcggcgagatcagagagatcggcgtggcatcggtaataaatcaatcaaacaccagctgggattaagctttctcccccacccacacgagctccagcaattccaggccgagggtaaaatctacgaatgtaatcacgtggaaaaaagcgtgaatcatgggagttcagtgagccctccccagattatctcatccacgattaaaacccacgtgagcaataagtatggaacagactttatttgctctagcctgttaacacaggagcagaagtcatgtattagagagaagccctacaggtacattgaatgcgataaggcattaaaccatgggtctcacatgactgtgagacaggtctcacacagcggagagaaggggtacaagtgtgatttgtgcggaaaggtcttctctcagaaaagcaacttagcccgccattggcgggtgcacactggggagaaaccctacaaatgtaatgagtgtgatcgcagtttcagtaggaacagttgcttagcgcttcatagacgggtccatactggcgaaaagccttataagtgttacgaatgcgacaaggtgttctcccggaatagttgcctggccctacaccagaagactcacatcggggaaaagccttacacgtgcaaggaatgtgggaaggccttctctgtcaggagtactctgaccaatcatcaagtgatccactccggaaagaaaccatacaagtgcaatgagtgcggtaaagtatttagtcagacttctagtctggccactcatcagcggatccacaccggcgagaaaccttacaagtgcaatgagtgcggaaaggttttctctcagacttccagtctggcccgtcattggaggatccatactggcgagaagccctacaaatgcaatgagtgcggcaaggtttttagttacaatagccacctggcctcacatcggcgagttcacacaggagagaagccttacaaatgcaacgagtgtggcaaagctttctcagttcactctaacttgacaactcaccaggttatacataccggcgagaagccatacaagtgtaatcagtgtgggaagggcttttccgtacactcatcactgactacccatcaggtcatccacacgggggagaaaccttataagtgtaacgaatgtggaaagagcttctccgtcagaccgaatttaactcgtcaccagattatacataccggcaagaagccgtacaagtgtagcgactgcgggaagagtttttctgtgaggcccaacttattcagacatcagattattcacacaaaagagaaaccttacaagaggaattag

SEQ ID NO: 52542 - DNA, 1812 bp, Artificial Sequence
  Description of Artificial Sequence: Synthetic coding sequence
atgcccgagctgtacaccgaggacttcatccagggctgcgacgtgggggagttgcaggagccgggcctccctggggttctgtcatacgtaggcgctcaagaacgggctctcgatcacaggaaaccctctacaagtagcaaaaaaactaagcgggtgggaatggatcagcgctgcgagaacagattggaatgcaatggcgctattagcgctcactgtaacctgaggctgccagactcaaatgacagcccagcaagcgccagccgagttgcaggaatcaccgacctgagccggaactgcgtcatcaaagaactagctccacagcaggaagggaacccgggtgaagtcttccacacggtcacactggagcagcacgagaagcacgatatcgaagagttttgctttagggagatcaagaagaaaattcacgacttcgattgtcaatggagggacgacgagcggaactgtaacaaagtcactaccgcacctaaggaaaatctgacatgccgcagagatcaacgagaccggaggggcatcggaaataaatcaattaagcaccaattgggcctgagcttcctccctcatcctcatgagctgcaacagtttcaggcagaagggaagatttacgagtgtaaccacgtggagaagtccgtgaatcacggcagttcagtgagtcccccccagattatctcctctaccataaagactcacgtgagtaacaagtatggcacagacttcatctgtagcagtctgctgacccaagagcagaaaagctgtatcagagagaaaccatacagatacatagagtgtgacaaagcacttaaccacgggtcccacatgacagtacggcaggtgagccactccggcgagaagggatataagtgtgatctgtgcggaaaggtgttcagccaaaagtccaatctagcccgccattggcgcgtccacaccggggaaaagccctacaagtgtaacgagtgtgataggtccttctcacgcaacagttgtttggccttgcaccgcagagttcacactggtgagaagccctacaaatgttatgagtgcgataaagtgttttcaaggaacagctgcctggcattacaccagaagacccatatcggagagaaaccatatacttgcaaggaatgcgggaaggcattctccgtccggtcaacactgaccaatcaccaggtcattcactctgggaaaaaaccttacaaatgcaacgaatgcgggaaggtcttctcacagacctcgtcactggctacgcaccaaagaatccacaccggcgaaaaaccttataagtgtaacgaatgcggcaaggttttttcacagacatctagtctggccagacactggcgcatccacacgggcgaaaaaccctacaaatgcaacgagtgcggtaaagtgttcagttacaactcacacttggcaagtcatcggcgcgtgcatactggagagaagccctacaaatgtaatgagtgcggcaaggcttttagcgtacacagtaatctcacaacgcaccaggttatacataccggtgagaagccttataagtgtaatcagtgcggcaaaggattttccgttcacagtagtctgactacgcatcaggtgatccacaccggggaaaaaccatataagtgcaatgagtgcggcaaatctttttcagtgaggccaaatcttacccgacatcagatcatccacaccggtaaaaagccctacaaatgttcggattgcggcaagtcttttagtgtgaggcctaatctgttccggcaccaaatcatacatactaaggagaagccctataagcgcaactag

SEQ ID NO: 52543 - DNA, 1668 bp, Artificial Sequence
  Description of Artificial Sequence: Synthetic coding sequence
atggacggcgacggcctgaccttccgggacgtggccatcgagttctcacaggacgagtggaagtgcctcaatagtacgcagcggactctgtatagggatgtcatgcttgagaattaccggaacctggtatctttagacctgtcaagaaactgcgtgattaaagagttggcacctcagcaagaaggcaacccgggcgaggtgtttcacaccgtcacgctcgaacagcacgaaaagcatgacattgaggagttctgttttcgggaaattaaaaaaaaaatccatgattttgactgtcagtggcgagacgatgaacggaattgtaataaagtgacaacagcccccaaggaaaacctaacatgcagacgcgaccagagggatcggagaggaatcggaaacaaatcgattaagcaccagctgggtctgtccttccttccccatccgcatgagctgcagcagtttcaagccgagggcaaaatttacgagtgcaaccatgtggaaaagtcagtcaatcacggaagctctgtttcacctccacagatcatctcatctacgatcaaaacccatgtgagcaacaagtatggtacagactttatttgtagtagcttactcacacaggaacagaagtcatgcataagggagaagccttataggtatattgaatgtgataaggctcttaaccatgggtcgcatatgactgtgaggcaggtgtctcattccggagagaaaggctacaaatgtgacctgtgcggcaaggtctttagccaaaaatctaacttggcccgccattggcgtgtgcacacaggtgagaagccatataagtgcaacgagtgtgacagatcgttttctagaaatagttgtttggccctgcataggcgcgtgcacactggcgagaagccctacaaatgttatgagtgcgataaagtcttttcccggaactcctgtctcgcccttcaccagaaaactcacatcggagaaaagccctatacatgtaaagagtgtggtaaagcttttagcgtgagatccacccttactaaccaccaggtgatccactcaggaaaaaagccctacaagtgtaatgagtgtggcaaggttttcagccagacctccagcctagccacccaccagcgcatccacaccggcgagaagccctacaaatgtaacgagtgcgggaaggtcttttcccaaaccagctccctggcccgtcactggaggattcacacaggtgaaaaaccatacaaatgcaatgagtgcgggaaggtcttctcttataatagccacctggcttctcatcgtagggtgcacaccggagagaagccatataagtgcaatgaatgcggaaaggccttttctgttcatagcaatctgactacccatcaggtaattcacacaggtgaaaaaccatacaagtgcaatcaatgtggcaaggggttttcagtacattcttcacttacaacacaccaggtgattcacaccggcgaaaagccctataaatgcaatgagtgcgggaaaagtttttctgtccgtccaaacctgactaggcaccaaataatccataccggcaagaagccatataaatgcagcgactgtggtaagtcttttagtgtgcgccccaacttgtttcgacatcaaataatccacaccaaggaaaagccctataaacgcaactag

SEQ ID NO: 52544 - DNA, 567 bp, Artificial Sequence
  Description of Artificial Sequence: Synthetic coding sequence
atgaccgagacccgggagcccgccgagaccggcggctacgccagcttggaagaagatgatgaagatctgtcaccaggcccggaacattcaagtgactctgaatataccctcagtgagccagacagcgaagaagaggaagacgaagaggaagaggaagaggaaacgactgacgatcctgagtatgaccccggctacaaagtcaaacagagactggggggcggacggggcggcccctcgagacgcgccccccgggcggcacagcccccggcccagccatgccagttatgcgggaggagcccgctgggggaagcaccccctggaaccccaccttgccgcctctgttgccccgcaaccgcccctcaggaggcccctgcgccggagggaagagctttaggagaggaagaggaagagccgcctagagcaggagagggccggcccgctggccgtgaagaggaagaggaagaggaggaagagggtacctaccactgtacagagtgtgaggattccttcgataacttaggggaactgcacggtcatttcatgttgcacgcccgcggtgaggtatag

SEQ ID NO: 52545 - DNA, 375 bp, Artificial Sequence
  Description of Artificial Sequence: Synthetic coding sequence
atgaccgagacccgggagcccgccgagaccggcggctacgccagcctcgaggaagatgacgaggacctttcccctggcccagagcattcaagcgattccgagtatactctatccgaacccgatagtgaggaggaggaggacgaagaggaggaagaggaagagacgaccgatgatccggagtatgaccccggctacaaagtgaaacagcggttagggggcggaagaggcgggcccagtcgcagggctcctcgggcagctcagcccccagctcagccttgccagctgtgcggtagaagcccactgggcgaggcaccacccggcacacccccttatggcgaactcggcaggcggggaggcgtggggggaggtggttag

SEQ ID NO: 52546 - DNA, 2412 bp, Artificial Sequence
  Description of Artificial Sequence: Synthetic coding sequence
atggacgtggccatcgagttctgcctggaggagtggcagtgcctggacatcgcccagcagaatttgtatagaaatgtgatgctggagaattatagaaacctggtgtttctgggtatcgccgtgtccaaacctgaccttatcacttgtctggaacaggaaaaggaaccctgggagcccatgagacggcatgaaatggtcgctaagccacctgtgatgtgctcgcacttcacccaagacttttggcctgagcagcacatcaaggatccatttcagaaggcaaccctgcgccgctacaaaaactgcgaacacaaaaacgtgcatctcaaaaaggaccataaatctgtggacgaatgtaaggtacaccgaggaggatacaacggttttaaccagtgcctcccggctactcaaagtaaaatattcttattcgataaatgcgtcaaggcctttcacaaattctcgaattcaaaccgccacaagatctcccacacagaaaaaaagctgtttaagtgtaaggaatgtggaaagagtttttgcatgctgcctcacctcgcacaacacaagattattcataccagggtgaatttctgtaagtgcgaaaaatgtgggaaggcttttaactgcccctccatcatcacaaaacataagaggataaacacgggggaaaagccgtacacctgtgaggaatgtgggaaggtgttcaattggtcgtctaggctgacaactcacaagaagaattacacccgttataaactgtacaaatgtgaagaatgtgggaaagcatttaacaagagttctatcctcaccacacacaaaataatccgcaccggagaaaagttttataagtgtaaagaatgtgctaaggctttcaaccagagcagcaatttgaccgagcacaagaaaatacacccaggagagaagccctataagtgtgaagaatgcggaaaggcttttaactggccgtcaactctgacaaagcataagagaattcatacgggtgaaaagccctatacttgtgaagaatgtggaaaggctttcaatcagtttagcaatctaaccacccacaagcgtattcacaccgcagagaagttttacaagtgtaccgaatgcggtgaggcattctctagatcctccaatctaactaaacacaaaaaaatacacacagagaagaaaccctacaaatgtgaggaatgcggtaaggcattcaagtggtcatccaagctcaccgagcacaaactgacacacacaggggagaaaccgtacaaatgcgaggagtgtggaaaggcatttaactggccctcaaccctaacaaaacataaccgtattcatacgggggaaaaaccttacaagtgtgaagtttgcggaaaggctttcaaccagttttccaacctaactacccacaagcggatccacaccgctgaaaaaccatataaatgtgaagaatgcggtaaagccttttctcgctcttctaatctcacgaagcataagaaaatccatatagagaagaagccttacaagtgcgaggagtgtggcaaggcattcaaatggagtagcaaactgaccgagcataagattacccacacaggagagaagccttataaatgtgaggagtgtggcaaagctttcaaccatttcagtattcttaccaaacataagagaatccatactggtgaaaaaccttataagtgcgaagagtgtggtaaggcattcacacaatcttcaaacttgacaacccacaagaagattcacacaggagaaaaattctacaaatgcgaagagtgtggcaaagccttcacccagtcgagcaatctgaccacccataagaagattcacactgggggcaaaccatacaagtgtgaggagtgcggtaaagccttcaaccagttctctactttgacaaaacacaagatcatccataccgaggagaagccttataaatgcgaggagtgcgggaaggcatttaagtggtcatctacactaactaaacacaaaatcattcacacaggcgaaaagccctacaaatgcgaagagtgcggcaaggcctttaagttgtcctcaacactgagtacccacaaaattatacacaccggcgaaaaaccctataagtgcgaaaagtgcgggaaggcattcaataggtccagcaatctgattgaacataagaagatccacaccggagagcagccatacaagtgtgaggaatgcggcaaggcattcaactatagctcccatctcaacacacacaagagaatccatacaaaagagcagccctataagtgtaaggaatgcggaaaggccttcaatcagtacagtaacctgacaactcataataagatccacaccggagaaaagctgtacaagccagaggatgttaccgtaatcctaactactccccagactttcagcaacattaaatag

SEQ ID NO: 52547 - DNA, 1095 bp, Artificial Sequence
  Description of Artificial Sequence: Synthetic coding sequence
atggagcggggcaagaagaagcggatcagcaacaagctgcagcagacctttcaccatagcaaagaaccaacattcctcatcaaccaggcggggctgctgagtagtgactcttacagtagtttgagtcctgagacagaatcagtgaatcccggtgaaaatatcaagactgatacacagaagaagcgacctggtacggttattctctctaaactgtcatctagaagaattatctctgagtcccagctgagccccccggtcatacctgcacgcagacccggatttcgggtgtgttatatatgcgggcgtgaatttggcagtcagtccatcgcaatccacgagccacaatgtttacagaagtggcatatagaaaactctaaactgcccaaacaccttagacgccctgagccatcaaagccccagtccttaagttcttctggcagctactcacttcaggccaccaacgaggctgcattccagagcgcacaagcccaattattaccctgtgagagctgtggccggacttttctgcccgatcacctgttggtccaccacagatcatgcaagcccaagggcgagggaccccgggcccctcactctaatagttccgaccatttaacagggctcaagaaagcctgtagtgggacaccagcccgcccaaggaccgtcatttgttacatctgcggaaaagagttcggcactctgtctctgccgatccacgaacccaagtgcctggaaaaatggaagatggaaaatgataggttgccagtggaactgcatcaacctctcccccagaagcctcagcccctccccaatgcccagtcttcccaggctggacctaaccaagcacaattagtgttttgccctcactgctcgcggatcttcacctcagatcggctgctcgtacaccaacggtcctgcaagacccatccttacggccctaaatatcagaacttgaaccttgggtctaaaggtgggctgaaggagtacactaacagcaagcagcaaagaaacagggctgctccatcagtgacagacaaggtgattcacgccactcaggacgccctcggggagcccgggggtgctctatgtctttag

SEQ ID NO: 52548 - DNA, 192 bp, Artificial Sequence
  Description of Artificial Sequence: Synthetic coding sequence
atggagcggggcaagaagaagcggatcagcaacaagctgcagcagacgtttcatcattcaaaagaacccactttcctaatcaaccaggctggacttcttagttccgattcctatagcagtctgagcccagagactgaatccgtgaatccaggtgagaacatcaagaccgacacccagaagaagagaccttag

SEQ ID NO: 52549 - DNA, 111 bp, Artificial Sequence
  Description of Artificial Sequence: Synthetic coding sequence
atggagcggggcaagaagaagcggatcagcaacaagctgcagcagacgttccaccacagcaaagaacctacattcctgattaatcaggcgggcctcctgagttccgactag

SEQ ID NO: 52550 - DNA, 4452 bp, Artificial Sequence
  Description of Artificial Sequence: Synthetic coding sequence
atgcccagcgagcagaagcagctgttctgcgacgagaagcagaccacactgaagaaggactacgacgtgaagaacgaaattgtcgatcggagtgctccgaaaccaaaaatctccgggtctatccactacgcactcaaaaacgtgaagatcgatctacctaagataaatattcccaacgaagtgctgctgaaacacgaagtcgacaaatacaggaaactatttcagtccaagcagcagaccgcgaggaagtcaatatctattaagaccgtgagttgcgttgaagaatgcactctcctgcataagagcgaacgtgctgaagaagagggagtgaaaatgagtgccaagattttgaattttagctgtctaaagtgcagagacaatactaggtacagcccgaacgacctgcaaaagcatttccagatgtggcaccacggggagctgccctcatatccatgcgagatgtgcaatttctcagccaacgactttcaggtatttaagcagcaccgccgtacccataggtcgactctggtcaagtgcgacatctgcaataatgagtccgtttacactttactcaatctgaccaagcacttcactagcacccattgcgtaaacggaaatttccagtgtgagaaatgcaagttcagcacccaggacgttggtaccttcgttcaacatattcataggcataacgagatccactacaagtgtggaaaatgccaccacgtgtgtttcacaaaaggcgagctccaaaagcatttgcacatccattcagggacctttccctttacatgccagtattgttcgtacggcgctacacggagggagcacctagtgcggcatgtgatcactcttcacaaggagcacttatacgccaaagagaaactggaaaaggacaaatacgaaaaacgcatggcaaagaccagcgctgggctgaaactcattctgaagcgatacaagataggagcaagccggaaaacattctggaaacgtaaaaagatcaatagcggcagtgaccggagtatcgaaaagaacacacaggttttgaaaaaaatgaataagacacagactaaatctgaggaccagagtcatgtcgtgcaggaacacctcagtgaggagaaggacgagagactgcactgcgaaaacaatgataaggcccccgagtctgaatccgaaaagcctactcccctgtcaacggggcaggggaaccgagccgaggagggcccaaacgcaagctccggcttcatgaaaaccgcggtgttagggcctaccctcaagaacgttatgatgaaaaacaacaagctggccgttagccccaattacaatgcaactttcatgggctttaaaatgatggacggcaagcaacatatagtcctcaaactcgtccccattaagcagaacgtatgctctcccggatcacagagtggcgccgccaaagatggcaccgcgaatcttcaacctcagacactggacacaaacggctttctcaccggcgtgacaacagagctgaatgacacagtgtacatgaaagccgccacaccttttagctgttcatcctctatactgtctggtaaagcttcctcagagaaggagatgacccttatctcacaaagaaataatatgctgcaaaccatggactatgagaaatccgtctcatcgctgtctgccacaagcgagcttgtgacagccagcgtaaatctgaccacgaaattcgaaaccagagataatgtggacttttgggggaatcacctcactcaatcccacccagaagtgctgggaaccacgatcaagtctcccgacaaagtcaattgcgtggccaagcctaatgcatataattctggggacatgcataactattgcatcaactacggcaattgcgaactgccggtggaaagctctaatcagggttcacttccatttcacaactactctaaagttaataattccaataagcgcagaaggttctctggcacggcagtgtacgaaaatcctcagagggagtcatcctcttccaagacagtcgtgcaacagcctatctccgagtcctttctcagcctggtacggcaggagtcctcaaaaccagactcactgctggcatcaatctcgttgctgaatgacaaagacggaactctgaaagccaaatccgagatcgaagaacagtacgtcctagagaaaggtcagaacatcgatggccaaaacctgtactccaacgaaaaccagaatctcgaatgcgctacagagaaatccaagtgggaggattttagtaatgtggacagtccaatgatgccacgaatcacatccgtattcagtttgcagtcccagcaggcgagcgaattcctgccccccgaggtgaaccaactcctgcaggacgtgctcaaaatcaagcctgacgtgaaacaagatagttcaaataccccgaacaaggggttgccgctgcactgcgatcaatctttccagaagcacgaaagagaaggcaagatcgtagagagctctaaagacttcaaggtccaggggatctttcctgtccctccgggatcagtagggatcaatgttccgacaaatgatttgaatctgaagtttggcaaagaaaagcaggtcagtagcataccccaggacgtcagagattctgagaaaatgccgagaatcagcggcttcggcacactgttgaaaacgcagtctgacgccataatcacccaacagctggtgaaggacaaacttcgggctactacccaaaatctgggctccttttatatgcagtccccactcttgaattctgaacagaagaagacgataatagtgcagacctcgaagggcttcttgattcccctgaatataacaaacaagcctggccttccagtcattccaggtaacgcgctgccactggtgaattctcaggggattcctgcttctcttttcgttaataagaagccaggcatggtgctgacactgaataacgggaaactggagggggtgtctgccgtgaagactgagggagcgcccgccaggggtacagtgacaaaggaaccgtgtaaaacccccatacttaaggttgaacccaacaataattgcctgacgccggggctgtgcagcagcataggcagctgtctgtcaatgaaatctagctctgaaaatactctgcccctgaaggggccttacatcttgaagccaactagttcagtgaaggccgtcctgatcccgaacatgctctccgagcagcagtctactaaattgaatatatccgactccgtcaagcagcagaatgaaatcttcccaaagccacctctgtatacgttcctgcctgatggcaaacaagccgtgttcctgaagtgcgtcatgccaaataaaaccgagctgctcaagcccaaacttgttcagaatagcacgtaccagaacatccaacctaagaaacccgagggcacaccccaacggatccttctgaagatcttcaatcctgtcctcaacgtgacggccgccaacaacctgagtgtgagcaattctgcatcaagcctgcagaaggataatgtaccttccaaccagatcatcgggggagagcagaaggagccagaaagccgcgatgccctgccctttctattagacgatcttatgccagctaacgaaattgtcattacctctaccgccacctgtcctgagtcaagcgaagagccgatatgcgtttccgactgttccgaaagtcgcgtcctgcgctgcaaaaccaactgccgcatcgaacgcaacttcaacaggaaaaagactagcaaaaagatattttccaaaacgaagactcatggttccaaagattctgagacagcctttgtttcccgcaatagaaattgtaagcggaaatgccgcgacagttatcaggaaccccccaggcgaaaggccacattgcatagaaagtgtaaagaaaaggccaagcctgaggacgttagagaaacattcggattcagcaggccaaggttgtccaaggattcaattaggactctgcgcctgtttcccttctcctctaagcagctggttaagtgtcccaggcgaaaccagcccgttgtggtcctgaaccaccccgacgccgatgctccagaagtggtgagtgtgatgaaaaccattgccaaatttaatggccatgtattaaaagtttctctcagcaaaaggaccatcaacgccctgctcaagccggtgtgctacaatccccccaagaccacatacgatgatttctcgaagagacataagacgttcaagcctgtttctagcgtgaaagagagattcgtcctcaagctcacgctgaaaaaaacaagtaaaaataactaccagatcgtgaagactacctccgaaaatattttaaaggctaagtttaactgttggttttgcggccgtgtgttcgacaatcaggatacgtgggcggggcacggccagaggcatttaatggaagctacaagagattggaacatgctggagtag

SEQ ID NO: 52551 - DNA, 1734 bp, Artificial Sequence
  Description of Artificial Sequence: Synthetic coding sequence
atggccgtgggcctgtgcaaggccatgagccagggcctggtgacctttcgcgacgtcgccctggatttcagtcaagaggaatgggaatggctgaagcccagtcagaaggatctttacagagatgtcatgctcgagaattatagaaatctagtttggctggactgggagtcctggtgcgaaattgaagagctctcacctaagtggttcatcgatgaggatgaaatcagtcaagaaatggtcatggaacgactcgcgtcccatggcttagagtgcagtagcttccgggaagcctggaaatataagggagaattcgaacttcatcagggaaacgcagagcggcactttatgcaggtgaccgccgtaaaagaaattagtacaggcaaacgcgacaatgagttttctaactctggccgatcaatcccgctcaaaagcgtatttctgacccagcagaaagtgcctacgatccagcaggtccataaatttgacatttacgacaaactgtttcctcaaaatagtgttatcatagagtacaagcggctccacgctgagaaggagtccctgatcgggaatgagtgcgaagaattcaatcagagtacatatctgtccaaagatatcggtattccacccggcgaaaagccctacgagagccatgatttcagtaagctgcttagcttccacagtctcttcactcagcatcagaccacccactttggcaaactgccccatgggtacgacgaatgcggggatgccttttcctgctactcattcttcacacagccacaacggattcactcgggagagaagccttacgcttgcaacgattgcggaaaagcattttcccatgacttctttttgtctgagcatcaacgaactcacatcggagagaaaccttatgaatgcaaagagtgcaataaggcttttaggcagtcagcccacctggcgcagcaccagcgaattcacacaggagaaaagcccttcgcctgcaacgagtgcggaaaggcgttcagtaggtatgcttttcttgtggaacatcagcgaattcacactggagaaaaaccatacgaatgcaaagagtgcaataaggctttcagacagtctgcccacctgaaccagcaccagaggatccacacaggagagaaaccttatgagtgtaaccaatgcggcaaagcattcagcaggcgcatcgccctcaccctgcatcagcggatccacactggagagaagccctttaagtgctccgagtgcggtaagacctttgggtaccggtctcacttgaatcaacaccagcggatccatacaggcgagaagccttatgaatgcatcaagtgcggcaaattcttccgaacggattcccagttgaaccgccaccatagaatccatacaggcgagaggcccttcgagtgttccaaatgcggtaaggctttttctgatgccctggtcctcatccatcacaaacgatcccacgcaggcgagaaaccctacgagtgtaacaagtgtggaaaagctttctcatgtggaagctatttgaatcaacatcagcggattcacacaggggagaaaccctatgaatgctcggagtgcggaaaggcctttcaccaaatactgtctctgcgcctccatcagagaatccatgccggtgaaaaaccctataagtgcaacgagtgcggaaacaatttctcctgcgtttcagctttacgccgacatcagaggatccacaaccgggaaacactctag

SEQ ID NO: 52552 - DNA, 1830 bp, Artificial Sequence
  Description of Artificial Sequence: Synthetic coding sequence
atggccgtgggcctgtgcaaggccatgagccagggcctggtgacctttcgggacgtcgcgctcgacttcagtcaggaggagtgggaatggctcaaaccatcgcagaaagacctgtatcgcgacgtcatgctggaaaattatcgcaatctcgtttggctcggcctttctatcagtaaacccaacatgattagcttgcttgagcagggcaaagagccgtggatggtggagcgaaagatgagccagggtcactgtgccgattgggagtcatggtgtgagatcgaggagctctctcccaagtggttcatcgatgaagatgagatcagccaggagatggtcatggaacgcctcgcgtcccatgggcttgagtgctccagtttccgcgaggcatggaagtacaaaggagagtttgagttgcaccaaggcaatgccgaaaggcattttatgcaagtcactgcagtcaaggaaatctcaacagggaagagagataatgagttctctaacagcggccgctccatcccactcaagtccgtgttcctgacgcagcagaaggtgcctactatccaacaggtccacaagttcgacatctacgataaactctttccacagaacagtgtgattattgaatacaaacgcctgcacgcagagaaggagagcctgatagggaatgagtgtgaagaattcaatcaaagcacatacctgagcaaggatattggcatcccacctggcgagaaaccatacgaaagccatgacttcagcaagttgctgagtttccattctctcttcacccagcaccagaccacccacttcggcaagcttccacatgggtatgatgaatgtggggacgctttcagctgttactccttcttcacccagccacaacggattcactcgggcgaaaaaccctacgcttgtaacgattgtgggaaagcattctcacacgacttttttttgtcggaacaccagaggacgcacatcggtgaaaagccttatgaatgtaaagagtgtaataaagctttcagacaatcagcacatctagcgcagcatcaaaggatccatacgggagaaaagccattcgcctgtaacgagtgcggcaaagctttcagccgctacgccttcctggtagaacaccaacgaattcatacaggtgagaagccttatgagtgtaaagagtgtaacaaggccttcagacaatcggctcatctgaaccagcatcagagaattcatacaggcgagaaaccttatgaatgtaatcaatgtggaaaagccttttcacggcggatcgcccttacccttcatcagagaattcacactggcgaaaagccattcaagtgcagcgagtgtggcaaaacctttggataccggagtcacctcaaccagcaccaaaggatccatacaggcgaaaaaccatatgagtgcataaagtgtggaaaattttttcgtactgacagccaactcaatcggcaccacagaattcataccggagaaaggcctttcgagtgttctaaatgtggtaaggccttcagcgacgctctggtcctcatccatcacaaaaggtctcatgccggcgagaagccttatgaatgcaacaaatgcgggaaggccttctcctgtggctcataccttaaccagcatcagcgaatacacactggtgaaaagccgtatgaatgtagcgagtgtggcaaagccttccaccagattctgtcactgcgcctgcatcaacgcatccatgccggggaaaaaccctacaagtgtaacgaatgcgggaataatttttcctgtgtgagcgccctgaggagacaccagcggatccataacagggagaccctgtag

SEQ ID NO: 52553 - DNA, 1674 bp, Artificial Sequence
  Description of Artificial Sequence: Synthetic coding sequence
accggcctgagcatcagcaagcccaacatgatcagcctgctggagcaggggaaagaaccatggatggtcgaacgcaaaatgtcccagggacactgcgccgattgggagagctggtgcgagatcgaggaactctccccgaagtggtttatcgatgaagacgaaatcagccaggaaatggtaatggagaggctagcttctcacggcctggaatgctcaagcttccgtgaagcctggaagtacaagggcgaattcgaactccaccagggcaatgctgaacgccacttcatgcaagtcacagctgtgaaggagatcagcactggaaaaagggataacgagttctcaaattccggcaggtccattccccttaagagcgtcttcttgacgcagcaaaaagtgcccaccattcagcaggtccacaagtttgacatatatgataagctttttccgcaaaactccgtgattatagaatacaagcgactgcacgccgaaaaggaatccctcattgggaacgagtgcgaagagtttaaccagtccacctatctgtctaaggatattggaatccctcctggcgagaaaccgtatgaaagccacgatttctcgaaacttctttcatttcacagcctgttcacccagcatcaaacaacccacttcggtaagttgccccacgggtacgacgaatgcggggacgcatttagctgctattctttttttacacagccgcaacgtattcattctggtgaaaaaccatacgcgtgcaacgattgtgggaaggccttctctcacgacttctttctgagcgagcaccagaggacccatatcggagagaagccatatgagtgtaaagaatgtaacaaggctttcaggcagtctgctcacctcgcccaacaccagcgcatacacaccggagagaaacctttcgcctgtaatgagtgcggcaaagcattttctcgctacgctttccttgtagaacaccagagaatccatactggcgagaaaccttatgaatgcaaagaatgcaacaaagcctttcgtcaatctgctcacctcaaccaacaccaacgcatccacactggagagaagccgtacgagtgtaatcagtgtggaaaggccttctcaaggaggatcgcactgacgttgcaccagcgcatacacacaggtgaaaagcctttcaaatgttcagaatgcgggaaaacattcggttaccgctcacaccttaaccagcaccaaaggatccacacaggagagaagccatatgaatgcatcaagtgcggtaaatttttcaggactgacagccagctgaatcggcatcaccggattcacacaggagagcggcccttcgaatgttccaagtgtgggaaggcgtttagtgacgctctggtacttatacatcacaaacgaagccatgcaggcgagaagccatatgagtgcaataagtgcgggaaagcattctcttgcggcagttacctgaatcagcaccagaggatacacaccggcgagaaaccctacgagtgtagcgaatgtgggaaggccttccaccagatcctgtcgttgcggttgcatcagaggatccacgctggcgagaaaccctacaagtgcaatgaatgcggcaacaatttctcttgcgtgtctgccctgcgccgtcaccagcgaatccacaatcgcgagacactttag

SEQ ID NO: 52554 - DNA, 1692 bp, Artificial Sequence
  Description of Artificial Sequence: Synthetic coding sequence
atggccaacagcagcttcatcggcgaccacgtgcacggcgccccccatgctgtcatgcccgaagtcgagttccctgaccagttttttacagtcctgacaatggatcatgaacttgtgaccctacgcgacgtcgtcataaacttttcacaggaggagtgggagtatctcgacagtgcccagaggaatctgtattgggatgttatgatggagaactactcgaacttactgagcctcgatttggaatcacggaatgagactaagcatctctcagtgggaaaggacatcattcagaacacgggatcacagtgggaagtgatggagagctcgaaactgtgcggcctggaaggctcaatttttcgcaacgattggcagagtaagagcaagattgacttacaagggcccgaggtagggtacttctcccagatgaagataatctctgaaaacgtgccatcatacaagacgcacgagtcgttgaccttgccaaggagaacccacgacagcgagaagccgtacgaatacaaggagtacgagaaagttttcagctgcgaccttgaattcgacgagtaccagaaaatccataccggaggtaagaattatgagtgcaatcagtgttggaaaactttcgggatagataactctagtatgttgcaactgaatattcacacaggtgtgaagccttgtaagtacatggagtacggtaacacctgttctttttacaaggatttcaacgtgtatcagaagattcacaacgagaaattctataaatgtaaagagtatcggaggaccttcgagcgagtcggaaaggtcacaccactgcagcgagtgcatgatggagaaaagcatttcgaatgtagcttctgcgggaaatcttttcgagtacacgcacagctgacccggcatcagaaaatccatactgacgagaaaacatacaagtgcatggagtgcgggaaggacttccgctttcattctcagctgacagagcaccaacgcatacacactggggagaaaccttataagtgcatgcactgtgagaaagtgtttcggatcagtagtcagctgatagaacatcagcgcatacacactggcgagaagccttacgcctgcaaggagtgtggaaaggcatttggcgtgtgtagagagctggcacggcaccagaggattcacacaggcaagaaaccttacgagtgcaaagcctgcggtaaggtcttcagaaactcctctagtttaactcgtcaccaaagaatacacactggcgagaagccctataagtgcaaagagtgcgagaaagcgttcggggtggggtcggagctgaccaggcatgagcgtatccactccggacagaagccttacgagtgcaaagaatgcggcaaattctttcgactgacgagtgccttgatccaacatcagcgcatccacagcggcgagaaaccatacgaatgcaaggtgtgcggaaaggcattccgacactctagtgcccttaccgaacaccagagaattcacaccggagaaaagccctatgagtgcaaagcctgtggcaaagccttccgacacagcagcagttttacgaagcatcaacgcattcacacagatgataagccatatgagtgcaaagaatgtggcaactccttctccgttgtcgggcatctcacatgccaaccaaaaatctataccggcgagaaaagtttcgactag

SEQ ID NO: 52555 - DNA, 1692 bp, Artificial Sequence
  Description of Artificial Sequence: Synthetic coding sequence
atggccaacagcagcttcatcggcgaccacgtgcacggcgccccccacgccgtcatgccagaggtggaattccctgatcaattcttcacagtgctcaccatggaccacgagctggtcactctcagggacgtggttattaatttttcacaggaagaatgggaatatctcgacagtgcccaacgcaatctctactgggacgtgatgatggaaaactattctaatctgctcagcctcgatctggagagccgaaatgaaacaaagcatttatctgttgggaaagacataattcagaacacaggatcccagtgggaggtaatggaatcaagcaaactgtgcgggctagagggaagcatctttaggaacgattggcagtcaaagagcaaaatagatcttcaggggccggaggtcggctactttagtcagatgaaaatcatttcggagaatgtgccaagctacaaaacacatgagagtttaacactccctaggcggacgcacgatagcgaaaaaccatatgaatacaaagagtatgaaaaagtcttttcctgcgaccttgaatttgatgagtaccagaagatccacaccggcgggaaaaactatgagtgtaaccagtgctggaaaactttcggaatcgacaattcctctatgctgcagctcaacatccatactggcgtaaaaccctgtaagtatatggagtatggcaacacctgttccttctacaaggatttcaatgtatatcagaagatccataacgaaaagttctacaaatgcaaggagtatagacggactttcgagagagtgggaaaggtgacgcccctacagcgtgtccacgatggagaaaagcactttgagtgtagtttctgtgggaagtctttccgggtgcatgcacagcttactcggcatcagaaaatccataccgatgagaaaacctataaatgcatggagtgcggaaaggactttaggttccattcccaacttaccgagcatcaacgaattcatactggagagaagccgtataagtgcatgcactgtgaaaaggtgttccggataagctctcagctgatcgagcaccaacggatacacactggtgaaaaaccatacgcttgcaaggagtgcggcaaggcattcggggtgtgtcgggaactcgctagacatcagcggattcatactgggaaaaaaccctacgaatgtaaggcatgcggtaaagttttccgcaactccagtagcctcactcggcatcagcggatccacaccggtgagaagccttacaaatgcaaggagtgtgagaaggcctttggtgtaggatcagagctcactcggcatgaaaggatccactctggccagaaaccttacgaatgtaaggagtgcggcaaattcttccggctgacctctgctctgatacagcaccaaagaatccactcaggggagaaaccctatgagtgtaaggtgtgtggcaaagctttccggcattcttccgcgttgactgagcatcaaaggatacacactggcgagaaaccctatgaatgcaaagcttgcgggaaagcgtttcgacactcttcaagtttcaccaaacaccagcgaatacacacagacgacaaaccttacgaatgtaaggaatgcgggaacagttttagcgttgtcggccacctaacatgccagcccaagatatataccggggaaaagagttttgactag

SEQ ID NO: 52556 - DNA, 1209 bp, Artificial Sequence
  Description of Artificial Sequence: Synthetic coding sequence
atggccgccgtgatcctgcccagcaccgccgcccccagcagcctgtttcccgcctcacagcagaagggacacacccaggggggcgaacttgtaaacgaactgttgacatcatggctacggggcctcgtcacattcgaagatgtcgcagtggaatttacacaggaggagtgggcattactggaccccgcgcaaagaaccctctatcgagacgtcatgctggaaaactgccgcaatctggcctcgctcgggtgccgggtgaataaaccctcgttaatctcacagcttgagcaggataagaaggtggtgacggaggaaaggggcattctcccatctacctgtccagatttggaaaccctgctgaaagcaaagtggctcactcccaagaaaaacgtctttagaaaggaacagtcgaaaggcgtgaaaacagagagaagccataggggcgtgaagttgaacgagtgcaaccagtgctttaaagtattctcgaccaagagtaacttgacacagcataaaagaattcacacaggagagaaaccttacgactgttctcagtgcggcaagtctttttcctctcgaagttatctgaccatccacaaaaggattcataacggcgagaagccctacgaatgcaatcactgcgggaaggcattctcagaccctagttcactgagactccacctgcgaatccacactggcgagaagccttatgagtgtaatcagtgcttccacgtgttcaggacaagctgtaatttgaagtcgcacaagcgaatccacacaggtgagaaccatcacgaatgtaatcaatgcgggaaagccttctccacacgcagctctctgactggccataactctatccacaccggcgagaaaccctatgagtgtcacgattgtgggaaaacctttaggaagtcttcgtatctgacacaacatgttcggactcacacaggggaaaaaccctatgagtgtaacgagtgtggtaaatccttctcctcctcgttctccctcaccgtacataagaggatccacaccggtgaaaaaccttacgaatgttcagactgtgggaaagccttcaacaatctcagcgcagtgaaaaagcatctccgcacccacactggcgagaagccgtacgaatgcaatcactgcggaaagagtttcacgtcaaatagttatttaagcgtgcataagcggattcacaatagatggatatag

SEQ ID NO: 52557 - DNA, 1098 bp, Artificial Sequence
  Description of Artificial Sequence: Synthetic coding sequence
atgcgggagaagagcttccagtgcaacgagaccggcgaggccttcaattgcagttctttcgtgcgcaagcatcagattatccacctgggcgaaaaacagtacaagtttgatatctgtgggaaagtttttaatgaaaagcggtatctcgcacgccatcggcgctgccacacaagcgagaagccgtataaatgcaatgaatgtggcaaatcgttctcttataagtcctccctgacttgccatcggcggtgtcatacaggcgaaaaaccgtataaatgcaatgaatgcggaaagtctttcagctacaagagctcactaacctgtcatcatcgatgtcatacaggtgagaaaccttacaagtgtaatgaatgtggcaaaagcttcagttacaagtcttctctacggtgccaccgccgactccacactggaataaagccatataaatgtaatgagtgtggcaaaatgttcggccagaattccacactcgttatccataaagcaatccacacgggcgaaaagccgtataagtgcaacgaatgtgggaaggcatttaaccaacagagtcacctgtctcggcatcacaggctccatacgggtgaaaaaccgtataagtgcaacgactgcgggaaggccttcatccaccagtcttcactcgcaaggcaccatcggttgcacaccggagagaagtcttataagtgtgaagaatgcgatcgggtgttttcgcagaagtctaacctggaacgtcataagattattcacactggagaaaagccttacaagtgtaatgagtgtcacaaaaccttcagtcaccgctctagtttaccgtgccaccgacgcctgcatagtggagagaaaccatataagtgcaatgaatgtggaaaaaccttcaatgtgcagtcccacctatcgagacaccatcggctccatacaggtgaaaagccttataaatgcaaagtttgcgataaggctttcatgtgccactcttatctcgccaaccacactcgtattcattctggcgaaaagccctataagtgcaacgaatgtgggaaagctcacaaccacctaattgactcaagcattaaaccatgcatgagctcatag

SEQ ID NO: 52558 - DNA, 1773 bp, Artificial Sequence
  Description of Artificial Sequence: Synthetic coding sequence
atgctgcacgaggaggccgcccagaagcggaagggcaaggagcccggcatggccctaccccagggtcgattgacgtttcgtgacgtagctattgagttctcactggccgagtggaagtttctgaacccagctcaaagagcgctttatagggaggttatgctggaaaactataggaaccttgaagccgtcgacatctcatctaaacgcatgatgaaggaagtcttgtcgaccggccaaggtaataccgaggtaatccacaccggaatgctgcagcgacatgagtcttatcataccggggatttttgcttccaagaaatcgagaaggacatacatgactttgagtttcagtcacaaaaagatgaacgcaacggccacgaagccagcatgccaaagatcaaggagctcatgggaagtacagaccgccatgatcagaggcacgcgggcaacaaaccaattaaggatcagcttggtctgtcgtttcatcttcacctgccagaattgcatatttttcagcctgaggagaagatcgccaatcaggtcgagaagagcgtgaatgacgcttcctctatctccacctcgcaaagaatttcgtgccgcccggaaacacatactccgaacaattatggtaataacttcttccacagctcgctgttaactcagaaacaggaggtacatatgcgggaaaagtcttttcagtgtaatgagaccggggaggctttcaactgctcatccttcgttcgcaagcatcagattattcacttaggcgagaagcaatacaagttcgatatttgtggcaaggtgttcaatgaaaagagatacctggctagacaccggcgctgccacaccagtgagaaaccttataaatgtaatgagtgcggtaaatccttctcatacaagtcaagcctgacctgtcacaggcgctgtcacacgggagagaagccttacaagtgcaatgaatgtggcaagagtttttcttacaagtccagcctcacatgccaccacagatgccacacaggggaaaagccctataaatgcaacgaatgcgggaaatctttttcatacaagtcctcactgcggtgccacaggagactccatacgggcattaagccttataaatgtaatgaatgtgggaagatgtttggccagaacagcacactggtgattcacaaagcaatacataccggggagaaaccctacaaatgcaacgagtgtgggaaggcattcaatcagcagagtcatctgagtcgccaccaccgtttgcacactggcgagaagccctacaagtgtaatgactgcggaaaagcctttatccaccagagttctctggcccgacaccacaggctgcacactggagagaagagctacaagtgtgaggagtgtgacagggtatttagtcagaagagcaatctagagaggcacaaaataattcacactggagagaaaccttacaagtgcaatgagtgccacaagacattttctcaccggtcttcactgccttgccatagacggttgcactccggagaaaagccttacaaatgcaatgagtgcggcaagacttttaatgtgcagagtcatctctctcgacatcacaggcttcacactggcgaaaagccctacaagtgcaaggtatgtgataaggctttcatgtgtcatagctatctggccaatcatactagaattcacagcggtgagaagccttataagtgtaatgagtgtggtaaggcgcataatcacctcattgactcatccatcaagccatgcatgtcatcatag

SEQ ID NO: 52559 - DNA, 1773 bp, Artificial Sequence
  Description of Artificial Sequence: Synthetic coding sequence
atgctgcacgaggaggccgcccagaagcggaagggcaaggagcccgggatggctctcccacagggacggctgactttcagggatgtagcaatagagttcagcttggccgagtggaagttcctgaatcccgcccagcgcgccttgtatagggaagttatgctcgagaattatcgcaacttagaagccgtagacatcagcagtaagagaatgatgaaggaggtgttaagcaccggccaaggcaacacggaggtgatccataccggtatgctccagcgccacgaaagctatcatacaggtgatttctgttttcaggaaatcgagaaggatatccatgacttcgaatttcaatcgcagaaggacgaaaggaatggacatgaagcttctatgcccaagataaaggaactgatgggcagcactgaccgccacgaccaacgacacgccgggaataagccaattaaggaccagttgggattgtcgttccatcttcacctgcccgaactccatatatttcagcccgaagagaaaatcgctaaccaagtggagaaaagtgtaaacgacgcctctagcatttccacctcacaaagaatttcctgcagacctgaaactcatacacctaacaattatggtaataatttcttccattcatccctgcttacccaaaaacaagaagtccatatgagggagaagagctttcagtgcaatgagactggagaggctttcaattgctcatcgtttgtacggaaacaccaaatcatccacctcggagagaagcaatataagtttgatatctgcggcaaggttttcaacgagaagcgatatctcgccagacatcggagatgccacacaagcgaaaagccgtataaatgcaacgaatgcggcaaatcttttagttataaatcttcactgacttgccacagacgctgtcacacaggggagaagccatataaatgtaacgagtgtggcaaaagctttagttacaaatcctctctcacgtgtcatcacagatgccacactggagagaagccgtataagtgtaacgagtgcggaaaaagcttttcttacaagtcttcattgcgctgtcacagacgtctgcatacaggcattaaaccctataagtgtaatgagtgcggcaaaatgttcggccagaatagtaccctggttatccacaaagcgatccacaccggagagaagccttataaatgtaacgagtgcggcaaagccttcaaccagcaatcacacttatctagacatcatcgactgcacacaggggaaaagccatacaagtgcaacgattgcggcaaggcgtttatccaccaatcttcccttgcccgccaccaccggctccataccggcgaaaaatcgtacaaatgcgaggagtgcgatcgggtgtttagccagaaaagcaatctcgagcgacataagatcatccatacaggtgaaaagccttacaagtgtaacgagtgccacaagacatttagccatcgctcaagcctaccgtgccacaggagacttcatagcggtgagaaaccctacaagtgcaatgagtgcggcaagacgttcaatgtgcagtcacacctaagtcggcatcacagattgcacacaggcgaaaagccttataaatgcaaggtctgtgacaaagcctttatgtgccatagctacctggctaaccacacccggatccattctggggaaaagccctataaatgtaacgaatgcggtaaagcccataaccaccttattgatagctctattaaaccatgtatgagcagctag

SEQ ID NO: 52560 - DNA, 279 bp, Artificial Sequence
  Description of Artificial Sequence: Synthetic coding sequence
atggagctggtgaccttccgggacgtggccatcgagttcagccccgaggagtggaagtgtctggacccagctcaacaaaacttgtatcgggacgttatgttagagaattataggaaccttgtctcactggggttcgtgatatccaatcctgatctcgtcacctgcctcgagcagataaaggagccctgtaatctgaaaatccatgagactgcagctaaaccacctggatcagacctgcaggtgtacaaggagtcccagtgccctctgtaccgtctgtag

SEQ ID NO: 52561 - DNA, 2715 bp, Artificial Sequence
  Description of Artificial Sequence: Synthetic coding sequence
atggccgccgccggcggcgccgagggccggcgggccgacatggaggccgaagcagccgcggccccagagcgtgagggcggtagctgcgtcctgtgctgtggagacctggaagccacagctctgggccgctgtgatcatcccgtgtgttaccgatgcagcactaagatgcgggtcctctgcgaacagaggtactgtgctgtttgccgcgaggaactgagacaggtggtgtttgggaaaaaacttccagcatttgccactataccaatccaccagctgcagcatgaaaagaaatacgacatatactttgccgatggtaaagtgtatgcattatatagacagctgctgcagcatgagtgccctcgatgcccagaattgcccccttttagcctgtttggcgacctggaacagcacatgcgccgtcagcacgagctcttctgctgtaggctttgcctgcagcacttacagatttttacatatgaacgcaagtggtattctcgtaaggacctggctcgtcatcgaatgcaaggcgaccctgatgacaccagtcataggggccaccctttatgcaagttctgtgacgaaaggtacctcgataacgatgaactgctcaaacatctgcggagggatcactacttctgccacttctgtgacagtgacggagcacaagactactatagtgattacgcatatcttcgcgagcactttcgagaaaaacatttcctttgcgaggagggccggtgttccactgagcagttcacccacgcctttcgcacagagatcgacctcaaagcacacaggaccgcttgtcattcccgaagcagggcggaagcaagacagaaccgccacattgacctgcagtttagttacgccccacgccatagtcgcagaaacgagggggtagtgggaggtgaggattacgaggaggttgaccgctattcccgccaggggagggtggcccgagcaggcaccagaggcgctcagcagtccagacgcggaagctggcggtataagcgagaggaggaagaccgagaagtggcagcagctgtcagggcttccgtcgcagcgcagcagcaggaagaggccagacggtctgaggaccaggaagaaggagggaggcctaaaaaggaagaagccgcagctaggggccccgaagaccctagggggccccggagaagtccccggactcagggcgaggggccagggccaaaggagacgagcaccaatggcccagtgagccaagaagcttttagtgttaccggacccgcggcacccggatgtgtcggggtaccaggggcactccccccccccagccccaaactcaaagatgaggacttcccttcactcagcgcgtcaacctcttcttcctgctcgacagccgccaccccagggcccgtggggctggcactcccctacgctataccagcccggggccgaagtgccttccaggaagaagactttcctgctctggtgtctagtgtacccaagccaggtaccgcccctacatctctggtgagcgcatggaactcttctagctcatcaaagaaggtggcccaacctcccctgtcggcccaggctacgggcagtggccagcccacacgtaaagccggcaagggctcaaggggaggcaggaagggcgggcctccattcactcaggaagaggaggaggacggagggccggccctccaagagctccttagtaccagaccgacagggagtgtgtcaagtacactgggcctggctagtatccaaccatccaaggtgggcaagaaaaagaaggtgggcagcgaaaaaccaggaacaaccttaccacagccaccgccagcaacctgcccacctggagccttgcaggcccccgaggcccctgcgtccagagccgagggaccggtggcggtggttgtgaatggacatatggaaggacccgctcccgcccggtctgcacccaaggaaccacctggcctgcctcggccgcttggcagcttcccatgcccgacaccccaagaagacttccccgccctaggaggaccatgccctccacgcatgccacccccccccggattttccgccgtggtcctcctcaagggcacccccccaccgccacccccaggccttgttccccccatcagcaagccgcctcccggatttagcggactgttaccttctccccatcccgcgtgcgttccatcccctgccaccaccacaactaccaaggcacctagattgctgcccgcaccacgcgcctacctggttccagaaaactttcgcgaacggaacctgcagcttattcagtcaattagagactttcttcagagcgacgaagccagattttctgagttcaaatcacacagcggagagttccgccaggggctcatatccgcagcccaatattataagtcttgccgggacttgctgggcgagaacttccagaaggtcttcaacgagctgctcgttctacttcctgacactgccaagcagcaagagttattgagtgcccacaccgacttctgtaacagagaaaaacccctaagcacaaagtccaagaaaaataagaaatctgcatggcaggccacaactcagcaggcagggttagattgcagagtctgcccaacctgccagcaggtgctagcccacggagacgcgtcctcgcatcaggcactgcacgccgcaagggatgacgattttccttctctgcaagctatagctcgcatcataacctag

SEQ ID NO: 52562 - DNA, 2550 bp, Artificial Sequence
  Description of Artificial Sequence: Synthetic coding sequence
atgcgggtgctgtgcgagcagcggtactgcgccgtgtgccgggaggaactccgccaggtcgtgttcgggaaaaagcttccagcctttgcaactattccaatccaccaacttcagcacgagaagaaatatgacatttacttcgctgatggcaaggtctatgcactctatcggcagctgctccaacacgagtgccctaggtgtcccgagcttccaccttttagcctgtttggcgatctcgagcagcacatgcggcgtcaacatgaacttttttgctgccgtctctgcctccaacacctgcagattttcacgtatgagaggaagtggtactctcgcaaagatctggcacgccataggatgcagggggaccctgacgacacgtcacacagaggacatcccctgtgcaaattttgtgatgagaggtacctcgataacgacgagcttctcaagcacttaagaagggaccattacttctgtcacttttgtgactccgacggcgcccaagactactatagcgactacgcatatctcagggagcacttccgggaaaagcacttcctctgcgaagaggggaggtgttcaaccgaacaattcacccatgcatttcggacagaaattgacctcaaggcgcaccgaacagcttgtcattctcggagtcgcgctgaggcccgccaaaatcgtcacatcgatctccaattctcttacgctccgaggcattcacggagaaacgagggcgtggtggggggcgaagattatgaagaggtggacaggtattctcgccagggtcgggtggcacgggcaggaaccaggggcgcccagcagtctcgtagaggatcgtggcgttacaaacgtgaagaagaagaccgggaggtagctgccgcagtgcgggcctcggtggctgcccagcagcaggaagaagcaaggaggagtgaggaccaggaagaggggggaagaccgaaaaaagaagaggcagccgccagagggcctgaggatccccgaggtcctaggcgctctcctagaacacagggcgaaggacctggccccaaggaaacctcaacgaatgggccggtttcccaggaggcattcagtgtcacagggcccgcagctccgggatgcgttggggtccccggcgccttacctccccctagccctaagttaaaggatgaagatttcccctcactgagcgccagtacgtcctcctcttgcagcaccgcagctactccgggccctgtcggtctggccctgccttacgccattcccgcacgggggcgcagtgcatttcaggaagaggattttcctgccctggtgtctagcgttcctaaaccgggtaccgcgcctacgtctctggtctccgcctggaacagcagttctagttccaagaaagtggcccagcccccactgagtgcacaggcaacaggatccggacaaccaactcgcaaagctggcaagggatctcgggggggccggaaaggggggcccccattcactcaggaggaggaagaggatggcggtcctgccctgcaagaacttctatccaccaggcctacaggatcagtctcctcaacactggggttggctagcatccagccttccaaagtggggaagaagaagaaggttggtagtgagaaaccagggacgactctccctcaacctccgcccgcgacctgcccccccggggccctgcaggctcccgaagcccccgcttcccgggcagagggcccagtcgccgtggttgttaatggacacatggaggggccagcacccgcgcgaagcgcgcccaaagaaccacccggcctgccccgtccgttaggaagtttcccttgccccacccctcaggaggattttcctgctctgggcggcccttgcccccctcgcatgcccccacccccaggcttcagcgccgtagtgttgttgaaaggcacgccaccaccccctccacccggcttggttccgcctatatccaaaccgcctccaggattttcagggttgttaccaagcccacaccccgcctgcgttcccagccctgcaaccactaccaccaccaaagcccctcgcttgttaccagcacctagggcttacttggtgcctgaaaatttccgggagaggaatcttcagctgatccaatctatccgtgatttcctccagtccgacgaggcacgtttctccgaattcaaaagccacagcggggagttccgacagggcctgatatctgccgctcagtactataagagttgtagagaccttcttggcgagaattttcagaaggttttcaacgaactgttggtgctcttgccagacactgctaaacagcaggaactgctgagcgcccataccgatttttgcaatagggagaagcctttatccaccaagagtaaaaagaataaaaagtctgcgtggcaagctacgacacagcaggctggtctggactgccgagtctgccccacttgccaacaggttctggcgcatggtgacgcctcaagccatcaggctcttcatgctgcacgggatgacgacttcccatcactgcaggccattgccagaatcatcacatag

SEQ ID NO: 52563 - DNA, 4539 bp, Artificial Sequence
  Description of Artificial Sequence: Synthetic coding sequence
atgagcgtgaacatcagcaccgccggcaagggcgtggaccccaacacggtcgatacctacgactcaggcgatgactgggagatcggggtcggcaacctgatcattgatttggacgccgatctggaaaaggatcgccagaagttcgagatgaacaactctacaacaaccaccagctcaagtaattcaaaggactgtggtggcccagccagtagtggagcaggtgcgacagctgccctggcagatggcctgaaattcgccagcgtacaggccagcgcacctcagggtaactctcataaggaaacatctaagtctaaggttaaacggtcaaagacgtctaaagatgcgaacaagagcctgccttcagccgctctatacggcatccccgagatttcctccactggtaagcgtcaggaagtgcagggacgccctggcgaagccaccggtatgaatagcgctttggggcagtcggtgagctctggcgggtctgggaacccgaactctaatagcacaagcacctcaaccagcgcagccaccgcaggagctggctcttgcggaaagagcaaggaagagaagcctgggaagtctcaaagttcgcgtggagccaagcgtgataaggacgcaggtaaatctagaaaggataagcatgacctgttgcaggggcaccagaatggatccggatcacaggctccatctgggggccatctgtatggtttcggggcaaagtctaacggcggcggtgcaagcccctttcactgtggtggaactggttccggatcagtggccgcagcgggagaagtctctaaaagtgctcctgactctggcctgatgggcaactcaatgctggtcaaaaaagaagaagaggaagaggagagtcaccgccgaatcaaaaagctcaagacagaaaaggtcgatccattgtttaccgtacctgcgcccccccctccgatcagtagctctctcacccctcagatcctgccctcttacttttctccctcctcctccaatattgccgctccagtggaacagctacttgttcgcactcgctctgtgggggtcaacacctgcgaagtcggagtagtaactgaacccgagtgtcttggcccttgcgaacctggtacatctgtgaacctggaaggtatcgtctggcacgaaacggaggagggggttctagtcgttaacgttacatggcgaaacaagacttacgtggggacgttgctcgattgtaccaagcacgattgggcccccccccgtttttgtgaatccccaacatcagacctggagatgcgcggggggagaggccgtgggaagcgcgctaggagtgcggccgctgcacccggcagcgaagcaagtttcacagagtcacgtggattgcagaacaaaaacagaggaggagcaaacggcaaagggcggcgcgggagcttaaatgccagtggacggagaacacccccgaattgcgcagccgaagatatcaaagctagccctagttctactaacaagcgtaagaataagccccccatggagctggacctaaattcaagctctgaggacaacaagcctggcaaaagagtgcggaccaactccagatctacgcctacaacgccccaaggtaaaccggaaaccacattcttggatcagggatgctcgagcccagtcttgattgactgcccacaccctaactgtaataaaaagtataagcacatcaatggtctaaggtaccaccaagcccatgcccacctggaccccgagaataaactggaatttgagccagacagtgaggacaagataagcgattgcgaggagggactttccaacgtagcactcgagtgctcggagccttccacctcggtctcagcgtacgatcaactgaaggcaccagcttccccgggagccgggaatccgccaggtactccaaaagggaaacgagaacttatgtctaatggcccaggttccataatcggtgccaaggctgggaaaaactccggcaagaagaagggactgaacaatgaactaaacaacctgcccgtgatctcgaatatgacagccgcacttgattcttgctctgctgccgatggcagtcttgccgccgagatgccgaagctggaggccgagggtttgatagacaagaagaatttgggtgataaggaaaagggcaagaaagctacaaattgcaagactgataaaaatctctctaagctaaaatcggccagaccaattgcgcctgctcccgcccctacccctccccaactgatcgccatcccaacagccacttttactaccaccactactgggacaatccctgggctgccctcattgactacaaccgtggtgcaagcgacacccaagtctccacctctgaaacccattcagcccaagccaactattatgggtgaacccatcacagtgaatccggctctggtgtcccttaaagataagaagaagaaggagaagcgcaagctaaaggataaggagggaaaggaaaccggctccccaaaaatggacgctaagttaggaaaactcgaggactcaaagggggcttctaaggacttacctggtcatttcctgaaagaccatttgaacaagaacgagggcctggctaacggcctgtcggagagtcaggagagcaggatggcctccattaaagccgaggcagataaagtgtacaccttcaccgataatgccccgagcccttcaatagggagcgcaagcaggttagaatgctccaccctggtcaatgggcaagcccctatggcccccctgcatgtgctaactcaaaatggcgccgaaagcagcgcagcgaagacatctagcccagcttactctgatatctctgatgcggccgatgatggtggctccgacagcaggtccgaaggcatgagaagcaaagcctcaagcccctctgatattatctcctccaaggactctgtggtcaaaggacattctagcacgactgcacagagttcacaactgaaagaatcacactcgccatactaccatagctatgacccctattattcaccctcctacatgcaccctggacaagtgggcgccccggccgctggcaacagcggctctacacaaggcatgaaaataaagaaggagtccgaagaggatgccgaaaaaaaagacaaagctgaacagcttgatagtaagaaggtcgaccacaacagtgcgtccctgcagccacaacatcagtccgtaattacacaaagacatccagcactggcacagtcactctactatggtcagtatgcttacggtctgtacatggatcaaaaatcgctcatggccacctctcccgcttaccgccagcaatatgagaaatattacgaggaccagcgcctggcggagcaaaaaatggcccaaacaggtagaggcgattgcgagcgcaagtcggagctccctcttaaggaactgggcaaagaggaaacgaaacaaaaaaacatgccttccgcaacaatttctaaagcacctagtacacccgagcccaataagaatcattcaaagctagggccgagtgttcccaataaaaccgaggagactggcaaatcccagctattgagtaatcaccagcagcagctgcaggccgattctttcaaagccaaacagatggagaatcaccagcttatcaaggaggctgtggagatgaagagtgttatggattcaatgaaacaaacaggcgtcgaccccacctccagattcaagcaagaccccgatagtagaacatggcaccactacgtgtatcagcccaagtatttagaccagcagaaaagcgaagaactggaccgtgagaagaagctgaaggaggactcaccccggaaaactcccaataaagagagcggggtcccctctctgccagtttctcttacctccataaaggaggaaccaaaggaagctaaacacccagactcccagagcatggaggaatctaaattaaaaaatgacgatcgcaagacccctgttaactggaaggactcccggggcacaagggtagctgtcagctccccaatgtctcaacatcagtcctatatccagtatctgcatgcatacccatatccacaaatgtatgatccctctcatccggcatatagggccgtgtctccagtgctcatgcacagctatccaggcgcttacctgagcccaggtttccattaccccgtgtacgggaagatgtccgggagggaggagacagagaaggttaacacaagcccgtccgtgaacaccaagaccacaactgagagtaaagcactggacttactgcaacagcatgccaaccagtatagatccaagagcccagcaccagtcgaaaaggcgaccgccgaaagagagagagaggcagagcgggagagagatcgccacagcccattcgggcagaggcatcttcacacacatcatcatacgcacgtgggcatgggttatcctttaatcccaggacaatacgaccctttccagggactgacaagtgcagccctagtcgcaagtcaacaggtagctgcacaggctagcgccagcggaatgttcccaggccagcgccgggagtag

SEQ ID NO: 52564 - DNA, 3258 bp, Artificial Sequence
  Description of Artificial Sequence: Synthetic coding sequence
atgcggggcggccggggccggggcaagcgggcccggagcgccgccgctgcgccaggctccgaagcctcttttaccgaaagtagggggctccagaataagaatcgggggggcgctaatggcaagggcagacgcggctccctgaatgcctctggtaggaggaccccgccaaattgcgcggcggaggatatcaaggccagtccgtctagcaccaataagcgcaaaaacaagcctcctatggaattagacctgaactcctcctccgaggacaataagccaggcaagagagtgcggacaaactccaggtccacacctaccacgccccaaggtaagcccgagactacatttctggatcagggctgctcctctccggtgcttatcgactgcccacaccctaattgcaacaaaaagtacaaacatatcaatggattgaggtatcatcaggcccacgctcatttggatcctgaaaataagttggagtttgagccggacagcgaggacaaaatttctgactgtgaagaagggctgtccaatgtcgccctggagtgctcagaaccaagtactagcgtctctgcctatgaccagctcaaagcccctgcatctcctggcgcagggaatcctcccggcacacccaagggcaaaagggaactgatgtcgaacggccccggtagtattatcggcgccaaagccggaaaaaacagtggaaaaaaaaagggcttaaacaatgaactcaacaacctgccggtgatctctaatatgaccgccgctctcgacagttgcagcgctgcagatggatctctagctgcagagatgcctaaactggaagcggaggggttgatagacaaaaaaaacctcggcgacaaggagaaaggcaaaaaggccaccaattgcaaaaccgataagaatctgagcaaactgaagtctgctcgccctatagccccagcgccagctccgacaccaccccagctaatcgccattcctaccgccacgttcaccacgactacgaccggaaccatccccgggctcccttctctgactacaacggttgtacaggcgaccccgaaatctcctccgctgaaacccattcagcccaaacctactattatgggcgagccaatcacggttaatcccgcgctcgtgtccttaaaagataaaaagaaaaaggaaaaacggaaattgaaagataaagaaggaaaggaaactggctccccgaagatggatgcgaagcttggcaagttggaggatagtaagggcgcatccaaagatctgccagggcacttcttgaaggaccaccttaataaaaatgaagggctggctaacgggctctcagagagccaggagtcaagaatggccagcataaaagcagaagcagacaaggtctatactttcaccgacaacgcacctagccccagtattggaagcgcgtccaggctggaatgttccacgctggtgaacggccaggcgcccatggctcctctgcacgtgctgacccaaaacggtgccgagtcctcggcggctaaaacatcgtccccagcatacagtgatatctcagacgccgcagacgatggcgggagcgactcccgctcagagggaatgcggtctaaggccagctcccctagcgacataatatccagcaaggacagcgtggtgaaaggtcacagctccacgacagcccaatcgagtcagctgaaggaatctcactcaccatattatcactcctatgacccatattacagtccaagttatatgcacccaggacaggtcggcgcacctgcggctggcaacagcggtagcacacagggaatgaagataaagaaggagtcagaggaggatgcagaaaagaaagacaaagcagaacagttggattctaaaaaggtcgatcacaatagcgcttctctgcagccccaacaccagtccgtaataacccagcgacacccagccttggcccagagcttgtattatggacagtacgcctatggcctgtacatggaccaaaagagcctaatggccacgtcgccagcatatcgccagcaatacgagaagtactatgaggatcaacgcctggctgagcaaaaaatggcccaaaccgggcggggagactgtgaacgcaagagcgaactgcctctcaaggagctggggaaagaggagaccaaacagaaaaacatgcctagcgccacaatcagcaaagcaccgagcacaccagaacccaataaaaaccactcgaaattaggtccgtccgtgcctaataagactgaggaaaccgggaaatctcagctgcttagtaaccaccagcagcaattgcaggccgatagctttaaggcaaagcagatggagaaccatcagttgattaaagaggctgtggagatgaagtcggtaatggatagtatgaagcagacgggggtagatcctactagtcggttcaagcaggacccagactctagaacatggcatcactacgtgtaccagccaaaatacctcgatcaacaaaaaagcgaagagttggatagggagaagaagttgaaggaggactctcctcgcaagacccctaataaagagtcaggcgttccttctctgcccgtgagtctgactagtattaaggaagagccaaaggaggctaaacatccggactctcagtctatggaagagtccaaactgaaaaatgatgaccgaaaaactccggtgaactggaaggattctcgcggcacacgcgtcgctgttagctcccccatgagccagcaccaatcctatatacaatacctgcatgcttacccttatccccaaatgtatgacccttcccaccccgcgtacagggcagttagcccagtgctcatgcactcttacccaggcgcttatctgtcccccggattccactacccagtctacggcaagatgagcggcagggaagaaacagaaaaagtaaacacctcaccttcggtgaacacaaagacgacgaccgagagcaaggcgctggacttgctccagcaacacgcaaatcagtaccgctcaaagtctcccgcaccggtagaaaaagccactgcggaaagagagagggaggccgagcgggaacgggatcggcactctccctttggccagagacatcttcacacgcaccaccacactcatgtgggtatggggtatcccctcatacctgggcagtacgaccccttccagggcctaacaagtgccgcacttgtggcgagtcagcaagtagctgcacaggcgtcagcctccggtatgttccctgggcaacgacgcgagtag

SEQ ID NO: 52565 - DNA, 2148 bp, Artificial Sequence
  Description of Artificial Sequence: Synthetic coding sequence
atgagcgtgaacatcagcaccgccggcaagggcgtggaccccaacactgtagatacatacgattctggtgacgactgggagataggagtgggaaatctgattattgacctcgatgcagatttggaaaaagatcggcagaagttcgagatgaacaactctactacaactacgtccagtagcaactccaaagattgtggtggtcctgcgagctccggtgccggtgccaccgccgcactggctgatgggctgaagtttgcctctgtgcaggcctctgctccccaagggaactcccacaaggagacaagtaaatccaaagtgaaacgctccaagacttcaaaagatgctaacaagtcactgccctcggccgcattgtacggcatccctgaaattagttcaaccggaaaacgccaagaagtgcaggggcgtccgggcgaagcaaccggaatgaacagcgccctaggccagtctgtcagttccggcggctccggcaaccccaacagtaattcaacatccacaagcaccagcgcagccaccgcaggcgccggctcatgtggcaagtcaaaggaggagaagcccggaaagagccaatcctctaggggggcgaagagagacaaagatgccggaaagagtcgcaaggataaacatgatctgttgcaaggccatcagaacggctctggaagtcaagccccttccggaggccacctgtacgggttcggcgccaaatcaaacggaggcggagcaagtcctttccattgcggaggaaccggctctggatctgtggcagccgccggtgaggtcagtaaaagcgctcctgacagtggtctgatgggtaatagtatgctggtgaagaaggaagaagaagaggaagaaagtcacagacgcatcaagaaactcaagaccgagaaggtcgatccactctttaccgtccctgccccgccacccccaatctcttcctccctgacaccacagatcctccctagttactttagcccctctagctccaacattgccgcccctgtggagcaattgttggtgcgaacaagaagcgtgggcgtgaatacatgcgaggtgggtgtggtcaccgaacctgagtgtttgggcccttgcgagccaggcacaagtgtgaacctcgagggtattgtttggcacgagactgaggaaggagtcttagtggtaaatgttacctggagaaacaaaacgtacgtcggaacccttctggactgcactaagcacgattgggcccccccccggttctgtgaatcccctacttcagacctagagatgagaggaggtagaggccgtgggaaacgcgcacgaagcgcagcggctgcccccggttcggaagcttcatttacggaaagtagaggactgcaaaacaaaaacagaggaggggccaacggcaaaggccgacgtggaagcctgaacgcatcaggccgccgcacacctcctaactgtgccgccgaggacatcaaagcctccccctcaagcacaaacaaacgtaagaataagccacctatggaattggacctgaattcttcttctgaagataacaaacccgggaagagagtaaggaccaattccaggtccacaccaaccactccacaagggaagcctgagaccacttttctggaccaggggtgcagctcacccgtgttgattgattgtccacaccctaattgtaacaaaaagtataaacatatcaacggtcttagataccatcaggctcacgcacacttggaccctgaaaacaaactggagtttgagcctgactcagaagacaagattagcgactgtgaggaagggctctccaatgttgccctggaatgctctgaaccctccacctccgtatccgcctacgatcagcttaaggctcccgcatcacccggcgccggaaacccccccggcacccctaaaggaaagagagagctgatgtccaacggccccggcagcataattggggccaaagcgggaaaaaactccggcaaaaagaaagggttaaacaacgaattgaacaacctgcctgtcatttctaatatgactgcagctctcgactcttgcagcgcagcagacggctctctagctgcagagatgcctaagctcgaagcggaaggtctcatagataagaagaaccttggcgacaaagaatag

SEQ ID NO: 52566 - DNA, 2124 bp, Artificial Sequence
  Description of Artificial Sequence: Synthetic coding sequence
atgagcgtgaacatcagcaccgccggcaagggcgtggaccccaacactgtggacacatacgattcaggtgatgattgggagataggcgtcggaaacctgattatagatctcgatgctgacctggagaaagataggcagaaatttgagatgaataactctacgacgactacatcgtccagtaactctaaagattgtgggggtcctgcttcatccggggccggcgcgacagccgctctggcagatggactcaagtttgcgtctgtgcaagcctcagcccctcaaggcaattcgcacaaggaaaccagcaaaagcaaagtgaagcgctctaaaacttcaaaagacgcaaacaaatcactgccatccgcagcactatatggcatccccgaaatttctagtacaggaaaacggcaagaggtccaaggaaggcccggagaggcaacaggcatgaatagtgccctcgggcagtctgtttctagcggtgggagcggcaacccgaactccaactctacttccacatctacctccgcagccaccgccggtgccggcagctgcggtaagagtaaggaagagaagccagggaaatctcagtcttccaggggtgctaaaagagataaagatgccgggaagagccggaaggataaacatgacctgctacagggacaccagaacggcagcggctcccaggcgccttccgggggtcacctctatggttttggcgcaaaaagcaacggagggggtgcgtccccttttcattgcgggggaactgggtcaggaagcgtagcagccgcaggcgaagtcagcaagagtgctccggactccggcctgatgggaaattctatgcttgtcaagaaagaggaggaagaggaggaatcgcaccgcagaataaaaaaactcaagaccgaaaaagtggatcccttgttcactgtgcctgcccctccacctccaataagtagctccctcactcctcaaatcctccccagctattttagcccttcctcttcgaacatagccgccccggtggaacaactactggtccgaacacgttcagtgggggttaacacatgtgaagtcggagttgtaacggagcctgagtgcctgggcccatgtgaacccggaaccagcgtgaacttggaagggattgtatggcacgaaaccgaggaaggggtattggtcgtcaatgtgacctggcgtaataaaacgtacgtcggcacgctcctcgactgcaccaaacacgactgggctcccccccgattctgcgagagtcccacaagtgacctggaaatgcgcggtggacggggccgcggtaagagggctaggagcgctgctgctgcgccaggctccgaagcaagctttacggagtctagggggctacagaataagaaccgtgggggggctaatgggaagggacggaggggatcgctgaatgcaagcggaaggcgcaccccacccaattgcgccgctgaagatattaaggcatctcccagctctactaacaagaggaagaataaacctcccatggaactagatctcaacagctcaagcgaagataacaagcctggcaagcgcgttagaactaatagtcgttcgacacccacaacccctcaaggcaagcccgagactacctttttggatcagggctgctccagtcccgtgttgatcgactgtccgcacccaaactgtaacaagaagtataagcacataaatgggctgcgatatcaccaggcccacgcccatctggatccggagaacaagctcgagttcgaacctgacagtgaagataagatctcagattgcgaggaggggctgtctaatgtggccctggaatgctcggagccctctacctccgtgagcgcctacgaccaactgaaggctcccgcatcgcctggggccggcaatccccccgggacacctaaaggcaagagggaactaatgagtaacggacccggctcaatcattggagcaaaagctggcaagaactcgggcaaaaaaaagggcctcaacaatgagctgaataatctgcccgtaataagcaatatgacagctgcgttagatagctgttcggcagctgatggcagcttggctgcggaaatgccaaaactggaggcagaaggactgatcgactag

SEQ ID NO: 52567 - DNA, 1503 bp, Artificial Sequence
  Description of Artificial Sequence: Synthetic coding sequence
ctgttcctgttcctggccgtggtgtgcagctacttcgcccaggacttttggcctaagcaggggatcaaaaactgttttcagaaggtgatcttgaaaaggtataaaaagtgtggacatgagaatttacagctgggcaagtactgtaagagtatggacgagtgtaaagtgcatgaagagtgttataacggcctcaaccagtgtctaagaacgacacagtcaaagatcctgcagtgtgacaaatatgttaaggtattccataaattcagcaattccaaccgatacaaaatcagacacaccggaaagaagcctttcaagtgtaaggaatgcgagaaaagcttttgtatgctgtcccacctcgcccaacacaagcgcattcacacccgagagaaaccctacaaatgtaaggagtgcgggaaagcctacaatgaggcatcaaatctgagtacacacaaacgaattcatacaggtaagaagccatataaatgtgagcagtgtggaaaggctttcaatagactttctcacctgaccacccacaaaatcatacacacggggaagaaaccgtatatctgcgaggactgcggcaaagcgtttaaccaatccgctaacctcaccacacataagcgcatccacaccggcgaaaagccatataaatgcgaggagagcggcaaagccttttctcagagcagcacactgacgacgcacaaaatcatccatgcaggcgagaagccttataaatatgaggagtgcggaaagagcttcaaccagagcagcactctcaccactaggaagattattcacacaggagagaagttctgcaaatgcgaggagtgggggaaggctttcagcagattatcccaccttacaacccacaagcgcatacacagcggcgagaagccctataaatgcgaggagtgtggaaaggcgttcaagcaatcttccacattaacaacgcataagcgcattcattctggtgaaaaattctacaaatgcgaagtgtgttccaaggctttctccaggttctctcatctcaccacacacaagagaatccatagcggtgaaaaaccttataaatgcgaagaatgcggcaaagcctttaatctctcttcacatctgaccacgcataagatcatacatactggcgaaaagccttataagtgcgaggagtgcggtaaggcctttaacctttcttctcacctgactacccacaagatcatacacacgggggaaaaaccctataagtgtgaggaatgcgggaaagcttttaaccaatcctccaccctttcaaaacacaaggtgatccacaccggagaaaaaccctacaaatgtggggaatgtggcaaagcgtttaatcagagcagccatctgacaactcataaaattattcataccggtgagaagccttataaatgtgaagagtgcgggaaggccttcaacaattcttccattctcaatcgtcataagatgatacacaccggagaaaagttttataagcccgagagttag

SEQ ID NO: 52568 - DNA, 1239 bp, Artificial Sequence
  Description of Artificial Sequence: Synthetic coding sequence
atgaccttcaccttccagagcgaggacctgaagcgggactgcggcaaaaagatgagccaccagcacgtcttttccttggctatggaggaggacgtcaaaacggccgataccaaaaaggcttctcgcatcttggatcatgagaaagagaatacgaggtctatttgccttcttgagcagaaacggaaggtagtgtcatccaatatcgatgtaccccccgctcgaaaaagcagtgaggagctcgacatggataaagtcacggcggctatggttctaacgtcactgtcaactagcccccttgtgcgctcaccccccgtccgccctaatgagagcctcagcggatcttggaaggagggcggttgcgtacctagtagtacatcctcttctggctactggtcttggtctgccccatccgaccagtcaaatccaagtactccatcccctccactgtctgcggactcctttaaaccgttccggtcacctgcccagccggacgacggcattgacgaggccgaggcaagtaacctcctcttcgacgaacctatcccgaggaaacgcaagaactctatgaaggtgatgttcaagtgtctgtggaaaaactgcggcaaagtcctgagcactgcggcaggcattcaaaagcacatccggacgatccatttaggccgggtgggggatagcgactattcagacggtgaagaagatttttattacactgagatcaagctgaacaccgattccgtggcagacggtctatcatcgctggcacctgtgtcaccaagtcagtcattggccagccctccaacttttcccatacctgacagcagtcgcaccgagaccccatgcgcaaaaaccgaaacaaaacttatgactcctctgtctcgcagcgcacccaccaccctttacctggtgcacactgaccatgcataccaggccaccccacctgtgactatcccaggcagtgccaaatttactcctaatggatcgtccttctctatcagctggcagtcacctcccgtaacttttaccggcatccctgtcagccccactcaccatcccgtgggaaccggcgaacagcgccagcacgcccacacggtcttaagtagccctcctcgcgggacagtgtctctgcggaagccaaggggagaggggaaaaaatgtcgcaaagtttatgggatggagaatcgggacatgtggtgtacagcatgtcgttggaagaaggcttgtcagcgattcctggactag

SEQ ID NO: 52569 - DNA, 570 bp, Artificial Sequence
  Description of Artificial Sequence: Synthetic coding sequence
atgaccttcaccttccagagcgaggacctgaagcgggactgcggcaagaaaatgtcccaccagcacgtgtttagcctggccatggaggaggatgtgaagaccgctgacaccaagaaagcgtctagaatcttggaccacgaaaaagaaaatacaagaagcatctgcctgctggaacaaaagcgaaaggtcgtaagctcaaacattgatgtgcccccggcaaggaaatcctcagaggaacttgacatggataaggtcaccgcagcgatggtcctcaccagcttgtccacaagcccactagtccgcagccctcccgttcggcctaatgagtctttgtctggctcctggaaagaaggggggtgtgtgccaagttctacttcatctagcggttattggtcctggtcggctccatccgatcagagtaatccctccactccatcgccgccgttgtcagcggacagctttaaacctttcagatcccccgcacagcccgacgatggtatcgatgaagcagaggccagcaacctgctgtttgacgagccaatacctaggaagaggaagaattcgatgtag

SEQ ID NO: 52570 - DNA, 903 bp, Artificial Sequence
  Description of Artificial Sequence: Synthetic coding sequence
atgcacagcctggagaaggtgaccttcgaggacgtggccatcgacttcacccaggaggagtgggatatgatggacacctccaagcgtaaattgtacagggatgtaatgctcgagaatatctcgcacctcgtgtccttgggctatcagatcagcaagagttatatcattctccagctggagcaagggaaggaattgtggtgggagggaagagtctttttacaggaccagaacccagaccgcgagtcagcactgaagaagaagcacatgattagtatgcatccaattattcggaaagataccagtacatcgatgacaatggagaattctcttatcctggaggaccctttcgagtacaatgactctggcgaggattgtactcactctagcacaatcacacagtgcttactcactcattcaggcaagaaaccctgcgtgtccaaacaatgtgggaagtcgctcagaaacctgctgagccccaaaccacgtaaacagatccataccaaagggaagtcctatcagtgtaacctttgcgagaaggcctacacaaactgtttctatctccgacggcacaaaatgacccacacaggtgagcggccctacgcatgccatctttgcggcaaggccttcacccagtgcagccacctcagacgccatgagaagactcataccggcgagaggccatacaaatgccaccagtgtggaaaggcgttcatccaaagcttcaaccttaggaggcatgagagaacgcatctgggacaaaaatgttacgaatgtgacaaatcaggcaaagcatttagtcagtcaagtggctttcggggaaacaagatcatccacattggagagaaaccccctgcctgccttctttgtggcaaggcattctctctgagtagcgatctcagatag

SEQ ID NO: 52571 - DNA, 903 bp, Artificial Sequence
  Description of Artificial Sequence: Synthetic coding sequence
atgcacagcctggagaaggtgaccttcgaggacgtggccatcgactttacccaggaagagtgggacatgatggatacgtcaaagcggaagttgtatcgcgacgtgatgctggagaacatttcacatctggtctccctggggtaccagatcagcaaatcatatatcatcctgcagctggagcagggaaaagagttatggtgggagggacgggtcttcctgcaggaccagaaccccgaccgagagagcgcactgaagaaaaagcacatgatttctatgcacccaattattcggaaggatacaagtaccagtatgacaatggaaaatagcctgatcctggaggatccatttgagtataatgactcgggggaagactgcactcatagtagcacaattactcagtgccttctaacccactccggcaagaaaccatgcgtgtctaagcagtgcgggaagtcacttcgcaatctcctgtcccccaagccgcggaagcaaatacacacgaaggggaaatcttatcagtgtaacctttgtgaaaaggcgtacactaactgcttttacttgaggagacacaagatgacccacacaggcgagcggccctacgcctgtcacttatgcggtaaggccttcacccagtgctctcatcttcgaagacacgagaaaacacataccggagaaagaccttacaaatgtcatcaatgtggtaaggcctttatccagtccttcaacctgcgcaggcacgaaaggactcatctggggcagaagtgctatgaatgcgataaatcgggcaaagccttctctcagtccagcgggttccgggggaacaagattattcacatcggcgaaaaacccccggcctgtctcctttgtggcaaagctttttctctgtcctcagacttaaggtag

SEQ ID NO: 52572 - DNA, 903 bp, Artificial Sequence
  Description of Artificial Sequence: Synthetic coding sequence
atgcacagcctgaagaagctgaccttcgaggacgtggccatcgactttacgcaggaagaatgggccatgatggacacttcaaagagaaaactctatagggacgttatgctggaaaacatttcccatctggttagcttgggataccagatatccaagtcctatatcatcctgcagctggagcaaggtaaggagctgtggagggaaggaagggtctttctgcaggaccaaaaccctaacagagaatctgctctgaagaagacccacatgatttcaatgcaccccattacacgcaaggatgcttctacttcaatgaccatggaaaactcactgatactggaggatccgttcgagtgcaatgactctggtgaagactgcacgcggagctccactatcacacaatgcttgttaactcattccggaaagaagccctacgtgtccaaacagtgcggaaaatcccttcgaaatctcttgtctactgagccccacaagcagatacacaccaagggcaaatcatatcagtgcaatctgtgcgaaaaggcctacacaaactgcttccacttacgacggcacaagatgactcatacaggtgagaggccgtacgcctgccacctgtgcagaaaggccttcacacagtgttcccacttgcgtcgacacgaaaagacccacactggacagcgtccatacaagtgccatcaatatgggaaagtgtttatccagagtttcaatctgcagcgacacgagagaactcatttgggtaagaagtgctacgaatgcgacaagtcaggcaaagccttcagtcagtcttccgggtttcgcggcaacaagatcatccacacgggagaaaagccccacgcatgcctgttgtgcggtaaagccttttcactgagctcaaatctgaggtag

SEQ ID NO: 52573 - DNA, 903 bp, Artificial Sequence
  Description of Artificial Sequence: Synthetic coding sequence
atgcacagcctgaagaagctgaccttcgaggacgtggccatcgactttacccaagaagagtgggctatgatggatacttccaaaagaaaactgtatagggatgtgatgctcgaaaatataagtcatctcgtgtctctgggataccagatctcaaaaagctatataattctgcagcttgagcaggggaaagaactgtggcgggaaggacgcgtttttctccaagaccagaatcctaacagggaatcagcgctgaagaaaacacatatgattagcatgcatcccattacccgcaaagatgcctcaacttcaatgacaatggaaaactccctgattctggaagacccctttgaatgtaatgattcgggcgaggattgtacgcgcagtagtacaatcacccagtgccttctgacccacagcggtaagaaaccatatgtctccaagcagtgcgggaaatctctccgcaatctgctgagcaccgagccacacaaacagatccataccaagggtaaaagctaccagtgcaacctctgtgagaaggcctataccaactgtttccacctgaggcgccataagatgacccacacgggcgagcgaccctatgcctgccatctgtgtcgcaaggctttcacacagtgcagccatctgcgcaggcacgaaaaaacacataccggccagagaccgtataaatgccatcaatatgggaaggtgtttattcaatctttcaacctgcaaaggcacgagcggactcacctggggaagaagtgttatgaatgtgataagtccggaaaggccttctcccagtcctcagggttccgggggaataagatcatccatacgggcgagaaacctcacgcgtgtctcctgtgcgggaaggccttttcactcagctctaatttgcgctag

SEQ ID NO: 52574 - DNA, 231 bp, Artificial Sequence
  Description of Artificial Sequence: Synthetic coding sequence
atggcccggggccagcagaagatccagagccagcagaagaacgccaaaaaacaggcaggccaaaaaaagaagcaggggcacgatcagaaagccgctgccaaggccgctctgatttatacctgcaccgtgtgtaggactcagatgccggaccctaaaacgttcaaacaacacttcgagagtaaacatccaaaaactcccctgccacctgagctggcggacgttcaagcatag

SEQ ID NO: 52575 - DNA, 231 bp, Artificial Sequence
  Description of Artificial Sequence: Synthetic coding sequence
atggcccggggccagcagaagatccagagccagcagaagaacgccaagaaacaggccgggcagaaaaagaagcagggtcacgaccagaaagcagccgctaaggcagccctcatatacacctgcacggtgtgcagaacacagatgccagacccgaagacatttaagcagcatttcgagtctaagcacccaaaaacaccactgcctcccgagctcgccgatgttcaagcctag

SEQ ID NO: 52576 - DNA, 231 bp, Artificial Sequence
  Description of Artificial Sequence: Synthetic coding sequence
atggcccggggccagcagaagatccagagccagcagaagaacgccaagaaacaagccggccagaaaaaaaaacaggggcatgatcagaaggctgctgctaaggccgctctcatatacacatgtacggtctgccgcactcaaatgccagatccaaagaccttcaaacagcattttgagtccaagcaccctaaaactccacttccacctgaattagccgatgtccaggcctag

SEQ ID NO: 52577 - DNA, 231 bp, Artificial Sequence
  Description of Artificial Sequence: Synthetic coding sequence
atggcccggggccagcagaagatccagagccagcagaagaacgccaagaagcaggcgggccagaaaaagaagcagggtcacgaccagaaggctgcagccaaagctgccctcatttacacatgtacagtatgcaggacccagatgccagaccctaagacctttaaacaacactttgagtctaagcacccaaaaacccctctcccccccgaactcgccgacgtgcaggcatag

SEQ ID NO: 52578 - DNA, 231 bp, Artificial Sequence
  Description of Artificial Sequence: Synthetic coding sequence
atggcccggggccagcagaagatccagagccagcagaagaacgccaaaaaacaggctggacagaaaaaaaagcagggccacgatcaaaaagctgccgccaaggccgctctcatctatacctgcactgtctgtaggacacaaatgcctgatcctaaaacgttcaagcagcatttcgaaagcaaacaccccaaaacccctctgcctcccgagctggctgatgtgcaggcctag

SEQ ID NO: 52579 - DNA, 27 bp, Artificial Sequence
  Description of Artificial Sequence: Synthetic coding sequence
atggcccggggccagcagaagatctag

SEQ ID NO: 52580 - DNA, 231 bp, Artificial Sequence
  Description of Artificial Sequence: Synthetic coding sequence
atggcccggggccagcagaagatccagagccagcagaagaacgccaagaagcaggccgggcagaagaaaaaacagggccatgatcagaaggctgcggccaaggctgctctaatttacacctgcaccgtctgcagaacacaaatgccagatccaaaaacctttaaacagcactttgaaagtaaacaccctaaaactccgctgccccctgagcttgctgatgtgcaggcctag

SEQ ID NO: 52581 - DNA, 231 bp, Artificial Sequence
  Description of Artificial Sequence: Synthetic coding sequence
atggcccggggccagcagaagatccagagccagcagaagaacgccaagaagcaggctggacaaaagaagaagcaagggcacgaccagaaagccgcagctaaagctgctctcatctacacatgcacggtttgccgtacgcaaatgccggatccaaagacatttaagcagcatttcgaatctaagcacccaaagacacctctacctcctgaactggctgacgtgcaggcatag

SEQ ID NO: 52582 - DNA, 129 bp, Artificial Sequence
  Description of Artificial Sequence: Synthetic coding sequence
atggcccggggccagcagaagatccagagccagcagaagaacgccaaaaagcaggcgggacagaagaaaaagcaggggcatgatcagaaagcagccgccaaggccgcccttatctatacatgtacatag

SEQ ID NO: 52583 - DNA, 1116 bp, Artificial Sequence
  Description of Artificial Sequence: Synthetic coding sequence
atggacatggcccaggagcccgtgaccttccgggacgtggccatctacttctcccgagaagagtgggcgtgcctagaaccctctcaacgggccctgtaccgcgacgtgatgctcgacaactttagcagcgtggcggccttgggattttgcagtccaagaccagacctggtgtccaggttggaacagtgggaggaaccatgggtcgaagacagggaacgccccgaattccaggcagttcagagagggcccagaccgggcgcgaggaagagcgccgatcccaaacgcccctgcgatcacccagcgtgggcccacaagaagacccatgtgcggagagaacgggcgcgtgaggggagctcattcagaaagggatttcgccttgatacggatgacggccaattacctcgcgcagcgcccgagaggactgacgctaagcccacagcatttccgtgtcaagttctgacgcaacgctgcggacgacggccaggccgccgtgaacgacggaagcagagagctgtcgaattaagttttatctgtggaacttgcggaaaagcattgtcctgtcactcccgcctgttggcccatcagacggttcatacaggaacgaaagcgttcgaatgtcctgagtgtggccaaacttttcggtgggctagtaacctgcagcgccatcaaaagaatcataccagggagaaacctttctgctgcgaagcttgcggacaggcttttagcctgaaagataggctcgctcagcatcggaaggttcatacagagcatcggccatacagctgtggtgactgcggaaaagccttcaaacagaaaagtaatctgctccggcaccaactggtgcacactggcgagcgtccattttattgcgcggattgtggcaaagccttcagaactaaggaaaatctcagtcaccaccaacgtgtgcattctggcgaaaaaccgtacacgtgcgcagagtgtggtaaatcctttagatggcccaaaggttttagtatccacaggcgcctgcacctgactaaacgcttctacgagtgcggccactgtggtaaaggctttaggcacttgggtttcttcaccaggcaccaacgcacgcatcggcacggcgaagtatag

SEQ ID NO: 52584 - DNA, 1116 bp, Artificial Sequence
  Description of Artificial Sequence: Synthetic coding sequence
atggacatggcccaggagcccgtgaccttccgggacgtggccatctattttagcagggaggaatgggcgtgcttggaaccttcacaaagggctctatatagagacgtgatgctcgataacttttctagtgtggcggctctgggtttttgttccccccgcccagaccttgtgtcccggctggagcagtgggaagaaccgtgggttgaggatcgcgagagacctgagtttcaagccgtgcagagaggcccccgtccaggcgcccgcaagtcagccgatcctaagcgcccttgcgatcatcccgcttgggcccataagaagacgcacgtgcgcagggaaagagctagggagggaagttctttccgaaagggattcagactcgatacagacgacggccagctgccacgcgccgctcccgagcgtaccgacgccaaaccaaccgcctttccatgccaggtattaactcagcgttgcggcaggcggcctggcaggagagaaagacgaaagcagagggccgtggagctgtccttcatatgcgggacatgtggtaaagccctgtcttgccacagtaggctccttgcccaccagacagtccataccggaacaaaggctttcgagtgccccgagtgcgggcagacctttcggtgggcgagcaacctgcaaagacatcagaaaaatcatacaagagaaaagcccttctgctgtgaggcttgcggacaggcgttctccttgaaagataggctggctcaacatcgcaaagtccacaccgagcacagaccctatagctgtggcgactgcgggaaggccttcaagcagaaatccaacctgctaagacatcagctggtgcacactggagagagaccgttctactgcgctgattgtggcaaagcctttcggaccaaggaaaatctctcgcaccaccagagagtgcatagcggcgaaaagccttatacttgtgcagagtgcgggaaatcttttagatggccaaaggggttttcaattcatagaaggctgcacctcaccaagcgcttctacgagtgcggtcactgcggaaagggttttagacacctagggtttttcacgagacaccagaggacccatcgacatggagaggtgtag

SEQ ID NO: 52585 - DNA, 1665 bp, Artificial Sequence
  Description of Artificial Sequence: Synthetic coding sequence
atgaacgtgatgctggagaactacaagaacctggtgttcctggccgggattgcggtgtctaagcaagacccgattactagccttgagcaggaaaaagagccatggaacatgaagatctgcgagatggttgatgagtcccccgccatgtgctccagcttcacacgagatctgtggcccgaacaagatattaaagacagctttcagcaggtgatccttcggagacatgggaagtgcgagcatgaaaatctgcaacttaggaagggttctgccaacgtggtcgagtgtaaggtatataaaaagggttacgagctgaaccaatgtctcaccactacccaatccaagattttcccttgtgacaaatatattaaggtgttccataagatctttaactcgaaccggcataaaacccgccacactggagagaagcccttcaagtgcaaaaagtgcgatgaaagtttctgcatgctgctccacctccaccagcacaagagaatccacatccgggagaactcctatcagtgcgaagagtgcgacaaggtcttcaagcgattctccacactaaccaggcacaaaagagtccatacaggtgaaaaaccattcaagtgtgaggagtgcggcaaagcatttaaacactcctccactctgacaacccacaagatgatacatactggcgagaagccctacaggtgtgaggagtgtgggaaagccttctatcactcaagtcacctaaccacccataaagtaatacacaccggagagaaaccatttaagtgcgaagagtgcggaaaggcctttaatcacccttccgcccttaccacacacaaatttatccacgtaaaggagaaaccttataagtgtgaagaatgcgacaaggctttcaatcgcttctcctatttgacaaaacataaaattatccacagcggcgagaaaagctacaaatgtgaacagtgtggaaaaggcttcaactggtcctctactctcaccaagcacaagaggatccacaccggagagaagccctacaagtgcgaagaatgcggtaaggcatttaatgtttctagccatctaaccacccataagatgattcacaccggagaaaagccctataagtgtgaggagtgtggcaaggccttcaatcacagtagcaagctgaccatccataaaatcatccacaccggggaaaaaccatacaaatgcgaagagtgtggaaaagcatttaaccagagctctaatctgacgaagcacaaaataatacacacaggagaaaagctgtataagtgcgaggaatgtggcaaggctttcaatcgcagttcaaacctgactactcacaagagaatccatacgggggagaaaccttataaatgcgaggaatgcggcaaggcgttcaatcgaagcagtaacctgacaaaacacaacataatccatactggggaaaagtcttataagtgcgaagagtgtggcaaagctttcaatcaatcatccacgcttactaagcacaggaagattcagcagggaatggttgcccatgcctgtaatcccaacaccttgagggggctgggggaacaaattgcccgctccggtgtccaggaccaacctggacaacacggcaaaacgccaagcctgctgaagattcagaaattcgcaggctgcggcggtcgccggctgtag

SEQ ID NO: 52586 - DNA, 1572 bp, Artificial Sequence
  Description of Artificial Sequence: Synthetic coding sequence
atgaacgtgatgctggagaactacaagaacctggtgttcctggccggtatcgccgtgtccaagcaggaccccattacaagcctagagcaggaaaaagaaccatggaatatgaaaatttgtgaaatggtcgatgaatctccagctatgtgcagttcttttacccgcgacctatggcccgaacaggatattaaggattcattccagcaagttatccttagacgccatggtaagtgcgagcacgagaacctgcagctccgaaaggggagcgcaaatgtcgttgaatgcaaagtatataagaagggttacgaactgaatcagtgtctgaccacgactcagagtaaaatcttcccttgcgataagtacatcaaagtgttccacaaaattttcaatagcaatcgccacaaaacacggcacacaggcgaaaaacctttcaagtgtaaaaaatgcgacgaaagcttctgtatgctgcttcatctgcatcagcataaaaggatccatatcagagagaattcctaccagtgtgaggaatgcgacaaggtgttcaagcgtttcagcacgctgacaagacacaaacgggtgcacactggcgaaaagccctttaagtgtgaggagtgtggcaaggcctttaagcactctagcacactgaccacccacaaaatgattcacactggcgaaaagccataccgctgtgaggaatgcggcaaggccttctatcactccagccacctgaccacacataaggtcattcatactggggagaagcctttcaagtgtgaagagtgtggaaaggcatttaatcatcctagtgccctgacgacccataagttcatacatgtgaaagagaagccatacaaatgtgaagaatgtgacaaagccttcaaccgctttagttacctgaccaaacacaagatcattcatagtggagagaagtcttacaagtgtgagcagtgcggtaaagggttcaattggtccagtaccctgaccaagcataagaggatccataccggagagaaaccttataaatgcgaagagtgcggtaaggcctttaatgtctccagtcacctcaccacccacaaaatgatccacactggcgagaaaccctacaaatgcgaggagtgtgggaaggcgtttaatcactccagcaaactgactatccataaaattattcatactggagaaaagccgtacaaatgcgaggagtgcggcaaagcgttcaaccagtcctcaaaccttaccaagcacaaaattatacatacaggagaaaaattgtacaaatgtgaggaatgtggaaaggccttcaaccgaagttccaacttaacaacacataagaggatacataccggagaaaagccttacaagtgtgaggagtgtggaaaggcctttaaccgatcatcgaatctcaccaagcacaacataatccacaccggcgagaaaagttataagtgtgaggagtgcggaaaggcctttaaccagagctcgacactaacgaaacacaggaaaattcagcagggtatggtggctcatgcctgtaacccaaatacgttgcgtggtcagggcagatggatcatgtag

SEQ ID NO: 52587 - DNA, 1665 bp, Artificial Sequence
  Description of Artificial Sequence: Synthetic coding sequence
atgaacgtgatgctggagaactacaagaacctggtgttcctggccggaatcgcggtgtcgaagcaggaccctattacgtcactcgagcaggaaaaagaaccgtggaacatgaaaatttgcgaaatggttgatgaaagtcccgctatgtgtagctcatttaccagggacctctggcccgagcaggatataaaagatagtttccagcaggtgatcctgcggcgacatggaaaatgcgagcacgagaaccttcagctgcgcaaagggtctgctaacgttgttgaatgtaaagtgtacaagaagggctacgaactgaaccagtgcctcaccacgacgcagagcaagattttcccctgcgataaatatatcaaagtctttcataagattttcaattctaaccgacacaagacccggcacaccggagaaaaaccgttcaagtgtaagaaatgtgatgaatcattttgcatgcttttacaccttcaccagcacaaacgtatccatataagagaaaacagttatcagtgcgaggagtgcgataaggtgttcaaaagattctctaccctgacgaggcataagcgcgtacacaccggtgaaaagccatttaagtgcgaagaatgcggaaaggctttcaagcattcgtccaccttgaccacccacaaaatgatccacacaggcgagaagccctacagatgcgaagagtgcggtaaagctttttatcactctagccatttgactacccacaaggtcatccatactggcgaaaagccatttaaatgtgaggaatgcggcaaggcttttaatcacccaagcgctttgactacacataaatttattcatgtcaaggaaaagccgtacaaatgtgaagaatgtgataaggcctttaataggttcagctatcttacaaaacacaagatcatccattcaggggaaaaatcgtacaaatgcgaacagtgtggtaaagggttcaactggagcagtactctcaccaaacacaaaaggattcatacgggcgagaaaccgtataagtgcgaggaatgtggcaaagccttcaatgtttccagtcatcttaccacgcataagatgatccataccggggagaagccgtataagtgcgaagaatgtgggaaggcgttcaaccactccagcaagctgactattcacaagataatacacaccggcgagaagccctacaaatgcgaggagtgtggcaaagcctttaatcaatcatcaaacctaacaaagcataaaataattcacaccggggagaaactatacaaatgcgaggagtgtggcaaggcctttaataggtcttctaatctcaccacccacaagcgaattcacactggggaaaaaccctacaagtgtgaagagtgtggtaaggcctttaataggtcttctaatcttacaaagcataatattatccacaccggggaaaaatcctataagtgcgaagagtgtgggaaggcctttaatcagagttcaacgctgactaaacaccgaaagattcagcagggtatggttgcccacgcctgcaatccgaacactcttcgggggctgggcgagcaaattgcgaggtctggggtgcaggatcaacccgggcagcatggcaagaccccaagcttattaaaaattcagaagtttgctgggtgtgggggcaggagactgtag

SEQ ID NO: 52588 - DNA, 1452 bp, Artificial Sequence
  Description of Artificial Sequence: Synthetic coding sequence
atgggcctgctgaccttccgggacatcgccatcgagttcagcctggcagaatggcagtgtctggaccacgcacagcaaaatctgtaccgcgatgtgatgcttgaaaactacaggaacctagtgtccttaggcattgccgtctccaagccagatctgatcacttgcctggagcagaataaagagccacagaacattaagcggaacgaaatggtggcgaagcatcccgtgacgtgcagccactttacccaggatctgcagtcagaacaaggcattaaagacagcttgcagaaggtaatacttcgtcggtatggcaaatgcggccaggaagacctgcaggtgaagaagtgttgtaaatccgtgggagagtgtgaggtgcacaagggcgggtataattacgtgaaccaatgtctgtccgccacgcaaaataagacctttcagacccacaagtgcgtcaaggtgttcggcaaattcagtaatagtaacaggcacaaaaccaggcatactgggaagaaacatttcaagtgcaagaacgatgggaagtcgttctgcatgctgagcagactgaaccagcatcaaatcattcacactagagaaaagagctacaagtgcgaggaatgtgggaaaagttttaactgcagtagcacgctcactcgccacaaaaggattcatacgggagagaaaccctaccggtgcgaagaatgtgggaaagcattctcatggtctgcttctttaacgaagcataaaagaatacacaccggcgagaagccatacacctgtgaggagagaggcaaggtgtttagccgctctacattgactaattataagcgcatacataccggggagaagccatacacctgtgaggagtgtggcaaggctttttcacggtcttcaaccttgaccaatcacaaacgaatccataccggcgagcgcccctacaagtgtgaggagtgcggaaaagcttttagcttgtcgagcactctgaagaagcacaagattgtacacacaggcgagaaactctacacttgcgaagagtgcggaaaggccttcacattctcctccactctgaacacccataagagaatccatacaggcgaaaagccatacacatgcgaggagtgtggcaaagcattctcactcccatctacttttacctaccataagaggacccacacaggagagaagccttataaatgcgaggagtgcggcaaagcctttaactgcagttcaaccctgaagaagcacaagattatccacaccggagaaaaattgtacaaatgtaaagagtgtgggaaagcatttaccttttcctccacgctgaatactcataaaagaatacacaccggagagaagccatacaagtgcgaagagtgtgatcagacatttaaatggcattcttccctggccaaccacaagaatatgcacaccggtgaaaaaccgtataaatacgagtag

SEQ ID NO: 52589 - DNA, 1488 bp, Artificial Sequence
  Description of Artificial Sequence: Synthetic coding sequence
atggccaagcggcccggcccccccggcagccgggagatgggcctgctgacattcagggacatcgcaattgaattcagtctcgctgagtggcagtgcctcgatcacgctcagcagaacctgtaccgggatgtgatgctggaaaactatcggaatttggtaagcctggggatcgcagtcagtaagcccgatctgataacatgcttggagcaaaacaaagagccccagaacatcaagcggaatgagatggtcgcgaagcaccctgtcacatgctcacactttactcaggacttacaatcagagcagggcattaaagacagtctgcagaaagtcattctgcgaaggtacggcaagtgtggacaggaagatttgcaagtgaaaaaatgttgtaagagtgtgggcgagtgcgaagtgcacaaaggaggctataattacgtcaaccagtgtctgtctgccacacagaataagacgttccagacacacaagtgcgtcaaggtatttggtaagttcagcaattcaaaccgccacaagacccggcacaccggaaagaaacattttaagtgtaagaacgatggaaagtctttttgtatgctgtcccggctgaaccagcaccagatcattcacaccagggagaaatcatataaatgcgaagaatgcggaaaaagttttaactgttcatcaactcttacacgacacaagcgcatccacaccggagaaaagccctacaggtgtgaggagtgtggtaaggccttttcttggagtgctagcttaaccaagcataaacgcatccacacgggagagaaaccatacacttgcgaagagcgtggaaaagtcttcagccggagcacactgacaaattataagaggattcacaccggggagaagccttatacgtgcgaggagtgtggcaaagcctttagcagaagcagcactctcaccaatcataaaagaattcacactggagaaaggccttataaatgtgaagaatgtggcaaggctttttctctgtcttcaactctgaagaaacacaaaattgtgcacacaggcgaaaaactgtacacgtgtgaggaatgtggcaaagcattcacattcagctccacccttaatacccacaaacggatccatacaggagagaaaccttacacttgtgaggagtgtgggaaagcttttagtctgcctagcacatttacctatcataagaggactcacactggggaaaagccatacaaatgtgaggagtgcgggaaggcctttaattgttcgagtaccttgaagaaacacaagattatacacactggagagaaactctataagtgtaaagagtgtgggaaggcatttacgttctccagcaccctcaacactcataagaggattcacacgggagagaaaccctataaatgcgaggagtgtgaccaaaccttcaagtggcactcctcactcgccaatcataaaaacatgcacaccggcgaaaagccttataaatatgagtag

SEQ ID NO: 52590 - DNA, 2724 bp, Artificial Sequence
  Description of Artificial Sequence: Synthetic coding sequence
atgctggagacctacaacagcctggtgagcctgcaggagctggtgtcatttgaggaagtcgctgttcacttcacctgggaagaatggcaagatctggacgacgcccagagaactctttaccgcgatgtcatgctcgaaacctactcctctctcgtaagcctcgggcattacatcacaaaacctgagatgatttttaagctggagcagggcgccgaaccatggatcgtcgaagagacccctaatctgagactgagtgccgtgcaaatcatcgatgatttgattgaacgctcacacgagagtcatgaccggtttttttggcaaattgtgattactaattccaatacgagcacccaagaaagggtcgagctaggaaaaacatttaacctcaatagtaaccatgttctcaacctaataatcaataacgggaattcgtctggaatgaagcctggtcagttcaacgactgccagaatatgctcttccccatcaagccaggggaaacacaatcaggagagaagcctcacgtgtgtgatatcacaagaaggtcccatcgacaccacgagcacctgactcaacaccacaagatccagaccctgcttcagaccttccagtgcaatgagcaaggcaagacattcaacactgaggcaatgttcttcatccacaaacgcgtgcacatagtgcaaacgtttggcaaatataacgagtacgagaaagcttgtaataattcagctgtgattgtacaggttatcacacaggtgggtcaacccacctgctgccggaaaagtgattttaccaaacatcagcaaactcataccggagaaaaaccctatgagtgtgtcgaatgcgaaaagccttccatctccaaaagcgatctaatgctccaatgtaaaatgccgactgaagagaagccctacgcctgtaactggtgcgaaaagctcttctcttataagagctctctgatcatccatcagcgcatccacacaggtgaaaagccttacggctgcaacgaatgtggaaagacctttaggcggaagtcctttctgactctgcatgagcggacccatacaggtgataaaccatacaagtgcattgagtgtggcaaaacgttccattgtaagagtttgctgacccttcaccaccgaacccactcaggggagaagccgtaccagtgttcagaatgcggcaaaactttctcacagaaatcctatctaaccatccaccatcggacacacaccggcgagaagccctatgcatgtgatcattgcgaagaggccttttcccataaaagccggttgaccgtgcatcagaggacccacactggcgagaagccatatgagtgtaacgaatgcggcaagccgtttatcaacaagtcaaacttacggctgcatcagaggactcacacgggggaaaagccctatgaatgcaatgaatgcggcaaaacttttcatcggaagtcttttcttacgattcaccagtggacccacacaggcgagaagccatacgaatgtaacgaatgtggaaagacattccgatgcaagtccttcctgactgtgcaccagcggacccatgccggcgaaaagccttacgcttgtaatgagtgtggaaagacatactcacacaaaagttacctcacagtgcatcacaggacccatacgggggaaaaaccatatgagtgcaatgagtgtggaaagtcctttcattgtaaatcttttctgactattcaccagcggacgcacgccggaaagaaaccctatgagtgcaacgaatgtgaaaaaaccttcataaacaagctgaacctggggatccataaaagaacacacacaggcgaaagaccttacgagtgtaacgagtgcggcaaaacgtttcgccagaagagtaatctgtctacgcaccagggcacccacacaggtgagaagccctacgtttgcaacgagtgcggtaaaactttccatcgtaagtcatttcttaccatccatcagcggacgcataccggaaagaatagaatggacgtgatgaatgtagaaaagttgttcgttcgtaatcacacgctactgtatatccgagagctcactccaggaaagagcccaatgaacgtgatgaacgtggagaatcccttcattagacggcagatttttcgttccattaaagtcttcaccaggggaaggaatcccatgaatgtcgccaatgtggaaaaaccatgtcagaagtcggtgctgacggtgcaccaccgcacccacacaggggagaaaccttatgaatgcaacgagtgtggcaagacattctgccacaaaagtaatttatccacacatcaaggcacacacagcggtgaaaaaccatatgagtgtgacgaatgccgcaaaaccttctatgataaaacagttctcacgatacaccagcgcacccacactggcgagaagccattcgagtgtaaagaatgtcggaagaccttctcacagaagtctaagctgttcgtacaccaccgcacacacactggcgagaagcctttccgatgtaatgagtgcagaaagacgtttagccagaagtcaggcttgagtatccaccaaagaactcataccggggaaaagccatacgagtgtaaggaatgcggcaaaactttctgccaaaaaagccatctatcccggcatcagcagacacatattggggagaagtcagacgtggccgaagctgggtatgtgttccctcagaaccactcattctttccttag

SEQ ID NO: 52591 - DNA, 2745 bp, Artificial Sequence
  Description of Artificial Sequence: Synthetic coding sequence
atgttccccgtgttcagcggctgcttccaggagctgcaggagaagaataaaagcctggaactggtctctttcgaggaagttgctgttcacttcacttgggaagagtggcaggatttggatgatgcccagcgcacattgtaccgcgacgtcatgctggagacatattcctctctcgtgtcactggggcactacattacaaaaccagagatgatttttaagctcgagcagggcgccgaaccatggatagtggaggaaacacctaatctccgtctgagcgcggtgcaaatcatagacgatctgatagagcggtcacacgagtcccatgacagattcttttggcagattgtaattacgaatagcaatacatctacccaggagcgcgtagagttgggaaaaacctttaatctgaacagcaatcatgtgctgaatctcatcattaacaatggaaattcgagtggcatgaagcccggacaatttaacgactgtcaaaatatgctttttccaataaagcctggcgaaactcagagtggcgagaaaccccatgtctgcgatataaccagacgctcgcacaggcaccacgaacatctgacccagcaccacaagattcaaaccctgttgcagaccttccagtgcaacgaacagggtaagaccttcaacacagaagccatgttttttatacacaaacgcgtgcacatagtccagacctttgggaagtacaatgagtacgagaaggcgtgcaataacagtgccgtgatagtgcaggtaattacccaagtgggccagcccacctgttgtcgtaagagcgattttacaaagcaccagcagactcacacaggggaaaagccatacgagtgcgtagaatgcgagaagccttccataagtaaaagtgacctgatgctgcagtgtaagatgccaactgaggagaagccttacgcttgcaactggtgcgaaaagctgttcagctacaaatctagcttgattatccatcagcgaattcacacaggtgagaagccctacggctgcaatgagtgcggcaagactttccgtcgtaaaagctttctgactctgcacgagagaacccataccggcgataagccgtataaatgtatcgagtgcggcaaaacgttccattgcaagtctcttttgaccttgcatcaccgaacccattctggcgaaaagccttaccagtgcagtgaatgtgggaaaactttttctcagaaaagctatcttacaatccaccacaggactcacacaggagagaaaccctatgcttgcgaccactgcgaggaagccttctcccataaatcgcgactcactgtgcaccaaagaactcatacgggcgagaaaccgtatgagtgcaacgagtgcggcaagccgttcataaacaaaagcaaccttcgtttgcaccaaaggacccataccggagaaaagccctacgagtgcaatgaatgcgggaagaccttccacaggaagagttttctgactattcaccaatggacacacaccggcgagaagccatacgagtgcaatgaatgcggaaagacatttcgttgtaagtctttcctcactgttcaccaaaggacgcacgccggcgagaaaccatatgcctgcaacgaatgtggaaaaacctactcacataaaagctacttaaccgtccatcacaggactcacacgggtgagaagccctacgaatgtaatgagtgcgggaagtcatttcattgcaagtcattccttaccatccaccaaagaacacacgcgggcaaaaagccttacgagtgtaacgaatgtgagaagacgtttattaataagctgaacctcggaattcacaaacgaacacataccggcgaacgcccatacgagtgcaatgagtgcgggaagacctttcggcagaaaagcaacttgtccacacatcaggggacacacacgggggaaaagccatatgtatgtaatgaatgcgggaagactttccacaggaagagtttcctcacgatacatcagcggacgcacacaggcaaaaatcgaatggacgtgatgaacgttgagaagttatttgtgaggaaccacaccctgctgtatatcagagagcttacgcctggaaagagcccaatgaacgtgatgaatgtggagaacccctttatccgaagacagatctttcggagtattaaagtctttactcgaggtcgtaatcccatgaacgtcgccaatgttgagaagccatgccagaagagcgtgctgaccgtgcatcaccgcactcataccggcgaaaaaccgtacgagtgtaacgaatgtggcaaaacattctgccacaagagcaacctctcaacacaccagggtacacatagtggggagaaaccttacgaatgtgacgagtgtcggaagactttctatgacaagaccgttttaacaattcatcagagaacacacaccggtgaaaaaccatttgagtgcaaagaatgcagaaaaactttttcgcagaagagcaagctgtttgttcatcaccggacgcacacaggggagaagccgtttaggtgcaatgaatgtcggaaaacattctcccagaagagcgggctttccatccatcagagaacccacaccggtgaaaaaccctacgagtgtaaagaatgcgggaaaacattttgtcagaagagtcatctaagtcgacaccagcaaacccatattggggaaaaatctgatgtggctgaagcagggtatgtcttcccacagaaccactcattcttcccatag

SEQ ID NO: 52592 - DNA, 381 bp, Artificial Sequence
  Description of Artificial Sequence: Synthetic coding sequence
atgggcctgctgaccttccgggacgtggccatcgagttcagccgggaagagtgggagcatttagactccgaccagaagttactttatggcgacgttatgctcgaaaactacggaaacctcgtcagcctggggttggccgtgtctaagccagacctgatcacattcctggaacagcgtaaagagccttggaatgttaagagtgcagagaccgtggcaattcagccagatatcttttctcatgacacccagggactcctccgcaaaaagctgattgaggctagttttcagaaggtgattttggatggttacggttcctgtggacctcagaatctgaatttgaggaaagaatgggagtccgagggcaagataatcctctggtag

SEQ ID NO: 52593 - DNA, 537 bp, Artificial Sequence
  Description of Artificial Sequence: Synthetic coding sequence
atggtgaacgtgcccgacatcttcagccacgacacccagggcctgttacgaaaaaaattgattgaggcctcttttcaaaaagtgatcctggatggttacgggtcatgtggtccgcagaatcttaaccttcggaaggagtgggaatctgaaggaaaatgcgaggggcacaatggttattatgatggacacactaagtgcaaaacaaccacctacaacaagaatctgaccgtgaccgggggccagaaacatgagaagacccagtttatgagcgtggctttcagcaaaccatgcgtgtcagtttcaaagtgccaacatcaatttctgaaacttactttcagtttcaagggtaacctggacaaccctaacagcgatctcgtgcacgtatccaacaaccacctcaatcaattgaagtatcgcaccggagttaacgtccagtctaatatatctgagaaggaaagattcaagaatgaggaggtcatatctaaatacgatcagttcgatgggtctcttctgaaagtctgctttaccaataaatag

SEQ ID NO: 52594 - DNA, 1428 bp, Artificial Sequence
  Description of Artificial Sequence: Synthetic coding sequence
atgagcctggccaccgtggacaccctgtacatcttcagccacgacacccaggggttgttgcgcaagaagttaattgaagcatccttccagaaagtaattttagacggttacggatcttgcggaccccagaatttgaatctccggaaagagtgggagagcgaggaaaagaatcagtacaataagagtgatactactctctcccagggcatctccccgcggaggcaccaaaaaactcatttcctgcataatcattgcaaacgtaagaagtgcgagaaggcctttcatgaatgtactaatcatgtgcaccagagtatcttcatccaggaaaagagcgcaaaatgcaataagtgcattgagaccttcatccaatcaagtaaacatacacagccccaacgcatacacatcggcgaaaaaagtcatagatgtaacaatggcgagaaaatcctttctaaactgagttcgctgcggaaacacaaaattatacacaacgaggaaaaaccttacaagtgtaaggagtgtgacaaggcattcaatcaccgttcccacctgacacagcatcagataattcatacaggcgagaagccttacaaatgtaaggagtgtggcaaggctttcaactcaagctcctacttcacacgacaccagagaatacataccggagagaaactgtacaaatgcaaagcctgctccaagtgctttacccactcttcaaatcttctggtgcaccaaaggatacacaccggagagaagccttataaatgcaaggagtgcgggaagagctttaaggtaagctcagccctgactcagcatgagaggatccacaccggcgagaaaccttacaaatgcaaagagtgcagcaaggcttttaactgccgcagttacctgactaagcaccaacgtattcacacaggagaaaagctgtacaaatgtaagagctgcagtaagtccttctcgcgaagctcatccctcatcgtccaccagagaatccacaccggcgaaaagccctacaaatgcaaggaatgcggcaaggcatttaattgtagtagccgactcacccagcatcagcggatacatactggggagaaaccttacatctgcaaagagtgcggcaaggctttcaactgtagctcatccttgaccaaacaccagcgcatccataccggagtaaagctttacaaatgcaaagcgtgtagcaagtcattctcccatagctcgtgtttaagcgttcaccagatcactcacactggaatgaagccgtatatctgcaaggactgcgggatatcgtttaaccgctcttccaacctacgaaggcatcagatgatacatacaggggagaaaccttataaatgcaaagaatgcggtaaactctttaatcgctgctccaccctgactagacataagtctattcacactcgcgagtttctatag

SEQ ID NO: 52595 - DNA, 1860 bp, Artificial Sequence
  Description of Artificial Sequence: Synthetic coding sequence
atgggccccctgaccttcatggacgtggccatcgagttcagcgtggaagaatggcagtgccttgacacggcccagcagaacttgtatcgtaacgtcatgctggaaaactacagaaacctagtcttcctgggcatcgctgtgtccaagcctgacctgatcacttgtctcgagcagggtaaggaaccttggaacatggaacgccacgaaatggtcgcaaagccgcctggtatgtgctgctatttcgcacaggatctcaggccggagcagagcatcaaggcctctctgcagagaataattctgcgtaagtacgaaaaatgcggccatcacaacctccagctgaagaaaggctacaaatccgttgacgagtacaaggtgcacaaaggctcatataatggctttaaccagtgtttaaccacaacacagtccaagatcttccaatgtgacaagtacgtgaaggatttccacaaattcagcaactcaaatcgccataaaacagaaaaaaatcctttcaagtgcaaggaatgtggcaagagtttttgcgtactgtctcacctgacccagcacaaaagaattcacactacagtgaattcttataagcttgaggagtgcggaaaggcattcaatgtgtcatctacactgtcccaacataagcgaatccacactggacagaaacactacaaatgcgaggaatgcgggattgctttcaataagagttcacatcttaatactcataagattatccacaccggcgaaaaatcctataaacgcgaggaatgcggaaaagcatttaatatctcgtcgcacctgaccacgcataaaatcattcataccggcgagaatgcttataagtgtaaggagtgcggaaaggcttttaatcagtcatcgaccttgactagacacaaaattatccacgctggcgaaaagccttacatctgtgagcactgcggaagagcttttaatcagtcttctaacttgaccaagcacaagcggatccacaccggggacaaaccctacaagtgtgaagagtgcggtaaagcctttaacgtctccagtaccttgacccaacataagcgtatccacacaggagagaagccttacaagtgcgaggaatgtggcaaagcctttaacgtctcgtccacacttacacagcacaagcggatccataccggcgagaagccctataagtgcgaggaatgtggaaaagctttcaacacctccagccatctcaccactcataaacggatccataccggcgagaaaccatacaagtgcgaggagtgtgggaaagccttcaaccagtttagtcaactgacaacacacaaaataatccatacaggcgagaaaccctacaaatgcaaagagtgtggaaaggcttttaaacggagctcgaacctcaccgagcaccggattatccatacaggagagaaaccctataagtgcgaggagtgtgggaaagctttcaacctgagcagccacctgaccacacacaaaaagattcacacgggagagaagccatacaaatgcaaagaatgcggaaaggcattcaaccaatcctccacattagctagacataagatcatccacgccggcgagaaaccctacaaatgcgaagaatgcgggaaggcattctatcagtatagcaatctgactcagcacaagataatccatacaggagaaaagccctacaagtgtgaagaatgcggcaaggccttcaactggtcatcaacactcaccaaacacaaagtgatccatacaggcgagaagccttataagtgcaaagagtgtggaaaagccttcaatcagtgttctaatctgaccactcataagaagatccatgcggtcgaaaaaagcgacaagtag

SEQ ID NO: 52596 - DNA, 1500 bp, Artificial Sequence
  Description of Artificial Sequence: Synthetic coding sequence
atgcgggtgctgaccttccgggacgtggccgtggagttcagccccgaggaatgggagtgtttggacagtgctcagcagcgactctatcgcgatgtgatgctcgaaaactacgggaacctgttcagccttgggctggccatatttaagccagacctaatcacgtacctggaacagagaaaggagccctggaacgccaggcgccagaagacagtagccaaacatcctgcggggtcacttcatttcaccgcagaaattctactcgaacacgacataaatgacagcttccaaaaagtcatccttcgaaaaagtggatcttgcgacctgaataccttaagactcaaaaaggactatcagcgcgtgggtaactgcaaaggtcagaagagtagctataacggaatccaccagtgcctctctgcaactagatcaaagacctgtcagtacaacaagtgcggcaaggcattcgggctgtgttctatcttcaccgagcataaaaagattttcagtcgcgaaaaatgttacaaatgcgaagaatgtgggaaagattgccgactgtctgatttcactatccagaagagaatccacaccgccgaccggtcctacaagtgcgaggagtgcggaaaagcctgtaaaaagtttagtaacctcacagagcacaacagagtccatacagggaaaaaaccttataagtgcgaggagtgtggtaaaaccttcacgtgcagtagtgcactgactaagcacaaaagaaaccacacaggcgaccgaccctacaagtgcgaagagtgtcataaagcttttcgctgctgcagcgacctgaccaagcataaacgaatacatactggagaaaaaccgtataagtgtaaagaatgccacaaggccttcaggtgttgctcagacctaactaaacacaaacgcatccataccggagagaagccctacaagtgtaacgagtgcggcaaggcctttatgtggatctcagccctgtcacagcacaatcggattcataccggggagaagccctatatttgcgaagaatgcggaaaggcctttacctactctagcacactcatatctcacaaacggattcatatggagctgcggccatataaatgtgaagagtgcgggaagacatttaagtggttttccgacctcacgaatcacaaacgcatacacactggtgaaaagccctataagtgcgaggagtgtgggaagtcatttacgtgctcgtctaaccttatcaagcataagagaatacacatggaagtgcgaccatataaatgtgaagaatgcggcaagacatttaaatggtttcccgacctgacaaaccacaagcgcatccacaccggagagaagccttataaatgtgaggagtgtggcaaaacgttcacatgttcttcttccctaataaagcataagcgatctcacactggtgaccgccctacctccgcaaagaatgtggcaaagccattgggcgggagtcagaccctacttaatatccgatag

SEQ ID NO: 52597 - DNA, 1869 bp, Artificial Sequence
  Description of Artificial Sequence: Synthetic coding sequence
atgggcagcctgaccttccgggacgtggccatccagttcagcctggaagaatggcaatgcctggacacggcacagcagaacctgtaccggaacgtgatgctggagaactacaggaacctggtgtttctcgggatcgctgccccaaaacctgacttgattatcttccttgaacagggaaaggaaccatggaatatgaagagacatgagctggtgaaggagccaccagttatctgtagccattttgcgcaggatttatggcccgagcagggtcgcgaagatagtttccaaaaggttattttaaggcgctacgaaaagtgcggacatgagaacctccagctgaagatcgggtgcaccaatgtcgatgaatgcaaggtccacaaaaagggctataacaaactgaatcagagccttaccactacacagtccaaggtgttccagtgtggcaagtacgcgaatatattccataaatgcagcaattccaagcggcacaagatccggcatactggcaagaagcttctcaaatgtaaagaatacgtgagaagcttctgtatgctctcccatctgagtcagcacaagcgcatttacacccgcgaaaatagctataaatccgaagaacatgggaaggcctttaattggtccagcgctctaacctataagcgcatccataccggcgaaaaaccctgcaagtgcgaggagtgtggaaaagccttctctaaatttagcatattgacaaagcataaagtgatccacactggcgaaaaacattataagtgtgaggaatgcggaaaagccttcacaaggagctcctctctaattgagcataaaaggagtcatgcgggagaaaaaccatacaagtgcgaggagtgtgggaaagccttctccaaggccagtaccttaacggcccacaaaacaatacatgcgggagaaaagccctataagtgtgaggagtgtggcaaggcctttaaccgctcatcgaacctgatggaacacaaacgcattcataccggagaaaagccatgtaaatgcgaggaatgcggtaaagctttcggcaattttagcacactaactaagcacaaagtcatccacacaggagaaaaaccatataagtgtgaggaatgcggcaaggctttcagttggccttcgtcactgactgaacacaaacgcatacatgcaggggacaagccctacaaatgcgaagagtgcggaaagacgttcaaatggtccagtacactgacaaagcataaaatcatacataccggggagaaaccatacaaatgtgaagaatgtggtaaggcatttactactttcagcagcctgacaaaacataaggtcatacatacgggtgagaagcactacaaatgtgaggagtgcggcaaggtgttctcctggagctccagtctgactacccataaggccatccacgccggtgagaaattatataaatgcgaggagtgcgggaaagcgttcaagtggagttcaaaccttatggagcataaacggattcacacaggtgagaaaccttacaaatgcgaggaatgcggaaaagctttcagcaaggtggccaatttaactaagcataaggtgatccatacgggtgagaagcaatataagtgcgaggagtgtggcaaggccttcatatggtcctcaagactgtccgagcacaagcgaattcacaccggagagaaaccctacaaatgtgaagagtgtgggaaagcttttagttgggtgagtgtgctgaataaacacaagaagattcacgctgggaagaaattctacaaatgcgaagagtgcggaaaagattttaaccagagctcccatctgacaacgcataagcgaatacatactgggggtaaaacattgcagatgtag

SEQ ID NO: 52598 - DNA, 3522 bp, Artificial Sequence
  Description of Artificial Sequence: Synthetic coding sequence
atgcccggcgcccccggcagcctggagatgggccccctgaccttcagagatgtgactatcgaattttctctggaagagtggcagtgcctcgataccgtgcagcagaatttgtatcgagatgtgatgctcgaaaactatagaaacttggtattcctgggcatggctgtcttcaaaccagatctcatcacctgtctcaaacagggtaaagagccgtggaatatgaaaagacatgagatggttacaaaaccccctgtaatgagaagccatttcacccaggatctttggcccgaccaaagcacgaaggattcattccaggaggtgattctgcgcacgtatgccaggtgcggacacaagaacctacggcttagaaaagactgcaagtcagccaacgaaggcaaaatgcacaaagagggatacaataaattgaaccagtgtcggacagctacacagcggaaaatattccaatgcaacaaacacatgaaggtattccataaatatagtaaccgaaacaaggttagacatacgaaaaaaaaaacctttaagtgcattaaatgcagcaaaagcttctttatgctcagctgtctcatacggcataaacggattcacataaggcagaatatttataagtgcgaggagagaggaaaagcgtttaagagttttagtaccctcacgaaacataaaatcatccacacagaggataaaccctataaatacaagaagtgcggaaacgcctttaagttttcatcaacttttacgaagcacaagcggatacataccggcgagactcctttccggtgcgaagagtgtggcaaggcctttaatcagtcgagcaacctgaccgatcataagaggatccacacaggcgagaagacatacaaatgtgaagagtgcggcaaggcatttaagggcagtagtaacttcaacgcccataaagtgattcacaccgcggaaaaaccctataagtgcgaagattgcgggaaaacatttaaccacttttccgcgctgagaaaacacaagattatccacactggaaagaaaccctacaagagagaggaatgtgggaaagcgttttcccagtcctccaccctacgaaaacatgagattatacatactggggagaagccatataaatgcgaagagtgtggcaaggccttcaagtggtcttcgaaactaaccgtgcacaaggtggtgcacaccggtgagaaaccttataagtgtgaggagtgtggtaaagcgttctcccagttctctactttaaagaagcataagattatccataccggtaagaagccctataaatgtgaggagtgcgggaaagcctttaacagtagctccaccctcatgaaacacaagatcatccacacaggagagaagccctataaatgcgaggaatgcggcaaggcattcagacagagctcccacctcaccaggcataaagcaatccacacaggagagaagccctataagtgtgaagagtgtggaaaagccttcaaccattttagcgatttacggcgacataaaatcatccacactggtaagaagccctataagtgcgaggaatgtggaaaggccttctctcagtcctcaacgctgcgtaatcatcaaattattcacaccggcgagaaaccctacaagtgcgaagagtgcggtaaagcatttaaatggtccagcaagcttactgttcataaggtgatccacacaggagagaagccatgtaagtgcgaggaatgcggaaaagctttcaagcacttctccgccttaaggaaacacaaagtcatccacacccgcgaaaaactatacaaatgcgaggagtgtgggaaggcattcaacaattcttctatcctggctaagcacaagattatacacaccgggaagaagccttataaatgcgaggaatgcgggaaggccttcaggcaatcatctcacctcactcgccacaaagcaatccacactggcgaaaagccttacaaatgtgaggagtgcggaaaagccttctcccacttcagtgccttaaggcgacacaagatcatccataccggtaagaagccttataagtgtgaagaatgcggtaaggcattttctcatttcagcgctctgcgccgtcacaaaattattcacacaggggaaaagccctataagtgtgaggagtgcggaaaggcattcaaatggagcagtaagctgaccgtgcataaagttattcatacagccgagaaaccttgcaagtgtgaggagtgcggcaaatcctttaaacacttcagtgccctgcgtaagcataaggttattcacacaagagagaagctttataaatgtgaggaatgtgtcaaggcgttcaattcatttagtgcattgatgaagcataaggtgattcacaccggcgaaaaaccatataaatgcgaagagtgtggaaaagcattcaaatggtcttctaagctgacagtacacaaggtgattcacaccggcgaaaagccatgtaagtgcgaggaatgtggtaaggcctttaaacattttagtgctctgcgaaagcataaagtcatccatactggcaaaaagccttacaagtgtgaggaatgcggcaaggccttctcacagagttcttccctccgaaagcatgagattatacattccggcgaaaaaccatataagtgcgaggaatgtggcaaagcttttaagtggttgagcaaactaaccgtccataaaatcatccatacgggcaagaagccatataagtgcgaggagtgcggaaaagctttcaacgattcgagtaccttgatgaagcataagataatccacaccggtaagaaaccttacaagtgtgctgagtgtggaaaggcatttaagcagtcttcacaccttacacggcacaaggccattcataccggagaaaagccctacaaatgtgaagaatgcggtaaggattttaataacagctccacattgaagaaacataagctaatacatacgcgcgagaagctctataaatgtgaggagtgcgtcaaagctttcaataacttctccgcactgatgaagcacaagatcatccatactggcgagaaaccatataaatgtgaagagtgtggaaaggcctttaaatggtcaagtaaactgacggagcacaaagtgatccacacgggagagaagccatgtaaatgcgaggaatgtgataaggcttttaaacatttttcggctctcaggaagcacaaagtcattcacacagggaaaaagccctaccaatgtgatgaatgcggcaaagccttcaataatagtagtacactaacaaagcataaaatcattcatacgggggagaagccttacaagtgtgaggagtgcggaaaggcttttagccaaagcagtatcctgactaagcacaaaatcattcacagtgtggaaaaaccctataagtgtgaggaatgtggcaaggctttcaaccagagcagccaccttacaagacacaaaacaatccacacaggtgaaaaaccttacaagtacaaaaccattcacaccggagaaaaaccgtataaatag

SEQ ID NO: 52599 - DNA, 3759 bp, Artificial Sequence
  Description of Artificial Sequence: Synthetic coding sequence
atgcccggcgcccccggcagcctggagatgggccccctgaccttcagggacgtgactattgaattttccctggaggagtggcaatgtctggatacagtgcagcagaatctgtacagggacgtgatgctggaaaactataggaatttggtgttcctgggcatggcagtcttcaagcctgacttgatcacctgcctgaaacaaggcaaggagccgtggaacatgaaacgccatgaaatggttaccaagccccccgtcatgagatctcattttacacaggacttatggccagaccagtcaacaaaagacagcttccaggaggtaatcctcaggacctatgctaggtgcgggcacaaaaatctgcgactccggaaggactgcaaatctgccaacgaagggaagatgcataaagagggttataacaagctgaaccagtgcaggactgcaacacaacgtaaaatttttcaatgcaataaacacatgaaggtctttcacaaatactcgaataggaataaagtgcggcataccaaaaaaaagacttttaagtgcatcaagtgcagcaaatcatttttcatgctcagctgccttattaggcacaaacgaattcacatcaggcaaaacatctataaatgtgaggagcgcggcaaagctttcaagtccttttccaccctgacaaagcataagatcatccacactgaagacaagccctataagtataaaaagtgcggtaatgcatttaaattcagcagcacatttaccaagcacaagagaatccacaccggagaaacgcccttcaggtgcgaggaatgtgggaaggcctttaaccagagtagcaatttaactgaccataagaggatccacaccggtgagaaaacatacaagtgcgaagaatgtggaaaggccttcaaaggttcctccaacttcaatgcccataaagtgatccacaccgccgaaaagccatacaagtgtgaggattgcggcaagacattcaatcacttttccgctttgagaaaacataaaattatccatacgggcaaaaagccttataagcgagaagagtgtggtaaggcctttagtcaatccagtaccctcagaaaacatgagattattcacacaggcgaaaaaccatacaagtgtgaagagtgcggaaaagccttcaagtggagttctaaactgacagtacacaaagtggtgcataccggcgaaaagccctataagtgcgaggagtgtgggaaagccttttcacaattttccacactgaagaaacacaaaataattcataccggcaaaaagccctacaaatgcgaagaatgtggcaaggctttcaacagctccagcaccttgatgaagcacaagatcatccatactggagagaagccctataaatgtgaagaatgcgggaaagccttcaggcagagcagtcatctcacccgacacaaagctatacacacgggggaaaagccttacaagtgtgaggaatgcggcaaggcgttcaatcattttagtgaccttagaaggcacaagatcatccacactggcaagaagccctacaagtgcgaagagtgcggtaaagctttctcccaaagtagcacactcagaaatcatcagatcattcacactggcgagaaaccctataaatgcgaggagtgcggcaaagctttcaagtggtcttccaaactaacagtgcacaaggtcattcacacgggggagaaaccatgcaagtgcgaggaatgcggcaaagcatttaagcatttctccgcattacggaagcataaagttatccacacacgagagaaactctataagtgtgaggaatgcgggaaggccttcaacaattcctctattctcgccaaacataagattatccacaccggcaagaaaccttataaatgcgaggagtgcggcaaagcctttcggcagtcgtcccatctgactagacacaaggcaatacacacaggcgaaaaaccttataagtgtgaagagtgtgggaaagccttctctcattttagtgccctacgcaggcataagattatacacaccggtaaaaagccttacaagtgtgaagaatgcggaaaggcatttagccattttagcgcgcttaggaggcacaaaattattcacactggagagaagccttataagtgcgaggagtgcggtaaggcttttaagtggagtagcaagctcaccgtacataaagtcattcacaccgctgaaaagccttgtaaatgcgaggagtgtggaaagagtttcaagcacttttctgctctgcgcaaacataaggtaattcacacaagggagaaactctacaagtgtgaagagtgcgtgaaagcctttaacagcttttccgcattgatgaagcataaggtgatccacacaggggaaaaaccttataaatgcgaagagtgcgggaaagccttcaaatggagtagcaaactgacagtgcacaaggtgatccataccggagaaaagccttgtaagtgcgaagagtgtgggaaggcattcaaacatttttctgccctgaggaagcataaagtcatccacacaggtaagaaaccatataagtgcgaagaatgcgggaaagctttctcgcaaagctccagccttcgcaagcacgagataatacattctggcgagaagccatacaaatgtgaggagtgtggtaaagcattcaagtggctgagtaagctcactgtccataaggtcattcatacagccgagaaaccttgcaagtgcgaagaatgtggaaaagcctttaaacacttttccgcgctcagaaagcataagattatccataccgggaagaaaccttacaaatgcgaggagtgcggcaaagccttcaatgactcctccaccctcatgaagcacaagattatacacacaggcaagaagccatacaaatgcgcagagtgcgggaaggccttcaagcagagctcccatttgacccgccataaagccattcacaccggcgaaaaaccttataagtgcgaagaatgcggtaaggacttcaacaactcttcaaccctgaaaaagcacaaactaatccacacgcgtgaaaagctctacaaatgcgaggaatgcgtcaaggcctttaataatttcagtgctctgatgaaacacaaaattatacacacaggagagaaaccatacaaatgcgaagaatgtggcaaagcctttaagtggtcgtcgaaactcactgagcataaagtgattcacacaggcgagaagccttgtaagtgcgaagaatgcgacaaggccttcaagcacttcagtgctctccgtaaacataaggtcattcacacaggaaaaaagccttaccagtgcgatgagtgcggaaaggccttcaataacagtagtaccttaaccaagcacaagattatccacacaggagagaagccgtacaagtgcgaggaatgtgggaaggcctttagccaatcttccatcctgacgaagcataaaatcatccattcagtcgagaagccctataagtgcgaggagtgtggaaaagcatttaaccaaagctcccacctcacaaggcacaagactatccataccggggagaaaccatataaatgcgaggagtgcggcaaggctttcatacagtgtagctacctgattcgacataagacgatccatacacgcgaaaagccaaccaatgtaaagaaggtgcctaagttattgtcaaaccctcacactctacttgacaagaccattcataccggagagaaaccgtataagtgtgaggagtgcgcaaaggccttctag

SEQ ID NO: 52600 - DNA, 576 bp, Artificial Sequence
  Description of Artificial Sequence: Synthetic coding sequence
atgaccgaccccagcctgggcctgaccgtgcccatggccccccccttagctcccctgcctcctcgggatccaaatggcgccggatccgaatggcggaaacccggagcagtcagttttgccgatgttgctgtgtacttttctagggaggaatgggggtgtctccgacctgcccagcgtgccttatacagagatgtaatgagggagacctacgggcacctgggggccctgggagagtctcctacctgcctgccaggtccatgtgctagtaccgggcccgctgcccccctgggagccgcctgcggggtaggtgggcccggtgcagggcaggccgcctcgtcccagcggggtgtgtgcgtgctgctaccgcaagaaagcgaagccgcctcacgccgaagtagcccggggtggaggagacggccgaactgtgggatccgactgcctcgcatccgtaggtggcgatcagtgcgccaaaaacgtacacagcagatcccagaaacccgaaagcggaaggacaaggggaaggggagggagccctggcggagccctaccttgtggcccccaggactgctgggctag

SEQ ID NO: 52601 - DNA, 573 bp, Artificial Sequence
  Description of Artificial Sequence: Synthetic coding sequence
atgaccgaccccagcctgggcctgaccgtgcccatggccccccccctcgcccctttaccacctagggatcccaacggagccggtagtgaatggcgaaagccaggcgcggtctcctttgccgatgtcgccgtatacttctcaagagaagagtggggatgtctccggcccgctcagcgcgccctctatagggatgtgatgcgggagacgtatggacacctgggagcactaggcgaatctcccacctgcctccctgggccgtgtgcctcaactggacccgcagccccattgggggcggcttgtggcgtgggtgggccgggtgccggccaagccgcctctagccaacggggggtctgtgttctgctgccccaggagagcgaagccgcttctagaagaagcagcccaggttggcgtagacgccctaactgcggcattcgactgccacgaatacgacgctggagatccgtgagacaaaaaagaactcaaatcccggagacccgcaagaggaaggacaaaggaaagggccgggagccatggaggagtccgactttgtggccaccagggcttttgggctag

SEQ ID NO: 52602 - DNA, 993 bp, Artificial Sequence
  Description of Artificial Sequence: Synthetic coding sequence
atgaccgaccccagcctgggcctgaccgtgcccatggccccccccttggccccacttccaccgcgcgatccaaatggagcgggttctgaatggaggaagcccggggccgtctcgtttgctgacgtcgccgtttattttagccgcgaagagtggggatgcttacgcccagctcaacgcgcgctttacagggacgttatgcgagagacgtacgggcatctgggagctctcggcgtcggtgggtccaagcccgccctcatttcctgggtggaggaaaaagctgagctgtgggaccccgctgcccaggaccctgaagtggccaaatgcccaacagaggcagatccagattctagaaacaaggaggaagaaagacagagagagggaaccggagctctagaaaaaccggaccccgtggccgccggatcgccagggctgaaggcgccccaggccccattcgcaggacttgagcaattatcaaaggcgcgtaggcggtctcgccctagattcttcgcccaccctcccgttccccgcgccgatcagcgacacggctgttatgtttgcggcaagtccttcgcatggagaagcaccctagttgagcacatttactctcacagaggagaaaagccctttcactgtgcagattgcgggaagggatttggccacgcctcttccctcagtaaacatcgggcaattcacaggggcgagagacctcaccgttgtccagaatgcggccgcgcattcatgagacggaccgccctgacgtcccacttgcgcgtgcacaccggagaaaaaccttatcgttgcccacagtgcggcaggtgtttcggcctgaagactgggatggcaaagcaccagtgggttcaccggccggggggagaagggaggcgaggcagacggcctggcggactaagcgtcacgttgacacctgtccgcggggatctcgatcctccagtagggttccaactgtacccagagatattccaagagtgtggctag

SEQ ID NO: 52603 - DNA, 2496 bp, Artificial Sequence
  Description of Artificial Sequence: Synthetic coding sequence
atggagaaccagcggagcagccccctgagcttccccagcgtgccccaggaggaaaccctgagacaggccccagcaggtctgccccgggaaactttattccagagtcgcgtcctcccccccaaggaaattcccagtttatcacctacgatccctaggcaggggtcactcccccagacttcctccgcccctaaacaggagactagcggtcgaatgccccatgtgttacagaaggggccatctctcttatgtagtgccgcgtctgaacaggagacatcattgcagggaccgctggcttcccaggaggggactcagtatccacctccagcagctgccgagcaggaggtaagtcttctgagtcactcccctcaccaccaggaagcccccgttcattctccagaggcgcctgagaaagatccactaaccctctccccgacagtccccgaaactgacatggatcctctcctgcagagtcccgtctcacagaaagacacacctttccagatctcatcggcagtccagaaagagcagccactccccacagcggagatcacccgactggctgtgtgggctgccgtacaggcggtggaaaggaaattggaagcacaggcaatgcgactgttgactctggaagggaggactggtacaaatgaaaaaaagatcgcggattgtgaaaaaactgcagtggagttcgcaaatcaccttgagagcaaatgggtggtgctcgggaccctgctgcaggagtacggtctcctgcaacgtagactggagaacatggagaatctgctcaagaacaggaacttctggattttgaggctaccccccggatctaatggggaggtgccaaaagtgcccgtgactttcgacgatgtcgccgtgcacttttctgagcaggaatgggggaatctaagcgaatggcaaaaagagctctacaagaatgtgatgagaggcaactatgaatcccttgtctctatggattacgcgatctctaagcctgacctgatgagtcagatggagagaggggagaggcctaccatgcaagaacaagaggatagtgaggagggggagacccccacggacccatccgccgcccacgacggcatcgtgataaaaatcgaggtccagactaatgacgagggaagcgaatcactggagactcccgagcctctcatgggtcaggtggaggagcacggcttccaggattccgaactgggcgacccatgcggggaacagcctgaccttgacatgcaggagcctgagaacacattggaggagtcgactgagggctctagtgaattctcagaacttaaacagatgctcgtgcagcaaagaaattgcaccgaggggatcgtgatcaagaccgaagaacaggacgaagaggaagaggaagaggaagaggacgagctgccccaacatctccagagtctcgggcaactgagcggtaggtatgaagctagtatgtatcagacgccactgccgggcgagatgtcccccgagggtgaggaatccccaccacctttacaattggggaatccagcagtaaaaaggctcgcaccaagcgtgcacggtgagcggcatctttccgagaacaggggagcctcctcacaacagcagcggaatcgtagaggcgagcgccctttcacatgcatggaatgcgggaaatcgtttcggctcaaaataaatctgatcatacaccagcgtaaccatatcaaagaaggcccttacgaatgcgcagagtgcgaaatctccttcagacataagcagcaattgactctgcaccagcgaatccacagggtgcgcggcggatgcgtgagccccgagcgaggacccactttcaatcccaagcatgctttgaaacccaggcccaaaagccccagcagcggcagcggtgggggtggtcctaagccttataagtgccctgaatgtgactctagttttagtcacaaatcttcactgacaaaacaccagattacccatactggcgaacgtccatacacgtgccccgagtgcaagaagagcttccggcttcacatctctctggttatccatcagagggtgcacgcaggaaagcatgaagtttcttttatatgctcattgtgcggaaagtcctttagtcggccatcccacctccttaggcaccagcgtactcatacaggggaaaggcctttcaaatgccccgagtgcgaaaagtccttcagcgagaaatcaaagcttaccaaccactgcagggttcatagccgcgagcgccctcatgcttgccccgagtgtggtaagtcgttcattagaaaacatcacctgcttgaacaccggcggatccacaccggcgagagaccgtatcactgtgccgagtgtggaaaacgttttacgcagaaacatcatctcttggagcatcagagggcccatacgggagagcgcccttacccatgcactcactgcgccaagtgtttcaggtacaaacagtcgttgaaataccatctccggacacatacaggggaatag

SEQ ID NO: 52604 - DNA, 1575 bp, Artificial Sequence
  Description of Artificial Sequence: Synthetic coding sequence
atggagaacctgctgaagaaccggaacttctggatcctgcggctgcccccagggtctaatggggaggtgcctaaggtgccagtgactttcgatgacgttgctgtccacttctcagaacaagaatgggggaatctctctgagtggcaaaaagagctctacaagaatgtaatgcgcgggaattacgagagtctggtgagtatggactacgccataagtaaaccagacctcatgagtcagatggaacggggcgagcgtcccactatgcaggaacaggaagatagtgaagagggagagacgccaaccgatccatctgccgcacacgacgggattgtcattaagatcgaggtgcagactaacgacgaagggtcagaaagtctcgaaactccagagcctctcatgggtcaggtggaggagcatggctttcaggacagtgagctgggggatccctgcggagaacagcccgatttagacatgcaagaacccgagaacactctggaggaatctactgaaggcagctctgagttttccgagctcaagcagatgttagtccagcagcggaattgcacagaggggattgtcatcaagaccgaggagcaggacgaggaggaggaagaagaagaggaggatgaactgcctcaacacctccagtccctaggccaactgtcaggcaggtatgaggccagcatgtatcagacccccctgcccggggagatgtccccagagggtgaggaatcacccccccctctgcagcttggtaatccagctgtgaagcgcctggccccatctgtacacggcgaacgccatctgagtgagaaccggggcgccagtagtcaacagcagcggaacagacgaggggagcgtcctttcacatgtatggaatgcggaaagagctttagactgaaaattaaccttattatccaccagcggaaccatatcaaggagggcccttacgaatgcgccgaatgtgagatctcgtttcgccataagcagcagttgacacttcatcagaggattcatcgagtcagagggggctgcgtgagtcccgagcgcgggcccaccttcaatcccaagcatgctctcaagcctcggcctaagagcccctcttctgggagcggggggggcggccccaagccgtacaaatgtccggagtgcgattcctccttctctcacaagagctctttaactaaacaccaaatcacacacaccggagaaagaccttatacctgccctgacgccgctgcaaggccaggcgcaagagccgtccctccactgggacaccgccaagcaagggcgcagagggccggacgaggggccccgcaacctttatgtagagaactcccactgtcctcgaggccttccagccagggtcacgggggtagcgaaacccgttctttggccgccgccttcccccggggaccacaggggggaggccgcggccccggtgagccctttcgagctgtcaacttcctagataacaagatggatgaaacaaatcagcatggtgggcgagacctcgcagctggtcatagcgaaggccgctgcagagcgcacctggtgggggacagaacgctttag

SEQ ID NO: 52605 - DNA, 984 bp, Artificial Sequence
  Description of Artificial Sequence: Synthetic coding sequence
atgcagcggaacgccatgtacctgaagaacgtggccgagaccgcctgcaacttccagttaacccagtaccaaatcagccatgctaaccagaagccttacgaatgccagatctgcgggaagccttttcggaagcgagctcacctgacccagcacaatagaatccatactggtggtaagccatatgagtgcaaggaatgtggcaaggtctttatatgttgcagcacactcatccagcataagaggacacatacatccgaaaaaccatacgaatgcttggagtgccgcaaaacattcaggcgcagtgcacatctgataagacaccagagaatacataccggggagaagccttacaagtgtaaacagtgctggaaagcattcgctagcgtaagcgacctgattgatatagggaaattcacccttatgcgggacttcacaaacgtacaaaatgtcggtaggcatctaaccattgctcaactgctgttctctatcagagaatttaccctcgtgagaagtcctctgaatgttcggaacgttgcaaaacattctattattgcccagcacttactcaacactcgcgagctgattcttatgaggaacttaatgaatgtaagaaacgtaaagcgtcttctcggaaaggtgcacattctgctgaatatcaaagagttcatattggttcgaaaccacatgtctgtgtccaacgtgggtcgactttcacttgtgtttctaattctgatcgacatccgggaattcacccttgtcaaaaacccgatgaatgtcaagaacgtggtggaactgttgactatcgtgcagctactcttcaacactcgtgaattcactctcgtgcggcgcctgatgaatatcagttccgttggccgattcctgtcaccggtgcagcacctatttaatattcgggagcacatcctcatgaagaacctcatgaacgttagtaatgccaggaggccgtctagtattatgcacatctag

SEQ ID NO: 52606 - DNA, 1062 bp, Artificial Sequence
  Description of Artificial Sequence: Synthetic coding sequence
atgcagcggaacgccatgtacctgaagaacgtggccgagaccgcctgcaattttcagttgacccagtaccagatcagccacgccaatcaaaagccatacgagtgtcagatatgcggtaaacctttccgaaaacgggcccatcttacacagcataatcggatacacactggcgggaaaccatatgaatgcaaagaatgtggtaaggtctttatatgttgcagtaccctcatccagcataagaggactcacacttctgagaaaccttacgagtgtctggagtgcaggaagactttccggcgctccgctcaccttatacgtcaccagcggatccacactggggaaaaaccttataagtgcaaacagtgctggaaggcattcgcttccgtttccgatctgattgacatcggaaagtttacgctgatgagggatttcaccaacgtccagaacgttgggcgacacttgacaatcgcccaactgctcttcagcatcagggagtttactttagtgaggagtccactcaatgtccgcaatgtggcgaaacactccattattgcgcaacatttgttgaacacacgtgaactcattctaatgaggaacctcatgaatgtccggaacgtgaaaagactcctcgggaaggtgcacatactcctgaatataaaagagttcatcctggtgcgcaaccatatgtctgttagcaacgttggtcgacttagcctcgtctttctgattcttattgacattcgcgagttcactctggtgaagaatcccatgaatgttaaaaacgtcgtcgagctgctaaccatcgttcaattgctcttcaatactagagagttcactctggtgagacgtctcatgaacatttcatctgtcggacggtttctgtcacctgtgcaacacctctttaacataagggaacacatcctaatgaaaaacttgatgaatgtctcaaacgcgcgtcgcccatctagcatcatgcatatagatatcagagaattcaccgttggcaggaatcctatgaacgttatgaacgtcggaatgccttcttttgtttttttgatttag

SEQ ID NO: 52607 - DNA, 1122 bp, Artificial Sequence
  Description of Artificial Sequence: Synthetic coding sequence
ctggagtaccagatccccgtgagcttcaaggacgtggtggtgggcttcactcaagaggaatggcaccggctgtccccagcccagagagccctgtatagggatgttatgcttgaaacctatagtaatctggtgagtgttggctatgaagggacaaagccagatgtgattctgagactggagcaggaggaggccccttggataggcgaagccgcctgtccagggtgccactgctgggaggacatctggagagtgaacattcagagaaagcgaaggcaggatatgctccttagaccgggtgcagcgatttcaaaaaaaacccttccaaaagaaaagagttgcgaatataacaagtttggaaagatctcactcctgtctactgacttattttcatctatacagagtccaagtaactggaacccctgtggaaagaacctgaatcacaatttggatctgatagggttcaaacggaactgtgctaagaaacaggatgagtgttacgcatatggaaaattattgcagcggatcaatcacggaaggaggcccaacggggaaaaacccaggggctgtagtcattgcgagaaagccttcacacagaacccagctctgatgtataagccggcggttagcgatagtctcctgtacaaacgcaagagagtgccccccaccgaaaagccccacgtgtgctctgaatgtggcaaggcgttctgttataagtccgaattcatccgccaccagcgatcccacaccggtgagaaaccctacggctgtacggattgcggcaaagcgttcagtcataaaagcactctaattaagcaccagaggatacatactggcgtgaggccttttgagtgtttcttctgcgggaaagccttcacccaaaagagccatcgcacagagcaccaacggacccacactggcgaacgcccattcgtctgtagcgagtgcggcaagagcttcggcgagaaaagctatttgaacgtgcaccgcaagatgcacaccggcgaacgcccctatcggtgtagagagtgcggaaaaagctttagccagaagtcatgcttgaacaaacactggcgtactcactttggtgagagtagcctgagaagtaagtcctccaatacatag

SEQ ID NO: 52608 - DNA, 1125 bp, Artificial Sequence
  Description of Artificial Sequence: Synthetic coding sequence
atgatcgagtaccagatccccgtgagcttcaaggacgtggtggtgggatttactcaagaagagtggcatcggctgagtcctgcccagcgagccttgtatcgggacgtgatgctggaaacatacagtaacctggtttctgtgggctatgaggggacaaagcccgatgttatactcaggttggaacaggaagaggctccatggatcggcgaggcggcctgccctgggtgccactgttgggaggacatttggcgcgttaacatacagaggaaaagacgccaggacatgctcttgagacctggcgcagccatttccaagaaaaccttgcccaaagagaagtcatgtgaatataataagtttggcaagattagccttctgagcactgatctattcagctctatccagagcccatcgaactggaacccatgtggaaaaaacctgaaccacaacctggatctcatcggttttaagcgcaattgtgccaagaaacaggacgagtgttacgcttatggcaagctgttgcagcggataaaccacggcaggcgtcccaatggggagaagccgcgcggatgcagccactgtgagaaagcatttacccagaatccggccctaatgtataaacctgcagtgtctgatagcctcttgtacaagagaaaacgggtcccccctactgagaaaccccacgtatgctctgaatgcgggaaggcgttctgctataaaagcgaattcattagacaccaacggtcccacactggggagaagccatatggttgcactgactgtgggaaagccttcagtcacaaatccacattgattaaacaccaacggattcacacgggcgttcgcccgttcgagtgttttttttgcggcaaagcattcactcagaaatcccacagaaccgagcaccaaaggactcacaccggagaacgcccattcgtgtgctctgagtgcggtaagtcctttggcgagaagtcctatcttaacgtccataggaaaatgcataccggggagcggccttacagatgtagggagtgtggtaaatccttctctcagaaatcatgtctgaataagcattggagaacacataccggagaatccctggagccccgaaggcagagattacagtag

SEQ ID NO: 52609 - DNA, 1221 bp, Artificial Sequence
  Description of Artificial Sequence: Synthetic coding sequence
atgatcgagtaccagatccccgtgagcttcaaggacgtggtggtgggtttcactcaggaggagtggcaccgtctgtcacctgcccaacgggctctgtaccgcgatgtcatgctcgagacctactcaaacctcgtttcagtgggttacgagggcacaaagcccgatgtgattctgaggctggagcaggaggaagctccatggatcggagaggctgcttgccctggatgtcactgttgggaagacatttggagggtgaatattcagaggaaaagaagacaggatatgctgttaaggccaggggcagcaatctccaagaaaaccttgcctaaggaaaagtcctgcgaatataataaattcgggaagattagcctcttaagcactgacttattctcatctattcagagtccttccaactggaacccctgtggcaagaacctcaaccataatttagatctgattggtttcaagaggaattgtgcaaaaaagcaggatgaatgttatgcttatggcaaattactccagaggattaaccacgggcgaagacctaacggagaaaaacctcggggttgctctcattgcgagaaggctttcacccagaatcccgccctgatgtacaagcctgccgtgtctgattctctgctctacaaacggaagagggtgcctcctactgagaagcctcatgtgtgttccgagtgtgggaaggccttctgttacaaaagcgagttcattcgccatcagaggtctcacactggagagaaaccgtacggctgcactgattgtggtaaggctttttcccacaaaagcacactgatcaagcaccagagaattcacacaggggtgagaccctttgaatgtttcttttgtgggaaagccttcacccagaagtcacatcgaacagagcaccagagaacccacacaggggagaggccttttgtctgctctgaatgcggtaagagctttggcgaaaaatcgtatctgaacgtgcacaggaaaatgcacactggagagagaccttaccgatgtcgggagtgtggcaaatccttctcacaaaagtcttgcttgaacaagcattggagaacacatactggcgaaaagccctacggatgtaatgagtgtgggaaggccttttaccagaagccaaatctctcaaggcaccaaaaaatccacgcacggaagaatgcttaccggaatgaaaacctaatcatagttggcaatacttag

SEQ ID NO: 52610 - DNA, 1221 bp, Artificial Sequence
  Description of Artificial Sequence: Synthetic coding sequence
atgatcgagtaccagatccccgtgagcttcaaggacgtggtggtgggatttacccaggaggaatggcacaggctctccccagcacagcgggctttgtatcgcgacgtgatgctcgagacctacagtaatctagtcagcgtgggctacgagggcaccaagcctgatgtcatcctgcgcctcgagcaggaagaggccccctggatcggggaggctgcttgtcccggctgtcactgttgggaggatatctggcgcgtaaacattcaacgcaagaggaggcaagacatgttgctgcggcccggagctgctatctctaaaaagacactgccaaaagagaagtcttgtgaatataacaagtttggcaagatcagcctactatctaccgacctgttttcgtccatccagagcccatctaactggaatccctgtggtaaaaatctcaatcacaacctggacctcattggctttaagaggaactgcgccaaaaagcaagatgagtgttacgcctatggcaaattgctgcaacgaataaaccacgggcggcgccccaatggcgaaaaaccacgagggtgctctcactgtgagaaggcgttcacacaaaatcccgcgcttatgtacaagccggcggtctccgactcacttttgtataaacgtaagagagtcccacccacagagaagccacacgtctgttccgaatgtggaaaggccttttgttacaaatctgagtttattcggcatcaacggtctcatacaggagaaaaaccatacggctgcacggattgtgggaaagcattcagtcacaaatcaaccctcatcaagcatcagcgcattcacactggcgtgagaccctttgagtgttttttctgtggcaaggcattcacgcagaagtcccatagaactgagcaccagagaactcacaccggggagcgtccattcgtgtgcagcgagtgcggcaagtctttcggagaaaaaagctatcttaatgtgcatagaaagatgcacacaggcgaaaggccgtaccgatgcagggagtgcggcaagagcttctcacagaaaagttgcctcaataagcactggcgcactcataccggagagaagccctacggctgcaatgagtgtggtaaggcattctaccaaaagcccaatttgagccggcaccagaagatccatgctcgcaaaaacgcatacaggaatgagaatttgattatcgtgggaaatacgtag

SEQ ID NO: 52611 - DNA, 4050 bp, Artificial Sequence
  Description of Artificial Sequence: Synthetic coding sequence
atggcctgctacctggtgatcagcagccggcacctgagcaacggccactacagaggcatcaagggagttttcagaggaccgctgtgtaagaatggcagtcccagccccgacttcgcagaaaagaaatcaactgcaaaggcgctggaagatgtgaaagcaaacttctattgcgagctgtgtgataaacagtatcataaacatcaggaattcgacaatcatatcaatagctatgatcacgcccacaagcagaggctgaaagaacttaagcagcgtgagttcgcccgaaacgtggcaagcaaatcctggaaggatgaaaaaaaacaggaaaaggcactgaagcggctccaccagctggcggaactgcgccaacaatcggaatgcgtctctggaaacggtccagcatacaaggctcctagagttgctattgagaagcaactgcagcaagggattttcccaatcaagaacggccgcaaagtgtcttgcatgaagagcgcgctgttattgaaaggaaaaaacctgcctagaattatcagcgataagcaacgttccactatgcccaatcgccatcaattacagtccgatcgtaggtgcctcttcggtaatcaggtgctgcaaaccagcagtgacctgagcaacgccaaccataggacaggggtttccttcaccttttctaaaaaagtacacctgaaattagagtcctccgcctctgtgttctccgaaaataccgaggagactcatgactgcaacaaaagcccaatctacaagaccaaacagaccgcagacaagtgtaagtgttgtagatttgctaataaagatacccatctcacgaaggaaaaagaggtgaacatttccccctcccatcttgagtctgtgctgcacaacaccataagcatcaacagcaagattctgcaggataaacatgattctatcgacgaaacactcgaggatagcattgggattcatgcatcattttctaaatccaatatccatctttccgatgtggattttactcctacgagccgcgaaaaagagactcgaaataccctgaaaaataccttagaaaactgtgttaaccacccctgccaggccaatgcctcctttagtccgccgaacatctacaaccactccgacgctcggatcagcgagtgcttagatgaattttcttcactcgagcccagtgagcaaaagagcaccgtgcaccttaatcccaactccagaatagaaaaccgtgaaaagtccttggataaaaccgaacgggtttccaaaaacgtccagcggctggtgaaagaggcctgcacccataacgttgccagcaaaccccttcccttccttcacgtgcaatccaaggacggccataccacccttcagtggcccaccgagctccttctcttcacaaagaccgagccatgcatctcttatggctgtaaccctttgtactttgattttaaactgtcaagaaacacaaaggaagatcataacttggaagacctgaagaccgaactggggaagaagccgctcgaactcaagaccaagcgagaatcccaggtgtccggattgactgaggaccagcaaaagcttatccaggaggactatcaatacccaaagcctaagacaatgattgcaaatccagactgggaaaagtttcagaggaagtacaatctcgattattcagactctgagccaaataagtccgaatacacattctctgctaacgatctcgagatgaaaaaccctaaagtgcctctatacttaaacactagcctgaaggactgcgccgggaagaacaatagtagtgagaataagctgaaagaagcttcaagagctcattggcaaggctgtaggaaggccgtgctgaacgacattgacgaggacctcagtttccctagttacatctcccgatttaagaaacacaaattgattccttgtagtccccatctggagtttgaagatgagaggcaattcaactgcaaatcctccccgtgcactgtgggaggacattccgaccacggtaaggattttagcgtcatcttgaaaagtaatcacatcagcatgacaagtaaggtgtctggctgtggcaaccaacggtacaaacggtactccccacagtcctgcctatcccgctatagttcctccctggatacttccccttcttccatgtcttccctgcgctcgacctgcagcagccataggttcaacggtaatagccgaggaaacttgctgtgcttccacaaacgggaacaccactctgtcgaacggcataaaaggaaatgcctgaagcacaattgtttctatttgtccgatgacatcaccaagtcaagccaaatgcagtccgagcctcagaaggagagaaattgcaaactgtgggagagcttcaaaaacgagaaatacagtaaaagaagatactgtcattgtcgcgagaggcagaagttgggaaaaaaccagcagcaatttagcgggctgaagtcaacccggataatctactgcgattctaatagccagatctcctgtacgggcagctccaaaaagccacctaactgtcaggggacccagcacgaccgattagacagttattccatcgaaaaaatgtattacttaaacaaatcaaagcggaaccaggagagcctgggatccccacacatttgtgacctcggaaaagtgagaccaatgaagtgcaacagcggaaacatctcttgtctacttaaaaactgctcttctggtccgagtgaaacaaccgaaagcaatacagctgagggagaaagaaccccattgaccgcaaagatcctgctagagcgtgtccaggctaaaaagtgtcaggaacaaagcagtaacgttgaaattagttctaattcttgcaagtccgagctcgaggccccaagccaggtcccttgcaccatccagctggcgccttctggttgcaatcggcaggctctgcctttaagcgagaagattcaatacgcctctgagagccggaacgaccaggactcagcaatcccccggactaccgagaaggataaatctaaaagctcgcacaccaataatttcaccatcctggctgacacagactgtgataaccacttatccaagggtattatccacctcgtgaccgagagtcagtctctaaatattaaacgcgatgccacgactaaggagcagagtaagccgctgataagcgagattcagccattcattcagagctgcgaccctgtgccgaacgagttcccgggagcatttccatctaataaatacaccggcgttaccgacagtacagaaacgcaggaggaccagataaatctggatctgcaggacgtttccatgcacattaaccacgtagaagggaatatcaactcatactacgacaggactatgcaaaagcctgataaggtagaggacggtctggagatgtgccataagagcatctccccgccgcttattcagcagcccataacgttcagtccggatgagatagacaagtataagattctccagctgcaagcccagcagcacatgcagaagcagctgctgtccaagcacctcagagtcttgccagcggctggcccgaccgcttttagccctgctagcaccgtgcaaaccgtgccagtccatcagcacacatcaatcaccactatacatcacaccttcttgcagcattttgccgtttccgccagcttatctagtcattcttcacatctgcccattgctcacctccatcccctgagccaggctcatttcagtccgatatctttttcgacattaactcccaccattatccccgcccaccctacctttctggccggtcaccccctccatcttgtggcggccacgccctttcacccaagccacatcacattacagcccttgccacccactgcctttattccaaccctgtttggtccccacctcaaccccgccactacttccatcatccacctcaacccattaattcaaccggtgttccaggggcaggatttttgccaccactcatgcagcagccaaatgcagcagttgaacgaggtgaaggaggctttgaatgtaagcacccacctcaactag

SEQ ID NO: 52612 - DNA, 1986 bp, Artificial Sequence
  Description of Artificial Sequence: Synthetic coding sequence
atgcccgccaacgaggacgccccccagcccggcgagcacggcagcgcatgtgaggtctcagtgagtttcgaggatgttacggtggacttcagtagggaagagtggcagcagttagactctacgcagagacggctctatcaagacgttatgctcgaaaactacagccacctgctttccgtcggttttgaggtcccgaagcctgaggtgatattcaagctcgaacagggagagggcccatggacgctggagggcgaagctccacaccagagctgtagcgatgggaagtttggcatcaaaccttcacagcgaaggattagtggcaagagcacttttcatagtgagatggaaggcgaagacactcgcgacgactcattgtactctatcctggaggaattgtggcaggacgcggaacaaatcaagagatgccaggaaaaacataacaagctcttaagccggacaacatttttaaataagaagattttgaataccgagtgggactatgaatacaaggattttggcaagtttgtacatccaagccctaatctgatcttgtcccagaagagacctcacaaaagagattcatttggcaagagctttaagcacaatctagacttgcacattcataataaatctaatgctgcgaagaacttggataagaccattggacacggccaggtttttacacagaattcttcctactctcaccacgaaaacacccacaccggcgtgaagttctgcgagaggaatcagtgtggcaaggttctttctctgaagcacagcctgtcacagaacgtgaagtttcccatcggcgagaaggcaaacacctgcaccgagttcggcaagatttttacacagcgttcccacttctttgcaccccagaagatccacactgtggaaaagccacatgagctgtccaagtgcgttaatgtgtttacacagaagcccctgctgtccatctatctcagagttcaccgagatgagaagctgtatatctgtacaaagtgcggcaaggccttcatacaaaacagtgaactgatcatgcacgaaaaaactcacacgcgagaaaagccctacaagtgcaacgagtgcggcaagtctttcttccaagtgagttcgcttctgcgtcaccagaccacccacactggcgaaaagctattcgagtgttccgagtgtggaaagggcttctctctgaactcagccctcaatattcaccaaaagattcacacaggggagaggcaccataaatgctcggagtgtgggaaggcctttacccagaagtcaactctgcgaatgcatcagcgaattcacacaggtgagagaagttacatttgtacacagtgtggacaggcctttatccagaaggcccatctgatagctcaccaacgcatccacacgggggaaaagccttacgaatgttccgactgcgggaagagctttccgagtaagtcccagctgcaaatgcataagaggatccacactggagaaaagccttatatctgcacagagtgcggcaaagcctttacgaacaggtcgaacctaaatacacatcagaaatctcacacaggggagaagagctacatctgtgctgagtgtggaaaggcctttaccgatcgttccaacttcaacaagcaccagaccatccacaccggggagaagccatatgtgtgtgccgactgcgggcgggcttttatccaaaagagcgagctgatcacacaccagcgcatacacacaacagagaagccatacaaatgtcctgactgcgaaaaaagtttttccaaaaaaccccatctgaaagtgcatcaaaggattcacactggggaaaagccttacatctgcgcggagtgtggaaaagcgttcactgacagaagcaattttaataagcaccaaaccatccatacaggtgataagccatacaagtgttcagactgcggaaaggggttcacccagaaaagcgtgttgagtatgcaccgaaacattcatacatag

SEQ ID NO: 52613 - DNA, 1365 bp, Artificial Sequence
  Description of Artificial Sequence: Synthetic coding sequence
atggccgtgaccgacctgagccacggcttcttcccccgggagcccatttgtcccttcgaggagaagaccaagatcggcacaatggtcgaagactatcttgccaattcgtatcaggatagcgtgacatttgatgacgtggcggtggaattcacccctgaggagtgggccctgttggacacgacagagaagtgcctctatcgcgatgtcatgttggagaactacgtcaatctggccagtgtggaagctactgtggacggaaactccgagaattgcggcgaggtgttcagtgaatggttctgcctgaagacacacatgcgggcccagaatggcgggaatatatttgagggcaattgctacggaaaagatatacttagtgtgcacaaggaggccagtatcggtcaggagctctccaaatttaacccatgtgggaaggtattcaccctcacccctgatctggccgcccacctgggtatcctgaatgctcggcaaccgtataaatgtaaagagtgccggaaaggctttaaatactttgcaagtttagataatcatatgggaatccacattggggagaagttttgcgaatttcaagaatgccgacgcgcaatcacacacagtagtcatcttaagcaatgcgtgaccgttcacacgggtaagaagtccaaaaaaaccaagaagcacggaaaatcttttacgaatttcagccagctctctgcgcacgttaaaatccacaagggcgaaaagtcttttgagtgcaaagagtgcggtcgctcttttagaaacagcagctcatttaacgtgcacatccagatccatactggcatcaagccccacaagtacaccgagtgcggaaaagcttttactaggtccacacacttaacacagcatgtgcgaacccatactggcatcaagccttacgagtgcaaggagtgcggacaggcatttacccagtacaccggcctggctatccacattagaaatcacactggcgagaaacactatcagtgcaaagagtgcggaaaggcatttaatggtagctccacgctgacccagcataaaatcatccatacgggagaaaaaccatatggatgtgttgaatgcgggaaaaccttcattaccagcagttaccggagcaagcatctgaaaacgcaccacgaggagcgcccgtttgtatgcaaaatctgtggcaaggctttcttgtatagttcgccactgaacgtccacttacaaacacatacgagggaaaaagctctgatctgcaaagaatgcggcaaagcctttgctgtgtcttctcacctctccagacacgagcgaatccataccggggaggaaccttatgaatataaaggaatgaatgtcacaatttag

SEQ ID NO: 52614 - DNA, 1734 bp, Artificial Sequence
  Description of Artificial Sequence: Synthetic coding sequence
atggccgccgccgccaccctgcggctgagcgcccagggcaccgtgacctttgaggacgtggctgttaactttacttgggaggagtggaacctgctttcagaagctcagcgatgtctgtaccgggacgtcactctggaaaatctggctctaattagtagcctgggatgctggtgcggtgtcgaagatgaggctgcaccttctaaacagtctatttatatacaacgggagacacaagtccgaactccaatggccggggtcagccctaaaaaagctcatccctgcgagatgtgcggccccatcctaggagatatcttgcatgtggccgatcatcagggcacgcaccacaagcaaaaactgcacaggtgcgaagcctgggggaacaagttatatgatagcggaaatttccaccagcatcagaacgagcacatcggcgaaaagccatatcggggatcagtggaggaggccctgttcgcaaaacgctgcaagctgcacgtgtccggcgagtccagcgtattttccgagtctggaaaagatttcctcccaaggtccggattactacaacaagaagcctcccatacaggagaaaagtctaatagcaagaccgaatgcgtgagtcccatacaatgcggaggggctcactatagctgcggtgagtcaatgaagcatttttcgaccaagcacatcctctctcagcatcagcggctgcttactagggaggaatgctacgtgtgttgcgaatgcgggaaaagcttttcgaagtatgcaagtttttcgaatcaccagcgtgtccataccgataaaaagcactatgaatgcggagagtgcgggaaaagcttttcacagaaaagcagtctgatacagcaccagcggttccacaccggggagaagccttacgggtgcgaggagtgcggaaagagcttcagccacaaacgcagccttgtgcaccaccagcgggtccactctggagaacggccatatcagtgcggagaatgtggaaagtcgtttagccagaaaggtaacttggtactgcaccagagagtacatacgggcgcccgcccttacgaatgcggtgagtgtggaaaatccttctctcataaaagaagcttagtccaccaccagcgaatgcacaccggtgagagaccatataagtgcggcgattgcgggaaatcattcaacgaaaaaggtcacctccgaaatcatcagcgagtgcacaccaccgagaggccttttaaatgtggcgagtgcgggaagtgtttctcgcacaaaggtaatcttattttacatcagcacggccacaccggggagaggccatacgtttgcagagagtgtggaaaattgttcaaaaaaaaatctcatcttttagtccaccagcggatccataatggcgaaaaaccctatgcatgtgaggcctgccagaagttcttcaggaataactctaccttttgcgtgcacaagcgtatccacaccggcgagaaaccgtatgagtgctcagaatgtggaaagtcatttgctgaaagttcaagttttactaagcacaagagggtgcacaccggggagaagccatatgagtgttcagagtgcggcaagagcttcgccgagagctcgagtctgacaaagcacaagagagtccacacaggggaaaagccctacaagtgtgagaagtgcggtaagttgtttaacaagaagtcacacctgctcgtccaccagagttcccactggaggaaggctatttag

SEQ ID NO: 52615 - DNA, 2568 bp, Artificial Sequence
  Description of Artificial Sequence: Synthetic coding sequence
atggccgccgccgccaccctgcggctgagcgcccagggcaccgtgacctttgaggacgttgcagtcaattttacgtgggaagagtggaacttactgtcagaggcccagcggtgtctttacagggacgttactctcgagaacctcgccctgatatcatctctgggttgttggtgcggagtggaagacgaagctgctccgtccaaacagtctatctatattcagcgagagacccaggtgcgcactcccatggctggagtgtcaccaaagaaagcacatccatgcgagatgtgtggacctatcttaggagacattctgcatgtggccgaccaccaggggactcatcataaacagaaactgcacagatgcgaggcatgggggaataaactctacgacagcggaaactttcaccagcaccagaatgagcacataggggaaaagccctaccgaggaagcgtagaagaagccctattcgctaaaaggtgtaagcttcatgtttccggcgagagttcagtgtttagcgaatcaggcaaagattttctcccacggagcggactcttgcagcaggaagcatcccacactggcgagaaaagcaacagtaaaacggagtgcgtctctccaatccagtgcggtggcgcccattattcctgcggggagtctatgaagcacttctcaaccaaacacattctgtctcagcatcagaggctgctgacaagggaggagtgttacgtatgttgtgagtgtgggaaatcctttagtaagtacgccagcctgagcaaccaccagcgagtgcacactgagaagaagcatgagtgcggagaatgcggtaaatcattttccaaatacgtctcattctctaaccatcagcgagtccatacagaaaagaagcacgagtgcggcgagtgcggaaagtcattctccaaatatgtcagtttttcaaaccaccagcgggtacacactggaaaacgcccatacgaatgcggagaatgcggaaagtccttctcgaaatatgcctcattcagcaatcaccagcgcgtgcataccgaaaagaaacactatgaatgcggcgaatgcggtaaaagcttctcaaaatatgtgtccttttcaaaccatcagcgtgtgcacactggcaagcggccatatgaatgcggggaatgcggcaaatcctttagcaaatacgcctcgttcagcaaccatcagcgcgtgcacaccgacaagaaacactacgagtgcggcgaatgtgggaaaagtttcagtcaaaagtcttccctcattcagcaccaacgattccatactggtgaaaaaccctacggatgtgaggagtgtgggaagtctttttcgtccgagggccacctgagatcacaccagcgagtccacgccggagagagaccatttaaatgcggggaatgcgtcaaatcgttttcgcataagcgttcactggtgcatcaccagagggtgcatagcggcgaaaggccctaccaatgcggtgaatgcggcaagtcattttcgcagaaggggaacttagtgctccatcaacgcgtgcatacaggcgcgcgcccgtacgagtgcggagaatgtgggaagagcttctcctcaaagggacacctgcgaaaccaccagcaaattcacacaggtgataggctgtatgaatgcggcgagtgcggaaagtccttttcacacaaaggcacattgatccttcatcagcgcgtgcatcctcgggagaggtcctatggatgtggagagtgcggcaagagtttttctagtatcggtcatttgagatcacatcagagggtccacaccggtgagcgcccatatgagtgtggtgaatgtggcaaaagcttttctcacaagcgatcgctcgttcaccaccagaggatgcacactggcgagcggccttacaaatgcggggactgtggaaagtctttcaacgagaaaggccatctgcgaaatcatcagagagttcatacgaccgaacgacctttcaagtgcggtgagtgtggcaagtgcttctcgcacaagggcaatctaatacttcatcaacacggacacaccggtgagcgcccatacgtgtgtcgggagtgtgggaagctctttaaaaagaaatcgcacctccttgtgcaccaaaggatccacaacggggagaagccatacgcctgcgaagcttgccagaaattttttcgcaataagtatcagttgatagcacaccagcgcgttcatactggtgaaagaccgtacgaatgcaacgactgcggtaagtcatttactcatagttctactttctgcgtgcacaaaaggattcacactggggagaaaccatatgagtgtagtgaatgtggcaagtcgtttgccgagagtagtagttttaccaaacataagcgtgtgcatactggagaaaaaccgtacgagtgctctgaatgtgggaaatctttcgctgagagctcctcattgactaagcacaaaagggtacatactggcgaaaagccatacaagtgtgagaaatgtggaaaattgttcaataagaagagtcacctgttggtgcaccagagctcgcattggagaaaagccatctag

SEQ ID NO: 52616 - DNA, 1113 bp, Artificial Sequence
  Description of Artificial Sequence: Synthetic coding sequence
atgagccggcggaagcagaccaaccccaacaaggtgcactgcgacagcgagggcgacgaggaggaaactacacaggatgaggtgtcctctcataccagcgaggaggatgggggcgtggttaaagtggagaaagagctggagaatacggagcagccggtgggaggcaacgaggtggtcgaacacgaggtgaccggtaacctgaattcagatcctctgctcgaactatgccagtgtcctctctgccagctggattgcgggagcagagaacagcttattgcccatgtgtaccaacatactgctgccgtggtgagcgcgaagtcttacatgtgtcccgtctgcggaagggcactctcaagcccggggtctctggggcgccacctgctgatccattctgaggaccagcgttcaaattgcgccgtctgcggagcccggtttacctcgcacgcaacttttaatagtgagaaactccctgaagttcttaacatggaatctctgccaaccgtccacaatgagggccctagcagcgcagagggcaaggatattgcctttagtccacccgtctaccctgcaggcatcctcctcgtgtgcaataattgtgccgcctacagaaaactcttggaggcccaaacaccatccgttcgcaagtgggcacttcggcgacagaatgagcctctcgaagtgcggctgcaacgccttgagagggagcgcaccgccaagaagtcacgcagagacaacgaaacacccgaggagcgagaggtccgtcggatgcgcgacagagaagcaaagaggctccagcggatgcaggagaccgacgagcaacgggctcggaggttgcagcgtgaccgtgaagctatgagacttaaacgggccaacgaaacaccagaaaaacggcaggcacgattgattcgggaacgggaagctaaacggctgaaaagacgactcgaaaagatggacatgatgttgcgcgctcagttcgggcaagacccaagtgccatggccgctctggccgccgaaatgaattttttccagctccccgtgtcaggcgtagaacttgacagccagctcctcggcaaaatggcctttgaagagcagaatagcagtagcttacactag

SEQ ID NO: 52617 - DNA, 1239 bp, Artificial Sequence
  Description of Artificial Sequence: Synthetic coding sequence
atgagccggcggaagcagaccaaccccaacaaggtgcactgggaccaggttttcgccggactcgaagagcaggcccggcaggccatgatgaaaactgatttcccaggcgatctaggcagccagcggcaggcgattcagcagctacgagaccaagattccagcagctccgacagcgagggggacgaggaagagacgacacaggacgaggtgagcagccatacttcagaggaggacgggggcgtggtgaaagtggaaaaagagctcgaaaatactgaacaaccggtgggggggaatgaggtagttgagcacgaagtaactggtaatctgaacagcgacccactcctggagctctgtcagtgccctctgtgccagttagattgcgggtctcgtgagcagctaattgctcatgtgtaccagcacacagccgccgtggtgagcgccaagtcatacatgtgtccggtatgtgggagagctctcagttccccaggctctctcgggaggcacctcctgattcatagcgaagaccaacgctctaactgtgcagtgtgcggggcccgtttcacttcacacgccaccttcaactcggaaaagttacccgaagtcctgaatatggaaagcctgccaaccgtacataacgagggtcctagctcagctgaaggtaaagatattgccttttcacctccagtgtatccagctggcattctgttagtttgcaataattgcgctgcctacagaaaactccttgaggcccagacaccatccgtcaggaagtgggcgcttcggcgccagaacgagcctctggaagtgaggctacaaagactcgagagagagcggaccgccaagaagtcccgccgtgataatgaaacccctgaggaacgcgaggtgaggcgcatgcgggacagagaagccaaacgtttacagcgcatgcaggagacggacgagcaacgggctcggcgcctgcaaagggatcgggaggcaatgaggctgaaacgggctaacgagactccagaaaagcggcaagccaggttgatccgcgaaagggaggctaagcgcctaaagagaaggctggagaaaatggatatgatgctgcgggcccagtttggccaggaccccagtgctatggcagctctcgctgccgagatgaactttttccagcttcccgtgtccggagtggaactagactcccagttactaggcaagatggccttcgaggaacagaactcaagctccctgcactag

SEQ ID NO: 52618 - DNA, 1113 bp, Artificial Sequence
  Description of Artificial Sequence: Synthetic coding sequence
atgagccggcggaagcagaccaaccccaacaaggtgcactgcgacagtgagggtgatgaggaggaaaccactcaggatgaggtatcctctcacacctccgaagaggatggtggggtggtcaaggtggaaaaggaactggaaaatactgagcagcccgtaggaggcaatgaggtagtcgagcacgaggttacgggcaacttgaactctgatccactcctggagttgtgtcagtgtcccctgtgtcagctagactgcgggtccagggagcaactgatagctcatgtataccagcatactgccgcggtcgtgagcgctaaaagctacatgtgcccagtgtgcggtagggctctgagttctcccggaagccttgggaggcatttgctgatccactctgaggatcagagatcgaactgcgcagtgtgcggcgccaggttcaccagtcatgccactttcaattcagaaaaacttcccgaggtgttgaacatggaaagcttaccaacagttcacaacgagggcccctccagcgccgaaggaaaggacatagcgttcagccctccggtgtacccagccgggatactcctggtatgcaataactgtgccgcatacaggaagctgctggaggcacaaactcccagcgtccggaaatgggccctgcgccggcaaaatgaaccactggaggtgcggctgcagcgactcgaacgagagagaaccgcaaaaaaatctcgccgcgataatgagacccccgaggagcgggaagtcaggcggatgcgcgacagggaagccaaaaggttgcagagaatgcaggagacagatgagcagcgcgcccgccgcctgcagcgtgacagggaggctatgagactgaaacgagcgaatgagactcccgaaaagagacaggccagactcattcgagagcgtgaggccaagaggctcaaaaggcggttggaaaaaatggatatgatgctccgggcgcagttcgggcaggaccctagcgccatggcagctcttgccgccgaaatgaactttttccagttgcctgtatccggggtggaactggactcgcagctgcttggcaaaatggcgtttgaagagcaaaactccagttccttgcactag

SEQ ID NO: 52619 - DNA, 417 bp, Artificial Sequence
  Description of Artificial Sequence: Synthetic coding sequence
atgagccggcggaagcagaccaaccccaacaaggtgcactgggaccaagttttcgctggcttggaggagcaggccagacaagcaatgatgaagactgacttccctggcgacctggggtctcagagacaggccatacaacagctgagagatcaggactcttcttcatctgatagcgagggcgacgaagaggagaccacacaagatgaagtaagttcacacacctccgaagaggacgggggggtggttaaagtagaaaaggagctcgagaatactgagcaaccagtgggcgggaacgaagtcgtagagcatgaggcaagaaatcttaactccgacccactgttagaattgtgccagtgccctttgtgtcaactcgattgcgggagtagagaacaacttattgcgcatgtctatcaatag

SEQ ID NO: 52620 - DNA, 1239 bp, Artificial Sequence
  Description of Artificial Sequence: Synthetic coding sequence
atgagccggcggaagcagaccaaccccaacaaggtgcactgggaccaagtgtttgcaggtctggaagaacaggccagacaggccatgatgaaaaccgattttcccggagatcttgggtctcagcgccaggctattcagcaattgcgcgaccaagattcttcctcttcggattctgagggagatgaggaggaaaccacccaggacgaagtgtcttcacacaccagtgaagaagacggaggggtcgtgaaggtagagaaggaactggagaacactgaacagccagtgggcgggaacgaggtggttgaacacgaggtcaccggcaatttgaatagcgatcccctgctcgagctttgtcagtgcccgctgtgtcagttggattgtggctcaagagagcagctaatagctcatgtgtatcaacacacggcagctgtggtgtcggctaagagctacatgtgtcctgtctgcggaagggcactgagtagccctgggtccctaggccgccacctccttatacactcagaagatcagaggtctaattgcgccgtgtgcggggctcggtttacctcccacgcgacctttaatagcgagaagcttcccgaggttcttaacatggagtctctgcctacagtgcacaatgagggccctagcagcgccgaagggaaggacatcgcattctcgcctccagtgtatcccgccgggattcttctcgtttgcaataactgtgcagcatatcggaagttgctcgaagctcaaacacccagcgttaggaaatgggcgctgagaagacagaatgagcctttggaggtccggctgcaacgtctggaacgcgaacggaccgcaaagaaaagtagacgcgacaatgaaacaccagaggaacgagaggttcggagaatgcgcgaccgggaagctaagaggctgcagaggatgcaagaaaccgacgagcagcgcgcccgaaggctccagcgggaccgggaggcaatgcggttgaagcgggccaacgagacccctgaaaagcgccaggcgcgcttaattcgcgaaagggaggcaaaaagactcaagagaaggctagagaagatggacatgatgcttcgggcccagtttggccaggacccatcagctatggctgcactggctgccgagatgaactttttccagctcccagtctccggagtcgagctcgattctcagctactgggaaagatggcatttgaggaacagaatagttctagtctgcactag

SEQ ID NO: 52621 - DNA, 1680 bp, Artificial Sequence
  Description of Artificial Sequence: Synthetic coding sequence
gtgcccggcagccagtgcgaccccgagaagcggtgcgagatcaagacagcggctcaaggaagcagaatggagggacttctgtcggtcgcactgcagggtgccgaactcgaggggaactggaaacacgagggtcaggtcgaggatctccaagaaaatcaggaaagctgcccagagccagaggctgtcgcctgtaagggcgaccccgcaggagacagtatgcaggaacgggacgagtttagccggattcctaggaccatttcctccccagccgccacccaggcatccgtccccgatgatagctcaagtagacggtgctccgctcctggggaatcccccaaggagcgtcatccagactcgcgccagagggagcggggtggggggcctaagaagccctggaaatgtggggattgcggcaaggccttttcgtactgcagcgcctttatcttacaccaaagaattcacacaggagagaagccctttgcttgtccagagtgtggaaaagcatttagtcagagtgtacacctgacattgcaccagcgcacgcataccggggaaaagccgtatgcctgccacgaatgcggtaaggccttttcacaagggtcctatctcgcaagtcactggagaactcacacgggcgaaaaaccccataggtgtgccgactgcgggaaagccttcacccgagtgactcatctgacccagcaccgaagggtgcacaccggagaaagaccatatgcgtgcgcgcagtgcgcaaaggcattcaggaatcgctcctcacttatcgagcaccagaggattcataccggcgaaaagccctacgagtgctcggcctgcgccaaagccttcaggttttctagcgctctaatccggcaccagcggattcatactgaggaaaagccttaccggtgtgggcagtgcgcaaaagccttcgcccagatcgcgcatttgacgcaacacaggcgggttcatacgggcgaaaagccatatacttgtcaggattgtggcgctttattcagccaaagtgcaagtctcgcggagcacagacgcattcatactggagaaaagccttacgcatgcggccagtgcgccaaagcttttactcaggttagtcacctgacacaacaccagaggactcataccggtgaacggccctacccatgccatgattgcggtaagcgtttctcaaaccggagccatctccttcagcacagattagtgcacaccggagaaaggccttacagatgccttcagtgcggagctgctttttctcatgtgtcttcactgattgagcatcaaaaaatccacacaggcgaaaggccgtataagtgtggagagtgcggaaaagcctttagtcagggaagttctttggcccttcaccagcgcactcacacaggggaacgcccatacacctgcccagaatgtggaaaggccttctccaaccgctcatatctgattcaacaccacatcgtgcatacgggagagaaaccatatgaatgttcaggctgtggaaaggcattcagcttctcctccgccctgattcgacaccagcgtacccacgcagacagcagcggacgactctgtcctgctccaaccccggacagcacccctggactttcccaaggaggggaaacgtgtcagcaggggtgccctggcaggaacccaaggggaccagcagaagactag

SEQ ID NO: 52622 - DNA, 1614 bp, Artificial Sequence
  Description of Artificial Sequence: Synthetic coding sequence
atggagggcctgctgagcgtggccctgcagggcgccgagctggagggcaattggaaacacgagggacaggtagaggacctccaggagaaccaggaatcctgtccagaacctgaggccgtagcgtgtaagggcgatcctgcaggtgatagcatgcaggaacgcgatgagttcagcagaattccacgaaccatttcgtctcctgccgcgacccaggcatcagttcccgacgatagcagcagccggcggtgctcagcccccggcgaatctcctaaggaaaggcatccagactcccggcagagggagcggggaggggggccgaagaagccttggaaatgcggtgattgcggcaaagcgttcagctattgctccgccttcattctgcatcaacggatccacacaggcgagaagccgttcgcatgcccagagtgcggaaaagcattcagtcagtcagtgcatctgacactccaccaacgtactcatacaggtgaaaagccttatgcctgccatgagtgtggaaaagccttttcgcagggctcgtatcttgctagtcactggcgcacacacacaggcgaaaaaccccataggtgcgccgactgcggaaaagcattcactagggtgactcacctcactcaacatagacgtgtccacaccggggagcggccctacgcctgcgcacagtgcgccaaggcgtttaggaatcgctcttccctcatagagcaccagaggattcataccggtgagaagccttacgaatgttcagcatgcgcgaaggcatttcgcttctccagtgcactgattaggcaccagcgtatccatacggaagaaaagccctacagatgcgggcagtgtgccaaagcctttgcgcagatcgcacacctcactcagcaccggcgggtccacaccggtgagaagccctacacatgccaggactgcggcgccctcttcagccagtccgcgtcactcgctgaacaccggcgaattcacacaggagaaaagccttacgcatgcgggcagtgtgctaaggccttcacccaggtttcccacctgacgcagcaccagaggacacatacaggggaaagaccatatccctgtcatgactgcgggaaacggtttagcaatcgctcgcacttgttgcagcataggctggtacatacgggggagcggccctatagatgtctccagtgcggtgcagcattctcccacgtttcctctctgatcgaacatcaaaagatccacaccggggagcggccatacaagtgcggtgaatgcggaaaggctttttcacagggctctagcctagcacttcatcagaggacccacaccggggagcggccttacacctgccctgaatgcgggaaagcttttagtaaccgcagttacctaattcagcatcacattgtgcacaccggagagaaaccttatgagtgttccgggtgtggcaaggcattctcattctccagtgctctgatccgccaccagagaacacatgctgactcttccggacgcctctgtccagcccctactccagactcaaccccgggtctttcacaaggaggtgaaacctgccagcagggttgtccaggacgtaatccccgcggacccgcagaagattag

SEQ ID NO: 52623 - DNA, 2442 bp, Artificial Sequence
  Description of Artificial Sequence: Synthetic coding sequence
atgctgctgcccaccaccatccagccccagaccgcccggaagagccagttgccaaggggcaatagctgtttggtcggattgcatatcgccagccctcagctccttcgtgtgcagccactcgtgcgtacggagccacagagctgcttcctcagcgatctctgtcagccacctgctcagggattcgttcagagacccctccccgccctacaggtggtacctgccaagcgggttcctgctccgaaggccccagacgagcaagggagcatgctgacgcctctatccgccagtgaccccctcgctgtcacgagtctgagcagctcttcggcccatcctttcattagtaacctgcacactagacacaccgagaagctcaaaaagagtctcaaggtgaagacacgctccggaagagtttcccggcctccaaaatacaaggccaaagactataaatttatcaagacggaggacctggctgatggccacctcagcgacagtgatgattactcagagctgtgcgtggaggaggatgaagatcagagggaaaggcacgccctgttcgatctgtccagttgtagcctgcgtccaaagagttttaaatgccagacatgcgaaaaatcatacatagggaaaggaggtttagcgcgccacttcaagttaaatccgggccacgggcagctggatccagaaatggtcctttctgaaaaggcctcagggtccacactgagggggtgtaccgaagaacggacgctctcattgacctctctgggattgagcatgcccgccgacccctgtgagggcggagctcgcagttgcctggtaaccgagtctgcaaggggcggactgcagaatggacagtcagtcgacgtggaagagactctgccgtctgagcctgaaaatggcgccttgttgaggagtgaacggtatcagggaccccgccgccgtgcgtgttctgaaacactcgcagagagtagaaccgcggtgctccagcagcgcagggccgcgcaactgccagggggaccagccgccgctggtgaacagcgcgcctccccatccaaggcacgccttaaagagtttctgcaacagtgtgatagggaggacctggtagagctggcgctgccgcagctggcccaggtggtgactgtctatgagtttctcctcatgaaagtggagaaagaccacctcgccaagccattctttcccgccatatacaaggagtttgaagaattacacaaaatggtgaaaaagatgtgtcaagactatctgagcagctctggactctgtagtcaggagacgctcgagatcaataacgacaaggtggctgaaagcctgggcataaccgaattcctgaggaagaaggagatccatccagacaatcttggacctaagcacctgtctagggatatggatggggagcagctcgaaggcgccagctcagaaaaacgcgaacgggaggcagccgaggaggggttggcaagcgtgaagcggccccgcagagaggccctgtcaaatgacactaccgagtcactcgctgccaattctcgcggcagagagaaaccaagacccctgcacgcgctagcagctggtgagggattctcaccccctgtcaatgtcaccgtcagcccacggtctgaggagagccacaccaccacagtgagcggtggaaacggctctgtcttccaagccggccctcagttgcaggccctggctaacctcgaagcccggcgaggaagcatcggggccgcattgtccagccgtgatgtgagcggtctgcccgtctacgcacaaagtggtgaacctaggcggctaactcaggcccaggtggcagcatttccaggcgagaacgccctcgagcattcgtctgaccaagacacgtgggactcgcttcgatcacccgggttttgctccccactaagctccggagggggagcggaaagcctgcccccaggcggtcccggccacgccgaggctggccacctgggtaaggtttgcgactttcatctcaatcatcagcagccatctcccacttccgtgcttcccacagaagtcgctgcaccgccattggaaaaaatactgtctgtcgactccgtggccgtggactgcgcataccgcacagtccctaagcccggacctcaacccgggccacatgggagcctcctcactgaagggtgtttacggtcgctgagcggagatcttaataggttcccctgcggcatggaagtacactccggccagcgggagttagagtcagtcgtcgccgtcggggaagcaatggcttttgaaatttccaacggaagtcacgagcttctgagccagggtcagaagcagatcttcatccagacttccgacggactgatcttatcccctccaggcaccattgtctcacaggaggaagacattgtgacagtgaccgatgctgaaggacgagcttgtgggtgggccagatag

SEQ ID NO: 52624 - DNA, 1368 bp, Artificial Sequence
  Description of Artificial Sequence: Synthetic coding sequence
atgcccgccgacccctgcgagggcggcgcccggagctgcctggtgactgagtccgctcggggcggactgcaattcctgcagcagtgtgacagggaagacctggtggagctcgccttaccacagctggcgcaggttgtgacagtatatgagtttctcctcatgaaggtggaaaaagatcatcttgcgaaaccattcttccccgccatctataaagagtttgaggaattgcataaaatggttaaaaagatgtgccaagattacctgagcagctctgggctctgcagccaggaaacgctcgagattaacaacgataaggtagccgagagtttggggatcactgaatttctccggaaaaaggaaattcatcccgataatctgggccccaagcacttaagcagggatatggacggtgagcaattggaaggagctagcagtgaaaaaagggagcgagaagccgccgaagagggcctcgctagcgtgaagcgccccagacgtgaggcactcagtaacgacacgacagagtccctggctgctaattcccgcggtcgcgaaaaacctcggccattgcacgctttggcagcggggttctcgccccctgtgaatgttacagtgtcaccaaggagtgaagaatctcatacaacaactgtcagcggcggcaacggttccgtgtttcaggcgggacctcaactgcaggcacttgcaaacctggaggcccgacggggcagcataggtgctgccctaagctcacgggacgtgagcggactcccagtctatgctcagagcggagagccccgtcggctgacccaggcccaggttgctgcttttcccggggagaacgcccttgagcactccagtgaccaagatacctgggattcgttgaggtcccccggtttttgcagtccattaagctccgggggaggcgctgaatcactgcctccaggaggcccaggccatgcagaagctggacacctgggcaaggtatgcgacttccacctgaaccatcagcagcccagtcccacctccgtgctgcctaccgaagttgccgccccacctttagaaaagattctttcggtggattccgtcgcagtcgattgtgcttaccgaacagtgcctaagccggggccacagcccgggcctcatggaagtctactgactgagggctgcctgcgtagtctgtccggcgatttgaaccgatttccctgtggtatggaagtgcacagcgggcagagggaattggagagcgttgtggctgtcggcgaggctatgttgaagtttcctatgggagccatgtcatactgcctgcgagatcgcagcaggttcttgtttcgacttccaatgggccttagttgccccctgcaggtccagtag

SEQ ID NO: 52625 - DNA, 2784 bp, Artificial Sequence
  Description of Artificial Sequence: Synthetic coding sequence
atggccgacgccgagcccgaggccggcggcggcagcgaggacggcggaggggggggcggccctgcccccccaggccagagtggtagcgtggccagggtggcgcctttggggcccgaacagctcagacaggtcctcgagcaggtgactaaagcccaaccccccccaccaccgccaccctttgtgctgagggacgccgcaaggcggttgcgcgatgcagcccagcaagccgcccttcagcgaggacgcgggaccgaaccccctcgactgccgagacttctgcctcctcaacagctggaggcgatatgcgttaaagttacaagcggagaaaccaagggccaggagcggccaatgcttttacccactactatccagccccagaccgcacgaaagagccaactgccccggggcaacagctgcctcgtggggctgcatatcgcttcaccccaactgcttagggtccagcccttggtccgcacggaacctcaaagctgttttttgtccgacctttgccagccaccagcacaggggttcgtccagcggcctctccctgcccttcaagtggtcccagccaagcgggtgcctgcccctaaagccccagatgagcaaggatcaatgctgaccccactgtccgccagtgaccctttggccgtgacttccctgtcttcatcttcagcccatcccttcatttccaacctccatactcggcacaccgaaaagctgaagaaatccttgaaagtgaaaacacgatcagggcgagtcagtaggcctcccaaatacaaggctaaagactacaaattcatcaagacagaggatcttgccgacggccacctgtcagactccgatgattacagcgaattatgcgtcgaagaggacgaagaccagcgcgagcgacatgccctcttcgatctctctagttgtagcttacggccaaaaagcttcaaatgccagacctgcgagaagagttatatcgggaagggaggtcttgcccgccactttaagctcaaccccgggcatggtcagctggaccctgaaatggtcttaagcgagaaagctagcgggagcactctgcgcggctgtaccgaggagcgaacactatcacttacatccttgggcctgagtatgcccgccgatccatgcgagggtggggctcgttcctgtttggtcaccgagtccgccagaggtggactgcagaacggccagagtgtggatgtcgaggagacattgccgtctgaacctgaaaatggtgctctgctgagatccgagagataccaaggtccccgtcgccgggcctgttcggaaaccttggctgagtctagaacagctgttttgcagcagcgtcgcgccgcacagttgcctggggggcccgctgccgcaggagagcagagagcctccccgagcaaggcccgtctgaaggagtttttgcagcagtgtgacagagaggacttagtggagctcgcgttgccccagctagcccaggtggtgacagtgtacgagttcctgttaatgaaagtcgagaaagatcacctggccaaaccattcttccccgcgatctacaaagaattcgaggaactccataagatggtgaagaagatgtgccaggattacttaagttccagtgggctctgctctcaggagaccctcgagataaataacgacaaggtcgctgagagcctgggtattaccgagtttctgcgcaagaaagaaatccaccctgataacctggggcccaagcatctgtctcgggacatggacggagaacagctggaaggagcaagtagtgagaagagagaaagggaggctgcggaagagggattggcctctgtcaagcgccctcggcgcgaggccctgagcaacgatactactgaatctcttgccgcaaacagccgtggaagggagaagccccgccccctgcacgctcttgcggctgggttctctcctccagtcaatgttactgtttctccccgatcagaggaaagtcataccacaacggtctccggaggcaatggctctgtgttccaggccgggccacagctacaggcgctcgccaacttggaggctcggcgcggttcaatcggagccgctctttccagtagagacgttagcggcctgcctgtatatgcgcaaagtggggagcctcgcaggctcacccaggcacaagtagctgcttttcctggcgaaaacgctctggaacatagctctgaccaagatacttgggattcattgcgatcgcctggattctgtagtcccctgagctcgggaggaggggctgagtccctcccacccggtggacctgggcatgcggaggcaggacatctggggaaggtgtgcgacttccatctgaaccatcagcagccctccccgaccagtgtgctacccacggaggtggccgccccgcctctggaaaagatactgtcagtcgactctgttgccgttgattgcgcgtaccggaccgtccctaagccaggtcctcaacctgggccacatggctctctgttgaccgaagggtgccttcgcagtcttagtggcgacttaaatcggttcccatgcgggatggaagtccattctggtcagcgagaactggaatctgtcgtcgccgtaggagaggccatggcttttgaaatatctaatggcagccacgaactgttatctcagggtcagaaacaaattttcatccaaacgtccgatggcctcatcctgagcccacccggcaccatcgtgtctcaggaggaagatattgtaacagtgacagatgccgaaggacgcgcctgcgggtgggctagatag

SEQ ID NO: 52626 - DNA, 2436 bp, Artificial Sequence
  Description of Artificial Sequence: Synthetic coding sequence
atgctgctgcccaccaccatccagccccagaccgcccggaagagccagctgcctcggggaaactcctgccttgtgggcctgcacatcgctagcccccagctactgagggtgcaaccactggtgcgcaccgagccacagtcgtgctttctctccgacctgtgtcagcctcccgcacagggttttgtgcaacggcctctgccagccttacaggtcgtgcccgccaaaagagttcccgcccccaaagcacccgatgagcagggatctatgcttacgcccctgagcgcttctgatcctctggctgttacctcgttgagcagcagttctgctcacccctttatttcaaacctccatacacgccacaccgaaaagctgaagaagtctttaaaggtcaagacaagatcgggccgcgtatcccggccgcccaagtataaagcgaaggattataagtttattaagaccgaggacctagctgacggccacctgtcggacagcgatgattactctgaactctgcgttgaggaagatgaagaccagcgggaaagacatgccctgttcgaccttagttcttgttccctaagacccaagtctttcaagtgccagacctgtgaaaagtcatacatagggaagggtggcctggcacgccactttaagctgaatcctggccacgggcagctggaccctgagatggtgctctccgagaaggcttcagggagcacgctgaggggttgtacagaggagcgcacactgagcctaacatccctcggtctgagtatgcctgcggatccttgtgaggggggggcacggtcctgtctcgtaactgagagcgcacgcggcggcctacagaacggtcagtcagtggatgtcgaggagactctgccttccgaacctgaaaatggtgccctgctgcgaagtgagaggtatcagggcccgcgaaggagagcatgtagtgagaccctggcagagtcacgaacagcggtgctgcagcagaggcgtgccgcccaattaccagggggaccagccgcagctggcgaacaacgggccagcccctctaaagcacggcttaaggaattcctgcagcaatgcgatcgggaagatctggtcgaactcgccctcccacagttagctcaggttgtaacagtatatgaatttctgttgatgaaggtcgagaaggaccacctggcaaagccattctttcctgctatctataaggagttcgaagaactccataaaatggtgaaaaagatgtgtcaagactatctttcatcttccggcttgtgctcccaggagaccctggaaataaataatgataaggtagccgagtctttaggcataacagaattcctgagaaaaaaagaaatccacccagataatttgggacccaagcacctgtctagagacatggacggggagcagcttgaaggggccagtagcgagaagagggagagagaggcagccgaagagggtctagcgtcagtgaaacgccctcgaagggaagctctgagtaacgatacgacggaatccctcgcggccaattcacgtggcagagaaaagccaagaccactccacgcactcgcggctggcttcagtccacccgtgaacgtgacagtaagccccaggagcgaggagtcccacaccaccacagttagcgggggcaatggctctgttttccaggctggcccccagctgcaggcactggcaaacctggaggctagacggggaagcatcggcgctgccctgagtagtcgcgacgtgagcggccttcctgtgtacgcacagagcggcgaacctcgccggctgacgcaggctcaggtcgctgcatttcccggggaaaatgccctcgagcattcttcagatcaggacacctgggactcactgaggagccccggcttctgtagtccgctttcgtccggagggggggctgaaagcctgcctcctggtggcccgggacacgctgaggcggggcacctcggtaaagtgtgtgatttccacctcaaccaccagcaaccctcaccaacaagcgtcctgcctaccgaagtggccgccccaccccttgagaaaattcttagcgttgactctgttgctgtcgactgcgcttaccgtaccgtgcctaaaccaggccctcaacccggcccccatgggtctcttttaactgagggctgcctgagaagcctgtcaggcgatttgaatcggttcccttgcggcatggaagtgcacagcggacagcgagaactagaatccgtggtggccgtcggagaagcaatggccttcgagatttccaatggtagtcacgaactgcttagccagggccagaaacagatatttattcagacgagtgatggcttgatcctcagcccacccggtactatcgtgtcgcaggaagaagatattgtcactgtgaccgatgcggagggccgcgcatgcggctgggcccggtag

SEQ ID NO: 52627 - DNA, 2436 bp, Artificial Sequence
  Description of Artificial Sequence: Synthetic coding sequence
atgctgctgcccaccaccatccagccccagaccgcccggaagagccagctgccgcgcggaaacagttgccttgtggggctgcacatcgcttcacctcagctgctccgcgtacagcctctcgtgcgaaccgagccccagtcctgctttctaagtgacctttgtcagcctccggcacaggggttcgtgcagagaccgctgcctgcactgcaggtcgtccccgcaaaaagagttcccgcccccaaggcccctgatgaacaaggcagcatgctcacaccgctgtccgcaagcgatcccctggcggtgaccagcctaagtagttcatccgctcatcccttcatttcaaatctccatacccggcatactgagaagctgaaaaaaagtttgaaagtcaaaacccggagcggccgggtgagcagacccccaaaatacaaagcaaaggactacaaatttattaaaaccgaggatctggcagatggtcacctgtccgactccgacgactatagtgaattgtgcgtcgaagaagacgaggatcaacgggaaaggcatgctctttttgatctgagcagttgcagtctccggcctaaaagttttaaatgtcagacttgtgaaaaaagctacatagggaagggaggactggcccgccatttcaagttgaatcctggacatgggcagctggaccccgagatggtgcttagcgagaaggcatccggttccacgctcagaggatgcacagaagaacggacactttcattaacctccctgggactctccatgccagccgacccctgtgagggaggggccaggtcttgcctggttacagagtctgctcgcggaggtctgcagaatggccagtcagtggacgttgaagagacactgcctagtgagcccgaaaacggagccctcctgcgttccgagcgctaccagggtcccagaaggcgcgcgtgcagcgaaaccctggcagagagccgcacagccgtgctgcagcagcggcgcgcggcccaacttccaggcggacctgccgctgccggcgaacagcgtgcatcaccctccaaagcacggctgaaagaatttctccagcagtgtgaccgggaggacttagtggagttagccctcccgcagttggcacaggttgtgaccgtttatgagtttctcctgatgaaggtcgagaaggatcacctggctaagcccttttttcctgcaatttacaaagagtttgaggagctgcataagatggtgaagaagatgtgccaggattacctttcatccagcggattatgctcacaagagacactcgagatcaacaatgataaggttgcagagagtctgggaatcactgaattcctgagaaagaaggaaattcacccggacaacctgggaccaaaacacctcagccgggatatggatggcgaacagttggagggggctagctctgaaaaaagggaacgggaggctgcggaggaaggccttgcgtccgtgaaacgccctagaagagaagccttaagtaacgatacaaccgaaagtctggcggcaaattcaaggggccgagaaaaacctaggcccctacacgctctagccgcaggattctctccgcctgtgaacgtgaccgtaagccctaggtctgaagagtcccacacaaccaccgtgtccgggggaaatggatccgttttccaggccggcccacaactccaggctctagctaacctggaagcgcggcggggttctatcggtgcagccttatccagccgagatgtaagcggacttcctgtgtatgctcagtcaggcgaaccaaggcgcctcacacaagcccaagtggctgcctttccaggtgaaaacgcattagagcactcctccgaccaagatacctgggacagcttgcgatcgcctggcttctgcagccctttaagcagtgggggcggggcggagtctctacccccaggtggcccagggcatgccgaagccgggcacctgggaaaagtgtgtgacttccatctaaatcaccagcagccaagccccacctctgtcctccctaccgaagtcgccgcgccgcccctggaaaagatcttgagtgttgactcagtggccgtggactgcgcttacagaacagtgcctaagcccggcccgcagccaggcccgcatggatctcttctcacggagggatgcctgcggagtttgtcaggcgacctgaaccgattcccatgcggcatggaggtgcactctggccaacgggaactggagagcgttgtggccgtgggagaggccatggcctttgagatctccaatggcagccatgagctgctgtctcagggccaaaaacaaatattcatccagacaagcgatggcctcatattaagtcctcctgggacgattgtttctcaggaagaggatatagtaaccgtgacagacgctgaaggccgcgcttgtgggtgggcaagatag

SEQ ID NO: 52628 - DNA, 1047 bp, Artificial Sequence
  Description of Artificial Sequence: Synthetic coding sequence
atgcggagcctgcccttcgccctgaccgtggagagcgtgagcgccagggctcctacatgttgcagcacgggcagattcacgcaggggcgtcagccctgtaagtgcaaggcttgcggacgcggttttacccagagcgccagtctgcttcagcactggagggtgcattccgactggcgcgaaacgctgtcactgagtcccgttcggcaagacctgctgtggccgctacaaccccaccaggcaccagcaagtcccctagggcggtcacatagttctgcaggtgtgcgccagggattttcagggcagctctgctgctggctgacgaaggagcatactctggccgaagctctacgattaagcccggtgccagctggcttttgggggcctgtcgaggcagaccgccctcctgcaaattcccatagacgggtatgtccattctgttgttgctcctgtggagattccgtcaatgagaaaacatctctgtcgcagagagtcctgcctcatcccggcgaaaaaacctgtagaggaggcagtgtcgagagtgtcagtcttgcacccagtagtgtcgccccagactccacctctggcttgaggccatgtgggagccctggctcatttttacaacacctgccaccttcaaccctgctgcctagacccccatttctgtatcccggcccccctttatctttacagccattggtacctagtggcctccctgcagtccctgcagtccccctcgggggactggaggtcgcccaagtccctcccgctacacagcctgcagcccagcaggagggagccatgggcccaaggtcatgcgcaagtgcaggcagagatagtagagaagcagtgcaggctccaggataccccgaacccgctcggaaagcctcccaacacagagccgccgggcctctgggagaggccagggcccgtctgcagcgccagtgtcgggcccccccgcccccttctaacccacactggaggggggcactgccggtcttccctgtttggaaggccagtagtcggcgctcaaatctagcaaggcactag

SEQ ID NO: 52629 - DNA, 1788 bp, Artificial Sequence
  Description of Artificial Sequence: Synthetic coding sequence
atgggccccctgaccttccgggacgtggccatcgagttcagcctgaaagaatggcagtgcctggacactgctcagagaaacctttacaggaatgtcatgttggagaattataggaacctggtgtttctcggtattactgtgtccaaacccgacctgatcacttgtttggagcagggcaaggaggcgtggtccatgaagaggcacgaaattatggtagcaaagcctacagtgatgtgctcacacttcgctcaggatctctggcctgagcaaaacatcaaggactcgttccaaaaggtgaccctgaagcgctatggaaaatgtaggcacgagaatttgccgctcaggaaaggatgcgagagcatggatgagtgtaaaatgcataaggggggttgcaacggcttgaaccagtgtctcactgctacacagtctaaaatattccagtgcgacaagtacgttaaggttgctcacaaattctccaattccaatcgtcatgaaattcgccacaccaagaagaagccattcaagtgtacaaaatgtggcaaatctttcgggatgatctcttgcctgaccgagcacagccggatccacacaagggtgaatttttataagtgcgaagaatgtggcaaggccttcaactggagttccactttaactaagcacaagagaattcacacaggcgagaagccctataagtgcgaggagtgcgggaaggccttcaatcaatctagcaatctgattaaacacaaaaagatccataccggagagaaaccatataaatgcgaggagtgcgggaagaccttcaaccgattttccacactgactactcataaaataatacatactggcgaaaagccgtataaatgcaaggagtgtggaaaagctttcaacagatctagcacgctgaccacgcatagaaagatccatactggagagaagccatacaaatgtgaagagtgtggaaaagctttcaagcagtcaagtaatctcacgacccataagataatccatacaggcgaaaagccatataagtgcaagaagtgcgggaaagcttttaaccaatctgcccacctgaccactcacgaagtcattcacacaggtgagaaaccgtataaatgcgaaaaatgtggaaaagcttttaatcacttttcccaccttacaacacataaaatcattcatacaggagaaaagccgtacaagtgcaaagagtgcggcaaggcgttcaaacacagtagtactttgacgaaacataaaattatacacaccggagaaaaaccgtataaatgtaaggagtgtgagaaagcctttaaccaatcaagcaagctcactgaacataaaaagatccatactggagagaaaccgtacgagtgcgaaaagtgtgggaaggcattcaaccagtcatctaacttaacacggcataagaaatcgcacactgaggagaaaccttacaagtgtgaagaatgtggaaagggttttaaatggccatcaacattgactatccacaaaatcatccacaccggcgagaaaccgtacaagtgcgaggaatgtgggaaggccttcaaccagagctccaaactgaccaaacacaaaaagattcataccggtgagaaaccttatacatgtgaggaatgtggcaaggcgtttaatcagtcgagtaatctgacaaagcacaaaagaattcataccggcgaaaagccttataagtgcgaggaatgcgacaaggcctttaagtggagttccgtgctcaccaagcacaagatcatccacacaggggagaagcttcagatatag

SEQ ID NO: 52630 - DNA, 3273 bp, Artificial Sequence
  Description of Artificial Sequence: Synthetic coding sequence
atgaacatggagggcctggtgatgttccaggacctgagcatcgacttcagtcaggaggagtgggagtgcctagacgcagcccaaaaagatctttacagagacgtgatgatggagaattatagttcgctagtgtccctagggttatccattcctaaaccagatgtcatttctctgctggaacagggcaaagaaccatggatggtttccagggacgtcctgggaggctggtgtcgcgatagcgagtttaggtgcaaaacaaaggactcctgtctgcctaaggagatatatgaagtgacctcaagtcagtgggttaggatggaaaaatgccattcactggtgggtagttccgtccgagatgattgggagtgtaaagggcagtttcagcaccaggatatcaatcaagagcggtatcttgaaaaagcaattatgacatatgagaccactcccaccttctgtttacaaacttcactcaccctacaccaccggatccatcccggcgagaaactgtacaaaagcacagagtgtatggcattcaaatacggcagcgagttaactcaacagcaggagacccacacaggtgaaaagctttataaatgcaaagagtgcggaaaggcatttcaccacttctcctacctcgtgaaacaccagcggatccacacaggggaaaagccatgtgcctgcaaggaatacggcaaggcttttatcagtggctcacatctcattcagcaccaaaagatgtacacagacgaacgtcctcacgaatgtcaggaatccgtaaaagcctttagaccctctgctcacctgatccagcactggcgcattcacaccggcgataaaccctatgagtgtaaggaatgtggtaagtctttcacgagcggctctacattaaaccagcaccaacaaatccatacaggtgagaaaccttatcactgcaagcaatgcggcaaatcgttcactgtaggttctaccctgatccgtcaccaacagatacatacaggagagaaaccttacgattgtaaggagtgcggcaaaagttttgcgtctggctcagcgctcatcagacaccaacggatccataccggcgaaaaaccgtatgattgtaaggaatgcggcaaaagttttaccttccatagtgcgcttatccgccatcaaagaattcacaccggagagaagccctatgattgtaaggagtgtgggaagagctttacattccggagtggtttgatcggccaccaggccatacatactggagagaagccctacgattgcaaggaatgtggaaagtcgttcactgctgggagcacactgatacagcaccagagaattcatacgggggagaagccatatgactgtaaggaatgcgggaaaagcttcgcaagcggcagtgctctccttcagcaccagcggattcacactggtgagaagccttattgctgtaaagaatgcgggaagtcattcacgttcaggtcaacccgaaatagacatcagagaatccacactggggagaagccttacaactgtaaggagtgcggaaagtcgttcgcctcaggctccgctctgttacagcatcagaggatccatactggcgagaagccttaccattgcaaggaatgcgggaaaagttttacgtttaggtccggtcttattgggcaccaggcagttcatactggagagaagccttacgactgcaaggagtgcggaaagtctttcacatcacgtagcgctcttatccagcaccagagaattcataccggagaaaagccatatcactgcaaggagtgtgggaagtcatttactgtgggctcaacacttttgcagcatcagcagatccacaccggcgaaaaaccttatgactgtaaggagtgcggtaaggcttttcggctgagactaaggcttacacagcatcagcaaattcatacaggtgaaaagccttaccagtgtcaagagtgtggaaaggcgttcgtatccgtctctggattgacgcagcatcacaggattcataccggtgagaaaccatatgaatgtcccgactgcggcaaggcgttccgccagcgaacgtaccttaaccagcaccgcagaattcacactggagaaaagccctatgaatgtaaagagtgcggaaaaagttttacgttctgcagtggtttgatccaacatcaacagaatcacacagacgaaaagccttacgatggcaaagaatgcgggaagagtttcacctctcattctacactaattcagcatcaacaaatccacaccggcgagaagccgtatgactgcaaggagtgcgggaagagtttcacgagtcactctacgctcatccagcaccagcagatacacaccggtgagaagttgtatgactgtaaagagtgcgggaagagctttacttcacactctacactgatccagcaccagccactgcacacaggggagaagccctatcactgtaaggagtgcgggaaatcctttactctccggagcgccctcatccagcacaggcccgtgcacacaggggaaaagcggtactcctgtaaagagtgcggcaagagctttacaagtagaagtacacttattgagcatcagcgtattcataccggagaaaaaccttatcattgcaaggaatgcggaaaatctttcgcctttcgctcggccatcatccagcacagaaggatccatactggcgagaagccgtacgactgtaaagagtgcgggaaagctttcagacgccggtccaaactcacgcagcatcaaaggattcacacaggggagaagccatataggtgtcatgagtgtggcaaggccttcgtgaggtttagtgggttaactaaacatcattccatccatacgggagagaagccatacgagtgcaagacatgtggaaaatctttcagacagcgaacccatctgacactgcatcagaggatacatactggcgatcgaccatacgagtgcaaggaatgtggcaaaagcttcacctgcggctccgagctgatcaggcatcaaaggactcatacgggagaaaagccctatgattgcaaggagtgcgggaaggcattccggtgccctagtcagctaagccagcacaagcggattcacactggggaaaagacctaccagtgtccggagtgcgggaaggcatttttctacgcgtcaggactttcccggcaccagtccgtgcataccggcgagaagccctatgagtgtaagacctgtggaaaggccttcaaacagctgacccagctgacacggcatcaaagaatccacgaccttacgtag

SEQ ID NO: 52631 - DNA, 1593 bp, Artificial Sequence
  Description of Artificial Sequence: Synthetic coding sequence
atggtgcggccccaggacaccgtggcctacgaggacctgagcgaggattacacacagaagaagtggaaaggcttggccctgtcccagcgcgcacttcattggaatatgatgctcgagaatgacagaagtatggcctccctcggtcgaaacatgatggagagttccgaattaacgccgaagcaggagatctttaaagggtctgaatctagtaatagcacctccggaggattgtttggcgtagtgccgggcggaacagagaccggggatgtttgcgaagacaccttcaaggaactggaaggccagcctagtaacgaggaaggtagtcgccttgaaagcgattttctggagatcatcgatgaggacaagaagaaaagcactaaggacaggtacgaggaatacaaagaagtggaagaacacccaccactgtcatcgtcacccgtagagcacgagggcgtgctcaagggtcaaaagagctaccggtgcgacgaatgtggcaaggccttctactggtcatctcatttgataggacaccgccggatccacacgggggagaagccctatgaatgtaacgagtgtggtaagaccttccgtcagactagtcagctaattgtccacctgagaacccataccggtgagaagccctatgaatgctccgagtgtggaaaggcttatcgccattcaagtcatctcatccaacaccaacggcttcataacggcgagaagccctacaagtgtaacgaatgcgcaaaagcctttaatcaatccagcaagttgtttgatcatcagcggacgcacactggagaaaaaccatacgaatgcaaggaatgtggagccgccttctccaggtccaaaaatctggtccgtcatcaattcttacacactggaaagaagccttataagtgtaatgagtgtggaagggccttttgttccaataggaacctgatcgaccatcagcggacccacacaggcgaaaagccttacaagtgcaacgaatgcggcaaagcattctccagaagcaaatgtctgatccgtcatcaaagcctccacaccggagagaaaccgtacaaatgctccgagtgcggcaaagccttcaaccaaatcagtcaattggtggagcatgaacggatccataccggagaaaagccattcaaatgttccgagtgcggcaaagcatttggtttgagcaaatgcctcatcaggcaccagagactccacacaagcgaaaaaccctataaatgtaatgaatgcggtaagagcttcaatcagaactcgtatttaatcatccaccaaaggatacatacaggcgagaagccttatgaatgcaacgaatgcggtaaagtcttctcttataactcctcgcttatggtacatcagagaacccacaccggcgaaaagccgtacaaatgtaatagttgcggcaaagccttttccgactcctcccagctcaccgttcaccagcgagttcataccggtgaaaagccttatgagtgcattgaatgtggcaaggccttttcccagagaagtacctttaatcaccaccagaggacacatgccggagaaaaaccgtctgggctggcacgatcctcatcttag

SEQ ID NO: 52632 - DNA, 1632 bp, Artificial Sequence
  Description of Artificial Sequence: Synthetic coding sequence
atggtgcggccccaggacaccgtggcctacgaggacctgagcgaggactacacccagaaaaagtggaaggggcttgctctctctcaaagggcgctacactggaacatgatgcttgaaaacgatagatccatggccagtctgggtcgcaatatgatggagtcctccgagctaacacctaagcaagagatttttaaggggtccgaaagttccaacagcacaagcggcggtctgtttggtgtagtgcctggcggcacagaaaccggggatgtatgcgaggacacctttaaggagctggagggccagccttcaaatgaggaagggtcacgcttggagtccgactttctcgaaattatcgacgaggacaagaagaaaagtacaaaggatcggtacgaagagtacaaggaggtcgaggagcacccgccgttgagtagctcccctgtggaacacgaaggcgtgctgaagggccagaagagctatagatgtgacgaatgcggcaaagccttctattggagtagccaccttatcggccatagacggatacatacaggggaaaaaccgtacgagtgtaacgagtgtggtaaaacttttcgccagacatcacagctgatcgtccacctgcggacacatacaggagagaagccatacgaatgcagtgaatgcggcaaagcttaccggcacagttcccatctcattcagcaccagcgcctgcataatggcgagaagccgtacaagtgcaacgaatgcgccaaggccttcaaccaatccagtaaactgttcgatcatcagcgtactcacactggggagaaaccttacgaatgtaaggagtgtggtgccgctttttcacggtcgaagaacctggttcggcaccagtttctgcatacaggcaagaagccgtataagtgcaatgaatgtggacgtgccttttgcagcaatcggaacctaattgaccatcaacgaacgcacaccggagaaaagccatacaagtgtaacgaatgcggaaaggctttttctagatcgaaatgtttgattcggcaccagagcctccacacgggtgagaagccctacaaatgttccgagtgcggtaaagcctttaaccagatcagtcagctggttgaacacgagaggatacacacaggagaaaaacctttcaaatgtagcgagtgcggaaaggccttcggtctcagcaaatgtctcattcgccatcagaggctgcatacctctgaaaaaccttacaagtgtaacgagtgtgggaagtcttttaaccaaaatagctatctaataattcaccagagaattcacacaggagagaaaccatatgagtgtaatgaatgcggcaaggttttctcatacaatagttctctgatggttcatcaacgcacacatacaggcgagaaaccctataagtgcaactcttgtgggaaagctttttccgatagctctcagctcaccgtgcatcagcgggtacacactggcgaaaagaatctcatgaacgtactttccgtaggaaaacctctcgtgtctgttcccctcctgattaccacatctgagttgatgcttgagcggtccccgcaagtctggctgggacatttattgaaagcttggttcagcgaaacagattccaaggacctatag

SEQ ID NO: 52633 - DNA, 1980 bp, Artificial Sequence
  Description of Artificial Sequence: Synthetic coding sequence
atgctgcaccagcccacccccggcaaccggggcctgaccgcccggatggaagtagggcctgccaccgaaacattcgtgctagagctgcagtgtctggaggacggcggtcccggcccagacaccctgagtggcggttcaggcggtagcgaatctcaagaagaggaggagcctcaggaacgaaatagctctccccaacgaccagccgtttcagcccccgtgggcgcatccgagatagccgaggagactcggcccgggcagcgggagctgcagctgcagcagctggagcagcaaccagagccccagcagcagccacagcatgaacaattacaacagccacaaccccatctggagctgcagcagcagcctcagcaggatggccagcaacagctgagtcagctccagcaggaaaagcatcaatcagttcaccaccaggagcttaagcctgagctccagttgatgcaccagcagcagcagctccagccccagcaggtgcaggagcagcaacggctgcagcagcaacaagagcagctacaaacgcagcaggcacaggaacagcaggtcctgcagcagcaggaacagctacagcagcaggttcaggaacagcagttattacaacagcaacaggagcaactgcaacagcagcagctgctacagcagcaggaacagcttcagcaacagcaatttcaacagcagcaggaacagttacaacagcaacagcagctcctgctcctccagcagcaggggcaacttcaacagcagctcttacagcaacagcaggcacagctccagcagcaattacttgagcaacaacaggcgcagctgcagcaacagttgctgcttcagcaacaggaacagttgcagcagcagcagcagcagcagctactacagcagcagcaggagcaactgcagcaacagcagctgcagccccctcccttagaacccgaggaggaggaagaggtcgagctggagcttatgccggtggatctaggcagtgaacaagagttagagcagcagcgccaggagctcgaaaggcagcaggagttagaaaggcaacaagagcagaggcaactccagcttaagctgcaggaggagcttcaacagctagaacaacaactggagcagcagcagcagcaactagaacagcaggaggtgcaactggagctcacccccgtggagctgggtgcacagcagcaggaggttcagctggagctgactccagtgcagcccgagctccaacttgaattagtgcccgcggcgggaggtggcggggcagccgtgcctggcgcccccgccgccgtggtggtcgctcccccaggttacgttgtagtgcaagaacttatggtcctaccagctgtggccgcccctgctgtcgtggccattcctggtccggccggctccgcagcactcacccctgctcgccagcggcggagaagacgcgcccgcgaccgtcctaccatctgcggcgagtgtggcaagggcttctccagatccactgatttagtgagacatcaagcgacgcacaccggggaaaggccacacagatgcggagaatgcggcaaaggcttcagccaacacagcaatctcgtcacacaccagcgcatccacacaggcgaaaagccatacgcctgtagctattgtgctaagcgcttctcagagtcctctgctctggtgcaacatcagcgcacccatactggggagcgcccctatgcctgtggcgactgcggcaaacgttttagcgtgagctccaacctcttaaggcacaggagaacacatagtggagaaagaccctacgtgtgcgaggactgcggggagcggttccggcacaaggttcagattcgccgacatgagcggcagttgcatggtgccgggagatcaagagggctgggcctactgcgcgccagcaggccagctgcactcgggggccccgctagagctgagcaggccgcaaccgctaccgcccctgctgacaaggcactctag

SEQ ID NO: 52634 - DNA, 3180 bp, Artificial Sequence
  Description of Artificial Sequence: Synthetic coding sequence
atggaggccaaccccgccggcagcggcgccggcggcggcggcagctcagggattggtggggaggacggggtgcactttcaatcttacccctttgactttctggagtttctgaaccatcaaagatttgagcctatggaactgtatggtgaacacgccaaagccgtggccgcactcccgtgcgctccaggacccccaccacagccccccccgcagccccccccacctcaatacgactatccacctcaaagtactttcaaaccgaaagccgaagtcccttcgtcttcaagcagctccagctcaagctcaagctcatcttccagctcatcctctagctcctctagttcatccagccaggcgaagaagccagatcctcccttgccgccagcgtttggcgcaccccctccccccctgttcgatgctgcttttcctaccccccagtggggaattgtcgacctatccggccatcagcacttattcggtaacctcaaaaggggaggtcctgctagcgggcctggcgtcacgccaggcctcggcgctcccgctggcgctcccggccctctgccagccccttcccagactcctccagggccgcctgccgccgcagcttgcgatcctacgaaagacgataaaggctacttcagacgccttaaatacctcatggagcgtcgatttccatgtggcgtgtgtcagaagtcattcaaacagtcctctcaccttgtgcagcatatgctagtgcacagcggcgagcgcccctacgagtgcggtgtttgcggccgaacttacaaccacgtgagcagtctgatccggcaccgccggtgccacaaagacgttccaccagccgcgggtgggccaccccagcctggtcctcaccttccccctctgggcctccccgcccccgcggcaagcgctgcaacagccgccgcgccaagcactgtgtcttcaggcccccccgccacaccggtcgcacctgccccaagcgccgacggcagcgccgctcccgctggcgtgggtgtccctcctcccgccacaggaggcggggatggacccttcgcttgtcctttgtgttggaaagtttttaagaagcctagccatctacaccagcaccagataattcacacaggggaaaaacctttttcctgcagtgtgtgttccaagtctttcaatcggcgcgaaagccttaaaaggcacgtgaagacccacagcgccgatctactgcggcttccatgcggcatctgcggcaaagccttccgtgacgcaagctacctgcttaagcaccaggccgcccacgctggtgccggcgctggcggtccccgaccagtttatccctgtgacctttgcggaaagagttactccgcgccacagtccctcctgaggcataaggccgcacatgcccctcccgccgcagccgcagaggctccaaaggatggcgccgcttccgccccacaacctccccctaccttcccgccaggtccttacctgcttccaccagaccctccaacaaccgattctgagaaagcagctgccgccgcagctgccgtcgtgtacggtgccgtgcccgtgccactgctgggcgctcatcctttactcctcggcggtgcaggcaccagcggcgcaggcggttctggggcatcagtgcctgggaagacgttttgttgtggaatttgcggtagaggatttggccggcgtgagaccctcaaaagacacgagcgaatccatactggggaaaagccgcaccaatgccctgtgtgcgggaagcgcttccgggaatccttccacctgtcgaaacaccacgtcgtgcatacaagagaaagaccttacaaatgtgagttgtgcggcaaggtgtttggataccctcagagccttactaggcaccgccaagtccatcgtctgcagttgccttgcgccctggctggggccgccggccttccttccactcaggggacacccggagcatgcgggcctggggctagtggcactagcgccggaccaacagatggactgtcttatgcttgcagcgattgtggagagcatttcccagacttattccacgtgatgagtcacaaggaggtgcacatggcggagaaaccatacggttgcgatgcttgcggcaaaacatttggctttatcgagaatttaatgtggcacaagctagtgcaccaggcagcccctgaacgcctgcttccaccagcccccggaggtcttcaaccaccggacggtagctccggcaccgacgccgcaagtgtcctcgacaatggactggctggagaagttggcgcagccgtggctgctctggcaggcgtgtcgggaggagaggacgctggcggtgctgcagttgccggcgcaggtggtggcgctagctccggccccgaacgctttagttgtgcaacctgcggccaatctttcaagcattttcttgggctggtgacccataaatatgtgcatctggtccgcaggaccctgggctgtggcctctgtggtcagtcatttgcgggcgcttatgacttattactgcataggcggagccataggcaaaaaagaggctttcgctgccccgtgtgcggaaaacggttctgggaagccgccctgctgatgcgccatcaacgctgtcacactgaacagcggccctatagatgcggagtctgcggtaggggattcctccgtagctggtaccttcggcaacacagagtggtgcatacaggcgagagggcctttaaatgcggagtgtgcgccaaaaggtttgcacagtcttcctccctagcggaacataggagactccatgcggtggcccgcccacaaaggtgcagcgcctgtggcaagaccttccggtatcgtagtaacctgctagagcaccaacgactgcaccttggagagcgggcgtataggtgtgaacattgcggcaaaggctttttttacttaagcagtgtgctgagacaccaacgcgcacatgagccccccagaccagaactccgttgtcccgcttgtctcaaagctttcaaagacccgggctacttcaggaaacacctggctgcacaccaaggggggagaccattccgctgctcaagctgcggcgagggtttcgctaatacctacggcctgaaaaagcatcgcctggcgcacaaagctgaaaacctgggaggtcctggcgctggcgctggaacattggctggtaaagacgcttag

SEQ ID NO: 52635 - DNA, 1596 bp, Artificial Sequence
  Description of Artificial Sequence: Synthetic coding sequence
atggacagcgtggccttcgaggacgtggccgtgaacttcacccaggaagagtgggcactactggacccgagccagaaaaatctctatagggaggtgatgcaagagacactgaggaatctgacgtccatagggaagaaatggaataatcaatacatagaggatgaacaccagaatccacgaaggaacctgaggagactaatcggcgagcgcctgtctgagtccaaggagagtcaccagcacggggaagtgctcacacaagtcccggatgacaccctgaaaaagaaaacaccgggtgtgcagagctatgagtcctccgtctgcggcgaaatcgggataggcttgtcgagccttaaccggcacctgcgggctttctcttatagtagctccctcgcaattcatgggcggactcataccggagaaaaaccttacgagtgtaaggagtgcgggaaggccttcaggttcccctccagcgttaggcgacacgaacggattcactctgccaaaaagccctatgaatgtaaacagtgtggaaaggctttctcattccctagctcagttcgaagacacgagaggatccactctgccaaaaagccctacgagtgcaagcagtgtggaaaagcccttagctatctcgtcagtttccagacgcatatgcgcatgcacaccggcgaacgcccccataagtgtaacatctgtggtaaagccttttttagtccctcctcactcaaaagacatgagaagagtcacaccggcgaaaaaaggtacaagtgtaagcagtgcgataaagcgtttaattgtccatcctcttttcaatatcacgaaaggacgcatagcggtgagaagccttatgaatgcacccagtgccgaaaagcttttcgcagtgtcaaatatcttcgagttcacgaaagaaagcacaccggagagaaaccgtatgagtgtaaattgtgtgggaaaggttttataagcagcacctctttccgatatcacgagaagacccatactggcgagaagccatatgaatgcaaaaaatgcgtgaaggcgttttcatttgttaaggatctgcggatacacgaaagaacgcataccggggaaaaaccttttgaatgcaaacagtgtgggaaaactttcacatccagtaattccttccactatcatgaaaggacgcacaccggagagaagccatacgagtgcaaacaatgtggcaaagccttccgttcagcctccgtactgcagaagcatattaggacacatacgggcgagaaaccatatggatgtaaacaatgtggaaaagtttttagagtagctagtcagctgaaaatgcacgaaagaactcatacaggcgaaaagccgtacgagtgtaagcagtgcggaaaagcctttatttcttctaacagcattcgctaccacaagagaactcacaccggcgagaagccatacaagtgcaaacaatgtggcaaggcattcatctcatctaattcattcctgtatcatgagcgcatacataccggagagaagccgtatgaatgcaagcagtgtggaaaggcttttaggagcgcctccattctgcagaagcatgtacgtacacacgccgggtag

SEQ ID NO: 52636 - DNA, 297 bp, Artificial Sequence
  Description of Artificial Sequence: Synthetic coding sequence
atgctgcggcggggccacctggccttccgggacgtggccatcgagttcccgcaggaggagtggaagtgtctggatcctgcccaaagaactctctatcgggaagtgatggtagaaaactatcgcaatctggtcttcctcggcatatgcctgcccgatttgtcggtgataagcatgcttgagcagagacgcgacccccggaatctgcagtcagaagttaagatcgctaataatccgggatcatgcagtgttacacaggccgtggtggagtggcaatcaagtgttgccatcgtggcctag

SEQ ID NO: 52637 - DNA, 1734 bp, Artificial Sequence
  Description of Artificial Sequence: Synthetic coding sequence
atgctgcggcggggccacctggccttccgggacgtggccatcgagttccctcaagaagagtggaaatgtctcgaccctgcacaaagaaccctttaccgggaggtgatggtagagaattaccgcaacctcgtctttctcggcatctgcctgcccgacctgtccgtcatctctatgctggagcagcgccgggacccacgtaatctgcagagtgaggtcaagatcgcgaataatcctggcggccgcgagtgtatcaagggggtcaatgcagaaagttctagcaagttgggttccaacgccggcaacaagtctcttaagaatcaactcggactcacattccagctgcacctgtcagaacttcagctttttcaggcagaacgcaacatttccggttgtaagcacgtggagaagcctattaacaattctctggtgagccctctgcaaaagatttattcctcggtgaagtcacacatcctcaataagtaccgtaatgactttgacgattcccccttcctgccccaagagcagaaggcccagatccgggaaaagccgtgtgaatgtaatgagcacggaaaggcctttagagtaagttctcgactcgccaacaaccaggtgattcacacagcagataatccctataaatgtaatgagtgtgacaaggttttctctaattcctcaaatctcgtgcagcaccagcgtattcacactggggagaaaccttacaagtgtcacgagtgtgggaaactgttcaatagaatatcactgctcgcgagacatcagcgcatccacaccggggagaagccttataaatgtcacgagtgtggaaaagtgttcacacagaactctcatcttgcaaaccaccacaggatacacactggcgaaaaaccctacaagtgtaacgaatgcggcaaagtttttaatcggaatgcccacctagctcgccatcagaaaatacactctggcgaaaagccatataagtgtaaggagtgtggaaaagccttctcaggaggttccggtcttacagcacatttggtaatccataccggggagaagttatacaaatgcaataaatgtgggaaagtttttaatcgaaacgcacatcttactcgacatcaacgcatccacacaggagaaaagccctatgaatgcaaagagtgcggaaaggtatttcgccacaagttttgtctgaccaatcaccaccggatgcacacaggtgagcagccttacaagtgcaacgagtgtggtaaagcgttccgcgattgctccggattaacggcccatctcctcatacacacaggtgagaagccatataaatgcaaggaatgtgcaaaagtttttaggcacagattgtcactaagcaatcaccagcgcttccataccggggagaagccttaccggtgcgacgagtgtggcaaggactttaccagaaatagtaatctcgctaatcatcacaggattcataccggagagaaaccatacaagtgctcggaatgccataaggtgttcagccataacagccacctggcaagacatagacagatccacactggtgaaaaatcttataaatgtaacgaatgtggcaaagtcttttctcataaattgtacttaaaaaaacacgagcgaatccacaccggcgaaaagccttataggtgccacgagtgtgggaaggactttactaggaattccaatctggccaaccaccacagaatacacacaggcgagaagccctatcggtag

SEQ ID NO: 52638 - DNA, 1635 bp, Artificial Sequence
  Description of Artificial Sequence: Synthetic coding sequence
atggccgtgatggacctgagcagcccctgggccctgaccaagcaggattccgcctgcttccacctgcgcaacgccgaagaagagcgcatgatcgccgtcttcttaacgacatggctccaggaacctatgacattcaaggatgtggctgtagagtttacacaggaagagtggatgatgttggatagcgctcagcgaagtctctaccgtgatgtgatgctggagaattacaggaacctgacatctgtagagtaccagctatataggttgaccgtgatttcccctctggaccaagaggagattagaaatatgaaaaaacgcattccccaggccatttgtcccgatcagaagattcaacccaagactaaggaatctactgtgcagaagatactttgggaagaacccagcaatgccgtgaagatgatcaagctaaccatgcataattggtcatctactctgagagaagactgggagtgtcacaaaataaggaaacagcacaaaattcctggtggacattggcgtcagatgatttatgccccaaagaaaactgtgccgcaggagctgttcagagactaccatgagctggaagaaaactccaagctgggaagtaaattgatcttcagccagtctatctttacttctaagcactgccaaaagtgctattcagagattggttgcttaaaacacaactctatcatcaataactacgtaaagaattcgatctccgagaagctctacgaatcacatgagtgtgacacgactctctggcacttccagagaaatcaaactgtccagaaggagtacacgtatagcaagcacggcatgcacttcacgcataatatgttcccagtgcctaataacctgcacatggctcagaacgcttgcgagtgcaataaagatgaaacgctgtgccaccagtctagcctgaaaaaacaggggcagacccacacagagaaaaaacacgaatgcaatcaatgtggaaaagcatttaaaaggatcagcaacttgacactatacaaaaagtctcatatgggcgagaagcagtatgagtgcaaagaatgcggaaaggtgtttaacgactccagcacactgcgaagacacgtgcggacgcacacaggggagaagccctacgagtgcaaccagtgtggcaaagccttttcacagaaaactagcttaaaagcccatatgcgcactcacacaggggaaaagccttatgagtgtaatcaatgtgggaaatcgttcggcacctccagctatctgatcgtgcataagaggattcatacaggagagaagttgtacgagtgctcagagtgtgggaaggctttcaacacaagctcccacttgaaagtgcacaagaaaatccacacaggggagaacgtttacgagtgcagtgactgtggtaaggtgttctctggggtctcctccctgaggatgcacatcagaacacatacgggagaaaagccgtacgaatgcaaggagtgccggaaggccttctccgtctcctcgtcactgcggagacacgtgagaatccacactggggagaagccttacgagtgcattcagtgtggtaaagccttttcacagagctccagccttattatacacaagcggattcataccgaacgggagacactgtag

SEQ ID NO: 52639 - DNA, 2820 bp, Artificial Sequence
  Description of Artificial Sequence: Synthetic coding sequence
atggccaccagccagtacttcgacttcgcccagggcggcggcccccagtattctgcacagcctcctacactccctttacccacagtcggcgcgtcatacaccgcccagccgaccccaggaatggatcctgccgtcaaccctgcattcccacccgcagccccagcaggctacggcggctaccagccccattcaggccaggattttgcttacgggtctagacctcaggagccggtaccgaccgcgactaccatggctacatatcaggactcatacagttacggccagagtgcggctgccagaagctacgaagaccggccatactttcaatctgccgcccttcagtcaggacgcatgacagccgcagattctggccagcctggcactcaggaggcatgtggccagccgtcaccccacgggagtcactcacacgcgcagccgccccagcaggcccctatcgttgagtctggccagccagcttccactctgtctagcggatatacatatcccactgctacaggggttcagccagagtccagtgcatccattgttacctcttatccgccaccctcctacaacccgacctgcacagcttacacggctccctcgtaccctaactacgacgcatccgtgtactcagctgctagtccattctatccccctgcccagcccccacctccaccaggtcctccccagcaactccctccacccccagcccccgctgggagcggctcaagtccgagggcagacagcaaaccgcctctgccatccaagctccctaggcccaaggccgggcctcggcagctgcagttgcattattgtgatatctgcaagatctcctgcgccggcccacagacttacagagaacatctgggaggccagaagcataggaaaaaagaagctgctcagaagactggggtccaacccaatggatccccccggggggtgcaggcccaactgcattgcgacctctgcgctgtcagctgtaccggtgctgacgcttatgctgcccacatccgcggctcaaaacatcagaaagtctttaaactgcacgctaagctgggcaaacccattcccacactcgagcccgcactggccactgagtcaccccctggagctgaagccaaacccacctccccaacgggcccgagcgtctgtgcaagcagcaggcctgccctggctaaaagaccggttgctagcaaagctttatgtgaaggtcccccagaacctcaggctgcgggatgcaggccccaatggggcaaaccagcacagcccaagcttgagggccccggggctccaacccagggtgggtctaaggaagctcccgcaggttgcagcgatgcgcagccggtcggaccagaatatgtggaggaggtgttcagtgacgaaggacgggtgcttaggttccactgcaaactgtgcgaatgcagtttcaatgatctgaacgccaaggacctacacgtgagaggcagacgtcatcggctccaataccgcaaaaaggtgaatcccgacctgcccattgctacagaaccctcctcaagagctagaaaggtcctcgaagagcgaatgcgcaaacagcggcatcttgccgaggaacggctcgagcagcttagacgctggcatgctgagcggagacgtttagaagaggagcccccccaggatgtgccacctcacgcacctccagattgggcccagccgttacttatgggccgaccagaatctcccgctagcgctcccctgcaacccggccgtaggcctgcctcttcagatgaccggcatgtcatgtgtaagcatgcaacaatctatcctacagaacaggaacttttggctgtccagcgagccgtgtcccacgctgaacgggccttgaaactcgtcagcgatactctggcggaagaggatcggggaagacgggaggaagaaggggacaaacgctcttccgttgctccgcagactcgggtgctgaagggagtgatgagggtgggaatcttggcaaaaggcctgctcctgaggggtgacaggaacgtgagactggccctgttatgtagcgagaaacctacgcactctctgctgaggcgcatagctcagcagctccctcggcagttgcaaatggtgaccgaagatgagtacgaggtgtcttcagatcccgaggcaaatattgtgatttccagctgcgaggaacccaggatgcaggttaccattagcgtgacgagccccttgatgcgggaggacccttcaacagaccccggagttgaggaaccccaagccgacgccggcgacgtcctctctcctaagaagtgcttggagtctctagcagctttgcgacatgcaaggtggttccaggccagagcgagcggcctgcagccttgtgttatcgtcatccgtgtgctgcgagacctctgtagaagggttccaacatggggcgccttacctgcttgggcaatggaactattggtagaaaaggccgtgtctagcgcggcgggtcccctgggccccggagacgccgtgagaagagtgcttgaatgtgtggcaacaggcacactgctgacagacggccccggacttcaggatccctgtgaaagggaccaaaccgacgcattggaacccatgaccttgcaggagagagaggatgtgacagccagcgcccagcatgccctgcgtatgctggcctttcgacagactcataaagttctcgggatggacctacttccgcccagacatcggctgggggcgaggtttaggaagcggcagcggggcccaggcgaaggcgaagaaggcgctggcgagaaaaaaagaggaaggaggggaggtgaaggactcgtgtag

SEQ ID NO: 52640 - DNA, 1101 bp, Artificial Sequence
  Description of Artificial Sequence: Synthetic coding sequence
atggccaccagccagtacttcgacttcgcccagggcggcggcccccagtattctgctcagcctcctacgctgccattgcctactgtcggagcttcctacactgctcaacccacccccgggatggacccagccgtgaatcccgcctttccacccgctgcccctgccggttatggcggctaccagcctcatagcgggcaggattttgcctacggctccagaccacaagagcccgtgccaacagcaaccacaatggctacatatcaggattcctacagctacgggcagtctgccgctgcacggtcctacgaggacagaccctactttcagtccgctgccctgcaaagtgggaggatgaccgcagcggattcaggccagcccggcacgcaagaggcatgtggtcagccatcccctcacggtagccattcccatgctcagcccccacagcaggcacctatcgtcgaatcgggacaacctgccagcacattgagctctggttatacatatcccacagccaccggcgtgcagcctgaatcctccgccagtattgtgacatcctatcccccaccgtcatacaacccaacctgcaccgcctacacagcacccagctaccctaactatgatgcgagcgtgtacagcgcagcgtctccgttttatccgccggcacagccccctccccccccgggccctcctcagcagctacctcctcctcccgcccctgccggaagcggaagctctccccgggcagacagtaagcccccactgcccagtaagttacctaggcctaaggccgggccacggcagctccagctccattattgcgacatctgcaagatttcctgcgccggaccccagacttatcgcgagcatcttggtggccaaaagcaccggaaaaaggaggcggcccagaagactggagtccagccaaatgggtctccccgcggggttcaggcacagctgcattgcgacctatgcgcggtgtcttgtactggggcagacgcgtatgccgcccacatcaggggaagcaagcaccagaaggggttgctctcgcaccggcaacaggccgcagacccctccggggggaatcaacccaatctgaattag

SEQ ID NO: 52641 - DNA, 213 bp, Artificial Sequence
  Description of Artificial Sequence: Synthetic coding sequence
atggccaccagccagtacttcgacttcgcccagggcggcggcccccagtactctcccgaggtcgaaaccactccccccgccctggccagtggactgccatgtgcacttccatggacagtgggttgctcaggcagcgacgcggtgaccgccctctgtcccagcctccgcggactcgcctgcatatgttctatcctttgggatcctgcctggtag

SEQ ID NO: 52642 - DNA, 843 bp, Artificial Sequence
  Description of Artificial Sequence: Synthetic coding sequence
atgctgagctgcaacatctgcggcgagaccgtgaccagcgagcccgatatgaaagctcatctgattgtgcatatggagtcggagattatatgtcccttctgcaaattaagcggcgtgaattatgatgaaatgtgctttcacatcgagaccgctcacttcgaacaaaatacactggaacgtaatttcgaacggattaatacggtccagtacggcactagcgacaataaaaaagacaacacgctgcaatgtgggatggaggttaactcatctatattgagcgggtgtgcctcaaaccatcccaaaaattcagcccagaacctcaccaaagacagcacactgaagcatgaaggtttttacagtgagaatctgacagagtcgcgtaaatttttaaagtcacgagagaagcagagttctcttactgagatcaagggcagtgtttatgagaccacctattcccctccagaatgtcccttctgtgggaaaattgaggagcactctgaagatatggaaacacacgtgaagacaaaacacgccaatctcttggacatccctttggaagactgtgaccagcccttgtatgattgcccaatgtgcggcctgatctgcaccaactatcatatattgcaggagcacgtagatctgcacctggaagagaacagttttcagcagggaatggacagggtccagtgcagcggcgatctgcaactcgcccatcagctgcaacaggaggaagaccgcaagaggaggagtgaagaatccaggcaagaaattgaagagttccagaagttgcaggaactgctgaagcatttcataggtattattcgcatgctcccccagatgtag

SEQ ID NO: 52643 - DNA, 1737 bp, Artificial Sequence
  Description of Artificial Sequence: Synthetic coding sequence
atgctgagctgcaacatctgcggcgagaccgtgaccagcgagcccgacatgaaggctcatctcattgtgcatatggaatctgagatcatctgtcctttctgcaaattgagcggggtgaattacgacgaaatgtgctttcatatcgaaaccgcacattttgagcaaaacactctagaaagaaactttgagcgaattaacactgttcagtacggaacttccgacaataagaaggacaatacactgcagtgtggaatggaggttaatagtagcatacttagcgggtgtgcaagcaaccatccaaagaacagtgcgcaaaacctaacaaaggactccaccctaaaacacgaggggttctactccgaaaatcttaccgagtcccggaaattcctcaagtcaagggagaagcagtctagcctaaccgagatcaaaggttctgtatacgaaactacgtactcccctcctgaatgtcctttttgtggaaaaatagaggagcattcagaggacatggagacacacgtcaaaacaaagcacgctaacctcttagatattcccctggaggattgcgatcagccattgtatgactgtcccatgtgtggcttaatctgcacaaattatcatatactacaagagcacgtggatcttcaccttgaggagaactcatttcaacagggcatggatcgcgtgcagtgttcaggagacctccagttggcccatcagcttcagcaggaggaagatcgcaaaaggcggagtgaggagtcacggcaggaaatagaggagtttcagaagttgcaacgccagtatggtttggataatagtggcggttataaacagcagcaactgcggaacatggaaattgaggtcaatcggggcaggatgcctccgtcggagtttcaccgacggaaggcagacatgatggagtctttggcacttggattcgatgatggaaaaacaaaaacgtctggaatcatagaagcgctccaccgctattaccagaacgcagccacagatgtgagacgcgtctggctgagctcagtagtggatcactttcatagctccttgggcgataaaggttgggggtgcggctaccgcaatttccagatgttgttgagctcactcctgcagaacgatgcatataatgattgtctgaaggggatgcttattccctgtatccctaaaattcagagtatgattgaagacgcatggaaagaagggtttgatccgcagggtgcaagccaactgaacaaccggttacagggcacaaaagcctggataggtgcttgtgaagtatacatcctactgacatcccttagagtgaaatgccatattgttgattttcacaagtctaccggacctctaggcacgcatccacgactattcgagtggatccttaattattattccagcgaaggcgagggctcccctaaggtggtgtgcactagcaaaccaccaatatacttacaacaccaaggtcactcgcggacagtgattgggatagaagaaaaaaaaaatcggaccctgtgtttgcttatcctcgacccaggatgtccctcacgggaaatgcagaagttgctgaagcaagacatcgaggcctcgtcccttaaacagctccgcaagagcatgggcaatctgaaacataaacagtatcaaatcctggcagttgaaggtgcactctctctcgaagagaaactggctagaagacaagcctctcaggttttcaccgccgaaaagataccatag

SEQ ID NO: 52644 - DNA, 1260 bp, Artificial Sequence
  Description of Artificial Sequence: Synthetic coding sequence
atgcccggccggggccggtgccccgactgcggcagcaccgagctggtcgaggatagccactactcccagtcacaattagtgtgcagtgactgcggctgtgtcgtgacagagggcgtgctcaccaccactttcagcgacgaaggtaaccttagagaagtgacctactccagatctacgggcgagaacgagcaagtgtcccggtcacaacagaggggattacgccgggtgagggatctgtgtcgggtgctgcagcttcccccaaccttcgaggataccgcagtcgcttactaccagcaggcctaccgccattcaggtataagagccgcaaggttgcagaaaaaagaggtgctcgtgggctgttgtgtcctgatcacatgtcggcagcacaattggcccctcacaatgggtgccatttgcacactgctctatgcggatttggacgtattcagcagtacctacatgcaaattgtcaagcttttgggccttgacgtgcccagtctctgtttagccgagctggtcaagacatattgtagttccttcaagctctttcaggctagcccctcggtgcccgctaaatatgtggaggataaggagaagatgctctctaggaccatgcaactggtggagttggcaaatgagacctggctggtgacgggaaggcatcccttaccagtaatcacggctgcgacctttctggcctggcagagtttgcagcctgctgacaggctgtcatgcagtctggcaagattttgtaagctggctaatgttgacttgccctatcccgcttcttcacggttacaggaactgttggcggtactactgcgcatggccgagcagcttgcatggctgagggtgctccgcttggataagaggagcgtagttaagcacatcggtgatttacttcagcatagacagtcacttgtccgctcggcgttccgcgatggcaccgccgaagttgaaactcgtgaaaaagaaccgcccgggtgggggcagggccagggggagggagaagtcgggaataattccttgggattgccccaggggaaacggcccgcgtcaccagctctgttacttccgccatgtatgcttaagtcacctaaaagaatttgccccgtgccgcctgtgtcaaccgtgaccggagacgaaaatatctcggatagcgagatcgagcagtatctgagaacaccgcaggaagtgagagatttccagagagcacaggccgcccgacaagctgctactagcgtgccaaatccaccatag

SEQ ID NO: 52645 - DNA, 162 bp, Artificial Sequence
  Description of Artificial Sequence: Synthetic coding sequence
atggccgccacccagaagctggtgaaggacatcatcgacagcaagaccggagagactgcgtccaagagatggaagggtgctaagaacagtgaaactgccgccaaagtggcccttatgaaactgaaaatgcacgccgatggcgataagagcttaccccaatag

SEQ ID NO: 52646 - DNA, 132 bp, Artificial Sequence
  Description of Artificial Sequence: Synthetic coding sequence
atggccgccacccagaagctggtgaaggacatcatcgacagcaagacgggggaaaccgccagcaaacgctggaagggcgccaagaactctgagacagccgctaaggtggcactgatgaagctcaagatgtag

SEQ ID NO: 52647 - DNA, 129 bp, Artificial Sequence
  Description of Artificial Sequence: Synthetic coding sequence
atggccgccacccagaagctggtgaaggacatcatcgacagcaagaccggcgagaccgcctcgaagagatggaagggtgctaaaaactctgagaccgctgcgaaggtagcactgatgaagcttaaatag

SEQ ID NO: 52648 - DNA, 294 bp, Artificial Sequence
  Description of Artificial Sequence: Synthetic coding sequence
atggccgccacccagaagctggtgaaggacatcatcgacagcaagaccggtgaaacagcgtccaagagatggaagggagctaagaactccgaaaccgctgctaaagtcgcccttatgaagcttaaaatgcacgcagacggagacaagagcctcccccagaccgaaagaatttacttccaggtgttcttacctaaaggcagtaaggagaagagcaagcccatgtttttttgccacaggtggtccatcggcaaagcaattgacttcgcagcatctttagccaggctcaagaactag

SEQ ID NO: 52649 - DNA, 360 bp, Artificial Sequence
  Description of Artificial Sequence: Synthetic coding sequence
atggccgccacccagaagctggtgaaggacatcatcgacagcaagacaggcgagaccgcctctaaacgatggaagggcgctaaaaattcagaaacagcagcaaaggtggccttgatgaagctgaaaatgcacgctgatggggacaaaagtctgccccagactgaaagaatatatttccaggtcttccttcccaaaggttctaaagagaaatctaagccaatgtttttttgccatcgctggtccattggcaaagccattgattttgcagcttcactggcccggctaaaaaatgacaacaataagtttacagctaagaaacttcgcctgtgtcatatcacctctggagaggccctgccatag

SEQ ID NO: 52650 - DNA, 486 bp, Artificial Sequence
  Description of Artificial Sequence: Synthetic coding sequence
atggccgccacccagaagctggtgaaggacatcatcgacagcaagaccggagagacagcctccaagcgctggaagggagccaagaattctgagacagcagccaaggttgcactgatgaagctcaagatgcatgctgacggcgataagtccctgccgcagactgagcgaatttatttccaggtgttcttgcccaaggggtcaaaggagaagtcaaagcccatgtttttctgccatcggtggagtatagggaaggccatcgatttcgccgcatccctcgcaaggctgaagaacgataataataagtttaccgccaaaaagctgagactttgccacataacctctggtgaggctctacctttggaccacaccctagaaacttggatcgcaaaagaagattgcccactgtacaacggggggaatatcattctggagtatctgaatgacgaggagcagttttgtaaaaacgtggaaagttacctggaatag

SEQ ID NO: 52651 - DNA, 162 bp, Artificial Sequence
  Description of Artificial Sequence: Synthetic coding sequence
atggccgccacccagaagctggtgaaggacatcatcgacagcaagactggcgagactgccagtaagcgttggaaaggagccaagaacagtgaaacagctgcaaaagtcgccctcatgaagttgaaaatgcacgcggacggcgacaagtcgctcccacagtag

SEQ ID NO: 52652 - DNA, 486 bp, Artificial Sequence
  Description of Artificial Sequence: Synthetic coding sequence
atggccgccacccagaagctggtgaaggacatcatcgacagcaagactggcgaaacagcatctaagaggtggaaaggcgccaagaacagtgaaactgcggccaaggtggcactgatgaaacttaagatgcacgccgacggagacaaatccttgccacagacagagagaatttattttcaggtgtttctaccaaaggggtccaaagaaaaatctaagcctatgttcttctgccacagatggtcaattggcaaggctattgacttcgcagcgtcactggccagactcaaaaatgataacaacaaattcaccgctaaaaagctccgactctgccacatcacgtcaggggaggctctcccccttgaccataccctggaaacatggattgctaaagaagattgtccactgtataatgggggtaacattatcctggaatatttaaacgacgaagagcagttctgcaaaaatgttgagtcatacctggaatag

SEQ ID NO: 52653 - DNA, 186 bp, Artificial Sequence
  Description of Artificial Sequence: Synthetic coding sequence
atggccgccacccagaagctggtgaaggacatcatcgacagcaagaccggtgagacggcgtccaagagatggaagggcgccaagaactccgaaacggctgccaaggtggcactcatgaagttgaaaatgcacgccgacggtgataaatcgttgccccagacggagcgaatatattttcaggtctag

SEQ ID NO: 52654 - DNA, 348 bp, Artificial Sequence
  Description of Artificial Sequence: Synthetic coding sequence
atggacaaccggaaggagccccccttcttcaacgacgacaacatggggcccttctattataggttgcatttctgtgatacaatggagctgtttattgaaacccttacgggcacttgttttgagctgagggtctctccttttgagaccgtgatcagcgtgaaggccaagattagaagactcgaaggcatccctatctgccggcagcatttaatatggaataacatggagctggagaacgactactgtctgaacgactataacatctccgaaggatgcaccttgaagctggtgctggcaatgcgcggtggccctatcaacacaagacgagatctccagattccccgatag

SEQ ID NO: 52655 - DNA, 2184 bp, Artificial Sequence
  Description of Artificial Sequence: Synthetic coding sequence
atggacaaccggaaggagccccccttcttcaacgacgacaacatggggcccttttattacagacttcacttttgtgacaccatggaactcttcattgagacattgaccggcacttgctttgagctgcgggtgtcccccttcgaaactgtcatcagtgtcaaagccaaaattagacgactagaaggcatccctatctgccgccaacacctcatctggaacaacatggagctcgaaaacgactactgtctgaatgattacaacatttccgagggatgcacgctaaagctggttcttgccatgcgcggaggccccattaacactcgcagagtgcccacggacgatcctctgcgcaagatggcagaatacttagactctagccgggtggaagtctgggaaaagacaagctgtagcaagcaagtgacgttcttggtctatcaggaaggcgatcagctgaacttctttccagctgtggatagaggggatggcaccctgacaccactctcggactcttccaaaaagattgactttcacctccatgttttgaggagaaaaggggagcatcgtatgtccggcggaagtatgtataatagtgacactgacgaagacgaagaaacagagccatcttcttcaggccagcagattattgaaaatagcattaccatgaataaaatgaagctgctcaaggctaaaatgaaaaacatgaacctatctaagaagcctaaaaaggcggtgaaaatcaagccacacccaccagtggcgccgaggccttccagcggttcaaccgcaccttcaagacatcgtttattgagggtgttgccgaacattggccagagctgctcccctgccttcggcaacgcgtacccacctgaaatatccaggaatggaattagcagcctggccacacagctctccgccgagcggtacatttcatccattaccggcgagtttttgaaggaagataattcatgggagaacaacaccctgtcacacttttcctcgaacgtaaagctgccccctcagatcccccacctggagcttggcaatgatcaagaactggccgatagtgtgctgcatttggggagctcactgcctcgacagaccaagcactttctggggaacctgcccagcagcaatggaaacattgttctgccctccgaagagtgcgtgactgagcagtccttgctcccaaaggtgggaagtctggcctcttttgccgaaggtaatgccgacgagcagtcttccggtctggagggcgcatgcaaagtgaatctagagttactgcttactaatgcagataaggggctcaaggctcccgagcagcatcttaaacacgtggccggagtgcttaacggcgagtccgtggaaacatctgttttaaattaccgagagctctcaccccataaaaacaggctcctgtcaccgctaaggtgctccgcgccaatgagcttacataatagtttagtcaaacctgagcgacagtccaagtgttttgaattcggcaagcttcaaccctcttcgagccagtccttggacgtacaaaacatcaccgactcttcattctcccggaccacttgtttccagggcgttaaagtagactcgttgggcaagaggagtgatgtaatatcaaaggtagaagcacgagacattactgaaatgactaataaggccagcaaagagcctgtgggctgcgttaataatatctccttccttgccagtttagccggtagtactagcagaaatagattgcagtccacccggggagccggtcggttgcagaattcaggcactggtctcagcacgaatctacaacattttcaagaggagaactttcgcaagtcctcaccccagcttgaacacacgggggtgtttctatccacacatggtgtgggaatgaacgggaataacgctgctgctggaaagtccgttggtgagtgcaccacccatcacctccctcccgtgaaagctcccctgcaaaccaagaaaaaaactacaaaccactgctttctgtgcgggaagaaaacaggtctcgcctcaagttatgagtgccgttgcggaaataacttctgcgcttcccacaggtacgcagagacccatggctgcacttatgattataaatctgcgggtaggcggtatttacatgaagccaatccagtcgtcaatgccccaaagctccccaaaatttag

SEQ ID NO: 52656 - DNA, 1962 bp, Artificial Sequence
  Description of Artificial Sequence: Synthetic coding sequence
atggagctggagaacgactactgcctgaacgactacaacatcagcgagggctgcactttgaagctggtcctggccatgcgcgggggacctatcaacaccaggcgggtgcccacagatgacccattgaggaagatggctgagtacctagatagcagcagagtcgaggtttgggaaaagactagttgctccaagcaggtgacctttctggtgtaccaggagggagatcaactcaattttttcccagctgtggacaggggtgatggaaccctcacaccgctgtctgacagtagcaagaagattgacttccacttacacgtactgaggcgaaaaggtgaacatcggatgagtggggggtccatgtataattctgatacagacgaagatgaagagactgaaccttcctcttccggccagcagattattgaaaactctataaccatgaataaaatgaagctcctgaaggccaagatgaagaatatgaacctgtccaagaaacccaagaaggccgtgaaaataaagccacacccccccgtggctccccgcccatccagcggaagcacagctcctagccggcaccgcctgctgagagttctccccaatatcggacagtcctgttccccagcatttggcaacgcctacccccccgaaatcagtagaaacggtatcagcagcctcgccacccaactttcagccgagagatacatctcttcaattaccggcgagtttcttaaggaggacaactcttgggaaaataataccttgtctcactttagttccaatgtgaagctgcccccgcagatcccccatcttgagctaggaaatgaccaggaactagccgactcagttctgcatctcggatccagcttgcctcgccagaccaaacattttctgggtaacctgcccagctccaatggaaacatcgtgttaccctccgaggagtgcgtgactgagcagtcgttgcttccaaaggtgggtagtctggcctcatttgcggagggcaacgctgacgagcagtcttcaggcttagaaggtgcgtgtaaagtgaacctcgagttgctacttacaaacgcggacaaaggccttaaggcacctgagcagcacctgaaacatgtcgccggcgtgctcaacggagaatctgtggagacatcagtcctcaactaccgcgagctctccccacacaaaaatagactgttgagccctctgagatgcagcgctccaatgagcctgcataattccctggtgaagcccgagagacagtccaagtgtttcgagtttggcaagttacaaccctcctcatcccaaagcctggacgtgcagaacatcacagacagttcgttctctcgaacaacgtgtttccagggcgtgaaagtagacagccttggcaagcggagcgatgtgatatccaaggttgaggctcgcgacataacggagatgaccaacaaggcttctaaagagccagtaggttgcgtaaacaatattagcttcctggcctcactggctggaagtacaagccgcaaccgactgcaaagcacccgcggggctggccgccttcagaattcaggcacagggctctccaccaacctgcagcatttccaagaagagaattttcgcaagagttctcctcaactcgaacatacaggggtgtttttaagcacgcacggtgtgggaatgaacggaaataacgcagccgcgggtaaatcagtgggagaatgcaccacccatcaccttcctccagtaaaagctccgttgcagactaaaaaaaaaacaacgaaccactgctttctgtgtggaaaaaagaccggcctggccagctcttatgaatgtcgatgcggaaataatttttgcgccagccaccgatacgccgaaacccacggatgcacttatgattacaaaagcgcaggaagacggtacctccacgaggccaatccagtcgttaatgccccgaaacttcctaagatctag

SEQ ID NO: 52657 - DNA, 1830 bp, Artificial Sequence
  Description of Artificial Sequence: Synthetic coding sequence
atggccgagtacctggacagcagccgggtggaggtgtgggagaagacttcgtgttctaaacaagtgaccttcctggtgtatcaggaaggcgatcagctgaatttcttccccgcagtcgatcgtggcgatgggaccctgacacctctgtctgattcctcaaagaagatcgatttccatctgcatgtgcttcgccggaagggagaacacagaatgtctggcggtagtatgtataattccgacacagacgaggatgaagagacagagccgagcagttccgggcagcagataattgaaaatagcattactatgaataaaatgaagttacttaaggcaaaaatgaaaaatatgaacctgtccaagaagcccaaaaaagccgtgaagataaagccccatcctcctgttgcacctagaccctcgtccggctcaaccgcaccgtcccgccatcggctcctccgggtcttaccaaatattggtcagagttgcagccctgcattcggcaacgcctacccacccgagatttctagaaacggtataagttcactggccacccagctgagcgccgaaaggtacatttctagtatcacaggagagtttctgaaagaagataattcctgggagaataatacactttcacatttcagttcgaatgtgaagctgcccccccaaatacctcaccttgaactggggaatgatcaagagctcgccgattctgtgttgcaccttggctccagccttccgcgtcagactaaacatttcttgggcaaccttccttcgagcaatgggaacattgtactcccttcagaagaatgcgtgacagagcagtctttgttgcccaaagttggctcattagcttcctttgcagaggggaatgcagatgaacagagtagtggcctcgagggcgcatgtaaggtgaacctggagctcctccttactaatgccgacaagggtctgaaggcgcctgagcaacaccttaagcacgtggccggtgtgttgaatggagaaagtgtggagacatccgtcctgaattaccgggaactgtcaccacacaaaaaccgcctactttcgcctctgcggtgcagcgccccaatgagcctgcacaactctctcgtgaaaccagagaggcagagcaagtgtttcgagttcggtaagctgcagccgagtagcagccaaagcctcgacgtgcaaaacattacagattcaagcttttctcgaacaacttgtttccagggagtgaaggtggacagcctggggaagaggtccgacgttattagcaaggtggaggctagagacatcaccgaaatgacaaacaaggcttcaaaagagccagtgggttgtgttaacaatatttctttcctagcatcgctcgcaggctctactagccgcaatcgactacagtccactaggggcgccggcagactgcagaatagtggtacaggtttgtcaacgaacctgcagcacttccaggaagaaaacttcaggaaatcttctccacaactcgagcatacaggtgttttcctgtccacgcatggcgtcggcatgaacggcaataacgccgccgctggaaaatccgtaggtgaatgcaccacgcaccacctgccaccagtgaaggcacctctgcagactaagaaaaagacgacaaaccattgtttcctgtgtggcaaaaagaccggtctggcctcatcatacgaatgtcgatgtgggaataatttttgtgcctcacacagatatgctgaaacccacggctgtacgtacgactataaaagtgccggacgcagatacctgcacgaggctaaccccgtcgtgaatgctccaaagctgccaaagatctag

SEQ ID NO: 52658 - DNA, 675 bp, Artificial Sequence
  Description of Artificial Sequence: Synthetic coding sequence
atggacaaccggaaggagccccccttcttcaacgacgacaacatgggccctttttattacagactccacttctgtgacactatggagctgttcattgagacgttgaccggcacctgtttcgagctaagggtgtcgccattcgaaacggtgatttccgtgaaagcaaagattcggcgcctggaaggaatacccatttgccgccaacacctcatatggaataacatggagctcgaaaatgattactgtctgaatgattataacataagcgagggatgcactctcaagctggtcttggctatgcgtggaggtccaattaacactcggagagtccctaccgacgatcccctgaggaaaatggccgagtaccttgacagcagcagggtcgaagtatgggagaagacctcttgtagcaagcaggtgacattcctcgtgtaccaggagggggatcagctaaacttctttccagcggtggatagaggagacgggaccttgacgcccttgagcgattcaagtaaaaagattgatttccatctgcatgtgctccgtagaaaaggggagcacaggatgaggcgcatgtactatagctcaccaccgacctgtgaatcaccctcgtctgacaaagaggagaataataaatcgttattttctctgtggaaggaaaaccgaacgggctag

SEQ ID NO: 52659 - DNA, 675 bp, Artificial Sequence
  Description of Artificial Sequence: Synthetic coding sequence
atggacaaccggaaggagccccccttcttcaacgacgacaacatgggtcctttttactaccgtctgcacttttgcgatacaatggagttgttcatcgagacactcaccggtacttgcttcgaactgagagtctcgcctttcgagaccgtgatttcagttaaggcgaaaatcagaaggttggagggaatacccatctgtaggcagcatctcatctggaataatatggagctcgaaaacgattattgcctgaacgattacaatattagcgaggggtgcactctcaaattggtactagctatgagaggaggacccattaacactcggagggtacctaccgacgatcctctgaggaaaatggcggagtatttggactcctccagagttgaagtgtgggagaagacatcttgctcgaagcaggtgaccttcctggtgtaccaagaaggagaccagttgaacttttttcccgcggtggaccggggcgatggtacccttacccctctctccgatagtagcaagaagattgattttcacttacatgtgctccgacgtaagggggagcaccgtatgcggaggatgtattattcgtccccgcctacctgtgagtcaccttcaagtgacaaggaggagaataataagtccctgttctccttgtggaaggagaaccggaccgggtag

SEQ ID NO: 52660 - DNA, 627 bp, Artificial Sequence
  Description of Artificial Sequence: Synthetic coding sequence
atggcccaggagaccaaccacagccaggtgcccatgctgtgcagcacagggtgtggtttttacgggaacccaagaaccaatggaatgtgttccgtatgttataaagagcacctccagcgacagaattcctcaaatggccgaatctcccctcccgccactagcgtgtcaagtctgagtgagtcgctcccagtccagtgcacagacggaagcgtgcctgaggctcagagcgctctggatagcacaagctcaagtatgcagcccagccccgttagtaaccaaagccttctgtcagaaagcgtggcttcaagccagttggacagcaccagcgtagataaggccgtgcctgaaaccgaggacgtgcaggccagcgtgtctgataccgcccagcagccttcagaagaacagagtaagtctctcgaaaaacctaagcaaaagaagaacagatgtttcatgtgcagaaaaaaggttggtctaaccggttttgagtgccggtgcggcaatgtgtactgtggcgtgcatcggtacagcgatgtgcataactgttcatacaactacaaggccgacgccgccgagaaaatcaggaaagagaacccagtcgtggtaggcgagaaaattcagaagatctag

SEQ ID NO: 52661 - DNA, 2520 bp, Artificial Sequence
  Description of Artificial Sequence: Synthetic coding sequence
atgaaccggaaggacttcgtggtgctgccctggggcaagcccggcaactctgtaaaactcaagtacaggaatgcccaggagcttaggatggaaaaggtgcaactggaatttgaaaatcaggagatggagaagaaactgcaggagtttcgcagtacccggaataaggagaaggaggaccgagagtccagtgaatattattggaagagcggcaaagtgggtaagctcgtgaatcagagttacatgatgagccagaataagggaaatgtcgtgaagtttagcgccggaaaggtgaagctgaaactcctcaaggaacagatccaagagcctgtcaagcctacagttaattacaaaatggcaaatagtagcgaatgcgagaagccgaagatcaacgggaaagtgtgcgggcagtgtgaaaacaaggccgccctgcttgtgtgcttggaatgcggcgaggattactgcagtgggtgttttgcaaaggtccaccagaaaggagcacttaagctgcatcggacaacactccttcaagccaagtcccagatactgttcaatgttctggatgtcgctcaccagttcatcaaagacgtaaatcccgatgaacccaaagaagaaaataactcgaccaaggagacgagtaaaatccagcataaacctaagtctgttctgctccagcgatccagcagtgaggtagaaataacaaccatgaagagggcccagagaacaaagccacggaagtcattactatgcgagggcagcttcgatgaggaagcctccgcacaatcttttcaggaagtcctctcacagtggagaaccggaaatcacgatgataacaaaaaacaaaacctacatgccgccgttaaggactccctcgaggaatgcgaagtccagacgaacctgaagatttggagggaacctctgaatatcgagcttaaggaggacatcctttcctatatggaaaaactgtggctgaagaagcataggaggactccccaggagcagctgtttaaaatgttgcccgacacgtttccccaccctcacgaaaccactggagatgctcagtgctcacagaacgaaaacgatgaggactccgacggcgaggagactaaagtgcagcatacagcactcctgttacccgtagagactttaaatatcgaacggcctgaaccgagtttaaaaatcgtggaactagatgatacttacgaagaggagtttgaggaggccgaaaatatagtcccctacaaagtgaaactggccgacgccgattcccaaagatcatgtgccttccatgactgtcaaaagaattcctttccctatgaaaacggtatccatcagcaccacgtgtttgacaaagggaagcgggattttctgaatctgtgtcttcgcaattcgagcacgtattacaaggacaactccaaagctgagaccagcaacaccgatttcgataatattgtcgatccggacgtctacagctccgatatcgaaaagattgaggaatctaccagcttcgagcggaacttgaaagaaaaaaatatcggtctggaaagtaatcagaaatcggacgactcatgcgtctcgctggaatcaaaagacacactcctcggtcgtgatttagagaaggctccaattgaggagaaactgagccaggacatcaaggaatcccttgagctttctaatttgtataagcggccatcattcgaagagagcaaaacgactaagagttcccttctcctccaggaaatagcttgccggagcaaaccaatcacaaaacagtaccaaggcctggaacgcttttttatttttgacaccaacgagcgtcttaacctgctgcccagtcatcggctcgaatgtaataactcttccacgcgtatcacacttgccgaagaccgcgaatggatccccgatcactcattgtctgaatatgcggataacgcgatcgtgctaggagtactgcagggtgctcaaagcccaagctccagccgcaaacagcaaaaaatgggccagaaatcccagagaccttcaacggctaatttccccctctcaaacagtgtgaaggaaagcagctcttgtctgtcatcttcacacccgaggtctcggtccgccgcagcccagtctagctcacgcgccgctagtgaaatttctgaaatagaatatatcgatatcaccgaccaaaacgagctttctctggatgatacgaccgaccaacacacgctcgataatctggaaaaggagctgcaggttctgcgatctctggctgacacctctgagaaactgtacagtcttacaagtgaggagttcccagacttcagcagccaatctcttaatataagtcagatctccactgactttctcaaaacttctcacgtgcgcgggccatgcggtgtggaggagctttcctgttctggacgggacaccaaaatccagagcctgcttagcctctcagagtccagcactgatgaggaagaggaggacttccttaataaacaacacgtcatcaccctcccctggagtaaatccacatag

SEQ ID NO: 52662 - DNA, 2403 bp, Artificial Sequence
  Description of Artificial Sequence: Synthetic coding sequence
atgaaccggaaggacttcgtggtgctgccctggggcaagcccggcaattctgtgaaactaaagtatcggaatgctcaggagctccgtatggaaaaggtgcaactagaattcgaaaatcaggaaatggaaaagaaactgcaggagttccgtagcactcggaataaagagaaggaggatagggaaagcagtgagtactactggaagagcgggaaggtgggtaaattagtgaaccagtcctatatgatgagccagaacaaaggcaacgtggtcaagttctccgccggtaaggtgaaattgaagctgctcaaagaacaaattcaggaaccagtgaagcctacggtgaattacaaaatggccaatagtagtgaatgcgagaaaccaaagataaacggcaaagtgtgcgggcagtgcgagaataaggcagctttgcttgtctgtctggaatgtggcgaggactactgcagcggatgctttgccaaggtccatcaaaagggcgctctgaaactacacaggactacactgcttcaagctaagagtcaaattctcttcaacgtgctcgacgttgcgcaccagttcattaaggacgtgaaccctgacgaacctaaggaggagaacaattccacaaaggagacaagcaaaatccagcacaagcctaagtcggtactgcttcaaaggtctagttccgaagtcgaaattactacaatgaaacgagcccaacgaaccaaaccccgaaaaagtcttctgtgcgaggggtcattcgacgaggaggcttccgcccagagcttccaggaggtcctgagtcagtggcgcactggaaaccatgacgataataaaaaacagaatttgcatgctgccgtaaaggactctctcgaagaatgtgaagtgcaaactaacttgaaaatctggcgcgaacctctgaacatcgagctgaaggaggatatactgagttacatggagaaactctggcttaagaaacatcgcagaacccctcaggagcagctgtttaagatgttaccggatacctttccccatcctcatgaaaccactggtgatgcccaatgtagtcagaacgaaaatgatgaagactcggatggagaggagacaaaagtgcagcacactgctctgctattaccagtggagactctcaatatcgagaggccagagccttctttaaagatcgtcgaactggacgatacctacgaggaggagttcgaggaagctgagaatattgttccgtacaaggtcaaactcgccgacgctgactctcagcgcagctgtgcatttcatgactgccaaaagaattcgttcccgtatgaaaacggcattcatcagcaccacgtattcgacaagggcaaacgagatttcttaaatctgtgccttagaaatagctccacatattacaaagataatagtaaggctgaaacctcaaacacggacttcgacaacatagtcgaccccgacgtctacagctctgacattgagaagatcgaggaatcaacctcttttgagcggaatttgaaggagaaaaacatagggctcgagtctaatcagaagtctgacgattcatgcgtgagtctggagagcaaagacactctgctagggcgagatttggaaaaggctccaatcgaggagaaactcagccaagatataaaagagtctcttgaactgagcaacctctataagaggccttcgtttgaggagagcaagactactaaatccagcttgctgcttcaggagatagcgtgcaggagcaagccgatcaccaagcagtaccaggggttggaaaggttcttcatctttgataccaacgaacgcctaaacctgctgccttcccataggctggaatgcaacaattcctctacccgcattactctagcaggccagaagtcccaacgccccagcacggccaatttcccactatcaaactccgtaaaggaatcgagctcctgcctgagctcctcacaccctaggagccggtctgctgctgcacaatccagtagcagggctgcctcggaaattagcgaaatagaatacatcgacattacagaccagaacgaactctctttggacgacaccacagaccaacacacactcgacaatctggaaaaggagctgcaggtcctgcgaagtttagcggacacctcggaaaaattatatagtctcacttcagaagagtttccagactttagcagccagtccttgaacatttcccaaatttcaacagatttcctgaagacttcccatgtgagagggccttgcggcgtagaggagttgtcctgtagcggcagggataccaagatccagagtttgctctcgctgtctgagagctccactgatgaggaggaagaagactttcttaataagcaacacgtgattactttgccttggtccaagtctacgtag

SEQ ID NO: 52663 - DNA, 2403 bp, Artificial Sequence
  Description of Artificial Sequence: Synthetic coding sequence
atgaaccggaaggacttcgtggtgctgccctggggcaagcccggcaattcagtcaagttaaaatataggaatgcacaggaactgcgaatggaaaaagtccagctggaattcgagaaccaggaaatggagaaaaagttgcaggagttcaggagcacaagaaacaaagaaaaagaggaccgggagagctctgagtattactggaagtcaggaaaggtgggtaagctggtcaatcaatcttacatgatgtctcagaacaagggaaacgtggtgaaattcagcgccggaaaagtgaaactgaagcttctcaaagagcagatacaggaacctgtgaagccaactgtcaactacaagatggctaattcatctgaatgtgaaaagccgaagattaacggtaaggtgtgtggacagtgtgaaaataaggcagccctgcttgtctgcctggaatgcggcgaggactattgttcggggtgctttgccaaagtgcatcagaaaggtgcccttaagctccataggaccactttactgcaagccaaaagtcagatcttatttaacgttctggacgttgctcaccagtttattaaggatgttaaccccgatgagccaaaggaagagaacaatagcaccaaggaaacaagcaagatccagcacaagcctaaatctgtcctcttacaacgctcaagctccgaggtggagattactaccatgaagagagcccagcggacaaagcctcgcaagtcccttttatgtgaaggtagctttgacgaggaggcatccgcccagagctttcaggaagtgctgtcacagtggaggaccggcaatcatgatgataataaaaaacagaatctccatgccgcggttaaagactctctcgaagaatgcgaggtgcaaactaatctgaagatctggcgggaacctctaaatatcgagctcaaagaggacatactgtcttacatggagaaactctggctgaaaaaacaccggagaaccccccaagaacaattatttaagatgctgccagacacattcccgcaccctcatgagacaacgggggatgcccagtgcagtcaaaacgagaatgatgaagacagcgatggggaggagacaaaagtacagcacaccgcgttgttgttacctgtggaaaccctgaacatcgagaggcctgaaccgagcctcaagatcgtggaactggacgatacttatgaggaggaatttgaagaggctgagaacatcgtaccgtacaaggtgaagctggctgacgcagactcccagcgatcctgcgcctttcacgactgccagaaaaactcctttccttacgagaatggtattcaccagcaccacgtgttcgacaaaggaaagagggactttttgaacctatgcctccggaactcaagtacctactacaaggacaacagtaaggccgaaactagtaacactgatttcgataacatcgtcgacccggatgtgtactcctccgacattgaaaaaattgaggaatctacctcattcgagcgtaatctcaaagagaagaatatcggcctggagtccaatcaaaaaagtgacgattcctgtgtgtctctggagtctaaggatactttattaggccgggatctggagaaagcacccattgaagagaaattgagccaagatattaaggagagtcttgagctgtcaaatctctacaagcgccctagctttgaagagtccaagacaacaaagagcagccttctgctgcaagagatcgcctgccgtagcaagcccataacaaagcaatatcagggcctggagcggttcttcatcttcgataccaacgagaggctgaacctccttccatcccaccgcctcgaatgtaacaatagctccacacgcataactctggccggccagaagtcacagagaccctcaaccgccaactttccactgtcgaacagtgtcaaggaaagttcatcttgcctctcatcatcacacccacgcagccgcagcgcagcagcccaatcgtcaagcagggccgcttctgagattagcgagatagaatatattgacattactgatcagaacgaacttagcctggacgataccaccgaccaacatacccttgataacctagaaaaggagctccaggtacttcgctcgttggctgacacaagcgagaagctgtactcactaactagcgaggagtttcccgatttcagctcccagtctttaaatatctcacagatctccacagattttttaaaaacgtctcacgtgaggggaccctgtggcgtcgaagaactgagctgcagcggaagggacactaagatacagtctttgctgtccctctccgagtcctcaaccgacgaagaagaggaagattttctgaacaagcagcacgtcataactctcccgtggtctaaatccacttag

SEQ ID NO: 52664 - DNA, 2520 bp, Artificial Sequence
  Description of Artificial Sequence: Synthetic coding sequence
atgaaccggaaggacttcgtggtgctgccctggggcaagcccggcaatagcgtcaagctaaaatacagaaacgcccaggaattgaggatggagaaagtacaactggaatttgagaatcaggagatggagaagaaactacaagagttcagatctacgcggaacaaggagaaggaggaccgcgagtcaagcgaatactattggaagagtgggaaagtggggaaactcgtcaatcagagctacatgatgtcacagaacaagggaaacgtggtcaagttcagcgcaggaaaagttaagctgaagctactgaaagaacaaatacaggaacccgttaagccgaccgtcaattacaaaatggcgaactctagtgaatgtgaaaaacctaagatcaacgggaaggtgtgcgggcagtgcgagaacaaagcggcgctgctggtgtgccttgagtgcggggaggactactgttcaggttgcttcgcgaaagtgcatcagaagggcgctctgaagttgcacagaacaaccctgctgcaagctaagtcccagatcctgttcaacgtgttggatgtggcccaccaattcattaaggacgtgaaccccgatgaaccaaaggaggaaaataactccactaaggagacctcaaagattcaacacaagcccaagagtgtcttactccagagatcgtcttccgaagtcgagatcacgacaatgaaacgcgctcagcgcaccaaaccccgaaaatcacttctctgtgaggggagctttgacgaagaggccagtgcccagagtttccaggaggttctgagccaatggcgaaccggaaatcacgacgacaacaagaaacaaaacctccacgccgccgtcaaagactcactggaagagtgtgaggtgcagacgaacctcaaaatctggcgagagccacttaatattgaactgaaggaggatatcttgtcttatatggaaaagctgtggctgaagaaacacaggcggacccctcaggagcagctgttcaaaatgctcccagatacatttccgcacccgcacgagacaaccggggatgcacagtgctcccagaacgagaacgacgaggacagcgacggcgaagaaactaaagttcagcacactgctcttcttctcccagttgagacccttaacatcgaacgcccagagccaagtctgaagattgtagagttggatgatacctacgaggaggagttcgaggaagcggagaacatcgtgccctataaagttaagcttgctgacgcggattcccaacgttcttgcgccttccacgattgccaaaaaaacagcttcccctacgagaacgggattcatcagcatcacgtttttgacaagggcaaacgcgacttcctgaatctgtgtcttcggaactcatcgacgtattataaggacaacagcaaagccgagactagcaatactgactttgacaatatcgtggaccccgatgtttactcttccgacatcgagaaaatagaggagagcacatccttcgaacggaacctgaaagaaaagaacattggcctcgagtctaatcagaagtctgacgattcctgcgtctctttggaatccaaagacaccctcctgggaagggatctagaaaaggctccaatagaggagaagctctcccaggatattaaagagagcctggaactcagcaacctgtataaaaggccatcgtttgaagagtctaagactacaaagagttctctcctactacaggagattgcctgcaggtcaaagccaattaccaagcagtatcagggattagaacgcttttttatcttcgacactaacgagagacttaatcttctcccttctcacagactcgagtgtaataacagctcaacgcgtataactctagctgaggacagagaatggattcccgatcactcactgagcgaatacgccgataatgcaattgtattaggagtcttgcagggagcccaatcaccctcctcgagcagaaagcagcagaaaatgggtcagaagtcacagcgcccctctacagccaacttcccactctctaattcggtaaaagagtcatctagctgcctgtctagcagccacccacgaagccggtcagcagccgcacaaagcagttcgcgcgccgcttcagagatcagcgagattgagtacattgatataaccgaccaaaacgaactgtctctggacgataccaccgatcagcatactttggataacttagaaaaagaattgcaggtgcttcgatcattggcggacacatccgagaaactctattccctgacctccgaagagttcccagatttctcctcacaatcactgaatatctcccaaatctccaccgattttctgaagacttcccatgtgagggggccatgcggggttgaggaactgtcctgctccggaagagataccaagatccaaagtctcctctcactgagtgaaagcagcactgacgaggaagaagaagatttcctcaataagcagcacgttatcacactcccatggtcaaagtctacatag

SEQ ID NO: 52665 - DNA, 492 bp, Artificial Sequence
  Description of Artificial Sequence: Synthetic coding sequence
atgaaccggaaggacttcgtggtgctgccctggggcaagcccggcaactccgtcaagctcaaatataggaatgcccaggagctgcgtatggaaaaagtccagcttgagtttgagaatcaagagatggagaagaagttgcaggagtttcgaagtactagaaacaaggagaaggaagatagggaatccagcgaatattactggaagagcggtaaagtcggtaaactggtgaaccagtcttatatgatgtcccaaaataaaggcaatgtggtcaagttttctgccggcaaggtaaaactaaagcttttgaaagaacagatacaggaaccagtgaaacccaccgtgaattataagatggcaaactcctccgagtgtgagaagcctaagataaacgggaaggtatgcggccagtgtgagaataaagccgccctgctagtgtgtcttgaatgtggggaagattattgctcaggctgtttcgcaaaggtgcatcagtag

SEQ ID NO: 52666 - DNA, 657 bp, Artificial Sequence
  Description of Artificial Sequence: Synthetic coding sequence
atgatgcggcgggaggacgaggaggaggagggcaccatgatgaaggcgaaaggcgatctggagatgaaagaagaggaggagatatcagagacgggagagctcgtgggaccctttgtgagcgccatgcccacacccatgccccataacaagggcacacgcttttctgaggcctgggagtattttcacctggcccccgctcgggcaggtcatcatcctaatcagtacgccacttgcagactgtgtggtcgccaggtgtcaagaggccctggcgtgaacgtaggaacaacagccctgtggaagcacctaaaaagcatgcatcgtgaggagctcgagaaatcggggcatggtcaagcagggcaacggcaggatcccagaccccacggaccacagctgcccaccggaatcgaaggaaattgggggagactgctggagcaggtgggcaccatggccctctgggcttcacaacgagagaaagaagtcctgcgcagggagcgagcagtcgaatggagagagagggcagttgagaaacgggaaagagccttggaggaggttgagcgcgccatcctggagatgaagtggaaagtccgtgcagagaaggaggcttgtcagcgcgagaaagagcttcctgcggcggttcacccgtttcacttcgtgtag

SEQ ID NO: 52667 - DNA, 705 bp, Artificial Sequence
  Description of Artificial Sequence: Synthetic coding sequence
atgcggagcggcgagcccgcctgcaccatggaccaggcccggggcctggacgacgctgcagctagggggggtcagtgtcctggcctggggcctgcccctacccctactccaccaggccgcttgggggccccatattctgaggcctggggctactttcatctcgcgcccggtcgaccgggacatccgtcaggtcattgggccacctgtcgcttgtgtggagagcaggtcggtagaggacccgggtttcacgccggaacctccgctctttggcgacatctgcgttccgcacacaggcgagagctggaatcatctggcgcgggatctagcccccctgctgctccatgccccccccctcctggccctgcggctgcgccagagggtgactgggcacgtttactggagcagatgggggcgttggctgtaaggggctctcgacgggaaagagagctggagcggagagaacttgcggtcgaacaaggcgagcgggctctagagcgccggcgcagggctttgcaggaggaggagagagccgcagcccaggcgagacgggaactccaggctgaaagggaggcactacaggctagactccgtgacgtttccagaagagaaggagctttgggctgggcccccgccgcccctccccctctgaaagatgaccccgaaggcgacagagacgggtgcgtgatcaccaaggtcctcctttag

SEQ ID NO: 52668 - DNA, 453 bp, Artificial Sequence
  Description of Artificial Sequence: Synthetic coding sequence
atgcggagcggcgagcccgcctgcaccatggaccaggcccggggcctggatgacgccgcagccagaggcgggcagtgcccgggactgggtcctgcccccacaccaacaccccccggcagattgggcgctccttacagtgaagcatggggttatttccacttagccccaggccgcccagggcacccctccggacattgggcaacatgtaggctttgtggcgagcaggtcggtagagggcctggatttcacgctggcaccagtgcattatggagacacttgcgatcggcccaccggagggagctggaaagctcaggagccggttccagcccccctgcagcaccctgtcctcctcccccaggaccggccgcagctccagagggtgactgggcccgtctgctggagcagatgggagccctggcagtgcgaggaagccggcgtgaacgagagttgtag

SEQ ID NO: 52669 - DNA, 5970 bp, Artificial Sequence
  Description of Artificial Sequence: Synthetic coding sequence
atggccaccgccgacacccccgcccccgccagcagcggcctgagcccaaaggaagagggagagctggaagatggcgagatcagcgacgacgacaataacagccagattcgaagcagatcctccagtagttcatcaggcggcgggctcctgccctacccccgccggaggcccccccactctgctcggggggggggttcagggggcggagggggaagttcaagtagttctagctcaagtcagcaacaacttcgcaactttagccggtcacgtcatgctagtgagaggggacatctcaggggcccatcttcctaccggcctaaggagccattccggagccatcctccttccgtgagaatgccatcatcatctctcagtgagagcagtcctaggccgagtttttgggagcggtcccacctagctctggaccggttccgatttcgggggcggccttatcggggtggctctagatggtcccgcgggagaggggtgggcgaacgaggtgggaaaccaggatgcagacccccactcgggggcggtgctggttccgggttctcaagctcccaatcctggcgcgagccctcgccacctcgaaagtcatccaagtccttcggcaggagccctagtcggaaacaaaattattcttccaaaaatgaaaattgtgtggaggagaccttcgaggatctcctgttgaaatataaacaaattcaactggagctggaatgcataaacaaggatgagaagctcgccctgtcctcaaaggaagaaaacgtgcaagaggatccgaaaactcttaacttcgaagaccagacttcaactgacaatgtatctattaccaaggactctagtaaggaagttgcccccgaggaaaagacccaggtgaaaacctttcaggcttttgagctcaaacccctcaggcagaagctaaccctccccggtgataaaaatcgcctgaagaaggtcaaggatggggccaagccattatccctgaaaagtgataccacagatagttcacagggactgcaggataaagaacaaaatctcacccggaggatctcaacaagcgatatcttgtccgagaagaaactgggcgaagacgaggaagaactgtccgagctccagttgcggctgctggctctccaaagtgccagtaagaagtggcaacaaaaggaacaacaggtgatgaaggaaagcaaagagaagctgacaaagaccaaaactgtgcagcaaaaggtcaagacctcaacgaagactcatagcgccaagaaagtttccacaaccgctaagcaggcgcttagaaagcagcagaccaaggcgtggaagaagcttcagcagcagaaggagcaggagcgtcaaaaggaggaggatcaaagaaaacaggcggaagaagaggagcggaggaagcgggaagaggaaatccgcaaaattcgggacctgtctaatcaggaggaacaatataaccgttttatgaagctcgtcggcgggaaacggcggtcacgatccaaatcaagtgatcctgaccttcgccggtctctcgacaagcaacctacggattccgggggtgggatttatcagtacgacaactacgaagaggtcgccatggacaccgactccgagacatcatctccagccccatccccggtgcagcctcctttttttagtgagtgtagtctcggatacttcagtccagcacctagcctttctttaccccctccaccccaggtttcatctctgcctccgctcagccagccctatgtagagggcctgtgcgtgagcctcgaaccgcttcctccgcttcctccgctgccgcctttgcctcccgaggaccccgaacaacctcccaaacctccctttgcagacgaagaggaagaggaagaaatgctcctgagagaagagctgctgaaatcgctcgctaacaaacgagccttcaagcccgaagaaacaagcagcaactcagatccacccagccctccagtcttaaataatagtcacccagtcccgagaagtaatctgtccatagtttccataaataccgtgtcacaaccacgcatccaaaacccaaaattccatagaggccctagactgccacgcacagtgatatccctgcctaaacacaagagtgtggtagtgactttaaacgattccgatgattctgaatccgacggcgaggcctctaaatctaccaacagtgtatttggcggcctggagagtatgatcaaagaagccagacggacggcagaacaagcgtctaagccgaaagtgccccccaagtctgagaaagagaatgacccactccgcacccccgaggccctacctgaggagaaaaaaatcgagtacagactcctgaaggaagagatcgctaatagggaaaaacagagactcataaagagtgaccagcttaaaacctcgtccagcagtcctgcgaattcagacgtggaaatcgacggtattggccggatcgcgatggtgactaagcaggttacagatgctgagtctaaactcaagaagcatcggattctgctgatgaaagatgagagtgtcctgaaaaacctggtgcagcaggaggccaaaaagaaggagagcgtgcgcaacgccgaagcaaagattacaaaactgacggaacagctccaggcgaccgagaagattttgaacgtgaacagaatgttcctgaagaagctgcaggaacagattcacagggtccagcagagagtgaccattaagaaagcactcacacttaagtacggcgaagagctggccagagctaaagcagtggcctcgaaggaaatcggcaaacggaagttggagcaggacaggttcgggccaaacaaaatgatgcgactcgactcatcacctgtatcctcgcctcgcaagcacagcgccgagttgatagccatggagaagcgcaggctgcaaaagctggagtatgaatatgcgctcaagatccaaaagcttaaggaagctcgcgcccttaaggctaaggaacagcagaatattagtcctgtcgtggaagaagaaccagaatttagtttgccacagcctagccttcatgatctgacccaggacaaactcacgctcgatactgaggagaatgacgttgacgacgagatcctgtctggtagttccagggagagacgtaggtccttcctggaatccaactatttcaccaagccaaatctgaagcacacggacacggctaataaagaatgtatcaacaagctgaacaagaacacagttgagaagcctgaactcttcctgggccttaagataggagagcttcagaaactgtactctaaagccgattccctgaagcaattaatattaaagaccacaacaggtatcaccgagaaggttctccacggtcaagaaatatctgtcgacgttgacttcgttactgctcagtctaaaaccatggaggtcaagccatgtccattcaggccctatcactctccattactggttttcaaatcttataggttcagtccgtactatcgcaccaaggagaaactgccactctcatcagtgagctacagcaatatgattgagccagatcagtgcttctgtcgctttgacctcacgggtacttgtaacgacgatgattgccaatggcagcacatccaggattataccctgtcacgaaagcagttgtttcaggacattctcagttacaatctgtccctcattggttgcgccgagaccagtactaatgaggagataactgcaagtgctgagaaatatgtcgagaagctgtttggagtgaacaaagacagaatgtctatggatcagatggctgtgctgctggtgtcaaacattaatgagagcaaaggccatactccccccttcaccacctataaggataaacgcaagtggaagcctaagttttggcggaaacctatcagtgataatagcttctcaagcgacgaggagcagtccacgggaccaatcaagtacgcgttccagccggagaatcagatcaacgtgccagcccttgacactgtcgtgacaccagacgacgtccggtacttcactaacgagacagatgacatagctaatcttgaggcgtccgtcctggaaaacccttcacatgtacagctgtggctgaagttggcctacaagtaccttaatcagaacgagggtgaatgtagtgaaagtctggattctgctctcaacgtgctggccagagctctggagaataacaaggacaatcctgaaatttggtgccactacctgcgcttgttttctaaaagaggcacaaaagatgaggtgcaggaaatgtgtgagaccgccgtcgaatatgctcctgattatcagtctttttggacgttcctccacctggaatctacgtttgaagagaaggactatgtgtgtgaacgaatgttggagttcctcatgggagctgctaaacaagaaacaagcaacattttgtcattccagctgctggaagcattacttttcagagtccagctgcacatttttactgggcggtgtcagtccgcattggctattttacagaatgccctgaagagcgctaatgacggcatcgtcgctgagtacctgaaaacttctgaccgttgcctggcctggcttgcttacatccatctaattgagtttaacattctgccatctaagttctatgacccgtctaacgacaaccctagccgcatcgtgaacacagaatcctttgtgatgccgtggcaggccgttcaggacgtcaagaccaacccagatatgctcttggccgtcttcgaagatgccgttaaagcatgcactgacgagtccctagctgtggaagagaggattgaggcttgtctaccgctttatacaaacatgattgccctgcaccagctcctggagcggtatgaagcggcaatggagctgtgcaagagcctcctggagtcatgccccattaactgccagctgctggaggcactggtagccctgtacttgcagacaaaccagcacgataaggcgcgcgcagtgtggttgacggcttttgaaaagaaccctcagaacgcggaagtattttaccacatgtgtaaattcttcattcttcaaaatcggggagacaacttactgccattccttcgcaagttcatcgcaagtttctttaaacccgggttcgaaaagtacaacaacctagatctgttccggtacctgttgaacatcccaggtcccattgatatccccagccggctctgcaagggtaacttcgacgatgacatgttcaatcatcaagtgccatatctgtggctcatttactgtctgtgtcacccacttcagtcttccattaaagaaaccgtggaggcgtatgaagccgcacttggtgtggccatgcgatgcgatatcgttcagaagatctggatggactatctggtatttgcgaacaatcgcgccgcgggctctcgcaacaaagtgcaggagttcaagttcttcacagatttggtaaatagatgtctcgtcaccgtgcccgcccggtaccctatcccattctccagtgctgactattggtccaactacgaattccataacagagttatttttttttaccttagctgcgtgcccaagacccagcatagcaagacactcgaacgtttctgtagcgtaatgcccgccaatagcggactagcccttcgcctactccagcacgagtgggaagaaagcaatgtgcagattctgaaacttcaagccaaaatgttcacctacaacatccctacttgtcttgccacttggaagattgccattgccgcagaaattgtcctcaagggacagagagaggtccacaggttgtatcagcgtgctctccaaaaacttcctctctgcgcctccttgtggaaagatcaattactgttcgaggcttccgagggaggaaaaacagataatttgcgaaaactggttagcaaatgccaagagataggcgtgtcattaaacgagctgctcaaccttaacagcaataaaaccgaaagtaagaaccattag

SEQ ID NO: 52670 - DNA, 1041 bp, Artificial Sequence
  Description of Artificial Sequence: Synthetic coding sequence
atggccaccgccgacacccccgcccccgccagcagcggcctgagccctaaagaggagggagagctcgaagacggcgaaatatccgacgacgacaacaactcccaaatccgaagtaggagcagctcctccagttctggaggagggttacttccttatcctcggaggagaccaccgcactccgctcggggcggcggcagcgggggcggcggcgggtcttcgtcaagctcatcatctagccagcagcagctgcggaactttagccgctcaaggcatgcttcagaaagagggcatctgagaggaccttctagctaccgaccgaaggaaccattccggagccatccaccctcagtgcggatgccatcttcttccctgagtgagagctccccacgtccttccttctgggaacggtctcatttggccctcgatcgattccgctttcgtggacggccttacagaggcggttcccgctggtcacgcgggcgaggtgtgggggaacggggaggaaagcccggttgtcgaccaccactcggaggaggtgccggctcagggttctcctcttcccaatcctggcgggagccttctcctcctcgcaaatctagcaagtccttcggcagaagccccagccggaaacagaactattcaagcaaaaatgagaactgcgtggaggagacctttgaagatctgttgttaaaatataagcagatccagctcgagctcgagtgcattaataaggatgaaaagctcgctctgtcctcaaaggaggagaacgtgcaagaggatcccaagaccctgaatttcgaagaccagacatccacggacaacgtttcgatcacgaaggattcttccaaggaggtggccccggaggaaaagacgcaggttaaaacattccaagccttcgagcttaaacctctaaggcaaaaactaactctgcctggggataaaaatcggctgaagaaggtgaaagatggggcaaagcccctgagtctgaaatccgacacaactgattccagccaggggaacggaatcaagtacttttcttag

SEQ ID NO: 52671 - DNA, 606 bp, Artificial Sequence
  Description of Artificial Sequence: Synthetic coding sequence
atggagaagatcaaggcccggctgaaggccgagttcgaggccctggagtccgaggagcgccatctgaaggagtacaagcaggagatggacttgcttctgcaagagaagatggctcatgtcgaagaactgcgattgattcatgccgacataaatgtgatggaaaataccatcaagcagagcgagaacgatcttaacaagcttttggagagtactagacgcttgcatgatgagtataaacccctcaaagagcacgtcgatgctctgcggatgacacttggcctgcagagacttcccgatctttgcgaagaagaagaaaaactctccctggactactttgaaaaacagaaggcagagtggcagacagagccacaggagcccccaatccctgagtcacttgcagcagccgccgccgctgcgcagcagctgcaggttgcgaggaaacaggacacgcgccaaacggctactttccgtcagcaacccccgccaatgaaggcatgtctttcgtgccatcagcagatccaccgcaacgcccctatttgtcccctctgcaaggctaagagtagatcgagaaaccctaaaaagcctaagcgaaagcaagatgagtag

SEQ ID NO: 52672 - DNA, 675 bp, Artificial Sequence
  Description of Artificial Sequence: Synthetic coding sequence
atggccgacgagcaggagatcatgtgcaagctggagagcatcaaggaaatccgaaacaaaactctacagatggagaagatcaaggccagactcaaagcagagttcgaagcactggagagcgaagagaggcatctgaaagagtacaaacaagagatggatctcttgttacaggagaagatggctcacgtggaggagctaagactgatccacgccgacatcaacgtgatggaaaacacaatcaagcagtcggaaaatgaccttaacaagctgttggaaagcaccaggagactgcatgacgaatacaagccactcaaggagcatgtggatgcgctcagaatgaccctggggttgcagagacttcccgacttgtgcgaggaagaggagaagctgtccctcgattacttcgaaaagcagaaggcagaatggcagaccgaaccacaggagccaccaatccctgaatccctggctgctgcagcagctgcggcccaacagctccaggtagccagaaaacaggacactagacagactgctacttttagacagcagcccccgccgatgaaagcgtgcctgagctgccatcagcaaatccaccggaacgcacccatatgtcctctgtgcaaggccaagtcgaggtcccgcaaccctaagaagccaaagcgaaaacaagacgagtag

SEQ ID NO: 52673 - DNA, 531 bp, Artificial Sequence
  Description of Artificial Sequence: Synthetic coding sequence
atggccgacgagcaggagatcatgtgcaagctggagagcatcaaggagatccgaaacaagaccttgcagatggaaaagataaaagcaagacttaaggcagaattcgaggccctggagagcgaggagcgccatctcaaagaatataagcaggaaatggacctgttactgcaggagaagatggctcacgtggaagagcttcggctgatacatgcagatatcaatgtcatggagaatacaataaagcagtccgagaacgacctcaacaagttgctggaatccacgaggagactgcacgatgagtataagcccttaaaagagcacgtagatgcacttcgaatgactttaggcctgcagagactgccggacctttgcgaggaggaggagaaactcagtcttgagccagcgtgccatgtgacctccaagtttacaggaatgcacctctacgcgctgttcgctcgtccccgcgtgggaccggggacacccaaatctcgaaacgggagcagaatgaataaggaacgggaatcaacctag

SEQ ID NO: 52674 - DNA, 660 bp, Artificial Sequence
  Description of Artificial Sequence: Synthetic coding sequence
atgatccacttccacctgatcttcctgtacgtggcccggaacaagacgttgcaaatggaaaaaatcaaagctagactgaaggctgaattcgaggccctagagagtgaagagcgccatttgaaagaatataaacaggaaatggacctgctgctccaggaaaaaatggcacatgtcgaggagctccgcctgatccatgcagacatcaatgtgatggagaataccattaaacagtcagagaatgacctgaacaaattgctggaatcaactcgacggctgcatgatgagtacaaacctctgaaagaacatgtggacgcccttcgcatgaccctgggacttcagaggttgcccgacctctgcgaagaagaggaaaagttatccctagattacttcgagaagcagaaggccgagtggcaaaccgagcctcaggagcctccaatcccagaatctctggctgctgccgcagccgccgcacagcaactacaagtggctcgtaagcaggacaccaggcagaccgctacctttcgacagcagcctccccctatgaaggcatgcctgagctgtcaccagcagatacataggaacgcaccaatatgtccactgtgcaaggcaaaaagtcgaagccggaatccaaagaaacccaagcggaaacaggacgaatag

SEQ ID NO: 52675 - DNA, 513 bp, Artificial Sequence
  Description of Artificial Sequence: Synthetic coding sequence
atggccacccccatgcaccggctgatcgcccggcggcaggccgaggcgaataagcagcatgtacggtgtcagaaatgcctcgagttcgggcactggacctacgagtgcactggtaaacgcaagtatcttcaccggccctctaggaccgccgaacttaagaaagcgctgaaagaaaaggaaaaccgcctcctgttacaacagagcatcggcgaaaccaatgtggagagaaaagccaagaagaagcggtccaagtcagtgacatccagctccagctctagctccgacagctctgccagcgattctagctctgagagcgaggagaccagtacctcctcaagctcagaagacagcgacactgatgagagcagctcttcttctagtagtagtgccagcagcactactagcagcagctcatctgactctgacagtgattcgtccagctcaagcagctcctctaccagtacagactcatcatcagatgatgaaccccccaagaagaaaaaaaaaaaatag

SEQ ID NO: 52676 - DNA, 501 bp, Artificial Sequence
  Description of Artificial Sequence: Synthetic coding sequence
atgagcagcaaggacttcttcgcctgcggccacagcggccactgggcgagaggttgccctaggggtggcgctggcggccgtcggggaggagggcatggccgcgggagccagtgtggttcaacaaccttgagttacacgtgttactgctgtggtgagagcggtcggaacgccaagaattgtgttcttctcggcaatatctgttacaactgcggaagatccggccacattgctaaagattgtaaggatccaaagcgagaacgccgtcaacattgctatacatgcggtagactggggcacctggcacgcgactgcgatcgccagaaggaacagaagtgttactcatgcggaaaactcgggcatatccagaaagattgtgctcaggtcaagtgttatcgctgtggagagatcggacacgtcgccatcaactgcagcaaagctaggcccggtcagctccttcctctgaggcagatcccaactagttctcagggcatgagtcagtag

SEQ ID NO: 52677 - DNA, 2850 bp, Artificial Sequence
  Description of Artificial Sequence: Synthetic coding sequence
atggccagcaaccaccccgccttcagcttccaccagaagcaggtgctgcggcaggaactaacccagatacagagtagcctcaatggcggcggcgggcacgggggtaagggtgctccaggccccggtggggcccttccaacttgccctgcttgccataagatcacccctagaacagaggcccccgtgagctccgtcagcaacagtttggaaaatgctctccacacctccgcacacagcaccgaagagagcctccccaagcgaccactaggaaaacactctaaggtgtctgttgaaaagatcgatctaaagggcctgtcacacaccaagaacgaccgcaacgtggaatgttctttcgaggtgctctggagcgactcatctatcacttcagtcactaagtctagctcagaagtcacagaattcatcagcaaattatgtcagctgtatccagaggaaaacttggagaagctcataccatgcttagcaggacctgacgctttttacgttgagagaaaccacgtagaccttgattcgggccttagatacttggcgagtctcccaagccatgttctgaaaaatgatcacgtgagaaggttcctgtcaactagttctccaccccagcagctgcagagcccttccccaggtaaccccagcctctctaaagtgggaacagtgatgggggtaagcgggcggcccgtgtgcggggtggctggaatcccctcttcccaatccggcgctcagcatcacggccagcatcctgcgggcagcgcagcgcctcttccgcattgcagccatgccggcagcgcggggtcagcactggcttaccgcacccagatggatacaagcccagctatcctgatgccttcttccctacaaacaccacaaacgcaggagcaaaacggcatcttagactggctgcgaaagttgcggctgcacaagtactatcccgtattcaagcagctcagcatggagaaatttctcagcttaacagaggaggatctgaacaaatttgaatccctgactatgggcgcaaaaaagaaactgaaaactcaactcgagctggagaaagagaagtccgaaaggaggtgtcttaacccctcggcccctcctctcgtcacctcatccggagtggcccgggtgcctccaacgtctcacgttggaccagtacagagcggcaggggaagtcacgccgccgagcttcgcgtggaggtcgagcagccccatcatcagcttcccagagagggctcttcatcagagtattccagctctagctcatcccccatgggcgtgcaggccagggaagagtcttctgactcagccgaagaaaacgatcgcagagtagaaattcatctcgagtcctctgacaaggagaaacccgtgatgctgctaaatcattttaccagtagcagcgcccggcccacagcgcaggtgcttcctgtccagaacgaggccagctcaaacccttctggccaccatcctctacctcctcagatgctctccgctgccagccatattacaccaattagaatgctgaacagtgtgcacaaaccagaacgtggatcagctgatatgaagctgctgtcttcttcagtccactctctcctcagcctggaggaacggaacaaaggcagcgggcctcgctcgagcatgaaagttgataaaagctttggatcagccatgatggacgtgcttcccgcaagtgccccgcatcagcctgttcaggtcctgtcaggcctaagtgagtcctctagcatgtctccaacggtctcctttgggccgcggaccaaagtggtccatgcctctacgctagatcgggtgttaaaaactgctcagcagcctgctctggttgtggaaacgtcgactgccgcaacgggcacacccagtactgtgctccacgccgcccgaccaccaatcaaactcctgctctcctcttctgtgcccgctgatagcgccatatcggggcagaccagctgtccaaacaacgtccagattagcgtgccgcccgctattattaaccctcggaccgcactttatacagcaaacaccaaggtggctttctcagcgatgagttccatgccagtgggaccgttacaagggggcttttgtgctaacagtaacactgctagcccctcttcacatcccagcactagttttgctaatatggctacccttccttcctgtccagccccttcaagtagcccggcattatcaagcgtgcccgagtcctcattctattccagttccggcggtgggggatccactgggaacatcccggcgagcaatcctaaccatcaccaccatcaccaccaccagcaaccacccgctcccccccagcctgctccacctccaccagggtgtatcgtatgcacatcctgcggctgctccgggtcatgcgggtcctcagggctaactgtcagctacgccaactacttccagcacccattcagtggcccctcagtgtttacttttccattcttgcccttttctccgatgtgttcctccggatatgtctcggcccaacagtacggtggcgggtctacatttcccgtggtccatgctccatactcgagtagtgggacccctgatcccgtgctatccggccagtccaccttcgccgtgcccccgatgcagaatttcatggcgggcactgcaggcgtctaccagacccagggccttgtgggcagttcgaacggcagtagccataagaaatccggaaatctgtcttgctataattgtggagcgaccggtcaccgtgcacaggactgcaaacagcctagcatggatttcaatagaccaggcacttttaggctgaaatacgcaccacccgccgagagcctggactccactgattag

SEQ ID NO: 52678 - DNA, 933 bp, Artificial Sequence
  Description of Artificial Sequence: Synthetic coding sequence
atggagaagtgcaccaagagcagcagcaccatgcaggtggagccctctttcctacaggctgagaatcttatccttcggttgcaaatgcagcacccaaccactgagaacacggccaagaggggacaggttatgcccgcactagccacgacagttatgcccgtgccttattccttggaacatctgacacagttccatggtgatccagctaattgttccgagtttctgacacaagttactacctacctgacagcactccagataagcaatccagccaacgacgcccagatcaaattattttttgactacctgagccagcagttggagtcctgcggtatcatctccggccccgataagagtaccctgttgaaacagtacgagaacctgattctagaattccagcaaagtttcggtaaaccaacaaaacaggaaataaatcccctaatgaacgctaagtttgacaaaggcgataacagtagtcagcaggatccggcgaccttccaccttctcgcacagaatttgatctgcaacgaaaccaatcagtccggccagttcgagaaagccttggctgatccgaaccaggatgaggagtctgtaacagacatgatggataacctgcccgacctcattacgcaatgcatccagctcgataagaagcatagcgacagacccgaactactccagtcagagacgcaactgcctttgttagccagccttattcaacatcaggcactgttttctccaaccgaccccccacctaagaaggggccaattcagcttcgcgaaggccagctgccactgacgcctgctaagcgtgcaagacagcaggagacacagttgtgcttgtactgttcacaaagtggccacttcaccagagattgcctggccaagcggtctcgggcccctgccacaaccaataacacagcacatcaatag

SEQ ID NO: 52679 - DNA, 687 bp, Artificial Sequence
  Description of Artificial Sequence: Synthetic coding sequence
atgcaggaggtgtgcagcggcgaggacacccacggcggccacttccccagcaggcctggccataccggcgcggagcaacagtgcgtgcaggggagactgaccttatggttacctcagcagcacagaagatggccgcagctcccccacagggcgctgctccggcccgatccccacctgcgaggtagtcaggcgcagcaggccgcacccacacagctacccgtcccacccgtgctgcagcaaagaactttacaccaagggttgccaccggggactcctcagcgacggggcccagatagtatacctggccagaaggcactgctgcgtagagtgcaagtttcccaggttcaggaaaagatggatgagcgtgaactgctaggtcaacacggagcaggggttcatcaggtgccccaccaaagggtgagcacgcaggcagagactccgggcgaggcgaggcgcccgggccgagttcgccctgagcagggcgctcccgctgcccctcttcgcgaagtgcaggggcctggcttacttttaccaagcagggccgtaacgggatgtccaccagccccccgggcgacgcctcgtcaacccgaggaaacactgcttccctgcgccacgccaagaggctgcgtctccccttgcgcctggggcgccctggcaggactgcgggggtgggcagggggatcttag

SEQ ID NO: 52680 - DNA, 726 bp, Artificial Sequence
  Description of Artificial Sequence: Synthetic coding sequence
atgagcctgctgagcgccatcgacaccagcgccgccagcgtgtaccagcccgcccagctgctgaattgggtgtacctgagccttcaagacacacaccaagcatcggcattcgacgcctttcgtccggagccgactgcaggggctgcccctccagagctggcgtttggcaaaggccgccccgaacaactcgggagtccactgcattcttcctacctgaattcctttttccagctccaacgcggagaagccctgtccaactccgtgtacaaaggagctagcccctacggatctctcaataatatagctgacggactgtcgagccttaccgaacacttctcggatcttaccctaacctctgaggcccgaaaaccttcaaaaaggccaccacccaactatctatgtcacttgtgctttaataaagggcattacataaaggattgcccacaggccaggcccaaaggcgaaggtctgactccatatcaggggaagaagcggtgttttggagagtataagtgtccaaagtgtaagagaaagtggatgtcggggaacagctgggcaaatatgggacaggagtgcatcaaatgccacataaacgtctacccacataaacaacgcccgttggagaagcccgacggccttgatgtgtcagatcagagcaaggagcacccacaacatctgtgtgagaaatgtaaagtccttgggtactactgccggagggtgcagtag

SEQ ID NO: 52681 - DNA, 1215 bp, Artificial Sequence
  Description of Artificial Sequence: Synthetic coding sequence
atggccaccggcggcggcgccgaggaggagcggaagcggggccggccccaacttctccctccagctcgccctgctgcgaggggggaggaggctgatgggggtcgggaaaagatggggtgggctcaggtggtgaaaaatctggccgaaaagaagggcgagtttagagaacctcgccctcccaggagggaagaggagtcgggaggtggcgggggttcagcgggcctggggggccccgctgggttggctgcaccagacctcggagactttccaccggccgggaggggggatccaaagggccgcaggagggaccccgcaggtgaggctgtagatccccggaaaaagaaaggtgccgccgaagctggccgcaggaaaaaagccgaggccgctgcggctgcaatggccacaccagctcggccgggcgaggccgaagatgcggcggagagacctctgcaggatgaaccagcagccgccgccgctggtcccgggaaaggtcgtttcttagtccggatttgctttcagggggacgaaggcgcctgccccacccgagatttcgttgtcggtgctctgatcctccgatcaataggcatggacccaagtgacatttacgccgttatccagattcccggttctcgtgagttcgacgtgtcatttcggtcggcagaaaaactggccctgtttttacgagtgtacgaagagaagagagaacaggaggactgctgggaaaattttgtggtgctgggcagatctaagagttccctcaagactctttttatactgtttcgcaacgagaccgtcgacgtggaagacattgtcacctggctgaaacggcactgcgatgttctggcggtgcccgtgaaggtgacggatcgatttgggatatggaccggagagtacaaatgcgagatcgaattgaggcagggcgagggaggtgtgcgacacttgccaggtgcattttttttgggggcagagcgggggtattcatggtataagggccaacccaaaacgtgcttcaaatgcggcagcagaactcacatgtctggatcgtgcacacaagacaggtgctttcgctgcggagaagagggccatctgtccccttattgtagaaaggggatcgtgtgtaacttatgtggaaaacgtggccacgccttcgcccagtgccctaaagctgtacataactcagttgccgctcagctaacaggcgtggcaggtcactag

SEQ ID NO: 52682 - DNA, 1428 bp, Artificial Sequence
  Description of Artificial Sequence: Synthetic coding sequence
atggtggaggacctggccgccagctacatcgtgctgaagctggagaacgaaataaggcaggcccaggtccagtggctgatggaggaaaacgccgcattgcaggctcagatccctgagctgcagaaatctcaggccgccaaggaatacgacctcctgcgaaaaagcagtgaagctaaagagcctcagaaacttcccgaacatatgaacccaccagcagcctgggaggcccagaaaacacctgagtttaaagaaccacagaaaccacctgaaccacaggacctgcttccctgggaaccaccagctgcttgggaactgcaggaggctcccgcggccccagagtctcttgcccctcctgccacaagggagtcgcaaaaacccccaatggcacacgagatccctacagtgttagaggggcagggtcccgcgaatacccaggatgccaccatcgctcaggaaccaaagaacagtgaacctcaggatccacccaatatagaaaaaccacaggaggcacccgagtaccaagagacggcagcccagctggagtttttggagctccctccaccccaggagccactggaacccagcaatgcacaggaattcctggagttgagcgcagctcaggagtccctcgaagggctgatcgtggtggaaactagtgcagccagcgaattcccccaggcaccaattggtcttgaggctaccgactttcctctccaatacaccctgacgttctccggagactcccagaagctgccagagtttcttgtgcaactgtactcctacatgagggtaagaggccatctttatcccacggaagcagcactcgtctcgttcgtggggaactgcttttctggtcgggcgggctggtggttccagttactgctcgacatccaatcccccttgctcgagcaatgtgaaagcttcattccagtgttacaggacacatttgacaatcctgagaatatgaaagatgccaatcagtgcattcaccagctgtgccagggcgaaggccatgtggccactcattttcacttaattgcccaagagctaaattgggatgaatccacgctctggatacagtttcaagaaggacttgccagcagcatacaggacgaactaagtcacacttcacctgcaacaaacttgtccgatctgataacccaatgcattagcctggaggagaagcccgaccccaaccccttgggcaagtcttcatcagcggaaggggacgggccagagagcccccctgcagagaaccaacctatgcaggctgctattaattgcccacatattagtgaagccgagtgggtcagatggcataagggccgtctgtgtctgtattgcggatatccagggcacttcgcccgcgattgtcccgtcaagcctcatcaggccctacaagccggcaacattcaagcctgtcagtag

SEQ ID NO: 52683 - DNA, 2355 bp, Artificial Sequence
  Description of Artificial Sequence: Synthetic coding sequence
atgggcaacgagcacatcagcgtgcaccccgagaacagcgactgcatccaagccgatgtgaacagcgacgattacaaaggagacaaggtgtatcatcctgagacaggtaggaaaaacgaaaaagaaaaggtcgggaggaagggaaaacatcttctgacagttgatcagaagcgcggggaacacgtcgtgtgcggatcgacacggaacaatgaaagcgaaagtactcttgatttagagggattccagaatcctacagccaaggagtgcgaaggactggcaactctcgacaacaaagccgacttagacggggagagtactgaggggactgaggaactggaagactcactcaaccatttcacacacagcgtgcagggtcagacctcggagatgatccccagcgatgaggaagaagaagacgacgaggaggaggaggaagaggaggagcctcgcctgacgattaatcagcgtgaagacgaagacgggatggctaatgaggacgagctggataacacatataccggcagcggggacgaagacgcattgtctgaggaggatgatgaattgggagaggcggctaaatatgaagacgtgaaggaatgcggcaagcacgtcgaacgggccctgcttgtggaactcaacaagatctcactgaaggaggagaatgtctgcgaggaaaagaatagccccgtcgaccaatccgactttttctatgaatttagcaagttgatattcacgaagggcaagtccccgacggtcgtctgtagcctgtgcaagagggaaggtcacctcaaaaaagactgccctgaggattttaagaggatccagttggaaccattaccacccctgactccaaaattccttaatattctcgaccaagtctgcatccagtgctataaggattttagccccactatcatcgaagatcaagcgcgagaacacatcaggcaaaatttggagagtttcattcgacaggatttcccgggcaccaaactgtccttatttggaagctcaaagaacggctttggcttcaagcagtccgaccttgatgtctgtatgaccatcaatggtctcgagaccgctgagggcctggattgcgtgcggactatcgaagaactggcccgggtgctgaggaaacattcaggcctgcgcaatatcctccctatcaccaccgccaaggtgccaatcgtgaaattctttcaccttcgctcaggcctggaggtggacatcagtttgtacaacaccctcgctctgcacaatacaagattgttgagcgcctatagtgcgatcgacccacgggtcaagtacctctgttacactatgaaggtttttactaaaatgtgcgacatcggcgatgcctcacggggttccctgtcgtcatatgcatatacgctaatggtgctgtactttcttcaacagcggaatccaccagtcatacctgtgcttcaggaaatatacaagggcgaaaagaaacccgagatctttgtagacgggtggaatatttacttttttgatcagattgatgagctccccacatactggtcagagtgtggaaagaataccgagtccgtggggcagctgtggctcgggctgctgaggttttacaccgaggagttcgatttcaaggagcatgtcatcagtatcagaaggaagtcacttctcacgacatttaaaaagcagtggactagcaagtatatcgtgatcgaggacccattcgatctgaatcacaacctaggagcaggactgtccagaaagatgacaaattttatcatgaaggccttcatcaatggcaggcgtgtgttcggtatacctgtgaaaggcttccccaaggactacccaagcaaaatggagtatttcttcgatcctgacgtcctgactgagggggagctggcccccaatgaccgttgttgcaggatttgtggtaagataggccatttcatgaaggattgtcctatgcgcagaaaggtgcgccgaaggcgggaccaagaggacgctctgaatcagagataccccgagaataaggaaaagcgttccaaggaagacaaggaaatccacaacaaatacaccgagcgagaggtgtccactaaggaagataagccaatccaatgtacgcctcagaaggccaagcctatgagggctgccgctgacctcggacgcgagaaaattcttaggccacccgtggagaaatggaaacgccaggacgacaaggacctccgggagaagcggtgcttcatatgtggacgggagggccacataaagaaagaatgccctcagttcaaaggcagcagcggtagtttgtccagcaagtacatgacgcaagggaaggcttcagccaaacgcactcaacaggaatcatag

SEQ ID NO: 52684 - DNA, 507 bp, Artificial Sequence
  Description of Artificial Sequence: Synthetic coding sequence
atggaggccggcagccccgagaacaagaagcagcggagccggccccgcaaaccccgaaaaacccggaacgaagaaaatgaacaagatggcgacttggaaggccctgtgatcgacgagagtgttctgtccaccaaggaactgctgggactgcagcaggctgaagaaagactcaagcgagattgtattgacagactaaaacggaggccgaggaactatccgaccgccaagtacacctgccggttatgcgacgtactcatcgagagcatcgcctttgcgcacaagcatattaaagaaaagaggcacaagaaaaacataaaagagaaacaggaggaggaactgctcaccaccctcccccctccaacaccgtcccagattaacgcagtgggaatcgctattgacaaggtagtgcaagaatttggactgcacaacgaaaacctggagcagcgactggagatcaagcgcattatggagaacgtgttccagcacaagcttcccggaatcttttag

SEQ ID NO: 52685 - DNA, 375 bp, Artificial Sequence
  Description of Artificial Sequence: Synthetic coding sequence
atgagccagcccgacgtgctgctgctggtgcaggagtgcctgaagaacagtgattcattcattgatgtcgacgctgatttccatgcccgtgtgcccgtagtagtgtgcagagagaagcaaagtggcttgctctgcaaagtttcagcgggtaatgaaaacgcttgcttaaccacaaaacacctaactgcactgggcaagctggaaccaaagctggtgcctcttgtgatcgccttccggtattgggcaaaactttgtagcattgaccgtccggaagaggggggcctgcctccctatgtgtttgctttaatggccatttttttcctccaacaacgaaaagaacccttactacctgtgtatctgggctcatgggtgtag

SEQ ID NO: 52686 - DNA, 1188 bp, Artificial Sequence
  Description of Artificial Sequence: Synthetic coding sequence
atgaccatcaacggcctggagaccgccgagggcctggactgcgtgcgcactatcgaagaacttgcaagggtgctcagaaaacacagcggactgcgcaacatactaccaatcactactgctaaggtgccaatcgttaaattctttcatctgcgcagcggcctcgaagtggatataagtctgtacaataccctcgctctgcataacactcgcttgctgtccgcctacagtgccatcgatccgcgggtgaagtacctgtgttacacaatgaaagtgttcactaaaatatataaaggcgagaagaagcctgaaattttcgtggatggctggaatatctactttttcgaccagatcgacgagctgccgacttactggagtgaatgcggcaaaaacaccgagtcggtcggccagctgtggttgggactgctccgcttctacacagaggaatttgatttcaaagaacatgtcataagtattcgccggaaatccctgctgaccacatttaaaaagcagtggaccagcaaatacattgttatagaggatccattcgatttgaaccataatctaggcgcgggactgtctcgaaagatgacaaattttatcatgaaggctttcatcaatgggcggcgggtgtttgggatacccgttaaagggtttcctaaggattatccctcgaagatggaatatttttttgatccggacgtgcttactgaaggagagttggccccgaatgatcgatgttgtcgcatttgcggcaagatcgggcactttatgaaagactgccctatgaggaggaaggtacgcaggaggcgcgatcaggaagatgccctgaaccagcggtacccagaaaacaaggagaaacgatccaaggaggacaaggaaattcacaacaaatatactgagcgggaggtgagtactaaagaggataagcccattcaatgcactcctcagaaagcgaaaccaatgcgcgcagcagctgatctcggaagggagaaaattctgcggccccctgtggagaaatggaagaggcaggatgacaaggatctgcgggagaagcgttgttttatctgcggccgggagggccacatcaagaaagagtgcccacagtttaaggggagcagcggaagcctcagctccaagtatatgacccagggaaaagccagcgccaagcgaacacagcaggaaagctag

SEQ ID NO: 52687 - DNA, 3780 bp, Artificial Sequence
  Description of Artificial Sequence: Synthetic coding sequence
atgggcgacaccgccaagccctacttcgtgaagcggaccaaggacagaggaacaatggatgatgatgattttagaagggggcatccacagcaggactacctgattatcgacgaccacgcgaagggacatggaagcaaaatggagaaaggcttacaaaaaaagaagattacgccgggaaactatggcaataccccacggaaaggcccatgcgcagtgtctagcaacccctatgctttcaaaaaccccatctattctcagccggcctggatgaacgattcccataaggaccagtctaaacgctggttgagcgatgagcacaccgggaactctgataattggagagagtttaagcccggaccacgaatcccagtaatcaaccgccaaaggaaagatagttttcaggagaacgaagatggctaccgctggcaggacaccaggggctgccggacagtcaggaggttattccacaaagatctcaccagtctggaaacgacttcagagatggaggcgggctcccctgagaacaagaagcagcgaagccggccacgcaaaccacgcaaaacaaggaatgaggagaacgagcaggacggcgatctcgaaggccccgtcatcgacgaatccgtcctgagcaccaaagagctactgggactacagcaggctgaggagcgtctgaaacgggattgtattgatcgccttaaaagacgccctaggaactacccgaccgctaaatatacatgtaggctgtgtgacgtgttaatagaatctatcgccttcgcccacaagcacattaaagagaaacggcacaagaaaaacataaaggagaagcaggaagaggagctcttaaccacattgccacctcctactccctcccagattaacgctgttggaatcgcaattgataaggtggtccaagagttcggcctgcacaacgaaaacttagaacagagactggaaatcaagcgtatcatggagaacgtgttccagcacaagctgcctgactgttctctcagattatacggttctagctgttcccggctgggcttcaaaaattctgatgtgaacattgacatccagtttccggccatcattgaagggtttagcttaagtaagttggggaatttcaacctgcaggatatcgagaaggacgtggtcatttgggagcatactgattccgccgccggtgatactggtatcactaaagaggaagcgccgcgtgaaacaccgatcaaacgtggacaagtgagccttattctggacgttaagcaccagccttctgttcctgtcggccagctttgggtggaactgttgaggttttacgcactggagttcaacctggcagacctagtcatcagcataagagtgaaagagctggtgtcccgcgaactaaaggactggccgaaaaagcgcatcgcaatcgaagacccgtattcagtgaagaggaatgtggctcggacattgaacagccagccagtttttgaatacatcctgcattgtctaaggactacctataagtattttgctctgccacacaagataaccaagtcttccttgcttaagcccttgaatgcaattacttgcatctcagaacatagcaaggaggtgataaatcatcacccagatgtgcagaccaaggatgataaactgaaaaacagtgtactggcacaggggcctggtgcaacaagcagtgccgccaacacatgtaaggttcagcctctaactctgaaggagacggcggaaagctttggtagcccccctaaagaagagatggggaatgaacacatctcggtacacccagagaacagcgattgcattcaggcagacgtgaacagcgacgactacaagggagacaaggtataccaccctgagacgggcaggaaaaacgagaaggaaaaagtaggccgcaaagggaagcacctcttgacagtggaccaaaagagaggcgaacatgtggtttgcggatccacacggaataatgaaagtgaatccaccctggatctggaaggatttcagaaccccacagcaaaggagtgcgaggggcttgccacgctcgacaacaaggccgacctcgatggagaatcaaccgagggcactgaagaactcgaggatagccttaaccacttcacacacagcgtgcaggggcagacctctgagatgattcccagcgacgaggaagaggaagacgacgaagaggaagaagaggaggaggaaccgaggttaacaatcaatcaaagagaagatgaggatggaatggcgaacgaagatgagttggataatacatacaccggatcaggagacgaggacgccctctctgaggaagacgatgaactgggagaggccgccaaatacgaggacgtcaaagagtgcggaaaacacgtagaaagggctttgctggtggagttgaataagatctcactgaaggaggaaaatgtctgtgaagagaaaaacagtcccgtggatcagagcgacttcttttatgaattcagtaagttgattttcactaaaggtaagggcctggattgcgtgcgcaccattgaggagcttgcccgcgtgctgaggaaacactctgggcttagaaatatcctgccaatcaccacagctaaagtgccaatcgtaaaattctttcatctgagaagcggtttggaggtcgatattagtctgtacaacacattagcgcttcacaacacaaggctgctcagtgcatactcagccatagatccccgggttaaatacctgtgttacactatgaaggtgttcactaaaatgtgcgacattggcgacgccagccgcggcagcctttcgtcctacgcatataccctcatggttctgtactttttacagcagcgcaacccaccggtcattcctgtgctgcaggaaatttacaaaggtgaaaagaaaccagagatttttgtcgatggctggaacatctatttcttcgatcaaattgatgagttacccacctattggagtgagtgtgggaagaacaccgaaagcgtcgggcagctgtggctgggactgctaaggttctacaccgaggagttcgatttcaaggagcacgtgatttcgattagacgtaaatcgttgctgacaaccttcaaaaaacagtggactagcaagtatattgtgattgaggacccatttgatctgaaccacaatctcggcgctggcctctctagaaagatgactaacttcatcatgaaggcatttattaacgggcgacgggtgttcgggatcccagtaaaaggctttcccaaggactacccatccaaaatggaatacttcttcgatcctgatgtgctcaccgaaggcgagctggcgcccaatgaccgttgctgcagaatatgcggcaagatcggccatttcatgaaggactgccctatgagacggaaagttcgaagaaggagggatcaggaggatgctctaaatcagcgatatcccgagaacaaagagaagcgatcaaaagaggacaaagaaattcataataaatacactgagcgcgaggtcagtacaaaggaggacaagcccatccagtgtactccacaaaaggctaagccgatgcgggccgctgccgatctgggacgagagaagattctccgaccccccgtggagaagtggaagcgccaagatgacaaagatctgcgagaaaaacgctgtttcatctgcggcagagagggccacatcaagaaagagtgcccccagttcaagggcagcagcggctcactgtctagcaagtacatgacacagggcaaggcttccgctaagaggacccaacaggaatcatag

SEQ ID NO: 52688 - DNA, 4374 bp, Artificial Sequence
  Description of Artificial Sequence: Synthetic coding sequence
atgggcgacaccgccaagccctacttcgtgaagcggaccaaggaccgggggacaatggacgacgacgatttcaggagagggcatccgcagcaggattacctcatcatagacgatcatgctaaagggcatggttccaaaatggaaaaagggctacagaagaaaaagataaccccgggaaactatggcaacaccccccgtaaggggccatgtgcggtgtcctctaacccatatgcgtttaaaaaccccatctactcccagcccgcatggatgaatgattcccacaaagatcagtcgaaacgttggctgtccgacgagcataccggcaacagcgacaactggcgcgagttcaagcccggccctcgtatccccgttatcaacaggcagagaaaggattcttttcaggaaaacgaggacggataccgctggcaggacacgcgagggtgtcgcactgttagacgtctttttcataaagacttgacctcccttgaaaccactagcgaaatggaggctggttcaccagagaataagaagcagcggagtaggccccgtaagcctagaaaaaccaggaacgaggagaatgagcaggacggagatctggaaggacccgtgatcgacgagagcgtactgtcaactaaggagctgctggggctacagcaagcagaagaaagactcaagagggattgtattgaccgactaaagcgaaggcctcgaaactatccaaccgctaaatatacttgtaggctgtgcgacgtgctaattgaaagcatcgcctttgctcataagcacatcaaggagaaacgacacaaaaagaatattaaggaaaagcaagaagaggagttgcttacaacgcttcctcctccaacaccatctcagattaatgccgtgggcattgctatcgacaaagtggtgcaagagttcggcttgcataacgagaacctggagcaacgtttggagattaaacgtattatggaaaatgtgttccaacacaaacttcccgattgcagcttgcggttgtacgggtcctcttgttcccggctggggttcaaaaatagcgatgtcaacattgacattcaatttccggcgatcatgagccaacccgatgtgcttcttctagtgcaagagtgtctcaagaactcggactcgttcatcgacgtggatgctgacttccatgctagggtaccggtcgttgtctgtcgggagaagcagagcggattactatgtaaagtgtcagcaggtaacgagaacgcctgtctgactactaagcacctgacagctctcggaaagctagagcctaaactcgtcccactggtaatcgccttccgatactgggccaagctttgcagtatcgatcggcccgaggaaggaggtttgcccccatatgttttcgccctcatggctatcttctttttgcagcaacggaaggaacctctgctgcccgtgtacctcggatcttggatcgaaggcttttcattgtcgaagttgggtaattttaatttgcaagatattgagaaagatgtagtgatttgggaacacaccgactctgccgcaggcgatacagggatcaccaaggaggaggcccccagagaaacgcccattaagcgtgggcaggtctccctcattttggacgtgaaacatcaacctagcgtgcctgtgggccagttgtgggtggaactgttgaggttctacgctctggagttcaatttggctgacctggtaatctccatacgcgtgaaggaactggtctccagggaacttaaggattggcccaaaaaacgcatcgctatcgaagatccctattccgtgaagagaaacgtggcccgaaccctaaacagccaacccgtcttcgagtatatactgcattgtctcaggacaacctacaaatatttcgccctacctcataagatcactaaatcctccttactgaaaccattgaatgcaatcacatgtatttccgaacattcaaaggaggtgataaatcaccaccctgatgtgcaaacaaaagatgacaaattgaagaattctgtgctggcacagggccccggagcgacaagcagtgctgcaaatacatgcaaagtgcagcctctgaccctcaaggaaactgcggaatccttcggctcccctcccaaggaggaaatgggtaacgaacatatttccgtgcaccctgaaaacagcgattgtattcaggccgacgtaaatagtgatgattacaagggagacaaagtctaccatccggaaaccggaaggaagaatgagaaagaaaaggtgggacgaaagggaaaacatcttttaactgtggatcagaagagaggcgagcacgttgtgtgtggcagcactcgtaacaatgagagtgaatcaacattagacctggaaggatttcaaaaccccaccgcaaaggagtgcgaaggcctggccacactagataacaaagccgacttggatggagagagtactgaaggcactgaggagctagaagattctctcaaccactttacccatagtgtgcaggggcagaccagtgaaatgatcccgtcagatgaggaggaagaagacgacgaagaagaagaggaggaggaagagcccagattgacaatcaatcaacgggaggatgaagatggcatggctaatgaagatgaactggacaatacctatacagggagtggggatgaagatgccctgtccgaggaggacgacgagttgggggaagccgcaaagtacgaagatgtcaaagaatgcggaaagcatgttgagcgcgccctgctcgtggagctcaacaagatttccttaaaggaggaaaatgtgtgtgaagaaaagaactcccctgtagaccagtccgacttcttctatgaattctctaaacttatattcaccaaaggaaagagtccaaccgtagtgtgcagcctatgtaaacgggaagggcacctgaagaaagattgtcctgaggactttaaaaggattcagctggagcctcttccccccctgacgcccaagttcttgaacatattggaccaggtctgtatccagtgttacaaagacttttctcctaccataattgaggatcaagccagagagcacatccgtcagaacctagagtcattcatacggcaagatttcccaggtacaaagttgagcctgtttggttcatctaaaaatggcttcggctttaagcagagcgacctggacgtctgtatgaccattaatgggctcgagaccgccgaaggcctggattgtgtaagaacaatcgaggagctcgcacgggtactgaggaagcatagtgggcttagaaacatcttacccatcacaaccgccaaagtgccaatcgtgaaattttttcatctgaggtctggacttgaagtggatatctccctgtacaatacattggcactacacaatacccgactcctctctgcctactccgcaatcgaccctcgcgtcaaatacctctgctacacaatgaaggtgtttacaaaaatatataagggagagaaaaaaccagaaatcttcgtggatggatggaatatctatttcttcgatcagatcgatgaactgcccacatactggtccgaatgcggcaagaataccgagtctgttggacaactatggctcgggcttcttagattctatacggaagaatttgacttcaaggagcacgtaataagcatcaggcgcaagtccttactgaccacattcaagaagcaatggacatctaagtacattgttatcgaggatcctttcgaccttaatcataatttaggagcaggattgagtcgaaaaatgaccaacttcatcatgaaagccttcataaacggcagacgcgtttttggaatacctgtgaaaggttttccaaaagactacccatcaaagatggaatatttctttgatcctgacgtccttacagagggggagctggccccaaacgacagatgctgcagaatctgtggcaagatcgggcatttcatgaaggactgccctatgagacggaaagtcaggcgccggcgtgaccaggaagatgccttgaaccagcgctaccctgagaataaagaaaagcgctctaaggaggacaaagagattcacaacaagtacacagaaagggaggtatctaccaaagaagataaaccgattcaatgtactccgcagaaggctaaaccgatgcgggcggctgccgatctgggtcgagaaaagattctacggcccccagtggagaaatggaaacggcaagatgataaagatttgcgcgaaaaacggtgctttatttgtggacgagagggacacatcaagaaggagtgcccgcaatttaagggctcatctggctcactcagttctaagtacatgacacagggcaaggcctccgcaaagaggacccagcaagaaagctag

SEQ ID NO: 52689 - DNA, 4488 bp, Artificial Sequence
  Description of Artificial Sequence: Synthetic coding sequence
atgggcgacaccgccaagccctacttcgtgaagcggaccaaggaccggggcaccatggatgatgacgactttaggaggggtcaccctcagcaggactatttaatcattgacgatcatgctaaaggccatggcagtaagatggagaagggccttcaaaagaagaaaattacccctgggaattacggtaataccccaaggaagggcccttgcgcagtctcctccaatccttacgcttttaagaaccctatctactctcaaccagcttggatgaacgatagccacaaggatcagtcaaagagatggctaagtgacgaacacactggaaacagcgataattggagggagtttaagcctgggccaagaatcccggttatcaaccgtcagcgcaaggacagctttcaggaaaacgaggatggatatcggtggcaggacaccaggggatgccggacagtacgtagactgttccacaaggacttaacatccctggagaccacttccgagatggaggctggctcacctgagaataagaagcaaaggtcgaggccgcgaaagccaagaaagacacgaaatgaagaaaatgagcaggacggtgatctggaagggccagtgatcgatgagagcgtacttagcaccaaagaactgctgggcctgcagcaggccgaagaacgactgaaacgtgactgcattgataggcttaagcggagaccacgaaattaccctacagctaagtatacctgtcggctatgcgatgtcctgatcgaatccatcgcctttgcacataaacacatcaaggaaaaacggcacaagaagaacattaaagagaagcaggaggaggaactgttgaccactctgccaccaccaacgccctcacaaatcaacgccgtaggcatcgcaatcgacaaggtggtccaagaatttggactgcataatgaaaatctggaacagcggcttgagatcaagagaattatggagaatgtttttcagcataagctgccagattgcagtctgagattatacggttctagctgttcaaggctgggatttaaaaactctgacgttaacattgacatccagttcccagccattatgtctcaacctgacgtgctcttactggttcaggaatgcttgaaaaacagtgactcctttatcgacgtcgatgcagatttccatgccagggtcccagttgtagtctgtagagagaagcagagtggtctcttgtgtaaagtgtcagccggaaatgaaaatgcttgcttgaccacaaagcaccttacggctctggggaaacttgagcccaagctggtgccattagtaatcgccttccgctactgggcaaaactttgcagcatcgataggccagaggaaggaggtttgcccccctatgtgttcgcactcatggctatcttcttcttgcagcaaaggaaggaacctctgctaccagtctaccttggttcttggatcgaaggattcagcctgtccaagctcggaaactttaacctccaggatatcgagaaggacgtggttatctgggagcataccgacagtgccgctggagatactgggatcacaaaagaagaggctccgcgggaaactccaatcaagcggggccaggtctcattaatcctggacgtcaaacatcagccttccgtgccagtcgggcagctgtgggtggaactccttcggttctatgcgttggaatttaatctggccgatctggtcatatccatccgagtgaaggagcttgtgtcacgggaactcaaggactggccgaaaaaacggattgctatcgaggatccttactcagtgaaacgcaatgtcgcccgtacactgaatagccagcccgtgtttgagtatatcctgcactgtctcaggaccacttacaaatacttcgcactgcctcataaaataacaaaaagctccctgctgaagccgctgaacgcaatcacctgcatttcagagcattctaaagaggtcattaatcaccacccagatgtgcaaacgaaagatgacaaattgaaaaatagcgtgctcgctcaggggcccggcgccacatcttctgccgccaacacctgcaaggtgcagcccctgacactgaaagagaccgccgagtcctttggcagtcccccaaaagaggagatggggaacgagcacatctcagttcaccccgaaaattcagactgtatccaggccgatgtcaatagcgatgactacaaaggtgacaaggtttaccatccagagaccggtaggaaaaacgagaaagagaaagtaggcagaaaaggcaagcacttactgactgttgatcagaagcgaggcgagcacgtggtgtgtggatcaacccgcaacaacgagagtgaaagtaccttggacctcgaaggcttccagaatcctaccgccaaagagtgcgaagggctcgccactttggataataaggccgatctcgatggcgagtctacagagggtaccgaggaactcgaggatagtcttaaccatttcacccatagtgtacagggccagacaagcgaaatgatcccttccgacgaggaggaggaagatgacgaggaggaagaagaagaggaggagcctagactcactattaatcagagggaggatgaggatgggatggccaatgaggacgagctggacaatacgtatacaggctccggcgacgaggatgccctatccgaggaagatgacgaactaggcgaagcggccaagtatgaggatgtgaaagagtgcggaaagcatgtggaacgagctctgctggtagagctgaataagataagtttgaaagaggaaaatgtgtgtgaagaaaaaaatagccctgtggaccagtctgatttcttctatgaatttagcaagcttatttttactaagggcaagtctccaacagtggtttgctctctgtgcaagagggagggccacctgaagaaagactgcccggaggactttaagcggatccagctggagcccctcccgccccttactcccaagttcttgaacattcttgaccaggtatgtatccagtgttataaagattttagccctacgatcattgaagaccaggcccgggagcacatccgccagaacctggagtcattcattcggcaggacttcccaggcaccaagctttccctgttcggctctagtaagaacggctttgggtttaagcagtccgatctggatgtgtgcatgaccatcaatgggctggagactgccgaaggcctcgattgtgtgcggaccatagaggaactggcgcgcgtactgcgaaagcactccggcctgaggaatatccttcctataacgacagctaaggtcccaatcgttaagttttttcacctgcgctctgggttagaggtggatatcagcttatataacacactggccctccacaatacacggctgcttagcgcttattccgccattgacccccgagtgaaatacttgtgctataccatgaaggtatttacgaagatgtgcgatatcggagacgcatctaggggctctctgtcctcatatgcatataccctgatggtgctgtatttcctgcagcaacggaatccccctgtgatcccagtactgcaagagatctataaaggcgagaaaaaacctgagatcttcgttgatggttggaatatctactttttcgaccagatagacgaattgcctacctattggtccgaatgcggaaagaatacagagagcgtgggacagttgtggttgggtctcctgcgcttctacacagaagagtttgactttaaggaacatgtgatatctattcggcgcaaatctctgctcaccactttcaagaagcaatggacatcaaaatatatagtgatagaagacccgtttgatttgaaccataatctgggcgccgggctctccaggaaaatgactaactttattatgaaggcgttcattaacggacggcgcgtgtttggaatacccgtcaagggatttcccaaggattatccgtccaagatggaatacttcttcgatcctgacgttctaaccgaaggcgagctggcccctaacgatagatgctgccgtatttgtggcaaaatcggtcacttcatgaaggactgccccatgcggcgcaaggttcgccgacgccgggatcaggaggacgctcttaatcagagataccccgaaaacaaagagaagagatcaaaagaagacaaggagattcacaacaagtataccgagcgggaggtctcaactaaagaagacaagcccatccagtgcactccccagaaagctaaaccaatgcgggctgctgccgatctggggagggaaaaaattcttaggccgcccgtcgaaaaatggaaacgccaggacgataaagatctccgggagaagagatgcttcatatgcggcagggagggacacattaagaaggagtgccctcagttcaaaggatcatctgggagcctgagtagcaagtacatgacacaggggaaggcatctgcaaagcgcacccagcaggaaagctag

SEQ ID NO: 52690 - DNA, 498 bp, Artificial Sequence
  Description of Artificial Sequence: Synthetic coding sequence
atggaggccggcagccccgagaacaagaagcagcggagccggcccaggaaacctcgcaagacacgcaacgaggaaaacgagcaagatggtgacctcgagggtcctgtcattgatgaatcagtcttatctacgaaggagctgctcggactccaacaggcagaagagaggcttaaaagagactgcattgaccgtctgaagcgacggccaagaaactaccccactgctaagtacacatgcaggttgtgtgacgtattaatcgaatctattgcatttgcccacaaacacatcaaggagaaaagacataagaagaatataaaggagaaacaggaggaggagctgttgacaacccttcccccaccaaccccttctcaaattaacgccgtcgggattgctattgataaagtggtgcaggagtttggccttcacaatgagaacttggaacaaagacttgagattaaaaggatcatggagaacgtgttccagcacaaacttccgtag

SEQ ID NO: 52691 - DNA, 618 bp, Artificial Sequence
  Description of Artificial Sequence: Synthetic coding sequence
atgttcggcggctacgagaccatcgaggcctacgaggacgacctgtatcgggatgagtctagcagtgagctgagtgtcgactcagaagtagagttccagttatactcacagatccactacgcccaagatctggatgacgtcatccgagaagaggaacacgaagagaaaaattctggaaacagcgagagctctagtagtaagcctaaccaaaaaaagcttatagtgttgagtgactccgaagtcattcaactgagcgacggctccgaggtcattaccctatccgatgaggacagcatttacaggtgtaagggtaaaaatgtccgggtgcaggctcaggaaaatgcacatgggttgagctcctcactgcaatcaaacgagttggtggacaagaagtgtaaatctgatatcgagaagcccaagagtgaggagaggtccggagtcatccgtgaggtgatgataatcgaggtaagctcatctgaggaggaagaaagcacgatatctgagggggacaatgtggaatcttggatgcttctcggatgcgaagtggatgataaggatgatgacattttgctgaacctcgtgggctgtgagaattcggttactgaggggcaagagtag

SEQ ID NO: 52692 - DNA, 1632 bp, Artificial Sequence
  Description of Artificial Sequence: Synthetic coding sequence
atgatgttcggcggctacgagaccatcgaggcctacgaggacgacctttatcgtgacgaaagctcatccgagctgtcagtggactctgaggttgagttccaactgtactcgcagatccattacgctcaggacctcgatgacgtaattagagaggaggaacatgaagagaaaaattcggggaattccgaaagttcttcgtccaagcctaaccagaagaaacttattgtgctgtcagacagcgaagtgattcagctctctgacggctcagaagttattacactgagcgatgaagactccatttacaggtgtaaggggaaaaatgtgcgcgtccaggcacaggagaacgcccacgggctgtcctcgtccctccagagtaatgagttagtggataagaaatgcaaatctgacatcgagaaacccaagagcgaggaaagatcaggtgttatcagagaagtcatgatcatcgaggtgagcagctccgaggaggaggagagtaccatcagtgaaggcgacaatgttgagtcctggatgctgctcggatgcgaggtcgatgataaagatgatgatattttattgaaccttgtgggttgtgaaaactcagtcacagagggggaagatggtattaactggagcatcagtgataaggacatagaagcccagatagctaacaacagaacccccggcaggtggacccagcgctactatagcgcaaacaaaaatattatctgccggaactgtgataagcggggtcacttgagcaagaactgtcctcttccgcggaaggttagaagatgttttctatgcagcagaaggggccatctgctgtactcctgccccgcaccactgtgtgagtactgcccggtaccgaagatgctggaccatagctgcttattccgccattcatgggacaaacaatgcgaccggtgtcacatgctcggtcactatactgacgcctgtaccgagatctggcgccagtatcaccttaccaccaagcctggtcctcccaagaaacctaaaaccccaagcagaccaagtgccctggcttattgctaccactgtgcccagaaaggccactacggccacgagtgccccgagagggaagtgtacgatccatccccggtgtctccttttatctgctactacgatgacaagtatgagatccaggaacgggagaagcggctcaaacagaaaatcaaagttctgaaaaagaacggcgtaataccagagccatccaaactcccctatatcaaagcagctaatgagaacccccaccatgacatcagaaagggtcgggccagctggaaaagtaatcgttggccacaggagaacaaagaaactcagaaggagatgaaaaacaagaacaggaattgggaaaagcatcgtaaagcagaccgacacagggaggtggacgaggacttcccacggggaccaaagacctattcctcaccagggtcctttaaaacacaaaagccctccaagcccttccaccgctctagtcactatcacacatccagagaggacaagagccctaaagaagggaaacggggtaagcaaaagaaaaaggagagatgttgggaggatgatgataatgacaatcttttcctcatcaagcaaagaaaaaagaagtcctag

SEQ ID NO: 52693 - DNA, 762 bp, Artificial Sequence
  Description of Artificial Sequence: Synthetic coding sequence
atgctggaccacagctgcctgttccggcacagctgggacaagcagtgcgaccggtgtcatatgctcggacactacaccgacgcgtgtactgagatctggagacagtaccaccttacgactaagcccgggcccccgaagaaacctaagacccctagccgtccatccgccttagcttactgttaccactgtgctcagaagggccactacggccacgagtgcccagaaagagaggtttatgatccgtctcctgtctccccatttatctgttactatgacgacaagtacgagatccaggaaagagagaaacgtttgaagcagaaaattaaagtactgaagaaaaacggcgtgattccagaaccttccaagctgccttacatcaaagcagcgaacgaaaatccccaccacgacattaggaagggtagggcttcatggaagtctaacaggtggccgcaggagaacaaggaaacacagaaggagatgaagaacaagaacaggaattgggagaaacaccggaaagccgataggcatcgggaggtagacgaagactttcctaggggtcctaaaacatactcatccccaggatcatttaagacccagaagccctcaaagccttttcaccggtcaagccattaccacacatcaagagaagacaagagccccaaggagggaaaacgcggcaagcagaagaagaaagagcgctgttgggaggatgacgacaacgacaatctgttcctgatcaaacagcggaagaagaaatcatag

SEQ ID NO: 52694 - DNA, 2124 bp, Artificial Sequence
  Description of Artificial Sequence: Synthetic coding sequence
atggccgccgaggtgtacttcggcgacctggagctgttcgagcccttcgatcaccccgaggaatctattcctaagcctgtacatacccggttcaaagacgatgacggggatgaagaagacgaaaacggggtgggggacgccgaactgcgagagagactccgtcagtgtgaagagacaatcgagcagctgagagcggaaaatcaagagctgaagcgaaaactaaatattctgacgcggccatcaggcattcttgtgaacgacacaaaactggacggtcccatcctgcagatattattcatgaacaacgcgatttcgaaacagtaccatcaggagatcgaagagttcgtgtccaatttggtaaagagattcgaggaacagcagaagaacgacgtggaaaagacttccttcaatctcctacctcagccttcttccatcgtgttagaggaggatcacaaagtggaagagtcctgcgcgatcaagaacaacaaagaggcattcagtgttgtaggttccgtcctctactttactaacttctgcctagataagctgggtcagcctttactcaacgagaatcctcaattgtccgaaggatgggagatcccaaaatatcaccaggttttctcgcatatcgtgagtctggaggggcaagagatccaggtcaaggcaaaacgcccaaagcctcactgcttcaactgcggctccgaagaacaccagatgaaggactgtccgatgcctagaaatgctgcccggatcagcgaaaagcgtaaggaatacatggacgcatgtggagaggcaaacaaccaaaacttccagcagcggtaccatgccgaagaggtcgaggagcggttcggacgattcaagcccggtgttatatccgaagaattgcaggacgcactgggcgtcaccgataagtccttgcctccttttatctatcgcatgagacagctcgggtacccaccgggatggctgaaagaggctgaactagaaaatagcggactggcactgtatgacggcaaagacggcacagatggcgagacagaggttggagaaatccagcagaacaaatccgtcacatacgacttgagtaagctcgttaactaccctggcttcaatatctctacaccaagggggatccctgacgagtggagaatcttcgggtcaatacctatgcaggcctgccaacagaaggacgtcttcgcaaattatttaacctcaaatttccaagccccaggcgtgaagagtgggaacaagcggagcagctcccactcttccccaggatctccgaaaaagcagaagaatgagtcaaatagcgcagggtctcccgccgacatggaactcgactcagacatggaagtcccacacggttcgcagtcaagtgagagttttcagttccagcctcccctaccccctgacactccgcccctccccaggggcacacccccaccagtttttacaccgcctctacctaagggcactcctcctttgacacccagtgactctcctcagacgcggacagctagcggggccgtggatgaagatgccctcacattagaagaactggaggagcaacagagaaggatttgggccgcgctggaacaggccgaaagcgttaattctgattccgacgttcctgttgatacccctctaaccggtaatagcgtggcgtctagtccctgtccgaatgaactggaccttcctgttcccgaaggaaagaccagtgaaaagcagactttggatgagcccgaagtacctgagatctttacaaaaaagagcgaagctggccatgctagttcccctgacagtgaagtgactagcctttgtcagaaggaaaaggcggagctagcacccgtgaacactgagggcgccctgttggataatggttcagtggtgccaaactgtgatatctctaacgggggatcccagaaactgttccctgccgacacctcaccatccaccgcaaccaaaatccacagcccgattcccgatatgtctaaattcgccactggaattaccccctttgaatttgaaaacatggccgagtctaccgggatgtacctgcggattagatctttgttgaagaactcgccccggaaccaacaaaagaacaagaaggccagcgaatag

SEQ ID NO: 52695 - DNA, 1410 bp, Artificial Sequence
  Description of Artificial Sequence: Synthetic coding sequence
atgaaggactgccccatgccccggaacgccgcccggatcagcgagaagcgcaaagagtatatggacgcttgtggggaagccaataaccagaatttccaacagaggtaccatgctgaagaggtggaggaacggttcggccgcttcaaaccgggcgttattagtgaggagcttcaagacgccctcggtgtcactgataagagtcttcccccttttatataccggatgcgacagctgggctatccccctggttggctgaaggaagccgaactcgagaacagtggcctcgctctgtacgacgggaaggacgggactgatggcgagaccgaggtaggcgaaattcaacaaaataagagcgtgacctatgatctaagcaagcttgtgaactaccctggcttcaatatctccacacctcgcgggatccctgatgaatggcgtatttttggcagcatacccatgcaagcttgccagcagaaggatgtcttcgccaattacctgacatctaattttcaggctcccggcgtaaagtcggggaacaagcggtccagctctcacagctctccaggaagtcccaagaaacagaagaacgaaagcaactcagcaggatcacccgctgacatggagctagatagtgacatggaagtgcctcacggatcacagtcctctgaaagtttccaattccagccacccttgccccctgacacccctcctctgccccggggcaccccaccacccgttttcactccacctctgccgaaaggtaccccccctttgaccccatctgacagtccccagactcgcactgcttctggtgcagtggatgaggacgcactgacactggaggaactcgaagaacaacaaaggcgcatttgggcagctctcgaacaggctgaaagcgtgaatagcgattcagatgttccagtggacaccccgctgacgggcaattccgtcgctagcagtccatgtcctaatgagctcgatctgcccgtcccagaagggaagacaagcgagaaacagaccctggacgagccagaggtgcccgaaatcttcactaaaaaaagtgaagccggacacgccagctctccagactctgaagtcacctcgctgtgccagaaggagaaagcggagctagcccccgtgaacactgagggtgccctactggataatggcagtgtcgtgcccaattgtgatatatctaatgggggaagccagaagctgtttcccgccgacactagccccagcaccgccaccaaaatccacagcccaatacccgatatgagcaaatttgcaaccggaattactccctttgagttcgagaacatggccgagtcaactggcatgtacctccggatccgatctttgctaaagaatagcccaagaaaccaacagaagaacaagaaggcatccgagtag

SEQ ID NO: 52696 - DNA, 117 bp, Artificial Sequence
  Description of Artificial Sequence: Synthetic coding sequence
atgaaggactgccccatgccccggaacgccgcccggatcagcgagaaacggaaggagtacatggacgcctgtggcgaggcaaataaccagaactttcagcaacgctatcacgcatag

SEQ ID NO: 52697 - DNA, 1410 bp, Artificial Sequence
  Description of Artificial Sequence: Synthetic coding sequence
atgaaggactgccccatgccccggaacgccgcccggatcagcgagaagcggaaagagtatatggatgcctgtggtgaagcaaataaccagaactttcagcagagataccatgctgaggaggttgaagagagattcggcagattcaagccgggagtcatcagtgaagagctgcaggacgcgctgggagttaccgataaaagtctccctccttttatctaccgcatgcggcagctcggatatccccccggctggcttaaggaggctgagctggagaatagcggtctcgcactgtacgacggtaaggacgggacagacggagaaaccgaggtcggtgagattcagcaaaacaagtcagtgacttacgacttaagtaagttagtcaactaccccggtttcaacatctctacaccacgaggcatccccgacgagtggcggatctttgggagcataccaatgcaggcatgccagcagaaagacgtcttcgccaactacttgacgtctaatttccaggctcctggcgttaaaagtgggaataagcgatccagctcacatagcagtccagggagccctaaaaagcagaaaaatgaaagcaactctgccggctccccagccgatatggagctcgacagcgacatggaagtgcctcacggcagtcagagcagtgaatctttccaattccagccccccctgcctcctgacacaccacctctgccccggggcactcctccacccgtgttcacacccccactgcccaaggggactcctcctctgacgcctagcgactctccacaaacaagaactgcatcaggcgccgtcgacgaggatgccttgactctcgaagagttggaagaacagcagaggaggatatgggctgctctggaacaggcagaaagcgtcaattcggattcagacgtaccagtagacacacccctcaccggtaattccgtggcttcctccccatgccccaatgaacttgacctgcccgtaccagaagggaaaacatctgagaagcaaacgctggacgaacctgaggtccctgaaatttttacaaagaagtccgaggccggacacgccagcagtcccgattcagaggtgacaagcttgtgccaaaaagaaaaagctgaactggcacccgtcaacacggaaggagccctgctcgacaacggaagcgtagtgccaaactgtgacattagtaacggaggttcccagaagctgttccctgccgacacttcccctagcactgcaactaagatacattcccctatcccggatatgtccaaattcgccacaggtattacacccttcgaatttgagaacatggccgagagcaccggcatgtatctgaggatacgctcactgcttaagaattctccccgaaaccaacagaagaacaagaaggccagtgaatag

SEQ ID NO: 52698 - DNA, 816 bp, Artificial Sequence
  Description of Artificial Sequence: Synthetic coding sequence
atgacccggtgggcccgggtgagcaccacctacaacaagcggcccctcccagctaccagctgggaggacatgaagaaaggatccttcgagggcacgagccagaacctgcctaaaagaaaacaactggaggctaatagactttctctgaagaacgacgcgccacaggctaagcacaagaagaataagaagaagaaggagtatctaaacgaagatgttaatggattcatggaatacttgcgacagaattcacagatggtgcacaacgggcagatcatcgccacagactccgaagaagtgcgggaagagattgcagtggccctgaaaaaggactcacggagagaggggagacggctgaaacgccaggcagccaagaaaaacgcgatggtgtgtttccactgtcgtaagcccggccacggaatcgcagattgtccagccgctctggaaaatcaggacatgggtaccggaatctgctataggtgtggcagtacagagcatgaaattacaaagtgcaaagccaaagtcgatcctgctctgggcgagtttcctttcgccaaatgctttgtgtgtggagagatgggccacctgagtcggagttgcccagataacccaaagggactttatgctgatgggggcggctgcaagttatgcggcagtgttgagcatcttaaaaaggactgcccagaatcacagaactccgagcgcatggttactgtgggacgttgggccaaagggatgtccgccgactacgaagaaattttggatgtcccgaaaccacagaagcctaaaaccaaaatcccaaaggtcgttaatttttag

SEQ ID NO: 52699 - DNA, 816 bp, Artificial Sequence
  Description of Artificial Sequence: Synthetic coding sequence
atgacccggtgggcccgggtgagcaccacctacaacaagcggcccttaccagctacaagctgggaagatatgaagaaaggatctttcgaaggtacctcccaaaacctgcctaaaaggaagcagctggaggctaacaggttgagccttaagaatgatgctccacaggctaagcacaagaagaacaagaagaagaaggagtaccttaatgaagatgtcaatggatttatggaatatctcaggcaaaatagccaaatggtgcacaatggccagattatcgccactgactctgaagaagtcagggaggagattgccgttgccttgaagaaagactcaagacgggagggacgcagactcaagcggcaggctgctaaaaagaatgctatggtgtgctttcactgtcgcaagccaggacacggcatcgccgactgcccggccgccttggagaaccaggacatggggacaggcatttgttaccgctgcggcagcacagaacacgagatcactaaatgtaaagctaaagtggatccagctctgggcgagtttcccttcgctaaatgcttcgtgtgtggagaaatgggccaccttagtcgctcctgccctgataacccaaaaggattgtatgcggacggtgggggttgcaaactgtgtgggtccgtagaacacctgaagaaggactgtccagagtcccagaatagcgagcggatggtgacagtaggtagatgggctaaaggcatgagcgctgattatgaggaaatcctggatgtgccaaagccacaaaaacccaagaccaaaatacctaaggttgtgaatttttag

SEQ ID NO: 52700 - DNA, 816 bp, Artificial Sequence
  Description of Artificial Sequence: Synthetic coding sequence
atgacccggtgggcccgggtgagcaccacctacaacaagcggcccctgccagctacttcctgggaggacatgaagaaagggtcctttgaaggcacgtcccagaatcttcccaagaggaagcaactcgaagctaatagactttccctcaagaacgatgcgccccaagcgaaacacaaaaaaaataagaagaaaaaggaatacctgaacgaggacgtcaacggctttatggagtacctgcgccagaatagccagatggtgcacaacggacaaattatcgctactgacagcgaggaagtgcgggaggaaattgccgtggccctgaagaaagactcccgtagggaaggacgccgactgaagaggcaggcggctaagaagaatgcaatggtctgtttccactgtcgaaagcctggacatggcattgcggattgtccagcagctctggagaaccaggatatgggaacgggaatctgttaccgctgcgggtcaaccgagcacgagatcaccaaatgtaaggctaaagtcgatcccgccctcggggagtttccattcgctaagtgttttgtctgcggagagatgggtcaccttagccgaagctgcccagataatccaaagggcctgtacgccgatggggggggctgcaagttgtgtggaagcgtcgagcatctgaaaaaagattgcccagaatcccagaactccgaaagaatggtgaccgtaggtcggtgggcaaaagggatgtcggcagactacgaagaaatcctggacgtgcccaaacctcagaaaccaaagactaagattccgaaagtcgtcaatttttag

SEQ ID NO: 52701 - DNA, 816 bp, Artificial Sequence
  Description of Artificial Sequence: Synthetic coding sequence
atgacccggtgggcccgggtgagcaccacctacaacaagcggcccctgccagccacaagctgggaggatatgaagaaaggcagctttgagggtactagccaaaacctccccaagagaaaacagttggaagccaaccggttatccttgaaaaatgatgctccccaagccaagcataaaaagaacaaaaaaaagaaggagtacctgaatgaagacgtcaatgggttcatggagtacctgagacagaactcgcagatggtgcacaatggtcagatcatcgcaacagactcggaggaggttagggaggaaatcgctgtagctctgaaaaaggatagccggagagaaggacgaagactgaaacgacaggcagccaaaaaaaatgccatggtgtgtttccattgtcgaaaaccgggacacggcatcgcagactgccctgcggccctggaaaatcaggacatgggtactggaatttgttatagatgcgggagtaccgagcacgaaatcaccaagtgtaaagcgaaggtggatcccgctcttggtgagttcccctttgccaaatgtttcgtctgcggagagatgggtcatttgagcaggagctgtcccgacaaccccaagggattgtatgctgacgggggaggatgtaagctttgtggctccgtggagcacttaaaaaaagactgtccagaatcccagaacagcgaacggatggtaaccgtggggcggtgggctaaaggtatgtccgctgattacgaagagatcttggacgtgcccaaaccacagaagccgaagaccaaaattccgaaggtggtgaatttttag

SEQ ID NO: 52702 - DNA, 1434 bp, Artificial Sequence
  Description of Artificial Sequence: Synthetic coding sequence
atgggcagcggcctggacttcgccgagaccagctgcgcccagcccgtcgtcagcactcagtcggacaaggaacccgggattactgcaagtgccaccgataccgataacgccaacggcgaggaagtgccccatacccaggagattagtgtatcctgggaaggcgaggctgcccccgagatccgcacaagcaagctgggacagcccgaccctgccccaagcaagaagaaaagcaataggctgaccctatcaaaaaggaaaaaggaagctcaggacgagaaagttgaaaagactcagggcggacacgagcaccgtcaagaagaccgtttgaaaaaaacagtacaggatcattctcaaattcgcgaccagcagaagggggagattagcggtttcggtcagtgtttagtgtgggtgcagtgttcgtttccaaattgcggcaagtggcgccgtttatgtgggaatatagaccccagcgttctccccgataattggtcctgtgaccagaacacggacgtccagtacaatcgatgcgacatccccgaagagacctggactggactcgagagtgatgtggcatacgcctcttatatccctggcagtatcatttgggccaagcagtatggctacccctggtggcccggaatgatcgagtccgaccctgacctaggcgagtactttctgtttacctcacatctcgacagtttgccgagtaagtatcatgtgactttcttcggagaaaccgtgtcaagagcttggatacctgtcaacatgctcaaaaatttccaggagctgtccctggagctgtcagtgatgaagaagcgcagaaacgattgtagccagaagttaggagtggcattgatgatggcccaagaggctgaacagataagtatccaggagcgcgtgaatctgtttggattttggagccgcttcaacgggagcaatagtaatggcgaaagaaaagacttacagctcagtggactaaatagccccggctcatgcctggaaaagaaagagaaggaagaggaactagagaaggaggagggggagaagacagatcctattttgcccattcgcaagagggtgaaaattcagacgcaaaagaccaagccccgtgggcccaaaaaaaaattcaaggctccacagagtaaagcactggccgcctcgttcagtgagggcaaagaagtacggactgtacctaagaatctggggttgtccgcctgcaagggggcatgtccttcttctgctaaggaggagcctcggcacagagaaccactcacccaggaagctgggtcagtccctctcgaggatgaggccagctctgacctcgatcttgagcagctgatggaggatgtgggccgggaactggggcagtctggggagctgcagcattcaaacagcgacggagaggacttccctgtggctttatttggtaagtag

SEQ ID NO: 52703 - DNA, 1410 bp, Artificial Sequence
  Description of Artificial Sequence: Synthetic coding sequence
atgatgaccaccctgcagaacaaggaggagtgcggcaagggccccaagcggatctttgctcccccagcccaaaagagctactctttgttgccttgctctcccaattcccccaaggaggaaacaccaggaatctcttcgccagaaactgaggccaggatctccttacccaaagcatcgctcaaaaagaaggaagagaaggcgaccatgaagaatgtcccttcccgcgaacaggaaaagaagcgcaaggcccagataaataagcaggctgaaaaaaaagagaaggaaaaatcaagcctgaccaatgctgagttcgaggaaattgtgcagatagtcctccagaaatctctccaagaatgcctgggtggaatgggctctggattagacttcgctgaaacctcttgtgcccagccagtggtcagtacccaatctgataaggaacccggaataactgctagtgccacagatacggacaacgccaatggagaagaagttccccacacccaggagatttctgtgtcctgggaaggggaagctgcacctgaaattcgaacttcgaaactgggccagcctgacccggcaccttccaagaagaagtccaatcgcttaaccttgtcgaaaaggaaaaaggaggcccaggatgaaaaggtcgagaagacacaggggggtcatgagcataggcaagaagatagactgaaaaaaactgtgcaggatcattcacagattcgggatcagcaaaaaggagagattagtggattcggccagtgtctcgtctgggtgcaatgtagctttcctaactgtgggaagtggcggcggttgtgtggaaatattgacccctccgtactcccagacaactggtcatgcgaccagaacaccgccgacgttcagtacaatcgttgcgacatcccagaggagacttggactggtctggagagcgatgtggcatatgcgtcttacattccggggtctatcatctgggctaagcaatatgggtacccgtggtggccgggcatgatcgaaagcgatcccgacctgggggaatattttctatttacatcacacctcgactcgctcccttctaagtatcacgttacttttttcggggaaacggtttcacgcgcatggatccctgttaatatgctcaagaatttccaggaactcagtttggaactgtccgttatgaagaaacgacgtaatgactgctcccagaaattgggagtcgccttgatgatggctcaggaagccgagcagatctcaatccaggagcgagtgaacctgttcggtttttggagccgtttcaatgggtcaaattccaacggcgagaggaaagatctccagctgtcggggctcaacagtccagggtcttgcctcgagaacgggaaggagaggagacctagggagttccgattttag

SEQ ID NO: 52704 - DNA, 1947 bp, Artificial Sequence
  Description of Artificial Sequence: Synthetic coding sequence
atgatgaccaccctgcagaacaaggaggagtgcggcaagggccccaagcgcattttcgcaccaccagctcagaagtcctactcattgctcccctgttcgcccaattccccgaaagaagagacacccggtatttcgtcacccgagacagaagctcgcatctccctgccgaaggcctcgctcaagaaaaaggaagaaaaggccacgatgaaaaacgtgccgagccgggagcaggagaaaaaacggaaagcccagatcaataagcaagccgaaaaaaaggaaaaggagaaaagttccctgacaaatgccgagtttgaagaaattgtgcagatcgtactgcaaaagagtcttcaggaatgtttgggaatgggttccggcttagatttcgccgaaaccagttgcgctcaacccgtcgtgtcaacgcaatctgacaaggagccggggattacagctagcgccaccgatacagacaacgccaacggggaagaagtgccccacacccaggaaatctcagtatcctgggagggcgaggctgccccagagattcgcacttccaagctggggcagccagacccggctccgtctaaaaaaaagagcaacaggcttaccctctccaaacgcaagaaggaggcccatgagaaggtggaaaaaacgcaggggggccatgaacacaggcaggaagacagactgaagaagaccgttcaggaccacagccaaatcagggatcaacagaagggagagatcagcggtttcgggcaatgccttgtgtgggtgcagtgctcattccctaactgtggtaagtggagaaggctttgcggaaacattgatccctccgttttgcccgacaattggagctgcgaccaaaacacagatgtccaatacaacagatgtgacatccccgaggaaacctggactggcctggagagtgacgtagcttacgcgtcttatatccccggttccattatctgggcaaaacagtatgggtatccttggtggccgggcatgatcgaaagcgaccctgatctcggtgaatatttcctatttaccagccaccttgactctttaccgtccaaataccatgttaccttcttcggggaaacagtgtcacgcgcttggatccccgtgaacatgttaaagaactttcaagagctgagtctcgagctgtccgtcatgaaaaagagacggaacgactgctctcagaaattgggggtcgcactaatgatggcacaggaggctgaacagatctccatccaggagagggtaaacctctttggcttttggagccggtttaacgggtctaacagtaacggcgagcgaaaggacttacagctgtctggactgaactcaccaggaagctgtctagaaaaaaaggagaaggaagaggaactggaaaaggaggagggggagaagacggaccctattctgcctatacggaagcgagtaaagatccagacgcaaaagacgaaaccgcgtggcctgggaggtgatgcgggtacagccgatggccgaggacgcacgctgcagcgtaagattatgaagaggagcctcggccgcaaatccaccgcccctccagcaccacgcatggggcgtaaggagggccaaggaaactccgattccgaccaacccggcccaaaaaagaagtttaaggccccacagtcgaaagcactcgctgcatcattctccgagggcaaagaggttcggacagttccaaaaaatctgggtctgtcagcgtgcaagggggcttgccccagcagtgcgaaggaggagccccgtcaccgtgaacctctgacacaggaggctggcagtgtccctcttgaagacgaggcgtctagtgatcttgatctggagcagctgatggaagacgtgggaagggaactaggccaatcaggagagttgcagcatagcaattctgacggtgaggattttccagtggccctgtttggtaagtag

SEQ ID NO: 52705 - DNA, 1071 bp, Artificial Sequence
  Description of Artificial Sequence: Synthetic coding sequence
atggacaaggagaagctggacgtgaagatcgagtactgcaactacgctatggatagctccgtggagaacatgtatgtgaataaagtttgggtgcagtgcgagaacgaaaattgcctcaagtggcggctcctcagttctgaggactctgccaaagtggaccatgatgaaccttggtattgcttcatgaatactgatagtagatacaacaactgctcaattagtgaggaggactttccagaggaaagccagctgcatcaatgtggttttaaaattgtctattcacaactccctttaggttctctggttctcgtaaagctccaaaactggcctagctggcccgggatattatgtcccgacaggtttaagggcaaatacgtgacgtatgaccccgacggaaatgtagaggagtaccatattgaatttctaggggaccctcattctaggtcatggatcaaagccacttttgtgggacactatagcataacactgaagccggaaaaatgcaagaacaaaaagaagtggtataaatccgcccttcaggaggcctgcctcttgtatggctattctcatgagcaaaggctcgagatgtgctgtctgagcaagctgcaggataagagcgagacccacgacaaagttgccgcgctggttaaaaagaggaaacagacatcaaaaaataacatcgaaaagaaaaagccgaaattcagaaaaagaaaacgaaaagccatcctgaagtgcagcttcgagaacgtctactcggacgacgctctgagcaaggagaaccgtgtcgtgtgtgagactgaagtgctgctgaaggagctggaacagatgttacagcaagcgctgcagcctaccgcaacgccagacgaaagtgaggagggtcacggcgaagagatcaacatgggagaaaaactctccaaatgttctccagaagccccggctggcagccttttcgaaaaccactacgaagaagattacttagtcattgatggtatcaaacttaaggccggtgagtgcatagaggacattaccaataagtttaaagaaattgacgccctcatgagtgaattttag

SEQ ID NO: 52706 - DNA, 384 bp, Artificial Sequence
  Description of Artificial Sequence: Synthetic coding sequence
atggacaaggagaagctggacgtgaagatcgagtactgcaactacgcgatggattcttccgttgagaacatgtatgtgaataaagtctgggtacagtgcgagaatgagaactgtctaaagtggcgacttctatctagtgaggattcagctaaggtagatcacgatgaaccatggtattgttttatgaacactgattcaagatacaacaattgcagcatttccgaggaagatttccccgaggaaagccagctgcaccagtgcgggttcaagatagtctacagccaactccctctggggtcgctggtcctagtgaagctccagaattggccaagctggccaggcatactctgcccggatcggtttaaagggaaatatgtgacctag

SEQ ID NO: 52707 - DNA, 1071 bp, Artificial Sequence
  Description of Artificial Sequence: Synthetic coding sequence
atggacaaggagaagctggacgtgaagatcgagtactgcaactacgccatggactctagcgtagagaatatgtacgtcaataaggtgtgggtgcagtgcgagaatgagaattgcctaaagtggcgactgctctctagcgaagacagcgccaaggtcgatcacgacgaaccttggtactgctttatgaacaccgattcacgttacaataattgcagtatttcagaggaagacttccctgaagaaagtcaactgcaccaatgcgggtttaaaatcgtgtatagccagctgcctctgggaagcctcgtgttggtgaaattacagaactggccatcatggccaggcattctttgccccgaccgctttaagggaaaatatgtgacctacgatccagatgggaatgttgaggaataccacatcgaatttctgggggacccacatagccggtcttggatcaaagcaactttcgttgggcactatagcatcacattgaaaccggaaaaatgcaaaaataagaagaaatggtacaagtcagctctccaggaggcctgccttctctacggttacagtcacgagcaaagactcgaaatgtgttgcttatctaaactccaggacaagagtgagacccacgacaaggtggctgccttagtgaagaaacgcaaacaaacatccaagaataacatcgagaagaagaagcctaaattcagaaagcgtaagcggaaagccattctaaagtgctcattcgagaatgtgtattccgatgatgctctgagcaaagaaaaccgggtcgtgtgcgaaactgaggtgctcttaaaggagctggagcaaatgctgcaacaagccctgcaacctactgctaccccagacgaaagtgaggaaggacacggcgaggaaattaacatgggcgaaaagcttagcaagtgctctcccgaggccccggctggctcattgttcgaaaaccactacgaagaggattatttggtcattgatggaattaagttgaaggccggcgaatgcattgaagatataacgaacaaattcaaggagatagatgcactgatgtccgagttctag

SEQ ID NO: 52708 - DNA, 7065 bp, Artificial Sequence
  Description of Artificial Sequence: Synthetic coding sequence
atgcagaagcggcagggctactgcagctactgccgggtgcagtacaacaacttggaacaacaccttttcagcgctcaacatcggtcgcttactcgccaatcgcgcagacagatctgcacctcctcactcatggagcgcttcctgcaggacgtactgcagcaccatccataccactgtcaggaaagttccagcacccaagatgagacccatgtgaacaccgggagctccagtgaagtggttcatcttgatgatgcattctcagaagaagaagaagaagacgaagacaaagtggaagatgaagacgctacagaggagagacctagcgaggtgtcggagcccatagaggagctgcacagtcggccccataagagccaagagggaactcaggaagtatccgtgcgcccttctgtgatccagaaactggaaaaaggtcaacagcagccgcttgagttcgtgcacaagatcggggcatccgtgcgcaagtgcaatctggtggatatcggacaggctacaaacaaccggtcaaatctggtacgacccccagtcatatgcaacgctcctgcctcttgtctcccagagtctagcaacgaccggccggtgaccgccaatacgacctcactgcctccagcggcacacctggactcagtgtccaagtgcgaccctaataaggttgaaaaatacctcgagcagcccgatggggcctcaaggaatcctgttccctcctctcatgtggagacaacatctttcagttaccaaaagcacaaggaatcgaacaggaagagcctccggatgaatagcgataaactggtcctgtggaaggatgtaaaaagtcaggggaagacgctctcagccgggctgaagttccacgagcggatgggaacaaaaggctccctgcgggtcaagagtcctagtaaattggctgtcaaccctaataagacagacatgcctagcaacaagggcatattcgaggacactattgccaagaaccacgaagaatttttcagcaacatggattgtacgcaggaggaaaaacacttggtctttaacaagaccgccttttgggaacaaaagtgtagtgtatctagcgagatgaagtttgattgtatttcgctgcagtccgccagcgaccagccacaggagaccgcccaggatctgtccctctggaaggaagagcaaattgaccaggaagataactacgaatcccgcggatctgaaatgtccttcgattgttcatctagcttccacagtctgaccgatcagtcgaaggtgtctgccaaggaagttaatttgagcaaagaagtaaggaccgacgttcagtacaaaaataacaaatcatacgtgtctaaaattagctctgactgtgatgatattcttcatttggtgaccaaccagagccagatgattgtaaaggaaataagcttacagaatgcccgtcacatctctctagttgaccagtcctatgagagttcctctagcgagacaaacttcgactgcgatgcatcaccccaaagcacttccgactacccccaacagtccgttactgaggtgaatctccccaaggaggttcacatcggcttggtagacaagaactatgggtcatctagctcggaggtttctgccgactcagtttttcctctgcagagtgtagttgatcgtccacctgtggctgttacagaaactaagttgcgtaaaaaagctcatacgagcctggtggacaactacggctcgagctgtagtgaaaccagttttgactgcgacgtgagtctcgagtctgtggtggaccacccacaactcaccgtcaagggacggaatctcaagggccgacaggtacacctgaagcacaaaaaacgtaagccttcctccgccaaggcacatcttgattgtgatgtaagcctcggaacagtggctgatgaaagccagagagccgtggagaaaatcaatctgctgaaggagaagaacgccgatctgatggacatgaattgcgagtcccacggccctgagatgggattccaagccgacgctcaactggctgaccagtctcaggtggcagagattgagagacagaaggtagacgtagatctcgaaaataagtcagttcagagctccaggagctccttgtcctcggattccccggcatctttataccacagcgcgcatgatgaaccacaggaggccttggatgaggttaatctgaaggaacttaatattgacatggaagtgcgctcctatgattgttcatccagcgagctgacctttgactctgaccctcctctcctgtctgtcacggagcagtcccacctcgacgcagaaggaaaggagcgccacatcgatctggaagacgaatcatgtgaaagcgactcctcagagatcacattcgacagcgacatccctttatacagtgtgattgaccaacccgaggtggcggtgtatgaagaagagacggtcgacctggaatctaagtcaaacgagtcctgcgtttctgagattaccttcgattctgacatccccctgcattccggcaatgatcaccctgaagtagccgtcaaagaagttattcagaaggaagagtacatccacttggaaagaaagaatgacgaaccttctggctccgaaatctccagcgattcacacgcccctctgcactctgtcacgaattcccctgaagtggcagtgaaaaagctcaacccgcagaaggaggaacaagtgcacctcgaaaataaggaaaatgaacctattgacagcgaagtgtccctggactataatatcatatttcattccgtgactgggcgctcagaggatccgatcaaagaaatcagtttgcacacaaaagagcacatgtatttagaaaacaagtcggtctttgagacaagcctcgattccgatgtaccactccaggccgcgacacacaagcccgaggtcattgtgaaagaaacatggctgcaacgggagaagcatgccgaattccagggccggtccacagagttctccggttccaaaacgagcctcgattctggggtgccccattattccgtcaccgagccccaagtcgccgtgaataagattaaccgcaaaaaacagtatgttctggaaaacaagaacgacaaatgttcggggtctgaaatcattcttgacagcaatgttcctcctcagtcaatgacggatcagcctcaacttgcattcctgaaggagaagcacgtgaacctgaaggataaaaactcaaaaagtggagactcaaaaattactttcgacagcgagcaactgcaggaggctgtcaagaaaatcgaccaatggaaagaagaagtaatcgggttgaaaaataagataaatgagccctccacttacaagcttatccaccaccctgacgtatcagttcagtccgtggctgatcagcctaaagtggccatcaaacacgtgaacctgggcaatgaaaatcatatgtacctcgaagtgaagaacagtcagtacagctgtagtgaaatgaatctggatagtgggtttcttggccaatcaatagtaaaccggccacagatcactatccttgaacaggaacacattgaattggagggaaagcacaaccagtgttgtgggagtgaggtttctttcgactctgacgatcctctccagtcagtggctgaccggctcagggagaccgtgaaggaaatctctctgtggaaggatgaggaggtcgacacagaagatcgaagaaatgaggctaagggcttcgagattatgtacgacagtgacgtgctgcaaccagtggccgggcaacctgaagaggtggtcaaggaggtctctctctggaaggagcacgtggacctcgaaaataaaatcgtcaagccgacagactcccgaattaactttgattctcatgaacctctccagtcagtcactaataaaataccgggggcgaacaaggagattaacctgctgagggaggaacacgtttgtctagacgacaaaggttatgtgccctcagacagtgagattatctatgtctctaacatcccactgcaaagtgtgataaagcagcctcatattctcgaggaggaacatgcctccctggaagataagtctagcaactcttactctcccgaagagagcagcgatagcaacgatagcttccaggctgctgccgacgagttgcagaagcccgtgaaagaaatcaacctctggaaggaagaccacatctacctcgaggataaatcctacaagttgggtgacttcgacgtttcgtacgcttctcacatccccgttcagtttgttaccgatcagtcctccgtacctgtcaaagaaattaacctccagaagaaagaccacaacgatctggagaacaagaactgtgaagtatgtggctccgagattaagtgtcacagctgtgtccatctgcagagtgaagtagaccagccgcaggtgagctacaaagaagcggacctgcagaaggaggagcacgtggttatggaggagaaaacggaccagccatctgactccgaaatgatgtatgattctgatgtgcccttccaaatcgtggtaaatcagttccccggatctgtgaaagagacccacttacctaaggtagtgcttgtggacctagtgcccggagactccgactacgaggtgatctccgacgatatcccactgcagctggttaccgacccaccacagctgaccgtcaaggatattagctgcatcaataccgagtgcattgacatcgaggataaatcctgcgatttttttgggagtgaagtacggtgtaactgtaaggctagcacgcctagcatgacaaatcagtgcaaggaaacattcaaaattatcaatagaaagaaggactatatcatccttggcgaacctagttgtcagagctgtggaagcgaaatgaactttaacgtggatgctagcgaccagtctatgacctatgaatctcagggacctgatgaaaagatggtaaagtatatcgactcagaggataagtcttgtgggtataatggcagcaagggtaaattcaacttggaagacactagtcatcggactacccacagactccagaaagcccataaggaggcatctcttcgaaaagatccgcgtaacgctggactaaaaggcaagtcctgtcagtccagtgcttcagcagtggactttggcgcaagcagcaagagtgcgctgcataggcgggccgacaagaagaagcgctctaaattgaagcatagggatttggaagtgagttgcgaaccagacggcttcgaaatgaatttccaatgcgcacctccgctgccgagtgacacagaccagccccaggagaccgttaagaaacggcacccctgcaaaaaggtctcaagcgacctgaaggagaaaaaccatgactctcagtcatcatcagttctaaaagtggatagcgtccggaatctgaagaaggccaaagacgtgattgaagataaccctgacgagcctgtgctagaggccctaccacacgtgcccccctccttcgtagggaaaacttggagtcagattatgagagaggacgatatcaagatcaatgctctggtaaaagagtttagagagggtcggtttcattgctatttcgatgacgactgtgagacaaaaaaggtgtcgtccaaggggaaaaagaaggtgacatgggctgatctccaaggaaaggaagacaccgcaccaactcaagccgtaagcgagtccgatgatattgtgtgcggcatttccgatattgatgatttgtccgtagcgctggataaaccatgtcacaggcacccacctgcagaacgccctcccaaacagaaaggccgcgttgcttctcaatgccagaccgccaagattagccactcgactcagacctcttgcaaaaactaccccgtgatgaagcggaagattatcaggcaggaagaggacccccccaaatctaaatgtagcaggctgcaggacgacaggaaaacgaaaaagaaagtgaagattgggaccgttgagttcccagcctcctgtaccaaggtcttaaagcccatgcagccgaaggctcttgtctgcgtcctttcttccctaaatatcaagttgaaggagggggaaggactcccttttccgaaaatgagacaccattcctgggataatgacattcggtttatctgtaagtacaagcgaaacatcttcgattactatgagccactaatcaagcagattgttatatcccctccgctgtctgtcattgtccccgagttcgaaagacgcaattgggtgaagattcactttaatcgctcaaaccagaacagttctgcaggggacaatgacgcagacggacaagggtcggcttctgcaccactgatggccgtgcctgccagatatggatttaatagccatcaggggactagcgacagcagtttatttctggaggaatctaaagtcctccacgcccgagagctgccaaaaaagagaaacttccagctaacattcctgaatcatgacgtggttaagatctcaccaaagtctgtgagaaacaaactgctggagagtcagtcaaagaaaaaaatccacgggaagcgagtgacgaccagctctaacaagctgggctttcctaaaaaggtgtacaaaccgattattctccaacagaagccgaggaaagcatccgagaagcaaagcatatggatccgaaccaaaccgagcgacattattagaaaatacatttcaaagtacagcgtgtttttgcggcaccgatatcagtctcggtctgcgttcctgggcaggtacctgaaaaaaaagaaaagtgttgtttctagactgaaaaaggccaaacgcacagcaaaggtgctgctgaacagttcagtgccacccgctggcgcggaggagctttcctcggctatggccaatccgccgccaaagcggccagttcgagcatcttgtcgtgtggcaagaagaagaaagaaaactgacgagtcttaccatgggaggcagaagggaccttctacccctgtgagagcttatgatctccgatcctcatcatgccttcaacagcgggagcgcatgatgacgaggttagccaataagttgaggggcaatgaggttaaatag

SEQ ID NO: 52709 - DNA, 1116 bp, Artificial Sequence
  Description of Artificial Sequence: Synthetic coding sequence
atggacacccggagcggcagccagtgcagcgtgacccccgaggccatccggaacaacgaagagctcgtgttaccccccaggatttcccgggtcaacggttggtcactgcctctgcactattttcgcgtggtcacctgggcggtgtttgtcgggttgtccctcgctaccttccgcatctttattcccctcctacctcacagctggaagtacattgcctatgtggtcaccggcggcatcttcagcttccatctggttgttcatctgatcgcatcgtgcatcgatccagcagattccaacgtcagactgatgaagaattattcccagccaatgccactctttgaccgctctaagcatgcccacgtcattcaaaaccagttctgccacctatgtaaagtaaccgtcaataaaaagaccaagcattgtatcagctgtaacaaatgcgtgtccgggttcgaccatcattgcaaatggatcaataattgcgtggggtcccgtaactactggttttttttttctactgtggcatccgcgacagctggcatgctatgcctgattgctatcctgttatatgtgctggtacagtatctcgtaaaccctagagtcctcagaacggaccctcggtatgaagacgtgaagaatatgaatacatggctgctgttcttgccattgttccctgttcaggttcagaccctaattgtggtgataatccggatgttagtgctgctgctcgatctcctcggcctggtgcagctgggccagctactcatctttcacatctatctaaaggccaaaaaaatgaccaccttcgagtatctcatcaacactaggaaagaagaatcctctaaacatcaggctgtgcgaaaggacccttatgtgcagatggacaagggattcctgcagcaaggggcaggggctctgggatcatctgcacaaggcgttaaggctaagagcagtttgttaatttataaatgcccatgtcatttctgcaccagtgtgaatcaggatggggattccaaggcacaagaggccgacgatgctcccagtacatctactctaggactgcaacaggaaacaaccgagccaatgaagacagatagtgctgagtctgaggactag

SEQ ID NO: 52710 - DNA, 1212 bp, Artificial Sequence
  Description of Artificial Sequence: Synthetic coding sequence
atgaactacgacagccagcagccccccctgccccccctgccctacgcaggttgcagacgagccagtggttttcccgctctgggaaggggtggtactgtgcctgtgggcgtgtggggcggtgctggtcagggaagggagggccgaagttggggagagggtccgcgcggaccagggcttggcagaagagatctgtctagcgctgacccagctgttttgggagctaccatggaaagtcggtgctatgggtgcgccgttaagttcactttgtttaaaaaagagtatggatgcaaaaattgcggcagagctttttgtagcggctgtctgagtttcagcgccgccgtgccccgtaccgggaacacacagcaaaaagtatgcaagcaatgtcatgaagtgctcacccgaggatcaagcgctaacgccagcaagtggagcccgccgcagaattacaaaaaacgggtggccgctctggaagccaaacaaaagccctccacaagtcaaagtcaaggccttacccgccaagatcagatgatcgccgagcgactggcaaggctgcgccaggagaacaaacctaagcttgtcccaagtcaggccgaaatagaagcacgtctggcggcactgaaggacgaaagacagggcagcatcccttccacccaagagatggaggctagactcgccgcccttcagggccgtgtcctgcccagccaaacaccacagcctgctcatcacacaccagacacaaggacccaggcccaacagactcaggatctgctaacccaactggccgcagaagtagccatcgacgagagctggaaaggaggcggcccagttaccctgcaagattatcgcctgccagacagcgacgacgacgaggatgaagagaccgcaattcagagagtcctgcagcaacttacagaggaggctagtctggacgaagccagtgggtttaatatccccgcagagcaggcaagtcgtccatggacacagcccagaggggcagaaccggaagcccaggacgtcgacccaaggcctgaggccgaggaggaagaactgccctggtgttgtatttgtaacgaggacgccacccttcggtgcgccggatgtgatggtgacctcttctgcgcacgttgcttcagagagggccatgacgcgtttgagctgaaagagcatcagacttccgcctattctccccctagagctggacaggaacattag

SEQ ID NO: 52711 - DNA, 1386 bp, Artificial Sequence
  Description of Artificial Sequence: Synthetic coding sequence
atgcccgccgtggccgaggccctgggccaggagggcccccccgacctgtctcgctctgctttcctggccactgtactgacatcactttccgccgccttctcctcaatgccttccagcgcttatagtttacccttctctagatccctcgagctggactatcacacctcttcatgctttaggggtacaatggtgaaagcggattgtcctgttcccataaccgatctccctgactcttcaggaaaacttcagtacggatgtaagaattgcggcagggctttttgctctggctgcctgagctttagcgcggccgtacctcgaaccggaaatactcaacaaaaggtctgcaaacaatgccacgaggtcctcacaaggggctctagtgcgaacgcttctaaatggagcccgcctcagaactacaagaagagagtcgcagcactggaagctaaacagaaaccctctacctcacagtcccaggggctcactcgccaggaccagatgattgccgagcgcttggctaggctgaggcaggagaacaaacctaagctggtgccaagccaggctgagatcgaagcccgacttgccgccttgaaggatgagcggcaggggtccattccgtctactcaggagatggaggcacggctggctgctcttcagggaagagttctgccctctcagacaccacagccagcccatcacaccccagatactcgcacgcaggcccaacagacccaggacctgctcacccagttagctgctgaggttgctatagatgaatcgtggaaaggcggcggaccagctgcttcattgcagaatgacctgaatcaaggcggccctgggagcaccaacagcaagcgccaggccaactggtctctagaggaagaaaaaagccggttactcgctgaggcggctttggaactacgagaggagaatactaggcaagagcggatcctggccctggccaaaagattggcaatgttgcgtggccaagaccccgagagagtgactcttcaggactaccggctgccagatagcgacgacgatgaggatgaggagaccgctatccagagggttctacagcagctgactgaagaggccagtcttgacgaagcttctggattcaacatccctgcagagcaagcctcgaggccctggacacagcctaggggcgcggagcctgaggcccaggacgtggaccccagacccgaagcggaggaggaagaactcccatggtgctgcatctgcaatgaagatgccacactgaggtgtgctggctgcgacggtgacctgttttgcgcccgttgctttcgggaaggacatgatgcatttgagcttaaagaacaccagaccagcgcctactcccccccccgcgcggggcaagaacactag

SEQ ID NO: 52712 - DNA, 1416 bp, Artificial Sequence
  Description of Artificial Sequence: Synthetic coding sequence
atgaactacgacagccagcagccccccctgccccccctgccctacgcaggatgtcgccgggcgagcggatttccggctttaggcaggggtgggactgtgcctgtgggtgtgtggggcggtgccggccagggacgcgaaggcaggagctggggggagggaccacgtggcccggggcttgggcggagagatctgtcgtctgcagatcctgccgttctgggcgcaacgatggaatcaaggtgctacggttgtgccgtcaaatttacacttttcaaaaaagagtacggatgtaaaaactgtggccgggccttctgtagcggatgtctcagcttttctgccgcggtccctcgaactggcaacacacaacagaaggtctgcaagcagtgtcatgaggtgctaaccaggggaagcagtgcaaacgcaagcaaatggagtccccctcaaaattacaaaaaaagggtcgccgcactggaggctaagcaaaaacccagcacctcccagagtcaaggcttaacccggcaagaccaaatgattgcagaaagattagcccgattgcgacaagagaataaacctaaactcgtgcctagccaagcagagattgaagctagactggccgcactcaaggatgaaaggcagggcagcattccatccacacaggaaatggaagctagactcgccgcattgcaggggagagtgctaccatcacagactccccagcccgcacaccatacacctgacacgagaactcaagctcagcagacacaagatttactgactcagctggccgctgaagttgcgatcgacgagtcctggaagggcggcggtccagctgctagtctgcaaaatgatctgaaccagggcggtccaggatctacaaacagcaaacgtcaggcgaattggtccctggaagaggagaaatccaggctgctggcagaagcagcactcgagctccgggaggagaacacgcgtcaggaacggatcctcgctcttgctaaaaggcttgctatgctccgtggccaggatccagagcgggtcacactgcaggattacagacttcccgacagcgacgacgacgaggacgaagaaaccgctatacagagggttctacagcagttgactgaggaggcgtcgctggatgaagcatctggatttaacattcccgctgagcaggcatcccgcccctggacccagcccagaggcgccgagcccgaagcacaggacgtcgacccacgccccgaagcagaagaggaggagctaccatggtgttgcatttgtaatgaggatgcaaccctgagatgcgcaggctgcgacggggacttgttctgcgcaagatgtttcagagaaggccatgatgccttcgaactgaaagaacatcagacgagcgcgtacagtccaccgagagcaggtcaggaacattag

SEQ ID NO: 52713 - DNA, 465 bp, Artificial Sequence
  Description of Artificial Sequence: Synthetic coding sequence
atggtggagaagaagaccagcgtgcggagccaggaccccggccagagaagggtcctcgatcgcgctgcgaggcaacgcagaatcaatagacagctagaggcccttgagaatgacaattttcaggacgatcctcacgccggacttcctcagctggggaagaggctgccgcaatttgatgacgacgcagacactggaaagaagaagaagaaaacgcgaggagaccacttcaagcttcgtttccgcaagaactttcaggcacttctggaagagcagaatctcagcgtagcggagggacccaactatctcacggcttgtgcagggccaccatcccgaccccagcggccattttgcgcggtgtgtggtttccccagcccttacacttgcgtatcctgtggagctaggtattgcaccgttcgctgtttgggcactcatcaagaaacacggtgtctcaagtggacagtttag

SEQ ID NO: 52714 - DNA, 1413 bp, Artificial Sequence
  Description of Artificial Sequence: Synthetic coding sequence
atggagttcgccgccgagaacgagggcaagagcggcggcggcctgcattcagtggcagaaggtgtacggttgtcccctgagcctgggcgcgagggtgtgcgtgatttggccggcgccgaggagtttggaggcggcgaggagggtaccggactgactggcataaaagagattggagatggtgaggagggttcaggccagcggcccgaagagattccaatggatctcactgtcgtgaaacaggaaataattgattggcccgggaccgaggggagactggcagggcaatgggtcgagcaggaggtggaagaccggcctgaggtgaaggatgaaaatgcaggtgtgctggaggtgaaacaggaaaccgattctagtctggtggtgaaggaagctaaagttggcgaaccagaggttaaggaagagaaagtcaaagaagaagtcatggattggtccgaggtcaaggaggagaaggataacttggagatcaagcaagaagaaaaatttgtggggcagtgtatcaaggaagaacttatgcacggggagtgtgtaaaggaagagaaagatttcttaaaaaaagagatcgtggacgacacaaaagttaaagaggaaccacccattaaccatccagtaggctgtaagcggaagctggcaatgtcaaggtgtgagacttgtggcactgaagaagcaaaatatagatgccccaggtgtatgcggtattcatgctcattaccctgtgtgaagaaacataaagctgaactgacctgcaacggcgtgcgggataagaccgcctatattagcattcagcagtttacggagatgaacctgctgagcgattaccgattcctggaagatgtggctcgcactgccgaccatattagcagagatgccttcctcaagcggcctatttcaaacaaatatatgtattttatgaagaacagggcgaggagacaggggattaatctgaagctgctacctaatgggttcaccaaaagaaaggaaaattctactttttttgataagaaaaaacagcaattctgctggcatgtcaaattgcagttcccacagagccaggctgagtacatcgagaagagagttcctgacgacaaaacgatcaatgagatcctaaaaccttatatcgaccccgagaagtctgatcctgtaattaggcagaggttgaaagcctatattcgtagccagactggagtacagatcctcatgaagattgaatacatgcagcaaaatctggttcgctactacgaattagacccctacaaatcactccttgacaatctgagaaacaaagtcataattgagtatcctacgttgcacgtcgtgttgaaaggctctaacaatgatatgaaagttcttcaccaagtgaagagtgaaagcactaagaacgtgggtaatgaaaactag

SEQ ID NO: 52715 - DNA, 1296 bp, Artificial Sequence
  Description of Artificial Sequence: Synthetic coding sequence
atggagttcgccgccgagaacgagggcaagagcggcggcggcctgcatagcgttgccgaaggcgtaaggctatctcctgagccggggcgtgagggcgtccgagatctggccggggcggaggaatttggtggaggggaagagggaaccgggcttacgggaataaaggagattggcgatggagaggaaggatcaggacaacgccctgaggagatccctatggatctaacggtggtgaagcaggagactgatagtagtttagtggtgaaagaggctaaagtgggggagcctgaagtcaaagaagagaaagttaaagaggaggtcatggattggtctgaagtaaaagaggaaaaggataatcttgaaatcaaacaggaggaaaaatttgtgggccagtgcatcaaggaggagttgatgcacggtgaatgtgttaaggaggaaaaggacttcttgaaaaaggaaattgttgacgataccaaagttaaggaagaaccgcctataaatcatcctgtcggctgtaagagaaagctggctatgagtcgctgtgaaacctgcggaaccgaggaggccaaatatcgatgcccccgctgcatgcgctactcctgctctctaccttgtgtaaagaaacacaaagccgaactgacatgtaatggcgtccgggacaagaccgcatatataagtatccagcagtttactgagatgaacctgctgagcgactaccgcttcctggaagatgttgctcgtaccgccgatcatatctctcgcgacgcttttctgaagcgccccatatcaaataaatacatgtactttatgaaaaatcgggcccggcgccagggaatcaacctgaagcttctgcctaacggctttaccaagcgaaaggagaacagtaccttcttcgacaagaaaaaacaacagttctgttggcacgtgaaactccagttccctcagtcacaggccgagtatatcgaaaagcgcgttcccgatgacaagacaataaatgaaatactcaagccatatatcgaccccgagaaatctgatcctgtaatccgacagcgtctgaaggcatacattcgttctcagaccggggtccagattctgatgaaaattgagtacatgcagcagaatctcgtgcgctactacgaacttgatccatacaaaagcctcctggacaatctccgcaataaagtaatcattgagtacccgactctgcatgtcgttctcaagggcagtaacaatgatatgaaggtcctccaccaggtgaaatccgagtcaactaaaaacgtgggtaatgaaaattag

SEQ ID NO: 52716 - DNA, 4647 bp, Artificial Sequence
  Description of Artificial Sequence: Synthetic coding sequence
atggccgagcgggaggtggagagcggcccccggaagcggttcgagcagaagagtggcgctgttttcgatgagattgtggagaattgtggtggaattatggataccgagatgtcggaggacatcgatcataacttaactcccaccctcgacagcatgagttatggcatgcccaatcagaccggttctgagaacagcctgctagacgaggacgattacttcctgaattctggagacctggccggaataccagtggtgggcagcgacaatgaagatgagcaggatttctcctctaaggacaacctggtgagcagcatacataccgatgactccttagaagttgaacgccgcgttacacagcacgagtccgataatgagaatgagatccagatccagaataaactcaagaaagacttccccaaacagtttgaccaggttagtgtattcaaaagtattcgcaaggacttttctttggtccgggaaaacagcaaggagactttctccggaaaagagaaaaaccgggatttgacctatgagcgagagaaacgcttagacaaacctcataaggacctcgattctagactcaaatcaagtttttttgataaagccgctaatcaggtagaggagactttgcacacgcatctgccccagacccctgagaccaactttcgcgattcctcctatccgttcgccaacaaggagtcaatcggttcggagcttggaaactcctttgcctcaaacattcgtataaaggaggaaccattggatgatgaatatgataaggccatggctccccaacaaggcctgctggataaaattaaggatgagcccgacaacgctcaggagtactcccatggacaacaacagaagactcaggaaggcgagctgaagatctcagccgtgttttcggtgagtgggtctcctctcgccccccagctgaccaccggatttcagccctctctagctagctctgggatgaacaagatgctgccaagtgtcccggctaccgctgtcagagttagctgctcgggctgcaaaaaaattctgcagaagggccagaccgcttaccaacggaaaggttctactcagctcttttgttccactctgtgtctcacaggatatacagttcccccagcccggcccccgcctccactcaccaagaagacctgttcgtcttgttcaaaggacatcctgaacccaaaggacgtaatctcagcccagtttgagaatacgaccactagcaaggacttttgctctcagtcctgcttgagcacctatgaactgaagaagaagcctatagtcacaattaataccaattccatcagcacaaagtgttcgatgtgtcaaaagaacgcggtgattcggcacgaggtcaattatcagaatgtagtccacaagctgtgcagtgacgcctgcttttcaaagttccgcagtgcgaacaacctcactatgaactgttgcgaaaactgcggcgggtattgttattctggcagcggacagtgccacatgcttcagattgagggtcagtctaaaaagttctgctcatcttcctgtattaccgcatacaagcagaagtctgcaaagatcaccccttgcgccctttgcaagagtttgcgctctagcgccgaaatgatcgagaatacaaacagcttaggaaagacagaattattctgctcagtcaactgcctaagcgcctacagagtgaagatggtcactagcgctggcgttcaggtgcagtgcaactcatgtaaaacatccgctatccctcagtatcatctggccatgtctgatggatctatccgaaacttctgttcctactcttgtgtcgtggcttttcaaaatttgttcaacaagcccaccggcatgaatagcagcgtagtgcccctcagtcagggtcaagtgatagtttctatacctactggtagcaccgtaagtgctggaggcgggtctacgagtgcagtgagcccgacaagtatttcaagtagcgctgcagcaggcttgcagcggttggccgcccagtctcagcatgtagggttcgccagatcagtggttaaattaaaatgccagcactgcaacagactcttcgctaccaagccagagctgctggattacaaggggaagatgtttcagttttgcgggaagaattgtagcgacgagtataagaaaattaacaatgtcatggcgatgtgcgagtactgtaagattgaaaaaatcgtgaaggaaacagtgcgcttttctggagccgacaagtccttttgttccgagggctgcaagctcctctacaagcacgacctggccaaacgctgggggaatcattgcaagatgtgtagctactgcttgcagacttccccaaagttggtgcaaaacaatttaggaggaaaggtagaggagttctgctgcgaagaatgtatgtcaaagtacaccgttctgttctatcagatggctaaatgcgatgcgtgcaagcgacagggaaaattgtctgaatcactgaagtggaggggcgagatgaagcacttttgtaacctgctgtgcattctgatgttttgcaaccagcagtctgtgtgtgaccctccaagccaaaataacgcggctaatatctctatggttcaggctgccagtgccggtccaccctctcttcgcaaggacagcacccctgtgatcgcgaacgtggtgtctctagcgtccgccccagccgcccagccaacagtgaatagcaattctgtgctgcagggcgccgtaccgaccgtcactgccaaaatcataggtgatgcttcaacccagacagacgctcttaaactcccccctagccaaccccctcggctccttaagaacaaagctctgctgtgcaaaccgatcacacaaacaaaggcgacaagttgcaagcctcatactcagaacaaggagtgccagacagaggatactcccagtcagccacagataatcgtcgtccctgtccctgtgccagtgttcgtaccaattcctctccatctgtatacacagtacgcccccgtgccttttggaatccctgtacccatgcccgtaccgatgctgatacctagctcaatggatagcgaggacaaagtgaccgagagtatcgaggatatcaaggagaagctgccgacccacccatttgaagctgacttactcgagatggccgaaatgattgctgaagatgaggagaaaaagacattgtctcagggtgaatcacaaaccagtgaacatgaactcttcctcgacactaagatatttgagaaagaccaaggctcaacatacagcggagacctggaaagtgaggccgtctcaactcctcactcctgggaggaagagctgaatcactatgcacttaaatccaacgcagtgcaggaggctgactccgaactgaagcagttctccaagggagagactgaacaagatctagaagcagacttcccatctgactccttcgaccctcttaataaagggcagggtattcaggcccgctcccgcaccaggcggcgtcaccgagatggatttccgcagccccgccggcgaggcaggaaaaaatctattgtagccgtggagcctcgaagcctgatccagggcgccttccagggttgctccgtgtctgggatgaccttgaaatacatgtacggcgtaaatgcgtggaagaattgggtccagtggaagaacgccaaggaagagcagggggatctgaaatgtggtggggttgaacaagctagtagcagtcccaggagcgatcctttgggctctactcaggatcacgctctgtctcaggagtccagcgagcccggctgccgcgtgcgctctatcaagctcaaggaagatatcctatcatgcacatttgcagagctatctttgggactttgccagtttatccaggaagttagaaggccaaacggtgaaaagtacgatccagattcaatcttgtatctctgtttggggatacagcagtacttattcgagaacggtcgaatcgataacattttcaccgagccctatagtcgatttatgattgaactgactaagttactaaagatctgggaacctaccatcttgccaaatggctacatgtttagccgcatcgaggaggaacatttatgggagtgcaaacaactcggggcctactcccccatcgtcttgctgaacaccctcctgttttttaatactaagtactttcagctgaaaaatgtgaccgagcatctcaagttgagcttcgcccacgtgatgagacggacaagaacccttaagtactcaactaagatgacctacctaagattcttccctccgctgcagaagcaggaaagtgaaccagataagctcacggttggcaagcgaaaaagaaacgaggacgacgaagtgcccgtgggcgttgagatggcagaaaacacagataaccctctgcggtgccccgtgcggctctatgagttctacctttcaaagtgctctgagtcagtgaagcagaggaatgatgtgttctacctgcaaccagagcgttcgtgtgtgcctaactcacccatgtggtacagtacattcccgatcgacccgggcaccttggacacaatgctgacacggatccttatggtgagagaggtgcacgaggagctggccaaggccaaatctgaagactccgacgtagagctgtctgattag

SEQ ID NO: 52717 - DNA, 4380 bp, Artificial Sequence
  Description of Artificial Sequence: Synthetic coding sequence
atggccgagcgggaggtggagagcggcccccggaagcggttcgagcagaaatctggcgccgtgttcgatgaaatcgttgaaaactgtggcggcatcatggatacagagatgtccgaagatattgaccataacttgacgcctactctggacagtatgtcttatggcatgcccaatcagactgggagtgagaattctctgctcgacgaagacgactactttttaaattctggagacttggcagggattccggttgttggctcggataatgaggacgagcaggacttctccagcaaggataacttggtctccagcattcacactgatgactcacttgaggtggagcggcgggtgacgcaacacgagagcgacaatgagaacgaaatccagatacagaacaagctcaaaaaggacttccctaaacagttcgatcaggtgagcgtgtttaaaagcatcagaaaagatttttccttggtgagggaaaactcaaaggagacattttcaggcaaggaaaagaatagagacctcacctatgaaagagagaagagactagacaagccccataaggatctcgatagtcgtctaaaaagctccttttttgataaggctgccaaccaagttgaggaaacactccatactcatctgcctcagactcctgagactaactttcgagattcttcataccctttcgcaaataaggagagtatagggtcagaactgggaaacagcttcgccagtaacattcggattaaggaagaacctctcgacgatgaatacgacaaggctatggccccccagcaggggctgcttgataagattaaagatgagccggacaatgcccaggagtactcccacggccagcaacagaagacgcaggaaggggagcttaaaatcagcgccgtgtttagcgtgagtgggtcgcctttggcaccccagttaacaacgggattccaacccagccttgcctcctccggaatgaacaagatgttgccaagcgttccagctaccgcagtgcgtgtttcatgctcagggtgtaagaagatcctacagaagggacagactgcatatcagaggaaaggttcaacacagctgttctgctctacactgtgtctaacaggctacacagtcccaccagctagaccacccccacccctgacaaaaaagacctgttccagttgcagtaaggacatcctgaatccgaaagatgtgatctcagcacaattcgagaacaccactaccagcaaagacttttgtagccaatcatgcctgagcacctatgagttgaagaaaaagcccattgttactatcaacacgaactcaataagcacaaaatgcagtatgtgtcagaagaatgctgtgattcggcacgaggttaactaccagaacgtagttcataagttatgttccgacgcctgctttagcaagttcagatccgcgaataacctgactatgaactgttgtgagaactgtggcgggtattgctacagcggatcgggccaatgccacatgctccaaatcgaaggccagagcaagaaattctgttcgtcttcttgcattacggcctacaaacaaaacttgtttaataaacctacaggcatgaattcttctgttgttcccctgtctcaaggccaggttatcgtgtcaatccccaccggatccacagtgagtgctggcgggggcagcacaagcgcggtctcccccacgtcaatatcatcatctgccgccgctgggctgcagcggctggccgcccagtctcagcatgtggggttcgctcggtccgtggtgaagctgaagtgtcaacattgcaaccggctctttgccacaaagccagaactcctggattacaaagggaagatgttccagttttgtggaaagaattgtagcgatgagtataaaaagatcaacaatgttatggccatgtgcgagtactgtaagattgagaaaattgtgaaagaaaccgtccgtttctccggggcggacaagagtttctgctctgaaggttgtaaacttttatataaacacgatctggcaaagcgatggggaaaccattgcaaaatgtgttcgtactgtctccaaaccagccctaagcttgttcagaataatctgggcggtaaagtcgaagagttttgctgcgaagaatgtatgagcaagtataccgtgttgttttatcagatggccaaatgtgacgcctgtaagagacagggcaaactcagcgagtctcttaagtggcgaggggagatgaaacacttttgtaacctgctatgtatccttatgttctgtaatcaacagtctgtgtgtgacccaccctctcagaataacgctgccaacataagcatggtgcaggccgctagtgccggaccaccaagcctgcggaaagacagtacacctgtgatcgccaatgtggtttcactggccagtgcgcccgcggctcagcctaccgtcaactccaattccgttctgcagggcgctgtccccacagtgactgcaaaaatcatcggcgatgcgagcacgcagacagacgcccttaagctgccacccagccaacccccccgactcctcaagaacaaagccctgttgtgtaaacctatcactcaaactaaggccacctcatgtaagcctcatacccagaacaaggagtgccagaccgaagataccccttctcaaccgcagataatcgttgtgcccgtgccagtccccgtattcgttccaatacctctgcacctgtacacccaatacgcccctgtgcccttcggaattccggtcccaatgcccgtcccaatgctgatcccttcctcaatggattcagaggacaaggtcaccgaaagtatcgaggatatcaaagagaaactgcccacgcatccctttgaggccgatctccttgagatggctgaaatgattgcggaagatgaggagaagaaaactctgagtcaaggtgagagtcaaacgagcgagcatgaactcttcctggataccaagatctttgagaaggaccagggctctacatacagtggcgacctggaaagcgaagcagtgtctactccacattcgtgggaagaagaactgaaccactatgccctgaagtctaatgcagtgcaggaggcggattcggaattaaagcagttttcaaaaggcgaaacagaacaggacctggaggcggactttccaagcgacagtttcgatcctctgaacaaggggcaggggatccaggcaaggtcaagaacacgccggcggcatagagacggatttccccagccacgtagacgtggtcgaaaaaagagtatcgtggcggtggagccccgctctctcatccaaggcgctttccagggttgttcagtaagtggtatgactctgaaatatatgtacggagtcaacgcatggaagaactgggtgcagtggaaaaatgctaaggaggaacagggcgacctcaagtgtgggggggtggaacaagcctcctcaagcccgagatccgacccactgggttccactcaggaccacgctctgtcccaggagtcgagcgagccgggttgtagagtacgctccattaagctgaaggaagacattcttagttgcacgtttgcagagctatccctagggctctgccagtttatccaagaggtccgaaggccaaatggggagaaatatgatccggatagtattctgtatctgtgcctgggcatacagcagtacctctttgagaacggaaggattgacaatatctttacagagccctatagtaggtttatgatagagctgacaaagcttctgaaaatttgggagccgactatactaccaaatgggtatatgttcagccgtatcgaggaggagcatctgtgggaatgcaaacagttgggtgcttattctcccattgtgctcctgaacactcttttgttctttaatactaaatatttccagctcaagaatgttactgagcaccttaaattgtctttcgcacatgtcatgagacggacgagaacgctgaaatactccactaaaatgacatacctgaggttcttccctccgcttcagaagcaggagtccgaaccagacaagttaaccgttggaaagaggaaaagaaatgaagacgatgaagtgccagttggtgtggaaatggcagagaacacagacaacccactgcgctgtccggtgcgtctctatgaattttacctgtctaagtgctcagagagcgtgaagcagcgcaatgacgtattttatctccaacctgaacggagctgcgttccgaatagccccatgtggtattccacgtttcctattgaccctgggacactggatacgatgcttacaagaatattaatggtgcgagaggtgcatgaagaattagctaaagctaaatccgaggattccgatgtggaactgagcgactag

SEQ ID NO: 52718 - DNA, 297 bp, Artificial Sequence
  Description of Artificial Sequence: Synthetic coding sequence
atggacaccgagatgagcgaggacatcgaccacaacctgacccccacgttagattctatgagttatggaatgcctaaccagactggctctgaaaactctctgctcgatgaggatgattacttcctgaatagcggggatctcgcgggaatcccagtggtgggaagcgacaacgaagatgagcaggatttcagctctaaggacaacctggtatctagtattcatacagacgattcattggaagttgagagacgcgtgactcagcacgaaagcgataacgagaacgagattcaaatatag

SEQ ID NO: 52719 - DNA, 3624 bp, Artificial Sequence
  Description of Artificial Sequence: Synthetic coding sequence
tgacccctggacgacgagtacgacaaggccatggccccccagcagggactgctcgacaagatcaaagacgagccagacaatgctcaggaatattcacacggccagcagcaaaagactcaggagggagagttgaaaatctctgccgtgtttagcgtttcaggctcccctctcgcccctcagctgactacgggcttccaacctagccttgcctcatccggaatgaacaagatgctgccatcagttcctgccacagctgtgcgcgtttcatgcagcggatgcaagaaaattctccagaagggacagactgcttatcaaagaaaaggctcgacacagctcttctgctcgacattgtgccttacgggttacacagtccccccggctcgccctccgccaccactgaccaaaaagacctgcagctcctgttcaaaggatatcctgaatccgaaggatgtgatctcggcacaattcgagaacacaacaaccagcaaggacttttgcagtcagtcctgtcttagcacatatgagctgaagaagaagcctattgtgactattaacactaactccatcagtaccaagtgctctatgtgtcaaaagaacgcagttattaggcatgaggtcaattaccaaaatgttgtgcacaagctttgcagcgacgcctgcttctccaagttccgctcagccaacaacctgaccatgaactgctgcgagaattgtgggggctactgctacagcggaagcgggcagtgtcatatgctccagatcgagggacagtcaaaaaaattttgtagttccagctgtatcacagcctataagcaaaacttattcaacaaacccaccggaatgaacagcagcgtggtcccgctgtcacagggacaagtaattgttagtataccaaccgggagtaccgtgagcgctggaggggggtcaacttcagctgtatcccccacctccatctcctcttccgctgccgcgggcctgcaaaggcttgcagcccagtcccagcacgtcggtttcgcacgatccgtcgtgaagttgaaatgccagcactgcaaccgacttttcgccacaaagccagagctgctggactacaaggggaaaatgttccagttctgcgggaagaattgctcagatgaatataagaagatcaataatgtcatggctatgtgtgagtactgtaaaatcgagaaaattgtgaaggaaaccgtgaggttctcaggcgccgataagagtttttgttccgagggttgcaagttgctttataaacatgacctagctaaaaggtggggcaatcattgcaagatgtgtagctattgccttcagacaagtcccaagctggtccagaataatctgggaggaaaggtagaggaattttgctgtgaggaatgtatgtcaaaatacactgtgttgttctaccagatggcgaagtgtgatgcatgtaaacggcagggcaaactttcagaaagcctgaagtggaggggtgaaatgaaacatttctgcaacttgctctgcatcttgatgttttgtaatcagcagagcgtttgcgaccccccaagtcagaataacgctgcaaacattagcatggtgcaggccgcaagcgccgggcctccttcccttcgcaaagactcaacccccgtcatcgccaacgtcgtgtctctcgctagcgcccccgcagctcaacccactgtcaactcgaacagcgtgctgcagggcgccgtgcctaccgtgaccgctaaaattatcggagacgctagcacacagactgacgcactgaagcttccaccctctcagcctccacgcttgcttaaaaataaggctctcctgtgtaaacccatcactcagaccaaggctacatcctgcaaacctcacacacagaacaaagaatgtcaaactgatacgccaagccagccccagatcattgttgtgccggtccctgtaccagtgttcgtccccatcccactacatctgtacacacagtatgcccctgtgccattcgggatcccggtgcccatgccagtgccaatgcttataccatcttcaatggacagcgaagataaggtcactgaaagcattgaagatatcaaggaaaaactccctacacacccattcgaagcagacctcctcgaaatggccgaaatgatagcagaggatgaggagaaaaagaccctttctcagggcgaatctcagacttccgaacacgagctcttcctggacactaagatctttgagaaagaccagggctctacttactcaggcgacctggagtcagaggctgtgtcgacccctcactcctgggaagaggaattaaatcactacgctctgaagtcaaacgctgtgcaagaagcagacagtgaactgaaacagtttagcaaaggggagacggagcaggacctggaagccgatttcccgtcagactcatttgatccgctgaacaaaggccagggcatccaggctcgaagcaggacgcggagacggcatagagatggtttcccccagccaagacgtaggggacgaaagaagtctattgttgctgtcgaacccagatcactgatccaaggagcattccaggggtgctcagtgagcggcatgacactgaaatatatgtatggagtgaatgcatggaagaactgggtccagtggaagaatgctaaagaggaacagggcgatctcaagtgcggcggcgttgaacaggcgagtagtagtccccggtcagacccgcttggctccacccaagaccatgcgctctcgcaagagtcttctgaacccgggtgtagggtgcggtcaatcaagcttaaggaagatattctgagctgcactttcgctgagctgagcctcggcttatgtcagtttattcaagaagtgaggaggcctaatggggaaaagtacgaccctgactctatcctctatctttgcttaggcattcagcagtacctgtttgagaacggcaggatcgataacatcttcacagagccctacagccggttcatgattgagctgacaaagctcctgaaaatctgggagcccaccattctacctaacggatatatgttctcaaggatagaggaagagcacctgtgggagtgcaagcagctgggtgcctatagtcccattgtactcctcaacacattgttgttctttaacacaaagtatttccagcttaaaaatgtgacggagcacctgaagctatcattcgctcacgtaatgaggcgaacaaggacgctcaagtattctactaagatgacctacctccgcttttttccaccactgcaaaaacaagaatctgaaccggacaagctgacagtaggaaaacggaagcgaaacgaagatgacgaagtgccagtgggcgtagaaatggccgagaataccgataacccccttcggtgtcccgtcagactctatgaattctatttgtccaagtgcagcgaaagtgttaaacaacgcaacgatgtcttctacctccaaccagagcgcagttgcgtacctaattctccaatgtggtatagtaccttccccatcgatcccggtaccctggacacaatgctaactcgcattctcatggtgagagaagtgcatgaagaactggccaaggcaaaatctgaagacagcgacgttgaactatctgactag

SEQ ID NO: 52720 - DNA, 1098 bp, Artificial Sequence
  Description of Artificial Sequence: Synthetic coding sequence
atgaacgtgatctaccccctggccgtgcccaagggccggcggctgtgctgtgaagtttgtgaggctccggctgagagagtttgtgcggcatgcactgttacctactactgtggcgtggtccatcagaaggcagattgggacagtattcacgaaaagatctgtcagctcttgattcctctgaggacttcgatgccattctacaactcggaggaggagagacagcatggcctccaacagcttcaacagaggcaaaagtacctgatcgagttttgctacacgattgcccagaagtacctgttcgagggaaagcacgaggatgctgtcccagctgctctgcaaagtctaagattcagagttaaattatacggcctctcaagcgtggaattggttcctgcgtatctgctcttggccgaggcctctctgggcctcgggagaatagtacaagccgaagaataccttttccaagctcagtggactgtcttaaagagcactgactgctcgaacgctacccattccctgctccatagaaatttaggcttgttgtatatcgccaaaaagaactacgaggaagcgcgttaccatctggccaacgacatctactttgcatcttgtgcgttcggcaccgaggacatccgcacgagtggcggctattttcacctcgccaatatattttacgatttgaaaaagctcgacctggcggatacactttacaccaaggtctccgaaatttggcatgcttatctaaataaccactatcaggtcctttcccaggcccatatccaacaaatggatctgcttgggaagttgttcgagaatgatactgggttagatgaggcccaagaggcggaggctatccggattctcacatccattcttaacatccgagagtcaacctcagataaggctccccaaaaaacaatctttgtcctgaaaattctggtgatgttctactacctcatgatgaactcctcaaaagcgcaagagtacgggatgcgggccctttccttggctaaagaacagcagttggatgttcacgaacagagcacgatccaagaattgcttagtttgatctccaccgaagaccaccccatcacctag

SEQ ID NO: 52721 - DNA, 768 bp, Artificial Sequence
  Description of Artificial Sequence: Synthetic coding sequence
atgagcgccctggacagcaccgcccacttccacgccctgctgcagtttcgcggccggacggctgcgtggccagccgctgcagctgccgcggccgggctcggcagaatcgtacaagcggaagagtatctcttccaggcccaatggaccgtgttgaagagtactgactgctctaatgccacccactcactgttgcaccgtaatctcgggctgctgtacatcgccaagaagaattacgaggaggcaagatatcacctggctaacgacatttattttgcctcttgcgcatttggcactgaggacattcgcacgagcggcggatacttccacctcgccaacatattttacgatctcaaaaagctggacctagccgacacactatacactaaggtgtccgagatttggcatgcatacttgaacaatcactaccaggtgttgagtcaggcacacattcagcagatggacctccttggcaagctgtttgaaaacgataccggccttgacgaagctcaggaagccgaagctatcagaatcctgaccagtatattgaatattcgtgagagcacttccgataaggccccacagaagacaattttcgttcttaagatacttgtgatgttttactacttgatgatgaactcctccaaagcacaggagtacgggatgcgtgccctctcactcgcgaaggagcagcaactcgacgttcatgagcaatccactatccaggagcttctttcccttatcagtactgaggatcatccaattacatag

SEQ ID NO: 52722 - DNA, 1383 bp, Artificial Sequence
  Description of Artificial Sequence: Synthetic coding sequence
atggccccccggagccggcggcggcggcacaagaagccccccagctctgtggcccctattatcatggcacccaccactatcgttacacctgtacccctgaccccttccaagcccggtcctagcatcgacacactgggattctttagcctggacgataacgtgccgggcctgtcccagctgatcctgcagaagctgaatatgaagagctatgaggagtacaagctggttgtggatggcgggacacccgtgagtggcttcggctttagatgcccacaggagatgtttcagcgtatggaggatacatttcgtttttgcgctcattgtagggctttgccttcaggactgagcgattctaaggtcttgcgccactgtaagcgatgccgcaatgtttattactgtggtccggagtgccagaagtccgattggcccgcccacaggagagtttgccaggagctccgcttggtcgctgtcgaccgcctgatggaatggctcctggtgacaggtgattttgtgcttccttctggcccctggccctggcctcctgaggctgtacaagattgggacagctggttcagcatgaaggggctacacctcgacgctaccttggatgctgttctggtcagtcacgctgtaactactctgtgggcctccgtgggtcgccctcggccagacccagatgtcctgcagggctcattaaagagactgcttacagacgttctgagccgacctctgacactaggcctagggctgagggccctgggcattgatgtgcggcggactgggggcagcacagttcatgtggtcggagccagccacgtagaaaccttccttacccgacctggagattatgacgagttgggatacatgttcccaggtcaccttggcctccgggttgtgatggtaggggtggacgtcgcgactggattttcgcagtccaccagcacgtcccccctcgaacctggcactatccagttgtccgcacatcggggtttataccatgacttctgggaagagcaagtggagacgggacagactcaccatcctgacctggtggctgccttccatcccgggttccacagctcaccagatctgatggaagcgtggttacctaccctgctgctcttgagggattataaaatccctacacttatcaccgtctactcgcatcaagagttagtgtccagtctgcagatattggttgaactcgacacacatataactgccttcggatcgaaccccttcatgtccctgaagccagaacaggtgtacagctcacctaacaagcagcctgtgtactgctctgcgtactacataatgttcttaggtagcagttgccaattggacaaccggcaacttgaagaaaaagtagacggcggcatatag

SEQ ID NO: 52723 - DNA, 1383 bp, Artificial Sequence
  Description of Artificial Sequence: Synthetic coding sequence
atggccccccggagccggcggcggcggcacaagaagccccccagctctgtggcccctatcatcatggcaccaaccaccatcgtgacccccgtgcccctgacacctagcaagcctggtccgagtatcgataccctgggcttcttcagtctggatgacaatgttcccggactgtctcagcttatattacagaaattaaacatgaagagttatgaggagtacaaactggttgtggatggaggcacccctgtgtccggatttggctttcggtgtcctcaggaaatgtttcagaggatggaggacactttcagattttgtgcccattgccgcgccctcccctcagggttgtccgactctaaagtgctcagacattgcaaaaggtgccgcaacgtatactactgcggacctgagtgccagaagtccgattggcccgctcatagaagagtgtgccaagaactacggctggtggccgtggataggctcatggaatggcttttggttacaggcgactttgtcctgcctagtggtccctggccatggccgccggaggctgtgcaggattgggacagctggttctcgatgaagggtctacacctcgacgcaactcttgacgctgttctggtttcacatgccgtcacaacgctatgggcatctgtcggccgtcccaggcctgaccccgatgtgctgcaagggagtttgaaaagactactaactgacgtcctgagccggccactgacccttgggctgggactccgcgccctggggatagacgtgcggcggaccggcggctccactgtgcacgtagtcggtgctagtcacgtcgaaacattccttacacggccaggagactatgatgaactcgggtacatgttccccgggcatctgggactgcgggtggtgatggtaggagttgatgtagccacagggttcagccagagcacctcaaccagccccctcgagccagggacaatccagttatcagcacacaggggactctaccatgacttctgggaagagcaggtcgaaacagggcagacccaccatcctgatcttgtcgctgcctttcaccctggcttccacagcagcccggacctcatggaggcatggcttccaactctgttgctgttacgcgactacaagatccctaccctaattacagtgtattcccaccaggagctggtgagcagcctgcagatcttagttgagctcgacacacacattaccgcgtttggatcaaatccatttatgagccttaaacctgagcaagtatactcttcacccaacaagcagccagtgtattgttcagcttattatattatgtttctcggcagctcctgtcagttggacaatcgccagctggaagagaaagttgatggcggaatctag

SEQ ID NO: 52724 - DNA, 3240 bp, Artificial Sequence
  Description of Artificial Sequence: Synthetic coding sequence
atgccccgggtgcacaacatcaagaagagcctgaccccccacatctcttgcgtgacaaatgaatctgataatctcctggatttcctgccagataggctcagggccaaactgttgcctttccaaaaggatggaattatttttgcgctcaagaggaacggcagatgcatggtggccgacgaaatggggttgggtaagaccatacaggcaatcggcattacatacttttataaggaagagtggccattgctcatcgtcgtgcccagctcactgagatatccttggaccgaagagattgaaaagtggattccagaactgtcaccagaggagattaacgtgatccagaacaagacggacgtaagaaggatgtctacttcgaaagtaacagtcctggggtacggcctacttacagcagacgctaagaccttaattgatgctcttaataaccagaactttaaggtggtgatcgtcgacgagtctcactacatgaagagtcgcaatgcaactcggagccggatcctgctgccgattgtccagaaagctcggagagccattctcctcaccggaactcccgccttaggcaggcctgaagagctgttcatgcagatagaggcgctatttccccagaagttcggacgttggacagactacgcaaagcgctactgtaacgctcatatccgctatttcggaaaacgcccacagtgggattgtaggggagcctccaatttaaatgagctccaccagctgctttcagatattatgattcggcgcttaaaaacagaagttctcacacagctcccccccaaggtgaggcagcgcatcccttttgatctgcccagtgcagccgcaaaggagctaaataccagtttcgaggagtgggagaaaattatgcgcactccaaactcaggagccatggaaacggtgatggggctaataaccaggatgtttaagcaaaccgccatcgccaaagcaggggctgtgaaggattatatcaagatgatgctccaaaatgatagccttaaatttctggtgttcgcccatcatctgagcatgctacaggcttgtacggaggcggtgatagaaaacaaaacacgctatatccgtattgacggtagcgtctctagctcggagagaatccacctagtcaatcagtttcagaaagaccccgacacgagggtagccattctgtcaattcaggcagccggccaaggcctcactttcactgcagcttctcatgtcgtcttcgcggaactctattgggatcccggccatattaagcaggccgaagaccgagctcacagaatcggccagtgcagttctgttaatatccactacttgattgctaacggcaccctcgacaccctgatgtggggaatgcttaataggaaggcccaggtgaccgggagcactttaaacggacgaaaagagaagattcaggcagaggagggcgataaagaaaagtgggatttcctgcaatttgccgaggcatggacaccgaatgatagtagcgaagagctgcgcaaggaagcactatttacgcactttgagaaggagaaacaacacgacattcggagcttctttgtgccacagccgaaaaagagacaattgatgaccagttgtgacgagtcaaaacggttcagggaggaaaacacagttgtgtcctctgatccgaccaagactgcagcccgggatattattgactatgagagcgacgtagagccggagactaaaagattaaagctcgccgcgtcagaggaccattgttctccctctgaggagacaccctcccagtctaagcaaattagaacccccctggtggagtccgtacaggaggcgaaagcacagctgactactcctgcttttccagttgagggatggcaatgttctctgtgcacctatataaacaactctgagttaccctattgcgagatgtgtgagactcctcaaggatcagccgtgatgcagatcgattcccttaatcacatccaagacaagaacgagaaagatgacagccaaaaagacacatccaagaaagtccagacgatcagtgactgtgagaagcaggctctggctcagtctgaaccaggacagctcgctgactccaaagaagaaacacctaaaatagaaaaagaagacggcctgacttcacagcccggtaacgagcaatggaagagttctgatactctcccagtgtacgacaccttaatgttttgcgcatcacgcaacacggaccgcatccacatctacactaaggacggaaagcaaatgagttgtaatttcataccgctcgacataaaattggacctttgggaggatctcccggcctccttccagcttaaacagtatagatctctgatccttcggttcgttagggagtggtcttccctcacggcaatgaagcaacggatcattaggaagtcggggcagcttttctgcagccccatattagctctggaggagatcaccaagcagcagactaaacagaattgcaccaaacgatacatcactaaggaggatgtagctgtcgcgtcaatggacaaagttaaaaacgtaggtgggcacgtgcgcttgatcaccaaagaatcgcgtccacgagacccatttacaaagaaactgctggaagatggcgcgtgtgtgcccttcctgaatccttacacagtccaggccgatctgacagtgaagccttctacttcaaaaggttatctgcaagctgttgacaacgagggtaatcccttgtgtctacgctgccagcagcccacatgtcaaacaaagcaggcctgtaaagcaaactcctgggactccagattctgctcactcaagtgccaggaggagttttggataaggagcaacaattcttatctgcgtgccaaagtcttcgagaccgaacacggcgtgtgtcagttgtgcaacgttaatgctcaggaattgttcttgcggctgagggacgccccaaagtctcagcgcaaaaatctcctatatgctacgtggactagcaaactgccactggaacagctgaacgagatgatacgcaatcctggcgaagggcatttctggcaggttgaccacatcaagcctgtgtacggcgggggaggccaatgcagcctggataacctgcaaacactgtgcacagtgtgtcataaagaacgtaccgctcggcaggccaaggaacgttcccaagttcggagacagagtcttgcctccaagcatgggtccgacatcacacggtttttagtgaagaagtag

SEQ ID NO: 52725 - DNA, 1797 bp, Artificial Sequence
  Description of Artificial Sequence: Synthetic coding sequence
atgaccagctgcgacgagagcaagcggttccgggaggagaacaccgttgtgtcgagtgaccccacaaagaccgctgcccgggacatcattgattatgagtcagatgtcgaacccgagaccaaacggcttaaactcgcagcaagtgaggaccactgctctccaagcgaggaaacaccatcgcagagcaaacagatccgcaccccgctggtcgagtctgttcaggaagcgaaagcccagctgaccacacccgctttcccagtggagggctggcagtgctccctgtgtacatacattaacaactccgagctgccttactgcgaaatgtgtgagacaccacagggtagcgcagtaatgcaaattgacagtcttaaccatatccaggacaaaaatgagaaggatgactcccagaaggacacaagcaaaaaggtgcaaacaatttccgactgcgagaaacaggccctagcccagagtgagcccggccaattggcagacagcaaagaagagactccaaagatcgaaaaagaggacggccttacctctcagcctgagcagtggaaatcttctgatacgcttcctgtctatgacaccttgatgttctgcgctagccggaacacagatagaatccacatttacaccaaagacggtaagcagatgtcttgcaatttcattccattggacatcaagctggacctatgggaagatcttcctgcgagctttcagctgaagcaataccggtcactcattcttcgattcgtccgagaatggtccagtctgacagctatgaaacagagaatcattcggaagagtggccagctgttttgtagtcctattttagccctggaggagattacaaaacagcagactaagcagaactgcaccaagaggtacatcactaaggaagatgtcgcagtggcaagcatggacaaggttaaaaatgtgggcggccacgttcgactgatcacgaaggagtctaggccccgcgacccttttaccaaaaagctcttagaagatggggcttgcgttcctttcctgaacccgtacactgttcaggcagacctgaccgtcaagcccagcacaagcaaaggatatctccaggcagtggacaatgaaggcaaccccctttgtttgcgttgccagcagccgacgtgccagaccaagcaggcttgtaaagctaattcctgggactcaagattctgcagcctcaaatgccaagaggaattctggattcgttcgaacaatagttatctgagagctaaagtatttgagacggagcatggggtgtgtcagttgtgcaatgtgaacgctcaggagctgtttctgcgccttcgagacgctccaaaatcccaaagaaaaaacctgttatacgcaacctggacgtcaaagttgccgttggagcagctcaacgagatgatccgcaatccgggagaaggtcacttctggcaggttgaccacataaagcctgtgtatggggggggcggtcagtgctctctggacaatctgcaaactctgtgcaccgtgtgtcataaggagcggactgctcgccaggcaaaagaaagatcacaggttcgccggcagtctttggcaagcaagcacggtagtgacattaccaggtttctggttaagaaaaagctgcatgaaagccacaaagtcaccggcgctgagcagggactccaggtctccggcctgcccgactccgcagccccagaaggcggtgcagcgcatacaaacgatcagagacggtgccaacgaatgaagcagcccctgacggaggtgcagattctgagccactcatcatag

SEQ ID NO: 52726 - DNA, 1107 bp, Artificial Sequence
  Description of Artificial Sequence: Synthetic coding sequence
atgggcctgggcaagaccatccaggccatcggcatcacctacttctataaagaggagtggcccctccttattgttgtgccctccagtctgcgctacccctggaccgaggagattgagaagtggattcccgaactttcacccgaagagattaacgtcatccaaaataagacagacgtgagaaggatgagcacctcaaaggtaacggtcctgggctacggtctactcacagcagacgccaaaactctcatcgatgccctgaataaccagaactttaaagtggttatcgtcgacgagagccactatatgaaatcgaggaatgccacgcggtctcggatactgctcccaatcgtgcagaaagcacgacgcgctattctgctgactggtacgcccgccctcggacgtccagaggaactattcatgcagattgaggcactgttcccgcagaagttcgggcggtggacggactatgccaaaagatactgcaatgcacatattagatactttggtaagcggccgcagtgggactgcaggggcgcttccaatttgaacgaactgcaccagctgttgtcagacataatgatccgtaggctgaagaccgaggtactcactcagctgccacctaaggtccggcagcggataccctttgatttaccgagcgcagccgcgaaggaactgaacaccagctttgaggagtgggaaaagattatgaggacgccaaattctggagccatggaaactgtcatggggttgattacccgcatgttcaagcagaccgctatcgcgaaagcaggagccgtgaaagactacattaaaatgatgttacagaatgactcactcaagttccttgtgtttgctcatcacctgtctatgctccaagcgtgcaccgaagcagtaattgaaaataaaacacggtacatcagaattgacggtagcgtcagcagtagtgaaaggattcacctggtcaaccagtttcagaaagaccccgatactcgggtcgctatcctgagtatccaagcagctggacaagacctctacgataaagtggcctggggaaagcggaccctggtctccggtttattcatggagtgcttctgctttgtgccctag

SEQ ID NO: 52727 - DNA, 3234 bp, Artificial Sequence
  Description of Artificial Sequence: Synthetic coding sequence
atgccccgggtgcacaacatcaagaagagcctgaccccccacatcagttgtgtgactaatgagagtgataaccttctggattttctgcccgatcgattgcgagctaagttgctcccgttccagaaagacggcatcatctttgctctgaagcggaatgggcgttgtatggtggctgacgagatgggactgggtaaaactattcaggccattggaattacttatttctataaggaagagtggcctctgctcatagtcgtcccttcaagcttgcgctacccctggacggaggagattgagaaatggattcctgaattgagccccgaagaaatcaatgttatccagaacaaaacagacgtgaggcgcatgtccacctccaaggttaccgtgctcgggtatggtcttttaacggccgacgctaagactttaattgatgctctgaataaccagaatttcaaagtcgtcattgttgacgaatcccattatatgaaaagtcggaatgcaaccagatctcggatactacttcctattgttcagaaggctagacgggccatcctcctgacaggcacacccgccctcggtaggccagaggagttgttcatgcagatagaggcactctttccccaaaaattcggtagatggaccgattacgccaaacgatattgcaatgcacatatcagatattttggaaagcggcctcagtgggattgtcgtggggctagtaacctgaatgagttgcatcaactgctgtcggatatcatgatacgcagacttaaaaccgaggtcctcacccagcttccaccaaaagttcggcagcgtattccgttcgacctccccagtgccgccgccaaggagctgaatacatccttcgaggagtgggaaaaaattatgagaaccccaaacagcggcgccatggaaaccgtgatgggcctcataacgagaatgtttaaacagacagcgattgctaaagctggcgccgtgaaggattacattaaaatgatgctacagaatgatagcctcaagttcctagtgtttgcccatcacctgtcaatgctgcaagcttgtactgaagcagttatcgaaaacaagactaggtatatacgtattgacggtagcgtatcaagttcagaacgcatccacttggtgaatcaattccagaaggatcctgatacacgcgtggctattctgagcattcaagctgccgggcaaggcctaaccttcaccgcagcgagccatgtagtttttgcagaactctattgggatccagggcacatcaaacaggcagaagacagagcgcaccgtatagggcagtgtagcagcgtgaatatacactatctgattgcgaacggaacgctggataccctgatgtggggcatgttgaataggaaagcccaagtgaccggctcaaccctcaacggaagaaaggaaaagatccaggctgaggaaggagataaggagaagtgggacttcctgcagtttgccgaggcatggacccccaatgactcatccgaggaactgcgcaaagaagcattgttcacccactttgaaaaagagaaacagcatgacatccgatcattctttgtcccacagcccaagaaacgtcagctcatgacaagttgcgatgaatcgaaacgctttcgcgaggagaataccgtcgtgtccagtgaccctactaaaaccgctgcccgggacatcattgattacgagtcggatgtcgagccagaaacaaagcgccttaaactagctgcttctgaagaccactgctcgccctccgaggaaaccccaagccagtcaaagcagataagaacacctctagtcgaatccgttcaggaggccaaggctcagctgacaacccccgccttcccggtggaagggtggcagtgctctctctgcacttacataaataacagtgagctgccctactgcgagatgtgtgagactccgcagggatccgcagtgatgcagatcgactcactgaaccatattcaagataagaatgaaaaggatgactcacagaaagacacttccaaaaaggtccagaccataagcgattgcgaaaaacaggccttagcccagtctgaacctggccagttagccgattccaaggaggaaaccccaaagatcgaaaaggaagacggactcacgagtcagcccgagcagtggaagtcttctgataccctcccggtttacgatacactcatgttttgcgcttcccgtaacacagatcgtattcacatttacaccaaagatggaaaacagatgagttgtaattttatccctctagatataaaacttgacttatgggaagatctgcctgcatcatttcagctgaaacagtataggtcgctgattttgagattcgtgcgtgagtggtccagtttaactgcaatgaagcagcgcattattcggaaatccggccagctgttctgttccccaattctcgcgctcgaggagattaccaagcagcagacaaagcagaattgcactaagaggtacattacaaaggaggacgtcgctgtggcaagtatggacaaagtgaaaaacgtaggaggtcatgtgaggctcatcacaaaggaatcccgacccagagatccctttacgaagaagctgctcgaagacggcgcctgtgttccttttctcaatccttacaccgtccaggctgacctgacggtgaagccgagtacatcaaaagggtaccttcaggccgtagacaacgaaggaaacccgctgtgtctcaggtgccagcaaccgacttgtcaaactaagcaggcgtgtaaggctaattcatgggactcccgtttctgcagcctcaaatgtcaagaagagttctggatccgctccaacaatagttacctgagggccaaggtgtttgaaaccgagcatggcgtgtgtcagctctgcaacgtaaacgcccaggaactgttcctgaggctccgcgacgctcccaaaagccagcggaagaatctgttgtacgcaacctggacctccaagctccctctcgaacaactgaacgagatgatacgtaatccaggggaggggcatttttggcaagttgatcacattaaaccagtgtatggaggagggggtcagtgctctctggacaatctccaaactctttgtaccgtgtgccataaggagaggaccgccagacaggcaaaggagcggtcgcaggtccgtcgccagtctttagcatccaagcatgggtccgatattactagattcctagtgaagaaatag

SEQ ID NO: 52728 - DNA, 1797 bp, Artificial Sequence
  Description of Artificial Sequence: Synthetic coding sequence
atgaccagctgcgacgagagcaagcggttccgggaggagaacaccgtggttagctccgacccgactaagactgcagcgcgcgacatcatcgactacgagtcagacgttgagccagaaaccaagcgtctgaaattagctgcatctgaggaccattgtagcccctccgaggagactccatcacagagcaagcagatcaggacgcccctggtggagagcgtgcaggaggccaaagcacagctgacaaccccggcattccctgtggagggatggcagtgttcactgtgcacctatatcaataatagcgagctgccttattgtgaaatgtgcgagactccacagggcagcgctgtgatgcaaattgacagcttaaaccatatccaggataagaatgaaaaggatgacagccagaaggatacgagcaagaaggtgcagaccatctctgattgcgaaaagcaggctttggcccagtccgaacctggacagcttgccgatagtaaggaagaaacccccaaaattgagaaagaagacggcctgactagtcagcctgaacaatggaagtcctcagacacacttccagtctatgacacactcatgttctgcgctagccgcaacaccgatcggattcacatttataccaaggatggcaagcagatgtcttgtaacttcatcccgctggatattaagctggatttatgggaggacctgccagcatccttccagcttaagcagtatcgttcgttgattttacgcttcgtgagggagtggagctcactgaccgccatgaaacagaggatcatacgaaagagtggacagcttttctgcagcccgattctcgccttagaggaaatcaccaagcagcaaaccaagcagaattgtactaagagatacataactaaggaagatgtggctgtggcttcaatggacaaggtgaaaaacgtgggaggtcacgtaaggctgattaccaaggagtcacgaccccgggatcccttcacaaagaagctgttagaggatggtgcctgtgtaccttttcttaatccctacactgtgcaggccgatctcacagtgaagccatccaccagcaaagggtatctgcaagcggttgataatgaaggtaatccgttgtgtctacgatgccaacaacccacatgccagacaaagcaggcatgtaaggcaaacagctgggattccaggttttgctcactcaagtgccaagaggaattctggatccgctctaataatagctacttacgcgctaaggtctttgagaccgaacatggcgtctgccagctgtgcaatgtcaacgcccaggagctcttcctgagacttagggatgctcctaagtctcaaagaaagaacttactgtatgccacatggacttccaaattgccactcgaacagttaaacgaaatgatccggaatccgggagaaggtcatttctggcaggttgaccacatcaaacccgtgtatggggggggcggccagtgctctctggataacttacagacactgtgcacagtatgccacaaagaacgcacagcccgccaggccaaggaacgcagccaggtaagaaggcagagtctggcatcaaagcatggctcggatattaccaggttcttggagacatctaaactgcacgagtcccacaaggtcactggcgctgagcaaggactccaggtgagtggtctgcctgacagcgccgctccagagggtggagcagcccacacaaatgatcaacgacgctgtcagaggatgaaacagcccctcaccgaagttcagatactctcccatagctcctag

SEQ ID NO: 52729 - DNA, 3234 bp, Artificial Sequence
  Description of Artificial Sequence: Synthetic coding sequence
atgccccgggtgcacaacatcaagaagagcctgaccccccacatctcatgcgtcacaaacgaaagtgataatttgctggacttcctccccgatcggctgcgagctaagcttctgccattccaaaaggatggcatcatctttgcactcaaaagaaatggttcacgaatcgattgcgaccagatggggctcgggaagacaattcaggctattgggatcacctacttttataaggaggaatggccactgttaattgtcgtgcccagctctctgcgctacccctggaccgaggagatcgaaaagtggattccggagttgagtcctgaagagatcaacgtcattcaaaacaaaacagacgtgagacgtatgagcacttcgaaggtgacagtattgggctacggcctcctgaccgcggacgctaaaaccctcattgacgctctgaacaaccagaactttaaggtggttatagttgatgagtctcactatatgaaaagtcgaaatgctactcggtcccgaatcctcttacctatagttcagaaggcccggagagccatactcctgacgggtactccagctctgggacgaccagaagaactttttatgcagatcgaagccctgttcccccagaaatttggaaggtggacagattacgccaaacgatactgtaacgcccatatccgatattttggaaagcgaccacagtgggactgcagaggcgcttccaacctgaatgagctgcaccagcttctatcagacattatgataaggcgccttaaaaccgaagtgctgacccaactacctcctaaagtgaggcagaggatcccttttgatcttcccagtgccgcagctaaggagctcaacacctcattcgaagagtgggaaaagattatgagaactcccaacagtggggccatggaaacagtaatggggctgatcacgcgcatgttcaagcagaccgctattgctaaagccggcgctgttaaggattacataaaaatgatgctgcaaaacgattcccttaagtttcttgtgttcgcccaccatctctccatgctgcaagcctgtacagaagcggtgattgaaaacaaaacaagatacattcgaatcgatggcagtgtgtcaagctccgagcggatacatctggtcaaccaatttcagaaagatcccgatactcgagttgcaattctgagcatccaagctgccggacagggcctgactttcaccgctgcctcacacgtcgtgtttgcagagctctactgggacccgggccatattaagcaggctgaagaccgagcccaccggatagggcagtgttcatcggtgaatatccactacctgatcgctaatggcactctggacactctcatgtggggaatgttgaaccgcaaggcccaggtgactggttctactctaaatggtcgaaaagagaaaatacaggcggaagaaggagataaagaaaagtgggatttcctgcagttcgctgaagcgtggacgccaaacgattcatccgaggaacttcgaaaagaggctctatttacccactttgagaaggaaaagcaacacgatatccggagtttcttcgttcctcagccaaagaagcgccagctcatgactagctgtgacgaaagtaaaagattcagggaagaaaacacggtagtgagcagcgatcctacgaagactgccgcccgggacatcattgactatgaatccgacgtggaacctgaaaccaaacgcctcaagctagccgcttcagaggatcattgctcccccagtgaggagaccccaagtcagtctaaacagattcgcacgccgcttgtggaaagcgtccaggaagcgaaagcgcagctgactacccccgcgttccccgtggagggatggcaatgtagtttgtgtacatacataaacaacagcgaactcccttactgcgaaatgtgtgagactccacaggggtctgctgtcatgcagatcgacagtttgaaccatattcaagacaaaaatgaaaaggatgactctcagaaggataccagtaaaaaagttcagaccatatcagattgcgaaaaacaggctctggcacagtccgagcctgggcagttggccgattcgaaggaagagacccccaaaatcgaaaaagaggacggactgacttctcaacctgagcaatggaaatcttcagacactctgccggtatacgataccttgatgttttgcgcatcaagaaacacagacagaattcacatttacactaaggatggcaagcaaatgtcgtgtaattttattcccctggatataaaactggatctatgggaggacctgcctgcctcatttcaactgaaacagtatcggagcctcatcttaaggtttgtgagggagtggagcagtttaacagcaatgaagcagcggataattcgcaagtcgggacagctcttttgttcccctatcctagctctggaggaaatcaccaagcagcaaactaagcaaaactgcaccaaaagatatatcactaaggaagatgtggccgtagcctctatggacaaggtcaaaaatgtgggtggtcacgtccgcttgataaccaaggagtctagacccagagaccctttcacgaagaaactcctcgaggacggggcgtgcgtaccctttcttaacccttatactgtccaagcggacttgacggtcaagcctagcacctccaaaggatatctgcaggcggtagacaatgagggtaaccctttatgcctcagatgtcagcagccgacctgccaaaccaagcaggcatgcaaggcgaatagctgggatagcaggttctgctcattgaagtgccaagaagagttttggatcagatcaaataattcttacttacgagccaaggtgtttgagactgaacacggtgtgtgccagttatgtaacgtaaacgcccaagagctgtttctgcgcctgagagacgcgcctaagtcccagcgcaagaacctactttacgctacgtggacgagcaagctacctctggaacaacttaacgagatgatccggaatccgggagagggacacttctggcaggtggaccacatcaagcccgtctacggcggtggcgggcagtgttctctggacaatctccagacattatgcaccgtttgtcacaaagaaaggacagcccggcaagccaaggaaagatcccaggtgaggcgccagtcactcgcttctaaacacggttccgatataacacggtttctggtgaaaaagtag

SEQ ID NO: 52730 - DNA, 1794 bp, Artificial Sequence
  Description of Artificial Sequence: Synthetic coding sequence
atgaccagctgcgacgagagcaagcggttccgggaggagaacaccgtggtaagcagcgaccccaccaaaacagccgcccgcgacattattgattacgagagcgatgtcgagcccgaaacaaagagattaaagctggcggcaagtgaagaccactgttctccatcagaggagaccccaagccaaagcaaacagattaggacgccgcttgtcgagagtgtgcaggaggcgaaggcccaattgaccacacccgcttttccagtggaggggtggcagtgcagcttgtgcacatatattaataatagtgaactgccttactgtgaaatgtgcgagactccacaggggtccgccgtcatgcagatagacagcttgaatcatattcaggataaaaatgagaaagatgactcacagaaggacacgagtaagaaagtgcaaaccatctcagactgcgaaaaacaagctctcgcacaatcagagccaggccaactggcagactcaaaggaagagaccccgaaaattgagaaggaagatgggctgacttcccagccagaacagtggaagagcagcgatacgcttcctgtgtacgataccctgatgttctgcgcgagccggaacaccgaccgcatccacatttacaccaaagatggcaagcagatgtcttgcaactttatccccctcgatattaagttagacctttgggaagatctcccagccagtttccagctgaagcagtatagaagtctgatcctcaggtttgtgcgagagtggtcctccctgaccgcaatgaagcagcggattattaggaagagcggtcaactgttctgtagcccaattctggcactggaggaaataactaaacaacagactaagcaaaattgcacaaaacgctatatcaccaaggaagacgtggcagtagcttctatggataaggtcaagaatgtcggagggcatgtcagactgatcactaaggaaagccggccgcgcgacccgtttaccaaaaagctgctcgaagacggtgcatgcgtgcctttcctgaatccctacactgtgcaagctgatctgacagtgaagccttcaacgtctaaaggctatctgcaggccgtcgataacgaaggaaatccactgtgcttgcgctgccagcagccaacctgtcaaacgaagcaggcctgcaaagcaaacagctgggacagcaggttctgcagtcttaaatgtcaagaggaattctggatcaggtccaacaactcctatctgcgcgcaaaggtgtttgaaacggagcacggtgtatgccagctgtgtaacgttaacgctcaggaactcttcctgagactccgggacgcgcccaaatcgcagcgcaaaaatttgctgtatgccacctggacatcgaaactgccactcgaacagcttaatgaaatgattaggaaccccggcgagggccatttttggcaggtggaccacattaaaccagtatacgggggcggggggcagtgctcgttagataacttacagaccttatgtactgtttgccacaaagaacggacggcccgccaagctaaggagaggtctcaggtcaggagacaaagtctcgcaagtaaacacgggtccgatatcacccgattcctggttaagaaattgcatgagtctcacaaggtaaccggggccgaacaggggctgcaggtgtcagggctgcctgactcagctgcacctgaaggaggagcagcgcatacaaacgaccagcggcggtgccaaagaatgaagcagcctctgaccgaggtacagatcctgagtcactcatcctag

SEQ ID NO: 52731 - DNA, 1902 bp, Artificial Sequence
  Description of Artificial Sequence: Synthetic coding sequence
atgctgcggcggggctacaaggccagcgagcggcggcggcacctgtcagagcgcttgtcttggcaccaggaccaagctttgagttctagtatatatctgctgagagagatggggcctactgggtttctactcagggaggaggaaccggagtacatggacttccgcgttttcttgggcaatcctcacgtatgcaattgttctacttttcccaaaggcggagaactctgtaagcatatctgttgggtgctgcttaagaagtttaaactgccacgcaatcacgaatcagccctgcagttgggcttgggcgagcgcgaaatctcagacttgctgcgcggcattcatcgcgtgcagacaccacagcctggaaccaatgacgaaaacgagcatgtcgaagaggacgggtatatcaagcagaaggagatcgactccgaggacatctgcagtatatgccaggaactgctgcttgagaagaagctgcctgtcacgttctgcagattcgggtgtggcaacagcatccacatcaaatgcatgaagatcctcgctaattaccagtcaaccagcaacacttctatgttaaaatgcccgctctgccgcaaagaatttgcacctttgaagttgatcctcgaggagttcaagaatagcagcaaactcgtggccgccgccgagaaggagcgcctggacaaacacctaggcataccgtgtaacaattgcaaacagtttcccattgagggtaaatgttataaatgcaccgagtgcatcgaataccatctctgtcaggagtgttttgatagctgttgccatctgtctcatacattcacgtttagagagaaaaggaatcaaaaatggaggagtctcgagaagagagccgatgaagtcgtgaaatatattgatacaaagaacgaaatcgaggaaaaaatgtcccactttcaagaaaagcaggggcaagtgtatactcccaagcacatcgtgaggagcctgccccttcaactgatcaccaaaaatagcaagctgctggccccaggatatcaatgcctgctctgcctcaaggcattccacctgggccagcacactagattgctaccctgcacacacaagttccaccgtaaatgtattgacaactggctgttccacaaatgtaattcctgccccattgatggtcaagtcatttataatccgttaacttggaagaactcggccgttaacggacaggcccatcagtccgtgtctaatcgcgatatcatacacctgagcaagcagaaagaacccgatctcttcattccaggcaccggactcgttctaaaacaaaatagacttggcatcctgccttctatccctcagtgtaatttcgatgagttaaatactccccaaagcccaaaagacgcttacgagaacaccaccattgacaacctgtgctccattaaattggataacagcaattcaaagaaattaacttacgattataaaatctcccaacactttcctagatatctgcaggacttgcctacagtctcctttggtaaaatcccatctcagactctcctgccacccattgtgcacaaaaatatcgtgtgtccaacagctatggaaagcccatgcatctcgggaaagttccatacgtctctgtcgcgtatgacaaaggggtgcaaatgcaacaatcataacctcaaaaaaactcctgctaccaagatccgcgaagataacaaacgctccaccctgcttccagaggactttaatctgattgtgaactggagtaccgcaaaactgagtctctcaaaaaggtactctaattgcatgggggaaattacaaggaaatgcagccatctgtctcgccagccagtgtctcacagcgtaaataccaagtcaacagagctgtccttgatcatcgagggtgtccagctgtag

SEQ ID NO: 52732 - DNA, 2091 bp, Artificial Sequence
  Description of Artificial Sequence: Synthetic coding sequence
atggagctgggcagctgcttcaagacctacgaggacttcaaggagtgcttttctgcttacaagcgcgagaacagatgctcatttatcttgcgcgactgtgtctcagttcgctttcataatctgaaccatggcacctccatacgcgaagacattctgtacgtgcaagtgaaatttgtctgtatcaggacgcagtctaatcggaagcgcacaagggaagcagacatgtgccctgcttatcttctcctgagatataacgaacggctcgatcgcctcttcatttccgaattgaacacccagcatatccacggggattctaaggtcgcaagtcccggcggagataccaccggcaagtcccagaagaccatgtgccttcagcgtctgcagcctgttcaaccaaccaccaagaaagatctcgacacagcagagaaatccttagtggagccatcattttgtttagataaggtgcaggtctctagcaaaccagagcaagagggcatcacaccttccgacttggctaagattgcaaaagtgatgaagaattttctcaaggttgatgagggatctatggcaagcttctcggtcggagacagccagcacctagacagactgagcttccagagttcaaaaatgaccgacttgttcatcaggtttccagagaacctgctgttacatcgtgtggagaatacccagggtcatatcctctacgcgttcctggttgagaataaagagagagagtctcgtgtggtccacttcgccgtgcttaaagctgagacagtgacctctgtggctaagatgctgagcattttcaccgagtttaattccgactggccaaaagtgaaggtggttttcgtcgacccatccttccattatcgcgccatcctgcaggagatttttccagccgccagaattcttctcagcatataccacacaactcgactcctagagaaaaaactgcaccgctcttccgccaacccgagctttaagagactcatgaaagaagccctcagagaagctgttttcgtgacctccgaggcctcgctgaagaacctctgtcaaatgagccaggcggttctggatgaagatcttttcaattttttgcaggcccactggttcacttgcgagttactgtggtacatgcacgtgaggaagggattacttgcctgcaacacctatatggatagcctggacattgtcacctctaaggtatccagtttgtttagagaacagcagagtctgctcgattgcatcctatgtttcgtcgactatattgatttcttcaacacgaaaggcctaaaaaacctgcccacacccccccctaaactgaagagggcaaggccagcctcaatgccactcaaaagtaagaaggctttcggaatctgcggcgagagcctgaccagtctcccagccgaggagactaagccagatgcccagcaggtgcaagttcagcagcagtcacaagtcccccctagtcaggttggtatgttggataccctgcaccagagcgggtcggagttggcctacaaactttgccataacgagtgggaagttgtccaaaactctacacaccttgtggacatggccggcagctctgtcgacgttcagctcttggaggattcacatcaggtgtcaaaagatggatgttcttgttcgtgctcctttcagcagtggtatcacctgccttgtcggcacatccttgctctgctccacacatcccagcagccggtcggagaagccatggtctgcagacggtggcaaaagaagtatcaatacctgctgggtcccaacggggagttgcaagaccgaggcatggtcccaaataccgggcaacctgagaaacaagggaggaacgacatgatccaggatctgtctagggagcttgccaacctcctgatgcagaccgaggggccagagctggaggagagatacagcactttgcgtaagatcgtggacatatgggcggggccatctcagccaagcgagctgtttcagcaaccgggggactttaaagacgtcgggaggctgcctttcctgtggggcaagcaggaggagggggaaggattccctcccgcaaccgccgttatgcactactag

SEQ ID NO: 52733 - DNA, 2073 bp, Artificial Sequence
  Description of Artificial Sequence: Synthetic coding sequence
atgaagacccggctggagcggcaggccgagaccaccagcggccacccgtcactcgcatctctctattactggacagcaccggctctgcccggtcctgagctagagatggcaccaccaccgcactgtgctcataatagatacgtgcaggtaaagtttgtgtgtattcggactcaaagcaataggaaaagaacaagggaggccgacatgtgtccagcatatttgcttcttagatataacgaacggctggaccgactcttcatatcggaattgaatacacagcatattcacggcgactctaaagtcgctagtccaggtggggatactactgggaaaagccaaaaaaccatgtgtctccaacgactacagcctgtgcaacccaccacgaaaaaggatctggatactgccgagaaatcactggtcgagcccagcttttgcctcgacaaagtccaggtgagttcgaagccagaacaggagggcatcactcccagcgatctagcaaaaatcgccaaagtgatgaagaattttctgaaagtggatgagggttctatggcctccttttcagttggagattcgcagcacctggatagactcagtttccagtcttccaaaatgaccgaccttttcattcgttttcctgaaaacctgctcctacacagagtcgaaaacacacagggccatatcctgtacgcgtttttggtggagaacaaggaaagagaatctcgggtggtccatttcgcagtactaaaagcagagacagtcacttccgtcgctaagatgctgagcatctttacggagtttaatagtgactggcctaaagtaaaagtggtcttcgtggatccttctttccattaccgggcaatactgcaggagatctttcccgcagcaagaattctcctgtcaatttaccacacgacccgactgctggagaaaaaattgcacaggtccagcgccaaccctagctttaagagacttatgaaggaggcattgagggaggcggtctttgttacgtcagaggccagtctcaaaaacctctgtcagatgtctcaggctgtgcttgatgaggatctttttaacttcctccaggcccactggtttacatgcgagctgctctggtacatgcatgtgagaaaaggtttactcgcttgcaacacatatatggactcactcgatatcgtcacaagcaaagtaagcagcttatttcgagagcagcaaagccttctggattgcattctgtgcttcgtggattacatagactttttcaatacaaaagggttgaaaaacctgcccaccccaccacctaaactgaagcgggcacgtcctgcttcaatgccccttaagagtaagaaggcgttcggcatatgcggcgagagtctgacctctctccccgctgaggaaaccaagcccgatgcccagcaggtacaggttcagcaacagtcccaggtgccaccctcccaggttgggatgctggacaccttgcaccaatctgggagcgaattagcctacaagttatgccataatgagtgggaggttgtgcagaacagcactcatcttgtcgatatggctggcagcagtgtcgacgttcagctgctggaagatagccaccaagtgagtaaggacggctgtagttgcagctgctcttttcagcagtggtatcatctgccttgcagacacatcctcgcccttctccacaccagccagcaacctgttggcgaagccatggtgtgccggagatggcagaaaaaataccagtatctactaggaccaaacggtgagctacaggacagaggcatggtgccgaatacaggccaaccggagaagcaaggacgaaacgacatgatacaggatctttctagagagcttgccaacctgctgatgcagaccgaaggccccgaactggaggagcgctacagcaccttacggaaaatcgttgacatatgggcaggtccgtctcaaccatctgagctcttccaacagcccggtgatttcaaagatgtggggcgcctccctttcttgtggggtaaacaggaagaaggcgaaggtttcccgccagccacggcagtcatgcactattag

SEQ ID NO: 52734 - DNA, 2970 bp, Artificial Sequence
  Description of Artificial Sequence: Synthetic coding sequence
atggagccccccgccgccaagcggagccggggctgccccgccggccctgaagaacgtgatgcaggtgccggagcggcacgggggaggggtcggcctgaagcactgcttgacctcagtgccaaacgggtggccgaaagctgggcctttgagcaggtggaggagcgcttctctcgcgtgcccgagcctgtacagaagagaatcgtgttttggtcatttcctaggagtgagagggaaatttgcatgtacagcagcctgggctatccgcccccagaaggggagcatgatgcgagggtgccatttacaagaggtctgcatctcttgcagtcaggcgctgtggaccgggtgttgcaggtcggcttccatctgagtggtaatattagagagccaggctctccaggtgagcccgagcgcctatatcacgtttccatctccttcgataggtgcaagatcacctccgttagctgcggatgcgacaaccgggacctcttttactgtgcccacgtggtcgcactgagtctgtacagaataaggcacgcccaccaggtggaactgcgactgccgatctccgaaacgttgtcccaaatgaacagggaccaactgcagaaattcgtacagtatttgatttctgctcatcataccgaggttcttccgacggcgcaacgcctggcagatgagattctgctgcttggttcagagatcaatctggtgaacggtgcacccgacccaaccgcgggcgcggggatagaggacgcaaattgttggcatctggatgaagagcagattcaggaacaggttaaacaattactgtccaacggtggctactacggcgctagccagcaactgcgaagcatgtttagcaaagttcgggagatgctaaggatgcgcgactcaaatggtgcccggatgctgattctaatgactgagcaattcctgcaggatactcggctcgctctctggagacaacagggagcgggcatgactgacaaatgtaggcagttgtgggacgaacttggcgctctgtgggtctgcgtggtcttatccccacactgcaagcctgaagaacgcgccggctggttgcagttactaagcaggtgggataagctagatgtctgccccttggaagagggaaattatagtttcgacgggccaagcttgcaaccaacaatggcacccgcccctgagctgctccaaaaagggtccacttgtataaccaacaccgagggctgggtgggacaccctctcgaccctattggatgcctttgcagggcacttttggaggcttgccggctagaggaagaaaccctgacgctgtatcccgatagcggccccgaaaaaaggaaagtggcataccagcacgtgcccgtgcccggctccccaggggagagttacttggtgctcgctctcgaagtggccctgctagggctcggtcaacaacgagcactgccagaagggctctacgcacaggataaggtggttcggaacgaggaacagctcctggctctgctggaagaggtcgagttggacgaacggcttgtgcaagtgcttagaaagcaggccggcctgctcctggagggggggcccttctcaggcttcggtgaggtactgtttagggagtccgtaccaatgcacacttgtgctcgttatctgttcacagctcttctgccccacgatcctgatcttgcatataggctggccctcagggccatgagattgccgatcttggagaccgccttcccagcgggggagccacacccaagcccacttgatagcattatgtctaacaggttcccgcgatggtttatcctgggacatctggagactagacagtgcgaattggccagcactatgctgactgccgccaagggtgaccccaaatggctccatactgtgctgggaagcatccagcaaaacatccatagccctgcccttctgtttaaacttgctcaggacgcctgtaagacagctacccccgtcagcgctccaccagataccaccttgcttgggatcgcactggaattgggtttgcaggttatgcgtatgaccctgaatgtaatgacatggcgtcgtagggagatggtaagatggcttgtcagttgtgctaccgagatcggccctcaggccctgatgaatattatgcagaactggtattccttgtttacgcccgtagaggctgccacaatcgtggccgtaactggtactactcacgcaactcttctccgtttgcagctagacacgtctcgccgggaagagctatgggcttgtgcccgaaccctggccctgcagtgtgccatgaaagacccacagaactgcgcactccctgctctcactctgtgcgagaagaatcacagcgcttttgaagccgcctatcagattgtgctagatgcagccgccggtggcttaggtcacgcccacctgttcactgtagctcgctacatggagcacagaggcttgcctttgcgagcctataagctggcgactttagctcttgcgcagctctctatcgccttcaatcaagactctcatccagcggtaaatgacgttctgtgggcatgcagtctgtcacactccctgggcagacacgagctgagtgccatcgtgcctctgatcatccggtccatccactgcgcaccgatgcttagcgatattctgcgacggtggaccctgtcagctcctggcttaggccccctgggggctagacgcgctgccaaacctttgggcgccgaccgtgcaccactctgtcagctgcttgatgccgcagtgactgcatacataactacctcccactcaagactgacccatatcagcccaagacactacggagatttcatcgagtttctaggaaaagcgagggagacatttttgctcgcaccagatggccacctgcagttctcacaatttctggaaaatctgaaacagacctataaagggaagaagaagctgatgctgttagttcgagagagatttggctag

SEQ ID NO: 52735 - DNA, 2472 bp, Artificial Sequence
  Description of Artificial Sequence: Synthetic coding sequence
atgttcagcaaggtgcgggagatgctgcggatgcgggacagcaacggggccagaatgctcatcctcatgacggaacagtttctgcaagataccaggctggcactgtggcgccaacagggcgccggaatgacagacaaatgcaggcagctttgggacgaattgggggccctgtgggtgtgcgtagtgctctctccccattgtaagcccgaagaaagagcgggatggctgcagcttctgtcaagatgggataagctggatgtgtgtcccttagaggagggaaactattcatttgatggcccatctctacagcccaccatggcgccagccccggggagcgaggaggaggaagaagttgccgcaaccagcccgaggcatacggtgtttggccgtgcactgttggcaggagagttgcactggaatgatgcctacctccagcgtatccttgcctcagatagctacgggccatcccttactggctcagtcgggggggataagccaacgtttgacccccagggcagacccctatggctgggcgagccatttcccaccgcctgcgcccgcgtagacaccctcagagcccatggataccccaggcaggccctgagattagcgtcagcaataatcaatactttaagacttcaacagcgccatcagctagaatcctacaaacaacagaagaaggagctgctgcagaagggatccacttgtatcactaacaccgaggggtgggtcggtcacccacttgatcccattggctgcctatgcagggctctgcttgaagcctgtcgtctggaggaggaaaccctgacactctatcccgattcggggccggagaaacgaaaagtggcttaccagcacgtgccagtgcctggcagtccaggcgaatcatacctggttctcgccttggaagtggctctgctgggcctcggtcagcagcgagcgctgcccgaaggcttgtacgcccaggacaaagtggtgaggaatgaggaacagctgctggccctcctcgaagaggtcgaactggatgagcgactcgtacaggtgctcaggaaacaagctggactcctgttagagggcgggccattcagcgggttcggcgaggttctgttcagggaatctgtgcctatgcatacgtgtgcgaggtacctatttactgccttgctgccccacgaccctgacctcgcctacaggctcgcgctacgagcaatgcggctgcctatcttggaaaccgcctttcctgctggtgagccccatccctctcccctcgattcgattatgagtaacagatttcctcgatggttcatccttggccacctcgaaactcgtcagtgcgagctggcaagcacaatgctgactgccgcgaaaggggatcctaaatggctccataccgtactgggcagcattcagcagaacattcactcgcctgctctgctctttaaattggctcaagacgcctgtaagactgctacaccagtgtcagccccacccgatacaactctccttggaatagcccttgaactcggtctgcaagtgatgagaatgacactgaatgtgatgacttggcgtcggcgcgaaatggtcagatggctggtttcgtgcgctaccgagatcggaccccaagctttgatgaatatcatgcagaattggtacagtttattcactcctgtggaggccgcaacaattgtcgctgtgactggtaccactcacgccactttactaagactgcaactagacacaagtcgacgcgaagagctgtgggcatgcgcccgcacccttgccttgcagtgtgctatgaaggatccccagaactgcgctctgcccgctttgacactctgtgagaaaaaccactcagcttttgaagcagcttaccagattgtgctggatgccgccgccggcggactgggtcacgcccacctgttcaccgtggcacggtatatggagcaccggggtctgcctcttagggcttacaagctcgcaaccctggccttggctcaactgtcaatcgcttttaaccaagactctcacccagccgtcaacgacgttctgtgggcgtgttctctcagccattccctgggacgccacgagctgtctgctattgttcctcttataatccggtccatccactgtgcccccatgctcagcgacatcctgcggcgctggactctttcagcacccggccttggcccattaggggcgcgccgagccgctaagccactgggcgcggacagagctccgctgtgccagctcctcgacgccgccgtgactgcctatatcacgacaagtcattcaagactcactcatatcagtccccgccattacggcgactttatcgaatttctcgggaaggctcgagagacctttttgctggctcccgacggccatctccagttcagccagttcctggaaaacctcaagcagacatacaagggcaaaaagaaactaatgctgcttgtcagagagaggtttgggtag

SEQ ID NO: 52736 - DNA, 3558 bp, Artificial Sequence
  Description of Artificial Sequence: Synthetic coding sequence
atggccgacggcggcgagcgggaggagctgctgagccccagccccgtatcccctgcaaagcggcaatgcagctggccctctccacaggcccatcatccccggggcagccctggagccgcaggaggaggtgcaggcggtgtgggctcatcctgcctcgtactgggtgcacgaccacacctgcagccagactcacttttagactgtgctgctaagaccgtggccgagaagtgggcgtacgaacgggtggaggaaagatttgaaaggatacccgaaccggttcaacgcagaatagtgtactggtctttcccccgtaacgagcgagaaatctgcatgtactctagcttccagtatcgcggcgggcctggagccggagcagccggcggcgccgccggagcttcccccgcagaagaaggcccccagcctccccctggcgctgctgccccggccggatccgctcctggaggagtcgcggctggggcgagccccggcctgggagctggagcaggcgctgcaggttgtggtggagagggcctgccctttaggcgcggaatcagactgctcgatagcgggtcagtggaaaacgtcctgcaagtaggcttccatctatcaggcaccgtcactgagcttgctactgcctcagagccggctgtgacttataaagtggcgataagcttcgaccgctgtaaaattacttccgtgacctgcggctgcggaaacaaagacatcttttattgcgcccacgttgtggccctatcactgtaccggatccggaagcccgatcaagtcaaactgcgtcttccaataagtgaaaccctattccaaatgaatagggaccagctgcagaaattcatccagtatctcataacagctcaccacacagaggtactccctaccgcacaaaagttggctgacgaaatcctgagttcaaatagcgaaattaaccaagtgaatggcgcacctgatcctacagccggtgcctcaattgatgacgagaactgttggcatctggacgaagagcaggtgaaagagcaggtgaagctgttcctctcccagggagggtactgcgggtccggtaaacagctcaactctatgttcgctaaggttcgagaaatgctccgaatgagggactccaacggagcccggatgctgaccttgattaccgagcagtttgtcgctgaccctagactcaccctatggaggcagcagggcactaatatgaccgacaagtgcaggcaactgtgggacgagttaggcgccttatgggtttgtatcatcttgaaccctcactgcaaactagaggaaaagtcgtgttggctccaacagctccagaagtggagcgacctggatgtgtgtccactggaagatgggaactacggacacgagctccccaatattactaacgcgttgccacagtctgctatccacagtccagattccttgagccgtccaagaagaaccgtgttcactagggccattgaaggcagagagttgcattggcaggactcccaccttcagaggattatctcgtccgatgtttacaccgccccagcttgtcagcgcgagtcagaacgactgctgttcaattcgcaggggcagcccctttggctggagcatgtccccactgcctgcgctcgggtcgacgctctgcggtcccacggctatcccaaagaggctttaagactcaccgtggcaatcataaacacactacgcctgcagcagcagcgccagcttgagatttacaaacaccagaagaaggagcttctgcagcgggggacaacaaccataacgaatctcgaggggtgggtggggcatccacttgatccaatcgattgcctgtttctgactctaaccgaggcttgtagattgaatgatgacgggtatcttgagatgtccgatatgaatgagtctcgccctcccgtgtaccaacacgtccctgtcgccgctgggagccccaactccagcgaatcgtacctgagtttagccctggaagtggcattgatgggactgggccagcagcggctcatgccagagggtttgtacgctcaggataaggtgtgtaggaatgaggagcagttgctctctcagctgcaggaactgcagctagatgacgagttggtccagactcttcagaaacagtgcatcttactgctcgaaggggggccattctccggactcggcgaggtcattcaccgcgagtctgtgcctatgcatacgttcgcaaagtatctgtttagtgctctgcttcctcatgaccccgacctgtcatataagctggcccttagagcaatgcgacttcctgtgttggaaaattccgcctcagccggagatacaagccacccacatcacatggtgagcgtcgtgcccagccggtatcccaggtggttcacacttggccatttggaatcccagcagtgcgagcttgcatccaccatgctgacggccgctaagggtgatactttacggctgcggacaatactagaggcaattcagaagcacatccacagttcctcactgatttttaaactggcacaggacgccttcaaaatagccaccccaactgacagcagtacagactcaacactgctgaacgtggccttggaactcgggctccaagtgatgcgcatgacattatcaacactgaattggaggcgaagagagatggtaagatggctggtaacctgtgccaccgaagtaggggtccgcgcgctggtgtcgatcctgcagtcttggtatacgctgtttacgcctactgaggccacgtctatcgttgccgccaccgccgtgtcacacaccactatcttgcgcctctcgctggactatcctcaacgagaagaactggcttcatgtgctaggacgttggctctgcagtgtgcaatgaaagacccacaaagctgcgcactctccgcgttaaccctttgcgagaaagaccacattgcgttcgaggctgcttatcagatcgccattgatgccgccgcgggcggaatgacccattctcaactcttcacgattgcaaggtatatggagctgcgtggatacccgctcagagcatttaaactagccagtctggccatgtctcacctgaacctggcatataaccaagacacacacccggccattaacgacgtcctgtgggcatgtgcgctgagtcattccctcggcaagaacgaactcgccgcactcattcctctcgtcgtgaaatccgtgcactgcgccacagtgctgtctgatattctgcgccggtgtaccgttacagcccctggtctggcagggataccaggccgcagatcgagtgggaaactgatgagtaccgacaaagctcccctgaggcagctgttggatgccacgattaatgcatatattaacactacgcattctcgcttgactcacatttctcctcgacattatggagaattcatcgagtttctgagtaaggcaagggagaccttcctactgccacaagacggccacttgcagtttgcccagtttattgataatctgaagcaaatttataaggggaaaaagaagctcatgctcctggttcgggagagatttgggtag

SEQ ID NO: 52737 - DNA, 3648 bp, Artificial Sequence
  Description of Artificial Sequence: Synthetic coding sequence
atggccgagcggggccagcagcccccccccgccaagcggctgtgctgtagacccggcggcggcggaggcggcggcggcagtagcggtggtggcggcggggcagggggaggatactctagtgcgtgcaggcctggccccagggctgggggcgccgccgcagccgccgcctgtggcggcggcgcagccctgggcttgctcccccctggtaagacgcaatccccggagagtctgctcgacatagcagctagaagggtcgcagagaagtggccgtttcagagggttgaagaacgctttgagagaataccagagcccgtacagcgaaggatcgtgtactggtcttttccaaggtccgaaagggaaatttgtatgtacagtagcttcaatacagggggaggtgctgccggcggccccggtgacgactcaggtggcggaggaggagctggcggcgggggtgggggcggttcatcctcctcacccgccgcaaccagtgccgcggctacgtccgctgccgccgcggccgcagcggcagctgcagcagcagcggccgctgccggtgctggggcaccatccgtgggtgcggccggtgccgccgacggtggcgacgagactaggctgccatttcgcagaggtattgcgctcctggagtctgggtgtgtggataacgtactccaggtaggctttcacttgtccggaacagtaaccgaaccagcaatccagtcagagccagaaacagtgtgtaatgttgcgattagctttgaccggtgcaagatcacatcagttacctgttcctgcgggaataaggatatcttctattgtgcccacgtcgtcgccctgagtctgtacaggatccgaaagcctgaccaagtgaaactgcatctgcccatatccgaaactttgtttcagatgaaccgtgatcagttgcagaagttcgttcaatatttgattaccgttcaccacacagaggttttaccaactgcccagaaacttgctgacgagatcctctcccagaactccgagatcaatcaagtgcatggagctcccgaccctaccgccggcgctagtatcgacgatgaaaactgctggcacttggatgaggagcaggttcaggaacaagttaagctcttcctgagccaaggtggataccatggcagcgggaagcagctcaatctgttgtttgccaaggtgagggagatgcttaaaatgagggacagcaatggtgcacggatgctaacgctgattaccgaacagtttatggccgatccccgcctttctctctggcggcagcagggtaccgctatgacagataagtacaggcaactgtgggacgagctgggggcattatggatgtgcatagttttgaacccgcattgcaaattggaacagaaagcaagctggctgaaacagctcaagaaatggaatagcgttgacgtgtgtccgtgggaggatggaaatcacggttctgagctgcccaatctcacaaatgctttaccccaaggagccaacgcaaaccaggatagcagtaatcgacctcacaggacggtcttcacaagagctatcgaggcctgtgatcttcactggcaggactcacatcttcagcacattatttcgtcggacctttacaccaactattgttaccatgatgacacagaaaattcccttttcgattctaggggatggccactatggcatgagcacgtgccaacagcctgcgcgcgggtcgatgcactgagatcgcacggatacccacgtgaggcactgagacttgcgattgccatagtcaacacccttcgtcggcagcagcagaagcaactggagatgtttcggactcagaaaaaggagctgccacacaagaacattacatctatcaccaatctggaggggtgggtaggccaccccttggaccccgtggggaccctgttctcctcactaatggaagcatgtcgcatcgacgatgaaaacttatcaggcttctctgattttacggagaacatggggcagtgtaagtccctcgaataccagcatctccccgcacataagtttttagaggagggcgagagctatctgacacttgccgtggaagtcgccctgatcggcctcggccagcaaaggattatgcctgatggcctgtatacgcaggagaaagtgtgccgtaacgaggagcagttaatcagtaagttgcaggagatagaactggatgacaccctggtcaagatttttcgaaagcaggccgtgttccttctggaagccggcccctactctgggctgggcgagattatccacagagaatcggtccctatgcacactttcgctaagtatctctttacctctctgctaccccacgacgccgagcttgcatacaagatcgccctccgcgccatgcgtctgttagtattagagtctactgcacccagcggcgacctcactagaccacaccatatcgcttccgtcgtgccaaacaggtacccccgatggtttaccctgtcgcacattgagtcgcagcagtgtgagcttgcaagcaccatgcttacagcggctaaaggcgatgtccgacgcctcgaaaccgtgcttgagagtattcagaagaatatccattcatcttcacatatctttaagctggctcaggacgctttcaagatcgccacgctgatggactccctacccgacataactcttctgaaggtgtccttggagcttggactgcaagtcatgcggatgacgttgtccactctgaactggaggagacgcgaaatggtgcgttggcttgtgacctgcgccactgaagtcggagtctacgccctcgactcgatcatgcaaacctggtttacactgttcaccccgaccgaagccacgtctatagttgctacaacagttatgtctaactctacaatcgtccgcctgcatcttgattgtcaccagcaggaaaagctcgctagtagtgcccgcaccctcgccctgcagtgcgcaatgaaggacccacaaaactgtgcactgtctgcccttaccctgtgtgagaaagaccacatcgctttcgaaaccgcttaccagatcgtgctggatgctgcaaccactggcatgtcgtatacgcaactgtttactatcgctcgatacatggagcacagggggtaccccatgcgtgcctacaaacttgctacacttgctatgacacacctgaacctgtcttataatcaagacacccatcctgctattaacgatgtgttgtgggcgtgtgcacttagtcacagcttaggaaaaaatgagctggcggcaataattccactcgttgtcaaatccgttaaatgtgccaccgtgctgtctgacattctgaggagatgtacactgacaaccccaggcatggtagggctacatggtagaaggaactccggaaaactgatgtccctcgataaagctcctcttcggcagctcctggatgccaccatcggcgcttacataaacacaacccatagccgactgacgcacatttctcctagacattatagcgagtttatagaattcctgagtaaggcccgggagaccttccttatggctcacgatggacacattcaattcacacagttcatcgacaacctgaagcaaatctataagggcaagaagaagttgatgatgcttgtcagggagagatttgggtag

SEQ ID NO: 52738 - DNA, 8886 bp, Artificial Sequence
  Description of Artificial Sequence: Synthetic coding sequence
atgggcaacgcccccagccacagcagcgaggacgaggccgccgccgcaggaggagaaggctggggcccccaccaggattgggcagctgtttctggcacaactcctggacccggtgtagcagcacccgcactgcctccggctgccgccctgttggagccagccaggctgcgcgaagctgccgcagccctgctcccaactcccccttgcgagagtcttgttagcagacatagaggggccctcttccgctggctcgaggagcggcttgggaggggcgaggagtctgtgactcttgagcaattcagggaactgttagaagcacggggagctggctgctcttcagagcagttcgaggaggcttttgctcagttcgacgccgagggtgatggaacagtggatgctgagaatatgctcgaggctctcaagaattcctcaggagcgaatctgcagggcgaactgagccatatcattcgtcagctgcaggcatgttccctggttccagggtttaccgacatattctccgagtcaaaggaaggtctggatattcactcttctatgatactgaggttcctgcacaggaaccggcttagtagcgcggtgatgccgtaccccatgttggaacactgtaacaatatgtgcactatgagaagttcagtccttaaggagtccctcgatcagttagtgcaaaaagagaaggaatcacctggcgatctgacgaggagccctgaaatggacaagcttaaaagtgtcgccaaatgttacgcatatatcgaaacgtctagtaactccgccgacatcgacaaaatgactaacggggaaacgagttcgtattggcagtccgatggcagcgcctgcagtcattggattcgtctgaagatgaagcccgatgtggtgcttcgccacctctccatagctgtagctgcaacagaccagagttacatgccccagcaggtgacagtggctgtggggagaaatgcctcagacctacaggaagtgcgcgacgttcacattccttctaacgtgacaggctacgtgaccctgctggaaaacgcaaatgtcagtcagttgtatgttcagattaatatcaagcggtgcctgagtgacgggtgtgacaccagaattcacggactacgggccgtggggttccagcgcgtcaagaagagcggggtgagcgtctctgacgcttcagccatatggtattggagtttgcttacaagccttgtgacagcatccatggaaactaaccctgcctttgtgcagacggtgctgcacaatactcagaaggcgttgcgtcatatgccccctcttagcctgtcgcctggttctacagacttttctaccttcttaagcccaaacgttttagaagaggtggactcattccttattaggataacatcctgctgcagcacccctgaggtggaacttacactgctggcctttgcattggcgcgcggctcggtcgcaaaagtgatgtcttctctttgcacgattactgaccatcttgatacccagtacgatgccagttcacttattctgagcatggcttctgtaaggcagaatctgctgttgaagtatggcaaacccttacagctgactctccaagcctgcgacgtgaaaggtaaggaagacaagagtggccctgagaatctgctagtcgagccttggacacgggacggctttttgactgagacgggtaagacccgagcttcaacaattttttctacagggactgagagcgcctttcaggttactcagatacggatcatggtaagacgagggggcatcggagcccagtgcggactcgtgttcgcgtacaactcatcatcggataaattctgcgctgaagaacacttcaaaaggttcgagaaatatgataaatggaaactccaggagcttagacaattcgttaagagtcgcataggttgttcttctgacgacctgggagaggatgaccccataggatggttcgaactcgaggaagagtgggacgaagcagatgtgaagctgcaacagtgtagagtagccaagtatttgatggtgaaattcttatgcacacggcaagaatccgctgaacggctgggagtgcaaggcctgaccatatcgggatatctgcggccagccagggctgaggccgaacagtcagttacttgcgcacattgccgcaaagacaccgaagaatctgtgtgtggtgcgacccttctcctgaggacgctgcagttcatacagcaacttgctcacgatttagtccagcagaaggagagtggtctcaaatacaagtcttttctggactttgccgggttggacctgcaaatcttttggaatttctattcaaagttaaaacaaaaccccagggaggaatgtgtttccgcccaaacactgctgctgcagcttttacagagttgtttttccgtgctccagggcgatgttcttgctgcaagtgaggaagagaaagccccaatccaatcaccgaaaggcgtggaagcagctaaggaactctacactcacttgtgcgatgtggtggacaaggtggacggcgacagtgtacccatggagattctgaagcaagaggtcagaaataccttgctcaatggggcagctatcttcttccctaacaggcagactcggcggaaccacctcttcactatgatgaacgtgaccgagcaggaacacaagcaatcgcttcagcttacctttcgctccctctgcacgtacttctcagacaaggatcctggcggcttactattgcttcccgagaaaaatgacctggccaaaatgaatatcagcgaggtgttagcagtgatggatacactggtctcagttgcagctagggaatgcgagttgctgatgctgtccggcgctcctggtgaggtgggtagtgtgttgttctctctcttttggtccgtgcaggggtcccttctctcttggtgttatctccagctcaaaagtacagactctggagcaaaagatctagcggtcgacctgatcgaaaagtatgtcggccagttcctggcttctatgagagccattcttgagtctcttttcagccagtatagtggaaagaccattgttgagagattatgcaatagcgtgttctccatggcagcccggcagctggtgatctttctgctggatttttgcactttggacatccctcactgcgtactcctcagagagttctcagtgctgaccgagcttttgaaaaagctctgtagtgggccagaggggggccttcgcaaactcgacgtagagacatggcagcaagaacaaccagtcgtcctgcacacttggaccaaagaatctgcccacaactatgaaaataactgtcacgaggtgtcagtgttcgtgagtccaggggccacgtacttcgaagtcgagttcgatgaccgatgtgagacggagaaaagatacgattatttggaatttactgacgctcgcgggagaaaaacacgctatgatactaaggttgggacagacaagtggccgaagaaggtgacgtttaaggctggtcctcgattacagttcctatttcacagcgattcttcccacaatgagtggggttacaaatttacggttaccgcctgcggactgccagacgttgccgtctcctgggggttggatcttcagttgctggtcagccggttgatgggtcgtctggccagccaatgcatggcgctgaaaagtgtgcgccagcttggctccaacatggtggtgccacaagccaagatggcccttgttctgagcagtcccctctggaagccggtcttccgacatcaagtctgcccagaattggaactggaggccagctggccaactcatccacaccgcaacagcaaggaggtgaaaaatatccccgacgatccatgtaggcattttcttctcgactttgcccagtcagagcccgcacagaacttttgcggtccctactcagaattgttcaaaggattcatccaggcctgccggaaacaagccccaaagacagacatagtcgcagggagcacaattgaccaagcagttaacgctacttttgccgccctggtttataggacacctgatctctatgagaagttacagaagtacgtgaattcggggggcaagattgccttgtctgaggagttcgcacaggtctacagtttagctgacggaatccgcatttggatgttagaaatgaagcagaagtccttgatgtcattgggaaacgaggctgaagagaagcattcttctgaagcgacggaagtgaaccctgagagtcttgcaaaggagtgcatcgaaaagagtctgcttcttctcaaatttctgccaaccgggatttccagcaaggaaagttgcgaaaagcttgaaacagccgatgagacaagtcaccttcaaccactcaacaagagacagcgcacttcaagcgtggttgaagagcactttcaggcaagtgtgtctccaacagaagcagccccgccagctactggggaccaaagccctggattaggcacccagcctaaactgccatccagctcgggcctgcccgcagccgatgttagtccggcaaccgctgaggagccactctctccgagcacacctactaggaggcctcccttcacaaggggtcggttgagacttctgagtttcagatcaatggaagaggctaggctggttccaacggtcaaagagaagtatcctgtgctgaaggacgtgatggacttcatcaaggaccagtccctttcgcataggagtgttgtgaaggtcctgtctcttcggaaggctcaagcacaatctattctggaggtgctgaagattacgcagcactgtgctgagtctctgggtcagccgcactgttttcaccctccctttatcctattcctcttagagctgctcacgtgtcagaaggacttcaccaactatttcggacatctggaagggtgtggcgctgacttgcataaagagattcgtgacacttattaccagctggtgcttttcttagtgaaggcggttaagggtttctctagcctcaatgatagaagccttcttccggcgctctcctgtgtgcagactgcactgctccacttgttagatatgggctgggagcccaacgaccttgcgttctttgttgatatacagctgcctgatctgcttatgaagatgagtcaagaaaacatctcagtgcacgattccgtgatttctcagtggagcgaggaggatgaacttgccgacgccaagcagaactctgaatggatggatgagtgccaagacgggatgtttgaagcgtggtatgaaaaaatcgcccaagaagaccctgagaaacagagaaagatgcatatgtttatcgcaaggtactgtgaccttctcaacgtggacatctcttgcgacggttgtgacgagattgccccttggcaccgatacagatgtctgcagtgttctgatatggacctctgtaaaacctgttttcttggaggagtcaaaccggagggccatggtgacgaccacgagatggtgaatatggagttcacctgcgaccattgccaggggctcatcatcgggcgacgaatgaattgcaatgtgtgcgacgacttcgatttgtgctacgggtgctatgccgcgaagaaatatagctatgggcatcttcctacacattcgataactgcacatccaatggtgaccatccgcatttctgaccgccagcgactgattcagccatacatacataattattcgtggcttctatttgctgcactggcgctttactctgcacatctcgcatctgccgaggacgttgatggcgagaagctcgacccgcagactaggtccagcgccacaacactgcgaagccagtgcatgcagctggtgggtgactgcttgatgaaagctcaccagggcaagggcctcaaggccctagccctcctaggcgtcctgccagacggcgactcttctctcgaagatcaagcacttcccgttacagtgcccactggcgcctccgaagagcaactagaaaaaaaggccgtacagggagctgagctatctgaggctggaaacggtaagagggccgtgcatgaagaaattaggcccgtggactttaaacagcggaacaaagccgataaaggtgtgagtttgtctaaagacccaagctgccagactcagatctcagactcccccgctgatgcctctcctcccactgggctgcctgatgctgaagattcagaagtgagcagccagaagccgatcgaggaaaaggctgtgactccctcccccgaacaggtctttgctgagtgtagtcaaaagcggatcctgggattacttgctgcaatgctaccgccactcaagtccggcccgacagtgcccctgatcgatttagagcacgtgcttccactcatgttccaggttgtgatttctaatgccggccatttgaatgaaacttaccacctaacactcgggctgctaggacagcttatcatccggcttttgccggccgaggtggacgctgcggtgataaaagttctctctgctaagcataatctcttcgctgcaggggattcctccatcgtgccagacggctggaagaccacccacttgcttttctctcttggagccgtgtgtcttgatagccgggtggggttggattgggcttgctctatggccgagatcttgcgttcccttaattcagcgcctctgtggcgggatgttatcgctacattcaccgaccactgtatcaaacagctgcccttccagctgaaacataccaacatattcaccttgctggttttggtggggtttccccaagtgctctgtgtgggcacaagatgtgtgtacatggataacgcgaacgaacctcacaacgttattattctgaagcatttcaccgagaagaatcgcgccgtcatagtggacgtgaagacgcgcaagaggaaaaccgtgaaagattaccagcttgtgcaaaaaggcggcggccaggaatgcggagattccagagcacagttaagccagtattcacagcacttcgcattcattgcctcacaccttctgcaatcttctatggacagccactgccccgaagccgtggaggccacctgggttctatcgcttgcactaaagggcctctataagactttaaaggcacatggattcgaggagattcgcgccacattcctgcagacggatcttcttaagctgctagttaaaaaatgctctaagggtactggtttctctaagacttggctgttgcgcgatttggagattctgtctatcatgctgtatagttctaagaaagagattaatgctctcgccgaacatggagatctggagctggacgagcggggtgaccgggaggaggaggtcgaaagacctgtgtcctccccgggggaccctgaacagaaaaaactagacccgctggaaggcctagatgaaccaacacggatatgtttcctcatggcacacgacgctttgaacgccccactgcacatactgagagcaatatacgaactgcaaatgaaaaagacagattatttcttcttagaggtgcaaaaaagattcgacggggatgaacttactactgacgagcgcattcgaagcctcgctcagaggtggcagccgagcaagagcctgcgactggaggaacagtccgccaaagcagttgacacagatatgatcatcctcccctgtctatctaggcccgcgaggtgcgaccaggcaaccgccgagagcaaccccgtgactcaaaagttgataagttccaccgaaagtgaactgcaacagtcttatgcaaaacagaggcggtccaagtccgccgcactgctccacaaagaactcaattgcaaaagcaagcgggccgtgcgagattacctgttcagggtcaacgaagctaccgctgtgctgtatgcacgccatgttctcgccagtctcctggccgagtggccaagtcatgttcctgtgtctgaggatattctggagctgtcagggccggcccacatgacctacatactggacatgttcatgcagttggaagaaaagcacgaatgggagaagattctgcagaaagtactccaaggatgcagggaggacatgctcggaacaatggcattggcagcatgtcagttcatggaagagcccggcatggaagtgcaggtccgtgagtccaagcacccatacaataacaataccaacttcgaagacaaggtgcacatccctggcgcgatatacctgtcaattaagttcgactcccagtgcaatacagaagaggggtgtgacgaactcgccatgtcctcctcctctgacttccaacaggacaggcactcatttagcggctcccaacagaaatggaaggattttgagctgcctggcgatacgctgtactacagattcaccagcgacatgagcaacaccgaatggggctataggtttacggttactgcagggcatttgggacgttttcaaacaggctttgagatacttaaacagatgctgtccgaggaacgcgtggtgccccatctgcccttggctaaaatttgggagtggctggttggggtcgcatgtaggcagaccggtcaccagcgcctcaaagccatccacctcctgttaaggatagtacggtgctgcggacacagcgacctttgcgatctagctcttttaaaacctctttggcagctcttcacccacatggagtatgggcttttcgaggatgtgacccagcccgggatccttctccccctgcaccgggcactgaccgagctgttttttgtcactgaaaaccgggcccaggaattgggggtgctgcaggactacctgctggctctgaccacggatgatcaccttctcaggtgtgccgcacaggccctgcaaaacattgcagcaatctcccttgccattaactatcctaacaaggccaccaggctttggaacgtggaatgttag

SEQ ID NO: 52739 - DNA, 588 bp, Artificial Sequence
  Description of Artificial Sequence: Synthetic coding sequence
atgggcgtgtggggcaagaagcacctgcggctgacccacgccccctccccaacttttagtcacctcccacctagcccccaggcaggcgagcccggcatcgacggcatttctctggccgtggtgtgtgccgcctttattcggatacaccctgcaagaagacaccctgctcgcaacggatcccggctggcctgcacacctaccccccgcccgaacgccggcttggaggtagtgtctagcgctcgtgtcgctgcttcactgcccagcgaagggggatggacctccggggctcctcgatcctctggactgagcctccccggcagtgcatggcagcctcccccattgccagtgctgcgcaagcccgcctggccgggatctccagcagttaagaatgagtccaaatttcccaacagggggtccaggaacttcccaagacgccggctgccccccgcaccagtgtcaggcgagccgccagaacgctgtaagctcgcgagagagattaggtggaggctctggaaggcgcatgaaggatgggggggaggggcaaagcgcccactgggcgatccagcttggagtggcgtcaaacggtag

SEQ ID NO: 52740 - DNA, 7872 bp, Artificial Sequence
  Description of Artificial Sequence: Synthetic coding sequence
atggtgccccccgtgtggaccctgctgctgctggtgggcgccgccctgtttcggaaagagaaaccccctgatcaaaaactggtggttcgctcgtctcgggacaactatgtactgacacagtgcgacttcgaagacgatgccaaaccactgtgcgattggtcccaggttagtgccgacgacgaagattgggtgagagcctccggaccaagtccaacaggatccaccggcgctcctggagggtatcccaacggagaagggtcctacctgcacatggaaagcaattctttccaccgggggggcgtcgcccgactgctctcccctgacctgtgggagcagggcccattatgcgtgcatttcgcccaccacatgttcggattatcatggggtgctcaactgcggcttttacttctaagtggggaagagggtcgcagacccgatgtcctgtggaaacattggaacacacagaggccaagctggatgttaacgaccgttacggtcccggccggatttacgctgcctacgcgactaatgttcgaaggaacgagaggttcaacggcatatctggacattgcgttagatgctctctccatccggcgtggcagctgtaaccgcgtttgtatgatgcaaacctgcagttttgacattcctaatgatctgtgtgattggacttggataccgaccgcctcaggtgccaaatggactcagaagaagggctctagcggtaagcctggagtggggcctgacggtgacttcagctcccccgggagtggttgctacatgctgctagatcctaagaatgcacgtccaggccagaaagcggtgctgctttcacctgtaagtctgtcgtcaggatgcctgtcttttagctttcattatatactccgcggccagtctcctggcgctgctctccatatttatgcttcggtgttgggctccatccgcaagcacaccctcttttccgggcaacccgggcctaattggcaggccgtgtctgtgaactataccgccgttggaagaattcagtttgccgttgtgggggtcttcgggaagacacctgagccggccgtggccgtggacgcgacctccattgccccatgcggcgaaggcttcccccagtgtgatttcgaagataacgcccaccctttctgcgattgggtgcagacctccggagatggaggccattgggccttaggccataagaatggacccgtccacggcatgggccctgcgggaggctttcccaacgcgggcggccattacatctatctcgaggctgacgagttttcacaggccggccagagcgtgcgtttggtctcccgccctttctgtgctccaggtgatatttgtgtcgagttcgcataccacatgtacggcctaggcgagggcacaatgctggaactgctcctgggttctcctgccggcagcccgccaattccactgtggaaacgcgttggttcgcagagaccctattggcagaacacctccgtgacagttccaagcgggcaccagcagcctatgcaactgatcttcaagggaattcaaggctccaatacggcctcagtggttgctatggggttcatactgatcaacccaggaacctgccctgttaaggtcctcccagaactgccaccggtctcccctgtttcctccacgggacccagtgaaacaacgggtctcaccgagaatcccaccattagcaccaaaaaacctaccgtgtctatcgagaagccctccgtgactacggagaaacctactgtgcccaaggaaaagccgacaattcctactgagaagcctaccatttccaccgagaagccgacaatcccctctgagaagccaaatatgccaagcgagaagccaactatcccctctgaaaaaccaaccatcctcaccgagaaacccactataccctcagaaaaacccaccataccgtccgaaaagcctacgatcagtactgaaaagcctaccgtgcctaccgaagaacccacaaccccgactgaggaaaccaccacatccatggaggaacccgtgattcctactgaaaagcctagcatccctaccgagaaacctagtatccctactgagaaacctaccataagtatggaagagactattattagcaccgaaaaaccaacaatttcacccgagaaacccacaataccaactgaaaaacctacgattcccacagagaagagtacaatcagccccgaaaagcctactacaccgaccgagaagccaaccatccctacagagaaaccaaccatcagtccagagaaacctacaactcctaccgagaaacctacgatctctcctgagaagctgaccatcccgaccgaaaagcctacaatccccacagaaaaacccacaatccccactgagaagcccaccatctcaaccgaggaacctacgactccaaccgaggaaactacaataagcaccgaaaagccttctatcccaatggagaagcccactttgccaactgaggagacaacaacaagcgtggaggagacaactatcagcacagagaagctcactatcccgatggagaaaccgaccatcagtacagagaaaccgacgatccccacagaaaagcccacaatctctcctgagaagcttacgatccctaccgagaagttaacaatccctacagaaaagcctaccatccccatagaggaaacgacaattagcaccgaaaagcttactattccaaccgaaaagcccactatttccccagaaaagcctaccattagcaccgagaaacccactatccctacggagaagccaactatcccaactgaggaaaccacaatctctacagaaaagctgacgattcctacagaaaaaccaactatatcaccggagaaactgacaatccccactgaaaagccgaccatctcaacagaaaagcctacgattcccactgagaaactcaccattcctacggagaagccgacgatccccacagaaaagccgaccattcctaccgagaagctaacagccctgcgccctccacatccaagccccaccgccacaggcctggctgcattagtaatgtcgcctcacgcaccctccacccccatgacctcagtgattcttggaaccactacgacttcgcggtcctccaccgaaaggtgtcctcccaacgccagatacgaaagttgtgcctgtcccgccagctgtaagtccccaagaccttcttgcgggccattgtgcagagaagggtgcgtgtgtaaccctggattccttttctccgacaaccactgcatacaggcctcatcatgtaactgcttttacaataatgattattacgagccaggagccgagtggttcagccctaattgtactgagcactgccggtgttggcccgggtccagagtggagtgccaaatcagtcagtgcgggactcacaccgtgtgtcaattgaagaacggccaatacggatgtcatccgtacgccggaacagctacgtgcctcgtgtatggggaccctcattatgtgactttcgacggtcggcacttcgggtttatgggcaagtgtacttacatcttagcacagccctgcggcaattcgaccgacccctttttccgggttaccgccaagaacgaagagcaggggcaggaaggcgtgagctgcctgagcaaagtttacgtgaccttgcccgaaagcaccgtgacactgttgaagggacgccgtaccttggttggggggcagcaggtaaccctgcccgccatcccttcaaaaggcgtgttcttaggcgcgtccggacgttttgttgaactccaaacggaatttggcttgagggtgcggtgggatggcgatcagcagttgtacgtcaccgtttcctcaacatatagcgggaaactctgcggcctgtgtggcaattatgacggtaattcagataacgaccaccttaagctggatgggagtcctgccggtgataaagaggagttgggaaatagttggcaaacagatcaggatgaagaccaggagtgccagaagtaccaggtcgtcaatagccctagttgtgattcctccttacagagctcaatgtctggcccagggttctgtggccggttggttgacacccacggccctttcgaaacttgtctgcttcacgttaaagcggcatccttttttgacagctgtatgcttgacatgtgcggctttcagggtctgcagcacttgctctgcacgcacatgagcaccatgaccacgacttgccaggacgctgggcatgctgtgaagccttggcgtgagccccatttttgtcccatggcatgcccaccaaattccaaatacagtctatgcgccaaaccatgtcctgatacctgtcactccggcttctccggaatgttttgctctgaccgctgcgtagaggcctgcgagtgcaatcccgggttcgtactttctggcctagagtgcattccacgctcacagtgcggatgccttcatcccgccggatcatacttcaaagtgggcgagagatggtataagccgggctgtaaggagctttgcgtgtgtgagtctaacaatcgaatccggtgtcagccctggcgctgtcgggcacaggagttctgcggacagcaagatggcatctacggatgtcacgcccagggggccgctacatgtactgccagcggcgacccacattacctgacctttgatggcgcactccaccacttcatgggaacctgtacctatgtgttgacacggccatgttggtcccgaagccaagattcgtatttcgtggtgtcagcaaccaatgagaacagagggggaattttggaagtgagctacatcaaggccgtccacgttacagtgttcgatctttccatatccctgcttcggggttgcaaggtaatgctgaatggacatagagttgcactaccggtatggcttgcacagggccgggttacaattagactgagctccaatctggtgctgctttacaccaatttcggcctccaagttaggtatgatggcagtcacctcgttgaggttacagtgccgagcagctatggggggcagctgtgtgggctctgtggcaattataacaacaattctctggacgacaatctgcggcctgaccggaaactagctggcgattcaatgcagctgggggctgcttggaaactccccgagtctagcgaaccggggtgtttcttggtagggggaaaaccttcctcttgccaggaaaactctatggccgacgcatggaataaaaattgtgccatcctgatcaaccctcagggtccattttcacagtgccatcaggtagtgcctccacagagttccttcgcaagctgcgttcacggccagtgtggaaccaagggagatacgacggccctgtgccggagtctgcaagcatacgcatccctgtgcgcccaggccgggcaggcccccgcgtggcgaaatcgcaccttctgtcctatgagatgtccacctggcagtagttacagcccgtgttctagcccgtgccctgatacttgctcttccatcaataaccctagggattgtcctaaggccctaccgtgcgccgaatcatgcgaatgtcagaaggggcatattctgtcaggcactagctgtgtgcccctgggtcagtgcggctgcaccgatcctgcagggtcttaccacccagtgggcgaacggtggtacaccgagaatacttgtaccagactgtgcacttgctccgttcataacaacatcacatgtttccagtcaacgtgcaagcccaatcagatttgttgggccctggacggactgctgcgccgggcaagcggtgtgggagtttgccagctgcctggcgaaagccattatgtctcttttgacggatcaaaccatagtattcctgatgcatgtaccttggtgttggtaaaagtctgccacccagccatggcccttcccttctttaagataagcgccaagcatgaaaaagaagaaggcggcactgaagctttccggctgcacgaggtgtatatcgatatttacgacgctcaggtgactctgcagaaaggccatcgggtgttaattaactctaagcaagtcacactccccgctatctcccagatcccaggggtctccgtgaagtcttcaagcatctacagcatcgtaaatatcaaaatcggagtacaggtcaaattcgacggcaaccatctgttagagattgagatcccaacaacttattacgggaaggtttgtgggatgtgtggaaacttcaatgacgaagaggaggacgaactgatgatgccctctgacgaggttgctaactccgattcagagttcgtgaacagttggaaggataaagatatcgatccatcatgccagtccttacttgtcgacgaacagcagatccccgctgagcagcaggaaaacccttcgggcaactgcagggctgctgatttgaggcgagctagggagaagtgcgaggcggccctgagggcacccgtttgggcacagtgcgccagtcggatcgacctcactccttttttggtggactgtgcaaacaccctctgtgaatttggcggcctctatcaggctctgtgtcaagctctgcaggcgtttggcgccacttgtcaaagtcaggggctcaagccacccctgtggcgcaactcttccttttgcccgctcgagtgcccagcttatagttcctacaccaattgcctgccttcatgctctccctcttgttgggatcttgatggtaggtgtgaaggggctaaggtgccgagtgcctgcgccgagggctgcatctgtcaacctggctacgtgctgtccgaggataagtgcgtacctcggtcgcaatgtggctgcaaggatgcccacggtggctccatacctttggggaaatcctgggtgagctcagggtgcacagaaaaatgtgtgtgtacgggaggagccatccagtgcggcgactttagatgtccgtccggaagtcactgccagctcacgtccgacaatagcaactctaactgtgtttcagacaagagcgaacaatgctccgtttatggggatcccaggtacctgacattcgacggattttcttatcgcctgcagggacgaatgacgtatgtgctgatcaagaccgtcgatgtactccccgagggagtggagcctctgctcgtggaaggaaggaataagatggatccacccagatcgtcgatcttcctgcaggaggtcattactaccgtgtatgggtacaaagtgcaactccaggccggtctggagctggtggttaataatcagaagatggctgtcccgtataggccaaacgagcacctcagggtgacactgtgggggcagcggttgtatctagtgactgacttcgagctagtcgtgagtttcggggggcgtaagaatgctgtcatatcactcccctccatgtatgaggggctggtgtcaggactgtgtggaaactacgacaaaaacaggaaaaacgatatgatgctgccctcaggcgctctgactcagaatctgaacactttcggtaatagctgggaggtaaaaactgaagacgctttgctgaggtttccacgcgcaattccagcggaggaggaaggtcagggagccgagctggggctgcggacgggactccaggtaagtgaatgcagtccagagcagttagcttctaattccacacaggcatgtcgggttctcgccgacccacaaggaccctttgcggcctgccaccaaacagttgcccctgagccatttcaggagcactgcgtcctggatctttgctccgcgcaggatccaagggagcaggaagaattgagatgtcaagtgctatccgggtacgcaatactgtgccaagaggccggcgcggccctagctgggtggcgcgatcgaactctttgtgccggacagcagctgagcgactag

SEQ ID NO: 52741 - DNA, 8067 bp, Artificial Sequence
  Description of Artificial Sequence: Synthetic coding sequence
atggtgccccccgtgtggaccctgctgctgctggtgggcgccgccctatttagaaaggagaaaccaccggaccaaaaactggtggtccggtctagcagggataattatgtgctgacccagtgcgacttcgaggatgacgccaaaccactttgcgactggtcccaggtctccgctgatgacgaggattgggtgcgggcctctggacctagtcccactggttcaacaggagcacctgggggttaccctaatggcgagggctcctacctgcatatggagagtaactccttccaccgcgggggggtggcgaggctgctttcacccgacctttgggagcagggcccattgtgtgtccatttcgcccaccatatgttcgggctctcctggggtgcccagcttcgcctcctcttattatcaggtgaggaaggtcgtagaccagatgtcctgtggaaacactggaatacccagagaccatcctggatgctgaccacggtgacagtgcccgccggattcaccctgcccacccgactgatgttcgagggcactaggggctctaccgcttatctggatatcgctctggatgcactgtccatcagaaggggttcttgcaaccgagtctgcatgatgcagacgtgctccttcgacatacctaacgatctttgtgattggacctggatcccgacagcctccggggcaaagtggacccagaaaaaaggttcaagtggaaaaccaggggtgggacctgatggggacttttcaagtccagggtccggatgttacatgttgctggaccctaagaacgccagacccgggcagaaagcggtgctcctgtcacctgtttccctgagttccggctgtctgtccttttcctttcactacatactccgagggcagtcgcccggggctgcacttcatatttatgcctccgtgcttggatcaatacgaaagcatacactgtttagcggccagcccggacctaactggcaagccgtgtccgtcaattataccgccgtcgggcggatccagttcgcagtcgtgggtgtatttggcaagacacccgagcccgccgtggcagtggacgcgacctccattgctccttgcggcgaagggttcccccagtgcgacttcgaggataatgcgcatcctttctgcgattgggtacagaccagtggagacggcggacactgggccctgggtcacaagaatggccccgtacacggcatggggccagctgggggttttccaaacgcaggaggacactatatttacttggaggccgatgagttcagccaagccgggcagagcgttcggttggttagccgccctttctgcgccccaggcgacatttgtgtcgagtttgcgtaccacatgtacggcctgggtgaaggcacaatgctcgagctgctgctgggctcgcccgccggatccccacccatcccactgtggaaacgcgtaggaagccagcgaccatattggcaaaacacctccgtaaccgtgcccagtggccaccagcagcccatgcagctaatcttcaaggggatccaggggagtaacaccgcctctgtggtggccatgggattcatcctcatcaatccaggtacttgccctgtaaaggtgcttccagaactcccgcctgttagcccggtttcatcaacgggccctagcgagactacagggcttaccgagaaccccaccatcagcaccaagaagcccaccgtgtctatagagaaaccaagcgtgactacagaaaaacctacagtacctaaagagaaaccaaccattccgacagagaaacctaccattagcaccgagaagcctactattccttcagagaagcctaacatgcctagtgagaaacctacaatcccaagtgagaaacccacaatactgactgaaaaaccaaccatacctagcgaaaagcccaccatccccagtgaaaagcccactatcagtactgagaagcccacagttccaacagaggagcccactactcctaccgaggagacaaccacctccatggaggagcccgtcatccctacagagaagccgagcatccccacagaaaaaccctccattccaacggagaaacccacgatctcaatggaggagaccatcatttctaccgagaagcctaccatctcacctgagaagccaacaatccccacagaaaaacctacaataccaaccgagaagtcaactatatcccccgaaaaaccgacaacacctaccgagaaacctaccatccccacagagaagccgacgatcagtcctgagaaacccaccactccgacagagaagccaactattagtccagaaaagctcactattcctacagagaagccgacaattcccacagaaaagccaaccattcctactgagaaaccgactatatctacagaagagcccacgacccccacagaggagacaacaatcagtaccgagaagccgtctatcccgatggaaaagcctacattgccaaccgaggaaacaactactagcgtggaggagactaccatttccacagagaagctgacaattccaatggaaaaacccaccatatcaactgaaaagcccaccattcccacggagaaacctacaatcagcccagagaaactgacgatccccacagaaaaattgactatacctacagagaaacctacaatcccaatcgaagaaaccactatctccactgagaagctgaccattcctactgagaagcccaccatttcccccgagaagcccacgataagtaccgagaaaccaaccattcccaccgagaagcccacaattcccaccgaagagaccacaatcagcactgagaagctcacaattcccactgaaaagcccaccattagcccggaaaaactgaccatccctactgagaaacccaccatcagcactgaaaagcccactattcccacagaaaagttaacaatccccaccgagaaacctacaatccccaccgagaagccgaccatccccaccgagaagctgaccgcactccgcccaccacacccttcccctaccgcgaccgggctggcagctctcgtcatgtcaccacacgcacctagcacccctatgacttcggtgatcctgggcacaaccacaacatctagatcttccaccgagagatgcccaccaaacgcgcggtatgagtcttgcgcctgccccgcctcctgcaagtcccctcggccgtcgtgcggccccctgtgtcgggagggctgcgtgtgtaaccctggtttccttttttctgataaccattgtatacaggcttctagttgcaattgcttctacaacaacgactactacgaacccggggccgagtggtttagtcccaactgtaccgaacattgtcgctgctggccggggtcacgggtagagtgtcagatctctcagtgtgggacccataccgtatgtcagctgaaaaatgggcagtatggatgccatccgtacgctgggactgctacctgtttggtttacggggatccacactatgtcacattcgacggtcgacatttcggttttatgggaaagtgtacctacatccttgcccagccctgtggcaatagcactgatccctttttccgcgtaacggcaaagaacgaggaacaggggcaggagggggtaagctgtttgagtaaggtgtacgtgaccctccctgaatcaacggtgacgctgctgaaaggtcggagaacgctcgtgggcggtcagcaggttacactgcccgctatcccctctaaaggcgttttccttggagcaagcggtcggttcgtggaacttcagacggagtttggcttacgagtccgctgggacggagaccagcagctttacgtgacggtctcttctacttactctggtaagctgtgtgggctgtgcggcaattatgacggtaactcagataatgaccatctcaagttggatggcagccccgcaggcgataaggaggagctgggtaactcatggcagacagaccaagatgaagatcaggagtgccagaagtaccaagtcgtgaactcccccagctgtgactccagcttacagtcctcaatgtcaggccccggattctgcggccggttggtcgatacccacggaccgttcgaaacatgcttgctgcatgtcaaggctgctagcttcttcgattcctgcatgctagacatgtgcgggtttcaaggtttgcagcacctgctgtgtacccacatgagcacaatgaccacaacttgtcaggacgctggacacgcagtgaaaccttggagagaaccgcatttctgcccaatggcctgtccacccaatagtaaatacagcctatgcgcgaagccctgtccggacacgtgtcacagcggattctccgggatgttttgctctgacagatgtgtggaagcatgcgagtgtaatcctggcttcgtgttatctgggttggaatgtatcccccggtcgcagtgtggatgcctgcaccccgcgggcagttacttcaaagtgggggaacgctggtacaaaccaggatgtaaagagctgtgtgtatgtgaaagcaacaatagaattcgctgtcagccgtggcgttgtcgtgcccaggagttttgcgggcagcaggacgggatctatgggtgccacgcacagggcgccgctacttgtacagcgagtggcgatccccattatctgacattcgacggcgcgttacaccattttatggggacgtgtacgtacgttcttaccagaccatgctggtcaagaagccaagatagttacttcgtcgttagcgcaactaacgagaacagaggtgggatcctggaagtctcttacatcaaggcagtgcacgttaccgtgttcgacctgtccattagtcttctgaggggatgtaaggtgatgttaaacggacatcgagtagctctccctgtttggctggcccaggggcgcgtgacgatcaggttgtccagcaacttggtcctcctctatactaatttcgggctgcaggtgaggtacgatgggtcccatttggtggaggttacagtgccatcaagctacggggggcagttgtgcggcctgtgcggaaactacaataacaactccctcgatgataatctgcgccctgatcgtaagctcgctggcgatagtatgcagttaggggccgcctggaagttaccagagtcaagcgagcccggctgctttctcgtagggggtaaaccaagctcatgtcaggagaatagtatggctgacgcctggaataaaaactgcgctattttgatcaaccctcagggtcccttctcacagtgtcaccaggtcgtgcctccgcaaagtagctttgcctcctgcgtccacgggcagtgcggaacaaaaggtgacactaccgccttgtgccggagtttacaggcgtatgcatctctttgtgcccaggctggtcaggctccagcctggcgaaataggacgttctgccccatgaggtgcccgccaggatcaagctattccccatgttctagcccctgcccagacacctgcagttcgattaataaccctagagactgccccaaggctctcccatgtgccgagtcatgcgagtgccagaaaggtcacatcctgagtggaacaagctgcgtccctttgggccagtgtggatgcacagaccctgccggaagttaccaccccgtgggtgagaggtggtatacagaaaatacctgtacccgattatgtacgtgttctgtgcataataacattacgtgtttccagagtacttgcaaaccaaaccagatctgttgggccctggatggcctgctgagacgtgcatccggtgtgggcgtctgtcagctgcccggcgaaagccactatgtgagcttcgatgggtctaatcactccatccccgatgcctgtaccctggtccttgtgaaagtgtgccatcctgcaatggccctgcccttctttaagatctcagcaaaacatgaaaaggaggagggagggaccgaagcttttcggctacacgaagtctacattgacatttacgatgctcaggtgactctgcaaaaggggcacagagttctcatcaactctaagcaggtgaccctgccagctatctcgcagatccccggggtatccgtgaagagttcatcgatatactcgatagtaaacattaaaattggagtgcaggtgaagttcgacgggaatcatctcctggaaatcgaaatacctacaacttattacggcaaggtctgtgggatgtgcgggaattttaacgacgaggaagaagacgagctgatgatgccttccgacgaagtagccaactcagattccgagtttgtgaacagctggaaagataaggacatcgatccaagttgccaatccctgctagtggacgagcagcaaatacctgctgagcagcaagagaaccccagcggaaattgtagggccgctgatctcagaagggcacgcgagaaatgcgaggctgcactgcgcgcccccgtttgggcgcagtgcgcctctcggatcgacctcacacctttcctcgtcgactgtgcgaatacactgtgtgaattcggaggcctctaccaggcgctctgccaggccctccaggccttcggtgcgacttgtcaaagccagggattaaagccaccgttgtggagaaactcctctttctgtccgctcgagtgtccagcctatagctcctacactaattgtctaccgtcttgcagtccttcctgttgggacctagatggacgctgtgagggtgccaaggtgcctagcgcgtgtgctgaaggatgcatctgccagcctggatacgtcttgagcgaagacaagtgtgtcccccggagccaatgcggatgcaaagatgctcatggaggttcgatcccccttggcaaatcttgggtaagttccgggtgcaccgaaaagtgtgtttgtaccggaggcgccatccagtgcggtgacttccgttgccccagcggttcacactgccaactgacaagcgacaacagtaattctaactgtgtgtcagacaagtctgaacagtgctccgtgtatggcgatcctagatacttgaccttcgacggctttagttaccggttgcaagggagaatgacatacgtactgatcaaaacggtggatgtgcttcctgaaggggtcgaaccccttctggttgagggccgaaataagatggacccgccccgcagtagtattttccttcaggaggtcatcaccactgtgtacgggtataaggtgcagctccaagccggtctcgaactcgtggtgaacaatcaaaaaatggccgtgccctacagacctaacgagcacctgcgcgtgacactctggggccaacgtctgtacctagtgactgatttcgagcttgttgttagcttcgggggccgcaaaaatgctgtcatctctctgccgtccatgtacgaggggttggtttccgggctctgcggaaattacgacaaaaaccgcaagaacgatatgatgctcccctcgggcgctttaactcagaatctaaatactttcggaaatagctgggaggtgaaaaccgaagacgccttattaagattccctcgggccatccccgccgaggaggagggtcaaggggccgaacttggcctgcgcacaggactgcaggttagtgagtgcagtcccgaacaacttgcttcaaactctacacaggcttgtcgggtactagctgatccacagggcccattcgcggcttgtcaccagacagtcgctccggagccttttcaagagcactgtgttttggatctttgttcagcacaagaccctcgagaacaggaagagctccgctgtcaggtcctttctggctacgcaatcctgtgccaagaagctggtgccgctttagcgggctggagggacagaacactgtgcgccatggaatgtcctgccgggactatctatcagtcttgtatgaccccatgtcccgcatcctgcgctaatctggccgaccctggagactgcgagggcccttgcgtcgaaggctgcgccagcatccctgggtatgcgtacagcggtactcagagcctgccttggctgaccgtcgctgccccagcgatggcaagtactaccagctgggccgccgcgttctag

SEQ ID NO: 52742 - DNA, 3555 bp, Artificial Sequence
  Description of Artificial Sequence: Synthetic coding sequence
atggcctgcccccccaacagcaagtacagcctgtgcgccaagccctgtcccgatacctgccacagtggttttagcggcatgttctgctcagatcggtgcgtggaggcatgtgagtgcaatcccggctttgtcttgtcaggtctggagtgtatcccaagaagccaatgtggctgtctgcatccagcaggcagctatttcaaagtgggcgagagatggtacaagccaggatgtaaggagctctgtgtgtgcgagagtaacaaccgcatcagatgccaaccctggcgttgcagggcccaggagttttgcggacagcaggacgggatctatggatgccatgctcaaggagcagcgacctgcacagcatccggcgatccgcactacctgacatttgacggtgcgctacaccacttcatggggacatgtacctacgtactgactcgaccctgctggtcacggtcccaggacagctatttcgtggtgtccgccactaatgagaatcgaggaggaatcctggaagtaagttacatcaaagctgtgcatgtcaccgtgttcgacctgagcattagtctattgcggggttgcaaggtgatgctgaatggacacagggtagcactccccgtgtggcttgcgcaggggcgtgtaaccattcgcctgagctctaacctggtgctcttatataccaacttcggcctgcaggtaagatacgacggttctcatctggtggaggtgaccgtcccatccagttacggtgggcagttgtgcggcttgtgcgggaactataataacaattcacttgatgataacctgagacctgacagaaaactagccggggactctatgcagctgggcgctgcttggaaacttcccgagagctcagagcctggatgctttctagtgggcgggaaaccttccagttgtcaggaaaactccatggccgatgcctggaacaagaattgcgctatcttgatcaacccgcaggggcctttcagccagtgccatcaggtggtgccacctcaaagcagctttgcttcctgtgtgcacgggcaatgtgggactaagggcgataccactgccctgtgtcgctccttgcaagcttacgcctccctgtgtgcacaggcagggcaggcgcccgcctggcgcaatcggaccttttgccccatgagatgtcccccgggtagctcttattcgccttgcagcagcccttgcccagacacatgttcctcaattaataacatcacctgcttccagtccacctgcaaaccaaaccagatttgctgggctttagacgggctactgagacgagcctctggcgtgggagtatgccaactccctggggagtcccattacgtgtcgttcgatggatctaatcactccattccggatgcttgcactctcgtattggttaaggtgtgccatcctgcaatggccctgcccttctttaaaatttcagctaagcacgagaaggaggagggtggcactgaggcgtttagacttcacgaggtctacattgacatctatgatgcccaggttacactgcagaaaggtcaccgcgtgctgatcaacagcaaacaggtgactctgccagcaatttcacaaatcccgggggtgtcggtgaaatcgagcagcatttattcgatcgtgaacatcaaaatcggggtgcaggtgaagtttgacggcaaccacctgcttgagatcgaaataccaaccacgtattacggcaaagtttgcggtatgtgcggcaatttcaacgacgaagaggaggatgaattgatgatgccatcggatgaggtggctaactcggactctgaattcgtgaattcctggaaggataaggacatcgacccctcatgtcagagcttgctcgtcgatgaacagcaaattccagcggagcagcaggaaaatccctccggaaattgtagagctgctgatttgcggagagcacgcgaaaagtgcgaggccgcactgcgcgctcccgtctgggctcagtgtgcctcgaggatagatctgactcccttcctggtagactgtgccaacaccttatccctggaatgcccagcctactcttcatacacgaattgcctaccttcttgcagcccctcatgctgggacctggatgggcgctgcgagggcgccaaggtgcctagcgcctgcgcggagggatgtatctgccagcctggatacgtgctaagcgaggataaatgtgttccccgatcacaatgcgggtgtaaagatgcacatggcggatctattcccctgggcaaatcctgggtttcaagcggatgtactgagaagtgcgtctgtacaggcggggccattcagtgcggcgacttccgctgtccatccggcagtcactgtcagctgaccagtgacaacagtaatagcaactgcgtttccgataagtctgaacagtgctcagtttatggggaccctagatacctgacattcgacggattctcctacagactgcaaggcaggatgacgtacgtcctgatcaagacggttgatgtcctgcctgagggcgtagagccgttgctggtcgagggcaggaacaagatggatccccccagaagctcaattttcctccaggaagttatcaccacagtgtacgggtataaagtgcagttacaggcaggtctggaactagtggttaacaaccaaaagatggccgtgccgtacaggccgaacgaacatctacgtgtgacactgtggggtcagcgcttgtatttggtgacagactttgagctcgtggtctcttttggaggtcggaagaacgcgggcctataccaaaggaggcggcgtgacaaggggcgatcctgggcttctgcacgagctagcaagtgcccaaatgtggccagaagctcttggagggctactgcaccgagaccagtgggctgctggcagacaccacgtgcaccattgctgccagtgactcggagatggccccaatcaccatccaagtcaaccgcttgttggatctgcgcactcctaagaacacaagagtctaaacgatcgtgcgtagcaagaagctctgttggcacaccttcgagtgccagacggcgtgctctgccttggcttgcggggggtactgctccaagcgcactggggagtagctttctcactgaagactgtagccagaggtgtacatgtgcctccagcagaatactactctgcgaacctttctcctgtcgggccggggaggtgtgtaccctcggcaaccatacccagggatgtttcccagagtccccttgtctccagaacccttgccagaacgacggacagtgtcgtgaacaaggtgcgactttcacctgtgaatgtgaggtcggatatggagggggcttatgtatggagcccagggatgccccaccacccaggaagcctgaggccagtaatttagtgggcgttctcctgggcctgctcgtgccggtggtggttgtactgctggctgtcacaagagaatgcatctacaggacaaggaggaaacgtgagaagactcaggaaggcgatcggcttgcccgccttgttgacacggatacggttctggactgcgcttgctag

SEQ ID NO: 52743 - DNA, 8163 bp, Artificial Sequence
  Description of Artificial Sequence: Synthetic coding sequence
atggtgccccccgtgtggaccctgctgctgctggtgggcgccgccctgtttcgaaaggagaaaccccccgatcagaagctggtggtccggtcctctagagacaactacgttctgactcaatgtgattttgaagacgatgctaagccactttgcgattggtctcaggtatcagcagatgatgaagactgggtccgtgcctcgggccccagccccacggggagcaccggagccccgggcggctacccaaacggagaaggctcatatctccatatggagagcaatagctttcacagggggggggtggcgcggctactctcacccgacttatgggaacagggaccattgtgtgtgcacttcgcacaccatatgttcggcctgtcctggggcgctcagttgcgcctgttgctgttatccggagaggagggcagaaggcctgatgttctctggaaacattggaacacgcagcgaccatcctggatgctgacgaccgttaccgtccctgcaggattcaccctacctacccgtcttatgttcgaagggaccagggggtccacagcttacttggatatcgcacttgacgccctatccatccgccgaggctcctgcaatcgcgtgtgtatgatgcagacctgttcattcgatatccccaatgacctgtgtgattggacctggattcccaccgcctccggtgctaaatggacccagaaaaaaggaagttcaggaaagcctggagtgggccccgacggcgatttctcttcccctggttccggatgttacatgctgctggaccccaagaacgcccgacccggtcagaaagcagtcctgctttctcccgtcagcttgagttcaggttgtctgagcttttctttccattacattctgagagggcaatcacctggagccgcacttcacatttatgctagtgtgctgggaagcattagaaagcacacgctcttcagtggccagcccggcccaaattggcaagcagtgtctgtcaactataccgcggtcggccgcatccagttcgctgtggtgggtgtcttcgggaagacacctgagcctgccgtggcagtagacgctacatcaatcgccccttgcggtgaagggttcccacaatgcgactttgaggataatgctcatcctttctgtgactgggttcagacgagcggagatggcggtcactgggcactcgggcacaagaacgggcccgtgcatgggatggggcccgccggcggtttcccgaatgcaggaggtcattatatatacctggaggcagacgagttctcacaggccggtcagtcagtgaggttggtgtccaggccgttctgcgccccaggcgatatctgcgtagagttcgcgtaccacatgtatggcctgggcgaggggaccatgctggagctattgttagggagcccagctggcagtccacctatccctctctggaaacgagtgggctcccagaggccatactggcagaataccagcgtgaccgtgcccagcggccaccaacagccaatgcagctgatctttaaaggtattcagggctcaaacactgcctctgtggtggcgatgggatttatcctgataaatcccggaacctgtccagtgaaagtattaccagaactcccgccagtttcccccgtctcttccacgggcccatccgaaacaacaggcctgactgagaacccaacgataagcaccaagaagcctaccgtatcaattgagaaaccctccgtgactaccgagaaacccacagttcctaaggagaagccgaccatcccaacagagaaacccactattagtaccgagaagccgaccatcccgtctgaaaaacccaatatgccttctgagaaaccaacaattccatccgagaagcccactatcctaacagaaaagccaactattccttcagagaagcccaccattccatctgaaaagcctaccatctccacagagaagccaaccgtgcctaccgaagaacctactacccctactgaagaaacgacaacaagcatggaggaacccgtgatacccactgagaagccgagcatcccaaccgagaaacccagcatcccaacagagaaaccgacaatctctatggaggagaccatcatctctacagaaaagcctactatttccccagagaaacctactatccctaccgagaaacctactattcccacagaaaaatctaccatctccccagagaaacccaccacacctaccgagaaaccgaccatcccgaccgaaaaaccaaccatttcgcccgaaaagcctacgactcccacagaaaagcccacaatttctcctgagaaattgacaattccaacagagaagcctacgattcctacggagaagcccactatcccaactgagaagcctaccatctccaccgaagaaccaactactcccacagaagagaccaccatttccacagagaaaccgtctatccccatggagaaacctacactacccacggaagaaactacaacttctgtggaagagacgactatcagcacagagaaactaactatccctatggaaaaaccaacaatctccacggaaaaaccaaccatcccaaccgaaaagcccaccattagtcccgagaagcttacgataccaactgaaaagctgaccatccctacagaaaagcccacaatccccatcgaagagactacaatcagcaccgaaaagttgacaattccgactgagaaaccaactatttcgcctgaaaagccgacgatcagtaccgagaaaccaacaatacccactgagaagccaaccatcccaaccgaagaaacaacaatctctacagagaagcttacaatacctacggaaaagcccaccatcagccccgaaaagctcactataccaacggagaaacccaccatctccacagagaagcccacaatccccacggagaagctaactattccaaccgaaaagccgaccatcccaacagagaaacctacgattcctacagagaagctgactgccctccgccccccacacccatcgcccacagcaaccggtctggctgccctggtcatgagtcctcacgctccatctaccccaatgacctcagtcatcctgggcaccaccacaacttctaggtcatccacagaaagatgccctcccaacgctagatatgagtcctgcgcttgccccgcctcctgcaaatcaccccgcccctcatgtggccccctctgcagagaagggtgcgtatgcaatcccggcttcctgttcagcgataaccactgcattcaggcttcttcatgcaattgtttctacaacaacgactactacgaaccaggagctgagtggttcagtcctaactgtactgagcattgccgatgctggcccgggtctagggtagagtgccagatctcacaatgtggcacccataccgtctgtcagcttaaaaatggtcaatatggctgccacccttatgctggcacggcaacatgtttagtgtacggggacccacattacgtcacgttcgacgggcggcattttggctttatgggcaaatgcacttacatcctcgctcagccatgcggtaattctacagaccccttttttcgcgtcactgccaaaaatgaagagcagggtcaagaaggagtcagttgcctgtctaaagtatacgtgacccttccagaaagtactgtcaccttattgaaggggcgtcgcacactggtaggaggccagcaagtgacgctccccgctatcccttccaagggagtatttttgggggctagtggccgatttgtcgaactgcagactgaattcggactgcgcgtgcgctgggatggcgaccaacagctgtatgtaacagtcagctcaacctacagcggtaagctgtgtggcttgtgcggaaactatgacggaaattccgataatgatcacctgaaactggacggcagtcctgccggagacaaagaagaactcggaaacagctggcagacggatcaggacgaggatcaggaatgccagaagtatcaggtagtgaactctccctcttgcgactccagtctgcagtccagcatgagcggtccgggcttctgcggcaggcttgtggacacccacggaccctttgagacatgtctgctccacgtgaaggcggccagctttttcgactcatgtatgctcgatatgtgcggtttccagggcttgcagcacctactctgtacccatatgtcgacaatgactacaacctgtcaggatgcaggacacgccgtaaaaccatggcgagagcctcacttctgtcccatggcttgcccccctaactcaaagtattctttatgtgctaagccttgcccagatacctgccactccggtttcagtggaatgttctgctccgaccggtgtgtggaggcttgcgaatgcaatcctggatttgtcctgagcgggcttgagtgtatcccccgttcacaatgcggctgcctacatccagcggggtcatactttaaggtcggagagaggtggtacaagccaggctgcaaagaactttgtgtatgtgagtcaaacaatcggatccggtgtcagccttggagatgcagggcccaggagttctgtgggcagcaagatggcatctacggctgtcatgcgcagggagctgctacatgcaccgccagcggcgacccacattaccttacgtttgatggtgcgctacatcatttcatgggtacgtgcacttatgtcctcacacggccttgctggagcagatcacaggacagttacttcgttgtaagtgctacaaatgaaaacagaggggggatcctcgaggtgtcatatattaaggcagttcacgtgaccgtgttcgacctgagtataagcctactgaggggatgcaaggtgatgctgaacggccatagagtggcacttcccgtctggttggctcaaggcagagtcacgatcaggctgagcagcaatcttgtgctgctgtacaccaacttcggactccaagttcggtacgacggtagccatctggtggaagtcacagtcccatcctcatacggcggacagctctgtggcttgtgtggtaattacaataacaattcgctagatgataatctgcgccctgaccggaaactggcaggggattccatgcagctgggcgctgcatggaaactgcctgaatcttccgaacccgggtgctttttggttggaggaaagccatccagttgccaggaaaactccatggccgatgcatggaacaagaactgcgctattctgatcaatccgcaggggccattcagccagtgccaccaggttgtcccaccacagtcttcttttgcttcctgcgtgcatggtcaatgcggcactaagggcgataccacagccctctgcaggtccctacaggcctacgcttccctgtgcgcccaggctggacaggcacctgcctggcgtaacagaacattctgccctatgagatgccctccgggcagtagctactcgccgtgttcatcaccttgccctgacacatgctcttcaataaataatccaagggattgtcccaaagcccttccctgtgccgagagctgtgaatgtcagaaggggcatatcctgtccgggacatcctgcgttcctcttggccagtgcgggtgtaccgatcctgcaggaagttatcaccccgtcggcgaacggtggtacactgaaaacacgtgtacccgtctatgcacgtgttctgttcacaacaatataacttgttttcagagtacctgtaaaccaaaccagatctgctgggccctggacggactgctgcggagggccagcggggtgggggtgtgtcagctgcctggggaatcgcactatgtgtcctttgacggctccaatcacagcatccctgatgcctgtaccctcgtgttggtcaaagtctgtcatcctgcaatggcattgcctttcttcaagatctccgccaaacatgagaaggaagagggtggcactgaggccttccgcctgcatgaggtgtatatagatatctatgacgcacaggtcacactgcagaagggccacagggtgctgataaacagcaagcaggtgactcttccagctattagtcagatccccggcgtcagcgtcaaaagtagcagtatatacagtatcgtgaatatcaagattggagtgcaggtcaagttcgacggtaatcacctattagagatcgagatcccgactacatactatggtaaagtctgcggcatgtgcggcaattttaatgatgaagaagaggatgagctgatgatgcccagcgacgaagtggcaaattctgactcagagttcgttaatagctggaaggataaagatatcgatccctcatgccagtcactgttagtcgatgaacagcaaatcccagcagaacagcaggagaacccgagcggaaactgtcgggcggctgacctgaggcgcgcacgggagaagtgcgaagcagcccttagggcccctgtgtgggctcagtgtgcctctaggatagatcttactcccttcttggtggactgcgccaacacgttatgcgagttcggtggcctgtatcaggctttatgccaggctctgcaggctttcggcgcaacctgccaatcccaggggttgaagcctcctttatggcgcaacagctctttctgtccactggaatgccctgcctactctagctatactaactgtctgccttcctgcagccctagctgttgggatctcgatggaagatgtgaaggggctaaagtgcctagtgcctgtgccgagggttgtatttgtcagcctgggtatgtattaagtgaggacaagtgcgtcccgcggagccagtgtgggtgtaaggacgctcacggaggtagcattccattgggaaaatcctgggtgagttctggatgcacagagaaatgcgtgtgcaccggtggagccatacagtgtggagactttcggtgtccgtcagggtcgcattgtcaactcaccagcgataactccaactcaaactgcgtgtctgacaaaagtgaacagtgcagcgtctacggtgacccccggtacttaaccttcgatggtttctcctacagattacaagggcgaatgacctacgtgttgataaagactgtggacgttctgccggaaggcgtcgaaccgctgctggtggaaggtaggaacaaaatggacccccctcgttcaagcatcttcctccaggaggtgatcaccaccgtctacggatacaaagtgcagctccaagccggtttggagctggtagtaaacaaccagaagatggccgtgccctataggcccaacgagcaccttcgcgtcaccctatggggccaaagactgtacctcgtcactgacttcgagctggttgtctccttcggtggtagaaagaacgccgttattagtttgccaagcatgtatgaagggctggtcagtggcctgtgtggtaattacgacaagaatagaaagaacgacatgatgttgccaagcggggccctgacacaaaacctgaacaccttcggaaatagttgggaggtgaagacagaggatgctctcctaagattcccacgagcgatcccagccgaggaagaaggccagggcgctgagctgggcttgagaaccggactgcaggtgagtgagtgtagccccgagcagttggctagtaacagcacacaggcttgtcgggtcctggcggacccccaaggtccatttgccgcttgccatcaaaccgttgcacccgagccgttccaggaacactgtgttctcgatctgtgctctgcccaggacccaagggagcaggaggagttgcggtgtcaagtgctatccgggtacgccatcttgtgccaggaagctggagccgcacttgccggttggcgcgacaggacactctgcgagagcccctgccttcagaatccctgtcaaaacgatggacaatgcagagaacaaggcgcaacttttacatgcgaatgcgaagtagggtatggaggaggcctctgtatggagccccgcgacgcgcccccaccaaggaagccagcttctaatctggttggagtcctcttgggcctgctcgtccccgtggtggttgtgctcctcgcggttacccgcgagtgtatctatcggactcgacggaaacgcgagaaaacccaggagggagaccgactggcgagactggttgacaccgataccgtgctcgactgcgcctgttag

SEQ ID NO: 52744 - DNA, 2280 bp, Artificial Sequence
  Description of Artificial Sequence: Synthetic coding sequence
atggtgcacttcctgcaccccggccacaccccccggaacatcgtgcctccagacgcccagaaggatgctttgggctgctgtgttgtgcaggaggaggcatcaccttatactctcgttaatatctgccttaatgtgttgatagcaaatttagagaagctttgttccgagcgcccagatggcacgttgtgcctgcctgagcactggtcttttcctcaagaggtggcggagcggtttctgagggtaatgacatggcaggggaagctgacagaccgtacggcgtccattttccgcggaaaccagatgaagctcaagctcgtgaatatccaaaaagccaaaatctcaaccgctgcattcatcaaagccttctgtcggcacaagctaattgagcttaatgcaactgcggtgcacgctgatttgccagtacccgacattatttccggcctctgctccaaccgttggatccagcagaaccttcagtgtttactgctggactccacatcaattccccagaattcacggctcctcttttttagccagttgaccggcctccggatactttcagtgtttaatgtttgctttcacacggaggatctcgccaatgtttctcaattgccccggctggagagtctggacatcagcaataccctcgtaacagacattagcgccctgcttacttgcaaggacagattgaagtctctcaccatgcactatctgaagtgcctggccatgacaaaatcacaaatcctagccgtgatccgagagctgaagtgcctgttacacttagacatcagtgaccatcggcaattaaagtctgacctggcatttcacctcctgcaacaaaaagacattctcccgaacgtcgtgtccctggacatcagcggcggaaattgcatcaccgacgaagcagtggaactgtttatcagacttaggcctgccatgcagttcgtggggctgcttgccacagacgccgggagctctgacttcttcacaactaagcagggcctgagggtagccggtggcgctagcatgagtcagattagtgaggccctgtcgagatatcgcaaccgctcctgtttcgtgaaggaggccctgcacaggctattcactgagaccttctccatggaagttacaatgccggctatactaaaacttgttgccataggcatgaggaatcatcctctggatcttcgggtccagttcacagcatctgcctgcgccctgaatctgacccgacagggactcgctaagggaatgcccgtccgacttcttagtgaagttacttgtttactttttaaagctttgaagaactttccgcattatcagcagttacagaaaaattgtctgctgagcctcactaactctcgcatcctagtggacgttcctttcgatagattcgatgccgcgaagttcgtgatgcggtggctctgcaaacacgaaaacccaaagatgcagacaatggccgtgagcgtaacatccattctagccttacagttgagccctgagcagactgcccagctagaagagctttttatggcggttaaggagttactcgccattgtgaaacagaaaacgaccgagaatctggatgacgtaaccttcctgttcactctgaaggcattatggaatctgacggatggaagccccgcagcctgcaagcacttcatcgagaaccaggggctgcagatctttatccaagtgctggagacgttttccgagagtgctatccagtccaaggtattgggtcttctgaataacatcgctgaggtgagagaactttccagcaagctggttaccgaagatgtgctcaaacacatcaattctttactgtgtagccgggaaatggaggttagctacttcgctgccggcattatcgcccacctgacatctgaccggcagctctggatttccagagattttcaacggcgaaccctcctgcaggaccttcacgccactatccagaactggccctcctcttcttgtaagatgactgcgctggtaacttacagaagcttcaagactttttttcccctgctggggaatttctctcagccggaagtccagttgtgggcactttgggcaatgtatcatgtctgctctaaaaatccttcaaagtactgtaaaatgctggttgaagaggagggactacaactgctgtgcgatatccaagaacattccgaggctactcctaaagctcaacagatcgctgctagcatattggatgactttagaatgcattttatgaactaccagagaccaacactttgccaaatgccgttttag

SEQ ID NO: 52745 - DNA, 1254 bp, Artificial Sequence
  Description of Artificial Sequence: Synthetic coding sequence
atgagccagatcagcgaggccctgagccggtaccggaaccggagctgcttcgtgaaggaagccctacatcgcctgttcactgaaaccttctctatggaggtaacaatgcctgccattctgaaacttgtagcaattggtatgcggaatcaccctctcgacctgcgagtgcagttcaccgcctccgcgtgcgctctcaacctaacacgccaggggctggccaagggcatgcctgtgcggctgctgagcgaggttacctgtcttctgtttaaggcattaaaaaatttccctcattaccaacagctgcagaagaattgtctcctatcgttaacgaactcccggatactagtagacgttcccttcgaccgtttcgacgcagccaagttcgtcatgaggtggctgtgtaaacatgagaatccgaagatgcagactatggccgtgagcgtgaccagcatactggctctgcaactgagtccagaacagacggcgcagttagaggaattattcatggctgtaaaggaactgcttgccatcgtcaaacaaaagactacagaaaacctggatgacgtgacattcctgtttacgctgaaagctctttggaacttaaccgatggtagccccgccgcctgcaaacattttatcgagaatcagggattgcaaatcttcattcaggtactggaaacattctccgagagcgccatacaatctaaagtactgggcctgctgaacaatatcgccgaggtcagggaactgtctagtaagctcgttactgaggacgtgctgaagcacattaacagtctcctttgctctcgggaaatggaggtgtcctatttcgccgccggaatcattgctcacctgacttctgacaggcagttatggatcagccgggacttccaacgacggacactcctgcaggatctgcatgcaaccattcagaactggccttctagcagttgcaaaatgactgctttagtaacctacaggagtttcaagaccttctttccgttgctcggaaacttctcacagcccgaggtccagctgtgggccctatgggccatgtatcacgtgtgtagcaagaatcccagcaagtactgcaaaatgctggtagaagaggaagggctgcagcttctatgtgacattcaggaacactctgaggcaaccccgaaggcgcagcagatcgctgcttctatcctggacgacttccggatgcactttatgaactatcaacggcccaccctgtgccagatgccattctag

SEQ ID NO: 52746 - DNA, 2235 bp, Artificial Sequence
  Description of Artificial Sequence: Synthetic coding sequence
atgcccgaggaccaggccggcgccgccatggaggaggccagcccctacagtctgcttgatatctgtctaaattttctaacaacacatctcgaaaagttctgtagcgctcgccaggatggaaccctgtgcctccaggagcccggagtcttcccacaggaggtggccgataggcttttgagaaccatggcctttcatgggctgctaaacgacggcacggtgggcatcttccgcggcaatcagatgagactaaagcgcgcatgtatccggaaggcgaagatcagtgctgtagctttcagaaaggcattctgccaccacaagctggtggaactggatgccaccggagtgaacgcagacattaccatcactgacattatttctgggctgggctcaaacaagtggattcagcagaacctccagtgtctcgtcctcaactctctaacactgtcactcgaggatccgtacgagcgctgtttcagccgtctgagtggcctgagggcgctgtccattacaaacgttcttttttacaacgaggacctggcagaggtcgcaagcctgcccagactggagtcattggacatttccaatactagcattacagacatcaccgccctgttagcttgtaaagaccgtctgaagtcattgaccatgcaccatcttaagtgtttgaagatgacaaccactcagattctggatgttgtgcgggagcttaagcaccttaaccacttggatatcagcgacgacaaacagtttacatccgatattgcgttaaggctgttagagcagaaggacattctcccaaatttggttagcctcgatgtgtccggaagaaaacatgtgaccgacaaagccgtggaggccttcatccagcaaaggccttcgatgcagttcgtgggcctgctggcaacagatgcaggctattcagaatttctcacaggggaaggtcatcttaaagtcagtggcgaggctaatgagacgcaaatcgctgaggccctcaaacgctacagtgaaagggcttttttcgtgagggaggccctcttccatcttttcagcctcactcacgtaatggaaaagactaagccagaaattttgaaactcgtggtgaccggcatgcggaatcaccccatgaatctgcccgttcagctggcggcatcagcttgtgtgtttaatctgaccaaacaggacttggcggccgggatgcccgttcggttattggccgatgtaacccacttgctgctgaaggccatggaacatttccccaaccaccaacaactgcagaaaaattgcttactgtctctgtgtagcgatcgcatcctccaagacgttccttttaatcgatttgaggcggctaagctggtcatgcagtggctttgcaaccatgaggatcagaacatgcaaaggatggctgttgcgattattagcatccttgccgcaaagctctccacagagcagacagcccagctcggcaccgagttgtttattgtgcgccagctcttgcagattgtgaagcagaagaccaatcagaactcggtggacacgaccctgaagtttacactctctgccctatggaacctcacagacgagagccccactacatgtcgtcatttcattgagaatcaggggctggagttattcatgagagtgctggaaagcttcccgactgaaagctctattcagcaaaaagtactaggcctgctgaacaacatcgctgaagtgcaggagcttcactctgagctgatgtggaaggacttcatcgaccatatttccagccttctgcattcagtggaggtcgaagttagttacttcgccgcgggaatcattgctcatcttattagcagaggggagcaagcttggactctcagcagatcccagcgaaactctctcctggatgacctccactccgcaatcttgaagtggccaactcccgagtgcgagatggtggcctatcgatcttttaaccctttttttcctctactcggctgttttactacccccggagtgcagctctgggctgtgtgggctatgcagcacgtgtgtagcaaaaacccctctagatactgcagcatgttgatcgaagagggcggattgcagcacctgtacaatataaaagaccacgagcataccgatccccatgtgcaacagatcgcagtggccattctggactcactggagaagcacatagtcagacatggccggcctcccccctgcaaaaaacaacctcaggccagactcaattag

SEQ ID NO: 52747 - DNA, 2025 bp, Artificial Sequence
  Description of Artificial Sequence: Synthetic coding sequence
atgcccgaggaccaggccggcgccgccatggaggaggccagcccctactccctgctggacatttgcttaaattttctaacaacacacctggagaaattctgttctgcccggcaggacggtactttgtgtttgcaagagcccggtgttttcccccaggaagtggctgataggttgctcagaacaatggcattccatggtctgctgaacgacgggaccgtgggcatttttcgcggcaaccaaatgcgcttgaagcgggcatgcattcgcaaggccaagattagcgctgtggccttccggaaagctttctgccaccacaaactggtcgaactggacgctacgggcgtaaacgcagatattactataacagatatcatttcgggattgggcagcaataaatggattcagcagaacctccagtgcctcgttcttaatagcctgacactgtctttagaagacccttacgaacgctgctttagtcgcctttctggtcttagagccctctccatcactaatgttctgttctacaatgaggatctggccgaggtggctagtttgcccaggcttgaatccctcgacatatcgaacaccagtattaccgacattaccgccctcctcgcttgtaaggataggttaaagtctctgaccatgcatcacctgaagtgtctgaagatgacaaccactcagatcctggacgtggtacgcgaacttaagcacctaaaccatttggatattagcgatgataaacagttcacctccgacatcgcgcttaggcttctggagcagaaggacatactgccgaacctggtgagcctagacgtaagtgggcgcaaacacgtcacagacaaggcagtggaggcatttattcagcagaggccatccatgcagtttgtcggcctgttagccaccgatgccggctacagcgagttcctcacaggagaagggcacttgaaggtgtccggagaggccaacgagacacaaattgcagaagcactaaagaggtactctgagcgcgctttcttcgttagagaggccctgttccatctgtttagtctgactcatgtgatggagaaaactaagcctgaaatcctcaaacttgtggttaccgggatgaggaaccatcctatgaatctgccagttcagctcgcagcttcagcctgtgtgtttaaccttacgaaacaggatctagccgcagggatgccagtgcgcctgctggcggatgtgacccacctgctgctcaaggccatggagcactttcccaatcatcagcagttgcagaagaattgcctacttagcctatgcagtgatcgaatcttgcaggatgtacccttcaacagatttgaagcagccaagcttgtgatgcaatggctctgcaaccacgaagaccagaatatgcaacgaatggctgtagccattatttccattcttgccgccaaactgagcaccgagcaaacggcccagcttggcacggaactgttcattgtccggaataacatagctgaagtgcaggaactccactctgaactgatgtggaaagacttcatcgaccatatctcaagcctgctgcactctgtcgaagtcgaggttagttatttcgcggcgggcattattgcccatctgatctcacgcggggaacaggcatggaccctgtcaaggtcacaacgcaatagcttgctagacgacctgcactccgctattttgaagtggcccactcctgagtgcgaaatggtggcttaccggtccttcaatcccttcttccccctgcttggctgctttactactcctggcgtgcagctctgggcagtttgggccatgcaacacgtttgcagcaaaaatccatcccggtattgcagcatgctcatcgaggagggaggcctccagcacttgtataacataaaggatcacgagcataccgacccccatgtgcagcagatcgcagtggctattctcgatagtctggagaaacatatcgtgcgccacggacgacctcccccgtgtaagaagcaaccacaggccagacttaattag

SEQ ID NO: 52748 - DNA, 1701 bp, Artificial Sequence
  Description of Artificial Sequence: Synthetic coding sequence
atgcccgaggaccaggccggcgccgccatggaggaggccagcccctacagcctcctggacatttgcctgaactttctcaccactcacctggaaaaattctgctcggccaggcaggatggtaccctgtgtctgcaggagcccggggtgtttccccaggaggtggcagataggctgctgagaacaatggcgtttcatggcctgctcaacgacggcactgttggtatttttcgcggaaaccagatgaggctaaagagggcttgcatacggaaggccaagatctccgcagtagccttcaggaaggccttttgccatcataagttagtcgagctggatgccaccggggtgaatgctgacatcacaataacagacatcatatctggcctagggagcaacaaatggattcagcagaacctccagtgtctggtattgaactccttgaccctctccctcgaggatccctatgagagatgcttcagtcgcctcagtgggcttcgggctttgtccattaccaatgtcctgttctataacgaagacttagccgaggtcgcgtctttaccgaggctggagagcctcgacatatccaacacatctatcaccgacatcactgcgttgttggcatgcaaggataggctgaaatctctgacaatgcatcacctgaagtgtctcaagatgaccaccactcagattctcgacgttgtccgagagttgaagcatctgaatcacctagacattagcgatgacaaacaattcacttcagatatagcactcagactgcttgaacagaaagatattttgcccaatctggtgagcttggatgtatccggcaggaagcatgtgacggacaaggcagtcgaggcctttatccaacaaaggccatcaatgcagtttgttggcctcctggccaccgacgccgggtatagtgaattcctgaccggagaaggtcacttgaaggtgagcggggaagccaatgagactcagatcgcagaggccctgaaaaggtattccgagcgtgctttcttcgtgcgagaggccttattccatctgttctcccttacacacgtgatggaaaaaaccaaacctgagatcctgaaactggtagtcactggaatgcgaaatcatcccatgaatttgcccgtgcaactggcagcctctgcatgcgttttcaacctcaccaagcaggatctggccgcaggcatgcccgtgagactactggcagatgtgacacacctgctattgaaggctatggagcactttcccaatcaccaacagctccagaaaaactgtcttctgtctctgtgctctgatagaatcctgcaggatgtacccttcaataggtttgaagccgctaagctggtgatgcaatggctctgcaatcatgaggaccagaatatgcagaggatggccgtggctatcatttctattcttgccgccaaactgtccacagagcagaccgcccagctcggtaccgaactgttcattgtccgccagctgctgcagattgttaaacaaaaaaccaatcaaaactcggtcgataccactttgaagtttactctgtcagctctttggaatttaactgatgagtctccgacgacttgcagacacttcatagaaaaccaggggctggaattgttcatgcgggttctggaaagctttcctacagaatcgtctatacagcagaaagtgctgggtttgctaggttag

SEQ ID NO: 52749 - DNA, 966 bp, Artificial Sequence
  Description of Artificial Sequence: Synthetic coding sequence
atggagcggttcgtgcgggtgccctacggcctgtaccagggctacggcagtaccgtccctctaggacagcccggtctgagtgggcataagcagccggactggagacagaacatgggccccccaacatttctcgctcgccctggtttattggtgccggccaatgctccagattactgcatagacccttataaacgcgcccagctaaaggctattttatcacagatgaacccaagcctatccccacggctttgtaagcctaatacaaaagaggtcggggtgcaagtgtccccccgggtggacaaggcagtccaatgctctctgggaccaagaacgttatcgtcctgcagtccttgggacgggcgggatccccaagaacccctgcccgcctgtggtgttacctcccctgctactggccgacgcggtcttattaggcttcgaagggacggtgatgaagctgaatccaaggcgcttcctggcccggcagaagcatcccaaccccagcccccatcgcgacgcagcggagccgaccgccaggaagaaccgggacagttggaagagagtggggaaaaggatgccccctgccctcaggagaccaaatcaaaacaggtcccaggcgacgcagcaagcgagccactgcgtagaccgaacttccagttcctggagcccaagtacggctacttccattgcaaggattgcaagacaagatgggaatctgcttacgtgtggtgcatttccgggactaacaaagtgtacttcaagcagttgtgctgcaagtgtcaaaagagtttcaacccctacagagtcgaggccatccagtgtcaaacttgctcaaaatcacactgttcctgccctcagaaaaaaaggcatatcgatctccgccgtccacacaggcaggagctgtgcggtcggtgtaaagataagcgcttctcctgtggcaatatatactcttttaaatatgtaatgtag

SEQ ID NO: 52750 - DNA, 78 bp, Artificial Sequence
  Description of Artificial Sequence: Synthetic coding sequence
atggagcggttcgtgcgggtgccctacggcctgtaccagggctacggatccactgtgcctctcggacaacctgggtag

SEQ ID NO: 52751 - DNA, 504 bp, Artificial Sequence
  Description of Artificial Sequence: Synthetic coding sequence
atgctgaccgtggccctgctggccctgctgtgcgccagcgccagcgggaatgccattcaggctcggtcaagcagctactccggggagtacggcgggggcggcgggaagcggttctcccatagtggaaaccaactggacggacccatcaccgcactgcgagtcagagtgaacacctactacattgtaggacttcaggtgcggtacgggaaagtttggtctgactacgtcggcggtcgcaacggtgatctggaggagatcttcttacaccccggtgagagtgttatccaggtcagcggtaaatacaaatggtacttaaagaaactccttttcgtgactgacaagggcaggtatttgagttttggaaaggattctggcacatcattcaatgcggttccacttcaccccaataccgtcctgaggttcatatcaggccggtctgggtccctgatcgacgccatcggcctccattgggatgtgtatccttccagttgcagccggtgttag

SEQ ID NO: 52752 - DNA, 489 bp, Artificial Sequence
  Description of Artificial Sequence: Synthetic coding sequence
  Description of Combined DNA/RNA Molecule: Synthetic coding sequence
atggccgctggcccatccgggtgcctggtgccagccttcgggctgcggctcttgctcgcaacagtgttgcaggcggtctctgcatttggcgcagaatttagctctgaggcttgtcgtgagctcggtttctctagcaacttgctctgtagttcttgcgatctgctcggtcagttcaatttgttacagctagacccagactgccggggatgttgtcaggaggaggcccaattcgagaccaagaagctgtacgctggtgctatcctagaggtgtgcggtugaaaactgggcaggttccctcaggtgcaggcattcgtgcggagtgataagccaaagctgttccgagggctccagattaagtacgtcagaggctcagatcctgtgctaaaactgttggatgacaacggcaacattgccgaggaactttctatcttgaaatggaatacagactccgtggaggaatttctgtcagaaaaactggaacggatttag

SEQ ID NO: 52753 - DNA, 366 bp, Artificial Sequence
  Description of Artificial Sequence: Synthetic coding sequence
  Description of Combined DNA/RNA Molecule: Synthetic coding sequence
atggccgctggccctagtgggtgcctcgtgccggcattcggactccgactgctgctggccactgtgctgcaggccgtgtccgcgtttggagcagagttttcctcagaggcctgccgggagctaggattctcctcaaacctgctgtgctcaagctgcgacctcctgggccaattcaatctcctgcagctggatcctgattgtagaggttgctgccaggaagaggcccagtttgaaacaaagaaactctacgccggtgccatcctcgaggtctgcggaugaaagttggggaggttcccccaggtacaggtttgcccctggttccggccttgtattaaggctttcggccgacaatgggagcactgttag

SEQ ID NO: 52754 - DNA, 426 bp, Artificial Sequence
  Description of Artificial Sequence: Synthetic coding sequence
atggcggctggcccttcaggctgcctggtgcctgccttcgggctccgactgctgctcgccactgtattgcaggccgtgtctgcctttggagccgagttctccagcgaggcttgccgagaattaggcttttcaagcaatctgctctgtagttcatgcgatttgctgggccagttcaacctgctgcagttggatccagattgcaggggctgctgccaggaggaggctcagttcgagacaaagaagtatagctctatcgtatcaaagcaggagtgccaccactctaattgtatgcaggaactgtttcttaagttcgtagacgagaattgggagggaagcttaaaatctaaactgttgctgggtgtgataaatcccaactgcagcgaggattgtaaatcgagtatgtcagtagttcagaccctgtactag

SEQ ID NO: 52755 - DNA, 1707 bp, Artificial Sequence
  Description of Artificial Sequence: Synthetic coding sequence
atgagtcatcgaagcgacactctccccgtcccctcaggacagcgtagaggtcgggtacctagggatcacagcatttacacacaactgctggaaatcacattgcacctgcagcaggcgatgaccgagcacttcgtccaactgacaagtagacagggcctctctcttgaggagcgcagacacactgaagccatctgcgaacacgaggcattgctctccaggctaatttgccgaatgatcaaccttttgcagagtggcgcagcctcgggtctggaacttcaggtccctctaccctcagaggacagtcgcggagacgtgcggtatggacaaagagcacaactgagcgggcaacccgatccggtaccccagttatccgactgcgaggcggctttcgtgaaccgcgacctttccatccggggaatcgatatttctgtgttttaccagtccagttttcaggactacaatgcctaccagaaagataagtaccataaggacaagaacactttagggttcatcaatctgggcacaagcgagaacaaactctgtatggacctgatgactgagcgtctccaggagagcgacatgaattgcattgaggacacgctgctgcagtaccccgactggaggggccagcctttcctgcgggaagaggtcgccagatttctaacatactactgcagggcacctacgcgattggatccggagaatgtggtcgtgttgaacggatgctgttccgtgttttgcgcactggccatggtgttgtgtgatccaggggaggcctttcttgtgccggctccattttatgggggtttcgctttttcaagtcgactatacgccaaagtagagctaattcccgttcacctggagtccgaagtgaccgttacaaatacccacccttttcagcttacggtggataagcttgaagaagcactcctggaagctcgcctcgaaggtaaaaaagttagaggtctggtgttaatcaatccccagaacccgcttggtgacatttactcccccgacagccttatgaagtaccttgaatttgccaagcgctataatctccacgtcattatcgatgagatctatatgctctccgtgtttgacgagtctattacgttccactctatactatcaatgaaaagtctcccagatagtaatagaacacatgtgatttggggcacttccaaggatttcggcatctcagggttccgctttggcgctctgtatacccacaacaaggaggtcgcgagtgctgtgtccgcattcggctacctccactccattagtggcatcacacaacataagctgtgccagctgctacagaacactgagtggatcgacaaggtatacctcccaactaactgctacagactgcgcgaggctcacaaatacatcaccgctgaactcaaagcactagagatccccttccataatagatcttccggactctacgtgtggattaatcttaagaaatacctggacccctgcaccttcgaggaggaacggctgttgtattgccgtttcctcgacaacaaacttttgcttagccgcggaaagacatatatgtgtaaagagcccggttggttttgtctgatattcgctgacgagcttccgagactgaagctggctatgaggcgattctgtgacgtgcttcaagagcagaaagaggctcttattgtaaagcagttagaggacgccatgcgcgaatag

SEQ ID NO: 52756 - DNA, 264 bp, Artificial Sequence
  Description of Artificial Sequence: Synthetic coding sequence
atggccaagcatctcaagttcattgctagaaccgtgatggtccaggagggcaatgtcgagagcgcgtacagaacgctgaaccggatcttgaccatggatggactgattgaagatatcaaacaccggaggtactacgagaagccttgctgccgcagacagagagagtcatacgagaggtgcagaagaatctataatatggaaatggccaggaagataaactttcttatgcgcaagaaccgagctgacccatggcaggggtgttag

SEQ ID NO: 52757 - DNA, 1629 bp, Artificial Sequence
  Description of Artificial Sequence: Synthetic coding sequence
atgaacggtaaacgccctgctgagccaggccctgctcgtgtggggaaaaagggcaagaaggaggttatggccgaattttccgatgcagtgacagaagagaccttaaaaaaacaggtggccgaagcctggtcacgcaggacccccttttcacatgaggtgattgtaatggacatggacccgttcctgcattgcgtcattcccaacttcatccagtcgcaagatttcctcgaaggtctacaaaaagaactcatgaacttggactttcacgaaaaatacaacgatctttacaaattccaacagtccgatgatcttaagaaacgacgtgaaccccatattagcactctcagaaagatactgtttgaggactttcggtcctggctgagtgatatttctaaaattgacctggaatccactatcgatatgagctgcgctaagtatgagtttacagacgccttgctatgccatgacgatgaacttgaaggcaggaggattgcattcatactctatctcgtgccgccatgggatcgcagcatgggtggcactctggatctgtacagtattgacgagcactttcagcccaagcaaatcgttaaaagcctgattcccagctggaataaacttgtctttttcgaagtaagcccggtgagcttccatcaggtcagcgaggtgttgagcgaggagaaatcacgtctgtcaattagtggctggttccatggcccatcactaacacgacccccaaattattttgaaccaccaattcctcggagcccccatattccacaggatcacgaaatcttgtacgattggattaatcccacgtacctggacatggactatcaagttcaaattcaggaggaatttgaagagagcagcgagattctattgaaagaatttttgaaacccgagaagttcacaaaagtatgtgaggcccttgagcacggccatgttgaatggtcctcaaggggtcccccaaacaaacgcttctatgaaaaggccgaagaatccaaactacctgaaattcttaaggagtgtatgaagctgttccggagtgaggccctttttctgctattgagtaacttcaccggactgaagctccactttctggccccttcagaagaggacgagatgaatgacaagaaggaggcagagaccacagacatcactgaggaaggcactagccacagtcctcccgaacctgaaaataaccagatggcaatcagcaacaatagccaacaatcaaacgagcagacagatcctgaacccgaagagaatgagactaagaaggagagctcggtcccaatgtgccagggagaactaagacattggaagaccggccattacaccctcatccacgatcacagcaaagccgaatttgctctagacctaatactttactgcggttgtgaaggatgggagccagaatacggtgggttcacttcctatatagccaaaggagaggatgaagaactgcttacagttaacccagaatctaatagcctggccctggtctacagagaccgcgagacccttaagtttgtcaaacatattaaccatcgtagtctcgagcagaaaaaaactttccccaaccgaaccgggttctgggacttctcttttatatattatgaatag

SEQ ID NO: 52758 - DNA, 1161 bp, Artificial Sequence
  Description of Artificial Sequence: Synthetic coding sequence
atgaacagcctcatgccatgctgcgcgttcatcctatatctggtgcccccttgggatcgcagtatgggagggaccctggacctatactccatagatgagcatttccagcccaagcagattgttaagtccctcatcccttcctggaacaagctggtctttttcgaagtgtctcctgtctcgttccaccaggtttccgaagtgctcagtgaagaaaagtcacggctcagcatatctggctggttccacgggccaagcctcacccggccaccaaattacttcgagcctcccatcccgagaagtccccatattccccaagaccacgagattttgtacgattggataaacccaacttacctggacatggactatcaggtgcaaattcaggaagagtttgaagagtcctctgagattctcctcaaggagttccttaagccggaaaaattcacaaaagtctgtgaggcactagagcatggtcatgtcgaatggtctagcagaggccctccaaacaaacgattttatgaaaaagccgaagagagtaaactgcctgagatactcaaagaatgtatgaagctgtttcggtcagaggcactgtttctgctactcagtaactttacagggctcaagcttcatttcctggctcccagtgaggaagacgagatgaacgataagaaagaggccgagactactgacatcaccgaggagggtacatcccattctccccctgagccagagaataaccaaatggcaatctcaaataattctcaacagtccaatgaacagaccgatccggaaccggaagaaaacgaaactaaaaaggagtcaagtgtgccgatgtgtcaaggagagcttcggcattggaaaacaggacattacacccttatccacgatcacagcaaggctgagtttgctcttgacttgattttgtactgcggatgcgagggctgggaaccagagtatggaggatttaccagctacatagccaaaggcgaagacgaggaactcttgactgtgaaccccgagtccaacagcttggccctggtgtaccgtgaccgcgagacattgaagtttgtcaaacacatcaaccaccggtcattggagcagaagaagacctttccaaatagaacgggattttgggatttttctttcatatattatgaatag

SEQ ID NO: 52759 - DNA, 1629 bp, Artificial Sequence
  Description of Artificial Sequence: Synthetic coding sequence
atgaatggaaagcgtccagccgaaccgggtcctgccagagtgggtaagaaaggtaagaaggaagtgatggccgagttctctgatgccgtgacggaagaaaccctaaagaagcaggttgcggaggcatggtcccggagaactcccttttcccatgaagtgattgttatggacatggacccctttctccattgcgtgatccctaattttatccaatcccaggatttcctggaggggttgcagaaagaactaatgaacctggatttccatgagaaatataacgacttgtacaaattccagcagtctgacgatctaaagaagcggagagagccacacatctccacactgcgaaaaattctgttcgaagactttaggagctggctgtcggatattagcaagatcgacctagaatcaaccatcgacatgtcgtgtgccaaatacgagttcaccgacgctctactgtgtcacgacgacgagctcgaggggagaaggatagcttttatcctatacttagtaccgccatgggacaggtctatgggcggtacgctcgatctgtattctattgacgaacatttccaacccaaacagatagtcaagtccctgatacccagttggaataaattggtgttcttcgaggtgagtccggtgtctttccatcaagtttcagaggtcctttccgaggaaaagagtagactatcaatctccgggtggtttcacggcccatcacttactcgtcctccaaattacttcgagccccctatccctagatcacctcatatcccacaggatcatgagattttgtacgactggatcaaccctacctatctcgatatggattaccaggttcagatacaagaagaatttgaggaatctagcgagatactgttaaaagagtttttgaagccagaaaagttcaccaaggtctgcgaagcactggagcacggtcatgtggaatggtcatccaggggacctccaaacaaaagattttatgagaaagctgaggagagtaagttacctgaaattcttaaggagtgcatgaagctgttccggtccgaagctttgtttttgcttctgtccaacttcactgggttgaagcttcacttcctcgccccatccgaagaagatgagatgaacgataaaaaagaggcggagaccacggatattaccgaggagggcacgtcacatagcccccctgagcccgaaaataaccagatggccatttcaaataattcccagcagagtaacgagcaaacggaccctgaaccggaggaaaatgagactaaaaaggaatcttccgtgccgatgtgccaaggcgagcttcgccattggaagaccggtcattatacactcattcatgaccattctaaagccgaatttgccctggatttgatcctctattgcggttgtgagggctgggaaccagagtacggaggtttcacttcatatatcgccaagggggaggacgaggaactcctaactgtgaacccagaatcaaacagcctggctctggtttacagagacagggaaacactgaagttcgttaaacacatcaaccatagaagcctggagcaaaaaaaaacatttccaaacagaacagggttttgggacttttcatttatatactatgagtag

SEQ ID NO: 52760 - DNA, 1308 bp, Artificial Sequence
  Description of Artificial Sequence: Synthetic coding sequence
atgctgctaccttgggcaacgtccgcgcctggattagcatgggggcctctggtactgggcctcttcggcctgctcgctgcgagccaacctcaggctgtccctccctacgctagtgagaaccaaacatgtcgcgaccaagaaaaagagtattacgagccgcagcaccggatatgctgcagtcgctgtccacctggtacatatgtgtccgccaaatgttctcgtatcagggacactgtctgtgccacttgcgccgaaaatagctacaacgagcactggaattacctgaccatttgccaactatgtaggccatgcgaccctgtcatgggactggaggagatagccccttgcacctcaaaaaggaaaactcaatgccgctgccagcctgggatgttctgcgcagcctgggccctggagtgcacacactgtgaactgctctcagactgcccacccggtactgaggccgaattgaaagatgaagtcggcaaaggcaacaaccactgtgtcccatgtaaagccggacatttccagaacacgtcatcaccttccgcacggtgtcagcctcatacaagatgcgagaaccaagggctggtggaagccgctcccggaaccgctcaatcagacacaacctgcaaaaacccccttgaacctctgccgcctgaaatgtctggtacaatgctgatgctggcggttctattgccgctggcgtttttcctgctcttagctacagtgttctcctgcatctggaagtcgcacccgtctctttgtagaaagttgggctcactgctcaagcggaggcctcaaggagaagggccaaatccagtggctgggagctgggagcctcccaaagctcacccctacttccccgatctggtgcaacccttgctgcctatcagcggggacgtgtcccctgtttccacaggactccctgccgcaccagtcttggaagccggtgtcccgcagcagcaatcccctcttgaccttacgagggaaccacaactggaaccgggagagcagagccaggtggctcatggcactaatggtattcacgtgaccgggggttcaatgaccattaccggtaacatctacatttataatggacccgtgctgggcggaccacccggaccaggcgaccttccagctacgcctgaacccccttacccaatcccagaggagggcgatcccggaccccctggtttgtcgacaccccaccaagaagatggaaaagcctggcacttagctgaaacagaacattgcggagcaaccccctctaatagaggaccacgaaatcagttcatcacacacgactag

SEQ ID NO: 52761 - DNA, 873 bp, Artificial Sequence
  Description of Artificial Sequence: Synthetic coding sequence
atggtggagctcgagcaggaggttgagcgcagacagcggctgggacaggagtctgccgctcgcaaggctctgatagcttccagttatcaccccgcacggccagaggtttacgattcactccaggacgccgcacttgctcctgaatttttagctgtaacagaatattctgtctcaccggacgccgacctgaaaggattactccagcgactcgaaaccgtaagcgaggagaaacgaatttatagagtgccggtttttactgctcctttctgccaggcgctcctcgaagaacttgaacatttcgagcagtctgacatgccgaagggcaggcctaatactatgaacaattatggggtgttactgcacgaattggggctggacgagcctctcatgacccccctgcgggagcgcttcctgcagccactcatggcactgctctatcctgactgcggtggcggtaggctggacagccaccgtgccttcgtggtgaagtacgcacccggtcaggacctggaactgggctgccattatgacaacgcagaactgacactaaatgtggccctcggtaaagtgtttaccggtggtgctttgtactttggcggtctgtttcaggctcctaccgccctgaccgagcctctggaggtggaacatgttgtcggccagggggtgctacaccgaggaggccagctacatggagcacggcctctgggtactggtgagcggtggaatctcgtggtttggctcagggcctcggctgtccgcaacagtctgtgtcctatgtgctgcagggaaccagacctggtggacgacgagggtttcggagatgggtttaccagagaagaaccagcaaccgtggatgtctgcgcgctgacctag

SEQ ID NO: 52762 - DNA, 1023 bp, Artificial Sequence
  Description of Artificial Sequence: Synthetic coding sequence
atgggtaatgtgcctagtgctgtgaagcattgtctgagctatcagcagctgttgcgcgaacatttatggattggggacagcgtggccggtgcgctggatccggctcaggaaacttctcaactctcagggctccccgaattcgtcaagatagtcgaagtggggccacgagacggtctgcagaacgaaaaggtcattgtccctacggatatcaagattgagtttatcaatcggctctcccagactggcctgtccgtcatcgaggtgactagcttcgtgagttcgcggtgggtgccccaaatggcagatcatactgaggtcatgaagggcatccatcagtatcccggagtgaggtacccagtgctcacaccaaatcttcaaggtttccaccacgccgttgctgcgggagctactgagatttccgttttcggggctgccagcgaatcattcagcaaaaaaaacatcaactgctccattgaggagtccatggggaaatttgaggaggtggtcaagtccgccagacacatgaatattcctgcacggggttatgtcagctgcgcactcggttgtccttacgaagggagcatcactcctcaaaaggtcacagaggtcagcaagcgcctgtacggtatgggctgctatgaaattagcctgggcgatacaatcggtgttggaacccccggatctatgaaacgcatgctggagtctgtcatgaaggagattcctccgggtgcgttggctgtccactgtcacgacacctacgggcaggccctggccaatatcttgaccgcacttcagatgggtattaatgttgtggattcggccgtctctgggctcggtgggtgcccttatgcaaaaggtgcaagcgggaatgtcgccacggaagacctcatctacatgctaaacggactcggactcaacaccggggtgaacctgtataaggtcatggaagccggtgacttcatctgtaaggccgtgaacaaaacgaccaacagcaaagttgctcaggcaagtttcaacgcttag

SEQ ID NO: 52763 - DNA, 162 bp, Artificial Sequence
  Description of Artificial Sequence: Synthetic coding sequence
atgggaaatgtgccatcagccgtaaaacattgtctgtcataccaacaactactgcgggagcacttatggatcggagacagcgtggctggagcgctggatccagcacaggaactccagtcagtgatgctcatgttgcatcacggaccattgaggaagccttag

SEQ ID NO: 52764 - DNA, 1113 bp, Artificial Sequence
  Description of Artificial Sequence: Synthetic coding sequence
atggggaacgtcccctcagccgttaagcactgtctgagctaccaacagctcctgcgcgagcacctgtggatcggggactcggtagccggtgctctcgaccctgcccaaaccagcttgctgacaaatctgcactgcttccaacctgatgtcagtggcttctccgtcagcctggccggaacagtggcatgcatccactgggagaccagccagttgagtggcctgcctgaattcgtcaagatagttgaagtagggccaagggacggcctgcagaacgaaaaagttatagtcccaactgatattaagattgaatttatcaatcgcctcagccagacagggctgtctgtaatagaggtgacatccttcgtgagcagccgctgggtgccccaaatggctgatcataccgaggtgatgaaagggatccaccagtacccaggcgtgaggtatccagtgcttaccccaaatctgcaaggctttcatcatgctgtcgccgctggcgctaccgagatttccgtgttcggtgccgcaagcgagagcttcagtaagaagaatattaattgtagcatagaggagtccatgggaaaattcgaggaagtggtgaagtcagccaggcacatgaatatacccgcaaggggttacgtgtcttgcgcccttggatgcccttacgaggggtccatcaccccccaaaaagtgactgaggtttctaagcgcttgtacggcatgggttgttacgagatctcgttgggggacacaatcggagtgggaaccccgggtagcatgaaacggatgctggaaagcgtgatgaaagagattccaccaggggctttagccgtccactgccatgatacatacggacaggcactggccaacattctgactgccctccagatgggcattaacgtggtcgattcagctgtatccggccttggcggatgcccatatgctaagggggctagcggaaatgtagcaacggaagatctgatctacatgctgaacgggttagggttaaacactggagtcaatctctacaaggtgatggaagccggtgactttatatgcaaggcagttaataaaaccaccaactctaaggtggcacaggcctcatttaacgcatag

SEQ ID NO: 52765 - DNA, 1116 bp, Artificial Sequence
  Description of Artificial Sequence: Synthetic coding sequence
atggccgcaccagctcttaggctctgtcacatcgcttttcacgttcctgccggacagccactggcgcgtaatttgcagcgcctttttggctttcaaccacttgcgtcccgcgaggtcgatggatggagacagctagccttgcggtcaggcgacgctgtgtttctcgtaaatgaaggggcaggttctggtgaaccactatatggactcgaccctagacacgctgtaccctctgcaaccaacctgtgcttcgacgtagccgacgccggtgccgcaacacgggagctggccgctctcggatgcagcgtcccagtacctcctgtgcgggtacgggatgcccagggtgccgcaacctatgccgtcgtttcctcccccgctggaatcctttcccttacgcttcttgaaagggctgggtaccgcggaccattcctgccaggctttagacccgtgagttcagcgccaggccctggatgggtctcccgcgttgatcacctgaccctagcctgtaccccgggatcttcccccacactcctgaggtggtttcacgactgcctgggattctgccacttgccgctctcaccaggagaggatcccgagctgggcctggaaatgaccgccggatttggactaggtgggttacgcctaaccgcgttgcaggcgcagccaggctccattgtccctaccctcgtgctcgcggagagcctccctggagccactacgaggcaggatcaggtcgaacagttcttggcacgacacaagggacccggtttacagcatgtgggcctgtataccccgaacatcgtggaagctaccgagggagtggctacggccggagggcaattcctggcacccccaggggcttactaccagcagcctggcaaggagcggcagattagagctgccggacacgaaccacatctattggcgagacagggaatccttctcgatggggacaaaggcaagtttttgttacaggtatttacgaaatccctctttaccgaggacacttttttcctggaactgattcagaggcaaggagcgacgggattcgggcaagggaacatccgcgcactctggcagtcagtgcaagagcagtcagcaaggagccaggaggcttag

SEQ ID NO: 52766 - DNA, 1368 bp, Artificial Sequence
  Description of Artificial Sequence: Synthetic coding sequence
atggctcaacacttctctttggctgcttgtgacgtggtgggctttgacctagaccacacattgtgtcgctacaaccttccggaatccgccccactgatatacaactcctttgcccagttccttgtcaaagaaaaggggtatgacaaggaactgctcaacgtgacccctgaagattgggacttttgctgtaagggcttggcgctcgatctagaggacggcaactttctcaaactggccaacaacgggacagtattgcgggcatcccatggaaccaagatgatgacccctgaggtgttagcagaagcatacgggaaaaaggagtggaaacacttcctgagcgataccggaatggcgtgtaggagtgggaaatattacttttatgacaactattttgatctgcccggtgccctgctgtgcgctagggtggtcgactacctgacgaaactgaacaacgggcaaaagaccttcgacttttggaaagatattgtcgccgcaatacagcacaattataaaatgtcagcctttaaagagaactgcgggatatactttccagagattaaaagagatccagggagatatcttcattcatgcccagaaagtgtgaagaaatggcttcgtcaactcaaaaacgctgggaagatcctccttctgataacttcgtcccattctgactattgcaggcttctgtgcgaatacattctgggaaatgattttacggacctgttcgacattgttataacaaatgctctgaagccaggatttttttcccacctcccatcacagcggcctttcaggacgctggagaacgacgaggagcaagaggccctgccttccctcgataagccaggctggtatagtcagggaaacgcagttcatttgtatgaactcctgaaaaaaatgaccggaaaacctgaaccaaaggtggtttactttggggatagtatgcattcagacattttccccgctagacattatagcaattgggaaacagtgttaatcctggaggaactccgaggggacgagggaaccaggtcgcagcggccagaagagagcgagccactcgagaaaaagggtaaatacgaaggtcccaaggccaaaccgctgaacacttcttcaaaaaagtgggggagcttcttcattgacagtgtgctgggactggagaataccgaagattcacttgtgtatacatggtcttgtaaacggatctccacttattccaccatcgctatcccatctattgaggctatcgctgaactgccattagattataaattcacccgattctcgtcatcgaattctaaaaccgcgggatattatccaaatcccccattggttctgtcctccgacgaaaccctgatctccaagtag

SEQ ID NO: 52767 - DNA, 588 bp, Artificial Sequence
  Description of Artificial Sequence: Synthetic coding sequence
atggcccaacatttttccctggctgcctgcgacgtcgtcgggtttgacctcgatcacaccttgtgccggtacaacttgccagagtccgccccactgatctacaactcattcgcccagttcttagtgaaagagaaagggtacgataaggagctgctaaatgtgactccggaagactgggatttttgctgtaaagggttggcgctcgacctggaggatggcaacttcctaaagctagcaaacaacggtactgtgctgagagcttcacatggtactaagatgatgactcccgaggtcctggctgaggcatacggaaagaaagagtggaaacacttcctgagcgacaccggcatggcctgccgctccggcaaatactatttctacgacaactactttgatctgccaggtgcactgttatgtgctagggttgtggattatctgactaagttgaataacggccagaaaactttcgacttctggaaagacatcgtcgcagctattcagcacaattataagatgagcgcattcaaagtgcgcaggctggccacctcattgctccaggatatcagcacatcgttcattctcatctag

SEQ ID NO: 52768 - DNA, 336 bp, Artificial Sequence
  Description of Artificial Sequence: Synthetic coding sequence
taatcccacggcactaagatgatgacacccgaggttctcgcagaagcctacgggaaaaaggaatggaaacacttcctgtccgatactggcatggcctgccggagtgggaagtattatttttatgacaattacttcgaccttcccggtgccctgctgtgtgcaagggtggttgactatctcactaagctgaataacgggcagaagaccttcgatttttggaaggacatcgtcgccgctattcagcataactataaaatgtccgctttcaaagggaagtattgcgaggaagggccttctaacacgtgcttgctgtcttacgtctgcttagtcaactag

SEQ ID NO: 52769 - DNA, 588 bp, Artificial Sequence
  Description of Artificial Sequence: Synthetic coding sequence
atggcacagcacttctctctagctgcctgcgacgttgtcgggtttgacctcgatcacacgctgtgtagatataacctgcctgaatctgccccattgatctacaatagcttcgctcagttcctagtaaaggagaagggctacgacaaagagctgcttaacgtgacaccagaggattgggacttttgttgcaaaggactggctttagacctggaggacggaaactttctgaaattagctaataatggcacggtactgagagcgtctcacggtacaaagatgatgacgccagaagtcctcgcagaggcatatggtaagaaagaatggaaacatttcctgtcggatacaggcatggcttgtaggtccggaaagtactatttttatgataactattttgacctgccaggcgcactcttatgcgcacgggttgtggactacctgaccaagctgaacaacggtcagaagacatttgacttttggaaggacattgttgctgcaatccagcacaactacaagatgagcgccttcaaagtgaggaggttggctactagcttgctgcaagacatctccacgtctttcattctgatctag

SEQ ID NO: 52770 - DNA, 1563 bp, Artificial Sequence
  Description of Artificial Sequence: Synthetic coding sequence
atgagagtagaaagcgggtccgctcaggaacgtggtatccttctggagtcactctctacactactggagaagacaacagcatcccacgagggacgggctccgggtaatcgggaactgaccgacttgctgccacctgaggtatgctccctcttgaacccggcagctatctatgcaaataatgagatctccctgagagacgtagaagtttacggctttgactatgactatacgcttgcacagtacgccgatgcccttcatcccgagattttcagtactgcccgtgatattctcatcgagcactacaagtaccccgagggcatccggaagtatgactataatcccagctttgcgatccggggtctgcattacgatattcagaaatcgctgctgatgaagatcgacgccttccattacgtgcagttggggactgcctatcgcggacttcagccagtacctgatgaagaggtcatcgagctgtacggtggaactcagcacattcccttgtaccaaatgtccggtttctatggcaaagggccatcaatcaagcagtttatggatatcttcagcttacccgaaatggcactgctgtcatgcgtggtcgattatttcctggggcactcgctcgagtttgaccaagctcatctctacaaggatgtgacagatgcaattagggacgtccacgtcaagggtttgatgtatcagtggatcgagcaggatatggaaaagtatattcttcgaggtgatgaaaccttcgccgttctgagtcgcctggtggcgcacggcaagcagctctttcttatcacgaatagccccttctcattcgttgataaagggatgagacacatggtaggaccagattggaggcagctgttcgacgtcgtgattgtgcaggccgataaaccaagctttttcaccgatagacgcaagccattcagaaaacttgatgaaaaggggtctttgcagtgggacagaattacgcgacttgaaaagggaaagatctaccgccagggtaatctgttcgacttcctccgtttaacggaatggaggggcccacgggtgctttatttcggtgatcacctttactccgacctggccgacctgatgttgcgccacggttggcgtaccggcgcaattatccctgagctcgagcgtgagatccggataattaataccgagcagtacatgcattccctgacttggcaacaggccctcacagggctcctggagcggatgcagacctaccaggatgcggagtcaagacaggtgttagccgcatggatgaaagaacggcaggaactgcggtgcattaccaaggccctgttcaacgcccagtttggatcaatcttcagaacattccacaaccccacgtatttttcaagaagattagttaggttcagcgatctgtatatggccagtctgagttgccttttgaattacagggtagatttcactttctatcctcggagaacgcccctccagcacgaagccccactatggatggaccagctgtgtacggggtgcatgaagacaccctttctcggagacatggcacatatccgatag

SEQ ID NO: 52771 - DNA, 1386 bp, Artificial Sequence
  Description of Artificial Sequence: Synthetic coding sequence
atgcggagattagttcatgacttgcttccccctgaggtctgcagtcttctaaaccccgctgccatttacgccaacaatgagattagtcttcgcgacgtggaggtatacggatttgactacgattacactctggctcagtatgcagatgcactgcaccctgagattttttcgaccgcgagagacattttaatagaacactacaaatcgctgttgatgaaaattgacgcgttccactatgtacagctggggacagcatacaggggtctccagcccgtgcctgatgaagaggttatcgaattgtatggtggaacccagcacatcccactttatcagatgtccggattctacggcaaaggccctagcattaaacagttcatggatattttctccttaccggagatggctctgctgtcttgcgttgtagattacttcctggggcatagccttgaattcgaccaggcccacttgtacaaagacgtcacagacgctatccgagacgtgcatgtcaaaggactgatgtaccagtggattgaacaggatatggaaaaatacatattgagaggtgatgaaacttttgctgtcctgtctagactggtggcccacggcaagcaactgttcctgattactaatagtcctttctcctttgtggataagggcatgcggcatatggtcggtcctgactggcgtcagctgttcgatgtggtgatcgtacaggccgataaaccttcctttttcacggacagaaggaagcctttccgtaagctcgatgaaaaaggctccctccaatgggatagaattactcggttggagaagggcaagatctaccgtcagggtaatctgtttgacttcctgaggctaaccgaatggcgcggacccagagttctgtattttggagatcatctctacagcgacctggctgatctcatgctcagacatggctggagaacaggggcaataatacccgagctcgaaagggagatccgcattattaacacagaacagtatatgcacagcctgacttggcagcaagccctgaccggccttctggagagaatgcaaacttaccaggacgcggagagccggcaagtcctcgccgcttggatgaaggaacgccaggaactgcgctgtatcactaaggccctgttcaatgcacagtttggcagcatttttcgcacctttcataaccctacatatttcagtcgcaggcttgttaggttttccgacttatacatggccagcctgtcctgcctactgaactaccgggtcgattttactttctatcctagaagaacgccactgcagcacgaagcgccactttggatggaccagctgtgtactggttgcatgaagacccctttcctcggagatatggcccacattaggtag

SEQ ID NO: 52772 - DNA, 1674 bp, Artificial Sequence
  Description of Artificial Sequence: Synthetic coding sequence
atggcgggagccggtcttagggccgcagcccgaagatggctgctgtgcggtggacacggagggcctcgcgcagcgtcctcctccccctcatgtccgggatgcgggcctccaggtcccggtgcccactgccccggtgtcccccgaagcgcccctgcccaggccccaacatcaggcgctgacttatccgcccacttatgggcccgataccaagacatgaggcggcttgtacacgacctgcttcctccggaagtttgtagtctgttgaatccagccgctatctacgcgaacaatgaaatttcattgagagatgtggaagtatatgggtttgactacgattatacgttagcccagtacgccgatgcactgcatccagagatcttcagcactgccagggacatcttgattgagcactacaagtatccggagggcatcaggaaatatgactataatcccagctttgccattagaggcctgcattacgatatccagaagagcctgcttatgaagatcgacgctttccactatgtgcagctgggtaccgcttacagaggcctgcagccggtccctgacgaagaagtcattgagctgtacgggggtacgcagcacatcccactctaccagatgtccggcttctacgggaaggggccatctattaaacagtttatggatatattcagccttccagaaatggcccttctttcctgcgttgttgactattttctgggccacagtctagaattcgaccaagcccacctatacaaggatgtgacggacgctattcgagatgtccacgtgaagggacttatgtatcagtggattgagcaggatatggaaaagtacatcctccggggagatgagacctttgcagtgctctccagattagtggcccatggtaaacagctcttcctgatcaccaatagcccattttctttcgttgacaaggggatgcggcatatggtgggccctgactggcgccagttattcgatgtggtgatcgtgcaggcagataaaccatcctttttcactgacaggcggaagccgtttcgcaagctggacgagaagggctccctgcagtgggaccgtattacccgattggaaaagggtaagatctatagacagggtaatctgtttgacttcctgaggctgactgaatggaggggccctagggtgctgtacttcggggatcatctgtattcagacctggccgatttgatgctacgccacggctggcgcacaggcgctattattcctgaactggagagggaaatacgcattataaatactgaacagtacatgcactctttgacctggcagcaggctttgacaggcctcctggagcggatgcagacttatcaggacgcagaatcaagacaggtgctggccgcttggatgaaagagcgccaggagctgcgctgtataactaaagccctgtttaatgctcagtttggctctatcttcaggactttccacaatcctacgtacttctctcggagactggtgcgcttctccgacctgtatatggcttcattgagctgcctgcttaactatcgagtggactttaccttctacccaagacggacacccctgcagcacgaagctccactgtggatggaccaactgtgcaccggatgcatgaaaaccccctttctgggggatatggcccacattcggtag

SEQ ID NO: 52773 - DNA, 2538 bp, Artificial Sequence
  Description of Artificial Sequence: Synthetic coding sequence
atgagcgatgacattgactggctcaggagtcaccggggtgtatgtaaagtggacctgtacaaccccgagggacaacaggaccaggataggaaagtcatctgcttcgtggatgtgtcaacactgaatgtagaggacaaagactataaagacgcagccagttcatctagcgagggcaatctgaacctagggtctctggaggaaaaggagataattgtgatcaaagacaccgagaagaaagatcagtcaaagacagagggctccgtttgtctttttaagcaggcaccctctgatcctgtttccgtgctgaactggctgctctccgatctacagaaatatgcactcgggtttcagcacgcgctctcccccagcaccagcacctgtaagcataaggtcggggacaccgagggcgagtaccaccgggcttctagcgagaactgctacagcgtgtacgccgatcaagtaaacatcgattacttaatgaaccgaccacagaatctgcgacttgaaatgacggccgctaaaaacaccaataacaaccaatccccatctgcacccccagcgaaacctccatcgacacagagggccgtgattagccctgacggagagtgttccatagacgacctgagcttttacgtcaataggctctcatccctggtgattcagatggcacataaggaaattaaggagaagctcgaagggaaatccaaatgcttacaccattccatttgtccaagcccaggaaataaagagcggatctcgcccaggacaccagcttctaaaatcgcctctgaaatggcttatgaagctgtggagttgacggctgctgagatgcggggtacaggggaagaaagcagggagggtggacagaagtcattcctttattctgagctcagtaataaaagtaagagtggtgataaacagatgtcacagagagaatctaaggaattcgccgactccatttccaagggtcttatggtatatgctaaccaggtcgcttccgacatgatggtgtcgctgatgaaaacactgaaggtccatagttccggaaagccaattccagcatccgttgttctcaaaagggtcctgctccggcacactaaagaaatcgtcagtgacctgattgactcgtgtatgaagaacctgcacaacattactggcgtgctaatgacagattctgacttcgtgagcgccgtgaagaggaacctgtttaaccagtggaagcagaacgcaacagacatcatggaagcaatgctcaaaaggttggttagcgccctgattggcgaagagaaagagacaaaaagccagagtctgtcttacgcttctctgaaagctggcagtcatgatcctaagtgtcgaaatcaatcgctggagttcagcacaatgaaagccgaaatgaaggaacgagacaaaggcaaaatgaagtctgacccttgtaagtccctgacttccgccgagaaagtgggtgagcacatcctgaaggaaggactgaccatatggaatcagaaacagggaaatagctgtaaggtagccaccaaagcatgcagcaataaagatgagaaaggagaaaaaattaatgctagcaccgactcactcgcgaaggacctcatcgtttccgccctgaagctgatccagtatcacctaacccaacagaccaagggtaaagatacttgtgaagaagactgcccaggatccaccatgggatatatggctcagtcaacacagtacgagaaatgcgggggtggccagagtgccaaggccctcagcgtgaaacagctagagtctcaccgggctccaggtccatcaacttgccagaaggagaatcagcaccttgattctcagaagatggatatgtccaatattgtgcttatgctgatacagaagctgctgaatgaaaatcctttcaagtgcgaagatccttgcgagggggagaataagtgcagcgaacccagggctagcaaagctgctagtatgtccaataggagtgacaaggctgaggagcagtgtcaggagcatcaggagctggattgtacttcaggcatgaagcaagcaaatggccagttcattgacaaactcgtagagagcgtgatgaaactttgtttgataatggcgaagtacagtaacgacggcgctgctctggctgagctggaggaacaggctgcatcagcgaataagcccaacttccggggaacccgctgcatacactcaggcgctatgcctcagaactatcaggacagtctgggccacgaggtcatagtcaacaatcaatgtagcaccaacagcctacagaagcagttacaggccgtgctgcagtggattgccgcatcccagtttaacgtacccatgctgtacttcatgggcgacaaagacggacagctcgagaaactgccccaggtttccgccaaggcagcagaaaagggatattcagtggggggattactccaagaagtgatgaaattcgccaaggaacggcagcctgatgaggctgtggggaaagtggctagaaaacagctcctcgattggttgctggccaacttgtag

SEQ ID NO: 52774 - DNA, 1089 bp, Artificial Sequence
  Description of Artificial Sequence: Synthetic coding sequence
atggatgcccaggattgccaggccgctgcttccccagaaccaccgggacctccagcacgctcttgtgtggcagcttggtgggatatggtggatcgaaacttgaggtacttcccacactcttgctcaatgctgggcagaaagatcgctgcactgtacgactccttcacctccaagtctcttaaagagcatgtgtttctgcctctgatcgacatgctcatctatttcaatttttttaaagctccatttcttgtggatttaaagaagccagagttaaagattccacacacagtgaatttctatcttagggtcgagccgggtgtcatgcttgggatatggcacaccgtcccttcctgccggggtgaagatgccaagggtaaggattgttgctggtatgaggctgctctacgcgacgggaaccccataattgtctatctgcacggttcggccgagcatagagcggcttctcaccgcctaaagctcgtaaaggtgcttagcgacggagggttccacgttcttagcgtggattatcgaggctttggagattcgaccggtaagccaacagaagaaggactcacgaccgatgcaatctgcgtatatgagtggaccaaagcacgtagcggaattaccccagtttgcctgtgggggcacagcctcgggactggcgtggcaaccaatgcagccaaggtgttggaagagaaaggatgtcctgttgatgcaatcgtgctggaagccccattcaccaacatgtgggtcgcgtccatcaattatcctttactcaagatctaccgtaatatacccggatttttaaggactctcatggatgccctgagaaaggacaagattatcttcccgaacgatgagaacgttaaattcctgtcatcaccgctgctgatacttcacggggaagacgacagaactgtgcctctggaatacggaaaaaagttatacgaaatcgctcgcaatgcgtatcggaacaaagagcgggtgaaaatggtgatttttcccccagggtttcagcataatctcttgtgcaagagtcctaccctgctgataaccgtcagagacttcctcagtaaacagtggagttag

SEQ ID NO: 52775 - DNA, 858 bp, Artificial Sequence
  Description of Artificial Sequence: Synthetic coding sequence
atggatgctcaggattgccaggccgctgcaagtccagaaccgcctggtccccctgcacgctcctgtgtcgcggcatggtgggacatggtggaccgaaacctcaggcacacagttccttcttgtcgtggcgaggacgctaagggcaaagattgctgttggtacgaggctgctctcagggacggcaaccccatcatcgtctacctccatgggagtgctgagcacagggcagctagccaccgactaaagctggtcaaagtgctgtcagatggaggcttccacgtattgtccgtggattatagaggctttggcgatagcacagggaagccaacagaggaaggcctgactaccgatgccatctgtgtgtatgaatggactaaagcgagatcagggatcactccagtgtgcctgtgggggcattcacttggaaccggagtcgcaaccaacgctgcaaaagtgttagaggagaagggttgtcccgtggatgcaattgtcctagaggcaccctttaccaatatgtgggtggcctctatcaattatcctctactcaaaatttataggaacatccccggattcctgcgcaccttgatggatgctcttcggaaggataagattatctttccgaatgatgagaatgtgaaattcctcagctcccccctacttatcctgcacggagaggatgatcggaccgtgcctttggagtatggtaaaaaactgtatgaaatcgccaggaatgcatacaggaataaagaaagggtgaagatggtcattttccccccagggtttcaacataatctgctgtgcaaatcccccaccctgttgataaccgtgcgcgactttttgtctaagcaatggtcttag

SEQ ID NO: 52776 - DNA, 768 bp, Artificial Sequence
  Description of Artificial Sequence: Synthetic coding sequence
atgcttggcatatggcacaccgtgccttcttgtaggggcgaggacgctaagggaaaggactgttgctggtatgaagccgctctccgagatggtaatcccatcattgtctatcttcacggtagtgctgagcacagggctgccagccacagactgaaactggtaaaagtcttatctgacggcggatttcatgtcttgtctgtcgactacagaggtttcggagattccaccggaaaacctaccgaggaagggctcacaaccgatgccatctgtgtttacgaatggacaaaggccagatcaggcatcacccctgtctgtctgtgggggcactccctggggaccggcgtcgccactaatgccgctaaagttctggaagagaagggctgccccgttgatgccattgtccttgaggcaccctttacgaacatgtgggtcgctagcattaattatcctctgttgaaaatttacagaaacattccagggtttttaagaacattgatggatgccttaagaaaggacaagatcatttttccgaacgatgagaacgttaaattcttgagcagccctctgctgatcctgcatggcgaagacgataggaccgtgccgctggaatacggtaagaagctgtatgagatcgccagaaatgcttaccgcaataaggagcgggtgaagatggttattttcccccctgggtttcagcacaatttgctgtgtaaaagccccacactacttattaccgtccgggatttcctgtccaagcagtggagctag

SEQ ID NO: 52777 - DNA, 1410 bp, Artificial Sequence
  Description of Artificial Sequence: Synthetic coding sequence
atgtgcgtgatctgttttgtgaaggctttggtgagggtcttcaaaatttacttgacggcttcttatacttacccttttcgcggatggcctgtggcattcaggtgggacgacgtgcgggctgtgggcaggtcttcgtcacaccgggctcttacttgtgccgcagccgcagccggtgtgtggctgctacgtgatgaaaccctgggaggagatgccctgggacgcccacctagaggggctcggtctcaagcccagtgtctcctgcagcagctgagggaactgcctggccagttggctagctacgcactggcacattctctcgggaggtggctggtgtatcctggctctgtgagcctaatgactcgagccttactccccctgctccagcagggccaagaacggttggtggagaggtatcatggacggagagctaagctggttgcatgcgacggcaacgaaattgatacaatgtttatggaccggaggcaacatccaggctcccacgtgcacggtcctcggctggtcatctgctgtgagggcaatgccggattttacgaaatggggtgcctatcagcccctctggaggcaggctacagcgtgttgggttggaatcacccaggttttggtagcagtactggcgtacccttcccacaacatgacgccaacgccatggacgtagtggtggaatatgccctccatcgtcttcatttcccccctgcacatcttgtggtctacggctggagtgttggcggattcacagctacctgggccacaatgacatatccagaactgggtgcgctcgttctcgatgcaacatttgacgacctggtgccgttggccctcaaggtgatgccacattcttggaaaggcctcgtggtgcggactgtgcgggagcacttcaaccttaacgtggccgagcagctctgctgctaccctggcccagtgctcctcttaagaagaacacaggacgatgtggtgtccacatccgggagactgcgccctctctccccaggggacgtggaaggcaaccgtggaaatgagctcttgctccgattacttgagcaccgataccccgtcgtgatggccagagaaggaagagccgtggttacccgatggctcagagccggttctctggcccaggaggctgccttttatgctagatacagggtagacgaggattggtgcctggccctgctgcgctcttatagggctcggtgtgaggaagagctcgaaggcgaagaggcccttggtcctcacggtcccgcatttccctggctagtaggccaggggctgtcttccaggaggaggaggagactcgccttattcctcgctaggaagcacctcaagaacgtggaagctactcactttagcccactggaaccagaggaatttcagcttccgtggcgactctag

SEQ ID NO: 52778 - DNA, 1029 bp, Artificial Sequence
  Description of Artificial Sequence: Synthetic coding sequence
atggcagatgatctagaacagcagtcgcaagggtggctgtcatcatggctgcctacttggcggcctacaagcatgtcccagctgaagaatgtagaagcccgtatcctgcaatgtttgcagaataagttccttgcgcgatatgtctcactgcctaaccagaacaagatctggactgtgaccgtgagcccagaacagaacgacagaactccccttgtgatggtgcacggattcggcggaggagttggcttgtggattttaaatatggactcccttagtgcacgcagaacactccacacatttgatctgcttggttttggaaggtccagcaggccggcattccctcgagaccccgaaggagccgaggacgagttcgtcacatccattgaaacttggcgagagaccatggggattccttctatgattctgctgggtcactccctaggtgggtttctggcgacatcctattccattaaataccccgacagggtgaaacacctgatcttggtggatccatggggctttcctctgcgcccaactaaccccagcgaaatccgcgctccaccagcatgggtgaaggctgttgcttctgtcttaggacggagcaacccactggccgtcctcagagttgctggaccatggggaccaggactggtgcaaaggtttaggccagactttaaaaggaaatttgcggacttcttcgaagacgacaccatcagcgaatacatttatcactgcaatgcccagaacccgtctggtgaaactgcattcaaagcgatgatggaatcattcggatgggctaggagaccgatgctggagagaattcatctcatcagaaaggatgtcccgattacgatgatctatggcagcgatacctggattgatacatcaactgggaagaaggtaaagatgcaacggcctgacagctatgtccgggatatggaaattaagggcgcaagccatcacgtgtatgccgaccagccccacatctttaatgccgtcgtggaggaaatatgcgacagtgtggactag

SEQ ID NO: 52779 - DNA, 1320 bp, Artificial Sequence
  Description of Artificial Sequence: Synthetic coding sequence
atgctcaccggcgtcaccgacgggatcttttgctgtcttcttggtactccccctaacgccgtcggacctcttgaatcagtcgaaagttccgacggttacaccttcgtagaggtaaaacctggtcgagtcctgagagtgaaacacgccggtccggctccagccgctgcacctccaccaccgtcatctgcttcctctgacgccgctcagggagacttgtccgggcttgttcgatgccaaagacgtatcacggtgtaccgtaacgggaggttactagttgagaaccttgggagagcccctcgtgccgatctgctccacggccagaatggcagtggagagcccccagctgccttggaggtggagctggccgatcctgcaggctccgatggtagactagccccaggaagtgccggttcaggaagtggctcagggagtggtgggaggcggcgacgcgcaagacgcccaaaaagaacaattcacattgactgtgaaaagcggatcacttcatgcaagggcgcacaggccgatgtcgtattgtttttcatccatggcgtggggggatccctcgctatctggaaggaacagttggacttctttgtaaggctaggctacgaagtcgtagcacccgatctggctggacatggggctagctcagcacctcaagtcgctgctgcatacactttttacgcgctggcagaagacatgagggcgatctttaagagatacgcgaagaagcggaatgtgctcatagggcattcctatggagtgagtttctgcacgtttctggctcacgaatacccagacctcgtgcacaaagtgataatgatcaatggaggcggaccaaccgccctcgagccaagcttttgttctatatttaacatgcccacctgcgtcctgcactgcctgagcccctgcctggcttggtccttccttaaggccggttttgccaggcaaggcgcaaaagagaagcagttgctaaaggagggaaacgctttcaacgtgtcctcattcgtgctgcgtgctatgatgtctggacagtattggcctgagggtgacgaggtctatcacgccgaattaacagtgcctgtcctccttgtgcatggcatgcatgacaagttcgtccctgtggaagaagaccagagaatggcagaaattttacttctagcatttctgaagcttattgatgagggctctcatatggtgatgctggagtgtcctgagaccgtaaacactttactgcacgaattcctcctgtgggaaccggaacccagtcctaaggccttgcccgagccgctccccgctccacctgaggataagaaatag

SEQ ID NO: 52780 - DNA, 1158 bp, Artificial Sequence
  Description of Artificial Sequence: Synthetic coding sequence
atggcaacacctcccccttctagcgcctcatctgacgccgcacagggcgatctctccggcctggtgcgctgtcagagaagaatcaccgtgtaccgaaacggcaggcttttggtggaaaacttgggtcgggcaccaagggcagatctcttgcatgggcaaaatggatcgggagagcccccagccgctttagaagttgaactggcggatcctgctggaagcgatgggagacttgcacctggcagtgccggatctggatctggatcaggctccggagggagaaggcgtcgggcacggcgtcccaagcgcaccatccacatagactgtgagaaacgcattactagctgtaaaggggcacaggccgatgtggttctgttcttcattcacggcgtgggtggatccttagctatatggaaggaacagctagatttttttgtcaggttgggttacgaggtggtagctccagacctcgcaggccacggagcttcttcagctccccaggtggccgcagcctatactttttacgctttggccgaagatatgcgggctattttcaagcggtacgcaaaaaagcgcaatgtgctgattgggcacagctacggtgtgagcttctgcaccttcctggcccacgagtacccagatctcgtacacaaggtaataatgataaacggaggaggccctacagctctggagccctccttctgcagcatcttcaacatgccaacatgcgtgctgcattgcctgtccccttgccttgcatggtccttccttaaggctgggttcgctcggcagggggctaaagagaaacaattgctgaaggagggaaacgcatttaacgtgagctcttttgttctgagagctatgatgtctggtcagtactggcctgaaggcgatgaggtgtaccacgccgaattgaccgtgccagtcctccttgttcatggcatgcacgacaagttcgtcccagtcgaggaggaccagcgcatggccgaaattctgctcctggccttcctcaaactcatcgatgaagggagtcacatggtgatgttggagtgtcctgaaacagtgaatacacttctgcacgagttccttctgtgggagcccgagccatctcccaaagcactccccgagcccctgcccgcaccgcctgaggacaaaaagtag

SEQ ID NO: 52781 - DNA, 1851 bp, Artificial Sequence
  Description of Artificial Sequence: Synthetic coding sequence
atggaacttcggactcctggaactaagtggtcccctcaaggcatcggttccctgcggcgagtcgtatgggactattccacaccggagataagcctgttttccgaggagggcctgaaaggtgaacaggtaaagctgacggaggccctcaagaacagccaggggctggagaaaccattgcaggttgcttctgcgactgttagtgccggactctggctcttgtatcccaagcctctctttgaagatactccttatatactcgaacccggagaataccccacctccgaagcttggggcacatctgatcccagtgttggatccctaaagcccatgaggctggggtgcccctctgtcgagaaaccgggagaacctagggcggttgtttatgaagctccgggatttcagggcagaagctgggaagttagtagagatatctataacttgcagcaacctgaagattcacagtctcctcatctagcatcagtcggcagtctgcgtgtgctcggcggttgctgggtgggctacgagaaggagggtttccgcggacaccaatacctccttgaggagggagagtaccccgattggtcccattggggcggatacgacgagttattaacaagtctgagagtcattagaaccgattttggggatccagctgtcgtgttattcgaggctatggacttcgagggccatggcgtggaggtttccaaggccctgcctgatgttgagttggtccagcacgggccttcgactcaggccattcatgtactgagtggtgtctgggtggcttaccaagaagtgggattctctggagagcagtatgtgcttgaaaaaggggtgtatcgcaactgtgaggactggggcgcaggcaacagcactctggcaagccttcagcccgtgctgcaggtaggcgagcacgacctgcacttcgtctcgaagattcagctatttagcagaccggattttctaggcgatcacttttccttcgaggatgatcaggcagcgctgcctgcctcttttcgtccccagtcatgtcgcgtccatggcggaagttggattctatttgacgagaccaactttgagggcgaccagcacatcctgagcgaaggagaattccccacattgacagctatgggctgccttgctagcacagtgctggggtctcttcaaaaagtctctctgcacttttccgaaccttctatatttttgtacggactggaatgctttgaaggcaaggaaatcgaactgagcagagaagtgaggtccttgcaagccgaaggatttaacaatcacgtgctaagtgtcaggatcaagggcggaatctgggtgctttgcgaacattccgatttccgcggtagacaatggctcgtggggtcctgtgaaataacgaattggttaacctattcaggcactcagcgggtgggtagcctgtaccctatcaagcagaggcgcgtgtacttcagactatggaatgctgctctagggggattcctggcagtacctgatcacgtggaggacatgaaagcaggccgagtagttgtagcggacccacaagcaggcggttcctgtatctggtactacgaggatggtcttctcaaaaaccaaatggccccaactatgagcctccaggtgatcggacccccatcccctggctccaaggtagtactttgggccgagagcagactgcctaggcagacatggtccatcagcgaaagtggacacatctgcagccaaatgttcgagggacagatcctggatgtgaagggagggaggggctacgaccgcgaccatgtcgtgttatgggagcctgatgaggatagggctagccagatctggaccatccatgtgttgtag

SEQ ID NO: 52782 - DNA, 282 bp, Artificial Sequence
  Description of Artificial Sequence: Synthetic coding sequence
atggaggaagcagggggaccgatggccagggctaaggctagagtggacggtcccgttgacccaccagccgcaactgtgctgccaatggtaagaagcgaacatgttaccgtgcctggccagcctcccgcacccagcactaccagacggaaagatgtccccagccccggagtcgatagagtgtcaccctcacccggaggaaccccagcacctgtaccgactggggctgaggcctctacagagagtcagttggtgtcagatccgaccgaaggaaaaacatgctag

SEQ ID NO: 52783 - DNA, 2364 bp, Artificial Sequence
  Description of Artificial Sequence: Synthetic coding sequence
atgatgaagaagcacgttgctggcacgaaagggccacactccgagttaggcctggagttacaagggggtagtcggcctacttccaggctgggtggatccctgctgttcggctctctggtaccaaccgcaaaggaggcttcaacccccgaacccctgggcaccaaactgtccgctctgctgcctcatggagcgcctggactgagaaaagttcctggacaactacctttactgtgttcggaacggtcctcacctacagaaaaacttgcttgtagcttgccactagagggatggtcccctgccctgaagactcagggaaagctgaatacccggccaggaaaggttattttcttctccgagtctggatgccaaggtagtggcagagaagtgtggggagacattgttgatgcttcaggatgggctcctgtcgcctctattcgagtagtccgcggatgttgggtgctgtacgaagagccggagttcaggggccaaaagcttgtgttgccggagggagacatggagctgaggacacctgggaccaaatggagtccgcagggcattgggtcactcagaagggtggtgtgggactattctacgcctgaaatctctttattttccgaggaaggcctaaagggcgaacaggttaagttgacagaagcgcttaaaaatagccagggtctcgagaaacctctacaagtggcaagcgcaacagtttctgctggtctgtggctcctctatcctaaacctctgtttgaggacacaccatatatacttgagcccggagagtatccaaccagcgaagcctggggaactagcgaccccagcgtcgggtccctgaagcccatgcgtctgggatgcccttccgtagaaaagccaggtgaacccagggctgtcgtgtacgaggcaccaggcttccaggggaggtcttgggaggtcagtcgggatatttataatttacagcaacctgaggactcccagtccccacacttagcctctgttggctccctgcgggtcctcggaggctgttgggtcggctatgagaaagaggggttcagaggccatcaatacctgctggaggaaggcgaataccccgactggagccactggggcggttatgacgagctactcaccagcctcagggtgattaggactgacttcggagatccagccgtcgttttattcgaagcaatggatttcgagggacatggagtagaagtttccaaagcactcccagatgtggaactcgtgcaacatggtccctccacacaggccatacatgtattaagcggcgtatgggtggcgtaccaggaagtgggtttctccggcgaacagtatgtgctcgaaaaaggagtgtatcggaactgcgaagactggggcgctggtaattctaccctcgcctctcttcagccggtgctgcaggttggagaacatgacctccattttgtttcaaagatacagctgtttagccgtcccgacttcctgggcgatcactttagcttcgaggacgaccaagccgctctgcctgcctcattccgcccacaaagctgtagagtacacgggggaagctggatcctattcgacgaaaccaattttgagggagaccagcacatactctcagagggggagttcccaactttaactgctatggggtgtttggcctcaacagtgctgggttccttgcagaaggtgtcgctccatttttccgaaccgagcatcttcctttacggattggagtgctttgaagggaaagagattgagctgtcacgcgaggtgcgaagcctccaggcagagggctttaacaaccatgtgctgtccgtcagaatcaagggcggtatctgggtgctgtgtgagcattccgattttcgcggtagacagtggttggttggaagctgtgagatcacgaactggttgacgtacagtgggactcagcgagtcggtagcttgtatcccatcaagcagcgacgcgtgtacttccgcttgtggaacgccgctctgggagggttcctggccgttcctgaccatgtcgaggacatgaaggccggtagagttgtcgtggccgacccacaagccggtggatcatgcatctggtattatgaagacggactgctgaaaaatcaaatggcgcctacaatgtccttgcaggtgatcggccctccctctcccggtagcaaagttgtgctctgggcggagtccagactgccccgacagacctggtcaataagcgaatcagggcatatatgtagtcagatgtttgaaggacagatcctggacgtaaagggaggtaggggctatgaccgcgaccatgtcgtgttatgggagcctgatgaggacagagccagtcagatctggaccatccatgtcctctag

SEQ ID NO: 52784 - DNA, 1224 bp, Artificial Sequence
  Description of Artificial Sequence: Synthetic coding sequence
atggaagaggcaggcggaccgatggcgagagcaaaggcacgcgttgtcagtgctaccctgacatggaggcaacgcccaccaactcaggaggagattaaacacggctttcacaaggtttccctggtgagcggagcgcagatggaagctccgcagaaagagatgttcgagttctcgagaagagaagaggtagaggtgaatggcttcgccactcaagaggaggagactgtgaactgtcagggcccaagggacaccgcgggttctaagaacttccagagtcatggccctatatttagcaagaaatatataccaccccctaaggagaaacgccctgagggtagactcaaggaggcagttgaccagtccgacggtagtagacaagccccacggacagagcctccgtgcgtcggagctatggcccgaaccgagttgctcgtcccactgcctggccctagggagcctagtccccacccaggcgtcggccttacatctgggtcttctcgcagcctcgaagagtatcgtgtcacccgcactgtgcgaaccactactgttgtagggggtcacgtggaccgaaggatgtccagctccgtgactgttcgacctgttagttcaggagaagccctgccaagaggccgacaggtcagtcggatggtgccaccggtggtggtagggagtcctcccggttcacccagccggtctcaggcagtcaaggttctgagtaatctggtgcccgcagggcattccccacctgctagccatttgcctcggccaaccgcaggaggcccaagaagcactggtctgggtagcaccgtgggagcagcccttcgccagctccctgaaactgggaccgctgagctcaaggactcttctgccctcgctagcaccggaattcccgctagcgctcacctgcccaagaaccaggacgcgcctgccgcatgtcccgaccgggatcagggcagggccccagacgctcgcgcttgtgagctgtggcaggtgttaggagccccatcctcaactgagctgccgcttcagacatcacagggccaagctagcgttccttcatcacctcgccttgagacacatgttccctcaccaggactgacccatcccgcaaagcagccggtggtgcccacgcacccaggtgcacggcttacaccgctggtcttgcccccaaagaaacggactgggccatggaccccacttctcccgccttcctgcccatggtag

SEQ ID NO: 52785 - DNA, 1128 bp, Artificial Sequence
  Description of Artificial Sequence: Synthetic coding sequence
atggaggaggagatcgctgcactagtaatcgataacgggtcaggcatgtgtaaagcaggcttcgctggggacgatgcccctagggccgtttttccaagcatcgtggggaggccgcgacatcagggggttatggtcggaatgggccagaaggactcctatgttggggatgaggctcagagcaagaggggcattctgacgcttaagtaccctattgagcacggtatcgtaactaattgggacgacatggagaaaatttggcaccatacgttttacaacgagctccgcgttgctccagaggagcaccccgtattactgacagaggcccctctcaacccaaaggcaaaccgcgaaaagatgactcagataatgttcgaaacatttaatactccagctatgtacgtggccatacaggcagtgttgagcctgtacgcaagcggacgcacaactgggatcgtgatggactcgggcgacggggtcacacacactgtcccaatctatgaaggctatgccctaccccatgcaatattgcggctggatctcgccggtagagacctcaccgactaccttatgaagattctcaccgagcgaggctacagctttacaactaccgccgagagggagattgtccgggacattaaggagaagctctgctatgtggccctcgattttgaacaggaaatggccaccgcagccagcagtagcagtctggaaaaatcatacgagctcccggatgggcaggtcattacaattggtaacgaaaggttccggtgccccgaggccctgttccaaccatcctttctgggcatggagagttgcggcattcacgaaacgactttcaactctattatgaaatgcgatgtcgacatcaggaaagacctatacgcgaataccgtgctcagcgggggaaccacaatgtacccgggaattgctgacaggatgcaaaaggaaatcactgcactggccccatcaaccatgaagatcaagattatcgccccacctgagaggaaatactctgtctggattggcggtagcatcctagcatcgctgtctaccttccaacagatgtggatcagcaagcaggaatacgacgaatcagggccaagtatagtccacaggaaatgtttttag

SEQ ID NO: 52786 - DNA, 1128 bp, Artificial Sequence
  Description of Artificial Sequence: Synthetic coding sequence
atggaggaggaaatagcagcactggtaattgacaatgggtccgggatgtgcaaggctggattcgcgggagatgatgcgcctagggccgtgtttccttcgatcgttgggaggccacgccaccagggtgtcatggttggcatgggccagaaggattcttatgtcggagacgaggctcagtcaaaaagagggatactaaccttaaagtacccgatcgagcacggcattgtgacaaattgggacgacatggaaaagatttggcatcatacattctacaacgagctgagagtggcgcctgaagaacacccagtgctcctgactgaagctcccctgaaccctaaggctaaccgtgaaaaaatgacccagatcatgtttgaaactttcaatactcctgctatgtacgttgccatccaggcagtgctgtcattgtacgcctcagggcgaacaactggtattgtgatggacagcggcgacggtgtaacacataccgtgcctatatatgaaggttatgccttgccccatgcgattttgcggctggacctggctggacgggatttgacagattacttgatgaaaatccttacagaacggggatatagcttcacgactacggcagagcgcgagatcgtgagagacatcaaagagaaactctgctatgttgctctggattttgaacaggagatggccacagccgcttcctcttcatctttggagaaatcctacgaattacccgacgggcaggtcataactattgggaacgaaagattcagatgccccgaggctttgttccaaccgagctttctggggatggagtcctgcggcatacacgaaactacttttaatagcatcatgaagtgcgacgtcgatatcaggaaggatctatatgcaaatacagtgttgagcggaggcaccacaatgtaccccggaatcgcagatcgtatgcagaaggaaattactgcccttgccccttcaacaatgaagattaaaatcatagcaccaccagagcggaagtattctgtttggatcggtggcagtatactggcgagcctgtctactttccagcaaatgtggatttccaagcaggaatatgacgaaagtgggccaagcatagttcaccgtaagtgtttctag

SEQ ID NO: 52787 - DNA, 1026 bp, Artificial Sequence
  Description of Artificial Sequence: Synthetic coding sequence
atgggaacagaaaaggagtcccccgagccggattgtcagaaacagttccaggccgctgtgagtgtaattcagaatctgccaaaaaacgggtcctatcgccctagttatgaggagatgctgcgcttttacagttactacaaacaagccaccatgggcccatgtctggtgccaaggcccggattttgggatccaattggacggtacaagtgggatgcttggaattcgctcgggaagatgtcccgcgaggaggccatgagtgcatacattactgaaatgaaactggtggcccagaaggttatcgatacggttcctctgggcgaagtggcagaggatatgtttgggtacttcgaacccttatatcaggtaatacctgatatgcctcgtcctcctgagacatttctgcggagggtaaccggctggaaggagcaggtggtgaatggtgatgtcggagccgtaagcgaacctccttgcctgcctaaggagcctgcacccccaagtccagcgtctctgtgggcagtcaccctgcccactccgccacagtcccccatccaccccggtacctggacccccaggttttcagtaatcccttggtcaagttggtctctgagttggtttggacagtcttcaggtcagcatctcgaggaatcagtgattcctggtacagctccctgccctcctcagagaaaaagggggtgtggcgcagcgaggcgaggacccagaagttggacatgtgggtgttggggacaattcgagcattaccgaagggcttgtagacgttgccgaaggggctgtagggcctggcgcgcatgcccgggacccctgtcgcgaggtcgctcacccggtcccgtacttgggcatggccctctgggcagtcggggtcctcgctgttcttcgagttcttgcgggcctagttcatcttccgggtcatccgagtgcttcggccctaagcggggagactgtcaatggcggggtctgtgtagccagctcagactaagctgctgtgcactgtctctgcctcgggtgtag

SEQ ID NO: 52788 - DNA, 807 bp, Artificial Sequence
  Description of Artificial Sequence: Synthetic coding sequence
atgggaacggagaaagaatctccagaacctgactgccagaaacaattccaagccgctgtttctgtgattcagaacctgcctaagaatggttcttacagaccttcctacgaggaaatgcttcgattttatagctactataagcaggccacgatggggccatgtttagtaccgagacccggattttgggaccccatcgggagatacaaatgggatgcttggaatagcctgggcaagatgtccagagaggaagctatgtcagcctatattacagaaatgaagctggtggctcagaaagtaattgacaccgttcccctgggcgaggttgctgaagatatgtttggatatttcgaaccgctataccaagtcattcccgacatgccccgtccgcctgaaactttcctacgcagggtgacgggctggaaagagcaggtggtaaacggggacgtgggtgcagtcagcgagccaccatgtctgcccaaggaaccagcaccgccatcccccgagtcacactctcctagggacctcgatagcgaggtgttctgtgacagccttgagcagttggagcctgaactttcatccgggcaacacctcgaggaatctgtcatccctggtaccgcgccttgcccaccacagaggaagaggggatgcggtgccgctaggagaggcccaagaagctggacatgcgggtgctggggccagttcgagcactataggcgcgcttgtaggagatgtcgcagaggctgtagggcttggagggcttgtcccggacctctgtcaagcctgaccctgtctgtccgcctagaatag

SEQ ID NO: 52789 - DNA, 918 bp, Artificial Sequence
  Description of Artificial Sequence: Synthetic coding sequence
atggggaccgagaaggaatctccagaacccgattgccagaaacaatttcaggctgctgtttctgtcatacaaaacttgcccaagaatgggtcgtacagaccctcttatgaagagatgttacggttctacagctactacaagcaggctacgatgggcccatgtctcgtgccacggccaggcttttgggacccgatcggccgttataagtgggacgcctggaacagccttggtaagatgtcacgcgaagaagcaatgtctgcttatattaccgagatgaagcttgtggcacaaaaggtgatcgacactgtacccctgggagaagtggcagaagacatgttcggctattttgagcccctctatcaagtgattcctgacatgccgcgaccgcctgagacattcctgcggcgtgtgacgggatggaaggaacaggtggtgaacggagatgttggtgccgtcagcgaacccccatgtctgcctaaggagccagcccctccatcgccagagtcccatagccctagggatctggatagtgaggtgttttgcgactccctggagcagctagagcctgaactcgtatggacagaacaaagagctgcttctggaggaaaacgcgaccccaggaactctcccgtccctcccacaaagaaagagggactcagggggtcgccacctggtccccaggagctcgatgtctggctcttaggaaccgtccgggcactgcaggaaagtatgcaagaggtccaggccagggttcagagcttagagtccatgccaagaccacccgagcaaagacctcagccccgacccagcgcccgaccgtggcctctgggtctgcctgggccagcactactattctttctcctttggccatttgtggtgcagtggctgttccggatgttccggacacagaagaggtag

SEQ ID NO: 52790 - DNA, 1026 bp, Artificial Sequence
  Description of Artificial Sequence: Synthetic coding sequence
atgggtaccgagaaggaatcacccgagcctgactgtcaaaaacagttccaagccgctgtttccgtgattcaaaatcttcctaagaacggctcctatcgacctagttacgaggaaatgttgcggttctatagttactacaagcaagccacaatgggtccctgcctggtgccaagacccggtttttgggatcctattggcaggtacaaatgggacgcttggaattccctggggaaaatgagcagagaggaggccatgtccgcttacatcaccgagatgaaattggtggcgcagaaggttattgacacagtgcccctgggcgaggttgctgaagacatgttcggatacttcgagccgctgtaccaagtgattcctgatatgccccgaccacctgaaaccttcctgaggcgggtcactggctggaaagaacaagtggtgaatggcgacgtgggcgcagtctcagaacccccatgtctgcctaaggaacctgctccgcctagccctgcatcattatgggcggtaacactccccactcctcctcaatcccccattcatcctggaacatggaccccacgattcagtgttattccttggtcgagttggagcctgagctggttcgggcagagcagcggccaacacctggaggagtctgttatccccggtaccgcaccatgtccccctcagaggaagcgcggatgcggtgccgctagacgtggtcccaggagttggacatgcggctgctggggacagttcgagcattacagacgcgcttgccggaggtgtcgtagaggatgtcgagcctggagagcttgccccggacctctgtccaggggtcgcagccctggtccagtgctgggccacggccctctaggatccagagggccacgctgctcatcttctagctgcgggcctagctccagctccggctcatctgaatgtttcggcccaaaaaggggcgattgtcaatggaggggcctttgttcacaactccgcttgagctgctgcgccctcagtctgccgcgtgtgtag

SEQ ID NO: 52791 - DNA, 267 bp, Artificial Sequence
  Description of Artificial Sequence: Synthetic coding sequence
atggccctgcaagcagacttcgacagggccgctgaggatgtgcgcaagcttaaagccaggccagatgatggcgagctcaaggagctttacgggctgtacaagcaggccatcgtcggtgatattaacatcgcctgtcctggtatgctggacctgaaaggcaaggctaaatgggaagcttggaatttgaaaaagggattatctaccgaagatgctacatcagcctatatcagtaaagccaaggagctgattgaaaaatacggcatttag

SEQ ID NO: 52792 - DNA, 3180 bp, Artificial Sequence
  Description of Artificial Sequence: Synthetic coding sequence
atgtgtgtacggtcttgttttcagtctccgcgtctgcagtgggtctggcgaaccgcgtttctgaagcacacccagcggcgacaccagggctcccatcggtggacacatctggggggatcaacatatagggccgtcattttcgacatgggaggggtcctgattcccagtccaggccgagttgcggctgagtgggaggtccagaatcgcatcccaagtgggactatcctgaaggccctcatggagggcggtgaaaacggtccctggatgaggtttatgcgcgctgagattacagcagagggcttcttgcgcgagttcggacggttgtgctctgagatgcttaaaacgtccgtgcccgtcgattcattcttctccctgctgacctcggaacgcgtggccaaacagtttcctgtgatgacggaggcgatcactcagatcagggctaagggactgcagacagcggtcctgtcaaacaacttttaccttcctaaccagaagtctttcctgcccctggatcgcaagcagttcgacgtgatcgttgagagctgtatggagggcatttgtaagcctgatccccgaatttacaaactgtgcctggagcaattggggcttcagccgtcagagtcaatctttctggacgacctgggaacaaatttaaaggaggccgcaaggttgggaatacacaccataaaggtgaatgaccctgagaccgccgtaaaagaactggaggcactgctgggctttaccctgagggttggagttcctaacactaggccggttaagaagaccatggagattcctaaggattcattacagaagtacttaaaggacctgctaggtattcagaccacaggacccttggagctactgcagttcgaccacggccagtccaatccaacctactacatccgactggccaacagggatctggttttgcgcaagaagccccctgggaccctactcccgtccgcccatgcgatcgagagagagtttcgcatcatgaaggccctggcaaatgccggagtgccggtgcccaatgtcctagacctgtgcgaggattctagcgtgatcgggactccgttctacgtcatggagtactgtccgggattgatttataaagacccaagtttgccaggtctggaaccctctcaccgccgtgccatatacactgccatgaacacagttctatgcaaaatccattcagtcgacctacaggccgttggtctcgaggactatgggaaacagggcgactatattccacggcaagtaagaacatgggtcaagcaataccgagcttcggagacttctacgatcccggcaatggaacgattgatcgagtggctccctctgcacttacctcgccaacagcggaccaccgtcgtgcatggagattttaggttggacaacctggtgtttcatccagaagagcccgaagttctggccgtactcgattgggaactgtcaacactcggtgaccctctcgccgatgtggcctactcttgcttagcacactatttgccaagttcatttcccgttctccgcggaattaatgactgcgatctcacccagttggggattcctgcagcagaggaatacttccgtatgtattgcctgcagatggggttgccgcctaccgagaattggaatttttatatggccttctctttttttcgcgtcgcagctattctgcagggggtgtataagcggtccctcacaggacaggcgagctctacctacgctgaacagacaggtaaactgaccgagttcgtgtccaatttagcgtgggacttcgcagtcaaggaggggtttagagtattcaaagaaatgccttttacaaatccacttacgcgctcttatcatacttgggccaggccccaaagccagtggtgccccactggatccagatcctactcttctgtgcccgaagcatctccagcccacacatccaggggcggtcttgtgatctcccccgaatcgttgtcaccgcctgtgcgggaattgtaccacaggctcaagcattttatggagcaaagggtgtatcccgcagaaccggaactacagagccatcaagcctccgccgcacgctggtccccatcacccctgattgaagatctaaaggaaaaagctaaagccgaaggcttgtggaatctgttcctgcccctggaagccgaccccgaaaagaaatatggcgctggactgaccaacgtcgagtatgcacacttgtgcgaactgatggggacgagcctgtatgcaccagaagtgtgtaactgtagtgcacctgatactggaaacatggagctgttggttcgctacggaacagaggcccagaaggcccgatggttgattcccctgctagagggaaaggcgcgttcctgtttcgctatgactgaaccacaagtggcatcatccgatgctaccaacattgaggcctccatcagggaggaagacagcttctatgtgataaatgggcacaaatggtggataactggaatactagatcccagatgccagttgtgcgtgtttatggggaagacggatccacacgcccctcggcacaggcaacagagcgtgctgctggtccccatggatacccctggcattaagatcatacgcccacttacagtgtacggcctcgaagacgctcccggagggcatggcgaggtgcggtttgagcacgtccgcgtgcccaaggaaaacatggttttggggcctggtaggggcttcgagatcgcccaagggagacttggccctggccgaatacatcactgcatgcgactcatcgggttttccgaacgtgcactcgcccttatgaaggctagggtcaaaagcaggttggccttcggtaagcctctggtggagcagggaaccgtactcgctgatattgcccagtcgcgcgtggaaatcgaacaggccagacttctggtgctacgagcagctcatctgatggaccttgcgggtaataaggcagccgctttggatattgccatgattaaaatggtcgcaccttctatggcctctagggtgatcgatcgggcaatccaagcctttggggctgcgggtctttcttcagattatccactggcacagttttttacatgggctcgggctctgaggtttgcagatggtcctgatgaggtgcaccgggctaccgtagcgaagttggaactgaaacataggatctag

SEQ ID NO: 52793 - DNA, 1479 bp, Artificial Sequence
  Description of Artificial Sequence: Synthetic coding sequence
atgctagagtacctctcactgactttcctgatcagtgtcaagatccagggggactacattcctcgtcaggtacggacatgggtaaagcaatatagggccagcgaaacatccaccattccagcaatggagcggctgatagaatggctacccctgcacctgccaagacagcaaagaaccacagtagtccatggggattttcgactggacaatctggtctttcaccccgaggaaccagaggtgctggcagtccttgactgggaacttagcaccctcggcgaccccctggctgatgtggcatattcctgcctggcccattacttaccttcctcctttcccgttctccggggaatcaatgactgtgacctgacccagttgggcatccctgccgcagaggagtattttcgcatgtactgcctccagatggggttacctcctaccgagaactggaatttctatatggcattttctttttttcgggtggcggcaattcttcaaggcgtgtacaagcgctcattaacaggacaggcgtctagtacttatgctgagcagaccggaaagctaaccgagttcgtgagcaaccttgcgtgggattttgctgtcaaggagggttttcgggtgttcaaggaaatgccctttaccaatccactcacccggtcgtaccacacctgggccagaccccagtcacaatggtgccctacagggtctcgcagttacagtagcgtcccagaggcctctcccgcacatacaagcagagggggactggtgatttcaccagagtctctttccccccctgtccgcgagctgtaccatcgactgaaacattttatggagcagagggtgtatcccgctgagcccgaattacaaagccatcaggcttctgcggcacggtggagcccatccccactgatcgaagatctgaaggaaaaagccaaggccgaggggctctggaacctcttcctgcctctcgaggcagatcccgaaaagaagtacggtgccggtctaacaaacgtggagtacgctcatttatgcgaattgatgggtaccagtctatacgcccctgaggtgtgtaactgctccgctccagacactgggaacatggagcttttggtgcgttacggcaccgaggcccaaaaggccagatggctgatccctctgctcgaagggaaagctcggtcctgtttcgcgatgacagaacctcaggtcgccagttcagatgcaactaacatcgaggctagcattcgcgaggaagactctttttatgtgatcaacggtcacaagtggtggattactggaatacttgatccccgatgtcaactttgtgtgttcatgggcaaaactgatcctcatgcgccacgccatcgacaacagtccgtactgctcgtgccgatggatacacctgggattaagattatccgccctcttacagtctacggcctggaagacgctcctggctgttttctgccaagcttctcactgtag

SEQ ID NO: 52794 - DNA, 2673 bp, Artificial Sequence
  Description of Artificial Sequence: Synthetic coding sequence
atgtgtgtaagatcctgttttcagtctcctcgcctgcagtgggtgtggcgtaccgccttccttaagcatacccagagaaggcatcaaggctcacatcgctggacccacctggggggtagcacatatcgggctgtgatctttgacatgggcggtgtactgataccctccccagggcgagttgcagcagaatgggaggtgcagaatcgtatacccagcggaaccatcttaaaagccctgatggaagggggagagaatggaccatggatgagattcatgcgcgctgagatcacagcagagggatttctgagggagtttggccgactctgctcagagatgctcaagacctccgtgcctgttgattcatttttctccttgctcacttcagaacgggtggcgaaacagtttcccgttatgacagaggccattactcaaatcagggcaaaaggcctgcagaccgccgttctctccaacaacttctacttacctaaccagaagtccttcctgccgctcgatagaaaacagttcgatgtaatcgtggaaagttgcatggagggaatttgcaaacccgatccaaggatatataagctgtgcctggaacaattgggtctccagccatcggaatctattttcctggacgaccttggaacaaatctcaaggaagcagccaggcttggaatccacacaatcaaagtcaacgatccggagactgcagtaaaggagttggaggcactgctgggattcacactacgggtgggggtgccaaatacgcggccagtcaaaaagaccatggaaatacctaaagacagtcttcagaaatatctcaaagacctgctggggattcagacaacaggtcctctagagcttctacagttcgaccacggacagtcaaatccaacttactacatcaggttggctaacagagaccttgtacttagaaagaaacctcctgggaccctgctgcccagcgctcacgccatcgagagagagttccgcatcatgaaagccctggcaaacgccggtgtgcctgtacccaacgttctcgacctatgtgaggactcatccgtgattgggacacccttttacgtaatggagtactgcccagggctgatctataaggatcctagcctgcccggacttgaaccatcccaccgtagagccatctacacagcaatgaataccgtgctctgtaagatacatagcgtggaccttcaggctgttgggctggaggactatggtaagcagggtgactacatccctaggcaggtgagaacttgggtgaagcagtaccgggctagcgagactagtaccatcccagcaatggaacgccttatcgagtggttgcccctgcacctcccaagacagcaaaggaccaccgtggttcatggtgacttcaggcttgacaatttggttttccatccagaagagcccgaagtcctcgccgtgctcgattgggagttgagtaccttgggtgatcccctagctgatgtagcctattcatgcctggcccactaccttccgagcagtttccctgtgcttcgtggaataaatgattgcgacctgacccagcttggaatcccggctgcagaggagtatttcaggatgtactgtctgcagatgggtttgccccctactgagaactggaatttctacatggctttctccttctttcgggtggctgccatactgcagggcgtttataaaagatctcttacaggccaggcctcctcaacctacgcagaacagacaggaaaacttacagaatttgtttctaatctcgcttgggattttgcagtgaaggaaggatttcgcgtgtttaaggaaatgccttttaccaatccacttacaaggtcttatcatacttgggcaagacctcaatcgcaatggtgccccaccggaagccgaagttatagctcagtacctgaagcgagccctgcgcatacctccaggggaggcctggtgatttcaccagaatctctatcccctccagtgagggagctctaccatagacttaaacactttatggagcagcgggtctacccagccgaaccagagctccagagtcatcaggcctccgcagcacggtggtcacctagcccactcatcgaggacctgaaggagaaggcaaaggcggaaggcctatggaatctgtttcttccactggaggccgaccctgagaagaaatacggggctggcctgacaaatgtggagtatgctcacctgtgtgaactgatgggcaccagcctatacgcgccagaggtctgcaactgttcagcacccgacacaggtaatatggagcttctagtgaggtacggaacagaggctcagaaagctcgatggcttatcccattgcttgaaggaaaggccaggagctgttttgccatgacagagccccaggtggcctcatcagacgccacaaatattgaagcaagtatccgtgaggaggattctttttatgtgatcaatgggcacaaatggtggatcacaggaatactggatcccaggtgccagctttgcgtgttcatgggtaagactgatcctcacgcaccaaggcaccgacagcagagcgttctcctggtgccgatggatacacccggaatcaagatcattcgtcccctaacagtatatggcctggaagacgcccctggatgcttcctgccatcgttttctctgtag

SEQ ID NO: 52795 - DNA, 3273 bp, Artificial Sequence
  Description of Artificial Sequence: Synthetic coding sequence
atgtgtgtgaggagctgctttcagtctccacggttgcagtgggtgtggagaaccgcttttttgaagcacacccagcgcagacaccagggctcccaccggtggacccatttggggggatctacctatagggcagtaatctttgacatggggggagttttaatcccttctccgggtcgcgtcgccgcagagtgggaggtgcaaaacaggatcccaagcgggacaatattgaaagccctcatggagggcggagagaacggaccttggatgcgattcatgcgcgcagagataactgccgaggggttcctcagggaattcgggagattgtgcagcgaaatgctcaagacaagtgtacccgttgatagcttcttttcgcttctaacctctgagagagtggcaaagcagtttcctgtaatgactgaggctatcacccagatacgcgcaaagggcctgcaaacagcagtcctctccaataatttctacctccctaaccaaaagtcctttctgccactagatcgtaagcagtttgatgtaattgtggagtcttgcatggaaggcatctgtaagccagaccccaggatttataagctgtgcctggagcaacttggattgcagccaagcgagtccattttcctcgacgatctgggcaccaacctcaaggaggcagcaaggttgggaatccatacaattaaacggcagggcttcgccgtgcttcccaagctggtcagcaactcatgggcacaggcgatttatcccccatatccacctaaggtcgtgagactgcaggtgaatgacccagagactgctgttaaggagctcgaggcgttactgggcttcaccctgcgggtcggggtccccaatacaagaccagtgaaaaagaccatggaaatcccaaaggactctctgcaaaagtacctgaaggacctgttgggcatccaaaccaccggccctctcgagctgttacaatttgatcatgggcagtctaatccaacgtattacattaggctggctaatcgagatttagtgctgaggaagaagcctccagggactctgttaccctccgcccacgcaattgagagagaattcagaatcatgaaagccctcgccaatgcgggagtacctgtaccaaacgtattagacctatgtgaggatagctctgtcatcgggactcctttttatgtgatggagtactgccctgggctcatctacaaggacccttcactcccgggtttggagccttctcacaggagagccatctacaccgccatgaacactgtgttgtgcaaaattcattctgtggaccttcaagccgtggggctagaggattatggaaagcagggagattacatccctcgacaggtgaggacctgggtgaagcagtaccgagcaagcgagacctctactatccctgcgatggagcggctcatcgaatggcttcctctgcacctaccaagacagcagagaaccacagtggtgcatggcgacttccggctcgacaatctggtttttcaccccgaggaacctgaggtgctcgccgtgttagactgggagctttcgactctgggagatccattagctgacgttgcctactcttgtttagcccactaccttccctcatcctttcccgtactgcggggtattaacgattgcgatctcacccagttggggatccccgcagcggaggagtactttagaatgtattgccttcagatgggcctgccaccaactgaaaactggaacttctacatggcgttttctttttttcgcgtggctgccatcctgcagggcgtctacaaacggtctctcactggacaggcaagcagcacatacgccgagcagacgggcaagctgaccgagttcgtctcgaatctggcatgggacttcgcagtgaaggaaggtttcagggttttcaaggagatgccattcacaaatcctttgacacgttcctatcacacttgggccaggcctcaatcacagtggtgtcctactggctcaaggtcgtatagctctgttccggaggcctccccagcccacacatcccgaggagggctggtgatttctcctgagagcctttctcccccagttcgagaactgtaccaccgtctgaaacattttatggaacagagggtgtatcctgcagagccagagctgcagagccaccaagcatccgccgcaaggtggtcccccagtccattaattgaggatctcaaagagaaagccaaagccgaagggttatggaacctattcttgccgcttgaagcagatcccgagaagaagtacggggctgggctgacaaatgtggagtacgcgcatctgtgcgagttgatgggtaccagcctatacgcacctgaagtctgtaactgtagtgccccagataccgggaacatggagcttctggtgcggtacggaactgaagcgcagaaggccaggtggctaattcctttgctcgagggtaaggcaagaagttgtttcgccatgactgagcctcaggtagcttcctcggatgcaactaacatcgaagcgagcattagagaggaggactcattctacgtgataaacggccacaagtggtggattaccggcatactggacccacggtgccaactctgcgtgtttatgggaaagactgacccccacgctcctcgtcacaggcagcaatccgtgctattggtgcccatggatacacccggtattaagatcattagacccctcactgtgtacggcctggaggacgcgcctggcggtcacggagaggtgaggttcgagcacgtccgcgtgcccaaagaaaacatggtgctgggtccgggacgcggatttgagattgctcaaggtcgactggggcctggacgtatccatcattgcatgagactaatcggatttagtgagcgagccttagcgttgatgaaagcaagagtcaagtctaggcttgcattcgggaagccactggtcgagcaggggactgtgttagccgatattgcacagtctagggtcgagatagagcaggctaggctgctcgttctgagagctgctcacctgatggatttggcaggaaataaagccgctgctctcgatatagccatgattaaaatggtggccccatccatggcatcacgtgtaattgatcgcgcaatccaggcttttggagccgcaggtttgtcttccgattatccactggctcagttcttcacttgggccagagcgctccgctttgctgatgggccagatgaggtccaccgggctactgttgccaagctggagctgaaacacaggatatag

SEQ ID NO: 52796 - DNA, 291 bp, Artificial Sequence
  Description of Artificial Sequence: Synthetic coding sequence
atgtgcgtgaggtcgtgtttccagtcaccgaggctgcagtgggtctggagaactgccttcctcaagcacacccagaggagacaccagggaagtcaccggtggacacatctcgggggttcaacataccgggcagttattttcgatatgggtggtgtgctcatcccgagtcccggacgggtcgcagcggaatgggaagtgcagaatcgcattcctagcggaacaatactgaaagccctgatggagggcggtgagaacggcccatggatgcgtttcatgcgagcagaaatatag

SEQ ID NO: 52797 - DNA, 3312 bp, Artificial Sequence
  Description of Artificial Sequence: Synthetic coding sequence
atggcgccagcttgccagattttaaggtgggcacttgccctgggcctgggactgatgttcgaagtaacgcatgccttcaggagccaggatgagttcctgtcctcgcttgagtcctatgaaatcgccttccctacccgtgtggatcacaatggagcgctcctggcttttagccctccgcctcctcggaggcaacgaagaggtacaggagccaccgctgaatcaagactgttctataaagtggccagtccgagcacacacttcctgctgaacctcactagatcatcaagactactcgcagggcacgtttcagtggagtattggacccgcgaggggctcgcttggcagcgggcagcacgaccacattgcttatatgccggacaccttcagggccaggcctctagcagccatgtggcaatcagcacatgtggagggctccatggactaattgtagccgacgaggaagaatatctcatagagccattacatgggggtcccaaaggtagccgctcaccggaagagagcggcccacacgtggtatataagagatcatcacttcggcacccccacttagacaccgcatgcggggtcagggacgagaagccatggaagggtcgaccatggtggctgcgcactctgaagccccctcccgctagacctctcggcaacgagacagaacgaggccagcctggactgaaacgcagtgtgagtcgggaaaggtatgtggaaacccttgtggtggctgacaaaatgatggtagcttatcacgggcgaagggatgttgagcagtacgttctggccattatgaatatcgttgccaaattattccaagattctagcctgggatccactgtgaacattctcgtgactcggcttattctgttaactgaggaccagcccactctcgaaataactcatcatgccggtaagtcccttgactccttctgtaagtggcagaagagtatcgtgaatcacagtggacatgggaatgccattccagagaatggagtggctaatcatgacaccgcggtgctgataacacgttacgatatttgcatctataagaataaaccttgcgggactctgggtcttgccccagtcggtggcatgtgcgagcgcgagcgctcctgcagcgtcaacgaggacataggtctggcaacagcctttactatagctcacgaaataggacacaccttcggcatgaatcatgatggggttggcaactcctgtggagcccgaggtcaggaccccgctaagttaatggctgcgcacattaccatgaagacgaacccgtttgtgtggtcttcttgttcacgagactacataactagttttttggactcaggtctggggctgtgtctgaacaacaggcctcctcggcaggactttgtttatccgacggtggcgcctggccaggcttacgatgcagatgagcagtgtcggttccagcatggcgttaagtcccggcagtgtaagtatggggaagtctgtagcgagctttggtgtctatccaagagcaataggtgtatcactaactcaatcccggctgccgaagggaccttatgtcaaacacataccattgacaagggttggtgttacaaacgggtgtgtgtacccttcggatccaggcccgaaggagtcgatggtgcatgggggccttggactccatggggtgactgttccagaacctgcggcggaggcgtgagtagttcctccagacactgtgacagtcctcggcctacaataggaggcaagtattgcctgggcgaaaggcggaggcacaggtcctgcaatactgatgattgcccacctggaagtcaggatttcagagaagtgcagtgctcagagtttgattctatccctttccgcggtaaattctataagtggaaaacttaccggggaggcggagtcaaagcctgctctcttacatgtctggccgaaggatttaatttttatacagaacgcgctgccgcagtggttgacggtacaccctgcagacccgacacagttgacatctgcgtatctggagaatgcaaacacgttggatgtgatagagtgctgggtagcgatctccgggaggacaaatgtagggtgtgtgggggagatggttccgcctgtgaaaccattgagggagtgttttcgccagcctcacctggtgccggatacgaggatgtggtctggatcccaaaggggagcgtgcacatcttcattcaagacctgaatctttcactctctcatctcgctctgaagggcgatcaggagtcactgctgctggaagggcttcctgggactccccagccacatcgcttaccacttgccggaaccacattccagctccgccagggcccagatcaggtacagtccctagaagccctgggaccaataaacgcatccctgatcgttatggtgctggcacgtaccgaacttcccgctttgcgttatcgcttcaacgcaccaatagcgagagatagcctccctccatattcttggcactatgccccatggactaaatgcagcgcgcagtgcgctggaggatcgcaggtgcaggccgtcgaatgtaggaaccagcttgatagcagtgctgtcgctccccattactgctccgctcattccaaactgcccaagcgacagagagcatgtaacaccgagccatgcccccctgattgggtcgtaggcaattggtccctctgttcacggagctgtgatgccggagtccgctccaggtctgtcgtgtgccagcgcagagtatcagccgcagaggaaaaagccctggatgacagcgcatgtccacaacccagaccccctgtcctggaggcttgccatggccctacttgccccccagagtgggcggctctggattggagtgaatgcacgccaagctgcggacctgggctgcgccaccgcgtcgtcttgtgcaaatcagctgatcatagagccaccctgccacccgcacactgtagtccagcagcaaaaccgcctgccacgatgcgttgtaacttgcgccgttgcccccctgcccgttgggttgctggcgaatggggcgaatgctccgctcagtgcggagtggggcaaagacaacgcagtgtgaggtgcacgtctcacactgggcaggccagccatgaatgcaccgaggctctgcgaccaccaaccactcagcagtgcgaagccaagtgcgattctcctacacccggtgacggcccagaagagtgcaaggacgtcaacaaggtcgcctattgcccgttagttctgaaatttcagttttgctctagggcttacttcaggcaaatgtgctgtaagacttgtcatggccattag

SEQ ID NO: 52798 - DNA, 1998 bp, Artificial Sequence
  Description of Artificial Sequence: Synthetic coding sequence
atggcgagcgcctcgcagggcgctgacgacgatggatcaaggcgaaaaccaaggctggccgcatctctgcagattagtccccaaccacgcccatggagacccctgcctgctcaggctcagtcagcctgggggccagctcctgcccctgccacataccgcgcagaggggggatggccacaggttagcgtcctaagagattccggtcccggagcaggtgccggagtgggcgagctcggggctgctcgggcttgggagaacctgggagagcagatggggaaggctccacgggtcccagttcctcccgcaggactgtctctgccactgaaggatccaccagcttctcaggccgtgtccctgcttaccgagtatgccgcatcactgggaatcttcctgctgtttagagaagatcagccccctggcaaagttttcaaataccgggctccaggcggtgaggagttgaaagccatgtgcctctggcaggtcgaggtgctcagagcattcctactgagaaccggatggcgcggtctctggcggggtgacttggacctgggccctgatagttcttgggctaaccgactgccctttctcctgatctgtgaaatggagtctagaataccagccgtcgaggagctggggccttgtttccccttcagcgtgagcgcagaactggatggcgtcgtttgtcctgcagggacagcaaattccaaaaccgaggctaaacagcaggccgcactctccgctctgtgctatattaggtcacagctggagaatccagaaagtccacagacatccagccgcccacctctagctcctttatctgtcgaaaatatcttgacccacgagcagcggtgtgccgctctggtgtcagcgggattcgaccttttactcgacgagaggtccccgtactgggcttgtaagggcaccgtcgctggagttattttggagagggggtgggcagtgagcgccccaagctgtactgagatcccacgcgctagggggcacgttaaagagatatacaagctggtggcactggggactggatccagttgctgtgccggttggttggagtttagcggtcaacaattacacgactgtcacgggctggtgattgcccgaagggcactcctgagatttctcttccgtcagttattgctggcaacccagggagggccaaaagggaaggagcagagcgtcctggctcctcagcccggaccgggacctcctttcacattgaagcctagggttttcctgcatctctatatctctaatacaccgaagggagcagctcgggacatttacttgccaccaacctctgaaggtggccttccacactcaccaccaatgcggctgcaggcgcatgtgctgggacagctcaaaccggtttgttatgtggctccctcactctgcgacacccatgtagggtgcctctctgcaagcgacaagctcgcccgatgggccgtgctggggttgggcggtgccctgctggctcacttggtatcaccattatacagtacatccttgatactggccgattcctgtcacgatcctccaacactgtcccgggctattcatacgaggccatgtctggacagcgtgctgggcccttgtttgccaccaccgtacgtcagaaccgcattacatctctttgcaggtcctccagttgcacctagcgagcctacacctgacacttgccggggactgagtctgaactggtccctgggtgaccccggtattgaggtagtggatgtcgcaaccgggagagtgaaggccaacgcggctcttggaccgccatctcgcctgtgcaaggcaagctttctgcgagccttccaccaggccgcacgagccgtgggcaagccttatttgttggccctcaaaacctatgaggcagccaaagcgggaccgtaccaggaggctcgtcgacaattatctctgctgttggaccagcaggggctaggagcctggccatctaaaccgttggttggcaagtttaggaactag

SEQ ID NO: 52799 - DNA, 1752 bp, Artificial Sequence
  Description of Artificial Sequence: Synthetic coding sequence
atggccagtgccagccagggcgcagacgacgatggcagcagaagaaagcctaggctcgccgcttcattacagatctcccctcagcccaggccatggaggcccctgccagctcaggcacaatccgcctggggcccagccccagctcctgcgacatatcgcgcagagggtggatggccccaagtgtcggtgctcagagactctggccctggggctggagcgggagtaggggagttaggagccgctagggcttgggagaaccttggggagcagatgggcaaagcccctcgggtgccggttccacctgccggactctcattgccattgaaagaccctcccgctagtcaggccgtttccctgctaacagaatacgccgctagcctcggcatttttctcctgttcagagaagaccagccgcctggaccatgctttcccttttctgtgtccgctgaactggacggggtcgtatgtcctgctggcacggctaattccaagacggaggctaagcaacaggctgctttaagtgcgctgtgttatatcaggagccagctggaaaatcccgaatcacctcagacaagctcgcggccacctctcgctccactatctgtcgagaacatcttgacacacgagcagagatgtgccgctctcgtgagtgcaggatttgatttgctcctcgacgagagatcaccatattgggcgtgcaagggaaccgtcgcaggggtgatcttggagcgcgaaatcccacgtgcgcgaggtcacgtgaaggagatctataaactggtcgccctcggcacgggaagtagctgctgtgccggatggctggaattttctgggcagcagctgcatgattgccacggcctggtgatcgctaggagggcattgctgcgatttctgtttaggcagcttctgctagccactcaaggaggacccaaggggaaggagcagagtgttctcgctccacagcccggacccggtccaccttttacacttaaaccccgagtcttcctgcacttgtacatcagcaacacaccgaagggggcagccagggatatttatctacctcctacttctgaaggaggtttaccacatagccctcccatgagacttcaggcccatgtcctcggccagcttaaaccggtgtgctatgtggccccatctctctgcgatacccacgttgggtgcctgtccgcgtccgataagttagcacgatgggccgtgctgggtctggggggagctctgctggcccacctcgtaagcccattatatagtacttctcttatcttggctgattcttgccacgatcctcctaccctctcacgagctattcatactcgcccatgcctagatagcgtgctcggcccttgcctgcccccaccttatgtgcggactgctctccacctgttcgccggtcccccagttgcaccatccgagcctacaccagatacctgtagggggctgtcattgaactggtcactgggtgaccccggaatcgaggtggttgatgtggccacgggacgcgtcaaggcaaacgctgccctgggtccgccttccaggctgtgcaaggcctcattcctgagggcatttcaccaggctgctcgtgcagtgggcaaaccctaccttttagccttaaaaacttacgaggcagcgaaagctggtccgtatcaagaagctagacgtcagctatcattgctgttggaccagcagggtctgggggcatggccatctaagccacttgttggtaaattcaggaactag

SEQ ID NO: 52800 - DNA, 576 bp, Artificial Sequence
  Description of Artificial Sequence: Synthetic coding sequence
atggaagcgaaagcagcacctaaacctgcagcttctggcgcatgtagtgtgagtgccgaagaaacagagaagtggatggaggaggccatgcacatggccaaggaggccctagaaaacaccgaggtgcccgtcgggtgcttgatggtttacaataatgaagttgtgggcaagggcaggaacgaagtgaatcagacgaaaaatgcaacgcgccacgctgagatggttgccattgatcaggtgttggattggtgcaggcaaagcggcaagtcccccagcgaagtgttcgagcacaccgtgttgtatgtgactgttgagccctgtattatgtgcgccgcagcactgaggctcatgaagattccactcgtggtgtatgggtgccagaacgaacggtttggtggctgcggaagtgtactgaacatcgcctcagcggatttgccaaacactggacgccctttccagtgcatcccgggttatcgggctgaggaagccgtcgaaatgctcaaaaccttttacaaacaggaaaatccgaatgcacccaaaagtaaggtgcgcaaaaaagaatgccagaagtcttag

SEQ ID NO: 52801 - DNA, 111 bp, Artificial Sequence
  Description of Artificial Sequence: Synthetic coding sequence
atggaagctaaggccgctcccaagcccgctgcgtctggtgcttgctcagtgagcgccgaagaaaccgagaagtggatggaagaagcaatgcatatggagatctttttgtag

SEQ ID NO: 52802 - DNA, 435 bp, Artificial Sequence
  Description of Artificial Sequence: Synthetic coding sequence
atggtgtataacaatgaagtcgtgggaaagggcagaaatgaggtcaatcagactaagaacgcaactcgccatgccgagatggtcgccattgaccaggtactggattggtgcagacagtccggcaaaagcccttcagaggtttttgagcatacagtgttatatgtaactgtcgaaccatgtatcatgtgcgctgccgctctgcgcctgatgaagattccgctggtcgtgtacggctgccaaaacgagcgctttgggggttgtgggtctgtactgaatatcgcttcagcagatctcccgaacactggcagaccgtttcagtgtattcctgggtaccgcgctgaggaagctgtcgaaatgcttaagacattttacaagcaggagaacccaaacgctccgaaatctaaagtccggaagaaagagtgccagaaatcatag

SEQ ID NO: 52803 - DNA, 1056 bp, Artificial Sequence
  Description of Artificial Sequence: Synthetic coding sequence
atggaaccggctccagggcttgtcgaacaacctaagtgtctggaagcagggtcaccagaaccggaaccggctccttggcaagcactgccagtgctgtctgaaaagcaaagcggagacgtggagctggtcctcgcctacgccgcacctgtactggataagcgacagacttccaggcttctcaaggaggtgtccgcactgcatccgctacccgcacaaccacacctgaagcgggtccggccttcccgggacgccggttccccacatgctctcgaaatgctcttatgcctggccggaccggcttctggtcccagaagtctagccgagttgcttcccaggccagcagttgatcccaggggactaggccagccttttttagtccccgttcctgcgcgtcctcctctcacaaggggacaatttgaagaagcccgtgcccactggcctaccagcttccatgaggacaaacaggtcactagcgctctcgccggaaggttattcagcacccaggaacgtgctgcaatgcaatctcatatggaaagagccgtctgggccgctcgacgggcagccgcacgagggctcagagctgtgggagctgttgtggtggaccctgccagcgatagggttctagccactggacatgactgttcctgcgccgacaatcctctgttgcacgcggtgatggtatgtgtggaccttgtggcacgcggacagggcagggggacctacgactttcgcccattcccggcttgctccttcgcgccagccgcagccccacaggcggtgagagcaggagccgttcggaagctggacgcagatgaagacgggctaccctacttatgcacaggctatgacttgtacgtgactcgcgaaccctgcgctatgtgtgcgatggcccttgttcacgcgcgaatcctaagggtgttctacggtgctcccagtcccgatggggcactggggacacgattccggatccatgccaggcccgatcttaaccaccgctttcaggtgtttcgcggtgttctggaagaacaatgcaggtggctggacccagacacctag

SEQ ID NO: 52804 - DNA, 162 bp, Artificial Sequence
  Description of Artificial Sequence: Synthetic coding sequence
atggagccagccccaggcctcgtggagcaacctaaatgtctcgaagctggctctccagagcccgaacctgctccatggcaggctttgcccgtactttcagagaaacagagcggcgacgtggaacttgttctcgcctacgctgctcctgttctcgataaatag

SEQ ID NO: 52805 - DNA, 804 bp, Artificial Sequence
  Description of Artificial Sequence: Synthetic coding sequence
atgatcgaggcggaggagcagcagccatgtaagaccgatttttattccgagctcccaaaggtggaactacatgcacacctgaatggatctatttcatcccacaccatgaaaaagctgatcgctcagaagcctgatcttaaaattcacgaccagatgaccgtgatcgacaaggggaaaaagcgaacattggaggagtgctttcagatgtttcaaacgattcaccagctcacctcttcaccggaggacatcttgatggtgacaaaagatgtgattaaggaatttgccgatgatggcgttaaatatttagagctgaggagtacgccacggagggagaacgccaccggaatgactaaaaaaacatatgtggaatctattttggaggggatcaagcagagtaagcaggaaaacctggatattgacgtccgctaccttatcgccgtggataggagaggaggtccccttgtggcgaaagagacagttaagcttgccgaggagttttttctgtcaactgaaggcactgtactcggtctcgatctatccggagatcctactgtcggtcaggcaaaagacttcttagagccgctgctggaagccaaaaaggctggcctgaaacttgcccttcatctatccgagattcctaatcaaaagaaggagacccagatattgttagatctcctccctgacaggataggacacgggacctttctgaatagcggggaagggggatctcttgacctggtagacttcgttcgacagcacagaattcccctggggaaggcttggagcttccggagctctagatag

SEQ ID NO: 52806 - DNA, 1068 bp, Artificial Sequence
  Description of Artificial Sequence: Synthetic coding sequence
atgattgaagcggaagagcagcagccctgtaagacagacttctactctgagctgcctaaagtagaactccatgcacatttaaacggcagtatatcaagccatacaatgaaaaaattgattgcacaaaagcccgatctaaagatccacgatcagatgaccgtaatcgacaaaggtaaaaaaagaaccctggaggagtgttttcagatgtttcagaccattcatcagctaacaagcagcccagaagacattctcatggtcaccaaagatgtcatcaaggagttcgctgatgatggagtgaagtacctggaactacgatcaactcccaggcgggaaaacgccacagggatgacaaaaaagacgtatgtggaatccattctcgagggaataaaacagtctaagcaggagaacttggacattgacgtgcggtatctaattgcagtagaccggcgtgggggacccctggtggcaaaggaaaccgtgaagctggccgaggaattcttcttgtccaccgaaggcactgtgctgggcttggaccttagcggggacccaaccgtggggcaggcaaaggatttcctggagcctctattagaagccaagaaagccggactcaagcttgccctgcatttgtccgagatcccaaatcagaaaaaagagactcaaatccttctggacctgctacctgataggattggacatgggaccttcctgaactcaggggagggcggatctcttgatctggtggactttgtacggcagcacagaatacccctagagttgtgcctgaccagcaatgtcaagagccagaccgtaccaagctacgatcaacaccactttggcttctggtattcaatcgcgcacccttctgtaatttgtacagatgacaaaggggtctttgctacccatctatcgcaggagtaccagctggccgctgagactttcaacctcacccaatcccaggtgtgggacctgtcatacgagtctattaattatatttttgctagcgatagcacccggtccgaactgcgcaaaaaatggaatcatcttaagccacgagtccttcatatctag

SEQ ID NO: 52807 - DNA, 987 bp, Artificial Sequence
  Description of Artificial Sequence: Synthetic coding sequence
atgattgaggcagaggaacagcagccttgcaaaacggacttttattctgagttgcctaaggtggagcttcacgcacatttgaacggctcaatctctagccacaccatgaagaaactcattgcacagaagcccgacctaaagattcacgaccagatgacggtgatcgataagggcaaaaagcgcacattagaggaatgtttccaaatgtttcagactatccatcagctgacgagctcccccgaagacattcttatggtgaccaaggatgtaattaaagaatttgccgacgatggcgtcaagtacctagaactacgctccacaccgagacgggaaaatgctacagggatgacaaaaaagacctacgtagaatccattttggaagggataaaacagtcaaaacaagaaaatcttgatattgatgtgagatacttgattgctgtggatcgcagaggtggtccacttgtggccaaagagaccgtgaagctcgctgaagagttcttcctgtcaaccgagggcactgtgctcggacttgatctgagtggagaccctactatcccaaaccagaagaaagagacccagattctgctggacctgctccccgacaggataggacacgggacatttttgaattctggcgaaggcggaagcctggatttggtcgatttcgtccgacagcaccgcatccctctagagctgtgtctcacctctaatgttaaatctcagaccgtgcctagttatgatcaacaccactttggtttttggtacagcatcgcacacccttctgttatctgcacagacgacaagggcgtgttcgccactcacctcagtcaggagtaccaactcgccgctgagaccttcaatcttacacagtcccaagtgtgggacttaagctatgaaagcatcaactacatcttcgcatccgattcgaccagatcggaactgcgcaagaaatggaatcatcttaaaccgagggtgctccatatttag

SEQ ID NO: 52808 - DNA, 1836 bp, Artificial Sequence
  Description of Artificial Sequence: Synthetic coding sequence
atgagcgtgcaagtggtgagtgccgcagcagccgcaaaagttcctgaagtagaactgaaagatctgtcccccagcgaagctgagtctcagctaggcctgtctactgctgccgttggagccatggccccaccagctgggggaggtgacccagaggcccctgcccctgccgcagagcggccaccagtgcccggtcccggttctggtcctgccgctgccctaagcccagctgccggaaaagtcccccaggcaagtgcaatgaaacggagtgaccctcatcatcagcaccaacgccaccgtgacgggggagaggccctagtcagcccggatggaactgtgactgaagctccacggacagttaaaaaacaaattcagtttgccgaccagaaacaggaattcaacaaacgtccaaccaagatcggcaggagatcacttagtagatctatcagccagagttcaaccgattcatactcttccgctgcttcatacactgactcgtctgatgatgaaacttccccacgggataaacagcaaaaaaattccaaaggctctagtgatttctgtgtcaagaatattaaacaggcagagttcggcagaagggaaattgaaatcgccgagcaggaaatgcctgcactgatggccttgcggaaaagagctcaaggggagaaacctctggctggcgcaaagatcgtgggttgcactcacatcaccgctcagaccgctgtgctgatggaaacattaggagcactaggtgcccagtgcagatgggctgcatgtaacatttatagcaccctaaatgaagtggctgctgctttggcagaatccgggtttccggtgttcgcctggaagggtgaatcggaggacgatttttggtggtgcatagacaggtgcgtgaacgtggaaggctggcaacccaacatgatcctggacgatggcggtgacttgactcattggatctataagaaatacccgaacatgttcaaaaaaatcaagggcatcgtcgaggaaagtgtcaccggtgtacaccggctttaccaactgtcaaaagcgggaaaactgtgcgtacccgctatgaatgtcaacgactccgtgaccaaacaaaagttcgacaatctgtattgttgcagggagtccatcctagatggtctcaagagaactactgatatgatgttcggtggaaagcaggtggtggtctgtgggtatggagaggtggggaagggctgctgtgcagctctcaaagccatgggaagcatcgtttacgtgacagagattgatccaatttgcgccctgcaggcctgcatggacggatttaggttggtgaagctgaatgaggtcattaggcaagtcgatatcgtgattacatgtacagggaacaagaatgtcgtgactagggagcatttagatcggatgaagaattcctgcatcgtgtgcaacatggggcactctaacacagagattgacgtggccagtctgagaacccccgaacttacctgggagagagtgcggagccaggtggaccatgtgatctggccagatggaaaacgcattgtgctcctcgccgaggggcgtcttctgaacctgtcctgctccaccgttcctacgttcgtgctgagcattactgcaactacacaggcccttgccctaatcgagctctataacgcacctgaagggaggtataaacaagatgtgtatctgttgccaaagaaaatggacgagtacgtcgcctcgctccacctacctacatttgacgctcacctgactgagctgacagatgaacaggccaagtatctgggcctcaacaagaatggtcctttcaaaccaaactactacagatattag

SEQ ID NO: 52809 - DNA, 1530 bp, Artificial Sequence
  Description of Artificial Sequence: Synthetic coding sequence
atggaaaaatgggatgggaatgaagggactagcgcatttcacatgcctgagtggatgcaaattcagttcgcagatcaaaaacaagagttcaacaagcggccaacaaagattggcaggcgctccttgagtcgaagtatctcacagagcagtactgacagttactccagtgctgcatcatacaccgatagctctgatgacgagactagcccgagggataaacagcagaaaaatagcaaaggcagctcagatttttgcgtcaaaaatatcaaacaggctgagtttggacggagagagattgaaatcgccgaacaggaaatgcctgccctaatggctttaagaaagagagctcaaggagagaagcccttggctggcgcaaagatcgtaggttgtacacatattaccgctcaaactgctgtgcttatggagaccctaggggctctcggagcccaatgcagatgggctgcctgcaatatttacagtacgctaaacgaagtcgcggctgcactggctgaatcagggttcccggtgtttgcttggaagggggaaagtgaggatgatttctggtggtgcattgatcgctgtgtaaacgtggaggggtggcaacccaatatgattctggatgatggtggcgacctcacacactggatttacaaaaagtacccaaatatgttcaagaagatcaaagggattgtagaagaaagtgttaccggagtccaccgcctgtaccaactgtccaaggcaggtaagctatgtgtcccagctatgaacgtgaatgactcagtgacaaagcagaagttcgataacctctactgctgccgtgagtcaattttggacggcttgaagcggaccaccgatatgatgtttggaggaaaacaggtcgttgtgtgtggctacggagaagtgggcaaaggatgttgcgccgctttaaaggctatgggttccatcgtatacgtaactgagatcgaccctatttgtgccctccaggcctgcatggacggatttaggttggtgaagctgaacgaagtgattcgacaggttgatatcgttataacctgtaccggcaacaagaatgtagtgacacgcgaacatctggacaggatgaagaacagctgtatcgtctgcaacatgggccatagcaacaccgaaatagatgtggcatctctgagaactcctgagctcacctgggagcgggtgaggtctcaggtggatcatgtgatctggcctgacgggaaaagaatcgttctccttgctgagggaagattgctcaatctaagttgcagtacagtgcctaccttcgtgctaagcattacagctactacccaggccttagccctgattgagttgtacaacgcccctgaggggagatacaagcaggatgtgtatctgctcccaaaaaagatggacgaatacgttgcctcactgcaccttcctacctttgacgctcacttgaccgaactgaccgacgagcaggctaagtatcttggcctaaataagaatggtcccttcaaacccaattactaccggtattag

SEQ ID NO: 52810 - DNA, 1833 bp, Artificial Sequence
  Description of Artificial Sequence: Synthetic coding sequence
atgagtgtccaagtggtgtccgctgccgctgcagccaaagtgccggaagtggagctcaaagacttatctcctagtgaggccgagtcacagctgggcttaagtactgccgcagtgggtgccatggctccaccggcaggcggaggagaccccgaggcccctgctccggctgctgaacgccctcccgtaccaggacctgggtcgggcccagctgctgcactgagcccagccgctggtaaggttccccaggccagcgccatgaaaagatcagatcctcatcaccagcaccagcggcaccgggacggtggggaagcactggtgtccccggacggaactgtaaccgaggcaccaaggactgtgaagaagattcagttcgcagatcagaagcaggaattcaataaaagaccgacgaaaatcgggaggcggtctctgagtagaagcatatcccagtcatccaccgattcctattctagtgcagcgtcatatactgacagctctgacgatgagacaagccctcgagacaaacagcaaaagaacagtaaagggtcctctgatttttgcgttaaaaatataaaacaggctgagtttgggcgacgagagattgaaatagccgagcaagagatgcccgcactgatggcactaaggaagagggcccagggcgagaaaccactggcaggggctaagatagtaggttgtactcacatcactgcacagactgctgtgttgatggaaactctgggcgcactgggggctcagtgtcggtgggctgcgtgtaatatctacagcacgttgaacgaagttgctgctgctttagccgagtccggctttcctgtgttcgcatggaagggcgagagtgaagacgatttttggtggtgcatcgatcggtgcgtgaatgttgagggctggcaacccaacatgatcctcgatgatgggggagacttaacccattggatttataagaagtaccctaacatgttcaaaaagatcaaggggatcgttgaagagagtgtgactggcgttcaccgcctttaccagctgtctaaggccggaaaactatgtgtccccgctatgaatgttaatgactcagtcacgaaacaaaagtttgataacctctactgctgtagagaaagcattctggatggcttaaaaagaacaacagacatgatgtttgggggtaaacaggtggtcgtctgtgggtacggggaagttggtaagggttgctgcgctgctctaaaggccatgggcagtatagtttatgttaccgagatcgatcctatatgtgcccttcaagcatgcatggacggcttccgtctagtgaagctgaacgaggtcattagacaagtggatatcgtcataacctgtacagggaacaaaaacgtcgtcacccgggagcacttggatcgtatgaaaaattcttgcattgtatgcaatatgggccattcaaacactgaaatcgacgtcgcctcacttcggacacctgaactgacctgggagagagtccgctcacaggttgaccatgtaatctggccagatggaaagaggattgtgctcttagcagagggcaggcttctgaacctgtcttgtagtaccgtccctaccttcgtactgtcaattactgctaccacccaggctctggctctaattgaactgtacaatgcacccgagggccgatacaagcaggatgtttacctgttgcctaagaagatggatgagtacgtcgcaagccttcatctgccaacttttgatgctcatctcactgagctgaccgacgagcaggccaaatatctaggcctgaacaaaaacggccctttcaagcctaattactatcggtattag

SEQ ID NO: 52811 - DNA, 228 bp, Artificial Sequence
  Description of Artificial Sequence: Synthetic coding sequence
atggaaaagtgggatggcaatgaggggaccagcgcgtttcatatgcctgaatggatgcagatccagtttgccgatcagaaacaggaattcaacaagcgcccaacgaagattggccgacgatccttgagtcggagtattagccaatctagcacagattcctactcatctgcagctagctacaccgattcttctgacgacgagacgagcccacgagacaaacagcagtag

SEQ ID NO: 52812 - DNA, 1527 bp, Artificial Sequence
  Description of Artificial Sequence: Synthetic coding sequence
atggagaaatgggacgggaatgagggtacctctgcctttcacatgcccgaatggatgatccaattcgcagaccagaaacaggagtttaacaagcgaccaactaagataggtcgaaggtctctctcccgctctatctcccagtcctccacggattcttattcaagcgctgcgagctataccgattcaagtgatgatgaaacgtctccgagggacaagcaacaaaagaacagtaaagggtctagcgacttttgcgtgaagaacattaagcaggcagaattcgggaggcgcgaaattgagattgccgagcaggagatgcccgctctcatggctctacgcaagagagctcaaggggagaagccactggccggtgccaagattgtgggttgcacccacataacagcccaaacagcggtactcatggagactcttggggctttaggcgcacagtgtaggtgggcagcatgtaacatctactcaacactgaacgaggtggcagccgcactcgctgaaagcggtttccctgtgttcgcatggaagggcgagagcgaagatgatttttggtggtgcatcgaccggtgtgtgaacgttgaaggatggcagccaaacatgattctggatgatggaggagatttgactcactggatttacaagaaatatcctaacatgttcaagaaaatcaaaggcatagttgaggaaagcgtgactggagtacacaggctctaccagctatcaaaggctggaaaactctgcgtacccgctatgaacgtcaacgacagcgtcacaaagcagaagttcgataatctgtactgttgccgcgagtcaattttggacggattgaaaaggaccactgatatgatgttcggtggcaagcaggtggtggtatgtgggtacggagaggttgggaagggctgttgcgccgcactgaaagccatgggttccatagtgtatgtcactgaaatcgatccaatctgtgcgttgcaagcttgcatggatgggttcaggctggtgaaactgaacgaggtgattagacaggtggatatcgtaataacatgcaccggcaataaaaacgtcgtgacaagggagcatctggatcgcatgaaaaatagctgcatcgtgtgtaacatggggcactctaataccgagatcgacgtcgcatcactacgcactcccgaactaacatgggaacgcgtgagaagccaggtggaccacgtaatttggccagacggcaagcgaattgtactcctcgccgagggcagactgctcaacctgtcatgcagcactgtcccgactttcgtgctgtcaatcactgcaaccactcaggctctggcccttatcgagctctacaatgccccagagggacgctataaacaagacgtctatcttctgcccaaaaagatggatgaatacgtagcctcactgcacctgccaacctttgatgcccacttaactgagctcaccgacgagcaagccaagtatctgggcctgaacaaaaatgggccttttaaaccgaattactacagatactag

SEQ ID NO: 52813 - DNA, 1593 bp, Artificial Sequence
  Description of Artificial Sequence: Synthetic coding sequence
atgtacttcctctgttttttctgtctgttcgtttcaggcagaaaatggtcaaggcaattcctattgagtttttggtgtaccgtgtgttctgcgcaccagggcaccatcttcctgagcctaaaaatacaattcgcagatcagaagcaggagtttaacaaaagaccaacaaagatcggcagacgctctctgagtcgctccatcagtcaatctagtactgattcttacagtagtgctgccagttacacggattcatctgatgacgagacctccccaagagataaacaacagaaaaacagcaaggggagtagcgatttctgtgtgaagaatatcaagcaggccgagttcggtagacgggaaatcgaaatcgccgagcaggagatgcctgccctaatggctctgcggaaaagggcccaaggcgagaagcccctggctggtgccaaaatcgtgggctgcactcatattaccgcccagacagctgttctcatggagacactcggcgctctgggagcacagtgtcggtgggcggcatgcaacatttactcaaccttaaatgaagtagccgctgctctggctgagagcggatttccagtctttgcatggaagggagaatctgaggatgatttttggtggtgtatcgaccggtgcgtcaatgttgaaggatggcagcctaacatgatacttgacgacggaggggatctgacacactggatctacaagaagtacccgaatatgtttaagaaaatcaagggtattgtagaggaatcggtcaccggggtacaccgcctctaccagctctcgaaggcgggaaagctctgtgttccggctatgaatgtgaatgacagcgtcacaaagcagaagtttgacaatctttactgctgtcgcgagtccattctggatggtttaaagcggaccactgacatgatgtttgggggaaagcaggtggtggtttgtggctacggggaagtcgggaaaggttgttgtgcggctctgaaggcaatgggcagcattgtatatgttactgaaattgatcccatttgcgccctgcaggcttgcatggatggtttcaggctcgtgaagctaaatgaggttattagacaggtggacattgttattacatgtacaggaaataaaaatgtagtcactcgggagcacctggacagaatgaagaactcatgcattgtctgtaacatgggccactccaacacagagatcgacgtggccagccttcgcactccggagctcacctgggagcgggtgaggagccaagttgaccacgtaatctggccagacggtaaacgcatagttttactcgcagaagggaggttactgaatttatcctgcagtacggttcccacatttgtcctcagtattaccgccaccacacaggccctcgccctgatcgagctgtacaacgcacccgaggggagatacaagcaggacgtctacctgttgcctaagaagatggacgagtacgtcgccagcctgcacctcccaacatttgatgcacatctgactgagctgaccgacgagcaagccaagtacctcggcttaaataaaaacggcccattcaaaccaaattattatcgttactag

SEQ ID NO: 52814 - DNA, 1527 bp, Artificial Sequence
  Description of Artificial Sequence: Synthetic coding sequence
atgctcgggtccaagaaaaagtacattgtgaatgggaatagcggcattaaagcccaaattcaattcgcagatcaaaagcaggagtttaataaacgccctaccaaaattggccgacgttcattaagccggtccatctctcaatcgagtactgacagctactccagtgcagcaagctacacagattcctcggacgacgaaacttctcctcgggacaagcaacagaaaaactccaaaggcagctccgacttttgtgtcaaaaatattaaacaggctgagtttggacgtagagagatcgagatcgccgaacaggagatgccagcgctgatggccctgcgtaagagagcccagggcgaaaaacctcttgccggagctaaaatagttggctgtacccacattactgcgcagaccgctgttttgatggagaccctaggcgcactaggtgcacagtgccgctgggctgcttgtaatatctactccacacttaacgaagtggccgcagcgctggccgagagcggattccctgttttcgcttggaagggagaaagcgaggacgacttttggtggtgcattgacaggtgtgtcaatgttgaggggtggcaacccaacatgatactggacgacggaggggatttgacccactggatttacaagaagtatcccaatatgttcaaaaagatcaagggaatcgttgaggaaagcgtgacaggtgtgcacaggctgtatcagctttctaaggccggtaaactctgtgtaccagctatgaatgtgaacgatagtgtgacaaagcaaaagtttgacaatctctattgttgtcgcgaatctatcctagatggactaaagcgcacaaccgatatgatgtttgggggaaagcaagtggtagtgtgcggttatggcgaagtgggtaaagggtgctgtgcagcactgaaagcgatgggcagcatcgtttatgtgactgagatcgacccaatatgcgcactgcaggcttgtatggatgggttcaggttggtgaaactcaacgaggtgattcgccaggtcgatatagtaattacatgtaccggtaacaagaacgtagtcacccgcgaacatctcgacaggatgaaaaacagctgtatcgtgtgcaatatggggcactctaataccgaaatcgacgttgcttccctcagaacaccggagttgacatgggagagagtgcgaagccaggtggatcatgttatttggccggatggcaagagaatcgtgctactggccgaaggcaggctccttaacctgtcgtgcagcacagtgcctactttcgtgctatccattactgcaaccacacaggcccttgccttgatcgaactatataacgccccagaaggcaggtataagcaggatgtgtacctgctgcccaagaagatggacgagtacgtcgcatcgctgcacctacccacttttgatgctcatctgactgagcttactgacgagcaggcaaagtacctgggcttgaataagaatggtccttttaagcccaactactaccgctattag

SEQ ID NO: 52815 - DNA, 1266 bp, Artificial Sequence
  Description of Artificial Sequence: Synthetic coding sequence
atgaccagtcaggagaaaactgaagaataccccttcgctgacatttttgatgaggacgaaacagagaggaatttcctcctgtcaaagcctgtctgctttgtggtgttcggaaagcccggtgtgggaaagacaaccctagctagatacatcacacaggcctggaagtgtatccgcgtggaggcgctgcccattttggaggagcagattgccgcagagaccgagagcggagtgatgctgcaaagcatgctgatcagcgggcaaagtatccccgatgagctcgtcattaagctgatgttggagaaattaaacagccccgaggtttgccattttggatacattataactgaaatcccatcactgagtcaggatgcaatgacaacgctgcagcagatcgaattgattaagaacctgaacctgaaacctgacgttatcatcaacatcaagtgtccggactatgacctgtgtcaaagaatctctggacagcggcagcataacaacaccggttacatctacagtcgggaccagtgggatccagaagtaatcgaaaatcaccgaaagaagaagaaagaggcccagaaggacggtaaaggggaagaagaagaagaggaggaggagcaagaggaagaggaagccttcatcgcggaaatgcaaatggtggctgaaatcttacaccatctcgtacaacgaccggaagactatctggaaaacgtggagaatatcgtgaagctgtataaggaaacgatcctgcagacactggaggaggtgatggctgagcataatccacaatatctgatcgaactgaacgggaacaaacccgcagaggaactttttatgattgttatggacagactgaaatacctaaatttaaaacgcgcagcaatcctgactaaactacagggggcagaggaggagattaatgacactatggaaaacgatgagttatttagaactctcgccagctataagcttatagctcctcgataccgctggcagcgctctaagtggggtaggacatgccccgtcaacctgaaggatggcaacatttattctgggctgccagattactccgttagcttcttggggaaaatttactgcctttcttctgaggaagcactaaaacccttcctgctgaatccgaggccgtacctcctacctcctatgccaggtcctccatgtaaggtgtttattctgggaccacaatatagcgggaaaacaaccctgtgtaatatgctggcagagaactacaaggggaaggtgaccaattag

SEQ ID NO: 52816 - DNA, 1089 bp, Artificial Sequence
  Description of Artificial Sequence: Synthetic coding sequence
atgaaggaaaggaaaagacacttaggagacactaaacacttctgccctgtcgtcttgaaagagaacttcatactgcaacctggcaacaccgaagaggcagcaaagtaccgcgaaaagatctactacttctcctctgctgaggctaaggagaagttcctggagcatcccgaagactacgttgcccatgaggagcctcttaaggcaccccctctgagaatttgtctggtagggccacaaggtagtgggaaaacaatgtgcgggagacagctggcagagaagcttaacatcttccatatccaatttgaagaagtgctccaggagaaacttttgctcaaaacggaaaaaaaagtaggcccagagtttgaagaagattcagagaatgagcaggccgctaagcaagaactcgaggaattagcaatccaggcaaacgtgaaggttgaagaggaaaataccaagaagcagctacctgaggtgcagcttactgaggaggaagaggtgatcaaaagttcattaatggagaatgaacccctgccccctgagattcttgaagtcatactcagcgagtggtggttgaaagaacccatacggtcaaccgggttcatcctcgacggattccccagataccccgaggaagcccaatttctgggcgaccgcggtttctttccagatgccgcagtgttcatccaagtggacgaccaggatattttcgaccgcctgttgccggctcagattgagaagtggaaattgaagcagaagaaaaaactcgagcgtaagaaactgattaaggatatgaaggccaagatccgcgtggataccatcgcaaaacggagagcagagcttatcctcgagagggacaagaagaggcgggaacccaataaagagaaaaggaaacgcggtatttccgaaaacacaacatgctataagtgtaaccatatgagtccatggtgtgaatacgctgggctaccctaccgcggtctcctgatcctctactccgccactgctactgccaccgccggtactaagcattgtcgttcaggtgcaaaggtgatcgtggctctctctaaacagaacatccataatcagaaatag

SEQ ID NO: 52817 - DNA, 2211 bp, Artificial Sequence
  Description of Artificial Sequence: Synthetic coding sequence
atgacatctcaggagaaaaccgaggagtatccctttgcagacatctttgatgaggatgaaacagagcgaaactttctcctgtcaaagccagtgtgcttcgtggttttcggtaagcctggggtggggaaaactacactggcaagatacattacgcaagcctggaaatgcattagagtggaggcacttcccattctggaagagcagatcgctgcggagaccgagtcaggcgtcatgctccagtctatgttaatcagtggccaatctatacccgacgagctggtgataaaattgatgcttgagaagttaaacagccccgaagtctgtcacttcggttatatcatcacagaaattccgagtctttctcaagatgccatgaccaccttgcagcagatagaattgatcaaaaatctgaatctgaagcccgacgtgattatcaatattaaatgccccgattacgacctctgccagagaatatctggccagcgccagcataataataccggctatatctacagcagagaccaatgggaccccgaggtcattgaaaaccatcggaagaaaaaaaaggaagcacaaaaagatggaaagggtgaagaggaagaagaggaagaggagcaagaggaagaggaggccttcatcgccgagatgcagatggtggccgagattcttcaccatctggtccaacgtccagaagattatctcgagaacgtggaaaatatcgtgaaactgtacaaagagactatcttacagaccctggaagaggtaatggccgaacacaaccctcaatatttgattgaattgaacggtaacaagcctgcagaagaattgtttatgatcgtgatggatcgcttgaaatatcttaatctgaaacgagcagctatactgacaaagcttcagggagcagaggaagagatcaatgatacgatggaaaatgacgaactctttcgaaccctagcatcatacaaattgattgctccacgctatcgatggcagcgatcaaagtgggggagaacttgccctgttaacctgaaggatggtaacatttactcaggccttcctgactattccgtttccttcctggggaagatctactgtctttcctcagaggaggcgttaaagccctttcttctgaatccacgcccatacctgctgcccccaatgcctggtccaccttgtaaggtgtttattctaggccctcagtactccggcaagacgactctgtgcaatatgctcgcagaaaattataaggggaaggttgtagactacgctcagctggtgcagcctaggttcgataaagcaagagagaccctggttgagaacacaatagccgaggcaacagctgcagctatcaaggtagtaaaggagaagctgctgcgcgagctgcaggccaggaagcaagcggagaccgctctaagggagttccagcggcaatacgagaagatggagttcggggtgtttcccatggaggctactcacagttccattgatgaagaagggtatatacaagggtcccagagagacaggggaagtagtttggtggacacagaagaggccaagacgaaatcagagaacgtgctacatgatcaggcagccaaagtggataaagacgatggcaaagagaccggagagacttttacgtttaaaaggcacagtcaagacgcatcccaagacgtcaaactctattcagataccgcccctactgaggatctgatcgaggaggtgacagccgaccaccctgaggtggtgacaatgatagaggagacaatcaaaatgagccaggacattaatttcgagcaaccgtacgaaaaacacgcagaaatcctccaggaggttctgggagaggtcatggaggagaacaaggatcggttcccaggcgcacccaagtacggagggtggattgtggataattgccctatagtaaaagagctatggatggctctgataaaaaagggtatcattcccgacctcgtgatctatctttccgacaccgagaataacggcaagtgtctgtttaataggatctatctgcagaaaaagagtgaaattgatagcaaaattctggagagactgctcgaggagctgcagaaaaaaaaaaaagaagaggaagaagccagaaaagctactgaggaagagttgcgtcttgaagaagaaaatagacggctgttagagttgatgaaagtcaaggccaagggaaagcatcgtctgctttag

SEQ ID NO: 52818 - DNA, 5735 bp, Artificial Sequence
  Description of Artificial Sequence: Synthetic coding sequence
atgacaagccaggaaaaaaccgaggaatacccattcgctgatatctttgatgaagacgagacagagcggaatttcttgttgtccaagcctgtttgctttgtggtattcggaaaacctggagtagggaaaaccactctcgcacgctatatcacacaggcttggaagtgcatcagagttgaagccctgcccatccttgaagaacagatagctgccgaaacggagagcggcgtgatgttacagagcatgcttattagtggccagagcattcctgatgaacttgtcatcaaactcatgttggaaaagctcaatagccccgaggtgtgccactttggatatatcattacggaaattccctccctgagccaggatgctatgacaacactccagcagattgaactgatcaagaatctcaaccttaagccagatgtgataatcaacatcaagtgtccagattacgatctttgccagcgaatttcggggcagagacagcacaataacaccgggtacatctacagtagagaccagtgggatccagaagtgatcgagaatcaccgcaagaagaaaaaagaagcacaaaaggatggcaagggtgaagaggaagaagaggaggaagagcaggaggaagaagaggcgtttattgccgagatgcagatggtggccgaaattctgcaccatcttgttcaacggcctgaggattacctggaaaatgtggagaatatagtgaaattatataaagagaccatactgcagactcttgaagaggtaatggctgaacataacccccagtacctcatagagcttaatggcaacaaacctgccgaggagctgttcatgatagtgatggacaggctcaagtatctcaatctgaagagagcggcaatcttgacaaaactacaaggggctgaggaagaaataaatgacacaatggaaaatgacgagcttttccgaactttggcgtcctacaagctgattgcccctaggtatcgctggcagagaagcaaatggggtaggacctgtccagtgaacctcaaagatggtaatatatactcgggacttccagattactccgtctcattcctgggtaagatctattgtctgtcttcagaggaagctctgaagcctttccttctgaatccacgaccatacctcctgccacctatgcccggacccccatgtaaagtgttcattctcggcccacagtattccgggaagactaccttatgtaatatgttagccgagaactataagggaaaggtggtggattatgcccagctggttcagccacgcttcgacaaggctagggagacactggtggagaataccatcgccgaggccaccgcagccgcaatcaaagtggtgaaggagaagctgttgcgtgagctgcaggcgagaaagcaggctgagactgcgcttagggaattccagcgacagtatgagaaaatggagttcggtgtgtttcccatggaagcaactcattctagcatcgatgaggagggatatatccagggaagccaacgcgatcgcggatcctctctggtggacacagaggaagccaagactaaaagtgaaaatgtcctacacgaccaggcagcgaaagtagacaaagacgacgggaaggagacgggagaaactttcaccttcaaaagacacagccaggatgctagccaggacgtcaaactctattctgatacagcacccacagaagatctgatcgaggaggtcactgctgaccatcctgaggtggtcacaatgattgaggaaaccatcaaaatgtcacaggatatcaatttcgaacaaccttacgagaagcacgctgaaatactgcaagaggttctgggcgaagtcatggaggagaacaaagaccggttccccggagcacccaaatatggcggatggatcgtagacaactgccccattgtgaaggaactttggatggccctgatcaaaaaaggcataatccctgacttggtgatttacctttcagacacggaaaacaacggcaagtgtctgtttaacagaatttacttacagaagaagtccgagatagatagtaagatcctggaaaggttgttagaggaactacaaaaaaagaaaaaggaggaggaagaagcacgaaaagctacagaagaggaattgcgccttgaggaggaaaacagacggctcctggaacttatgaaagtgaaggccaaggaagccgaggagacagacaacgaggacgaggaagagatcgagggggacgaactcgaagttcatgaggaacccgaggcttcccatgacaccaggggctcatggctgcctgaagaattcgaggcctccgaagtgcccgagaccgaaccagaagccgtgagtgaacctattgaggaaactaccgtggaaacggagattcccaagggttctaaggaaggactagaaatcgagaaactcagcgaaacagtcgtactgccagagttcccagaagactcctatcccgatgtacctgagatggagccctttaaggagaagatcggcagctttataatcctgtggaagcagctggaagccactatctctgaagcttatatcaagatcttgaatctggagattgctgacagaacaccgcaggaactccttcagaaggtcgtggaaaccatggagaagccatttcagtatacagcctgggaattgacaggtgaagactacgaagaagaaacggaggactaccaaaccgaagccgaagtggacgaggagctggaagaagaggaggaggaagagggtgaggacaagatgaaggagcgcaagcgccatctgggggataccaaacacttttgccccgtggtactgaaagaaaatttcattctccagcctggaaataccgaagaagctgccaaatatcgtgagaaaatttactacttcagttctgcggaagctaaggagaaattcctcgaacacccagaagattacgtggcacacgaggagcccctcaaggccccaccccttcggatttgcctggtcggccctcaaggctccggaaagactatgtgtggcagacagctggcggaaaagctgaatatatttcacattcagttcgaggaggtcctgcaggaaaagctactgctaaaaaccgagaaaaaagttggaccggaattcgaggaggactccgaaaatgagcaggcagctaagcaggaactggaggagctggctattcaagcaaacgtcaaggtggaggaggaaaatactaaaaagcaactccccgaggtgcagcttactgaggaggaggaagttattaaaagcagcctcatggaaaatgaaccgctgccccctgagatactggaggttatcctgtccgagtggtggctgaaggagccaataaggagtaccggctttattttagatggtttcccgagataccctgaagaagcacaatttctgggcgaccgtggctttttccctgatgctgccgttttcattcaggtcgacgaccaggacatttttgatcggctgttgcctgcccaaattgagaagtggaagctaaagcaaaaaaagaagctggagcggaagaagctgatcaaggacatgaaagccaagattcgcgtcgacactatagccaagcggagggccgagttgatcctggagcgggacaaaaagcggagggagaacgtggtgagggatgatgaggagatcagtgaggaagagctcgaagaggataatgacgacattgaaaacatcctcgaagacgagtttcccaaagacgaagaggaaatgtctggggaagaggacgaagaacaggagaccgatgccattgagagactgcgcggtgagcttggcgagaagttcgaggcggacactcataatttgcagattatccaggatgagctggagcgctatctgatccctatcatcagtattaatggcgcaagacggaaccatatcgttcagtataccttgaacatgaagcttaagcccctcgtcgagaacagagcctcaatctttgagaagtgtcatcctattcccgcacccctcgcccagaagatgctgacatttacctataagtatatcagcagtttcggatactgggatcccgtgaaattgagcgagggcgagacgatcaaaccggtggagaatgctgagaacccgatttacccagtgatccatagacagtacatctattttctgtctagtaaagagacaaaagagaagttcatgaaaaaccccatcaaatatatacggcagcccaagcctaaacctacagttcccattcgtatcatcatagtcggcccacccaagagcgggaagaccaccgtcgccaagaaaattaccagtgagtacggcctgaagcacctgtccatcgggggagcattaagatatgtgctcaataaccatcctgagaccgaactggctttaatgctgaattggcacctgcacaagggcatgacagcgcctgatgaacttgccatccaagcgctggagctttcccttatggaaagtgtgtgcaacactgccggtgtagtcatcgacggctatccagtgacgaaacatcagatgaatcttctggaggcgagaagcatcatcccaatggtgatattcgagctgtctgtgccatcaaaagagatatttaagaggctgttacttgaaaaggaaaacgaacagcgattgccttaccctttacataactcggcccagatcgtcgccgtgaacaatgtgaagtatcggaaaaatatcggagaaatccgccagtactatcaggagcaacatcagaattggtatgtgatcgatggtttccactccaaatggtgggtgtggaatgaggtgatcaagaacgtgcagatggtgaacaagtatatgcagacatacctggaaagaattaaggctggaaaggccgcttgtattgacaagctctgtattaccccacaggagctactcagtagactcggcgagttcgagcagttctgcccggtgtcccttgccgaatctcaggagctgttcgattgctcggctaccgattctcttgaattcgcagctgagttcagaggacactactataaaatgagtagccaggagaagctgaataagttcttagaaaaccccgagctatacgtgccaccattggcgccacatccattaccatccgccgacatgatcccaaagaggctgacactttctgagctgaagtctcgctttcctaagtgcgcggagttacagggctactgccctgtcacttacaaagacggtaatcaacgctatgaggccttggtccccggttcaattaactatgcgctggaatatcacaacagaatttatatctgcgaaaataaagagaagctccagaaattcttgaggagccctctgaaatactgggaacaaaaacttccacataagcttccaccgctgcgggaacctatactgctgactagtctgccccttcctggctaccttgagcaggggatcgcaaccagtcttattaaggccatgaatgctgcaggctgtctgaaaccaaagtttcctttcctctctatacggaggtcggccctcttgtatatcgccctccatctcaaggcattcaatccaaaaggatccgagtacacgcgtaaaaagtacaaaaaaaagatggaacaatttatggagtcatgcgagctgatcacttatttgggcgctaagatgactcggaagtacaaggaaccgcagttcagagcaattgattttgatcacaaactgaaaacctttctgagcctacgcaatatcgacccgataaacggtta

SEQ ID NO: 52819 - DNA, 684 bp, Artificial Sequence
  Description of Artificial Sequence: Synthetic coding sequence
atgttgcagagcatgctgatcagtggtcagagcattcctgacgaactagtaattaaattaatgcttgagaagctgaattcacctgaggtgtgccacttcggatatatcatcacggagataccctccctgtctcaagatgctatgacaacgttgcagcagatcgaactgatcaaaaacctgaaccttaagcctgacgtaatcatcaatataaagtgccctgattacgatctctgtcagaggataagtggacagcgccagcacaataacactggatacatatatagtagagaccagtgggatccagaagtgattgagaatcataggaaaaaaaagaaagaggctcagaaagatgggaagggagaggaggaagaggaagaagaggaacaggaagaagaggaagcttttattgccgagatgcagatggtggccgaaattctccatcacctggtgcagcgacctgaagactatctggagaacgtggaaaatatcgtgaaactgtataaggagacaatcctacaaacacttgaagaggtcatggctgagcacaaccctcagtatttgatcgaacttaatgggaacaaacccgcagaagagctgtttatgattgtaatggatcggctcaagtatctcaacttaaaacgggctgcgatcctgaccaagctgcaaggggctgaggaggagtag

SEQ ID NO: 52820 - DNA, 1074 bp, Artificial Sequence
  Description of Artificial Sequence: Synthetic coding sequence
atggagaagtacgtggccgctatggtgctgtctgctgctggagatgccctgggctattataatgggaaatgggaattcctgcaggacggcgagaagattcaccgccaattggcccagttgggaggattggatgcattggatgtagggcgatggcgtgtgagtgacgacaccgtgatgcaccttgcgaccgcggaggcactggtggaagctggcaaggctcccaagcttactcagttgtattacctactggccaagcactatcaagattgcatggaggacatggacggacgggctcctggtggtgccagtgtgcataacgctatgcaattgaagcctggcaaaccaaacggttggaggattcctttcaattcccacgaagggggatgtggggcagccatgagggctatgtgcatagggctgcgcttccctcaccacagccagttggacaccctgatccaagtttccatagagagcggacggatgacccaccaccacccaacgggatatctgggggcactggctagcgccctcttcaccgcatatgccgtcaatagcaggccgccattgcagtggggcaagggactcatggaactgctccctgaggccaaaaagtacattgtgcagtccggctatttcgttgaggagaacctgcagcattggtcttacttccagaccaagtgggagaactatctcaagttgagaggaatcctggacggggagtctgcccctacattccccgagagtttcggggtgaaggaaagagatcagttctacaccagtctgtcctactctggatggggagggtcttcgggccatgatgccccaatgatagcctatgatgccgttcttgcagcaggggattcatggaaggaattagcccacagggccttctttcatgggggtgatagtgatagtacggcggctatcgctgggtgttggtggggcgttatgtatggattcaaaggtgtatccccatctaattacgagaagctggagtataggaacaggttggaagaaactgccagggccctctattcactgggcagcaaggaggacacggtgatctctttgtag

SEQ ID NO: 52821 - DNA, 1074 bp, Artificial Sequence
  Description of Artificial Sequence: Synthetic coding sequence
atggaaaagtatgtggctgccatggtgttgagcgcagccggtgatgccctcggctactataatggaaagtgggaatttctgcaggacggcgaaaagatccacagacagctggctcagctgggtggattggacgcactggatgtgggcaggtggagagtgagtgatgacaccgtaatgcacctcgccaccgcagaggcccttgttgaggctgggaaggccccaaaattgactcaattatattatctcctggcaaagcactaccaggactgtatggaagacatggacgggagggcgccaggcggtgccagcgtgcataacgcaatgcaactgaaacctggtaagcccaatggctggagaatcccttttaactcacatgaaggcggttgcggggctgcgatgcgagcgatgtgcatcggtcttcggttcccacatcactcgcagcttgacacgctgattcaagtgtccatagaaagtggcagaatgacccaccaccatcctacggggtatctaggcgcacttgccagcgcacttttcacagcttatgccgtcaatagtaggccgcctttacagtggggtaaagggctaatggaactgctccccgaggccaagaaatacattgtacagtctgggtatttcgttgaggagaacctgcagcattggtcttactttcagacgaagtgggaaaactacctgaaactgcggggaattcttgatggcgagagtgcgccaacctttcctgagtcattcggggtcaaggagcgagaccagttctacaccagcctgagctattcaggatggggcggaagctccggacatgatgcccctatgattgcctacgacgccgttctcgccgcaggggacagttggaaggaactagcccaccgggcttttttccatggcggagattccgatagtactgctgccatcgcgggatgctggtggggagtaatgtacggcttcaagggagtttccccgagtaattatgaaaagctggaatatcgtaaccgactggaggagaccgctcgcgctttatatagcctcgggtccaaggaggacaccgtaatctccttgtag

SEQ ID NO: 52822 - DNA, 1074 bp, Artificial Sequence
  Description of Artificial Sequence: Synthetic coding sequence
atggaaaaatacgttgcagccatggtgctgagcgccgcaggggacgccctcggatattataatgggaagtgggaatttcttcaggatggcgaaaagatccatcgacagctggcccagctcggaggtctagatgctttagatgtgggacgctggagagtctccgacgataccgtcatgcatctggctacagccgaagcgcttgtcgaggccggtaaagcacctaagctgacacagttatactaccttttggctaagcattaccaggattgtatggaagacatggatggtcgggctcctggtggagccagcgtgcacaatgccatgcagcttaagccaggaaagcccaatggttggcggattccttttaactctcatgaggggggatgcggcgcagccatgcgtgcaatgtgtatagggttgcggttcccccaccactcgcagttggacacactgatccaggtgagtatcgaaagtggacggatgacccatcaccacccaacagggtacctcggggctctggccagcgccctgttcactgcttatgccgtcaattctaggccccctttacagtggggtaagggactcatggagttgctccccgaggccaaaaagtacatcgtgcagtccgggtactttgtcgaggaaaacctgcaacactggtcatactttcaaactaagtgggagaattacctgaagttgcgaggaatcttggacggagagtcagccccaacttttcctgagtctttcggcgtgaaggagagggatcagttctacacctctctgtcctactctggttggggtggaagtagcggacacgatgctcccatgatcgcatatgacgcagtacttgctgccggagatagttggaaggaattggcacatcgagccttcttccacggtggtgatagtgattctacagctgcgatagctggttgttggtggggggtcatgtatggattcaaaggtgtcagcccgagtaactacgagaagcttgagtatcgtaatcggctcgaagaaaccgctcgcgcactgtactcgcttggttcaaaggaagataccgtgattagcttgtag

SEQ ID NO: 52823 - DNA, 1074 bp, Artificial Sequence
  Description of Artificial Sequence: Synthetic coding sequence
atggagaagtacgtcgctgcgatggtcctcagcgctgcaggagatgccctcggatactacaacgggaaatgggaatttctgcaggacggcgaaaagattcacaggcaattggcgcagttggggggactcgatgcgttggacgttggtcggtggcgcgttagcgacgacaccgtaatgcatctggctacagctgaagccctggtagaagctggaaaggcacccaagctgactcagctgtattatctcctggcgaaacactaccaagattgtatggaagacatggacggtagagctcccggaggtgcttctgtgcataatgccatgcagctcaaacccggaaagccgaatgggtggcggattcctttcaactcccacgaaggtgggtgcggcgctgccatgagagcgatgtgtatcgggttgcggtttccacatcattctcagttggacacactgattcaggtaagcattgaaagtgggcgaatgacgcatcaccacccaacgggctacctcggagcactggcctcagcactatttactgcatacgcggtgaacagccggccacccctccaatggggaaagggcttgatggagctgcttccagaagccaaaaaatatattgtgcagagtgggtatttcgtggaggagaacctccagcactggagttatttccagaccaagtgggagaattaccttaagctgaggggaatcctggacggagaatctgcccctacattccccgagtcctttggagtaaaagagcgcgaccagttctataccagtttatcctatagcggctggggcggttcctccggacacgatgcccctatgatcgcttatgacgcagttctggctgccggagacagttggaaagaattggctcatagagcatttttccatggcggtgacagcgattctacagccgctatagccggttgctggtggggagtgatgtacggatttaagggtgtttcgcctagcaactacgagaagctcgagtatcgtaacaggttggaggagaccgcccgagcgttgtatagcttgggttccaaggaagatacagttataagcctgtag

SEQ ID NO: 52824 - DNA, 378 bp, Artificial Sequence
  Description of Artificial Sequence: Synthetic coding sequence
atggagaagtatgtggctgcaatggtgctgtcagcagctggcgatgcactcggatattataacggaaagtgggaatttcttcaagacggtgagaaaatccatcgtcagctggcacagctggggggattggatgccctagacgtcggcaggtggcgagtttctgatgacacagttatgcacctggctacagctgaagctttagtggaggctggcaaggcgccaaagctcactcagctttattatctgctggccaaacactaccaggactgtatggaagacatggacggcagagctccaggtggggcatcagttcacaatgccatgcaactcaaaccagggaaaccgaacggctggcggataccctttaacagccactag

SEQ ID NO: 52825 - DNA, 735 bp, Artificial Sequence
  Description of Artificial Sequence: Synthetic coding sequence
atggctcctagaccactcggccctttggtgttggctttagggggtgcagcagccgttcttggcagcgtgttatttatcctgtggaagacgtattttggcagagggagggagcgaaggtgggaccgtggagaagcatggtggggtgccgaggcagctcgattgccagagtgggacgagtgggatcctgaggatgaggaggacgaagagcctgcattagaagaactagagcaaagggaagtgctggtgctcgggctggacggggctggcaagagcacgtttttacgcgtgttgtcaggcaaaccacctctggaagggcatatccccacatggggattcaacagcgtgcgcttacctaccaaagactttgaagttgatctactggagatcgggggatctcaaaatctgaggttttactggaaggagttcgtaagtgaggtagacgtattggtcttcgttgtcgacagtgcagataggctgcggctcccgtgggcccgacaggagttgcacaaacttctcgataaagatcctgatctgccggtggtagtggtggctaataagcaggatctgagtgaagcaatgtctatgggcgagctccagcgcgagcttggcttgcaagccattgataaccagcgcgaggtatttctcctggcagcttcaattgccccagcgggacccaccttcgaggaacccggtacggtgcatatctggaagctgttgttggagctgctgtcatag

SEQ ID NO: 52826 - DNA, 771 bp, Artificial Sequence
  Description of Artificial Sequence: Synthetic coding sequence
atgtttcggctcctcagcagttgttgtagctgtctgagaaccaccgaggagacacgcagaaacgttacgatccccataatagggctgaacaattccggaaagacagttctcgtggaagctttccagaagttattaccctccaaaacagaccactgcatgaagagcgagctcacaaccttgttactcgacgagtacgagctgtctatttacgacctgaacggggacctgaagggacgggaggcttggccaaattattacgcacaggctcatgggctcgtgtttgttctggacagcagtgatattcgacgaatgcaggaagtgaagatcattctgacccatctgttaagcgacaagagggtggctggcaaaccaattctcatcttggccaataagcaggataagaaaaaagcacttatgccgtgcgacattatcgattacctattgctgaaaaagctggtgaaagagaataaatgcccatgtagagtggagccttgtagcgcaatacggaatctggaacgaagaaatcatcagcccatagtggagggcctgaggtggctgctggccgtgattgatacctgtcaactcccccctacttcaagcatctctataagcaagaataataccggcagtggcgagaggtgtagctcgcacagttttagtacccgcactggcatgtctaaagagaagaggcagcatctcgagcaatgctctattgaagccaagccacttaaatccatcctgcagcctagcaatcagagttacactcattag

SEQ ID NO: 52827 - DNA, 873 bp, Artificial Sequence
  Description of Artificial Sequence: Synthetic coding sequence
atgttccggctcctgtcgtcatgctgttcgtgtctgagaactacagaagagacacgacgtaatgtgacgatccctattatcggactgaataattccggtaagaccgtgttggtggaggcgtttcagaagctcctgccaagcaagacggatcattgcatgaagagcgagctgacgactctcttgctcgacgagtacgagctcagcatctacgatttgaacggagatcttaagggaagggaggcttggccaaattattacgcacaggctcacggtcttgtctttgtacttgattctagtgacattcgcagaatgcaggaagtcaagatcatcctgacccacctcctttcagataaacgggtcgccggaaaacccatcctcatcttggcgaataaacaggacaagaagaaggcgttaatgccatgcgatatcatcgactatctcctgctcaagaaactggtcaaggaaaacaaatgcccctgtagggtggaaccctgttcggccatccgaaacctggagcggaggaaccaccagcccattgtggaggggctgaggtggctgctcgcagtgattgacacatgtcagcttcctcccacatcctctatatccatcagtaagaataatacaggctctggtgagaggtgcagcagccactcattcagcacccgtaccggtatgtctaaggaaaagcgccagcatctggaacaatgcagtatcgaggctaagcctcttaagagcatcctacagaaggagggaacaaggctctggagtaaaaagaatatgtccgttacattcgccctagacgaacccatgaaggagggggaatgttcaaggcggatgagggcccagaacactaccaaactgtgctacaactag

SEQ ID NO: 52828 - DNA, 594 bp, Artificial Sequence
  Description of Artificial Sequence: Synthetic coding sequence
atgcgggtggccggtggccgtgccctgtccagaggcgctgagctccgagtgcccggtggagccaaacatggaatgtgcctattgctgggcgctactggcgtgggtaaaaccctgcttgtcaagaggctgcaggaggtgtcctcacgagatggcaagggggacctcggagaacctccgccaacccgccctacagtgggaacaaaccttacagacattgtggcacagcgaaaaataaccattcgtgagcttggcggttgtatgggtcccatctggtcctcctattacgggaactgtcgatcactcctgtttgtcatggatgctagcgaccccactcagctatctgcttcgtgtgtacagctcctcggccttctctccgccgagcagctggctgaggcctctgtgctcatcctgtttaacaagatcgaccttccctgctatatgagcactgaagagatgaagtccttgatcaggctcccagacataattgcgtgtgctaaacagaacataacaactgctgaaatcagcgccagggaggggactggcctggccggtgtgctggcctggctgcaagcaacccaccgggcaaacgactag

SEQ ID NO: 52829 - DNA, 540 bp, Artificial Sequence
  Description of Artificial Sequence: Synthetic coding sequence
atggggcaattgatagcgaaacttatgtccatatttgggaatcaggagcatacggtgattatagtgggcttagacaatgagggcaaaactacaatactgtatagattcctcactaatgaagtggtacacatgtgtccaacgataggctctaacgtggaagaaatcatccttcccaagacccacttctttatgtgggacatagtaaggcctgaagccttatcatttatctggaatacctattatagcaataccgagttcataatactggtgatagattctactgaccgtgacagactcctgactacacgcgaggagctgtacaagatgctcgctcacgaagcactgcaggacgcttcggtgctcatatttgctaacaagcaggacgttaaggactcgatgcgaatggtcgaaattagtcatttcctcacactgtccacaatcaaggaccactcatggcacattcagggctgctgtgctctgacaagagagggactccctgcaagactgcagtggatggaatctcaggccgctgcgaattag

SEQ ID NO: 52830 - DNA, 540 bp, Artificial Sequence
  Description of Artificial Sequence: Synthetic coding sequence
atggggcaactcattgccaagctgatgagcatttttggcaaccaggagcacaccgtaattatagtgggcctggataatgagggcaaaaccactattctttatcggtttctgaccaacgaagtcgtgcatatgtgccctactataggatccaatgttgaggagatcatacttccaaagactcatttcttcatgtgggacatcgtgcggcctgaagccctttccttcatctggaatacgtactacagcaacaccgagtttataatccttgtgattgactccaccgaccgcgacagattgctgacaacacgcgaggaactatataagatgcttgctcacgaggcattacaggatgcaagcgtgctaatctttgcaaacaaacaggatgtgaaagattcaatgagaatggtggaaataagccactttctgactctgagcactatcaaagaccactcatggcacatacagggatgctgcgccctgactcgcgaggggctgcctgcaaggctgcagtggatggagtcccaagctgccgctaattag

SEQ ID NO: 52831 - DNA, 3935 bp, Artificial Sequence
  Description of Artificial Sequence: Synthetic coding sequence
atggatctgtttgatttttttcgtgattgggacctggagcaacaatgccattacgagcaggacaggtctgccctcaaaaaacgcgaatgggagcggaggaaccaggaggtgcaacaggaagacgatcttttttctagtggctttgacctgttcggcgagccatacaaggtggctgagtacacgaacaagggtgatgctcttgcaaatcgggtgcagaacacactgggaaactacgacgaaatgaaaaacctccttaccaatcatagtaatcagaatcatttagtgggaattcctaaaaatagtgtgccccagaatccaaacaacaagaatgaaccctctttttttcctgagcagaagaataggatcattccccctcatcaggacaatacgcacccttctgcccctatgcccccaccgagtgtggtgatccttaatagtacgctgattcactctaaccgtaagtcaaaaccagaatggtcccgagattctcataatccatccaccgtcctggcttctcaggctagcggccagccaaacaaaatgcagaccctcactcaagaccagagtcaggcaaagctagaggatttttttgtctaccctgccgagcagccgcagattggcgaggtcgaggagtccaacccctcagccaaggaggattcaaatccaaattcctcaggcgaggacgcgttcaaggagatatttcagtccaactctccagaagagtctgagttcgccgtacaggccccaggaagccccttggtagcaagttcactgttggcacccagtagtggtctgtctgtgcagaatttcccacctgggctgtattgcaagacctccatggggcagcagaagccgaccgcctacgtgagacccatggacgggcaggatcaggccccagatatctcaccaaccctgaaaccctcaattgaatttgagaattcattcggtaaccttagttttgggaccctcctagacgggaaaccctccgccgcatcctcgaagacaaagttgccaaaattcacaatccttcagaccagtgaagtctctctgcctagtgatccctcatgcgtagaggagattctcagagaaatgactcactcctggcccacccctctgacctctatgcacacagctggccactccgagcagtctaccttttcaatacccggacaagagagccagcacctcactcctggcttcactctgcaaaaatggaacgacccaactaccagagcttcgactaaaagcgttagcttcaagtctatgttagaggacgacctgaaactcagcagcgacgaggatgacttggaaccggtgaagactctgacaactcagtgcaccgccactgagctttaccaggcggtggagaaggctaagccacggaacaatccggtcaacccacccctggccacaccccagcctcccccagctgtgcaggccagtggcggtagcggcagtagcagcgagtctgaatctagtagtgaatctgactctgataccgaatcttctactacagatagcgagtctaatgaggcccctagagttgcaacaccagagccagagccccctagcaccaataaatggcagctggataaatggcttaataaggtgaccagccaaaataaaagctttatctgcgggcagaatgagacgcctatggagactatatctctgccaccgccaatcatacaacctatggaagttcagatgaaggtgaaaaccaatgcctcccaagtgcccgctgaaccgaaagagaggccgctgttatccctaataagagagaaggccaggcccagacctacccagaagattcccgagaccaaagccctgaagcataaactttccacgacaagtgagacggtgagccagcgcaccatcggtaaaaagcagccgaagaaagttgagaaaaatacatccacggacgagtttacctggcctaagcccaatataacctcctcaaccccaaaggaaaaagaaagcgttgagctgcacgatccgccaagaggccgaaataaggccaccgcacacaagcctgctcctcgtaaagaaccccgaccaaatatccccctggctcctgagaaaaagaagtaccgaggtccaggaaaaatagtgcccaagtctagggagttcatcgagaccgactcaagtactagcgactcaaacacagaccaggaggaaactctgcagatcaaagtgctacccccttgtatcatttccgggggaaacacagcaaagtctaaagagatctgcggagcgtctcttaccctttcaaccctgatgtctagctccggctccaataacaacttatccatttctaacgaagaacccaccttttcaccaattccggtcatgcagactgagatcctttcacctctcagggaccatgagaatctgaaaaatctgtgggtaaagatcgacttagacctgctgagtcgggtccctgggcactccagtctccatgctgcacctgctaaacccgatcataaagaaactgcaacaaagcctaagcgtcagaccgcagttactgctgttgaaaaacccgctcccaaaggaaagcggaaacataaacccatagaggtcgccgagaagatacctgagaagaaacagcgccttgaagaggcgactacgatctgtctgctgccaccatgcatctcgccagcgcctccccataaaccccctaacaccagggagaataattcttctcgcagagccaaccgaaggaaggaggaaaaactcttcccaccacctctcagcccccttcccgaggaccctccgaggaggcgcaacgtcagcggaaataacggaccatttggccaggacaaaaacattgccatgacaggccagatcacaagcaccaagccaaaaaggaccgagggcaagttttgcgctaccttcaaagggattagtgttaatgagggcgacaccccgaagaaggcatcgtctgctacgataaccgtcacgaacacggctattgccacagctaccgtgactgcgaccgccatcgtgacgaccaccgtcacagcaacggcaacagcgactgctacaacaaccacaaccacaaccacaatttccaccatcacatccacaatcactactggacttatggattcctctcacctcgaaatgacaagttgggcagccttgcctctcttgtcatcttcttccactaatgttaggcgcccaaaactgacgtttgacgatagcgtccacaacgccgattattatatgcaggaggctaagaagctcaaacacaaagccgacgcactgtttgaaaaattcggcaaggcagttaactacgccgacgccgctctgtcatttaccgagtgcggcaacgctatggaaagggaccccctggaagcaaaatccccttacaccatgtattctgaaacagtggagttgctccggtacgccatgagacttaagaactttgcgagcccactcgcttccgatggcgataagaaactggccgtactgtgctatcgctgcctcagcctgctgtacttgcgcatgtttaagctcaagaaagatcacgcaatgaaatatagtagatcattaatggagtattttaagcagaacgcatctaaggtcgcacaaattcccagcccttgggtcagtaatggcaaaaacacgccatcccctgtgtctctgaacaacgtgtcgcccattaatgcaatgggcaactgtaacaatggtcctgtaactatacctcagcgaatccaccatatggcagcaagccacgttaacatcacttccaatgtgctgagaggctatgagcattgggatatggctgacaaattgacccgcgagaacaaggagttctttggtgaccttgatacacttatgggtccattaacacagcatagctctatgactaacctggtaaggtacgtccgccagggcctgtgctggttgcgcatcgatgcccacctgttgta

SEQ ID NO: 52832 - DNA, 3830 bp, Artificial Sequence
  Description of Artificial Sequence: Synthetic coding sequence
atggacctgtttgattttttcagggactgggatttggagcagcagtgccactatgaacaagataggtcagcactgaagaagcgggaatgggaacggaggaaccaagaggtgcagcaagaagatgatctgttttcctcgggctttgatttgttcggcgaaccgtacaaaaccaataaaggggatgctctggccaatagggtgcagaatacgctcggaaattacgacgaaatgaagaatctgctcaccaatcactctaaccagaaccatctggtgggcattccaaaaaattccgttccgcagaatccgaataataagaatgagccatcctttttccctgagcagaaaaatagaatcatccccccacatcaggataatacacacccttctgctcctatgcctcctccttccgtggttatcctcaattccactttaatacacagcaatagaaagagcaagccagaatggtcacgggattctcataatccctcaactgttttggccagccaggcctcaggtcagccaaacaaaatgcagactctcactcaggatcagtcccaagccaaattggaggacttttttgtctaccccgctgagcaacctcagattggggaggtggaggagagtaatccgagcgcaaaggaagatagcaaccccaactctagcggggaggatgcgtttaaggaaatctttcagtctaatagccccgaggagtcagaatttgccgtgcaggcccctggctcccctctggtagccagcagtctcctggctcccagtagtgggctgtctgttcaaaactttccgcctggactgtactgcaagaccagtatgggacagcagaagccaaccgcctatgtaaggcctatggatggacaggatcaggcccctgacatctcccctactttgaaaccatccattgaatttgaaaatagtttcggaaacctgagcttcggtaccttgctcgatgggaagcctagtgccgctagcagcaagaccaaactgcctaagtttaccatattacaaacttcagaagttagcctgccttccgatccttcctgtgtcgaggaaatcctcagggagtcacaacaccttacccctgggttcaccctccagaagtggaatgaccctacgactagggcctctacaaaaagtgtgagcttcaagtctatgcttgaagatgatctgaagttgtcttccgacgaggatgacctggagccagtgaagacacttaccacgcagtgcaccgccacggaactttaccaggctgtcgaaaaagctaagcctcggaacaacccagtcaacccaccactggccaccccccagccccctccggctgtgcaggcctccggtgggagcggatccagcagcgagagtgagagctccagcgaatccgattctgacactgagagcagtactaccgatagcgaaagtaatgaggcaccaagagtagccacgccagagcccgaaccaccgtccactaataagtggcagctcgacaaatggctaaacaaggtgacaagtcaaaataaaagctttatttgtggccaaaatgagacgccgatggaaacaatctctctcccaccacctattattcagccgatggaggttcagatgaaagtgaaaacaaacgcgtcccaagttcccgctgaaccgaaagagcggccactgctatccctgattagagaaaaggctcggccacgccctacccaaaagatccccgagactaaggcccttaagcacaaactgtcaactactagcgagactgtctctcagcgcaccattggtaaaaaacagcccaagaaagttgaaaaaaatacctccaccgatgagtttacgtggcctaagccaaatatcacttcatccacgcccaaggagaaagaatctgtcgaactccacgaccctcccagagggaggaacaaggctacagcacataagcccgctcccaggaaggagcctcgtcctaacatcccattggcgcctgagaagaagaaatatcgcggtcctgggaaaatcgtgccgaaaagtcgcgaatttatcgagacagattcctctacctccgactccaacacagatcaggaggaaacgctgcagataaaggtgctccccccatgcataatttcaggcggtaacacggccaagtccaaggaaatttgtggggcatcccttacgctatcaacactaatgagcagctccggtagtaacaacaacctgtccattagcaacgaggaacctacatttagtccaatccctgtgatgcaaaccgagatactgtctccattgcgagaccacgagaacctcaagaatctgtgggttaaaatcgatctcgacctgctgtcccgcgtgcccggacattcatccttacacgcagcacccgctaaacctgatcacaaagaaactgctactaaaccgaagcgtcagacagcagtcactgcggtcgaaaagcctgctcctaaggggaaacgaaaacataagccaattgaggttgcagaaaagatccctgagaaaaagcagaggctcgaagaggccaccaccatctgcctcttgcccccatgtatcagtcctgcccctccgcacaaaccgcctaatacccgggagaataattcttctagaagagcaaaccggaggaaggaggagaaattgtttcccccaccccttagccctttacctgaagaccctcccaggcgaaggaacgtcagcggcaacaatggccctttcgggcaggacaaaaacatagcaatgaccgggcagattactagcacgaagcctaagaggactgaggggaagttttgcgccaccttcaaagggatcagcgaaggggataccccgaagaaggcttcatcagcaaccattaccgtcacaaacacagccattgccactgcaaccgtgacagccaccgccattgttacaacgaccgtgaccgcgacggccactgcgactgccaccaccacgactactaccacgacgatatctacaatcacctcaactattaccaccggactcatggattcatctcacctggagatgacatcgtgggccgcactccctctgctgtccagttctagcaccaatgtgaggaggcccaaactgacatttgatgatagcgtacataatgcagactactatatgcaggaagcgaagaaactgaagcataaagccgatgcattattcgagaaatttggaaaagcagtgaactacgccgatgctgctctgagtttcacggagtgtgggaacgctatggagcgggaccccctagaagctaagtccccttataccatgtatagcgagactgtggagttactcaggtatgctatgcgcttgaagaactttgcctccccgctcgcaagtgacggagacaaaaagctcgccgtcctgtgctatcgttgtctgtccctgctgtatctgaggatgttcaagcttaaaaaggaccatgctatgaaatactctaggagcctgatggagtatttcaagcagaacgcttctaaggtggcacagattcctagtccctgggtgtccaacggtaagaatacacccagccctgtgagcttgaacaacgtgtccccaatcaatgcaatggggaactgcaacaacggcccagttacaatcccacaaagaatccaccacatggcggcatcccatgtaaacattacctcaaacgtcctcaggggttacgagcattgggacatggcagacaagctcacccgtgaaaataaggagttctttggagatctcgacacgcttatggggccactgacccagcatagctctatgaccaatctggtgaggtacgttaggcaggggttatgctggctgcgcatcgatgctcacctgctcta

SEQ ID NO: 52833 - DNA, 1332 bp, Artificial Sequence
  Description of Artificial Sequence: Synthetic coding sequence
atgacacgaccacggaaacatgctgagacactcgggggaggtaagctgtgcgacttgttttgtggacgacctgggcaggtcagctcctcccggggtaggcagggcatcccagatatggagccgatcgtacacatccaccaggaactgcttactggtatcgagagcgaggcgtccctctcaaagttgagccccactagccagaagggaacaagttctagctcttcctacattttccagaaaatcagccagggtaagcagatgtgtcaaaagctaaaggaacagacagatcagttaaagaccaaggttcaagaatttagtaaaaggatcaaacaggacagcccctatcacctacaagataagaaactggtgctcgaaaagcttcagggccacctggagctgctggagcaaaatttcctcgccactaaggacaagcatctgaccctacagcaacaagtgcacaaacacgagagcactatcgtcggcgacttcgatccagagcgcaaagttgagggagagatcttcaagcttgaaatgttgctcgaggacgtgaaagagaagatggatgaatctaagtacacttccgccccatccctccccgtttcaagccccgtgacgctggacgacctggcttcaaccttcagcagcctgagtaatgaaatccccaaggagcaccctggccaccccagtggtccaagagggtctggtggcagcgaggtaaccggcacgcctcagggcggaccccaggaagctcccaacgaagagctgtgcgaacttgccccacagacgtacctcaatggccattacggggacgccgcagcacagaacaagccggatcaggtcgcgatgcggcttagctccaacagcggggaagatcctaacggcacgcctaggaggcaagactgcgctgagatgactgcacctagcccctcatgtgccttttgtcgaagacttctggagtggaaacagaacgtcgaaaaaaaagggcatggaagaatcaactgtgggagattctcaatcgttcttcatgaaaaggcaccccacagcgattctacacctaactccgacaccggacacagtttctgtagtgactccggaaccgagatgcagtcaaataaatgccaggactgcgggaccaaaatacccacttctcggagagcatgccgcaaagagccgactaaggaatttcactacagatacaacacccctgggcagaactactccaatcactctaagcgcggagcattcgtccagcctcactctttggatgaatcaaagaatagttccccatgtaagtacattagctgtatgacaccatctatcagcactacctag

SEQ ID NO: 52834 - DNA, 2169 bp, Artificial Sequence
  Description of Artificial Sequence: Synthetic coding sequence
atggatgaggctgatttcagtgagcacaccacatacaagcaggaggatctaccatatgacggcgatctctcccagattaagatagggaacgattatagtttcacatccaagaaagatggcttggaagtgctcaaccagattatcttcatcgcagacgacccccaagaaaaggcaatgcattccgaaacttgtggtaatacagccgttacgatcccactggggaaaataaccgaaaacgccgctaataagaaagatgaaaaggaaaaacaatgtaccgctgccttgcatatacccgcaaatgaaggcgatgccagtaagagttccatatccgacatccttcttcaccacttgagtaaggaacccttcctcagagggcagggcattgattgcgagacactgcctgaaatttctaatgcagacagcttcgaagaagaagccataatcaagagcataattagctgttacaacaaaaactcctggccgaaagaacaaactcctgaattgactgaccagctcaaccccaagcgcgacggcgaaaatagcaacaagccgggatccgccaccaccaccgaagagaatacttccgacctcgagggcccagttgcagccggtgattcctcacaccaggagaatgtaaatgtgctgacaaagactaagggaccaggggacaaacagaaaagctaccaaggccagagcccacagaagcagcaaaccgagaaggccaatagcggaaacaccttcaaatacggccagggacaagtgcattaccagcttccagacttcagcaagatagccccaaaagtgaagatccctaagaacaaaattattaataagcctttggctatagccaagcaagcttctttctcgtctaagagccgagacaagccaacattggtgcaggacagtttggaaacgactccagaatctaactgcgtggaaaagcagcatcaggaacagaagggcaaaatcaccgagccatcccaacagatccagatggaacctattgtccatatccaccaagaattactcactggtattgagtccgaagcctccctatccaaactgtccccaaccagtcagaagggcacaagctcttcctcttcatacatctttcagaaaatcagtcagggaaagcagatgtgccagaaacttaaggagcagacggaccagctcaagactaaggttcaggaatttagtaagcggatcaagcaggattccccctaccacctccaggataaaaaactcgtgcttgaaaaattgcaaggccatctagaattattggagcagaattttctcgcaactaaggacaaacacctaactctgcagcagcaagtgcacaaacacgagagcacgatcgttggcgacttcgatcctgagagaaaagttgagggggagatatttaaattagagatgctgttagaggacgtcaaggagaaaatggatgagagcaaatacaccagtgccccatctctgcctgtgagttcgcctgtgactctcgacgatctggctagtaccttttcatcgttgtccaatgaggcccctaatgaggagctgtgcgagctggcaccacaaacttatctgaatggacactatggagacgcagccgcacagaacaaaccagaccaagtggcaatgcgactgtcgtccaatagcggtgaagatcctaacggtactcctcgcagacaagactgcgccgaaatgactgccccaagtcctagttgcgccttctgcaggcgcctgctcgaatggaagcaaaatgtggaaaaaaagggccacggcaggataaattgcggacgtttttctatcgtattgcatgagaaggccccacattccgacagcacacctaactctgacacgggtcactcattttgttcggattccgggaccgagatgcagagcaacaagtgccaggactgtgggactaaaattccaacttcgcgcagagcctgccgcaaagagccaactaaagagtttcactataggtacaacacaccaggacaaaattactccaatcacagcaaaagaggcgcattcgtccagccacattccctggatgaatccaaaaactcaagcccatgcctagtccattcacctgatacttctaaatccagtcctacaagtggatggcaggaggccgagctgggcctcgagaacatgaagagtcaatag

SEQ ID NO: 52835 - DNA, 2286 bp, Artificial Sequence
  Description of Artificial Sequence: Synthetic coding sequence
atggacgaagcagatttttcagagcacactacttataagcaggaggacctgccttacgatggcgacctgagccagatcaagattggtaatgattacagcttcacgtccaaaaaggatggcctggaagtcctgaaccagataatcttcattgccgacgatccccaggaaaaagccatgcattccgagacgtgcgggaacaccgctgtcaccatccccttaggcaaaatcaccgagaatgcggctaataagaaagatgagaaagagaaacaatgcaccgcagctctccacatccctgccaatgagggcgatgcatcaaaaagcagcatctccgatatcctgctgcatcatctgagtaaagagccatttctgcgtggccagggcatagattgcgaaactttgcccgaaatcagtaatgccgacagttttgaagaggaggccattatcaagagcatcataagctgctacaataaaaacagctggcctaaagagcaaacaccagaacttacagaccagttaaatcctaagcgagatggggagaactccaacaaacccggttcggctaccacaacggaggagaacacaagcgatttagagggcccagtggccgcaggtgactcgagtcaccaggaaaacgtgaacgtcctgactaagaccaaaggtcccggtgataaacagaagtcctaccaagggcagagcccgcaaaaacagcaaacagagaaagcaaactcaggtaacacctttaaatatggccagggacaggtgcattaccagctgcctgattttagtaagatcgcacctaaggtaaagatccccaagaataagatcataaataaaccactcgccatcgcgaaacaggccagtttcagttccaaatccagagacaaacctacccttgttcaggactcactggagactactcctgaaagtaactgtgttgagaaacagcaccaggaacagaaaggcaagatcaccgagccttctcagcaaatccaaatggagcccattgtgcacattcaccaggagctcctgacaggcattgaatccgaggcgtcactctctaaattgtccccaacctcccaaaaggggacttcaagcagcagcagttacattttccaaaagatcagccagggcaaacagatgtgtcagaagctgaaggagcagactgatcagctgaagacaaaggtacaagagttctcaaagaggattaagcaggattccccttatcatctccaggataagaaacttgtactggagaagctgcagggccatctcgaactccttgaacagaattttctggccaccaaagataagcacctgaccctccagcaacaggttcataagcacgagagcacaatcgtgggcgacttcgaccctgaacgcaaggtggaaggagaaatctttaaactggaaatgctgttagaagacgttaaggaaaaaatggatgagagcaagtatacctccgcacccagcctgcccgtgtcgtcccccgtcacacttgatgacctcgcttccacctttagcagcttgagcaatgaaatcccaaaggaacaccccggacacccatctggtcccaggggtagcggcggttcagaggtgactggcacaccccagggcggtccccaggaagctcccaacgaggaactgtgtgagctagcccctcagacttacctgaacggacattacggggacgctgcagcccagaacaaacctgatcaggttgctatgcgcctcagttcaaactctggtgaggatcccaacggtacccctcggaggcaggactgcgcagagatgactgccccttccccctcctgtgctttttgccgacgcctgttagagtggaaacagaacgtggagaagaaagggcatggaaggattaactgcgggcgattctcgatcgtgctacacgaaaaagctccgcactctgacagcacccctaactctgacactggccactcattttgttcagattctgggaccgagatgcagtcgaacaaatgccaggactgtggcactaagattcccacgtctaggagggcctgtcgcaaggaacctacaaaagaatttcactaccggtataatactcccggtcagaattacagtaatcatagcaagagaggcgcattcgtgcaaccgcattccctggacgagtccaagaactcctccccaagcctggccagccccttctgctgccccggtctcgtccattcccccgataccagtaagagctcgcccacgagcggctggcaggaggccgagctcggattagaaaacatgaagagccagtag

SEQ ID NO: 52836 - DNA, 2511 bp, Artificial Sequence
  Description of Artificial Sequence: Synthetic coding sequence
atggacgaagctgattttagtgagcacacgacttataagcaggaggatttaccctacgatggggatctgtctcagattaagatcggaaatgactactctttcacctccaaaaaggacggattagaagtcctgaaccagatcatttttatcgccgatgacccccaggaaaaggccatgcattccgaaacatgtggaaatactgctgtgaccatccccttgggcaagattaccgaaaacgccgctaataaaaaagatgagaaagagaagcagtgcactgccgcactccacatccctgctaatgaaggcgatgccagtaaaagctccatctcagacatcctcctgcaccatctgtccaaggaaccattcctccgaggccagggaatcgactgtgagacactccctgagatcagcaatgcagactcttttgaagaggaggccattataaaatcaatcatcagctgctacaataagaacagttggcccaaggaacagacccccgaactgaccgaccagttgaatccaaaacgagatggcgaaaacagcaataaaccgggttccgctacaacaactgaggagaacacgtccgatctggaaggtccagtggctgccggtgactcttcccaccaggagaatgtgaatgtcctgaccaaaaccaaagggccaggagataaacagaaaagttatcaggggcaatccccccagaaacagcagaccgaaaaggccaatagtggaaatacttttaaatacggtcagggtcaagtccactaccagctccccgattttagcaaaattgccccaaaggtgaagatcccaaagaacaaaataataaataaacccctggccattgctaagcaagcaagcttcagctccaagtcaagagacaaaccgaccctcgtgcaggacagcttagagacaacaccagaatcaaactgcgtcgagaagcagcatcaagagcagaaagggaagattactgagccttcccaacagatccaaatggagccgattgtgcacattcatcaggaattgctgactgggatcgaatctgaggcatccctctctaaactgagtcccacttcgcaaaagggaacaagctcttctagttcttatatatttcagaagatctcacagggaaagcagatgtgtcaaaaattgaaagagcagacagaccagctgaagactaaggtgcaagaattctccaagagaatcaagcaggattccccataccatctccaggacaaaaagcttgtactcgaaaagcttcagggacacctggagcttttggagcagaattttcttgcgaccaaagataaacacttgaccttgcagcaacaggtccacaagcacgagtcaactattgtcggagacttcgatcccgagcggaaggtggaaggcgaaatctttaaactggaaatgctgcttgaggacgtgaaagagaagatggatgagtccaagtacacctcagcacccagcctgcctgtgagctctccagtgacgctggacgatcttgcatctacgttttcctccctaagtaatgagattcctaaagagcaccctggacatccctccggtcccaggggctccgggggttctgaggtgactgggactccacaaggcggacctcaggaagcacccaatgaggagctgtgtgagcttgcaccacagacctaccttaacggccactacggagatgcagcagcgcagaataagccagaccaggtagccatgcgcttatcctccaacagtggtgaggaccctaacgggactccacggagacaggattgcgcagagatgacagcaccaagtccatcctgcgcattttgtaggcgcctcctagagtggaaacaaaatgtagagaaaaaggggcacggtcgaataaattgtggcaggtttagcatcgtgctgcacgaaaaggcccctcattccgactccacaccgaacagtgatacaggacacagcttctgcagcgatagtgggacagagatgcaaagcaataaatgtcaggactgtggaaccaaaattcctacatccaggcgcgcttgtaggaaagagccgaccaaagagtttcactatcgatacaatacgcccggacagaattactcaaatcacagcaagaggggggcattcgttcaaccgcattcacttgatgagagtaagaactcaagcccctcttttctgaaacctaaaagaatttgttctcagcgcgtcaactccaaatcttttaaaggcgaacatgagccaactccaggcaaaaagaagctgcaagctttcatgacttactccagcgacccagcaactcccagtccccacttttatagttgcaggattagcgggagtaaatctctgtgcgattttgatagtactgaggagatcaagagtgagattctgaactccgcactggatcacgccctgcgtacagccaccattctgaaagagacaactgaccagatgattaagaccatcgccgaggaccttgccaaggcacaacggtggagaaaccggctcaaatattag

SEQ ID NO: 52837 - DNA, 1035 bp, Artificial Sequence
  Description of Artificial Sequence: Synthetic coding sequence
atggtgctgcaaatggaaccccaggtcaacagtaccaacaattttcatcagggtcccttagatcaaccggtcggcccactcactggcctcaaaagctccctgctgaaggacactacatccgccggacccttgctgcgtccttaccccgctagcctgctcggtaaagtcaaagaagctgtgaaggtggcgatagacgcagaatataggcacattgactgtgcctatttctacgagaaccaacatgaggtaggcgaagccatccaggaaaaaatacaggaaaaagctgtgatgcgtgaagacctcttcatcgtcagtaaggtgtggcctacctttttcgagaggccactggtgcgcaaagcctttgagaagacactgaaggacttgaagctttcttacctggatgtctatctcattcactggccacaaggattcaaaaccggagatgactttttcccaaaagatgacaaaggcaacatgatttccgggaagggaacctttcttgacgcatgggaagccatggaggagcttgtagacgaagggctcgtcaaagcattgggcgtgtctaatttcaatcactttcagatcgagcggcttctgaataagcccggactgaagtacaagcctgtgactaaccaagttgaatgtcatccctacttaacacaggaaaaactaatacagtactgccacagtaaaggaatcacggttacagcctacagcccacttggtagcccggataggccttgggccaagcctgaggatccaagcctgctcgaggaccccaagataaaggagattgccgcaaaacacaagaaaacaaccgcccaggtgttgatacggtttcatatacaaagaaatgtgactgtaatccctaagagcatgacccctgctcacatagtcgagaatatccaggttttcgatttcaagttgtccgacgaagaaatggcaaccatcttgtcctttaaccggaactggagagccttcgactttaaggagttctcccacctagaggatttcccttttgacgcagagtactag

SEQ ID NO: 52838 - DNA, 972 bp, Artificial Sequence
  Description of Artificial Sequence: Synthetic coding sequence
atggattccaagtatcagtgcgtgaagctcaacgatggacatttcatgccagtgcttgggtttggtacatatgccccagccgaggttcccaaatccaaggccctggaggcaaccaagctggccatcgaggctggctttcgacacattgactctgcccatctttacaacaacgaggagcaggtagggctcgcgattcgatccaaaattgccgatggatctgttaagcgagaggacattttctatacatctaaactgtggtgcaactcccaccggccagagttggtgaggcccgctctggaaaggtcgctgaagaatttacagttagactatgtcgatctttacctcattcacttccccgtgtctgtcaagcctggagaagaagtgatccctaaagatgagaacggcaagatcctgttcgacactgtggacctgtgtgccacatgggaagcagtcgaaaagtgtaaagacgcgggattggcaaaatcgattggtgtctccaacttcaaccggcgacagctcgagatgattctgaataagccaggtctaaagtataaaccagtctgtaaccaggttgaatgccacccttattttaatcaaagaaagctgcttgacttctgtaagtctaaagatatcgtgcttgtcgcttacagcgccctaggaagccaccgagaagagccttgggtagatcctaactccccagttttgcttgaggacccagtgctgtgcgctctagcaaaaaaacataaacggactcctgctctgatagctcttcgatatcagctgcagcggggtgtagtggttctggccaaatcttataatgaacagaggattcggcagaatgtgcaagtgtttgagttccagctgacctccgaagagatgaaggctatcgacggcttgaacaggaatgtgcgctatctcacactggatatttttgctggtcccccaaactaccccttttcggacgagtactag

SEQ ID NO: 52839 - DNA, 972 bp, Artificial Sequence
  Description of Artificial Sequence: Synthetic coding sequence
atggatagcaagtaccagtgcgttaaactcaacgacgggcacttcatgccagtactcggcttcggcacatatgccccagccgaagtgcccaagtccaaggccctcgaggccgtcaaattggccatagaagcagggttccaccacatcgacagcgcccacgtttataataacgaggaacaggtgggcctggctatacgcagcaaaatcgccgacgggagtgttaagcgcgaagacatcttttatactagcaaactatggtccaacagtcaccgtcccgagctggtgcgcccagccctggagagatccctgaagaacctgcagctcgattatgtagatctctacctaatccatttcccagtcagtgtgaaaccgggagaagaggtgataccaaaagatgaaaacgggaagattctgtttgataccgtggatttgtgcgccacatgggaagccatggagaaatgtaaagatgctggcctggccaagagcatcggggtgagtaactttaaccacagactgttagagatgattttaaacaagccaggcttgaaatataaacccgtttgtaaccaggtggagtgccacccatatttcaaccagcggaaattgctggacttttgtaagagcaaggacatcgtgctcgtcgcttactcggccctcgggtctcaccgggaggagccctgggtggaccctaactctccagttttactggaagatccagtgctgtgcgccctggccaagaagcacaaacgcacaccggctttgatcgcattgagatatcaactccagagaggggtagtcgtgttggccaagtcctacaacgaacagaggatccgtcagaatgtccaggtctttgagtttcaactgacaagcgaggaaatgaaagctattgacggcctgaacagaaacgtgcgttatctcacattggatattttcgcgggacctcccaattatccgttttctgatgagtattag

SEQ ID NO: 52840 - DNA, 972 bp, Artificial Sequence
  Description of Artificial Sequence: Synthetic coding sequence
atggacagcaagcatcagtgtgtgaagctgaacgatggccactttatgccagttttaggattcggaacctacgcaccacccgaagtgcctaggtctaaggcattggaagtgacgaagctcgccatcgaggccggatttaggcacatcgactcggcacatttatataataacgaggagcaggtgggattggctatcagatccaaaatcgcagatggttctgtcaaaagagaagacatattttacaccagtaagctttggtcaacgttccaccgcccagagctggtgcgccctgccttggaaaactcactgaagaaagcccaactggactacgtagacctatacctgatccactctccaatgtccttgaaaccgggagaagagctttcccccactgacgagaacgggaaggtgatcttcgatattgtcgatctgtgtactacctgggaggcaatggagaaatgcaaggatgcgggactggccaaatcaattggcgtgtcaaacttcaaccgtcgccagctagaaatgatcctcaacaaaccaggactcaagtacaaacccgtgtgtaaccaagtggaatgccacccatatttcaacagatctaagttattagatttttgcaaatcaaaggatatcgtgctggtggcttattcagccttaggctcccagagagacaagcgctgggtggatccgaatagtccagtgctgcttgaagatcccgttctttgtgccctcgcgaaaaaacacaagagaactcctgccttgatcgcactccggtatcagctgcaaagaggtgtagtagtgctcgctaagtcctacaacgagcagcggatccgccagaacgttcaggttttcgaattccagctgactgctgaagatatgaaggctatcgatggcttggaccgtaatctacactacttcaactccgactccttcgcaagtcacccaaattacccatactcagatgaatattag

SEQ ID NO: 52841 - DNA, 972 bp, Artificial Sequence
  Description of Artificial Sequence: Synthetic coding sequence
atggatcctaagtatcagcgggtggaactgaacgatgggcactttatgccagtcttaggtttcgggacctacgcccctcctgaagtgccacgaaatagggccgtcgaagtgacaaagctagctattgaagccggttttcggcacatcgactcagcctacctgtataacaacgaagagcaagtaggcctggccattagatccaagattgcggatggcagcgttaagcgggaggacattttctacactagcaagttatggtgtaccttctttcagccgcagatggtgcaacccgctctggaatcgagcttgaaaaaactccagctcgactacgttgacctatatctgctccactttcccatggcactgaaacccggagagaccccattacccaaagatgagaatggaaaagtgatctttgataccgtagacttgtctgccacctgggaggtaatggagaaatgcaaagatgcaggcctcgctaaaagtattggcgtgagtaactttaactgtcgacaactggagatgattttaaacaagcctggcctgaaatacaagccagtttgtaaccaggtggaatgccacccgtaccttaaccagagtaaactactcgatttttgcaagagtaaggacattgtgctggtcgcccattccgccctggggacgcagcgccacaagttatgggtggatccaaactcccccgtgttacttgaggacccagtgctttgcgccctcgctaagaaacataagcagaccccagccctgattgcgctgagatatcaacttcagcggggagtcgtggtgctcgcaaagtcctataacgagcagcgcatccgcgaaaacattcaagtattcgagtttcagctgactagcgaggacatgaaggtattggacggtctgaaccggaattatcggtatgtggtaatggacttccttatggatcatcctgactacccatttagcgacgagtactag

SEQ ID NO: 52842 - DNA, 972 bp, Artificial Sequence
  Description of Artificial Sequence: Synthetic coding sequence
atggaccctaaataccaacgagtggagctaaatgatggtcattttatgccggtcctgggattcgggacctacgccccacctgaggtgcctagaaatagggctgtggaggtcaccaaactggctatcgaagctggattccgccatattgactcggcctacctctacaataatgaagaacaggtaggcctggccatccgtagcaagattgccgacggctcagtgaagagagaggacatcttttatacatcgaaattgtggtgcaccttttttcagcctcagatggtgcagccagctctcgaaagttctcttaagaaattacagctcgattatgtagatctatacctcctccactttcctatggcccttaagcccggagagacacccctcccaaaagatgaaaatggcaaagtcatatttgatacagtcgacctctccgccacttgggaggtcatggagaaatgtaaagacgccggactagcaaagtcaatcggcgtcagtaacttcaattgtcggcagctcgaaatgatcctaaacaagcctggcttaaagtacaagcccgtgtgcaatcaagtggaatgccatccctatcttaaccagagtaagttgctggatttctgcaagagcaaagacatcgtgcttgtcgctcacagcgctttaggcactcagcgtcacaagctatgggttgaccccaatagtcctgtcctcttggaggatccggtcctgtgtgctctagctaaaaaacataagcaaacacctgctctgatcgctttgaggtaccagttacagcggggagtagtagtgctggcaaaaagctataatgagcagcgcattagggagaacattcaagtgtttgagttccagttgactagcgaggatatgaaggtactagacgggcttaacagaaattatcgctacgtggttatggactttctaatggaccaccctgactaccctttctccgatgaatattag

SEQ ID NO: 52843 - DNA, 951 bp, Artificial Sequence
  Description of Artificial Sequence: Synthetic coding sequence
atggccaccttcgtcgagctgtccactaaggccaagatgcccatcgtgggtctgggaacatggcgatctctgttaggaaaggtaaaggaggcagttaaagttgccattgatgcagaatatcgccatatcgactgcgcttacttttacgagaaccaacacgaagttggtgaggcaattcaggaaaaaatccaggagaaagctgtgatgcgcgaagacctgtttattgttagcaaagtgtggcccacttttttcgagcggcctctggtgagaaaggcctttgaaaaaactctgaaagaccttaagctgagctatttagatgtgtacctcatccactggcctcaagggtttaaaactggggatgattttttcccgaaggatgataaagggaacatgatttctgggaaaggcactttcttggatgcctgggaagcaatggaggaactcgtggatgagggactcgtcaaggcattaggagtttcaaattttaaccactttcagattgaacggctgctgaataaacccggtctaaagtataagcctgtcactaatcaagttgaatgtcacccgtacctgacgcaggaaaaactgattcagtattgccatagcaaaggcatcacagtaacagcctactcgccccttggatccccagaccgaccctgggctaagcctgaagatccgtccctgttagaagatcccaaaattaaagagatagctgctaagcataagaagacaaccgcccaggtcttaatcagattccacatccagagaaacgtgacagttataccaaaaagtatgacccctgcacatatcgtcgaaaacatacaggtatttgacttcaagctgtctgacgaagaaatggcaacgatactgagttttaacaggaactggagagctttcgactttaaagagttctctcatctcgaggactttcctttcgatgcagagtactag

SEQ ID NO: 52844 - DNA, 84 bp, Artificial Sequence
  Description of Artificial Sequence: Synthetic coding sequence
aaccctaactggaaaagaatccggctcaatgatggcccattcatgcctgtacttggcttcggaacatatgccccagatcactag

SEQ ID NO: 52845 - DNA, 462 bp, Artificial Sequence
  Description of Artificial Sequence: Synthetic coding sequence
atgcatttgactactgcccctaggtggaaacgacattgcgtgccagcaacttcctgtacaagacgtgccagctcctggtctctcgcatccccaactatgccgcctgggaagtggcctcggtcagtgccttctgccagggcgaccgcaggatcttgtcctctttgtacatccttttggaaggaacaccactttgagggtatcgccctggtagaaaaggccctccaggccgcatatggcgcttccgcaccttcgatgacgtctgccgctctacggtggatgtatcaccacagccagctccagggagcccacggagacgctgttatcctcggcatgtcttcactggagcagttggaacagaatcttgcagcagcggaagaggggcctctggaacctgctgtcgttgatgcgttcaatcaagcatggcatctgtttgctcatgagtgcccaaattacttcatttag

SEQ ID NO: 52846 - DNA, 903 bp, Artificial Sequence
  Description of Artificial Sequence: Synthetic coding sequence
atggagttccccttcgacgttgacgcattgtttcctgagcgcattaccgtgctagaccagcatcttcgtccgcctgcaagaaggccaggaacgaccaccccagctcgcgtggatttgcagcagcagataatgacgatcattgatgagctgggaaaagcatccgctaaggcccagaatctgtcggccccaattacctccgccagcaggatgcaatctaatcgtcatgtagtgtatattcttaaggatagtagtgcacgtccggcaggaaaaggagccattatcggcttcattaaagtgggatacaagaagctgttcgtactcgacgaccgtgaagcacataacgaggtggagcccctttgtatcttggacttttacatccacgagtctgtgcagagacacggtcatgggagagagcttttccaatatatgctgcaaaaggaacgggttgaaccacatcaactcgccattgaccgccctagtcagaaattactcaagttcctgaacaaacattacaacttagagaccacggtcccgcaggtcaacaatttcgtcatcttcgaagggttttttgcccaccaacatcccccagccaggaaactcccccctaagagagcggagggcgacattaagccatacagcagcagcgacagggagttcctcaaggttgccgtcgagcccccttggcctctaaaccgtgccccaagacgtgccacccctccagcccatccaccccctcgatccagtagtcttgggaactcccctgagcggggtcccctgcgaccgttcgtgccggagcaagaactcttgcgcagcctgcgtctttgtccaccccacccaaccgcacgactccttctggccgctgatccgggaggctctccggctcagagacgcaggactcgatag

SEQ ID NO: 52847 - DNA, 933 bp, Artificial Sequence
  Description of Artificial Sequence: Synthetic coding sequence
atggaattcccattcgacgttgacgctttgttcccagaacggatcacagtgctggatcagcatctgcggccacccgcacgccgtccaggcacaactacccccgcacgtgtggatttgcagcaacagatcatgaccatcattgatgagttgggaaaggctagcgccaaggcacagaatctctccgcacctattactagcgcctccaggatgcagtccaataggcatgttgtgtacatactgaaggacagttccgcgagacctgctggaaagggtgcaatcatcgggttcattaaagtcggctacaagaagctgttcgtgttagacgatagggaggctcacaatgaagtggagcccttatgcatattagatttttatatccatgagagcgtgcagcgccacggtcacggcagggagctcttccagtacatgcttcagaaggaaagagtagaaccccaccagcttgctattgatagaccctcacagaaactactgaagtttctcaacaaacattacaacctggaaacaactgtgccccaggtgaacaactttgtcattttcgagggattctttgctcaccaacatccgccagctagaaagcttccgcctaaacgcgctgagggcgatataaagccttatagctcaagtgacagggagttcctcaaagtcgccgtagagccaccttggccacttaacagggccccaaggagagcaacgcccccagcgcacccaccccctcggagctcctccctgggcaactccccagaaagaggaccactgcggccttttgtgccagaacaggagcttttgcgcagtctgaggctgtgcccccctcaccccactgccagattactcttggccgctgatcctggtggatcacctgcccaaaggcgacggacctcaagcttacctagatcggaagaaagtagatactag

SEQ ID NO: 52848 - DNA, 1002 bp, Artificial Sequence
  Description of Artificial Sequence: Synthetic coding sequence
atggagttccccttcgatgtggatgcattattcccagagcggatcaccgtactcgaccagcatctgaggccccctgccaggagacccggaaccacgacacctgcgagagtagaccttcaacagcagataatgacaatcattgatgagctgggaaaggccagcgcgaaagcccaaaatctttcagccccaattacatctgctagtcggatgcagtcaaatagacacgtggtctatatcctcaaggatagctccgctcgccctgcgggtaagggcgcaatcatcggtttcatcaaggtcggctacaagaagctgttcgtacttgacgatcgagaggctcacaacgaggttgaaccactgtgtatcctggacttttatattcacgagtctgtccaacgccatggccacggcagagaactgtttcagtatatgctgcagaaagaacgcgtggaaccccaccaattggcaattgacaggcccagccaaaagctgctgaagtttctgaataagcattacaacttggagaccacagtgccgcaggtcaataactttgttatctttgaaggcttcttcgctcaccagcacagaccgccagctcccagcctcagagccaccagacattctcgcgcagcagcggttgatcctacccctgccgctccagctcgtaagctccccccaaagcgggctgagggggacattaagccgtactcaagtagcgacagggagttcttgaaagtggccgtggagccaccctggcccttaaatcgcgctcctaggagggccacacctccggcacatcctccgccacgctccagtagtctgggaaatagtcctgagagagggcctcttagaccctttgtacctgagcaggagttacttcgctcgttgcgactctgcccacctcacccgaccgcaaggctacttctggcagcagatccaggtggctcgcccgcacagcggagacgcacctcttcgctacctaggagtgaggagagcaggtactag

SEQ ID NO: 52849 - DNA, 1230 bp, Artificial Sequence
  Description of Artificial Sequence: Synthetic coding sequence
atgtggctaacctggcctttttgtttccttacaatcacattacgcgaagagggcgtgtgccacctcgagtctgtcgacctgcagcagcaaatcatgaccatcatcgacgagctggggaaagctagtgctaaggcccaaaatctctcggctcccatcacctcagcctcccggatgcagtcaaacaggcatgtggtgtacatcctgaaagatagtagtgcgcgtcccgctgggaaaggcgcaataattggcttcatcaaggtgggctataagaagctgtttgtactggacgatagggaggctcacaacgaagtagagcccttatgtattctggatttttacatccatgagtctgtccaaagacacggtcacggacgggaacttttccagtacatgttgcagaaggagcgagtagaacctcatcagctggccatagaccgaccaagccagaagcttttaaagtttctgaacaaacattacaatctggagactacagtccctcaggtgaacaatttcgtgattttcgaggggttctttgcacatcagcaccggcctccagctccgagcttacgtgctacccgtcattcaagagctgcggcagtagacccgactcctgcagcacctgccaggaagctgccaccaaaacgggcagagggggatataaagccttattcatcttctgatcgggaatttctgaaggtggctgtggaaccaccgtggcctctgaatcgcgctcccaggagggccacgccgccagcgcacccacccccacgaagcagcagtctcggtaattctccggaaagagggccactgcgcccttttgtgcccgaacaggagctcctgcgttctctccgcttgtgtcctcctcatcctacggctaggttgctgctggctgctgaccctgggggttcccctgctcagaggcgacgtacccgaggaacacctccaggcctcgtagctcagtcctgctgctattcacggcacggtggtgtgaatagtagctctcctaacacagggaaccaggactcgaagcagggcgaacaagaaactaaaaaccgaagcgcgtctgaggagcaggcactgagtcaagatggatccggggaaaagccaatgcacacagcccctcctcaagcccctgctccgcctgcccagtcctggactgtgggtggcgacatcctgaacgctcggtttatccggaatctgcaagagaggcgcagcacaagaccatggtag

SEQ ID NO: 52850 - DNA, 1197 bp, Artificial Sequence
  Description of Artificial Sequence: Synthetic coding sequence
atggaattccccttcgatgttgacgccttgttcccagaaaggatcacagtgctcgatcagcacttgaggcctccagctcgccgtccaggaaccaccactcccgcacgcgtcgacctgcagcaacagatcatgaccatcatcgatgagctgggaaaggcaagcgcaaaggctcagaatctgagcgctccaatcacctcggcgtcccgcatgcaaagcaatcgacatgtggtatacatcctcaaagacagcagcgcgagacctgctggcaaaggtgcgattattgggtttattaaagtgggatataaaaaactgttcgtcctggacgatagagaagcacacaacgaggtggaacccctatgcattttagacttttatatacatgagtcagtgcagcggcatggccatggccgagaattgtttcagtacatgttgcaaaaagaacgcgttgaacctcatcaactggccatcgatcgcccttcgcagaagctgttgaagtttttgaataaacactataacctggagactactgttccccaagtgaacaactttgtgatctttgaagggttcttcgcgcaccaacaccccccagcgaggaaactaccccctaaaagggccgagggagatataaaaccctatagttcatcagacagagaatttctgaaagtcgccgttgagcctccatggcccttgaatcgagcaccacggcgtgctacacctccggcacatccacccccaaggtctagtagtctgggaaatagcccagagagaggacccctgagacctttcgttcctgagcaagaattgttgcgcagtctccgcctttgtcctccacatcctaccgccaggctgctgctggctgcagatccaggtggttctccagcccaaagaaggagaacaagagggaccccaccagggcttgtggcccagagttgctgctactcccggcatggaggggtcaattcttcctcccccaacaccggtaaccaggatagcaagcagggcgagcaagagaccaaaaataggtctgcctctgaagaacaagcactgtcccaagacgggtcaggcgaaaagcctatgcacacagctccaccacaagcccctgcccctccggctcaatcgtggacagttgggggagacatcctcaacgccagattcattaggaacctccaagaacggcgtagcacgcgcccttggtag

SEQ ID NO: 52851 - DNA, 972 bp, Artificial Sequence
  Description of Artificial Sequence: Synthetic coding sequence
atggagtttccatttgacgtggacgctctctttcccgagaggattaccgttttagaccaacatctgcgtcctcccgcacgcaggcccggaactacaactcctgccagagtagatcttcaacagcaaatcatgaccattatagatgaacttgggaaggcatccgctaaagcacaaaatctatccgcgccaattacttctgcttcccgcatgcagagcaaccggcacgtagtgtatatcctgaaggactctagtgccaggcctgccggtaaaggcgctataattggattcataaaagttgggtacaagaagctgttcgtgctggacgaccgggaagcacataatgaagttgagccactctgtatcctcgatttttacatccacgagagcgtgcagcgacacggccacgggagagaactgttccagtacatgctgcaaaaagagcgggtcgagcctcaccaactggccattgacaggcctagccaaaaactgctcaagtttttgaataagcattacaatctcgagaccaccgttccacaagtgaacaatttcgtcatttttgaaggcttcttcgcccaccaacatcgcccaccagccccttccctccgggcaacaaggcacagtagggccgctgctgtggatcccactccagctgctccggcaaggaagctccctccaaaacgggctgaaggcgacataaaaccctattcatctagtgatcgtgagttcttaaaagtagccgttgaacctccttggcccctcaatagagccccaagaagagccactcctcctgcccatcctccccctagatccagttctctcggcaatagtcccgagcgtggacctctcaggccgtttgtaccggagcaagaactgctgcggagtttgaggctgtgtcccccacatcctactgcccgtctgctgttagctgcagacccaggcggaagccccgcacagcggaggagaacccgttag

SEQ ID NO: 52852 - DNA, 1266 bp, Artificial Sequence
  Description of Artificial Sequence: Synthetic coding sequence
atggaatttccctttgatgtggatgctctgttcccagagagaattactgtgctggatcagcatctgcggccacccgctcgcaggccgggtacgacaacccccgcaagggtggaccttcagcagcagatcatgaccattattgacgagcttggtaaggcctctgccaaggctcaaaacttatcagctccgattacatctgccagccgaatgcagagcaacagacacgtggtgtacatcttgaaagactcaagcgccaggcccgctggaaaaggcgctattattggctttattaaagtgggctataaaaagctgtttgttctggatgatcgtgaggcccataatgaagtcgagcctttatgcatcttggacttttatatccacgagtccgtgcagcgccatgggcacgggcgtgagctttttcagtatatgttgcagaaagagcgggtagagcctcaccaactggcgatcgacaggccatcccagaaactgttaaagttcctcaataaacactacaacctggaaacaaccgtccctcaggtgaacaattttgtgatcttcgaaggctttttcgctcatcagcatcggcctccggcaccgagcctcagagccacgagacactctcgagcagctgccgtcgatcctacccctgccgcacctgctcggaaactgccccctaagcgagccgagggcgacatcaagccttacagctcctccgatcgcgaatttctgaaggtggcggttgagcccccttggccattgaacagagctccaaggcgcgctaccccacccgcacatcctccccctaggtcttcttcactcggtaattcccccgaaaggggacccttaaggccatttgtgccagagcaggaactactgcgctcgctgaggctgtgcccaccacatcccaccgcaaggctgctcctcgctgctgacccagggggatcccccgcacagcggagaaggactcgaggaacccctccgggtttggtggcacagtcctgttgttactctcgtcacgggggagttaacagcagtagccccaacactgggaatcaagatagtaaacagggcgagcaggaaaccaagaatcgatctgcttcagaggagcaggccctgtcccaggatggttcaggagagaaacccatgcacaccgcgccaccccaagcccctgcccctcccgctcagagctggactgttggcggagatatcctgaatgctcgattcatacgcaacctgcaggaaagacgaagcacaagaccatggtag

SEQ ID NO: 52853 - DNA, 1230 bp, Artificial Sequence
  Description of Artificial Sequence: Synthetic coding sequence
atgtggctgacgtggcccttctgcttccttacaatcactcttcgggaagaaggagtatgccacctcgaaagtgtcgacctgcagcagcagattatgacaattatcgatgaattgggcaaggcttccgcgaaagcccagaatctttccgcccctataacttccgcttctcgtatgcagtccaaccgccatgtggtgtatatcttaaaggacagttcagccagaccagccggaaaaggcgcaatcattggtttcatcaaagtgggatacaagaagctgttcgttcttgatgatcgggaggcccacaacgaagtcgaaccattgtgcattcttgatttctatatccatgagagcgtgcagcggcacgggcacgggagagagttattccagtacatgctgcaaaaggagagagtggagccgcaccagctggcaatcgacagaccttcccaaaagctgttaaaattcttgaataaacattataacctcgagacaactgtgccgcaggtgaacaattttgttatcttcgaaggttttttcgctcaccagcatcgccctcctgctccttcgctccgggcaacccggcattctagggcagcagcagtggaccccacacccgctgccccagcgagaaagctcccaccgaaacgagctgagggtgatattaaaccatactcctcgtcggaccgcgaatttctgaaggtggcagtggaaccaccctggcctcttaaccgcgcacccagaagagctacaccaccagcccaccctccccctaggtccagctcactgggtaacagcccagagcgcggtcccctcagacctttcgttccagaacaggaacttctgcgaagcttaaggctttgccccccacaccccactgctcgccttttgttagccgcagatcctggtggctctccagcgcaacgcaggagaactcggggtactccacccggactggttgcccagtcatgttgctattcacggcacggcggtgtgaactcttccagccctaacactggcaatcaggacagcaagcagggtgagcaagaaactaagaaccggagtgcttcagaggagcaagccttgagtcaagacggttctggggagaagccaatgcatacggcccctcctcaggccccagcgcctcccgctcaatcctggaccgttggcggagacatcttgaacgcccgatttattaggaatctccaggagcgaagatctacacggccatggtag

SEQ ID NO: 52854 - DNA, 1002 bp, Artificial Sequence
  Description of Artificial Sequence: Synthetic coding sequence
atggagttcccattcgacgtagacgctctctttcccgagagaattactgtccttgatcagcacctcaggcctcctgctcgcaggccgggaacaaccaccccagctcgggtcgacctgcagcagcagattatgaccataattgacgagctcggcaaagcctccgcaaaggcccagaacctctctgcaccaataacatcggccagtcgaatgcagtctaataggcacgtcgtctacattttgaaggatagcagcgccaggcctgctggaaagggagctatcattgggttcatcaaagtcggatacaagaagctctttgtccttgacgacagggaggcccacaacgaggttgagccactatgtatcttagacttttacattcatgagtcagttcagagacacggtcatggcagagagctcttccagtatatgctgcaaaaggagcgggtagaaccacatcaacttgcaatagacaggccatcccagaaacttctgaaattcctaaataagcattacaacctggagaccactgttccacaagtcaacaactttgttatcttcgagggcttctttgcacatcaacatagaccccctgccccttccctcagggcaacgcgacatagtcgggcagcggcagtagatcctacacctgccgctcctgctcgcaaattgcctcccaagagggctgaaggtgatattaagccatattcctcatctgatcgcgagttcctcaaggtcgctgttgaacctccttggccgttgaaccgggctcccagaagagcaaccccaccagcacatcccccaccacgctcctcctcgctcggaaatagtccagagagggggccactgagaccctttgtgccagagcaagaactgctgaggtcattacggttgtgccctccccacccaactgccaggctcctactcgcagccgatcccggtggcagccccgctcagagacgtcgaaccagcagcctgccccgaagcgaagaatctagatactag

SEQ ID NO: 52855 - DNA, 903 bp, Artificial Sequence
  Description of Artificial Sequence: Synthetic coding sequence
atggagttccccttcgatgtggatgcgctcttcccggaacggatcacagtgctggaccagcatctgcgtccaccagccaggcgcccaggcactactactcccgcaagagttgacctccagcagcagatcatgactataatagatgaactggggaaggccagtgccaaggcacagaacctttctgcgcctatcacatctgctagccgaatgcagagcaacaggcacgtggtatatatcttgaaggatagcagcgctcgcccagctggaaaaggggcaattattgggtttattaaggttggctacaagaaactgtttgttttagatgatcgcgaagcccacaacgaagtggagcccctgtgcatcctcgatttttatattcacgaatccgttcagaggcatggccacggacgtgaactgttccagtacatgttgcagaaggagagggtcgagccccaccagttggctatcgatagaccaagccaaaagcttctaaagtttttgaacaaacactacaatctggaaacaaccgtcccacaggtgaataatttcgtgatctttgaggggttctttgcacaccagcacccgcctgcacgcaagctgccacccaagcgggcagaaggcgacatcaaaccctattcttcctccgaccgcgaatttctcaaagtggccgtggaacccccttggcctctgaatcgtgcccctagacgggctactccacctgcccacccccctcccaggtcatcatcacttggaaatagtcctgagagaggtccattgcggcctttcgtgcccgagcaagaacttctccgcagtcttagactttgtcctccacatcccaccgcaaggctgttactggccgcagaccctgggggatcccctgcacaaagacgaaggacaagatag

SEQ ID NO: 52856 - DNA, 1266 bp, Artificial Sequence
  Description of Artificial Sequence: Synthetic coding sequence
atggaattcccatttgatgtggacgctttgttccctgagagaatcaccgtgttggatcaacatctgaggccgcctgccagacgtccgggaaccacaacgccagccagagtggacctacagcagcagatcatgaccattattgatgaacttggcaaggcttcggccaaggcccaaaatctctcagcgcctatcacttcagcaagccggatgcaatctaacaggcacgtagtatacattttaaaagacagttccgcgcgaccagctgggaagggagcaatcatcgggtttattaaagttggatacaagaaactttttgtcttggacgaccgggaggcccataacgaggtggaaccattgtgtatactggatttttatatccacgagtctgtccagaggcatgggcatggcagagagctgttccagtacatgctgcagaaggaaagggttgagccacatcagttggctattgacagaccaagtcaaaagctgctcaaatttctcaataaacactataacttagagacaactgttccacaggtaaacaattttgtgatcttcgaggggtttttcgctcaccagcatcgccctccagcaccttcgctccgtgcgacacgccattctagggccgctgccgtagacccaacccctgcagcgcctgcacggaaactgcctccaaaacgggctgaaggagatattaagccttatagtagttccgatcgtgagtttttgaaagtagcagtcgagccaccctggccgcttaatagggcccctagaagggcaaccccgcctgcccaccctcccccacggagtagctcactcggtaatagccccgaaaggggccctctccggcctttcgtacccgagcaggaactattaaggtctctaagattatgcccgcctcaccccacagcccgactgctactggccgctgatcctggcggaagcccagcccagcggagacgcacaagaggcaccccgccagggctggtagcccagtcctgttgctatagcaggcatggcggagtgaattccagcagccccaacactggcaatcaggacagtaaacaaggcgaacaagagacaaaaaacaggtctgcctctgaagagcaggccctgtctcaggacggttctggggaaaagcccatgcacacggctccacctcaggccccagcccctccagctcagagctggaccgtgggcggtgacatcctaaacgccaggtttatccgcaacctgcaggagcggaggagtacgagaccatggtag

SEQ ID NO: 52857 - DNA, 972 bp, Artificial Sequence
  Description of Artificial Sequence: Synthetic coding sequence
atggagttcccttttgatgtggatgccctgttccccgagaggatcaccgtgcttgatcagcatctccgcccacctgcccgacggccaggaaccaccaccccggctagagtggacttacagcagcaaataatgactattatcgatgaactcggaaaggccagtgccaaggcacagaacctctccgcgcctatcacttccgcttcacgtatgcagtcaaaccgacacgttgtatacattctgaaagactcttcagcgaggcctgcaggcaagggcgctatcatcggattcattaaagtgggctataaaaaattgttcgtcttagacgaccgtgaagcccacaacgaggtcgagcctctgtgcatcctggatttctacattcacgaatccgtgcagcgtcacggacacgggcgagagcttttccagtacatgcttcagaaagagagagtggagccgcatcaattggccatcgacaggccttcgcagaaactcctgaaattcttgaacaaacactacaacctggagacgaccgtgccacaggtgaacaactttgtaatcttcgaggggttcttcgcgcatcagcatcgccctcccgctccctctttgcgcgctacccgacattctcgtgccgcagcagttgatcccacacccgcagcccctgcgagaaagctgccccctaagcgagcggagggtgatatcaaaccgtatagctcttctgaccgggaatttctgaaagtggctgttgagccaccatggcctttgaaccgtgctcccagaagggcaacccctcccgctcaccccccacccagaagctcttcactgggcaactcacctgagcggggtccgctgaggcccttcgtgcctgagcaggagttgctaaggagcctgagactgtgcccaccacatccgactgcccgtctcctgctggcagcagatcccggaggcagccccgctcagagacgaagaactcgctag

SEQ ID NO: 52858 - DNA, 933 bp, Artificial Sequence
  Description of Artificial Sequence: Synthetic coding sequence
atggagttcccgttcgatgtcgacgccctgtttcctgagagaatcaccgtgctggaccagcacctccggcctcctgcgaggagacccggaacaaccacccctgccagggtggatttacagcaacagatcatgaccattattgatgaacttggtaaggccagcgcaaaggcccagaaccttagtgcacctatcacgtccgccagtcgcatgcagtccaacagacacgtagtatacattctcaaggactcatctgctcgccctgccggtaagggcgcaattatcgggttcatcaaggtgggatacaagaaactgttcgttctggatgaccgcgaagcccacaatgaagtcgagccgctgtgtattcttgatttttatatccacgagtccgtccagaggcacggtcatggaagagagctgttccagtacatgctgcagaaggagcgggtggagccgcaccaactggcaatcgaccggccttctcagaaactgctgaaattcctaaataaacactataatctcgagaccacggttcctcaggtcaacaacttcgttatttttgaggggttttttgcccatcagcatcccccagcgaggaagctgccccctaagagagccgagggtgacattaaaccttattcttcttcagacagagaattcctgaaagtggcggttgagccaccttggccactgaatagggccccacggagagctacgccccctgcccaccccccacctcggtcttctagcctgggaaacagtccagagcggggacccctgcgcccttttgtccccgagcaggagcttttgagatcactgcgactctgcccaccacatcctacagctagactgttactcgccgcagacccagggggatcccctgcccaacgacgacgtacctcaagcctgccacgctcagaggaaagccgctactag

SEQ ID NO: 52859 - DNA, 972 bp, Artificial Sequence
  Description of Artificial Sequence: Synthetic coding sequence
atggaatttccattcgacgtggacgccctgttccccgagaggattactgtcttagaccaacaccttagaccgccagccagacggccagggactacaactccagcgagagtggacctgcaacagcaaatcatgaccataatcgatgaacttggtaaagcctccgctaaggctcagaatttaagcgcaccaatcacatctgcaagcaggatgcaatctaaccggcatgtggtctatatcctcaaagacagcagtgctcggccagctggaaaaggagcgatcatcggcttcatcaaggtgggttacaagaagttattcgtcctggacgacagagaggcccacaatgaagtggagcctctttgtattctcgacttctatatacacgaaagtgttcaacggcacggtcacgggagggaacttttccagtacatgctccagaaagaacgagtggagccccaccagctggcaattgatcgccctagccagaagctcctgaagttcctgaacaagcactataaccttgagaccaccgtgcctcaggttaacaattttgtcatttttgaggggttctttgcacaccagcaccgcccacccgctccttcactgagagcaactcgacatagcagagccgctgcagtcgaccccaccccagctgcacctgctagaaagttgccacctaagcgggcagaaggggacattaagccctactcatcttctgatcgggagtttctcaaagtggctgtggaacctccatggcccctgaaccgggctccgcgacgtgctacacccccagcacatccaccccctaggagtagttctttgggtaacagcccagagagagggcctttaagaccgttcgtgcctgaacaggaactcctccggtctctccgattgtgtcccccacatccaaccgcccgactgctcttggcagctgatccaggcggttcccctgctcagcggcgacggacaagatag

SEQ ID NO: 52860 - DNA, 1230 bp, Artificial Sequence
  Description of Artificial Sequence: Synthetic coding sequence
atgtggctgacctggccgttctgtttcttgaccattactctcagggaagaaggagtatgccacctagagtcggtcgacctgcagcaacagatcatgacaataatagacgagcttggaaaggcgagcgcaaaggctcaaaatctgtccgcccctatcacaagcgctagccggatgcaaagtaacaggcatgtcgtttacattctcaaggactctagcgccagaccggcaggaaagggggcaattattggcttcatcaaagtaggctacaagaaactgttcgtgttggacgaccgggaagctcataatgaggtggaacccctgtgtatcctcgatttttacatccacgagtctgtgcagagacatggccatgggagggagctttttcagtatatgttgcagaaggagcgggtcgagccccaccaactggctattgatcgccctagtcaaaagttgttaaagtttctgaataagcactataacctagaaacgaccgtgccccaggtgaataatttcgtcatcttcgagggtttctttgcgcatcagcatagacctccagctccttcactacgggctacaagacactctagagcggctgcagtagatcccactcctgccgcaccagcacgtaaattgccgccaaaacgggcagaaggcgatatcaaaccatactcttcatctgacagagaatttctcaaggtagcagtcgagcccccttggcctctgaacagagcccctagacgggcaactcctcccgctcacccaccaccaaggagctctagcttaggtaattctcccgaacgtggtcctctacggcctttcgtgcccgagcaggagctcttgcgttccctccgcctctgtcctccacaccctaccgcgaggctgctgcttgcggcagatcccggtgggtctccggcacagaggcgaaggacaaggggaacgccaccaggactggttgcccagagctgttgctattcacgtcacggcggagtgaattcctcctcccccaatacgggaaaccaggattcaaaacagggagaacaggagacgaaaaatcgaagcgcgtctgaagaacaggccctgtcccaggacggctctggcgagaagccgatgcacactgcgcctcctcaagccccagcaccgccagcccagagctggacagtgggcggagatatcctgaacgccaggttcataaggaatctccaggagcggcgttccactaggccttggtag

SEQ ID NO: 52861 - DNA, 903 bp, Artificial Sequence
  Description of Artificial Sequence: Synthetic coding sequence
atggagttcccatttgacgttgacgctttgtttcccgagcgcattaccgtccttgatcaacatctacgtccccctgctaggaggcccggaacaaccactcccgcacgagtggatctgcagcaacagattatgaccattatcgacgaactcgggaaggcctctgcaaaagctcagaacctcagcgctcctattacatccgcatcacgaatgcaaagtaacagacacgtggtttacatcctcaaggacagctccgctcggcctgctgggaagggcgctattatagggttcatcaaagtgggttacaagaagctgtttgtgttggacgaccgtgaggcgcacaatgaagtcgagcctctctgcatcctggatttctacatccatgaaagcgtgcagcgccacggccatggaagagaactgttccaatatatgcttcagaaagaacgggttgaaccccatcaactggcaatcgacagaccctctcagaagcttttgaagtttctgaataaacattacaacttggagaccaccgttccacaagtcaataattttgttatatttgagggcttctttgcccatcaacatccgccagcccgaaaactcccccctaagcgagctgaaggggatatcaaaccctattcctcctcggaccgtgaattcctgaaagtagctgtcgagcccccttggcctcttaacagagctccacgacgggcaacccctcccgctcacccaccccctagaagtagctctttaggaaactcacctgagcggggaccacttcgtccctttgtaccagaacaggagctactccgaagcttgaggttgtgcccacctcatccaaccgcccgtctattattggccgcagatccgggaggcagtcctgcccagaggaggcgaactcggtag

SEQ ID NO: 52862 - DNA, 903 bp, Artificial Sequence
  Description of Artificial Sequence: Synthetic coding sequence
atggagtttcctttcgacgtagacgccctttttcccgagagaatcacagtgctggatcaacacctgcgccctcccgctcgacggcctggaacgaccacacctgccagagtggatctgcagcagcagatcatgaccataattgatgaactaggtaaggcaagtgcaaaagcccaaaatctcagcgccccaattacttcggcttctagaatgcaaagtaataggcacgtggtctatattctgaaggatagttccgcaagacccgcaggaaaaggggctatcatcgggtttattaaagtcgggtacaaaaagctgttcgttctcgatgaccgcgaagctcataacgaagtcgagcctctgtgtatccttgatttttacatccacgagagtgtgcagagacatggccatggtcgtgaactgttccaatatatgcttcaaaaagaaagagtcgagcctcatcagcttgccatagaccgaccatcgcagaagttactgaagttcttgaataagcattacaatctggagacgaccgtcccacaggtgaataattttgttatttttgagggcttctttgcccatcagcaccctccagccaggaagttgccacctaagagggccgagggcgatattaaaccctactcctcctccgaccgcgaattcctcaaagtggccgtcgaacccccttggccactgaatagagccccacggagggctaccccgccagcccacccccctcccaggtcatcctccttgggaaatagtccagagcggggaccactacgcccattcgtacccgagcaggagctcctgcgcagtcttagattgtgcccaccccaccccaccgctcggctcctgttggctgccgatcctggaggatcacccgctcagcgaaggagaactaggtag

SEQ ID NO: 52863 - DNA, 972 bp, Artificial Sequence
  Description of Artificial Sequence: Synthetic coding sequence
atggagtttccattcgatgtggatgccctgttccctgaaagaatcactgttctggatcagcatctgaggcctcctgcccgaaggccgggtactaccacgcctgctcgcgtggatcttcagcaacagataatgaccattatcgacgagttaggaaaggccagcgccaaggctcagaatctgagcgccccaatcacgtctgctagccgtatgcagagtaatcgacatgttgtttacatactgaaggactcatctgcgaggcctgctggcaagggcgcaattatcggatttatcaaggtgggctacaagaaactcttcgtcctggatgatcgcgaagcacacaatgaagtcgagccgctgtgcatcctggacttctatatccatgagtctgtccagcgacatggccacgggagagaactcttccagtacatgctgcaaaaagaacgggtggagcctcaccagctggctatagaccgcccaagccagaagctgctgaagtttttgaataagcattataatctggagactaccgtcccacaggtcaataacttcgtcatcttcgaggggttcttcgcccatcagcaccgcccacctgcgccttctctaagggccacacggcactcacgtgctgcagccgtggacccaacaccagcagcgcctgctaggaagttgcctcccaagagagcagaaggagacatcaagccctatagttccagtgatcgtgagttccttaaggtggccgtggaaccaccctggcccctcaacagggctccacgtagggctacaccgcctgcacacccacccccaagaagcagctctttgggtaactcaccagagagaggtccacttagacccttcgttccggagcaggagctgctgaggagtttgaggctgtgtccccctcatccaacagctcgattgctcctggcggctgatccgggtggcagccccgctcaaaggcgacggactagatag

SEQ ID NO: 52864 - DNA, 1266 bp, Artificial Sequence
  Description of Artificial Sequence: Synthetic coding sequence
atggagtttccgtttgatgtcgacgcccttttccctgagagaattaccgtgctggatcagcaccttcgacctccggctagacggccagggactacaacacccgcacgagttgatttgcagcagcagatcatgacgatcatagatgaactcggaaaagcatccgccaaagcacagaaccttagcgcacccatcacctctgcatccaggatgcagagcaatcgccatgtggtgtacattcttaaggacagctctgccagacccgctggtaaaggggcaatcatcggattcattaaggttggatacaaaaaattgtttgtgctcgacgatcgggaggcacacaacgaagtggaacctctgtgtatcttggacttctacattcatgaaagtgtgcaaaggcatggacatgggagggaactcttccaatatatgcttcagaaggagagggtggagccacatcaactggccattgatcggccttcccagaaactgttgaaatttcttaataagcactataatctggagacaacagtcccgcaggtaaacaacttcgtgatatttgaagggtttttcgcccatcaacataggcctcccgcaccttccctaagagccacaagacactcacgcgctgctgcggttgacccaactcccgcagcgccagcaaggaagctgccgccaaagcgcgcagagggcgatatcaaaccttatagctcatcagatcgtgagtttcttaaagtggcggtggagcctccttggcctctgaaccgtgcccctcgccgagcaacacctcctgctcatccacccccaagaagcagttctcttgggaatagtccagagagagggccactccgaccttttgtccccgagcaagaactgttgaggagcctacgattgtgtcccccacatcccaccgcacgtctgctcctagccgctgacccgggtgggtcccccgctcagcgccgtagaactcgcggaacccctcctggtctggtcgctcagtcctgctgttactctcggcacgggggagtgaattctagtagtcccaacaccggcaaccaagacagtaaacaaggagagcaggagacaaagaacagaagtgcatccgaggagcaagccctgagtcaggatggaagtggtgagaaaccaatgcacactgcacccccacaggccccagcacctcctgcccagagctggaccgtggggggagacatcttgaatgcgaggttcatcaggaatctgcaagagaggcggtcaacaagaccttggtag

SEQ ID NO: 52865 - DNA, 903 bp, Artificial Sequence
  Description of Artificial Sequence: Synthetic coding sequence
atggaatttccttttgatgttgacgctctgttccctgagagaattaccgtgcttgatcagcacttaaggccacccgctcgcaggccagggaccacgacccctgcacgtgtcgaccttcaacagcaaatcatgaccatcattgacgaactgggaaaggctagtgcaaaagcccaaaacctgtctgctccaattacctccgcctcacggatgcaatccaaccggcacgtggtttacatcctgaaggacagttcagcacggcctgctgggaagggggcaatcatcggtttcatcaaggttggatataagaaactgttcgttctcgacgatcgcgaagctcacaacgaggtcgaacccttgtgtatcctcgacttctatatccatgaatctgtacagaggcatgggcacggacgggagctgtttcaatacatgcttcagaaagaaagagtggaaccccaccagcttgccatagacaggccatcccagaagctgctgaaattcttgaataaacattataacctagagactacagtgcctcaggtcaacaattttgtgatcttcgagggcttcttcgcacatcagcatcctccggctagaaaacttccacctaagcgggcagaaggggacatcaagccttatagctcctccgaccgcgaatttttgaaagtggcggtggaaccaccctggccgctcaatagagcacctcggagagccacaccccctgcccacccacccccaaggagtagcagcctcggtaatagccctgaacggggacctcttcgacctttcgtgcccgagcaggaacttctgcgcagtctccgcctgtgccccccacatccaacggctcggctgcttctggcagctgatcctgggggatcaccagcacagcggaggcggactcgatag

SEQ ID NO: 52866 - DNA, 972 bp, Artificial Sequence
  Description of Artificial Sequence: Synthetic coding sequence
atggagtttccattcgatgtggacgcccttttcccggaacggattacagtgctcgatcaacatttgagaccgcctgcacggagaccgggaacaacgactcctgctcgagtcgatctgcagcagcagataatgactattattgatgagcttggaaaggccagtgctaaagcacagaatttgtcagcgcctattacatcagccagcaggatgcagtcaaatcgacatgtggtctacatcctcaaagatagctcagctaggcctgctgggaaaggtgcaattattggctttattaaggttgggtacaaaaagctgtttgtgcttgatgatcgggaggcccacaatgaagtggagccactgtgtatcctggacttctacattcatgaaagtgtacagcggcacgggcatgggagggaattattccagtacatgctgcagaaggaacgcgtggagcctcaccagctcgctatcgatcgtccttcacagaaactcttaaagtttttaaacaagcattacaacctagaaactactgtcccacaagttaataacttcgtcattttcgaagggttttttgcccaccagcaccggcctcccgctcccagtctgcgcgctaccaggcattcccgcgcagctgccgtggatcccacgccagcagccccagcgaggaaactcccgcctaaaagagctgaaggcgatattaagccctattcttcaagcgatcgcgagttcctgaaggtcgcagtggaacctccttggccgctcaacagagcacccaggcgagccactcccccagcacacccgcctcccaggtcttctagtcttggcaactcccccgaacggggaccactcaggccatttgtgcctgaacaggaacttctgaggagcctgagactttgccccccacaccctactgctcggctgctattagctgcagatcccggaggctcccccgctcagagaaggcgtacccgctag

SEQ ID NO: 52867 - DNA, 933 bp, Artificial Sequence
  Description of Artificial Sequence: Synthetic coding sequence
atggaatttcccttcgatgttgatgccctgttcccagagcgcataacagtcctcgaccagcacctgcgacccccagccaggagaccaggaacgactacgcctgccagggtggacctacagcaacaaatcatgaccattatcgatgaattggggaaagcgagcgccaaggctcagaacctatctgcacctataactagtgctagtcggatgcagtccaaccgccacgttgtctatattcttaaagactccagcgccaggccagcgggtaagggggcaatcatcggcttcatcaaggttggctacaaaaagctcttcgtgctcgacgacagagaagctcataacgaagttgaacccctgtgtattctcgatttctacattcatgagagcgttcagcgtcacggccacggaagagagctcttccagtacatgctgcagaaggagcgggttgaaccccaccagctcgccatcgatagaccttcacagaaactgctcaaatttctcaataagcactataacttggagacaactgtacctcaggtgaataattttgtaatttttgaagggttctttgcacaccagcatcctcctgctcgaaagctgccccctaagcgcgctgagggtgatatcaagccctactcttcatcagacagagaatttctgaaagttgccgtcgagccaccttggccacttaaccgcgctccaagacgtgccacaccacccgcacatcctccacccagatcttctagcttgggaaatagtcctgaacggggacccctgaggcctttcgtgcctgagcaggaattgctgaggtcattgagactgtgtcccccacacccgaccgctcggctactactcgctgcagacccagggggttccccggctcagaggcgccgaactagttctctccctcgctcagaggaaagccggtattag

SEQ ID NO: 52868 - DNA, 1230 bp, Artificial Sequence
  Description of Artificial Sequence: Synthetic coding sequence
atgtggctgacttggcccttctgtttcctgacgataacactgcgagaggaaggcgtctgccacttggagagtgtggatcttcaacagcagattatgaccataatagacgagctggggaaagcatctgctaaagcgcagaacctgagtgccccaataactagcgccagccgaatgcagagcaatagacatgtagtctacatcctgaaggactcctcggccagaccagctgggaagggcgcaattatcggatttataaaagtgggctataagaagctgttcgttctggacgatcgggaggcacataatgaagtggaacctctttgcatcctcgatttttacatacacgagagtgttcaaagacacggccacggcagggagctcttccagtacatgctgcagaaagagcgagtggagccccaccaactcgccatcgacaggccctctcaaaagttgctgaaattcctcaacaagcactacaaccttgagaccactgtgcctcaggttaacaactttgtcatttttgagggattttttgcccatcaacatcggcctccggcaccaagtttgcgggctactcggcacagtcgcgctgccgcagtggacccaacaccggctgctccagctcggaaactccctccgaaacgggctgaaggtgacatcaagccttattccagcagcgacagggagttcttaaaggtggctgtggaacccccatggcctctgaatcgggcacctcggagggcgacaccgccagctcatcccccaccgagatcatctagtttgggcaactctcccgaaaggggtccactcagacccttcgttccagaacaggaactgcttcgatccctgcggctttgcccaccgcatcctactgcaagactcttactggcagctgacccgggaggttctcctgcccagagacggagaacccgcggaactcccccaggactcgtagcccaaagttgctgctactctagacacggcggtgtgaactcctcctctcccaacactgggaaccaggactcgaaacagggtgaacaagagacaaaaaatcggtccgcgtccgaggaacaggctcttagccaggatgggtccggagaaaaacccatgcatactgcaccaccgcaagccccagctcccccagcacagtcctggaccgtcggaggcgatatcttaaacgctagatttatcagaaacctacaggagcgtagatccacgcgaccttggtag

SEQ ID NO: 52869 - DNA, 1002 bp, Artificial Sequence
  Description of Artificial Sequence: Synthetic coding sequence
atggaattcccatttgacgttgatgctctgtttcctgagcgaatcactgttctagatcaacacctgcggcctcctgcacggagaccaggtactaccacacctgcaagggttgacctgcagcaacagatcatgactataattgacgaattgggaaaagcctctgcgaaggctcagaacctgtccgcgccaatcacatcagcctcaagaatgcagtctaaccgccacgtcgtgtatatcctgaaggatagctctgctcgccctgccggtaaaggcgctattatcggttttattaaagtcggttataagaagctcttcgtactggacgacagggaagcccataacgaggtagaaccgttgtgtatcctagatttttacatacacgaaagtgtgcagaggcacggccacggccgtgagctgtttcaatacatgttgcagaaggaaagggtggaaccccatcaattggctatcgaccggccaagccagaagctgttgaagttcttgaacaagcattacaatctggaaactactgttcctcaggttaacaacttcgtgatcttcgaggggtttttcgctcaccagcatcgacctcccgctccatcattgagagcaacgcggcattcgagagcagctgcagtcgatcccacccctgctgcccctgccaggaagcttcccccaaagcgcgctgaaggagacatcaagccctattcgtctagcgaccgcgaatttttgaaggtcgctgtcgagccaccctggcctctcaaccgggctccaagaagagccactccgccagctcatcccccaccccgatcttcatcgctgggtaacagtcctgagcggggacccctgagacccttcgtaccagagcaggaactgttacggagcctgcgcctgtgcccgcctcacccaacagcccgacttttgcttgccgctgacccaggcggttctcccgcacagaggagaaggacttccagcctgcccagatccgaggaaagtcgctactag

SEQ ID NO: 52870 - DNA, 933 bp, Artificial Sequence
  Description of Artificial Sequence: Synthetic coding sequence
atggagttcccgttcgatgttgacgccctgttccctgaacgcataaccgtcctcgaccaacatttgcggcctccagccaggaggcccggaaccactacaccagcccgtgtagatctccagcagcagatcatgaccattatagacgagctgggaaaggcttcagccaaggctcagaatctgtcagctcccatcaccagcgcttcccgcatgcagagcaacaggcatgtggtgtacatcctgaaggactcatctgccaggccggctggtaagggggctatcataggcttcattaaggttggttataaaaaactctttgtactggatgaccgtgaagcccacaatgaggttgagcccctttgtattctggacttctacattcatgaatctgttcagcgacacgggcatggccgtgagctcttccagtatatgctgcagaaagagagggtggagccacaccaactcgcgatagaccgtccaagccaaaaactcctcaaattcttgaataaacactacaacctggagactactgttccccaggtcaataacttcgtcattttcgagggtttctttgcccaccagcaccctcctgcacgtaagttacccccaaaacgagcagaaggagacattaaaccgtatagcagctccgatagggagtttctgaaggtcgccgtggagcccccttggccattaaatagggctccgcgtagggccacccctcccgcacatccaccaccacggtccagctccctgggcaactcacccgagcggggtcccctgcgccctttcgtccccgaacaggagctgttaagaagcctgcgtctgtgccctccccaccctacagcccgtctgctgctcgccgctgaccctgggggatcccccgctcagcggcgacgaacctccagccttcctaggtccgaagaatcccgatattag

SEQ ID NO: 52871 - DNA, 1266 bp, Artificial Sequence
  Description of Artificial Sequence: Synthetic coding sequence
atggagttccctttcgacgtcgatgccttgttccccgagcgtattacagtcctggatcagcatctccggccacctgccaggcgtccagggactaccacaccagccagggtggacctgcagcaacagataatgaccatcatcgatgagctcggtaaagcctccgctaaggcgcagaatcttagtgctccaatcacaagtgcctcacgaatgcaaagcaaccgacacgtagtctacatcctcaaagactcgtcggccagaccagctggaaagggtgccatcattggtttcatcaaggtcggttacaaaaaactgttcgtcctggacgacagggaagcccataacgaagtggaaccgctctgtatcctggatttctacatccacgagtcagtgcagcgccacggccacggacgggagctgttccagtacatgctgcagaaggaaagggtggagccccaccagctcgccattgatcgccctagtcagaaactgctgaagtttctgaacaaacactataacctagaaacaaccgtgcctcaggttaataatttcgttatcttcgaaggattctttgcacaccaacaccgccctccagccccatctctcagggcaaccagacacagccgggctgccgctgtcgaccccacacccgctgctcccgcaagaaaacttcctcccaaacgggcagaaggcgatattaagccatatagttctagtgacagagagtttctgaaagtggctgtggaacccccatggccgctcaaccgcgctccaaggcgggctacccctccagcccatcctccacctcgctcttcttcgctgggcaacagtccagagaggggccctcttcgtccttttgtgcccgaacaggaactattgcgaagcctcaggctctgtcctccacatcctacagctcgactcctgctagccgctgatcctggcggatccccagcacagcggaggcgtacccgcggaactccacctggcctagtagcgcagagttgttgctattccaggcatggaggagtaaattcttcttctcctaataccggaaaccaggattcaaaacaaggcgagcaggagacaaagaataggagtgccagcgaggagcaggctctgagccaagacggctctggagaaaaaccaatgcatactgcccctccccaagctccagcccctcccgcacaaagctggaccgtaggcggagatatattaaatgctagattcatccgtaacctgcaggagcgcaggagcacaaggccctggtag

SEQ ID NO: 52872 - DNA, 1230 bp, Artificial Sequence
  Description of Artificial Sequence: Synthetic coding sequence
atgtggctgacatggcctttttgctttctgacgataaccttgagggaggagggggtttgccacctggaaagtgtcgatctgcaacagcagatcatgacaataatcgacgagctcgggaaagccagcgctaaggcacagaacctctcagcccctataacaagcgcttcccgaatgcagtccaatagacacgtagtatacatcctaaaggattcttccgctaggccagccggaaagggggctataatagggttcatcaaggtgggctacaaaaagctctttgtcctagacgatcgagaggcccacaacgaggtagagccactgtgcatcctggacttctatatccatgagtccgtgcagcgccatggacacggcagggaattgtttcagtatatgctccagaaagaaagggttgaacctcatcaattggctatcgaccgacccagccagaagcttctgaagttcctcaacaagcactataacctagagaccacagttccccaggtcaataatttcgttatttttgaaggcttctttgcacaccaacacagaccgcctgccccttctttacgcgcaacccggcacagtagggcggcagcagtcgaccccaccccagccgcaccagctcgcaagctcccaccgaagagggccgagggagacattaagccatactcttcatccgaccgtgagttcttgaaagtggctgtagagccaccttggcctctgaatagagcgccacgcagagcaacaccgccagctcacccgcctcctcgtagttctagcctgggcaatagtccagagcgcggaccactgcgaccttttgttcccgaacaggaattgctgcgttcactgcgcctgtgcccccctcatccgacagccagactcttgttggcggctgatcctgggggatcgccggctcaaagacgtcggactcgagggacaccaccagggctggtagcccagtcttgttgctacagcaggcacggaggagtgaattcctcttcccctaacacgggaaatcaagactcaaagcagggtgagcaggagacaaaaaacagaagcgcctcagaggagcaggccctgagccaagacggctccggtgaaaaacccatgcatacagccccaccccaggcacctgcccctcccgcacaaagctggacagtgggaggcgatattctgaacgcccgattcattagaaatttgcaagagcggcgatcgaccagaccatggtag

SEQ ID NO: 52873 - DNA, 1266 bp, Artificial Sequence
  Description of Artificial Sequence: Synthetic coding sequence
atggaattcccatttgacgttgatgcgctgtttcccgaacgaattaccgtgttagaccaacacctccgcccacccgctaggcggccaggaactaccactcctgccagagtcgacttgcaacagcagattatgacgattatcgatgaactgggtaaggcaagcgctaaagcccagaacctgtctgcccctattacgtccgcgtctcgcatgcaaagcaaccgacatgtagtctatattttaaaagattcctccgcacgtcccgcaggaaagggagccatcatcggttttatcaaggtgggttacaagaaactgttcgtactggacgacagggaggcccataatgaggtggaacccctgtgcattctcgacttctacatacacgaatccgtccagagacacggccacggccgagaactctttcaatatatgctgcagaaagaacgcgtggagcctcatcagttagctattgataggcccagccagaaactactcaagtttcttaacaagcattacaacctggaaaccacggtacctcaggtgaataattttgtgatctttgaaggcttttttgctcaccagcaccgccctcctgctccaagtctgagagccacccgtcattcaagagccgctgcggtggatcctacccccgcagccccagctcgaaaactgccgcctaaacgagcagagggggatatcaaaccatattcttcgtctgaccgggagtttctgaaggtggctgtggagccaccatggcctctaaaccgagcaccgaggcgagcgacgcccccagcccaccctccaccccgatctagctcattgggaaactctcccgaacgcggtcccctacggcctttcgttcctgaacaggagctcctcagaagcctaagactctgcccgccacatccgactgcacggctacttctcgccgctgacccaggaggtagccctgctcagcggagacggacacgcggaactcctcccggtcttgtggctcagtcttgttgttattcacggcacggaggggtgaatagtagctcccccaatactgggaatcaggattcaaagcagggcgaacaggagactaaaaaccgcagcgcctctgaggaacaagcactgtcccaagatgggtctggcgagaagccaatgcacacagcacccccacaggctcctgcccctccagctcagtcttggactgtggggggtgacatcctgaacgcccgttttattcgcaacttgcaagagaggagatccacaagaccctggtag

SEQ ID NO: 52874 - DNA, 903 bp, Artificial Sequence
  Description of Artificial Sequence: Synthetic coding sequence
atggaatttccatttgatgtggacgcgctgttcccagagaggattactgttctggatcagcatctgcgcccaccagctcgacggccaggaacaacaaccccagcgagagtagacttacagcaacagatcatgaccatcatcgacgagctgggcaaggccagtgccaaggcccagaatctgtcagccccaatcacttctgcaagtcgtatgcaatccaatcggcacgtggtctacatcctgaaggattcaagcgcacgcccagccggaaagggcgctatcatcgggtttattaaagtaggttataaaaagctgttcgtgctggatgatcgtgaggctcacaacgaagttgagcctctttgtatcctcgatttttatatccacgagagcgtgcagcggcatggccacggaagagagctttttcagtatatgctgcagaaggagcgggtcgagcctcaccagctagctatcgataggccgagtcagaaactcttaaaattccttaacaaacactacaaccttgagaccacagtgccccaagtcaataactttgtgattttcgaagggttcttcgctcatcagcatccacccgctcgaaagttacctccaaaacgggctgagggcgacattaaaccatatagctcttccgacagggagtttctgaaagtggcagtcgagccaccttggcctcttaaccgggcacctaggagagcaacccctcccgctcaccccccacctcggagctcatctttgggcaacagtccggaaagaggcccattgcgtccttttgtgcctgagcaggagctgttgcgctcactgcgattgtgtccccctcacccaaccgccagactgctcttggccgctgaccctgggggttcaccggctcagcgcagacgcaccaggtag

SEQ ID NO: 52875 - DNA, 933 bp, Artificial Sequence
  Description of Artificial Sequence: Synthetic coding sequence
atggaattcccttttgatgtggatgccctgttccccgagcggatcaccgtgctggatcagcaccttcgtcccccagctcgacgaccaggaaccactacccctgctagggtcgatctgcaacaacagataatgacaattattgacgaattaggaaaggcatcagcgaaggcacaaaacctttcggcgccaattacgagcgcctcccggatgcagagtaatagacatgtcgtgtatatactgaaagactccagtgcaaggccagccggaaagggggcaattattgggttcatcaaggtaggctataaaaagctcttcgttctggatgatcgggaagcccacaatgaggtcgagccactgtgcatcttagatttttatattcatgaatctgtccaacgacacggtcacggacgcgaactgttccaatatatgttgcagaaggaaagggtggagccgcaccaactggccatcgaccgtccctcccaaaagctgctgaagttcctgaataagcactacaatctcgaaacaaccgttccccaagtgaataactttgtgatcttcgagggatttttcgcccaccagcatccacctgccaggaagctgcctccaaagcgcgctgagggtgatatcaagccctacagctcttctgacagagaatttcttaaggtagccgttgagcctccctggcccctgaaccgggcacctaggcgcgctacccctcccgctcacccaccccctcgtagctccagtctgggaaactcccccgaacgtggtcctctccggccatttgtcccagaacaagagctgcttagatctttgcggctgtgccccccacacccaacagcacgattgcttctggctgccgatcccggtggaagccctgcccagaggcgcagaacatcttccctgcctaggagcgaagagtcccggtattag

SEQ ID NO: 52876 - DNA, 1266 bp, Artificial Sequence
  Description of Artificial Sequence: Synthetic coding sequence
atggaatttccgttcgacgttgatgctcttttcccagagagaattaccgtcctcgaccagcacctgagaccccctgctagacgccctggaactacaactccagccagagtggacctccaacagcagatcatgacaatcattgacgaactcggcaaagcttcagcaaaagctcagaacctcagcgctccaataacatccgcgagtcgcatgcagtccaatcgccacgttgtgtatattttaaaggactcttccgcaaggcccgctggtaagggcgcaatcataggttttattaaagtcgggtataagaagctgtttgtgctggatgatagggaagcacacaatgaggtcgaaccgttgtgcatcttggacttttatatccacgaaagtgttcagcgccacgggcacgggagggaactgtttcagtatatgctgcagaaggaacgagtagagccccaccaactcgcaattgatcgcccttcccaaaagctcctgaagtttctgaataagcattacaatctggagaccaccgttccccaggtgaataacttcgtcatatttgagggattttttgctcaccagcataggcccccagcacccagccttcgtgcgacccgtcactcaagagctgcagctgtggatcctacacccgcagctcctgccagaaagcttccccctaagcgcgctgaaggcgatatcaagccttattcctcctcagatcgggagttcctgaaagttgcagtcgaacctccttggcccttgaatagagcaccgaggagagcaaccccccctgcccatccacctccccgttcctcaagtttgggcaacagtcctgagcgcggtcccctccggccatttgtccccgagcaagaacttctgcgaagtctgcgcctctgccctcctcatcccacagctaggctgcttctcgctgccgatccagggggaagcccagcgcagcgtcggagaacaagaggcacgccaccaggcctcgttgcccagtcctgctgttattcaaggcatggtggagtaaattcatcgtcccctaatacagggaaccaggacagtaaacagggggagcaggaaaccaagaataggagcgcgtcagaagaacaggctctgtcgcaggacggctcgggcgaaaaacctatgcatacggctcccccacaagcacctgccccaccagcacagtcttggaccgtgggcggagatatcctgaatgccagattcatccgaaacctccaggagcgccgatccactcggccttggtag

SEQ ID NO: 52877 - DNA, 933 bp, Artificial Sequence
  Description of Artificial Sequence: Synthetic coding sequence
atggaattcccgtttgacgtagacgcactttttccggagcgcattaccgtcctcgatcagcatctgcgtcccccagcacggagacctggaaccacaacacctgcaagggttgacctgcagcagcagattatgaccatcattgacgaattaggaaaagcttccgccaaagcacaaaacctgtccgcacctatcacctcagcgtcccgcatgcaatcaaacaggcacgtcgtgtacatcctgaaagacagcagtgctagacccgctggaaagggcgctattatcgggttcatcaaggttggatataaaaaactattcgttcttgacgatcgggaggctcacaacgaggtggaaccactttgcatactcgatttttacatacatgagtctgtccaaaggcacggccacggaagggagctgttccagtatatgttgcagaaggagcgagtggaacctcatcagctggctatagataggccatcccaaaagttactaaagtttcttaacaagcactataacctggaaactaccgtgccacaggtgaacaacttcgttatttttgagggcttcttcgcccaccagcatccgcctgcgaggaaactgccacccaagagggccgagggggatattaaaccttacagctctagcgatagagaattcctgaaagttgccgtggagcccccttggcccttaaacagagctccacgtagagccacgccccctgcccatccaccccctcgtagctcctccttagggaacagtcccgaaagaggccctttgaggcctttcgttccggagcaagaactcctcaggtccctgcgactgtgtccaccacatccaactgcgcgtctcctgctcgctgccgatcctgggggtagccccgcacagcgcagacgcacatcctccctgccccgtagcgaggaaagccggtattag

SEQ ID NO: 52878 - DNA, 972 bp, Artificial Sequence
  Description of Artificial Sequence: Synthetic coding sequence
atggagttccctttcgatgtggatgccctgttccccgaaagaatcaccgtcctggaccaacatctcagacctccagcccgtcgcccaggtactaccactcccgctcgagtcgacctacagcagcagattatgaccattatcgacgaattggggaaagctagtgccaaagcacagaaccttagcgcgccaatcaccagcgcgagtagaatgcagagtaatagacacgttgtgtacatcctcaaagactcctccgctaggcccgcaggtaaaggtgctatcattggcttcattaaggtaggttataagaagctgttcgtgttggatgaccgggaggctcacaatgaggttgaacccctgtgtattctggatttctatatccacgagtctgttcagagacacggtcacgggcgtgaactgtttcaatatatgcttcagaaagagcgggttgagcctcatcagttggcaatcgatcgaccttcacagaaacttctcaaattccttaacaagcactacaatttagaaaccacagtgccccaagtcaataatttcgtcatctttgagggtttcttcgcacaccaacacaggcctccagcaccatcactacgtgctacgagacactcgcgggctgcagctgtggatcctaccccggcagcccctgccagaaaactgccgcctaagagagcagaaggggatatcaagccatattcctcttctgaccgggagtttctgaaggtcgcagtggaacctccttggccactgaatagggcacctcgcagagctacccctcccgctcacccccctccgagaagttcttctttgggcaactcaccagaaaggggccctcttcgacccttcgttcccgagcaggagcttttaaggtctctccgcctctgccccccacaccccactgcccgattgctactcgccgcagaccctggcggttctcccgcacagcggaggaggactcgctag

SEQ ID NO: 52879 - DNA, 1230 bp, Artificial Sequence
  Description of Artificial Sequence: Synthetic coding sequence
atgtggcttacatggccattctgttttctgaccatcacactaagagaggagggtgtgtgtcatctcgaatcagtcgatctccagcaacagatcatgaccatcattgacgagctgggcaaggcgagcgccaaagctcagaatctgtccgcccctatcacctcagcatcccggatgcagagcaaccgacacgttgtttacattctcaaagattcatcagccaggcctgcagggaaaggagccatcattggattcatcaaggtgggatacaagaaactcttcgtccttgatgaccgggaagcgcataacgaagttgagcccctttgtatcttggacttctacatccatgagtcagtgcagagacatgggcatggcagagagttgttccagtacatgctgcagaaagaaagagtggaaccacaccaattggctatcgataggccctcccagaagctgctaaagttcctgaacaagcattacaacttggagacaactgtaccccaggtgaacaactttgttatatttgaaggcttttttgcacaccagcacaggcccccagccccatctctccgagcaaccaggcatagcagggctgcagctgtggatccaacacctgccgcacccgctcggaaacttccccctaaacgtgctgagggtgatattaaaccctatagttccagcgatcgcgaattcctgaaggtcgcggtggagcctccctggccattgaaccgtgcaccacgacgagcaactcccccagcccatccaccaccgagaagttcttcactcggcaattccccagagcgcggacccctgagacccttcgtgcccgagcaggagttactgagatccctaagattgtgcccaccacaccccacagctcgcctgctactcgcggctgacccgggtgggagtcctgcacagcgcaggaggaccagggggacccccccaggcctggtggctcagagttgctgctattcgaggcacggcggtgtaaatagctcctcgcctaacacgggcaatcaagactcgaaacagggcgaacaggaaacaaagaaccggtccgcttctgaggagcaggccttgtcacaggatggttccggagaaaaaccaatgcatacagctccccctcaagcgccagcccctccagcccagtcctggacagtcgggggagatatccttaatgcgcgattcatcaggaatctgcaagaacgcagatctacccggccttggtag

SEQ ID NO: 52880 - DNA, 903 bp, Artificial Sequence
  Description of Artificial Sequence: Synthetic coding sequence
atggagttccctttcgatgtagatgccctgtttccggagaggattaccgtgctcgatcagcacctaaggcccccagcccgaagacctggaacgacaacccccgctagagtcgacctgcaacagcaaattatgacaatcattgatgagctggggaaagcctcagctaaggcgcagaatctcagtgctccaatcacctccgcctcccggatgcagtccaaccgccacgtagtatacattctcaaggattcaagcgcaaggccagctgggaaaggcgctataattggatttattaaggtcgggtacaaaaaactgttcgtcctggacgacagagaagcacataacgaagttgagccactgtgtatcctggatttctacatccatgagtccgtccagcgtcatggtcacggccgtgaactgtttcagtatatgctgcagaaagaaagggtggagcctcatcagctcgccatcgacaggccatctcagaagctgctgaagtttttgaataaacactataacctggagacaaccgtaccccaggtgaataatttcgtcatctttgagggcttctttgcccatcagcatccaccggcacgcaaactgccgccaaaacgggctgaaggagacatcaaaccctatagctctagcgaccgagagttcctcaaggtagctgtcgagccaccttggcctttgaatcgagcgccacggagggccacgcctccagcacacccgccaccgagatcgagctccctaggaaatagccctgagcgaggtccgctgaggcccttcgttccagaacaggagttgctgaggtcactccgactgtgtccacctcaccctaccgcacggttgctccttgcagcagaccctgggggatcgcccgcacagagacgcagaacacgttag

SEQ ID NO: 52881 - DNA, 1002 bp, Artificial Sequence
  Description of Artificial Sequence: Synthetic coding sequence
atggagttccccttcgatgtggacgccctgttccctgagcgaattaccgttctcgaccagcatctccgtccgccagccagaaggccgggaaccaccacaccggcaagggtagatctacagcaacaaatcatgaccataattgacgagctgggcaaagcctctgccaaagcccagaacctaagcgcccctatcacctccgcctcccggatgcaaagtaacaggcatgtagtgtacatcttaaaggactcgtctgcacgcccagctggcaaaggcgctatcattgggtttataaaggttggttacaaaaaactatttgtgctagatgaccgtgaggcgcataacgaggtggagcccctgtgtatcctggacttttatatccacgagtcagtacagcgacacggacacgggagggaactctttcagtacatgctgcagaaggaacgcgtggagccccatcagctcgccatcgatcggccttcacagaagcttctgaagttcttaaataaacactataacttggaaaccaccgtgccccaggtgaataactttgtcattttcgagggcttctttgctcatcagcaccgcccaccggctcccagtttacgcgctacacgccactcacgggctgccgcagttgatcctacgcctgctgcccctgccagaaagctgccaccgaagagggccgagggggatattaagccctattccagctccgatagagagtttcttaaagttgccgtcgagccaccctggcccctgaaccgagcccctcgtagggcgacgccacctgctcacccgcctccaagatccagttccttaggtaactcgccggaaaggggacctttacggccattcgtgccagagcaggaactcctgcgtagccttagactttgcccaccacatccaactgcaagactcctgcttgccgcagatcccggtggttcccctgcccaacgtcgaaggacatcaagtttaccacgttctgaagagtctagatactag

SEQ ID NO: 52882 - DNA, 1002 bp, Artificial Sequence
  Description of Artificial Sequence: Synthetic coding sequence
atggagttccccttcgatgtggacgccctatttcctgagagaatcactgttcttgatcagcacctgaggccgccagcgaggaggccgggtacaactacaccagctcgcgttgatcttcagcaacagataatgaccatcatcgacgagctagggaaggcgtctgctaaggctcagaacctgagtgcccctattacttccgcttccagaatgcagtctaatcgacacgttgtctatatactgaaagactccagtgccagaccagccggtaagggcgcaatcatcggctttataaaagtgggctacaagaaactgtttgtgttggacgaccgagaagcccacaatgaagtagaaccgctttgcatccttgacttctacatccatgagtccgttcagaggcatggtcatggtagagagttgtttcagtatatgctgcaaaaagaacgcgtggagcctcatcagctggccatcgaccggcctagccaaaagcttctcaaattcctcaataaacactacaatctggagacgacggtcccccaagtgaacaattttgttatcttcgaagggttctttgctcaccaacaccgaccacccgctccgtccctgagggcaactcgacatagtcgagccgcagctgtagatccaacacccgcagctcctgcccgaaagctgcctcctaagagggcggaaggcgatatcaagccatactcgtcctccgatagggagtttctgaaagttgccgtcgagcccccatggccgttgaacagagcccctcggagagctacgcctccggcacatccccctcctcggtcatcctcactgggaaatagcccagagagagggcctctccgaccgtttgtgccggaacaggagctgctccgttctttgcgcctatgtccacctcaccctactgcccgtcttctcctagccgctgatcctggcggaagtccagcccaacgtcgcaggacctcctcattacctaggagtgaggagtcacgatactag

SEQ ID NO: 52883 - DNA, 1266 bp, Artificial Sequence
  Description of Artificial Sequence: Synthetic coding sequence
atggaattcccatttgacgtagatgccctgtttcctgagaggatcacagtcctcgatcagcacctcagacctcctgctcgtcggccaggcacaaccactcccgcacgggtcgacttgcagcagcagatcatgacaattattgacgaattgggaaaggcgagcgctaaagcacagaacctcagcgctcctatcaccagtgcgagcaggatgcagagcaatcgacacgtggtgtatattctaaaggattcttccgcccgacctgccggaaaaggcgctattattggttttatcaaagtcggctataagaagctcttcgtgcttgacgatcgtgaagcccacaatgaggtggaacctctgtgcatcctggatttttatatacatgaaagcgtgcagagacacgggcatggaagggagctgttccagtacatgttgcagaaggaaagggtggaacctcaccagctggctatagatagaccgtcccagaagctgctgaaattcttgaacaaacattacaatttagaaaccaccgtgccgcaggtgaataattttgtgattttcgagggcttcttcgctcaccagcataggccaccagcaccctcattgcgcgcaactcggcattccagggccgctgctgtggatcccacaccagctgccccagcccgtaagttaccaccaaagagggcagagggcgatatcaagccttacagttcatccgaccgagagttccttaaagtggcagtcgagcccccatggccattaaatcgtgctccacgacgggctacgccaccggctcatccacctccaaggtcctcctccctcggtaattcaccagaacgcggacctctacggcctttcgttccagaacaggaattgctccgatcactaaggctgtgcccacctcaccctacagcacgactcctgctggcagcagacccaggtggtagtcctgcgcaacggagaagaactcgcggaaccccaccaggacttgtcgcccagtcctgttgctatagccgtcacgggggagtgaactcgagctccccaaataccgggaaccaggattccaagcagggcgaacaggaaactaaaaaccgcagtgcaagtgaggagcaggccctttcccaggacgggagcggcgagaaacccatgcacactgcccctcctcaggccccagctccaccggcacagtcgtggaccgtcggcggagacattttaaacgctagatttattcgtaaccttcaggaacggaggtcgacgcggccttggtag

SEQ ID NO: 52884 - DNA, 933 bp, Artificial Sequence
  Description of Artificial Sequence: Synthetic coding sequence
atggagttcccatttgacgtagacgcattgtttcccgagcggataaccgtgttggatcagcatcttaggcctccagcccgtcgccctggaaccaccacccccgcacgcgtcgacctgcagcagcagattatgacaattattgatgagctcgggaaggcatctgctaaggcgcagaacctgtctgctcccatcacatcggcatcaaggatgcaatccaatcgacatgtcgtgtatattcttaaagacagctcagcccgtcccgcagggaaaggcgcaataatcgggttcattaaggtggggtataagaagctgttcgtgctagacgatagggaagcgcacaacgaggtggaacccctgtgcatcctggacttctatatccacgaatccgttcaacgacatggacacggcagagaactcttccagtatatgcttcagaaggagagagtggagccacatcagctggccatcgatagacccagtcagaaactcttgaaatttctgaacaagcactacaacctggagactaccgtgccccaggtgaacaactttgttattttcgagggattctttgctcaccagcacccgcctgcaaggaagctgcctccaaagagagccgagggcgatatcaaaccgtacagctcgtcagatcgcgagttcctgaaagtcgccgtcgaaccgccatggccactaaatcgggctccaaggagagccacccccccagcccaccctcccccacgctcaagttccctggggaactccccagaacgcggaccgcttaggcccttcgtgcccgaacaagagttattgaggtccctccgcctgtgtccgcctcatcccactgccaggctgctcctagcagccgacccaggcggatcacccgcacagcgaagacgcacttcctctctccctcgcagtgaggagtcgcgctactag

SEQ ID NO: 52885 - DNA, 1002 bp, Artificial Sequence
  Description of Artificial Sequence: Synthetic coding sequence
atggaatttcccttcgacgtagacgcactgttccccgagaggatcaccgttctggatcagcacctcaggccacctgctagaaggccgggaacaaccactccagcccgagtggatctccagcagcagataatgacgatcattgacgaactgggcaaagcatcggctaaggcccagaacctgagcgcaccgatcacctccgcctcccggatgcagagtaatcggcacgtcgtgtacatattgaaagattccagcgctcggcctgctgggaaaggcgctatcatcggctttatcaaagtcggatacaaaaagctgttcgtcctggacgatcgggaagcacacaacgaggtggaaccactgtgtattcttgacttctatattcacgaatctgtgcaaaggcatggtcacggacgagagctgttccagtacatgctgcagaaggagcgggtcgagcctcaccaactggcaattgaccggcctagccagaagctcctcaagttcctcaataaacactataacctcgaaacaacagtgccacaagtgaacaattttgtaatctttgagggattctttgctcatcaacaccgccctccagctcctagcctgcgagcgacccggcacagcagggcggcagctgtagatccaaccccggctgccccagcacggaaactcccaccgaaacgagcagaaggggacattaaaccttattcctcttctgacagagagtttctaaaagtggctgtggagcctccctggcctttgaacagagctccacggagagctacccctccagctcatccacctcctcgcagctcttcactcgggaacagccccgagcgtggccctctcagacccttcgtccccgaacaggaactgctgcgttctttgaggttgtgccctcctcaccctacagcccgactgctcctcgccgcagacccgggaggatctcctgctcagcggaggaggacgagctctctgccgaggagcgaggagtcccggtattag

SEQ ID NO: 52886 - DNA, 1002 bp, Artificial Sequence
  Description of Artificial Sequence: Synthetic coding sequence
atggaatttccgtttgatgtagatgccctatttcccgaacggattactgtgctggatcagcatctccggccacccgctagacgaccaggcactacaacccctgccagggtggatctgcagcagcagattatgacaatcattgatgagctgggcaaagctagcgcaaaggcccagaatctttctgctccgatcacatctgctagcagaatgcagtccaatagacacgtagtgtatatccttaaagatagcagcgctcggccagccggtaagggggctatcatagggtttatcaaggtcggctacaaaaagctgtttgtgctcgatgacagggaagcacacaacgaagttgaaccactctgtattttggatttttatatccacgagtcagtgcaacgacatggccatggacgggaacttttccagtatatgctgcagaaggaacgagtagaacctcatcaactggccatagatcggccaagccagaagctgttaaagtttctgaacaagcattacaatctggagaccacagtgccccaggtgaacaatttcgtgattttcgaaggtttctttgcacatcaacaccgcccacctgccccttctctgagggctacaaggcattctcgcgcagcggctgttgaccccacgcccgctgcccctgctcgtaagctgccaccaaaacgggctgagggagacattaagccctactcaagcagcgatagggagtttctgaaagtcgcggtcgaacccccatggccactgaatcgcgcaccaaggcgtgccactcctccagctcaccctccacctagaagcagctcacttggaaacagtcccgagcgcggacctttgaggcctttcgtgcctgagcaggaactcctccggtccttgcgtctgtgtccacctcatccgaccgctcggctcctgcttgcggcagatccaggaggctcaccagcgcagagacgacgtacttctagtttgcctcggtctgaagaaagccgctattag

SEQ ID NO: 52887 - DNA, 972 bp, Artificial Sequence
  Description of Artificial Sequence: Synthetic coding sequence
atggaatttccattcgacgtagatgcgctcttccccgagcgtatcacagtgctggatcagcatttacgacctcccgctcgtaggcccggaacgacgacaccagcccgagtagatctgcagcagcaaatcatgacgatcattgatgagttgggcaaagcgtctgccaaggctcaaaacctgtctgcaccaataacatctgcaagcagaatgcagtcaaatcggcacgtggtctacatattgaaggattcttctgctcgtccagccggtaaaggcgctatcataggattcatcaaggtgggatacaagaagcttttcgtcttggatgatagagaggctcacaatgaagtggaacccttgtgtatactggatttttacatccacgagagcgtccaaagacacggtcatggccgtgagttatttcagtatatgctgcagaaggagcgcgtcgagccccatcaactcgcaattgatcgtccctcacagaagttgcttaaattccttaataagcattataacctggagacaaccgtgccccaagtgaataatttcgtcatatttgaaggcttctttgctcaccaacacagacctcccgcaccatctttgcgagctacgagacattcccgcgctgcagcggttgacccaactccggctgcgccagcacgcaagctacctccaaagagggcagagggagatatcaagccctacagtagtagcgatagggaatttctcaaagtggccgtggagcctccttggccactgaaccgggctcctcgtagagccacccctcccgctcatcctccgcctaggtcgagttcactcgggaactctcctgaacggggaccattaaggccctttgttcctgaacaggagctcctccgttctttgcgtctgtgtccgccacatccgacagcgcgtctgctgttggctgccgatccaggcggttcccctgcccaacgtcgcagaactagatag

SEQ ID NO: 52888 - DNA, 1230 bp, Artificial Sequence
  Description of Artificial Sequence: Synthetic coding sequence
atgtggctgacatggccattttgcttcctaaccatcaccctccgggaagaaggcgtgtgccatctcgaaagcgtcgatctgcagcagcagatcatgaccatcatcgacgagctggggaaagcttccgcaaaagcccagaaccttagtgcacctatcacttccgcctctcgtatgcagtctaatagacacgttgtgtacatcctgaaagattcatctgccagaccggctgggaagggcgcaataattggatttatcaaggtgggctacaagaaattgtttgtgctggacgacagagaggcccacaatgaggtcgaacccctttgcatactggatttctacatacatgagtccgttcagcggcacggccatgggagagagctgttccaatacatgctacagaaagagcgcgtcgagccccaccaattggcaatcgacagaccttcacaaaagctactgaagtttctcaataaacactacaacctggaaactacagtgccacaggtgaataattttgttatttttgaagggttcttcgcacatcagcacagaccaccagcaccttcactgcgtgcaacacgacatagtagggccgctgccgtggaccctacccccgcagccccagccaggaagcttccacccaagagggctgagggagatataaaaccgtattcaagcagtgatcgtgaatttttaaaagttgctgttgaaccaccatggccgttgaatagagctccgcgaagggcaaccccacccgctcatcccccaccaaggtccagcagcctggggaattctcctgagagaggccctctcagaccctttgtacccgagcaggaactgctccggagcctgaggctttgtccccctcatccaacagctcgcctgttgctcgcagctgatccaggaggtagtccggctcagaggagacgcacccggggaactccacccggtctggtcgcgcaaagttgctgttattctcggcatggcggagtgaacagctcttcgcctaacactggaaaccaggatagtaagcaaggcgagcaggaaaccaaaaatcgctctgcgagcgaagaacaagccctcagtcaggacggtagcggcgaaaagccaatgcacaccgccccaccccaagctcctgcaccaccggctcagagctggactgttggtggggatatccttaatgccagattcatcagaaatctgcaggaacgacgctcaacccgaccttggtag

SEQ ID NO: 52889 - DNA, 1197 bp, Artificial Sequence
  Description of Artificial Sequence: Synthetic coding sequence
atggaatttccgttcgatgttgacgctctctttcccgaaaggatcactgttttggaccagcatttgcgacctcccgcacgcaggccgggaaccaccacacccgctcgcgtcgatctccagcagcagataatgacgatcatcgacgagcttggaaaagccagcgccaaggctcagaatctgtctgctcctattacttccgcatctaggatgcagagtaaccggcatgtcgtgtatatcttgaaagacagttcagccagaccagcagggaagggtgctataatcggctttataaaagtggggtataaaaagctcttcgtattggatgatcgggaggcccataatgaagtcgaacccctgtgtatcctggacttctatatccacgagagcgttcagagacacggccacggtcgggaactgttccagtacatgctccagaaggagcgagtggagccccatcaactcgccattgacaggccttctcaaaaattgttgaagttccttaacaagcattacaaccttgagaccaccgtgcctcaggtcaacaattttgtcattttcgaaggcttctttgctcatcagcatcctcctgcaagaaaactgccacctaagcgagctgaaggggatattaagccatatagctcatccgatcgagaatttctcaaggtcgcagtggaaccaccctggcccctgaaccgggcacccaggcgggcaacaccgcctgcacaccctccccctaggtcttcttccctcgggaattcgccagaacgcggacctctccggccttttgttcctgagcaggagctccttagaagcctgaggctttgtccccctcatcccactgccaggttacttctggcagcagacccagggggttccccagctcaaagaagacggacccgaggaactcctcccggattagtggcccaatcctgttgttattcaagacacggaggcgttaacagtagctctcccaacactggcaaccaggatagcaagcagggagaacaggaaacaaagaatcgaagcgcctccgaggaacaggcattgtcacaggacggctccggggagaaacccatgcacacagcccctccgcaagcgccagcccctcccgcacagtcatggactgtcggcggagacatacttaatgcgaggttcatcagaaatctgcaggaaagacgcagcacccgaccctggtag

SEQ ID NO: 52890 - DNA, 1197 bp, Artificial Sequence
  Description of Artificial Sequence: Synthetic coding sequence
atggagtttccctttgatgtggacgctctttttcctgaaagaatcaccgtattagaccaacatctgagacctccggcacgtaggccaggaactactactccagcgcgtgttgatctgcagcaacagattatgacgatcatcgacgaactgggtaaggcctccgctaaagctcagaatttatccgcgccaatcaccagtgccagcagaatgcagagcaatagacacgtcgtgtatatcctgaaagattcctcagccagacccgcaggcaaaggagccattatcggcttcataaaggtcggctataaaaaactgttcgtcctggacgatagagaggctcacaatgaggtggagccgctgtgtattctggacttctacattcacgaaagtgtgcagaggcacggccatgggcgagaactcttccagtacatgctgcagaaagagagggtggaaccccaccaactggccatcgacaggccttctcagaaactcttgaagttccttaacaaacattacaacctcgagacaaccgtccctcaggttaataacttcgtcatttttgagggtttttttgcccatcaacacccacccgcacggaaactgccgccaaagagagctgagggagatatcaaaccctactctagctccgatcgtgaattcctgaaggtcgcggtcgagccgccttggcccctgaacagagcacctcgcagagcgacaccccctgcgcacccccctccacgctcttcgtctttaggcaatagccccgaaaggggtccactgagaccattcgtgccagagcaggagctgctcaggtctctgcggctatgccctccacatccaacagccaggttgcttctggctgccgatcccggtggcagtccagctcaaaggaggcgtactcgaggtacacctccaggtctggtcgcccagagctgctgttactcaagacacgggggagtcaactcgagctctcctaataccgggaaccaggactccaagcaaggggagcaggaaactaaaaatcgctccgcctcagaggagcaagcactgagtcaggacggctccggggagaagcccatgcacaccgccccacctcaagctccagcccctcccgcacagtcctggaccgtgggtggagacatcctgaatgcacgattcatcaggaaccttcaagagagaagaagtacccggccatggtag

SEQ ID NO: 52891 - DNA, 1197 bp, Artificial Sequence
  Description of Artificial Sequence: Synthetic coding sequence
atggagtttcccttcgacgtggacgccctgttcccggaaagaattactgtgctggatcagcacctgcgcccacctgctcggaggccaggtactactacccccgctcgggtcgatctgcagcagcagattatgaccataattgacgagttgggtaaagcttccgccaaggcccaaaatttatcagctcctattacaagcgctagccgcatgcaatccaaccgccacgtcgtgtatatcctcaaggatagcagcgcaagacctgccggaaagggcgcaatcattggctttattaaggtgggctacaagaaattatttgtcctggacgatagagaagctcataatgaggtagagcctctttgtattttggacttttatattcacgagagcgtgcaaaggcatggccatggccgagagctcttccagtacatgctccagaaagaaagggtggagccgcaccagttggccatcgaccggccaagccagaagttattgaaattcctgaacaagcactataacctggagactaccgtgcctcaggtgaataatttcgtgatattcgaaggattttttgcgcatcagcatccaccggctcgtaaactgccacccaaaagggctgaaggggacatcaaaccgtactcatcgagtgaccgggaattcctgaaagtcgccgtggagcctccctggcctctaaatcgagcccctaggagggccacaccccctgcacacccgccacccagatcttcctccctgggtaattcaccagagaggggcccattacggcctttcgtcccagaacaagaactcctgagaagccttaggttatgccccccacatcccacagctaggttgctcctcgccgctgacccaggcggatctcctgcccaacggcgaaggacacgagggacgccacccggactggtagcacaatcttgctgctattcacggcatggcggagtgaactcatcgtcacccaacactgggaaccaggattctaagcagggagagcaggaaactaagaataggtctgcctctgaagagcaagcactctcgcaagacggtagcggagagaaaccaatgcataccgccccacctcaggcgccagctccaccggctcagtcctggactgttggaggcgacatcttgaatgcaagatttatcaggaaccttcaggagagaaggtctaccaggccatggtag

SEQ ID NO: 52892 - DNA, 1197 bp, Artificial Sequence
  Description of Artificial Sequence: Synthetic coding sequence
atggagttcccctttgacgtagacgccctcttccccgaacggatcacagtactggaccagcacctgagaccccctgcccgtcgaccaggcaccactaccccggctcgcgtcgacctgcagcagcagattatgacgatcattgatgaactgggtaaagccagtgcaaaggcccagaatcttagcgcccctatcacgtccgcaagtaggatgcagagcaatcggcatgtggtgtatattttgaaagactctagcgccaggccagcaggaaagggtgctatcattggttttatcaaagtgggatacaagaaattgtttgtcctcgatgatcgtgaggcacacaatgaggtagagccgctgtgtatactggatttctatattcacgaaagcgttcaacgccatgggcatggcagagagttgttccagtacatgctccagaaggagcgtgtggagccccatcagcttgctatcgatcggccatctcagaagctgttaaagtttctgaataaacattacaatctggagactacagtgccacaggtgaataacttcgtgattttcgaaggctttttcgcacatcagcacccgcctgcacgtaagctacctcctaagagggccgaaggagacatcaagccctattcttcatccgacagagagttcctgaaagtagccgttgagcccccatggcctctcaacagggctcccaggagagcaaccccacccgctcatccaccacctcggtcctctagcctcggaaactcccccgagagggggccactgcggccattcgtacccgagcaggaactacttcggagtctgcggctttgcccccctcaccctactgcacgcctgctcctggcagccgatcccggaggaagcccggctcagaggcgaaggacaagaggcacaccccctggattagtcgctcagagctgttgctactcacgccacgggggtgtcaactcctcctcgcccaacacaggcaatcaggactctaagcaaggggagcaggaaactaaaaacaggtcggccagcgaagaacaggctttgagccaggacgggagcggtgagaagccaatgcacacggcaccccctcaggccccagcgcctccagctcagtcctggacggtgggaggggacatcttgaatgcacgtttcatcaggaacctccaggagcgcagatcgacccgcccatggtag

SEQ ID NO: 52893 - DNA, 1197 bp, Artificial Sequence
  Description of Artificial Sequence: Synthetic coding sequence
atggaatttcccttcgatgtcgacgcgttattccccgagcgaatcacagttctggaccagcatctgagaccaccagcacgaagacccggaactacaactcctgcacgagttgatctgcagcagcaaatcatgacaatcatagatgagctgggtaaagcgtcggccaaagcccagaacctgtcagctcctatcacgtccgccagtagaatgcagtccaaccgtcacgtggtatacatattgaaggacagctccgctcgtccagccggaaaaggggctattattggatttatcaaggtcgggtataaaaaactgttcgtgctggacgatcgagaggcacacaatgaggtcgaacccctttgcattctggacttctacattcacgagagcgtgcagcgtcatggacacggtagagaactattccaatacatgctccagaaggagagggtggagccccaccagctcgccattgacagaccctcacaaaaactgttgaaattccttaacaagcactacaacttggagaccactgtgccacaggtgaacaatttcgttattttcgagggcttcttcgctcaccagcaccctcccgctcgaaaactgccacccaagagggccgagggtgacattaagccatacagttcatctgatcgagaatttctgaaagtcgcagttgagcccccatggcctctgaatagggctcctcgaagagctacccctcctgcccatccgccacccagatccagctcgctggggaactcccctgagcgcggacctttgcgaccttttgtccctgaacaggagttgttgcgatcccttcgtctttgcccaccccaccctacagcacgcctgctcctcgctgctgaccccggaggaagtcccgcacagcggcgtagaactcgcggtacgccgcctgggctggtcgcccaaagttgttgctactccagacacgggggtgtgaactctagctcacctaacacaggcaatcaggatagcaagcaaggcgaacaggagactaagaatcgctccgccagcgaagagcaggcgcttagccaagatggttctggtgagaagcctatgcacacggcgccaccccaggcacccgcaccccctgctcagagctggaccgtcggaggagatatcctgaacgcccgttttatacgcaatttgcaagaacggagaagcacccggccttggtag

SEQ ID NO: 52894 - DNA, 1197 bp, Artificial Sequence
  Description of Artificial Sequence: Synthetic coding sequence
atggaatttccctttgacgtggacgcactgttccccgaacggatcacagtgctggaccaacatttaaggcccccagccaggcgaccaggcaccaccacccccgcaagagtggacctccagcaacagatcatgacaattatagatgagctcggcaaggcgagtgccaaggcgcagaatctgagcgccccaattacaagcgcttcacggatgcagagcaacaggcatgtggtctacatcctgaaagactcatctgcgagacccgctggaaaaggagccatcatcggttttatcaaagtcggttataagaagctttttgtgctggatgatcgcgaggcccacaatgaggttgagccactgtgcatcctagatttttatattcatgaaagtgtccagcggcatgggcacggccgtgagctgttccagtatatgctgcaaaaggaacgagtcgagccgcaccagctggccatcgatcgtccctcgcagaagctactgaagttcctgaacaagcactacaacctggaaaccactgttcctcaagtcaataattttgtgatctttgaaggatttttcgcccaccagcatcctcccgcacgcaagttgcctcctaagagggccgaaggggatataaagccttacagcagctctgatcgcgagttccttaaagtagctgtggaaccgccttggccactcaatagggctccacgacgcgctacacctcctgctcatccccctccccgttccagtagcctaggcaacagcccagaacggggtcctctgaggccatttgttcctgaacaagagctgttgaggtctctgcgactctgtccaccccaccctacagctagacttctcctggctgctgacccaggtggcagtccagcacagcgtaggagaacacggggtacacccccaggactggtcgcccagtcatgctgttacagccggcatggaggcgtgaactcgtcatcccctaacacaggcaaccaggactcaaagcagggcgagcaggagacaaagaacaggtcagctagtgaggagcaagcactgagccaggacggaagcggagagaagcccatgcacactgccccaccgcaagcccctgcccctcctgctcagagttggaccgtcgggggtgatattctcaatgcccgatttattagaaatctgcaagagcggaggtcaactaggccctggtag

SEQ ID NO: 52895 - DNA, 618 bp, Artificial Sequence
  Description of Artificial Sequence: Synthetic coding sequence
atgtcattcgcaactaaatttagtgactacttcctcttaatcgaggacaacgtcttcttcgctcctaattttgtgacccacatacatagtcgggtgactacaatgaagagtaacagctgggtacttatggaattttctaatatgggtttccttggaaaactgtttcactcgcgcgatctccctctgttggcacacttcctgctcttattctataaagagaagcctcttgacagcctaatctctcactttcacactctgctggttcaagaatcaccaattctctgtcggccattcctcttctattgtagggtctcttacaccgcctttgatcacaagcagaaagccaccgctctgcaaaaaaagaacgcagacgggcctaataaccctcctggcgcagtgttcactgatatgcaggtgtcagacgtgcacttcccctgggaagcatacactcttgacgaaagctttttttggacccataacatttccatcggtaaccacctgacagtcatcttaaaccatcccgctaacctatcaagagtccaggtgatgacgggctcgattgtggagtgggaagtgcggccaggtgagggggcaggcggtgcagggcttccaacgtag

SEQ ID NO: 52896 - DNA, 618 bp, Artificial Sequence
  Description of Artificial Sequence: Synthetic coding sequence
atgagctttgcaaccaagttctctgactactttttattgatcgaggacaacgttttttttgcaccgaacttcgttacacatatacacagccgtgttacaactatgaaatccaactcctgggtgctaatggagttctccaacatgggatttctaggcaaactgtttcacagccgcgaccttcccttactggcccactttctgcttctcttctataaggaaaaacctctggatagcttaatcagccacttccacaccctgctcgtccaggagtccccaattctctgtcggccattcctgttttactgccgcgtctcatacaccgcttttgaccataaacagaaggctaccgcgctccagaagaagaacgctgacgggccaaacaatcccccaggcgcagtgttcactgatatgcaggtttccgatgtgcattttccttgggaagcttatacattagacgagagcttcttctggacccacaacatctctataggcaaccacctcaccgtaattttaaatcacccagccaacctgtctcgcgtacaggtcatgaccggaagcatagttgagtgggaagtaagacctggagagggcgcaggcggtgcgggactgcccacctag

SEQ ID NO: 52897 - DNA, 6512 bp, Artificial Sequence
  Description of Artificial Sequence: Synthetic coding sequence
atgaaagactctgagggaccccaaaggccgccattgtgctttctaagtacactgcttagccaaaaagtcccagagaaatcagacgcggtcctccggtgtatcatttctgggcagcctaagcctgaggtaacttggtacaagaatggacaggcaatcgatggttctggaatcatcagcaactacgaattcttcgagaatcagtatatccacgtgctgcatcttagctgctgcaccaaaaatgacgccgctgtgtatcagattagcgcgaagaatagctttgggatgatttgttgcagtgccagtgtggaggtcgagtgctcaagcgagaacccccaactcagtcccaacctagaggatgaccgcgatagaggctggaagcacgagacaggaacccatgaggaggaaagggctaatcagatagacgagaaagagcatccctacaaagaggaagaatctatatccccaggtacgccaaggtctgccgacagcagcccctccaagagcaaccatagtctgtcactccagtcgctcggcaatctggatatctcagtaagtagctcagaaaatccacttggcgtgaagggaactcggcacactggggaagcctacgaccccagcaataccgaggagatcgccaacggcctgctgttcctaaactctagtcatatatacgagaagcaggatagatgttgccacaagaccgtccacagcatggccagcaaattcaccgacggcgacctcaacaatgacgggcctcacgatgagggattgcggtcctcccagcaaaatcctaaggtgcagaagtacatcagcttcagtctgcccctgtctgaagcgaccgcgcacatctacccgggtgattctgcagtcgcaaataagcaacccagcccgcagctcagttctgaagatagtgatagtgattatgagctgtgtccagagatcacgctcacctacactgaggaattctcggacgatgacctggaatacttagaatgctcagacgtcatgactgattacagcaacgccgtctggcagcgcaatctgcttggaacagagcacgtgttcctgttggagagcgacgatgaagaaatggaatttggagagcattgtctagggggatgcgagcactttctgtctggaatggggtgcgggtcccgggtgagtggggacgccggtcccatggtcgccacagcgggattttgtggacatcactcccaaccccaagaggtgggcgtaagatcttcccgcgtctctaagcatggcccttcctccccacagactggtatgacattaatactcggtccacaccaggacggtacgtcaagcgttactgagcaggggagatataagcttccaacggcccctgaggcagctgagaacgactatccgggaattcagggggagaccagagatagtcaccaagccagagaggaatttgcatccgacaacttactgaacatggacgagagtgtaagggagacagaaatgaaactgctgtccggtgagtcagaaaattctggtatgagccagtgctgggagacagctgccgacaagagagtcggtggaaaggatctgtggtcaaagagaggtagcagaaagtccgccagggtcaggcagcccggtatgaaaggtaacccaaagaagcccaatgctaacctgcgagagtcaaccaccgaaggaactttgcatctgtgcagtgccaaagaaagtgctgagcctccactgacccagagtgataagcgagagacaagccatacaactgccgctgccaccgggagatcatcccatgccgatgccagagagtgcgcaatctctacgcaagccgaacaggaggcaaaaacacttcaaacaagcacagacagcgtgtccaaggaaggaaataccaactgcaaaggggagggtatgcaagtgaacacactttttgaaaccagccaggttcccgattggtctgaccccccacaggtgcaggttcaggagaccgtccgcgaaactatttcttgctcccaaatgcccgctttcagtgagcctgctggagaggaatctccctttactggcaccactacaatttctttttctaatttgggaggtgtgcataaggagaacgcttctctcgcccagcattctgaggtgaaaccctgtacatgcggaccacagcatgaggagaagcaggaccgcgatgggaatattcctgataacttccgcgaggatttaaaatatgagcaatctattagcgaggccaacgatgaaactatgtcccctggcgttttcagccgtcatctccctaaggacgccagagccgacttcagggagcctgtggcggtgtcagtggctagcccggaacctaccgataccgccctaaccttagaaaacgtgtgcgacgaacctcgtgaccgggaagccgtgtgcgctatggaatgtttcgaagctggcgaccagggcacgtgctttgacactatcgacagcctggtgggacgcccagttgacaagtattccccacaggaaatctgttccgttgacacagaactggccgaaggccagaataaggtgtcagacctctgctcctccaacgacaaaacactagaggtgttttttcaaacacaggtctcagagacatccgtcagcacttgcaaaagttcaaaggacggtaacagcgtgatgtcccccttgttcacctctacctttaccctgaacatcagccatacagcaagcgaaggggctaccggcgagaacctggcaaaagttgaaaattctacataccccctagcgtcaaccgtccacgctggccaggaacagcccagcccatccaactctggaggtctggatgaaacccagttattgagttccgagaataatccgctagtccagttcaaggagggcggagacaagtccccctccccttctgcggcagacacaacggctacacccgctagctatagcagcatagtgtcttttccctgggagaaacctactacactgacggcgaataatgaatgctttcaagctacacgggaaaccgaggataccagcacagtgacgatcgccaccgaggttcaccctgcgaaatacttggccgtctcaattccggaagacaagcatgctgggggaacagaagagaggttcccgagagcctcgcacgagaaagtaagccaatttccttcccaggtgcagctggaccatatcctgtcaggcgctaccatcaagtctacaaaggagctcctgtgcagggcccctagtgtccccggtgtcccccaccacgtcttacagctccctgaaggcgagggattttgcagtaactcccctctccaggttgataacttgtcaggtgacaaatcccagacagtggaccgcgctgacttcagatcttacgaagagaactttcaagagcggggatcagagaccaaacagggtgtacaacaacagagcctgagccaacaaggatctctttctgctcccgactttcaacagtcattgccaactacctccgcagcccaagaggagcggaaccttgtgcccacggcacattcgccagctagctcacgagagggagcgggacagcggtccggttggggcactcgagtttcagtggtggcagagaccgcaggcgaagaagactctcaggccttatcaaacgtaccctcactgagcgacatactgctggaggaaagtaaggaataccggcctggaaattgggaagccggaaataagctcaaaatcattacactggaggcgagcgcctcagaaatatggcccccaaggcagcttaccaactccgaatccaaggcttccgatggtggattgattatacctgataaagtatgggccgtgcctgattcattgaaagccgacgctgtggtgcctgaattagcaccctcagagatcgccgctctggcacattctcccgaagatgcagagagcgccctggctgattcccgggaatctcacaagggcgaagagcctaccataagcgttcactggagatcactgtcttccagaggtttttcacagccccgactgctggagtcatctgtggaccctgtggatgagaaggagctgtcagtgaccgacagcctatcagccgctagcgagactggaggaaaggagaatgtgaacaatgtgtcacaagaccaggaggaaaaacaactgaagatggaccataccgctttcttcaaaaagtttttaacatgcccgaagattctggaatccagcgttgacccaattgatgaaatcagtgttattgagtatacacgtgcaggaaaaccggagccttctgagaccactcctcagggagcgagggaggggggtcagtcaaacgacggaaatatgggccacgaagccgaaatccagcccgctattctgcaggttccctgcctacaaggaacaatcctgtccgagaataggatctctcgctcccaagaagggtcgatgaagcaggaggccgaacagatacagcccgaagaagctaagactgcgatctggcaagtgctgcaaccttctgaagggggtgagcgaataccgagtggctgttcaatagggcaaatacaggaaagttcagacgggagcctgggggaagctgaacagagtaagaaagataaggctgagttaatcagccctacctcacctctgagcagctgcttgcctatcatgactcacgcatctctcggggtggatacacacaattctacaggacaaatccacgacgtgcctgagaacgatattgtggaaccacggaagcggcagtacgtgtttcctgtgagccagaagagaggcaccatcgagaatgaaagagggaaacctcttccgtccagtcccgatttgacccgctttccctgtacgtcgtcgccagaaggcaatgtgacagatttcctgatcagccataagatggaggagcccaagattgaggtgttacaaattggggaaaccaagccacccagctcaagcagctctagcgccaagactctcgccttcatatccggagagcgggagctagagaaagctccaaagcttctgcaggatccatgccagaaaggaaccttaggctgcgccaagaaaagtcgggagagagagaagagtctggaggctcgtgctgggaaatctccgggtacgctgactgccgttaccggttctgaggaagttaagagaaaacctgaggccccaggatccgggcatctggctgaaggcgttaagaaaaagatcctttcacgggtggctgcactgagattaaagctggaggaaaaggagaatatcagaaagaactcagctttcctaaagaagatgccaaaacttgagacctctctttcacacactgaagagaagcaggatccaaaaaaaccttcttgtaagcgggaggggagggcacccgtgctcctgaagaagattcaggcagaaatgttccccgagcactctggcaatgtaaagctctcctgtcagtttgccgagattcatgaggacagcaccatttgttggaccaaagattcaaaatccatcgctcaggttcagaggtccgccggtgataattcgaccgtctccttcgcaatcgtccaggcgtcacctaaggatcagggtctctattactgttgcattaaaaacagctacggcaaggtcacagctgaattcaatctgacagctgaagtcttaaaacagttgtcctctaggcaagataccaagggctgtgaggagatcgaattctcccagctcatttttaaagaagacttcttgcatgacagttattttggaggcagactccggggacagatcgccacagaggagctgcattttggcgagggtgttcaccggaaagcgttccgttctacagtcatgcatggtctgatgccagtgtttaagccgggacatgcctgcgtgctaaaagtgcacaacgccatagcttacggaactcgtaataacgacgagctgatccagaggaattataaattggctgcccaggaatgttacgttcagaataccgccagatattacgctaaaatttacgccgcagaggctcagccccttgagggattcggagaagtgccagagataatcccaatttttctgatccacaggcctgagaataatattccttatgctactgtggaagaggagttaattggggagttcgtgaagtacagtataagggatgggaaagagatcaattttctgaggcgtgagtccgaggctggacagaaatgctgcacctttcagcactgggtgtatcagaagacctccgggtgcctactggtgactgatatgcagggcgtgggtatgaagctcacggatgtaggcatcgctacactcgctaagggctacaaaggcttcaagggcaattgtagcatgacgttcattgaccagttcaaggcactccaccagtgcaataaatattgtaaaatgctggggctgaagtcactgcagaacaacaatcagaaacagaagcaaccgtccatcggtaagagcaaagtgcaaaccaacagcatgacaatcaagaaagccggaccagaaaccccaggcgagaaaaagaccta

SEQ ID NO: 52898 - DNA, 1230 bp, Artificial Sequence
  Description of Artificial Sequence: Synthetic coding sequence
atgcggggagagcagggcgcagccggagctagggttttgcagttcactaactgcagaattctccgcggagggaagctcctgcgcgaagacttatgggttcggggaggccgaatcctggacccagaaaagcttttctttgaggaaagaagggtggccgacgagcgcagggattgtggaggtagaattctcgcgccaggattcattgacgtccaaataaatggaggcttcggtgtagatttctcccaggccaccgaagacgtgggcagcggagtggctctcgtggccaggcgcattctgtcacacggcgtgacctcattttgccccaccctcgtgacgtccccgcctgaagtgtaccataaagtggtgccacagatacctgtgaaaagtggaggacctcatggcgcaggtgtcctggggcttcatctcgagggtccctttatcagcagggagaaacgcggagctcatccagaagcccatctgcgtagctttgaagcagatgcctttcaggatcttctggctacctacggacccctggataacgtgcgaatcgttactctcgcacctgaacttggtcgatctcatgaggtcatcagagcattgaccgccagagggatttgcgtctcattaggacatagcgtggccgatctgcgggctgccgaggacgcagtgtggtctggcgcaacttttatcacgcatctattcaacgctatgctgccattccatcacagggacccagggattgtggggttgttgacatccgatcgcttaccagcgggacggtgtatcttctatggcatgattgcagacggcacccacacgaaccccgcagccctccgcatcgcccatagggcccatccacaaggtctggtgcttgtaaccgacgcaatcccagccctcggcctgggaaacggccgacatacattaggacagcaggaagtcgaggtcgacggactcaccgcctatgttgcaggaaccaaaactctgagcggttctatcgcccctatggacgtctgtgtgcgccatttcctccaggccactgggtgcagcatggaatctgcactggaagccgcaagcctccatcccgctcagctgctcggactcgagaaaagcaaaggaacacttgatttcggagctgacgccgacttcgtagtgcttgatgactcactacacgtccaggctacctacatttcaggggaactggtctggcaggcagatgctgctaggcagtag

SEQ ID NO: 52899 - DNA, 1320 bp, Artificial Sequence
  Description of Artificial Sequence: Synthetic coding sequence
atgagaggcgaacagggtgccgcaggcgctagagtgctgcagtttactaactgtcgcattctcagaggaggtaaactgctgcgcgaagatctgtgggtccggggaggcaggatcctcgacccggagaaacttttctttgaagaacgcagagtcgcagatgagcggagagactgcggaggcagaattctcgcccctggtttcattgacgtccagattaacgggggatttggcgtcgacttttcacaagcaacggaagatgtaggtagtggcgtcgcactggtggcaaggcgaattctgtcccatggggtcactagtttctgcccaacactcgtcacatccccccctgaggtttaccataaggtagttccacagatccccgtgaaaagcgggggaccccatggggcaggcgtgttaggcctccacctggaaggcccttttatcagccgagagaaaagaggggcacaccctgaagcacacctgaggtcctttgaagccgatgcgttccaggacctcctggccacatacggaccactggacaatgtgaggattgtgactctggctcctgagctgggcagatctcacgaagtgatccgagcccttaccgccagaggaatatgcgtgtccctgggccacagcgtggctgatctcagggccgcagaggacgcagtgtggagcggcgcaaccttcatcacacatctgtttaacgcaatgctgccttttcatcaccgcgaccctggcatcgtaggactcttaacaagcgatcggctacccgctgggagatgcattttttatggcatgatcgccgatgggactcacacgaacccagccgctctgcggatcgcacatcgagcacacccccaaggactggtgttggtaaccgatgccattcctgcactggggctggggaacggacggcacactcttgggcaacaagaggttgaggtggatggcctcaccgcgtatgtggcaggcgaaagaccagaccccctgggcccacggtcacagccagcttgccaagtggctcacgacccacccagggcatgcccgctgtgcagccagggcacaaaaaccctgagtggtagcatcgccccaatggatgtgtgtgtacgccacttcctgcaggccaccggctgttcaatggaaagtgccctggaagctgcttccttgcacccggcacagcttttgggccttgagaagagtaagggtacactggatttcggagccgatgcagatttcgttgtgctcgacgactctctgcacgtccaggccacatacatctctggcgagctagtgtggcaggccgacgcagcgagacagtag

SEQ ID NO: 52900 - DNA, 1785 bp, Artificial Sequence
  Description of Artificial Sequence: Synthetic coding sequence
atgagaggcgagcagggggcagccggagccagggtcctgcaatttactaactgcaggatcttgcggggaggcaagctgcttcgggaagatctttgggtgagaggaggccgtattctcgacccagagaagctattctttgaagaacggagggttgccgacgaaaggcgggactgcggcggtcggatcctagccccagggtttatcgatgtgcagatcaacgggggtttcggcgtggatttcagccaagcgactgaagatgtcggatccggtgtggcgttagttgcccgaagaatcctttctcacggggtcacatccttctgccccactttggtgacatccccccctgaggtctatcataaagttgttccccagattcctgtgaaatctgggggaccccacggagctggcgtcctggggctacatctagagggcccattcattagtcgcgaaaagcggggagctcatccagaagcacacctgagatcatttgaagctgatgccttccaggacctcctagccacctatggccctttggacaatgtgcgcatagtgactctggcccctgagctgggtcggagtcacgaggtgattcgggctcttacagctaggggcatatgtgtgagtctcgggcatagtgttgccgatctgcgggctgccgaagacgccgtttggtcaggagcgacctttatcacacatctctttaatgctatgcttccgttccaccatagagacccaggcattgtaggcttgttgacaagcgaccgcctccctgccggacgatgcatcttttatggcatgatcgccgatgggacccacaccaatccagcagccctacggatagctcaccgcgcacacccgcagggattggtgctggtaaccgacgcaatcccagctctgggcctgggtaatggtcggcacaccctgggccaacaagaggtcgaggtggacggtctgaccgcttacgttgcaggtgagcggccagaccccttgggtcctagatcacagccagcctgccaagtagcacatgaccccccaagagcatgtcccctgtgctcccagggaacaaagacattgtcaggaagcatcgcgccaatggatgtttgcgtacgtcatttcctgcaggctaccggctgctccatggagagcgccctggaagcagcgagccttcatcccgcacaattgctgggcctggaaaaatctaaggggacactcgacttcggggcagacgccgatttcgtcgtattggatgattcactgcacgtccaggctacatacatcagcggaccagtgctcgccggttgcggcgaccctgcttggtgttggagggctgtgtgggaagcgcctgtttgcccggcacacccaatcagtgtcattcttcctagtagcgtgtcaccatggccgtggcatacaccaatgtggcaaactagagcggtgcgcctaccagagcagctgcgcggtggatgggcaagcggcgcattgttggctttacggaccgcgaccgtggggagcgacgtccgagactggtgttctccaacttccggcgtgatagtccttactttctcccccttcgaattttggggcggatggctgccgagcccactcctgacaggggctgttctcggaacaggcggtaccaggttggccttgccgcttttctccagtctgtgttgtaaagctcaactccgcaagtgcttgcaggtgcaacgcgaccgcatggtctgggcacctcctgtgggccgagagcagccgggaaagaatcacctgcccggacaaggcttggcttag

SEQ ID NO: 52901 - DNA, 933 bp, Artificial Sequence
  Description of Artificial Sequence: Synthetic coding sequence
atgggtaagagacgatgtgtcccccctttggagccgaagttagcagccggttgttgcggcgtgaagaagccaaagctgagcggatcaggcacccactcccacggcaatcagagcaccacagtgcccggaagcagttccggccctctacagaatcatcagcacgttgattcttcgagcggccgagagaacgtgtccgacctgacgctaggtcccggaaatagtcccatcacacgcatgaacccagctagcggggcattaagcccgcttccacggccaaacggaacagccaatacaactaaaaaccttgttgttacagcagaaatgtgttgttattgctttgatgtgttatattgccacttgtacggcttcccccaaccacgacttccgagatttacaaatgacccataccctctgttcgtgacttggaagacaggacgcgacaaacgcctcagaggatgtatagggactttttcagccatgaaccttcactcaggactgcgggaatacacactcacctccgctctgaaagacagtcgatttccaccactaaccagggaagagctgccaaaactgttttgttccgtctccttgttaacaaatttcgaagatgccagcgattacctagactgggaggtgggtgtacatgggattagaatcgaatttattaatgagaagggtgtgaagaggactgcaacatacctgccggaggtggctaaggagcaggactgggatcagatccagacaattgactccctcctgcgcaaggggggtttcaaagcccctatcacatccgaatttaggaagacaataaagctcacaagataccggtcagagaaggtcaccatcagctacgcggagtacatcgcgtcgagacagcactgttttcagaacggcaccctgcatgcgccacctctctacaaccattatagttag

SEQ ID NO: 52902 - DNA, 933 bp, Artificial Sequence
  Description of Artificial Sequence: Synthetic coding sequence
atgggcaaacgacgctgtgttccaccgttggaacctaagctcgcggctgggtgttgtggtgtcaaaaaaccaaaactgtctggttccggcacacactctcatggtaatcagagtacaaccgttcccggttctagtagtggtccattgcaaaaccaccagcacgtggacagtagttcaggtagagagaacgtctctgacttaacactgggccctgggaatagccctattactcgcatgaacccagctagtggagccctgtccccactgcctcggcctaatggcacagctaataccacaaaaaatctcgtggtcacggctgagatgtgctgctattgttttgatgtgctgtattgtcacctgtatggattcccacaacctagactgcccagattcacgaacgacccatatccgctctttgtcacctggaaaacaggcagagataagcgcctgcgcggttgcattggcacgttctctgctatgaatctccactcaggattaagggagtatacactgacatctgctctcaaggattctcgattcccacccttaactcgggaagagctccccaaactcttctgttccgtgtcgctgttgactaacttcgaagacgccagtgactatctcgactgggaggtcggggttcacggtataaggatagagtttatcaacgagaaaggcgtaaagcgcaccgccacctacttgccagaggttgcaaaggaacaggattgggaccagatccagactatcgactccttactacgaaagggtggattcaaagcgccaataacatccgagttccgtaagaccataaaacttacgcgttaccggtccgagaaagtgaccatcagctatgcagagtacatagcaagtcgtcagcactgcttccagaacgggacccttcacgcacctcccctctacaaccactacagttag

SEQ ID NO: 52903 - DNA, 1728 bp, Artificial Sequence
  Description of Artificial Sequence: Synthetic coding sequence
atggattttcctacaatatcaagatcaccgagcggcccacctgcgatggacctggagggcccacgcgacatcttagttccatcagaggacctgacacccgacagtcagtgggatcccatgcctggcggacccggatcgttgtctcggatggaattagatgagagctcgcttcaggaactggttcaacagtttgaagcattaccaggcgatctggtgggaccttcacccggtggcgctccctgcccccttcatatagcaaccggacatggtctcgctagccaggaaattgctgacgctcatggcttgctgtctgctgaggccggacgcgatgatctgcttggcctgctgcactgcgaagagtgcccaccatcacagacaggacctgaagaacctctcgaacccgctccacgcctactccaaccacccgaagacccagacgaggacagcgatagcccagaatgggtggagggcgcttccgctgaacaggagggctcacgctcttcgtcatcatcgccggagccatggctggagactgtgccactcgttacccctgaagagccaccagccggtgcccagtctccggagactctggcctcctacccggcaccgcaggaagttcccggaccatgcgatcacgaggatttactggacggtgtcatttttggcgctagatacctgggtagtacgcagctggtgtctgaaaggaatccccctacctctacaaggatggcacaggctagggaagcaatggatcgcgttaaggccccagatggagaaacccagccaatgaccgaagtagatttatttgtatctactaaacggatcaaagtgctcactgctgatagtcaggaggctatgatggaccatgcgctgcacactatctcgtatactgccgacattggctgcgtcctggtgctgatggcgagacgacgcctggctcggagacccgctccccaggatcacggcagaaggctttataaaatgttgtgtcatgtgttctacgccgaagacgcccagttgatcgctcaggctattgggcaagctttcgcggctgcctacagccaatttcttcgggagtctgggattgatccatctcaagtgggcgtgcaccccagcccaggagcctgccatttacacaacggcgaccttgaccacttctcaaattctgacaattgccgcgaggtccacctggaaaaaaggcgcggtgaggggttaggtgtggctttggttgagtctgggtggggatccttactgcctacagccgtgatcgccaatcttttgcacggtggacctgccgaaagaagtggagccctttctatcggcgaccgcctgacagccattaacggcacatctctggtgggcttgcctctcgccgcttgtcaggccgctgtgcgggaaacaaagagccagacatctgtgactttatccattgtccattgtcctcccgttactaccgccatcatacaccgcccacacgcgagagagcagctgggcttttgtgttgaggacgggatcatttgcagcttacttcggggtggaattgcggagagaggtggcatccgtgtcggccataggattatagagataaacggccagtcagtggtcgccaccccacatgctagaataatcgaacttctaactgaggcttatggtgaggtgcacattaagaccatgcctgccgcaacttataggctcctcaccgggcaagagcagcctgtatacttgtag

SEQ ID NO: 52904 - DNA, 2013 bp, Artificial Sequence
  Description of Artificial Sequence: Synthetic coding sequence
atgatcgcctcatgtctgtgttatcttcttctgcctgccacaaggcttttccgggcattaagcgacgctttctttacttgtcgcaaaaatgtgcttctggccaactccagcagccctcaggtcgaaggcgattttgctatggctccccgaggccctgaacaggaggagtgtgagggactgctgcagcagtggagagaggaaggactcagtcaagtactcagtactgcttcagaggggccactcatagacaaaggccttgctcagtcttccctggccctgctgatggacaatccgggagaagagaacgccgcatcggaggatcggtggagcagtagacagctaagcgaccttagggctgcagagaacctggacgagcccttcccagagatgttgggcgaggaaccgctgttagaagtcgagggtgtggaaggatcaatgtgggcagctatccccatgcaaagcgagccacagtatgctgattgtgccgcactgcctgtgggcgctctcgccacagaacagtgggaagaagaccctgccgtgctggcctggtctattgcgcctgagcccgtcccgcaggaagaggcctcaatttggccttttgagggtctgggccaattgcagccacctgcagttgagatcccctaccacgagattctctggagggaatgggaagatttttcaacgcaaccggacgcccagggtctgaaggctggagacggaccacaattccaattcactcttatgagctacaatatactggcacaggatctgatgcagcagagtagcgagctgtatctccattgccacccggatattctgaattggaactatagattcgtcaacctcatgcaagagttccagcactgggacccagacatcctgtgcctccaagaggtgcaggaagaccactattgggagcagctggagccaagccttaggatgatggggtttacctgtttttacaaacggaggactggctgcaaaacagacggctgtgccgtgtgttataagcctacgagattccgcctgctgtgcgcttcacccgtggaatactttcggccaggcctggagctactgaacagagataacgttggtttggtgttgcttctacagccactagtccctgagggtcttggccaggtaagcgtagcgcctctttgtgtcgccaacacccatatcctatataacccacggaggggagacgtgaaacttgcccagatggcgattcttctcgccgaagtagacaaggtggccaggttatccgatggcagccactgtcccataattctttgcggagatttgaatagtgtaccagactccccactgtataactttatcagggacggcgaactacagtaccatggcatgcccgcatggaaagttagcgggcaggaagattttagccatcagctttaccagagaaagctgcaggcccctctttggccaagctcgttggggattaccgactgctgtcagtacgtgacaagctgtcaccccaaaaggtcggaaaggagaaagtatggcagggactttctgctgaggttccgtttctgctccattgcatgtcagaggccggtaggtcttgtccttatggaaggcgtcaccgacaccaagccagagcggcctgctgggtgggcagaaagcgttcttgaggaggatgccagcgagttagagccagccttctctcggactgtggggacaattcaacactgtttgcaccttacaagcgtatatactcacttcctgccccaacgcggacgccctgaggtcacaacaatgcctctcggcctcggtatgaccgtggactacatattctttagcgctgagagttgtgagaacgggaaccgaaccgaccatcgtctctatcgagacgggaccctgaagcttctgggcaggctaagcctgctaagtgaggagatcttatgggcagccaacggcttgcccaatcctttctgtagcagcgatcacctttgcctcctagcatccttcggcatggaagtgaccgccccttag

SEQ ID NO: 52905 - DNA, 789 bp, Artificial Sequence
  Description of Artificial Sequence: Synthetic coding sequence
atgtttccacatcacagccgctctcttggtcgggattggaccacaccttgggaaaatctccagcgttgctgttggaacagacacatttcaagctgcatgcgatggccaggccactatagtcgcgcaccgtacccctacttctcatcacgccatttctctctcaactggaggcccccatgtctcttcgagtcaagaacacagtttcagtattgtaattggcgtcccgacaacttaagccagacctccctcatccacctttcttcttacgtgatgaatgctgaaggggacgagccatccagcaagagacgcaagcatcagggcgtcataaaacgaaactgggagtacatctgttcgcatgacaaggagaaaactaaaatcctgggcgataaaaatgtcgacccaaagtgcgaagacagcgaaaacaaattcgacttcagcgtgatgtcctataacatcttaagtcaagacttactggaggataattcacacctgtatcgccactgtcgcagacccgttcttcattggtcgttcaggttccctaatattctgaaggaaatcaagcacttcgacgcagatgtgctgtgtttgcaagaggtccaggaagaccactacggggctgagatccgcccttccctggaatccttgggcacaatgcagttatttttttttttttttttctttgagactggtagccacagtgtcgcccaactggagtgttccggcactatcatggcccactatagcctaaacctgttgggctcctccaaccccctgatctcagcgtcttag

SEQ ID NO: 52906 - DNA, 1128 bp, Artificial Sequence
  Description of Artificial Sequence: Synthetic coding sequence
atgtcatacaacattctatcgcaagacctactcgaggataactcacacctgtacagacattgcaggagacccgtactgcactggtcgttccgtttcccaaatatactaaaggagattaagcacttcgatgctgatgtgctttgtctgcaggaagtgcaggaagatcattatggggctgagatccggccaagtctggagtccctaggataccactgcgaatataaaatgcggaccggacggaagccagacggctgcgccatctgtttcaagcatagtaaattctccttgctgtctgtcaatcccgtggagttctttcgacccgatatctctctgctcgaccgcgataacgtcggactggtattactgctgcaaccaaaaatcccttatgcggcatgccccgcaatatgcgtcgcaaatactcatttgctatacaatccacggaggggtgacattaaactgacccagctggccatgttactcgccgagatatccagcgttgctcatcagaaggatggctccttctgccccatcgtgatgtgtggcgattttaattctgtacctgggagccctctctacagcttcattaaagagggcaagttaaattatgaaggtctacccattggtaaggtctcaggccaggagcagagcagccggggacagaggatactctcaataccaatctggccgccaaatcttgggatctcccagaattgtgtctatgaagtgcagcaagttcccaaagtggaaaagacagacagtgacctcacgcaaactcaactcaagcagaccgaggtgctggtgactgctgaaaagctgtcttccaacttacagcatcatttttcgctaagctctgtctactcccattatttccccgacactggaattcccgaagtgaccacttgtcactcgcgttccgcgataacagtggattacatcttttactcagccgaaaaggaggacgtggctggccacccaggcgctgaagtcgccttggtgggtgggttaaagctgctggccagactgtccctgctgacagagcaggatctatggacggtgaacggcctgcctaacgaaaacaactcctcggatcacttacccctcttggccaagtttaggttggagctgtag

SEQ ID NO: 52907 - DNA, 1635 bp, Artificial Sequence
  Description of Artificial Sequence: Synthetic coding sequence
atggaggcttggcggtgtgtgagaaaaggatacggtcattgtgttgtcggacggggacgatacccaatgttccctcatcattcccgcagtctcgggagggattggaccaccccttgggaaaatctacagcgatgctgttggaaccgccatatcagctcctgtatgagatggccaggccactattcacgagcaccatatccctactttagctcaagacacttctcgctaaactggagaccgccttgtctcttcgaatcacgcacacagttccagtattgcaattggcggccagacaatctgtcccagacatccctgattcatttatccagctacgttatgaatgcagaaggagatgagccttccagcaagcgcagaaaacatcagggtgtgatcaagcggaactgggaatacatctgctctcacgacaaggagaagacgaaaatccttggcgataagaatgttgaccccaagtgcgaagacagtgagaataaatttgatttcagcgttatgtcttataacatcctgtcccaggacctgcttgaggataatagccacctataccgacactgtcgccgaccagttcttcattggtctttcagatttccaaacatcctgaaagagataaaacattttgatgccgacgttctgtgtttgcaagaggtccaggaggaccattacggcgctgaaatccgaccctcgctggagagccttgggtatcattgtgaatacaaaatgcgcacaggcagaaaacctgacggctgcgcaatctgttttaagcacagtaaattctcccttctgagcgtgaaccccgtggaatttttccgaccagatatctcccttctcgatcgcgataacgtgggcttggtgctcctccttcagcctaagatcccttatgccgcatgtccagcaatttgcgttgccaacacacatttactttacaaccctcggcgtggggatatcaagctcacccagcttgctatgttacttgcagaaatttccagcgtcgcacaccagaaggacgggtcattctgtccaatagttatgtgtggggacttcaatagtgtccccggttcaccattgtattcttttattaaagagggaaaactgaactacgaggggctgcctatcggaaaagtatcgggtcaggaacagtcttcacgcggtcagcgtattctttctatccctatctggccgcctaatctgggtatctcccagaactgcgtctacgaagtgcagcaggtacctaaggtagaaaagaccgatagtgacctgacccagactcagctgaaacagactgaggtattagtgaccgcagagaagctctcaagcaacctccagcaccactttagtctctcttctgtttacagccactactttccagataccggaatccccgaggtgaccacttgtcacagtcgaagcgcaatcacagtcgactatattttttactccgccgagaaggaggatgtggctgggcatccgggagctgaagtggccctggtgggagggctaaaattgctcgcacgccttagcttactgactgaacaggatttgtggaccgtcaacggcctccccaatgagaataactcctccgaccatttgcctctgctggccaagtttcggctggaactgtag

SEQ ID NO: 52908 - DNA, 639 bp, Artificial Sequence
  Description of Artificial Sequence: Synthetic coding sequence
atgtcatataatattctctctcaggacctgctggaggacaactcacacctttataggcactgtagacgccctgtgctccattggtcttttcgatttcctaatattctgaaggagattaagcactttgacgcagatgtgctttgcttgcaggaagtgcaagaggaccactatggagccgagatccgccctagtcttgagagtttgggctaccactgtgagtacaagatgagaacaggcagaaaaccagatggctgcgcaatttgttttaagcacagcaaatttagtttgttgagtgtgaaccccgttgagtttttccgacctgacatctccttgcttgatcgggacaacgttggcctggtcctgctcctgcaacctaagatcccctacgcagcgtgccccgcaatatgcgtcgcgaatactcaccttctctacaacccacggagaggcgacatcaagcttacccagctggctatgctcttagctgaaatctcctcagtcgcgcaccaaaaggatggtagtttttgtccaattgtaatgtgtggcgactttaacagtgtacctggtagccctctgtatagcttcattaaggagggcaagttaaattacgaaggcctgcccataggaaaaaccgtgatttag

SEQ ID NO: 52909 - DNA, 1257 bp, Artificial Sequence
  Description of Artificial Sequence: Synthetic coding sequence
atggaaggcgttatcaagaggaattgggagtacatatgtagtcatgacaaagagaaaactaagatcttgggcgataagaacgtggaccccaagtgcgaagactccgagaacaaatttgatttctctgtaatgtcctataacatattgagtcaggacctgcttgaggataatagccacttgtaccggcattgcagacgcccagtcctgcattggtcatttaggttcccaaacattttgaaggagatcaaacattttgatgccgatgtgttgtgcctgcaggaagtgcaggaagatcattacggagctgaaatcagaccctctctggagtccttgggataccactgtgagtataagatgcgcaccgggaggaagccagacggctgcgctatctgctttaagcattccaagttcagtctcctgagcgtgaatccggtggaatttttcaggccagatatcagtctcctggacagagacaatgtgggcctggtgctgctgcttcagcccaaaatcccctatgcagcgtgcccagccatatgtgtcgcaaatacacatctgctgtacaacccgaggaggggagatattaaactgactcagttagcaatgctccttgccgagatcagctccgtggctcatcaaaaggatgggagcttttgtcccattgtgatgtgtggagactttaacagcgttcctggttctcctctatatagtttcatcaaagaagggaagttgaattacgagggcttgcccataggcaaagtcagcggacaggagcagtcttctcggggtcagaggattctatctatccctatctggccacccaatctgggtattagccagaactgcgtgtacgaggtccagcaggtccccaaggtagagaaaaccgattcagatctgacacagacacagctgaaacagactgaggtgctagttactgctgaaaaactgagcagtaacctgcagcatcatttcagcctgtcttcagtctatagccattattttcccgacactggtattcctgaggtgacaacgtgccattctagatccgcgataaccgtggactacattttttactctgctgagaaggaggacgtggccggtcaccctggcgcagaagtcgcactcgtcggcggattgaagctcctagctaggctgtctctgttgactgagcaggatctatggacagtgaacggcctgccaaatgaaaacaactcttccgatcacctgcctctgctcgcaaagtttaggctggaactgtag

SEQ ID NO: 52910 - DNA, 1128 bp, Artificial Sequence
  Description of Artificial Sequence: Synthetic coding sequence
atgagctacaacatcttgagccaagatcttcttgaggataacagtcacctgtaccgacattgtaggagaccagtcttgcactggtcttttagatttcctaacattctgaaggaaattaagcattttgacgcagacgttctatgtctccaggaagttcaagaggatcactacggggctgaaataagaccgtcattggaatctctggggtatcattgcgaatacaagatgcgcacaggacgaaagcccgatggatgtgccatctgtttcaagcactccaagttcagtctgttatctgtcaatcccgttgagttctttcgccctgatatctctctgctcgaccgtgataacgtggggctggttttgctgttacagccaaagatcccctacgcggcatgtcccgctatctgtgtggctaacacacacctgttatataatcctagacgcggtgatataaagctcacacagctcgcgatgttgcttgctgagattagctctgttgcccaccaaaaagacggctccttctgccctattgtaatgtgcggcgatttcaacagcgtgcctggttcaccgctctactcgttcatcaaggaggggaagcttaattacgaaggcctccccatagggaaagtctccggccaggagcagagttctaggggccagaggatattgtcaatcccgatttggccacctaacttaggtatatcccagaactgtgtctatgaggttcagcaggtgcccaaagtcgagaagacagactcagatctgacgcaaacacagctgaaacagacagaggtactggtaaccgccgaaaaactttctagtaatttgcaacatcatttcagcctcagtagcgtctattcccactactttccggacaccggaattccagaagtcactacctgtcacagtaggtcggctatcacagtggattacatattctatagtgctgagaaggaagacgtcgctggacaccccggagccgaggtagccctggtcgggggtctgaagttactggcaagactgtccctgctgaccgagcaggacctctggaccgttaacggcctgccaaatgaaaacaattcatccgaccatctgcctctgctggcaaagtttcgattggagttgtag

SEQ ID NO: 52911 - DNA, 2520 bp, Artificial Sequence
  Description of Artificial Sequence: Synthetic coding sequence
atgtcagccggagatggcctgaggagaggcaagtccgcaagatgtgggttaaccttttctgtcgggaggttctttagatggatggtggacacacggatttctgttcgcatccatgaatacgcggcaattagtctgaccgcctgtatggagaacctggtggaggaaatccgcgctcgggtcatggccagccactcccccgatggtggcggtgctggcggaggggaagtgagcgcggaggctttggaaatggtgataaataacgatgcagaattgtggggggttctgcagccctatgagcatctaatctgtggaaaaaacgccaatggggttttgagcttgcccgcttacttttcaccttacaacggaggcagcttgggccatgatgaaagggctgacgcctatgcccagcttgagttgagaacgctggagcagagccttctggctacctgcgtaggaagcattagcgagctttccgacctggtttctagagcaatgcaccacatgcagggcaggcatcctctatgtcccggagcaagtcccgctcgacaggctcggcagcctcctcagcccatcacatggagtcctgacgcactccacacactttactacttcctgcggtgtcctcaaatggagtccatggagaaccccaatctggatccaccaagaatgacgctgaataacgaacggccatttatgcttctccctccactaatggaatggatgcgtgtagcgatcacctacgccgagcaccgacgatccctgactgtcgactccggggatattcgccaggcagccagactcctgcttcccggactagattgcgagcctcggcagctgaagccagagcattgttttagttcctttagaaggctggacgctagagcggctacggagaagtttaatcaagatttaggcttccgtatgcttaactgcggcagaacagatctgattaaccaagctattgaagccctgggacccgatggcgtaaataccatggatgaccaggggatgactcctttgatgtacgcgtgtgcggcaggagatgaggcgatggttcagatgttgattgatgccggagcaaacttagatattcaggtaccatccaactcccctcggcacccctctatccacccggactcgcgccactggacatctttgacttttgctgtcttgcacgggcacatttcagtcgtgcagctgcttcttgacgctggtgcacacgttgagggttctgccgtcaacggaggtgaggactcttatgccgaaacgccactgcagctggcatcagccgctggcaactacgaactggtgagtctgctactgagcagaggcgcagacccattgctatctatgctggaggcccatgggatgggatcaagcctccacgaggacatgaactgctttagccatagcgccgcacatggtcatcggaacgtcctccgaaagctactgactcagcctcagcaggcaaaagccgacgtactttccctggaagaaattttggcagaaggcgtagaggagtcagacgcttcctcgcagggctccggttcagaaggcccagttagattaagccggaccaggaccaaagctctgcaggaggcaatgtattattcagccgaacacgggtatgttgacattactatggaactgcgggcactgggggtgccctggaagttgcatatctggatagaatctctgcggacatcattctcccagtcaagatactccgtcgtccaatccctcctgcgcgacttttcaagtattcgcgaggaagagtacaatgaagaactggttaccgagggcctgcagctgatgtttgatatcctgaaaacaagcaagaacgactccgtcatacagcagctcgctaccatttttacacactgttacggttccagtccaattcctagcatcccggaaattcggaagaccttgccggctcgccttgacccccactttctgaataataaggaaatgtccgatgttacgttcttggtggagggcaagctgttctatgcacataaagtcttgctggtcacggcctccaaccggtttaaaacactgatgaccaacaagtctgaacaagacggagatagttctaagactattgagatctccgatatgaaatatcatatcttccaaatgatgatgcagtacctatactatggtggcacagagtcgatggagattccgaccaccgatatattagaactgctgagcgctgctagtttattccaactggacgcgctccaaagacactgtgagatcctgtgctctcagacccttagcatggaatcagcagtgaatacctacaaatatgctaaaatccataatgcccctgagctggccctcttctgcgagggatttttccttaaacatatgaaagctctgctcgaacaagacgccttccgacagctgatctatggcaggagctccaaggtgcagggtctcgacccacttcaggacctacagaatactctggcggaacgagtgcattcagtttacatcacatcgcgagtatag

SEQ ID NO: 52912 - DNA, 3078 bp, Artificial Sequence
  Description of Artificial Sequence: Synthetic coding sequence
atggctggcacatattcctcaactctcaaaactctcgaggatctaacgctagatagtggctatggcgcaggggacagttgtcgttcgctgagtctcagctcttctaagagtaactctcaggcgcttaacagctcagcacagcagcatcgaggcgctgcatggtggtgctatagcggatccatgaactctcggcataattcatgggacactgtcaacacagtgctacctgaggatcctgaagtcgcagacttgttttcccggtgcccccgattacccgaactcgaggagttcccctggaccgaaggagacgtcgcacgggtgctcaggaaaggtgcgggtggcaggagattgccccagttcagtgctgaggccgttaggaggctcgctggccttttgcgaagagctttgatcagagtagccagagaggctcaacgcctcagcgtgctgcacgcgaaatgcactagatttgaggtgcagagtgccgtccgtctggtccactcttgggctcttgccgagtcttgtgctttagcagccgtgaaggccctctctctctatagcatgtcagccggagacggcctccgcaggggaaaaagtgcaagatgtggactgacattcagtgtgggacgttttttcaggtggatggtggacacgcggatatccgtgcgaatccatgagtatgcggctatctccctgacggcgtgcatggaaaacctcgtggaggagatcagggcgagggtcatggcgtcacactcccccgacggtggcggtgccggtggaggagaggtgtcggcggaagcattagagatggttataaataatgacgctgagctttggggtgtgttgcaaccatatgagcatttaatatgtggtaagaacgcgaacggggtgctgagcttaccggcttacttttctccctacaacgggggaagtctcggccacgatgaacgcgcagatgcgtatgctcaactcgagcttagaacactcgagcaaagcctgttagcgacttgtgtcggcagcattagcgagctgagcgatctcgtgtcacgcgcaatgcaccacatgcagggacgtcaccccctgtgtccgggagctagtccagccagacaggcccgtcagcccccacaaccaataacttggagcccggacgcactgcacaccttgtattattttctgcgctgtccacaaatggaaagcatggaaaaccctaacttggaccctcccagaatgactctgaataatgagagaccattcatgctcctgccaccgctgatggagtggatgagggttgctattacttacgccgagcatcgacggagtcttacagtggattccggagacattcgacaagctgcacgcctgttactaccaggcttggactgtgaacctcggcagctgaagcccgagcactgtttctcaagctttaggcgtctggacgcccgagccgcaacggagaagtttaaccaggacttgggatttcgcatgcttaattgtggtaggacggacctaattaatcaggccatagaagctctggggcctgatggcgtgaatacgatggacgaccaggggatgactcctctgatgtacgcctgcgcagcaggagacgaggcaatggtgcaaatgttgatagacgccggagccaatcttgacattcaggtgccatcaaatagtccacgtcacccctctatccaccctgacagtcgacattggactagtctgaccttcgccgttctgcatggacacatctctgttgttcagctcctgctagatgccggtgctcacgttgagggctctgccgtaaatggcggagaagatagctacgccgaaaccccgctgcagctggcaagcgctgccggaaattacgagctagtatccctcctcctcagtagaggagccgatccacttctctctatgctggaagctcacgggatgggcagctccctgcatgaggacatgaattgcttctctcactcggctgcccatggacacagaaacgtgctgagaaaattactgacacagccacagcaggcaaaagcagatgtcctgtccctcgaggagatactcgccgaaggcgtcgaagaaagcgacgctagctcacaggggagtgggagtgagggccctgtgcggctgagtagaacccggaccaaggcgttgcaggaggccatgtattactccgccgagcacgggtatgttgatataactatggaactccgagctctgggtgtcccctggaaactgcacatctggatcgaatccctacgcactagtttttcacagagtcggtactctgtcgtgcagagtctgctgagagacttcagttctatccgagaggaggaatataatgaagagctagttactgagggcttgcagttgatgttcgacattctcaagacatcaaagaacgattcggtaattcagcagttagctaccatttttacccattgctacggctcatctcctataccttcaatacctgaaatcaggaaaacactgccagctcgtctcgaccctcactttctcaacaacaaggaaatgtcggatgtaacgttccttgtagagggcaagctgttttacgcccataaggttctgctggtgactgcatcaaacagatttaagaccctgatgaccaacaaatctgagcaagatggcgattcatccaagacaattgaaatctcagatatgaagtatcacatcttccaaatgatgatgcagtatctgtattacggcggaacagaatccatggaaattccaacgactgatatcctggaactgctttccgctgcgtcgctgttccagttagatgcactccaacgacattgcgagattctctgcagccagacgctcagcatggagagcgctgtgaacacctacaaatacgcaaaaatccacaacgccccagagctagccctcttctgcgaaggcttcttcctcaagcacatgaaagctctcttagagcaggatgccttccgacagctgatctacggaaggtcgagcaaggtgcagggtctggatccactgcaggaccttcagaatactttagcagagagggttcactccgtttatataacctcaagagtatag

SEQ ID NO: 52913 - DNA, 126 bp, Artificial Sequence
  Description of Artificial Sequence: Synthetic coding sequence
atgcaggaagaactagcttgggagacggacggcctctgggacgagtgcgcctcccctgtctgtttagtgcgcccactcactaacccacccgacctcggaaagctcagagggcaggacccactttag

SEQ ID NO: 52914 - DNA, 414 bp, Artificial Sequence
  Description of Artificial Sequence: Synthetic coding sequence
atgcaggagttgatcgggagaagggtgaatacacgagcccgtaaccacgttggtcgagtcgcacttcattgggctgccggtgccggacatgagcaggctgttagactgctacttgaacatgaggcagctgtagacgaggaggatgccgtaggggctttgacggaggaaggcaatactgcgctgcacttggctgctggccgaggccacatggctgtcttacagcgcctggtagacattggcctcgatctggaagagcaaaacgcggaagggctgacggcactgcactccgctgcaggcggatcgcacccagattgtgtgcagctgttactcagagccggaagtaccgtcaacgccctgacgcaagtggccagaccatcccaggattgtgggcgtttacttgctgccgaaccatag

SEQ ID NO: 52915 - DNA, 1473 bp, Artificial Sequence
  Description of Artificial Sequence: Synthetic coding sequence
atgcaggaggaactagcgtgggagacggatggcctgctgccgctcgagcgccagctgcacgaagccgcaagacagaataatgtgggacgaatgcaggaactcattggaagaagagtgaacacacgcgctcggaaccacgtgggccgagttgctctgcactgggctgcgggtgccggacacgagcaggctgtgagactgctgttggagcacgaggcagccgtggatgaagaagacgccgtgggggcactgaccgaggcccgactgtgtttcggtatgaacgctttgctgctgtccgcctggttcggccatttgcggatactgcagatcttagtcaatagtggcgctaagatacattgcgagtcaaaggatggcctgactctgttacactgtgctgctcagaaggggcacgtcccggtcctggcattcatcatggaagatctggaagatgtcgcactcgatcatgtggacaagctgggcagaacggcattccatcgtgcggcagagcatgggcaacttgacgccttggatttcctggtggggtcaggttgcgatcataatgtgaaagacaaagaaggcaacaccgcgctgcatctggcagctggtcggggtcatatggctgtgctgcagagactggtcgacattggactagatctggaggagcagaatgcggaagggttgacggctcttcatagtgccgcaggcggttcccaccctgattgtgtgcagttactgctgcgcgctgggagcaccgttaatgccttaacccagaagaatctttcttgtttacactatgccgctctcagtggttctgaggatgttagtagggtgctcatccacgctggaggttgtgctaacgttgtcgaccaccagggggcatctcccttgcatctggcggtgaggcacaacttccccgcacttgtacgcctgctgataaactcggacagtgacgtgaatgcggtcgataatcgacagcagacccctttacacctagccgcagagcacgcctggcaggatattgcggacatgcttctcatagctggcgtggatttaaatcttagggacaaggaccatccatctgatcccagtggcaagtctctcagtttcaagcaggaccaccgtcaggagactcagcagctccggtctgtgctgtggcgactggcaagccgttacctccagccccgagaatggaagaaactcgcatacagttgggagtttaccgaggcccatgtagatgcaatagagcaacagtggacaggaacccggagctaccaagaacacggccacaggatgttgctaatctggctccacggagtggctaccgcgggagagaaccctagcaaggcactctttgaaggcttggttgcaataggacgcagagatctcgccggttggagcaccatggcaagatcgcagcttacagccaccagcgcatcgcgcgtgcagatgattctggtaccccagcctccagagtag

SEQ ID NO: 52916 - DNA, 1569 bp, Artificial Sequence
  Description of Artificial Sequence: Synthetic coding sequence
atgcaggaggaattagcttgggagaccgacggcctcctgcctctcgagcgtcaactgcacgaagctgccaggcagaataacgtgggtcggatgcaggaacttattgggagaagggtgaacacccgtgcaaggaaccacgttggacgcgtggctctgcactgggcagccggtgccggtcacgaacaagctgtccgattgcttctggaacacgaggccgcagtggacgaggaagatgccgtcggagccctgactgaggcacgcctctgtttcggcatgaacgccctgctcttgagcgcttggtttggtcacctccggatcctgcaaatactggtgaattctggcgcaaaaatccactgtgagtcaaaagacggacttacactgctgcattgtgccgcacaaaaagggcatgtgccagtgctggcatttatcatggaggatctcgaggacgtggccctggatcacgtggataaattgggtcggactgcatttcaccgtgctgccgagcatggtcagctggatgccctggacttccttgttggcagcggatgcgaccacaatgtgaaagataaggaagggaatactgcgctccacctagcggcaggtcggggacacatggcagttctgcaaaggttagtggacatcggcttggacctggaagaacagaacgctgaaggactgactgctctgcactcagctgccggtgggagccacccagactgtgtgcagttactgctacgcgctggttcgactgttaatgctctgacccaaaagaacttgagttgtctgcattacgcagcactgtcaggctccgaggacgtgtcacgtgtattaatccacgcaggaggttgcgctaacgttgtggatcaccagggggcatcccctctccacctcgccgtgagacacaatttccccgctctggtccggcttttgatcaattccgacagtgacgtgaatgcggtagacaatcgccagcagacccccctgcatctggctgccgagcacgcttggcaggatattgccgatatgttattgatcgctggcgtcgatctcaacctgcgcgacaaacagggtaagacggccctggccgtagctgtgcggtcaaatcatgtgtccctggtggatatgatcattaaggctgaccggttctaccggtgggagaaagaccatccatctgacccctcgggaaaaagtttgtcattcaaacaggaccacaggcaggaaacacagcagctcagaagcgtcctctggcgcttagcaagtcgctatctccagcccagagagtggaagaaactcgcctactcctgggaatttacagaagcccatgttgatgcaatagagcaacaatggactgggacgcgatcctatcaggagcacggtcacaggatgctattgatctggctccacggcgtggcgactgcaggagagaatccgtccaaggccctcttcgaaggcttggtggctatcggacgtcgggacctggcaggatggtccaccatggccagaagccagctgacggcgacctctgcttccagagttcagatgatactggtgcctcagcccccagagtag

SEQ ID NO: 52917 - DNA, 1545 bp, Artificial Sequence
  Description of Artificial Sequence: Synthetic coding sequence
atgcaagaagagctagcgtgggagaccgatggtctactgccccttgagaggcaactgcacgaagcagccaggcaaaacaatgtggggagaatgcaggaactcattgggagacgtgtaaatacaagagcacgtaaccatgttggtcgggttgctctgcattgggctgccggagctgggcacgaacaagcggtgcgcctgttgctggaacacgaggctgcagtagacgaagaagacgccgtgggagcccttacggaggcccgtttatgctttggcatgaatgcactgctgctgagcgcttggttcggacatctcaggatcttacagatcctggttaattctggagccaaaatccattgtgaatctaaagacggcttaacgctcctccactgcgcagctcagaagggtcatgtcccagtcctggccttcatcatggaagaccttgaagatgtcgccttggaccatgttgacaaactgggacgcaccgcttttcatcgcgcagctgagcacggccagctggacgcattggactttctcgtggggtccggctgtgatcataacgtaaaggacaaggagggaaatacagcactgcatctggctgctgggaggggccacatggcggtgttacagaggctggttgacataggcctggacctcgaagagcaaaacgctgagggccttactgcgttgcactccgcggctgggggttctcaccccgactgcgttcagctgttacttcgcgctgggtctacagtgaacgctctgacacagaagaacctgagttgcctccattacgccgctctgtccggatctgaagatgtgtcccgcgttttaatacacgccggtggttgtgccaatgtggtggaccaccagggggctagtccactgcatctcgctgtgcgccacaattttcccgctctcgtccggttactcatcaacagtgatagtgacgtgaacgctgtggacaacaggcagcaaacccccctccatctggcagccgaacacgcttggcaagatatagccgatatgctcctgatcgctggagttgatctcaatctgcgcgataaacaagggaaaacggctcttgcagtggcagtacgctctaaccacgttagcctcgtcgatatgatcattaaggccgatcggttttacaggtgggaaaaagaccatccttctgatccaagcgggaaaagcttgtcttttaagcaagaccataggcaggaaacacagcaactcagaagcgtgctctggagactggccagtcgctacctgcagccccgagagtggaagaagctggcgtattcttgggagtttaccgaagcccacgtcgacgccattgagcagcagtggactgggacccgttcctaccaggagcacggacaccggatgctgctcatatggctgcatggcgtggctaccgccggagagaatccaagcaaggccttgttcgagggactggtcgcaatcggcaggcgagacctggcggagaacattaggaagaaggccaacgccgcaccgagcgctcctcggaggtgtacagcaatgtag

SEQ ID NO: 52918 - DNA, 1200 bp, Artificial Sequence
  Description of Artificial Sequence: Synthetic coding sequence
atgaacgctttgttgctctctgcttggtttgggcatctgcgaattctccagatactggttaattccggagctaagatccattgtgaaagtaaggatggcctgacactgctgcattgcgcggctcagaaaggccatgtgcctgtgttggcctttataatggaagaccttgaggatgtggcgttggaccatgtcgacaaactggggagaactgcctttcatagggccgctgaacatggacagttagatgctctggatttcctggtggggagcggctgcgatcacaatgtgaaggacaaggagggaaacaccgctttgcacttggccgctggccgtggacacatggctgttcttcagagactagtcgatataggactggacctggaagagcaaaatgctgagggcctaaccgccctgcatagcgccgctggcggtagccacccagactgtgtgcaactcctgctccgcgctggcagcactgttaatgcactgacccagaaaaacctgtcatgccttcattacgcggctctctccggttccgaggatgtatcaagggtgcttattcatgcaggaggttgcgccaacgttgtggatcaccagggcgcatctccgttgcatttagccgttaggcacaacttccccgcattggttcgcttgctcatcaatagcgactctgacgtgaacgctgtagataaccgacagcagacccccctccacctggccgctgagcacgcctggcaggacatcgctgacatgctgctgatagctggggtcgatctgaatttacgagataaagaccatccaagtgatccgagtggcaagtctctctcctttaagcaggatcaccggcaggaaactcagcaacttcggtctgtcctttggcgcctggcctcccgctacctccagccacgggaatggaaaaagttagcatattcctgggagtttaccgaagcacatgtcgacgccattgagcaacagtggacagggacccggagctatcaggaacacggacatcggatgcttctaatttggctgcacggggtcgcgaccgcaggggaaaatccatctaaagccctgtttgaggggctggtggctattgggcgtagagacctcgccggttggagtaccatggcccgatctcaactgaccgccaccagtgccagccgagtacagatgatcctcgtgccccagcctcctgaatag

SEQ ID NO: 52919 - DNA, 546 bp, Artificial Sequence
  Description of Artificial Sequence: Synthetic coding sequence
atgaatgcgctactcctgagtgcttggttcggacacttgcgaatcctccagattctggtgaactccggcgcaaagatccactgcgagagtaaagatggtttaacactgctgcattgcgctgctcagaaggggcatgttcctgtattagcgtttattatggaggatttggaagacgtggcactggatcacgttgataagctgggaaggaccgcctttcaccgggctgccgaacacgggcagctagatgccctggattttctcgtgggtagtggctgtgaccataatgtcaaagataaagagggaaacaccgctctgcaccttgcagccggaaggggtcacatggccgttctgcaaaggctagtggacataggcctggatttagaggagcagaatgccgagggattaaccgccctccacagcgccgctggtgggtcacatcccgactgcgtacagctcctgctgagagcaggatctacagtaaacgcccttacacaggtcgcacgccctagccaggactgtgggagacttttggcagcagagccttag

SEQ ID NO: 52920 - DNA, 270 bp, Artificial Sequence
  Description of Artificial Sequence: Synthetic coding sequence
atgttagggggactgggaaaactggcagcggagggcctggcacatcgaaccgaaaaggccactgagggcgcaatacacgcagtggaggaagtggttaaggaggtggtcggacatgctaaagaaacaggtgaaaaggcgatagccgaggccataaagaaagcccaggaatccggggataaaaaaatgaaagaaatcacggaaacggtcacaaataccgttacaaatgctatcacccacgctgccgagtctttagataaattaggtcagtag

SEQ ID NO: 52921 - DNA, 3270 bp, Artificial Sequence
  Description of Artificial Sequence: Synthetic coding sequence
atgggtaatacaactacaaagttcaggaaggcactgatcaatggggacgaaaacctggcctgtcaaatatatgagaataacccccagttgaaggaaagcctggatcccaacacctcctacggcgaaccgtatcaacacaacaccccacttcactatgcagccaggcacgggatgaataagatcctcggcacctttctgggacgcgatggaaatcctaacaaacgcaacgtccataatgagacatctatgcatctgctgtgcatgggccctcaaatcatgatctccgagggagctctacaccccagactggcacgcccaactgaagacgacttccgcagggcggactgcctgcagatgattctcaagtggaagggcgcaaagctggaccagggtgaatacgaaagggctgccattgatgccgtggataacaagaaaaacacccccctgcattatgccgcagcaagcggcatgaaagcctgtgtcgagctgctggtaaagcatggcggtgacctcttcgccgaaaatgagaataaggatacaccgtgcgattgcgccgagaagcagcatcacaaagacttggccctgaatttagagtctcagatggtgttttcgagggatcctgaagctgaagagatcgaagcagaatatgctgccctagataaacgtgagccctatgagggcttgcgcccacaggatctgcgaagacttaaggacatgctgatcgtagaaacagccgatatgctccaggctcctcttttcacagcagaagccttgcttcgcgctcatgactgggacagagagaagcttctcgaggcttggatgtccaacccagagaactgttgtcagaggagcggcgtacagatgcctacccccccaccaagcggctacaatgcttgggacaccctgcctagccccaggactcccaggacaaccaggtcttccgtgacctcccccgatgagattagcctgagccctggggatctggacacatctctgtgcgacatttgcatgtgcagcatatcagtgttcgaagaccccgtcgacatgccttgcgggcatgacttctgcaggggttgttgggaatcctttctgaacctcaagattcaggagggcgaggcacacaatatcttctgccctgcttacgactgctttcaactggtaccagtggacataattgaatctgtcgtgagcaaagagatggataagcgctatttgcagtttgatataaaagccttcgtcgagaataatccagctatcaagtggtgtcccaccccaggctgtgaccgggctgtaagactcacaaagcaggggagcaatacctctggcagtgacaccctttctttccccctgctgcgtgctccagctgtggattgtgggaaaggccacttgttttgctgggagtgtctcggggaggcccatgagccctgcgattgccaaacgtggaagaactggttacagaaaatcaccgaaatgaagcccgaagagttggtcggagtaagtgaagcctatgaagatgctgccaactgtctgtggttgttgactaattcaaaaccatgtgcgaactgcaagtcccccatccaaaagaacgagggatgcaaccacatgcaatgtgccaaatgcaagtatgacttctgctggatttgtctggaggaatggaagaagcactcttcctcgaccggagggtactataggtgcaccaggtacgaagttatccaacatgtggaagaacaatcgaaggagatgactgtggaggccgagaagaaacataagaggttccaagaactggaccgttttatgcattattacaccaggtttaagaaccacgagcactcctatcagctggagcagagactgctgaagactgctaaagagaaaatggagcaactctcaagagccctgaaggagactgagggaggctgtccagatacaacattcatcgaagacgccgttcacgtgctgctcaagacccggagaatcttaaaatgcagctacccgtatggattctttctggaacctaagagcactaagaaagagattttcgaactgatgcaaacagatctggagatggtgactgaagaccttgcccagaaagtgaacaggccctatttgaggacaccgcgacacaagattatcaaggcagcatgcctggtgcagcaaaagagacaagaattcttagccagcgtcgccaggggcgttgcaccggctgattcgccagaggcacctcgaaggagcttcgctgggggaacttgggattgggaatacctcggtttcgcatcacccgaggagtatgccgagttccagtatcggcgaaggcacagacagaggaggagaggtgatgttcatagcctcctctccaatcctccagatccagacgagccctcagagagcactcttgacatcccggaaggcggatcttcatctaggcgtccgggaacatcagtagtatcgtctgccagcatgtccgtcctccacagttcgtctctgcgagactatacccctgcaagccggtccgagaaccaagacagccttcaagccctttcatcattagatgaggacgaccctaacatccttctggccatccagttgtcacttcaggagtctggcctggcgctggatgaagagaccagagattttctgagtaacgaagcttcactgggagcaattggcacatcactgcctagtcgtctggacagcgtgcctcgcaatactgactccccaagggcagctctaagcagtagtgaactgctcgagctcggggacagtctgatgaggctcggcgcagagaatgacccattcagcacagacaccctgagttcacatcccctgtcggaggcaagatcagatttctgtccctcaagttctgatcccgacagcgctggccaggatcccaacattaacgataacctgcttggaaatattatggcctggttccacgatatgaatccccagagcatcgcactgatacctcccgctactactgagatctctgctgatagccaactgccatgcattaaagacgggagtgaaggggtgaaagacgtggaactagttctgcccgaggacagcatgttcgaagatgcttctgtgtctgagggaaggggcactcagatagaggaaaacccacttgaggagaatatcctggcaggagaagccgcatcccaggccggtgactccggtaatgaggcggcaaaccgcggagacggatctgacgtgtcttctcagacaccccagaccagctctgactggcttgaacaggtccatttagtttag

SEQ ID NO: 52922 - DNA, 405 bp, Artificial Sequence
  Description of Artificial Sequence: Synthetic coding sequence
atgggtaacacaactacaaagtttcggaaggccctgattaatggcgacgaaaatctggcttgtcaaatctacgaaaacaaccctcagttgaaagagagtcttgaccctaataccagctacggcgaaccctaccagcataacaccccactccattacgctgcaagacacggtatgaacaagatacttgggacatttcttgggagggacgggaatccaaacaagcgcaacgtccacaacgaaacaagcatgcacctgctgtgcatgggcccacagattatgatctccgaaggtgccttgcatcctcggctcgcccgtcccactgaggatgacttccgcagagctgactgcctccagatgattctgaaatggaaaggtgccaaactggatcagggtgagtacgagtag

SEQ ID NO: 52923 - DNA, 1947 bp, Artificial Sequence
  Description of Artificial Sequence: Synthetic coding sequence
atgctctggcctaggctggccgcagcagagtgggcagccttagcttgggagctcctgggcgcttcagtgttgctaatcgctgtgcgctggcttgtgaggagactcggacctaggcccggtgggcttggtcgctctggaactcccgtcccgccaccttctgcagccgctgcacccgcatccggagaaatgaccatggatgcgcttctggctaggcttaagctgctgaatccagacgatcttcgcgaagagatcgttaaggccggactcaaatgcggtcccatcacctctacaacccgatttattttcgaaaagaagctcgcgcaagccctgctggaacaagggggacgcctgtcatctttctatcaccatgaagcgggtgtcactgctctttcgcaggatcctcagcgaatcttaaagcccgcagaggggaatccaaccgatcaggcgggattctccgaagaccgggattttggttactcggtgggcctgaatccgcctgaggaggaagctgtgacgtccaaaacctgttccgtgccgccttccgacactgatacgtaccgggctggggcaactgcctcaaaagagccccctctgtactacggtgtgtgcccagtgtacgaggacgtaccagcccgaaacgagaggatttacgtctacgaaaacaaaaaagaggcactccaggccgtgaagatgatcaagggaagtaggttcaaagctttcagcacccgggaggacgccgaaaaatttgcaagggggatctgcgattacttcccatccccaagtaaaacctccctgccccttagtcccgttaagaccgctccactcttctctaatgacagactgaaggacggcctgtgccttagcgaatccgagactgttaacaaagaaagggcaaacagctacaagaatcctcggactcaagatctcacagccaaacttcggaaagccgtggagaagggtgaagaagacaccttttcagaccttatttggtccaaccccaggtacctgatcggaagcggcgacaaccccacaatcgttcaggagggttgccggtacaatgtaatgcatgtggctgcaaaagaaaaccaggctagcatttgccaactgacccttgacgttctcgagaatccagattttatgaggctcatgtatcctgatgatgatgaagccatgctccagaaaaggatcagatacgtggtggatctgtacctaaacacgccggataagatgggctacgatacccctcttcactttgcatgcaagttcggtaacgcagatgtggttaatgtgctatccagccatcatctcatagtcaaaaattctagaaacaaatatgataagacaccagaagacgtcatttgcgaacgtagtaaaaataagtcagttgagcttaaggagcgcattagggaatacctcaaaggtcactattacgtcccccttctcagggctgaagaaacatccagcccagtgattggagagctgtggtcccctgaccagaccgctgaagccagccacgtatcaagatatggcggatcacctcgagacccagtgcttacattacgggcttttgctgggccactgagtccggctaaagccgaagattttagaaagctctggaagactccaccaagggagaaggccggttttctgcaccatgtgaaaaagagcgatcctgagaggggcttcgagcgggttggacgagaactcgcacatgaactgggatacccgtgggtcgaatattgggagttcctagggtgcttcgtggatctgtcctctcaggagggcctgcagcgcctggaagaatatcttacccagcaggaaattggtaaaaaggctcagcaggagaccggcgagagagaggccagttgccgggacaaagctaccacatcagtggagatgcgcttccaccgcattgaccaagctggcttggaactgctgacatcttag

SEQ ID NO: 52924 - DNA, 2817 bp, Artificial Sequence
  Description of Artificial Sequence: Synthetic coding sequence
atgctatggcctcggctagctgccgcagaatgggccgcactggcctgggagcttctgggagccagcgtgctgctgatcgctgtgaggtggctggtgcgtcgcctagggcctagacctgggggtctcggtagaagcggaactccagtaccccctccatcagctgccgcagctcctgctagcggtgaaatgacgatggatgcgctacttgcaaggctcaaacttttgaatccagacgatctgagggaggagattgtcaaggcaggcctgaaatgcggaccgataacttcaacaactaggttcatctttgaaaagaagctggcccaagctctgctcgaacagggcggtcgcctctcatctttttatcatcatgaagcaggagtgacagctttgagccaggacccacagcgaatcttaaaaccagctgaaggtaaccctactgaccaggcaggtttctccgaagatagggacttcggatattctgtcggcctcaacccccctgaggaggaggcggtgactagcaagacatgctctgtgccaccttccgacactgacacctaccgtgccggagccactgcctccaaggagcctcccctatattacggcgtgtgccctgtatatgaagatgtgcccgcaaggaacgaaagaatttacgtgtacgagaataaaaaggaggccctgcaggccgtgaaaatgattaaggggtccagatttaaggctttttctactcgggaagatgcagagaagttcgctcgaggcatctgtgattacttccccagtcccagtaagacttccctgccactgagccccgttaagacagcccctctcttcagcaacgatcgcctgaaagacggattgtgccttagcgagagtgagacggtgaataaagaaagggcgaactcctataagaaccctcggactcaggatctgactgcgaagctccgaaaggcagtcgaaaagggggaggaggacactttcagcgacttgatctggtctaacccacggtatttgattggtagcggcgacaatcccacaattgtgcaggaggggtgtaggtacaatgtgatgcacgtggcagcaaaggaaaatcaggcatcaatctgccaactgacactcgacgtgctagagaaccctgattttatgcgcctgatgtaccccgacgacgatgaagccatgctgcaaaagagaatacgctacgtcgttgacctctatctcaacacaccggataaaatggggtacgatacgccactccatttcgcctgcaaattcggcaatgcagacgtcgtgaatgtgctttcgagccaccatctgattgtgaagaattcaaggaataaatatgacaagacaccagaagatgtgatttgtgaacggagcaagaacaaatctgttgaactcaaggaacgcatcagggagtacctgaaggggcactattacgtaccgctgttgagggccgaggaaactagttctcccgtgatcggagagctctggagccctgatcagaccgcggaagcttcacacgtcagccggtacggcggttctcccagagatcccgttctgacgctgagggctttcgcaggacctctgagccctgccaaagctgaagacttccgaaagctttggaaaaccccccctcgcgagaaggcagggtttttacaccacgttaaaaaaagcgatccagaaaggggtttcgaaagagtggggagggagctcgctcacgaactggggtacccgtgggtggagtattgggagttcctggggtgctttgtggacctctccagtcaagagggtctgcagcggcttgaggaatatctcacacagcaggagattgggaaaaaggcccaacaggaaaccggtgaacgggaggccagctgtcgggacaaagctaccacttctggcagtaatagcatctctgtgcgcgcattccttgatgaagatgatatgagcctggaagagatcaagaatcggcagaatgcagcccgaaataactccccacccacagttggcgctttcggccatacccggtgcagcgccttccctctggagcaggaagcagaccttatcgaagccgctgaacctggtggccctcacagcagcaggaacggcctgtgccaccctctaaaccacagcaggactctagcgggtaagaggccaaaagcaccgagaggggaagaggcgcacctcccgcctgttagtgacctcacagtggagttcgataagctgaacttgcaaaacatagggagatctgtatctaaaacgccagacgaatccactaagacaaaagaccagatcctgacctcccgcattaatgcagtggagcgagaccttctagagcccagtccagctgaccagctcgggaatggacaccggcgtacggagagtgagatgagcgcacgaattgcaaaaatgagcctgagtccctcttcccccagacatgaggaccagctcgaagtgactcgtgaacccgctcgaaggctcttcctctttggcgaagaaccttctaagctggatcaggacgtcctggctgctctcgagtgtgccgacgtcgatccccaccagtttccagcagtgcatcgctggaagagcgctgtgctatgctattcaccgtccgaccggcaatcgtggccatcacctgcggtgaaaggcaggtttaagtcccagctccccgatctctctggcccacatagctacagccctggcaggaatagcgtggccggttcaaaccccgctaaacctgggcttgggagtcctgggagatattccccagtgcacggatcacagctcaggcgtatggccaggctggctgaattggcagccctctag

SEQ ID NO: 52925 - DNA, 2631 bp, Artificial Sequence
  Description of Artificial Sequence: Synthetic coding sequence
atgaccatggatgccctgctggccaggctgaagctgctgaatcctgacgatctaagggaggagatcgtgaaggctggactcaaatgtggccctatcacatctacaacacgatttatttttgaaaagaaacttgctcaggcgttgcttgagcagggtggcagactgagcagcttttaccaccacgaggccggtgtaacggctttatctcaagatccccaacgcattcttaaacctgccgaaggcaatccaacagatcaggcaggcttcagcgaggatcgagatttcggttactcggtcgggctcaatccacccgaggaggaggcggtcaccagtaagacctgcagcgttccgccatcggatacagatacctaccgcgctggcgcaaccgcatccaaggaacccccactttattacggggtgtgcccagtttatgaagatgtgcctgccaggaatgaacgtatttatgtgtatgagaataagaaagaagccttgcaggcagttaagatgattaaaggcagccggttcaaagcattttccacaagagaagacgcggaaaagtttgctaggggcatttgtgattacttcccttccccctccaaaactagcttgccactgtccccagttaagaccgctccgctcttcagtaacgatcgcttgaaggacggcctgtgtttaagcgagtccgagactgtgaataaggaaagagctaacagttacaagaaccccaggacccaggacctgactgccaagcttcgcaaggccgtggaaaaaggcgaggaggacacattctcggacttgatttggtccaacccccgatacctgatagggtctggagataacccaacgatagttcaggaggggtgccgttacaatgttatgcatgtggcagccaaggagaaccaggcctccatttgtcagctgaccctggacgtgttggagaacccagattttatgagactgatgtatcccgacgacgatgaggctatgctgcagaaacgaatacggtatgtggtcgatttgtaccttaataccccagataagatgggctatgatactcctctacatttcgcctgtaagtttggtaatgccgacgtggtgaacgtgctgtccagccatcatcttatagtaaagaactcaaggaataagtatgataaaactcctgaggatgtcatttgcgaacgctccaagaataaatccgtggaattgaaggaacgcattagagagtacctgaaggggcactattacgtgcctctcctgagggccgaggagacctcttctcctgtgataggagagctctggagccctgatcagacagctgaggcgtctcatgtgagcagatacggcggttctccacgcgatccagtgctcacactccgtgccttcgcaggccctttaagtcctgccaaggccgaggactttagaaagctgtggaagactccaccaagagaaaaagccggtttcctgcatcacgtaaagaaatcggaccctgagagaggctttgaaagggtgggcagagagttggcacacgagcttggctatccatgggttgagtattgggagttcttggggtgctttgtggacttgagctcacaggagggcctgcaacggctggaagaatatctgactcagcaagagataggcaaaaaggcccagcaggagaccggcgaaagagaggcgtcctgtagggacaaggctactacaagcgggtcaaattctattagcgtgcgcgctttcctggacgaggatgacatgtcactcgaagagattaagaacagacagaatgccgctaggaacaattctccgcctactgttggtgcatttggccacaccagatgttcggcgttccctctggaacaggaggccgacctgatcgaagctgccgaaccaggaggaccccactcctcaagaaatgggctctgtcacccactcaaccacagtcgcactctggcaggtaagcgcccaaaggcgccacggggtgaagaggcccaccttccaccagtgtcggacctgacagtcgaattcgacaaactgaatctgcagaacataggcagatctgtgtccaaaactcccgatgagagtacaaagacaaaggatcagattcttacctcacgcattaacgccgtggagcgcgacttgctggagccatcgcccgctgaccagctgggcaacggccacagaagaaccgaatcggagatgagcgctagaatagctaaaatgagcctttcgccctcttcaccgagacacgaagatcagttggaagtaacccgcgagcccgctcggaggctcttcttgtttggggaagagccttcgaagttggatcaagacgtgctggcagctctcgaatgcgcagacgtggatcctcatcagttcccagccgtccaccggtggaaaagtgcagtgctatgctactcaccaagtgataggcaatcttggccctccccagccgtcaagggtcgcttcaaatctcagctgccggacctctcagggcctcacagctactcgcctggacgtaactcagttgccggatctaatcccgctaaacctggcttaggcagcccgggacgatacagccctgtgcatggtagccaattgaggagaatggccagactcgcagagttggctgctctgtag

SEQ ID NO: 52926 - DNA, 2826 bp, Artificial Sequence
  Description of Artificial Sequence: Synthetic coding sequence
atgtatcagggtgagtttggcctaaacatgaaactgggctacggcaaattcagctggccaacaggtgaaagctaccacggacagttctatcgcgaccattgccacggtcttggtacctacatgtggcctgacgggagcagttttactgggacattttatctttctcatcgtgaagggtacgggactatgtacatgaagactcgcctcttccagggactttataaagccgatcagcgtttcggacctggagttgaaacttaccctgatggtagtcaggatgtgggcctctggtttagggaacaactgataaaactctgcacacagattccctccggcttctccctcctccgttaccctgaattttcgagtttcataacacacagccccgcacggatctcactgagcgaggaagagaagactgagtgggggttgcaggaaggtcaggatccctttttctatgactacaagcggtttctgctgaacgataacctcacactgcctccagaaatgtacgtatacagcactaatagtgaccatctgcctatgacctcatcgttcagaaaggaactggatgctcggatcttccttaacgaaatccccccattcgttgaggacggagaaccatggttcatcatcaacgagacacctctcctggtgaagatccagaagcaaacatacaagttcaggaacaagccagcccacacttcatggaacatgggggcaatacttgaaggcaagagaagtgggttcgcaccttgcggaccgaaagagcaattatcaatggagatgattctcaaggcggaagaaggaaaccatgagtggatttgcaggatcctgaaagacaatttcgcctccgccgacgtcgctgacgctaaaggctacacggtgctcgcagcagccgctacccactgtcacaatgatatcgtcaacttgctgcttgactgcggggcagatgttaacaaatgctccgatgagggattgaccgcattgagtatgtgtttccttctccattaccccgcacagtcatttaagcctaatgtggccgaacggaccatccccgaaccacaggagcctcccaagttcccagttgtacctatattgtcttcaagctttatggacaccaatcttgagagcttgtactatgaggtcaatgtgcccagccagggcagctacgagctgcgccctccccctgctccgctgctgttgccacgcgttagcggctcccatgaaggagggcactttcaggacaccgggcagtgcgggggaagcattgatcaccggtcttcctccttgaagggcgactctcccctcgtgaagggtagcctgggccatgtcgaatctggactcgaggacgtgttaggcaatactgaccgcggaagtctctgctctgcagagactaagtttgaaagtaacgtctgtgtctgtgatttttccatagaactgtctcaagctatgttggaaaggtcggcacagtcccatagcctgctaaaaatggccagtccatcaccttgcacatcgtctttcgacaagggtacaatgcgcagaatggctctgagtatgatcgagcgcaggaagagatggaggaccatcaagttgcttctgcgccgaggagctgatcctaatttgtgctgcgtccccatgcaggtcctttttctggccgtaaaggctggtgacgtcgacggcgtgaggcttctcctggaacacggggcaagaacggatatatgctttcctccgcagctttctacacttacaccgctgcatattgcggcagctctgcctggcgaggagggagttcaaatcgtggagttgctactgcacgccataacagacgtcgatgcaaaggccagcgatgaagacgacacgtataaacccggaaagttagacctgctgccatcctcccttaagctgagcaatgagcctggacccccacaagcttactacagcaccgatacagctttgcctgaggagggaggcaggaccgcactgcacatggcatgtgagcgtgaagacgataataagtgcgcacgtgatatagtccgcctgctgctgagtcacggggctaaccccaacctcctctggtcaggtcattcccccctgtctctctcaatcgcttcaggtaatgaactggtggttaaagagttgttaacacagggggcagacccaaaccttcccttgaccaaaggcctggggagtgctttgtgtgtagcatgtgatttgacgtacgagcatcagaggaacatggactctaagctagccctcattgaccgccttatctcccacggagctgacatcctgaaaccagtcatgctgagacaaggtgagaaggaagcagtggggaccgccgtggactatgggtatttccggtttttccaggatcggaggattgcccgttgccccttccacaccttaatgcctgccgagagggaaactttcctggccaggaaacgcctgctagaatacatgggcctccagctgcggcaggcagtgttcgccaaagagagtcaatgggatcctacttggctgtatctatgcaagcgagccgagcttatcccatctcatcgtatgaaaaagaaggggccatcactgccacgcggactggatgtgaaggaacagggtcagatacctttcttcaaattctgctaccagtgtggcaggagcatcggcgtgaggcttcttccttgtccaaggtgttatgggattcttacctgctcaaaatattgcaaaaccaaagcttggaccgaattccacaagaaggactgcggagatcttgttgccattgttactcagctggaacaggtgtcccgcaggcgcgaagagttccaatag

SEQ ID NO: 52927 - DNA, 2154 bp, Artificial Sequence
  Description of Artificial Sequence: Synthetic coding sequence
atggagggcgcacacgctagcctgagtctcgaggatgaggttagtggggcaggctccaggcagaggcccctggagggcaaaggcggagagacacccgctgctgaagagcccggatctttgaagaattatgcggtttttgccacaagagacgtgtcagccgctccagagaaagaggaagaagaggcggaggggcctctgagagcccaggatcttagagagagttatattcagctggtgcagggtgtccaggagtggcaggatgggtgcatgtatcagggcgagtttggtttgaatatgaagctggggtatggcaaattctcctggcccaccggagaatcataccacggtcagttttatagggatcactgccatggtttgggcacctacatgtggcccgatgggtccagtttcacggggaccttctacctgtcccaccgtgagggatacgggactatgtacatgaagacaagacttttccagacccactgtcataacgacattgtcaacttgcttctggactgtggagcagatgtgaacaaatgctccgacgaaggactgacggcgctcagcatgtgttttctcctccactaccccgcacagagctttaagcctaacgtcgcagagcggaccattcccgaaccccaagaaccaccaaagttcccagtggtcccaattttatcatcttcgttcatggatacaaacctggaatctctctattacgaagttaacgtgccctctcaaggttcttacgaactaaggccaccccctgcacctctgctcttgccccgtgtttccggaagccacgaaggcggacacttccaggacactggacaatgtggaggttctattgaccatcgatccagcagtctgaagggagatagcccgctggtcaaggggagtctagggcacgtagagtccgggctggaggacgtgttagggaatacagacagaggctcgctctgctcggcagagaccaagtttgagagtaatgtttgcgtgtgtgatttcagtattgagctctcgcaagccatgctggagcgctcagcacagtcacatagcttactgaaaatggcctccccctctccatgtacaagcagcttcgataaggggaccatgcgcagaatggctctgtccatgattgagagaagaaaacgatggagaactatcaagcttcttttgcgcaggggagccgacccaaacctttgctgcgtcccaatgcaggtcttgttcctggccgtaaaggccggagacgtggatggcgtgcggctcttactggaacatggggcaaggaccgacatttgcttcccccctcaacttagtactttgacccccttgcacattgctgccgctctcccaggagaagagggagtgcaaatcgtggagctgctgctgcatgccatcacagatgttgatgcaaaggcctctgacgaagatgatacgtacaagcctgggaaagttgtaaaggagctgctgacccagggggctgatccgaacctcccacttacaaagggattgggctctgccctgtgtgtggcatgcgaccttacgtacgaacaccagaggaacatggacagcaaattagccttgatagacaggctgatcagccatggcgctgacatcctgaagcctgtaatgcttcgccagggagaaaaggaggccgtgggtacagcggttgactacggctacttcaggttctttcaggatcgaaggattgcccgatgtcctttccacaccctgatgcccgcagagagggaaacgttcctcgcacgcaaacgtctcctcgaatatatgggacttcaattaaggcaggccgtttttgccaaagaatctcagtgggatcctacatggctgtacctttgtaagcgggctgaactgattccctcccatagaatgaagaaaaagggaccctccctgccaaggggactagacgtgaaggaacagggacagatcccttttttcaagttctgttatcagtgtggtaggtcgatcggggttagattactgccttgtccaagatgctatggcatcctcacctgtagcaaatactgcaagacaaaggcctggacagagttccataaaaaagattgtggcgatctcgtggcgattgtaacccaactggaacaggtgtcaagacgaagggaggagtttcaatag

SEQ ID NO: 52928 - DNA, 2136 bp, Artificial Sequence
  Description of Artificial Sequence: Synthetic coding sequence
atgtatcagggggagttcggcctcaatatgaagctgggttacgggaaattttcctggcccaccggcgagagttatcacggccagttttatcgggatcattgccacggcctcggaacgtatatgtggcccgacggatcatcttttactggcaccttctacctctcgcatcgagagggatatgggacaatgtacatgaagactaggctgtttcagacccattgtcacaacgacatagtgaatttgctgctggactgcggtgcagatgtgaacaagtgtagtgatgaggggttgaccgctctgtcaatgtgttttcttctgcattatcctgctcagagcttcaagccaaacgtggcagagcggactattccagagcctcaagaaccccctaaatttccagttgtgcctatcctttcctcgtcgttcatggacactaacctcgagtctttgtactacgaggttaacgtccctagccaggggtcctacgaattgcgccctcctccagcgcctttgcttttgcctcgcgtttccggctcccatgagggaggccacttccaggacacaggacagtgtgggggaagcatcgaccaccggtcaagtagtctgaagggagacagcccccttgtgaaaggcagcctcggccatgttgaatcaggcctggaggatgttctgggcaatacggatagaggaagtctctgcagcgctgagacgaaatttgagagcaatgtctgtgtgtgtgactttagcatcgagttatctcaggccatgctggaaagatccgctcagagccactctctactgaaaatggcctccccctctccctgtacttcctctttcgacaagggcacaatgagaaggatggcactcagcatgatcgaacggagaaagcgatggcgcaccatcaagctcctgctcaggcgcggagccgacccaaacctttgctgtgtgccaatgcaggtcctcttcctggccgttaaggcgggagacgtcgacggcgttcgcttgctgctggagcacggagcaagaaccgatatatgcttccctccccagcttagcactctgaccccgctgcacatagccgcagcactgcctggcgaggagggggtccagatcgtggagctgcttctgcacgcaatcaccgacgtggacgcgaaagcaagtgacgaggatgacacctacaaacctggaaaattagacctgctcccctcaagcttgaagttgagcaatgaacctgggcctccacaagcctattacagcacagatactgctctgcccgaagagggcggtagaacagcactgcatatggcatgcgagcgggaagacgacaacaagtgtgctcgtgacatcgtgaggcttttactaagccacggcgctaatcccaaccttctgtggagcggccattccccattgagccttagcatcgcatccggtaacgaactcgtggtcaaggaacttcttacgcaaggcgcagacccaaacctgcccctcacaaaaggcctggggtcagctttgtgtgtcgcatgcgacctgacctatgaacaccagcgtaatatggattcgaagctggcactgatagataggttgatttcacatggagcagacattttaaaacccgtgatgctgaggcagggcgaaaaagaggcagtagggactgccgttgattacgggtactttcgttttttccaggatagaaggattgctagatgcccctttcacaccctgatgcccgcagaacgggagacatttcttgcccgaaagaggctcttggaatatatgggactgcagttacgccaagcagtctttgcaaaggaatctcagtgggatcccacctggttgtacctgtgtaagagggccgagctgattcctagccacaggatgaagaagaaaggaccttccctgccacgtgggttagacgtgaaggagcaggggcagatcccattttttaagttttgttatcagtgcgggagatctatcggtgtgaggctcctcccatgccctcgttgctacggaatactcacctgttccaagtattgcaagaccaaagcatggaccgaattccacaaaaaggattgcggggatttggttgcaatcgttactcaactcgaacaggttagtcgaaggagagaagaatttcagtag

SEQ ID NO: 52929 - DNA, 2826 bp, Artificial Sequence
  Description of Artificial Sequence: Synthetic coding sequence
atgtaccagggggaattcggcttgaacatgaaactgggctatggtaagtttagttggcccactggggagtcctatcacggtcagttttaccgcgaccattgtcacggtttgggcacatatatgtggccggacgggtcatcctttaccggcactttttacctgtctcacagggagggctacggaaccatgtacatgaagacacgtctcttccaaggattgtataaagctgaccagagatttggtccgggagtagagacctaccctgacgggagccaggacgtgggcctttggtttagagaacagcttatcaaactttgtacccagatcccctccggattctccctgctgcgatatcctgaattctcaagttttattacccacagcccagcaagaatcagcctatcagaagaagaaaagacagaatggggcctccaggagggacaggaccccttcttctatgattataaacggttcctgctgaatgacaatttaacgctgccaccagagatgtacgtctattccacaaactcagaccacttgcccatgacatcatccttccgcaaggagctggatgcgcgaatattcctgaatgagatcccaccattcgtggaagatggtgagccatggtttattatcaacgagacccctctgctggtgaagattcagaaacaaacctacaagttccgcaataagcccgctcacacttcctggaacatgggcgcaattctggagggcaagaggtcaggatttgcaccttgcggacctaaagaacagttgtcaatggagatgatcctcaaagccgaagagggaaaccacgagtggatctgtcggatcttgaaggataattttgccagcgccgacgtggccgacgcaaagggatacaccgtgctggccgctgcggcaactcactgccacaacgacatcgtaaatctcctactggactgtggagcggatgtcaacaagtgttccgacgaggggctgaccgcactcagcatgtgcttcttgctgcattatcctgcacagtcatttaagcctaacgttgccgagaggaccatcccagagccgcaggagccacccaagttccccgtggttccgatcctctcttctagctttatggacacgaacttggagtccctctattacgaggtaaatgtgccctcccagggatcatacgagctgcgcccacccccagcgccactgctcctgcccagggtgtcaggcagtcatgaaggtggccatttccaagacaccggacaatgcgggggatccatcgatcatcgaagtagcagtctgaagggagatagccctttggtcaaaggaagtctgggccacgtcgagagtggattggaggatgtcctcggaaacaccgatagggggtccttatgttctgccgagacgaagttcgaatctaacgtttgtgtctgcgacttcagcatagagctgtcccaggctatgctcgagagatcagcccaatcacatagtcttctcaagatggcatcaccgagcccatgcacctcttcgttcgacaagggcaccatgagacgcatggccctgagtatgatagaacgaaggaagcgttggcggacgattaagcttttgctgcgacgtggcgcagatcctaacttgtgttgcgtgccaatgcaggtgctgttcctggctgtgaaggctggagacgtagatggtgtgcggctgctactggaacacggtgctcgaacagatatttgttttccaccccagctctcaacactcactcctctgcacatcgctgccgctctgcctggggaagagggagttcagatcgtggagttgttgctgcatgccataactgatgttgatgcaaaggcttccgatgaagacgatacatataaaccagggaaattggatttattaccatcaagtttgaagctgagcaatgagcctggaccaccccaggcctactatagcaccgacactgcccttcctgaagaaggcggacggacggctctgcacatggcctgcgaacgtgaggatgacaataagtgtgcccgagatatcgtccgcctgctgctgtcacatggcgcaaaccccaacctattgtggagtgggcactcccctttgagtcttagcatcgcgtcaggaaacgagctagtcgtaaaggagctcttaactcagggggctgaccccaacctgcctttaaccaaggggttgggcagtgccctttgtgtcgcctgcgatttgacatacgaacaccagcggaatatggattccaaactcgccctgattgataggttgatctcccatggcgctgatatcctaaaaccagttatgctcagacaaggtgagaaagaggcggtgggaacggccgtagattacggatatttccgattcttccaggataggcggattgcccgatgccctttccacaccctgatgccagctgaaagggagacatttctcgcaaggaaaaggctcttggagtatatgggcttgcagctgcgccaagctgtattcgccaaggaatcccagtgggatcccacctggctctatctatgtaagcgagccgagctcatccctagtcacaggatgaaaaaaaaggggccatctctccctcggggtctcgatgttaaggagcagggccagatacccttcttcaaattttgttatcaatgtggcagatcaatcggcgtgcggctactgccatgtccgaggtgctatggaattctgacatgtagcaagtattgcaagactaaagcctggaccgaattccacaaaaaggattgtggggatcttgtcgccatcgttactcagctggagcaggtgtctaggaggcgagaagagttccaatag

SEQ ID NO: 52930 - DNA, 1320 bp, Artificial Sequence
  Description of Artificial Sequence: Synthetic coding sequence
atggagggcgctcacgcttctctgtcgttggaggacgaggtcagtggcgctggctctagacagcggcctttagaggggaagggaggcgaaactccagccgcagaggagccaggctctttgaagaattacgctgtgttcgctacccgggacgtgtctgccgcacccgagaaagaggaggaggaagcagagggccctttacgcgctcaggaccttagggagagttacattcaattagtgcagggagttcaggaatggcaagatggctgtatgtaccaaggagagttcggattaaacatgaaactgggctatgggaaattcagttggccaactggtgaatcttaccatggacagttctatagagatcactgccatggcctgggaacctacatgtggcctgacgggtcatctttcaccggcactttttacctgagccatagggaggggtacggaactatgtatatgaagacccgcctcttccagacacactgtcacaatgatatagtgaatttgctgctggactgcggggcagacgtaaacaaatgttccgatgagggattgactgccctttccatgtgcttccttctacactatcctgctcaatcttttaagccaaacgttgcagagagaaccatccccgaaccccaagagcctccaaaatttccagtggtccccattctgtccagctcattcatggacactaacctggagagtttgtactatgaggtgaacgtgcccagccagggatcatacgaactccgaccacctccagcccctctgctgttgcccagagtcagcggcagccacgagggaggacacttccaagatacagggcagtgtgggggttccatagatcacaggtccagtagtttaaagggcgattccccgttagtgaagggcagtttaggccacgtcgagtcggggttggaagacgtgctgggaaacaccgacagaggctcgctctgttccgctgaaacgaaattcgagtctaatgtttgcgtgtgcgacttcagcatcgagttatcgcaggccatgttagaaagatcagctcaatcgcactctctccttaagatggcgtctccaagcccttgcaccagttcctttgacaaaggaaccatgcgcagaatggcactttcgatgattgagcgcaggaaacgttggcgtacaattaagctgctactgcgtcgcggagcggaccccaatctgtgttgtgtgccgatgcaagtcctctttcttgccgtcaaagcgggagacgtcgacggcgtgcggctactattggaacacggcgctagaacagacatatgttttcctccccaatgttag

SEQ ID NO: 52931 - DNA, 225 bp, Artificial Sequence
  Description of Artificial Sequence: Synthetic coding sequence
atggagggagcacacgcatcactttctttggaggacgaggtgagcggggcaggcagcagacagcgcccactcgaaggaaaaggaggagagactcccgcagctgaggagccaggatctctcaagaactacgcagtgttcgccactcgcgacgtcagcgcagcccctgaaaaagaagaagaagaggcggagggcccactgcgggcacaggacctccgcgaatcctag

SEQ ID NO: 52932 - DNA, 684 bp, Artificial Sequence
  Description of Artificial Sequence: Synthetic coding sequence
atgtatcagggagaattcggcttgaatatgaaattgggctatggaaaattctcttggcctaccggtgagtcgtatcatggccagttttatagagaccactgtcatggcctgggaacctacatgtggccagatgggtcttctttcacaggcactttttatctgtctcatcgggaaggatatggtacgatgtatatgaagaccagactgtttcaggggctgtataaggctgaccaaagatttggcccaggagtcgaaacttatcctgacggctctcaggatgtgggcctatggtttcgcgagcagctcattaaactgtgtacgcaaattccgagcggtttcagtctcttgaggtatcctgaatttagtagttttatcactcatagccctgctcgcatatccctaagcgaggaagagaaaactgagtggggtctccaggaaggccaagatccattcttttacgattacaagagatttcttttgaacgataatctcacattgccccctgaaatgtatgtctacagcaccaactcagaccatttgcccatgacatcttcatttcgcaaagagctggacgctcggattttcctgaatgagattcctcctttcgtggaggatggcgaaccatggttcatcatcaacgaaacacctctactggtgaagatccagaagcaaacgtataaatag

SEQ ID NO: 52933 - DNA, 1020 bp, Artificial Sequence
  Description of Artificial Sequence: Synthetic coding sequence
atgagagatgtgagcgctgcgccagagaaagaggaggaagaggccgagggacccctgagagcccaggacttgcgggaaagctatattcaactggtccagggagtgcaagagtggcaggacgggtgcatgtatcagggagaattcggcctcaatatgaaactaggatacggtaaattcagctggcctaccggggaaagctaccacgggcagttctacagagaccactgccacgggctgggaacatacatgtggccagacggaagctcttttacaggaaccttctacctgtcccatcgggagggctatgggacaatgtatatgaagacgcgcctttttcaaacacattgccacaatgatatcgtcaatctgctgttggattgtggggctgacgtgaacaaatgctccgatgagggactcaccgctctgtccatgtgctttttgctgcattaccctgcccaatcttttaagccaaatgtcgcagaacggacaatcccggagcctcaggagcctccaaagttccctgtggtgcctatcctatcttcgtctttcatggataccaacctggagagcctgtattacgaagtgaacgtgccttctcaaggaagttacgagctccgccctcctcctgccccactgcttctgcccagggtgtccggcagtcacgaggggggacacttccaggacacaggacagtgcgggggatccatcgaccatcggtcgtcctcacttaaaggcgacagtccactcgtgaagggctcactgggccatgtggagtctgggttagaggacgtcctggggaacaccgatcgcggttcactgtgtagcgccgagacaaaatttgagtccaatgtctgcgtgtgcgacttttcaatcgagctctcacaggctatgctcgaaagatccgcccagagccattctttactgaaaatggcttcaccatctccgtgtacatcttccttcgataaagggaccatgaggcgcatggccctgtctatgattgagtcttgtagtctcctgtag

SEQ ID NO: 52934 - DNA, 741 bp, Artificial Sequence
  Description of Artificial Sequence: Synthetic coding sequence
atgtaccagggcgagttcggcctgaacatgaaacttggatacggcaagttctcatggcccactggagagagctatcatggacagttctatcgggaccattgccatggcctaggcacatatatgtggccggacggatcctctttcaccggcactttttacctgagccacagagaggggtatggtactatgtacatgaaaacacgactgtttcagggcctgtataaggctgatcagagatttggccctggggtggagacgtatcctgatggcagtcaggatgtcggtctttggtttagagagcagctgattaaactttgcactcagattcctagtggcttcagcttgcttaggtaccccgaattttctagctttatcacccacagccccgctagaatcagcctttccgaggaggagaagaccgaatggggtctacaggaaggacaggaccctttcttttatgactataagcgctttctacttaacgataatctgaccctgccgcctgagatgtacgtgtacagcactaattctgatcatctccctatgacttcctccttcagaaaagagttagacgccaggattttcctaaacgagatccctcccttcgtggaggatggggagccttggttcataatcaacgaaacgcctctgctagtcaaaattcaaaaacagacatacaagttccgactaacggcaacgaccaccctgagcacgttctcttggacggtcggccctacctag

SEQ ID NO: 52935 - DNA, 1326 bp, Artificial Sequence
  Description of Artificial Sequence: Synthetic coding sequence
atggtgcacataaagaagggagagctcacccaggaggagaaagagctcttggaagttattggcaagggaacagtgcaggaggcgggaaccttgctcagctccaaaaatgtgagggtcaactgccttgatgaaaacgggatgacccccctcatgcatgctgcctataaaggtaaactggacatgtgtaagttgcttctgaggcacggtgctgacgtaaattgccaccagcatgagcacggctacaccgccctgatgtttgcagccttgagcggaaataaagatattacttgggtgatgctagaggccggtgccgaaaccgacgtggttaacagcgtaggcaggacagcggctcaaatggccgcatttgtcggacagcatgactgcgttactattattaacaacttttttccgagagaacgtctggattattataccaagccacagggcctcgataaagaacccaaactgccgcctaagctggctggaccactccacaagatcatcaccacgacaaaccttcatcccgtcaaaattgtcatgctggttaatgaaaatcccttgctgacagaggaggccgctcttaacaaatgttatagagtgatggacttgatttgcgagaaatgtatgaagcagagagacatgaatgaagtactggccatgaaaatgcattacatttcgtgcattttccagaagtgcatcaattttttgaaggatggggagaacaagcttgacacgttaatcaagtccctgctaaaagggcgagcttcggacggtttcccagtttaccaagagaaaatcatcagagagtccatcaggaaatttccgtattgcgaagcgaccttactccagcaactggtgagatctatcgctcctgttgagattggtagtgaccccaccgccttcagcgtgctcacccaggctatcacgggccaggtgggctttgtggatgtagaattttgcactacttgcggagaaaagggcgcttccaagaggtgttctgtatgcaaaatggtaatctactgcgaccagacctgtcaaaagacccactggttcacacacaagaagatctgcaaaaatctgaaggatatttacgagaaacagcagcttgaggccgctaaagaaaaacgccaggaggaaaaccacggcaagttggacgtcaactctaactgcgtcaatgaagagcagcctgaggccgaggtgggcatttcgcagaaggactctaatcctgaggacagtggtgagggcaaaaaagagtccctggaatccgaggccgagctggagggccttcaggacgctcccgctggcccacaagtgagcgaggagtag

SEQ ID NO: 52936 - DNA, 1290 bp, Artificial Sequence
  Description of Artificial Sequence: Synthetic coding sequence
atgctgatgtcctggtctccggaggaatgcaaaggccagggcgagccattagacgatcgacacccactgtgcgcacgtttggtggaaaaaccatcacgaggttcggaggagcacctgaagtcgggccctgggcctattgtaaccagaaccgcctctggtccggcacttgccttttggcaggcggtgttagcaggcgacgtgggatgcgtctctagaattcttgcagacagtagtacaggtctagcacccgactccgtgttcgacacgtccgatcctgaacgctggcgggatttccgctttaacattagggccctgagactctggtctttgacttacgaagaagagcttacaacccccctccatgtcgcggcatctagggggcacactgaagtcctgcgtctgctgcttcgtagaagagcaagaccagattccgcccctggcggacgaacagcacttcatgaggcctgcgccgctgggcatacagcatgcgtgcatgtgttgctagtagctggggctgatccaaatatcgccgaccaggacggcaagagacctttacacttgtgtcggggaccaggcacactcgagtgcgctgagctgctgctaaggtttggggctcgcgtagatggccgatctgaggaggaagaggaaactcctcttcacgtggcggcacgcctgggccacgtcgagcttgctgatctgttgctccggcgtggtgcctgcccagatgcccgaaatgcagaaggttggactcccttgcttgccgcttgtgatgttcggtgtcagagtattacggacgctgaagccactactgccagatgcttgcagctgtgcagtctgttactgagcgccggagcagacgccgacgctgctgaccaggataagcagcggcctctgcatttagcatgtcgacgaggccatgccgcagtggtggagctactgttatcttgtggtgtgagcgccaacacaatggactatggtggacataccccgctccattgcgccctccaggggcctgcagcagctcttgcccagtctcctgagcacgtcgtcagagctttgctgaaccacggcgctgttcgagtctggcctggggcattaccaaagaagcatcaaagattctactccagcctgttcgcactcgtgcggcaaccccgatccctccaacacttgtcacggtgtgcgctgcggtcacaccttgaaggtagtctgccacaggctcttccaagactaccactcccgccaagactgcttcggtacctacaactggatttcgaaggggtcttatattag

SEQ ID NO: 52937 - DNA, 1359 bp, Artificial Sequence
  Description of Artificial Sequence: Synthetic coding sequence
atgccctggggaaaaaattcctccccacactggggccaccaccttggctgtctcccctctgctccagcatgtcgtatttggcgccctcacagtcgtcctgcatgggagcctcctcgacctagcccgctcctgtgccaagatatggctctccagaacgcgctgtacaccggagacctcgcccgattgcaggaactcttccccccacattcaacagccgacctcttgctggaatccagagcggctgagccaaggtggagcagccatcagagaggcctgtggagtttaacctatgaggaagaactaacaaccccactccacgtcgcggcttcccgaggacacacagaagtgctaagactcctcttgcggcgaagagcaagacctgactccgctcctggtgggagaaccgccctacacgaagcatgcgcagccggacacaccgcgtgcgtgcatgtgctactggtagcaggcgctgatcctaacattgcagatcaggacggcaagcggcctttacacctgtgtcggggaccaggtaccctggagtgtgcggagctgctcctgagatttggagccagggtggatggacgatctgaggaggaggaagaaaccccgctgcatgtagcagccagactgggacatgtggagttggccgacctgctactaagacgaggggcatgccccgatgccagaaacgctgagggctggacgcctctccttgccgcatgcgacgtgcgctgccagtccatcaccgacgcagaagccactactgccagatgtcttcagctctgctcactcttactgtcagcaggcgcagacgccgatgctgcagatcaggataaacagcgccctttgcacttggcttgccgcaggggtcacgcagcagtggttgagctcctgctgagttgtggagtgagcgctaatactatggactacggcggacacactcctttgcactgcgcattacaagggccagcagcggcactcgcgcagtcaccagaacacgttgtgagagctctgctgaaccatggagccgtgagggtatggccaggcgctttgccaaaggtactggagagatggagtacttgcccacggaccatcgaggtcctgatgaacacctattccgtcgtgcagttgccagaggaagccgtgggtctggtgacccccgaaaccctgcagaaacaccagaggttctattcatctttatttgccttggttcgacagccacggtctttgcagcatctgagcaggtgtgccctgagatcccacctggagggctcactcccccaagccctcccacgcttgcctctgccccctcgcctgcttcgatatttgcagctggacttcgagggggtgctgtattag

SEQ ID NO: 52938 - DNA, 1404 bp, Artificial Sequence
  Description of Artificial Sequence: Synthetic coding sequence
atgctgatgtcttggtctccagaagagtgcaagggccaaggagagcctcttgatgacaggcatcctttatgcgctcggctggtggagaagccgtcccggggatctgaagagcatctgaagtccggcccaggtcctatcgtgaccaggacagcatctggaccggctctcgcattctggcaggcagtcttggctggcgacgtggggtgcgtgagtcgcattctcgccgactcaagcaccggcctcgcgcctgattcagtcttcgatacctctgatcccgagcgctggagggacttccgctttaacattagggccctccgcctgtggagccttacctacgaagaggagctgaccacgcccctccacgtggccgcaagcagagggcatacggaggtcttgcgactgttactccgacgcagagcacgcccagactccgctccaggcggacgcaccgcactgcatgaagcatgtgccgcaggtcatacagcttgtgtgcacgttttgctggtagctggagccgaccctaacatagcggatcaggatggcaagagacccctgcatctctgtaggggaccgggaacgttagagtgtgctgagctactgttaagattcggggctagagttgatggcaggtcggaggaagaagaagaaacccctttgcatgtagccgcacgtctggggcacgtcgagctggcagacctcctcctccggaggggggcatgcccagacgctcgaaacgcagagggatggactcctttgctggccgcttgtgatgtgaggtgccagagtattacagacgcggaggctaccacagcacggtgcctacagctttgttccctccttctgtctgcaggtgccgatgccgacgcagctgatcaggataaacaacgtcctctgcacctagcctgccggaggggacacgccgcagtagttgagctccttctttcatgtggtgtaagtgctaatacgatggactatggcggtcacaccccgctgcattgtgctttgcagggacctgccgcagctctcgcccagtcccccgagcatgtggtgcgggcactcctgaaccacggggcagtgcgagtttggcccggagcactcccaaaggtacttgagcgttggtccacttgtcctcgcactattgaagtattgatgaacacttatagcgtggtgcagctgcccgaggaagctgtgggattagtaacccctgagactctgcagaagcaccagcgcttctattcctccctctttgcactcgttagacagccgaggagcttgcaacacctttctcggtgcgccctcagatcccaccttgagggaagtctgcctcaagctctacctcgcctccctctgcccccacggctgttgcgctacctccagttagactttgagggcgtgttatactag

SEQ ID NO: 52939 - DNA, 1539 bp, Artificial Sequence
  Description of Artificial Sequence: Synthetic coding sequence
atgagaggccaggtgtcactgggcgcatgggataccggagcattttgcctctccgtgtttccctcatgtagtctttccctgtcacttcctttggcgtatacctccccccctccccacagtccctttcccgctcatatgttaatgtcctggagtcccgaagaatgtaaaggacaaggtgaaccactcgacgataggcacccgctgtgtgctaggctcgtcgaaaagcccagccgcggatcagaagaacatctgaagtctggtcccggacccatcgtcaccaggactgcatccggcccagcgctggccttctggcaggctgtgctcgccggagatgttggctgcgtcagtcgcatcctggctgactcctcaactgggctggcccctgactccgtgttcgataccagcgaccctgaacgctggagagacttccgttttaacatccgggcactgcgcctgtggagcttgacttatgaagaggaattaacgaccccccttcatgtcgcggcttcacgaggccataccgaagtgttgcgcctgctgctccggagaagagcccgtcctgactctgcccctggcggtaggaccgctctgcacgaggcttgtgcagcagggcatacagcctgtgtgcacgtattgctggttgcaggggctgacccaaacatcgcggatcaagacggcaaaaggcctttgcacctgtgtcgcggacctgggactctggaatgtgctgaattgctgctgcggttcggcgctcgtgtcgatggtcgtagcgaggaggaggaggagaccccactccatgtggccgcaagacttggtcacgtcgagttagcagatctgctgctcaggcgtggcgcttgccccgatgccagaaacgctgaggggtggaccccacttctagccgcatgtgacgttagatgccagagcatcaccgatgcagaggctactacagcccgatgcctacagctttgctccctactcctttcagccggagcagacgcggatgccgctgatcaggacaaacagcggccactccacctggcctgtcgccgtggtcacgccgcagtggtagagctcctgctctcctgcggggtgtcggctaatacaatggattacgggggtcacacgcccctccactgtgccctgcaggggcctgccgcagcacttgcccagagcccagagcacgtggtacgagcactgctgaatcatggagctgttcgggtgtggccgggagccctgcccaaggtgctggaaagatggtccacctgcccgcgaaccatagaggtgctgatgaacacttacagcgtggttcagctccccgaagaggctgttggtcttgtaacccctgagactttgcagaaacatcagcggttctacagctctctgttcgcccttgtgcggcagccaagaagtcttcagcatctttcccggtgcgctctgcgcagtcatttggagggctccttgccgcaggcactccctcgtctgcctcttccacctcggctcctgagatatttacagctggactttgagggtgtactgtattag

SEQ ID NO: 52940 - DNA, 1425 bp, Artificial Sequence
  Description of Artificial Sequence: Synthetic coding sequence
atgagagggcaggtctctttgggcgcatgggacactggagccttctgcttgtccgtgtttccctcctgcagcctctcactttccctacccctggcatatacatctcctccccctcactctcccttccccgctcacatgcttatgagttggagccctgaggaatgtaaaggtcagggggagcctctggacgaccggcaccccttatgcgccagactggtagaaaaaccgtccagaggatcagaggagcacctgaaatctggcccaggacctatagtgactaggactgcatccggaccagctctggccttttggcaggccgtgctcgctggtgacgtcggctgcgtttcgagaattcttgctgattcgagcactgggcttgcacctgattccgtcttcgatacttcagaccccgagcgttggcgagattttcgcttcaacatccgggctctgcggctgtggtctctgacctatgaagaggaactgactacaccactccatgttgcggcatccaggggccatactgaagtcttaagattactgcttcggcgacgggctagacccgattccgcccctggcggacgtacagctctgcacgaggcctgcgccgcaggtcacactgcttgtgtacacgtcttattggtcgccggtgcagacccaaacatcgctgaccaggatggtaagagacctcttcacctttgcaggggacctgggacacttgagtgcgctgaactgttactgaggtttggcgctcgcgttgacgggcgttctgaagaagaggaagagaccccactacatgtcgctgctcgtctgggccacgtcgaactcgctgacctgctcctgagaagaggagcctgcccagacgccagaaatgccgagggatggaccccattgcttgccgcttgcgacgtccgctgccagtctatcacagatgccgaggcgacaaccgctcgctgcttgcagctgtgtagcctgctgctctcggcaggcgcagatgctgacgccgcagatcaagataagcaacgcccactgcatctggcatgtcgaagagggcacgcagctgtggttgagctgctgctgagctgtggcgtgagtgcgaacaccatggactatggcggacatacgcccctgcattgtgccctgcagggcccagccgcagcactcgctcagtccccagaacacgtagtgcgcgcactcctgaatcatggagctgtccgcgtgtggccaggcgcacttccaaagaaacatcagaggttctatagcagcctgtttgctcttgtgcgccagcctcggtccctgcagcatttgagtagatgtgcgctaaggtcccacctggaggggtcccttccacaagcgctacccaggctgccattaccaccccgtctgttgcgatatctccagcttgactttgagggggtgctatactag

SEQ ID NO: 52941 - DNA, 861 bp, Artificial Sequence
  Description of Artificial Sequence: Synthetic coding sequence
atgcgtatagtgctccagctcgctaaaatgaatttgatggacataacaaagatcttctccctgctgcagcctgacaaggaggaggaagacactgacaccgaggaaaaacaggcactgaatcaagccgtttatgataacgactcctatactctcgatcagttgctgagacaggagaggtacaagagattcatcaactcccggtcaggctggggtgtcccgggtacacctctgcggctagctgcgtcttatggccacctgtcatgtctgcaggtgctgttggcacatggggcagacgtggattctctggacgtaaaagcccagacaccactgttcacagctgtcagccacggtcatctagattgcgtgcgggtgctcttggaggccggagccagccccggtggtagcatctataataactgcagtccagtactgactgctgcgcgtgacggcgctgttgctattctgcaggagctgctggatcatggcgcagaggctaacgtaaaggccaagcttcctgtttgggcgtctaatattgcatcctgcagcggcccactgtacctggctgctgtttatggacacctggactgctttagactacatcataactgtgaacctgagtatatccagctattgatagactttggggcaaacatctatttgccttcgctgagcttggatctgacatctcaagatgacaagggaattgccctactgctgcaggcgcgtgcaacaccacgcagcttgctctctcaggtgaggttagtcgttagaagggctctgtgccaggctggacagccacaggcgattaatcagctggacatcccaccaatgctcatctcctacctcaagcaccaactgtag

SEQ ID NO: 52942 - DNA, 957 bp, Artificial Sequence
  Description of Artificial Sequence: Synthetic coding sequence
atgcgcatcgtcctgcagcttgctaagatgaacctgatggacataaccaaaattttctccctcctccaaccggacaaggaggaggaggatacagacaccgaggaaaaacaggccctcaaccaggccgtgtacgataatgatagttatacgttggaccaacttttgcggcaagaacgctataagcgtttcataaatagcagatctggctggggggtgccgggtactcccctgcgcctggctgctagctatggacacttatcttgtctccaggtcctgcttgcacatggagctgatgtcgatagcctggatgtgaaagcccaaacccctctgtttaccgcggtgtctcacggccacctggactgcgtacgggtgctactggaagctggtgcttctccaggcggaagcatctacaataattgtagtccggtgctgacagccgcacgcgacggagctgttgcaatactgcaggagctgctcgatcacggggctgaggcaaacgtaaaggctaagctccccgtatgggcttctaatatagcatcctgcagtggacccctgtacctcgccgctgtttatgggcacctcgactgtttcaggctgctgctgctgcatggggcagaccctgattacaactgtaccgatcagggactgctggcacgtgtccccagacccaggaccctactggagatatgcctccatcacaattgtgagccggaatatatccaacttctgattgatttcggcgcaaatatatatctgccaagcctcagtctggatctgacatctcaggacgataaaggtatcgcgctgctgctgcaggctcgagctactccgcgttctttgctgagccaagtgcgtctggtggtccgaagagcgctgtgccaagccggtcaaccccaagcaatcaaccagcttgacatcccgcctatgctaattagttatctgaaacatcagctttag

SEQ ID NO: 52943 - DNA, 930 bp, Artificial Sequence
  Description of Artificial Sequence: Synthetic coding sequence
atgaacctgatggacattactaagattttctcactgcttcagccggataaggaggaggaagatacagacacagaggagaagcaggcactgaaccaggctgtgtacgacaatgatagctataccctagaccagctactgcgtcaggagaggtacaagcgtttcatcaatagcaggtccggctggggtgtacccggaactcctctgcgtctcgctgccagctatggccacttgagttgtctgcaggtcctcctggcacatggtgccgatgttgacagtttagacgtcaaggcccagactcccctttttacagcggtctctcatggacacctggactgcgtgcgcgtcctcctggaagccggtgcctcgccgggaggttcaatttacaataactgctcgccagtgctgaccgcagccagagacggggctgtcgctatactgcaggagctgcttgaccatggggctgaagctaacgtgaaagctaagctgcccgtttgggcgtccaacattgcttcctgcagcggtcccctctatcttgccgctgtatatggacacttggattgttttcggctgcttctgctgcacggtgcagacccagattataattgcacagatcaggggctcctggctagagtacctcgccctcgcactctacttgagatttgcctgcaccacaattgcgaacccgagtatatacaactccttatcgattttggggcaaatatctacttgccctcgttgagcttagacctgacttctcaggatgataaagggattgctctacttttgcaggccagagctacccccagaagcctgctaagccaggtgcggctggtggtacggagggccctctgtcaggccggacagccgcaggctattaaccagctggatataccaccaatgctgatctcctatttgaagcatcagctttag

SEQ ID NO: 52944 - DNA, 1764 bp, Artificial Sequence
  Description of Artificial Sequence: Synthetic coding sequence
atggacaattacactagtgatgaagacatcgatgaagatttcgatacgcaactgatcattcagcaaagtttgcaggatatttacaaaccaggcactgctcagcatgcaccgaaggacgagtccctccactccttcttgtctgcagactacaaaaagatcgtggaaacgatcgaaaaggttggtaaggaagacgctctttcccacctcaccaagtatcatagcgcattcggcgaggccgacgagattgggtggatacccctgcacaaggcagccgtgcagcttaatcggaagattctggaaataaccctgtccgccagcgacccgtctctgtgggagcagacaacacataatggtgagacaccgctgttcttggccgtgtcaagctgcctgctcgagaacgccacatttctgcttctcaatggatgcaatccgaatgccaaaaacttcgagggcaattcccctttgctggctgctgtattgagagattgttatgacatggctgctctgctcatcaactatggggctgatgtaaacttgcgctgcgccaacgaaagaacggctctgcacgaagccgcaaaattagggagagaggacatggtcaagctgatgcttgtgtcaggcgcacacccggatcctcagtctacttatggctttaccccgcttgcattggccgctcagagtggccacaccgaaattatggaaatgctgctgagaaaggggaagattttctgtctggcctcagacagttcttccattttacttgaagctgcctctgggggaaacccagacgctgtggccctactgctagaatatggcgctgacgccaacatccctaagaatagtggtcatctgcctattcatgtggctgccgaccgtgggcaccttctcgccctgaagatcctcattccagtgacggatcttgcggcaataaaacagtcgggtattagcccagtgcactgcgcggctgccggagcacatccacaatgccttgaactcctcattcaagcaggttttgatgtaaatttcatgctggaccagcgcattaataaacactatgacgaccacaggaaaagcgctctatacttcgcggtatccaactccgacctctcctccgtgaaactattgctaagcgcgggtgccttgcccaaccaggacccggtgaattgtctgcagatcgctctccgtatgggcaactacgagctgatcagccttctgctgagacacggcgctaatgttaactacttctgtagagtcaatccgttacactttccatcagccctccagtacacgctgaaggatgaagtaatgctccggatgcttctgaactatgggtacgacaccgagcggtgcttcgactgtcctcacggtgataaggtgcacccatcttacactgtggagggctggacatccaccgtaataaaggacactaagttttgcgaagttatcaccttgagctggcttcagcacctaagcgggaaagtcgtccgcgttatgcttgactacgttgaccaagtgcgtatctgctcaaagctgaaagctgtcctccaaaagcaaggtatctggagtgagatacacttcatcctcaccaatcctcgcagcttgaagcacctgtgccggttaaagatccggaagtgtatggggagactgcacttgcgctgccccgtatttatgagttttcttcccctgcctaatagactaaaggcctatgtcctgtacaaggagtacgacttatacggccagggaatcttcacgggtacctggtag

SEQ ID NO: 52945 - DNA, 1272 bp, Artificial Sequence
  Description of Artificial Sequence: Synthetic coding sequence
atggcagccctgctgataaattacggcgcagacgtcaatctgcggtgcgcaaacgagcgcaccgctctccacgaggctgctaagctggggagggaggacatggtgaagctcatgctcgtgagtggtgcgcaccctgacccacaaagcacatatggttttacccccttagccctggctgctcagtccggtcacacagagatcatggagatgctccttagaaagggtgccaatgcgcacggccaggcctccgactcttctagcattctcttagaagcagccagtggcggtaaccccgacgccgttgcgctcctattggagtacggggctgacgctaacatacccaaaaattctggacacctgccgattcacgtcgcggctgataggggacaccttttggcactcaaaattctgattcccgtgaccgacctcgccgctattaagcagtccggcattagccccgtccactgcgctgctgccggagcccaccctcagtgtttagagctccttatccaagcgggtttcgatgtcaatttcatgctcgatcagcgcatcaacaaacactatgacgaccaccggaagagcgctctgtactttgccgtgagcaatagtgatcttagctccgtgaagttgctcttgagcgccggtgccctgcctaaccaggaccctgtgaattgccttcagattgcactgcgcatggggaactatgagttgatctctttactgctgaggcacggggcaaatgtaaattacttttgtcgggttaaccctctgcacttcccttctgccctgcaatatactctcaaggatgaagtgatgctgcgcatgctgctgaactatggatacgataccgagagatgctttgactgtccacatggtgacaaggtccatccatcttacaccgtggaggggtggacatccacagtaattaaggacacgaagttttgcgaggtaatcaccctctcttggttgcagcatctctctgggaaggtggttagggttatgctggactacgtggaccaggtccgcatctgcagcaaattgaaagccgtccttcagaagcagggaatatggtccgaaattcatttcatcctgacaaaccccaggagccttaagcatctctgtagattgaagatacggaaatgcatgggacgactacatctgaggtgtccagtgtttatgtcgtttctacctttgccgaataggttgaaagcttatgtcttatataaggaatacgacttgtacgggcaaggcatctttaccgggacttggtag

SEQ ID NO: 52946 - DNA, 1764 bp, Artificial Sequence
  Description of Artificial Sequence: Synthetic coding sequence
atggataattatacctccgacgaagacatagacgaggactttgacactcagttgattatccagcagtctctgcaggatatttacaagcctggtacagcccaacacgcaccaaaagacgagtctttgcatagcttcctgagcgcggactacaaaaaaatcgtggagactatcgaaaaggggaaggaggatgctctgtcccatctgaccaaataccacagtgcttttggcgaggccgatgagatcggatggattccactccataaagccgcagtacagctcaaccggaagatcctggaaattaccctttccgcgtctgacccttccctatgggagcagactacacacaatggggaaactccccttttcctggccgtttcttcttgtctcttggagaatgcaacgttcctgctcctgaatgggtgcaaccctaatgctaagaacttcgaagggaactccccacttctcgccgctgtcctgagggactgctacgatatggcagctctgctcattaactacggcgctgacgtgaatctgagatgtgccaacgagagaacagctttacacgaggctgctaagctggggagggaggatatggtgaaattgatgctggtgtccggcgcacatcccgacccgcaaagcacttacggtttcacccccctcgccttggcggctcagagtggacacaccgagatcatggagatgctgcttcggaagggcgcaaacgctcacggccaggccagcgactcttcctccatattgttggaggccgcttctggcggtaacccagatgcggtcgccctgcttctggaatatggagctgatgccaacattcccaaaaactcaggccaccttcctatacatgtcgctgcggaccgcggtcacctgttggctctgaagattctcatccccgttactgacctggctgcaatcaagcaaagcgggatatctccagttcattgcgccgctgccggtgcgcaccctcaatgcctggaactgttgattcaggccggattcgatgtgaactttatgttggaccagaggatcaacaagcactacgacgaccaccgcaagtccgccctctatttcgctgtcagcaactccgacttaagcagcgtaaagctgctcctgagtgcaggagcactgcctaaccaggatcctgtgaattgtttgcaaattgctttacgaatgggtaactatgaactgatctcacttctgctgagacatggcgctaacgtgaactatttctgccgcgtcaaccccctgcatttccctagcgcattgcagtatacccttaaggacgaggtaatgctgcggatgctgttgaattacggttacgacactgagaggtgtttcgactgcccccatggagacaaggtacacccatcttacacagtggaaggttggacaagtaccgtgattaaggatacaaagttttgcgaagtgatcaccctgtcttggcttcagcatttgtccggcaaggtcgtccgcgtgatgctggactatgttgatcaggtgcgcatatgtagtaagctgaaggccgtcctgcaaaaacaggggatttggtctgagatacacttcatccttacaaatcctagatcgctgaaacacttgtgtagactgaagattcgaaagtgcatgggtaggctacatctgcgttgccccgtctttatgagcttcctccccctgcctaatcggctgaaggcctacgtactgtacaaggagtatgacctgtacgggcaaggtatttttactgggacatggtag

SEQ ID NO: 52947 - DNA, 1767 bp, Artificial Sequence
  Description of Artificial Sequence: Synthetic coding sequence
atggacactaatgatgaccccgacgaagatcatcttactagttacgatatccagctgtcaattcaggaatccatagaggcgagtaagacagctctctgtccagagaggttcgttccactgagtgcacagaaccgaaagcttgtcgaagcaatcaagcagggccacatcccagaactacaggagtacgtaaaatacaagtacgcaatggacgaggccgatgagaagggctggtttcctctccacgaggccgtagtgcaacccatacagcagatcctcgaaattgtcctcgacgctagctacaagaccctgtgggaattcaagacctgcgatggcgagacgcctctgacgctggccgttaaggctggcttggtggagaacgttagaacccttctcgaaaagggagtttggccaaacactaaaaatgacaagggcgaaaccccattgctgattgctgtgaaaaaggggagttatgacatggtgtctactctgataaaacacaataccagtctggatcagccttgcgtcaagcgctggagcgccatgcatgaagctgcaaaacagggaaggaaagacatcgtcgcgcttctactgaagcatggcggaaacgttcatctgcgggacggcttcggagtgacaccgctgggcgtcgccgcagagtatggtcattgcgacgtgctagagcacctcattcacaaagggggtgatgtcttggctctggctgacgatggtgcctcagtgctgtttgaagctgccggtggtgggaaccctgattgtataagcctgcttctggagtacggcggaagtggcaatgtgccgaatagggcagggcacttgccaattcatagagctgcatatgagggtcactacctcgccttgaagtatctgattccagtgaccagcaagaatgcaattcgtaaaagcggactgactcctatccactcagccgcagacggccagaacgcacagtgtctagagctgctcatagaaaacggctttgacgtaaacaccttgttggcagaccacatttcgcaatcttatgacgacgagcgcaaaacagccttatactttggagttagcaacaacgacgttcattgcactgaagtgttgctcgccgctggggctgatcctaatctggaccccctgaattgcctgcttgttgccgtacgagcgaacaattacgagattgttcgcctcctgttgagtcacggggctaatgtcaactgctactttatgcatgtaaacgacacgaggttcccaagcgtcatccaatacgcgctcaacgatgaggttatgctgcggcttctactgaataacgggtaccaggtggaaatgtgtttcgactgtatgcatggcgatatttttggaaacagttttgtctggagcgagattcaggaagaagtgctgcccggatggactagctgcgtgattaaagacaatccgttctgcgagttcatcactgtcccctggatgaaacacttggtcggacgcgtcaccagggtgctgattgactatatggactatgtgcctttgtgtgccaaactcaagtccgcccttgaagtccaacgcgagtggccagaaattcgtcaaatcttagagaacccttgttcattgaagcacctgtgcaggctgaagatccgaaggttgatggggctgcagaaactgtgccagcccgcatcggtggaaaaactccctctccctcccgctatccaaaggtacattctcttcaaagagtatgacctctatgggcaggaactaaagctgacatag

SEQ ID NO: 52948 - DNA, 1767 bp, Artificial Sequence
  Description of Artificial Sequence: Synthetic coding sequence
atggacactaacgacgatcccgacgaggaccacctcactagctatgacatccagctgtcaatccaggaaagcatcgaggcttccaagacagctctgtgtcctgagcgtttcgtgccactgagcgcacagaacaggaagcttgtggaggctataaagcaaggccacatccctgaactccaggagtacgtcaagtacaagtacgccatggatgaggcagacgaaaagggttggttcccactgcatgaggctgtggtacaacccatccaacaaatattagaaattgtactggacgcctcgtataagaccctatgggagtttaaaacctgtgacggggagactccccttactctggcagtcaaagcaggattggtggagaatgtcaggacactgctcgaaaaaggggtgtggcccaacacgaagaatgacaagggcgagacgcctttgctcatagcggtgaagaagggcagctatgatatggtatctacactgatcaaacataacaccagcctagaccagccctgcgtaaagcgttggtctgcaatgcacgaggcagctaaacaaggtcgcaaagatattgttgcccttttactgaaacacggaggcaacgtccacttaagggacggctttggtgtgacacccctcggcgtcgccgctgaatatgggcactgcgatgtcctggaacatctgatccacaaagggggagacgtgcttgctctagccgacgacggagcttcagtgcttttcgaggccgcaggcggaggcaatccagattgcatctctttgctgttggagtacggagggagtggtaatgttcccaacagagccggacatcttccaatacaccgagcggcatacgaaggccactacttagcactgaaatacctcatcccggtgacctccaaaaacgcgatacgcaagagcggactgacccccatccacagcgccgcagacggccagaacgctcaatgtctggagttgctaatcgaaaatggcttcgacgtgaacaccctgctggccgaccacatatcccagtcatacgatgatgaaaggaaaaccgcactctatttcggcgtctcaaataatgacgttcactgtacagaggttctgttggcggctggcgcagaccccaatctggaccccttaaattgtttgctggtggcagtgagagccaacaactacgaaatcgtgagactgctcctgtcccatggggctaacgtcaactgctattttatgcatgtgaacgataccagattccccagtgtgatccagtacgctctgaacgatgaagtgatgcttcggttgctgctgaacaacgggtatcaggtagaaatgtgtttcgactgtatgcatggagatatcttcggcaatagttttgtatggtctgagattcaagaggaagtcttgccaggatggacttcatgtgtcataaaggacaaccctttttgcgagtttataaccgttccttggatgaagcatcttgtgggcagggtgactcgagtacttattgactatatggattacgtgcccctgtgtgcgaagctcaagtcagcactggaggtccagagggaatggccggagattaggcagatcctggaaaacccgtgctcactgaagcacttgtgccggctgaagatccggagactgatgggcctgcagaagctatgtcagcccgcatccgtggagaaattgccacttccccctgcaattcaacgctacatactctttaaggagtatgacctttacgggcaggagttaaagcttacatag

SEQ ID NO: 52949 - DNA, 294 bp, Artificial Sequence
  Description of Artificial Sequence: Synthetic coding sequence
atggatacgaacgatgaccccgacgaagaccacctgacatcctacgacattcagctgagcatccaggagagcatcgaagcttcaaagactgcactctgtcctgaaaggtttgttccactaagtgcgcagaaccgcaagttagttgaggcaataaagcagggtcacatcccagagttgcaagagtatgtaaagtacaagtatgcgatggatgaggccgatgagaagggttggtttcctctgcacgaggccgttgtgcaacctatacagcagatcttggaaattgtactggactag

SEQ ID NO: 52950 - DNA, 726 bp, Artificial Sequence
  Description of Artificial Sequence: Synthetic coding sequence
atggatactaacgacgatcctgacgaggaccaccttacaagttatgatatccagctgtctatccaggaatctatagaagcaagcaaaaccgcactttgtcctgaacggtttgtgcccctgagtgcccagaatcgaaaactggtagaagctatcaagcaaggacacatacccgagctgcaggagtatgttaagtacaagtacgccatggacgaagccgacgagaaaggatggttccccttacacgaagccgtagtacaaccgatccagcagatcctcgaaattgtgctggatgcttcctataaaaccctgtgggagttcaaaacctgcgacggtgagacgccccttacactggccgtgaaggccggtctcgtggaaaacgttaggaccctgctggagaaaggggtgtggcccaataccaagaacgacaaaggagagactccactcctgatcgcggtgaaaaaggggtcgtatgacatggtgtccaccctgattaaacacaatacaagcttagatcagccatgtgtgaaaaggtggtcggccatgcacgaggctgctaaacaggggagaaaagacatagtggccctgctactcaagcatgggggaaacgtgcacctcagagatggctttggcgtgacacctttaggagtggccgcagagtacgggcactgtgacgtcttagagcacctaattcataagggaggagacgtgttagccctggcagactag

SEQ ID NO: 52951 - DNA, 1767 bp, Artificial Sequence
  Description of Artificial Sequence: Synthetic coding sequence
atggatacgaatgacgatcctgatgaagaccatctcaccagttacgatattcagctctccattcaggaaagcatagaggcttcaaagaccgcactgtgccccgaaaggttcgttccactgtccgcacagaatcggaaattagttgaggctatcaagcagggccacattcccgaactccaggagtacgtgaagtacaaatatgccatggacgaagcggatgagaagggttggttcccactccatgaagctgtggttcagcctatccagcaaatcctggagatcgtgttagacgcctcctacaagactctctgggagttcaagacatgtgatggggagacgcctctgaccctggccgtgaaggccggactggttgaaaatgttcgcaccctgcttgagaagggtgtgtggcccaacaccaaaaacgataagggcgaaactcctctactcattgccgtgaagaaggggtcttacgatatggtgtcaactctcattaaacataacaccagtctcgatcagccgtgtgtcaaaagatggtcagccatgcatgaggctgcgaagcaggggaggaaagacatcgttgcactccttctgaagcacggtggtaatgtgcacctaagagatggattcggggtcaccccactgggagtggcagctgaatacgggcactgcgacgtgctcgaacatctgatacacaagggcggtgatgtattggccctggcggatgacggtgcgtccgtcctctttgaggcggcaggcggtggcaatcccgattgtatatctctgctacttgagtacggcggatcaggtaatgtgcctaatcgcgctgggcacctgccaatccaccgtgcagcctacgagggacactatctggccctcaagtacctgatccctgtcacaagtaaaaatgcgattagaaaatccggattgaccccaatccactccgccgctgacggccagaacgcacaatgtctggagctgttaatcgaaaacggttttgatgtaaacacgctgctggccgaccacatatcccagtcttatgatgatgagcggaaaaccgcattgtatttcggtgtctcaaacaacgacgtccattgtacagaggtgctcctggcggctggagctgacccgaacctggacccactgaactgtctccttgtcgccgtccgcgcaaacaattacgagattgtcagactgctgctgagtcacggggcaaacgtcaactgctatttcatgcatgtaaacgacactaggttcccaagcgttatccagtacgcccttaatgacgaggtgatgctccgattgctgctcaacaatggctatcaggtcgagatgtgcttcgattgcatgcatggggatatcttcggcaactccttcgtctggtccgaaattcaggaagaagtcctgcctggatggacctcatgtgtgattaaagataatccattctgtgagtttataaccgtaccttggatgaaacatttagtggggagagttacgagagtgctgattgattacatggactacgttcctttatgcgctaaattaaaaagtgcgctcgaggtccagcgggagtggccggagattcgacagattttggagaatccgtgttccctgaaacacctctgtcgcctaaaaatcagacgcttaatggggctgcagaagctgtgtcaacccgcttccgttgaaaagctgcccctgcctcccgcaattcaaaggtacattctgtttaaggagtatgatctgtacgggcaggagctcaagttaacgtag

SEQ ID NO: 52952 - DNA, 1767 bp, Artificial Sequence
  Description of Artificial Sequence: Synthetic coding sequence
atggataccaatgatgatccagatgaggaccacctgaccagttatgacatacagctttctatccaggagagtattgaggcatctaaaaccgctctttgccctgagcggttcgtgcctttatccgcccagaataggaaactggtggaggccatcaagcaggggcacattccagaacttcaagagtacgtcaaatataagtacgctatggacgaggccgacgagaaaggatggttcccattacacgaagcagtggtgcaacccatccagcagatcctggagattgttctcgatgcaagctacaaaaccctctgggaatttaaaacctgcgacggagaaacccccctgaccttggctgtcaaggctggactagtcgagaacgtacgcacactgctcgagaagggtgtgtggcccaataccaagaacgacaagggagaaacccctttgctgattgccgtgaagaaaggcagctacgacatggtctctacccttatcaaacacaacacgtctctggatcaaccctgcgttaaacgctggagcgcgatgcatgaggctgcaaagcaaggcaggaaggatattgtcgctcttctgctaaaacatggcggtaatgtgcatctgagagacggatttggcgtcacacctcttggcgtcgcagcggagtatggacactgcgacgtactcgaacacctgattcacaaaggaggcgatgtgttggccctggcagatgacggagctagtgtgctcttcgaggcggcaggcggaggcaacccagactgtatctctcttctcctggagtacggagggagcggcaatgtgcctaatagggccggacatctgccaatccaccgagccgcatatgaaggccactacctggccctgaaatatctgatcccggtcacgagcaagaacgccataagaaagtctgggctgacaccaatccactcagccgctgatggtcagaacgcacagtgcctggagctacttattgagaatgggtttgacgtaaatactttgttggctgaccatatcagtcagtcttacgacgacgaacggaaaacggctctatatttcggagtgagcaacaacgatgttcactgcaccgaggtcctcttggccgcaggagctgaccctaacctggaccctttaaattgcctcctggttgccgttagggccaataactacgagatagtgaggctgctgctgtctcacggggcaaacgtcaactgctactttatgcatgtgaacgatacaagattcccatctgtgatccagtacgccttgaacgatgaagtgatgcttagactgctcctgaataacgggtaccaggtggagatgtgtttcgactgtatgcatggggacatctttggtaatagttttgtgtggagtgaaatccaagaagaggtgttacctgggtggacaagctgcgtaataaaggacaatccattctgcgagttcattaccgttccttggatgaagcatctcgtgggtcgcgttactagagtcctgatcgactacatggattatgtgcctctgtgcgcaaaactgaagagcgcattggaggtgcagcgggaatggccggagatcaggcagatactggaaaacccgtgcagcctcaagcatttatgtagacttaagatcaggagactaatgggcttgcagaagctatgtcaacctgcaagtgtggaaaagctgcctttgcctccagctatccaaagatacatcctgtttaaggaatacgacttgtatggtcaggaactcaaactaacctag

SEQ ID NO: 52953 - DNA, 1767 bp, Artificial Sequence
  Description of Artificial Sequence: Synthetic coding sequence
atggacaccaacgacgaccctgacgaagaccatctcacttcctacgatattcagttgtctatccaggaaagtattgaggcctctaaaacagccctgtgtccagaacgctttgttcctctgagcgcccagaaccgtaagttagttgaggccataaagcagggacacatccccgagcttcaggagtacgtcaaatataagtacgccatggacgaagccgatgaaaagggctggtttccactccacgaagcagtggtccagcctattcagcagattctcgaaattgtgttagatgcatcgtacaaaaccctatgggagttcaaaacttgtgatggggaaactcccctgacactggcagttaaggccggattagtggagaatgtgcgaacgttacttgagaagggagtctggcccaacaccaaaaacgataagggcgagacccctctcctcattgccgtgaagaaaggatcatacgatatggtaagcaccttaatcaaacataatactagcttggaccagccatgcgttaaaaggtggtcggccatgcatgaagccgcaaagcaaggtagaaaggacatcgtggccttgctgcttaaacacgggggtaatgtgcacctacgcgacggcttcggagtgacacccctgggtgtagctgccgaatatggacactgcgacgttctggaacacttaatccataagggcggagacgtcctggcactggccgatgacggcgcttccgtcctctttgaggccgctggtggcggaaacccagactgtatctccctgctgctggagtatggtgggtccggtaacgtgcctaatcgggcaggccacttacccatccaccgggctgcctacgagggacactatttggccctaaagtatctgatcccagtaacatcaaaaaacgctatccgaaaatccggcctaaccccaatacacagcgctgccgacgggcaaaacgctcaatgtctggaactgctgatcgaaaacggattcgacgtgaatactttactggcagaccacatcagccaatcctacgatgatgagagaaaaactgctctgtattttggcgtgagcaacaacgatgtgcactgtactgaggtgttgctggctgcaggagccgatcctaacctagatccacttaattgcttactcgtggctgtccgcgctaataattacgagatcgttcgcctgttgctgtcccatggggcaaacgtgaattgctactttatgcacgtgaatgacacccgctttccttccgtcatacagtacgctctgaacgatgaggttatgctccggctcctgctgaataatggttatcaagtggaaatgtgtttcgactgcatgcacggggatatcttcgggaactcctttgtttggtccgaaattcaggaagaggtgttacctggctggacatcttgtgtgatcaaggataatcccttctgcgaatttattaccgttccatggatgaaacatcttgtcggcagggtaacgcgtgtgttgatcgactatatggactatgttcctctttgtgccaagctgaagtcagcattggaggttcaaagggagtggccagaaatccggcagattctcgaaaacccctgtagtttgaagcatctgtgtagactcaaaatccggcgtctcatgggcctccaaaaattgtgccagccagctagcgtagagaaactgccactgccccctgcaatccagagatatatcctttttaaggagtatgacctatatgggcaggaacttaagctgacttag

SEQ ID NO: 52954 - DNA, 750 bp, Artificial Sequence
  Description of Artificial Sequence: Synthetic coding sequence
atgaagcaaccttctaaggctgagtacggccattgcgacgtcctggaacacttgatacacaaaggtggagatgtgctcgccctcgccgatgacggggcaagtgtcctgttcgaggcagcagggggagggaatcccgattgtatatccttgctgctcgagtacggtggctcgggaaatgtgccaaatcgtgccggtcatttacccattcaccgcgcagcctatgaaggccattatctcgccctgaagtacctcattccagtcacttccaagaacgctatccgtaaatccggccttacaccaattcacagcgcagccgacgggcagaatgcacagtgtctggaactgctgattgagaatgggttcgacgtgaacacccttttggccgaccacatctctcagagttatgacgatgagcgcaagactgccctttactttggtgtgtcaaacaacgacgtgcactgcaccgaggtgcttctggccgctggcgcagatcccaatttagacccacttaactgtttgctcgtggccgttcgggcaaacaattacgagatagtccggcttttactttcccacggggctaacgttaattgttattttatgcatgtgaatgacactaggtttccatcagtaatccagtacgccctgaatgacgaagtcatgctgagactgctactaaacaatggctaccaggtcgagatgtgctttgactgtatgcatggggatatcttcggaaacagtttcgtatgctag

SEQ ID NO: 52955 - DNA, 1362 bp, Artificial Sequence
  Description of Artificial Sequence: Synthetic coding sequence
atggcaagagagacctttccatttacttcttccatgctgcggagcctgcgcctgcagcaggaatggctagagtgggaagacagaaggcgggctgccgcacagcagtgccgcagccggcgttgtccatcctcccctcgggctcgcctgacccgaccacatagatcctgtagggatccggcagtgcaccaggctctgttctccggtaacctccaacaggtgcaagccctgttccaagacgaagaagctgcaaatatgattgtggagacggtgtctaaccagctggcgtggtccgccgagcaaggcttctgggtgctgacccccaaaactaaacagaccgcccctctcgctattgccacggcccgaggttataccgactgcgcccgacatctgattcgccaaggcgcagaattagacgcgcgagtgggtgggcgtgcggcactacacgaggcgtgcgcgagagcccagtttgattgtgttcgccttctcctgacctttggagccaaggccaacgtcctgactgaggaaggtaccactccgctccatttatgcactattcctgaaagtctgcagtgcgctaagttattactcgaggccggagccacggttaacctggccgctggggaaagccaggagacccccctccacgtggccgctgccagaggactcgagcaacacgtggccttgtaccttgaacatggcgctgatgttggtttgaggacctcccagggcgagaccgctcttaacaccgcgtgcgccggtgcggagggtcccggaagttgtaggcgccaccaagctgccgctagaagactccttgaggctggagccgacgctagggcagctggcagaaagcgacacacaccattgcacaacgcctgtgccaacgggtgcggaggattagccgagctgctgttgaggtacggggcacgtgccgaagttcctaatggggcaggccacacacctatggattgtgcgctgcaagcagtccaggacagtccgaactgggaacccgaagttctgttcgccgctttactcgactacggcgcacagcccgttcggccagagatgctgaagcactgcgcgaattttcccagggcactggaagtgctgctgaatgcttatccttgcgtaccgtcctgtgaaacatgggtggaagccgtcttaccggaactgtggaaagaacatgaggccttttattccagtgctctatgtatggtaaatcagcccagacagttacagcatctggctcgcctggctgtccgagcccgactcggctcccgatgtagacagggagcaaccaggttgccgcttccaccactgctgcgcgattatctcctgctgagggtggaaggatgcatccaatag

SEQ ID NO: 52956 - DNA, 888 bp, Artificial Sequence
  Description of Artificial Sequence: Synthetic coding sequence
atgtcaaaatcaacaaagctgtgcgggaagacaagctgccctagaagtaacatattctgtaatctcctggacaagatcgtcaaacggccaagcttacagttcttgggtcagtggggctaccattgctatgaacctcgcatttataggtccctggcaaagatattgcgttatgtcgacttggacgggtttgatgccctgcttactgattatatcgccttcgtagagaagtctgggtataggtttgaggtatctttcaatttggacttcacggaaatctgcgtgaatactatcctgtactgggtatttgccagaaaaggaaaccccgatttcgtcgaactcttgttgaaaaaaacgaaggattatgtacaggatagaagctgtaaccttgctcttatatggagaacattcactcccgtctattgtccaagtccactgtccggaattacccctctgttttacgtggctcaaaccagacaatcaaatattttcaaaattctgctgcaatacggcatattagagagggagaaaaacccaattaatattgtgctcactatcgtgctctatcctagccgggtcagggtgatggttgacagggaactagcagatatacatgaggatgccaaaacatgcctggtgctgtgttccagagtcttaagtgtgatctcggtgaaagagatcaaaactcaactgagtcttgggcgacatccaatcatcagtaattggttcgactacatccccagcacacggtataaagacccatgtgaactgctccatttatgccgtctcacaatcaggaatcaactgttgacgaataatatgcttccggatggcatctttagcctactcatcccagctaggctgcagaattatctgaacttggagatctag

SEQ ID NO: 52957 - DNA, 1314 bp, Artificial Sequence
  Description of Artificial Sequence: Synthetic coding sequence
atggaacgtcagccgggaccagtacgcggaaaactgcaaatcttccagaagacagagaaagacccgcaagcaagggctggatcacctgtgcaagaataccacaccgccttggttgcgggagaccttgatcatctcaaacctcttatggatcagttctttcaggatgccaacgttgtttttgagattaataaagacgaaatggagtggcaggtgaagtcgcccgcaactttcggactgtctggtctttggaccctcgagtataagagagaactgactaccccattatgtatagccgctgctcatgggcacacggcctgcgtgcgacatctgctcgggagaggcgctgatccagatgccagccccggaggtagaggcgctctacacgaggcctgcttaggaggtcatactgcatgcgttcgcctattactgcagcatcgagccgatccagatctgttgagcgccgagggcctggcccctctccatctgtgcaggaccgccgctagcctggggtgcgctcaggccttactggagcatggggcttccgtacaacgggtcggtggaaccggacgtgacacccctctgcacgtggctgcgcagaggggcctcgatgaacatgctaggttgtacttgggtaggggagcgcacgttgacgccagaaacggtcggggtgagaccgccctctctgcagcgtgtggcgcagctcggagacctgacgaacatggtaggtgccttcgcctttgcgccctcctgctgcggaggggcgcagaagccgatgctagagatgaggacgagagaagcccacttcacaaagcttgcgggcatgcctctcatagcctggcaaggttgcttctgagacacggcgctgatgccggtgccctggactatggcggagcgagccccttgggccgtgtactgcagactgcttcctgtgccctgcaggcaagcccccagcgaacagtgcaagccttactgaaccacggcagcccaaccgtttggcccgacgcctttccgaaggtgttgaaaacctgcgcaagtgtacctgcggtaatcgaggtgctattcaacagttacccacaactgtgtctctccgagagttggaaggaagtgattccggaggaagtcttccaaatgcacaaaccattttatcagagtctgttcgctttagcactgacacctcggtgcctccagcatctctgtcgatgcgccctcaggagactttttggtaagagatgctttgatctgatccccctgctccctctcccaaagcctctccaaaattatcttctgcttgaacctcaaggggtgctgcattag

SEQ ID NO: 52958 - DNA, 1401 bp, Artificial Sequence
  Description of Artificial Sequence: Synthetic coding sequence
atgtcaaacagcgactaccttcctgactaccctctcaatagcgatttggtaaaacggctgaagagtgctttggacgcaaaagacgaagaacgggtgcgcgacctgatatgtaccgaaatcacaccggtggacgccgtgattgaactcgcaaatgatgattggatgaaggatcctagtgctcagctgccgaccggcatgctgctgggtgacctggatcacttaaaacctttgatggatcagttctttcaggatgccaacgtggtttttgagattaataaagatgaaatggaatggcaggtaaagagtcctgctacattcggccttagcgggctgtggacacttgagtataagcgcgaacttacaacccccctttgcatcgccgctgcccacggtcataccgcctgtgtccggcatctactgggcaggggagccgacccagatgcgtcacctggtggcagaggcgcacttcacgaggcatgtctggggggacataccgcctgtgtgcggctcctgctgcagcacagagccgatcccgatcttctgtcagccgagggcctcgccccactgcatctgtgtcggacagcagccagcttgggctgtgctcaggccctgttggaacatggggcttccgtgcagagggtcggtggaactggaagagacacccccctacacgtcgctgcccagcggggtctggatgaacacgctcggctgtacctaggcaggggcgctcacgtggacgcccgaaatggtagaggtgaaactgctcttagcgctgcttgtggggctgcccgacggcctgacgagcacgggcgttgcctccggttgtgtgcattactgttaagacggggtgcagaggcagacgccagggacgaggacgagcggagtccactgcacaaggcctgcggtcacgcaagccattctctggccaggctcctactgagacatggggcagatgcaggcgctctcgattacggcggtgcaagccccctggggcgagtgctgcagaccgcctcatgcgcactccaggcttcaccacaaagaactgttcaggccctgctgaatcacggctcacctacagtctggcctgacgcttttcctaaggtgcttaaaacctgtgcctcagtgcctgccgtaattgaggtgttatttaactcgtacccacagctctgccttagcgagagctggaaggaggtgatccccgaagaagtcttccagatgcacaagccattctatcagtcgctgtttgccctggccctgactccccgatgcctacaacatctgtgcaggtgcgcacttcggcgtctgtttgggaaaaggtgcttcgacttgatcccactcctgccactgcctaaacccctccagaactatttgctgctcgagcctcagggggtgctgcactag

SEQ ID NO: 52959 - DNA, 990 bp, Artificial Sequence
  Description of Artificial Sequence: Synthetic coding sequence
atgagcgtcctagaggagaatagaccctttgcccaacagctgagtaacgtctactttaccatcctttccctgttctgctttaaactgttcgtgaagatcagcctggccatactgagtcatttttatatcgttaagggcaatcgcaaagaagctgcacggattgccgctgagttttacggagtgactcagggccaaggatcttgggccgatcgctcacccctgcatgaagctgcctcacaaggcagactgttggccctgcggaccctgctgagtcaaggttacaacgttaatgccgtgacactcgaccatgtgaccccactgcacgaagcctgcctcggagatcacgtcgcctgcgcccgaactcttttagaggctggggcaaacgtgaatgctattacaattgacggcgtcacgccactcttcaacgcctgctcccagggcagccccagctgcgctgagctgctgttggaatatggcgcaaaggcacagctggagtcgtgtttaccttccccgacacatgaagctgcatctaagggccaccacgaatgtcttgacatacttatttcctggggtatcgatgttgaccaggagatcccacatctcgggactcctctgtacgttgcgtgcatgtcacagcaattccattgcatctggaaactgctgtacgcgggagcagacgtgcagaaagggaaatattgggacacgcccctgcacgcggcagcacagcagagctccaccgagattgtgaatttattgcttgagttcggggctgatatcaatgctaagaacaccgagctcctgaggcccatagacgtcgcaaccagctcctcgatggtagaaagaattctactgcagcacgaggcgaccccgtcttctctgtaccagctgtgtagactgtgtatccggtcatatattggtaaacccagactgcatcttataccacaactgcagctgcctacactgctgaaaaacttcctgcagtacagatag

SEQ ID NO: 52960 - DNA, 63 bp, Artificial Sequence
  Description of Artificial Sequence: Synthetic coding sequence
atgtctgtactggaggagaacaggccttttgctcagcaactgagtaacgtgtacttcacgtag

SEQ ID NO: 52961 - DNA, 957 bp, Artificial Sequence
  Description of Artificial Sequence: Synthetic coding sequence
atgcttcatcatcattgcagacgcaaccctgaactgcaggaggagctccaaattcaagctgcagtcgccgctggcgatgtccacacagttaggaagatgctggaacaggggtatagtccgaacggcagagatgcaaacggttggactttgctccactttagtgctgcacgaggaaaggagcggtgtgtgagggtgttcctggagcacggcgctgaccctacggtgaaggatctcatcgggggttttacggcattgcactatgcagctatgcatgggcgtgctaggatagctcgcctgatgttagaatctgaatacagatccgacattataaacgcaaagtccaatgacggctggacacctcttcatgtggctgcccattacggcagagacagtttcgttcgcctgttgctcgagttcaaggcggaagttgatccactgagtgataaagggacaacccctctgcaactcgccatcatcagggagaggagctcatgcgtgaaaattctgctggaccacaacgcaaacatcgacatacagaacggattcctgctgcggtacgccgtgatcaaaagcaatcacagctactgtcgaatgtttctccagcgaggcgcagatacaaatctcggacgcttagaggatggccaaaccccgctgcatcttagtgccttaagagacgatgtgctctgcgctaggatgctttataattacggtgcggacacaaacacgcggaattatgaagggcaaactccactggccgtgtcaatcagcatctctgggtcctcgcgcccttgtctggactttctgcaggaggtaactagacagccacggaatctgcaggatctgtgcagaatcaagatccggcagtgtattggcctgcaaaacttaaaacttcttgacgagttgccgattgcaaaggtaatgaaagattatctgaagcataaattcgatgacatctag

SEQ ID NO: 52962 - DNA, 825 bp, Artificial Sequence
  Description of Artificial Sequence: Synthetic coding sequence
atgcttcatcatcattgccgccgaaacccagagctgcaagaggagctacaaattcaggctgccgtggcagctggggacgtacacaccgtgagaaagatgcttgagcagggctattcaccgaacggacgagacgctaacggctggacactgctccatttcagcgctgccaggggtaaggagcgctgtgtcagggtgtttttggaacacggcgcagatcctacagttaaggatctgattggcggtttcaccgctctgcactatgcagcaatgcatggacgggcacgcatagccaggctgatgttagaatcagagtaccgctctgacatcattaacgccaagtctaacgacggctggactcctctgcacgtggccgctcattatggacgtgatagctttgtgcgtctactgctggagtttaaggccgaagtcgaccctttgagcgacaaagggacaacacctctgcagttagccattatccgggaacgctctagctgcgtgaaaatcctcctggaccacaacgcaaatatcgatatccaaaatggatttctgctacgatacgctgtaatcaagtccaaccattcatactgtagaatgttcctgcaacgcggagcagacactaacctgggtcgacttgaggatggccagaccccactgcacttgtccgctctccgagacgacgtactgtgtgcaagaatgctgtacaactatggcgcagacactaacacccgtaattacgaaggacagacccccctcgccgtctccatcagtatcagcggcagcagccgcccatgtctcgacttcttgcaagaggtaaccagtatgtag

SEQ ID NO: 52963 - DNA, 759 bp, Artificial Sequence
  Description of Artificial Sequence: Synthetic coding sequence
atggacggtaaacagggcggaatggacggttctaagccggcagggcctcgcgactttcccggaatccgccttctttccaaccccctcatgggcgacgccgtctccgactggtcaccaatgcatgaggccgcaatccacggacatcagctctctcttagaaacctcatttctcagggatgggctgtcaacatcattacagcagatcatgtgtctccactgcacgaggcctgtcttggtgggcacctgtcttgcgtgaaaatcctgctgaagcatggtgctcaagtcaatggggtgactgccgattggcacactccacttttcaacgcctgcgtgtctggctcctgggactgcgtgaatctgctgttgcaacatggtgcctcagtgcagcccgaatctgacttggcaagcccgattcacgaggccgctaggcgggcttatggcggtaatatagatcacaaaatctcacatttgggaaccccactgtaccttgcctgcgaaaaccaacaacgtgcttgcgttaagaagttgcttgagtccggtgccgatgttaatcagggaaagggccaggattcccctctccacgcagtagcgcgaaccgcgagcgaggagctggcatgcctgttgatggattttggggctgacactcaggccaaaaatgctgagggcaagagacccgtcgagttagtcccccctgagtcccctctcgcccagctgttcttagaacgggagggtgcctctctcccaaaacctaaaccttag

SEQ ID NO: 52964 - DNA, 789 bp, Artificial Sequence
  Description of Artificial Sequence: Synthetic coding sequence
atggacggcaaacagggtggcatggatggatctaagcctgccggtccaagagacttccctggcattagattgctctcaaaccctttaatgggtgacgccgttagtgattggagccccatgcacgaggccgcaatacacggacatcagcttagcctgcgtaacctgatatcccagggctgggctgtcaatatcataacagctgaccatgtatctccactgcatgaagcctgcctaggtggacacttatcatgcgtcaagatcctgctcaagcacggtgctcaggtcaacggtgttaccgccgactggcacacgccactcttcaacgcatgtgtttctggcagctgggattgcgtgaacctgttgctccaacacggtgcaagtgtgcagcctgagagtgacctggcttccccaattcacgaagccgctagacgaggccacgtcgagtgcgtcaattctctgatcgcttacggtggtaacattgaccacaaaatctctcacctcgggaccccactgtacttggcctgcgagaaccagcagcgagcttgcgtaaagaaactgcttgagagcggagctgacgtcaaccaggggaaaggccaggattctcctttgcatgccgttgcccgtacagctagcgaggaattggcctgccttttgatggactttggcgctgatactcaggccaaaaatgccgaaggaaagagacctgttgagctagtgccgccagaaagccctttggcacagttatttctcgaacgtgaaggcgcttcactgccaaagccaaagccatag

SEQ ID NO: 52965 - DNA, 885 bp, Artificial Sequence
  Description of Artificial Sequence: Synthetic coding sequence
atggacgggaaacagggtggtatggacggctccaaaccagccggtccacgcgactttcctggtataagactgctgtccaacccactaatgggtgacgccgtgagcgattggtcacctatgcacgaggctgccatccacgggcaccagctgagtctgcgaaatctgatatcccagggctgggccgtaaatataatcaccgccgaccatgtttccccattacacgaagcctgcctaggcggtcatctgtcgtgtgtcaaaatcttactgaaacatggcgctcaggtgaatggggtcaccgctgattggcatacaccgctctttaacgcatgtgtgtccggctcgtgggattgcgtgaacctgctgctacagcacggagcaagcgtgcagccagaatctgatttggcctctccaattcacgaagccgcacgacggggacacgttgagtgtgtaaacagccttattgcctatggtgggaacattgatcataagatatcccaccttggtacccccttatatctagcatgcgagaatcagcagcgggcatgtgtgaaaaaattgctcgagtccggcgcagacgtgaaccaggggaagggacaggacagcccactccacgccgtagcccgtaccgccagtgaagagctggcatgtctgctgatggattttggggcagatactcaggccaagaacgccgagggaaagcggccagtggagttagtcccacccgaaagcccacttgcccaactcttccttgagcgagaggggcctccctcccttatgcagctctgtagactccggatccggaaatgcttcggcatccagcaacatcacaagataacgaaactcgtgctgcctgaagaccttaagcaatttctgctgcacctttag

SEQ ID NO: 52966 - DNA, 789 bp, Artificial Sequence
  Description of Artificial Sequence: Synthetic coding sequence
atggatggcaagcagggcggaatggatgggtcgaagccagccggtccacgggacttccccggaattagactgctctcaaatcctttgatgggcgacgctgtatctgattggtcacccatgcacgaggcggctattcacggccatcagctgagcctccgaaacctcattagccagggttgggccgtgaacattataaccgctgaccacgtgtctcctctgcacgaagcgtgcctcggcggtcacctctcttgtgtgaaaattctgctgaagcatggggcacaggtgaatggcgtcactgccgattggcacacaccattgttcaacgcgtgcgtctcgggcagctgggattgcgtgaatctcctgctgcaacacggtgctagcgtccagcctgagagtgatctggcgtcacccattcacgaagctgctcggagaggacacgtggagtgcgtcaactccttgattgcatacggcggtaatatcgaccacaagatttcacatctgggaactcctctctatctggcttgtgagaatcagcagcgcgcatgtgtcaaaaaacttttagagtcaggcgcagatgtgaaccaagggaaaggccaggacagccccctccatgccgttgccagaacggccagcgaggagctcgcttgtctgcttatggacttcggcgctgacacccaggctaagaacgcagagggcaagagacccgtggagcttgtccccccagaatcacccctcgcgcagctgttccttgagcgagagggagcatctctcccaaagccgaagccatag

SEQ ID NO: 52967 - DNA, 1971 bp, Artificial Sequence
  Description of Artificial Sequence: Synthetic coding sequence
atgtccgagctgtctgatgaagcttcagagcccgaactgctgaaccgcagcctgtccatgtggcacggtctgggaacccaagtctcaggcgaggaactcgacgtaccattggatctgcacaccgcagctagtatcggacaatacgaagtcgtcaaggaatgtgtacaaaggcgcgagttagaccttaataagaagaatggcggaggatggacccctctgatgtacgcctcgtacattggccacgacacaatcgtccatttactcctagaggcgggtgtgtccgtgaacgtgcctacaccagaggggcagacccctctgatgctggcctcttcctgcggcaatgagtccattgcttattttcttctccagcagggagccgagctggaaatgaaggacattcagggctggacagctttattccactgcacgagtgccggacaccagcacatggtgagatttctgcttgatagcggtgcaaatgccaatgtgcgagagcctatatgtgggttcactccgctcatggaagcggcagcagccggtcatgaaattatcgtgcagtactttttgaatcacggggtgaaggtggacgcacgagaccactccggcgcaaccgcaagaatgctggccaagcagtacgggcatatgaaaatcgtggcccttatggacacttattcaccatcactcccgaaaagcctttatcgtagtcctgagaagtacgaggacctaagttcttccgatgaatcatgtccagcaccccagagacagagaccgtgcagaaagaagggcgtatctattcatgaagggcctcgcgcactggccaggattacaggcatcggccttggcggaagagccccacgacctcgctatgagcaggcccctcccaggggctatgtgacatttaactctagcggtgagaaccccctggaagaagagggcctctgttgtcgtgatgttacctccccaatcaatgaacgagatgtcgagtctagcagcagttcttcctcacgagaggaacacgccttctgcgcaaatctgggccctgtgcaatcctcttccagctccgaaggactggcaagggctcagggcttgagttcggaagcctctgtggagtctaacgaggatagcgatcatgcctgcaaaagtagcgccagaaagcaagccaaatcatacatgaagactaaaaatcctgatagccagtggccacctcgcgcagcaaccgacagggagggttttttggccgagtcctcgccacaaacgcaacgtgccccatactcaggtccacaagacttggctgcgctgctggagcagatcggctgtctcaagtacttacaagtgtttgaggagcaggatgtggatctgagaatctttttgactttgacggagtcggatctcaaggaaatcgggataaccctttttggcccaaagcggaagatgacttccgccatcgccaggtggcacagttcggccagacccccaggtgatgcactagagctggcatacgccgataggttggaagcagagatgcaggagctggctattcagttgcataaaaggtgcgaagaggtggaagccacgcgcggacaggtgtgccaagagcaagagctccgagctgtagttgaatcctgtctcctggagcaagatagagccagagaggacctccaggccagactgcgtgaaacttgggctttagctcgcgacgccgcattagtgctggaccagctacgagcatgtcaggcagaattaagctcccgagtaaggcaggatcagccccctggtgccgctaccttgggcctcgctgttccgccagccgacagcaagggctggcaggcgagcttacaggcgatgagtcttcctgagctgtccggagctctagaggaccgggtccgagagatggggcaggctctttgcctggtgacccagtccctcgagaaattgcaggtgctcaatggcaagaagtggcgagagacctag

SEQ ID NO: 52968 - DNA, 1584 bp, Artificial Sequence
  Description of Artificial Sequence: Synthetic coding sequence
atgaaggacattcaaggatggaccgcactgttccactgtactagcgcagggcaccagcatatggtccgcttcctgctggactccggggctaacgctaatgtgcgtgaacccatttgcggctttaccccattgatggaagcggcagccgcaggacacgaaataatcgtgcaatacttcctcaaccatggcgtcaaggtcgacgccagagatcatagcggcgctactgcgcgaatgctggcgaaacagtatggtcacatgaagattgtggccttgatggacacttatagtccctctttgccgaagtctctttaccggtcaccggaaaaatatgaagatctaagctcttccgacgagtcttgcccagccccacagcggcagcgcccttgcaggaagaagggtgtctccattcatgagggaccccgtgccctggctaggattaccggaattggcctaggtggccgagcgcctagacctcgctatgagcaggccccaccacgcggatatgtgacattcaattcatcgggggagaaccctctggaggaggaggggctatgctgcagagacgttacctctcctatcaatgaacgcgatgtggagagcagttccagttccagctctcgggaggagcacgccttctgcgccaacctaggacccgtccaatcgtcatccagctccgaagggcttgcacgtgcccagggcctcagctctgaagcatccgtggagagcaacgaagattccgaccatgcttgtaagtcatctgcacgaaaacaagcaaagagctatatgaagactaaaaacccagacagccagtggcctcccagggcagccacagaccgggagggcttcctagcagagtctagcccacaaacacagagagccccttactccggtccccaggacctcgcagccctgctcgagcaaatagggtgtctcaagtacctgcaagtctttgaagaacaggacgtggacttgaggatatttttaaccctgacagaatcagatctgaaggagataggtattactctcttcggaccgaagcgaaagatgacctcagccattgccagatggcatagtagtgctcgacctcctggagatgctctggagttggcttatgctgaccgccttgaggcggaaatgcaggagctggccattcagctgcacaagcgctgcgaagaggtcgaggcaactcggggacaggtgtgccaggagcaggaactgcgagctgtagtggaatcgtgccttctcgagcaggaccgagccagggaggacctgcaggcaaggctgcgcgaaacctgggccctcgctcgcgacgccgctctggttctcgatcagctcagagcctgtcaggccgagttaagctcacgtgtaaggcaagatcagccccctggagctgcgacgctggggttggcagtgcctcctgcggactcaaaagggtggcaggcctctttacaagcaatgtcattacccgagctgtccggtgcactggaagatagggtccgggagatgggacaagctctatgtcttgtgacccagagcctggagaaactacaagtactgaatggtaaaaagtggcgcgagacctag

SEQ ID NO: 52969 - DNA, 921 bp, Artificial Sequence
  Description of Artificial Sequence: Synthetic coding sequence
atgttagccaaacaatacgggcacatgaagattgtggcgctgatggatacttactccccctcactgcccaagtccctttatcgaagcccagagaaatacgaagacctgagcagctcggatgaatcttgccctgctccacagcggcagcggccttgtagaaaaaaaggtgtatctattcacgaggggccaagggcgctggcccgaattacgggaattggcctggggggaagagctccgcgaccgagatatgaacaagcacccccaagggggtacgtgaccttcaatagctccggggagaaccctctcgaggaagaaggcctgtgttgtcgggacgtgacctcacctatcaatgagcgggacgtcgagtcttccagttcctctagtagtcgggaagagcatgcattctgcgctaatcttggccctgtgcagagctcatcctcatcagaaggcctcgctagggctcaggggctgtcctctgaagcttcagtggagagcaacgaggatagtgaccacgcctgtaaatcttcagctaggaagcaggcaaaatcgtacatgaaaactaaaaacccagattcccagtggcccccacgggcagcaactgatcgggagggcttcttggccgagagtagccctcagactcagagggccccttacagtggccctcaagtgcggccattagtgaagctggaggttactctgagggatggaacgttttgcgatctaggaggcatgtgttgtgtatatgatgtccccggagccgctcgccgaactgagtggcgctggcaccctcatggactactggggagcactggaagccagcctgcaccatggctggccgctcccctgcagcgcttttactccgttcccctgcacggcaaggatttatctccgtgctttccgtactggtcctggcccccatag

SEQ ID NO: 52970 - DNA, 1275 bp, Artificial Sequence
  Description of Artificial Sequence: Synthetic coding sequence
atgagaatattcatagcctttgaaggctccttcgagccatttgacgtcagcgccgatgagacggttgaggtagtgaaactaatgatcaaagattactttcatatcccattatcggaggacaaacaggggaggcgatatctcgagctcatgtacgctggggctgccctgaaagacagctggtctctcgcagacgtagggatctctttctgttcaactttgaaatgcttcgtgaaggaagaggacaaaccaactctatacgtattcaacgccgtcacacaggataccatgccagtgatggagtccataagcctcctggataagacagtttctgacctgcgtacactggtgacattgcgttgcggtctcccagtttccgtttactgcctacgcaccccaaggggactggaaatgtacgactgtaacactctcaaagattatcagacggatatcggcacaacacttcggctggatgtttgggatggttggaaagagttcctgatgggctgcttgctgggtcagaagctcaaggtccagcgatatctctctaaagagggcccagtgctgaaataccaaaaaagagtcgccctctatatagccgcattctgcggctacatcgagctgacagagtgggctctgaaacaaggcgctcggccacacgaagccgttggagtgcacccataccgcgcatggtgtcatgaggcactccacgcagacgtgtccaaatgtccaattcacgctgctgccgaggccggacaactgttaattttgaaggctttcgtgaattattcagtcctgtgcttagaatgtaagaacgcggcagggcaaactccactgaccatagtgttcaagcataagcacaaagattgtgtgctctacctgttgagtaaaatgtggtccacggtgtcatttcccaaaatttccgtgcctatgagaatctatattaaaataaaacagtggatactgcgagcgcagagtcattcattgcacaagtcccagttttgcggagcgagagtttttggtgcaaaggtgggggataccgtcatggtagacggttttactaaacctaaaatgacttccaaaagctggcacaaggctggcaattccgactctcagtccatcgtgctcaagctgccatccctgagcaagcagaccgcttcttctaaacctgtgaatccactcgctatcagccagcccgatacacgcaagcaagctctcaagtttcatcctctgaagggtgagagccctaaggccgacaaatccagcggcatcatgtag

SEQ ID NO: 52971 - DNA, 1635 bp, Artificial Sequence
  Description of Artificial Sequence: Synthetic coding sequence
atgcgcatatttatcgccttcgagggaagctttgaaccatttgacgtgagtgccgacgagacggttgaggtggtgaagctgatgattaaggattacttccatatccctctttccgaagataagcaaggcagaagatatctcgaactcatgtatgctggcgctgcactgaaggactcctggtcactggccgatgtgggaattagcttttgcagcaccctgaagtgctttgtcaaggaagaagataagccaaccctatatgtgtttaatgccgtcacgcaggacacaatgcctgtcatggagagcatttctctgttagataagactgtgtccgacctccgcaccttggtaaccctgaggtgtggcctccccgtcagcgtttactgtctgcgtactccacgtggcctcgaaatgtacgattgtaacacactgaaggactaccagacggacattggcacaaccttgcggctggatgtgtgggatggatggaaggagtttctgatgggatgtttattgggacagaaactgaaagttcagcggtatctcagtaaggaaggaccagttttgaagtatcagaagcgcgtcgcgctttatatcgccgcattttgcggctatatcgagctcactgagtgggcgctcaagcaaggagccagaccccacgaggcagtgggagtgcatccctacagagcatggtgtcacgaagccctgcatgcagacgtctctaagtgccccatacacgcagcagctgaggcgggacagctgctgatactcaaggccttcgtcaattatagtgtgctgtgcctcgaatgcaagaacgccgctggccagacaccgctaacaatcgtgttcaagcataagcacaaggattgtgtgctgtatcttctgagtaaaatgtggagtaccgtatcattccctaaaatttcggtgcccatgaggatttacatcaaaatcaagcagtggattttacgagcacaaagccacagcctgcacaaatctcagttctgcggggcacgtgtgtttggcgctaaagttggagataccgtgatggtcgacggcttcactaaaccaaaaatgacttcgaagagttggcataaggccggaaacagcgacagtcagagtattgtacttaagttaccaagtctgagcaaacagactgcaagcagtaagccagtgaatcccttagcaataagtcagcctgatacccggaagcaggctctaaaattccacccattggtcaatgctagcagcttctccgaactgcaaaaacaccaacaacagaaccagaaaaagatcacggccactgccagaaagaaggagaagctgatcaaaaacacctacctgccgcaggtcccactgccccctgtgagcagggtgggctattcacaccctagctttttctacgccactcctagtgcagacttcctgctcaaatcgagtttcagcagctttctggagcatagtggaaaaacgccttgggagaatgctatttactgcctcgccgtggcctccgcgtttaaggagaaaagatggctgcagcagctggagattgccagggtgctcgccaagaagagcatctctaatctcacaacccgcggtgggctaacagcctgcgagaattctttggaaacagtgctctag

SEQ ID NO: 52972 - DNA, 2181 bp, Artificial Sequence
  Description of Artificial Sequence: Synthetic coding sequence
atgagccctgccccagacgccgcacccgcacctgcaagtatcagtctgtttgatctgagcgccgacgcacctgtgtttcagggcttatcactggtttcacacgcgcctggagaggcactggcgcgagcacctcgcacaagttgcagcgggagcggcgaacgtgagtccccagaacgcaaacttcttcagggacctatggacataagtgaaaagttgttctgtagcacatgcgaccagacattccagaaccaccaggaacagcgagaacactacaagcttgattggcatcgctttaacctcaagcaacgcctgaaggataaacccttgctgagtgcgctggactttgaaaaacaaagtagtactggggatctttcttctattagtggttcagaagactcagattctgcgtccgaagaggatctgcagacattggacagggaacgcgctacattcgagaagctctcacgacctcccggattttacccgcaccgagtgctgtttcagaatgcccagggacagtttctatacgcttaccgctgtgtcctgggccctcatcaggatcctccagaggaagctgaactacttctgcagaatctgcagtcgagaggtcctcgcgactgcgtcgtcctgatggcagctgcaggccatttcgccggtgccatctttcaggggagagaggtagtgactcacaagacatttcaccgatatactgtaagggcaaagcggggaacggctcaggggctcagagatgccagaggagggccatctcacagcgccggagctaacttgagacgatataacgaagccaccctgtataaggatgttcgagacctgctggctggacccagctgggccaaggctctcgaggaggctggcaccatcctgctgcgggcacctaggtctggcaggtccctcttctttggcggtaaaggcgcacccctccagaggggggatccccgactgtgggacattcctttggctacacgccgacccaccttccaggagttacaacgcgttcttcataaattgacaacactgcacgtatacgaggaggacccaagggaagccgtccgcctgcactctcctcaaacacattggaaaacagtgagggaggaacgtaagaagccgaccgaggaggagattcggaagatctgcagagacgagaaagaggccctgggccagaacgaggaaagccctaaacagggatcggggagcgagggagaggatggctttcaagtggaactggaacttgtcgagctgacagtgggtacccttgatctgtgcgaaagcgaagtgcttccaaagaggaggcggaggaagaggaacaaaaaagaaaagtccagggatcaagaagcaggcgctcacagaaccctcctccagcaaacacaggaggaggagcccagtactcagagttcccaagcggtggctgccccattaggccctcttctggacgaagcaaaggctcctggacagcctgagctgtggaatgctctgctagcagcttgtagggcgggtgacgtcggtgtcttgaagctgcagttggctccatctcccgctgatccccgagtgctgtctctactatctgcgccactgggtagcggtggattcacactactgcatgccgctgcagcagccggaagaggaagcgttgttagactgctgctcgaggctggtgcagatccgacagtgcaggactcccgggctcggccaccgtacactgttgctgcggataagtctaccaggaatgagtttcggagattcatggaaaaaaatcccgacgcctacgattataacaaggcgcaggtgccaggccctctaacccctgagatggaagcgaggcaggccacaaggaaacgggagcagaaagccgcacggaggcaacgggaagagcaacagcagagacagcaagaacaagaggaacgagaaagggaggaacaacgcaggtttgccgcattgagtgatagagagaagcgcgcactggccgctgaacgcaggctggccgcacagctcggcgctccgacaagccccatcccagattctgcgatcgtgaacactagaaggtgctggtcttgcggagcatccctgcagggtctcacacctttccattacctggacttcagcttttgtagcacaagatgcttacaggatcatagaagacaggctgggcgtccgtcaagttag

SEQ ID NO: 52973 - DNA, 2181 bp, Artificial Sequence
  Description of Artificial Sequence: Synthetic coding sequence
atgtctcccgctcccgacgccgctcctgccccagcgtccatctcccttttcgatctgtcagccgacgcacccgtttttcaagggctatctctggtttctcatgccccaggggaggcccttgccagagcaccgcgaacttcatgctccggtagcggtgaaagggagagtccagagcgaaaactgctccaaggtcccatggatataagcgagaaactgttttgttccacctgtgaccagacattccaaaatcaccaagagcagcgggaacactacaagcttgattggcaccgctttaatcttaagcagaggcttaaggataagccactcctcagtgctctggacttcgaaaaacagtcaagtactggtgatcttagttcaatcagtgggtctgaggacagcgattccgcgtccgaggaagacctacagacattggacagagaaagggccacttttgaaaagctgtcaagacccccaggattttaccctcaccgcgtgctttttcagaatgcccagggccagtttctctatgcctacaggtgtgttctcggtcctcaccaggaccccccagaagaggccgaattgctcctgcaaaatcttcagtccaggggacctcgcgattgcgtggttttaatggcagctgccggtcacttcgctggcgctatcttccaaggcagagaggtggttactcacaaaacattccaccgctataccgtgagggccaagagagggacagcacaagggttgcgcgacgccagggggggtccgagtcacagtgcgggagcgaacctgcgccgatataatgaggccaccctctacaaggacgtgagggaccttctcgccggacctagttgggcgaaggcgcttgaggaggccggaacgatcctgcttagggccccacgcagcgggcgttcgcttttttttgggggaaaaggcgctccactacagcggggtgatccccgactctgggacatcccactcgccaccaggagacccacctttcaggagttacagagagtcctgcacaagcttacaactttgcacgtttacgaggaggaccccagggaggccgtgcggctccactctccccaaactcattggaagacagtcagggaagaaaggaagaagcccacagaagaggaaatcaggaaaatctgcagagatgaaaaggaagcactgggccagaatgaagaatcaccaaagcagggatcaggctcggagggcgaagacggctttcaggtggagctcgaattggtggaactcaccgtgggtactctggatttgtgtgaaagcgaagtgttgccaaagcggagaaggaggaagaggaacaagaaggagaagagcagggaccaagaggccggtgcccaccggaccctgcttcaacaaacgcaagaggaggaaccaagtacacagtcctcccaggctgtggcggctcctctgggccctctgttagacgaagccaaagctccagggcaaccagagctgtggaacgctttgttagcagcatgtagagccggagacgtgggtgtactcaagctgcagctcgccccaagccccgctgatccccgagtgttgtcgcttctgagtgctcctctcgggagcggcggatttactcttctgcacgctgccgcagcagccggtagggggtctgtggtgcggttgctgctggaagcaggggcagatccgaccgtccaggacagccgcgctcgaccaccctacacggtggccgctgacaagtccaccaggaatgagtttagacgcttcatggagaaaaatcctgacgcatacgattataacaaggcacaagtaccagggccattgacgccagagatggaggcccgacaggccaccagaaagcgcgagcagaaggcagcacggagacaacgagaggaacagcagcagaggcaacaggagcaggaggagagagagagagaggaacagcggagatttgctgccctcagtgaccgcgagaagagagccttagctgctgaaagaaggctggctgcccaactgggggctcctacctcaccaatccctgactctgctatagtaaacacacggcgatgttggtcgtgcggagcctctctccaagggctgaccccattccactatctcgatttcagcttctgttccacaagatgccttcaggatcatcgcagacaagcgggtcggccttcatcgtag

SEQ ID NO: 52974 - DNA, 273 bp, Artificial Sequence
  Description of Artificial Sequence: Synthetic coding sequence
atgtcccctgcgccagatgccgctcctgcacctgcctcgatctctctgtttgatctgtccgctgacgcccctgtgtttcaaggcctgtctcttgtaagccatgctcccggtgaagctctggcccgagcaccacgcaccagctgtagcggctcaggggaaagagagagccccgagcgaaagttactgcagggacccatggacatctctgagaagctgttctgctcgacctgcgatcagacattccagaaccaccaagagcagagagagcactag

SEQ ID NO: 52975 - DNA, 423 bp, Artificial Sequence
  Description of Artificial Sequence: Synthetic coding sequence
atgtccccagctccggacgctgctcccgctcctgcgagtatttctctattcgatttgagtgccgacgctccagtattccagggcctttccttagtttcccacgctcccggtgaagcgctggcaagagccccacggacctcctgctctggcagcggcgagagagaatccccagagcgtaagttgctgcagggaccaatggatatctccgaaaagttgttctgcagcacgtgtgaccaaacattccagaatcaccaagaacagcgcgaacactataaactggattggcacagattcaacttgaagcagcgcctgaaggataagcctctcctgtctgccctggacttcgaaaaacagtctagcaccggtgacctgagttctatctcgggctcggaggatagcgatagcgcaagcgaagaggactag

SEQ ID NO: 52976 - DNA, 1263 bp, Artificial Sequence
  Description of Artificial Sequence: Synthetic coding sequence
atgtccgctgctggggcaggggctggcgtcgaggcgggatttagttccgaggagctgttgagcctgagatttcctctgcaccgcgcatgccgcgacggtgatctagcaacactgtgcagtctgcttcagcaaaccccccacgctcatcttgcctcggaggacagcttctacggatggactccagtgcactgggccgcacacttcggaaagttagaatgcttggtgcagctggtgcgtgccggagccaccctgaatgtgtctacaacccgctatgcacaaacccccgcacacattgccgcattcggcggacatccccagtgtctcgtgtggctgatacaagccggagccaatatcaacaaaccagattgtgaaggtgagaccccgatccataaggccgcacggtcaggctcccttgaatgcatttctgccttagtagcaaacggggcacatgttgatctgcggaacgcgagcgggctgactgccgctgacattgcccagacacagggattccaggagtgcgcacaatttcttcttaacttacagaattgtcatctcaatcacttctataacaatgggatcctgaatgggggtcatcagaacgtgtttccaaatcacatatccgtcggaaccaaccgtaaacgctgtctggaagatagtgaagatttcggcgtgaagaaggctcgcaccgaagctcagtccctggacagcgctgtccccctgacgaatggcgacaccgaggacgatgccgacaaaatgcacgttgatcgcgaatttgctgtggtgaccgacatgaaaaacagctcctctgtctcaaacacgctgacaaacggatgcgtcattaacggccatctggacttcccgagcaccaccccactctctggaatggagtcaaggaatgggcagtgcctgaccgggactaatgggataagctccgggttggctccaggtcaaccctttccctcctcacagggaagtctatgcatatctgggaccgaggaacccgaaaaaactctgcgcgcaaacccggaactgtgcggcagtcttcacttgaatggctcgccttcctcctgcatcgcctcccggccatcatgggtcgaggacatcggcgacaacctgtactacggacactaccatggttttggagataccgcagagtctataccagaactgaattcggtggttgagcattcaaagagcgtgaaggttcaggagcggtacgactccgccgtgttaggcaccatgcacctgcatcatgggtcatag

SEQ ID NO: 52977 - DNA, 663 bp, Artificial Sequence
  Description of Artificial Sequence: Synthetic coding sequence
atgtcagccgctggagcaggcgcaggcgtggaggcaggctttagcagtgaagaactcctgtcgctgcgctttccactccacagagcttgcagggatggggacctcgctacactctgcagcctgctgcagcaaaccccccacgcacatttggctagtgaggactccttttatggctggaccccagtccattgggccgcacatttcgggaagttggagtgcctcgttcagttggttagagccggtgcaactctgaatgtaagcaccacccggtatgcgcagacccctgctcacatcgccgctttcggtggccaccctcagtgccttgtgtggctcatccaggccggagctaatataaacaaaccggactgcgagggcgaaacgcccatccacaaagccgcacgctctgggagcttagagtgcatctcggccttagtggccaatggggctcacgtcgaattcatcagccagtcctccgtgcacagttgcctgccaggggagctgcagcacggggtgacatttgatccatccgtcctcatccagtgcctgaagcccgagaaatgccaatggcccgacagttcaaggcactgtacgaatcccggtttcccccgagtgtgccctgtctcactggaaccccctgagctcagctctgagccattcttatag

SEQ ID NO: 52978 - DNA, 1557 bp, Artificial Sequence
  Description of Artificial Sequence: Synthetic coding sequence
atggtccaactggtgctgcagtatagggactaccagcgagctacacagagacttgctggcatcccagagttactaaacaaactcagacaggcaccagatttctacgtggaaatgaagtgggaatttacctcttgggtgcccttggtcagcaaaatgtgtccatccgacgtttaccgggtgtggaaaagaggcgaaagcctgagagtagacacctccttgctcgggtttgagcatatgacatggcagaggggcagaagaagtttcatttttaagggccaggaagcaggcgctttggtcatggaagtcgaccacgaccggcaagtcgtgcatgtggagacactcggcctgactttgcaggaaccggaaaccctcctggcagctatgaggccgtctgaagagcacgtggcttccagactgacctcgcctattgtctcaacacacctggatacaagaaacgttgctttcgagcgtaataaatgcggaatctggggatggaggtcagaaaagatggaaactgtctcaggatacgaggctaaggtttacagcgccactaacgtggaactcgtgacccgtactcgcaccgagcaccttagcgaccaggacaagtcgcggtctaaggccggtaagacccccttccaaagtttccttggcatggcccagcagcattccagccatactggtgcccctgtgcaacaggccgcaagtcccacgaacccaactgcaatttcacctgaagaatatttcgaccccaatttttccctggaaagccgcaacatcggccgtcctattgagatgagctccaaggtgcagcgctttaaagcaaccctttggttgagcgaggaacaccccctgagcctcggtgaccaggtgactcccattatcgacctcatggctatttctaatgcccactttgcgaagctccgcgattttataaccctgaggttacctccaggatttcctgtaaaaatagaaatcccactgttccacgtactgaacgcacggatcacattttccaatctctgtgggtgtgatgagcccctcagtagtgtctgggtgccggctccctccagcgcagtggccgctagtggtaacccttttccctgcgaggtggatccgactgtctttgaagtccctaatggctactcagtgttgggcatggaacgcaacgaaccgctgcgggacgaggatgatgatctactgcaatttgccatccagcagagcttgttagaagctggcacggaggcagagcaggtaacagtatgggaagctcttactaacacccgccctggggctcggccaccaccgcaggcaactgtttacgaggagcagttgcagctggagcgcgcactccaggagtctctgcaattgtccacggagccaaggggacccggatcaccaccacggacccctcctgctcctgggccaccgtctttcgaggaacagctcagactagccctggaactgtcctcgcgtgagcaggaagagagagaacggagaggccagcaggaggaggaggatctccagcggatattgcagctttcactgacagagcattag

SEQ ID NO: 52979 - DNA, 1557 bp, Artificial Sequence
  Description of Artificial Sequence: Synthetic coding sequence
atggttcagctggtcttgcagtaccgggattaccaacgagcgacacagcgcttggccggtatccccgaattgctaaacaaactcagacaggctccagacttttacgtggagatgaagtgggagttcacatcctgggtgcccttagtaagtaagatgtgtccatccgatgtttaccgcgtctggaagcggggagagagcttacgagttgataccagcttactgggattcgaacatatgacatggcagcggggacgtcgatccttcatcttcaaggggcaagaggctggggctctcgtgatggaagttgatcatgacagacaggtggtacacgtcgaaacgctcggtctcacgctccaggaacctgagacactcctggccgcaatgcggccttccgaagagcacgtagcaagccgcttgaccagtcctattgtttctacccacttagataccagaaacgtggcattcgagagaaataaatgtgggatatgggggtggagaagtgaaaaaatggagaccgtgtctggatacgaggcaaaagtatatagcgcaaccaatgttgaactggtgactcgaacgcggaccgaacacctgtcagatcaggacaaatctcggtcgaaggcgggtaaaacgccgtttcagtcttttctcggtatggcccagcagcactcctcccatacgggtgctcctgtgcagcaggccgcttcaccaacaaatccaactgctatctcacctgaagagtattttgaccctaactttagcctagaaagcaggaacatcgggcgaccaatcgagatgtcttcaaaggtgcagcgatttaaggccacattatggctgagtgaagaacacccgctgtcgcttggagaccaggtgaccccaatcattgatctgatggccatatccaatgcccattttgcaaaactgagggactttatcaccctgcggttgccaccaggatttcctgtgaagatcgaaatcccactcttccatgtgctaaacgcacgaatcacctttagtaatctttgtggctgtgacgagcctctgtccagtgtctgggtgccagctccctcaagcgctgtcgcagcttccggtaacccgtttccctgcgaggtggatccaacagtgtttgaagtaccaaacggctactccgtgctcggtatggagcgcaacgagcctttacgtgacgaggacgacgatcttctacaattcgccatacaacagtccctgttagaagcgggaactgaggccgaacaggtgaccgtgtgggaagcactgaccaatacaagacccggagcccgaccaccgccacaggctactgtttacgaagagcaactccaactcgaacgagccctgcaagaaagtctgcaattgagcaccgaaccacgaggacctggatcgccccctcgtactccccctgctcccggaccccctagcttcgaagagcagttaagactggctctggagctgtcctccagagagcaggaggaaagagaaagacgtggccaacaagaagaagaagaccttcaacggattcttcagctgtcgttaactgaacactag

SEQ ID NO: 52980 - DNA, 1818 bp, Artificial Sequence
  Description of Artificial Sequence: Synthetic coding sequence
atggcgggtccgggtcctacattccctttgcatagactggtgtgggccaatcggcaccgggagctggaggccgctttgcactcccaccagcatgacatcgagcaggaagatccccgtgggagaactcctctcgagctcgccgtgagcctcggaaatctcgagtccgttcgtgtgctgttacgccataacgccaacgtcggaaaagagaatagacagggctgggcagtgctgcaagaggccgttagcaccggagaccctgagatggtgcagttagtgctgcagtaccgcgactaccaaagagccacgcaaagactggcaggcataccggaactgcttaacaagcttagacaggcacccgatttttatgtggaaatgaagtgggagttcacctcttgggtgcctctcgtctctaagatgtgtccttctgacgtttatcgcgtctggaaaaggggtgaatccctccgggttgacacttcacttctgggcttcgagcacatgacatggcaacggggtcgtcggtccttcattttcaagggtcaggaggccggagctctagtgatggaagtagatcacgatcggcaggtggttcatgtagagactctcggcttaaccctgcaagaacctgagacccttctggccgcaatgcggccaagtgaggagcatgtcgcgagccgactcaccagcccaattgtgagtactcatctggatactcgaaatgtcgcattcgagcgcaataaatgcggcatttggggttggcggagcgaaaagatggagacagtctcaggctatgaggcgaaggtatattccgctacaaatgtggaactggtgacccgaacaagaaccgagcacttgtctgaccaggacaaaagccgatccaaagctgggaaaacccctttccagtctttcctaggcatggcacagcagcattccagccatacgggggctcccgtgcaacaagctgcatcgccgactaacccaacggccatctcccccgaggagtattttgaccctaacttttctctcgaatctagaaacatcggcaggcctatcgaaatgtctagcaaggtccaacggttcaaggctacactttggttatctgaagagcatcccctgtccttgggagaccaagtgactcccattatcgacttgatggccatctcaaatgcacactttgccaagcttagggattttattacactgaggctgccaccaggattccccgtgaaaattgagatcccattattccacgtgctgaacgcaaggatcacctttagtaacttatgcggatgcgatgagccgctgagctccgtgtgggtccctgctccatcctccgccgtcgctgcaagcggcaacccctttccctgcgaggtggatccaactgtgtttgaagtgcctaacggttatagtgtactcggtatggagaggaacgagccactgcgcgacgaagatgacgatctgctgcagttcgctattcaacagtccctgttagaggctggaacagaagctgaacaggtgaccgtgtgggaagccctgacaaatacccgtcctggtgcgcgaccaccaccccaggccacagtctacgaagaacagctgcagctggagagggccttacaggagtctcttcagctaagtacagagcccaggggtcccggttcgccccctcgcacacccccagccccaggacccccatcttttgaggagcagttaaggctggcgttagagctgtcctctcgcgaacaggaagagcgtgaacgcagaggtcagcaagaggaagaggatttgcagcgaatccttcagctttctctcaccgagcactag

SEQ ID NO: 52981 - DNA, 1557 bp, Artificial Sequence
  Description of Artificial Sequence: Synthetic coding sequence
atggttcagctcgtactccaataccgggactaccagcgcgcaacccaaagactggcgggaattcccgagttgttgaataagctgcgccaggccccagacttttacgtggaaatgaagtgggaatttacaagctgggtgcctctcgttagtaaaatgtgcccctcagacgtatacagggtctggaaaagaggggagagcttgcgagtagatacgtccctattgggctttgaacacatgacgtggcaaagggggcgtcgctccttcatatttaagggacaagaagccggtgctctcgtgatggaagtggaccacgataggcaggtggtgcatgttgagacgctggggcttactcttcaagaaccagaaacgctgctcgccgcaatgcggccttcagaagagcacgtggcctcccgactcacgtcaccaatcgtgtccactcaccttgacacccggaatgtggccttcgagcgcaataagtgcgggatctggggctggagaagtgagaaaatggaaacagtgtcaggttatgaggctaaggtgtatagtgctacgaatgtggagcttgtgacaagaactcgcactgagcatttgagcgatcaggacaagtcccgaagtaaggcaggaaaaacaccattccagtcctttctgggcatggctcaacagcactcaagccacaccggcgcacctgtccaacaagctgcctcaccaacgaaccccacagcgatctccccagaggaatactttgatccaaacttctcattggaaagtagaaacatcggccgacctatcgaaatgtccagtaaagtccaaaggttcaaggctaccctgtggttatcagaggaacatcctctgtcactaggtgaccaggtgacccccattatagaccttatggctatctccaacgcacattttgctaagctgcgcgacttcatcacgctccggttaccaccaggtttccccgtgaagatcgaaattcccctcttccacgtgctgaacgccaggatcacatttagtaatttatgcggctgcgatgaacctctaagctcagtttgggttccggcaccaagctccgccgttgccgcatcaggcaatccctttccctgcgaggtcgaccccacggtgtttgaagtgccaaacgggtactcagtgcttggcatggagcggaatgaaccattacgggatgaagacgacgatctgctccaattcgctatccagcagtcactgctggaggctggaacagaggcagaacaggtgactgtttgggaagccctgactaacacgcggcctggtgctcggcctcctccacaagctacagtatacgaggaacaactccagctggagcgcgctctacaggaaagcctgcagctaagtacagaaccaagggggcctggctctccacccagaacaccaccagccccaggtcccccttcctttgaagaacagctccggctggccttagagctgtcatctcgcgagcaagaggagagggaacgaagggggcagcaggaggaagaagacttgcagcgaatcctccagctctcacttacagaacactag

SEQ ID NO: 52982 - DNA, 768 bp, Artificial Sequence
  Description of Artificial Sequence: Synthetic coding sequence
atgtcatgtggacggcttggcagattcaaagctacactgtggctctccgaggagcatcccctctcattgggcgaccaagtcactccgatcatcgacctgatggctatttctaatgctcattttgccaaactgcgagacttcatcactctgagattgccccctggctttccagtgaagatcgaaatccccctgtttcacgtgctgaacgcccgaattactttttctaacctgtgtggctgcgacgagcctttgtcctcagtgtgggtccccgcaccttcgagcgcagtggcggcttcagggaacccttttccctgcgaggtggacccgaccgtcttcgaagtccctaacggctattcagtgctcgggatggaaagaaatgagcccctgcgtgatgaggacgacgatctgttgcagttcgccatccaacaatcccttctggaagctggaactgaggcggaacaggtaacagtatgggaggccctgactaatacaaggcccggagctaggcccccaccccaagccaccgtatatgaagagcagcttcaactcgaaagagccttgcaagagtctctgcaactgtctaccgaaccgagaggccctggatcaccccctcgtaccccaccagctccaggtcctccctcgtttgaggaacagctgcgtctggccctagagctctctagccgtgaacaagaagagagagagcgcagaggccagcaggaggaagaggacttgcagaggattttacaactttcactcacggagcattag

SEQ ID NO: 52983 - DNA, 1011 bp, Artificial Sequence
  Description of Artificial Sequence: Synthetic coding sequence
atgaagcccaagtccagggaggttgagcgcagacttacgtcgcccgtgattaatacctcacttgatacgaagaatatcgcattcgaaaggactaaaagcggcttctggggttggcgcaccgacaaggcagaagttgtgaacggctatgaggctaaggtgtatacagtgaacaacgtgaacgtaattactaaaataagaacggagcatcttactgaggaggagaaaaaacgctacaaagataggaatcctcttgaatcccttcttggtacagtggaacaccagttcggagcacaaggggacctgaccaccgagtgtgcaaccgccaataatccaacagctattacgcccgacgagtatttcaatgaggagttcgatttgaaagaccgcgatatcgggaggcccaaagaattgacaatacggacccagaaattcaaggccatgctctggatgtgcgaggagtttccactgagcctggtggagcaggtgatcccaatcatcgatctgatggcccgtacatcggcccactttgcacggttacgtgactttataaagctggaattcccaccaggattcccagtcaagatcgcttcccacatcacaaacttcgaggtagatcagtctgtgtttgaaattcctgagagttactacgtgcaggataacggccgaaacgttcatctccaggacgaagattacgagattatgcagttcgctatccagcaaagcttactggagagctcccgatcccaggaactttctggtcctgcctctaatggtggaatcagccagacaaatacttatgacgcccagtatgagcgtgcaatccaggagtccttgctgacctctaccgaagggctatgccctagtgctctttcagagacctcacgttttgataatgacttacagctggcaatggagctgtccgctaaagagctggaggaatgggagctgagactgcaggaggaagaggccgagctccagcaggtgttgcagctttctctcaccgataaatag

SEQ ID NO: 52984 - DNA, 1773 bp, Artificial Sequence
  Description of Artificial Sequence: Synthetic coding sequence
atgagctcggcctgcgacgccggtgaccattatccactgcaccttctcgtgtggaaaaatgattataggcagttggaaaaagagctacaaggacagaacgtggaggccgtggacccccgagggcgtacattactccaccttgccgtgagccttgggcacttagaaagtgctcgggtgctgcttagacacaaagccgacgtgacaaaagagaaccgacagggctggacagttttgcatgaagctgtgtctacaggagaccctgagatggtctatacagttcttcagcatcgggattaccacaacacctcgatggcccttgaaggagtcccggagttactgcagaagatcctcgaggctcctgacttctacgtacagatgaagtgggagtttaccagttgggtgccattggtgagtcgcatctgtcccaatgatgtgtgtagaatttggaagtcaggagccaagctaagggtcgacatcaccctgctgggcttcgaaaacatgagttggattaggggacgtcgaagcttcatctttaagggggaggacaactgggcggagttgatggaggtcaaccacgacgataaagtagtgactaccgaacgctttgacttgagtcaggagatggagcgacttactctggaccttatgaagcctaagagtagagaagtggagcggaggttgacttccccagtgattaacacctcactggacactaaaaacattgcttttgagcggaccaagagcggtttctggggttggcgtacagacaaggccgaggtggtgaacggatatgaagcaaaggtgtatactgtcaacaacgtaaatgtgatcaccaaaataagaaccgagcacctcaccgaggaagaaaaaaaaagatacaaggccgaccgtaaccctctggagtctctacttggcacagtggaacaccaatttggggctcaaggcgatctgaccacagagtgcgctacggccaataaccctactgctattaccccggacgagtattttaacgaggaattcgatttgaaggaccgcgacattgggaggcctaaagagctgaccatcagaactcagaaattcaaagcaatgctttggatgtgcgaggaatttcccctttctctagtggaacaggtgatccccataatcgacctcatggcacgcacttccgctcacttcgcgaggctgagagacttcattaagctggagttcccgcctggcttcccagtcaagatagagatcccgctttttcacgtgcttaatgccagaatcacttttggcaacgtgaatgggtgctcaacagcggaggagagcgtctcccagaacgtggaaggtacccaggctgactccgcatctcacattactaacttcgaggtggatcaaagtgtatttgaaatacccgagagttattacgtccaggacaacggcaggaatgtgcacctgcaagatgaggactatgagatcatgcaattcgccatccagcagtctctcctcgagtccagtcgctcccaggaactttctgggcctgcatcgaacggcggaatctctcagacaaacacctacgacgctcagtatgaaagggctattcaagagagtttattaacaagcactgaagggttgtgcccatcagcactgtcagagacaagcagattcgacaatgacctccagcttgctatggaattgagcgctaaggaactggaggagtgggaactcagattgcaggaggaggaagccgaactgcagcaagtactgcaactatcactgactgacaaatag

SEQ ID NO: 52985 - DNA, 1881 bp, Artificial Sequence
  Description of Artificial Sequence: Synthetic coding sequence
atgatacccgctaatgcctcggccaggaaggggcctgagggcaaataccctctgcactatttggtgtggcacaaccggcatagggaactggaaaaagaggtacgcgcaggtcaggtagatatcgagcagttagacccgagaggtcgcactcccttgcaccttgcaaccacacttggacatttggaatgtgccagagtgctgctggcccacggcgcagacgtcggtagggagaatcgttcagggtggacagtattacaggaagcagtgagtacaagagacctggaattggtgcaattggtgctgcggtatcgggattatcagagagtcgttaaaagactcgcgggaatccccgttctgctcgagaagctcagaaaggcccaggatttctatgtggagatgaaatgggagtttactagttgggtgcccctcgtttcaaaaatttgcccttcagacacctacaaagtgtggaagtcggggcagaaccttagggtcgacaccacccttctgggcttcgaccacatgacttggcaacgaggcaatagatcttttgttttcaggggccaagacacaagcgcggtggtaatggaaattgatcacgacaggcgggttgtgtacaccgagactctggctctcgcagggcaagacagggagctcttattagctgcagcccagcctaccgaggaacaagttttgagtaggttgaccgcacccgtcgtgaccacgcaactcgacactaaaaatatttcttttgagcgcaataagacaggcatattggggtggcggtccgagaaaacagaaatggtgaatggatatgaggcgaaagtctacggcgcttctaatgtggaactcatcacacgaacgaggaccgaacatctgagtgagcaacacaagggaaaagtgaaagggtgtaaaacacctctccaaagttttctaggaatagcagaacagcacgggggaccacaaaatggcacactgatcactcagacactaagtcaggctaatcctaccgctattactgcggaagaatattttaaccccaactttgagctagggaaccgggatatggggagacctatggagctcaccacgaaaactcagaagtttaaggcgaaattatggctctgcgaagagcaccccctgtccctctgcgagcaagtggcacccatcatagacctaatggccgtgtccaacgccctctttgccaagcttagggattttatcaccctcaggctaccacccggattcccagttaagatcgagatccccattttccatattctgaatgccagaattaccttcggtaatctgaatggatgcgacgaacctgtcccttctgttcgcggatctccatccagtgagactccaagtcccggatccgactcaagttcagtgagctcttctagtagtactacctcctgccgtggatgtgagatctctcccgcactctttgaggcccctagaggctactccatgatggggggacagagggaagcagccactcgagacgatgacgacgacctcctccaattcgccatacagcagtctttactcgaggccggatccgaatacgatcaagtgactatttgggaggctttaacaaattcgaaaccaggaacgcaccctatgagttatgaggggagacgccaggacaggtccgcccctcccacaccacagcgccaaccggctccacccgcatccgtgccatctcccaggccaagctccgggcctggcagcggagggcacgtgttcagaagttatgatgagcagctccgcctggcaatggaactgagcgcgcaagagcaggaggaaagaaggcgccgagctaggcaggaggaagaagagttagaacgcatccttaggctcagccttacagagcagtag

SEQ ID NO: 52986 - DNA, 915 bp, Artificial Sequence
  Description of Artificial Sequence: Synthetic coding sequence
atggcccaacccggagatccaaggagactgtgccgtctggttcaggaaggtagactgcgggcactcaaggaagagttacaggcagctggaggttgtcccggaccggctggggataccttactacactgtgctgccagacatggccaccgagacgttcttgcctacctcgcagaagcgtggggcatggacatagaggctacaaacagagattataaaaggcccctgcacgaggcagcttcaatgggccatcgggactgcgtacgctacttgttgggcagaggcgctgccgtggattgcctaaaaaaggccgattggaccccattgatgatggcgtgtacccgcaagaacctgggggttatacaggagttggtagaacatggcgcaaacccactgttaaaaaacaaggatggatggaacagcttccacatcgcatcacgtgaaggcgatccactgatcttacagtacctgttgacggtgtgtcctggtgcctggaaaacggagtcaaagatacgcagaacgcccttgcatacagccgcaatgcatggccacctcgaagccgtgaaggtccttcttaaaagatgccaatacgagcccgattatcgggataactgtggagttactgccttgatggatgcgatacagtgcggtcatattgacgtggcccgtttgctcttggatgaacatggcgcttgtctctcagcagaggactctttaggagcgcaagccctccacagggctgcggtgaccgggcaggatgaggctattcggtttcttgttagcgaactgggcgtggacgtcgatgttagagccacctccacacatctgacggcactccattatgctgccaaaccctgcatctggcccgttcaggtcagcacgtggccagtaccctcatttagctgttcgagagactag

SEQ ID NO: 52987 - DNA, 1086 bp, Artificial Sequence
  Description of Artificial Sequence: Synthetic coding sequence
atggcacaacctggcgatccacgccgactgtgtcgcctagtacaggagggcaggctcagagcccttaaggaggagttgcaggccgcaggcggatgtccgggaccagcaggagacaccttactgcactgcgctgccagacacgggcatcgtgatgttctggcctatctggccgaggcatggggcatggatattgaggctactaatcgagactataagcgaccactccacgaagccgctagcatggggcatcgggattgtgtgcggtatctgctgggacggggtgctgctgtagactgtctgaagaaggcggattggacccctctgatgatggcatgcactaggaaaaacctgggcgttattcaagaacttgtggagcatggtgcaaaccccttgcttaaaaacaaggatggttggaacagcttccacattgcctcaagagagggggatcccctgatcctccaatacttgctgaccgtttgcccaggcgcatggaagacagagtcaaaaatacgtcgtacccctctgcacaccgccgcaatgcacggtcacctggaggcagtcaaggtcctcttaaagcgttgccagtatgaacccgattaccgggacaactgtggggtaacagctctgatggatgcgatccagtgtgggcacatagatgtggccaggttgctcctggatgaacacggggcatgtctcagcgctgaggatagcctgggagcccaagcattgcatcgggctgctgtaaccggccaagacgaggcgattagattcctggtatcagaactcggagttgatgtagacgtgagggcaacctctactcatctcaccgcactgcactacgcagctaaggaagggcatacctctaccatccagacattactgagcttaggggctgatataaattccaaggacgagaagaaccggagcgcccttcacttggcctgcgccggacagcacttggcatgcgccaaatttctgctccaatcaggtttgaaagattccgaagacatcactggtaccttggcccaacaactgcctcgacgcgcagacgtgctccagggaagcgggcattctgcaatgacctag

SEQ ID NO: 52988 - DNA, 1086 bp, Artificial Sequence
  Description of Artificial Sequence: Synthetic coding sequence
atggcccaacctggcgatccacgtcgactgtgccggctcgtgcaggaggggaggcttagggctctcaaagaagaattgcaggccgcagggggatgtcccggacccgcaggagacactctgctgcattgcgccgctcgacacgggcatagggatgtactagcatatctggccgaagcatggggaatggacatagaggccactaatcgagattacaagcggcctctgcacgaggctgcttcgatgggacaccgggattgtgtgcgttatctgctggggagaggcgcagccgtagactgtctgaaaaaagcggactggacccctcttatgatggcttgtactcgcaagaacctgggcgttattcaagagcttgtggagcacggtgctaacccactccttaagaataaagatggatggaacagtttccacatcgcttcccgcgagggcgacccattaatattacagtatctgttgactgtctgtcctggggcttggaaaacagaatcaaaaatcaggcggactccacttcacacagccgctatgcacggccatcttgaagcggtaaaagtactactcaaacgctgtcagtacgaacctgattaccgcgataattgtggggtgactgcgctcatggacgccattcagtgcggccatatagacgtagccagactgctgctggatgagcatggcgcatgcttgagtgctgaggacagcctgggcgctcaggcattacacagggctgctgtgacaggacaggatgaagcaattaggtttctagtctccgaattgggcgtggacgttgacgtacgtgctacaagcacccacttgaccgccctgcactatgcggctaaagaaggccacacttccactattcagacacttttatctctcggggcagacataaacagcaaagacgaaaagaaccggagtgcattgcacctggcctgtgccggacaacacctagcctgtgcgaaattcctcctccagagtggtttgaaggactcagaggatatcaccggtactctggcccagcagttgcccagacgagcagacgtattacagggctctgggcactccgccatgacatag

SEQ ID NO: 52989 - DNA, 618 bp, Artificial Sequence
  Description of Artificial Sequence: Synthetic coding sequence
atgaaaaccgcttatgaagaggtgaccactgagttggaggagtttaaagaagccttcgccggagcggtgaaagccaataattcgatgtctaagaaactgatgaaaagcgataaaaagatcgccgtcatttctaccaaactttttactgagaagcaacgcatgaaatatttcctctcgactctgcccacaaggcccgagcctgagttaccatgtgtggaaaatctgaatagtatagagctgaaccgtaaatatattcccaaaactgcaatcaggatccctacctctaatcctcaaacctcgaataactgtaaaaacttcctcacagagatggaactggaccgcgttgaacagataatcacaggcacaaagaagtcgttcgcgatgctatctacttgtagcaggctcctgagcttcgtagaatcaaccgcccctcgcaagcatcgcagagcattgcccatcatgcgatccctggtaccaaatcgtagaacgaccgtggcctctacagaatcccggaccaaccgccctggcggagtgcgaagcccaggactccagctggagggtactagcacccttcaatgggagcagggcccaattgcccacccccgacatcgctgttag

SEQ ID NO: 52990 - DNA, 654 bp, Artificial Sequence
  Description of Artificial Sequence: Synthetic coding sequence
atgaagaccgcctacgaggaggtgacaactgagctggaggagtttaaggaagcattcgccggagcagtgaaagccaataacagcatgagtaagaaattgatgaagagcgacaagaaaatcgctgtcataagtacaaaactttttactgagaagcagcgcatgaagtactttctcagtacactacctactcggccagagccagagctgccttgtgtcgagaaccttaattctatcgaactcaaccggaaatacatccctaagacagcaatccgcattcctacatctaacccacagactagcaacaattgtaagaactttctcactgagatggagcttgatcgggtggaacagattatcacggggaccaaaaagtcattcgctatgctgtcgacgtgttcccggctcctgagttttgtggaaagcaccgcccctagaaaacatcgcagagcactgcccatcatgaggtcattggttccaaatcgccgtacaacggtggctagcaccgagatgtctcaactgttgtacaaaggggtaccctttcaatcgagaactaataggcccggtggagtacgatcccctgggctgcagctggagggaaccagcacacttcaatgggagcaggggcctatcgcccatcccaggcacaggtgctag

SEQ ID NO: 52991 - DNA, 2979 bp, Artificial Sequence
  Description of Artificial Sequence: Synthetic coding sequence
atgagaaagcttttctccttcggccgacggcttgggcaggccctgctgtcgagcatggaccaagagtatgccggacccggttatgacatccgggactgggaactgcgcaaaatccacagggccgcaataaagggcgacgcggctgaggtcgagcggtgtctgactcgcaggtttcgggacctcgatgccagggatcgcaaggaccgcaccgtgctccatctggcgtgtgcgcatggcagggttcaggtggtcactttgctccttcaccggaggtgccaaatcgatatttgcgacaggctcaatcgtacaccccttatgaaagcagtccactctcaggaagaggcttgcgctatcgtacttctcgagtgcggagcaaacccgaacatagaggacatctatggcaacaccgcactgcattatgctgtgtataataagggcaccagcttagcggaacggctcctttcccaccatgctaatatcgaggcccttaataaggaagggaacactcccctcctgtttgccatcaattccagacggcagcacatggtggaattccttctgaaaaaccaggccaacatacatgctgtggacaatttcaagaggacagcactgatcctggcggttcagcacaaccttagcagtattgtgactttactgctgcagcagaacataaggataagcagtcaggatatgtttggccaaactgccgaagactacgcactgtgctccgatctgcgctcaatcagacagcagattctggagcacaaaaataagatgttgaagaaccacttaaggaatgacaatcaggagaccgcagccatgaagcccgcaaatcttaagaaacggaaagaacgcgctaaagctgagcataacctgaaggtcgcttccgaagagaagcaggagagattacagagatcagagaacaaacaaccccaagatagccaatcctatggtaagaagaaggatgccatgtatggtaactttatgctgaaaaaagacattgctatgcttaaggaggaactatacgccattaagaatgacagcttgaggaaagaaaaaaaatatatccaggagatcaagagcataacagagatcaatgctaatttcgagaaatcagtaagattaaatgagaagatgatcactaagaccgtcgcccgatattcccagcaactcaatgatctgaaagcggagaacgcacgcctgaatagtgaactcgagaaggagaagcacaataaggagagactggaagccgaagtggagtcactgcattcctcccttgccacagctattaacgagtataacgagatcgtggagcggaaggacctagagctggtgttatggcgggcagacgatgtgtctcggcacgaaaagatgggatcaaacatatctcagcttacagacaagaacgagctgttgacagaacaggtgcacaaagccagagtcaagtttaatacgctgaagggtaaactcagggaaacgagggacgctctgcgtgaaaaaaccctggccctgggaagtgtgcagcttgatttacgccaagcacagcacagaatcaaggaaatgaagcagatgcatccaaacggcgaagccaaagagagtcagagcatcgggaagcagaactcactggaggaaaggataagacaacaagaattggagaacttgctgcttgaaagacaacttgaagacgctaggaaggagggcgacaataaggagatcgtgattaacatacaccgagattgcctcgaaaacggtaaagaggatctgttggaagaacgaaacaaggagcttatgaaagaatataactatttaaaggagaagttgctgcagtgtgagaaggaaaaagcagagagagaagtgatcgtgcgggagtttcaggaggagctggtggaccacctcaagacgttctctatctccgaatcgcctctggaggggacctcacattgccacatcaacctgaatgaaacctggacatcaaagaaaaaactgttccaggtcgagatccaacccgaagaaaagcacgaggaattccgcaagttgttcgaactaatctccctccttaactacactgctgaccaaattcggaagaaaaaccgggaactcgaggaagaagccacaggttacaagaaatgcctggaaatgaccatcaacatgctgaacgcctttgccaacgaggacttttcctgccacggcgacctgaataccgatcagctgaagatggacatcctctttaagaagctcaagcagaagtttaacgatctcgtggcagaaaaggaggctgtctcatccgagtgcgtgaatctggccaaagataacgaagtactgcaccaggagctgctgtcaatgagaaacgtgcaagagaagtgtgagaagctagaaaaggacaaaaaaatgcttgaggaggaagtcctgaatttaaaaacccacatggagaaagatatggtggagctcggtaagttgcaggagtataagtcggagttggacgaaagagctgtgcaggagattgaaaagctggaagagatccatctgcaaaagcaggccgagtatgaaaaacaacttgaacagctcaacaaggataacaccgcctctttaaaaaagaaggagctgactttgaaagacgtggaatgtaaatttagcaagatgaaaacagcctatgaggaagttacaaccgagctagaggaatttaaggaagccttcgcaggagctgtgaaggccaataacagcatgagcaagaaactcatgaagtccgacaagaagatcgcggtgatatcgacgaagctctttacggagaagcagcggatgaaatattttttatctaccctcccaacaagaccagagccagagttaccgtgtgttgagaacctaaactctatcgaattgaatcgaaaatatatccccaaaaccgcaattaggatacctaccagcaacccccagacatcaaataattgtaaaaatttcctaactgaggtcctgctctgttag

SEQ ID NO: 52992 - DNA, 3036 bp, Artificial Sequence
  Description of Artificial Sequence: Synthetic coding sequence
atgcggaaacttctgtcattcggaaggcggctgggccaagcgctgctgagtagtatggaccaggagtacgccggaagaggctaccacatccgggattgggagctcaggaagattcatcgtgccgcaattaaaggggatgcagctgaggtcgaacactgcctcactaggcggtttagagatcttgacgtacgcgaccgtaaagatcgcaccgtgctgcatctggcttgcgcacatggcagagtgcaggtggtgacccttctcctggatcgcaaatgtcagatcaacatctgcgaccgcctcaatcgtacgcccttgatgaaagcagtccattgtcaagaggaggcatgcgccatcattcttctcaaaagaggggctaacccgaacatcaaggacatctatggcaataccgccctgcattacgccgtgtataacgaaggtacctctctcgccgagcgccttctgagccatcacgctaacatcgaagctctcaataaggagggaaataccccgcttctgttcgcaatcaacagccgaagacagcacatggtagaatttctcctgaagaaccaagctaacatccacgcagtcgataatttcaagcggacggcccttatattggccgtgcagcacaatctcagctccatcgtgactctcctgctccagcagaacattcacatcagttctcaggatatgtttgggcaaacagcagaagactacgccttttgctgcgatttgcggtccattcaacagcagatattagaacataaaaataagatgctgaaaaatcacctgcgcaacgataaccaggaaacggccgctatgaagccagagaacctgaagaaacgcaaaaagcgcaagaaattaaaaaagaggaaagagggtgctaaggcagagcataatctcaaagtggcctcagaggaaaaacaggagcggctcgaacgatcggaaaacaagcaaccacaggatagccaaagttacggaaaaaaaaaagacgagatgttcggcaatttcatgctgaagagggatatcgcgatgttgaaggaagagctgtacgcgattaagaacgactcactgagaaaagagaaaaaatacattcaggaaattaaaagtattactgagatcaacgctaactttgagaagtccgtgcggttaaacgaggagatgattaccaaaaaggtcgcccagtattcccagcagttgaacgatctgaaggcagagaacgcgagattgaactccaagctggagaaagagaagcacaacaaggaaagactagaggccgaggtagaaagcttgcattctaatttggccactgccattaatgagtacaatgagattttagagcgcaaggacttggaacttgtcctctggagagctgatgacgtatcaaggcatgagacaatgggatctaacatctcccagttaaccgacaagaacgagctcctcacagaacaagtccacaaggcacgagtgaaattcaacaccctaaagggcaaactgcgggagactagggatgcactccgggagaaaacactagcacttgagtccgtgcaactcgacctgaagcaggcccagcaccgaattaaggaaatgaaacagatgcatccgaacggtgaagccaaagagagtcagtctatagggaaacaaaattcctcagaagaacgtattagacagcgcgagcttgagaaccttctgcttgaacggcagctggaagatgccagaaaagagggggataataaagaaatcgtcatcaacattcaccgagattgcctggaaaatggcaaagaggatcttctggaagagcgcaataaggagttgatgaatgaatataattacttgaaagagaagctgttacaatatgaaaaagagaaggctgaacgcgaagtgattgtgcgggagttccaagaagaattagttgatcacctgaagaagtttagtatgtccgaatcgccgctcgaggggacctcacattgtcatattaatctggacgaaacatggactagcaagaaaaaattattccaagtggaaatacagcctgaagaaaaacacgaggaatttaggaaggttttcgaactgatttcactactgaattatacggctgaccagatcaggaagaagaaccgcgaactggaagaggaggccaccggctacaagaaatgcttggaaatgacaattaatatgcttaatgcatttgctaatgaagatttctcctgtcatggagacctgaataccgaccagctgaagatggatatcctgtttaagaagctgaagcagaagtttgacgatctgatggcagaaaaagaggcggtgtccagcaaatgtgtgaacttagctaaagacaatgaagtgctccaccaagaactgctatccatgggaaaggtgcaggaaaaatgcgaaaaattggagaaggacaaaaaaatgctagaagagaaggttctgaacctgaagacgcatatggagaaggacatggtggaactgggcaaggttcaggaatataagtcagagctggatgaacgcgcaatgcaggcgatagagaagctggaggaaatccatctgcagaaacaggccgaatatgagaagcaactggaacaacttaataaagataacaccgcgtcattgaagaaaaaggagctcactctcaaagatgttgaatgcaaattttcaaagatgaaaacggcctacgaggacgtcaccacagagctagaggaatacaaggaagctttcgctgtggccttgaaggcaaacagcagtatgagtgaaaaaataaccaagtccgacaagaaaatcgctgtgatttctactaaactgtttatggagaaagaaaggatggagtacttcctctctacgctgccgatgagaccggatcctgagttaccatgcgtggagaacctcaacagcatcgaactcaatcgcaagtatataccgaagatggcaattcgcatcccaacttccaatccacagactagtaataactgcaaaaatagtttgacagagctcctgcttagatgggctttggccccaatttactttctcctctag

SEQ ID NO: 52993 - DNA, 1206 bp, Artificial Sequence
  Description of Artificial Sequence: Synthetic coding sequence
gagaaagaaaaagcagagcgcgaagtgatcgtaagggagtttcaggaggagctcgttgaccatctgaagaagttttcgatgtcagagagccccctcgaggggacatcccattgtcacataaaccttgatgagacctggacatccaagaaaaagctgttccaggtcgagatccagccggaagagaagcatgaagaattcaggaaggtctttgagctgatcagcttgctaaactacaccgccgatcagatccggaaaaagaaccgagagctcgaggaagaagcaaccgggtataagaaatgtctggagatgacgataaacatgttgaatgctttcgccaacgaagatttttcatgccacggtgacttgaataccgaccaactgaagatggacattttatttaaaaagctaaaacagaaattcgatgacctcatggccgaaaaagaagctgtctctagcaaatgcgttaatctcgccaaagataacgaagtactgcaccaagaacttctgtccatggggaaagtgcaggagaaatgtgagaagcttgaaaaggacaagaaaatgctcgaggagaaggtacttaatctgaagacgcacatggaaaaggatatggtggagctggggaaagtgcaggagtataaatccgaactggacgagagggccatgcaagccatagagaagttggaagaaattcatcttcagaaacaggccgaatacgagaaacagctggaacagctcaacaaggataatacagccagcctaaaaaaaaaagagctcacccttaaagacgtcgaatgcaagttctctaagatgaagaccgcgtacgaagatgtcacgacggagctggaggagtacaaggaggcctttgcagtcgctttaaaagcaaatagctccatgtcggagaaaattacgaaaagtgacaaaaaaatagcagtaataagtaccaagttgttcatggagaaggaaaggatggaatatttcctgtcaaccttgcctatgaggcctgacccagaactcccttgtgtggagaacttgaattctattgagcttaatcggaaatacattccgaagatggcgatccggatccctacgagtaatccccagacctccaataactgcaaaaactccctgactgagatggaactggattgtgcagaacaaattatcactgagacgaagaagagtatgctgcccaagtgtataaattag

SEQ ID NO: 52994 - DNA, 2472 bp, Artificial Sequence
  Description of Artificial Sequence: Synthetic coding sequence
atgaaactttttggctttggctctcggaggggccagactgctcagggatccatcgatcacgtgtatacgggtagcgggtacaggatcagggattcagaactacagaaaatacatcgggcagctgtcaaaggtgacgctgccgaagtggagaggtgtctggcacggcgaagcggggatttggacgccctggacaaacaacataggacggctctgcatctggcttgcgccagcggtcatgttcaggtggtcactcttttggttaatcgcaagtgccagatcgatgtgtgtgataaggaaaatcggaccccactgattcaggctgtgcattgtcaggaggaagcctgtgccgtgatcttgcttgagcacggagccaaccccaatctgaaggatatatacggaaacaccgcattgcactatgccgtctattcggagagtacgtccctggctgaaaaactactttctcatggcgctcatatagaggcccttgacaaagataataacactcctctgctctttgcaatcatatgtaagaaagaaaagatggttgagttccttctgaagagaaaggcctctagtcatgccgtagaccgccttcgcagatcagcactgatgctggcggtgtactatgattcccccggaatagtgaacattcttctcaagcagaatatcgatgtttttgcccaggacatgtgtgggagggatgcagaggattacgctatctcccatcaccttacaaaaattcagcagcaaattctagagcataagaagaagatcctcaaaaaggagaaaagtgacgtggggagctcggacgagtctgctgtttcaatattccatgagctacgtgttgattcgctgccagcttccgacgacaaagatctcaacgtcgctacaaagcagtgcgttcctgaaaaggtgagcgagcctctgcccggatcatcgcatgagaagggcaaccgaatcgtgaacggccaaggagagggtccccctgctaagcacccctcactgaaaccatccaccgaggtggaagaccctgccgtaaaaggagctgtgcagcgcaagaacgtgcaaactcttcgtgccgagcaggccctgccggtggccagcgaagaagagcaggaaaggcacgagagatctgagaaaaagcaaccccaagtcaaagaagggaataacactaataagtctgagaaaattcagctgtccgaaaacatctgcgattcgacgtcctctgccgctgccggacgactgacgcaacagcggaagatcggaaagacctatccgcaacagtttccgaagaagttaaaagaagaacacgacaggtgcactctaaaacaggagaatgaagagaagactaatgtcaacatgctatataagaaaaaccgagaagagttggaacggaaggagaagcagtacaaaaaagaggtcgaggctaaacagttggaaccgactgtccagagtctcgagatgaagtccaagaccgcccgaaataccccaaaccgagactttcacaatcacgaagagatgaaaggccttatggatgaaaactgcattctgaaagccgacatcgccatactgcggcaggagatttgcactatgaagaacgacaacttagaaaaagagaacaaatacttaaaagatatcaagatcgttaaagaaaccaatgctgctttagaaaagtatataaaactcaacgaggagatgattaccgagactgcatttcgctatcagcaggaactgaacgacttgaaggctgaaaacactagactgaatgccgagctgctgaaggaaaaagaaagtaagaaaagactcgaggccgacatagaaagctaccagtctaggcttgcagcggcaatctcaaagcactcggagtcagtaaagacggaacgcaatcttaagttagccctcgagcgcacgagggacgtcagtgtgcaggtcgaaatgtcttctgccatctcgaaggtaaaggacgagaatgaatttcttacggagcagttgagcgaaactcaaatcaaattcaatgccctcaaggacaagttccggaagacacgcgatagcctcagaaagaaaagcctggctctggaaactgtacagaatgacctcagtcaaacacagcagcagacccaggaaatgaaggagatgtaccaaaacgcggaagcaaaagtgaataacagcaccggcaagtggaactgcgttgaggagcgcatttgtcaccttcaacgcgaaaatgcctggttagtccagcagctagacgacgtgcaccaaaaggaggatcacaaggaaatcgtgacgaacatacaacggggatttattgagtctggtaaaaaggatctcgttcttgaagaaaaatctaagaagctcatgaatgagtgtgatcacctcaaagagtcactgttccagtatgagagagaaaaaactgaaggggtcgtgtctataaaggaggataagtattttcagacatcacggaagaagatatag

SEQ ID NO: 52995 - DNA, 2472 bp, Artificial Sequence
  Description of Artificial Sequence: Synthetic coding sequence
atgaaactgtttggtttcggaagcaggaggggccaaaccgctcaaggcagcatcgaccacgtttatactgggagcggctatcgaattagggactctgaactccaaaagattcaccgggcagccgtcaagggagatgccgctgaggttgagcgctgtctcgcacgcagatctggcgatctggatgccctcgataaacagcacagaacagccctacacctggcttgcgccagtggccacgtccaggtggtaactttactggtaaaccgcaaatgtcaaatcgacgtctgcgacaaagaaaaccggactcccctcatccaagccgtgcactgtcaggaggaggcatgcgcggtgatcttgctcgagcacggcgcaaatcctaacctgaaagatatctatggaaatacggctctacactatgctgtgtattctgagtccacctccctggcagaaaagttactgtctcacggagcccacatcgaggccttagacaaggataacaacacgcctctcttgtttgctatcatttgtaaaaaagagaaaatggtggagttcctgctaaaacgcaaggctagctcccatgccgtcgacagactgaggagatccgctctaatgctcgccgtgtactacgactcacccggtatagtaaatatcctgttaaaacagaacattgacgtctttgctcaggatatgtgcggcagggatgcagaggactacgcaatatcacaccacctgaccaaaatccagcagcagattctggagcacaagaaaaagattctgaagaaggaaaagagcgacgttggctcatctgatgaaagcgcggtcagcatctttcatgaactcagggtggattctctgcccgcaagcgacgacaaagatctcaatgtggcaacaaagcagtgcgtccccgagaaggtgtccgagccactgccaggctcttctcatgaaaagggtaaccgaatagtcaacggacagggagagggcccacctgctaagcatccctcgctgaagccatcgaccgaggtcgaggacccagctgtgaagggggctgtacaaaggaagaacgtacaaacactcagggctgagcaagccctccccgttgccagcgaggaagagcaggagcggcatgagaggtctgagaaaaagcagccccaggtcaaagagggtaataatacgaataagtccgaaaagatccagctaagcgagaacatatgcgacagcacgtcaagtgcagctgctggcaggctcacccagcagcggaagattggtaagacttatccccagcagtttccgaaaaaactcaaagaggagcacgatagatgcacactgaaacaggaaaatgaagagaaaaccaacgtgaacatgctgtataagaagaatagagaggagcttgaacggaaagagaagcaatacaaaaaggaggtggaggcgaagcagctcgagcccaccgtgcaatcgctggagatgaagagcaaaactgctagaaacaccccaaatagggatttccacaatcatgaagaaatgaaaggtcttatggacgaaaactgtatactcaaagccgacatcgccatacttcgccaggaaatttgcactatgaaaaacgacaacctggaaaaggagaataaatatctcaaagatattaagatagtgaaggagacaaatgccgcactcgaaaagtacataaaactcaacgaagaaatgatcacagaaacagcatttcggtatcagcaggagttgaattacctgaaagccgaaaatacccgattaaatgctgagctgctgaaagaaaaagagagtaaaaaacggctggaggcagacattgagtcatatcaatcaagactggctgccgctatttcaaagcacagtgaaagcgtgaagactgagagaaaccttaagttggcattagaaagaacgagggatgtgagcgtgcaagttgagatgtcctccgcaatatccaaggttaaggacgagaatgaattcctgactgaacaactcagcgaaacgcagatcaaattcaatgctttaaaggacaaattccgtaagacccgcgattccttgaggaagaaatcattagcactcgaaaccgtgcagaatgatttgagccagactcaacaacagacacaggagatgaaagagatgtatcagaatgctgaggctaaggtcaacaacagtaccggcaaatggaattgcgtggaagagagaatttgtcatcttcaaagggaaaatgcttggctggttcagcaactggatgatgtacaccagaaagaggatcataaagagatcgtcacaaacattcagcgaggattcattgaatcaggcaagaaggacctggttctggaagagaaatcgaaaaagctcatgaacgagtgtgaccacctaaaggaatccctgttccagtatgagagggaaaagactgagggggtggtctctattaaggaagataaatacttccagactagcaggaaaaccatttag

SEQ ID NO: 52996 - DNA, 2472 bp, Artificial Sequence
  Description of Artificial Sequence: Synthetic coding sequence
atgaaactgttcggcttcggctcacgaaggggccaaacagcacaggggtccatagatcacgtctacaccggttcgggctaccgcatccgggacagtgagctgcaaaagattcaccgggctgcagtgaagggcgatgctgcagaggtggagcgatgcctggccaggcgctcaggagagctggacgctcttgataaacagcatagaactgccctacacctggcgtgcgcctccggccacgtccaggtggtgactctgctcgtgaaccggaagtgccagatcgatgtatgcgacaaagagaatcgcactcccctcattcaggcagtgcactgtcaagaggaagcttgtgccgtgatcctgctggaacacggggcaaatcccaacctgaaggacatttatgggaacaccgcactgcattacgcagtttattcagagtctacctccctggccgagaaattattgagccacggtgctcatatcgaagcgctcgacaaggacaacaatacacctctactctttgccataatttgcaaaaaggagaagatggttgagttcttgctgaagaagaaagcttcaagccatgctgtagataggctccggcgatccgcgcttatgctcgcagtgtactacgattcgccagggatagtgaacattctattgaagcagaatattgacgtgtttgcccaggacatgtgcgggagagatgccgaggactacgcaattagccatcatctgaccaagattcaacagcaaatcctggaacacaagaaaaagatcctcaagaaggagaaatccgatgttggctccagcgacgagagtgccgtgagtatctttcatgagttgcgcgtggactccctgcccgcaagcgacgataaagacctcaacgtggcaactaagcaatgcgtgcccgagaaagtgtcggagcctttgcccggatcatcacacgagaagggcaatcggattgtgaatggacagggagaaggccctcctgcaaaacacccttcattgaagccaagcaccgaggtcgaagatcctgccgttaaaggggcagtgcaacgcaaaaacgtacagactctgagagccgaacaggcactgcccgtggcctcagaagaagagcagcagagacatgaaagatcagaaaagaagcagccccaagtgaaggaaggcaacaacacaaataagtccgaaaagatccagctgtcagagaatatatgcgatagcacctcctccgccgcagctggcaggcttacacaacagaggaagatcggcaaaacatacccccagcaattccccaaaaagctcaaggaggagcatgaccggtgtaccctcaaacaagaaaacgaggagaagacaaacgtcaatatgctgtacaaaaagaaccgggaggagttggaacgtaaggagaagcagtacaaaaaggaggtggaggctaagcaacttgagccaacagttcaaagcctagaaatgaagagcaaaaccgcgaggaatacgcccaactgggactttcacaaccatgaggagatgaaaggactgatggacgagaattgcattttgaaagctgacattgccatcctgcgccaggagatctgtaccatgaagaacgacaacttagagaaggagaacaaatacctaaaagatataaagattgttaaggaaacaaatgccgctttagaaaagtacatcaaacttaacgaggagatgataactgagactgctttcagatatcagcaggaactgaatgatctgaaggccgagaacacccgtcttaatgccgagctgctgaaggagaaggagagcaaaaagaggctggaggccgacatagaatcataccaatcacgtctcgccgctgccatttcaaagcattccgagtccgttaaaacagaacggaatctgaaactggcactggagagaacgcaggacgtttctgtgcaggtggagatgtccagcgccatatcgaaagtcaaggatgagaacgagtttctaactgaacagctgagcgagacccaaatcaagttcaatgccctgaaggataagtttaggaaaacgagggatagtctacgcaagaagtctttggcactggaaacagtgcagaacaatctctctcagacacagcaacagacacaggaaatgaaggagatgtatcagaacgccgaagcaaaagtgaacaactctaccgggaagtggaactgtgtagaggaacgtatctgtcacttgcagcgtgagaacgcctggcttgtgcaacagctcgacgacgtgcaccagaaagaggaccacaaggaaatcgtgacaaatattcagcggggattcatcgagagcggcaagaaggattttgtcctggaggaaaaaagtaagaagttgatgaatgagtgtgaccaccttaaagaatccctgttccagtacgagcgcgaaaaaaccgaggtagtcgtgagcattaaagaagacaagtactttcagacctctcggaagaagatctag

SEQ ID NO: 52997 - DNA, 576 bp, Artificial Sequence
  Description of Artificial Sequence: Synthetic coding sequence
atgggcattctgtatagcgagccaatctgccaagctgcctatcagaatgatttcgggcaggtatggcgctgggtgaaggaggactcctcatatgctaatgtgcaggatggctttaacggagacactcctctcatctgcgcctgtcgccgtggccatgtacggatcgtgtcttttctgctgaggcggaatgccaacgtgaatcttaaaaaccagaaagagcgcacttgtctgcactatgctgtgaagaagaagtttacgtttattgattatctgcttataattcttctaatgcccgtgctgcttatcgggtatttcctgatggtatccaagaccaagcagaacgaagccttagttcgcatgctgctagacgcaggcgtcgaagtaaatgcgactgactgctatggctgcaccgctctgcattatgcttgtgaaatgaagaaccagtcactaatacctcttttgctggaggccagggctgacccaaccatcaagaataagcatggtgagagcagtttggacatcgccagacgactgaagttttctcagatagaactgatgctgagaaaagctttgtag

SEQ ID NO: 52998 - DNA, 3711 bp, Artificial Sequence
  Description of Artificial Sequence: Synthetic coding sequence
atgcagcctgccgcttgtgccggagaaggagctgggcctccggctccaagacctccacatcccccaggggacaaggttagaagaggccgtggcggagcaccatcactctccccacagcccccagccccttacctaggcctccccattcccagcagaggaggtggcggatggcggggaggccagggaggagggggtgggacccgtgaggggggaacaggcagagccggaggcgctggcagttccggttcagctcaaccgaggccacctgccgctccaaggggcccaagccggcctagcggcagacggctgctcctcgagcctcgggctcccccagcacctcgtgcacccgacgcgatgaaacagctctgtctttgtgcagccgctagtttcgcttctcaggactggggcaaaagcgatgagcgcctgctgcaggctgtggagaataacgacgctccccgagtggccgctttgattgccagaaaagggctcgttcctaccaaactggacccagaaggcaagagtgccttccatctcgccgcaatgcggggagccgcatcctgccttgaggtaatgatagcacacggttccaacgtgatgtcagctgacggcgctgggtataatgcgctgcacctggcagcgaagtacggacacccacaatgtcttaaacagttgctccaggcgtcgtgtgtggtagatgtggtggatagtagcggctggacagcgcttcaccatgccgctgcaggcggttgtctgtcatgttctgaagtcctttgttcattcaaagcccacctgaacccacaggaccggagtggggctaccccacttatcattgccgctcaaatgtgccacactgacttgtgtcgtttactgctacagcaaggggctgcagccaacgatcaagacctccagggtcggaccgcactgatgttagcttgtgaaggtgcctcccctgaaactgtcgaggtcctgttgcaggggggagctcaaccaggcattaccgatgcgctcggacaggacgccgctcattatggagcactggctggagataagctgatactgcacctgctgcaggaggcggctcagcgcccttctccccctagtgccctgacagaagacgattccggggaagcgtctagccaaaattcaatgagttcacacggaaagcagggagcgccaaaaaagagaaaagctccaccccctcctgcctctatcccaatgcccgatgaccgtgacgcatacgaagagattgtgaggcttagacaggagcgcggaagattgttacaaaagatccgtgggctggaacagcacaaggagagacggcagcaggaatccccggaagcaagctctctccacattttagaacggcaagttcaggaacttcaacaactcctggttgagcgccaggaggagaaagagtcgctgggcagagaggtggagtccctgcagtcccgtctgtcactgcttgaaaacgagagagaaaacacctcttatgatgtgacaaccttacaggacgaagaaggagaattgccagacctgcccggtgccgaagtgttactgagccgtcaactgagtccctccgcccaagagcacctggccagtctgcaggagcaggtggctgtgctgaccaggcagaaccaggagcttatggaaaaggttcaaatactggagaactttgagaaagacgagacccagatggaggtagaggctctcgctgaggtgatcccgctagccctttatgactctctgagagccgagtttgatcagctgagaaggcagcacgctgaagccttgcaggccctgaggcagcaggagacgagagaggtccctagggaagagggtgccgcatgcggggagtctgaggtcgccggagctactgccactaaaaatggcccaacgcacatggagctgaacggatccgtggcccctgagaccaaggtaaatggcgctgagaccatcgacgaagaagccgcaggcgatgaaacaatggaggccagaacgatggaggctgaagctactggagcagaggctacaggggcagaggctaccggtgcaaaggtgactgagactaagcctacaggggcagaagtgcgggagatggagacaactgaagaggaagccaatatggagactaagcccacaggggctcaggcaacggatacggaaactacgggagtagaggccatgggggttgaggccacaaaaaccaaggctgaagaggctgagatgcaggcctacggtgtgggagctggccaggcagagccgcctgtgaccgggaccactaacatggaggctaccggttcaagagccactggcatggagtcaactggcgtgtcggctaccggggtggagaaccccggagtggaggcgacagtgcccggaatatcagcgggtccaatactgcaccccggagccgcagaggctagcgaaaaactacaggtagagctggagacgaggatccggggactggaggaggcgctgagacagagagagagggaagctgccgctgagctggaagccgctctcggcaagtgcgaagccgcagaggccgaggccggacggttgcgcgaaagagtgcgcgaagccgaagggagtggagcctcgggcggtgggggaggggatacaactcagcttcgggctgcactggagcaagcgagagaggaccttcgggatcgcgactctagactccgggagctcgaggccgcatccgcatgcctggatgaggcgagggcaagtagactcctcgctgaagaggaggccaggggtctgagggcagaactggcccaaagagaagaagctagactggagcagagtagggagcttgaggtactgcgagagcagctcgccaccgctcgcgctaccggcgaacagcaaaggactgctgcagcggagttgggacgcgcaagagacgccgctgaggctcgggtggccgagcttcccgctgcctgtgaggaagctcgccagggcctcgccgaactcagagaggcctctgaagctctccggcaaagcgtcgtacccgcttcagagcaccgcagactccaggaggaggcgctggagctgcggggacgggctgcgagcctggagcaggaagttgtggccactggcaaggaagcagccaggctgcgtgccgaactcgagcgggagcgggtctgtagcgttgccctatccgaacacgagcggattgtgggcacactgcaggcaaatgtggcccaactagagggtcagctggaggagcttgggaggagacacgaaaagaccagcgccgaggtttttcaggtccagagggaggccctgtttatgaagtccgaacgccatgccgctgaggcccagctggccaccgcagaacaacaactgcgaggactccgtactgaggctgaacgagctcgtcaggcccagagtagggcccaagaagctttggataaagctaaagagaaagataagaagattaccgaactgagcaaggaagtgtttaatctaaaggaagcactgaaagaacaacctgccgctttggcgaccccagaggtggaggctttgagggaccaagtcaaggatttgcaacagcagctgcaggaggccgctcgggaccacagttccgtcgtggccctgtataggagccacctgctgtatgctatccagggtcagatggatgaagatgtgcagcgaatactttctcagatactgcagatgcagcgactccaagctcagggcaggtag

SEQ ID NO: 52999 - DNA, 3441 bp, Artificial Sequence
  Description of Artificial Sequence: Synthetic coding sequence
atgaagacactgcgagcccgttttaagaagactgagctgcggctttcccctactgacctcggctcctgccccccatgtggaccgtgtccaattcctaaaccagccgctagggggaggcgccaatctcaggattggggtaaatctgacgagaggctgttgcaggctgttgagaataatgacgctcctcgagtggctgcgcttattgctaggaagggccttgtcccaacaaagttagatccggagggaaagtctgccttccacctcgccgctatgaggggtgccgcatcctgcttagaggtgatgattgcccacggctcaaacgttatgagcgcagacggagccggatataacgccttacacctggccgctaagtatggacaccctcagtgcctcaaacaacttctgcaggcctcctgtgtggtggacgtggtagattcctctggctggaccgctctgcaccatgctgccgctggaggttgcttgtcctgcagtgaagtgctgtgctctttcaaagctcacctgaatcctcaggaccggtctggggcaacgccgttgatcattgcggctcagatgtgtcatactgacctgtgcaggttattgctgcagcagggcgctgcagcaaacgatcaggaccttcaaggtcgcacagcccttatgctggcttgcgagggagcatcaccagaaaccgtggaggtgttgctgcaaggaggggctcagcccggtattacagatgcattaggccaggacgccgctcactacggagcgctggctggagacaaactgattttgcaccttctccaggaggcggctcagcgcccatcccctccaagcgctctcacagaagacgactctggtgaagcttccagccagaatagcatgtcatctcatgggaaacagggggctcctaaaaagcgaaaggcccctcccccacccgcatccattcccatgcccgacgaccgagatgcctacgaagaaatcgtgcgcctgcgccaagaaagaggaagattgctgcagaaaattagaggactggaacaacataaggaacgacgccagcaggagtccccggaggcatcctcattacatatcctggagcggcaggtgcaagaattgcaacagttactggtggagagacaggaggaaaaagaaagcctcggacgggaagtcgagagtcttcagtcaagactgagtctcctagaaaatgagcgagagaacactagctatgacgtcactacccttcaggacgaggaaggcgagcttccagatttgcctggagccgaggtgctgctgtcccgccaactcagcccctctgctcaggagcatcttgcatccctccaggaacaggtggcggtgctgacaagacaaaaccaggaactgatggaaaaggtacagatcctggagaacttcgaaaaagacgagactcagatggaggttgaagcattggccgaggtgattccattagccctgtacgattcactacgtgccgagtttgatcaattgaggaggcagcacgccgaagctctgcaagcccttcgccaacaggaaacccgagaagtgccacgagaggagggtgcagcctgcggagaaagcgaagtagccggtgccaccgccactaagaacggccctacccatatggagcttaatggcagcgtggccccagaaactaaagttaatggggcagagactattgacgaagaggcggcaggcgacgaaactatggaagcccgaacaatggaggctgaggcgactggcgctgaggcaacaggggcagaggcaaccggcgctaaagtgaccgagacaaaacctacaggcgctgaagtgcgagagatggagacaactgaagaggaggcaaatatggagacgaagcccacaggcgctcaggccaccgatacagagactaccggtgtggaagccatgggcgtcgaagctacaaagaccaaggctgaggaggccgagatgcaggcttatggggtgggcgcaggtcaggcagaacctccggtgacaggcaccacaaacatggaggcgaccggctcacgtgctaccgggatggaatcaacaggagtgtctgcaacaggggtggaaaatcctggggtagaggcaacagttcctgggatatccgcgggacctatactgcatcccggagccgctgaagcctcagagaagctccaggtggagctagaaactcgaatcagggggttagaggaggccctgcgacagagggagcgtgaagcagccgctgagctggaagccgcattgggcaaatgcgaagcagctgaggctgaagctggacgcttacgtgaacgggtccgcgaggctgagggtagcggtgcatcaggcggtgggggtggagacactacgcagctgagggccgcacttgaacaggcaagagaggaccttcgagacagggactctaggctccgcgagcttgaggccgctagcgcatgcctcgacgaagcccgtgccagcaggctgctcgccgaagaggaagcacgtggactgagggccgaactcgcacagcgggaggaggcgagactggagcagagtcgggagctggaggtccttcgcgaacaattggccactgcgagagcgacaggagaacagcagagaacagcagcggcagagctcggacgagcgagagacgccgcagaggcacgtgtcgcagagctgcccgctgcgtgtgaggaggcacgacaaggcttagcagaactgcgcgaagcgtccgaagctctgcgccagtctgtcgtacctgccagcgagcatcgccgactccaggaagaagccctcgagctgagaggacgggctgcatctttggaacaagaggttgtcgcaactggcaaagaagctgccaggctccgggctgaactggaacgcgaacgggtctgtagcgttgccctttccgagcacgaacgtatcgtaggcactctgcaagcaaatgtggctcagctcgaaggacaattggaggaactcggccgtagacacgagaaaactagcgctgaagtgtttcaggtgcagagagaagccctgtttatgaaatctgaacggcacgctgcggaagcccaacttgctacagccgagcagcaattgcgcggactccggaccgaagccgaacgcgctagacaggcccaaagtcgggcacaggaagccctcgacaaagctaaagagaaagataaaaaaataacagaattgagcaaggaagtgttcaacctgaaagaggctctgaaggagcaacctgctgcactggcaactccagaggttgaggcactgcgcgatcaggtgaaggaccttcagcagcagttgcaagaagcggctcgggatcacagtagcgtggtggcgctgtatcgaagccacctgttgtacgctatccaaggccaaatggatgaggacgtacagaggattctcagccagatccttcagatgcagaggcttcaggcccagggaaggtag

SEQ ID NO: 53000 - DNA, 3441 bp, Artificial Sequence
  Description of Artificial Sequence: Synthetic coding sequence
atgaagaccctgcgggcaagattcaaaaaaacagagttaagactctcccccacggaccttgggtcctgcccaccatgcggaccatgccccattcctaagccggcagctcgtgggcgtcgccagagccaggattggggcaagtccgacgagaggctcctccaggctgttgagaacaacgacgcccctcgagtcgcagcactgattgccagaaagggactggtgcctactaaactggaccccgaagggaagagcgctttccatctggcagccatgcgaggggctgcatcatgccttgaagtcatgatcgcccatgggtccaacgtaatgagtgccgatggagccggatataacgccctgcatctcgccgcaaagtacggacaccctcagtgcctgaagcagctcttgcaggctagctgtgtggtcgacgtagttgattcctctgggtggaccgcccttcaccacgcggcagccggaggctgtttgtcatgtagcgaagtcctgtgctccttcaaagctcacctgaacccccaggacagaagtggcgcaacacctctgataatagccgctcagatgtgtcataccgatctctgccggctcctactgcagcagggggcagccgctaacgaccaagatctgcaggggcgtactgctttaatgttggcgtgcgaaggggcatcaccagaaacagtcgaagttctgctgcagggtggagctcagcctgggatcacagacgcgctggggcaggatgccgcacactacggggctttagccggtgacaagctcattctccaccttctgcaggaagccgctcagaggccatcaccaccttccgccctgacagaggatgatagcggcgaggccagctctcagaactctatgtcaagccacggcaagcaaggcgcacctaagaaacgtaaggctcccccaccgcctgcctctataccgatgccagacgacagagatgcctatgaagaaatcgtccgcctgagacaggagagggggagattacttcaaaagattagagggttagagcagcataaggagaggagacagcaggagagtccagaagcatcctccctgcacatattggaaagacaggtgcaggaattacagcaactgctggttgaacgacaagaggagaaggaatccctgggacgcgaggtcgagtcccttcaaagccggctgagcctcctcgagaacgaacgcgaaaacaccagttatgacgtgactaccctccaggacgaagaaggggaactgcccgaccttccaggtgcagaggtccttcttagtagacagctgagtccatcagctcaggagcatttggcatctctacaggagcaagtagcagtactgaccagacagaatcaggaactgatggagaaggtgcagatcctcgagaattttgaaaaggacgagacacaaatggaggtggaggccctggccgaagtgatcccattggccctgtacgactcactccgcgcagagtttgaccagctccgacggcaacacgcagaagctctgcaagctctccgccaacaggagacccgcgaggtgcctcgtgaggagggggcagcttgcggagagtctgaggtggcaggcgctacagcaactaaaaacggccctacgcatatggagctcaacggcagtgtcgctcccgagacgaaggttaatggcgctgagactattgacgaggaggcggcaggagatgaaaccatggaagctcgtaccatggaggcggaggccactggggctgaggccaccggtgcagaggcaaccggggcaaaggtgaccgagactaagccaaccggggcagaagtgcgggaaatggagaccacagaggaggaagccaacatggagacgaagcccaccggtgcccaggccaccgacaccgaaacaaccggcgtcgaggcaatgggagtcgaggccacaaaaacaaaggccgaggaagcagaaatgcaggcctacggagtgggagcaggacaggccgagcctccggtcaccggcacgaccaacatggaggctaccggcagcagagccacaggaatggaaagcacgggggtatccgccaccggcgtagagaacccaggagtggaagcaactgtcccaggcatttccgccggtcccattttgcacccaggtgccgctgaggcctccgagaaacttcaagtagagctggaaacgcgcatccggggtcttgaagaagcactgaggcagagggaacgtgaagcagcagcagaattggaggccgctctgggaaaatgcgaggccgcagaggctgaggcgggacggctaagggagagggtccgcgaggctgaggggtcaggcgcatccgggggaggaggcggtgacacaacgcagttgagagcagccctggaacaagccagagaagacctacgagatagggacagccgtctccgtgagctggaagctgcatccgcctgcttggatgaagcacgcgcttctcgattgttggccgaagaagaagcacgtgggttgagggccgagctggcccagcgggaagaggcacggctggagcagtccagggagcttgaagttctcagagagcagctcgccactgcccgtgccactggtgaacaacagagaaccgcagccgctgaacttggacgcgcacgggacgcggcagaagcccgagtcgccgagttgccggctgcatgcgaggaagctcgccagggcctggctgagctacgagaggcatccgaggcgctgagacagtccgttgttccggcaagcgagcaccggaggctccaagaagaggcgttggaacttcggggaagggccgcatccctggagcaagaggttgtcgctactggtaaggaagccgcacgcttgcgtgccgaactagagcgagagcgtgtttgctcggtcgcgctgagcgagcacgagaggatcgtgggtaccctccaagctaatgtggctcaactcgaaggacagctggaggagcttggacgacgccacgaaaaaaccagcgccgaagtatttcaagttcagagggaggccctgtttatgaaatctgagcggcatgctgccgaggcacaactagcaacagccgagcaacagctccgcggactgcgcactgaggcggaaagagcacggcaggctcagtccagagctcaggaagccctggataaggccaaagagaaagacaaaaagatcaccgaactgagtaaggaggtgtttaatctaaaggaggctttgaaggaacaacctgccgctctcgccactccagaggtcgaggccctgagagaccaggtaaaagatctccaacagcagcttcaggaagccgctcgcgaccattcaagcgttgtggccctttacagaagtcatctcctttatgcgatccaaggtcaaatggacgaagatgtccagaggattctgtcccaaatcttgcaaatgcagcgcttgcaggcacagggacgctag

SEQ ID NO: 53001 - DNA, 807 bp, Artificial Sequence
  Description of Artificial Sequence: Synthetic coding sequence
atggaagaaaactcatttcagaaggagacacccctggccaatgctgccttctgggcagccaggagagggaatctcgcattgctcaagctccttctgaactccgggagagtggacgtagactgcagggatagtcacggcacgactctgttgatggtcgccgcttacgcaggacatatcgactgcgtgcgggagttggttctacagggagccgatatcaatttacagagggagagtggcaccacagccctgttctttgctgctcaacagggtcataacgacgttgtgcggttcctgttcggattcggggcatccactgagttcaggacgaaggacggtggtactgctttactggctgcaagccagtacgggcacatgcaggtcgtcgagaccctgctgaagcacggcgctaatatacacgaccagttgtacgacggtgcaacggccctcttcctggctgctcagggcggttacctggatgtgattcgcctgttgttagcatcaggcgcaaaggtgaaccaacccagacaggacggcaccgcaccactgtggatagcctcacagatgggccattcagaagtagttcgtgtgatgctcctgcgcggagccgacagagacgccgctaggaacgacggcaccacggcccttttgaaggcagctaataagggctataatgacgtaattaaggaattgttaaaattcagtcccacgcttggtatcctcaaggcaaacgagctgcctgccgaactaaccaaaaatgagcgaattctgcgcctgctgcgaagcaaagaagggccaagaaaatcttag

SEQ ID NO: 53002 - DNA, 906 bp, Artificial Sequence
  Description of Artificial Sequence: Synthetic coding sequence
atgtgccgcatgtcattcaagaaggaaactcccctcgccaacgcagcgttctgggccgcacgaagaggcaacctggctttgcttaagcttttactcaactcaggcagggtggacgttgactgccgcgactctcatgggacaacactgctgatggtcgccgcttacgcagggcatattgattgtgtccgagagttagtgctccagggggctgatataaacctgcaacgggagtctggtaccaccgcgttattcttcgcggcacaacagggccacaacgatgtcgtgagatttttgttcggatttggcgcttccaccgagttcaggacaaaggatgggggtaccgcgctgctggcagcctctcagtacggccacatgcaggtcgtggagaccctgctaaaacacggggctaatatccatgatcagctgtacgacggcgctactgctctgtttctggccgcacagggcggatatttggacgtcattcggttgcttctcgcttcaggcgcaaaggtgaatcagcccagacaggatggtacagccccactctggattgcaagccagatgggacacagcgaggttgtcagggttatgctgctccggggagccgacagagatgccgcaagaaatgacggaaccaccgccctcctgaaggccgctaataagggatacaatgacgtgattaaggagttactaaaattcagccccacccttggcattctaaaaaacggtaccagcgctttgcacgccgctgtgcttagtggaaatatcaaaacagtggcactgctgctggaggccggagcagatccatccctgcgcaacaaagccaacgagttgcctgccgagctcactaagaatgaacggatcctgcggttactgagatcaaaagaaggacctaggaaatcttag

SEQ ID NO: 53003 - DNA, 906 bp, Artificial Sequence
  Description of Artificial Sequence: Synthetic coding sequence
atgtgccgcatgtccttcaagaaggagaccccgctcgcaaacgccgcattttgggcagctcgcagagggaatctcgctctacttaagctgctgttgaactccggtcgagtggacgtggattgtcgcgacagccacggcactaccctgttaatggtagccgcatatgcaggccacatagattgcgtccgggagcttgtgttacagggcgcagacattaacctgcaaagggagagtggtaccactgcgttgttctttgccgcacagcagggccacaatgatgtagtccgatttttgttcggatttggcgcttctaccgaattccggaccaaggacggcggtaccgcgctgctggcagcttcccagtacgggcacatgcaggtcgtggagacactgcttaaacacggagctaacatccacgaccagctctatgacggcgctactgccctcttccttgccgctcaaggcggatatctggatgtgatccggttactcctggcaagcggagcaaaagtgaatcagcccagacaggacggaactgccccattatggatcgctagtcagatgggacattccgaagtcgtgcgggtgatgctgctgcgcggtgccgatcgagacgccgctcggaatgatggaaccaccgctctcctaaaggcagctaataagggatataacgatgttataaaggagttactcaagttctctcccacattagggatccttaagaatggcacctccgcactgcatgcagcagtgctctccgggaatattaagactgtcgctctgctcctcgaggctggcgctgatccttccctgagaaacaaggcgaacgagcttcccgctgagctcaccaaaaacgagagaattctccgactgctgaggagtaaggagggacctcgcaagagttag

SEQ ID NO: 53004 - DNA, 2439 bp, Artificial Sequence
  Description of Artificial Sequence: Synthetic coding sequence
ccttgtaaaaccctcctgcagaacgacgtatgcctgcctaaggccacacatcaaaaagaattcgacaccttatctggaaagctggaagtctacttctgtcccatcggtatgcttacaaacactaaaacccagaaaaccccaaagccctcagtaatcccgtttcagtcgaaacacgattttctactggagtcacctgataaagacggccttctgaaacctacgtgtgggagaaaggtgtctttacccaacaaggctctggaactcaaggaccgcgaaacactaaaggccgaatcacccgacaaagatggcctgctgaaacccacgtgcgtgagaaaagtatccctccccaacaaagcccttgaactgaaggaccgggagaccctcaaggcagcccagatgttcccctccgaaagcaagcagaaggacgacgaagagaactcttgggacttcgagtcattcttagaggcactgctgcagaatgacggatgcctacccaaagcaactcatcaaaaggaattcgacactttgtcgggcaagctggaagaatctccggataaagatgggcttctgaaacccacatgtggaatgaaaatctcgctcccaaacaaggccttagaactaaaggatcgcgagaccttcaaggccgaggatgtgagttcagtggaaagcacgtttagcttgtttgggaagcctactaccgagaactctcaatccacaaaagtggaagaagatttcaacttaactaccaaggaaggtgccaccaagacggtgaccggccaacaggagcgcgatatcggaattatagaaagagctccccaagaccagactaacaagatgcctacctccgagcttggaaggaaagaagacacaaagtccacgagcgattccgagataatctccgtatcggatacacagaactacgagtgccttccagaggctacatatcagaaggaaattaagacaacaaatggaaagatcgaagaaagcccagagaaaccttcacattttgaacctgctaccgagatgcagaactccgttcctaacaagggacttgagtggaagaataagcagactttaagagccgactctacaactctgagcaaaatactggatgccctgccctcttgcgagagaggcagggagttgaaaaaggacaattgcgagcagattactgctaagatggagcaaacaaagaataagttctgcgtgctgcaaaaggaactttccgaggcaaaggaaatcaagagccagttagagaaccagaaagcaaagtgggaacaggagctatgttccgtgcggctgacgctcaatcaggaagaggagaaacgcaggaacgtggacattctgaaagaaaagattcggccagaggagcaattacgcaagaaactcgaggttaagcagcagctggagcagactctgaggatccaggacatcgagcttaagagcgttacctcaaaccttaaccaagttagccacacgcacgaatccgaaaatgatcttttccatgaaaattgtatgctcaaaaaggaaattgccatgctgaaactggaggtggctaccttaaaacatcagcaccaggttaaagagaacaagtacttcgaagacattaaaatattacaagaaaaaaatgccgagctacagatgaccttaaaattgaaacagaagactgttaccaaaagagcctcccaataccgggagcagttgaaagttctgaccgccgagaataccatgttaaccagtaaacttaaagagaagcaggataaagagatcttggagaccgaaatagagtcccaccacccacggctggctagcgcccttcaggaccacgatcagagcgtcacatccaggaaaaaccaggagctagcattccatagcgctggcgatgctcccctgcagggtatcatgaatgttgacgtgagcaatacaatctataataacgaggtactgcaccagcctctgtatgaagcccagagaaagagtaagagtccaaaaattaatcttaattacgccggtgatgacctccgagaaaacgcccttgtttcagagcacgcacagagagaccgttgtgagacgcagtgtcagatgaaaaaagccgaacacatgtatcagaacgagcaggataacgtggacaaacatactgagcagcaagagtcactcgagcagaaactctttcagcttgagagtaaaaaccgatggcttaggcagcagctcgtgtatgcacacaagaaagtcaacaagagcaaggtcacgataaacattcagttccctgaaatgaagatgcagcgtcacttgaacgagaaaaatgaagaggtattcaactacggaaaccacttaaaggaacgcatagaccagtatgaaaaagagaaggctgaacgggaagtttccatcaaaaagtacaaatatttttccaattttcttaaggaatcaggcctagggtag

SEQ ID NO: 53005 - DNA, 2361 bp, Artificial Sequence
  Description of Artificial Sequence: Synthetic coding sequence
aacgcctgggacctcaactctttcctggagaccctgttacaaaatgacgtctgcctgcccaaagctacccaccagaaggagtttgatacgctgtccggaaagctcgaggagagcccagacaaagacggcctgcttaaacctacatgcggaagaaaggtgtccctgccaaacaaggcactcgaactcaaggaccgtgaaactctgaaggccgaatctcctgacaaagacggcctattgaaacctacctgtgtaagaaaagtgtcattgcctaataaggcactcgagctgaaagatagagaaaccttaaaggctgctcagatgtttccatcagaatcaaaacagaaggacgatgaggaaaatagctgggatttcgagtcctttctagaagcactgctgcagaacgatggctgtcttccaaaggccacacatcaaaaagagttcgataccttgagtggaaaactggaagagagtcccgacaaggacggcttgctcaagcctacctgcggaatgaaaatttccctccctaataaggccttagagttaaaggaccgtgagaccttcaaggcagaggatgttagcagcgttgagagtacattttctctgttcgggaagcccacaacggaaaacagccagagcaccaaagtggaggaggattttaatctgaccacaaaggagggtgccaccaagaccgtgactggccagcaggaaagagacatcgggattattgagagggctcctcaggatcagacgaataaaatgcccacatccgagttgggccgaaaagaggataccaaaagcacatccgactctgaaatcatctctgtcagcgacactcagaattatgaatgtcttcctgaggccacctaccagaaagaaatcaagaccaccaatggtaaaatcgaggagagccctgagaaaccctctcacttcgagcccgctacagagatgcagaatagtgtcccgaataagggtctggaatggaaaaacaagcagacacttagggccgattctaccaccctctccaagatacttgatgccctgccatcttgtgagcgtggcagagaactaaagaaggataattgcgagcagatcactgccaaaatggagcagaccaagaacaagttctgtgttctgcagaaagagctcagcgaggccaaagagatcaagtcacagttggagaatcagaaggccaaatgggagcaggagctgtgctctgtacgccttactctcaaccaggaagaggagaagcgccgaaatgttgacattctgaaggagaagattcggccagaggaacaactgaggaagaagcttgaagtgaagcagcagctggaacagacactgagaattcaggatattgagctcaaatctgtcacatctaatttaaaccaggtgagccacactcatgaatctgagaatgatttatttcacgagaactgcatgctcaaaaaggaaatcgcaatgctgaaactggaagtggccacactgaaacaccagcaccaagtgaaggagaataaatattttgaagacatcaagattctgcaggagaaaaatgcagagctgcaaatgaccctcaagcttaagcaaaagactgtcacaaagcgggcttcgcaatatcgcgagcagctgaaagtgcttacagctgagaacacgatgcttacgagcaaactgaaagagaaacaggacaaagaaatactcgagacggaaatcgagtctcatcatcccagattggcatcggccctgcaggatcatgaccagtccgttacgagcagaaagaatcaggaattggctttccacagtgcaggggatgcccctctccaaggcatcatgaatgtggacgtgtcgaacaccatatataataacgaagtgttgcaccagcccctgtacgaggcccagagaaagagcaagtccccgaagatcaacttgaactacgctggcgacgatctgcgagagaacgccctcgtatcagagcacgcacagcgggataggtgtgagacacagtgccaaatgaagaaagccgaacacatgtaccaaaatgagcaggacaacgtagataaacataccgagcaacaggagagcctggaacagaagttattccagcttgagagcaaaaaccgctggctacgccagcagctggtgtacgcccacaagaaagtcaataagagcaaagtgaccatcaacatccaattcccggagatgaagatgcagcgccatctcaacgaaaagaacgaggaggtgtttaattatggaaaccacttaaaggaacgaattgaccagtatgaaaaggagaaggcagagcgcgaagtgtccataaaaaagtataagtatttttctaactttttaaaggagtcagggctcggctag

SEQ ID NO: 53006 - DNA, 4179 bp, Artificial Sequence
  Description of Artificial Sequence: Synthetic coding sequence
atgaagagattactggccgctgccggtaaaggagtgaggggccctgaacccccaaacccattcagcgagagagtgtacacagaaaaagactatggtactatctatttcggagaccttggaaaaatccacaccgcagcaagccgcggtcaggttcagaagttggagaaaatgacagtgggtaagaagcccgtcaacctgaacaagcgtgacatgaagaagcggacggccctgcattgggcgtgtgtgaatggccatgccgaagtggttacattcctggtggatcggaagtgccagctgaacgttctagacggggaggggaggactccgctgatgaaggccctgcaatgcgaacgtgaggcctgcgcgaatatactgattgatgctggcgcagatctgaactatgtcgatgtgtatggcaacacagcactccactacgccgtttattcggaaaacctgcttatggtcgccaccttgctaagctacggcgctgtaattgaggtccagaataaggcctcgttgacaccgctgctcctcgcgattcagaagcgcagcaagcagacggtggagttcctccttacgaagaatgctaatgcaaacgcttttaatgagagcaaatgcaccgctctgatgctggccatttgtgagggcagtagcgaaattgtgggaatgcttctgcagcagaatgtagacgtgttcgctgaagatatccatgggatcacggcagagcgctatgccgctgcctgtggagtcaattacattcatcagcagcttctcgaacacatccgaaagttacctaagaacccgcaaaacaccaatcccgaaggcactagcacgggaacgcctgatgaggccgcaccactggcagaacgaaccccagacacagcggagagcctgctcgagaagacaccggatgaggcggcaagactcgtcgaaggcacttcagctaaaattcagtgcctggggaaagccaccagcggaaaattcgaacagagtaccgaggagactccaagaaagattctgaggccaacaaaggaaacttctgagaaattttcctggcctgcaaaggagaggtcccggaaaatcacctgggaggagaaagaaacctcagtgaaaacagagtgcgtggccggtgtaacacctaataaaacagaggtgttggaaaagggaaccagcaatatgattgcgtgtccaactaaggaaactagcacaaaggccagtaccaacgtggacgttagcagcgtggaacccatcttttccctgtttggcactcggacaatcgagaactctcagtgtacaaaagtggaggaagacttcaatttggcgacaaaaatcattagcaaaagcgccgctcagaactatacttgccttccagacgctacctatcagaaagatattaaaacgattaaccacaaaatcgaggatcagatgtttccttcagagtccaagcgtgaagaggatgaagagtattcctgggacagcggctctctgtttgaatcaagcgccaagacccaggtatgcattcctgaaagcatgtaccagaaagtcatggaaattaaccgggaggtggaggaactacctgagaagccctctgcctttaagcccgctgtggagatgcaaaaaacagtcccaaacaaagcgttcgagttaaaaaatgagcagaccctgcgcgctgcccagatgtttcccagcgagagcaagcagaaggacgatgaggagaatagctgggactctgagtccccctgcgaaaccgtctcacagaaagacgtgtacttaccaaaagccacccaccagaaagagtttgatactcttagcggcaagttggaagaatctccggtcaaggacggtcttttgaagcccacatgcggcagaaaagtgagcttaccaaacaaggctctggagttgaaggatagagagacttttaaggcagaatcacctgataaggacggtctcctaaagcccacttgcggcaggaaagttagcctgcccaataaggcactggagctgaaggatagagaaaccctcaaggcagaatctcccgataatgatggattgctgaaaccaacatgcggccgtaaggtgagcctgccaaacaaggccctggagctcaaagatagagaaacgttcaaagccgcacagatgtttcccagcgagagcaagcagaaagatgatgaagaaaatagctgggactttgagtcattcctggagaccctcctccaaaacgacgtgtgccttccaaaagcgacccaccagaaagagttcgacacactttcggggaaactggaggagagtcccgataaggatgggctgcttaagccaacctgcggaatgaagataagtctgccaaacaaggcactcgaactgaaagaccgcgagacatttaaggccgaagacgtgtcaagtgtggagtctacattttcactcttcgggaagcctaccacagagaatagccagtctaccaaggttgaagaggactttaatttaaccaccaaggagggcgctacaaagacagtaactggccagcaggaaagggacattgggatcatagaacgggcaccacaagatcagactaacaagatgccaacatctgaactggggagaaaagaagacactaaaagcacctcggactcagaaatcatatccgtgagcgacacacagaattatgagtgcctaccagaagctacctaccaaaaggagatcaagacaaccaacggaaagatagaggaaagtcctgagaagccttcccacttcgagcccgcaactgagatgcagaattccgtacccaacaaggggctggaatggaaaaacaagcagacacttcgagcggactccacgaccctaagcaagattttggatgccttgccttcctgcgagcgcggtcgagagctcaagaaagacaactgcgaacagattaccgcgaaaatggaacagacaaaaaataagttttgcgtccttcagaaggagttgtcagaagcgaaggagatcaagagtcagctggagaatcaaaaagccaaatgggagcaggagctgtgcagcgtgcgcctgaccctgaaccaagaagaggaaaaaagaaggaacgtagacatccttaaggagaaaatccggcctgaagaacaattacgcaagaagttggaggtgaagcaacagctggaacaaacgctccgaattcaggacattgagctcaagtccgtgactagcaaccttaaccaagtgtcacacacccacgagtctgaaaatgacttgtttcatgaaaactgcatgctaaaaaaagagattgccatgctcaagctggaggtcgccacgctgaagcaccaacatcaagtcaaggaaaacaagtacttcgaggacatcaagatcctgcaagaaaagaacgccgaattgcagatgacgctgaaacttaaacaaaagactgtgactaagagggcctctcaataccgtgagcagttgaaggtgctgaccgctgagaatacgatgctgacaagcaaactaaaggagaaacaggacaaggagattctcgaaacagagatagagtcccaccacccgagactggcctcagctctgcaagatcacgaccagtctgtcacatcccggaagaaccaggagttggcattccacagcgccggtgatgccccacttcaggggatcatgaacgtggacgttagcaacacaatctacaacaatgaagtgttacaccagcccctgtacgaggcccagaggaagtccaagtctcccaaaatcaacctcaattatgccggagacgatctcagggagaatgctttggtctcggagcacgcccagcgcgatcgctgcgaaacacagtgccagatgaagaaggctgaacacatgtatcagaacgaacaggataatgtggacaagcacacggaacagcaggagagtttggagcagaagctttttcagctggaatcgaagaaccgctggttacggcagcagctggtctacgctcataagaaagtgaataaatcaaaggttaccattaacattcagttccctgagatgaagatgcagaggcatctgaatgaaaaaaacgaggaggtgtttaactacggcaaccacctgaaggaacggattgatcagtatgagaaagagaaggccgagagggaggtttcaattaaaaagtacaaatactttagcaatttcctgaaagaaagtggattgggttag

SEQ ID NO: 53007 - DNA, 1860 bp, Artificial Sequence
  Description of Artificial Sequence: Synthetic coding sequence
atgaagagattgctcgccgcagccggaaagggcgttagagggcctgagcctcccaaccccttttccgagagagtttacacagaaaaagactatgggactatttacttcggagacctcggcaagatacatactgctgctagcaggggccaggtccagaagttggaaaaaatgaccgtcggcaagaagccagtcaatctaaataaaagagatatgaagaaaaggacagcgcttcactgggcatgcgtgaacggtcacgccgaggtagtcactttcctggtcgatcgaaagtgtcagctgaacgtcttagatggcgaaggccgaacacctttgatgaaggcactacagtgcgagagagaggcatgtgcgaacattcttatagacgcgggagccgacctgaattacgtcgatgtctacgggaacacggcactacattatgcggtctatagtgagaacttgctaatggtggctaccttattaagttacggagccgtaattgaggtccagaataaggcgagtctaacaccattgctgctggctatccagaaacgcagtaagcagacagtggaatttctcttaaccaaaaacgcaaatgccaacgcatttaatgaatccaagtgtactgccctgatgcttgctatctgcgaaggatcatcggaaatcgtaggcatgttgctccagcagaacgtggacgtttttgcagaggacatccacggaataacggcagagaggtatgccgctgcttgtggcgtcaactatattcaccaacagcttctggagcatatcagaaagctgcctaagaacccacagaatactaacccggagggcacaagcaccggcactcccgacgaagccgcacctttagcagaacgaaccccagatactgctgaatcactgctagagaagacacccgatgaggccgctagattggtcgaaggcacaagtgccaaaatccagtgcctcggaaaggcaaccagcggcaagttcgaacagtctactgaagaaactccgcgaaaaatcctccgaccaacaaaggagacttccgagaagttctcctggccagctaaagaacggagccggaagatcacctgggaggaaaaggagacgtccgtcaagactgaatgtgtcgcgggagtcacccccaataagaccgaggtgcttgagaagggaacatcaaatatgatcgcctgccccacaaaggaaaccagtacaaaggccagcactaatgtcgacgtctcctccgtcgagccaatattcagcctttttgggacacgtactatcgaaaatagccagtgtacaaaagtagaagaagactttaatttggctacaaaaatcattagtaagtccgctgcccagaattacacctgcctcccagatgctacgtatcagaaagacattaagaccattaaccacaaaatcgaagaccagatgttcccttctgagtcaaaacgcgaggaagacgaggagtacagctgggactcaggatccttatttgaatccagcgccaagacccaagtttgcattcccgagagcatgtatcagaaggtcatggagataaacagagaagtggaagagctgccagagaaaccctccgccttcaagcctgccgttgagatgcaaaagacggtccccaataaagctttcgagctgaagaacgagcagaccctccgagccgctcagatgttcccaagcgagagcaaacagaaggacgacgaggagaactcgtgggatagcgagtccccctgcgaaaccgttagccagaaagatgtgtacctgcccaaagccacacaccagaaggagtttgacaccttgagcggaaaactggaagcttatttgtggaaggagagcttttcgtccaaatag

SEQ ID NO: 53008 - DNA, 5622 bp, Artificial Sequence
  Description of Artificial Sequence: Synthetic coding sequence
atggaagaaggggtgcaagcacctgattgggacagcgatgaaactgtgattgagggtagcgtgactgagtccgatttagaagagaaagagctcccctggaggaggctgctatttgaccaagatgctagccttaagtctgaattctccttacaccccgatacgcggggaatgtgcaagggcatgccatctcccgagattcagctagggtttaaattacgcgaggatctgcaggagcagatgaacaaaaacaaaatgatgccagtcttaagtgaggacaccattctgcagagccaggacgaaaccgagagaaaccaggcgctgcttcagaccagaaagaactgtagcatgtttattgggtcatttagacagtcgggactatcccttaaccaccagaacatcgagggacctgaagccgagagtcccgaggttctaccccacatagagaaggaactttccgagggacgggacagtcccgaggtcagcctgctgtcaggaacggccattaccgtcagcgacactgttgccgttaaggagaccagtctggtggagccagaaaagatcctcgcagcccctaatacattctttgaaccaaggaaagaagtgaccatgacaatgacaagcgaggagacaaaagacgaggaaagttccttagagacctttgtctcggccctcgagtccctcctcaccagcccagagagcacacaagaggagcggttattcgaactcgtctccgacttcgatcggaaggagttgatgaaccccttaagcgactcactgtcatccatctccattccgttaaatagttggagtgcctgccatagggatctgctggaggacgctaaagacgatgctctccccgctgaattgcttgaggcactgaacaccctgagcgaagccaaggtggagacgatctgccaccgcaaagaggggggtagtagtcttattgccaggaacgaatgcctcgaggtggaatttaatacatcgcagacaaacgaagattgcacacaaattgccgaaacattacaggaccctaatccctccggcctgcaaactttggctcatcagaacatcacgtcttgtgagcctttgtccaacaagaggaactcaaattcagtgaccaactcatcggaccaggaaaccgcatgtgtgctccgccgaagctcccggttggagaagctaaaggtgagtagggatgccaaatactcagatcacatgtacaagatgcccgaaaagattctccctaaaatcctcggctgtgaagatctcactaacaacaactcctctgctcagaatttccgtatgcaggatcctgccctcatgatcgacggaaaagaaaaaaacatgcacagcgcacgtttcaaaaacgggaaacagataagaaaaaacgagcaattcagcggtaagaaggaaaagatgaaggtgaacaagatctcattgcacagcatcaaccgcaggaacatcttcggcgagaacctggtgtacaaggccgctctccacgacgacgcggacttagtgcaccattgcatcaagaagggaggcaatgttaaccagccatcgtacgccggatggacagccctgcacgaggcctccgttgggggattttacagaactgcctccgaattacttaaaggaggagctgacgtcaatattaagggactgtaccaaattacgcctctgcatgacgcagtcatgaatgggcattacaaagtggccgagttactgctgctcaatggagccgacccgttgttcaggaatgatgatggcaaatgcgcactggacgaggcgaaagacctctgtatgaagagactcttggaaaggtacatccctaagcatcagaaatgtctgactagtgcgcaacgttcctctattgaccctttggacattgaggatgtctaccaacataagaaacccaaattttcatctaagtcccatatctggcacgtgtacaacgagaactctaacaggcagaagctggagcatgtgaaggtaaacaagggctctaaagcttcactcttcattaataaagaggacgtctacgagtactatcagaaggaccctaagaataccaaatttgggaagtccaagcacaagcagagcacactggaccaaatctactccactggcctcagaaaaggtaatcttcacaacgtaaaagaccctaatactaatgtccctaaggggatcggacgtagaaagacacaacataagaggactcaggtggacgatgtggattgtaatcctagaaagattctggccgtttccccttctcgtcgcattaatagactggtgacttatcagcagcatattccagagacacacaatgaccttccagaggagttgtgcgaaccaagctcactcactctgagttctctcaggaacggactggattccagcacggaagcctgttcagtttctaaggaaaagcatattcaaaacctggacctgtccgattcccaggaggtgcagtgccttgagctggaaagcgtcgaccagaccgaagccgtgtccttcccgggattactgctgcacaaggagatcaagttgccagtcgtgactaccgacaaacagccccataccctgcaggaacagcatcacgttctatacaagagtcacgaaaattccaatctcgtgcctaaagatgaaagattcaataaatgggaaaactcttttctgtcctttgtgaaggagaattctgacaatgacgacgacgacgactgcagcacgtctgagaaagctattacaagcaaaaaggtactctgtagcaccgggggaaagaaacactataatttcaaagagaacttaactaacaaaaaagagatggggttccagcagtttttgttgagcgaggatcatttatcacaagagaatgagttaaaagcagtgtcactgacaactttgcctgaacaagaggccgtgaatttcagctacagtgacaacgccgttatctccgagcacgtagctaattacgaacaatgcatattcggcccttctttcgaccactccaacgggaatccagaacagaatagtcttgcatgcatgcgaacactgttaacccatgaggcatcaaagctgaccaaccatgtcgagctcttcaaaaaaccccaggactatatccctcgggctcccacatttctgatgaaccaaaccgacacccacatcgttgagaagatggccaagaattgtgacacggagcggaattacatagatagggatcagaagatcatctactctaacgagcccctgagcatcgttgcccatagtcaggtgatcgaaactactaaggttgagaagcgcagacagaaccacttggagagtgagacaatacataatattgatagtcactctaccgataacatgagcaaagaattggctaacatcagtaagctcagtcagcgggagaaaaaagaaatctctcacaagcctgggatgaaggctggtaggatcaataagcggaacgctagaggcgagagccagctgcatttggccgtccgccgaggaaacctgcctctggttaaggccttaattgagtcaggcgctgatgtcaaccttaacgacaacgccggatggacacccctgcatgaagctagcaatgagggaagcatcgacatcatcgtggagcttctgaaggctggtgccaaagtcaattgcgaaaatattgacggcattcttccgctgcacgacgccgtggcgaacaaccatttaaaggctgccgagatccttcttcaaaatggggctaaccccaaccagaaagatcaaaagcagaagtccgccttggacgaagccgatgatgaaaaaatgaaggagctgctcagaagctatggcgcaattgaaactgttaacagggacgagtccgatgctatagtaaatgagaagatccctgcagtccgttcaaaaagacacaagcagtgcttctgtgacgacgggaagacaatcgacagcagcagtcttagccaccaggaacggagccgggaatccttatctgtccaccaaactctgagcgccattctccaagatatagaagagaagcaagagtacctgcttgagttcgagatacgaaatcccgaggatgccgaacagtacatcgagaagatgctcaagattaagaagattatggacaacgtcctggccaagcagaaggcagaacgggacgatcttgcaaaaaagtatagagtctcgattgagtccttcaaacacggcgcattaagagaacagttggcgaacttggccgctcggcaaaagtctttacttgtggtcgcaaaaaaacaaaagaaaatttcactgaagatccagaactgtcgtaatgtcacctctctgccgtgcctgtcactgcgcaagctgccccctcgcagtgaaatttccagtgaaaaagactcccaggaattgacttccctggagaatctggaacaccctcagtccggaagccttagtccagtatccgggtccatgcaagaaacgcagctctctttggagacttggaactactcccaaaataccaacatctgcctcaatagtgaagctgttaggcgcggagagttttctggaaatgatatgaattctaagcaaaacggatctgactgtacgctcgatggctttccaaaatctaggcactcagatggcaccgagaaaaataaactgccgagtcagccagtagcattcattggccaaactgagtattcccagaaagaaaatgacctgaccgaggcaacagacaaagaccacgagttctacgtctcttcccccgtcatcggaaagttgaacattagtgaaactgcaagtgtgttagccgagaacgccgctcacccaagcaacatcatttgcgatcaagatctctccaattacgatccaaagcggggtaatagaaaaacctcaagtcaacaatcccctactggggctagcgagagcctggcccaccagggcatcgccgtgcttggctctgacacagtgcaccagatgaagccgtatctcaaaaagagcgtctcagtggtaccctgcgctgacgacagccagataagctcctctagtgggtcaggccagcaagatacgatcaagaaggccctgaattattctacagcgcctaaaaaaaagtgcattcaaattaaagatttaatactcctgggcagaatcaatcctggaaacaatatcctggaattcaagacacaagagactacacataaggcaagcattctcctgaacggcaagctcaaagtcgagtccggccagatctacaaaaatccagtcacatggctgaaggatctgctgggtggaaacagctacgtgacgtggaattatgcctggtccaaggtcacatacctggggaaagagctcttgcgctacgtctcagaggacgctcctattttgcccgaacctaattccgtcccacagcagtaccaaccttgtctgcccgaggtcgcctgtcttgacgatcctgtccaagaacctaacaaatccatgttcgagaagaccaagttcgggcagggaaccagccgggaaagtatgcagagctcccctcggtacttacaaatcaacgagatactgttaatttcggaccaggaatttctcccgtgtcatatcatggatcagcattggaagttctgtgtcgaatgcgaagaacttactccctas

SEQ ID NO: 53009 - DNA, 819 bp, Artificial Sequence
  Description of Artificial Sequence: Synthetic coding sequence
atggtggcctgctaccatggcttccagtcagttgtagctttactgtctcattgccccttcctggacgtcaaccaacaagacaagggcggagatacggcattgatgttagctgctcaggccggtcatgtgccacttgtctcccttctcctgaattactacgtaggcttggatctggaaaggcgcgatcaaagaggactcaccgcactgatgaaagcagcgatgcgaaaccgctgtgagtgcgtggcaacactgttgatggctggggctgacctgactgccgtggatcccgtgcgcggtaagactgctctagagtgggcggtcctaaccgattcctttgacaccgtctggcggattcggcagttactgcggaggcctcaagttgagcagctatcacaacactataagccagagtggccagcactgtcaggtctcgtcgctcaggcgcaggctcaggcccaggtagccccatcgctccttgagcgtctgcaggctaccttaagtttacctttcgcaccgagtcctcaggagggcggagtgctcgatcatttagtcactgccacgactagtttggcatccccgtttgtcactacggcctgtcacaccctctgcccagatcacccccctagcctgggaacgcgctccaagagcgtgcctgagttgctggtacctgctgaagcgcagtctttccggacgcccaagagtgggccttcatctctggccattcccggagcccaggacagagaggaagagaccggcggaggagggcaaaatggtacagaggttggtgaggatggaatagggcaagcaggaaatcgctag

SEQ ID NO: 53010 - DNA, 612 bp, Artificial Sequence
  Description of Artificial Sequence: Synthetic coding sequence
atgaaggccgcaatgaggaacaggtgcgaatgcgtcgctaccttgctgatggcaggggcagacctaacggctgtggacccagtgcgcggtaaaacggcgctggagtgggccgtcctcactgatagttttgatacagtgtggagaatccggcagcttctgaggcggcctcaagtagagcagctaagccagcattacaagcctgagtggcccgctctgtcaggccttgtggcccaggcccaggcccaggcccaggtcgctcctagcctgctggaacgtttacaagcaactcttagtcttccctttgctcctagtccacaggaaggaggagttttagaccacctagtgacagcgacaacctctttggcttcgccatttgttaccacagcatgtcacactctgtgcccagatcatcccccatctcttggaacacgcagcaagtctgtccccgaactgctcgtgcccgcagaggcacaatcctttcgcacccccaagagtggcccttcttcactcgccataccgggtgcccaagaccgggaggaggagactggcggtggaggacagaacggtacagaggtgggagaagatggcataggacaggccggaaatagatag

SEQ ID NO: 53011 - DNA, 1485 bp, Artificial Sequence
  Description of Artificial Sequence: Synthetic coding sequence
atggtgctgctcgccggaacaggccctgagggcggaggggctcgctgtatgaccccacctccacccagccctccaagaggagcccaggtggaggaggatccggctgactacgaggagttcgaagactttagctctctgcccgacaccagaagcatcgcctccgatgatagtttctaccccttcgaagacgaagaagagcacggcgtcgaatccgcagagtctgtgcccgagggggtgcctgagagcgtgcccgaaaccgctaccttgttgagagctgcatgtgccaacaatgtaggattgctacggaccctggtgcggcgaggggtgtcagtcgaggaagctcaggagaccgaccggaatggaagaacaggcctcatagtcgcttgttaccatggcttcgttgacaccgtagtggcccttgcagaatgcccacacgttgacgtcaattggcaggacagcgaaggaaataccgccctcattacagcagcgcaagctgggcacgccatcataactaactacctgctcaactactttcccggactcgatttggaaaggcgaaacgcatttggattcaccgcactgatgaaagctgcaatgcagggtcgaactgattgtattagggcactcatgctggccggtgcagatgttcatgccagggacccccgacggggaatgtcaccacaggaatgggccacttacaccgggagagtggatgccgtcaggttaatgcagcgactcctggagcggccatgccctgaacagttttgggagaagtatcgacctgagttgcccccaccccctgaagctgccagaaaaccagcagggagtaaaaactgcctgcagcgtctaaccgattgcgtgctttccgtgttaacacctaggagtgtacggggaccggaagacgggggagtcctggatcacatggtgagaatgacaacaagtttgtactcacctgccgtagccatcgtgtgtcagacggtgtgtcctgagtcacctccttccgtgggcaaaagaaggcttgctgttcaagagatcctggcggctcgcgctgcccgtgggccacaggcccaggaggaggatgaggttggtggagcgggacaaaggggtaggacaggacaggaggacgcggactcccgtgaagggtcgcctcgggcagggctgccccctgcgctagggagccgaggaccagcagcgcctgcaccacgaaaggcaagcttgttgcctctgcagaggctgcgcaggcggtccgtccgccctggagttgtagtccctagagtgagagtatcaaaggctcctgccccaacatttcagccagagaggccagcccgaaagggttccacaaaagattcgggacacctccaaattcctaagtggcgatataaggaggctaaggaggaaaaaagaaaggccgaggaggccgagaagaaaagacaggctgaagcgcagaaggagaggaggacagcgccatggaaaaaaaggacctag

SEQ ID NO: 53012 - DNA, 1491 bp, Artificial Sequence
  Description of Artificial Sequence: Synthetic coding sequence
atgttgcacaccgagggccacgctcttttgagggccgttgggcagggtaaactgagactggcccgtcttctactggaggggggagcctacgtaaacgaaggagacgcgcagggcgaaactgcattaatggcggcttgtcgcgcacggtatgatgaccctcaaaacaaagccagaatggtgaggtatctactggagcagggagcagaccccaatatcgccgacagactcggcagaactgcgttgatgcatgcctgtgctggaggcggaggcgcagccgtcgcgtctctgctcctggcccatggcgctgatccctccgtcagagaccatgctggggcttccgctcttgtacatgcactggacagaggggatcgagagactcttgccacacttctggatgcctgcaaagccaaaggcactgaagtgataattataactacggacacctctccgtctggaactaaaaaaaccaggcagtacctcaattcccccccatccccaggggtggaggacccagcccctgcctctcccagtccaggcttttgcacgagtccaagcgagatacagctgcaaaccgccggtggtggaggtcggggaatgttgtcgcctcgcgctcaagaagaggaggagaagagggacgtgttcgaatttcctctgcccaaaccacccgacgatccctcgccttcagagccattacccaagccccctaggcatccccctaagccgctcaaacggctcaactcggagccttggggccttgtcgccccaccccagcccgtgcctcccacagagggcaggcccggtatagagaggctgacagccgagtttaatgggctgacccttacagggaggcctaggctaagccgcaggcattccaccgagggacccgaagatccgccaccctgggccgagaaagtcacaagcggcggtccgctgtctagaaggaacactgcccctgaggcacaggagagcggtcccccaagcggtctgagacagaagctctccaggatggaaccagttgagctggacactcccggtcatctgtgccctgactctcccgagtcaagtaggttaagtttggagcggaggaggtattccgccagcccactgacattgccgcctgctggttccgccccatctccaaggcagtcacaggaatcactgccaggggcagtgagtcctctgagcgggagaagaagatccccaggactgcttgagcgacggggttctggtaccctgctcttggatcacatttcccagacaagacctggcttcctgccaccgcttaacgtttcaccgcacccaccaattccggatatccgtccgcagcctgggggaagggctcctagtctccctgccccaccatatgccggagctcccggaagcccaaggactaaacgcaagctcgtgagacgtcattcaatgcagacagaacaaatacgtctgttgggaggctttcagtcactcggcggaccaggggaacccggtaggtag

SEQ ID NO: 53013 - DNA, 1608 bp, Artificial Sequence
  Description of Artificial Sequence: Synthetic coding sequence
atgatggacgacgatacggagctccggactgatgggaacagcttgttgaaggccgtgtggttaggtagattgagactcactaggttactactggagggaggcgcatacatcaatgaaagtaatgacaagggcgaaaccgctcttatggtggcctgcattacaaaacacgtagaccagcaatctatctcaaaatccaagatggtcaagtacctgcttgataacagagccgatcccaacatacaggacaaatcaggaaaaacggctctaatacacgcttgcattagaagagccggtggtgaggttgttagcttgctgctggaaaacggagctgatccaagtctggaggatcgaacaggtgcaagcgctttggtgtatgcaatcaacgctgacgataaagacgctctgaagcatcttctggacgcatgcaaagccaaaggaaaggaggtcataattatcaccacagacaaatcctcttctgggaccaaaacaacaaagcagtatttaaacgtgccgcctagtccaaaagtggaggaccgccactcgccaccattgtgcgcatcaccgagcgatattgagcttaaagccctcggcttggactctcccttgaccgagaaggaggacgacttcttttccttacaggccggacacccatcttcttgtaacacttctaaagcagtcaacgagcctggatcaccaacccggaaagtgtccaatctaaaacgtgctagactgccccagctgaagcggctccagtccgagccctgggggctgatagcccctagcgtgctcgccgcttccactcgtcaggatgaaacccatggtgcctccacagataacgaggtgataaaaagcatatccgacatctcctttccaaagagaggccctctgtcccggactaacagcattgactccaaggatccaacattattccacacagtgaccgaacaggtgttaaagatccccgtctctagcgcacctgcaagctggaaagctgcttatgagaagggacaggcacctcacccacgattggcgagaagagggactttacctgtagatcaggagaaatgtggtatggggcctagcggaccctctgccttgaaggagccagcttcattgaagtggctagagaacgacctgtacgatctcgatatacagcctgggcctgaccctcctaatagcatctcgctagaaagtggaaaaggtccactggatagaaaaaagctgaatagcagccatcttagcctcttccatggctctagagagtccctcgatacagtaccaagtacttccccgtccagtgctcgacggaggccacctcatctcctcgaacgaagaggatccggtactctcctcctggatcgcatctctcacacccgccctgggttccttccccctctcaacgtcaacctgaaccctccaattccagacatacggtcttcatctaaaccttcctgcagtctagcctccggtttgaaaagcatggttccagtggccccaagtagcccaaagcgagtggacttgcgttcaaaaaagaagctcctgcgaagacactctatgcagattgagcaaatgaaacagctctccgacttcgaggagataatgacatag

SEQ ID NO: 53014 - DNA, 3006 bp, Artificial Sequence
  Description of Artificial Sequence: Synthetic coding sequence
atgaaacgcatcttctcatgttcctcaacccaggttgctgtggaaagatggaatcgacacgaccagaaactgttagaagccgtacataggggagacgtgggccgtgttgcagctctcgccagccgtaagtcagcccgacctacaaaattagactctaacggccagtccccttttcacttagccgcttccaaaggacttaccgagtgtttgaccatactcctagcaaacggagcagatatcaactccaaaaatgaagacgggtccactgctctacacctggccaccataagttgccaaccccaatgcgtgaaagtgctcttgcaacatggtgcgaatgaggacgcagtggacgccgaaaataggtcaccgcttcattgggcagcgagttcgggatgtgcatccagcgtgctactattgtgtgatcacgaggcattcctagacgtgctcgataacgacggcaggaccccacttatgatcgccagtctgggcggacacgccgctatttgttcccagctgttgcagcggggagccagagtaaacgttacggataaaaatgataaatccgccctgattcttgcgtgcgagaagggctccgcggaggtggcagagctcctgctctcccacggcgcagatgctggggctgtagattcaaccgggcatgatgcacttcactatgcactgcatacacaggataaagcattatggaggcatctgcagcaagccctcagccgcagacgccgtggagggcaaagactggttcagcatccagacctggcctctcaggcctctccctctgaaccacaggctggtagccccccaaagtccagttggagggccgaaccagaggaggagcaagaagagaaggaggatgaggacccatgctcagaggagtggaggtggaagtacgaggaagaaaggaggaaggtagtaagacttgagcaggagctagtgcagaagaccgaggagtgcaaaacccaagccgctgcctacctggacctcgaaaatcagattcgagaacaggctcaggagctgggagtgctattgagctgggagccgagagcgtctggtaagcaaggatcgtccctgcgcccaggtggcgatgggatggagcagggttgtcccaaggatctgctggcagaatctacccaagagttgaagaaacagcagcaggcggctgctacagtcaaccccgtgttggcacctaaaaaagcggaggatagtgcacctgggaaaatccaatacgaggtgcacgggaggagccaaccggaagagcaggggcctccacagagccccgcttccgagaccattaggaaagctaccggccagcagctaactacgaatggcgctcagacattcggccctgatcacgcagatcagctacctgctgggcaaaaggagtccagtcaagttttaggagtcgagccaggaggcaccgttgcagagcccgttggacccgcagcaatgaatcagctgctactccaactcagagaggagcttgcagccgtgtggcgcgaaaaagacgctgcccgaggagccctgtcaaggccagtaatggaaggcgcactgggcacgccacgtgccgaggccgctgccgctgcgtgggagaagatggaggcaagattggagagagtgttggcccgactggaatgggctaaggccggtctgcaggtcaagccagaggttccttctcaagagtcaagggaaggtgccctgaaagccgcacccggaagcattaagcaggacgaggaaaaagaaaagagggtgccgggtgctcggggtgagccactcggcgctttgggaggcgagaaagcactcggagggctggccaaaggccagcttgagaaggaaatgagcgtccttcgactgtcaaactctaatctcttagaggagctcggcgagctcgggcgagaacgacagcggcttcagagagagctgcaatcgttgtctcagcgcctccagcgggaattcgtgcctaaacccgaggcccaggtccagctgcagcagctcaggcagtctgtgggcctgctgaccaatgagctggctatggagaaggaggccactgagaagctgagaaagctgttagctagtcagtctagcggcttgcgcggattatgggactgtcttcctgccgacctggttggtgagaggtccgcacagtctaaggcagctgaatccctggaagagctaagagcctgcataagcacactggtggaccgccacagggaagctcagcaagttctggcaaggcttcaagaggagaatcagcagctgagaggaagcctgtccccgtgtagagagccagggacatcattaaaagccccagcgtcacctcaggtggcagccctggagcaggacctcggcaaattggaggaggaactgcgcgcagtgcaagccacaatgagcggcaagagccaagagatcggtaaattgaaacagctgctctatcaggctacggaggaagtggctgaactgagagcacgggaggcagcaagtctgaggcagcatgagaaaactcgtgggtcccttgttgctcaggcgcaggcttggggacaggagctgaaggctctgttagagaagtataacaccgcctgccgggaggtgggcaggctgcgcgaagcagtcgccgaggaacgcagacgcagcggcgatctcgcggctcaagcagcagagcaagaacggcaggcgtcggaaatgcgaggaagatctgaacagtttgagaagactgcagaattactgaaggagaagatggagcacctcattggcgcatgtcgcgacaaggaagctaaaatcaaggagctgctgaagaagctggagcagctgagtgaggaggtactcgccatccggggtgaaaatgccaggttggccctccagctgcaggactctcagaaaaaccatgaggaaatcatctctacatatagaaaccatcttctaaatgccgctcggggatacatggagcatgaagtttacaatatccttcttcagatcctgagcatggaggaggagtag

SEQ ID NO: 53015 - DNA, 2733 bp, Artificial Sequence
  Description of Artificial Sequence: Synthetic coding sequence
atgaaaagaatatttagctgtcagccacagtgcgtgaaagtgttacttcagcatggcgctaatgaagacgcggtcgatgcggagaataggtcaccattgcattgggctgcgagcagcggctgtgccagctccgtcctgttgctgtgcgatcacgaagcatttctggatgtgctcgataatgatgggaggacaccgctaatgatcgccagcctaggtgggcatgccgctatctgtagccagctactgcaacgaggcgctagagtcaatgtcactgataagaacgataaaagcgcccttattctagcctgcgagaaggggtccgcagaggtcgcagagctactgttgtcccacggcgctgatgccggtgccgtcgactccaccggccatgacgctctgcattatgcccttcatacgcaggacaaagctctgtggcggcatctccagcaggccttatcccgcaggcggcgtggaggacagaggctggtgcagcacccagatctggcatcgcaagcatctcctagcgagcctcaggccggatctcccccaaaatcctcctggagggccgagcccgaggaagaacaggaggaaaaagaagatgaggatccttgcagcgaggagtggaggtggaagtatgaggaggagcgccgaaaggttgtgaggctagaacaagagctggtgcaaaagacagaggagtgtaaaacccaggctgccgcttaccttgacctggaaaaccagattcgcgagcaggcgcaagagctgggagtcctgttgtcatgggagcccagagccagtgggaaacagggatcttctctgcggcctggtggcgacgggatggagcagggttgcccaaaagatctcctggctgaatcaacccaagagctgaaaaaacagcagcaggctgctgctaccgtcaatcctgttttggctccaaaaaaagcagaggattccgcacctggtaaaattcagtacgaagtccatggccgtagccagcccgaagaacaggggcctccccaatctcccgcatccgagaccatccgtaaagccaccgggcagcagttgaccacaaacggcgctcagacctttggccctgaccacgctgatcagttgccggcaggacagaaagaatcatctcaagtgctgggcgtggaaccaggaggcaccgtagcggaaccagttggcccagccgcaatgaaccagttgctgcttcaattaagagaggaactcgccgctgtgtggcgggaaaaagacgcagcacgcggtgcactgagtaggccagttatggaaggggctttgggaacaccacgggctgaagcagctgccgctgcttgggagaaaatggaagcgagactcgagcgagtgctggctcgcctggaatgggccaaagctggcctgcaagttaagcccgaggtgccaagccaggagagccgcgagggcgctctgaaagcggcacccggaagcattaagcaggacgaagagaaagagaaacgcgtgcccggtgcacggggtgagccactgggcgcactgggcggagagaaagccctagggggtcttgctaaaggacaattggagaaggagatgtcagtccttcgcctttctaactcaaacctgcttgaagagctgggggagctgggaagagaacgacagcgcttacaacgcgaactgcaaagcctgtcccaaaggctgcaacgggagtttgtgccaaagccagaagctcaggtgcagcttcaacagttacgccagtccgtggggcttttaacaaatgaactggctatggaaaaggaagcaaccgaaaagctccgaaagctgctcgcctctcagtcctcaggcctgagagggttatgggactgcctgcccgcagaccttgtcggagagcggagcgctcagtctaaggcagcggaaagtctggaggagctgagggcctgtatctcaaccctcgtggatagacaccgagaagctcaacaggtgttagccaggctacaggaggagaatcagcagctgagaggatcgctgagcccctgtcgggaacccggtacaagtctgaaggctcccgctagccctcaggtggctgcactggaacaggacctaggaaagctggaggaggaattgcgagcggtgcaggccaccatgagcggtaagtctcaagagataggcaagctgaagcaattactgtaccaggccactgaggaggtggccgaactgcgtgccagggaggcagcctctctacgacagcacgagaaaactcggggatcgctggtggcacaggcccaagcgtggggccaggagctgaaggcattgcttgagaagtataatacagcctgcagggaggtcggacgcctaagggaggcggtcgcggaagagaggcgtcgaagtggagatctggcggcacaggctgccgaacaggagagacaggcatccgaaatgagggggcgttctgagcaattcgaaaaaaccgcggaacttctgaaggaaaagatggagcatctgatcggtgcctgccgcgataaagaggcaaagattaaggaactgctgaaaaaactggagcagctaagtgaggaggtgctcgccatccggggtgagaacgctcgcttagcactgcaactccaggatagccagaagaatcacgaggaaatcatctctacctatcggaaccacctgctgaacgctgccagaggctatatggaacacgaggtctacaatattctgctacagattctcagcatggaagaagagtag

SEQ ID NO: 53016 - DNA, 414 bp, Artificial Sequence
  Description of Artificial Sequence: Synthetic coding sequence
atgaagagaatattttcatgttcaagcacccaagtagctgtggagcgctggaatcggcacgaccagaaactgttagaggcggtgcatagaggcgacgtgggccgtgtcgcagccctggccagccgcaagagcgcccgtcccactaaactcgactcgaatgggcagtctccttttcacctggctgccagtaaaggactgaccgaatgcttaaccattttgctggccaacggggcagatataaattctaaaaacgaagatgggagcaccgccttgcatttagccacaatctcatgccaaccacagtgtgtcaaggtcttactgcagcctccgctggcggtccctcaagtatgtagctgctgtgtcactacgaaaccttcttggacatgttggatcatgatggatgtgcacccgtag

SEQ ID NO: 53017 - DNA, 489 bp, Artificial Sequence
  Description of Artificial Sequence: Synthetic coding sequence
atggaagacggtaagcgcgaacgctggcccaccctgatggaacggctatgcagcgacgggttcgccttcccccagtatcctataaaaccgtaccatctgaagagaatacatcgcgctgttctgcacggcaatctcgaaaagttaaaataccttctgctgacctattacgacgcgaacaagcgggaccgcaaagagcggacagcgctgcatctcgcttgtgccacgggtcagccagagatggtgcatctgctggtgagcagaagatgtgaattgaatctttgtgatagagaggatcggaccccactgataaaggcggtccagctcaggcaggaggcctgtgctactttgttattgcaaaatggtgccaaccccaatataactgacttcttcggacggacagcgctgcactacgctgtgtataatgaggatacttccatgatcgagaagctgctgtcacatggcaccaacatcgaagagtgctcgaagtag

SEQ ID NO: 53018 - DNA, 384 bp, Artificial Sequence
  Description of Artificial Sequence: Synthetic coding sequence
atgctgctgcagcaacaattggatgacgccagaaataaggccgacaatcaagagaaggccattctgaatattcaggcacggtgcgatgcaagggtgcagaacttgcaagctgagtgtcgaaaacatcgattactcctggaggaggataacaaaatgctggtgaatgagctgaatcactcaaaagagaaagaatgtcagtacgaaaaggaaaaggccgaaagagaagttgctgtgcggcagttgcagcagaagcgtgacgatgtccttaacaaaggatcagccaccaaggccctgctggatgcatcgtcaaggcactgcacatatctggagaacggcatgcaagactcccgcaaaaaactggaccagatgcggtcacaagcatag

SEQ ID NO: 53019 - DNA, 1041 bp, Artificial Sequence
  Description of Artificial Sequence: Synthetic coding sequence
atggaagatggtaagcgcgaacgctggcccaccctgatggagaggctatgcagcgatggctttgcttttccccaatatccaattaaaccttatcacttaaaacggatacaccgggctgttcttcatggaaatcttgaaaagctaaaatatctcttgcttacctattacgacgctaataaaagggatcgcaaggagcgtactgccttgcacctggcatgcgcaaccgggcagccagagatggttcaccttctggttagccggaggtgtgagctaaacttgtgcgaccgggaggataggacacctttaatcaaagccgtgcagttacgtcaggaagcttgcgcgacgcttttgctccagaacggcgctaatccgaacattacagatttttttgggagaacagctctgcactacgcggtgtacaatgaggacacctcaatgattgagaaactgttgagccacggtacaaacattgaagagtgctcaaaatgcgagtaccagcctctcctctttgctgtgagccgccgtaaggtgaaaatggtggaattcttgttgaaaaaaaaagcgaacgtgaacgccattgactatctggggagaagcgcgctcattcacgcagtcacactaggggaaaaggacattgtgattctcctgctccagcacaacattgacgtcctgagccgtgatgcttttcggaaaattgcaggggactatgcaatcgaagccaagaaccgcgtcatatttgatcttatttatgagtacgagaggaaaaggtatgaagatctgcctatcaatagtaatcccgtgtcatctcagaagcccccaacattgaagggaaccagtgacgaggaagattctgtgctcgggattgcccgagagaataaggacggagaaaagagcaggactgttagctccgagaaacccccaggtcttaaggccagcagcgcagaaaaggatagtgtcctgaacattgctagaggcaagaaagacggggaaaagaccaagcgtgtgagctcgcgcaaaaagccttctttggaggcaacctag

SEQ ID NO: 53020 - DNA, 5825 bp, Artificial Sequence
  Description of Artificial Sequence: Synthetic coding sequence
atggaagatggcaagcgggaacgctggccaaccctgatggagcgactgtgcagcgatggattcgcctttccccagtatcccataaaaccatatcatctgaaaagaatccatagagctgtgttgcacgggaaccttgagaagctcaaatacctgttgttgacatattacgatgcgaataaacgcgatcggaaagaacggacggcactccacttggcctgcgccaccggacaacctgagatggtacacctccttgtcagtagaaggtgtgaattaaacttatgcgatcgagaggacagaaccccactgattaaagctgttcagctccggcaggaagcttgcgctaccctgctgttgcagaacggagccaatccaaacattaccgatttcttcgggaggacagctctacactacgcagtgtacaacgaggacacctcaatgatagagaaactcctctctcatggaacaaatatcgaagagtgctcaaagtgcgaataccaacctctgcttttcgccgtttcccgacgtaaagttaaaatggtggaattcctcctaaaaaagaaggctaatgtgaacgccatcgattaccttggaaggtctgccctgatccacgcggtgactctgggcgagaaagacattgttatccttttactccagcacaatatagacgtcctcagcagggacgccttcagaaaaatcgcaggagattacgccatagaggccaagaacagagttatatttgacttaatatacgaatatgagcgcaagaggtatgaagacctgcccatcaattcaaatcctgtgtcatcccagaagcagcccgctcttaaagccacaagcggcaaagaggactcaatttctaatatagctaccgagatcaaggatgggcaaaagtctggcacagttagctcccagaaacagcctgccctcaaggacacgagcgataaggacgactccgtgagcaacactgctaccgagatcaaagatgaacaaaaaagcggcaccgtcctcccagctgtggagcagtgtctaaatcggtcactctataggcctgacgccgtcgcccaaccagtcaccgagaacgaattcagtctcgaatctgagatcattagcaagttgtacatacctaaacggaagatcatttctcctcggtctattaaagatgtcctgccacccgtggaggaagccgtcgacaggtgtctttatctacttgatcgtttcgctcagccagtgaccaaggacaagttcgccctagagtctgagaacatttccgaaccatattttacaaatagaagaacaatctcacagcaatccgccgaaaacctagacgctgcgtgcggtatcgataaaaccgagaatggcaacatgttcgaggatcaaaacgtggataaggaggggaaagcattgccagccacagggcaaaaggctaatgtgtcacctgagcagccccctctcttcacacatactgtaaaagaccgggaccacataagtacccggtttttagggggtatggattccctgacctccagcgaagagtccagcgaacgcccaccactgtctacactcaccttgaaggaggccgatccgtcgagcaaggctgccatgaggcggaaggatagtcccccacctgggaaagtgtctagccagaagcagcccgctgaaaaagcaacatccgatgacaaagattcagtgtctaacatcgctacagaaatcaaagagggacctatctcagggaccgtctcctctcagaaacagcccgcagagaaagccaccagcgacgagaaagattctgtgtcaaatattgctacggagattaagaagggacagcagtctggcaccgtttcacctcagaagcaatcagcttggaaagttatatttaagaagaaggtaagcctcctaaatatagccacccggattatgggcggaggcaaatccgggaccgtgtccagtcagaagcagcctgctagtaaggctacaagcgacaagacggacagcgccttgaacatcgctacggaaatcaaagatggactgcagtgcggcacagtctcttctcagaagcagccagccctcaaggcaactacagacgaagaggattcagtcagcaatatagcaacagagattaaggatggcgaaaagagtggcaccgtgagtagtcaaaagcagcccgctcttaaagccaccacggacgaagaagattccgtcagtaacatcgcaacagagataaaggatggggaaaaatccggtacggtttccagccagaagcagcccgcattgaaggcaactacagatgagaaggatagtgtctccaacatcgccactgagatcaaagatggtgaaaaaagtggtaccgtgagtagtcagaagccccctgccttaaccgcaacgagtgatgaggagggatctgtgttgagtattgcgagagaaaataaagacggcgaaaaatctcgcaccgtttcgagcaggaagaaacccgctctgaaggctacctcagatgagaaagactccttctctaacattacacgcggaaagaaggatggggaaatttctagaaaggtttcctcgcagaagcctcccacactaaagggcacctccgacgaagaggactctgtcctgggcattgccagggagaataaagatggcgagaaatctcgtactgttagcagtgagaaacctccaggactaaaggccagctctgccgaaaaagattcggtgttaaatattgctcgaggaaagaaggacggagaaaaaactaaacgtgtcagttctaggaaaaagcccagcctcgaagctacaagcgacgaaaaggattctttcagcaacatcacacgtgagaagaaagatggggaaattagcagaaaggtgagtagtcaaaaaccgcctgctttgaaaggaacatcagatgaagaggacagcgtactggggatcgctcgcgagaacaaggatggagagaagtcacgtactgttagtagcgaaaagcctccgggactgaaagctacatccgatgaaaaggactccgtgctcaacattgcgagagggaaaaaagacggggaaaaaactcgaacagtgtccagtcagaagccaccgaccctgaaagctaccagcgacgaggaagattctgtcctgtctatcgctcgtgagaacaaggatggcgagaaaagcagaaccgttagcagcgagaaacccagcggattaaaggcaactagtgcagagaaagactctgtgctaaatatcgccagaggtaaaaagtatggggaaaaaaccaaacgcgtgagttcgagaaagaagccagccctgaaggctacctcggacgagaaggactccgtactctacatcgccagagaaaaaaaggacggggagaagagccggaccgtctcttcacctaagcagccagccctgaaagccatctgtgataaggaggatagcgtgccaaatatggccaccgaaaagaaggacgaacaaatctcaggcaccgtcagctgccagaagcagcccgctctgaaggccacttcagataagaaagattcggtgtccaatataccaacggaaattaaggacgggcagcagtcagggacggtgagcagtcagaagcagccagcatggaaagccacaagcgtaaagaaggactcagtcagtaacatcgccactgaaattaaggatggtcagatacggggaaccgggatcctggagtatacatttaacgttatgttcgaccagatcgaagagaagtttacaagtctgaataaatcagcaggcgtgagcccgcagaaacagtcagctcagaaggtgatcttcaagaaaaaagtttccctgctgaacatcgcaactcgcatcaccggaggctggaagtccggaaccgaatatcccgagaatctaccaaccctcaaggccaccatcgagaacaaaaatagtgtgctcaataccgccactaagatgaaagatgtgcagacgtccactcctgccgagcaggatttagagatggcttctgagggggaacagaagcgtctcgaggaatacgagaacaaccaaccacaagtgaagaaccagattcacagccgagacgacctggacgatattatccagagtagccagactgtctctgaggatggagacagtttatgctgtaactgcaaaaacgttattcttctaatcgaccaacatgagatgaagtgcaaggattgtgtccatctgctgaagataaaaaacacgttctgtctctggaagaggctaatcaagctgaaggacaatcactgcgagcaactgcgtgtcaaaatcaggaagctgaaaaacaaggcttctgttctacaaaagagaatatctgaaaaggaggaaattaagtctcagcttaaacatgagattcttgagttggagaaggagctgtgctctcttagattcgccattcagcaagagaaaaagaagagacggaatgtagaagaagtgcatcaaaaggtgagggaaaagttgaggatcactgaagagcagtacagaatcgaggctgatgtgactaagccaatcaagcccgctctgaagtctgctgaagtggaattaaaaaccggaggcaacaacagcaatcaagtgtcagaaacggacgagaaggaggacctgctgcatgagaatcggcttatgcaggatgaaattgctcgcttacgccttgagaaggataccatcaagaaccagaacttggagaaaaaatatctgaaagacttcgaaattgtgaaaagaaagcatgaagacctgcaaaaagcattaaagaggaacggcgagactttagccaagaccatcgcctgctatagcggacagttagccgcattgaccgatgagaacaccactctgaggagcaagctggagaagcaacgcgaatcacgtcagcgccttgagactgagatgcagtcttatcactgcaggttgaatgctgctaggtgtgaccacgatcagagccacagcagcaagagagaccaggagctcgccttccaaggcaccgtcgataagtgccgccacctgcaggagaatctgaattcccacgtgcttatcttgagcctgcaactgtcaaaagccgaaagtaagagccgggtgctgaaaaccgaactccattacacaggcgaggccctaaaggagaaggctctggtattcgagcatgtccagtccgagttgaaacagaaacagagtcagatgaaagacatcgaaaagatgtacaaaagcggctataacactatggaaaagtgtattgagaaacaggaacgcttttgccagttaaagaagcagaacatgctgctacagcagcagttggatgatgccagaaacaaggcggacaaccaggagaaggccatcctgaatattcaggcccgttgtgatgcaagggttcaaaacctgcaagctgagtgtcgcaaacataggttgctcctggaggaggataacaagatgctggtaaatgagctcaaccactccaaggagaaagagtgtcagtacgaaaaagaaaaggccgaacgggaagtggcagtgcgacagctgcagcagaaacgtgacgacgtactgaacaaaggatccgctacaaaggccctgcttgacgcatcgagtcgtcattgcacttacctcgaaaatggaatgcaagacagcaggaagaagttagatcaaatgcgcagccagttccaggagatacaggaccagctgaccgcgactatacgatgtacgaaggaaatggaaggagacactcagaagctggaggtcgagcatgtaatgatgagaaagatcatcaaaaagcaggatgaccagatcgaaaggttggaaaagatactccaacatagcagcttgatgctgcaagtctttgagtctta

SEQ ID NO: 53021 - DNA, 930 bp, Artificial Sequence
  Description of Artificial Sequence: Synthetic coding sequence
atggaagatggtaaacgagaaagatggccaactctgatggaacggctctgttcagacggtttcgctttcccccagtacccaatcaagccctaccacctcaagcggatccatagagcagtgttgcatggcaatctggaaaaacttaaatatctgctcctaacatattatgatgctaataagcgcgacaggaaagagcggaccgccctgcacttagcctgtgctaccggacagcccgaaatggttcatctccttgtgtcccgccgttgcgaactcaatttatgcgaccgggaagatagaaccccactcatcaaggcagtccaactccgtcaggaagcctgcgcaacactcctgctccagaatggtgcgaacccaaacattacggatttcttcgggagaactgccctccactatgctgtgtacaatgaggacacctctatgatcgagaaactgctcagccacggcacaaatattgaagaatgttccaagtgtgaataccagcctctgttgttcgcagttagcagacgtaaagtgaagatggtggaatttctgcttaaaaagaaggcgaatgtgaacgctattgactacctggggcgttcagccctgatccacgctgtcacgttgggagaaaaagacatcgtcatccttctcctgcagcataatattgacgtacttagcagggacgccttccgtaagattgccggtgactatgccatcgaggccaagaatcgagtgattttcgacctgatatacgaatatgaacggaagcgatatgaagacttgccaataaactctaatcccgtgtcatcacaaaaacagccagctcttgcaacagagcaggacagcatgtcgaagatcaagaaacgcaagctgattgttatgaaaaagaagtcaatggtaatccagaggtttctcgtgactttctgcaaatag

SEQ ID NO: 53022 - DNA, 5825 bp, Artificial Sequence
  Description of Artificial Sequence: Synthetic coding sequence
atggaagatggaaaaagagaacgctggcctactctcatggagagactgtgttcagacggttttgcgtttccacagtatccaatcaagccctaccatttgaagcgcattcacagagctgttctccacgggaatctagagaagctgaaatatcttttgctcacttactatgatgccaacaagcgcgacagaaaagagcgcacggccctccacttggcctgtgctacaggccagcctgagatggtgcacctgttagtgtctaggagatgcgagctgaacctttgtgaccgcgaggatcggaccccactgatcaaagccgtgcaattaaggcaggaagcgtgcgccactctacttctccagaacggtgctaaccccaatatcactgatttctttggtaggacggcccttcattacgctgtctataacgaagatacatctatgatcgaaaaactgctgagtcacgggacgaacatcgaggagtgttccaagtgcgaataccagcccctcctgttcgccgtgagtaggcggaaagttaaaatggttgagttccttctcaaaaaaaaggccaacgttaacgcaatagactacctcgggagatctgccttgatccacgccgtgaccctcggggagaaggatatagttatcttgctgctacagcataatatcgacgtgctgtcgcgcgatgctttcagaaagatcgctggcgattacgccatcgaagccaagaaccgggtcatcttcgacctgatctatgaatacgagaggaaacgctacgaggatctccccattaattcaaacccagtgtctagccagaaacagcccgctctcaaggccacaagcgggaaagaggactctatttcgaacatcgccactgagatcaaggatgggcagaaatcgggcaccgtttcatcacagaagcaacccgctcttaaggatacctcagataaggacgatagtgtaagtaatacagcgaccgagataaaagatgaacagaaaagcgggaccgtgctacctgctgtggagcagtgtctcaatagatctctatacagaccagatgccgtggcccagcctgtcactgagaatgaattcagcttagagagtgagatcattagcaagctgtacatccccaagagaaagataatttcccctcggtccattaaggacgtgctcccccctgtagaggaagccgtggataggtgcctttatctgctcgaccgcttcgcccaaccggttaccaaggacaaattcgctctcgaatccgaaaatatcagcgaaccctatttcactaaccgacggacaatatcacagcagagcgctgagaacctggatgccgcttgtggaatcgacaagaccgagaatgggaatatgttcgaggaccaaaacgtcgacaaggaaggtaaggctctccccgctaccggacaaaaggcaaatgtcagcccagagcagccgcctttgttcacccacaccgtcaaggatcgcgaccatatctcaacccggttcctgggaggaatggatagtctcacttcgagcgaggaaagcagtgaaaggccgccactgagcacactcactttgaaagaggccgatcctagcagcaaggctgcaatgaggaggaaggactcaccccctcctggcaaggtgtcctcacagaagcagcccgcagagaaagctacatccgacgacaaagattctgttagtaacattgcaacagagatcaaagaaggccctatctccggcacagtgagctctcagaagcagcctgcagagaaagctacctctgacgagaaggacagcgtaagcaatatcgcgactgagatcaaaaagggccagcaaagcggtaccgtctctcctcagaagcagtcagcatggaaagtaatcttcaagaagaaggttagcctactgaacatcgctactcgtatcatgggaggaggcaagagcggcaccgtgtcaagccagaagcaacccgcaagcaaggccaccagcgacaaaaccgactccgcgctgaatatcgccaccgagatcaaggacggcctgcagtgcgggaccgtttcctcacaaaagcaaccagccctgaaggccacaactgacgaggaagatagcgtgtccaatatcgctacagagattaaagatggtgagaagtccgggaccgtatcaagccagaaacaaccggctttaaaggcgactaccgatgaagaagacagtgtttcgaatatcgcaactgagataaaagacggagaaaagtcggggactgtgtcaagccagaaacagcccgctctgaaggcaactacagatgagaaagacagcgtgtccaatattgccaccgagataaaggacggcgaaaaatctggaactgtttcatcccagaagcctccggcattgacggctacgagcgatgaggaggggagcgtcttgagtatcgctagagaaaacaaggatggcgaaaagtcaaggacggtgagctcacgcaagaaaccagcgctcaaagccacgtccgatgaaaaggattcattttctaacatcacccgtggcaagaaggacggggagatttccagaaaggtcagctcccagaaaccaccaactttgaaggggacttccgacgaagaagactctgtgctgggcatcgccagggagaacaaagatggtgaaaagtctcggacagtgagcagcgaaaagccacccggtttgaaggcctctagcgcagagaaggatagcgtgctgaatatagcacgcggtaaaaaggacggagaaaaaaccaagcgcgtctcctctaggaaaaagccaagtctggaagccactagtgatgagaaagatagcttctctaatattacgagagaaaagaaagacggggaaattagcaggaaagtgtcttctcaaaaaccccctgcattgaaaggaacctcagacgaagaggatagcgtacttgggatcgcgagagagaataaggacggagagaagtcgagaacagttagttccgagaagccacctggccttaaagctacctccgatgaaaaagacagtgtcctcaatatcgccagagggaaaaaagatggtgagaaaactaggactgtaagttcccagaaaccacccactctaaaagctacatcagacgaggaagatagtgtccttagtattgctagggaaaacaaagacggggagaaatcccgaacggtgtcttccgaaaagccgagtggcttaaaggccactagtgctgaaaaggattccgtcctgaacatagctcggggaaagaagtacggggaaaagaccaaacgcgtttcttcgaggaaaaaacccgctctgaaggccacttcggatgagaaggactccgtgttgtacatcgctcgagagaagaaggatggagagaaaagtcggacagttagctcccctaaacaaccggcactgaaggcaatctgcgataaagaggattccgttcctaatatggcaacggagaagaaggatgagcagatctcaggaactgtttcttgtcagaagcaacccgcattgaaggcgacttccgataagaaggacagcgttagcaacatacctactgaaatcaaagacggccaacaaagcggcaccgtaagctcccaaaagcagcccgcatggaaggcgacatcagtcaaaaaagatagcgtgtcaaacatcgcaacagagatcaaagatggacagatacggggaacgggtatcttggagtatacatttaacgtgatgtttgatcagatcgaggagaagttcaccagtctgaataagtctgccggagttagtccacaaaagcagagcgcgcagaaagtgattttcaagaaaaaagtgagtttgctgaacattgccacaagaattaccggcggatggaagtctggcactgagtatccagagaatttacccacccttaaggccaccatcgaaaataaaaacagcgtgctcaataccgccaccaaaatgaaagatgttcagaccagcacccctgccgagcaggacttggaaatggcaagtgaaggagaacagaaacggctggaggagtacgagaacaatcaaccgcaggtgaaaaatcagatccacagtcgcgatgatttagatgacatcatacaaagttcacagacagtatccgaggacggagattccctgtgttgtaactgtaaaaatgtgatccttctgattgatcaacatgagatgaagtgtaaagactgtgtgcatctacttaaaattaaaaataccttctgtctctggaagcgcctcatcaaacttaaagacaaccactgcgagcaactgagggtcaagatcaggaaactcaagaacaaagccagcgtgctgcaaaaaagaataagcgaaaaggaagagattaagagccagctgaagcacgagatactggaactggagaaggaattgtgtagtttgcgctttgcaattcaacaagaaaagaaaaagaggcgtaacgttgaggaggtccatcagaaggttcgggaaaaattaaggattactgaggagcagtaccgaattgaggccgatgtgactaagcctataaagccggcacttaagagtgccgaagtcgaactgaaaactggaggcaacaactccaaccaggttagcgagactgacgagaaagaagacctgctccacgagaacagactcatgcaggatgagattgctcgcttacgcctggagaaagacacaattaagaaccagaatctcgagaaaaagtatctcaaagactttgagatcgtgaagaggaaacatgaagatcttcaaaaggcccttaagcgaaatggcgagacacttgctaagactattgcgtgttactccgggcagctggctgcattaaccgacgagaacacaaccctccgcagcaaattggaaaaacagcgagagtctagacagagactcgaaaccgagatgcagagttaccattgtcgcctcaatgccgcacggtgcgaccacgaccagtcccattcctctaagagggaccaagagctggcatttcaaggcaccgtcgataagtgccgccatcttcaggagaatctcaattctcacgttcttatattgagtctccagctgtccaaagctgaaagcaagagccgcgtgctcaagaccgaacttcattacactggagaggccctgaaagaaaaggctctcgtgttcgagcacgtccagtccgagcttaaacagaaacaaagccagatgaaggatatcgaaaaaatgtacaaatcgggttacaataccatggaaaagtgcatagagaagcaggaacgcttttgccagctcaaaaagcaaaatatgttgttgcagcagcagcttgacgatgcaaggaacaaggctgataatcaagagaaggcaatcttgaacattcaagcgagatgtgacgcccgtgtacagaatctccaggccgagtgtcgcaagcaccggctgctactggaggaagacaataagatgttggttaatgaactgaatcattccaaggagaaagaatgccagtacgagaaagaaaaagccgaaagagaggttgctgtccggcagttacagcagaagcgagatgatgtgctgaataaaggctccgccaccaaggcccttctggacgctagtagcagacattgtacatacctggagaatgggatgcaggattctagaaagaaactcgatcagatgaggagtcaatttcaagaaatacaggatcagctgaccgctacgatcagatgtactaaggaaatggaaggggacacccaaaagttagaagtcgaacatgtgatgatgcgaaagattatcaagaaacaggatgatcaaatcgaaaggctcgagaagattctgcaacattcgagcctcatgctgcaggtgtttgaatccta

SEQ ID NO: 53023 - DNA, 3627 bp, Artificial Sequence
  Description of Artificial Sequence: Synthetic coding sequence
atgggcggtggcaagagtggaacagtgtcttcacagaagcaaccagcatcaaaagcaacgtcagataaaaccgattctgcactgaacatcgctacagaaatcaaagacggcctccagtgtggcactgtgagttcccagaaacagcccgctctgaaggcaacgactgacgaggaggatagtgtctccaatattgcgacggagatcaaggatggggagaagtcagggacagtttctagccaaaaacagcccgcactcaaagctacaaccgacgaagaggactcggtctccaacatcgccacggagatcaaagatggcgaaaaatccggaactgtgtccagccaaaagcaacccgcattgaaagcgaccactgacgagaaggacagtgtgagcaacatcgctacggagattaaagacggtgaaaagtccggcaccgtatcctcccagaagcctcctgcgcttacggccacctccgatgaggaagggtccgtgctgagcatcgcaagggagaacaaggatggagaaaagagtaggaccgtgtccagcagaaaaaagcctgccttgaaagcaacgtctgacgagaaggattcgtttagtaatataactcggggaaaaaaggacggagaaatctcccggaaggtaagttcacaaaagccacccacactcaaaggtaccagcgacgaggaggactcggtactgggcatagcccgtgaaaataaagatggagagaaatcccggaccgtatctagtgagaaacctcctgggctgaaggctagcagtgccgagaaggactctgttttaaatatagctcggggtaaaaaggatggggaaaagaccaagcgcgtctcttctcggaagaagcctagcctcgaagccacatccgacgaaaaggactctttcagtaacatcactagggagaaaaaggacggcgaaatatcccgaaaggtgagctcccagaaaccaccggctctcaaaggaacctccgatgaagaggactctgtgctcggaatcgctagggagaacaaggacggtgaaaagtctcgcaccgtatcaagcgagaagccccctggacttaaggccacctccgacgaaaaagactcagtcctgaacatcgcgagggggaagaaggacggcgagaagacaaggacagttagtagtcccaaacaacccgctttgaaggcaatttgtgataaagaggactccgtccctaatatggccaccgagaaaaaagatgagcagatatctggaactgtctcatgtcaaaagcagcccgctctgaaagccacatcggacaagaaagactcagtgtccaatattccaactgaaattaaagacggccagcaaagcggaacggtctcctctcagaagcaacccgcttggaaggccacctcagtgaagaaagactctgtgtcaaacattgcgactgagattaaggacggccagattcgcggtaccgtgtccccacaggtgcctattcccaggcacaaggtggggaacattaagtcatacccaaacactggtcgcagaatccagcttgatgctaacacgttcagtgtgagccctcagaaacagtcggcccagaaagtgatttttaaaaagaaggtcagcctgctcaatattgctactagaatcaccgggggttggaagtctgggaccgaatacccggagaatctccccacgctgaaagctactatcgagaataagaattccgtgctgaatacagcaacgaagatgaaggacgtgcagacctcaacacctgctgagcaggatctagaaatggcttctgagggcgagcagaaacgactggaagagtacgagaacaaccaaccgcaagtgaagaaccagattcacagtagggatgacctggacgatattatacagtcatcccagacagtcagtgaggatggcgacagtttatgctgcaattgcaaaaatgttatcctgctcatcgaccagcacgaaatgaagtgcaaggattgcgtgcacctgctaaagatcaagaacactttctgcctttggaaaagactgatcaagttaaaggacaaccattgtgagcagctacgtgtgaagatccgtaagctcaagaacaaagcttccgtgctccaaaagcgtatctccgaaaaggaggagattaaaagccagctcaagcatgagatccttgagttagaaaaggagctgtgttcactgcgatttgcaatccagcaagaaaagaaaaagaggaggaacgtcgaggaagtgcatcagaaagtacgcgagaagctgaggatcactgaggagcagtaccgcatcgaggcagacgtaaccaagccaattaaacctgccttgaagagtgccgaggttgaacttaaaacgggcggaaataacagtaaccaagtgagtgaaaccgacgagaaggaggatctgctgcacgagaatagactgatgcaagatgagatcgcacgcttaaggttagagaaagacacaattaaaaatcagaacttggaaaagaaatacctgaaagatttcgaaattgtgaagaggaagcacgaggaccttcagaaggcgctgaagaggaacggagaaaccctcgccaagacgattgcctgctactccggccagctcgccgctcttaccgatgaaaacactacccttagaagtaaactagagaaacagcgagagtcccggcaaaggttagaaactgagatgcagtcttatcattgtagactgaacgcagcgagatgtgatcacgaccagtcccacagctctaaacgggatcaagagctggcctttcagggcaccgtcgataagtgccggcaccttcaggaaaatttgaatagtcacgtcctgattctttctctgcagctgtctaaggctgagtctaagagcagggtcctcaaaaccgagctccattacactggtgaggccttgaaggagaaggctctggtgttcgagcatgtccaatcggagttgaagcagaaacagtcccagatgaaagatattgaaaaaatgtacaagtctggctacaacaccatggagaagtgcattgaaaagcaggagcggttctgccagctcaaaaagcagaatatgctcctgcagcagcaactggatgacgctcgtaacaaagcagacaatcaggagaaagcaattctgaatattcaagctcgttgtgatgcccgtgttcagaatttacaggccgagtgtcgcaagcaccgactcttgttggaagaagacaacaaaatgctcgtcaacgagctgaaccactcaaaagagaaggagtgtcagtatgaaaaagaaaaggcggagcgtgaagtagctgtcagacagctgcagcagaaaagagacgatgtactgaacaagggctctgctactaaggcacttcttgacgctagctctaggcactgcacctatttggagaatggcatgcaggacagccgcaagaagttagatcagatgcgctctcagttccaggagatacaagaccagctgactgccaccatcagatgtacgaaagaaatggagggtgatacacagaaactggaagtggagcatgtgatgatgaggaaaatcatcaagaagcaggatgatcagatcgagcgcctcgagaagattctccagcactcctccctattattactgaactttgagacttag

SEQ ID NO: 53024 - DNA, 1821 bp, Artificial Sequence
  Description of Artificial Sequence: Synthetic coding sequence
agttctaggaaaaagccagcgttgaaggccacatcggatgaaaaggatagcttttcaaatatcactcgcgagaagaaggacggcgagacttcccgcaccgtttcgtcccagaaacctcccgctctgaaggcgacctcagacgaagaagattcagtcctctccattgccagggaggagaaggatggagagaaatcaagaacagtaagctcagagcaacctccgggactcaaggcaacacgcgatgagaaggatagtctgttgaatatcgctagagtcatccaagctggtgggcagtcttttagtgtgtcttctaggaaaaaggcagccctaaaggcaacaagcgacgagaaggattccttctccaacattactcgcgagaggaaagacggagagaccagccgcacagttagttctcagaaacctcccgctctgaaggcaacaagtgacgaggaggattctgtgctgaatattgccagagagaaaaaagacggcgaaaaaagtcgcactgtgtcctcaaggaagaaggccgctctgaaggctactagcgacgagaaggacagctttagtaatatcacacgcgagagaaaggatggtgagacatcgcggacagtttccagccagaagccaccggctttgaaggccacgagcgatgaggaagattcagttcttaacattgcacgggagaaaaaggacggcgagaaatctaggaccgtgagcagcgagcagcctcccggactgaaggcaacacgcgacgagaaggattctctgttaaacatcgcccgtgggaagaaacacggagagaagacacggcgagtcagctcacggaaaaaggcggctttgaaagcgacgtcagatgagaaggacagtttctcgaatattacaagagagcgcaaggatggtgaaacctcccgcactgtgtccagtcaaaagcccccagcattaaaggctaccggggacgaagaggacagtgtattaaacatagccagagagaagaaggacggtgaaaagagtcggactgtctcatccgaaaagccaagcggactaaaggcgacctctgacgagaaggatagcgttttgaatattgcgagagggaagaagcacggtgagaaaacaagaagagttagtagtcataaacaacccgctctcaaagcaacatcagataaagaaaactccgttcccaatatggccaccgaaaccaaagatgagcagatcagtggaaccgtgtcttctcagaagcagccagctcttaaggcgaccagcgacaaaaaggattctgtgtcaaatattccgacagaaatcaaggatggacaacagagcggaaccgtcagttctcaaaagcaattagcatggaaggcaaccagcgttaagaaggattccgtgagcaacattgccacggaaattaaagacggtcagatccgaggcaccgttagtagccagagacaacctgccctcaaggcaaccggcgatgagaaggattctgtaagcaatatcgccagggagattaaggatggcgaaaagtctggcaccgtgagtccccagaaacagtcagcccagaaagtgatttttaaaaaaaaagtgtctctgctgaacattgctacccgcatcaccgggggatggaagagcgggaccgaataccccgagaatttacctaccctcaaggctactatagaaaataagaattccgtactgaataccgctactaaaatgaaggatgtgcagacgtccactccagaacaggatctagagatggcctctgagggggagcagaagcggctcgaagaatacgagaataaccagccccaagtgtacttttcattctag

SEQ ID NO: 53025 - DNA, 2400 bp, Artificial Sequence
  Description of Artificial Sequence: Synthetic coding sequence
atggcaactgagaccaaggatgaacaaatctctggcaccgtgtcaagccagaagcagccggctctaaaggcaacttccgacaagaaggacagcgtttccaatattcctaccgaaattaaagacgggcagcagtcaggcacggtatctagtcagaagcagttagcctggaaggctacctccgttaagaaggattccgttagtaatatcgctacagagatcaaggatggacagatccgcggaaccgtatcctcgcagcgccaacctgccctgaaagctactggcgatgagaaggactccgtaagtaatatcgctcgtgagatcaaagacggtgaaaagagcggtacagtcagcccccagaaacagagcgcgcaaaaggttatcttcaagaaaaaagtttctctgctgaacatcgccacaagaatcactgggggatggaagagtgggacggagtaccccgagaatctacctacccttaaagccacaatcgagaacaagaactccgtgcttaataccgccaccaagatgaaagatgtgcaaacatccacacctgagcaggatctagagatggcctccgagggagagcagaagcgactagaagagtacgaaaataatcagcctcaggttaaaaaccaaatccactcccgtgatgacctggatgatataattcagtcatcacaaacagtgtctgaagatggtgacagtctctgctgtaattgtaagaatgtaatattacttattgatcaacatgaaatgaagtgcaaggattgcgttcatctcctgaaaatcaagaagacattttgtctctgtaagcgtttaaccgaattgaaagacaatcattgcgagcagctgcgggtcaaaattcgtaaactgaagaacaaagccagcgttcttcagaagcgtttgagcgagaaggaagagataaaatctcaactgaaacatgagaccctcgagctggagaaggaattgtgtagcctaagattcgccatccagcaggaaaagaagaaacgaaggaatgtggaagagctccaccaaaaggtgcgagaaaagctgagaatcactgaggaacaataccgtatcgaagcggacgttacaaaacccatcaaacctgcgttaaaatcagccgaagtggaactgaaaaccgggggtaataattctaatcaggtatccgagaccgacgagaaggaggacctcttgcacgagaataggctcatgcaggatgaaatagcacggctgcgattagagaaggatactataaaaaaccagaatctcgagaagaagtatctgaaagatttcgaaatagtgaagcgaaaacatgaagacctgcaaaaagcactgaaacgcaacgaggagacacttgccgaaacgatcgcgtgctactctgggcagctggccgctctcacggacgaaaacaccacgctgaggtccaaacttgagaaacagagggagagcggccagagactggagactgagatgcagagctaccgctgtcgcctcaacgctgctctttgtgaccacgaccagagccactctagcaaaagggaccaagagttggccttccagggcacagtggataaatgctgccatttgcaggagaacctcaactcgcatgtgctaatccttagcctacagctctctaaggcggagtctaaattcagggtgctcgagaccgagctgcattacacgggtgaagccctgaaggaaaaagcgctcgtattcgaacatgtgcagtctgagctcaagcagaagcaatcacaaatgaaggatatcgagaagatgtacaaatcaggctataacacaatggaaaaatgtattgagaagcaggagcggttctgtcaactgaagaaacaaaatatgctactccagcagcagttggacgacgctcggaataaggcagacaaccaggaaaaggctatcctcaatatccaggccagatgcgacgcgagagtggagaatctgcaggcagaatgtcgaaagcatcgactgctgctggaagaggataataagatgttggtcaacgagctcaatcacagcaaggaaaaaaagtgccagtacgagaaagagaaggctgagcgtgaggtcgccgtcagacaattgcagcagaagcaggacgacgtcctgaacaaacgatccgctactaaggcgctcttagacgccagcagccggcactgtatctacttagagaacggtatgcaggactcgcggaagaagcttgaccagatgcgcagccagtttcaggaaatccaggatcaactgaccgccacaatcaggtgtactaaagagatggagggcgacgcacagaagctggaagtagaaaacgtaatgatgcgaaagattataaagaagcaggacgagcaaatcgagagattcgaaaagattcttcagcacagctccctggtgtag

SEQ ID NO: 53026 - DNA, 3090 bp, Artificial Sequence
  Description of Artificial Sequence: Synthetic coding sequence
tccagccgcaaaaaggcggcactcaaggcaacctccgatgagaaggacagtttctctaatattacacgagagagaaaggacggcgagacatcccggacagtcagtagccagaaacctcctgcacttaaggccaccagcgacgaggaagacagtgtgttaaatattgcccgtgagaagaaagacggggagaagtctcgcactgtgtcctcagaacagcctccaggcctgaaagcgacccgcgacgagaaggattctctgctgaacatcgctagaggcaaaaagcatggagagaagaccagaagagtttcttcccgaaagaaagcagccctgaaggctaccagtgatgagaaagacagcttctctaacattacccgggagaggaaagatggcgagacttctaggaccgtgtctagccagaaaccaccggctcttaaagctaccggagacgaggaggactccgtgctcaatattgcacgggagaaaaaagacggcgaaaagagtagaaccgtctcctctgagaagcctagcggattgaaggcaacttcagacgagaaagattcagtcctgaatattgccagaggcaagaaacacggcgaaaaaaccaggcgagtgagcagtcacaaacaacccgcactgaaagctacctccgacaaagagaattctgtcccaaacatggcaacagaaactaaagacgaacagatctccggcactgtaagttcccagaaacaaccagctctgaaagccacatctgacaaaaaggatagcgtgagcaacattcccacagagataaaggacggacaacagtctggaacggtaagctcacaaaaacagctcgcatggaaagcgacctctgtcaagaaggacagtgtgtcgaatatagccacagaaatcaaagacggccagattcgaggcactgtgtcaagccagagacaacctgccctcaaggcaaccggcgacgagaaagatagcgtctctaacattgcaagggagatcaaagacggagaaaagtccggcactgttagtccacagaaacagtctgctcaaaaagtcatctttaagaaaaaagtgtctctgctgaacatcgcaacacggattacaggcggatggaaaagcggtaccgagtaccccgagaacttacctactctcaaggcaactattgagaataaaaactctgtccttaacacggcaacaaaaatgaaggacgtacagacctccacccctgagcaagacttagagatggcgtcggaaggggaacaaaaaagattggaggagtacgaaaataaccaaccacaggtgaagaaccagatccactcccgcgacgatctagatgatattattcaatcttctcagacagtgagcgaagatggggatagtctgtgctgcaactgcaagaatgtcattcttttgatagaccagcatgaaatgaaatgtaaggattgcgttcatcttctgaaaattaagaagacattctgtctgtgcaaaagactgactgagttaaaagacaatcattgtgaacagctgcgagtcaagatcagaaagttgaaaaataaagcctctgtccttcaaaaacgactaagtgagaaggaggaaatcaaaagccagctaaagcacgaaaccctcgagcttgagaaagaattatgctcactgagattcgccattcagcaggagaagaaaaagagacgcaatgtggaggaactgcatcaaaaagttagagaaaaactgaggattaccgaggagcagtacaggattgaggcagatgtgaccaagcctatcaagcccgctcttaagagtgccgaggtggaactgaaaacaggaggtaataactccaatcaagtatctgagactgacgaaaaagaggacttgctgcacgaaaacaggctgatgcaggacgagatcgccagattacgcctcgagaaggacacgatcaagaaccagaacctggagaagaaatacttaaaagattttgagattgttaagagaaaacacgaggatctgcagaaggctctgaagcggaacgaggagactctggccgaaacgatagcttgctactcgggccagctcgctgccttgactgacgaaaacaccaccttacggtctaagcttgagaaacagagggaatcaggccagagattggagactgaaatgcaatcctatagatgccgccttaacgctgccctgtgtgatcacgatcagtcacactctagcaaacgggatcaggagctagcttttcaagggactgtagataagtgttgccatttacaagagaacctcaactcgcacgtgttgatcctgtcactgcagctaagcaaggccgaaagcaaattccgcgtgctagagacagagctacattacaccggagaggcactgaaggaaaaggctttagtattcgaacatgtgcaatccgaattaaagcaaaagcagagccagatgaaggacatcgaaaagatgtataagtctggatacaataccatggagaaatgcatagagaagcaggagcgtttttgccaactgaagaaacagaatatgctcctccagcagcagctggacgacgcaaggaacaaggctgataatcaagaaaaggctattctcaacattcaggcacgatgtgacgcgagagttgagaaccttcaagccgaatgcaggaaacacagactgctgctagaggaggataacaagatgttggtgaacgaactgaatcacagcaaggaaaagaagtgtcagtacgagaaggagaaagcagaaagggaagtagccgtgcgtcagctacagcaaaagcaggacgacgtgttgaataagcgcagtgccacaaaagcattgctcgatgctagcagtcgccattgcatttatctggagaatggtatgcaggattcaagaaaaaagctagatcagatgagaagccagttccaggagatccaggatcagttgacggccaccattcgctgcaccaaggagatggaaggggacgcccagaaactcgaggtggagaacgtaatgatgagaaagattataaaaaagcaggacgaacaaatcgaaagatttgaaaagattctgcaacattccagcctcgtcagtataatcttcgagacctag

SEQ ID NO: 53027 - DNA, 5336 bp, Artificial Sequence
  Description of Artificial Sequence: Synthetic coding sequence
atggacgataaggaacctaagcgctggcccaccctccgagaccggctgtgcagcgatgggttcttgtttcctcagtatcccattaagccgtatcatctcaaagggatccatcgggcagtattctatcgggacttagaggagctgaagttcgtactgctgacccgctatgatataaacaagcgagatagaaaagagcgaaccgcattacatctcgcgtgtgcgaccggccagcccgagatggtacatctgctggtgtctagacggtgcgaactgaacctatgtgatagggaggaccgaacccctctgatcaaggccgtccagctgcgtcaagaagcttgcgcgacgctccttctgcagaatggggcagacccaaatatcacagacgtcttcggacgaaccgcccttcactatgcagtttataacgaagacacctcaatgatcgaaaagctgctctcctacggcgctaatatcgaggagtgctctgaagacgagtatcctccactctttctggctgtgtcacagaggaaagttaagatggtcgaattccttcttaagaaaaaagctaatatcaacgccgttgactaccttggcaggagtgctctgatccatgcagtgacgctgggcgaaaaggacatcgtgatcctgcttctgcagcacaatatcgacgtgttcagccgtgatgtatatgggaagctggcagaagattacgcttcagaagccaagaatcgcgttattttcgagctgatctacgaatatgaacgaaaaaaacacgaggagctatcgatcaattctaatccagtgtcttcccagaagcaaccagcattgaaagcgacaagcggaaaggaggactcaatctcaaacattgccacggagatcaaggatggacagaaatcagggaccgttagctcgcagaaacagccggctctgaagggtacaagtgataagaacgattccgtctcaaacactgccaccgagattaaggatgaacagaagtcaggcaccgtgagtagtcagaaacagccagctctgaaagacacctcagacaaaaatgactccgttagcaataccgcaacagagataaaggacgagcaaaagtccggcaccgtgcttcccgctgtggaacagtgccttaatcggagcttgtatcgacccgatgccgtggcgcagccagtcaccgaagatgagttcgcactggagtctgagattataagcaaactgtacatccctaagcgtaagattatttctccaaggtccatcgaggatgtactccctcccgttgaagaggccgtggacaggtgcttatatctcctggaccgcttcgctcaggccgtcaccaaggacaagtttgctctggaatctgaaaacatctctgaaccctacttcactaaccgacgaacaataagccagcagtctgccgagaagctcgatgctgcctgcggcatcgacaagaccgagaacggtacactcttcgaggatcagaatgttgataaggagggtaaggcactgcctgcaactggtcagaaagccaacgtaagtccagagcagcctccactctttacacatactgtgaaggactctgatcatatctctaccaggttcctgggctcaatggattcattgacatcctccgaagaaagctcggagcgaccaccactttctaccttgacactgaaggaagcagacccatccagcaaagccgctatgagacgtaaggactcccctccacccggaaaggtgtcatcccagaagcagccagcagagaaggcaactagcgatgacaaagacagcgttagcaacatcgcaaccgaaatcaaagagggcccaatttctgggaccgtgagctcccagaagcagcccgctgaaaaggcaactagcgacgaaaaggactcagtctcaaacattgccaccgaaatcaaagagggccagcagagcggtaccgtgagccctcagaaacaatccgcctggaaggtcatttttaaaaaaaaagtctccctcctgaatattgccacacgcatcaccgggggtggaaagagcgggaccgtgtcctcccagaaacagcctcctagcaaagccacaagcgataagacggatagtgccctcaacattgcaacggagatcaaggatggcttacagtgcggcaccgtgtccagtcagaagcagccagccctgaaagccactaccgacgaggaggactcagtgtctaacatcgctaccgagattaaagatggagagaaaagtggcactgtgtccagtcaaaagcagcccgctttaaaggcaaccaccgacgaagaggattccgtgagcataattgccacggaaatcaaggacggagaaaaatccgggaccgtctcctcccgtaaaaaacctgccctgaaagcaacgtccgatgagaaggattccttctccaatatcacacgcgagaaaaaggatggggagatttcaagaaccgtcacatctgagaagcctgccggtctaaaggccacttcagacgaggaggatagtgtcctcaacattgcccgtggcaaggaggacggtgaaaaaacgaggagggtgtcctcccggaaaaagccagcgcttaaggccacttccgacgagaaggactctttcagcaatatcacgcgcgagaaaaaggacggagagacctccagaaccgtgtcttcccagaagcctcccgctcttaaggctacatcagacgaagaagacagcgttttgaatatcgcaagagagaaaaaggatggggaaaaatcacgcaccgtgagttctgaaaagccgtccggcctcaaagcgacaagtgacgaaaaggactccgtgctgaacatagccagagggaagaaacacggcgagaagactcgacgggtcagctcacataaacagcccgctcttaaagccacctcggataaagagaattcagttccaaatatggccaccgagacaaaggatgaacagatcagcggaaccgtgagctcacagaagcaaccagccctgaaggccacctctgataagaaagactccgtgagtaacataccgactgagattaaggacgggcagcaaagcggtacagtgagcagtcagaagcaattagcctggaaagccacctctgtgaaaaaagactccgtctcaaatattgccaccgagattaaggacggccagatccggggaaccgtgtctagccagaggcaacccgctctcaaggcaacaggagatgagaaagactccgtcagtaacatcgccagggagataaaggacggtgagaaatctggcactgtgtccccccagaagcagagcgcacagaaggtgatctttaagaagaaggtgagtctattaaacattgccaccagaatcacagggggttggaagtccggtacagaatatccagagaacttaccaacccttaaagcgaccatcgagaataagaacagtgtactgaacacagccactaaaatgaaagatgtccagacaagcacacctgaacaggacttggaaatggcgtctgaaggcgagcaaaaaagattggaggaatacgaaaataatcagccccaagttaagaaccaaatccattcccgggacgacctcgacgacattatccaaagttcccagactgtgagtgaagatggtgacagcctctgctgtaactgcaaaaatgtgatcctgctgattgaccaacatgagatgaagtgcaaggactgcgtacacctcttgaagatcaagaagaccttttgcctctgcaagagattgacagagctgaaagacaatcactgcgaacagctgcgggtgaaaatcaggaaactcaaaaacaaagcctcagtacttcagaaaaggctgtccgaaaaagaggagatcaagagccaactgaaacacgagaccctggaactggagaaggaactgtgctctttacgtttcgcgatccaacaggagaagaaaaagagaagaaatgtggaagagcttcaccagaaagtgagggaaaagctgagaataaccgaggaacaatatcgcatcgaggctgatgtgacgaagcctataaaacccgcattgaaatcagccgaggtcgagctcaaaaccggcggaaataattcaaaccaggtttcggagaccgatgaaaaggaagacttgctccatgagaaccgactgatgcaggacgaaatcgccagactgcgcttagaaaaagacaccatcaaaaatcaaaatctggaaaagaaatacctcaaagacttcgaaattgttaaacggaaacatgaggacctgcagaaagcactgaagaggaatgaggagacgctggccgagactatcgcttgctactctggccagctcgccgctttaaccgatgaaaacaccacactgcggtccaaattggagaagcagcgggaaagcggccaaaggctcgaaaccgaaatgcagtcctaccggtgccgcttgaatgccgcactctgcgaccatgaccaatcccacagttcaaaacgtgaccaggaactagcatttcagggtaccgtggataaatgttgccacctgcaggagaaccttaattcccacgttttgattctgtctctccaactgtcaaaagcagagagtaagttccgcgtgttggagactgagctacattacacaggcgaggccctcaaggagaaggccttagtgtttgagcatgtccagagtgaactcaagcagaaacagtcccaaatgaaagatatcgaaaaaatgtacaagtctggctacaatactatggagaagtgtatagagaagcaggaaagattctgtcaactgaaaaagcagaacatgcttctccagcagcagctggacgacgcaaggaataaggctgacaaccaggagaaagctatcctgaatattcaggccaggtgcgacgcgagggtggaaaatctgcaagcggaatgccgcaagcacaggctcctgttggaggaagacaacaagatgctcgtgaatgagttaaaccactccaaggagaaaaaatgccaatacgagaaggaaaaggccgaaagggaggttgccgtaagacagttgcagcagaagcaagacgacgtgctgaacaaacgttcggcaacaaaagctttgcttgacgcaagtagccgccattgtatctatttagagaatggaatgcaggactccagaaagaaactggaccagatgcgcagccaattccaggagatccaggaccagctgacggcaacaatccggtgtacaaaagaaatggaaggggatgcacaaaagttagaggtggaaaacgttatgatgcggaaaatcattaagaagcaggacgagcagattgagcgcttcgaaaagatccttcagcactccagccttatgcttcaggtgttcgaatccta

SEQ ID NO: 53028 - DNA, 552 bp, Artificial Sequence
  Description of Artificial Sequence: Synthetic coding sequence
atggccactcctagaccatgtgccgatgggccttgctgctcccatccctccgctgtacttggggtgcagcagacactggaagagatggacttcgagcgagggatctggtctgcagctcttaacggcgacctcggcagggtgaaacacctcatccagaaggctgaagatccctcccagcctgactctgccggatacacagccctgcactacgcgagtaggaatgggcactatgcagtgtgccagtttttactggagtctggggcaaagtgtgacgctcaaacgcatgggggagctactgcactgcaccgagcatcctactgtggccataccgaaatcgctagactcttgctgagccacggttcaaatcccagggtggtggatgacgatgggatgaccagcctgcacaaggcagctgagagagggcacggggatatatgctccctgctcctgcagcacagcccggcactcaaggccatccgcgatcgtaaagcccgtttagcctgtgacctactaccatgcaattctgaccttagggacctcctctcctcatag

SEQ ID NO: 53029 - DNA, 1107 bp, Artificial Sequence
  Description of Artificial Sequence: Synthetic coding sequence
atgaatgctttattggagcagaaggaacaacaggagagactccgcgaggctgcagcattgggagacattcgagaagtgcagaaattggtcgagagtggagtcgacgttaatagccagaacgaggtgaatgggtggacatgcctgcattgggcttgcaagcgtaaccatggccaagtagtgagctatctgctgaagagcggagcagataaggagattcttacgaccaagggcgagatgcctgtgcaattgacctcccggagggagataagaaaaatcatgggggtcgaagaagaagacgatgatgacgatgatgatgataatttgccccagcttaagaaggagagcgaacttccgttcgtacccaattacttggccaaccctgcctttccctttatctatactcccactgccgaggactccgcacaaatgcagaacggcggaccttcgacccctccggctagtcccccagctgacggatctccgcctctgctgcctccaggcgaacctcccctcttgggcacattccccagagaccacactagcctggccttggtgcagaatggtgacgtgagtgccccaagtgccatcttgcgtacgcctgaatcaacgaagccagggcctgtatgtcagccacctgtgtcccagtcccgatctctgttctctagcgtacctagcaaacctcccatgtcattggaaccacaaaacggcacctatgctggacccgcacctgcatttcagcctttcttctttacaggagcttttccttttaacatgcaagagctcgtcttaaaagttcgcatccaaaacccatccctacgggagaacgacttcattgagatcgagctggatcggcaggagctgacctaccaggaactgctgagggtgtgctgctgcgaactgggggtgaatccggatcaggtagagaaaatacggaagctcccaaataccctgctccgtaaagataaggacgtcgcacggttgcaggactttcaagagctagaactcgtactgatgatctctgaaaataacttcctgtttaggaacgcggcaagtaccctgaccgaacggccttgttacaacaggcgcgcttcaaaacttacctactag

SEQ ID NO: 53030 - DNA, 777 bp, Artificial Sequence
  Description of Artificial Sequence: Synthetic coding sequence
ggggaaaccttggcattccctggccatgtcgcggctttcaaaggagacctggggatgctgaaaaagctggtggaagatggagtgatcaacatcaatgaaagggccgacaacggctcaactccgatgcataaggccgctggccagggtcatattgagtgtctgcagtggctcattaagatgggcgcagattctaatattaccaacaaagccggtgaaagaccgtcagacgtggctaagagatttgcacacttggcagccgtgaagttgcttgaagaactgcagaagtatgatattgacgacgagaacgaaattgacgagaatgatgtcaaatattttatcaggcacggagttgaggggagcacggacgccaaagatgacctctgcctgtcggacctggataaaacagatgccagaatgcgggcttacaagaagatagttgaactgcgccatctacttgagattgccgaatcaaactataagcatttaggagggatcacagaggaagaccttaaacagaaaaaggaacagctagagtccgaaaagaccatcaaggaattacagggacagcttgagtatgaaaggcttcgtcgcgagaagctcgaatgccagctggacgagtacagggccgaagtcgaccagctgagggagaccctggaaaagatccaggttcccaatttcgtggcaatggaggatagcgcatcttgcgagtcaaacaaagagaaacggagagtaaaaaagaaggtgagtagcgggggagtattcgtgagacgttactag

SEQ ID NO: 53031 - DNA, 597 bp, Artificial Sequence
  Description of Artificial Sequence: Synthetic coding sequence
atgcccggagttgccaatagtgggcctagcacatcttcacgcgagaccgctaacccctgcagcaggaagaaggtgcacttcggttctatacatgacgccgtgagagctggtgacgtaaagcagttgtctgagatcgtggtgcgcggagccagcatcaacgagctggacgtgctccacaaatttaccccattgcactgggccgctcattcaggaagtctggagtgcctgcactggctgctctggcatggagctgatattacacatgtgacaacaagagggtggactgccagccacatcgccgctatcagggggcaggatgcgtgcgtccaggcattgattatgaatggcgctaaccttaccgcccaggacgaccgcggttgtactccactgcatctggcagccacacacggccattcatttactctgcagatcatgttgaggtccggagtggacccttctgtcaccgataaacgcgagtggagacctgtccactatgcagcattccatgggagactcggatgcttacaactcctcgtgaagtggggatgttctatagaggacgtggactacaatgggaatttacctgagcctccctag

SEQ ID NO: 53032 - DNA, 1170 bp, Artificial Sequence
  Description of Artificial Sequence: Synthetic coding sequence
atgcccggagtggcgaattctggcccaagcaccagctcaagggaaactgcaaacccatgttctcgcaagaaggtgcattttggctctatacatgacgcagtgcgggctggagacgtgaaacaactttcagaaatcgtctgcttgcattggttactttggcacggcgctgatattacacatgtcaccaccagaggttggacagctagtcacatagccgcaattagagggcaagatgcatgtgtgcaggcactcatcatgaacggggctaacctgaccgctcaagacgacagaggctgcactccattgcatctggccgcaacccacggacatagcttcaccctgcagattatgcttcgctccggagttgacccttccgttaccgacaagcgggagtggagaccagtgcactacgcggctttccacgggaggcttggctgcctacagttattggtgaaatggggctgtagcatcgaagacgtcgactacaacggcaaccttccagtgcacctggccgcaatggaagggcatctgcactgtttcaaattcttggttagccgaatgagttctgcgacccaagtgctcaaggcttttaacgataacggagaaaacgtcctcgatttggcccaacggttcttcaagcaaaacattcttcagttcattcaaggagccgagtacgagggcaaggatctggaagaccaggaaaccctggctttccctggacacgtggccgctttcaaaggagacctagggatgctgaaaaagctggtagaggatggagtgatcaatattaacgagagagcagacaatggttctacccccatgcacaaggccgctgggcaaggccatattgaatgccttcaatggctgataaagatgggggcagattcaaacattactaacaaagccggtgaaagacctagcgatgtcgccaagcggtttgcccatctggctgctgtgaagctcctcgaggagttgcagaagtacgacattgacgacgagaatgaaattgatgagaacgatgtgaaatactttattcggcacggcgtggagggcagtacagacgcaaaggatgacctctgcttatctgacctcgataagacggacgcccgacgcccaagcaagaactgccgggcatcttggagcatgaacgactacgttgaaaaaaattag

SEQ ID NO: 53033 - DNA, 1776 bp, Artificial Sequence
  Description of Artificial Sequence: Synthetic coding sequence
tcattccctcgcaggagaccctgttgcctctcttctcaggtagccggtgtaggccgtttggagcgggactctgaaaaggtgcctgccgaaggcggtaggaggtatggagattcccagggagtcgcggatgaggacggaggcaggaggacctcccaccacgtctggcggatcaatggcctccacggacatagcggcgctgagtcccgcgaacgggtgagcgacgacggtgagcgaaaatgtgaggagtccgacaggaggtcccgagtggccgctgggtcactgtcagccgatgcgggattttcccgttcggatcttagaagggtgagcgaaaatctgggccactgcaggtccgtgtccagggagagagtcaggggagattctggccattcccacagctgttcttgggaacgagttagaggggattccacgttttgcagctcagacgtgaatttcagtgaggtgggtggacaccagactaccgattctaggggcacggcccgtgaagacagaggactccggttgagcggtccttgggaaggcgtgagtgacattagggatcctcggacttctgacttcggagaccgcgtcagcgatgacagatctcggaggttctcaggaagctgggagggcggaagtgttgaaggagggcactccgttggatcctcgtgggaggaggtctccggcgacaggggctacgctgccagtgactcaagtggcgtcagcgggagtgaagatgctagctatcggtttagcggcttctgggagcgggagtctgaggacgagggcttccggtgttccttctgggagagagccagggaggatctgggtcctaggccttcagacgatggagaggagggcagatgccgctgttctgggtcctgggtgcgtgcgagtgaggaccgccgaagtattcggggacttgatagcactccccctcagtctcggagatgctgcgcaatgcccggagtcgcaaactctgggccaagcacatccagccgagagacagctaacccttgcagccgtaaaaaagttcattttggctcaatccacgatgccgtgcgagccggagacgtgaaacagctctccgaaatagtggtgcggggagcctccattaatgagctggacgtccttcacaaattcacccccctccattgggctgcccactctggatcgcttgagtgcttgcattggctactctggcacggagccgacattacacatgtgaccacacgcggatggaccgcgtcccacatcgccgctattagaggccaggacgcctgcgtgcaggcactgatcatgaatggggctaatctcaccgcacaagacgaccgcggatgtactccactccacctcgctgctacccacggccacagcttcaccctgcagatcatgctccgctccggagttgaccccagcgtcaccgataaaagggagtggcgtccagtgcattacgcagcctttcatggtcgtctgggttgtttgcagttgctggtaaagtggggttgctctattgaagatgtggattacaacggcaaccttcctgtccacctggccgcaatggagggacatcttcattgctttaagttcctggtatctagaatgagttcagcgactcaagttctgaaagcatttaacgacaatggggagaatgtgctagatctagcacagaggtttttcaaacagaacatcctgcaatttattcaggggtcccccaaaccagcaacagatctgcagggggagacgggcgctacagagctcgcgccacgagagagttag

SEQ ID NO: 53034 - DNA, 1650 bp, Artificial Sequence
  Description of Artificial Sequence: Synthetic coding sequence
atggccttagccgctgccgcagcagccgctgccgcaggagtgagccaggccgcagtgctgggtttcctgcaggagcatggcggtaaagtgcgcaacagcgagctgctgagtaggtttaagcctttattggatgctggagacccccgtgggcgagccgcaaggagagacaggttcaaacagttcgttaacaacgttgctgttgtgaaggagctcgacggcgtgaaattcgtagtccttcgaaaaaagccacggccacccgagcccgaacctgccccattcggcccacctggcgctgccgctcagccctctaagccaacctctacagtgctgcctcgatccgcctccgcacctggcgcacccccattggtgagggtgccacggcctgtggaacctcctggagacctgggcttaccaacggagcctcaagataccccaggcggacccgcttctgaacctgcacagccaccaggcgaacgatcagccgatccccctctccccgcactggaactggctcaggcaaccgagaggccatcggccgacgctgctcccccaccaagagcgcctagcgaggctgcatccccatgcagtgatcctccagacgcagagccaggacccggagctgccaaaggacctccccagcagaagccctgtatgctgcccgtacggtgcgtgcctgccccagctactctccgtttgagagcagaagaacctggcctgagaagacagttatccgaggagccgagtccacggtctagtccactgcttttacgcagactgtcagtcgaggagagcggtctgggccttggcttggggccaggccgatcgcctcacctgcgccgacttagccgcgctgggccacggcttctgagccccgacgcagaagaattaccagccgcacccccaccaagcgccgtgccgttggaacctagcgagcatgaatggctggtgagaaccgccggtgggaggtggactcaccagctgcacggactcctgctgagggatcggggtctagccgcaaaacgcgactttatgtctggattcaccgcacttcactgggcagcaaagagtggagatggcgagatggcattgcaattggtggaggtagcacggagaagcggggcaccggtcgacgttaacgcacggagccacggcggatacaccccactgcacctggctgcactacacggccatgaggatgccgctgtgctcttggtggtgcgcttaggcgctcaagtgcacgtcagggaccatagtgggaggagagcgtaccaatacctgcggcctgggtcttcatatgcactgcgtagactgctcggggaccccggtctgcgcggtaccacagaaccggatgccaccggaggtggatcgggctcgctagcggctcgtcgaccggtccaggtcgcagccactatactgtcctcaacaacatctgcttttctaggcgtgctagctgacgacctgatgctccaggatttagctcgtggtctgaagaaatcaagtagcttttctaaattcctgagtgctagtcctatggctccgagaaaaaagacaaaaatacggggtggattacccgctttcagcgagatttcccgtcggccaacccctggaccactggcaggcctcgtgccctcttttccccctactacctag

SEQ ID NO: 53035 - DNA, 2958 bp, Artificial Sequence
  Description of Artificial Sequence: Synthetic coding sequence
caaccaccgctcgtccaggcaatcttttctggcgatcctgaagagattcgcatgttgatccataagaccgaggacgttaatacgctggattccgagaagagaacccctctgcacgtagccgctttcttgggagacgcggagataatcgaattactgattctttcaggggctcgcgtcaacgccaaggacaacatgtggctcacccccctgcaccgagcagtggccagtcgaagtgaggaagctgtccaggtgctcatcaagcatagcgccgatgtcaacgccagggataagaactggcagaccccgttgcacgtggccgctgcgaataaggcggtgaaatgtgccgaagtcattatcccactgctttcctctgtgaacgtttccgatagaggagggcgtaccgccttacaccacgcagccttaaatggtcatgtggagatggtgaacctcttgctggcgaagggcgcaaatattaacgccttcgacaagaaagataggagggcactgcactgggctgcatacatgggacatctagacgtggttgccctgctcatcaaccatggagccgaagtgacttgcaaagataaaaaagggtatacacctcttcacgctgccgcatcaaatggccagattaacgtcgttaagcaccttctgaacctgggggttgagatcgatgaaataaacgtatacgggaatactgccctgcatatcgcatgctataatggtcaagatgcggtcgtcaatgagctgattgactacggtgcgaacgttaaccaacccaacaataatggctttactcctctgcattttgcggctgcctcaacacacggcgctctgtgcctcgagttactggtaaataacggggcagatgtcaatattcagagcaaagacggtaaatcccctctgcacatgactgctgtgcacggtcggtttacccgtagtcagaccttgattcaaaacggcggtgaaattgattgtgtggacaaagacggcaacaccccactgcatgtggctgccaggtatgggcacgaactccttatcaatactcttattacttctggtgcagacaccgctaaatgtggaatacatagtatgtttccgctgcatttggctgcccttaatgcacatagcgactgctgtagaaaattattgagctcaggtttcgagattgatacgcctgacaaattcggtagaacatgtctccatgcagctgctgccggagggaatgttgaatgcatcaaactcttacagtctagtggcgctgacttccacaaaaaagacaaatgcggcagaacaccactgcactacgcagctgccaattgccattttcactgtattgaaactctcgttaccactggagctaatgtgaacgagaccgacgactggggacggaccgccctgcattacgccgctgcaagcgatatggataggaataaaaccatcttaggaaatgcccatgataattcagaggagttggaaagagcacgggaattaaaggagaaagaggccacactgtgcctggagttcctactgcagaacgacgcaaacccgtccatcagagacaaagaaggatacaacagcattcattatgccgcagcatacggacatcggcagtgtctggagttactgctggagcgaacaaatagcggtttcgaggaatcagacagtggcgctaccaagtcccccctgcacctagcagcctataacgggcaccatcaggctctggaggtgttgctacaaagcctcgtcgatttggatatcagggacgaaaaggggaggaccgctctcgacctggctgcttttaagggtcataccgagtgcgtcgaggcgctgataaatcagggggcatccatcttcgtgaaagacaatgtcactaagcgcacaccgttgcacgcaagcgtaatcaacgggcacactctttgtctccgtctgttgctcgaaattgcagacaacccagaagcagtcgatgtgaaggatgccaagggtcaaactccccttatgctagccgttgcatacgggcacatcgacgccgtgtcgctgcttctagagaaggaggccaatgtcgacacagttgacatactcggttgcacagccctccatcgaggaatcatgaccggccacgaagagtgcgtccagatgctgctcgaacaggaagtatctattctctgcaaagatagcagaggcaggactcctcttcattatgctgcggctcgtggacacgccacctggcttagtgaactcttgcagatggcgctctccgaggaggactgttgcttcaaggacaatcaaggctatacaccacttcactgggcctgttataatgggaacgaaaattgcatcgaggtactgctggagcagaagtgcttccggaaatttatcggcaacccattcactcccctgcattgcgcaatcataaacgatcacgggaactgtgcctcactgctcctgggagccatcgattcgagcatcgtgtcctgccgggacgataaaggccgaactccgctgcacgccgctgcttttgctgatcacgttgaatgtcttcagctactgctgcgccactctgcgccagtcaatgccgtcgataactcgggaaagactgccctgatgatggccgcagagaacggccaggcaggagcagtggacattctggtgaactccgcccaggctgacctgacagtcaaggataaagacctgaacaccccactccatcttgcatgcagtaagggtcatgagaagtgcgccttgcttatcctggataagatccaggatgagtctctgatcaatgaaaagaataatgctctacagacccctctgcacgtggcggctaggaatggcttaaaagtagtggtcgaagaactccttgccaagggagcatgtgtgctcgcggtcgatgagaacgcttctcgcagtaacggacccaggagtactccaggcacagccgtccagaaagaagaatag

SEQ ID NO: 53036 - DNA, 2760 bp, Artificial Sequence
  Description of Artificial Sequence: Synthetic coding sequence
atgctgatccacaagaccgaggatgttaacacactcgattcagagaagcgaacaccactgcatgttgcagcctttttaggcgatgctgaaattatcgagctgctgattcttagcggtgccagggtgaacgccaaggataacatgtggttaacacccctccaccgggcagtggcgagtcgctccgaggaggccgttcaggtgctgattaaacactctgccgatgtcaatgctagagataaaaactggcagacaccacttcacgtggctgcagctaataaggcggtcaaatgcgctgaggtgattatccctttgctgagctctgtaaatgtgtctgacaggggcggacggacagccttgcaccacgccgctttaaacggccatgttgaaatggtaaacctactcctcgccaagggagcaaatataaacgccttcgacaagaaggatcgaagagcgcttcattgggcagcatacatgggccatctggacgtggtcgctctcctgatcaatcacggggctgaggtcacttgtaaggataagaagggatatacccccctccacgctgctgcctcgaacgggcagattaacgttgtgaagcacctgctgaatttaggagtggaaatcgacgagatcaatgtgtacggaaacaccgctctacacattgcttgttataatggccaggatgccgtagtgaatgaactgatcgattatggtgccaacgttaatcagcccaacaacaacggttttaccccattgcattttgccgcagcgagtacacatggcgctctgtgcctggagttgctagtcaataacggagcggacgttaacatccagtcaaaggatggcaagtcccccctgcacatgacagccgttcacggcagattcacccgctctcagaccctcatccagaacgggggagagattgactgcgttgacaaagatggcaatacacctctccatgttgcggctaggtacggccacgaacttctcataaataccctgatcacgagcggtgcggatacagccaagtgcgggatccactccatgttcccccttcatctcgccgcactgaacgcgcattcagattgctgccgtaagctcctgtcttccgggtttgaaattgatacaccagacaaatttggaagaacctgcctacatgccgcagctgctgggggtaatgtagagtgtatcaaacttttgcaatcatcaggagcggatttccataagaaagataagtgcgggaggactccccttcattacgccgctgctaattgccactttcactgcattgagactctggtcactacaggagcaaacgtgaacgaaactgatgattggggtaggacggcgctccactatgcggcagcatctgacatggaccgcaataagaccattctgggaaacgcacacgataattcagaagagctagagagagccagagagcttaaggaaaaggaggccacactttgtctggagttcttgttgcagaacgacgcaaatccgagtatccgcgacaaggaaggctataattctatccattacgcagccgcatatgggcaccggcagtgccttgagttgcttctcgagcggacaaacagtggatttgaggaaagcgactcaggggcaaccaagtctccactgcacctcgccgcttacaacggtcatcatcaagcactagaggtgctgctgcagtctcttgtggacctggacatcagagacgagaagggcaggactgctctcgacctggctgctttcaagggtcatacggaatgcgtggaagctctgattaaccaaggcgctagcatcttcgtgaaggacaatgttacgaagagaactccgttgcacgcgtctgtgatcaatggacacactctctgcctcaggttgttgctcgagattgccgacaatcccgaggctgtggatgtgaaagatgccaagggacagactcccctgatgttggcagtcgcctacggtcatatcgacgctgtgagcctcttactggagaaggaggcaaatgtggacactgtcgatattttaggctgtacggccttgcatagaggcataatgactggtcatgaagaatgtgtgcagatgctacttgagcaggaagtatcaattttgtgtaaagattcccgcggtcggaccccattacactacgccgcagcaaggggccacgcaacttggctttctgagcttcttcagatggctttatctgaggaggattgctgcttcaaagataatcagggttacacaccactgcactgggcctgctacaatgggaatgagaactgtatcgaggtgttgttagaacaaaagtgcttcaggaaattcatcgggaacccctttactccactgcattgcgccattatcaacgaccacggaaattgtgcgtccctcctgctgggggcaatagactccagcattgtatcctgccgagacgacaagggacgcactcccctgcacgccgcagccttcgcagaccacgtagagtgcctgcagcttcttctgaggcacagcgccccagtgaacgccgtcgataattcaggcaaaacagcactgatgatggctgccgaaaatggacaggctggcgctgtggatattctggtcaactcagcgcaggccgacctgactgtaaaggataaagatctgaatactccattacacctggcctgcagtaaggggcatgaaaaatgcgccctgctgatcctggacaaaattcaagatgaatctctgattaacgagaagaacaacgctcttcagacttag

SEQ ID NO: 53037 - DNA, 2760 bp, Artificial Sequence
  Description of Artificial Sequence: Synthetic coding sequence
cttttgatttacaaaacggagattatcagcaccctcgacagcgaaaaaagaacaccactgcatgtggcagcttttctgggggacgcagagattatcgagctgctgattctgagcggagcacgagtgaatgccaaggacaacatgtggctgacccctctgcacagagccgtcgcctctcgcagcgaggaggccgtccaggtgttgatcaagcattcagcagacgtcaacgcaagagataagaactggcagactcctttacacgtggccgctgccaacaaggcagtgaaatgtgccgaggtgataatcccactgctgagcagcgtgaatgtaagcgacaggggaggtaggacggcattgcatcacgccgctctgaatggccatgtggagatggtaaacctgcttcttgccaaaggagcgaatattaatgcgttcgataagaaagaccggcgagcgctgcactgggccgcttacatgggccacctggacgtggttgccctcctaatcaaccacggcgctgaagtaacctgcaaagataaaaaggggtacaccccactacacgccgctgctagtaatgggcagattaatgtggtaaaacacctcctgaacctcggtgtggagattgatgagataaatgtgtacggcaacactgcacttcacattgcgtgttacaacgggcaggacgctgttgtaaacgaacttatcgactacggggctaacgtcaaccagcctaataataatgggttcactccgttgcacttcgcagctgcctcaactcacggcgcactctgcctggagctcctggtgaataatggggctgatgtgaacattcagtcaaaagatggcaagagccctctacacatgacagccgtgcatggacgctttacccgaagtcagacacttatccagaatggaggcgaaatcgactgcgtagataaagatggcaataccccgctgcatgtggccgcacgctacgggcatgagctcctcatcaatactcttattacttctggcgcagacaccgccaagtgcggaatacattcaatgttccccctccatctggccgcacttaatgcacactcggactgctgccgtaagctcctgagctcaggttttgaaatcgacacacccgataagtttggacgtacttgtctgcacgccgcagcagcgggaggaaatgtcgagtgcattaaattgctgcaaagtagcggggctgatttccacaagaaggacaagtgtggaagaacgccgctgcactacgctgcagccaattgccattttcattgtatcgagacactggtcaccactggcgcaaacgtaaacgaaacggacgactggggtcgaacagctctccactacgcggctgcaagcgacatggataggaacaaaacgatcctgggcaatgcccacgacaacagtgaggagctcgagcgggcacgagagttgaaggaaaaggaggcgacactgtgtctcgaatttctcttacaaaacgacgcgaatccaagtattcgcgataaagaagggtataattctatccattacgctgcagcctacgggcatcggcaatgtctggaactcctgctggagaggacaaacagcggattcgaagagtcggacagtggcgcaaccaaaagcccactgcacctggccgcatataatgggcaccaccaggccctggaggttctgctgcagagtctggttgatttagacatccgggacgagaagggcagaaccgccctggatcttgccgctttcaagggccataccgaatgtgtcgaggccctcatcaatcagggggcttcgatttttgtgaaggacaacgttactaagagaaccccactgcatgcctcggtcatcaacggtcacaccctgtgcttacgcctgttgcttgaaatcgcagacaatcccgaagccgttgatgttaaggatgctaaggggcagaccccattgatgctcgcggtcgcttacgggcatatcgacgcagtctccctccttctagaaaaggaggccaatgttgataccgtagacatcctgggatgcacagctctacaccgcggaataatgacgggtcacgaagagtgcgttcagatgctgctggaacaggaggtctcaatcctttgcaaggatagcagagggagaaccccactgcactacgccgctgctagaggacatgctacgtggctgtccgaattgctgcagatggccttgagtgaagaggactgttgctttaaagataaccagggatatactcccctgcactgggcctgttataacggtaacgagaactgcatcgaggtgttgctggagcagaaatgtttcagaaagttcatagggaaccctttcacaccactgcattgtgccatcatcaatgatcatggaaattgcgctagccttctgctcggtgcgatcgacagctctatagtctcctgtcgcgatgacaaaggccgaacacctctccatgcagcagcgtttgccgaccatgtcgagtgcctccagcttttgcttcggcattcagccccagtcaatgctgttgacaacagcggtaagactgccttgatgatggcagcagagaacgggcaagcaggcgctgtagatattcttgtgaacagcgctcaagcggacctaacagtgaaagataaggatctgaataccccactgcacctggcgtgctctaaaggacatgagaaatgcgcactcctaattctcgataaaattcaggacgaatccctgattaatgaaaagaacaacgccctgcagacttag

SEQ ID NO: 53038 - DNA, 1740 bp, Artificial Sequence
  Description of Artificial Sequence: Synthetic coding sequence
atggcggtgttaaagcttacagaccaaccacctctcgtccaggcaattttttcaggggacccagaagaaatccgtatgctgatccataaaactgaagacgttaacaccctcgactccgagaagaggaccccccttcacgtcgccgcattcttaggtgacgccgagattatcgagttactgatcttgtctggtgccagagtaaacgccaaggacaacatgtggctgaccccactccatcgggctgtggcatcccgttctgaagaggctgtgcaggtgctgattaaacatagcgctgacgtgaacgctagagataaaaattggcagactccccttcacgttgcggctgctaacaaagccgtgaagtgtgctgaggtgattattccattgctgagttccgtaaatgtgtctgacagagggggacggactgccctgcaccatgctgctctaaatgggcatgtggagatggtgaacctgcttcttgcgaaaggagccaacatcaacgcctttgataagaaggaccgcagggccctgcattgggcagcttacatggggcatctcgacgtggtagcgctcctcatcaaccatggtgccgaggtcacttgtaaagataagaaaggctacactccactgcatgctgctgccagcaacggccaaatcaacgtagtgaagcatctgttaaatctgggcgtagaaatagacgagatcaacgtatatgggaataccgcacttcacattgcctgttacaacggccaagacgccgtcgtcaacgagctgatcgattacggagccaatgtgaatcagcctaacaataacggcttcacgcctctccacttcgctgccgctagcacccacggcgctctctgcttagagctgctcgtgaacaatggggctgacgttaacatacaatccaaggacggcaagtctcccctgcacatgaccgcggtgcacgggcgatttaccaggagccaaactcttattcagaatggcggagagatcgattgcgtggataaagatggtaacaccccattgcacgttgcagctaggtacggccatgaactcctgatcaatacactcattaccagcggcgctgacactgctaaatgcgggatacattcaatgttcccgctccacctggcggcactgaatgcccacagcgactgctgtcgcaagcttctgagcagcgggttcgagattgacacccccgacaagtttggccgaacctgcctgcatgcagccgctgcgggagggaacgtcgaatgtatcaagctgctgcagagcagtggcgcagatttccacaagaaagacaaatgtggtagaacacctctgcattacgccgcagcaaattgtcacttccactgcattgagactttggtcacaaccggagccaatgtgaatgaaacggacgattggggaagaaccgccctccactatgctgctgcttccgacatggacaggaataagacgattttgggcaatgctcacgacaacagcgaggagctggaaagagctcgtgagcttaaagagaaggaagccactctgtgccttgagtttctcctacaaaatgacgcaaatcctagcattagggataaagaggggtataattcaatccactatgcagcagcttatgggcacagacaatgccttgaacttgtctcatgttttgtcctattctcacttacccacacccacacccacacgcccaatcatcggggtatcaactgcttttttccagaattgtag

SEQ ID NO: 53039 - DNA, 1104 bp, Artificial Sequence
  Description of Artificial Sequence: Synthetic coding sequence
atggctgtacttaagctgaccgaccagcccccactcgtccaggctattttctcaggcgatccggaggagatccgaatgttgattcacaagactgaggacgtcaataccctagacagcgagaaacggactccccttcatgtggccgctttcctgggtgacgctgagattatcgagcttctgatcctgagtggggcacgggtgaatgcgaaagacaacatgtggctcaccccccttcaccgggctgttgcctcaagatctgaagaagccgtgcaggttctgatcaaacatagcgccgacgtaaatgcgagagataagaactggcaaacccccctgcacgttgcagcagctaataaggcggtaaaatgtgctgaggttatcattccgctgctgagttccgtgaatgtgtcagatcggggtggtaggaccgccctccatcatgcagccttaaacggccatgtggagatggtaaaccttctgttggctaagggagctaacatcaacgcctttgataagaaagataggcgggctcttcactgggctgcctacatgggccaccttgatgtggtcgcacttctgattaaccacggtgcagaagtcacttgcaaggacaagaaggggtacacccccctgcatgctgccgcttccaatgggcagattaatgtggtgaagcacctgctgaacctgggcgtggagatcgacgagatcaatgtgtatggaaacacagcactgcacatagcttgttacaacggccaggatgccgtggttaacgagctgatagattatggcgctaatgttaaccagccaaataataacgggttcacaccacttcactttgctgcggcttccacgcacggtgcgctgtgtttagaactcctggtcaacaacggtgcggacgtcaacatccaaagcaaagatggaaaatctccgttgcatatgaccgccgtccacgggagatttacaaggtctcagactctcatacagaatgggggagagattgattgtgtcgacaaggacggcaacactcctttgcacgtggctgcccgttatgggcacgagctgctcataaataccttaataacgtcaggggcagacaccgcaaagtag

SEQ ID NO: 53040 - DNA, 2760 bp, Artificial Sequence
  Description of Artificial Sequence: Synthetic coding sequence
atgctcatacataaaaccgaagacgtcaataccctcgatagcgagaaaaggacccccctgcatgtcgctgccttcctcggcgatgccgagataatcgagcttctgatcctttctggagcacgcgtgaacgccaaggacaacatgtggctgactcccttacatcgtgctgtcgcaagccgaagcgaagaagctgttcaagtattaatcaaacacagtgccgacgttaatgctagggataaaaattggcagactccactacatgttgcagcggcaaacaaagcggtcaaatgcgccgaggtgattatcccattgctgtcttccgtcaatgtgagcgatcgaggcggacggacggcgctgcaccatgccgctctaaacggccacgtggaaatggtgaacctactgctcgcaaagggagccaatatcaatgcatttgataagaaagatcgccgagcgctgcactgggcggcatacatgggccacctggacgtcgtggcattgttgataaaccacggcgcagaagtgacttgtaaggacaagaagggttacacccctcttcatgctgcagcctctaacggtcagatcaatgtcgtaaagcacctccttaatcttggggtagagatcgacgagattaacgtgtatggcaacactgccttgcacatcgcttgctacaacggccaagatgccgtggtgaatgagttgatcgattacggtgctaacgttaaccagcccaacaataacggtttcactcctctgcactttgcagctgcatcaacccacggagctctgtgtttggagttactcgttaacaacggcgcagacgtcaatattcagagtaaggatggtaagtccccacttcatatgaccgcagtccacgggagattcacccgctcacagacattaatccagaacggtggggagattgactgcgtcgacaaagatggaaatacacccctccatgtggctgctcggtacggacacgaacttctgatcaacacccttatcacctccggtgcagataccgccaaatgcggaatccatagtatgttccccctgcatcttgcggctctaaacgctcactctgattgttgcaggaaactgctgagcagtggctttgagatcgatactcccgataaattcgggagaacttgtctgcatgccgcagcagctggagggaatgttgagtgcattaaacttcttcaatcaagcggggctgattttcacaaaaaagacaagtgcgggagaacccccctgcactatgccgctgctaattgccatttccattgcatcgagacgctggtgaccacaggtgctaacgtcaatgaaacagacgactggggacgtacggcactgcattatgcagcagccagtgacatggatcgtaataagactatcttgggaaatgcccatgacaattccgaagaactcgaacgggcacgggaactgaaggagaaagaagccactctgtgcttggagttcttgctgcagaacgacgcaaatcccagtatcagagataaggaaggctataattctattcactatgcagccgcatatggtcaccggcagtgcctcgaattgctgttagaacgcaccaactccggattcgaggagagtgatagtggagccacaaagagcccgttgcaccttgccgcttacaatggccatcatcaggccttagaggtgttgcttcagagtttggtggatctggacattagagacgaaaagggcaggaccgcattagatttggcggctttcaagggacacacagaatgcgttgaggctttaattaaccagggggcttcaatcttcgtaaaagacaacgtcaccaagagaaccccccttcacgccagcgtgataaatggacacacgctttgcttgaggcttctcctagagattgcagacaatccggaggccgtggacgttaaggacgcgaagggacagacgccattaatgctagcagtggcctacgggcatatcgacgcagtcagtctgctgttagaaaaggaggctaacgtcgataccgttgacatcctcggatgcaccgcactgcaccggggaattatgacagggcatgaagagtgcgtgcagatgctgctggagcaggaggtgagcatcctttgcaaggactcaagaggcaggactcctcttcactacgcggctgcacggggacatgccacatggctgtcagaactgctgcaaatggcactgagcgaggaggactgctgctttaaagataaccagggttatactccacttcattgggcatgttataatggcaacgaaaactgtattgaagtccttctggagcagaaatgctttcgaaaattcattggcaatccgttcacccccctgcactgcgccattattaatgatcatggaaattgtgcttcgttgctcttaggcgcaatcgactcgtctatcgtgagctgtagagacgacaagggaaggactccactgcatgctgccgcatttgcagaccacgtcgaatgtctgcagctgctgttaagacacagtgctcccgttaatgcagtggataacagcggaaagacagccttgatgatggcggctgagaatggtcaagccggagctgtggacatcctggtgaactcggcgcaggcagatttaacagtgaaggataaggatctgaacacccctcttcatctggcctgcagcaaaggacatgagaaatgtgctttactgatattggataagatccaagatgaatctctgattaatgagaaaaacaacgctctccagacttag

SEQ ID NO: 53041 - DNA, 1524 bp, Artificial Sequence
  Description of Artificial Sequence: Synthetic coding sequence
atgtggctaactcctctacaccgggctgtggcctcaaggagcgaggaagctgtgcaggtcttgatcaagcactccgcagacgtgaacgcacgggacaagaactggcaaacaccgctacacgtagcggctgccaacaaggccgttaagtgcgccgaggttataatacccctcctctcctcagttaatgtgtcagatcggggaggaagaacggccctccaccacgccgctctcaatgggcacgtcgagatggtaaatttgttattagccaaaggggcaaacataaacgcgttcgacaagaaagacaggagggctcttcactgggctgcatacatggggcacctcgatgtggtggctctgctcatcaatcacggggctgaggtgacatgtaaggacaaaaaaggctacacccctctccacgctgccgcatcaaacggccagattaatgtcgtaaaacacctgctgaacctcggggtggagatcgatgagattaacgtgtacgggaacactgcgctgcacatcgcctgctataacggacaagatgcagtcgtgaacgagttaatcgactatggtgcgaatgtcaatcaaccgaacaataacggtttcactccactgcactttgccgcagcttcaacacatggggcactgtgcttagagcttctggtgaacaatggcgctgacgtgaacatccagagtaaagacggcaaaagtccactccacatgaccgcagtccacgggaggtttacacgtagccagactcttattcagaacggtggcgaaattgactgtgtggataaggacggcaacacgccgctgcacgtggccgcaagatacggacatgagctgttaatcaatacgctgataacctctggcgctgacactgccaagtgtggtattcactccatgtttccccttcatctggccgcactgaatgctcattcagactgttgcaggaaactgctttccagtgggtttgagatagacacccccgataaatttggaagaacatgcctgcatgcagccgctgcagggggaaatgtagagtgtatcaagctgctgcagagctctggcgcagactttcataagaaagacaagtgtggcaggacccccctccattacgctgccgctaactgccacttccactgtatagaaacactcgtcactacaggggctaatgtgaatgagaccgacgactgggggcgtactgccctgcattacgctgccgctagcgatatggacaggaataagacaatcctaggtaatgcccatgataacagcgaggagctggaacgggctcgtgagctgaaggaaaaagaggcaaccctatgtcttgaattcttgctgcagaatgatgccaatccgtctatccgagataaagaaggttataacagcatccactacgcagccgcttatggtcacaggcaatgtctcgaactcgtttcatgtttcgtgttattttcacttacccatacccatacgcacacaccaaatcacaggggcattaattgcttctttcccgaactgtag

SEQ ID NO: 53042 - DNA, 801 bp, Artificial Sequence
  Description of Artificial Sequence: Synthetic coding sequence
atggagtccgaaggtcccccagagagtgagagtagcgagttcttctcccagcaggaggaagagaatgaagaagaggaggctcaggagcccgaagagacagggcctaagaacccactgcttcaacctgccttaaccggagacgtggagggcttgcaaaaaatttttgaagaccccgagaacccccatcacgaacaggccatgcagcttctgctagaagaagacatcgtagggagaaatctgttgtacgctgcttgcatggctgggcagagtgatgtgatcagggccctcgccaagtatggcgtgaacctgaacgagaagacgactaggggctatacactgttacactgcgcagccgcatggggtaggctcgagactctgaaagccctcgtggaactggacgtcgatattgaggccttgaatttcagggaagagagagctagagatgtggcagcaagatacagccagaccgaatgcgtcgaattcttggactgggctgacgctagactgactttgaagaagtacattgctaaagtgtcacttgccgtgacagacactgagaagggaagcgggaagctcctgaaggaggacaaaaatacgatcctgtccgcatgcagggctaagaatgaatggttagaaacccataccgaagcctccataaatgaactgtttgaacagcgtcagcagcttgaagacatagtaacacctatattcaccaaaatgacaacgccctgtcaagtgaaaagcgctaaatctgtaactagccacgaccaaaaacgaagccaggacgatacatccaactag

SEQ ID NO: 53043 - DNA, 2331 bp, Artificial Sequence
  Description of Artificial Sequence: Synthetic coding sequence
atggccctggctgataagagactcgaaaatttgcagatttataaggtgctgcagtgtgttcggaacaaagataaaaagcagattgagaagctgaccaaattgggctatcctgagctcatcaattacacagagcctattaatggcctttctgcgcttcacctggctagcgtctcgaatgatattgatatggtgtctttccttctggaccttggcgctcaccccgatgtgcaggatcgtatgggttgcacccccacaatgagggcagccgagcttggacacgagctgtccatggaaattctggccaaagccaaggctgacatgaccatcgtcgacaacgaaggcaagggggtgctcttctattgcattttgccaaccaagcgacactataggtgcgccctgatcgcactagagcatggggcagacgtcaacaattctacgtatgagggaaagccaatatttctgcgtgcgtgcgaagatgctcatgacgttaaggatgtgtgcctgacgtttcttgaaaagggagccaatcctaacgcaattaacagtagcaccggacgcaccgctctcatggaggcgtctcgggagggggtcgtcgagatagtgagaggaatcctggaacggggtggtgaggtgaacgccttcgacaacgaccgccaccatgccgctcactttgcagctaagggaggcttcttcgatatcctgaagctcctgtttgcctacaatggggatgtgggcctcatctctatcaacggtaataccccccttcactatgctgcaatgggcggtttcgccgactgctgcaagtacatagcccagagagggtgcgacttgaagtggaaaaacctggatcataagaccccaagagcggttgccaaagaaggaggctttaaagccgctagcaaagagatcagacgcgctgaacgcattgcaaataagctcgctcgtccaggagcaaaaaacccgaatccactctgggccctccgactgcacgactggtccgttgaacgcgaggcatttctgcgcgaggcttttgcagtcctggatcgaggagatgggtccatctcaaagaatgatttcgtgatggtgctggaggaaagacaggattacgcttccagtgagcagcttgctgcaatcgcccatttacacgaaaaaacccgcggagggggagtgaatatcaatgagttttttaaaggcacccggtacttaaataagagcttcgtcctcggcagctatggtccaaagaagaaagaaaaggggatggggaaaaaaggcaaaaagggcaaatttgtattaccgttgcctatctgcgtgattcccgaatatgccttccctcgaagacaggatgggggtcctccctattacatgattgaaacctacaagaacgtgactgattccagtcgtttcaaccgagaccacccccctgaacacccaatccaggacgactctgtctggtacatcgacgattccgagaaagtgttctccaatattaatatcattacgaaggcaggcgacctggcaagtctcaaaaaagcctttgagagcggcatacctgtcgacatgaaggacaactactacaaaactcccctcatgaccgcttgtgcgagtgggaacatcgacgtagtgaagttcttgctggagaagggggctaatgttaatgccacagacaatttcctttggacaccactgcattttgcctgccatgccggtcagcaggacatcgttgagctgctggtcgagtccggtgcgcttatcgacgctgcaagcataaataactcaacacctctgaatagggctatcgaatcctgtcgactggataccgtgaagtatctgcttgatatcggggcaaaatttcaactggagaaccggaagggacatagcgcaatggacgtggccaaggcctacgcagactataggataattgatcttatcaaggaaaagctggacaatctgccaaaacccgctgagaatcagaaactgaagggtaagacgcctccaatactaaagactgagggccctgaaataaagaaggaggaagaactgctgagttccatctacggtgttcctaccacctccgagggcaaaaaggtccaaaagggaaacgtagtccatctgaatagcctcattacctctggatatacaaagaaagttgacattacttttattcctaggcgcatctggtctcccgaggctaccactgcggagctgattcggaaacgggagctgaggcgggagcgatttacccacgaagtcgattttgacgacttcatgatgccgtttcagaagaacataaccgagaaggcaagagcactggaggccgctctcaaaacttag

SEQ ID NO: 53044 - DNA, 2331 bp, Artificial Sequence
  Description of Artificial Sequence: Synthetic coding sequence
atggctctagcagacaagcgccttgaaaacctgcagatttataaggtcctgcagtgcgtcaggaacaaagacaagaaacagattgagaagctcacgaaattgggatatccggagctgatcaactatactgaaccaatcaacgggctctcagccctccatttggcctctgtctcaaatgatattgacatggtgtcatttctcctcgatttaggcgcacatcccgacgtgcaggatagaatgggctgcactcctacgatgagagccgcagaacttggccacgagctgtccatggagattctggccaaggctaaggccgatatgaccattgtggataacgaaggcaagggcgtgttgttttactgcatcttgcctaccaaaaggcattaccgctgcgccctcatcgctctggagcatggcgcagatgtgaataatagtacctatgaggggaagccaatatttcttagagcatgcgaagacgcccacgatgtaaaagatgtttgtctcacattcctcgagaagggcgcaaaccctaatgccatcaattcctccactggacggaccgcgctcatggaggcttctcgcgaaggcgtagtagagatcgtgcgcggtattctggagaggggcggagaagtgaacgccttcgataatgacaggcaccacgcggcacatttcgccgcaaaaggcggttttttcgacattctgaaactcttgttcgcatataacggcgatgttgggctgatcagcatcaatggtaacacacctctgcattacgccgcaatgggtggctttgctgactgctgcaagtacatcgctcagcgaggctgcgacctcaaatggaagaatttggaccataaaacccctcgggcagtggctaaggagggcggatttaaagccgcttctaaagaaattcgaagagctgagaggatcgccaacaaactggcaagacctggcgctaagaatcctaaccccctgtgggcgctccgacttcacgactggtcagtggaaagagaggcgttcttaagggaggccttcgcagtactcgatcgcggagatggctccatcagcaagaatgatttcgtaatggtgcttgaagagagacaagattacgcttcgagcgagcagttggccgctattgcccatttacacgagaagacccgagggggtggagtgaacattaatgagttctttaagggtacccgctacctaaataagtccttcgtcctggggagctatgggccaaaaaagaaggaaaaggggatgggcaaaaaggggaagaaaggaaagttcgtattgccacttcccatctgtgtgattccagagtatgcttttccacgtcgccaagatggaggacccccttattatatgatcgagacctataagaacgttaccgactcctcccgttttaatagagaccatcctcccgagcatcccattcaggacgactccgtctggtacatcgatgatagcgagaaggtgttcagcaatatcaacatcattaccaaagctggtgatctggcatctctgaaaaaggcctttgagagcggcattccagtagatatgaaggataattattataaaacgccactgatgaccgcatgtgcctctggaaacatcgatgtggtcaagtttttactggagaaaggcgcaaacgttaacgcaacagacaacttcctgtggactccacttcactttgcctgtcatgccggtcaacaggacattgtcgagctgctggtggagtccggcgctctgattgacgcagccagcattaataactcaacacccctcaatagagcgatcgagtcttgccgcctggacactgtcaagtacttactggacattggtgcaaaattccagttggagaacaggaaaggccattccgcaatggatgtggctaaagcctacgcagactatcgcattattgacctgataaaggagaagttggataacttgccgaagcctgccgagaaccaaaagctgaaggggaagacgccgcctatcctgaagacagaaggccctgagattaagaaagaagaggaattgctgagcagtatctatggagtgccaacaacgagtgagggcaaaaaggtgcaaaagggaaacgtagtgcacttgaatagcttgatcacttccggctatacgaagaaggtcgacatcactttcatacctcgacgtatctggagccccgaggcgaccacggcagagctgatacgtaaacgagaactgcgacgagaaagattcacccatgaagtcgacttcgatgacttcatgatgccctttcaaaaaaacataactgaaaaggccagggccctagaagccgctctcaaaacctag

SEQ ID NO: 53045 - DNA, 4290 bp, Artificial Sequence
  Description of Artificial Sequence: Synthetic coding sequence
atgactaacccgtgggaagaaaaggtgtgtaagatggctcaaacatccctgctacagggcaagcagttctactgccgggagtgggtgttccataagttgcagcactgtctccaggagaaaagcaattgttgcaactccgctgttaacgcgcctagcttggtgatgaactccggtaataatgcctctggggttagcggtaagggcgcagcgtggggagtgttgttggtgggcggacccggatctggcaagacagcactgtgtaccgagctgttgtggccttccagccctgccagtctgcagcgagggctgcaccgccaagctctggcttttcatttctgtaaagcccaagacagtgacactctgtgtgtaggcggattcatccgcggattagtggcacagatatgccgttctggactcctccaaggttacgaagataagctgagggatccggcagtacagtccctgctgcaacccggagagtgcgaacgtaaccctgcagaagcctttaagagatgcgtactgctccctctccttgggatgaagccaccccagcagtccctgtatctcctggttgactctgtcgacgaggggtgtaacatcacggagggggaacaaactagcactagcctctcggggaccgtggccgcactgctcgcaggccatcatgaattttttccaccttggctgctactcctgtgctcagcaaggaaacagagtaaagcagtgaccaaaatgttcacagggtttaggaaaatatcactggatgatttgcgaaaggcctatatagtcaaggacgtgcaacagtatatcctgcatcgactagaccaagaagaggcactgaggcagcacttgacaaaggaaacagctgaaatgttgaaccagctgcacattaaatcctccggttgctttctgtacctggagagggtcctggatggcgtcgttgaaaacttcatcatgctgcgagagattcgggatataccaggtactttaaatgggctgtatctgtggttgtgccagcgactgttcgtgcggaagcagtttgcaaaggtgcagcctattctcaacgtcatactggccgcttgcaggcctttgactataactgaattataccacgctgtttggacaaaaaacatgtcacttacactggaagactttcaacgcaagctggacatcctgtcgaaactcctggtagatgggctgggcaacacgaaaattctgtttcactatagtttcgctgaatggctcctggacgtcaaacattgcacccaaaagtatctgtgcaacgcagcagagggtcatagaatgttggcaatgagttacacctgtcaggctaagaacctgacccccctggaggcacaggagtttgccttgcaccttatcaactcaaatctgcagctggaaacagccgagttagccctgtggatgatctggaatggaacgccagtgcgggatagtctgtcaacacttattcctaaggagcaggaggtactgcagctcctagtcaaggccggagcccatgtgaactctgaagacgatcgtacctcttgtattgtgcgccaggcgcttgagcgggaagatagcatccgcaccctgttagacaatggggcaagcgtgaatcagtgcgatagcaacggacgcactcttctcgccaacgccgcttactcgggctccctggatgtcgtcaaccttcttgtttcgcgaggagcagatctggagatcgaggatgcgcatggacatacaccgctcaccttggccgctcgccaaggacatactaaagtggtcaattgtctgataggctgcggcgctaacatcaaccacacagaccaggatggatggaccgccctaagatctgccgcttgggggggacatactgaggtagttagcgcgttgttgtatgccggagtcaaggtcgactgcgctgatgcggatagccgaacagccctgcgagccgcagcctgggggggtcatgaagacattgtgctgaatttgctccaacatggcgcagaagtcaacaaagcagacaacgagggtcggaccgccttaatcgcggctgcgtatatgggccatagagagattgtcgagcatctgttggatcatggggctgaggtcaatcacgaagacgttgatggtcggaccgcattatcggtggcagccctgtgcgtccctgcctccaaggggcatgctagtgtagtctcattattaattgatcgaggggcagaagtggatcattgtgacaaagacggcatgactccccttctggtggcagcgtacgaaggccacgtcgatgtggtcgaccttctgctggaaggcggtgccgatgttgatcatacagacaacaatgggcgtacacctttactggcggcagctagcatggggcatgctagtgttgtaaatacactgctgttttggggagccgcagtggattcaattgacagcgagggccgtaccgtgcttagcatcgcttcagcccaggggaacgtcgaagttgttcggacacttctggacagaggactggacgagaaccatagagatgatgcgggatggacaccccttcatatggctgctttcgaggggcaccggctgatctgtgaggcactgatcgaacagggggcaagaaccaatgaaatcgacaacgatggccgaatcccctttatccttgcaagccaggaaggccactacgattgcgttcaaattctcttagagaacaaaagcaatatcgaccaacgcggatacgatgggaggaatgcccttcgcgtcgcagccctggaagggcacagggacatcgtggaactgctgttctctcatggagcagatgtgaattgcaaagatgctgacgggagacccaccctgtacatcctggccctggagaatcagctcaccatggcggaatacttcctcgagaacggtgcaaatgtggaggccagcgatgcagagggtcgcacagctttacatgtgagctgttggcagggccacatggagatggtgcaggtgctgatagcctaccacgccgacgtgaacgctgctgacaatgagaagcggagcgccctgcaatccgcggcttggcagggccacgtcaaggtggtccaactgctcatcgagcacggggctgtggtggatcacacatgtaaccagggtgctacggccctgtgtatagccgctcaggaaggacatattgatgtggtccaggtactcttggaacatggggctgacccaaaccatgccgaccaatttggtcgcacagcgatgagggtcgcagccaaaaatggccattctcagattataaagctgctggaaaaatatggtgcatctagtttaaacgggtgcagcccatcgccagtgcacaccatggagcagaagccactacagagtctgtcctccaaagtccagtctctgacaatcaagagcaactcaagcgggagtactgggggaggagatatgcagccttcactgcggggacttccaaacggccctacacatgctttctctagtccctcggagagccccgactccaccgtagacaggcaaaaatcttccctcagtaataactctcttaagagctcgaagaattccagcctcaggacaaccagtagtactgctaccgcccaaactgtccctatagactcattccataacctgtcatttacagagcagatacagcagcatagtctgccccgaagccgtagtagacaatccatagtaagtcctagctccaccactcaaagtttaggtcagagccacaatagcccatcctccgagttcgaatggtcgcaggtgaaacccagtctgaaatccacaaaagcatctaaagggggaaagagtgagaactccgctaagtcgggttctgccggaaaaaaagcaaagcaatccaattccagccagcctaaagtgctcgagtatgagatgacacaattcgacagaagagggcctatcgccaaatccggcactgctgctcctccaaagcagatgcctgccgagagccaatgcaaaatcatgatcccatcagcccagcaggaaattggacgttcacagcaacagtttctgatccatcagcagtcgggtgaacaaaagaagcgtaacgggatcatgactaatcccaattatcacttgcaatccaatcaagtttttttgggacgtgtgtcagtgccaaggacaatgcaagaccggggacaccaggaagtgctagagggttacccatcatccgaaaccgagctgagtctgaagcaggctctcaagcttcagattgagggcagcgaccccagtttcaactacaagaaagaaacacccctgtag

SEQ ID NO: 53046 - DNA, 3753 bp, Artificial Sequence
  Description of Artificial Sequence: Synthetic coding sequence
atgaaaccacctcagcagtcactgtatcttctagtggactctgttgacgagggctgcaacattacggagggagaacagacaagcacgagcctgagcggcactgttgcagctcttctcgccggtcaccacgagttctttccaccttggctgcttctcctgtgctccgccaggaaacaaagtaaagcggtcactaaaatgttcaccggtttcaggaaaatctccctggacgacttacggaaggcctacatcgtgaaagacgttcagcaatatattttgcatagactggaccaggaagaagccctccgacaacacctgaccaaagaaacggccgagatgctgaaccagctgcatatcaaatcctctgggtgcttcctgtacttggaacgggtgctggatggcgtggttgaaaattttatcatgctgagggaaattcgggacattcctggcaccttgaatggcctctacctgtggctctgtcagcggctcttcgttaggaagcagttcgccaaggtccagccaatccttaacgtgattcttgccgcatgcagacctcttaccattacagagctttaccacgctgtgtggaccaagaacatgagccttacactggaggatttccagcggaaacttgacatcctgtcaaaattgctcgtggatggactcggcaacactaagattctgttccattactcgttcgctgaatggctacttgatgtgaagcactgcactcaaaaatacttgtgtaatgcagctgagggacacagaatgctagcaatgtcttacacatgtcaggccaagaacctgaccccccttgaagcacaggaatttgcactgcacctcatcaactccaatctgcagttagagaccgccgagctcgctctttggatgatctggaatggaaccccggtccgtgacagcctatctactctgattccaaaggaacaagaggtgctgcaactcctggtgaaggccggtgcccacgtaaattctgaggatgatcggaccagctgtattgtgaggcaagcattggagcgcgaggactctattcggactttgcttgacaatggcgcaagtgttaatcagtgcgactccaatggaagaaccctgctagctaacgctgcttacagcggcagcctggatgtcgtcaacctcctcgtgtcaaggggcgctgacttggaaatcgaagacgctcatggacatactcctctgaccctggctgccaggcagggtcatacaaaggtggtgaactgcctcattggctgcggcgctaacatcaaccacacagatcaagatgggtggaccgccctgcggtcagcagcctggggcggtcacaccgaggtggtctctgccctgctgtacgcaggtgtgaaagtcgactgcgcggatgccgatagtaggaccgccttgcgcgctgccgcttgggggggacatgaggatatagtgctgaatctgcttcagcatggggctgaggtaaacaaggctgacaacgagggcagaacggccctaattgcggcagcttatatgggacaccgcgagatagtggagcatctcctggaccatggcgctgaggtcaatcatgaggatgtggacggcagaaccgctctatccgtggcagcgctgtgcgtccctgcttccaaaggacatgcgagtgtcgtgagtttgctgatcgacaggggggctgaagttgatcattgtgacaaagatggtatgactcccctgctagtcgccgcttatgagggccacgttgacgtagtcgacctactactggaggggggagccgatgtcgatcacacagacaacaacgggagaacacctctgctggccgctgcaagcatggggcacgcctctgtggtgaacacccttttgttctggggtgctgcggtggacagcatcgactccgagggcaggaccgttttgagtattgcttcggcccaggggaacgtggaagtggtgcgtacactactggaccgaggactggatgagaaccaccgggacgacgccggttggacgcccctgcatatggcagcctttgagggccaccgattgatctgtgaggcgctgattgaacaaggcgctcggaccaatgaaattgataatgatggcaggatcccgtttatccttgcctctcaggagggacattacgactgcgttcagatcctgttggagaacaagtcaaatatcgaccaacggggatacgacgggagaaatgcactgcgtgtagcagcactggaggggcatagggatatcgtagaactgctgttcagccacggagctgacgttaattgtaaagacgccgacgggagaccgaccctctacatcttagcacttgagaatcaactgaccatggctgagtatttcctcgaaaatggcgctaacgtcgaggcatccgatgctgagggaaggaccgccttgcacgttagttgttggcaagggcatatggaaatggttcaggtcctgatagcctatcacgcagacgtaaacgctgccgacaatgagaaacgatcagctctgcaatctgcagcatggcaggggcacgtcaaagtggtacagctgttgatcgaacacggtgccgttgtggaccatacatgtaatcagggagcaacggcactctgtattgccgctcaagagggccacattgatgtagtacaggtgctgcttgagcacggcgctgacccaaaccacgcggaccagttcggacggactgctatgcgggtagccgcaaagaacgggcattcccagatcataaagctgctggaaaagtacggcgcttcctcattaaacggctgttcaccatcccccgtccatacaatggagcagaaacctctgcaatctttgtccagtaaggtacagtctttgaccatcaaatcaaactcctccggctcaacagggggaggggatatgcagccttcactgcgaggcttgccaaatggccctacccatgccttctcaagcccatcagagagcccggacagtacagtcgaccggcagaaaagtagcctctctaataattccctaaaaagctcaaaaaattccagtctaaggacaacaagctctactgctaccgcacagactgtgcctattgactcattccacaacctgagttttactgagcagatccagcaacacagcctcccccgttcacgatcccgccagagcattgtctctccttcctcaactacacaaagtctgggacaatctcacaatagtccatcttcagaattcgaatggtcccaagtgaagccgagcctgaagtctacgaaggcctccaaggggggaaagagtgagaacagcgctaaatcaggcagtgccggtaagaaggctaagcaaagtaacagttctcagcccaaggtgctagaatacgagatgacacaatttgaccgaaggggcccaattgctaagagtggcacagcagctccccctaaacagatgcctgccgagagtcaatgtaagatcatgattccaagtgcccagcaagaaatcggacggtctcagcaacagttccttatacatcagcagtccggcgaacaaaagaaacgaaatggtatcatgaccaaccctaattatcacttgcagtcaaaccaggtattcctggggagggtctcagttccgaggaccatgcaggatagggggcatcaagaagtgctagaagggtatccctcatccgagacagaactgtcactgaagcaggctctgaagctccagattgagggcagcgaccccagctttaattataagaaggagacacctctatag

SEQ ID NO: 53047 - DNA, 3231 bp, Artificial Sequence
  Description of Artificial Sequence: Synthetic coding sequence
atggggatcctgagcattaccgaccagccacccctggttcaggccattttcagccgggacgtggaggaagttagatcccttctctcccagaaagagaatataaatgtgttagaccaggagcgccgaaccccactgcacgcagcagcatatgtaggggatgtgcccattctccagctgctcctgatgtcaggcgctaacgtcaatgctaaggatacactctggctgacccctctgcaccgcgcagccgcttccagaaacgagaaggtcctgggccttttactggcacattccgcagacgtgaacgcccgtgataaactgtggcaaaccccgctgcacgttgcggcagccaatcgggctaccaaatgcgcagaagccctggcgccactgctgtcaagtctgaatgtagccgaccgttctggcagaagcgcccttcatcatgcggtacacagcgggcatcttgaaaccgtgaacctcctgctcaataaaggtgccagtctgaatgtatgcgacaaaaaagagagacagcccctgcattgggctgcctttctcggacatctggaggtgctgaaacttctggtagctcgaggtgccgacttaggatgtaaagaccggaagggttacggcttgctccatactgccgcagcgtcaggccaaatagaagtagtgaagtatctgctgagaatgggcgcagaaatcgatgaacccaatgcctttggaaatacagccctgcatatcgcttgctatttaggacaagatgcggtagctatcgagctggtgaatgctggtgccaatgtgaaccagcccaatgacaaggggtttaccccattgcacgtggcggctgtctctacaaacggtgctctgtgcctggaactgctggtaaataacggtgccgatgtaaactatcagtctaaggaggggaagagccctctgcacatggccgctatccatggtcggtttactaggagccagatccttatacaaaatggttcggagattgattgcgccgacaaattcgggaacacgccgctccacgtcgcggcaaggtatggtcatgaattgttgatcagcacccttatgacaaatggcgctgacacggccagacgtgggatacacgacatgtttcccctacacctcgccgttctcttcggcttctcagattgttgtaggaaactgctttcttccggacagttgtactcgatcgtatcttccctcagcaacgagcacgtgctgtctgcaggctttgacattaacactcctgataacttaggacggacctgtctccacgcggcagcctccggaggcaacgtggaatgcctgaatctcctgctcagttcgggcgctgatctgcgccgacgtgacaaattcggacgtacccccctacattacgctgcagcgaacggctcatatcagtgtgctgtgacgctggtgacagccggagcgggagtcaatgaggccgattgcaaggggtgctcccctctccactatgccgctgccagcgacacctatcggagagccgaacctcatacgccttcatcccacgacgctgaggaggacgaaccactgaaggaatcgcgcagaaaggaagcctttttctgtctcgagttcctactggacaatggcgcagatccgagcctgagagatcgccaaggatacaccgccgtccactacgctgcagcatatggaaacagacagaatctggagctcttattagaaatgtccttcaactgcttagaggacgtggagagcaccataccagtgtctcctctgcacctagcagcctataatggacactgtgaggctctcaaaactctggccgagacactagtgaaccttgacgtaagggaccataagggacggacagcgttgttccttgctactgagcgaggatccaccgagtgcgtggaagtgctgaccgcccatggggcatctgcgcttatcaaagagcggaaaagaaaatggacacctcttcacgccgcagccgcatcaggacacacagactccctgcacttgctcatagactcaggggagagggccgatatcacagacgtcatggatgcttatggccagacgccccttatgctggctatcatgaatggccacgtcgactgcgttcatctgttgctagagaagggatccactgcagacgccgcagacctgagggggcgaaccgcattgcacagaggcgcagtgacaggatgtgaagattgcctggctgctctgctagatcatgatgcttttgtgctgtgtcgagatttcaagggcagaacacctattcatcttgccagcgcatgtgggcacaccgcagtgctgagaacactgttgcaggcagccctcagtaccgacccactggatgccggtgtagattactctggctacagtccaatgcactgggctagttacactggccacgaagactgtttagagcttctgttagagcattcccccttttcttatttggaagggaacccattcactcccctccactgtgccgtgattaataaccaggactccaccacagaaatgctcctgggagcactcggtgcaaagattgtcaatagccgcgatgctaaaggccgtacccccctgcacgccgcagccttcgccgacaatgtgtctggtctgaggatgctgctgcagcatcaagctgaggtgaatgcgaccgaccatactggcaggacagcacttatgacagccgctgagaacggacaaactgcggctgtggagttcctcctttatcgcggaaaagcagatctaaccgtcctggacgagaataaaaataccgccctgcatcttgcttgttctaaagggcacgaaaaatgtgctttgatgatcctcgcggagacccaggatctgggcctcattaacgccactaattcagcactgcaaatgcctctgcacatcgccgctcgaaacggtctggcttccgtcgttcaagccttgctttcccatggcgcaactgtgctggccgttgacgaagaggggcatacaccagcccttgcatgcgcgccaaataaagacgtagctgattgtttagcgctaattctatccaccatgaagcctttccctcctaaagacgctgtatctccctttagctttagccttttaaaaaattgttctatcgcagcagctaaaactgtcggcggatgcggggctctgcctcatggcgcatcttgcccttattcacaggagagaccgggtgccatcggtctggacggttgttactcagagtag

SEQ ID NO: 53048 - DNA, 3231 bp, Artificial Sequence
  Description of Artificial Sequence: Synthetic coding sequence
atgggtatcttgagcattacagatcagcctcctttagttcaggccatattctcccgagacgtagaggaagtaagaagtctcctgagtcagaaagagaacatcaacgtgttggaccaggagcggcgtacacctctgcatgcagctgcgtacgtgggggacgtgccaattctgcagttgctccttatgagtggcgctaatgtgaatgcaaaagatacattgtggctgactccattgcacagggcagccgcaagtcgaaatgaaaaggtgctaggactgttactggcccattcggcagatgttaacgcacgggataaattatggcagacgccactgcatgtggcagcagccaatcgggctaccaagtgcgccgaggctctagcccctctgttgtcatcactgaatgtggctgaccgctctgggaggagcgctctgcatcatgctgtccacagtggacacctggagacagtaaacctgctgctcaacaaaggtgcttcgctgaatgtgtgcgacaagaaagagagacagcccctccactgggcagctttcctaggtcatctggaggtgcttaaactcttggtggctagaggcgctgacctcggctgcaaggaccgaaagggttacggcctcctccacacagcagccgcttccgggcagatagaggttgttaaatacttgctgcggatgggcgctgaaatagacgagcctaacgcctttggcaataccgcactgcacattgcatgttaccttggtcaggatgcggtggcgatagaactggtgaacgctggtgcaaacgtgaaccaaccgaacgataaagggttcacccccctacatgtggcggctgtgtccacaaacggcgctctgtgcctcgaattactggtgaacaacggagccgatgtcaactatcaaagtaaagagggcaaatctcctttacatatggcagctatccatggcagattcacacgatcacagatacttatccagaacggatccgagattgattgcgccgataagttcggcaacactccattgcacgtggcagcaagatacgggcacgaattgctgattagcacactcatgacaaatggagccgataccgccagacgcggtattcatgatatgttccctctgcacctggccgtgttgtttggcttctcggattgttgtagaaagctgctgtcaagtggccagctctattccattgtgtcttcgctgagtaatgaacacgtgttaagcgcaggctttgatatcaatacccccgataatttgggtcggacgtgcctgcatgccgcagcttcaggcggtaacgtggaatgtctcaacttgctccttagctccggggctgatctgagaagaagagacaaatttggcagaacacccttgcactacgctgccgctaacggatcataccagtgtgccgtgacactggtgacagccggagccggagtgaatgaggccgactgcaagggctgcagccctctccattatgctgctgcctcggacacctatcggagggcagaaccccacacccctagcagccacgatgcggaggaagatgagcctctgaaggagtctaggaggaaagaggcttttttttgtcttgagtttttactggataacggtgccgatccatctctccgagatcgacagggatacactgcagtgcattacgccgctgcctatgggaataggcagaatctcgagctgttgcttgaaatgtcattcaattgtttggaagacgtagaaagtacaatcccagtttcacccttacacttggcggcatacaatggacattgcgaggccttgaagactcttgcggagactttggtaaacctggacgtgcgagatcacaagggaaggaccgccctgtttctggcaacggaaagagggagtaccgaatgcgtggaagtgctgacagcacatggcgcatcggccctgatcaaagagcgcaagcgaaaatggacaccccttcacgcagcagccgcatctgggcacaccgactcccttcatctgctcatcgactctggggaacgcgctgatataacagatgttatggacgcgtatggacagaccccgctgatgttggccatcatgaacggccacgtagactgcgtccacctgcttctggagaaagggtcaacggccgatgccgctgatttgagggggaggactgcccttcaccggggtgctgtgacaggatgcgaagactgtctagccgcattgctcgatcacgacgcctttgttctgtgtcgggacttcaaaggcagaacacccattcacttagcttccgcgtgcgggcataccgcagtcctgagaactttgctgcaagccgctcttagtacagatcccctggatgctggggtggactactctggctattctcctatgcattgggcgagttacaccggacacgaagactgtctggaactgctgctggaacacagccccttttcctatcttgaaggaaatcctttcaccccactgcactgtgcggtaataaataaccaagactctacaaccgaaatgctcctgggcgcattgggtgcaaaaatcgtgaactctcgcgacgccaaagggcgtacaccactgcacgccgctgctttcgccgacaatgttagcggcctgcgaatgcttctgcagcaccaggctgaggtcaacgcaaccgatcacaccggacggaccgccctgatgactgctgccgaaaatggacaaaccgccgctgtcgagttcctactgtacagggggaaggcagacctcacagtcctggacgaaaacaagaataccgctttgcacctggcatgttctaagggccacgaaaagtgcgcccttatgattcttgcagaaacacaagatttgggactcatcaacgccaccaactccgctctgcaaatgccactgcacattgccgctcgtaacgggctggcctctgtagtacaagctctgctgtcacatggagccaccgtgctcgcagtggacgaagaagggcacacccccgctctggcttgcgctcccaataaagacgtcgctgactgtcttgccctgattctttcgactatgaaaccatttcctccaaaagatgccgtctcaccattctcattcagtttgctaaagaactgcagcatcgcagcagctaagaccgtgggtggatgtggagcgttaccccatggcgcaagttgtccatattcacaagagcggccaggagcaattggcctcgatggatgttacagcgagtag

SEQ ID NO: 53049 - DNA, 1032 bp, Artificial Sequence
  Description of Artificial Sequence: Synthetic coding sequence
atggcttctgccggaagcacagcacgccgagcaggatccggcagttggcacagcgagaggggagagggaagaggagccaggccccagcctactccaagcggtagtatgcagcaagcgaataaggtgtcacttaaagctacttggactgatgctgaatcaaagcagcctagccagccactgcccgatctagcagatcatctgagcgcccaggctaccgccctcgccagacctagaagaccggcaagcctcacgccgcctcgcgctgatccatccccgagcaaggagtccgaccaaaccgccatcgaccaaacggccatcggcagctactatcagttgttcgctgccgcagtggggaacgtggaatggcttcgcttctgcctcaaccaatctttgagagaaatccctaccgatgacaagggatttactgccatacacttcgcagcacagtggggaaaactggcgtgtttgcaagttctcgtcgaggagtataaattccctgtggacctccttacgaataattcgcagaccccactgcatctggttattcatagggacaataccaccgtggccctgccttgcatatactatctactggaaaaaggagccgaccttaacgcacagacatgtaatgggtcaacaccactgcatctcgcagcacgtgacggcctgctcgactgcgtcaaggtgcttgtgcagtcaggcgctaatgtgcatgcccaggatgcaatggggtataagcctattgatttttgcaaaatttggaaccaccgggcatgtgccagattcctcaaggacgcaatgtggaaaaaggataagaaggacttcgcgagagagatgaccaagatgaaaatgtttaagagccagttgaccttgatggagcataattacctgattgagtaccagggccaaggctgcagcgtgcatttcccattcgcattctcgcctatcacccccgagactctgctgtggcaggacatcagcctgctgagcgactgcgggtttctgtggcgcaggcgcgaactttcattctag

SEQ ID NO: 53050 - DNA, 1593 bp, Artificial Sequence
  Description of Artificial Sequence: Synthetic coding sequence
atggcttctgcgggttccacggctaggcgagctggatcaggaagctggcactccgagaggggtgaaggaaggggcgcacgaccccagcctaccccttccggatctatgcaacaggccaataaggtcagcctgaaggccacctggaccgatgccgagagcaaacagccatctcagccactgccagacctggcagaccacttgtctgctcaagcaactgctctcgccagacctaggagaccagcctccctgactcctcctcgcgctgacccctctcccagtaaggagtccgatcagacagcaattgatcaaacggctatcgggtcatactaccagctgttcgccgctgctgtggggaacgtggaatggttgaggttctgtctcaaccaatctcttcgagagattccaactgatgataaggggtttacagcgatccactttgctgcccagtggggcaagttggcttgtctccaggtcctggtggaggaatataagtttccggtcgacctgctcacaaataatagtcagactccattacacctggtgatccaccgcgacaatacaactgttgccctaccttgcatttattatttacttgaaaagggagctgatttaaacgcgcagacttgtaatggaagtaccccgctgcatttggcagctagggatggacttctcgattgcgtgaaggttctggtccagagcggcgctaacgttcacgcccaggatgctatggggtacaagccaatcgacttttgcaagatctggaaccacagggcttgtgcccgattccttaaggacgcgatgtggaagaaggataaaaaggacttcgcgagagaaatgactaagatgaaaatgtttaagagccagctgactttaatggagcacaactacctgatcgaataccaaaaagagcataagatccttcgtgaggcagcaatccggaagtggctccacgggaaactgcatcccggacattctctggtgtcaaataccaaacaggcaagagcgaccgcccttagcaagactcctgaacaacgggagtctcagagaagccgctcattccacccatcagtggacgccaggctgcaatgcataccacagcctaccgaaatgccgaagcccatctaccgcaaaccaactgttaaaaggcccaccatgtggaacgtgagcaacaatccagctcgtccacctacaactcagatcagtcactcccagggcattcgactaggagtgcatcccgacccaacacccgaacacgatttttcttcctttcttgaggtccggcctgacggccacgggggagccaggctgcatacagtggatggccattgggtggcgcctgtccccaggctgcccttcgaagtgctgttgcggatgctctatccccgtgtctggccttaccgcatgaaggtccctcagggcttttaccccatttcaatgcgggaagtgccgagaaaaagacacctaggagataatactttctggaccgataccctagccatgaatttgagagacaccttcgacgaggcttttctcgccgctgtgcgctcccaccagggccttcctacgctgcctagcccacagacaaacccctag

SEQ ID NO: 53051 - DNA, 1845 bp, Artificial Sequence
  Description of Artificial Sequence: Synthetic coding sequence
atgatgaggcaggctactatggatttttcgactccctctgtcttcgatcagcagcggggagactcctcagaggaagtggaccttaccatggtgtatcaagctgcctccaacggtgacgtgaacgctctcaccgctgtaattagggaggatccatctatcctggagtgttgtgactcagaaggttgcacgccactaatgcatgcagtgagcggtcgacaggcggatactgttaagctgctgctgaagatgggtgctaatatcaacatgcaggatgcctatggaaggacaagcctgtgcctggccacatacctgggctggctggaaggctgcgtaagtctgctcagaaatggcgcaaaacataatattccggataagaatggcagactgcctctccatgccgcaacagcagaacccgacatgaggctgcttaccgttctgcttcagcagagcaacatttcagaaataaaccaccaagacaatgaaggcatgacacctctgcactgggctgcgttccataaccagccacagcatacgcaaatgttgctgaaaaagggggcagacccgaccctcgtggacaaagactttaagaccgctttgcactgggctgtccagtctggaaatcgaattctctgcagcatcatcctgtcccatcatcaaggcccttccataatcaactacgacgatgaatcgggaaagacctgcgttcatatcgcggctgctgcaggttttagcgatatcatccacgagcttgcgagggtgccagagtgtaacctccaagcactggacgtggacgaccggacacctttacattgggcagccgcagccggaaaggcagagtgcgtgcagagtctcctagaactgggcatggatagcaatttgcgggacatcaatgagagtaccccgctggcctatgccctgtactgcggtcatactgcgtgcgtaaagctgcttagccaggaatcacgcacggaaccaactaggcctcctcctagccaaagcagcagacctcagaagaaagaacgccgttttaatgtcctcaaccaaattttttgtaaaaataaaaaggaggagcagcgcgcacaccaaaaggacccgagtcgtgatcgctaccgggaagaagacacgtccgaagtcaatgatataatcaccactttcgattctatcgtaggcacaaactgtcaggaacagcctggagaccaggtggccatggtggaatttaaaaaaaaaaccagcgataactccaagtatctgttacctgagaagaagcctctggccagaaaaggcctaccaccaatccgcactcagagtctcccccctatcacgctgggcaacaacttcctcacagctagtcatagggcgacgtcacatgccggtctttcgtccgcacctcaccacatggcccaaaggagtcaaaagtccaggagcgagcaggacctgctaaacaacagaactggttgtcagatgctgctggacaatccctggaaatccgactcaaatcaagtttttagttacaaggtctggaccgtgagcagcagtgacaaactgttagataggctgcttagtgtgagacctggacatcaggaagtgtccgtgccgcctcatcttcgacacctgcataatccctcgagcggacaaaatttccagcatctgtctcctaatcgtcacaagatcagggacctccccttcaccagaaataatcttgcacccctgcccgatcagaagttccttagcggcgaaccgttgcggactaaccgagtactgcccgctatcccaagtcagagacggcattccactgcagcagaagaaagcgaacacagtgctaacccaacttctgacgagaattag

SEQ ID NO: 53052 - DNA, 981 bp, Artificial Sequence
  Description of Artificial Sequence: Synthetic coding sequence
atggacagcaacctgcgggatatcaatgaaagtacacccctcgcatacgcattgtactgcggacatacagcttgcgtcaagctcttgtcacaagaatctcggacagagccaaccagacctccaccatctcaatcctcacggccacagaagaaggagagaaggtttaatgtcctaaaccaaatcttctgcaaaaacaagaaggaagaacaacgggcacatcaaaaggatccctcccgcgaccggtaccgcgaggaggataccagcgaggtcaacgacattatcaccactttcgatagtatagtagggaccaattgccaggagcagcccggagaccaggtggctatggtggaattcaaaaaaaagacatcagacaactcgaaatacctcctgcccgagaaaaagccactggctcgaaaaggactccctccaatcaggacacagagcctcccccctattacgttgggaaacaactttcttaccgcgtcgcacagggccacctcccacgccggactcagctctgccccacaccatatggcacaacgcagccagaagagtaggagtgagcaggacctattgaacaatagaaccggctgccaaatgctgctggataacccctggaaatccgactccaaccaagttttctcctataaggtctggaccgtaagcagtagtgataaactgctggatcggcttctctctgtgcggcctggccatcaggaagtctccgtgcctcctcacctccggcacctgcacaacccctcctccggtcagaatttccagcacctgagcccaaatagacacaaaatcagggacctgcccttcacccgaaacaatctggcccctttgcctgatcagaagtttttgagtggggaacccctgcgcaccaaccgcgtgttgccagccataccatcccaacgcaggcactctacagccgctgaagaaagtgaacactcagcgaatcctactagcgatgaaaattag

SEQ ID NO: 53053 - DNA, 1845 bp, Artificial Sequence
  Description of Artificial Sequence: Synthetic coding sequence
atgatgaggcaggcgaccatggacttttctaccccatccgtgttcgaccaacagcgtggagattcttcggaagaagtagatcttacaatggtgtaccaagccgcttctaacggggacgtgaacgccctgaccgccgtaatcagagaggatccttccatactagaatgctgcgatagcgagggttgtacccctctgatgcatgcagtcagtggcagacaggccgacactgttaagctgctcctgaaaatgggagccaacatcaatatgcaggacgcatacgggcgaacatccctgtgtctggctacataccttggctggctggagggctgcgtcagtctccttcggaacggtgccaagcacaatatccccgataagaatggtcgactccctctccacgcagcaactgcggaaccggatatgcggctgctgacagtccttcttcagcagagcaacattagcgagatcaaccatcaagataatgagggcatgacccccttgcattgggcagccttccacaaccagccacagcatacacagatgctcctgaagaagggcgcagaccctacacttgttgataaagactttaaaactgcactgcactgggccgtccagagcggtaacagaattctttgctcaatcattctctctcatcaccaggggccatcaattattaattacgacgacgagagtggaaagacatgcgttcatatcgcggctgccgctggtttctctgacatcatccatgagttggcacgggtgcccgaatgtaacctgcaggcccttgacgtagatgatcgcaccccccttcactgggccgctgcggctgggaaagctgagtgtgttcagagcctgttggaactaggcatggatagcaacctgagggacatcaatgagtcgacccctttggcttatgccctatactgcggtcacactgcctgtgtgaagcttctttcacaggaaagccgtaccgagcccactcgaccgccaccaagtcagagttcacgaccgcagaagaaggagaggcgattcaacgtgctgaaccagatcttttgcaaaaataagaaagaagagcagcgcgcacatcaaaaagatccttcaagagatagatatagggaagaagacaccagcgaggtgaatgatatcatcaccacatttgatagcatcgttggaacaaattgccaagaacagcccggagatcaggtggccatggtcgagttcaaaaagaaaacatccgacaacagcaagtacctgctgcccgagaagaagccgctcgctcgaaaaggactgccacccattcggacccaatcacttccaccaattacactaggaaacaattttctgacggctagccatcgggctacctcgcacgccggactcagctcagctcctcatcacatggcacagagaagccaaaaatctcgctccgagcaagacctgcttaacaaccgcaccggatgccaaatgctgctggacaacccctggaagtcggattccaaccaggtcttctcctataaggtttggaccgtgtctagctccgataaactcctggacagactcctcagcgttcgacccggacaccaggaggtcagtgtcccaccccacttgcggcatctccataacccgtctagcgggcagaactttcagcatttaagtcctaacagacataaaatacgggaccttccatttacgcggaacaatctggcccctctacctgaccaaaaatttctaagcggtgagcccctgcgtacaaaccgcgtgctgcccgctataccaagtcagcgtcgccactccacagcagcagaagagtctgagcactccgccaatcccacttccgatgaaaattag

SEQ ID NO: 53054 - DNA, 2382 bp, Artificial Sequence
  Description of Artificial Sequence: Synthetic coding sequence
atggcccgagaactcagccaggaagccctgctcgactttctctgccaggctgggggaagggtcacaaatgctgcattactgtctcacttcaagagttttctgcgtgatcccgatgcttccccctcgcagcaccaacatcgacgcgagctattcaagggctttgtaaattctgtcgcagccgtgcggcaggatcctgacggcacaaagtatgtcgtgctcaaacggaggtaccgagatctgcttggcgaggaagggctgcagaggccacgcgagcctccggctgccgctccttcggccggtggtgccgcaccctgcagcccgaggggcgctcgtaggggagagccgccacagcagcaacccaggcggagacggagagagaaggagcctgaagaggaacctgccggagctgccgcaagagcagccgatgcggcttgtaatggattgcccggatccgattcacgccgtgctcctgggaaaggtggaggcagtaagggctcccctggtcagagaccccctgtgcctgcagcagctgcagctggcgctcaggccagagcttcctgtgcggcagctaagacccaggggaggtgctgttgggaatgccttcaaaacaacctggcagtgctacccggagaacttggggctctgccacattccgccaccgccgaagaaaagccagcaagagctcttcctgcacaggatgaccgcggtgcttcccgggaaagggaagagggggctctggccgaacccgctcccgtgcctgctgttgcgcatagtccacccgcaaccgtagaagctgccacttctcgagctagcccaccagccttgttacccggaccagccccacggggagaccggcctgagctcctcactcccagctccctgcactatagcactctgcagcagcagcagcagcgaacccgcgagtgggtggcgaggcatccacaggtgccagaggccagagatcagggcccaatccgggcttggagcgtgcttcccgataatttccttcagcttcctctggagcctggctccacggagccgaattctgaacctcccgacccatgtctgtcgagtcactcactgtttcccgtggttcctgatgagtcatgggaaagttgggccggtaacccgtccctgacggtgtttcggagtatcagatgccagctctccctgcaggacctggatgatttcgtggatcaagagtcagatggctcggaggagagttcaagcggcccaaaggattctcctggcgctagcgaggagggtttgcaggttgtcctgggcaccccggacaggggcaaactcagaaacccagccggtgggctttcagtctccagaaaggaaggatctcccagcaggtctcctcagggcctcagaaacaggggcgatggtcacatctcccagcaggtccccgctggagcgaacggtctcgcaggacatcctcttaagcctctcccttggcctgtgcccaaattaagacgctctctaaggcgatcctcactggcaggcagggcaaagcttagtagcagtgatgaggagtacctagatgagggcctcctgaagcggtcgcggaggcctcccagaagcagaaaacccagtaaggcaggcacagcgcctagccctcgagttgatgccggactgtccctaaagctggcagaagtgaaagcagtcgtggcagagcggggatggcgacatagcttgtgggtcccatcaggcgaaggatcagctgccctggctcctcaccggaccagtgaacataaatctagtttagtgccactcgatgctcgcgaacacgaatggatcgttaagttggccagcggcagctggatccaggtttggacactgttctgggaggatccacagctagctctccataaagactttctgaccggctacaccgccctccattggatcgccaagcatggggatttgagggccctgcaagatctcgtcagcggagccaagaaagccggtattgtcctggatgtgaatgtgcgtagtagctgtgggtacacgccccttcatctggctgcgatccatggccatcaaggtgtcattaagctcctcgtacagaggttggcaagtcgcgtcaacgtcagagattccagcggcaaaaagccttggcaatatctcacaagtaatacgagcggggaaatttggcagctcctgggcgcaccccgtggtaaaccaatcttcccagtgtatcccctggtcggttcctcgagtccaacccgcaaagctaaaagtaaagagatatcgaggtctgttactcgcaagacttctttcgcagcgttgctgaagagccaacacaacaagtggaagcttgctaatcagtacgagaagtttcacagccctcgtgagcgtgaggagtatagcgattag

SEQ ID NO: 53055 - DNA, 1578 bp, Artificial Sequence
  Description of Artificial Sequence: Synthetic coding sequence
atggagggacccgcagagtggggccctgaggccgctcttgggcctgaggctgtgctccggtttctcgctgagagaggcggtcgagccctgcatgctgaactggttcaacattttcgcggagccctgggcggtgagcctgaacaaagagcaagagcgagggcacatttcaaggaactggttaatgctgttgcaacagtgcgggtcgatcccgctgacggagctaagtatgttcacctaaaaaaacggttttgcgagggtccttctgaaccgtctggggaccctcccagaatccaggtgacagccgagcctgaggcgcctgacgggcctgccggaccagaagctagggaccggttacccgatgccgctgcgccagagagcctccctgggcaagggagagagcttggtgagggggagccacccgctcccgctcattggcctccactgtcagctggcgcacgccgtaagaactcaagaagggatgttcaacctctgcctaggaccccggctcccggaccctcagaggatctggagctgccaccacacggctgtgaggaagcagaccgcggtagtagtctggttggcgcaactgcacaacggccagccaggcagaatctgcgcgatctggtcatggggtctagccctcagcttaaacggagcgtctgccccggaggctcaagtccagggagttccagtggaggtgggagaggccgaggcggtggagattctgatagcgcgtccgtggccagcagttcagctgaggaggagtcttccggaggcggttccgtaaccctggatccactggagcatgcttggatgctgagcgcatctgatggcaagtgggacagcttagagggcctgctgacgtgtgagcccggtttgctggtcaagagggactttattacgggcttcacttgtcttcactgggccgctaaacacggaaggcaagagctcctcgccatgcttgtaaattttgctaacaagcaccagctgccagtcaacatcgatgcccgtaccagcggaggatacactgccctgcaccttgccgctatgcacgggcatgtggaggtcgtaaaactactcgtcggagcgtacgacgcagatgtcgacattagggactacagcggtaagaaagcatctcagtatctgagccgcagtatcgctgaagagattaagaacttggtaggagccctagatgagggcgatggggaatccgcagccggatctggaggaggcaggtggagattatccaaagtgctcccctcacatctcatcacttacaagctatcccatgcattggaggacggcggtgatcaccaccaccaccaccatagcgcagaggggtgggtcggagggaaggccaaggatccgggtcgtaaagccagcggtagctcatcagggagaatcaagcccagactgaataagatcaggttccgtactcagatcgtccacaccacccccagcttccgcgaccccgagcagcctctcgaagggagaggcgaagaaggcgtgggggaggaaagacccgtcaagggacactcaccatttaccctccggcctaagtcaaacgtgttcggctag

SEQ ID NO: 53056 - DNA, 948 bp, Artificial Sequence
  Description of Artificial Sequence: Synthetic coding sequence
atggcacaactcggtggcgcagcaaatcgggctccaacggctagcttagcacccactagccagagtctccggtgtgccccacagcctcggccatcccgtgctgacacaggcagcctggggagatactggggcaaggccgcagcagccgcatcccgggaacaccccttccccggaaccctcatgcactcggcggctgggagcggacgcaggaggggcgctttacgggaactactaggtcttcagcgggctgccccagctggctggctaagcgaggagcgagcagaagagcttggaggaccctccgggcctggttccagtcggctgtgcctggagcctcgggaacacgcctggattctcgctgcggctgaaggccgttatgaagtactccgcgaactacttgaggctgaaccggaattgttgctgagaggggaccccatcaccgggtactctgtcctgcattggctggcgaagcacggcagacacgaggaattaatcctcgtccacgactttgccctgcgtcgtggcctgagactcgacgtctccgccccaggcagcgggggactcacacccctgcaccttgctgcattacagggccatgacatggttattaaggtactcgtcggcgctctgggcgctgatgctaccaggagagatcattcaggtcaccgggcatgccactacctcaggcctgatgccccatggagattacgggaactatccggggcagaagagtgggagatggagagcgggagcggatgcacaaacttgaataacaacagcagcgggacaaccgcgtggcgggcagccagtgccgttggcgcaacagcagttgagacgtcgcggcgagtcgccgctagccgcacaaaagccaaggatacagcagggtcgcgggttgcacaaatgcatagcctctttcgccatctctttccatcctttcaagatcggtag

SEQ ID NO: 53057 - DNA, 1026 bp, Artificial Sequence
  Description of Artificial Sequence: Synthetic coding sequence
taggcatgggggatgcggagggcagccgctggagccggtggcgctagagctgcaggaccaaccggaggggcttcccgactccatcccaacgccggtaggcgctctggtgcccgagccggtgcccagggatgtggaggaccacgggtaggctctgcggatagccgtgccctacccgctcagcctttagcatgtgccagaggtcgcagccagaggttggtctgcgatcccaaggcagcgtctgccttgccagacctggcgccagatgtgtttgttctcagagtgaggcttgaggagaccggcgaaatgtttcgcgtggctaattgtagaggagacatgacagtgcgagaactcaaggaggaattggacctgatggtcggcatcccctttaatctgcagaggctacagtacctggatgaaggtgtgctgatggatgacacaacactcaaatttcacgacgtggtccccggaggcataatttctttgtgcatctggcatcacgacggctggaccgaacttgtacttgctgctgtggaaggagacccctctaagctcagctgtctggggctcactgaagacagtttttaccggaccgctaatagcgagcatttcgaaggggagaagtggaaacactggacctcacagagggcctttgtcgcactttacgtcgcctcccaccgcggtcactttgatgcggtacagtacctgttggagcacggcgcaagctgtctgagtaggagccccctgggtcggacccccttacatgtggctgctgccatgggtagatccgactgcataatcctccttctgcagcacggcgcatccatccacgatagggacgctaagggtgagaccccaatatctatcgcccaccgcctgaatcatacattgagcgagagacagatggttctcctgcaccgaatcgcgaagagcggcatccgggatcttaacgatcttgtgatgaagaatgccttacaacgcgtgaaaagtggctttcgctccgaaaaaatgactatgactcctcactag

SEQ ID NO: 53058 - DNA, 1038 bp, Artificial Sequence
  Description of Artificial Sequence: Synthetic coding sequence
atgacacgtgggcgtgcgtgggggatgagacgagccgcagccggagcaggaggggcacgcgctgctggaccgactggaggtgccagccgtctgcatcctaacgccggacggagatccggtgcaagagctggggcacaaggctgtggaggtccaagagtgggctctgccgactcccgcgctctgcctgcacaaccgctggcgtgtgcacgaggcaggtctcagcgcctggtttgtgatcccaaagccgcatctgccctacccgatctggcgccagacgtatttgtgctgcgcgtacggctcgaggagacgggggagatgttcagggtcgccaattgtcggggtgacatgaccgtgagggaactgaaggaggaattggatttaatggttggtatcccttttaatctacaaagacttcaatatttagacgagggtgtgctgatggatgacactaccctcaagtttcacgatgtggtccccggaggcataatctccctgtgcatttggcaccatgatggatggaccgaactggtactcgcagcagttgaaggggaccctagcaaattgagctgcctgggtttaacagaggactccttttaccggactgccaatagcgaacacttcgaaggagaaaagtggaagcactggacttctcagcgtgcttttgtggccctctatgttgcctcacacaggggccactttgatgccgtgcagtatctactggaacacggcgcttcctgcctgtctcggagtcctctgggcagaacgcctctgcatgtagccgctgcaatgggcaggtccgattgtatcattctccttcttcaacatggggcatcaattcacgatcgcgacgccaagggtgaaacacccatctccatcgcacatcggctgaaccacacacttagtgaacgacagatggtgttgctccataggatcgctaagtctggcattcgagacctcaacgacctggtgatgaagaacgctctgcagcgcgtcaaatccggctttaggtctgagaaaatgacaatgacccctcattag

SEQ ID NO: 53059 - DNA, 2712 bp, Artificial Sequence
  Description of Artificial Sequence: Synthetic coding sequence
atggcaacctggaggaaaaaccgggacaaagatgggttctccaaccccggataccgagtaagacagaaggacctcgggatgattcacaaggcagctatcgctggcgacgttaataaggtgatggagtccattctgttaagactgaacgacttgaacgacagagataagaagaataggaccgcacttctgctggcctgtgctcacggtagaccaggcgtggtggctgaccttgtggctagaaaatgccaattgaatcttacggactcagaaaaccggactgctctgatcaaagctgtccaatgccaggaggaggtgtgtgcctccattctactggaacatggcgctaaccccaatgtcagagatatgtacggtaacacagcccttcactatgctatcgacaatgagaacatctccatggccagaaaactgctagcttacggcgctgatatcgaggctcggagccaggatggtcataccagcctactgctggcggtgaatcggaagaaggaacagatggtggcatttctgctgaaaaagaagccggaccttacagccatcgacaacttcggtagaaccgcactgattttagccgctaggaatggctctacttcagttgtttatcaactgttacagcacaatattgatgtcttctgccaggacattagtggttggaccgctgaagactacgctgtggctagtaagttccaggcaattagaggaatgataagtgagtataaagctaataaaagatgcaaatcactgcaaaatagcaacagtgagcaggacctggagatgacgtcagagggcgagcaggagagactggagggctgcgaaagtagccagccacaggtggaggagaagatgaaaaagtgtagaaacaagaagatggaagtatcccggaacgtccacgccgatgactctgacaattataacgatgatgtcgatgagctgattcataagatcaagaatcgtaagcccgataaccatcaatccccgggaaaagaaaatggagagtttgaccgattggctaggaaaacttcaaatgagaaatctaaagtcaagtcccagatatattttactgatgatctgaatgatatctcggggtcttcagagaagacctccgaggacgacgagttaccttactccgacgacgagaactttatgcttctgattgaacagtcaggcatggagtgcaaagattttgtctcactctcaaagagcaaaaacgccaccgcagcctgcggcaggtccatagaggaccaaaagtgctactgcgagcgcctgaaggttaagtttcagaagatgaagaataacattagcgtcctacagaaagtgctgtccgagaccgataaaacgaagagccagtcagaacatcagaacttgcagggaaagaaaaaactttgcaacctacgctttatactccagcagcaagaggaagagcgtatcaaggcggaagagctgtacgaaaaggatattgaagaactcaagatcatggaggaacagtaccgtacacaaacagaagtgaagaaacaaagcaaactgacccttaagtccctggaggtggaactgaaaaccgtcaggagtaactccaaccaaaatttccatacccatgagagggagagagacctgtggcaggagaaccatcttatgcgggacgaaattgctcggctgcgactagagattgataccatcaaacaccagaaccaggagacagaaaacaagtactttaaggatattgagataataaaggaaaataatgaggatttagagaagacactaaagcgaaacgaagaagcactgaccaaaactataacgcggtactctaaagagctgaatgtcctgatggatgagaacacgatgttgaattcggagctacagaaagaaaaacagtccatgtcccgacttgagacggaaatggagagctaccggtgtaggctcgccgctgcactatgcgatcacgatcagagacagtcctctaagagggatttgcagcttgcattccagtctacagtaaacgagtggtgtcatctccaggaagatactaacagtcacatccagatcctctcccagcagctgtccaaagctgaaagcacttcctccggcttggaaacagagctccattacgaaagggaagcgttaaaggagaaaacactgcacatagagcatatgcagggagtattgagccggacacaacgcagattagaggatatcgaacacatgtaccaaaatgaccagcccattctggaaaagtatgtgaggaaacagcagagcgttgaggacggtttgttccagttgcagtctcagaacctgctgtatcagcagcagtgtaatgacgctcgcaaaaaagcagacaatcaggaaaagaccattatcaacattcaggtaaagtgtgaggatacagtcgagaaactccaagcagaatgtagaaagctcgaagagaataacaaaggattgatgaaagaatgtacattgttaaaagagcgccagtgtcaatacgagaaagagaaggaagagcgagaagtggtgcgtagacagctgcaaagggaggtggacgacgctctgaacaaacaattacttctggaagccatgcttgaaatatcttcagagcgcaggatcaaccttgaagacgaagcccaaagtctgaagaaaaaactggggcagatgcggagtcaagtatgtatgaagctttctatgtcaacagtgaccctgtag

SEQ ID NO: 53060 - DNA, 1920 bp, Artificial Sequence
  Description of Artificial Sequence: Synthetic coding sequence
atgactagcgagggggagcaggagaggctggaaggttgcgagtcctctcagcctcaggtggaagaaaagatgaagaagtgtcggaataagaagatggaagtgagcaggaatgtgcacgcagacgactcagacaattataatgatgacgtggacgaactcattcacaaaattaaaaatagaaagccggacaaccaccaatcacccggaaaagaaaatggtgagttcgaccgtctggctagaaagacaagcaatgaaaaaagcaaggtgaagagtcagatctactttaccgacgacctgaacgacataagtggctccagcgagaaaacctctgaagacgacgagctgccatattccgacgacgagaattttatgctacttatcgaacaaagcggcatggagtgtaaagacttcgtgagcttatcgaaaagtaagaatgctacagcggcttgtggccgttcaatagaggaccagaagtgttactgcgagaggctgaaggtcaaattccagaagatgaaaaacaatatatctgtcctccagaaggtgttgagcgagactgacaagactaaatcccagtccgaacaccagaaccttcaaggaaagaagaagctgtgcaatttgcgattcatcttacaacagcaggaagaggagcgcatcaaggccgaagaattgtatgagaaagacatagaagagctgaagataatggaagaacagtaccgcacacagaccgaggtcaaaaagcagtccaagctgacactgaagtctttggaagtggagctgaagactgtgagatctaacagtaaccaaaacttccacacgcatgagcgcgaaagagacttgtggcaagagaaccatcttatgagagacgaaatagcccgacttcgcttagagatcgataccatcaagcaccaaaaccaagagactgagaacaagtacttcaaggacatcgagatcattaaggagaacaatgaggatctggagaagaccctgaagaggaacgaggaagccttaactaagacaataacgagatactctaaggaactcaacgttctcatggatgaaaataccatgctgaactcagagctgcagaaggagaaacagtcgatgagcagactcgagacggagatggagtcctatcggtgtcgtttagcagccgctctgtgcgaccacgaccagagacaatcctccaagcgggatctacagctcgccttccagtcaactgtcaacgaatggtgtcacctccaggaagatactaatagtcatatacagatactgtcacaacagctgtctaaagccgaatccacaagctcggggctcgagacggagttgcattatgagagagaagccctcaaggaaaaaactttgcacatagagcacatgcagggggtgctatcgcgaacccagcgacggctggaagatattgagcatatgtatcagaatgatcaacctattttagagaagtatgtgagaaaacagcagtccgtggaggacggcctgttccagctgcaatcccagaatctcctgtatcagcagcagtgtaacgatgcaagaaagaaggccgacaatcaggaaaagacaatcatcaacattcaggtgaaatgtgaggacactgtggagaagctgcaggccgaatgccgaaagcttgaagagaacaacaaaggccttatgaaggagtgcaccctactgaaggaaagacaatgccagtatgaaaaagagaaggaagagagggaggtagtaagaaggcagctgcagagagaggtggacgacgcattgaataagcagcttttgctggaagctatgctggaaattagctccgagaggcgtattaacctggaggatgaggcacagtcgctaaagaaaaaacttggccagatgcgaagccaggtgtgcatgaaactttctatgtccaccgtcactctctag

SEQ ID NO: 53061 - DNA, 1143 bp, Artificial Sequence
  Description of Artificial Sequence: Synthetic coding sequence
atgctgaagccaaaggatctttgcccaagagcaggaactaggaccttcctcgaagcaatgcaggccggtaaggtgcatctagccagattcgtactggacgctctggatcgcagtatcattgattgcagggcagagcagggcaggaccccgctgatggtggccgtgggtttgcccgacccagcactccgcgctcgcttcgtcaggcttctgctagagcagggagcagccgtgaatttgagagacgagaggggcaggacagccctctctctggcttgtgagcgcggtcatctggacgcggtgcaactcttagttcagttctcaggtgaccccgaagcggcagactctgccggaaactctccggttatgtgggctgctgcttgcggccatggtgcggtgctggagttcctggtgcgatcttttaggcggctggggctcagactcgaccgcactaatagggcaggcctcacagctttgcagttggccgctgcccgagggcatggtacatgcgttcaggccctgacaggtccttgggggcgagcagcagcagctgccgctgctaggggctcaaactcagatagtccacccggacggcctgcccctgccgcttcccccgaacaccggagaccctctcctcggagattacccaggccactcctggcacgattcgcaagggctgctggcggacatggtggtgaggcaggatccgcgggtaagaattccgggaggcacagggcccagggctctgaacgcccagagctcggtcggtcaatgtccctggcactaggggctgtgacagaggaggaagccgctcggctccgcgctggggcattaatggcacttcccaatagcccccaatcatccgggacgggacgttggcgatctcaagaagtcttagaaggtgcaccacccacattggcccaggcacccattggcctatcgccacatccagagggtggccctggaagcggaagactgggcctgcgaagaaggagcacagccccagatattcccagcctggtcggagaggctcctggccctgaatctgggcctgaactcgaggcaaacgctctgtccgtgagtgtgcccggtccaaacccctggcaggccggaaccgaagccgtggtgcttcgagcacaacgttag

SEQ ID NO: 53062 - DNA, 1200 bp, Artificial Sequence
  Description of Artificial Sequence: Synthetic coding sequence
atggattcacaaagacccgagcctcgggaagaggaggaggaggaacaggaattgcggtggatggaactcgattctgaagaggctctaggcacccgaaccgaaggaccctccgtggttcaggggtggggtcacttattgcaggctgtctggagaggacccgctggcctagttacccagttgttgcgccagggagccagtgtcgaggaaagggaccacgcaggccgaacacccttgcacttggcggtactcagagggcatgccccactggtgagactactcctccagcggggtgctcctgtcggcgcagtcgatcgagctggtcgcaccgccctgcatgaggccgcttggcatggccatagtcgggtagcagaactgctgctccaacggggagctagcgctgctgccagatctggcactggactgacccccttgcattgggccgcagcactaggtcacacactcctagctgctcgactccttgaagcccctggcccaggaccagccgcagccgaagcagaagacgctagagggtggaccgccgctcattgggctgctgccggtggtaggctggccgttttggaactgctcgcagctggcggtgctggtttggatggggcactgctcgtcgcggctgcagctggtcgcggagcagccctgcggtttctgctcgcacgcggagccagagtggacgcccgagacggagccggagctacggccctgggtttggcggctgcactggggaggagtcaggatatcgaggtgttgttaggtcacggagcggatcccggaattcgggataggcacgggaggtccgccctgcacagagccgcagcaagaggccacctgctcgccgtgcaattgttggtcactcaaggagctgaagtggatgccagggatactctgggtctgactcccctgcatcacgcctcaagggagggtcatgttgaagtggcaggctgcctgcttgataggggcgctcaggtggacgccaccgggtggctccggaaaacccctctgcatcttgctgcggagagaggtcacggcccaaccgtgggtctcctcttgagcaggggcgcttcccctaccctcagaacccagtgggccgaagttgcccaaatgccagaaggggatctacctcaggctttgccagagctggggggtggggagaaggagtgtgagggaattgagtctaccgggtag

SEQ ID NO: 53063 - DNA, 525 bp, Artificial Sequence
  Description of Artificial Sequence: Synthetic coding sequence
atggatagtcagcgcccagaacccagagaagaagaagaggaggaacaggagctaagatggatggaattagattcagaagaggctctcggaaccaggaccgaaggcccatccgtggttcaagggtggggccacctgctgcaggcagtttggcggggtccggcaggcctcgtaacacagctcctccgccagggagcttctgtcgaagagcgaacactgcgctgttgctgggccacaggacagactcaagcaagtggcaccggaatggccgctctgagatgcaccgggctgcccccagaggacacgtgcttgcccagcagctgctggtcccccaggggccctcgatggatgagaggcacgccatgggcctcgcacccctgcataacccctctgggtaaggccacatggagattacctgcggcatgttggaccggcgttccaaggtggatgctgcccgcaggctctgaacgtccaccttacacatggctgcagtccgaaggaatgggcctcccctggggtttctgctag

SEQ ID NO: 53064 - DNA, 198 bp, Artificial Sequence
  Description of Artificial Sequence: Synthetic coding sequence
atggacagccaacggccagaacctcgagaagaggaagaggaagaacaggaactccgctggatggagctcgactcggaggaagctttgggcacacgcaccgaaggacctagtgtggtccagggttggggccacttgcttcaagccgtgtggcgaggcccagctggactcgtgacccagctgctgcgccagggccattag

SEQ ID NO: 53065 - DNA, 954 bp, Artificial Sequence
  Description of Artificial Sequence: Synthetic coding sequence
atgccatgggatgcgcgtcggcctggcggtggagcagacgggggacccgaggccagtggggctgcacggtctagggctcagaaacagtgtcgtaaaagttcctttgccttctatcaggcagtccgagacctcctaccggtttggctcctggaggatatgcgtgcgtcagaagcctttcattgggatgaaaggggtcgggctgcggcatacagtccttctgaggctcttctgtatgccctggtacacgatcaccaggcatacgcccattaccttctggccaccttcccacggagagcactggctcctccatcagccggatttcgctgctgtgccgctcccggtccccacgtagcactcgctgttaggtataatagggtgggaattctgcggcgtatcctcaggaccttgcgtgactttcctgccgaggagcgagctcgcgtgttggaccggcgaggctgctctcgggtggaggggggtggtacctctctgcacgtggcctgtgaattggctcggccagagtgtctctttctgctgctgggacacggggctagcccgggtttacgagatgggggaggactcactcccttggaactgctgttgagacaactggggagagacgcaggtgcgacgccttccgcagcaggagcccctgctagcgctcctggggagcccagacagcgtcggcttttgttacttgatctcctggccctgtatactccagttggtgcagccggatcagcacggcaggaactcctgggcgataggcccagatggcagcgcctactgggcgaagacaagttccaatggctggctggcctggctccacccagcctcttcgccagggcaatgcaggtactggttaccgccatcagtccaggcagatttccagaagctctggatgagctgccgttgccgccattccttcaacccctggacctgacggggaagggctag

SEQ ID NO: 53066 - DNA, 318 bp, Artificial Sequence
  Description of Artificial Sequence: Synthetic coding sequence
atgccctgggacgcacggcgtcccggtgggggagccgatgggggacctgaggcttccggggcagctcggtctcgcgcacagaaacagtgccggaaatccagttttgcattctatcaagcagtgcgggacttactcccagtgtggctgctcgaggatatgcgggcatccgaggcctttcactgggacgaacgcggtcgcgcagccgcttactcaccttccgaggctctcttgtacgcacttgtgcacgatcatcaggcgtacgcccattatctgctcgccacgttcccgagaagggctttagccccaccctctgcttag

SEQ ID NO: 53067 - DNA, 783 bp, Artificial Sequence
  Description of Artificial Sequence: Synthetic coding sequence
atgccgtgggacgctcgccgacccggtggaggggcagacggcggtccagaagcgagcggcgcagcccgaagtagagcccagaagcagtgcagaaaatccagctttgccttttatcaggctgtgagagatctcttgcctgtctggctcctggaggacatgcgggctagtgaggcgttccattgggacgaaaggggacgcgcagcagcatactctccatcagaggcgctgctgtacgctcttgtccatgaccaccaggcctatgctcactacctcctcgccacatttccaaggcgcgcactggccccaccgtctgccggttttcggtgctgtgctgcacctgggccacatgttgccctcgcagtgcgatataaccgcgtgggcatcctgaggcgtatcttgcgtaccctgcgggacttcccagccgaggaacgagcacgcgtcctggaccgacgcggatgctcccgggtagagggaggcggaacctctttgcatgtggcgtgcgaacttgctcgacctgagtgcctattcctgttgctcggtcacggcgcatcgccagggctgcgtgatggaggtggactcactccattggaattgctcctccgccaacttggacgagatgccggtgccacaccatctgcagccggagcgcctgcgagtgctcccggtgagcccaggcagaggagactcctactgcttgaccttctggcgctctacacacctgtaggcgctgccggaagcgccaggcaggaactgcttggggatcgacccaggtggcagcgctag

SEQ ID NO: 53068 - DNA, 954 bp, Artificial Sequence
  Description of Artificial Sequence: Synthetic coding sequence
atgccatgggacgccagacgacccggtggaggtgccgacggcggacccgaagctagcggcgctgccagatctcgggctcagaaacaatgtagaaaatcctcattcgctttctaccaggccgtgcgcgatctgctccctgtgtggctattggaagatatgagagccagcgaggctttccattgggacgagcgcggacgcgctgccgcttactctccctcagaagctctcctgtatgctctggtccacgatcatcaggcttacgcccattatctgttggccacctttcctcgcagagcactcgctcccccttccgccggatttcgttgctgtgcagctcctggacctcatgtggccctcgcagtgcggtataacagagtaggcatcctgcgaaggatacttaggaccctgcgcgactttccagcggaagaacgagccagggtgctggataggagagggtgctctcgggtggagggaggcggaacgtcgttgcacgtggcctgcgagctggccaggcctgagtgtctctttctgctactgggccatggggcaagtcctgggctacgggacggaggcggactgacacccctggagcttctgctcagacagctaggtagggacgctggggctaccccaagcgcagccggagcccctgctagcgctcccggtgaacctaggcagcgcaggctcctgctcctagatcttctcgctctttatacaccagtcggggctgctggaagcgcgaggcaagaattgctcggcgaccgaccgaggtggcaaaggctgttgggtgaagataagttccaatggctcgcagggttagctcccccttctttgtttgctcgagccatgcaggtgctggtgacagctattagccctggacgctttcctgaagcgctggacgagctgccgctgccaccattcttgcagcctttggatctcaccgggaagggatag

SEQ ID NO: 53069 - DNA, 954 bp, Artificial Sequence
  Description of Artificial Sequence: Synthetic coding sequence
atgccgtgggatgcgaggaggccaggtggaggcgctgatgggggtcccgaggcctcgggtgccgctaggtccagagcgcagaaacagtgtcggaaaagctcattcgctttctaccaggctgttcgggaccttttgcctgtttggctccttgaggacatgagggcaagcgaggcattccattgggacgaacgaggacgggcagctgcgtatagcccgtctgaggcccttctgtacgctctggtgcacgatcatcaagcatacgcccattacttgcttgcgacctttcctcggagagcgttagctcctcctagcgccggatttcggtgttgcgctgcccctggtccccacgttgccttagccgttagatacaacagagtgggcatactgagaagaattctgcgcaccctccgggacttcccagctgaggaacgtgcaagagtgctcgatcggagagggtgttctcgcgtggagggcggaggcactagtctccacgtagcatgtgagctcgccaggccggaatgcctgttcctgctgcttggccatggtgccagccccggtctgcgcgatggcggaggactgaccccgctggagctcctgttacggcaacttgggcgagatgctggagcaacaccatccgcagccggtgccccagcttccgctccaggagaaccaagacagcgcaggctgttactcctggacttactggccctgtatacaccggtaggggctgccggttctgctagacaggaattacttggggaccgccctaggtggcaacggctgttgggggaggacaagtttcagtggcttgccggactggcgccaccatcactctttgcaagagccatgcaggttctggttacggcgatctcccccggtcgcttcccggaggctctagatgaacttccacttcctccctttttgcagccattagacttgaccggaaaagggtag

SEQ ID NO: 53070 - DNA, 2292 bp, Artificial Sequence
  Description of Artificial Sequence: Synthetic coding sequence
atggaagcgagcctgaccagaaggttgttgttcaaggacagacacttcacttgctctaagatcattgggagacggttcgcctgctttgcccagaggttgagccatcgcaggaaacaaagtcaatgcgatcttttaaatgagtcgaccggtcagctgcccactacgtgctcctccgcggcttcaaactcaattaactggaattgtcgagtgaagatgacccagcagatgcaaaacctgcatctttgtcagtctaagaagcattccgcaccatcaagcccgaatgccgctaagcgtctgtaccggaaccttagtgaaaagcttaaaggctcacactctagcttcgacgaagcctacttcaggaccaggaccgatcgtctgtcgctccggaagacctctgttaacttccagggcaatgaagccatgttcgaagccgtggagcaacaagatatggacgctgtgcaaattcttttgtaccagtatacccccgaagagctggatctgaacactccaaacagtgaaggcttaacccctctcgacatcgccatcatgacaaacaatgtgcccatcgccagaattttgctgcgaaccggggctagggagagcccgcatttcgtgagcctagagtcaagagcaatgcatctgaataccctggtgcaggaagctcaagagagggtgtctgagctgtccgctcaggtggagaatgaaggattcacgctagacaataccgagaaggagaaacagctgaaagcctgggaatggagataccgtctgtatcgaagaatgaaaaccggctttgaacacgcacgggcacccgagatgcccacaaatgtctgtctgatggtcacctcaagcacatctctaacagtttcttttcaggaacctttgagcgtcaatgcggctgttgtgactcggtacaaggtcgagtggagcatgtccgaagacttttctccactggcgggagaaatcatcatggacaatctccagactttgcgatgtactatcaccggcttaactatggggcagcagtatttcgtccaggtcagcgcgtacaatatgaaaggctggggtcccgcacaaaccaccacgccagcctgcgcatctcccagcaattggaaggactacgacgacagagagccacgacacaagggccagagcgaggtgttagaaggcctcttgcagcaggtcagagcacttcatcagcattatagctgtagggagagcacaaaactacagacaaccggacggaagcagagtgtttcccgcagtttgaagcacttgtttcactctagcaacaaatttgtgaagacactcaagagaggcctgtacatcgctgtaatcttctactacaaggacaatatccttgtaaccaacgaggatcaagtgcctatcgtggagatcgatgattcccatactagcagtattacacaggacttcttgtggttcacaaaacttagctgtatgtgggaagatattaggtggctcagacagtccatccctatctcatcaagctcaagtactgtacttcagacccgacagaagatgcttgctgccaccgcacagctgcagaatttgctgggcactcataacttagggagggtatattacgaacctattaaggacaggcatgggaacattctaattgtgaccattagagaggtcgaaatgctgtactcattttttaacggcaaatggatgcagatctctaagctccaaagccagcggaaatcgttatccaccccagaggaacctactgctctggatatactcctcatcaccattcaggacattttgagttatcacaaacgcagtcaccagagactgtttccgggactatacctcggctacctcaagctgtgtagcagcgtagatcagattaaggtcttggttacacagaagctgcctaacattctgtgtcacgtcaagatacgcgagaacaataacattagccgcgaggagtgggaatggatacaaaaactgtcagggagcgaatccatggagtctgtggatcatacctcagattgtcccatgcaactgttcttttacgaactccagatggcagtcaaggcacttttgcagcaaatcaatatccctctccatcaggctcggaacttccgcctctatactcaggaagtgctggaaatgggccacaatgtgagcttcttgcttctgctccctgctagcgacgacgtgtgtaccgcaccaggtcagaacaatccgtataccccacattctgggttcctgaacctcccgctgcagatgttcgagctgggaatcgtggcttgcttcacttag

SEQ ID NO: 53071 - DNA, 831 bp, Artificial Sequence
  Description of Artificial Sequence: Synthetic coding sequence
atggcatggtggaaatcttggatcgaacaagaaggagtgacagtgaaatcttcttctcattttaatcccgatcccgacgctgagactctgtatcaagcgatgaagggcatcggcgtgggaagtcagcttcttagccatcaagctgctgcctttgcgttccctagctccgccctaacctctgtgagcccttggggacaacagggtcacctctgctgcaatcctgctggcacaaatgagcaggctatcatcgatgtcttgacaaagaggtctaacacccagagacagcagatcgccaagtcctttaaagcccagttcggaaaggacctcacagagaccctgaaaagtgagttatccggtaaatttgaacgcctgattgtggccctcatgtatcccccataccggtacgaggcaaaggagctgcacgatgctatgaaggggtcacgggatgacgttagctcatttgtagaccccggtctggccctccaggacgcccaggatctctacgcagcaggcgagaagatcagaggaaccgatgaaatgaagttcattacaattctctgcaccaggagcgccacccatctcctgcgcgttaaatgcactcagaatttgcacagttactttgcagaacgactgtattatgctatgaagggggcaggtacgagagatggtacccttattcggaacattgtctctcgaagcgagatcgacctgaacctcataaaatgccacttcaaaaagatgtatggcaaaacgcttagctctatgattatggaagatacatcaggcgactataagaacgcccttttgagtttggtgggaagcgatccatag

SEQ ID NO: 53072 - DNA, 984 bp, Artificial Sequence
  Description of Artificial Sequence: Synthetic coding sequence
atggcttggtggaagtcctggatcgaacaggagggagtgactgtgaagagtagttcacacttcaaccctgacccggacgcagaaacattgtatcaggcaatgaagggaataggaaccaatgagcaggccatcattgatgtgctcactaaaagatctaacacccagaggcagcagatcgctaagtcttttaaagcacagtttggcaaagatttgactgaaaccctgaagtctgagctttccggcaaattcgagaggcttatcgtggcattaatgtatccaccgtaccgatacgaggcaaaggagctacatgatgccatgaaggggcttggcaccaaggagggcgtcattatcgaaatcctggcctctaggacaaaaaatcaattaagagagatcatgaaagcctatgaagaggattacggaagttctctggaagaagacattcaagctgataccagtggctatctagagcgtattctcgtgtgtctgctgcagggttcccgtgatgacgtgtcatcattcgtagaccccggactcgctctacaagacgcccaggatctctatgctgcaggcgaaaagatcagaggcacagacgaaatgaaattcatcacaattctgtgcacccggtcagcgacccatctcctgagggtgtttgaggaatacgaaaagattgcaaataagagcatcgaggattccattaaatctgagacgcacgggtctctggaagaggcgatgctaactgtggttaaatgcactcagaacctgcactcctattttgcagagagactgtactatgccatgaaaggggcaggaactcgcgacggaacattgatacgcaatatcgtgtcccgtagtgagatagacctgaacttaattaaatgtcattttaaaaagatgtatggcaagacattatcgtccatgatcatggaagatacttccggtgattataaaaatgccctgctttcactggtcggcagtgacccttag

SEQ ID NO: 53073 - DNA, 798 bp, Artificial Sequence
  Description of Artificial Sequence: Synthetic coding sequence
atggcctggtggaaatcctgggacttgactgaaaccctgaaaagtgagttatcaggaaaattcgagcgcctgatcgtggctttaatgtaccctccctaccgctacgaagccaaagagctccacgatgcaatgaaaggactgggtaccaaggaaggcgtaattatcgagatcctggccagtagaaccaaaaaccagctgagggaaatcatgaaggcctatgaggaagattacggatcatcactggaggaggatattcaagcggatacttccgggtatctagagaggatcttggtatgcttactgcagggctcacgggatgacgtgtcaagcttcgtggaccccggtctagcacttcaagacgcccaagacctttatgccgcaggcgaaaaaatacgagggaccgatgaaatgaagtttataactatcttatgcacccgatcggcgacacatctcctccgggtgtttgaagaatatgagaagatcgccaataaatcgatcgaggactccatcaaatcggaaacccacggatctctcgaggaagccatgctaacagtggtcaaatgtacccagaatctgcattcttattttgccgagcggctttattatgccatgaagggggcaggaactcgggacgggacccttattcggaacatcgtctcccggtctgaaattgaccttaaccttatcaagtgtcacttcaagaaaatgtacggcaagactctgagctctatgattatggaagatactagcggcgattacaaaaacgctctgctttcactggtcggctccgatccttag

SEQ ID NO: 53074 - DNA, 426 bp, Artificial Sequence
  Description of Artificial Sequence: Synthetic coding sequence
atggcctggtggaagtcgtggatcgaacaggaaggcgtcactgtcaaaagtagttcccattttaaccctgatccagacgccgaaaccttataccaggcgatgaagggaataggaaccaacgagcaggctattattgacgtcctaaccaaaagatcaaacacacagcgacagcagattgctaagtcttttaaagcccagttcggcaaagacttgacagaaacactgaaaagcgagctgtccggtaagttcgaacggttaatcgttgccctgatgtatccaccatataggtatgaggcgaaagagctgcacgatgccatgaaaggcctggggaccaaggagggcgtgattatcgagattttagcctcaagaaccaagaatcagttgcgagaaattatgaaggcatacgaggagggtcagcagggttag

SEQ ID NO: 53075 - DNA, 831 bp, Artificial Sequence
  Description of Artificial Sequence: Synthetic coding sequence
atggcctggtggaaggcatggatcgagcaggaaggggttacggtgaagagctcttcccactttaaccccgatccggatgccgaaacattatacaaagcaatgaaagggatcggagtgggaagccagctactgtctcaccaggctgccgctttcgcatttccttcgagtgcgctgacctccgttagcccttgggggcagcagggccatctctgctgtaatcccgcaggaaccaacgaacaagccatcatcgatgttctaacaaagcgcagcaatacacaacgtcagcaaatagccaaaagttttaaggctcagtttgggaaagatctgacagagactctaaaaagtgaattgagcggcaaatttgagagacttattgtcgccctcatgtatccaccatatcgatatgaagctaaggagcttcacgacgctatgaagggttcccgtgatgacgtgtcttccttcgtcgaccctgcgttagctctgcaggacgcacaggacctttatgccgctggtgaaaacattaggggcacggacgaaatgaaattcattacgatactatgcaccagatcggccacacacttgttgcgggtgaaatgcacccagaatttgcattcttactttgccgaaagactctactacgccatgaagggcgctggaacgcgggatggaacgctcatacggaacatcgtcagccgaagcgaaattgatctgaacctgatcaaatgccactttaagaaaatgtacggtaagacactgagcagcatgatcatggaagatacatccggcgactacaagaatgcccttctgagcctggtgggatcggatccctag

SEQ ID NO: 53076 - DNA, 984 bp, Artificial Sequence
  Description of Artificial Sequence: Synthetic coding sequence
atggcatggtggaaagcttggattgaacaagaaggagtaacagtgaaaagctcttcgcactttaatccggaccccgacgccgaaacgctgtataaagcaatgaaaggaataggaacaaatgagcaggctataatcgacgtactgaccaagcgatctaatacccagagacaacaaatcgccaagagctttaaagctcaattcggaaaggatctgaccgaaacactaaaatcagagctgtctggaaaattcgaacgtctgattgttgccttaatgtatccaccctacaggtacgaagccaaggaactccacgacgccatgaagggccttgggacgaaagaaggcgtgattattgaaatacttgcctctaggactaagaaccaactgagggaaatcatgaaagcatacgaggaggactacgggagtagcctagaggaggacattcaagcggataccagcggctacctcgagcggattttggtgtgcctgctgcagggaagccgagatgatgtctcctcatttgtcgatccagccctggctctccaggatgcccaggacctctatgccgctggggaaaacattagggggactgacgagatgaaattcattacaattttgtgtactagatctgcaacacacctcttacgcgtgttcgaagagtacgagaaaatcgctaataaatccattgaagactccatcaagtccgaaacccatgggtccctggaggaggctatgctgacagtagtcaaatgcacccaaaacctgcattcctactttgccgagcgcttgtactatgctatgaaaggcgcaggcaccagggatggtacacttattcgcaacatagtgtcccgctccgaaatcgacctgaacttgataaaatgtcacttcaagaaaatgtatggaaagacgctgagtagtatgatcatggaggacacttccggtgattacaagaatgccctcttgagcctcgttggatctgacccatag

SEQ ID NO: 53077 - DNA, 426 bp, Artificial Sequence
  Description of Artificial Sequence: Synthetic coding sequence
atggcgtggtggaaagcatggattgagcaagagggcgtaacagtaaagtccagctcacactttaatcctgacccagacgcggaaaccctgtacaaagcaatgaagggcattgggacaaacgaacaagccatcatagacgtgctaacgaagaggagcaatacacagagacagcagatcgctaaaagtttcaaagcccagtttggtaaggatcttaccgagacattgaaaagtgagttgagtgggaagttcgaacggctcattgttgcactgatgtaccctccctacagatacgaagcaaaagaattacacgacgcgatgaagggactggggacgaaggaaggcgtcatcatcgaaatcctggcatcccggaccaaaaaccagttgcgcgagatcatgaaagcttacgaagaaggtcagcaggggtag

SEQ ID NO: 53078 - DNA, 798 bp, Artificial Sequence
  Description of Artificial Sequence: Synthetic coding sequence
atggcctggtggaaggcttgggatttaactgaaactctaaagtctgagctcagcggtaaatttgagagactcatcgtcgcactgatgtaccctccatataggtacgaggcaaaagagttacatgacgcaatgaagggactgggcaccaaagagggtgtgattattgagattctggctagcaggaccaaaaatcaactgcgggagataatgaaggcatatgaggaggactacggctctagtttggaagaggatattcaggccgacactagtgggtacttagagcgaattctggtctgtctgctgcaggggtcacgcgatgacgtaagtagtttcgtcgaccccgctcttgccctgcaggacgcccaggatctttacgccgctggagagaatatccggggaacagatgaaatgaagttcatcactatactgtgcacccgaagcgcaacccacctgctgagagtcttcgaagaatatgaaaaaatcgccaataaatctatcgaggacagtatcaagtcagaaactcacggatcgttggaggaagccatgctgacagtcgttaagtgtacccagaacctccattcctatttcgctgagagactttattacgctatgaaaggagcaggaacgcgcgatggcactctgattagaaatatagttagcaggtccgagattgacctgaatttgataaagtgtcattttaagaaaatgtacggtaaaaccctgagtagtatgattatggaggacacttcaggagactacaagaacgccctactttctctcgtggggagtgacccctag

SEQ ID NO: 53079 - DNA, 306 bp, Artificial Sequence
  Description of Artificial Sequence: Synthetic coding sequence
tgacacgtccaccttggcttcattatcgctttcgagaacgtggtgttctttttcctgtgtccaaacgaccgcctggtccctgacgttccagctttggcgaccaaaatcaccgcacgcgctctgccaggtcaggcagggggaggccgacagcccggtgacgccgtaagtgtcagtaagctgaggatctgggctgtatcacaggggcgatctggcagctggatgagaggtctggagtttccaggcgatctccagacttgcaccgccacacttccgtgttcatgcttgctggcttctgtccagtgttag

SEQ ID NO: 53080 - DNA, 777 bp, Artificial Sequence
  Description of Artificial Sequence: Synthetic coding sequence
atgcccagaccgcgacgggtctcccaactgctagatctttgcctctggtgcttcatgaagaatattagcaggtatcttacagatattaaacccttgcccccaaacatcaaagaccgcctcatcaagatcatgagcatgcaagggcagatcaccgactcaaatatctcagagattctgcaccctgaggtgcagaccctcgaccttcgatcttgtgacataagtgacgcagctctattacatctctccaactgtaggaagctgaagaagttaaatcttaatgcctctaaggggaatagggtctctgtaacctctgaaggaatcaaagccgtcgcaagctcatgtagctatctccatgaggcgtctctcaaaagatgctgtaaccttacagacgagggggttgttgctctggctctcaactgccagctgctgaaaataatcgatctaggcggatgtctgtcgattactgatgttagtctgcacgccctgggcaaaaattgcccatttctacaatgtgtggactttagcgctacgcaggtgtccgactccggcgtgatcgccctggtgagtgggccttgcgccaaaaaactggaggaaattcacatgggccactgcgttaatctgacagacggcgctgtcgaagcagttttgacatattgtccccagatacgtattctgctctttcacgggtgtccactgataaccgaccattccagggaggtcctcgaacaactcgtgggtcccaataaactcaagcaggtgacctggactgtgtactag

SEQ ID NO: 53081 - DNA, 588 bp, Artificial Sequence
  Description of Artificial Sequence: Synthetic coding sequence
atgggcgctgcagtttttttcggctgcactttcgtggctttcggccctgctttcgcgcttttcctcattacagtagccggtgaccccctcagggtcatcatccttgtggctggaagatgctccgctctaccaaccacgagttgccttattagtgggctgagctttggcatcatcagcggagtattctctgtaatcaacatcttagcagacgcacttggacccggagttgtggggatccacggggatagcccctactactttctgaccagcgcttttcttacagcagcaatcattctgctgcacacattttggggagttgtattcttcgatgcatgtgaacggagaaggtattgggctctggggttggttgtaggatcccacctcctgacctcaggcttgacatttctgaacccttggtatgaagcatctctgttgcccatctatgcagtgaccgtcagtatgggcctgtgggcgttcattaccgctggcggatccctcaggtccattcagagaagtctcctatgtcggaggcaggaggattcacgggttatggtctattccgctctccggatcccaccggaggactag

SEQ ID NO: 53082 - DNA, 495 bp, Artificial Sequence
  Description of Artificial Sequence: Synthetic coding sequence
atggaggaggaggcagaaacggaagagcagcagcgtttctcataccaacagcgcctgaaggctgccgtgcactacactgtggggtgcctgtgtgaagaggtagctttggataaggagatgcaattctccaagcaaaccattgccgcaatctccgaattaacttttagacaatgcgagaacttcgctaaagatctggaaatgtttgccaggcatgctaaacgaacaaccataaatacagaggatgtaaagttgcttgctaggcgctcaaatagtctgcatatgcaggaggcagctggcatccgcaagagttctctgctcacgttccttgcttggtggtttgagtggaccagtcaggccagcgccggacctttaattggtgaagaagccagagaggtggccagacgtcaggagggggctcctccccagcaatccgcaaggcgggatcgcatgccatgtaggaacttcttttggaagacgtttagctcatgtaagtag

SEQ ID NO: 53083 - DNA, 234 bp, Artificial Sequence
  Description of Artificial Sequence: Synthetic coding sequence
atggaggaggaagcggagactgaagagcagcaaagattctcctaccagcagcgactcaaggccgctgtccactatacagtgggttgcttatgcgaggaagtggcactcgacaaggagatgcagttcagcaagcagaccatcgcggcaatatccgaactgaccttccgtcaatgtgaaaattttgcaaaggatctggagatgtttgcttcaatctgccgaaagagacaagaatag

SEQ ID NO: 53084 - DNA, 600 bp, Artificial Sequence
  Description of Artificial Sequence: Synthetic coding sequence
atggaggcctccccggcatcaggcccacggcacctgatggatccacatattttcaccagtaatttcaataacggaatcggtaggcataagacctacctgtgttatgaagtggagagactggacaacggaaccagtgttaagatggatcagcatcgaggctttctgcacaatcaggcgaaaaatttgctgtgcggcttctatggaaggcacgcagagctgaggttcctggatctcgttccttccttgcaattagaccccgcacagatctatcgggtcacctggtttattagctggtccccctgcttcagttggggatgcgctggagaggtcagggccttccttcaagagaacacccatgtgaggttaagaatctttgcggcaagaatctatgactatgaccccctctacaaggaagctttgcaaatgctgagagacgcaggggcacaggtgagtattatgacatacgacgaatttaagcattgttgggatacctttgtggatcaccagggttgcccattccaaccctgggacggacttgatgaacacagccaagctctcagcggacggttgagagccattctccagaaccaagggaactag

SEQ ID NO: 53085 - DNA, 1161 bp, Artificial Sequence
  Description of Artificial Sequence: Synthetic coding sequence
atgcatgcgaggggccctcacggacagctgagccccgcactgcccctggcatctagtgtgcttatgctcctcatgagtacactttggctggtcggcgctggacccggtctggtgttagccccagaactgttactggatccatggcaggtgcatcgcctactgacgcatgctctagggcatactgccctacctggattactcctctcgcttctactgctgcctaccgttggatggcagcaggaatgccaccttggcactctgagatttttgcacgccagcgcactgctggcactggcgtctggactgctagccgttctgctcgctggccttgggctgagctcagctgctggatcatgcggatatatgcctgttcacctggctatgcttgcaggagaggggcatcggcctcgaagaccacgtggggctctccccccatggctgagcccatggctgctcctcgcgctcactcctttgttatcctcagagcctccattcctgcagctactgtgtgggctgttagccggacttgcctacgcggcaggagctttcagatggctggaaccgagcgaaaggcggctgcaggtcctgcaagaaggcgtcttatgtagaaccctggcaggctgttggcctttgagactgctggcgacaccaggatcactcgctgagcttcctgtaactcacccggctggcgtaagacccccaatccccggacccccatatgtggcatctcccgatctctggtctcactgggaagattcagcgttgcctccgccttccctcaggcctgtgcaacctacttgggagggctccagcgaggctggcctggactgggcaggggcatcgtttagtcccggaacccctatgtgggctgccttggacgaacagatgctgcaagaaggcattcaggcatctctgctggacggcccagcccaagaaccccaaagcgcaccatggctgagcaaaagtagtgtcagcagcctgcgcttgcagcagctggaacgcatgggctttccaacagaacaggctgtggtcgccttggccgctacaggtcgagtggagggagccgtgtctcttcttgtcggcggacaggtcggtactgaaacccttgtgacccacggcaaggggggaccagcccacagtgagggtcctggcccaccctag

SEQ ID NO: 53086 - DNA, 1161 bp, Artificial Sequence
  Description of Artificial Sequence: Synthetic coding sequence
atgaatccacaaatacgcaaccctatggagcgcatgtaccgcgataccttttatgataattttgaaaatgagcccattttgtacggcaggtcatatacatggctatgctatgaagttaagataaagcgcggtcggtcaaacttactgtgggacaccggtgtattcagggggcctgttctgcccaaacgccaatctaaccacagacaggaagtatattttcgatttgaaaaccatgccgagatgtgtttcctgagttggttttgcgggaaccggctgcccgcaaaccggaggtttcagatcacatggtttgtgtcctggaacccctgcctgccgtgcgtggtaaaagttacgaaattcctagcagagcacccgaacgtgactctgaccatctcggctgcgagactatactactaccgtgaccgggattggcgatgggtacttcttaggcttcataaggccggagctcgcgtcaaaattatggactacgaggacttcgcatactgctgggagaactttgtgtgcaatgagggacagcccttcatgccttggtataaatttgacgataactatgcaagcttacacaggacactgaaggaaatcctccggaaccccatggaggcgatgtacccccacattttctattttcacttcaagaacctgctaaaagcttgcgggaggaatgaatcttggctgtgcttcaccatggaagtgactaagcatcactctgctgtcttcagaaaacgtggagtcttccggaaccaagtggatccagagacacactgtcacgcagaacggtgcttcctgtcctggttttgtgatgatatcctttcccccaatactaattatgaggtgacatggtatacttcttggtccccatgtcctgaatgtgcaggggaagtggccgagtttttagctaggcactcaaacgtgaaccttactatctttactgccaggctctgctatttctgggacacagattaccaggaaggcctgtgtagcctgtcccaagaaggagcctctgtcaaaatcatgggctacaaagattttgtgtcatgctggaaaaatttcgtttactcggacgacgaacctttcaaaccctggaaagggctacagacaaacttccggttgctgaaaagacggttacgggagatactacagtag

SEQ ID NO: 53087 - DNA, 609 bp, Artificial Sequence
  Description of Artificial Sequence: Synthetic coding sequence
atgaacccccagatacggaatcccatggagaggatgtatagggatacgttttacgataactttgagaacgagcctatcttatatggccgtagctatacgtggctctgttacgaggtgaaaatcaagagaggtcgatctaatctgctgtgggacacaggggtgttcagagggcctgttttacctaagcgtcaatccaaccaccgccaggaggtggatccagagacacactgccacgccgagcgctgttttctttcctggttttgcgacgatatcctcagccccaatacgaattacgaagtgacctggtacaccagttggtccccatgcccggagtgtgccggagaggtcgcggagttcttggccagacattccaatgtcaacctgaccatatttacagccagactgtgttatttttgggatacagactaccaggagggcctatgctccctcagccaagagggagcttccgttaagattatggggtataaggacttcgtttcatgctggaagaacttcgtctactctgacgacgagcccttcaaaccttggaaaggcttacagactaatttccgactcctgaaaaggaggctgcgcgagatactccaatag

SEQ ID NO: 53088 - DNA, 3210 bp, Artificial Sequence
  Description of Artificial Sequence: Synthetic coding sequence
atggattttttgcggctctaccttcctggtctgcaccaggccctgaggggtgcccttgactcgttgggcacattcgtatcatacctattaggggatgctgttccaaccgtggaaagagaggcccaggctgctgaggagctgggtgtcgtggcagtgggcaaaacggggaagattgtggaggaggaagcccaagaagaccttgaaggtcttcgaggatctcagaatgaaggagctggcaggctccggggacctggggatgatagacggcatgaggtgggcagcagtgcagtagaacagacatggggatggggagatggatctagccacggctctcaagcagagcgtcaagacagtggagccggtgagaccgccaaggccgctcgctgtcaagagccaagcgcacaccttgaagccagaaaaaaaagtaaggccggatccggcgcttgtcaggatagatccggacaggcacaggagcgacaggaatcacacgagcaggaggtgaatcgcgaagagcgattgcgaagctgggagcaagaggaggaggaggaggaggttcgcgcacgtgagcctgggatggctaggggagctgagtcggagtggacgtggcatggcgagaccgaaggtaaggccggtgccgtcgggccaaaagcggctggtgataaccgggagatggagcaaggagtgcgggaagcagacgcaggcgagacagaagaacctggagccgagggggcaggtaagggtgaggaagttgtggtggtcgagaaggcatgtgagtcaacacgagcatggggcacttgggggcctggcgctgagcctgaagactggggcatcctggggcgtgaggaggctagaactaccccgggacgggaagaagccagagccatactggacggggaagaagctaggacgatttcgggaggcgaagaagctgaaacagcctctggcggtgaagaggccgagaccgcttcaggaggtgaggaagcaggaaccgcttccggcggagaggaggccggtatcgcttctggaggggaggcaggaaccgcttcagggggagaggaggccggaactgcctcaggtggcgatgaggcttggacaaccagcggcaaggaggaagccgatctgctgggcgtgagacagacggaatatggggctgtgcctggcgaaagactcctggaggctaccggtaaggtctgggtgctcgaggaggagggggacgaagagcgcgaagctgaggtgtctccctttcccaagcagccccaagtcctcggcacggaaaggacagaggaggctgctgagtcacagaccgcgggacgagaggctgtcggcggacaggaggctggcgagtcttttgaggggcaggtggatcttagggggaaggaggctgagatgcggcaggacctggggatccgcgcagatcgggctcgcatggaggagctggtccaagcagaggaagcgcaggaggaacgcggatcttctagggatcctgtggcagagttgcccagtgatggcgaggccgagggcaccgccgacctggaagctacacctgaggcgagacccgaagaagagctcacgggagaggaatccgaggctgcgcagacatcttgtggactgctcggagtggaatggggaggccttacacacagcgtgacgaagggacagggacccgagctaatgggcggtgcgcagacccccaccaagcagccagaagaacgcgaggctggagaggtggaacttatgggcgtgctggctctgtctaaggaagaacaggagcggagtctggaagctggccctcgacatgccggatcggtgaagcctgaagcgtccgaagctttccctggtgcttgggaaaaccgaaccagaaaagacatggagagggggaacacacaggaggatgcggctgatggcgagcagcgggaggaagaagagacggcaggagggcagactcttgcggctgaagccgaaggcgaccgcgagtctgagctgtccgaagtgcctgaggccggaggagagggcctgacgacacaagatgcaggctgtggtacggaagaaggcgaggctagtgtatccgaaaaccaagaactcgacggctccaccggagccgatgcaggtccgtgcccgagcctgggcgaagcttatgccagggaaacggaggacgaagaggccgaagcagaccggactagccgcaggggctggagactgcaagcagtggcggtgggcctgcccgacagggaagacgcccagacaggcagcgtagccgctgggatcatgggcggtgacgttgtgcctcacataagcgctgctggtgccggtgaggccctggaaggagtgctaggacaggggtgggattcaaaggagaaggaggaagccgctgctggtgaacacgcaggcggacaagagtttggcctcgaaggatcagctgaagaggaggtcaccggacgcggtagccaggttgaggccttcgagtcgagagaagggggtccctggggcggaagggtcgaagctgaagaaagtgctggtgcagaagactcatgcggcctcgatcccgcaggatcccagacggcacgggctgagggtatgggcgctatggtcgaagctgggggactccttgagaaatggaccctgctcgaggaggaagccgtcgggtggcaggaacgagagcaaagagaggactctgaggggaggtgcggtgattaccatccagaaggagaagctcccagactcctggatgccgagggtttgatggtcactggcggacgcagagccgaggcgaaggagacagagcccgaaagcctggaacatgttcggggtcaggaagaacaacctacacaccaggccccagctgaggcggcacccgagtcagtgggcgaggctgaaactgctgaggcaatggggtctgccagagggggagcagctaattcctggagtgaggcgccactgccagggagtttactcgatgtgagcgtgcctcgcagcagggtgcatttgtcacgaagctcatcccaacgcaggagccggcctagctttaggcgaaccccagcctgggaacagcaggaggagcctccggctcctaaccctccagaagaagaactgagcgccccagaacagcggccactgcagctagaggagccactggagcctagatgggaggatcgcctcagaccaggggtgagggatcagcccggacagcattcaaagatcccgattttctag

SEQ ID NO: 53089 - DNA, 3267 bp, Artificial Sequence
  Description of Artificial Sequence: Synthetic coding sequence
atggactttctgagattgtatttaccaggactccatcaggccctgcgtggagccttggactccctcggcactttcgtctcttatctgttgggcgacgcggtgcccactgtagagcgggaggcacaggcagccgaggagttgggggtcgtggctgtcggcaagactggtaagatcgtcgaagaggaggctcaagaagatcttgagggacttcgtggcagccagaacgaaggcgcaggtcgtttgcgtgggcctggcgacgatcgacgccacgaagtaggatccagcgccgttgagcaaacatggggatggggtgatggcagcagccacggcagtcaggcagagcggcaggatagcggcgctggcgagactgctaaggcggctcggtgccaagaaccaagcgctcatctcgaggcaagaaaaaagtccaaggccggtagtggcgcatgccaggataggagcggccaagcacaggagagacaggagtctcatgaacaggaagtgaacagggaggaacgactgcgcagctgggagcaggaagaggaagaggaggaagttagggctcgcgaacctggcatggccagaggtgccgaaagcgagtggacatggcatggggagactgaggggaaggcaggcgcagtaggtccaaaggccgcaggagataatcgggagatggaacagggcgtgcgagaggctgacgcgggagagaccgaagagccgggagcagaaggggctggcaagggggaagaggttgtagttgtggagaaggcttgcgagtctaccagggcatggggcacctgggggccaggggctgagcccgaagactggggtatcctgggacgggaggaggcacgtaccactcccggtagagaagaagccagggcaattctggacggagaagaagcccgtacaatttccggaggggaggaggccgagacagcctctgggggtgaggaggcagagaccgcatcagggggagaagaagccggtacagctagcggcggagaagaagcaggtattgcttctggcggagaagccggtacagcctcgggcggtgaagaggctggtaccgcatccggaggcgacgaagcctggactacaagcgggaaggaggaggccgacctgctgggggtacggcagactgagtacggagcggtccctggtgaacgcctccttgaagcaaccggaaaggtgtgggtgctggaggaggaaggtgatgaggaaagagaggccgaagtctcccctttcccaaagcaaccacaggtcctgggcaccgaaagaaccgaggaagccgctgagtcacagacagctggcagggaggcggtgggaggccaggaagctggagagagcttcgagggccaagtagaccttaggggaaaagaagcggaaatgcggcaagaccttggtattcgtgctgatcgagccagaatggaagagctcgtgcaggcagaagaagcccaggaagagcggggttcttctagggaccctgtggcagaactgcccagcgacggagaggctgagggcacagcagacctggaggccacacctgaagcccgacccgaggaggagctgaccggggaagaatctgaagcagctcagacttcctgtggcctgctcggagtggaatgggggggtctgacacattctgtgaccaaagggcagggcccagagctgatggggggtgctcagacaccaacaaaacagcctgaagaaagggaggccggagaagtcgagctgatgggcgtgctggcgctgagcaaggaagagcaggaacggtccctggaggctgggccaagacacgctggcagcgtgaagccggaagcttctgaggcgttccctggtgcctgggagaatagaactcggaaggacatggagagggggaacacgcaggaggatgctgccgatggcgagcagcgagaggaagaagaaacagcaggcggacaaacattagccgctgaagccgagggagatcgcgagtcagagctgagtgaagtacccgaggccggaggggagggcctgaccacacaagatgcaggttgcggtacagaggagggcgaggcctccgtttctgagaatcaggaactggatggcagtaccggggcagacgcagggccttgtccaagcctgggcgaggcctatgcaagagaaactgaggatgaggaagcagaagctgacagaaccagcaggagaggctggaggctgcaggccgtggcggtggggctacctgaccgcgaggatgcccaaaccgggtcagtggcagcagggatcatgggcggagacgtggtgcctcacatctccgcagcaggggcaggggaggctctcgagggagttttaggccagggttgggactccaaggagaaagaggaagctgctgcaggagaacacgccggaggacaagagttcggcctcgaaggcagcgccgaggaggaggtcactggaagagggagccaggtggaggctttcgaatctagagagggaggcccatggggcggtagggttgaagctgaagaatcagctggtgccgaggactcctgtggcctagatcctgcgggaagtcaaactgccagagctgagggtatgggggcaatggtggaggctggcggattgcttgagaaatggactttgctggaggaggaggctgtgggctggcaggagagggagcagcgggaggattccgaaggaaggtgcggagattaccatccagagggcgaagctccccgattgctggacgctgaggggcttatggtgaccggaggaagacgagccgaggccaaagaaacggaacctgagagtctagagcacgtccgcggtcaagaggagcaacccacacaccaagcccctgctgaggcagctcccgaatccgtaggcgaggcagaaacagccgaagcgatgggctcggcaagagggggtgcagccaattcttggtcggaggcaccacttcccggtagtctgcttgatgtatccgtgccaagaagtagggtgcaccttagccggtccagcagccagaggagaagtcgcccatcttttaggcgaacaccggcatgggaacagcaagaagagcctcctgcaccgaaccctcccgaggaagagttgtctgctcccgagcaaaggccactccaactcgaggagcctctggagccgagccccctgagacacgatgggactcccgtgcctgccaggaggcgccctctggggcatggcttcgggcttgcacacccaggaatgatgcaggagcttcaggccaggttgggaaggccaaagcctcagtag

SEQ ID NO: 53090 - DNA, 3294 bp, Artificial Sequence
  Description of Artificial Sequence: Synthetic coding sequence
atggattttcttcgcctttatctgccgggtttacaccaggccctgaggggggctctggacagtctaggcactttcgtgtcttatctcctgggggacgcggtgcctactgtggagagagaagctcaggctgcagaggaactgggagtggtcgcagtggggaagacaggaaagattgtcgaagaagaagcacaggaggatttggaaggcttgaggggaagccagaacgagggcgcaggtagactgaggggcccaggcgatgatcgtagacacgaagtagggtcttctgccgtagaacagacgtgggggtggggcgacggcagtagccacggtagtcaggccgaacgacaggattccggggcaggcgaaaccgcaaaagccgcacggtgtcaggagcctagtgcccatctagaagcacggaaaaagagtaaggcaggtagcggagcctgtcaggaccggtcggggcaggctcaggagcggcaagagtcacacgagcaggaagtcaatcgggaggaacggctcagaagctgggaacaagaggaggaagaagaggaggtgagagccagagagcccggaatggcacggggagccgagtctgaatggacctggcacggagaaaccgagggaaaagccggagccgtcgggcctaaagcagccggagacaacagggaaatggagcagggcgtgagagaggcagatgcaggagaaactgaagagcctggggctgaaggtgcaggaaagggagaggaggtcgtcgtagtggagaaggcctgcgagtctacccgcgcatggggcacttggggacctggcgcagaacccgaggattggggcatcctgggtagagaggaggctcgcacaacccctggacgtgaggaggctcgggcaatcctggatggtgaagaagcgaggacaatttccggtggcgaagaagcagagaccgcatccgggggtgaagaggccgagactgcgtccggcggtgaggaagccggaaccgcaagcggcggtgaggaagctggtattgctagcggcggagaggccggaaccgctagcggtggcgaagaggccggtacagcctctggcggtgaggaggcaggtaccgcctctggtggtgacgaagcgtggacaacaagcgggaaagaagaggccgacctgctgggagtgaggcagacagagtatggtgcagtcccaggtgagcgactactcgaagctactggaaaagtatgggtgctggaggaagaaggtgacgaggagcgggaggccgaggtctcaccatttcctaaacaacctcaggtactggggacagagagaactgaagaggcggcagaatctcagacagccggaagagaggccgtgggcggacaggaggctggcgaatcctttgaggggcaggtggatctgcgcggtaaggaggcagagatgcgccaggatttaggcataagagccgacagagccagaatggaagaactcgtgcaggcagaagaggcccaagaagaaagaggctcaagtcgcgacccagtcgctgagctgccgtcagacggagaggctgagggaacagcggacctggaagccacgcccgaggctcgacctgaggaggagctaactggtgaggaatccgaagctgcgcagacctcctgcgggctgctcggagtcgaatgggggggacttactcactctgtaactaaaggtcagggacccgagctgatggggggtgctcaaacccccacaaagcagcctgaggagcgggaggccggagaggtagaactaatgggtgtgcttgctttgagtaaggaggaacaggaaaggtcactcgaggctggcccacgtcatgccggaagcgtcaagccagaagcgagcgaggcttttcctggcgcatgggagaatcggacacggaaggacatggaacgcggaaacacccaggaggatgctgccgacggtgaacaacgcgaggaggaagaaaccgcaggcggacagaccctcgcggcagaggcagaaggagatagagagtctgaactttcagaggtgccggaggcagggggtgagggactgactacccaagacgctggctgtggcaccgaagaaggtgaagctagtgtgtccgaaaaccaggaactggatgggagcaccggagcggatgccggtccatgtccgtcactgggggaggcctatgcacgggagaccgaggacgaagaagccgaggcagaccgtacctctcgtagagggtggcgcttacaggccgtcgcagtgggtctccccgacagggaagatgctcagactggcagcgtcgcagccggaataatgggcggagatgtggtgccccacatcagcgcggcaggggcaggcgaggcactggagggcgtactggggcagggctgggattccaaggagaaagaggaagcagctgctggagagcatgccggtggacaggagttcggactggagggatccgctgaagaggaggtaacagggaggggatcccaagttgaggcgtttgagagtcgcgagggcggaccatggggcggacgggtcgaggcagaggagagcgccggtgctgaggactcgtgcgggttagatcctgccggaagtcaaactgcacgggcagaagggatgggcgctatggtagaggccggtggcctactggagaaatggaccctgttagaagaagaagccgtgggttggcaagagcgtgagcaacgggaagactccgagggcagatgcggagactatcaccctgaaggcgaggctcccagacttcttgacgccgaaggcctcatggtgactgggggacgccgagccgaagctaaagaaactgagcctgagagcctggaacacgtgcgcggtcaggaggagcaacccacacaccaagcccctgcagaagctgcccctgaatctgttggcgaagccgagaccgccgaagcgatggggagcgctcgagggggtgccgcaaattcctggagcgaagcaccgctgcccggtagtcttttagatgtgagcgtaccgcgaagtcgagttcacctgtctaggagtagctctcagagacgatctagaccatctttccgcaggacgcctgcctgggaacaacaagaggagccaccagccccaaatcctcccgaggaggagctgagtgctcctgagcagcggcctctccaactggaggagccgctggagccctccccccttaggcacgacggcacacctgtgccggcacgccgtcggccactgggacatggtttcggcttggcacacccgggtatgatgcaggaattacaggccaggttagggcgaccaaagccccaatag

SEQ ID NO: 53091 - DNA, 384 bp, Artificial Sequence
  Description of Artificial Sequence: Synthetic coding sequence
atgtcgcttctgaggaatcgactgcaggcactgcctgctctatgcctgtgcgtccttgtgctcgcttgtatcggcgcttgccaaccggaagcccaggaggggaccctgtccccccctcctaagcttaagatgtccaggtggagcctggtgcgcggtcgcatgaaggaactgctggagaccgtggtgaaccgcacgcgggatggatggcaatggttctggtctccctcgacctttcgcggattcatgcagacctattatgatgatcatcttagagacctgggtccccttacaaaggcatggtttcttgagtccaaagacagtctccttaaaaagacccactcactgtgtcccaggttggtctgcggcgataaggaccagggatag

SEQ ID NO: 53092 - DNA, 924 bp, Artificial Sequence
  Description of Artificial Sequence: Synthetic coding sequence
atggccggactaaacgtgagcctgtccttcttttttgctacctttacactgtgcgaggcggcacggagagcttccaaggcactcctgcctgtgggcgcatatgaagttttcgctcgtgaagctgtgggagcggtccagttgggggcttgttttttggagatgagaacactggtagagctgggcccatgggctggtgacttcggtccggatctgttactgaccctgctgttcctactgtttttagcccacggagtgacactggacggcgctagtgctaaccctacagtgtcactgcaggagtttctgatggccgaggagagcctgcctggcactttactaaagctggccgcacagggcttaggaatgcaggctgcatgtaccctgactcggctgtgttgggcctgggagctatcagatcttcacctgttgcagagcctcatggcccagtcttgcagttctgccctccgcacgtctgtgcctcacggagcactggttgaggccgcttgcgctttctgttttcatcttactctgctgcacctgcgtcatagcccaccggcatactccggtcccgcagtcgccctcctagtaactgttaccgcttataccgcaggcccatttacttcagcctttttcaaccctgccctcgctgcctccgttacattcgcctgttctggtcatacactcctcgaatacgtgcaggtgtactggctcggccctttaactggcatggttctggctgtccttctgcaccagggcagactcccccacctctttcagcgaaacctcttctatggtcagaaaaataaataccgggctcctcgagggaagcccgcacctgcctcaggcgacacacagactcccgctaagggatcttcagttcgcgagcctggaagaagtggcgtggagggccctcatagctcttag

SEQ ID NO: 53093 - DNA, 1497 bp, Artificial Sequence
  Description of Artificial Sequence: Synthetic coding sequence
atgctacaatgccggccagcgcaggaattttcttttgggccacgcgcactgaaagatgcccttgtaagcaccgatgccgcactacaacagctgtacgtgagcgctttctcgcccgcagagcgcttgtttctggcagaggcatataatccccagcgcacactgttctgtactttgctcattcggaccggctttgattggctgctgagccgaccggaagcccctgaggactttcagaccttccatgcaagtctgcagcacagaaagcctcggctagccaggaagcatatctatctccagcctatcgacctgagtgaggaacccgtgggctcttccctgttgcatcaactgtgttcctgtactgaggccttctttttggggctgcgagtgaaatgtctgcccagcgtggcggctgcttcaattcggtgcagttcacgcccaagtagagactctgatcggctgcagctacacactgacggcatcctgagctttctgaaaaacaataagccgggagatgccctctgcgttctggggttgacactgagcgatttatatcctcacgaggcatggtccttcacatttagcaagtttttgcctggtcacgaagtcggagtatgcagctttgcaagatttagtggtgagtttcctaagagtggcccaagcgcccctgaccttgctctggtggaggccgctgctgacggtcctgaggccccacttcaggatcggggatgggccctttgcttctcagccctcggtatggtgcagtgctgcaaggtgacctgtcacgaactctgccatcttttggggttgggtaactgcaggtggctcagatgtctgatgcagggcgcactctctttggacgaagccttgaggagacccctggatctgtgccccatctgcctcaggaagctgcagcacgtgctggggtttaggcttatagaacgttatcagaggctctatacctggacccaggcggtggtgggaacatggccaagccaggaggcaggagaaccgtctgtgtgggaggacacaccacctgcaagcgctgatagcgggatgtgctgtgaatctgactctgagccagggacgtctgtcagcgagccccttaccccagatgccggatctcacaccttcgcctccgggccagaggaaggactctcatatctggctgcatctgaggccccactgccgcctgggggtcccgctgaagccatcaaggagcacgaaagatggctcgctatgtgcattcaagctctgcagagggaagtagcagaggaagatttagtacaagtcgaccgggcagtggatgcactcgaccggtgggaaatgtttactggccagctgcctgccacgcgacaagatccgcctagttcgcgggacagtgtgggactgcggaaagtactaggagacaaattcagctccctgaggaggaagctctcagctcgcaaattagcccgagcggagtctgctccacgaccttgggacggtgaggaatcctag

SEQ ID NO: 53094 - DNA, 909 bp, Artificial Sequence
  Description of Artificial Sequence: Synthetic coding sequence
atgcagatcattcggcacagcgagcagactcttaagacagctttgatttcgaaaaaccccgtgttggtgagccagtacgaaaagttaaatgctggagaacagcggctcatgaatgaagcctttcagccagccagtgatctcttcggcccaatcacactgcatagtccatccgactggattacttcgcaccccgaggcacctcaggatttcgagcaatttttttccgatccctacagaaagactccatccccaaacaaacgttccatttatattcagagtataggcgatatcctcaagttcctaaaaaaaaagaagccggaggatgcattctgcgttgtgggcatcactatgatagatctgtacccgagggactcctggaatttcgtctttggtcaggcttcccttacggacggcgtgggaatcttcagctttgctcggtacggatcggatttctactcaatgcattacaagggaaaggtgaagaagctgaagaaaacatcttccagtgactatagcatctttgacaattattatatccccgaaatcacatctgtattactcctgcggtcttgcaagacgttgactcatgaaataggacacatctttggactgagacattgtcagtggttggcctgtctgatgcagggctccaaccacttggaagaggctgacaggaggcccctgaatctttgcccaatttgtctccacaagctgcagtgtgcagtgggcttttccatcgttgagaggtacaaggccctcgtccgctggatcgacgacgagtcctctgatacgcctggagctaccccggagcattcgcatgaggataacggcaatctgcccaaacctgtggaagcattcaaggagtggaaggaatggatcatcaagtgtcttgctgtgctccagaaatag

SEQ ID NO: 53095 - DNA, 1083 bp, Artificial Sequence
  Description of Artificial Sequence: Synthetic coding sequence
atgcagatcattagacattccgagcagacactgaaaacagcgcttatatccaagaatcccgtgcttgtgtcacagtacgagaaactaaacgctggagaacagagactgatgaacgaggccttccagcccgctagtgacttgtttggccctatcacactccactcgccctccgattggattacctcccatcccgaagccccacaggattttgagcagtttttcagcgacccctaccggaaaacaccaagccctaacaagcgctctatctatattcagtcgattggctctctggggaatacacggataatctccgaggaatatataaaatggttgaccggctattgtaaggcatacttctatggtctccgcgtcaagcttttggagccagtgcctgtgagcgtgacacggtgttctttcagagtgaatgaaaacacacataatctgcagattcatgcaggagatatcctgaaattcctgaagaaaaaaaagcctgaagacgcattctgcgtggttgggatcacgatgattgatctttatccccgagattcttggaactttgtgtttgggcaagcgagtctgactgacggcgtcggcatttttagcttcgccagatatggctcggatttttattccatgcattataaaggaaaagttaagaagctaaaaaagacaagcagctcagattactcgatttttgataactactacattccagaaattactagcgtgctcctcctcaggtcttgtaagacgctgactcatgagatcggccacatcttcgggctaagacattgccagtggctcgcttgcctgatgcagggatctaaccacttagaagaggcagatagacggccactaaacctttgccctatttgccttcataagttacagtgcgccgtaggtttttctatagtcgagagatataaggcattagtgcgttggattgacgacgaaagttcggacacgcccggtgccactcccgaacactctcacgaggataacgggaatcttccaaaaccagtagaggccttcaaggaatggaaggaatggataatcaagtgccttgcggttctccaaaaatag

SEQ ID NO: 53096 - DNA, 1083 bp, Artificial Sequence
  Description of Artificial Sequence: Synthetic coding sequence
atgcagatcatcagacattcagagcaaactttgaaaacggccctgatctctaagaatcccgttctcgtgagccagtacgagaaactgaacgccggtgagcagagactgatgaatgaggcctttcaaccggctagtgacttgttcggacctatcacattgcactccccttccgattggatcacaagccatccagaagcccctcaggatttcgagcagttctttagtgatccttacagaaagaccccaagtcctaacaaacgttctatctatattcagagcatcggatcgctaggaaacacaagaattatttctgaggagtatatcaaatggctgactggctactgtaaggcctacttctacggccttagggtgaagcttctggagccggtgccagtgagtgttacacggtgcagcttccgggtcaatgagaatacccacaatcttcagatacatgcaggagacattctgaagttcctcaagaagaagaaacccgaggacgcattctgcgtagtggggatcactatgattgatctgtaccccagagactcctggaactttgtcttcgggcaggctagcctgactgacggagttgggattttctcattcgcccgttacggctcagacttttatagtatgcattataagggaaaggtaaaaaagcttaagaagacctcttcatccgattacagtatatttgataactactacataccagagatcacttcagttttactactaaggtcctgtaagaccctgactcacgagatcggacacatctttgggttgcggcactgtcagtggctcgcgtgcctgatgcagggatctaatcacctcgaagaagccgacagacgacctctgaacctttgcccgatttgcttgcataagctccagtgtgctgtcggcttctcaattgttgagaggtacaaggccctcgtgcgatggatcgatgacgaaagcagcgacacacccggtgctactccagaacattctcatgaggacaacgggaatcttccgaagcctgtggaggcctttaaggaatggaaagaatggattattaaatgcctcgcagttctccagaaatag

SEQ ID NO: 53097 - DNA, 1083 bp, Artificial Sequence
  Description of Artificial Sequence: Synthetic coding sequence
atgcagatcatccggcattcggagcagacactgaagacagcactgataagcaaaaaccctgtcttggtttcacagtatgagaagttgaatgctggcgagcagagactgatgaatgaggcattccagcctgctagcgacctgttcggcccaattaccctgcactctccaagcgactggattacttcccatcccgaagcccctcaggattttgagcaattcttctccgatccctaccggaagaccccatccccaaataagaggtctatctacatccagtcaattggatcactggggaatacccgaattatatccgaggagtacatcaaatggcttacaggctattgtaaggcttacttctacggtttaagagttaaattactggaacctgtgccagtgtctgtcacacgctgtagctttcgggtcaatgaaaatacccacaacttgcagatccatgctggcgatatccttaagttcctgaaaaaaaagaagccggaggatgccttttgcgtggtaggaatcaccatgatagatttatatcccagagattcttggaatttcgtgtttggtcaggcaagtctgacagacggagtgggaatcttctcatttgctagatatggatcagatttttattctatgcattataagggcaaggtcaagaagctcaaaaaaaccagcagttccgactacagcatttttgacaactattacattccggagattaccagcgtgttgctactacggtcatgcaagactctcacgcacgaaatcggacacatatttggcctgcggcactgccagtggttggcctgcctgatgcagggaagcaaccatctggaagaagccgatagacgtcctttgaatctctgtccaatttgtctgcataagctacagtgcgcagtaggatttagcatcgtggagagatacaaggctcttgtgcgctggatcgacgatgaatcttccgacactcccggagcaacgcccgagcatagccatgaggacaatggaaatctcccaaaacccgttgaggcgtttaaggaatggaaggagtggattatcaagtgtcttgccgtattgcaaaaatag

SEQ ID NO: 53098 - DNA, 1083 bp, Artificial Sequence
  Description of Artificial Sequence: Synthetic coding sequence
atgcagatcatcagacactctgagcagaccctgaaaactgctcttatcagcaagaatccggtgctggtttcacaatatgagaaactgaacgcaggagagcagcgtctcatgaatgaggcgtttcaacctgcaagtgacctttttgggccaataactctccactccccgtcagactggatcacgagtcaccccgaagcgcctcaggactttgaacagtttttctcggatccgtaccgaaaaacccctagccctaacaaacgtagcatctacattcagagcatcgggtccctgggaaatactcggattatctcagaagagtacataaagtggcttaccgggtactgcaaggcatatttctacggcctgcgcgtgaaattgttagagcctgtccctgtctcagtgactcggtgtagtttccgagtgaatgaaaatacacacaacttacaaatccatgctggggatattctgaagttcttaaaaaaaaagaagcccgaagatgctttttgtgttgttggaattaccatgatcgatctatacccacgcgatagctggaactttgtatttggccaggcctcactgactgacggggtaggtatcttttcttttgctagatatggctcagatttctactctatgcactataagggcaaggtgaaaaaacttaagaagactagcagttctgactatagcatattcgataattactacattcccgagataactagcgtgctgctgctgagatcttgcaagacactcactcatgagataggccacatcttcggactcagacattgccaatggctcgcctgcctgatgcaggggtccaaccacctggaagaagcggaccgcaggcctctaaatctttgtcctatttgcctccataagcttcagtgtgccgtggggtttagcatcgtcgaacggtataaagcgctggttcgatggatcgatgacgaatctagtgatacacccggagcaacccctgagcacagtcatgaggataacggcaatttgccaaaacctgtggaagcattcaaagaatggaaagaatggatcattaaatgccttgcagtactacaaaagtag

SEQ ID NO: 53099 - DNA, 1083 bp, Artificial Sequence
  Description of Artificial Sequence: Synthetic coding sequence
atgcagattatccggcatagcgagcagactctaaagaccgctctgattagtaaaaatccagtccttgtgtcacaatatgagaagctcaacgccggagagcaacggctgatgaatgaagctttccagcctgcgtcagacttgttcggaccaatcacactgcatagtccctcagattggattacctcacacccagaagcccctcaggattttgagcaattcttctccgacccctacagaaagacacccagtcctaacaagcgtagcatctacatacaaagtatcggaagccttggcaatactcgtattatctctgaggaatacataaagtggctgacgggatactgtaaagcttatttttatggattaagggtgaaactgctggaacccgtgcctgtctctgtaaccaggtgttcattccgcgtcaacgagaatacacataacttgcagattcacgctggggatatcttaaagtttctgaagaagaagaaacctgaagatgccttctgtgtggtcggaattacaatgattgacctgtaccccagagatagctggaatttcgtcttcggacaggcttcgttgaccgacggggttggcattttttcattcgccaggtatggaagtgacttttactccatgcactataagggaaaggtaaaaaagcttaaaaagacaagttctagcgattattctatttttgataattactatatacccgagattacaagcgtcttgctgctgagaagctgcaaaacgctgactcatgagatcgggcacatcttcggtctgcgccactgtcaatggcttgcttgtttaatgcagggcagcaatcacctggaggaggccgatcggaggcccctgaatctgtgccctatctgtttgcataagctccagtgtgcagtgggcttctctatcgtggaacgatataaggctctcgtaagatggatcgacgacgagtccagtgatactcctggcgcaacaccagagcactcccatgaggataacggtaatctacctaagcctgttgaagcctttaaagaatggaaagagtggatcattaagtgtttagcggttctgcagaagtag

SEQ ID NO: 53100 - DNA, 2505 bp, Artificial Sequence
  Description of Artificial Sequence: Synthetic coding sequence
atgacagtcgagttcgaggaatgtgtgaaggattcccccaggtttagagccaccattgacgaggtggaaactgacgtggtagagatcgaggccaagctcgataagttggttaagctctgtagcggcatggtggaggcaggtaaagcgtatgtctccaccagtcgtctgttcgtctccggggtccgggacttgagtcagcagtgtcaaggagacacagtaatctctgaatgtctgcagagattcgctgacagcttgcaggaggtcgtcaactaccatatgattctttttgatcaggcccagcgtagtgtgcggcagcaactccaatcatttgttaaggaggatgtgagaaaattcaaagaaacgaagaaacaattcgataaggtgagagaagatctagaactttccctcgtgagaaatgcccaggctccacgccaccgcccacatgaagttgaggaagcgacaggagccttgaccttgactaggaagtgcttcaggcacctggctctggactacgttctacagattaatgtgctgcaggctaaaaagaagtttgagatcctcgacagcatgttaagctttatgcacgcacagagcagctttttccaacagggctactctttgcttcatcagctcgacccatacatgaagaagctggctgcagagctggaccaattggtgatcgattcagctgtcgaaaagcgcgagatggagcgaaagcacgccgcaatacagcagagaactctcttacaggatttcagctatgatgagtcaaaagtcgagtttgacgttgacgccccaagcggcgtggttatggaaggatacctgtttaaaagggcaagcaatgcctttaagacatggaacaggaggtggttttccatccagaattcccagctggtatatcagaagaagctcaaggacgctctgacggtcgtggttgacgacctccgactgtgcagtgtaaagccatgcgaggatatcgagcggaggttttgctttgaggtgctttctccaaccaagtcctgcatgttgcaggcggacagtgagaagctgcgccaggcctgggtacaggcagtgcaagccagtattgcctctgcataccgggaaagcccggatagctgttatagcgaacggttggatcgcacggcttccccatccaccagttccatcgatagtgccaccgatacacgggagcgaggtgtcaagggggagagtgtcctgcagagagtgcaaagtgtcgctggtaatagtcagtgtggcgattgtggacaacctgaccccagatgggcgtcaattaatctgggagtattgctttgtattgagtgcagtggcatccatcggtcactgggcgtccattgcagcaaagttcgtagcctgaccctagatagctgggagccagagttactgaagctcatgtgcgagctgggcaattctgccgtgaatcagatctatgaggcacagtgcgagggagcaggatccaggaagcctaccgcttctagcagcagacaggataaggaggcctggataaaggacaagtacgtagaaaagaagtttttacggaaagcgcctatggctccagctttagaagcgcctcgacgctggcgggtgcagaagtgtctgcgcccacactcaagccctcgagcaccaacggcacgccgtaaggtgcggctcgaacctgtgctcccgtgtgtggccgcactcagttctgtcggcacactggacaggaaatttaggcgcgactcacttttttgtccggatgaactggacagcttgttcagctacttcgacgccggtgccgctggggcaggccctcgatcactatccagcgatagcgggctgggcggtagctcggacggaagctccgatgttcttgccttcgggagtgggtcggttgtggactctgtgacagaggaggagggggctgagtcagaagaaagctcaggcgaagctgacggcgatactgaagctgaggcctggggtctagcagatgtgcgcgagcttcaccctggcctgctggcccatagagcagccagggcgcgagatcttccagcactggcggctgccctggcgcacggggctgaggtgaactgggcagacgcggaagatgagggaaagacacctttggtccaggcggtcctgggcggaagcctcatcgtctgtgaatttctgttgcagaatggagctgatgtgaaccagagggacagtcggggacgcgctcccctccaccatgcaacattgttaggcagaacaggccaggtgtgcttatttttaaaacgtggcgcagaccagcatgcattggatcaggaacagcgggatccgctagcgattgcagtccaggcagctaacgcggatatcgtcacactgctgcggctagctcgaatggccgaagagatgcgagaggctgaggcggcacctggccctcccggagccctggccggaagccctaccgagctacaatttcgcagatgcatacaggaatttatatcccttcatctggaggagtcttag

SEQ ID NO: 53101 - DNA, 2280 bp, Artificial Sequence
  Description of Artificial Sequence: Synthetic coding sequence
atggtagaggccggaaaggcctacgtgtcaacctcccggctgtttgtgagtggcgtcagggatttatcacaacagtgtcaaggagatacagttattagtgaatgcctccagcggtttgccgattctttacaagaggtcgttaactatcacatgattttatttgatcaggcccagagatctgtgcggcagcagttgcagagcttcgtgaaagaagacgttaggaagttcaaagaaacaaaaaaacagttcgacaaggtgagagaagacctggaactgagccttgtgaggaacgctcaagcccctcgtcacagaccacatgaagtggaggaggctacaggtgctctgaccctgaccaggaagtgtttcaggcatttagctcttgactacgtcctacagattaacgttctccaggctaaaaagaagttcgaaattctggattccatgttaagttttatgcacgctcaatcctcattcttccagcagggatatagcctgctccaccagctggacccgtacatgaaaaagctggcggctgaattggaccaactggtgatagacagcgctgtggagaaacgtgaaatggaaaggaagcatgctgccattcaacagcgcaccctgcttcaggatttctcttacgacgaaagcaaggtggagttcgacgtcgatgccccatctggagtcgttatggagggctacttattcaaaagggccagcaatgcattcaagacttggaaccggcgttggtttagcatccagaactcccagttggtctaccagaaaaagttgaaggacgccctgacagtagtggtggacgacctcaggctgtgcagcgttaaaccctgtgaggacatagaaaggaggttctgcttcgaagtcctcagtcccacaaaaagctgcatgctccaggccgacagtgaaaaattacgacaagcgtgggtgcaagccgtccaggcttctattgcatcagcctacagggagtctccagattcttgttacagcgagaggctagacagaaccgcttctccctccacatctagcatcgactccgcaaccgacaccagagaacgcggtgtcaaaggagagtccgtactgcagcgcgtgcaatccgtggctggcaacagccagtgtggcgactgtggccaacctgatccgcgatgggcgagcattaacctcggcgtgctactctgtatcgagtgcagtggcatccacagatctctgggcgtgcactgttctaaggtgaggtctcttaccctggatagctgggagcctgaactccttaagctgatgtgcgagcttggcaattccgctgtgaatcaaatttacgaggctcagtgtgagggggcaggctcacgcaagccaactgcctccagttccagacaagacaaagaagcctggattaaagacaaatatgttgagaaaaaattcctgaggaaggcacctatggcacccgctttggaagctccacggagatggcgagtgcagaagtgcctcagaccacactcctctccaagggctcctacagccagacggaaggtgagactcgagcccgttctgccttgtgttgctgctctgtcttcagtcggaactctcgacaggaagttccggagagacagcttgttctgccccgacgagttagattcccttttcagctattttgacgcgggagcagcgggagccggaccaaggaaaggtgccgaatcagaggagtccagcggcgaagcagatggcgacacggaagctgaggcctggggcctggcagacgttcgcgaactgcaccccggtctcctcgctcaccgcgcagccagggccagagacctgcccgcactagccgctgctctggcccacggagccgaagttaattgggctgacgccgaggatgaaggcaaaacccctctggtgcaggcagttttaggcggatccctgatcgtctgcgagtttctgctgcaaaatggcgcagacgtcaatcagcgcgatagccggggacgggcaccactgcaccatgcgaccttactgggcaggaccggacaagtgtgcctgtttctcaagaggggcgctgaccagcatgcgttggaccaagaacagcgggacccacttgccatagctgttcaagcggctaatgctgacatcgtgacactactgaggctcgccagaatggccgaggagatgcgggaggctgaggccgcacctggccctcctggcgcacttgccggatccccgaccgaactgcagtttcggcgatgtattcaggaatttatttctctacatcttgaggaaagctag

SEQ ID NO: 53102 - DNA, 468 bp, Artificial Sequence
  Description of Artificial Sequence: Synthetic coding sequence
atggtaatggcagctaaaaagggcccaggtccgggagggggtgtatctgggggaaaggcagaagcagaagctgccagcgaagtgtggtgtagaagagttagagaactgggaggatgcagccaggcgggaaaccggcactgtttcgagtgtgctcagcggggagtgacctacgtcgatataactgttggaagcttcgtgtgcacgacttgtagtggcctgctcagggggttgaatccaccccatcgagtaaagtccatttctatgacaaccttcacagaacctgaagtggtctttttgcagagcagaggaaatgaggtctgccgtaagatttggctggggttgttcgatgcacggacctcactcgtgcccgatagcagggacccccagaaagttaaggagtttctccaggagaagtatgaaaagaagaggtggcctgataccttcccacgacgtctgtgtcagctctag

SEQ ID NO: 53103 - DNA, 1446 bp, Artificial Sequence
  Description of Artificial Sequence: Synthetic coding sequence
atggtgatggcagctaagaagggtccaggaccaggcggaggggtgtcgggaggcaaagccgaagcagaagccgcttcggaggtgtggtgtcgcagggttagagagttaggtggctgctcccaggctggcaacagacactgctttgaatgcgcccagcgaggagtcacttatgtggacattactgtcgggtcttttgtgtgtaccacatgtagtggactgttacgagggctgaaccccccacatagagtgaagtccatttcaatgactacattcacagagcccgaagtcgtgtttcttcagtcacgcggtaacgaggtttgtcggaaaatatggttgggcttgttcgacgcccgaacttctttggtaccagattccagagacccacagaaagtgaaggaatttctacaggaaaaatacgaaaaaaaaagatggtacgtgcccccagatcaggtgaagggccctacttatactaaaggcagcgcctctacacctgtgcaggggagtattccagaaggtaagcccttacgcaccctgctgggcgatccagcccctagtttgtccgtggctgccagcacatccagccagccagtctctcaatctcatgctcgtacctctcaggccaggagcactcagccacctccccattcgtccgtaaaaaaagccagcacagatctgctcgcggacattggaggcgaccctttcgcagcaccccaaatggccccagctttcgctgccttccccgctttcgggggtcagacaccctctcaggggggttttgccaatttcgacgctttcagctccgggccttcttccagtgtcttcggcagtttgccccctgcgggacaggcaagcttccaggctcagcccacccccgctggcagcagccagggcaccccctttggagccacgccacttgcccctgcttcacaaccaaattcgctcgccgatgtcggcagctttttgggtccaggcgtgcccgctgccggtgtgcccagcagtctgttcggcatggcaggacaggtcccccctcttcagtctgtcaccatggggggaggaggcggtagctccactggactcgcctttggtgctttcaccaaccctttcacagctcccgctgctcaatcgcccctgccctctactaacccgttccaacctaacgggctggccccagggccaggattcgggatgagtagcgcaggccctggattcccacaggccgtcccacctacaggcgcttttgcgtcttccttccccgctcctctttttcctccacagacacccctagtccaacagcagaacggcagtagttttggcgaccttggttccgcaaagttaggccagcgccctctgtcccagccagccggaatctctactaacccattcatgactggcccatcttctagcccatttgcatcaaaacctcccacaacaaacccatttctgtag

SEQ ID NO: 53104 - DNA, 1992 bp, Artificial Sequence
  Description of Artificial Sequence: Synthetic coding sequence
gaattgctgcgcattagcccggacttacttgctgcggctgtcatctccgctcaggaggaaccgctcaccaatattcagcgggctagcggacccaccggtttactatggtccgtgtccctcgaatttgatcaacagcaggggagtgtgtgccccagcgagtctgaaatttatgaggctggcgcagaagataggatggcaggggcacccatggccgctgctgtccagcctgccgaagttacagttgaggtcggagaagacctgcacatgcaccaggttagagaccgtgaaatgcctgaggctttggagttcaacctgtctgctaaccctgaagcctcaacaatctttcaaaggaatagccaaaccgacgccttggagttcaacagtagcgccaatccagaggcatcgacaatatttcaaagaaacagccaaacagatgtggtcgagatccgcaggtctaactgcacaaatcatgttagcaccgagaggtttagccagcagtatagtagctgctccacaattttcttagatgactccacagccatccagcactacctgactatgacaattatctcggttacgctggagattccccaccatattacccagcgcgacgcagatagatctctttcaatccctgacgagcaactacattccttcgccgtcagtactgttcacattatgaagaagcgaaacggaggcggaagtctgaataactacagctctagcattccacccaccccatctacctcacaggaggatccacagttcagcgtgcccccaacagctaatacaccgacacccgtttgtaaactttcaatgcggtggtcaaatctttttacctcagaaaaaggttccgaccctgacaaggagcgaaaagctcccgaaaatcatgccgatactatagggtccggaagggcgatccctataaaacagggcatgcttcttaaacgcagtggtaaatggttaaaaacctggaaaaagaagtatgtgactctgtgcagtaatggtgtactgacctattattccagcctgggcgattacatgaaaaatattcataagaaagaaatagacctaaggacgtccaccatcaaagtgcccggtaaatggccaagcttagcaacatcagcttgtgccccaatttcttcttccaaaagcaatggcctcagcaaagatatggacacaggcctgggggacagcatatgtttcagccctggcatatcttcgactaccagtcccaaactgaatcccccaccatctccgcacgcgaacaaaaaaaagcatctaaagaagaaatctacaaataactttatgatcgtcagcgccactggccagacctggcactttgaagccacaacttatgaagagagggacgcttgggtgcaagctatccagagccagtcggaagcaatggcgctacagtccatccagaatatgcgcggaaatgcacattgcgtcgattgcgaaacacagaatccgaaatgggcgtcactcaacctgggagtgctgatgtgcatcgaatgtagcggcatacacaggagcttcggcacccgcctgtcccgtgttcgctcccttgaattagacgattggcccgtcgaactgaggaaggtgatgtctagtatcgggaatgaacttgcaaatagcatctgggagggctcctctcaggggcagaccaaaccctctattaagtcgactagagaagagaaggagtggtggattaggtccaaatatgaggagaaattgttcctggctcccctgccatgcacggagctgtccctggggcagcagcttctcagggccacaacggatgaggacctgcagaccgctatcttgcttcttgcgcacggcagccgtgaggaggtgaacgagacatgtggagaaggggatggttgcaccgccctgcacctggcatgcaggaagggtaatgtggttttagagcagttgcttacggggtggacttcctggccagagatgccaacaggaacacagcgctag

SEQ ID NO: 53105 - DNA, 2112 bp, Artificial Sequence
  Description of Artificial Sequence: Synthetic coding sequence
atgtttgaggatgtgttttccgattccggtaataccgggaattttgatagaggcaagaagagacgtctgacgatcattgaatgcggctgtgatatcaacatgatgatagatctggccaaggttgctgatttggtgctgatgcttattgatgctagtttcggttttgaaatggaaatgtttgagtttctgaacatttgtcaggcccacggatttccaaaaatcctcggtgtactcacacaccttgatagcttcaagcacaacaagcagttgaagaaaactaaaaagcgccttaagcataggttttggactgaggtgtaccaggataaggtcgggctgacccacgagttagtgcagtccctcatttccacttatagcactatcgacgccaaaatggcaagtagtagggtgactcttctatcaaactcaaaaccgttgggatccgaagccattgacaatcagggcgtgtctcttgaatttgaccagcagcaaggctcggtgtgtccctcagaaagcgagatctacgaggccggtgccgaagaccgcatggcgggtgcacccatggccgctgcagttcagcctgctgaggtgacagtagaggtaggcgaggacctgcatatgcaccaagtacgcgaccgagaaatgcctgaagttgtggagatccgcagaagcaattgtacaaatcattgtgacctgggtgataccagttcttaccacaccaaggtctctacggtgcatattatgaaaaaaagaaatggcggaggcagtctcaacaactactctagcagcatccccccaaccccttcgacctcccaggaggatcctcagttttcagtaccgccaaccgcaaatacccccactccagtgtgcaagttgtccatgcggtggtccaatctgtttacatctgagaaagggtcagaccctgacaaggaacggaaggccccagagaaccacgccgataccatagggtccggcagagccatcccgatcaagcaaggcatgttactcaaaagaagcgggaagtggctcaaaacgtggaagaaaaaatacgtaaccctttgtagtaatggagtattgacctactactcttccctgggcgattacatgaagaacatacacaagaaagagatcgacctaagaaccagcaccatcaaagtccctggaaagtggccctctctggcgactagcgcttgcgctcctattagttcctccaaatctaacggcctgtctaaggacatggacacggggttgggcgatagtatttgtttctcacccggaataagctcaacgacgtctcctaagctgaaccctccccctagtccacatgccaacaagaaaaagcatctcaaaaaaaaatctaccaataatttcatgatcgttagcgccacaggccagacttggcacttcgaagcaaccacttatgaggaaagagacgcatgggtccaggctattcaaagccaaatacttgcctcactgcagagctgtaagagctcaaagtctaaatcccagttaacatctcagtccgaggcgatggcgctacaatctatacagaacatgcgtgggaacgctcattgcgtggattgcgagacccaaaatcctaagtgggcatctctcaacctcggcgtgctgatgtgtatcgaatgtagcgggatccacagaagtttcggaactcgactgtctcgggttagatcactcgagttggacgactggcccgttgaactgcgcaaggtaatgtcctctattggcaatgagctggccaattccatctgggaggggtcttcccagggccaaactaagcccagcatcaaatccaccagagaagaaaaagagtggtggattcgcagtaagtatgaagaaaagctcttccttgcgccactcccatgtactgaattgagtctgggtcagcagcttttgagggcaaccaccgacgaggacctgcaaacagccatattgctattggcccatgggtcccgggaggaagtgaatgagacatgcggagaaggggacggttgcacagctctccacctcgcatgcagaaagggcaatgtggtgctggaacagttgctaacgggttggaccagctggcctgagatgcctactgggactcagaggtag

SEQ ID NO: 53106 - DNA, 1977 bp, Artificial Sequence
  Description of Artificial Sequence: Synthetic coding sequence
atgggcaatatcctgacctgcagggtccacccttccgtgagtctagaatttgaccagcaacaaggctccgtctgtccctcagaaagcgagatttacgaagccggagccgaggacagaatggccggagctcctatggccgctgctgttcagcccgctgaggtcactgtggaagtcggcgaggatctgcacatgcatcaggtacgcgatagggagatgcctgaagctttagaatttaacttgtcggccaatccggaagcatctaccatctttcagcggaactcccaaactgacgcactggaatttaacagcagcgcaaaccccgaggcatcgacaattttccagcgaaattcacagactgacgtcgtcgagatccggaggtccaactgcactaaccacgtctcaacagaacgattctcacaacagtacagctcatgttcaacgatcttcctggacgattcaactgctattcagcactatctgacaatgacgatcataagcgtgacccttgagatccctcaccatatcacccaaagggacgcagatcggtcactatcaatacctgatgaacagcttcactcttttgctgtgtccacagttcatattatgaaaaagagaaatgggggaggctcgctgaataattacagcagcagcatccccccaacccccagcacctcacaggaagatcctcagttttccgtgccaccaaccgcgaatactcccacacccgtctgtaaattgagtatgcgatggtcgaacctgtttacatctgaaaaggggagcgaccccgataaagaacgaaaggcgccagagaaccacgctgacactatcggaagcgggagggcgatcccaattaaacagggcatgctgctgaaaaggagcggcaaatggctgaaaacatggaaaaagaagtatgttacactctgtagcaatggagttttaacctactactcctccctcggcgattatatgaagaatatccataaaaaggagatcgatctgagaacatccaccataaaggtgccgggtaaatggcccagcttagctactagtgcttgtgcacctataagctcctcaaagtcaaacgggttgtccaaggacatggatactggactgggagactccatttgtttctctccaggcatttctagtactacttcacctaagctgaatccacctccctctccccatgcgaacaaaaagaaacatctgaagaaaaaatccaccaacaacttcatgatcgtatcagcgacgggtcaaacatggcacttcgaggcaacgacatacgaagagcgagatgcttgggtgcaagccatccaatcccaaatcctggccagcctgcaatcatgcaaatcttccaagtccaagagtcaactcacttcgcaatctgaagccatggctcttcagtcaatacaaaatatgagaggcaatgcccattgtgtggactgtgaaactcagaacccgaagtgggcctccctcaacctgggggtgctgatgtgcattgagtgctcaggcatccaccggtcttttggaacgcgactttcacgggtgagaagcttggagctggacgactggcctgtcgaactgcgaaaggtgatgtcctccattggtaatgagctggcgaacagcatatgggagggaagtagccagggccaaacgaagcccagcatcaaatccactcgagaggagaaggaatggtggatccgctcgaagtacgaggagaagctttttctcgcacccctgccctgtaccgaattatcactaggacagcagcttctgcgtgcaacaacggacgaggacttacaaacggctatcttactgttagcccacggcagtcgggaagaagtcaacgagacctgtggcgagggggatggctgtactgccctgcacctcgcctgccggaaagggaacgtggtgctggaacagttgctgacgggttggacctcttggccggaaatgccgaccggcacccagcggtag

SEQ ID NO: 53107 - DNA, 1320 bp, Artificial Sequence
  Description of Artificial Sequence: Synthetic coding sequence
atgcggtggtctaacctgtttacttctgagaaaggcagcgaccctgacaaggagagaaaggcacccgaaaatcacgcagacaccatcggtagcggtagggccattcccattaaacaagggatgctgctgaaacggtccggcaagtggctgaaaacctggaaaaagaaatatgtgacactttgctccaatggagtgctgacatattactcctccctgggtgattatatgaaaaacatccacaaaaaagagatagaccttcagaccagtacaattaaagtgccaggcaagtggccctccctggcgaccagcgcatgtaccccaattagtacatcgaaatcaaacgggttatccaaggatatggatacaggcctaggggattcaatctgttttagtccatccatatcaagcacaacgagccctaaacttaatccaccaccctcgccccatgctaataaaaaaaagcatttgaagaagaaaagcactaacaactttatgatcgtatcagcaacgggccaaacctggcattttgaggcaaccacatacgaggaacgagacgcgtgggttcaggccattcagtctcagatcctggcatcactgcaaagttgcgagtcctcgaaatcaaagagccagctgaccagccaatcaaaagcaatggccttgcaaagcatccagaatatgcgcggaaatgcacattgtgtagattgtgagacccagaaccctaagtgggcctccctgaatctaggcgtcctcatgtgcatagagtgctccggtatccacaggtccctggggactagactgtctcgggtaaggagccttgaacttgacgactggcccgttgagctcaggaaggtgatgagctctatcggaaatgacctagccaattccatctgggagggatcctcacaggggcagacaaaacccagcgagaaatcaactcgcgaagagaaggaacgttggatccggagtaagtacgaggagaagcttttcctagcgcctctcccgtgtactgagctgtcactaggccagcagctgctgcgcgcaacagctgacgaggacctgcagaccgcaatcctcctactggcgcacggctccagggaggaagtgaatgaaacctgcggcgagggcgacggttgtaccgcccttcacttagcctgtcgtaagggaaacgtagtcctggcccaactgctgatctggtacggtgtggacgtcatggcccgagacgcccacgggaacactgcactgacatacgccagacaggcgtccagccaggaatgtattaatgttctgctgcagtatggatgcccggacaaatgtgtatag
